United States Patent 7,250,289 (METHODS OF GENETIC ANALYSIS OF MOUSE) - sequence listing, part 6

SEQ ID NO: 201506 - DNA, 25 bp, Mus musculus
agggtttgtctttgtagctatggct

SEQ ID NO: 201507 - DNA, 25 bp, Mus musculus
agggtttgttcacatctctagcccc

SEQ ID NO: 201508 - DNA, 25 bp, Mus musculus
agggtttgttcagatctctagcccc

SEQ ID NO: 201509 - DNA, 25 bp, Mus musculus
agggttttaattatactgcgtgtgt

SEQ ID NO: 201510 - DNA, 25 bp, Mus musculus
agggttttaattttactgcgtgtgt

SEQ ID NO: 201511 - DNA, 25 bp, Mus musculus
agggttttatggacaccagcttcac

SEQ ID NO: 201512 - DNA, 25 bp, Mus musculus
agggttttatggtcaccagcttcac

SEQ ID NO: 201513 - DNA, 25 bp, Mus musculus
agggttttcagtcctgctcaatgca

SEQ ID NO: 201514 - DNA, 25 bp, Mus musculus
agggttttcagtgctgctcaatgca

SEQ ID NO: 201515 - DNA, 25 bp, Mus musculus
agggttttcctgatagcactgtaga

SEQ ID NO: 201516 - DNA, 25 bp, Mus musculus
agggttttcctgttagcactgtaga

SEQ ID NO: 201517 - DNA, 25 bp, Mus musculus
agggttttctacagctctgtctcgc

SEQ ID NO: 201518 - DNA, 25 bp, Mus musculus
agggttttctactgctctgtctcgc

SEQ ID NO: 201519 - DNA, 25 bp, Mus musculus
agggttttctccaccggcaatggat

SEQ ID NO: 201520 - DNA, 25 bp, Mus musculus
agggttttctcctccggcaatggat

SEQ ID NO: 201521 - DNA, 25 bp, Mus musculus
agggttttctcgaatctctgaaata

SEQ ID NO: 201522 - DNA, 25 bp, Mus musculus
agggttttctcgtatctctgaaata

SEQ ID NO: 201523 - DNA, 25 bp, Mus musculus
agggttttctggctaaggaattgca

SEQ ID NO: 201524 - DNA, 25 bp, Mus musculus
agggttttctgggtaaggaattgca

SEQ ID NO: 201525 - DNA, 25 bp, Mus musculus
agggttttcttgactcataatgtta

SEQ ID NO: 201526 - DNA, 25 bp, Mus musculus
agggttttcttgtctcataatgtta

SEQ ID NO: 201527 - DNA, 25 bp, Mus musculus
agggttttgatcatgcagtcgtgta

SEQ ID NO: 201528 - DNA, 25 bp, Mus musculus
agggttttgatcttgcagtcgtgta

SEQ ID NO: 201529 - DNA, 25 bp, Mus musculus
agggttttgcacaccagaccttggt

SEQ ID NO: 201530 - DNA, 25 bp, Mus musculus
agggttttgcactccagaccttggt

SEQ ID NO: 201531 - DNA, 25 bp, Mus musculus
agggttttgccaattggtgaacgca

SEQ ID NO: 201532 - DNA, 25 bp, Mus musculus
agggttttgccatttggtgaacgca

SEQ ID NO: 201533 - DNA, 25 bp, Mus musculus
agggttttggccatagctctcacct

SEQ ID NO: 201534 - DNA, 25 bp, Mus musculus
agggttttggccttagctctcacct

SEQ ID NO: 201535 - DNA, 25 bp, Mus musculus
agggttttgtggaggccatcctcta

SEQ ID NO: 201536 - DNA, 25 bp, Mus musculus
agggttttgtggtggccatcctcta

SEQ ID NO: 201537 - DNA, 25 bp, Mus musculus
agggtttttcagcatccaaaagatg

SEQ ID NO: 201538 - DNA, 25 bp, Mus musculus
agggtttttcaggatccaaaagatg

SEQ ID NO: 201539 - DNA, 25 bp, Mus musculus
aggtaaaaatggatgctctctaact

SEQ ID NO: 201540 - DNA, 25 bp, Mus musculus
aggtaaaaatggttgctctctaact

SEQ ID NO: 201541 - DNA, 25 bp, Mus musculus
aggtaaaagcaaccactacacagtg

SEQ ID NO: 201542 - DNA, 25 bp, Mus musculus
aggtaaaagcaagcactacacagtg

SEQ ID NO: 201543 - DNA, 25 bp, Mus musculus
aggtaaacacgtatgcagacccaat

SEQ ID NO: 201544 - DNA, 25 bp, Mus musculus
aggtaaacacgtttgcagacccaat

SEQ ID NO: 201545 - DNA, 25 bp, Mus musculus
aggtaaacatgcctgttggctcagg

SEQ ID NO: 201546 - DNA, 25 bp, Mus musculus
aggtaaacatgcgtgttggctcagg

SEQ ID NO: 201547 - DNA, 25 bp, Mus musculus
aggtaaaccctcattgtcttagcat

SEQ ID NO: 201548 - DNA, 25 bp, Mus musculus
aggtaaaccctctttgtcttagcat

SEQ ID NO: 201549 - DNA, 25 bp, Mus musculus
aggtaaacctggcagctgccgtgat

SEQ ID NO: 201550 - DNA, 25 bp, Mus musculus
aggtaaacctgggagctgccgtgat

SEQ ID NO: 201551 - DNA, 25 bp, Mus musculus
aggtaaactgttctacatgctccca

SEQ ID NO: 201552 - DNA, 25 bp, Mus musculus
aggtaaactgttgtacatgctccca

SEQ ID NO: 201553 - DNA, 25 bp, Mus musculus
aggtaaaggaggaaagcgattctct

SEQ ID NO: 201554 - DNA, 25 bp, Mus musculus
aggtaaaggaggtaagcgattctct

SEQ ID NO: 201555 - DNA, 25 bp, Mus musculus
aggtaaagtgagatccctccctgtc

SEQ ID NO: 201556 - DNA, 25 bp, Mus musculus
aggtaaagtgagttccctccctgtc

SEQ ID NO: 201557 - DNA, 25 bp, Mus musculus
aggtaaatacacacccatctgtttc

SEQ ID NO: 201558 - DNA, 25 bp, Mus musculus
aggtaaatacactcccatctgtttc

SEQ ID NO: 201559 - DNA, 25 bp, Mus musculus
aggtaaatactcctgcagagcagcg

SEQ ID NO: 201560 - DNA, 25 bp, Mus musculus
aggtaaatactcgtgcagagcagcg

SEQ ID NO: 201561 - DNA, 25 bp, Mus musculus
aggtaaatcagcatcatcccagcct

SEQ ID NO: 201562 - DNA, 25 bp, Mus musculus
aggtaaatcagcttcatcccagcct

SEQ ID NO: 201563 - DNA, 25 bp, Mus musculus
aggtaaatgctgcacttgccaccca

SEQ ID NO: 201564 - DNA, 25 bp, Mus musculus
aggtaaatgctggacttgccaccca

SEQ ID NO: 201565 - DNA, 25 bp, Mus musculus
aggtaacaatcacatttctcctgtg

SEQ ID NO: 201566 - DNA, 25 bp, Mus musculus
aggtaacaatcagatttctcctgtg

SEQ ID NO: 201567 - DNA, 25 bp, Mus musculus
aggtaacacacacatcttttcaaga

SEQ ID NO: 201568 - DNA, 25 bp, Mus musculus
aggtaacacacacatggctcctttt

SEQ ID NO: 201569 - DNA, 25 bp, Mus musculus
aggtaacacacagatcttttcaaga

SEQ ID NO: 201570 - DNA, 25 bp, Mus musculus
aggtaacacacagatggctcctttt

SEQ ID NO: 201571 - DNA, 25 bp, Mus musculus
aggtaacacctcactgtgctatttg

SEQ ID NO: 201572 - DNA, 25 bp, Mus musculus
aggtaacacctctctgtgctatttg

SEQ ID NO: 201573 - DNA, 25 bp, Mus musculus
aggtaacacgcacccatcaagagtt

SEQ ID NO: 201574 - DNA, 25 bp, Mus musculus
aggtaacacgcagccatcaagagtt

SEQ ID NO: 201575 - DNA, 25 bp, Mus musculus
aggtaacagctcactggtactggtc

SEQ ID NO: 201576 - DNA, 25 bp, Mus musculus
aggtaacagctcatccttttcaaat

SEQ ID NO: 201577 - DNA, 25 bp, Mus musculus
aggtaacagctctctggtactggtc

SEQ ID NO: 201578 - DNA, 25 bp, Mus musculus
aggtaacagctcttccttttcaaat

SEQ ID NO: 201579 - DNA, 25 bp, Mus musculus
aggtaacagcttccctctttgtctg

SEQ ID NO: 201580 - DNA, 25 bp, Mus musculus
aggtaacagcttgcctctttgtctg

SEQ ID NO: 201581 - DNA, 25 bp, Mus musculus
aggtaacaggccaatgggccctgcc

SEQ ID NO: 201582 - DNA, 25 bp, Mus musculus
aggtaacaggcctatgggccctgcc

SEQ ID NO: 201583 - DNA, 25 bp, Mus musculus
aggtaacatgacaattgttgctgtc

SEQ ID NO: 201584 - DNA, 25 bp, Mus musculus
aggtaacatgactattgttgctgtc

SEQ ID NO: 201585 - DNA, 25 bp, Mus musculus
aggtaacatggtacagcctgccaaa

SEQ ID NO: 201586 - DNA, 25 bp, Mus musculus
aggtaacatggttcagcctgccaaa

SEQ ID NO: 201587 - DNA, 25 bp, Mus musculus
aggtaacattgcacagcctgcgttc

SEQ ID NO: 201588 - DNA, 25 bp, Mus musculus
aggtaacattgctcagcctgcgttc

SEQ ID NO: 201589 - DNA, 25 bp, Mus musculus
aggtaaccactgactgaagatcccc

SEQ ID NO: 201590 - DNA, 25 bp, Mus musculus
aggtaaccactgtctgaagatcccc

SEQ ID NO: 201591 - DNA, 25 bp, Mus musculus
aggtaaccaggaaatggccctctgc

SEQ ID NO: 201592 - DNA, 25 bp, Mus musculus
aggtaaccaggatatggccctctgc

SEQ ID NO: 201593 - DNA, 25 bp, Mus musculus
aggtaacccatacctggcactgaac

SEQ ID NO: 201594 - DNA, 25 bp, Mus musculus
aggtaacccatagctggcactgaac

SEQ ID NO: 201595 - DNA, 25 bp, Mus musculus
aggtaaccccatatgatcagctata

SEQ ID NO: 201596 - DNA, 25 bp, Mus musculus
aggtaaccccatttgatcagctata

SEQ ID NO: 201597 - DNA, 25 bp, Mus musculus
aggtaaccgttgcttcaatctttag

SEQ ID NO: 201598 - DNA, 25 bp, Mus musculus
aggtaaccgttggttcaatctttag

SEQ ID NO: 201599 - DNA, 25 bp, Mus musculus
aggtaacctcgtacagttagttctg

SEQ ID NO: 201600 - DNA, 25 bp, Mus musculus
aggtaacctcgttcagttagttctg

SEQ ID NO: 201601 - DNA, 25 bp, Mus musculus
aggtaactaatgagcagagtctaga

SEQ ID NO: 201602 - DNA, 25 bp, Mus musculus
aggtaactaatgtgcagagtctaga

SEQ ID NO: 201603 - DNA, 25 bp, Mus musculus
aggtaactatggatgcctgcagtgg

SEQ ID NO: 201604 - DNA, 25 bp, Mus musculus
aggtaactatggttgcctgcagtgg

SEQ ID NO: 201605 - DNA, 25 bp, Mus musculus
aggtaactcctcagtgttgggtcca

SEQ ID NO: 201606 - DNA, 25 bp, Mus musculus
aggtaactcctccatggctactttt

SEQ ID NO: 201607 - DNA, 25 bp, Mus musculus
aggtaactcctcgatggctactttt

SEQ ID NO: 201608 - DNA, 25 bp, Mus musculus
aggtaactcctctgtgttgggtcca

SEQ ID NO: 201609 - DNA, 25 bp, Mus musculus
aggtaactgcggagagctcagctcg

SEQ ID NO: 201610 - DNA, 25 bp, Mus musculus
aggtaactgcggtgagctcagctcg

SEQ ID NO: 201611 - DNA, 25 bp, Mus musculus
aggtaacttagaacagctctggctt

SEQ ID NO: 201612 - DNA, 25 bp, Mus musculus
aggtaacttagatcagctctggctt

SEQ ID NO: 201613 - DNA, 25 bp, Mus musculus
aggtaacttgcaaggcagggtctta

SEQ ID NO: 201614 - DNA, 25 bp, Mus musculus
aggtaacttgcatggcagggtctta

SEQ ID NO: 201615 - DNA, 25 bp, Mus musculus
aggtaactttatcctatcccctcag

SEQ ID NO: 201616 - DNA, 25 bp, Mus musculus
aggtaactttatcttgcaaacaaga

SEQ ID NO: 201617 - DNA, 25 bp, Mus musculus
aggtaactttatgctatcccctcag

SEQ ID NO: 201618 - DNA, 25 bp, Mus musculus
aggtaactttatgttgcaaacaaga

SEQ ID NO: 201619 - DNA, 25 bp, Mus musculus
aggtaagaagcccaggaccaaagca

SEQ ID NO: 201620 - DNA, 25 bp, Mus musculus
aggtaagaagccgaggaccaaagca

SEQ ID NO: 201621 - DNA, 25 bp, Mus musculus
aggtaagaccagctcagcccagggc

SEQ ID NO: 201622 - DNA, 25 bp, Mus musculus
aggtaagaccaggtcagcccagggc

SEQ ID NO: 201623 - DNA, 25 bp, Mus musculus
aggtaagaccttcattcctacatgt

SEQ ID NO: 201624 - DNA, 25 bp, Mus musculus
aggtaagaccttgattcctacatgt

SEQ ID NO: 201625 - DNA, 25 bp, Mus musculus
aggtaagagttgacacccagctggt

SEQ ID NO: 201626 - DNA, 25 bp, Mus musculus
aggtaagagttgtcacccagctggt

SEQ ID NO: 201627 - DNA, 25 bp, Mus musculus
aggtaagattcacatctctcgcttc

SEQ ID NO: 201628 - DNA, 25 bp, Mus musculus
aggtaagattcagatctctcgcttc

SEQ ID NO: 201629 - DNA, 25 bp, Mus musculus
aggtaagcaagcctctccagccagg

SEQ ID NO: 201630 - DNA, 25 bp, Mus musculus
aggtaagcaagcgtctccagccagg

SEQ ID NO: 201631 - DNA, 25 bp, Mus musculus
aggtaagcaattactagactctaat

SEQ ID NO: 201632 - DNA, 25 bp, Mus musculus
aggtaagcaatttctagactctaat

SEQ ID NO: 201633 - DNA, 25 bp, Mus musculus
aggtaagcactgctgtttcctggga

SEQ ID NO: 201634 - DNA, 25 bp, Mus musculus
aggtaagcactggtgtttcctggga

SEQ ID NO: 201635 - DNA, 25 bp, Mus musculus
aggtaagccacgctcccagaggcta

SEQ ID NO: 201636 - DNA, 25 bp, Mus musculus
aggtaagccacggtcccagaggcta

SEQ ID NO: 201637 - DNA, 25 bp, Mus musculus
aggtaagcctatacagcttctggta

SEQ ID NO: 201638 - DNA, 25 bp, Mus musculus
aggtaagcctattcagcttctggta

SEQ ID NO: 201639 - DNA, 25 bp, Mus musculus
aggtaagctccaaagcttccctgaa

SEQ ID NO: 201640 - DNA, 25 bp, Mus musculus
aggtaagctccactgttgcggcaaa

SEQ ID NO: 201641 - DNA, 25 bp, Mus musculus
aggtaagctccagtgttgcggcaaa

SEQ ID NO: 201642 - DNA, 25 bp, Mus musculus
aggtaagctccatagcttccctgaa

SEQ ID NO: 201643 - DNA, 25 bp, Mus musculus
aggtaagctgtcagtgaccccgaga

SEQ ID NO: 201644 - DNA, 25 bp, Mus musculus
aggtaagctgtctgtgaccccgaga

SEQ ID NO: 201645 - DNA, 25 bp, Mus musculus
aggtaaggatggagtttcttctctt

SEQ ID NO: 201646 - DNA, 25 bp, Mus musculus
aggtaaggatggtgtttcttctctt

SEQ ID NO: 201647 - DNA, 25 bp, Mus musculus
aggtaaggccctaaagtcaatcaag

SEQ ID NO: 201648 - DNA, 25 bp, Mus musculus
aggtaaggcccttaagtcaatcaag

SEQ ID NO: 201649 - DNA, 25 bp, Mus musculus
aggtaagggagcacctggcactgcc

SEQ ID NO: 201650 - DNA, 25 bp, Mus musculus
aggtaagggagctcctggcactgcc

SEQ ID NO: 201651 - DNA, 25 bp, Mus musculus
aggtaagggatcacccagccacatg

SEQ ID NO: 201652 - DNA, 25 bp, Mus musculus
aggtaagggatctcccagccacatg

SEQ ID NO: 201653 - DNA, 25 bp, Mus musculus
aggtaagtactcagcccctgaatta

SEQ ID NO: 201654 - DNA, 25 bp, Mus musculus
aggtaagtactctgcccctgaatta

SEQ ID NO: 201655 - DNA, 25 bp, Mus musculus
aggtaagtagctacaggctcaccct

SEQ ID NO: 201656 - DNA, 25 bp, Mus musculus
aggtaagtagcttcaggctcaccct

SEQ ID NO: 201657 - DNA, 25 bp, Mus musculus
aggtaagtcactcgtgcccagcttt

SEQ ID NO: 201658 - DNA, 25 bp, Mus musculus
aggtaagtcactggtgcccagcttt

SEQ ID NO: 201659 - DNA, 25 bp, Mus musculus
aggtaagtcagcaggctccatctca

SEQ ID NO: 201660 - DNA, 25 bp, Mus musculus
aggtaagtcagctggctccatctca

SEQ ID NO: 201661 - DNA, 25 bp, Mus musculus
aggtaagtccacattctctctgaca

SEQ ID NO: 201662 - DNA, 25 bp, Mus musculus
aggtaagtccactttctctctgaca

SEQ ID NO: 201663 - DNA, 25 bp, Mus musculus
aggtaagtcggtctgagtcaagtca

SEQ ID NO: 201664 - DNA, 25 bp, Mus musculus
aggtaagtcggtgtgagtcaagtca

SEQ ID NO: 201665 - DNA, 25 bp, Mus musculus
aggtaagtgagtcttcctgtgaact

SEQ ID NO: 201666 - DNA, 25 bp, Mus musculus
aggtaagtgagtgttcctgtgaact

SEQ ID NO: 201667 - DNA, 25 bp, Mus musculus
aggtaagttctcagtctataccctt

SEQ ID NO: 201668 - DNA, 25 bp, Mus musculus
aggtaagttctctgtctataccctt

SEQ ID NO: 201669 - DNA, 25 bp, Mus musculus
aggtaataaacccacagcagacatt

SEQ ID NO: 201670 - DNA, 25 bp, Mus musculus
aggtaataaaccgacagcagacatt

SEQ ID NO: 201671 - DNA, 25 bp, Mus musculus
aggtaatattttctggctcttatac

SEQ ID NO: 201672 - DNA, 25 bp, Mus musculus
aggtaatattttgtggctcttatac

SEQ ID NO: 201673 - DNA, 25 bp, Mus musculus
aggtaatcagataccgggcttttct

SEQ ID NO: 201674 - DNA, 25 bp, Mus musculus
aggtaatcagattccgggcttttct

SEQ ID NO: 201675 - DNA, 25 bp, Mus musculus
aggtaatcaggccttctcccgtcac

SEQ ID NO: 201676 - DNA, 25 bp, Mus musculus
aggtaatcaggcgttctcccgtcac

SEQ ID NO: 201677 - DNA, 25 bp, Mus musculus
aggtaatccactaccttgaatgctc

SEQ ID NO: 201678 - DNA, 25 bp, Mus musculus
aggtaatccacttccttgaatgctc

SEQ ID NO: 201679 - DNA, 25 bp, Mus musculus
aggtaatctgtcatcctcttctggc

SEQ ID NO: 201680 - DNA, 25 bp, Mus musculus
aggtaatctgtcttcctcttctggc

SEQ ID NO: 201681 - DNA, 25 bp, Mus musculus
aggtaatcttgtaatcctctgcctc

SEQ ID NO: 201682 - DNA, 25 bp, Mus musculus
aggtaatcttgttatcctctgcctc

SEQ ID NO: 201683 - DNA, 25 bp, Mus musculus
aggtaatgccttccaacaccaatgt

SEQ ID NO: 201684 - DNA, 25 bp, Mus musculus
aggtaatgccttgcaacaccaatgt

SEQ ID NO: 201685 - DNA, 25 bp, Mus musculus
aggtaatggcacagcccctgacaat

SEQ ID NO: 201686 - DNA, 25 bp, Mus musculus
aggtaatggcactgcccctgacaat

SEQ ID NO: 201687 - DNA, 25 bp, Mus musculus
aggtaatgtataaaaggcgtcttgc

SEQ ID NO: 201688 - DNA, 25 bp, Mus musculus
aggtaatgtatataaggcgtcttgc

SEQ ID NO: 201689 - DNA, 25 bp, Mus musculus
aggtaatgtgacctcttgggaaata

SEQ ID NO: 201690 - DNA, 25 bp, Mus musculus
aggtaatgtgacgtcttgggaaata

SEQ ID NO: 201691 - DNA, 25 bp, Mus musculus
aggtaattgactcccctcaagtact

SEQ ID NO: 201692 - DNA, 25 bp, Mus musculus
aggtaattgactgccctcaagtact

SEQ ID NO: 201693 - DNA, 25 bp, Mus musculus
aggtaatttatcctggcccagacgt

SEQ ID NO: 201694 - DNA, 25 bp, Mus musculus
aggtaatttatcgtggcccagacgt

SEQ ID NO: 201695 - DNA, 25 bp, Mus musculus
aggtaatttctcactatcttaagtt

SEQ ID NO: 201696 - DNA, 25 bp, Mus musculus
aggtaatttctctctatcttaagtt

SEQ ID NO: 201697 - DNA, 25 bp, Mus musculus
aggtacaaattgaaacttctctaca

SEQ ID NO: 201698 - DNA, 25 bp, Mus musculus
aggtacaaattgtaacttctctaca

SEQ ID NO: 201699 - DNA, 25 bp, Mus musculus
aggtacaatccactgcaccaggctt

SEQ ID NO: 201700 - DNA, 25 bp, Mus musculus
aggtacaatccagtgcaccaggctt

SEQ ID NO: 201701 - DNA, 25 bp, Mus musculus
aggtacacaatacgctcaatcctgt

SEQ ID NO: 201702 - DNA, 25 bp, Mus musculus
aggtacacaataggctcaatcctgt

SEQ ID NO: 201703 - DNA, 25 bp, Mus musculus
aggtacacacccagttctcaaagac

SEQ ID NO: 201704 - DNA, 25 bp, Mus musculus
aggtacacaccctgttctcaaagac

SEQ ID NO: 201705 - DNA, 25 bp, Mus musculus
aggtacacacctcaattcccgaatt

SEQ ID NO: 201706 - DNA, 25 bp, Mus musculus
aggtacacacctgaattcccgaatt

SEQ ID NO: 201707 - DNA, 25 bp, Mus musculus
aggtacacagacaggatagtcctca

SEQ ID NO: 201708 - DNA, 25 bp, Mus musculus
aggtacacagactggatagtcctca

SEQ ID NO: 201709 - DNA, 25 bp, Mus musculus
aggtacacattgcacagtctgaggt

SEQ ID NO: 201710 - DNA, 25 bp, Mus musculus
aggtacacattggacagtctgaggt

SEQ ID NO: 201711 - DNA, 25 bp, Mus musculus
aggtacacatttatgcctccataaa

SEQ ID NO: 201712 - DNA, 25 bp, Mus musculus
aggtacacatttttgcctccataaa

SEQ ID NO: 201713 - DNA, 25 bp, Mus musculus
aggtacaccatgaccaacacagctc

SEQ ID NO: 201714 - DNA, 25 bp, Mus musculus
aggtacaccatgtccaacacagctc

SEQ ID NO: 201715 - DNA, 25 bp, Mus musculus
aggtacacttttatctattaatatg

SEQ ID NO: 201716 - DNA, 25 bp, Mus musculus
aggtacacttttttctattaatatg

SEQ ID NO: 201717 - DNA, 25 bp, Mus musculus
aggtacagagtacagggtccagaat

SEQ ID NO: 201718 - DNA, 25 bp, Mus musculus
aggtacagagtagagggtccagaat

SEQ ID NO: 201719 - DNA, 25 bp, Mus musculus
aggtacagatctatcacatgcaggg

SEQ ID NO: 201720 - DNA, 25 bp, Mus musculus
aggtacagatctttcacatgcaggg

SEQ ID NO: 201721 - DNA, 25 bp, Mus musculus
aggtacagattaccccagagttact

SEQ ID NO: 201722 - DNA, 25 bp, Mus musculus
aggtacagattagcccagagttact

SEQ ID NO: 201723 - DNA, 25 bp, Mus musculus
aggtacagtattctttctccctcat

SEQ ID NO: 201724 - DNA, 25 bp, Mus musculus
aggtacagtattgtttctccctcat

SEQ ID NO: 201725 - DNA, 25 bp, Mus musculus
aggtacagttcacgggcactacaaa

SEQ ID NO: 201726 - DNA, 25 bp, Mus musculus
aggtacagttcaggggcactacaaa

SEQ ID NO: 201727 - DNA, 25 bp, Mus musculus
aggtacatacctagggatgccctgg

SEQ ID NO: 201728 - DNA, 25 bp, Mus musculus
aggtacatacctccaggctgctgag

SEQ ID NO: 201729 - DNA, 25 bp, Mus musculus
aggtacatacctgcaggctgctgag

SEQ ID NO: 201730 - DNA, 25 bp, Mus musculus
aggtacataccttgggatgccctgg

SEQ ID NO: 201731 - DNA, 25 bp, Mus musculus
aggtacatcattcattcccttcttt

SEQ ID NO: 201732 - DNA, 25 bp, Mus musculus
aggtacatcattgattcccttcttt

SEQ ID NO: 201733 - DNA, 25 bp, Mus musculus
aggtacatctacatgttgtctatta

SEQ ID NO: 201734 - DNA, 25 bp, Mus musculus
aggtacatctacttgttgtctatta

SEQ ID NO: 201735 - DNA, 25 bp, Mus musculus
aggtacatgcataatgtgtcacatt

SEQ ID NO: 201736 - DNA, 25 bp, Mus musculus
aggtacatgcattatgtgtcacatt

SEQ ID NO: 201737 - DNA, 25 bp, Mus musculus
aggtacatgtctccgtgtctctttc

SEQ ID NO: 201738 - DNA, 25 bp, Mus musculus
aggtacatgtctgcgtgtctctttc

SEQ ID NO: 201739 - DNA, 25 bp, Mus musculus
aggtacattcctctttttgtgacac

SEQ ID NO: 201740 - DNA, 25 bp, Mus musculus
aggtacattcctgtttttgtgacac

SEQ ID NO: 201741 - DNA, 25 bp, Mus musculus
aggtacattgttatgccctccaagg

SEQ ID NO: 201742 - DNA, 25 bp, Mus musculus
aggtacattgttttgccctccaagg

SEQ ID NO: 201743 - DNA, 25 bp, Mus musculus
aggtaccaaccaagggagagcacaa

SEQ ID NO: 201744 - DNA, 25 bp, Mus musculus
aggtaccaaccatgggagagcacaa

SEQ ID NO: 201745 - DNA, 25 bp, Mus musculus
aggtaccagagcagcgtctgtggca

SEQ ID NO: 201746 - DNA, 25 bp, Mus musculus
aggtaccagagctgcgtctgtggca

SEQ ID NO: 201747 - DNA, 25 bp, Mus musculus
aggtaccagcatctgtcactgggat

SEQ ID NO: 201748 - DNA, 25 bp, Mus musculus
aggtaccagcatgtgtcactgggat

SEQ ID NO: 201749 - DNA, 25 bp, Mus musculus
aggtaccatacccagtctgagcatg

SEQ ID NO: 201750 - DNA, 25 bp, Mus musculus
aggtaccataccgagtctgagcatg

SEQ ID NO: 201751 - DNA, 25 bp, Mus musculus
aggtaccatcctacagagcggctga

SEQ ID NO: 201752 - DNA, 25 bp, Mus musculus
aggtaccatccttcagagcggctga

SEQ ID NO: 201753 - DNA, 25 bp, Mus musculus
aggtaccatgaacctggagttggct

SEQ ID NO: 201754 - DNA, 25 bp, Mus musculus
aggtaccatgaagctggagttggct

SEQ ID NO: 201755 - DNA, 25 bp, Mus musculus
aggtaccatgtcattctggaaccca

SEQ ID NO: 201756 - DNA, 25 bp, Mus musculus
aggtaccatgtctttctggaaccca

SEQ ID NO: 201757 - DNA, 25 bp, Mus musculus
aggtaccatgttctgctttgtttcc

SEQ ID NO: 201758 - DNA, 25 bp, Mus musculus
aggtaccatgttgtgctttgtttcc

SEQ ID NO: 201759 - DNA, 25 bp, Mus musculus
aggtacccacacagtcaggctgcct

SEQ ID NO: 201760 - DNA, 25 bp, Mus musculus
aggtacccacactgtcaggctgcct

SEQ ID NO: 201761 - DNA, 25 bp, Mus musculus
aggtacccatcacggtgcctagaag

SEQ ID NO: 201762 - DNA, 25 bp, Mus musculus
aggtacccatcagggtgcctagaag

SEQ ID NO: 201763 - DNA, 25 bp, Mus musculus
aggtaccccatgatggacccatgtg

SEQ ID NO: 201764 - DNA, 25 bp, Mus musculus
aggtaccccatgttggacccatgtg

SEQ ID NO: 201765 - DNA, 25 bp, Mus musculus
aggtacccctacaaggatttgctgc

SEQ ID NO: 201766 - DNA, 25 bp, Mus musculus
aggtacccctactaggatttgctgc

SEQ ID NO: 201767 - DNA, 25 bp, Mus musculus
aggtacccgtctccaggtgtcttta

SEQ ID NO: 201768 - DNA, 25 bp, Mus musculus
aggtacccgtctgcaggtgtcttta

SEQ ID NO: 201769 - DNA, 25 bp, Mus musculus
aggtaccctggaattggaatcgatt

SEQ ID NO: 201770 - DNA, 25 bp, Mus musculus
aggtaccctggatttggaatcgatt

SEQ ID NO: 201771 - DNA, 25 bp, Mus musculus
aggtaccctgtgactgatgggccta

SEQ ID NO: 201772 - DNA, 25 bp, Mus musculus
aggtaccctgtgtctgatgggccta

SEQ ID NO: 201773 - DNA, 25 bp, Mus musculus
aggtaccgccctacagaaatgtcag

SEQ ID NO: 201774 - DNA, 25 bp, Mus musculus
aggtaccgcccttcagaaatgtcag

SEQ ID NO: 201775 - DNA, 25 bp, Mus musculus
aggtaccggtatagtgacactgctt

SEQ ID NO: 201776 - DNA, 25 bp, Mus musculus
aggtaccggtattgtgacactgctt

SEQ ID NO: 201777 - DNA, 25 bp, Mus musculus
aggtaccgtattccctctgagtgac

SEQ ID NO: 201778 - DNA, 25 bp, Mus musculus
aggtaccgtattgcctctgagtgac

SEQ ID NO: 201779 - DNA, 25 bp, Mus musculus
aggtaccgtgtcacctgcagtgagt

SEQ ID NO: 201780 - DNA, 25 bp, Mus musculus
aggtaccgtgtctcctgcagtgagt

SEQ ID NO: 201781 - DNA, 25 bp, Mus musculus
aggtacctaggacgtgacccaagca

SEQ ID NO: 201782 - DNA, 25 bp, Mus musculus
aggtacctaggaggtgacccaagca

SEQ ID NO: 201783 - DNA, 25 bp, Mus musculus
aggtacctattgcatgcacaccaag

SEQ ID NO: 201784 - DNA, 25 bp, Mus musculus
aggtacctattggatgcacaccaag

SEQ ID NO: 201785 - DNA, 25 bp, Mus musculus
aggtacctccgtctctgagccaatt

SEQ ID NO: 201786 - DNA, 25 bp, Mus musculus
aggtacctccgtgtctgagccaatt

SEQ ID NO: 201787 - DNA, 25 bp, Mus musculus
aggtacctcgtgagaccacagacac

SEQ ID NO: 201788 - DNA, 25 bp, Mus musculus
aggtacctcgtgtgaccacagacac

SEQ ID NO: 201789 - DNA, 25 bp, Mus musculus
aggtacctctccactgagttgtatc

SEQ ID NO: 201790 - DNA, 25 bp, Mus musculus
aggtacctctcctctgagttgtatc

SEQ ID NO: 201791 - DNA, 25 bp, Mus musculus
aggtacctctggcatgggcagcact

SEQ ID NO: 201792 - DNA, 25 bp, Mus musculus
aggtacctctgggatgggcagcact

SEQ ID NO: 201793 - DNA, 25 bp, Mus musculus
aggtacctgagacttatcctccacg

SEQ ID NO: 201794 - DNA, 25 bp, Mus musculus
aggtacctgagagttatcctccacg

SEQ ID NO: 201795 - DNA, 25 bp, Mus musculus
aggtacctgcgcacattatatgcat

SEQ ID NO: 201796 - DNA, 25 bp, Mus musculus
aggtacctgcgctcattatatgcat

SEQ ID NO: 201797 - DNA, 25 bp, Mus musculus
aggtacctggacaatgtattttcct

SEQ ID NO: 201798 - DNA, 25 bp, Mus musculus
aggtacctggactatgtattttcct

SEQ ID NO: 201799 - DNA, 25 bp, Mus musculus
aggtacctgtcactcgggtacatat

SEQ ID NO: 201800 - DNA, 25 bp, Mus musculus
aggtacctgtcagtcgggtacatat

SEQ ID NO: 201801 - DNA, 25 bp, Mus musculus
aggtacctgtttctggattaagctg

SEQ ID NO: 201802 - DNA, 25 bp, Mus musculus
aggtacctgtttgtggattaagctg

SEQ ID NO: 201803 - DNA, 25 bp, Mus musculus
aggtaccttgacattagcttctttc

SEQ ID NO: 201804 - DNA, 25 bp, Mus musculus
aggtaccttgactttagcttctttc

SEQ ID NO: 201805 - DNA, 25 bp, Mus musculus
aggtacgacgtaaggtactatgcta

SEQ ID NO: 201806 - DNA, 25 bp, Mus musculus
aggtacgacgtatggtactatgcta

SEQ ID NO: 201807 - DNA, 25 bp, Mus musculus
aggtacgctcacattgttgtgcatc

SEQ ID NO: 201808 - DNA, 25 bp, Mus musculus
aggtacgctcactttgttgtgcatc

SEQ ID NO: 201809 - DNA, 25 bp, Mus musculus
aggtacgctctgctgaggaagtcaa

SEQ ID NO: 201810 - DNA, 25 bp, Mus musculus
aggtacgctctggtgaggaagtcaa

SEQ ID NO: 201811 - DNA, 25 bp, Mus musculus
aggtacggttaaaagccacgcctat

SEQ ID NO: 201812 - DNA, 25 bp, Mus musculus
aggtacggttaatagccacgcctat

SEQ ID NO: 201813 - DNA, 25 bp, Mus musculus
aggtacggtttgatcaaggtcaggt

SEQ ID NO: 201814 - DNA, 25 bp, Mus musculus
aggtacggtttgttcaaggtcaggt

SEQ ID NO: 201815 - DNA, 25 bp, Mus musculus
aggtacgtcagtatgattcctagct

SEQ ID NO: 201816 - DNA, 25 bp, Mus musculus
aggtacgtcagtttgattcctagct

SEQ ID NO: 201817 - DNA, 25 bp, Mus musculus
aggtactaaaccaagagtcttgtgc

SEQ ID NO: 201818 - DNA, 25 bp, Mus musculus
aggtactaaacctagagtcttgtgc

SEQ ID NO: 201819 - DNA, 25 bp, Mus musculus
aggtactaactgactggcgagctaa

SEQ ID NO: 201820 - DNA, 25 bp, Mus musculus
aggtactaactgtctggcgagctaa

SEQ ID NO: 201821 - DNA, 25 bp, Mus musculus
aggtactagctgaccaccctggcga

SEQ ID NO: 201822 - DNA, 25 bp, Mus musculus
aggtactagctgtccaccctggcga

SEQ ID NO: 201823 - DNA, 25 bp, Mus musculus
aggtactagtctacggaggtccatt

SEQ ID NO: 201824 - DNA, 25 bp, Mus musculus
aggtactagtcttcggaggtccatt

SEQ ID NO: 201825 - DNA, 25 bp, Mus musculus
aggtactatactcgatcgtccctgc

SEQ ID NO: 201826 - DNA, 25 bp, Mus musculus
aggtactatactggatcgtccctgc

SEQ ID NO: 201827 - DNA, 25 bp, Mus musculus
aggtactcacaaagtttctaacatt

SEQ ID NO: 201828 - DNA, 25 bp, Mus musculus
aggtactcacaatgtttctaacatt

SEQ ID NO: 201829 - DNA, 25 bp, Mus musculus
aggtactcacgcatactggagcaga

SEQ ID NO: 201830 - DNA, 25 bp, Mus musculus
aggtactcacgcttactggagcaga

SEQ ID NO: 201831 - DNA, 25 bp, Mus musculus
aggtactcagccctgtgtttaagta

SEQ ID NO: 201832 - DNA, 25 bp, Mus musculus
aggtactcagccgtgtgtttaagta

SEQ ID NO: 201833 - DNA, 25 bp, Mus musculus
aggtactctggtctagcagcacatc

SEQ ID NO: 201834 - DNA, 25 bp, Mus musculus
aggtactctggtgtagcagcacatc

SEQ ID NO: 201835 - DNA, 25 bp, Mus musculus
aggtactgagacatgctgggcttct

SEQ ID NO: 201836 - DNA, 25 bp, Mus musculus
aggtactgagacttgctgggcttct

SEQ ID NO: 201837 - DNA, 25 bp, Mus musculus
aggtactgcagccttgtcagcgagc

SEQ ID NO: 201838 - DNA, 25 bp, Mus musculus
aggtactgcagcgttgtcagcgagc

SEQ ID NO: 201839 - DNA, 25 bp, Mus musculus
aggtactgcctgagactacaaggct

SEQ ID NO: 201840 - DNA, 25 bp, Mus musculus
aggtactgcctgtgactacaaggct

SEQ ID NO: 201841 - DNA, 25 bp, Mus musculus
aggtactgcttcactgagatggccc

SEQ ID NO: 201842 - DNA, 25 bp, Mus musculus
aggtactgcttcagtgccaagaggg

SEQ ID NO: 201843 - DNA, 25 bp, Mus musculus
aggtactgcttctctgagatggccc

SEQ ID NO: 201844 - DNA, 25 bp, Mus musculus
aggtactgcttctgtgccaagaggg

SEQ ID NO: 201845 - DNA, 25 bp, Mus musculus
aggtactgggttacagctctatcat

SEQ ID NO: 201846 - DNA, 25 bp, Mus musculus
aggtactgggtttcagctctatcat

SEQ ID NO: 201847 - DNA, 25 bp, Mus musculus
aggtactgtcctcggcatggcgacc

SEQ ID NO: 201848 - DNA, 25 bp, Mus musculus
aggtactgtcctgggcatggcgacc

SEQ ID NO: 201849 - DNA, 25 bp, Mus musculus
aggtactgtgtaagcagcacccacc

SEQ ID NO: 201850 - DNA, 25 bp, Mus musculus
aggtactgtgtatgcagcacccacc

SEQ ID NO: 201851 - DNA, 25 bp, Mus musculus
aggtacttaagacacagggcccaga

SEQ ID NO: 201852 - DNA, 25 bp, Mus musculus
aggtacttaagagacagggcccaga

SEQ ID NO: 201853 - DNA, 25 bp, Mus musculus
aggtacttaagccatgacaatgcat

SEQ ID NO: 201854 - DNA, 25 bp, Mus musculus
aggtacttaagcgatgacaatgcat

SEQ ID NO: 201855 - DNA, 25 bp, Mus musculus
aggtacttcaccagtaaagtcagta

SEQ ID NO: 201856 - DNA, 25 bp, Mus musculus
aggtacttcacctgtaaagtcagta

SEQ ID NO: 201857 - DNA, 25 bp, Mus musculus
aggtacttctgcagcttgaagcgcc

SEQ ID NO: 201858 - DNA, 25 bp, Mus musculus
aggtacttctgctgcttgaagcgcc

SEQ ID NO: 201859 - DNA, 25 bp, Mus musculus
aggtacttgagcctgttgaggccaa

SEQ ID NO: 201860 - DNA, 25 bp, Mus musculus
aggtacttgagcgtgttgaggccaa

SEQ ID NO: 201861 - DNA, 25 bp, Mus musculus
aggtacttgcagatgttccccagaa

SEQ ID NO: 201862 - DNA, 25 bp, Mus musculus
aggtacttgcagttgttccccagaa

SEQ ID NO: 201863 - DNA, 25 bp, Mus musculus
aggtacttgctacggcggatcctca

SEQ ID NO: 201864 - DNA, 25 bp, Mus musculus
aggtacttgctagggcggatcctca

SEQ ID NO: 201865 - DNA, 25 bp, Mus musculus
aggtacttgcttatcaaactgtaga

SEQ ID NO: 201866 - DNA, 25 bp, Mus musculus
aggtacttgcttctgtctgaactct

SEQ ID NO: 201867 - DNA, 25 bp, Mus musculus
aggtacttgcttgtgtctgaactct

SEQ ID NO: 201868 - DNA, 25 bp, Mus musculus
aggtacttgcttttcaaactgtaga

SEQ ID NO: 201869 - DNA, 25 bp, Mus musculus
aggtagaaaccacactcaagatttg

SEQ ID NO: 201870 - DNA, 25 bp, Mus musculus
aggtagaaaccagactcaagatttg

SEQ ID NO: 201871 - DNA, 25 bp, Mus musculus
aggtagaacctgagactttttgtgg

SEQ ID NO: 201872 - DNA, 25 bp, Mus musculus
aggtagaacctgtgactttttgtgg

SEQ ID NO: 201873 - DNA, 25 bp, Mus musculus
aggtagaatttgaggcgtttcatta

SEQ ID NO: 201874 - DNA, 25 bp, Mus musculus
aggtagaatttgtggcgtttcatta

SEQ ID NO: 201875 - DNA, 25 bp, Mus musculus
aggtagacaagccaaggtggcctca

SEQ ID NO: 201876 - DNA, 25 bp, Mus musculus
aggtagacaagcgaaggtggcctca

SEQ ID NO: 201877 - DNA, 25 bp, Mus musculus
aggtagacacacagagcaaccacac

SEQ ID NO: 201878 - DNA, 25 bp, Mus musculus
aggtagacacactgagcaaccacac

SEQ ID NO: 201879 - DNA, 25 bp, Mus musculus
aggtagacacagatcagggatagcc

SEQ ID NO: 201880 - DNA, 25 bp, Mus musculus
aggtagacacagttcagggatagcc

SEQ ID NO: 201881 - DNA, 25 bp, Mus musculus
aggtagacacatatgtttccccact

SEQ ID NO: 201882 - DNA, 25 bp, Mus musculus
aggtagacacatttgtttccccact

SEQ ID NO: 201883 - DNA, 25 bp, Mus musculus
aggtagacagagctgatgcctcccc

SEQ ID NO: 201884 - DNA, 25 bp, Mus musculus
aggtagacagaggtgatgcctcccc

SEQ ID NO: 201885 - DNA, 25 bp, Mus musculus
aggtagaccaaactctgccctcctg

SEQ ID NO: 201886 - DNA, 25 bp, Mus musculus
aggtagaccaaagtctgccctcctg

SEQ ID NO: 201887 - DNA, 25 bp, Mus musculus
aggtagaccctgagccctatgggca

SEQ ID NO: 201888 - DNA, 25 bp, Mus musculus
aggtagaccctgtgccctatgggca

SEQ ID NO: 201889 - DNA, 25 bp, Mus musculus
aggtagacctttctgctcaagccca

SEQ ID NO: 201890 - DNA, 25 bp, Mus musculus
aggtagacctttgtgctcaagccca

SEQ ID NO: 201891 - DNA, 25 bp, Mus musculus
aggtagacggcaacttccaacttcc

SEQ ID NO: 201892 - DNA, 25 bp, Mus musculus
aggtagacggcatcttccaacttcc

SEQ ID NO: 201893 - DNA, 25 bp, Mus musculus
aggtagacgggcactgggtcactca

SEQ ID NO: 201894 - DNA, 25 bp, Mus musculus
aggtagacgggctctgggtcactca

SEQ ID NO: 201895 - DNA, 25 bp, Mus musculus
aggtagagagagagccccaccatgt

SEQ ID NO: 201896 - DNA, 25 bp, Mus musculus
aggtagagagagtgccccaccatgt

SEQ ID NO: 201897 - DNA, 25 bp, Mus musculus
aggtagagatacaggcacttcccct

SEQ ID NO: 201898 - DNA, 25 bp, Mus musculus
aggtagagatactggcacttcccct

SEQ ID NO: 201899 - DNA, 25 bp, Mus musculus
aggtagagcccacgtccatcagctg

SEQ ID NO: 201900 - DNA, 25 bp, Mus musculus
aggtagagcccaggtccatcagctg

SEQ ID NO: 201901 - DNA, 25 bp, Mus musculus
aggtagagccctatgccgcgtagaa

SEQ ID NO: 201902 - DNA, 25 bp, Mus musculus
aggtagagccctttgccgcgtagaa

SEQ ID NO: 201903 - DNA, 25 bp, Mus musculus
aggtagaggaggacccaccacagga

SEQ ID NO: 201904 - DNA, 25 bp, Mus musculus
aggtagaggaggtcccaccacagga

SEQ ID NO: 201905 - DNA, 25 bp, Mus musculus
aggtagaggcccatcctgagcaggt

SEQ ID NO: 201906 - DNA, 25 bp, Mus musculus
aggtagaggcccttcctgagcaggt

SEQ ID NO: 201907 - DNA, 25 bp, Mus musculus
aggtagaggcttcgtgttcagaccc

SEQ ID NO: 201908 - DNA, 25 bp, Mus musculus
aggtagaggcttggtgttcagaccc

SEQ ID NO: 201909 - DNA, 25 bp, Mus musculus
aggtagagggcccaccacccatcgg

SEQ ID NO: 201910 - DNA, 25 bp, Mus musculus
aggtagagggccgaccacccatcgg

SEQ ID NO: 201911 - DNA, 25 bp, Mus musculus
aggtagaggttaatcagaccttcaa

SEQ ID NO: 201912 - DNA, 25 bp, Mus musculus
aggtagaggttattcagaccttcaa

SEQ ID NO: 201913 - DNA, 25 bp, Mus musculus
aggtagagtaccctgtcatgtacag

SEQ ID NO: 201914 - DNA, 25 bp, Mus musculus
aggtagagtaccgtgtcatgtacag

SEQ ID NO: 201915 - DNA, 25 bp, Mus musculus
aggtagagtttaagtgccctgtccc

SEQ ID NO: 201916 - DNA, 25 bp, Mus musculus
aggtagagtttactgcacgcatctt

SEQ ID NO: 201917 - DNA, 25 bp, Mus musculus
aggtagagtttagtgcacgcatctt

SEQ ID NO: 201918 - DNA, 25 bp, Mus musculus
aggtagagtttatgtgccctgtccc

SEQ ID NO: 201919 - DNA, 25 bp, Mus musculus
aggtagatatccatgagtacagcct

SEQ ID NO: 201920 - DNA, 25 bp, Mus musculus
aggtagatatccttgagtacagcct

SEQ ID NO: 201921 - DNA, 25 bp, Mus musculus
aggtagatccctcgaagcatcagtg

SEQ ID NO: 201922 - DNA, 25 bp, Mus musculus
aggtagatccctggaagcatcagtg

SEQ ID NO: 201923 - DNA, 25 bp, Mus musculus
aggtagatcctaacctgtctcaggc

SEQ ID NO: 201924 - DNA, 25 bp, Mus musculus
aggtagatcctatcctgtctcaggc

SEQ ID NO: 201925 - DNA, 25 bp, Mus musculus
aggtagatcctcaccaagggctgcg

SEQ ID NO: 201926 - DNA, 25 bp, Mus musculus
aggtagatcctctccaagggctgcg

SEQ ID NO: 201927 - DNA, 25 bp, Mus musculus
aggtagatccttaggcttgctggcc

SEQ ID NO: 201928 - DNA, 25 bp, Mus musculus
aggtagatcctttggcttgctggcc

SEQ ID NO: 201929 - DNA, 25 bp, Mus musculus
aggtagatctggaaacactgtagca

SEQ ID NO: 201930 - DNA, 25 bp, Mus musculus
aggtagatctggtaacactgtagca

SEQ ID NO: 201931 - DNA, 25 bp, Mus musculus
aggtagatgcgcacggcagtgaaca

SEQ ID NO: 201932 - DNA, 25 bp, Mus musculus
aggtagatgcgctcggcagtgaaca

SEQ ID NO: 201933 - DNA, 25 bp, Mus musculus
aggtagatggctcaggctgccttct

SEQ ID NO: 201934 - DNA, 25 bp, Mus musculus
aggtagatggctgaggctgccttct

SEQ ID NO: 201935 - DNA, 25 bp, Mus musculus
aggtagcaacgtcccaaggccagga

SEQ ID NO: 201936 - DNA, 25 bp, Mus musculus
aggtagcaacgtgccaaggccagga

SEQ ID NO: 201937 - DNA, 25 bp, Mus musculus
aggtagcaaggccagagaccccagc

SEQ ID NO: 201938 - DNA, 25 bp, Mus musculus
aggtagcaaggcgagagaccccagc

SEQ ID NO: 201939 - DNA, 25 bp, Mus musculus
aggtagcaatcgatcaatggtggtt

SEQ ID NO: 201940 - DNA, 25 bp, Mus musculus
aggtagcaatcgttcaatggtggtt

SEQ ID NO: 201941 - DNA, 25 bp, Mus musculus
aggtagcactctatggtgagccctc

SEQ ID NO: 201942 - DNA, 25 bp, Mus musculus
aggtagcactctttggtgagccctc

SEQ ID NO: 201943 - DNA, 25 bp, Mus musculus
aggtagcagagcagcagtcaaggct

SEQ ID NO: 201944 - DNA, 25 bp, Mus musculus
aggtagcagagctgcagtcaaggct

SEQ ID NO: 201945 - DNA, 25 bp, Mus musculus
aggtagcatacaagcccttgttttc

SEQ ID NO: 201946 - DNA, 25 bp, Mus musculus
aggtagcatacatgcccttgttttc

SEQ ID NO: 201947 - DNA, 25 bp, Mus musculus
aggtagcatagacttgtaaccccag

SEQ ID NO: 201948 - DNA, 25 bp, Mus musculus
aggtagcatagagttgtaaccccag

SEQ ID NO: 201949 - DNA, 25 bp, Mus musculus
aggtagcatgacattcctttcctct

SEQ ID NO: 201950 - DNA, 25 bp, Mus musculus
aggtagcatgactttcctttcctct

SEQ ID NO: 201951 - DNA, 25 bp, Mus musculus
aggtagccacaaccatggtggacta

SEQ ID NO: 201952 - DNA, 25 bp, Mus musculus
aggtagccacaagcatggtggacta

SEQ ID NO: 201953 - DNA, 25 bp, Mus musculus
aggtagccatagactcttaggttga

SEQ ID NO: 201954 - DNA, 25 bp, Mus musculus
aggtagccatagtctcttaggttga

SEQ ID NO: 201955 - DNA, 25 bp, Mus musculus
aggtagcccaagctatccaacagaa

SEQ ID NO: 201956 - DNA, 25 bp, Mus musculus
aggtagcccaaggtatccaacagaa

SEQ ID NO: 201957 - DNA, 25 bp, Mus musculus
aggtagccccatacaccagattctg

SEQ ID NO: 201958 - DNA, 25 bp, Mus musculus
aggtagccccattcaccagattctg

SEQ ID NO: 201959 - DNA, 25 bp, Mus musculus
aggtagcccctcacttagccaggac

SEQ ID NO: 201960 - DNA, 25 bp, Mus musculus
aggtagcccctctcttagccaggac

SEQ ID NO: 201961 - DNA, 25 bp, Mus musculus
aggtagccctggaagacttcgaact

SEQ ID NO: 201962 - DNA, 25 bp, Mus musculus
aggtagccctggtagacttcgaact

SEQ ID NO: 201963 - DNA, 25 bp, Mus musculus
aggtagccgacgacttgctgatggt

SEQ ID NO: 201964 - DNA, 25 bp, Mus musculus
aggtagccgacgtcttgctgatggt

SEQ ID NO: 201965 - DNA, 25 bp, Mus musculus
aggtagcctctgctgcgctcctctt

SEQ ID NO: 201966 - DNA, 25 bp, Mus musculus
aggtagcctctggtgcgctcctctt

SEQ ID NO: 201967 - DNA, 25 bp, Mus musculus
aggtagcctgaactgtgacctgtca

SEQ ID NO: 201968 - DNA, 25 bp, Mus musculus
aggtagcctgaagtgtgacctgtca

SEQ ID NO: 201969 - DNA, 25 bp, Mus musculus
aggtagcctgtaattctcaagttaa

SEQ ID NO: 201970 - DNA, 25 bp, Mus musculus
aggtagcctgtatttctcaagttaa

SEQ ID NO: 201971 - DNA, 25 bp, Mus musculus
aggtagccttctcggagtatcacca

SEQ ID NO: 201972 - DNA, 25 bp, Mus musculus
aggtagccttctgggagtatcacca

SEQ ID NO: 201973 - DNA, 25 bp, Mus musculus
aggtagcctttgaaacaagccccag

SEQ ID NO: 201974 - DNA, 25 bp, Mus musculus
aggtagcctttgtaacaagccccag

SEQ ID NO: 201975 - DNA, 25 bp, Mus musculus
aggtagctagctagcttctttcctg

SEQ ID NO: 201976 - DNA, 25 bp, Mus musculus
aggtagctagcttgcttctttcctg

SEQ ID NO: 201977 - DNA, 25 bp, Mus musculus
aggtagctcagaactacactcccag

SEQ ID NO: 201978 - DNA, 25 bp, Mus musculus
aggtagctcagaccattgtgccaac

SEQ ID NO: 201979 - DNA, 25 bp, Mus musculus
aggtagctcagacttagttctttaa

SEQ ID NO: 201980 - DNA, 25 bp, Mus musculus
aggtagctcagagcattgtgccaac

SEQ ID NO: 201981 - DNA, 25 bp, Mus musculus
aggtagctcagagttagttctttaa

SEQ ID NO: 201982 - DNA, 25 bp, Mus musculus
aggtagctcagatctacactcccag

SEQ ID NO: 201983 - DNA, 25 bp, Mus musculus
aggtagctctcacttctgcatgttc

SEQ ID NO: 201984 - DNA, 25 bp, Mus musculus
aggtagctctcagttctgcatgttc

SEQ ID NO: 201985 - DNA, 25 bp, Mus musculus
aggtagctctgcagtcatgtgggtc

SEQ ID NO: 201986 - DNA, 25 bp, Mus musculus
aggtagctctgctgtcatgtgggtc

SEQ ID NO: 201987 - DNA, 25 bp, Mus musculus
aggtagctgcaaatgtggacttcat

SEQ ID NO: 201988 - DNA, 25 bp, Mus musculus
aggtagctgcaattgtggacttcat

SEQ ID NO: 201989 - DNA, 25 bp, Mus musculus
aggtagctggtcaggcctcagagtc

SEQ ID NO: 201990 - DNA, 25 bp, Mus musculus
aggtagctggtctggcctcagagtc

SEQ ID NO: 201991 - DNA, 25 bp, Mus musculus
aggtagcttcataccatttactggt

SEQ ID NO: 201992 - DNA, 25 bp, Mus musculus
aggtagcttcattccatttactggt

SEQ ID NO: 201993 - DNA, 25 bp, Mus musculus
aggtagcttggtcagatggccttct

SEQ ID NO: 201994 - DNA, 25 bp, Mus musculus
aggtagcttggtgagatggccttct

SEQ ID NO: 201995 - DNA, 25 bp, Mus musculus
aggtagctttatctgcagggcgttc

SEQ ID NO: 201996 - DNA, 25 bp, Mus musculus
aggtagctttatgtgcagggcgttc

SEQ ID NO: 201997 - DNA, 25 bp, Mus musculus
aggtaggaaccaatgtacgagcttt

SEQ ID NO: 201998 - DNA, 25 bp, Mus musculus
aggtaggaaccattgtacgagcttt

SEQ ID NO: 201999 - DNA, 25 bp, Mus musculus
aggtaggactatacttcagctctct

SEQ ID NO: 202000 - DNA, 25 bp, Mus musculus
aggtaggactattcttcagctctct

SEQ ID NO: 202001 - DNA, 25 bp, Mus musculus
aggtaggattcactcctgctgctgg

SEQ ID NO: 202002 - DNA, 25 bp, Mus musculus
aggtaggattcagtcctgctgctgg

SEQ ID NO: 202003 - DNA, 25 bp, Mus musculus
aggtaggcacagattgtctcctcac

SEQ ID NO: 202004 - DNA, 25 bp, Mus musculus
aggtaggcacagtttgtctcctcac

SEQ ID NO: 202005 - DNA, 25 bp, Mus musculus
aggtaggccaatccaatagccccag

SEQ ID NO: 202006 - DNA, 25 bp, Mus musculus
aggtaggccaatgcaatagccccag

SEQ ID NO: 202007 - DNA, 25 bp, Mus musculus
aggtaggccactctagcatttgcca

SEQ ID NO: 202008 - DNA, 25 bp, Mus musculus
aggtaggccactgtagcatttgcca

SEQ ID NO: 202009 - DNA, 25 bp, Mus musculus
aggtaggcctccaggtaacatgtgc

SEQ ID NO: 202010 - DNA, 25 bp, Mus musculus
aggtaggcctcctggtaacatgtgc

SEQ ID NO: 202011 - DNA, 25 bp, Mus musculus
aggtaggcttgcatttacaggctct

SEQ ID NO: 202012 - DNA, 25 bp, Mus musculus
aggtaggcttgcttttacaggctct

SEQ ID NO: 202013 - DNA, 25 bp, Mus musculus
aggtagggacctatccttggcagct

SEQ ID NO: 202014 - DNA, 25 bp, Mus musculus
aggtagggacctttccttggcagct

SEQ ID NO: 202015 - DNA, 25 bp, Mus musculus
aggtagggccacaggatctatgtaa

SEQ ID NO: 202016 - DNA, 25 bp, Mus musculus
aggtagggccactggatctatgtaa

SEQ ID NO: 202017 - DNA, 25 bp, Mus musculus
aggtagggcctgaccgatgatgtca

SEQ ID NO: 202018 - DNA, 25 bp, Mus musculus
aggtagggcctgtccgatgatgtca

SEQ ID NO: 202019 - DNA, 25 bp, Mus musculus
aggtagggtttacagcatgcttgat

SEQ ID NO: 202020 - DNA, 25 bp, Mus musculus
aggtagggtttagagcatgcttgat

SEQ ID NO: 202021 - DNA, 25 bp, Mus musculus
aggtaggtaaccagaggcgaagcca

SEQ ID NO: 202022 - DNA, 25 bp, Mus musculus
aggtaggtaacctgaggcgaagcca

SEQ ID NO: 202023 - DNA, 25 bp, Mus musculus
aggtaggtgactatcaatatcacag

SEQ ID NO: 202024 - DNA, 25 bp, Mus musculus
aggtaggtgactcttgtgcccttca

SEQ ID NO: 202025 - DNA, 25 bp, Mus musculus
aggtaggtgactgttgtgcccttca

SEQ ID NO: 202026 - DNA, 25 bp, Mus musculus
aggtaggtgactttcaatatcacag

SEQ ID NO: 202027 - DNA, 25 bp, Mus musculus
aggtaggtgctaagcctgtctcgta

SEQ ID NO: 202028 - DNA, 25 bp, Mus musculus
aggtaggtgctatgcctgtctcgta

SEQ ID NO: 202029 - DNA, 25 bp, Mus musculus
aggtaggtgtcactagcatgtctct

SEQ ID NO: 202030 - DNA, 25 bp, Mus musculus
aggtaggtgtcagtagcatgtctct

SEQ ID NO: 202031 - DNA, 25 bp, Mus musculus
aggtaggtgtgcactcaacgatgtt

SEQ ID NO: 202032 - DNA, 25 bp, Mus musculus
aggtaggtgtgctctcaacgatgtt

SEQ ID NO: 202033 - DNA, 25 bp, Mus musculus
aggtaggttcctctgtgtggacaca

SEQ ID NO: 202034 - DNA, 25 bp, Mus musculus
aggtaggttcctgtgtgtggacaca

SEQ ID NO: 202035 - DNA, 25 bp, Mus musculus
aggtagtacctccatcaggacagtc

SEQ ID NO: 202036 - DNA, 25 bp, Mus musculus
aggtagtacctcgatcaggacagtc

SEQ ID NO: 202037 - DNA, 25 bp, Mus musculus
aggtagtatatacctctctgcccca

SEQ ID NO: 202038 - DNA, 25 bp, Mus musculus
aggtagtatatagctctctgcccca

SEQ ID NO: 202039 - DNA, 25 bp, Mus musculus
aggtagtcccctctgtcagctcaga

SEQ ID NO: 202040 - DNA, 25 bp, Mus musculus
aggtagtcccctgtgtcagctcaga

SEQ ID NO: 202041 - DNA, 25 bp, Mus musculus
aggtagtcctagagggccaggatat

SEQ ID NO: 202042 - DNA, 25 bp, Mus musculus
aggtagtcctagtgggccaggatat

SEQ ID NO: 202043 - DNA, 25 bp, Mus musculus
aggtagtcctccatggtaaagcccg

SEQ ID NO: 202044 - DNA, 25 bp, Mus musculus
aggtagtcctccttggtaaagcccg

SEQ ID NO: 202045 - DNA, 25 bp, Mus musculus
aggtagtcgctgattgacttttcta

SEQ ID NO: 202046 - DNA, 25 bp, Mus musculus
aggtagtcgctgtttgacttttcta

SEQ ID NO: 202047 - DNA, 25 bp, Mus musculus
aggtagtgatttcctccgaggactg

SEQ ID NO: 202048 - DNA, 25 bp, Mus musculus
aggtagtgatttgctccgaggactg

SEQ ID NO: 202049 - DNA, 25 bp, Mus musculus
aggtagtggacgacctcttgtttgt

SEQ ID NO: 202050 - DNA, 25 bp, Mus musculus
aggtagtggacgtcctcttgtttgt

SEQ ID NO: 202051 - DNA, 25 bp, Mus musculus
aggtagtggagtacagccccgcaga

SEQ ID NO: 202052 - DNA, 25 bp, Mus musculus
aggtagtggagttcagccccgcaga

SEQ ID NO: 202053 - DNA, 25 bp, Mus musculus
aggtagtggcttacctgtagctccc

SEQ ID NO: 202054 - DNA, 25 bp, Mus musculus
aggtagtggctttcctgtagctccc

SEQ ID NO: 202055 - DNA, 25 bp, Mus musculus
aggtagtgtgcaagtctttatttca

SEQ ID NO: 202056 - DNA, 25 bp, Mus musculus
aggtagtgtgcatgtctttatttca

SEQ ID NO: 202057 - DNA, 25 bp, Mus musculus
aggtagtgtggtacccagacctaga

SEQ ID NO: 202058 - DNA, 25 bp, Mus musculus
aggtagtgtggttcccagacctaga

SEQ ID NO: 202059 - DNA, 25 bp, Mus musculus
aggtagttgctacacaggaagcgaa

SEQ ID NO: 202060 - DNA, 25 bp, Mus musculus
aggtagttgctagacaggaagcgaa

SEQ ID NO: 202061 - DNA, 25 bp, Mus musculus
aggtagttgtcacggttagctgcca

SEQ ID NO: 202062 - DNA, 25 bp, Mus musculus
aggtagttgtcagggttagctgcca

SEQ ID NO: 202063 - DNA, 25 bp, Mus musculus
aggtagtttctcagagccacattca

SEQ ID NO: 202064 - DNA, 25 bp, Mus musculus
aggtagtttctctgagccacattca

SEQ ID NO: 202065 - DNA, 25 bp, Mus musculus
aggtataagctaagtttctattaaa

SEQ ID NO: 202066 - DNA, 25 bp, Mus musculus
aggtataagctatgtttctattaaa

SEQ ID NO: 202067 - DNA, 25 bp, Mus musculus
aggtataatgcacccacttggcact

SEQ ID NO: 202068 - DNA, 25 bp, Mus musculus
aggtataatgcagccacttggcact

SEQ ID NO: 202069 - DNA, 25 bp, Mus musculus
aggtataatgcccaagtttccttgt

SEQ ID NO: 202070 - DNA, 25 bp, Mus musculus
aggtataatgccgaagtttccttgt

SEQ ID NO: 202071 - DNA, 25 bp, Mus musculus
aggtatacacttcggaggtcttcaa

SEQ ID NO: 202072 - DNA, 25 bp, Mus musculus
aggtatacacttgggaggtcttcaa

SEQ ID NO: 202073 - DNA, 25 bp, Mus musculus
aggtatacatctacatgcttttaca

SEQ ID NO: 202074 - DNA, 25 bp, Mus musculus
aggtatacatcttcatgcttttaca

SEQ ID NO: 202075 - DNA, 25 bp, Mus musculus
aggtatacattacccctgactgtgt

SEQ ID NO: 202076 - DNA, 25 bp, Mus musculus
aggtatacattagccctgactgtgt

SEQ ID NO: 202077 - DNA, 25 bp, Mus musculus
aggtatactattagcatatgaccct

SEQ ID NO: 202078 - DNA, 25 bp, Mus musculus
aggtatactatttgcatatgaccct

SEQ ID NO: 202079 - DNA, 25 bp, Mus musculus
aggtatactgacaggcacttaaaac

SEQ ID NO: 202080 - DNA, 25 bp, Mus musculus
aggtatactgactggcacttaaaac

SEQ ID NO: 202081 - DNA, 25 bp, Mus musculus
aggtatatactacactcctaaaagt

SEQ ID NO: 202082 - DNA, 25 bp, Mus musculus
aggtatatactagactcctaaaagt

SEQ ID NO: 202083 - DNA, 25 bp, Mus musculus
aggtatattccaagctctgacagca

SEQ ID NO: 202084 - DNA, 25 bp, Mus musculus
aggtatattccatgctctgacagca

SEQ ID NO: 202085 - DNA, 25 bp, Mus musculus
aggtatcaacacatgtgcatttcag

SEQ ID NO: 202086 - DNA, 25 bp, Mus musculus
aggtatcaacacttgtgcatttcag

SEQ ID NO: 202087 - DNA, 25 bp, Mus musculus
aggtatcaatctattccagtgtata

SEQ ID NO: 202088 - DNA, 25 bp, Mus musculus
aggtatcaatcttttccagtgtata

SEQ ID NO: 202089 - DNA, 25 bp, Mus musculus
aggtatcacatcaacaggccctata

SEQ ID NO: 202090 - DNA, 25 bp, Mus musculus
aggtatcacatctacaggccctata

SEQ ID NO: 202091 - DNA, 25 bp, Mus musculus
aggtatcacttcaacttggacgcat

SEQ ID NO: 202092 - DNA, 25 bp, Mus musculus
aggtatcacttctacttggacgcat

SEQ ID NO: 202093 - DNA, 25 bp, Mus musculus
aggtatcaggtcaacagcttccttc

SEQ ID NO: 202094 - DNA, 25 bp, Mus musculus
aggtatcaggtctacagcttccttc

SEQ ID NO: 202095 - DNA, 25 bp, Mus musculus
aggtatcagtaacatgcatgtgcat

SEQ ID NO: 202096 - DNA, 25 bp, Mus musculus
aggtatcagtaagatgcatgtgcat

SEQ ID NO: 202097 - DNA, 25 bp, Mus musculus
aggtatcagtcaatccaacttggcc

SEQ ID NO: 202098 - DNA, 25 bp, Mus musculus
aggtatcagtcattccaacttggcc

SEQ ID NO: 202099 - DNA, 25 bp, Mus musculus
aggtatcatcatcccaagctctttg

SEQ ID NO: 202100 - DNA, 25 bp, Mus musculus
aggtatcatcatgccaagctctttg

SEQ ID NO: 202101 - DNA, 25 bp, Mus musculus
aggtatcatcttataagggcccaga

SEQ ID NO: 202102 - DNA, 25 bp, Mus musculus
aggtatcatcttttaagggcccaga

SEQ ID NO: 202103 - DNA, 25 bp, Mus musculus
aggtatcattgcacttacttggtgc

SEQ ID NO: 202104 - DNA, 25 bp, Mus musculus
aggtatcattgctcttacttggtgc

SEQ ID NO: 202105 - DNA, 25 bp, Mus musculus
aggtatccatgaaaccctgtctggg

SEQ ID NO: 202106 - DNA, 25 bp, Mus musculus
aggtatccatgataccctgtctggg

SEQ ID NO: 202107 - DNA, 25 bp, Mus musculus
aggtatcctcatagctgtactgagt

SEQ ID NO: 202108 - DNA, 25 bp, Mus musculus
aggtatcctcattgctgtactgagt

SEQ ID NO: 202109 - DNA, 25 bp, Mus musculus
aggtatcctcctcacattaacaagt

SEQ ID NO: 202110 - DNA, 25 bp, Mus musculus
aggtatcctcctgacattaacaagt

SEQ ID NO: 202111 - DNA, 25 bp, Mus musculus
aggtatctattcactttaaggtcag

SEQ ID NO: 202112 - DNA, 25 bp, Mus musculus
aggtatctattctctttaaggtcag

SEQ ID NO: 202113 - DNA, 25 bp, Mus musculus
aggtatctcccaaggtgtgcctgcc

SEQ ID NO: 202114 - DNA, 25 bp, Mus musculus
aggtatctcccatggtgtgcctgcc

SEQ ID NO: 202115 - DNA, 25 bp, Mus musculus
aggtatctcgatccacagggtttgg

SEQ ID NO: 202116 - DNA, 25 bp, Mus musculus
aggtatctcgatgcacagggtttgg

SEQ ID NO: 202117 - DNA, 25 bp, Mus musculus
aggtatctctacctcgaggagcctt

SEQ ID NO: 202118 - DNA, 25 bp, Mus musculus
aggtatctctacgtcgaggagcctt

SEQ ID NO: 202119 - DNA, 25 bp, Mus musculus
aggtatctctagagtgtatgtgtgc

SEQ ID NO: 202120 - DNA, 25 bp, Mus musculus
aggtatctctagtgtgtatgtgtgc

SEQ ID NO: 202121 - DNA, 25 bp, Mus musculus
aggtatctgctcatgtatctacatt

SEQ ID NO: 202122 - DNA, 25 bp, Mus musculus
aggtatctgctcttgtatctacatt

SEQ ID NO: 202123 - DNA, 25 bp, Mus musculus
aggtatctgtcgctttgcaaaagta

SEQ ID NO: 202124 - DNA, 25 bp, Mus musculus
aggtatctgtcggtttgcaaaagta

SEQ ID NO: 202125 - DNA, 25 bp, Mus musculus
aggtatcttgcgctaccgagtagat

SEQ ID NO: 202126 - DNA, 25 bp, Mus musculus
aggtatcttgcggtaccgagtagat

SEQ ID NO: 202127 - DNA, 25 bp, Mus musculus
aggtatcttggtatctcggtactct

SEQ ID NO: 202128 - DNA, 25 bp, Mus musculus
aggtatcttggtttctcggtactct

SEQ ID NO: 202129 - DNA, 25 bp, Mus musculus
aggtatcttgtaaatgtcactgcat

SEQ ID NO: 202130 - DNA, 25 bp, Mus musculus
aggtatcttgtatatgtcactgcat

SEQ ID NO: 202131 - DNA, 25 bp, Mus musculus
aggtatctttaaagcattccctgat

SEQ ID NO: 202132 - DNA, 25 bp, Mus musculus
aggtatctttaatgcattccctgat

SEQ ID NO: 202133 - DNA, 25 bp, Mus musculus
aggtatgaatttcgccaggccctct

SEQ ID NO: 202134 - DNA, 25 bp, Mus musculus
aggtatgaatttggccaggccctct

SEQ ID NO: 202135 - DNA, 25 bp, Mus musculus
aggtatgactatcgcttccacgtgt

SEQ ID NO: 202136 - DNA, 25 bp, Mus musculus
aggtatgactatggcttccacgtgt

SEQ ID NO: 202137 - DNA, 25 bp, Mus musculus
aggtatgagacacttggccccacag

SEQ ID NO: 202138 - DNA, 25 bp, Mus musculus
aggtatgagacagttggccccacag

SEQ ID NO: 202139 - DNA, 25 bp, Mus musculus
aggtatgaggcaccatacccagcca

SEQ ID NO: 202140 - DNA, 25 bp, Mus musculus
aggtatgaggcagcatacccagcca

SEQ ID NO: 202141 - DNA, 25 bp, Mus musculus
aggtatgagtcacaatatctggttc

SEQ ID NO: 202142 - DNA, 25 bp, Mus musculus
aggtatgagtcagaatatctggttc

SEQ ID NO: 202143 - DNA, 25 bp, Mus musculus
aggtatgagtgcaccctggaagctg

SEQ ID NO: 202144 - DNA, 25 bp, Mus musculus
aggtatgagtgctccctggaagctg

SEQ ID NO: 202145 - DNA, 25 bp, Mus musculus
aggtatgatctgcacctgcctcctg

SEQ ID NO: 202146 - DNA, 25 bp, Mus musculus
aggtatgatctggacctgcctcctg

SEQ ID NO: 202147 - DNA, 25 bp, Mus musculus
aggtatgatggcagactgcacctct

SEQ ID NO: 202148 - DNA, 25 bp, Mus musculus
aggtatgatggctgactgcacctct

SEQ ID NO: 202149 - DNA, 25 bp, Mus musculus
aggtatgattccaaggactgcaaga

SEQ ID NO: 202150 - DNA, 25 bp, Mus musculus
aggtatgattcctaggactgcaaga

SEQ ID NO: 202151 - DNA, 25 bp, Mus musculus
aggtatgccgcccaggagtacgact

SEQ ID NO: 202152 - DNA, 25 bp, Mus musculus
aggtatgccgccgaggagtacgact

SEQ ID NO: 202153 - DNA, 25 bp, Mus musculus
aggtatgcgccaaacttccacatct

SEQ ID NO: 202154 - DNA, 25 bp, Mus musculus
aggtatgcgccatacttccacatct

SEQ ID NO: 202155 - DNA, 25 bp, Mus musculus
aggtatgctcttacagtctatctgg

SEQ ID NO: 202156 - DNA, 25 bp, Mus musculus
aggtatgctctttcagtctatctgg

SEQ ID NO: 202157 - DNA, 25 bp, Mus musculus
aggtatgcttcaacccgggtgacct

SEQ ID NO: 202158 - DNA, 25 bp, Mus musculus
aggtatgcttcatcccgggtgacct

SEQ ID NO: 202159 - DNA, 25 bp, Mus musculus
aggtatggactgacaacttctcccc

SEQ ID NO: 202160 - DNA, 25 bp, Mus musculus
aggtatggactgtcaacttctcccc

SEQ ID NO: 202161 - DNA, 25 bp, Mus musculus
aggtatggcaggctgatcctcctct

SEQ ID NO: 202162 - DNA, 25 bp, Mus musculus
aggtatggcagggtgatcctcctct

SEQ ID NO: 202163 - DNA, 25 bp, Mus musculus
aggtatggcgatacagtactgcatt

SEQ ID NO: 202164 - DNA, 25 bp, Mus musculus
aggtatggcgattcagtactgcatt

SEQ ID NO: 202165 - DNA, 25 bp, Mus musculus
aggtatggtcatctgtaacccaacc

SEQ ID NO: 202166 - DNA, 25 bp, Mus musculus
aggtatggtcatgtgtaacccaacc

SEQ ID NO: 202167 - DNA, 25 bp, Mus musculus
aggtatggtggcaccgtgtctttca

SEQ ID NO: 202168 - DNA, 25 bp, Mus musculus
aggtatggtggctccgtgtctttca

SEQ ID NO: 202169 - DNA, 25 bp, Mus musculus
aggtatgtatgtcactccctggaat

SEQ ID NO: 202170 - DNA, 25 bp, Mus musculus
aggtatgtatgtgactccctggaat

SEQ ID NO: 202171 - DNA, 25 bp, Mus musculus
aggtatgtccaaaagtgtctagcaa

SEQ ID NO: 202172 - DNA, 25 bp, Mus musculus
aggtatgtccaatagtgtctagcaa

SEQ ID NO: 202173 - DNA, 25 bp, Mus musculus
aggtatgtgctgcagacacacgctc

SEQ ID NO: 202174 - DNA, 25 bp, Mus musculus
aggtatgtgctggagacacacgctc

SEQ ID NO: 202175 - DNA, 25 bp, Mus musculus
aggtatgttaccatctccttatttg

SEQ ID NO: 202176 - DNA, 25 bp, Mus musculus
aggtatgttaccttctccttatttg

SEQ ID NO: 202177 - DNA, 25 bp, Mus musculus
aggtatgttagcacaccacctgcat

SEQ ID NO: 202178 - DNA, 25 bp, Mus musculus
aggtatgttagctcaccacctgcat

SEQ ID NO: 202179 - DNA, 25 bp, Mus musculus
aggtattaaacaccagctctccagc

SEQ ID NO: 202180 - DNA, 25 bp, Mus musculus
aggtattaaacagcagctctccagc

SEQ ID NO: 202181 - DNA, 25 bp, Mus musculus
aggtattaacctagcctggtggtat

SEQ ID NO: 202182 - DNA, 25 bp, Mus musculus
aggtattaaccttgcctggtggtat

SEQ ID NO: 202183 - DNA, 25 bp, Mus musculus
aggtattagtatagctgcacgggag

SEQ ID NO: 202184 - DNA, 25 bp, Mus musculus
aggtattagtattgctgcacgggag

SEQ ID NO: 202185 - DNA, 25 bp, Mus musculus
aggtattcaaacacttagggcttag

SEQ ID NO: 202186 - DNA, 25 bp, Mus musculus
aggtattcaaactcttagggcttag

SEQ ID NO: 202187 - DNA, 25 bp, Mus musculus
aggtattcacctaaggcatttgatg

SEQ ID NO: 202188 - DNA, 25 bp, Mus musculus
aggtattcaccttaggcatttgatg

SEQ ID NO: 202189 - DNA, 25 bp, Mus musculus
aggtattcagcaccactctctcagg

SEQ ID NO: 202190 - DNA, 25 bp, Mus musculus
aggtattcagcagcactctctcagg

SEQ ID NO: 202191 - DNA, 25 bp, Mus musculus
aggtattcatacagactcccaaaga

SEQ ID NO: 202192 - DNA, 25 bp, Mus musculus
aggtattcatactgactcccaaaga

SEQ ID NO: 202193 - DNA, 25 bp, Mus musculus
aggtattccatgctctattttctac

SEQ ID NO: 202194 - DNA, 25 bp, Mus musculus
aggtattccatggtctattttctac

SEQ ID NO: 202195 - DNA, 25 bp, Mus musculus
aggtattccttcaatcatataacga

SEQ ID NO: 202196 - DNA, 25 bp, Mus musculus
aggtattccttctatcatataacga

SEQ ID NO: 202197 - DNA, 25 bp, Mus musculus
aggtattctattatggtcttaccat

SEQ ID NO: 202198 - DNA, 25 bp, Mus musculus
aggtattctattttggtcttaccat

SEQ ID NO: 202199 - DNA, 25 bp, Mus musculus
aggtattgctgaatcctcaggctgc

SEQ ID NO: 202200 - DNA, 25 bp, Mus musculus
aggtattgctgattcctcaggctgc

SEQ ID NO: 202201 - DNA, 25 bp, Mus musculus
aggtattgcttaactgccccaaact

SEQ ID NO: 202202 - DNA, 25 bp, Mus musculus
aggtattgcttatctgccccaaact

SEQ ID NO: 202203 - DNA, 25 bp, Mus musculus
aggtattgtcatctggcccctggcc

SEQ ID NO: 202204 - DNA, 25 bp, Mus musculus
aggtattgtcatgtggcccctggcc

SEQ ID NO: 202205 - DNA, 25 bp, Mus musculus
aggtatttaaacaatctgtctccaa

SEQ ID NO: 202206 - DNA, 25 bp, Mus musculus
aggtatttaaactatctgtctccaa

SEQ ID NO: 202207 - DNA, 25 bp, Mus musculus
aggtatttaatgaatggcatcaatg

SEQ ID NO: 202208 - DNA, 25 bp, Mus musculus
aggtatttaatgtatggcatcaatg

SEQ ID NO: 202209 - DNA, 25 bp, Mus musculus
aggtatttgaatctgctgtccgaac

SEQ ID NO: 202210 - DNA, 25 bp, Mus musculus
aggtatttgaatgtgctgtccgaac

SEQ ID NO: 202211 - DNA, 25 bp, Mus musculus
aggtatttgaccattcactggctga

SEQ ID NO: 202212 - DNA, 25 bp, Mus musculus
aggtatttgacctttcactggctga

SEQ ID NO: 202213 - DNA, 25 bp, Mus musculus
aggtatttgagaaggccactcgggc

SEQ ID NO: 202214 - DNA, 25 bp, Mus musculus
aggtatttgagatggccactcgggc

SEQ ID NO: 202215 - DNA, 25 bp, Mus musculus
aggtattttacgattctgctgctgt

SEQ ID NO: 202216 - DNA, 25 bp, Mus musculus
aggtattttacgtttctgctgctgt

SEQ ID NO: 202217 - DNA, 25 bp, Mus musculus
aggtatttttctcctttcctgcagt

SEQ ID NO: 202218 - DNA, 25 bp, Mus musculus
aggtatttttctgctttcctgcagt

SEQ ID NO: 202219 - DNA, 25 bp, Mus musculus
aggtcaaaactgagcccaggctagc

SEQ ID NO: 202220 - DNA, 25 bp, Mus musculus
aggtcaaaactgtgcccaggctagc

SEQ ID NO: 202221 - DNA, 25 bp, Mus musculus
aggtcaaactccaggaagtactggt

SEQ ID NO: 202222 - DNA, 25 bp, Mus musculus
aggtcaaactcctggaagtactggt

SEQ ID NO: 202223 - DNA, 25 bp, Mus musculus
aggtcaaagtcaactctgcttgcaa

SEQ ID NO: 202224 - DNA, 25 bp, Mus musculus
aggtcaaagtcatctctgcttgcaa

SEQ ID NO: 202225 - DNA, 25 bp, Mus musculus
aggtcaaagttacctactgcctcca

SEQ ID NO: 202226 - DNA, 25 bp, Mus musculus
aggtcaaagttagctactgcctcca

SEQ ID NO: 202227 - DNA, 25 bp, Mus musculus
aggtcaaatcacactatgcaggctc

SEQ ID NO: 202228 - DNA, 25 bp, Mus musculus
aggtcaaatcactctatgcaggctc

SEQ ID NO: 202229 - DNA, 25 bp, Mus musculus
aggtcaacaagaaggctgggaacgc

SEQ ID NO: 202230 - DNA, 25 bp, Mus musculus
aggtcaacaagatggctgggaacgc

SEQ ID NO: 202231 - DNA, 25 bp, Mus musculus
aggtcaacccacctctgagagacgg

SEQ ID NO: 202232 - DNA, 25 bp, Mus musculus
aggtcaacccacgtctgagagacgg

SEQ ID NO: 202233 - DNA, 25 bp, Mus musculus
aggtcaacccttaatggcagcttcc

SEQ ID NO: 202234 - DNA, 25 bp, Mus musculus
aggtcaaccctttatggcagcttcc

SEQ ID NO: 202235 - DNA, 25 bp, Mus musculus
aggtcaaccgtcaacttgaaactga

SEQ ID NO: 202236 - DNA, 25 bp, Mus musculus
aggtcaaccgtctacttgaaactga

SEQ ID NO: 202237 - DNA, 25 bp, Mus musculus
aggtcaacctgaacagcaaaactag

SEQ ID NO: 202238 - DNA, 25 bp, Mus musculus
aggtcaacctgatcagcaaaactag

SEQ ID NO: 202239 - DNA, 25 bp, Mus musculus
aggtcaacgaccacttcagtcggaa

SEQ ID NO: 202240 - DNA, 25 bp, Mus musculus
aggtcaacgacctcttcagtcggaa

SEQ ID NO: 202241 - DNA, 25 bp, Mus musculus
aggtcaacggacaactggtaggctt

SEQ ID NO: 202242 - DNA, 25 bp, Mus musculus
aggtcaacggactactggtaggctt

SEQ ID NO: 202243 - DNA, 25 bp, Mus musculus
aggtcaactgggatcttctcggaga

SEQ ID NO: 202244 - DNA, 25 bp, Mus musculus
aggtcaactgggttcttctcggaga

SEQ ID NO: 202245 - DNA, 25 bp, Mus musculus
aggtcaagatctagcaataacgatg

SEQ ID NO: 202246 - DNA, 25 bp, Mus musculus
aggtcaagatcttgcaataacgatg

SEQ ID NO: 202247 - DNA, 25 bp, Mus musculus
aggtcaaggccacctgactctacat

SEQ ID NO: 202248 - DNA, 25 bp, Mus musculus
aggtcaaggccagctgactctacat

SEQ ID NO: 202249 - DNA, 25 bp, Mus musculus
aggtcaagggctcgctctgctgtca

SEQ ID NO: 202250 - DNA, 25 bp, Mus musculus
aggtcaagggctggctctgctgtca

SEQ ID NO: 202251 - DNA, 25 bp, Mus musculus
aggtcaaggtccaggtcgcgatcga

SEQ ID NO: 202252 - DNA, 25 bp, Mus musculus
aggtcaaggtcctggtcgcgatcga

SEQ ID NO: 202253 - DNA, 25 bp, Mus musculus
aggtcaaggttgacactgggtgtct

SEQ ID NO: 202254 - DNA, 25 bp, Mus musculus
aggtcaaggttgacttcagtatgta

SEQ ID NO: 202255 - DNA, 25 bp, Mus musculus
aggtcaaggttgtcactgggtgtct

SEQ ID NO: 202256 - DNA, 25 bp, Mus musculus
aggtcaaggttgtcttcagtatgta

SEQ ID NO: 202257 - DNA, 25 bp, Mus musculus
aggtcaagtctgctgagctcttcag

SEQ ID NO: 202258 - DNA, 25 bp, Mus musculus
aggtcaagtctggtgagctcttcag

SEQ ID NO: 202259 - DNA, 25 bp, Mus musculus
aggtcaatacaaaccaccatttcct

SEQ ID NO: 202260 - DNA, 25 bp, Mus musculus
aggtcaatacaatccaccatttcct

SEQ ID NO: 202261 - DNA, 25 bp, Mus musculus
aggtcaatactccagatgtacaata

SEQ ID NO: 202262 - DNA, 25 bp, Mus musculus
aggtcaatactcgagatgtacaata

SEQ ID NO: 202263 - DNA, 25 bp, Mus musculus
aggtcaatagccaggtaggtcttct

SEQ ID NO: 202264 - DNA, 25 bp, Mus musculus
aggtcaatagcctggtaggtcttct

SEQ ID NO: 202265 - DNA, 25 bp, Mus musculus
aggtcaatagtacaaggctgctcta

SEQ ID NO: 202266 - DNA, 25 bp, Mus musculus
aggtcaatagtagaaggctgctcta

SEQ ID NO: 202267 - DNA, 25 bp, Mus musculus
aggtcaatataaactctactctcat

SEQ ID NO: 202268 - DNA, 25 bp, Mus musculus
aggtcaatataatctctactctcat

SEQ ID NO: 202269 - DNA, 25 bp, Mus musculus
aggtcaatccaacctcacattattg

SEQ ID NO: 202270 - DNA, 25 bp, Mus musculus
aggtcaatccaagctcacattattg

SEQ ID NO: 202271 - DNA, 25 bp, Mus musculus
aggtcaatccctaccatattttatg

SEQ ID NO: 202272 - DNA, 25 bp, Mus musculus
aggtcaatcccttccatattttatg

SEQ ID NO: 202273 - DNA, 25 bp, Mus musculus
aggtcaatcgttctgttgagcacaa

SEQ ID NO: 202274 - DNA, 25 bp, Mus musculus
aggtcaatcgttgtgttgagcacaa

SEQ ID NO: 202275 - DNA, 25 bp, Mus musculus
aggtcaatctccctgatgaaatgca

SEQ ID NO: 202276 - DNA, 25 bp, Mus musculus
aggtcaatctccgtgatgaaatgca

SEQ ID NO: 202277 - DNA, 25 bp, Mus musculus
aggtcaatcttcagtgtcatcctta

SEQ ID NO: 202278 - DNA, 25 bp, Mus musculus
aggtcaatcttctgtgtcatcctta

SEQ ID NO: 202279 - DNA, 25 bp, Mus musculus
aggtcaatgactctatactcacata

SEQ ID NO: 202280 - DNA, 25 bp, Mus musculus
aggtcaatgactgtatactcacata

SEQ ID NO: 202281 - DNA, 25 bp, Mus musculus
aggtcaatgaggatggccagcctga

SEQ ID NO: 202282 - DNA, 25 bp, Mus musculus
aggtcaatgaggttggccagcctga

SEQ ID NO: 202283 - DNA, 25 bp, Mus musculus
aggtcaatgcagacctgggctctcc

SEQ ID NO: 202284 - DNA, 25 bp, Mus musculus
aggtcaatgcagtcctgggctctcc

SEQ ID NO: 202285 - DNA, 25 bp, Mus musculus
aggtcaatgccaacgaacaaacgtc

SEQ ID NO: 202286 - DNA, 25 bp, Mus musculus
aggtcaatgccatcgaacaaacgtc

SEQ ID NO: 202287 - DNA, 25 bp, Mus musculus
aggtcaatgcccaggctactgtaat

SEQ ID NO: 202288 - DNA, 25 bp, Mus musculus
aggtcaatgccctggctactgtaat

SEQ ID NO: 202289 - DNA, 25 bp, Mus musculus
aggtcaatgctacgccgaaaccgta

SEQ ID NO: 202290 - DNA, 25 bp, Mus musculus
aggtcaatgctaggccgaaaccgta

SEQ ID NO: 202291 - DNA, 25 bp, Mus musculus
aggtcaatggacacttcacgtccca

SEQ ID NO: 202292 - DNA, 25 bp, Mus musculus
aggtcaatggactcttcacgtccca

SEQ ID NO: 202293 - DNA, 25 bp, Mus musculus
aggtcaatgtttcgagccaccggct

SEQ ID NO: 202294 - DNA, 25 bp, Mus musculus
aggtcaatgtttggagccaccggct

SEQ ID NO: 202295 - DNA, 25 bp, Mus musculus
aggtcacaatgcagcaagccactgg

SEQ ID NO: 202296 - DNA, 25 bp, Mus musculus
aggtcacaatgctgcaagccactgg

SEQ ID NO: 202297 - DNA, 25 bp, Mus musculus
aggtcacaattgagctgcctctgac

SEQ ID NO: 202298 - DNA, 25 bp, Mus musculus
aggtcacaattgtgctgcctctgac

SEQ ID NO: 202299 - DNA, 25 bp, Mus musculus
aggtcacagattacgggttcgccaa

SEQ ID NO: 202300 - DNA, 25 bp, Mus musculus
aggtcacagatttcgggttcgccaa

SEQ ID NO: 202301 - DNA, 25 bp, Mus musculus
aggtcacagcagagcgcaggtgata

SEQ ID NO: 202302 - DNA, 25 bp, Mus musculus
aggtcacagcagtgcgcaggtgata

SEQ ID NO: 202303 - DNA, 25 bp, Mus musculus
aggtcacaggtcacgaggccttgca

SEQ ID NO: 202304 - DNA, 25 bp, Mus musculus
aggtcacaggtcagcaggatgccca

SEQ ID NO: 202305 - DNA, 25 bp, Mus musculus
aggtcacaggtctcgaggccttgca

SEQ ID NO: 202306 - DNA, 25 bp, Mus musculus
aggtcacaggtctgcaggatgccca

SEQ ID NO: 202307 - DNA, 25 bp, Mus musculus
aggtcacagtccatcttcgagagaa

SEQ ID NO: 202308 - DNA, 25 bp, Mus musculus
aggtcacagtccttcttcgagagaa

SEQ ID NO: 202309 - DNA, 25 bp, Mus musculus
aggtcacatcaactactgtcgaatt

SEQ ID NO: 202310 - DNA, 25 bp, Mus musculus
aggtcacatcaagtactgtcgaatt

SEQ ID NO: 202311 - DNA, 25 bp, Mus musculus
aggtcacatgtgcagacatcctctg

SEQ ID NO: 202312 - DNA, 25 bp, Mus musculus
aggtcacatgtggagacatcctctg

SEQ ID NO: 202313 - DNA, 25 bp, Mus musculus
aggtcacattcacaggtgcctgtat

SEQ ID NO: 202314 - DNA, 25 bp, Mus musculus
aggtcacattcagaggtgcctgtat

SEQ ID NO: 202315 - DNA, 25 bp, Mus musculus
aggtcacatttaatctcttactggt

SEQ ID NO: 202316 - DNA, 25 bp, Mus musculus
aggtcacatttattctcttactggt

SEQ ID NO: 202317 - DNA, 25 bp, Mus musculus
aggtcaccaggtcaccatgcctagg

SEQ ID NO: 202318 - DNA, 25 bp, Mus musculus
aggtcaccaggtgaccatgcctagg

SEQ ID NO: 202319 - DNA, 25 bp, Mus musculus
aggtcaccagtgacgcggctatgga

SEQ ID NO: 202320 - DNA, 25 bp, Mus musculus
aggtcaccagtgtcgcggctatgga

SEQ ID NO: 202321 - DNA, 25 bp, Mus musculus
aggtcaccatcaactgcgcagagag

SEQ ID NO: 202322 - DNA, 25 bp, Mus musculus
aggtcaccatcatctgcgcagagag

SEQ ID NO: 202323 - DNA, 25 bp, Mus musculus
aggtcaccatgcaactgtgtctcca

SEQ ID NO: 202324 - DNA, 25 bp, Mus musculus
aggtcaccatgcagctgcccaaact

SEQ ID NO: 202325 - DNA, 25 bp, Mus musculus
aggtcaccatgctactgtgtctcca

SEQ ID NO: 202326 - DNA, 25 bp, Mus musculus
aggtcaccatgctgctgcccaaact

SEQ ID NO: 202327 - DNA, 25 bp, Mus musculus
aggtcaccattgaacctgctggcaa

SEQ ID NO: 202328 - DNA, 25 bp, Mus musculus
aggtcaccattgtacctgctggcaa

SEQ ID NO: 202329 - DNA, 25 bp, Mus musculus
aggtcacccagcagactgtggagct

SEQ ID NO: 202330 - DNA, 25 bp, Mus musculus
aggtcacccagctgactgtggagct

SEQ ID NO: 202331 - DNA, 25 bp, Mus musculus
aggtcacccaggacacccaggtatg

SEQ ID NO: 202332 - DNA, 25 bp, Mus musculus
aggtcacccaggtcacccaggtatg

SEQ ID NO: 202333 - DNA, 25 bp, Mus musculus
aggtcaccccgcaatgaactaagtt

SEQ ID NO: 202334 - DNA, 25 bp, Mus musculus
aggtcaccccgctatgaactaagtt

SEQ ID NO: 202335 - DNA, 25 bp, Mus musculus
aggtcacccgaactgcttttaggag

SEQ ID NO: 202336 - DNA, 25 bp, Mus musculus
aggtcacccgaagtgcttttaggag

SEQ ID NO: 202337 - DNA, 25 bp, Mus musculus
aggtcaccctacaggagatgctgaa

SEQ ID NO: 202338 - DNA, 25 bp, Mus musculus
aggtcaccctactggagatgctgaa

SEQ ID NO: 202339 - DNA, 25 bp, Mus musculus
aggtcaccctgacatcttgttccat

SEQ ID NO: 202340 - DNA, 25 bp, Mus musculus
aggtcaccctgagatcttgttccat

SEQ ID NO: 202341 - DNA, 25 bp, Mus musculus
aggtcaccctggcagagataactcc

SEQ ID NO: 202342 - DNA, 25 bp, Mus musculus
aggtcaccctgggagagataactcc

SEQ ID NO: 202343 - DNA, 25 bp, Mus musculus
aggtcaccgctcatgtgatgtgctg

SEQ ID NO: 202344 - DNA, 25 bp, Mus musculus
aggtcaccgctcttgtgatgtgctg

SEQ ID NO: 202345 - DNA, 25 bp, Mus musculus
aggtcaccgggtagcaacggagaca

SEQ ID NO: 202346 - DNA, 25 bp, Mus musculus
aggtcaccgggttgcaacggagaca

SEQ ID NO: 202347 - DNA, 25 bp, Mus musculus
aggtcaccgtgtatcagtcttatag

SEQ ID NO: 202348 - DNA, 25 bp, Mus musculus
aggtcaccgtgtttcagtcttatag

SEQ ID NO: 202349 - DNA, 25 bp, Mus musculus
aggtcacctaccatgtcatctttgc

SEQ ID NO: 202350 - DNA, 25 bp, Mus musculus
aggtcacctaccttgtcatctttgc

SEQ ID NO: 202351 - DNA, 25 bp, Mus musculus
aggtcacctaggacgcatgcgcaag

SEQ ID NO: 202352 - DNA, 25 bp, Mus musculus
aggtcacctaggtcgcatgcgcaag

SEQ ID NO: 202353 - DNA, 25 bp, Mus musculus
aggtcacctcttctcaaggcacttt

SEQ ID NO: 202354 - DNA, 25 bp, Mus musculus
aggtcacctcttgtcaaggcacttt

SEQ ID NO: 202355 - DNA, 25 bp, Mus musculus
aggtcacctggcaagatgtttagca

SEQ ID NO: 202356 - DNA, 25 bp, Mus musculus
aggtcacctggctagatgtttagca

SEQ ID NO: 202357 - DNA, 25 bp, Mus musculus
aggtcacctgtcaccatgatttctt

SEQ ID NO: 202358 - DNA, 25 bp, Mus musculus
aggtcacctgtcatttgacccattt

SEQ ID NO: 202359 - DNA, 25 bp, Mus musculus
aggtcacctgtctccatgatttctt

SEQ ID NO: 202360 - DNA, 25 bp, Mus musculus
aggtcacctgtcttttgacccattt

SEQ ID NO: 202361 - DNA, 25 bp, Mus musculus
aggtcacctgtgagctcctgtcctt

SEQ ID NO: 202362 - DNA, 25 bp, Mus musculus
aggtcacctgtgtgctcctgtcctt

SEQ ID NO: 202363 - DNA, 25 bp, Mus musculus
aggtcaccttatacctatgatctgg

SEQ ID NO: 202364 - DNA, 25 bp, Mus musculus
aggtcaccttattcctatgatctgg

SEQ ID NO: 202365 - DNA, 25 bp, Mus musculus
aggtcaccttccaaggagaactgat

SEQ ID NO: 202366 - DNA, 25 bp, Mus musculus
aggtcaccttcctaggagaactgat

SEQ ID NO: 202367 - DNA, 25 bp, Mus musculus
aggtcacctttaacctgtgtcttca

SEQ ID NO: 202368 - DNA, 25 bp, Mus musculus
aggtcacctttatcctgtgtcttca

SEQ ID NO: 202369 - DNA, 25 bp, Mus musculus
aggtcacgctaactaatcctgcttg

SEQ ID NO: 202370 - DNA, 25 bp, Mus musculus
aggtcacgctaagtaatcctgcttg

SEQ ID NO: 202371 - DNA, 25 bp, Mus musculus
aggtcacgctgtagacgacattcct

SEQ ID NO: 202372 - DNA, 25 bp, Mus musculus
aggtcacgctgttgacgacattcct

SEQ ID NO: 202373 - DNA, 25 bp, Mus musculus
aggtcacggacaacaatctgcagca

SEQ ID NO: 202374 - DNA, 25 bp, Mus musculus
aggtcacggacatcaatctgcagca

SEQ ID NO: 202375 - DNA, 25 bp, Mus musculus
aggtcacggaccattaaatgttaag

SEQ ID NO: 202376 - DNA, 25 bp, Mus musculus
aggtcacggacctttaaatgttaag

SEQ ID NO: 202377 - DNA, 25 bp, Mus musculus
aggtcacgggatcgcaggtacactc

SEQ ID NO: 202378 - DNA, 25 bp, Mus musculus
aggtcacgggatggcaggtacactc

SEQ ID NO: 202379 - DNA, 25 bp, Mus musculus
aggtcacgtgatattataccaaagc

SEQ ID NO: 202380 - DNA, 25 bp, Mus musculus
aggtcacgtgattttataccaaagc

SEQ ID NO: 202381 - DNA, 25 bp, Mus musculus
aggtcacgtgcacagccgtggcctc

SEQ ID NO: 202382 - DNA, 25 bp, Mus musculus
aggtcacgtgcagagccgtggcctc

SEQ ID NO: 202383 - DNA, 25 bp, Mus musculus
aggtcacgttaacagttcagggcca

SEQ ID NO: 202384 - DNA, 25 bp, Mus musculus
aggtcacgttaagagttcagggcca

SEQ ID NO: 202385 - DNA, 25 bp, Mus musculus
aggtcactaacactgcagagacagg

SEQ ID NO: 202386 - DNA, 25 bp, Mus musculus
aggtcactaacagtgcagagacagg

SEQ ID NO: 202387 - DNA, 25 bp, Mus musculus
aggtcactaacgcgcctcgcagctt

SEQ ID NO: 202388 - DNA, 25 bp, Mus musculus
aggtcactaacgggcctcgcagctt

SEQ ID NO: 202389 - DNA, 25 bp, Mus musculus
aggtcactaatcaacccctgaggta

SEQ ID NO: 202390 - DNA, 25 bp, Mus musculus
aggtcactaatctacccctgaggta

SEQ ID NO: 202391 - DNA, 25 bp, Mus musculus
aggtcactacggagggatgctgtcc

SEQ ID NO: 202392 - DNA, 25 bp, Mus musculus
aggtcactacggtgggatgctgtcc

SEQ ID NO: 202393 - DNA, 25 bp, Mus musculus
aggtcactagtcacttctcatggta

SEQ ID NO: 202394 - DNA, 25 bp, Mus musculus
aggtcactagtctcttctcatggta

SEQ ID NO: 202395 - DNA, 25 bp, Mus musculus
aggtcactattactggctcggctgc

SEQ ID NO: 202396 - DNA, 25 bp, Mus musculus
aggtcactattagtggctcggctgc

SEQ ID NO: 202397 - DNA, 25 bp, Mus musculus
aggtcactcactagtctgcttagcc

SEQ ID NO: 202398 - DNA, 25 bp, Mus musculus
aggtcactcacttgtctgcttagcc

SEQ ID NO: 202399 - DNA, 25 bp, Mus musculus
aggtcactcatgaaggtcacactgt

SEQ ID NO: 202400 - DNA, 25 bp, Mus musculus
aggtcactcatgtaggtcacactgt

SEQ ID NO: 202401 - DNA, 25 bp, Mus musculus
aggtcactccctccaagctgggtcg

SEQ ID NO: 202402 - DNA, 25 bp, Mus musculus
aggtcactccctgcaagctgggtcg

SEQ ID NO: 202403 - DNA, 25 bp, Mus musculus
aggtcactctccatcttcataaagt

SEQ ID NO: 202404 - DNA, 25 bp, Mus musculus
aggtcactctccttcttcataaagt

SEQ ID NO: 202405 - DNA, 25 bp, Mus musculus
aggtcactctgaacattgctcacaa

SEQ ID NO: 202406 - DNA, 25 bp, Mus musculus
aggtcactctgacctgcatggtcac

SEQ ID NO: 202407 - DNA, 25 bp, Mus musculus
aggtcactctgagctgcatggtcac

SEQ ID NO: 202408 - DNA, 25 bp, Mus musculus
aggtcactctgatcattgctcacaa

SEQ ID NO: 202409 - DNA, 25 bp, Mus musculus
aggtcactgcctcgattagttaagg

SEQ ID NO: 202410 - DNA, 25 bp, Mus musculus
aggtcactgcctggattagttaagg

SEQ ID NO: 202411 - DNA, 25 bp, Mus musculus
aggtcactgcgactttgtcaagttg

SEQ ID NO: 202412 - DNA, 25 bp, Mus musculus
aggtcactgcgagtttgtcaagttg

SEQ ID NO: 202413 - DNA, 25 bp, Mus musculus
aggtcactgctcaggatagctagtt

SEQ ID NO: 202414 - DNA, 25 bp, Mus musculus
aggtcactgctctggatagctagtt

SEQ ID NO: 202415 - DNA, 25 bp, Mus musculus
aggtcactggatacctgtccttgcg

SEQ ID NO: 202416 - DNA, 25 bp, Mus musculus
aggtcactggattcctgtccttgcg

SEQ ID NO: 202417 - DNA, 25 bp, Mus musculus
aggtcactgggaaatctagtctcaa

SEQ ID NO: 202418 - DNA, 25 bp, Mus musculus
aggtcactgggatatctagtctcaa

SEQ ID NO: 202419 - DNA, 25 bp, Mus musculus
aggtcactgggcacattctagtttc

SEQ ID NO: 202420 - DNA, 25 bp, Mus musculus
aggtcactgggctcattctagtttc

SEQ ID NO: 202421 - DNA, 25 bp, Mus musculus
aggtcactgtccacgacactaatga

SEQ ID NO: 202422 - DNA, 25 bp, Mus musculus
aggtcactgtcctcgacactaatga

SEQ ID NO: 202423 - DNA, 25 bp, Mus musculus
aggtcactgtgaacgcgggcagctc

SEQ ID NO: 202424 - DNA, 25 bp, Mus musculus
aggtcactgtgatcgcgggcagctc

SEQ ID NO: 202425 - DNA, 25 bp, Mus musculus
aggtcactgtggacggcatgtgttc

SEQ ID NO: 202426 - DNA, 25 bp, Mus musculus
aggtcactgtggtcggcatgtgttc

SEQ ID NO: 202427 - DNA, 25 bp, Mus musculus
aggtcacttagcactggctgctctg

SEQ ID NO: 202428 - DNA, 25 bp, Mus musculus
aggtcacttagctctggctgctctg

SEQ ID NO: 202429 - DNA, 25 bp, Mus musculus
aggtcacttcagatcaaactgcaag

SEQ ID NO: 202430 - DNA, 25 bp, Mus musculus
aggtcacttcagttcaaactgcaag

SEQ ID NO: 202431 - DNA, 25 bp, Mus musculus
aggtcacttcctcgtagtgtcccaa

SEQ ID NO: 202432 - DNA, 25 bp, Mus musculus
aggtcacttcctggtagtgtcccaa

SEQ ID NO: 202433 - DNA, 25 bp, Mus musculus
aggtcacttctgctagctggtcatc

SEQ ID NO: 202434 - DNA, 25 bp, Mus musculus
aggtcacttctggtagctggtcatc

SEQ ID NO: 202435 - DNA, 25 bp, Mus musculus
aggtcacttgagacaattcccatcc

SEQ ID NO: 202436 - DNA, 25 bp, Mus musculus
aggtcacttgagtcaattcccatcc

SEQ ID NO: 202437 - DNA, 25 bp, Mus musculus
aggtcactttcaattccatagcaga

SEQ ID NO: 202438 - DNA, 25 bp, Mus musculus
aggtcactttcacactcagcagttg

SEQ ID NO: 202439 - DNA, 25 bp, Mus musculus
aggtcactttcagactcagcagttg

SEQ ID NO: 202440 - DNA, 25 bp, Mus musculus
aggtcactttcatttccatagcaga

SEQ ID NO: 202441 - DNA, 25 bp, Mus musculus
aggtcactttcccagctaacttgac

SEQ ID NO: 202442 - DNA, 25 bp, Mus musculus
aggtcactttcccttgagctgagtt

SEQ ID NO: 202443 - DNA, 25 bp, Mus musculus
aggtcactttccgagctaacttgac

SEQ ID NO: 202444 - DNA, 25 bp, Mus musculus
aggtcactttccgttgagctgagtt

SEQ ID NO: 202445 - DNA, 25 bp, Mus musculus
aggtcagaaccaaggcttagcagca

SEQ ID NO: 202446 - DNA, 25 bp, Mus musculus
aggtcagaaccatggcttagcagca

SEQ ID NO: 202447 - DNA, 25 bp, Mus musculus
aggtcagaagttcaatcctccaact

SEQ ID NO: 202448 - DNA, 25 bp, Mus musculus
aggtcagaagttgaatcctccaact

SEQ ID NO: 202449 - DNA, 25 bp, Mus musculus
aggtcagaattcacatagttgcttt

SEQ ID NO: 202450 - DNA, 25 bp, Mus musculus
aggtcagaattctcatagttgcttt

SEQ ID NO: 202451 - DNA, 25 bp, Mus musculus
aggtcagactacacacagtgcctgt

SEQ ID NO: 202452 - DNA, 25 bp, Mus musculus
aggtcagactactcacagtgcctgt

SEQ ID NO: 202453 - DNA, 25 bp, Mus musculus
aggtcagactgacgcaccaagtata

SEQ ID NO: 202454 - DNA, 25 bp, Mus musculus
aggtcagactgaggcaccaagtata

SEQ ID NO: 202455 - DNA, 25 bp, Mus musculus
aggtcagagaaccaagccgcagcag

SEQ ID NO: 202456 - DNA, 25 bp, Mus musculus
aggtcagagaacgaagccgcagcag

SEQ ID NO: 202457 - DNA, 25 bp, Mus musculus
aggtcagagcttcccctgtgctgtc

SEQ ID NO: 202458 - DNA, 25 bp, Mus musculus
aggtcagagcttgccctgtgctgtc

SEQ ID NO: 202459 - DNA, 25 bp, Mus musculus
aggtcagaggcacctcttccacctg

SEQ ID NO: 202460 - DNA, 25 bp, Mus musculus
aggtcagaggcagctcttccacctg

SEQ ID NO: 202461 - DNA, 25 bp, Mus musculus
aggtcagaggttctggtccagcaaa

SEQ ID NO: 202462 - DNA, 25 bp, Mus musculus
aggtcagaggttgtggtccagcaaa

SEQ ID NO: 202463 - DNA, 25 bp, Mus musculus
aggtcagatactatagcaggctatt

SEQ ID NO: 202464 - DNA, 25 bp, Mus musculus
aggtcagatactttagcaggctatt

SEQ ID NO: 202465 - DNA, 25 bp, Mus musculus
aggtcagatccccagaattcactca

SEQ ID NO: 202466 - DNA, 25 bp, Mus musculus
aggtcagatcccgagaattcactca

SEQ ID NO: 202467 - DNA, 25 bp, Mus musculus
aggtcagcacgcatgtgtagacaaa

SEQ ID NO: 202468 - DNA, 25 bp, Mus musculus
aggtcagcacgcttgtgtagacaaa

SEQ ID NO: 202469 - DNA, 25 bp, Mus musculus
aggtcagcactgaagccctgcctca

SEQ ID NO: 202470 - DNA, 25 bp, Mus musculus
aggtcagcactgtagccctgcctca

SEQ ID NO: 202471 - DNA, 25 bp, Mus musculus
aggtcagcacttcgcgtccggcaga

SEQ ID NO: 202472 - DNA, 25 bp, Mus musculus
aggtcagcacttggcgtccggcaga

SEQ ID NO: 202473 - DNA, 25 bp, Mus musculus
aggtcagcatatctgttcagagtac

SEQ ID NO: 202474 - DNA, 25 bp, Mus musculus
aggtcagcatatgtgttcagagtac

SEQ ID NO: 202475 - DNA, 25 bp, Mus musculus
aggtcagcatgtcgcttgcaccagg

SEQ ID NO: 202476 - DNA, 25 bp, Mus musculus
aggtcagcatgtggcttgcaccagg

SEQ ID NO: 202477 - DNA, 25 bp, Mus musculus
aggtcagccaaaaggttaccacaga

SEQ ID NO: 202478 - DNA, 25 bp, Mus musculus
aggtcagccaaacagccgccacatt

SEQ ID NO: 202479 - DNA, 25 bp, Mus musculus
aggtcagccaaagagccgccacatt

SEQ ID NO: 202480 - DNA, 25 bp, Mus musculus
aggtcagccaaatggttaccacaga

SEQ ID NO: 202481 - DNA, 25 bp, Mus musculus
aggtcagcctagcattcctgagact

SEQ ID NO: 202482 - DNA, 25 bp, Mus musculus
aggtcagcctaggattcctgagact

SEQ ID NO: 202483 - DNA, 25 bp, Mus musculus
aggtcagcctgcattgtaggccatt

SEQ ID NO: 202484 - DNA, 25 bp, Mus musculus
aggtcagcctgcattttgacaccga

SEQ ID NO: 202485 - DNA, 25 bp, Mus musculus
aggtcagcctgctttgtaggccatt

SEQ ID NO: 202486 - DNA, 25 bp, Mus musculus
aggtcagcctgctttttgacaccga

SEQ ID NO: 202487 - DNA, 25 bp, Mus musculus
aggtcagcctgtcaggacaccaaca

SEQ ID NO: 202488 - DNA, 25 bp, Mus musculus
aggtcagcctgtccattgcagtcat

SEQ ID NO: 202489 - DNA, 25 bp, Mus musculus
aggtcagcctgtgaggacaccaaca

SEQ ID NO: 202490 - DNA, 25 bp, Mus musculus
aggtcagcctgtgcattgcagtcat

SEQ ID NO: 202491 - DNA, 25 bp, Mus musculus
aggtcagccttgaccaagccgaaga

SEQ ID NO: 202492 - DNA, 25 bp, Mus musculus
aggtcagccttgtccaagccgaaga

SEQ ID NO: 202493 - DNA, 25 bp, Mus musculus
aggtcagcgactccatcgtgaggat

SEQ ID NO: 202494 - DNA, 25 bp, Mus musculus
aggtcagcgactgcatcgtgaggat

SEQ ID NO: 202495 - DNA, 25 bp, Mus musculus
aggtcagctaccctgcatgagctgt

SEQ ID NO: 202496 - DNA, 25 bp, Mus musculus
aggtcagctaccgtgcatgagctgt

SEQ ID NO: 202497 - DNA, 25 bp, Mus musculus
aggtcagctcacaaggatcaacatg

SEQ ID NO: 202498 - DNA, 25 bp, Mus musculus
aggtcagctcactaggatcaacatg

SEQ ID NO: 202499 - DNA, 25 bp, Mus musculus
aggtcagctcgcagcacatgcagac

SEQ ID NO: 202500 - DNA, 25 bp, Mus musculus
aggtcagctcgctgcacatgcagac

SEQ ID NO: 202501 - DNA, 25 bp, Mus musculus
aggtcagctgcaccctcaatccaga

SEQ ID NO: 202502 - DNA, 25 bp, Mus musculus
aggtcagctgcagcctcaatccaga

SEQ ID NO: 202503 - DNA, 25 bp, Mus musculus
aggtcagctgctcctcttggagtca

SEQ ID NO: 202504 - DNA, 25 bp, Mus musculus
aggtcagctgctgctcttggagtca

SEQ ID NO: 202505 - DNA, 25 bp, Mus musculus
aggtcagcttttagggcgttcgact

SEQ ID NO: 202506 - DNA, 25 bp, Mus musculus
aggtcagctttttgggcgttcgact

SEQ ID NO: 202507 - DNA, 25 bp, Mus musculus
aggtcaggacagagcctcagcaggt

SEQ ID NO: 202508 - DNA, 25 bp, Mus musculus
aggtcaggacagtgcctcagcaggt

SEQ ID NO: 202509 - DNA, 25 bp, Mus musculus
aggtcaggacccagtcatgagacag

SEQ ID NO: 202510 - DNA, 25 bp, Mus musculus
aggtcaggaccctgtcatgagacag

SEQ ID NO: 202511 - DNA, 25 bp, Mus musculus
aggtcaggagccacccgggcaaagc

SEQ ID NO: 202512 - DNA, 25 bp, Mus musculus
aggtcaggagcctcccgggcaaagc

SEQ ID NO: 202513 - DNA, 25 bp, Mus musculus
aggtcaggcaccacagtccttacag

SEQ ID NO: 202514 - DNA, 25 bp, Mus musculus
aggtcaggcacctcagtccttacag

SEQ ID NO: 202515 - DNA, 25 bp, Mus musculus
aggtcaggccggcagatgcttcatc

SEQ ID NO: 202516 - DNA, 25 bp, Mus musculus
aggtcaggccgggagatgcttcatc

SEQ ID NO: 202517 - DNA, 25 bp, Mus musculus
aggtcaggctccacttcagtcagag

SEQ ID NO: 202518 - DNA, 25 bp, Mus musculus
aggtcaggctcctcttcagtcagag

SEQ ID NO: 202519 - DNA, 25 bp, Mus musculus
aggtcaggtgacaactctcaggaat

SEQ ID NO: 202520 - DNA, 25 bp, Mus musculus
aggtcaggtgactactctcaggaat

SEQ ID NO: 202521 - DNA, 25 bp, Mus musculus
aggtcaggtggtcatctacctggtc

SEQ ID NO: 202522 - DNA, 25 bp, Mus musculus
aggtcaggtggtgatctacctggtc

SEQ ID NO: 202523 - DNA, 25 bp, Mus musculus
aggtcagtacccatgggcagcttct

SEQ ID NO: 202524 - DNA, 25 bp, Mus musculus
aggtcagtacccttgggcagcttct

SEQ ID NO: 202525 - DNA, 25 bp, Mus musculus
aggtcagtactgaccgctctgatga

SEQ ID NO: 202526 - DNA, 25 bp, Mus musculus
aggtcagtactgtccgctctgatga

SEQ ID NO: 202527 - DNA, 25 bp, Mus musculus
aggtcagtcaacactccaactatat

SEQ ID NO: 202528 - DNA, 25 bp, Mus musculus
aggtcagtcaactctccaactatat

SEQ ID NO: 202529 - DNA, 25 bp, Mus musculus
aggtcagtctagactactacaggat

SEQ ID NO: 202530 - DNA, 25 bp, Mus musculus
aggtcagtctagtctactacaggat

SEQ ID NO: 202531 - DNA, 25 bp, Mus musculus
aggtcagtctcactttggcttgctc

SEQ ID NO: 202532 - DNA, 25 bp, Mus musculus
aggtcagtctcagtttggcttgctc

SEQ ID NO: 202533 - DNA, 25 bp, Mus musculus
aggtcagtgaggcacttgtttttaa

SEQ ID NO: 202534 - DNA, 25 bp, Mus musculus
aggtcagtgagggacttgtttttaa

SEQ ID NO: 202535 - DNA, 25 bp, Mus musculus
aggtcagtgagtatcaggtgctgct

SEQ ID NO: 202536 - DNA, 25 bp, Mus musculus
aggtcagtgagtttcaggtgctgct

SEQ ID NO: 202537 - DNA, 25 bp, Mus musculus
aggtcagtgatcattgcatctcaga

SEQ ID NO: 202538 - DNA, 25 bp, Mus musculus
aggtcagtgatctttgcatctcaga

SEQ ID NO: 202539 - DNA, 25 bp, Mus musculus
aggtcagtgatgagctcgtccagct

SEQ ID NO: 202540 - DNA, 25 bp, Mus musculus
aggtcagtgatgtgctcgtccagct

SEQ ID NO: 202541 - DNA, 25 bp, Mus musculus
aggtcagtgcatatccctttaggag

SEQ ID NO: 202542 - DNA, 25 bp, Mus musculus
aggtcagtgcatttccctttaggag

SEQ ID NO: 202543 - DNA, 25 bp, Mus musculus
aggtcagtgtgaacaacccgagccc

SEQ ID NO: 202544 - DNA, 25 bp, Mus musculus
aggtcagtgtgatcaacccgagccc

SEQ ID NO: 202545 - DNA, 25 bp, Mus musculus
aggtcagtgtgcaactggctattaa

SEQ ID NO: 202546 - DNA, 25 bp, Mus musculus
aggtcagtgtgctactggctattaa

SEQ ID NO: 202547 - DNA, 25 bp, Mus musculus
aggtcagttgaactctccattggaa

SEQ ID NO: 202548 - DNA, 25 bp, Mus musculus
aggtcagttgaagtctccattggaa

SEQ ID NO: 202549 - DNA, 25 bp, Mus musculus
aggtcagttgacaactgcccagcat

SEQ ID NO: 202550 - DNA, 25 bp, Mus musculus
aggtcagttgactactgcccagcat

SEQ ID NO: 202551 - DNA, 25 bp, Mus musculus
aggtcataagtcaacatgtctgttc

SEQ ID NO: 202552 - DNA, 25 bp, Mus musculus
aggtcataagtctacatgtctgttc

SEQ ID NO: 202553 - DNA, 25 bp, Mus musculus
aggtcataataacctttcccatcat

SEQ ID NO: 202554 - DNA, 25 bp, Mus musculus
aggtcataataagctttcccatcat

SEQ ID NO: 202555 - DNA, 25 bp, Mus musculus
aggtcatacacaatggtaagccatt

SEQ ID NO: 202556 - DNA, 25 bp, Mus musculus
aggtcatacacattggtaagccatt

SEQ ID NO: 202557 - DNA, 25 bp, Mus musculus
aggtcatactagatagcctgcatat

SEQ ID NO: 202558 - DNA, 25 bp, Mus musculus
aggtcatactagttagcctgcatat

SEQ ID NO: 202559 - DNA, 25 bp, Mus musculus
aggtcatagcaccatgttctcgata

SEQ ID NO: 202560 - DNA, 25 bp, Mus musculus
aggtcatagcacgatgttctcgata

SEQ ID NO: 202561 - DNA, 25 bp, Mus musculus
aggtcatagtcccaagttttagaat

SEQ ID NO: 202562 - DNA, 25 bp, Mus musculus
aggtcatagtccgaagttttagaat

SEQ ID NO: 202563 - DNA, 25 bp, Mus musculus
aggtcatatcttccattcttgtgaa

SEQ ID NO: 202564 - DNA, 25 bp, Mus musculus
aggtcatatcttgcattcttgtgaa

SEQ ID NO: 202565 - DNA, 25 bp, Mus musculus
aggtcatattcaagatcccccagag

SEQ ID NO: 202566 - DNA, 25 bp, Mus musculus
aggtcatattcatgatcccccagag

SEQ ID NO: 202567 - DNA, 25 bp, Mus musculus
aggtcatatttcaccatctttgtct

SEQ ID NO: 202568 - DNA, 25 bp, Mus musculus
aggtcatatttctccatctttgtct

SEQ ID NO: 202569 - DNA, 25 bp, Mus musculus
aggtcatcaatcagctcactgtgta

SEQ ID NO: 202570 - DNA, 25 bp, Mus musculus
aggtcatcaatctgctcactgtgta

SEQ ID NO: 202571 - DNA, 25 bp, Mus musculus
aggtcatcaccaacttcagcctggt

SEQ ID NO: 202572 - DNA, 25 bp, Mus musculus
aggtcatcaccatcttcagcctggt

SEQ ID NO: 202573 - DNA, 25 bp, Mus musculus
aggtcatcacttaatacctgccctt

SEQ ID NO: 202574 - DNA, 25 bp, Mus musculus
aggtcatcactttatacctgccctt

SEQ ID NO: 202575 - DNA, 25 bp, Mus musculus
aggtcatcagacattcacgggaggt

SEQ ID NO: 202576 - DNA, 25 bp, Mus musculus
aggtcatcagactttcacgggaggt

SEQ ID NO: 202577 - DNA, 25 bp, Mus musculus
aggtcatcagagagggccaaccctt

SEQ ID NO: 202578 - DNA, 25 bp, Mus musculus
aggtcatcagagtgggccaaccctt

SEQ ID NO: 202579 - DNA, 25 bp, Mus musculus
aggtcatcagccatgtgcagcgaac

SEQ ID NO: 202580 - DNA, 25 bp, Mus musculus
aggtcatcagccttgtgcagcgaac

SEQ ID NO: 202581 - DNA, 25 bp, Mus musculus
aggtcatccagaactgtttcctcag

SEQ ID NO: 202582 - DNA, 25 bp, Mus musculus
aggtcatccagatctgtttcctcag

SEQ ID NO: 202583 - DNA, 25 bp, Mus musculus
aggtcatccctccattgtagaacac

SEQ ID NO: 202584 - DNA, 25 bp, Mus musculus
aggtcatccctcgattgtagaacac

SEQ ID NO: 202585 - DNA, 25 bp, Mus musculus
aggtcatccgagatttcaccaccaa

SEQ ID NO: 202586 - DNA, 25 bp, Mus musculus
aggtcatccgagttttcaccaccaa

SEQ ID NO: 202587 - DNA, 25 bp, Mus musculus
aggtcatcctgactactcatgggct

SEQ ID NO: 202588 - DNA, 25 bp, Mus musculus
aggtcatcctgagtactcatgggct

SEQ ID NO: 202589 - DNA, 25 bp, Mus musculus
aggtcatccttccagagtacggctt

SEQ ID NO: 202590 - DNA, 25 bp, Mus musculus
aggtcatccttcgagagtacggctt

SEQ ID NO: 202591 - DNA, 25 bp, Mus musculus
aggtcatccttgactatgtattgag

SEQ ID NO: 202592 - DNA, 25 bp, Mus musculus
aggtcatccttgtctatgtattgag

SEQ ID NO: 202593 - DNA, 25 bp, Mus musculus
aggtcatcgccacttagttacttga

SEQ ID NO: 202594 - DNA, 25 bp, Mus musculus
aggtcatcgccagttagttacttga

SEQ ID NO: 202595 - DNA, 25 bp, Mus musculus
aggtcatcggtaactgtctttacag

SEQ ID NO: 202596 - DNA, 25 bp, Mus musculus
aggtcatcggtatctgtctttacag

SEQ ID NO: 202597 - DNA, 25 bp, Mus musculus
aggtcatcgtctagcttggcgtatc

SEQ ID NO: 202598 - DNA, 25 bp, Mus musculus
aggtcatcgtcttgcttggcgtatc

SEQ ID NO: 202599 - DNA, 25 bp, Mus musculus
aggtcatctctcaggagatccacat

SEQ ID NO: 202600 - DNA, 25 bp, Mus musculus
aggtcatctctctggagatccacat

SEQ ID NO: 202601 - DNA, 25 bp, Mus musculus
aggtcatctgcacagcgtggccatc

SEQ ID NO: 202602 - DNA, 25 bp, Mus musculus
aggtcatctgcagagcgtggccatc

SEQ ID NO: 202603 - DNA, 25 bp, Mus musculus
aggtcatcttcactgttcttgggag

SEQ ID NO: 202604 - DNA, 25 bp, Mus musculus
aggtcatcttcagtgttcttgggag

SEQ ID NO: 202605 - DNA, 25 bp, Mus musculus
aggtcatcttggaacttcttggcat

SEQ ID NO: 202606 - DNA, 25 bp, Mus musculus
aggtcatcttggtacttcttggcat

SEQ ID NO: 202607 - DNA, 25 bp, Mus musculus
aggtcatgaccccatgtgttcaaaa

SEQ ID NO: 202608 - DNA, 25 bp, Mus musculus
aggtcatgacccgatgtgttcaaaa

SEQ ID NO: 202609 - DNA, 25 bp, Mus musculus
aggtcatgatgcacacggaacgtgt

SEQ ID NO: 202610 - DNA, 25 bp, Mus musculus
aggtcatgatgctcacggaacgtgt

SEQ ID NO: 202611 - DNA, 25 bp, Mus musculus
aggtcatgcattattcagtctccac

SEQ ID NO: 202612 - DNA, 25 bp, Mus musculus
aggtcatgcatttttcagtctccac

SEQ ID NO: 202613 - DNA, 25 bp, Mus musculus
aggtcatgccctccacatcgggtgg

SEQ ID NO: 202614 - DNA, 25 bp, Mus musculus
aggtcatgccctgcacatcgggtgg

SEQ ID NO: 202615 - DNA, 25 bp, Mus musculus
aggtcatgcctacactgtgaaacat

SEQ ID NO: 202616 - DNA, 25 bp, Mus musculus
aggtcatgcctactctggaggttca

SEQ ID NO: 202617 - DNA, 25 bp, Mus musculus
aggtcatgcctagactgtgaaacat

SEQ ID NO: 202618 - DNA, 25 bp, Mus musculus
aggtcatgcctagtctggaggttca

SEQ ID NO: 202619 - DNA, 25 bp, Mus musculus
aggtcatgcctccagatgtgtaatt

SEQ ID NO: 202620 - DNA, 25 bp, Mus musculus
aggtcatgcctcgagatgtgtaatt

SEQ ID NO: 202621 - DNA, 25 bp, Mus musculus
aggtcatgctggaacttcctgccag

SEQ ID NO: 202622 - DNA, 25 bp, Mus musculus
aggtcatgctggtacttcctgccag

SEQ ID NO: 202623 - DNA, 25 bp, Mus musculus
aggtcatggaaacaagctaagctat

SEQ ID NO: 202624 - DNA, 25 bp, Mus musculus
aggtcatggaaagaagctaagctat

SEQ ID NO: 202625 - DNA, 25 bp, Mus musculus
aggtcatggcagaactcaacagtgt

SEQ ID NO: 202626 - DNA, 25 bp, Mus musculus
aggtcatggcagtactcaacagtgt

SEQ ID NO: 202627 - DNA, 25 bp, Mus musculus
aggtcatggctcaccaaaacttctc

SEQ ID NO: 202628 - DNA, 25 bp, Mus musculus
aggtcatggctctccaaaacttctc

SEQ ID NO: 202629 - DNA, 25 bp, Mus musculus
aggtcatggcttccttcaagatcct

SEQ ID NO: 202630 - DNA, 25 bp, Mus musculus
aggtcatggcttgcttcaagatcct

SEQ ID NO: 202631 - DNA, 25 bp, Mus musculus
aggtcatgggacacaaacttcagct

SEQ ID NO: 202632 - DNA, 25 bp, Mus musculus
aggtcatgggactcaaacttcagct

SEQ ID NO: 202633 - DNA, 25 bp, Mus musculus
aggtcatgtaccacgatggctatga

SEQ ID NO: 202634 - DNA, 25 bp, Mus musculus
aggtcatgtacctcgatggctatga

SEQ ID NO: 202635 - DNA, 25 bp, Mus musculus
aggtcatgtgacagctgcttcaata

SEQ ID NO: 202636 - DNA, 25 bp, Mus musculus
aggtcatgtgactgctgcttcaata

SEQ ID NO: 202637 - DNA, 25 bp, Mus musculus
aggtcatgtgtgatcctttgaggct

SEQ ID NO: 202638 - DNA, 25 bp, Mus musculus
aggtcatgtgtgttcctttgaggct

SEQ ID NO: 202639 - DNA, 25 bp, Mus musculus
aggtcattctctactacagggccaa

SEQ ID NO: 202640 - DNA, 25 bp, Mus musculus
aggtcattctcttctacagggccaa

SEQ ID NO: 202641 - DNA, 25 bp, Mus musculus
aggtcattgcccacggacaaggtag

SEQ ID NO: 202642 - DNA, 25 bp, Mus musculus
aggtcattgccctcggacaaggtag

SEQ ID NO: 202643 - DNA, 25 bp, Mus musculus
aggtcattgcgaaccatgtccataa

SEQ ID NO: 202644 - DNA, 25 bp, Mus musculus
aggtcattgcgatccatgtccataa

SEQ ID NO: 202645 - DNA, 25 bp, Mus musculus
aggtcattgtctctgcgaacagcag

SEQ ID NO: 202646 - DNA, 25 bp, Mus musculus
aggtcattgtctgtgcgaacagcag

SEQ ID NO: 202647 - DNA, 25 bp, Mus musculus
aggtcattttcccagctgaactctt

SEQ ID NO: 202648 - DNA, 25 bp, Mus musculus
aggtcattttccgagctgaactctt

SEQ ID NO: 202649 - DNA, 25 bp, Mus musculus
aggtccaaaacacaggtgcctcctc

SEQ ID NO: 202650 - DNA, 25 bp, Mus musculus
aggtccaaaacagaggtgcctcctc

SEQ ID NO: 202651 - DNA, 25 bp, Mus musculus
aggtccaaatgactgtctgtcctgt

SEQ ID NO: 202652 - DNA, 25 bp, Mus musculus
aggtccaaatgagtgtctgtcctgt

SEQ ID NO: 202653 - DNA, 25 bp, Mus musculus
aggtccaacaatcaaaagcccactt

SEQ ID NO: 202654 - DNA, 25 bp, Mus musculus
aggtccaacaatgaaaagcccactt

SEQ ID NO: 202655 - DNA, 25 bp, Mus musculus
aggtccaacaggcatctgccactag

SEQ ID NO: 202656 - DNA, 25 bp, Mus musculus
aggtccaacagggatctgccactag

SEQ ID NO: 202657 - DNA, 25 bp, Mus musculus
aggtccaagtaacccagcccgtgca

SEQ ID NO: 202658 - DNA, 25 bp, Mus musculus
aggtccaagtaagccagcccgtgca

SEQ ID NO: 202659 - DNA, 25 bp, Mus musculus
aggtccaagtgtagctgtacttcct

SEQ ID NO: 202660 - DNA, 25 bp, Mus musculus
aggtccaagtgttgctgtacttcct

SEQ ID NO: 202661 - DNA, 25 bp, Mus musculus
aggtccaatccaccttcttttcagg

SEQ ID NO: 202662 - DNA, 25 bp, Mus musculus
aggtccaatccagcttcttttcagg

SEQ ID NO: 202663 - DNA, 25 bp, Mus musculus
aggtccaatgagctttctgaacagc

SEQ ID NO: 202664 - DNA, 25 bp, Mus musculus
aggtccaatgaggtttctgaacagc

SEQ ID NO: 202665 - DNA, 25 bp, Mus musculus
aggtccacaggcaccagggtcaagg

SEQ ID NO: 202666 - DNA, 25 bp, Mus musculus
aggtccacaggctccagggtcaagg

SEQ ID NO: 202667 - DNA, 25 bp, Mus musculus
aggtccacagttctgctagcagctg

SEQ ID NO: 202668 - DNA, 25 bp, Mus musculus
aggtccacagttgtgctagcagctg

SEQ ID NO: 202669 - DNA, 25 bp, Mus musculus
aggtccaccagcatgtgatccatgc

SEQ ID NO: 202670 - DNA, 25 bp, Mus musculus
aggtccaccagcttgtgatccatgc

SEQ ID NO: 202671 - DNA, 25 bp, Mus musculus
aggtccaccagtctgctttcccatg

SEQ ID NO: 202672 - DNA, 25 bp, Mus musculus
aggtccaccagtgtgctttcccatg

SEQ ID NO: 202673 - DNA, 25 bp, Mus musculus
aggtccacctccagctggtgattat

SEQ ID NO: 202674 - DNA, 25 bp, Mus musculus
aggtccacctcctgctggtgattat

SEQ ID NO: 202675 - DNA, 25 bp, Mus musculus
aggtccacgtgcagctcataggaag

SEQ ID NO: 202676 - DNA, 25 bp, Mus musculus
aggtccacgtgctgctcataggaag

SEQ ID NO: 202677 - DNA, 25 bp, Mus musculus
aggtccactgacaggaaaccctcag

SEQ ID NO: 202678 - DNA, 25 bp, Mus musculus
aggtccactgactggaaaccctcag

SEQ ID NO: 202679 - DNA, 25 bp, Mus musculus
aggtccacttcactggcatcaggtc

SEQ ID NO: 202680 - DNA, 25 bp, Mus musculus
aggtccacttcagtggcatcaggtc

SEQ ID NO: 202681 - DNA, 25 bp, Mus musculus
aggtccactttacggcaggctgcaa

SEQ ID NO: 202682 - DNA, 25 bp, Mus musculus
aggtccactttagggcaggctgcaa

SEQ ID NO: 202683 - DNA, 25 bp, Mus musculus
aggtccagatagacttgcccataaa

SEQ ID NO: 202684 - DNA, 25 bp, Mus musculus
aggtccagatagtcttgcccataaa

SEQ ID NO: 202685 - DNA, 25 bp, Mus musculus
aggtccagattccaagcattcctct

SEQ ID NO: 202686 - DNA, 25 bp, Mus musculus
aggtccagattcgaagcattcctct

SEQ ID NO: 202687 - DNA, 25 bp, Mus musculus
aggtccagcaccatctttagagaag

SEQ ID NO: 202688 - DNA, 25 bp, Mus musculus
aggtccagcaccttctttagagaag

SEQ ID NO: 202689 - DNA, 25 bp, Mus musculus
aggtccagcagcaacatttacacat

SEQ ID NO: 202690 - DNA, 25 bp, Mus musculus
aggtccagcagctacatttacacat

SEQ ID NO: 202691 - DNA, 25 bp, Mus musculus
aggtccagcaggaaagcaagcgtct

SEQ ID NO: 202692 - DNA, 25 bp, Mus musculus
aggtccagcaggtaagcaagcgtct

SEQ ID NO: 202693 - DNA, 25 bp, Mus musculus
aggtccagccagaccaagcacatgg

SEQ ID NO: 202694 - DNA, 25 bp, Mus musculus
aggtccagccagtccaagcacatgg

SEQ ID NO: 202695 - DNA, 25 bp, Mus musculus
aggtccagccccaagctgttagaga

SEQ ID NO: 202696 - DNA, 25 bp, Mus musculus
aggtccagcccctagctgttagaga

SEQ ID NO: 202697 - DNA, 25 bp, Mus musculus
aggtccagctcaaatgtgctcttta

SEQ ID NO: 202698 - DNA, 25 bp, Mus musculus
aggtccagctcatatgtgctcttta

SEQ ID NO: 202699 - DNA, 25 bp, Mus musculus
aggtccagctgcagtatttctcttc

SEQ ID NO: 202700 - DNA, 25 bp, Mus musculus
aggtccagctgctgtatttctcttc

SEQ ID NO: 202701 - DNA, 25 bp, Mus musculus
aggtccagctgtccccaacatgtgt

SEQ ID NO: 202702 - DNA, 25 bp, Mus musculus
aggtccagctgtgcccaacatgtgt

SEQ ID NO: 202703 - DNA, 25 bp, Mus musculus
aggtccaggactccaggctaggcca

SEQ ID NO: 202704 - DNA, 25 bp, Mus musculus
aggtccaggactgcaggctaggcca

SEQ ID NO: 202705 - DNA, 25 bp, Mus musculus
aggtccaggagcatctcaatcgcgt

SEQ ID NO: 202706 - DNA, 25 bp, Mus musculus
aggtccaggagcttctcaatcgcgt

SEQ ID NO: 202707 - DNA, 25 bp, Mus musculus
aggtccaggcacctttgtttctgtg

SEQ ID NO: 202708 - DNA, 25 bp, Mus musculus
aggtccaggcacgtttgtttctgtg

SEQ ID NO: 202709 - DNA, 25 bp, Mus musculus
aggtccaggcgaacctaacgggagt

SEQ ID NO: 202710 - DNA, 25 bp, Mus musculus
aggtccaggcgatcctaacgggagt

SEQ ID NO: 202711 - DNA, 25 bp, Mus musculus
aggtccaggctcaagtccagcctag

SEQ ID NO: 202712 - DNA, 25 bp, Mus musculus
aggtccaggctctagtccagcctag

SEQ ID NO: 202713 - DNA, 25 bp, Mus musculus
aggtccaggtgtccctcagagagca

SEQ ID NO: 202714 - DNA, 25 bp, Mus musculus
aggtccaggtgtgcctcagagagca

SEQ ID NO: 202715 - DNA, 25 bp, Mus musculus
aggtccagtcccctcaggataggct

SEQ ID NO: 202716 - DNA, 25 bp, Mus musculus
aggtccagtcccgtcaggataggct

SEQ ID NO: 202717 - DNA, 25 bp, Mus musculus
aggtccagtctgactacagtgtgtt

SEQ ID NO: 202718 - DNA, 25 bp, Mus musculus
aggtccagtctgtctacagtgtgtt

SEQ ID NO: 202719 - DNA, 25 bp, Mus musculus
aggtccagtgtgctactcagaactt

SEQ ID NO: 202720 - DNA, 25 bp, Mus musculus
aggtccagtgtggtactcagaactt

SEQ ID NO: 202721 - DNA, 25 bp, Mus musculus
aggtccagttccaggctgacttccg

SEQ ID NO: 202722 - DNA, 25 bp, Mus musculus
aggtccagttcctggctgacttccg

SEQ ID NO: 202723 - DNA, 25 bp, Mus musculus
aggtccatagcgcagcaggctttcg

SEQ ID NO: 202724 - DNA, 25 bp, Mus musculus
aggtccatagcggagcaggctttcg

SEQ ID NO: 202725 - DNA, 25 bp, Mus musculus
aggtccatatcacatggattccggg

SEQ ID NO: 202726 - DNA, 25 bp, Mus musculus
aggtccatatcagatggattccggg

SEQ ID NO: 202727 - DNA, 25 bp, Mus musculus
aggtccatcatgaccagaatgtccc

SEQ ID NO: 202728 - DNA, 25 bp, Mus musculus
aggtccatcatgtccagaatgtccc

SEQ ID NO: 202729 - DNA, 25 bp, Mus musculus
aggtccatcccaccagaagccaatg

SEQ ID NO: 202730 - DNA, 25 bp, Mus musculus
aggtccatcccagcagaagccaatg

SEQ ID NO: 202731 - DNA, 25 bp, Mus musculus
aggtccatcggcaggttgtagtgaa

SEQ ID NO: 202732 - DNA, 25 bp, Mus musculus
aggtccatcggctggttgtagtgaa

SEQ ID NO: 202733 - DNA, 25 bp, Mus musculus
aggtccatcggtacatgtgtctgcc

SEQ ID NO: 202734 - DNA, 25 bp, Mus musculus
aggtccatcggttcatgtgtctgcc

SEQ ID NO: 202735 - DNA, 25 bp, Mus musculus
aggtccatctgcatactgagctaga

SEQ ID NO: 202736 - DNA, 25 bp, Mus musculus
aggtccatctgcttactgagctaga

SEQ ID NO: 202737 - DNA, 25 bp, Mus musculus
aggtccatgcttagcctgcaacgaa

SEQ ID NO: 202738 - DNA, 25 bp, Mus musculus
aggtccatgcttctataatattaat

SEQ ID NO: 202739 - DNA, 25 bp, Mus musculus
aggtccatgcttgtataatattaat

SEQ ID NO: 202740 - DNA, 25 bp, Mus musculus
aggtccatgctttgcctgcaacgaa

SEQ ID NO: 202741 - DNA, 25 bp, Mus musculus
aggtcccaagcgataacactgtaca

SEQ ID NO: 202742 - DNA, 25 bp, Mus musculus
aggtcccaagcgttaacactgtaca

SEQ ID NO: 202743 - DNA, 25 bp, Mus musculus
aggtcccaagggacatgtcttacga

SEQ ID NO: 202744 - DNA, 25 bp, Mus musculus
aggtcccaagggtcatgtcttacga

SEQ ID NO: 202745 - DNA, 25 bp, Mus musculus
aggtcccaatgcaagtttgccactt

SEQ ID NO: 202746 - DNA, 25 bp, Mus musculus
aggtcccaatgctagtttgccactt

SEQ ID NO: 202747 - DNA, 25 bp, Mus musculus
aggtcccaccaacaggtgctcagag

SEQ ID NO: 202748 - DNA, 25 bp, Mus musculus
aggtcccaccaagaggtgctcagag

SEQ ID NO: 202749 - DNA, 25 bp, Mus musculus
aggtcccacctcattcatgaagatg

SEQ ID NO: 202750 - DNA, 25 bp, Mus musculus
aggtcccacctctttcatgaagatg

SEQ ID NO: 202751 - DNA, 25 bp, Mus musculus
aggtcccactccataacaatggtct

SEQ ID NO: 202752 - DNA, 25 bp, Mus musculus
aggtcccactccttaacaatggtct

SEQ ID NO: 202753 - DNA, 25 bp, Mus musculus
aggtcccagatgatcgtctttatga

SEQ ID NO: 202754 - DNA, 25 bp, Mus musculus
aggtcccagatgttcgtctttatga

SEQ ID NO: 202755 - DNA, 25 bp, Mus musculus
aggtcccagcaaagatccctttagg

SEQ ID NO: 202756 - DNA, 25 bp, Mus musculus
aggtcccagcaatgatccctttagg

SEQ ID NO: 202757 - DNA, 25 bp, Mus musculus
aggtcccaggacatgcacttctgtt

SEQ ID NO: 202758 - DNA, 25 bp, Mus musculus
aggtcccaggacttgcacttctgtt

SEQ ID NO: 202759 - DNA, 25 bp, Mus musculus
aggtcccaggcaatgctggttgctg

SEQ ID NO: 202760 - DNA, 25 bp, Mus musculus
aggtcccaggcattgctggttgctg

SEQ ID NO: 202761 - DNA, 25 bp, Mus musculus
aggtcccagggacttaagtcaccag

SEQ ID NO: 202762 - DNA, 25 bp, Mus musculus
aggtcccagggagttaagtcaccag

SEQ ID NO: 202763 - DNA, 25 bp, Mus musculus
aggtcccaggtcacttggcagcacg

SEQ ID NO: 202764 - DNA, 25 bp, Mus musculus
aggtcccaggtctcttggcagcacg

SEQ ID NO: 202765 - DNA, 25 bp, Mus musculus
aggtcccataaacgcaagcaccatg

SEQ ID NO: 202766 - DNA, 25 bp, Mus musculus
aggtcccataaaggcaagcaccatg

SEQ ID NO: 202767 - DNA, 25 bp, Mus musculus
aggtcccatctgatgccaaggctga

SEQ ID NO: 202768 - DNA, 25 bp, Mus musculus
aggtcccatctgctgtagctgcagt

SEQ ID NO: 202769 - DNA, 25 bp, Mus musculus
aggtcccatctggtgtagctgcagt

SEQ ID NO: 202770 - DNA, 25 bp, Mus musculus
aggtcccatctgttgccaaggctga

SEQ ID NO: 202771 - DNA, 25 bp, Mus musculus
aggtcccatgagatcccaagtttca

SEQ ID NO: 202772 - DNA, 25 bp, Mus musculus
aggtcccatgagttcccaagtttca

SEQ ID NO: 202773 - DNA, 25 bp, Mus musculus
aggtcccatgatccacattccatga

SEQ ID NO: 202774 - DNA, 25 bp, Mus musculus
aggtcccatgatgcacattccatga

SEQ ID NO: 202775 - DNA, 25 bp, Mus musculus
aggtcccatgtccttggcagtgtcc

SEQ ID NO: 202776 - DNA, 25 bp, Mus musculus
aggtcccatgtcgttggcagtgtcc

SEQ ID NO: 202777 - DNA, 25 bp, Mus musculus
aggtcccattcccttgccaagctgg

SEQ ID NO: 202778 - DNA, 25 bp, Mus musculus
aggtcccattccgttgccaagctgg

SEQ ID NO: 202779 - DNA, 25 bp, Mus musculus
aggtcccatttaagtgttctcttct

SEQ ID NO: 202780 - DNA, 25 bp, Mus musculus
aggtcccatttatgtgttctcttct

SEQ ID NO: 202781 - DNA, 25 bp, Mus musculus
aggtccccacttaaggatcagacac

SEQ ID NO: 202782 - DNA, 25 bp, Mus musculus
aggtccccactttaggatcagacac

SEQ ID NO: 202783 - DNA, 25 bp, Mus musculus
aggtccccaggcagtaagctcctgg

SEQ ID NO: 202784 - DNA, 25 bp, Mus musculus
aggtccccaggctgtaagctcctgg

SEQ ID NO: 202785 - DNA, 25 bp, Mus musculus
aggtccccaggtactggaatccttg

SEQ ID NO: 202786 - DNA, 25 bp, Mus musculus
aggtccccaggttctggaatccttg

SEQ ID NO: 202787 - DNA, 25 bp, Mus musculus
aggtccccatgcacagccacagagg

SEQ ID NO: 202788 - DNA, 25 bp, Mus musculus
aggtccccatgcatacaccggaagc

SEQ ID NO: 202789 - DNA, 25 bp, Mus musculus
aggtccccatgccagagtcctggtt

SEQ ID NO: 202790 - DNA, 25 bp, Mus musculus
aggtccccatgcgagagtcctggtt

SEQ ID NO: 202791 - DNA, 25 bp, Mus musculus
aggtccccatgctcagccacagagg

SEQ ID NO: 202792 - DNA, 25 bp, Mus musculus
aggtccccatgcttacaccggaagc

SEQ ID NO: 202793 - DNA, 25 bp, Mus musculus
aggtccccggctagtgctcttgcca

SEQ ID NO: 202794 - DNA, 25 bp, Mus musculus
aggtccccggcttgtgctcttgcca

SEQ ID NO: 202795 - DNA, 25 bp, Mus musculus
aggtcccctcttaatatactatctg

SEQ ID NO: 202796 - DNA, 25 bp, Mus musculus
aggtcccctctttatatactatctg

SEQ ID NO: 202797 - DNA, 25 bp, Mus musculus
aggtcccctgctaaatgatactgaa

SEQ ID NO: 202798 - DNA, 25 bp, Mus musculus
aggtcccctgcttaatgatactgaa

SEQ ID NO: 202799 - DNA, 25 bp, Mus musculus
aggtcccctgggaaacaggtcagag

SEQ ID NO: 202800 - DNA, 25 bp, Mus musculus
aggtcccctgggtaacaggtcagag

SEQ ID NO: 202801 - DNA, 25 bp, Mus musculus
aggtccccttatcgcaggaaggctt

SEQ ID NO: 202802 - DNA, 25 bp, Mus musculus
aggtccccttatggcaggaaggctt

SEQ ID NO: 202803 - DNA, 25 bp, Mus musculus
aggtccccttctcttgataaatcta

SEQ ID NO: 202804 - DNA, 25 bp, Mus musculus
aggtccccttctgttgataaatcta

SEQ ID NO: 202805 - DNA, 25 bp, Mus musculus
aggtcccgcaggagccagttgagca

SEQ ID NO: 202806 - DNA, 25 bp, Mus musculus
aggtcccgcaggtgccagttgagca

SEQ ID NO: 202807 - DNA, 25 bp, Mus musculus
aggtcccgctggagaccatgactta

SEQ ID NO: 202808 - DNA, 25 bp, Mus musculus
aggtcccgctggtgaccatgactta

SEQ ID NO: 202809 - DNA, 25 bp, Mus musculus
aggtcccggcgtactgagcccgagc

SEQ ID NO: 202810 - DNA, 25 bp, Mus musculus
aggtcccggcgttctgagcccgagc

SEQ ID NO: 202811 - DNA, 25 bp, Mus musculus
aggtccctaaatatctgcgtgttgc

SEQ ID NO: 202812 - DNA, 25 bp, Mus musculus
aggtccctaaatttctgcgtgttgc

SEQ ID NO: 202813 - DNA, 25 bp, Mus musculus
aggtccctacagacgttcttatgag

SEQ ID NO: 202814 - DNA, 25 bp, Mus musculus
aggtccctacagtcgttcttatgag

SEQ ID NO: 202815 - DNA, 25 bp, Mus musculus
aggtccctacctagtgctttggtag

SEQ ID NO: 202816 - DNA, 25 bp, Mus musculus
aggtccctaccttgtgctttggtag

SEQ ID NO: 202817 - DNA, 25 bp, Mus musculus
aggtccctagtcagtgtggtggtac

SEQ ID NO: 202818 - DNA, 25 bp, Mus musculus
aggtccctagtctgtgtggtggtac

SEQ ID NO: 202819 - DNA, 25 bp, Mus musculus
aggtccctcacgctaatggcttttg

SEQ ID NO: 202820 - DNA, 25 bp, Mus musculus
aggtccctcacggtaatggcttttg

SEQ ID NO: 202821 - DNA, 25 bp, Mus musculus
aggtccctcatcacatactttgttc

SEQ ID NO: 202822 - DNA, 25 bp, Mus musculus
aggtccctcatccagagttgccagc

SEQ ID NO: 202823 - DNA, 25 bp, Mus musculus
aggtccctcatcgagagttgccagc

SEQ ID NO: 202824 - DNA, 25 bp, Mus musculus
aggtccctcatctcatactttgttc

SEQ ID NO: 202825 - DNA, 25 bp, Mus musculus
aggtccctgagtatgcagctcttgt

SEQ ID NO: 202826 - DNA, 25 bp, Mus musculus
aggtccctgagtttgcagctcttgt

SEQ ID NO: 202827 - DNA, 25 bp, Mus musculus
aggtccctgattatcctccaaatta

SEQ ID NO: 202828 - DNA, 25 bp, Mus musculus
aggtccctgattttcctccaaatta

SEQ ID NO: 202829 - DNA, 25 bp, Mus musculus
aggtccctgcaaactcaaggctata

SEQ ID NO: 202830 - DNA, 25 bp, Mus musculus
aggtccctgcaatctcaaggctata

SEQ ID NO: 202831 - DNA, 25 bp, Mus musculus
aggtccctgcttctgttgccttggg

SEQ ID NO: 202832 - DNA, 25 bp, Mus musculus
aggtccctgcttgtgttgccttggg

SEQ ID NO: 202833 - DNA, 25 bp, Mus musculus
aggtccctggcaacgggatgcaacc

SEQ ID NO: 202834 - DNA, 25 bp, Mus musculus
aggtccctggcatcgggatgcaacc

SEQ ID NO: 202835 - DNA, 25 bp, Mus musculus
aggtccctggctcaaggtgactctg

SEQ ID NO: 202836 - DNA, 25 bp, Mus musculus
aggtccctggctgaaggtgactctg

SEQ ID NO: 202837 - DNA, 25 bp, Mus musculus
aggtccctgggaccagtttgcacga

SEQ ID NO: 202838 - DNA, 25 bp, Mus musculus
aggtccctgggacctgcttacttag

SEQ ID NO: 202839 - DNA, 25 bp, Mus musculus
aggtccctgggagcagtttgcacga

SEQ ID NO: 202840 - DNA, 25 bp, Mus musculus
aggtccctgggagctgcttacttag

SEQ ID NO: 202841 - DNA, 25 bp, Mus musculus
aggtccctgtcaagcttctgggcct

SEQ ID NO: 202842 - DNA, 25 bp, Mus musculus
aggtccctgtcatgcttctgggcct

SEQ ID NO: 202843 - DNA, 25 bp, Mus musculus
aggtccctgttaagtttcttgtaga

SEQ ID NO: 202844 - DNA, 25 bp, Mus musculus
aggtccctgttatgtttcttgtaga

SEQ ID NO: 202845 - DNA, 25 bp, Mus musculus
aggtcccttaagagagtgacccctg

SEQ ID NO: 202846 - DNA, 25 bp, Mus musculus
aggtcccttaagtgagtgacccctg

SEQ ID NO: 202847 - DNA, 25 bp, Mus musculus
aggtcccttatgaccgatataccat

SEQ ID NO: 202848 - DNA, 25 bp, Mus musculus
aggtcccttatgtccgatataccat

SEQ ID NO: 202849 - DNA, 25 bp, Mus musculus
aggtcccttcttcgacttctatgtg

SEQ ID NO: 202850 - DNA, 25 bp, Mus musculus
aggtcccttcttggacttctatgtg

SEQ ID NO: 202851 - DNA, 25 bp, Mus musculus
aggtcccttgccatggcatagcaaa

SEQ ID NO: 202852 - DNA, 25 bp, Mus musculus
aggtcccttgccttggcatagcaaa

SEQ ID NO: 202853 - DNA, 25 bp, Mus musculus
aggtcccttgctagcctgagtgtaa

SEQ ID NO: 202854 - DNA, 25 bp, Mus musculus
aggtcccttgcttgcctgagtgtaa

SEQ ID NO: 202855 - DNA, 25 bp, Mus musculus
aggtcccttttccagctgcttgaac

SEQ ID NO: 202856 - DNA, 25 bp, Mus musculus
aggtcccttttcgagctgcttgaac

SEQ ID NO: 202857 - DNA, 25 bp, Mus musculus
aggtccgaagagatcaagctgcctt

SEQ ID NO: 202858 - DNA, 25 bp, Mus musculus
aggtccgaagagttcaagctgcctt

SEQ ID NO: 202859 - DNA, 25 bp, Mus musculus
aggtccgactgaacggagaagccct

SEQ ID NO: 202860 - DNA, 25 bp, Mus musculus
aggtccgactgatcggagaagccct

SEQ ID NO: 202861 - DNA, 25 bp, Mus musculus
aggtccgatctgaccgggacaagtt

SEQ ID NO: 202862 - DNA, 25 bp, Mus musculus
aggtccgatctgtccgggacaagtt

SEQ ID NO: 202863 - DNA, 25 bp, Mus musculus
aggtccgatttgatcagcgtgctaa

SEQ ID NO: 202864 - DNA, 25 bp, Mus musculus
aggtccgatttgttcagcgtgctaa

SEQ ID NO: 202865 - DNA, 25 bp, Mus musculus
aggtccgcagcaactttaatacttg

SEQ ID NO: 202866 - DNA, 25 bp, Mus musculus
aggtccgcagcatctttaatacttg

SEQ ID NO: 202867 - DNA, 25 bp, Mus musculus
aggtccgctatgctcagaagatgat

SEQ ID NO: 202868 - DNA, 25 bp, Mus musculus
aggtccgctatggtcagaagatgat

SEQ ID NO: 202869 - DNA, 25 bp, Mus musculus
aggtccgctgcgagaaacgttcttg

SEQ ID NO: 202870 - DNA, 25 bp, Mus musculus
aggtccgctgcgtgaaacgttcttg

SEQ ID NO: 202871 - DNA, 25 bp, Mus musculus
aggtccggagctcctgatccttatt

SEQ ID NO: 202872 - DNA, 25 bp, Mus musculus
aggtccggagctgctgatccttatt

SEQ ID NO: 202873 - DNA, 25 bp, Mus musculus
aggtccgggtcaccttggcatcttg

SEQ ID NO: 202874 - DNA, 25 bp, Mus musculus
aggtccgggtcagcttggcatcttg

SEQ ID NO: 202875 - DNA, 25 bp, Mus musculus
aggtccgggtccctgtgtccatcat

SEQ ID NO: 202876 - DNA, 25 bp, Mus musculus
aggtccgggtccgtgtgtccatcat

SEQ ID NO: 202877 - DNA, 25 bp, Mus musculus
aggtccgtctagcactgacctgcat

SEQ ID NO: 202878 - DNA, 25 bp, Mus musculus
aggtccgtctaggactgacctgcat

SEQ ID NO: 202879 - DNA, 25 bp, Mus musculus
aggtccgtctgaatcgagctcttga

SEQ ID NO: 202880 - DNA, 25 bp, Mus musculus
aggtccgtctgattcgagctcttga

SEQ ID NO: 202881 - DNA, 25 bp, Mus musculus
aggtcctaaaccacttcagcatcat

SEQ ID NO: 202882 - DNA, 25 bp, Mus musculus
aggtcctaaacccttgagagcctgg

SEQ ID NO: 202883 - DNA, 25 bp, Mus musculus
aggtcctaaaccgttgagagcctgg

SEQ ID NO: 202884 - DNA, 25 bp, Mus musculus
aggtcctaaacctcttcagcatcat

SEQ ID NO: 202885 - DNA, 25 bp, Mus musculus
aggtcctaaactcctgtggtgctaa

SEQ ID NO: 202886 - DNA, 25 bp, Mus musculus
aggtcctaaactgctgtggtgctaa

SEQ ID NO: 202887 - DNA, 25 bp, Mus musculus
aggtcctaaatcatccctagagcct

SEQ ID NO: 202888 - DNA, 25 bp, Mus musculus
aggtcctaaatcttccctagagcct

SEQ ID NO: 202889 - DNA, 25 bp, Mus musculus
aggtcctaataacttcaatttccag

SEQ ID NO: 202890 - DNA, 25 bp, Mus musculus
aggtcctaataagttcaatttccag

SEQ ID NO: 202891 - DNA, 25 bp, Mus musculus
aggtcctacctcctgaattctaggt

SEQ ID NO: 202892 - DNA, 25 bp, Mus musculus
aggtcctacctcgtgaattctaggt

SEQ ID NO: 202893 - DNA, 25 bp, Mus musculus
aggtcctacgcactctgagtcacca

SEQ ID NO: 202894 - DNA, 25 bp, Mus musculus
aggtcctacgcagtctgagtcacca

SEQ ID NO: 202895 - DNA, 25 bp, Mus musculus
aggtcctagaagatgtgccactgac

SEQ ID NO: 202896 - DNA, 25 bp, Mus musculus
aggtcctagaagttgtgccactgac

SEQ ID NO: 202897 - DNA, 25 bp, Mus musculus
aggtcctagagtcagtgtttcgtat

SEQ ID NO: 202898 - DNA, 25 bp, Mus musculus
aggtcctagagtgagtgtttcgtat

SEQ ID NO: 202899 - DNA, 25 bp, Mus musculus
aggtcctaggaacactgccacggct

SEQ ID NO: 202900 - DNA, 25 bp, Mus musculus
aggtcctaggaagactgccacggct

SEQ ID NO: 202901 - DNA, 25 bp, Mus musculus
aggtcctagtgtacaatgccattcc

SEQ ID NO: 202902 - DNA, 25 bp, Mus musculus
aggtcctagtgttcaatgccattcc

SEQ ID NO: 202903 - DNA, 25 bp, Mus musculus
aggtcctatctcagcaacaacctaa

SEQ ID NO: 202904 - DNA, 25 bp, Mus musculus
aggtcctatctctgcaacaacctaa

SEQ ID NO: 202905 - DNA, 25 bp, Mus musculus
aggtcctatgctccaatcctgaatc

SEQ ID NO: 202906 - DNA, 25 bp, Mus musculus
aggtcctatgctgcaatcctgaatc

SEQ ID NO: 202907 - DNA, 25 bp, Mus musculus
aggtcctatgtgagcctgggattcg

SEQ ID NO: 202908 - DNA, 25 bp, Mus musculus
aggtcctatgtgtgcctgggattcg

SEQ ID NO: 202909 - DNA, 25 bp, Mus musculus
aggtcctcacacatgggtgtctcct

SEQ ID NO: 202910 - DNA, 25 bp, Mus musculus
aggtcctcacacttgggtgtctcct

SEQ ID NO: 202911 - DNA, 25 bp, Mus musculus
aggtcctcagataccttagtcctaa

SEQ ID NO: 202912 - DNA, 25 bp, Mus musculus
aggtcctcagattccttagtcctaa

SEQ ID NO: 202913 - DNA, 25 bp, Mus musculus
aggtcctcagccaggacacgtgggt

SEQ ID NO: 202914 - DNA, 25 bp, Mus musculus
aggtcctcagcctggacacgtgggt

SEQ ID NO: 202915 - DNA, 25 bp, Mus musculus
aggtcctcaggcatgttggcaatct

SEQ ID NO: 202916 - DNA, 25 bp, Mus musculus
aggtcctcaggcttgttggcaatct

SEQ ID NO: 202917 - DNA, 25 bp, Mus musculus
aggtcctccattctcatcctgggaa

SEQ ID NO: 202918 - DNA, 25 bp, Mus musculus
aggtcctccattgtcatcctgggaa

SEQ ID NO: 202919 - DNA, 25 bp, Mus musculus
aggtcctccctgcagtgcaggtcct

SEQ ID NO: 202920 - DNA, 25 bp, Mus musculus
aggtcctccctggagtgcaggtcct

SEQ ID NO: 202921 - DNA, 25 bp, Mus musculus
aggtcctcctagaaatctggtcctc

SEQ ID NO: 202922 - DNA, 25 bp, Mus musculus
aggtcctcctagtaatctggtcctc

SEQ ID NO: 202923 - DNA, 25 bp, Mus musculus
aggtcctccttcctgtatgtggttt

SEQ ID NO: 202924 - DNA, 25 bp, Mus musculus
aggtcctccttcgtgtatgtggttt

SEQ ID NO: 202925 - DNA, 25 bp, Mus musculus
aggtcctcgcggctgcacaatccaa

SEQ ID NO: 202926 - DNA, 25 bp, Mus musculus
aggtcctcgcgggtgcacaatccaa

SEQ ID NO: 202927 - DNA, 25 bp, Mus musculus
aggtcctcgctcactggacataata

SEQ ID NO: 202928 - DNA, 25 bp, Mus musculus
aggtcctcgctctctggacataata

SEQ ID NO: 202929 - DNA, 25 bp, Mus musculus
aggtcctcgtgccatgtgccaagct

SEQ ID NO: 202930 - DNA, 25 bp, Mus musculus
aggtcctcgtgcgatgtgccaagct

SEQ ID NO: 202931 - DNA, 25 bp, Mus musculus
aggtcctctcttccaaagaacaggc

SEQ ID NO: 202932 - DNA, 25 bp, Mus musculus
aggtcctctcttgcaaagaacaggc

SEQ ID NO: 202933 - DNA, 25 bp, Mus musculus
aggtcctctgccagaatggtgcaca

SEQ ID NO: 202934 - DNA, 25 bp, Mus musculus
aggtcctctgcctgaatggtgcaca

SEQ ID NO: 202935 - DNA, 25 bp, Mus musculus
aggtcctctgctagtgctgctagga

SEQ ID NO: 202936 - DNA, 25 bp, Mus musculus
aggtcctctgcttgtgctgctagga

SEQ ID NO: 202937 - DNA, 25 bp, Mus musculus
aggtcctctgtacattacacatcac

SEQ ID NO: 202938 - DNA, 25 bp, Mus musculus
aggtcctctgtagattacacatcac

SEQ ID NO: 202939 - DNA, 25 bp, Mus musculus
aggtcctctgtcagattataccagc

SEQ ID NO: 202940 - DNA, 25 bp, Mus musculus
aggtcctctgtctgattataccagc

SEQ ID NO: 202941 - DNA, 25 bp, Mus musculus
aggtcctctttgcaattactgttct

SEQ ID NO: 202942 - DNA, 25 bp, Mus musculus
aggtcctctttgcagcactgctgga

SEQ ID NO: 202943 - DNA, 25 bp, Mus musculus
aggtcctctttggaattactgttct

SEQ ID NO: 202944 - DNA, 25 bp, Mus musculus
aggtcctctttggagcactgctgga

SEQ ID NO: 202945 - DNA, 25 bp, Mus musculus
aggtcctgaagccacaccggaaact

SEQ ID NO: 202946 - DNA, 25 bp, Mus musculus
aggtcctgaagcgacaccggaaact

SEQ ID NO: 202947 - DNA, 25 bp, Mus musculus
aggtcctgaccactttgcacacaca

SEQ ID NO: 202948 - DNA, 25 bp, Mus musculus
aggtcctgaccagtttgcacacaca

SEQ ID NO: 202949 - DNA, 25 bp, Mus musculus
aggtcctgacctcgatgatggctga

SEQ ID NO: 202950 - DNA, 25 bp, Mus musculus
aggtcctgacctggatgatggctga

SEQ ID NO: 202951 - DNA, 25 bp, Mus musculus
aggtcctgagatcccaccaccagtc

SEQ ID NO: 202952 - DNA, 25 bp, Mus musculus
aggtcctgagatgccaccaccagtc

SEQ ID NO: 202953 - DNA, 25 bp, Mus musculus
aggtcctgagcgaggtgtttccctt

SEQ ID NO: 202954 - DNA, 25 bp, Mus musculus
aggtcctgagcgtggtgtttccctt

SEQ ID NO: 202955 - DNA, 25 bp, Mus musculus
aggtcctgaggaacgtgcccgcaag

SEQ ID NO: 202956 - DNA, 25 bp, Mus musculus
aggtcctgaggatcgtgcccgcaag

SEQ ID NO: 202957 - DNA, 25 bp, Mus musculus
aggtcctgagtaccatgtcctgtca

SEQ ID NO: 202958 - DNA, 25 bp, Mus musculus
aggtcctgagtagcatgtcctgtca

SEQ ID NO: 202959 - DNA, 25 bp, Mus musculus
aggtcctgattgctccatgacgtca

SEQ ID NO: 202960 - DNA, 25 bp, Mus musculus
aggtcctgattggtccatgacgtca

SEQ ID NO: 202961 - DNA, 25 bp, Mus musculus
aggtcctgatttacagtggataaag

SEQ ID NO: 202962 - DNA, 25 bp, Mus musculus
aggtcctgattttcagtggataaag

SEQ ID NO: 202963 - DNA, 25 bp, Mus musculus
aggtcctgcaggaaatgtggcccgt

SEQ ID NO: 202964 - DNA, 25 bp, Mus musculus
aggtcctgcaggtaatgtggcccgt

SEQ ID NO: 202965 - DNA, 25 bp, Mus musculus
aggtcctgcatcaagtgttcatctc

SEQ ID NO: 202966 - DNA, 25 bp, Mus musculus
aggtcctgcatctagtgttcatctc

SEQ ID NO: 202967 - DNA, 25 bp, Mus musculus
aggtcctgccacctcaatcattaat

SEQ ID NO: 202968 - DNA, 25 bp, Mus musculus
aggtcctgccacgtcaatcattaat

SEQ ID NO: 202969 - DNA, 25 bp, Mus musculus
aggtcctgccttaatcctgtccctg

SEQ ID NO: 202970 - DNA, 25 bp, Mus musculus
aggtcctgcctttatcctgtccctg

SEQ ID NO: 202971 - DNA, 25 bp, Mus musculus
aggtcctgctcacaagctctaacga

SEQ ID NO: 202972 - DNA, 25 bp, Mus musculus
aggtcctgctcagaagctctaacga

SEQ ID NO: 202973 - DNA, 25 bp, Mus musculus
aggtcctggacaatgtgtgggttaa

SEQ ID NO: 202974 - DNA, 25 bp, Mus musculus
aggtcctggacattgtgtgggttaa

SEQ ID NO: 202975 - DNA, 25 bp, Mus musculus
aggtcctggcaaacactgactactt

SEQ ID NO: 202976 - DNA, 25 bp, Mus musculus
aggtcctggcaatcactgactactt

SEQ ID NO: 202977 - DNA, 25 bp, Mus musculus
aggtcctggctcctaaactaagcta

SEQ ID NO: 202978 - DNA, 25 bp, Mus musculus
aggtcctggctcgtaaactaagcta

SEQ ID NO: 202979 - DNA, 25 bp, Mus musculus
aggtcctgggagacactgatgccaa

SEQ ID NO: 202980 - DNA, 25 bp, Mus musculus
aggtcctgggagtcactgatgccaa

SEQ ID NO: 202981 - DNA, 25 bp, Mus musculus
aggtcctgggctcatcctcagttat

SEQ ID NO: 202982 - DNA, 25 bp, Mus musculus
aggtcctgggctgatcctcagttat

SEQ ID NO: 202983 - DNA, 25 bp, Mus musculus
aggtcctggttacacactgagcggt

SEQ ID NO: 202984 - DNA, 25 bp, Mus musculus
aggtcctggttagacactgagcggt

SEQ ID NO: 202985 - DNA, 25 bp, Mus musculus
aggtcctgtaggactttgactcttc

SEQ ID NO: 202986 - DNA, 25 bp, Mus musculus
aggtcctgtaggtctttgactcttc

SEQ ID NO: 202987 - DNA, 25 bp, Mus musculus
aggtcctgtgcccaacattcatgaa

SEQ ID NO: 202988 - DNA, 25 bp, Mus musculus
aggtcctgtgcccacacagtgggta

SEQ ID NO: 202989 - DNA, 25 bp, Mus musculus
aggtcctgtgccgaacattcatgaa

SEQ ID NO: 202990 - DNA, 25 bp, Mus musculus
aggtcctgtgccgacacagtgggta

SEQ ID NO: 202991 - DNA, 25 bp, Mus musculus
aggtcctgtggcctagcagttatat

SEQ ID NO: 202992 - DNA, 25 bp, Mus musculus
aggtcctgtggcgtagcagttatat

SEQ ID NO: 202993 - DNA, 25 bp, Mus musculus
aggtccttaagtcctttgacatgca

SEQ ID NO: 202994 - DNA, 25 bp, Mus musculus
aggtccttaagtgctttgacatgca

SEQ ID NO: 202995 - DNA, 25 bp, Mus musculus
aggtccttacgacaaccgcacggtg

SEQ ID NO: 202996 - DNA, 25 bp, Mus musculus
aggtccttacgagaaccgcacggtg

SEQ ID NO: 202997 - DNA, 25 bp, Mus musculus
aggtccttagcaccacaggaaacaa

SEQ ID NO: 202998 - DNA, 25 bp, Mus musculus
aggtccttagcagcacaggaaacaa

SEQ ID NO: 202999 - DNA, 25 bp, Mus musculus
aggtccttagccctagcatctggga

SEQ ID NO: 203000 - DNA, 25 bp, Mus musculus
aggtccttagccgtagcatctggga

SEQ ID NO: 203001 - DNA, 25 bp, Mus musculus
aggtccttatcccaggatcctctaa

SEQ ID NO: 203002 - DNA, 25 bp, Mus musculus
aggtccttatccgaggatcctctaa

SEQ ID NO: 203003 - DNA, 25 bp, Mus musculus
aggtccttattgctcatcaggctaa

SEQ ID NO: 203004 - DNA, 25 bp, Mus musculus
aggtccttattggtcatcaggctaa

SEQ ID NO: 203005 - DNA, 25 bp, Mus musculus
aggtccttcactagtcttgggataa

SEQ ID NO: 203006 - DNA, 25 bp, Mus musculus
aggtccttcacttgtcttgggataa

SEQ ID NO: 203007 - DNA, 25 bp, Mus musculus
aggtccttcagtaacgtctgctaga

SEQ ID NO: 203008 - DNA, 25 bp, Mus musculus
aggtccttcagttacgtctgctaga

SEQ ID NO: 203009 - DNA, 25 bp, Mus musculus
aggtccttcccaccagaggttgaca

SEQ ID NO: 203010 - DNA, 25 bp, Mus musculus
aggtccttcccagcagaggttgaca

SEQ ID NO: 203011 - DNA, 25 bp, Mus musculus
aggtccttcctccagcctagggctg

SEQ ID NO: 203012 - DNA, 25 bp, Mus musculus
aggtccttcctcgagcctagggctg

SEQ ID NO: 203013 - DNA, 25 bp, Mus musculus
aggtccttctacctgctaggcaagt

SEQ ID NO: 203014 - DNA, 25 bp, Mus musculus
aggtccttctacgtgctaggcaagt

SEQ ID NO: 203015 - DNA, 25 bp, Mus musculus
aggtccttctggaaaaagagactca

SEQ ID NO: 203016 - DNA, 25 bp, Mus musculus
aggtccttctggtaaaagagactca

SEQ ID NO: 203017 - DNA, 25 bp, Mus musculus
aggtccttctgtagcgccatggtgg

SEQ ID NO: 203018 - DNA, 25 bp, Mus musculus
aggtccttctgttgcgccatggtgg

SEQ ID NO: 203019 - DNA, 25 bp, Mus musculus
aggtccttcttgagtagtcatctga

SEQ ID NO: 203020 - DNA, 25 bp, Mus musculus
aggtccttcttgtgtagtcatctga

SEQ ID NO: 203021 - DNA, 25 bp, Mus musculus
aggtccttgtacacgcattttagag

SEQ ID NO: 203022 - DNA, 25 bp, Mus musculus
aggtccttgtactcgcattttagag

SEQ ID NO: 203023 - DNA, 25 bp, Mus musculus
aggtccttgtgcatacactgtgtca

SEQ ID NO: 203024 - DNA, 25 bp, Mus musculus
aggtccttgtgcttacactgtgtca

SEQ ID NO: 203025 - DNA, 25 bp, Mus musculus
aggtcctttcacaagcatggatgaa

SEQ ID NO: 203026 - DNA, 25 bp, Mus musculus
aggtcctttcactagcatggatgaa

SEQ ID NO: 203027 - DNA, 25 bp, Mus musculus
aggtcctttcagactatggaggtcg

SEQ ID NO: 203028 - DNA, 25 bp, Mus musculus
aggtcctttcagtctatggaggtcg

SEQ ID NO: 203029 - DNA, 25 bp, Mus musculus
aggtcctttccaacggcatccctgt

SEQ ID NO: 203030 - DNA, 25 bp, Mus musculus
aggtcctttccatcggcatccctgt

SEQ ID NO: 203031 - DNA, 25 bp, Mus musculus
aggtcctttcccctgatggctcacc

SEQ ID NO: 203032 - DNA, 25 bp, Mus musculus
aggtcctttcccgtgatggctcacc

SEQ ID NO: 203033 - DNA, 25 bp, Mus musculus
aggtcctttgctactttcaggcaag

SEQ ID NO: 203034 - DNA, 25 bp, Mus musculus
aggtcctttgcttctttcaggcaag

SEQ ID NO: 203035 - DNA, 25 bp, Mus musculus
aggtcctttggaacatagccgggta

SEQ ID NO: 203036 - DNA, 25 bp, Mus musculus
aggtcctttggatcatagccgggta

SEQ ID NO: 203037 - DNA, 25 bp, Mus musculus
aggtcctttgtgattcctctttcct

SEQ ID NO: 203038 - DNA, 25 bp, Mus musculus
aggtcctttgtgtttcctctttcct

SEQ ID NO: 203039 - DNA, 25 bp, Mus musculus
aggtccttttcaacctgagagtgac

SEQ ID NO: 203040 - DNA, 25 bp, Mus musculus
aggtccttttcatcctgagagtgac

SEQ ID NO: 203041 - DNA, 25 bp, Mus musculus
aggtcctttttaatacatacagagt

SEQ ID NO: 203042 - DNA, 25 bp, Mus musculus
aggtcctttttattacatacagagt

SEQ ID NO: 203043 - DNA, 25 bp, Mus musculus
aggtcgaacggaaatgccctgacat

SEQ ID NO: 203044 - DNA, 25 bp, Mus musculus
aggtcgaacggatatgccctgacat

SEQ ID NO: 203045 - DNA, 25 bp, Mus musculus
aggtcgaattgcagtgttttttcac

SEQ ID NO: 203046 - DNA, 25 bp, Mus musculus
aggtcgaattgctgtgttttttcac

SEQ ID NO: 203047 - DNA, 25 bp, Mus musculus
aggtcgacaatgctaacctctgttg

SEQ ID NO: 203048 - DNA, 25 bp, Mus musculus
aggtcgacaatggtaacctctgttg

SEQ ID NO: 203049 - DNA, 25 bp, Mus musculus
aggtcgagactgcagaagcacactt

SEQ ID NO: 203050 - DNA, 25 bp, Mus musculus
aggtcgagactggagaagcacactt

SEQ ID NO: 203051 - DNA, 25 bp, Mus musculus
aggtcgaggcccaactccgtgcgca

SEQ ID NO: 203052 - DNA, 25 bp, Mus musculus
aggtcgaggccctactccgtgcgca

SEQ ID NO: 203053 - DNA, 25 bp, Mus musculus
aggtcgagtatgaaacactgcctgg

SEQ ID NO: 203054 - DNA, 25 bp, Mus musculus
aggtcgagtatgtaacactgcctgg

SEQ ID NO: 203055 - DNA, 25 bp, Mus musculus
aggtcgattagcaggtccctggctg

SEQ ID NO: 203056 - DNA, 25 bp, Mus musculus
aggtcgattagctggtccctggctg

SEQ ID NO: 203057 - DNA, 25 bp, Mus musculus
aggtcgattcctatacagtccactg

SEQ ID NO: 203058 - DNA, 25 bp, Mus musculus
aggtcgattcctttacagtccactg

SEQ ID NO: 203059 - DNA, 25 bp, Mus musculus
aggtcgatttaactagaagtgcgtt

SEQ ID NO: 203060 - DNA, 25 bp, Mus musculus
aggtcgatttaagtagaagtgcgtt

SEQ ID NO: 203061 - DNA, 25 bp, Mus musculus
aggtcgatttcaatatccccattct

SEQ ID NO: 203062 - DNA, 25 bp, Mus musculus
aggtcgatttcattatccccattct

SEQ ID NO: 203063 - DNA, 25 bp, Mus musculus
aggtcgcactttaacagcactttag

SEQ ID NO: 203064 - DNA, 25 bp, Mus musculus
aggtcgcacttttacagcactttag

SEQ ID NO: 203065 - DNA, 25 bp, Mus musculus
aggtcgcatgtgatttattcagaag

SEQ ID NO: 203066 - DNA, 25 bp, Mus musculus
aggtcgcatgtgttttattcagaag

SEQ ID NO: 203067 - DNA, 25 bp, Mus musculus
aggtcgcatttgcatcactgtatcg

SEQ ID NO: 203068 - DNA, 25 bp, Mus musculus
aggtcgcatttggatcactgtatcg

SEQ ID NO: 203069 - DNA, 25 bp, Mus musculus
aggtcgccgaccaggtgaagtccca

SEQ ID NO: 203070 - DNA, 25 bp, Mus musculus
aggtcgccgacctggtgaagtccca

SEQ ID NO: 203071 - DNA, 25 bp, Mus musculus
aggtcgccgatgctctggccaatgc

SEQ ID NO: 203072 - DNA, 25 bp, Mus musculus
aggtcgccgatggtctggccaatgc

SEQ ID NO: 203073 - DNA, 25 bp, Mus musculus
aggtcgcgcacgaattgcacctcag

SEQ ID NO: 203074 - DNA, 25 bp, Mus musculus
aggtcgcgcacgtattgcacctcag

SEQ ID NO: 203075 - DNA, 25 bp, Mus musculus
aggtcgcgctcaaccaggtggatgt

SEQ ID NO: 203076 - DNA, 25 bp, Mus musculus
aggtcgcgctcatccaggtggatgt

SEQ ID NO: 203077 - DNA, 25 bp, Mus musculus
aggtcgctaggcacgggcaagcttt

SEQ ID NO: 203078 - DNA, 25 bp, Mus musculus
aggtcgctaggcctgcttgcaagta

SEQ ID NO: 203079 - DNA, 25 bp, Mus musculus
aggtcgctaggcgtgcttgcaagta

SEQ ID NO: 203080 - DNA, 25 bp, Mus musculus
aggtcgctaggctcgggcaagcttt

SEQ ID NO: 203081 - DNA, 25 bp, Mus musculus
aggtcgctatgcatttcagatctgg

SEQ ID NO: 203082 - DNA, 25 bp, Mus musculus
aggtcgctatgcttttcagatctgg

SEQ ID NO: 203083 - DNA, 25 bp, Mus musculus
aggtcggaagtcaccttggttcctg

SEQ ID NO: 203084 - DNA, 25 bp, Mus musculus
aggtcggaagtctccttggttcctg

SEQ ID NO: 203085 - DNA, 25 bp, Mus musculus
aggtcggcctgcagagaagctttgc

SEQ ID NO: 203086 - DNA, 25 bp, Mus musculus
aggtcggcctgctgagaagctttgc

SEQ ID NO: 203087 - DNA, 25 bp, Mus musculus
aggtcgggatctcctggacctaaag

SEQ ID NO: 203088 - DNA, 25 bp, Mus musculus
aggtcgggatctgctggacctaaag

SEQ ID NO: 203089 - DNA, 25 bp, Mus musculus
aggtcggtaactaagtgtccactag

SEQ ID NO: 203090 - DNA, 25 bp, Mus musculus
aggtcggtaacttagtgtccactag

SEQ ID NO: 203091 - DNA, 25 bp, Mus musculus
aggtcggtggtgattgccagactac

SEQ ID NO: 203092 - DNA, 25 bp, Mus musculus
aggtcggtggtgtttgccagactac

SEQ ID NO: 203093 - DNA, 25 bp, Mus musculus
aggtcggttccaatatttgatactt

SEQ ID NO: 203094 - DNA, 25 bp, Mus musculus
aggtcggttccattatttgatactt

SEQ ID NO: 203095 - DNA, 25 bp, Mus musculus
aggtcgtcagacatgtgtggaaagc

SEQ ID NO: 203096 - DNA, 25 bp, Mus musculus
aggtcgtcagacttgtgtggaaagc

SEQ ID NO: 203097 - DNA, 25 bp, Mus musculus
aggtcgtctactacgttgtgtccat

SEQ ID NO: 203098 - DNA, 25 bp, Mus musculus
aggtcgtctacttcgttgtgtccat

SEQ ID NO: 203099 - DNA, 25 bp, Mus musculus
aggtcgtgaagaacatccgccccag

SEQ ID NO: 203100 - DNA, 25 bp, Mus musculus
aggtcgtgaagatcatccgccccag

SEQ ID NO: 203101 - DNA, 25 bp, Mus musculus
aggtcgtgcctactcaagaactcta

SEQ ID NO: 203102 - DNA, 25 bp, Mus musculus
aggtcgtgcctagtcaagaactcta

SEQ ID NO: 203103 - DNA, 25 bp, Mus musculus
aggtcgtggaacaacaattactctt

SEQ ID NO: 203104 - DNA, 25 bp, Mus musculus
aggtcgtggaactacaattactctt

SEQ ID NO: 203105 - DNA, 25 bp, Mus musculus
aggtcgtgtattcatgctcgtgcac

SEQ ID NO: 203106 - DNA, 25 bp, Mus musculus
aggtcgtgtattgatgctcgtgcac

SEQ ID NO: 203107 - DNA, 25 bp, Mus musculus
aggtctaaatgacttgttttcccag

SEQ ID NO: 203108 - DNA, 25 bp, Mus musculus
aggtctaaatgagttgttttcccag

SEQ ID NO: 203109 - DNA, 25 bp, Mus musculus
aggtctaactttacttctggccttg

SEQ ID NO: 203110 - DNA, 25 bp, Mus musculus
aggtctaacttttcttctggccttg

SEQ ID NO: 203111 - DNA, 25 bp, Mus musculus
aggtctaagatgaatcggccccaac

SEQ ID NO: 203112 - DNA, 25 bp, Mus musculus
aggtctaagatgtatcggccccaac

SEQ ID NO: 203113 - DNA, 25 bp, Mus musculus
aggtctaagcaacgccatctgggat

SEQ ID NO: 203114 - DNA, 25 bp, Mus musculus
aggtctaagcaaggccatctgggat

SEQ ID NO: 203115 - DNA, 25 bp, Mus musculus
aggtctaagttgagctgagcctcct

SEQ ID NO: 203116 - DNA, 25 bp, Mus musculus
aggtctaagttgtgctgagcctcct

SEQ ID NO: 203117 - DNA, 25 bp, Mus musculus
aggtctacacacagaatcccaaggc

SEQ ID NO: 203118 - DNA, 25 bp, Mus musculus
aggtctacacactgaatcccaaggc

SEQ ID NO: 203119 - DNA, 25 bp, Mus musculus
aggtctacaccgagaatcatagttc

SEQ ID NO: 203120 - DNA, 25 bp, Mus musculus
aggtctacaccgtgaatcatagttc

SEQ ID NO: 203121 - DNA, 25 bp, Mus musculus
aggtctacactaagagctcgcactt

SEQ ID NO: 203122 - DNA, 25 bp, Mus musculus
aggtctacactatgagctcgcactt

SEQ ID NO: 203123 - DNA, 25 bp, Mus musculus
aggtctacagcaatgaaacttttat

SEQ ID NO: 203124 - DNA, 25 bp, Mus musculus
aggtctacagcattgaaacttttat

SEQ ID NO: 203125 - DNA, 25 bp, Mus musculus
aggtctacagcccagagagataact

SEQ ID NO: 203126 - DNA, 25 bp, Mus musculus
aggtctacagccgagagagataact

SEQ ID NO: 203127 - DNA, 25 bp, Mus musculus
aggtctacatctcccagatcctggt

SEQ ID NO: 203128 - DNA, 25 bp, Mus musculus
aggtctacatctgccagatcctggt

SEQ ID NO: 203129 - DNA, 25 bp, Mus musculus
aggtctacattcactaactcctttc

SEQ ID NO: 203130 - DNA, 25 bp, Mus musculus
aggtctacattctctaactcctttc

SEQ ID NO: 203131 - DNA, 25 bp, Mus musculus
aggtctaccagcagccacttaaaac

SEQ ID NO: 203132 - DNA, 25 bp, Mus musculus
aggtctaccagctgccacttaaaac

SEQ ID NO: 203133 - DNA, 25 bp, Mus musculus
aggtctacgtagaggagctggtcca

SEQ ID NO: 203134 - DNA, 25 bp, Mus musculus
aggtctacgtagtggagctggtcca

SEQ ID NO: 203135 - DNA, 25 bp, Mus musculus
aggtctacgtgtcgctttgtttcct

SEQ ID NO: 203136 - DNA, 25 bp, Mus musculus
aggtctacgtgtggctttgtttcct

SEQ ID NO: 203137 - DNA, 25 bp, Mus musculus
aggtctactaagcattaaggatcct

SEQ ID NO: 203138 - DNA, 25 bp, Mus musculus
aggtctactaaggattaaggatcct

SEQ ID NO: 203139 - DNA, 25 bp, Mus musculus
aggtctactcggctgacatgtccag

SEQ ID NO: 203140 - DNA, 25 bp, Mus musculus
aggtctactcgggtgacatgtccag

SEQ ID NO: 203141 - DNA, 25 bp, Mus musculus
aggtctactgtgaaactggcactgt

SEQ ID NO: 203142 - DNA, 25 bp, Mus musculus
aggtctactgtgtaactggcactgt

SEQ ID NO: 203143 - DNA, 25 bp, Mus musculus
aggtctacttcgctgaggagccaga

SEQ ID NO: 203144 - DNA, 25 bp, Mus musculus
aggtctacttcggtgaggagccaga

SEQ ID NO: 203145 - DNA, 25 bp, Mus musculus
aggtctagactcagttatggtaaca

SEQ ID NO: 203146 - DNA, 25 bp, Mus musculus
aggtctagactctgttatggtaaca

SEQ ID NO: 203147 - DNA, 25 bp, Mus musculus
aggtctagcaggataacttcaaaag

SEQ ID NO: 203148 - DNA, 25 bp, Mus musculus
aggtctagcaggttaacttcaaaag

SEQ ID NO: 203149 - DNA, 25 bp, Mus musculus
aggtctagccctcgacaagctgagt

SEQ ID NO: 203150 - DNA, 25 bp, Mus musculus
aggtctagccctggacaagctgagt

SEQ ID NO: 203151 - DNA, 25 bp, Mus musculus
aggtctagtatcacacacctctaat

SEQ ID NO: 203152 - DNA, 25 bp, Mus musculus
aggtctagtatctcacacctctaat

SEQ ID NO: 203153 - DNA, 25 bp, Mus musculus
aggtctagtgccacgcagctgagag

SEQ ID NO: 203154 - DNA, 25 bp, Mus musculus
aggtctagtgcctcgcagctgagag

SEQ ID NO: 203155 - DNA, 25 bp, Mus musculus
aggtctatagctcggcatggctgct

SEQ ID NO: 203156 - DNA, 25 bp, Mus musculus
aggtctatagctgggcatggctgct

SEQ ID NO: 203157 - DNA, 25 bp, Mus musculus
aggtctatatcgcagtccatcagtg

SEQ ID NO: 203158 - DNA, 25 bp, Mus musculus
aggtctatatcggagtccatcagtg

SEQ ID NO: 203159 - DNA, 25 bp, Mus musculus
aggtctatgataagtttactttgaa

SEQ ID NO: 203160 - DNA, 25 bp, Mus musculus
aggtctatgatatgtttactttgaa

SEQ ID NO: 203161 - DNA, 25 bp, Mus musculus
aggtctattacacgcatctcttcca

SEQ ID NO: 203162 - DNA, 25 bp, Mus musculus
aggtctattacaggcatctcttcca

SEQ ID NO: 203163 - DNA, 25 bp, Mus musculus
aggtctattcctcgctgcacagtcc

SEQ ID NO: 203164 - DNA, 25 bp, Mus musculus
aggtctattcctggctgcacagtcc

SEQ ID NO: 203165 - DNA, 25 bp, Mus musculus
aggtctatttacatcttactttcgg

SEQ ID NO: 203166 - DNA, 25 bp, Mus musculus
aggtctatttacttcttactttcgg

SEQ ID NO: 203167 - DNA, 25 bp, Mus musculus
aggtctatttctactgtagtgcctc

SEQ ID NO: 203168 - DNA, 25 bp, Mus musculus
aggtctatttcttctgtagtgcctc

SEQ ID NO: 203169 - DNA, 25 bp, Mus musculus
aggtctcaatcaatcctggatcact

SEQ ID NO: 203170 - DNA, 25 bp, Mus musculus
aggtctcaatcattcctggatcact

SEQ ID NO: 203171 - DNA, 25 bp, Mus musculus
aggtctcacaaacctgcatcaggat

SEQ ID NO: 203172 - DNA, 25 bp, Mus musculus
aggtctcacaaagctgcatcaggat

SEQ ID NO: 203173 - DNA, 25 bp, Mus musculus
aggtctcacactactagcaactatg

SEQ ID NO: 203174 - DNA, 25 bp, Mus musculus
aggtctcacacttctagcaactatg

SEQ ID NO: 203175 - DNA, 25 bp, Mus musculus
aggtctcaccgcagatgcaaggata

SEQ ID NO: 203176 - DNA, 25 bp, Mus musculus
aggtctcaccgctgatgcaaggata

SEQ ID NO: 203177 - DNA, 25 bp, Mus musculus
aggtctcacgatagcccagacccag

SEQ ID NO: 203178 - DNA, 25 bp, Mus musculus
aggtctcacgattgcccagacccag

SEQ ID NO: 203179 - DNA, 25 bp, Mus musculus
aggtctcactcacctgaagtccttt

SEQ ID NO: 203180 - DNA, 25 bp, Mus musculus
aggtctcactcagctgaagtccttt

SEQ ID NO: 203181 - DNA, 25 bp, Mus musculus
aggtctcactctccaatctgttcag

SEQ ID NO: 203182 - DNA, 25 bp, Mus musculus
aggtctcactctgcaatctgttcag

SEQ ID NO: 203183 - DNA, 25 bp, Mus musculus
aggtctcagacaacccttgtgggaa

SEQ ID NO: 203184 - DNA, 25 bp, Mus musculus
aggtctcagacatcccttgtgggaa

SEQ ID NO: 203185 - DNA, 25 bp, Mus musculus
aggtctcagagaattctaggttcaa

SEQ ID NO: 203186 - DNA, 25 bp, Mus musculus
aggtctcagagatttctaggttcaa

SEQ ID NO: 203187 - DNA, 25 bp, Mus musculus
aggtctcagaggactaacgagttca

SEQ ID NO: 203188 - DNA, 25 bp, Mus musculus
aggtctcagaggtctaacgagttca

SEQ ID NO: 203189 - DNA, 25 bp, Mus musculus
aggtctcagcacactttgataccag

SEQ ID NO: 203190 - DNA, 25 bp, Mus musculus
aggtctcagcactctttgataccag

SEQ ID NO: 203191 - DNA, 25 bp, Mus musculus
aggtctcagcctccctaaaagactg

SEQ ID NO: 203192 - DNA, 25 bp, Mus musculus
aggtctcagcctgcctaaaagactg

SEQ ID NO: 203193 - DNA, 25 bp, Mus musculus
aggtctcagctgacaattctccata

SEQ ID NO: 203194 - DNA, 25 bp, Mus musculus
aggtctcagctgtcaattctccata

SEQ ID NO: 203195 - DNA, 25 bp, Mus musculus
aggtctcaggttacagttgtttaat

SEQ ID NO: 203196 - DNA, 25 bp, Mus musculus
aggtctcaggttagatccttgcaca

SEQ ID NO: 203197 - DNA, 25 bp, Mus musculus
aggtctcaggtttcagttgtttaat

SEQ ID NO: 203198 - DNA, 25 bp, Mus musculus
aggtctcaggtttgatccttgcaca

SEQ ID NO: 203199 - DNA, 25 bp, Mus musculus
aggtctcagtagaggctgcccaaag

SEQ ID NO: 203200 - DNA, 25 bp, Mus musculus
aggtctcagtagcagtgtgtctctc

SEQ ID NO: 203201 - DNA, 25 bp, Mus musculus
aggtctcagtaggagtgtgtctctc

SEQ ID NO: 203202 - DNA, 25 bp, Mus musculus
aggtctcagtagtggctgcccaaag

SEQ ID NO: 203203 - DNA, 25 bp, Mus musculus
aggtctcataacaacaagctgcaat

SEQ ID NO: 203204 - DNA, 25 bp, Mus musculus
aggtctcataactacaagctgcaat

SEQ ID NO: 203205 - DNA, 25 bp, Mus musculus
aggtctcatagtcttcttcctctgg

SEQ ID NO: 203206 - DNA, 25 bp, Mus musculus
aggtctcatagtgttcttcctctgg

SEQ ID NO: 203207 - DNA, 25 bp, Mus musculus
aggtctcatattaattttcacttgt

SEQ ID NO: 203208 - DNA, 25 bp, Mus musculus
aggtctcatatttattttcacttgt

SEQ ID NO: 203209 - DNA, 25 bp, Mus musculus
aggtctcatggtacacacctgttaa

SEQ ID NO: 203210 - DNA, 25 bp, Mus musculus
aggtctcatggttcacacctgttaa

SEQ ID NO: 203211 - DNA, 25 bp, Mus musculus
aggtctcatgtgctgagggctcaca

SEQ ID NO: 203212 - DNA, 25 bp, Mus musculus
aggtctcatgtggtgagggctcaca

SEQ ID NO: 203213 - DNA, 25 bp, Mus musculus
aggtctcattggcaacgtacggatc

SEQ ID NO: 203214 - DNA, 25 bp, Mus musculus
aggtctcattgggaacgtacggatc

SEQ ID NO: 203215 - DNA, 25 bp, Mus musculus
aggtctccaagactcccgctttggt

SEQ ID NO: 203216 - DNA, 25 bp, Mus musculus
aggtctccaagagtcccgctttggt

SEQ ID NO: 203217 - DNA, 25 bp, Mus musculus
aggtctccaagcagattcttttctt

SEQ ID NO: 203218 - DNA, 25 bp, Mus musculus
aggtctccaagcatagggtcttgta

SEQ ID NO: 203219 - DNA, 25 bp, Mus musculus
aggtctccaagctgattcttttctt

SEQ ID NO: 203220 - DNA, 25 bp, Mus musculus
aggtctccaagcttagggtcttgta

SEQ ID NO: 203221 - DNA, 25 bp, Mus musculus
aggtctccaagtacttctgatgcca

SEQ ID NO: 203222 - DNA, 25 bp, Mus musculus
aggtctccaagttcttctgatgcca

SEQ ID NO: 203223 - DNA, 25 bp, Mus musculus
aggtctccacgaaaccagagccgtt

SEQ ID NO: 203224 - DNA, 25 bp, Mus musculus
aggtctccacgataccagagccgtt

SEQ ID NO: 203225 - DNA, 25 bp, Mus musculus
aggtctccagatatctcaaccattc

SEQ ID NO: 203226 - DNA, 25 bp, Mus musculus
aggtctccagatttctcaaccattc

SEQ ID NO: 203227 - DNA, 25 bp, Mus musculus
aggtctccagcaacaacctgaagtc

SEQ ID NO: 203228 - DNA, 25 bp, Mus musculus
aggtctccagcatcaacctgaagtc

SEQ ID NO: 203229 - DNA, 25 bp, Mus musculus
aggtctccagctatgtacatgccgt

SEQ ID NO: 203230 - DNA, 25 bp, Mus musculus
aggtctccagctttgtacatgccgt

SEQ ID NO: 203231 - DNA, 25 bp, Mus musculus
aggtctccaggcatcagtcgggtca

SEQ ID NO: 203232 - DNA, 25 bp, Mus musculus
aggtctccaggcttcagtcgggtca

SEQ ID NO: 203233 - DNA, 25 bp, Mus musculus
aggtctcccattcagcagcgtgaag

SEQ ID NO: 203234 - DNA, 25 bp, Mus musculus
aggtctcccattgagcagcgtgaag

SEQ ID NO: 203235 - DNA, 25 bp, Mus musculus
aggtctcccgctctggtgagaacct

SEQ ID NO: 203236 - DNA, 25 bp, Mus musculus
aggtctcccgctgtggtgagaacct

SEQ ID NO: 203237 - DNA, 25 bp, Mus musculus
aggtctcccggaaatgaatgtattt

SEQ ID NO: 203238 - DNA, 25 bp, Mus musculus
aggtctcccggatatgaatgtattt

SEQ ID NO: 203239 - DNA, 25 bp, Mus musculus
aggtctccctgaaggactgctgttg

SEQ ID NO: 203240 - DNA, 25 bp, Mus musculus
aggtctccctgatggactgctgttg

SEQ ID NO: 203241 - DNA, 25 bp, Mus musculus
aggtctccggctactgtgctttggg

SEQ ID NO: 203242 - DNA, 25 bp, Mus musculus
aggtctccggcttctgtgctttggg

SEQ ID NO: 203243 - DNA, 25 bp, Mus musculus
aggtctcctactacaggccctggat

SEQ ID NO: 203244 - DNA, 25 bp, Mus musculus
aggtctcctacttcaggccctggat

SEQ ID NO: 203245 - DNA, 25 bp, Mus musculus
aggtctcctcacaccggtccagtgg

SEQ ID NO: 203246 - DNA, 25 bp, Mus musculus
aggtctcctcactccggtccagtgg

SEQ ID NO: 203247 - DNA, 25 bp, Mus musculus
aggtctcctcagactacgtgggcag

SEQ ID NO: 203248 - DNA, 25 bp, Mus musculus
aggtctcctcagtctacgtgggcag

SEQ ID NO: 203249 - DNA, 25 bp, Mus musculus
aggtctcctctgcactctattctaa

SEQ ID NO: 203250 - DNA, 25 bp, Mus musculus
aggtctcctctggactctattctaa

SEQ ID NO: 203251 - DNA, 25 bp, Mus musculus
aggtctcctgatcccttatgggaaa

SEQ ID NO: 203252 - DNA, 25 bp, Mus musculus
aggtctcctgatgccttatgggaaa

SEQ ID NO: 203253 - DNA, 25 bp, Mus musculus
aggtctccttggatctgaggctgaa

SEQ ID NO: 203254 - DNA, 25 bp, Mus musculus
aggtctccttggttctgaggctgaa

SEQ ID NO: 203255 - DNA, 25 bp, Mus musculus
aggtctccttgtcaaaccctagaat

SEQ ID NO: 203256 - DNA, 25 bp, Mus musculus
aggtctccttgtgaaaccctagaat

SEQ ID NO: 203257 - DNA, 25 bp, Mus musculus
aggtctcctttcaattctgttgaaa

SEQ ID NO: 203258 - DNA, 25 bp, Mus musculus
aggtctcctttctattctgttgaaa

SEQ ID NO: 203259 - DNA, 25 bp, Mus musculus
aggtctcgaacgcttggcccatagt

SEQ ID NO: 203260 - DNA, 25 bp, Mus musculus
aggtctcgaacggttggcccatagt

SEQ ID NO: 203261 - DNA, 25 bp, Mus musculus
aggtctcgctggcaagcgccatgtt

SEQ ID NO: 203262 - DNA, 25 bp, Mus musculus
aggtctcgctgggaagcgccatgtt

SEQ ID NO: 203263 - DNA, 25 bp, Mus musculus
aggtctcggcaaattacagaactct

SEQ ID NO: 203264 - DNA, 25 bp, Mus musculus
aggtctcggcaatttacagaactct

SEQ ID NO: 203265 - DNA, 25 bp, Mus musculus
aggtctcgtctaactctcaggaaaa

SEQ ID NO: 203266 - DNA, 25 bp, Mus musculus
aggtctcgtctatctctcaggaaaa

SEQ ID NO: 203267 - DNA, 25 bp, Mus musculus
aggtctctagctataatgtaattac

SEQ ID NO: 203268 - DNA, 25 bp, Mus musculus
aggtctctagctttaatgtaattac

SEQ ID NO: 203269 - DNA, 25 bp, Mus musculus
aggtctctagtcatcggagcctctc

SEQ ID NO: 203270 - DNA, 25 bp, Mus musculus
aggtctctagtcttcggagcctctc

SEQ ID NO: 203271 - DNA, 25 bp, Mus musculus
aggtctctagtgagccctggaaatt

SEQ ID NO: 203272 - DNA, 25 bp, Mus musculus
aggtctctagtgtgccctggaaatt

SEQ ID NO: 203273 - DNA, 25 bp, Mus musculus
aggtctctatatcttccacttcgga

SEQ ID NO: 203274 - DNA, 25 bp, Mus musculus
aggtctctatatgttccacttcgga

SEQ ID NO: 203275 - DNA, 25 bp, Mus musculus
aggtctctatgcagactggtggcaa

SEQ ID NO: 203276 - DNA, 25 bp, Mus musculus
aggtctctatgctgactggtggcaa

SEQ ID NO: 203277 - DNA, 25 bp, Mus musculus
aggtctctcattaccacatttccat

SEQ ID NO: 203278 - DNA, 25 bp, Mus musculus
aggtctctcatttccacatttccat

SEQ ID NO: 203279 - DNA, 25 bp, Mus musculus
aggtctctctacaaccggtgcagaa

SEQ ID NO: 203280 - DNA, 25 bp, Mus musculus
aggtctctctactaccggtgcagaa

SEQ ID NO: 203281 - DNA, 25 bp, Mus musculus
aggtctctctagcttgaacgctgag

SEQ ID NO: 203282 - DNA, 25 bp, Mus musculus
aggtctctctaggttgaacgctgag

SEQ ID NO: 203283 - DNA, 25 bp, Mus musculus
aggtctctctccagaggacaatgac

SEQ ID NO: 203284 - DNA, 25 bp, Mus musculus
aggtctctctcctgaggacaatgac

SEQ ID NO: 203285 - DNA, 25 bp, Mus musculus
aggtctctgaatcggtctgctggct

SEQ ID NO: 203286 - DNA, 25 bp, Mus musculus
aggtctctgaatgggtctgctggct

SEQ ID NO: 203287 - DNA, 25 bp, Mus musculus
aggtctctgagtcattccaattctt

SEQ ID NO: 203288 - DNA, 25 bp, Mus musculus
aggtctctgagtgattccaattctt

SEQ ID NO: 203289 - DNA, 25 bp, Mus musculus
aggtctctgatgcttctagcctgaa

SEQ ID NO: 203290 - DNA, 25 bp, Mus musculus
aggtctctgatggttctagcctgaa

SEQ ID NO: 203291 - DNA, 25 bp, Mus musculus
aggtctctgcacctgtgtcagccgc

SEQ ID NO: 203292 - DNA, 25 bp, Mus musculus
aggtctctgcacgtgtgtcagccgc

SEQ ID NO: 203293 - DNA, 25 bp, Mus musculus
aggtctctggcactgttacacagta

SEQ ID NO: 203294 - DNA, 25 bp, Mus musculus
aggtctctggcagtgttacacagta

SEQ ID NO: 203295 - DNA, 25 bp, Mus musculus
aggtctctggctcaactttgtccta

SEQ ID NO: 203296 - DNA, 25 bp, Mus musculus
aggtctctggctgaactttgtccta

SEQ ID NO: 203297 - DNA, 25 bp, Mus musculus
aggtctctgttgcttccctagaaat

SEQ ID NO: 203298 - DNA, 25 bp, Mus musculus
aggtctctgttggttccctagaaat

SEQ ID NO: 203299 - DNA, 25 bp, Mus musculus
aggtctcttaacactttctgtattt

SEQ ID NO: 203300 - DNA, 25 bp, Mus musculus
aggtctcttaactctttctgtattt

SEQ ID NO: 203301 - DNA, 25 bp, Mus musculus
aggtctcttaccatttgtcagcagc

SEQ ID NO: 203302 - DNA, 25 bp, Mus musculus
aggtctcttaccttttgtcagcagc

SEQ ID NO: 203303 - DNA, 25 bp, Mus musculus
aggtctcttcaaatcaccggcatga

SEQ ID NO: 203304 - DNA, 25 bp, Mus musculus
aggtctcttcaattcaccggcatga

SEQ ID NO: 203305 - DNA, 25 bp, Mus musculus
aggtctcttcctactaagtactagt

SEQ ID NO: 203306 - DNA, 25 bp, Mus musculus
aggtctcttccttctaagtactagt

SEQ ID NO: 203307 - DNA, 25 bp, Mus musculus
aggtctcttctcataggacagggtt

SEQ ID NO: 203308 - DNA, 25 bp, Mus musculus
aggtctcttctcttaggacagggtt

SEQ ID NO: 203309 - DNA, 25 bp, Mus musculus
aggtctcttctgcattaacttgcca

SEQ ID NO: 203310 - DNA, 25 bp, Mus musculus
aggtctcttctggattaacttgcca

SEQ ID NO: 203311 - DNA, 25 bp, Mus musculus
aggtctcttgagcttttgtgtcatg

SEQ ID NO: 203312 - DNA, 25 bp, Mus musculus
aggtctcttgaggttttgtgtcatg

SEQ ID NO: 203313 - DNA, 25 bp, Mus musculus
aggtctctttctaagactgggaagg

SEQ ID NO: 203314 - DNA, 25 bp, Mus musculus
aggtctctttcttagactgggaagg

SEQ ID NO: 203315 - DNA, 25 bp, Mus musculus
aggtctcttttaacatgtcttggct

SEQ ID NO: 203316 - DNA, 25 bp, Mus musculus
aggtctcttttatcatgtcttggct

SEQ ID NO: 203317 - DNA, 25 bp, Mus musculus
aggtctcttttcatatgatggcaaa

SEQ ID NO: 203318 - DNA, 25 bp, Mus musculus
aggtctcttttcttatgatggcaaa

SEQ ID NO: 203319 - DNA, 25 bp, Mus musculus
aggtctgaaagactcatcccaggct

SEQ ID NO: 203320 - DNA, 25 bp, Mus musculus
aggtctgaaagagtcatcccaggct

SEQ ID NO: 203321 - DNA, 25 bp, Mus musculus
aggtctgaagacagtgttcgacgag

SEQ ID NO: 203322 - DNA, 25 bp, Mus musculus
aggtctgaagactgtgttcgacgag

SEQ ID NO: 203323 - DNA, 25 bp, Mus musculus
aggtctgacaacactttcagcttct

SEQ ID NO: 203324 - DNA, 25 bp, Mus musculus
aggtctgacaactctttcagcttct

SEQ ID NO: 203325 - DNA, 25 bp, Mus musculus
aggtctgaccgacagcattatggaa

SEQ ID NO: 203326 - DNA, 25 bp, Mus musculus
aggtctgaccgagagcattatggaa

SEQ ID NO: 203327 - DNA, 25 bp, Mus musculus
aggtctgacgagcttgctgtcctga

SEQ ID NO: 203328 - DNA, 25 bp, Mus musculus
aggtctgacgaggttgctgtcctga

SEQ ID NO: 203329 - DNA, 25 bp, Mus musculus
aggtctgacgttcatttgtatgtct

SEQ ID NO: 203330 - DNA, 25 bp, Mus musculus
aggtctgacgttccattacagctct

SEQ ID NO: 203331 - DNA, 25 bp, Mus musculus
aggtctgacgttgatttgtatgtct

SEQ ID NO: 203332 - DNA, 25 bp, Mus musculus
aggtctgacgttgcattacagctct

SEQ ID NO: 203333 - DNA, 25 bp, Mus musculus
aggtctgagaccatctgccttcaca

SEQ ID NO: 203334 - DNA, 25 bp, Mus musculus
aggtctgagaccttctgccttcaca

SEQ ID NO: 203335 - DNA, 25 bp, Mus musculus
aggtctgagactagctattttctag

SEQ ID NO: 203336 - DNA, 25 bp, Mus musculus
aggtctgagacttgctattttctag

SEQ ID NO: 203337 - DNA, 25 bp, Mus musculus
aggtctgaggttactgtgctgagca

SEQ ID NO: 203338 - DNA, 25 bp, Mus musculus
aggtctgaggtttctgtgctgagca

SEQ ID NO: 203339 - DNA, 25 bp, Mus musculus
aggtctgagtacatcctggctctag

SEQ ID NO: 203340 - DNA, 25 bp, Mus musculus
aggtctgagtacttcctggctctag

SEQ ID NO: 203341 - DNA, 25 bp, Mus musculus
aggtctgagttcacatctcagtcag

SEQ ID NO: 203342 - DNA, 25 bp, Mus musculus
aggtctgagttctcatctcagtcag

SEQ ID NO: 203343 - DNA, 25 bp, Mus musculus
aggtctgatcatcacatcttcttac

SEQ ID NO: 203344 - DNA, 25 bp, Mus musculus
aggtctgatcatgacatcttcttac

SEQ ID NO: 203345 - DNA, 25 bp, Mus musculus
aggtctgatcgaacacttccagaag

SEQ ID NO: 203346 - DNA, 25 bp, Mus musculus
aggtctgatcgatcacttccagaag

SEQ ID NO: 203347 - DNA, 25 bp, Mus musculus
aggtctgatgacctaccctaaccct

SEQ ID NO: 203348 - DNA, 25 bp, Mus musculus
aggtctgatgacgtaccctaaccct

SEQ ID NO: 203349 - DNA, 25 bp, Mus musculus
aggtctgattagctactgctgctgt

SEQ ID NO: 203350 - DNA, 25 bp, Mus musculus
aggtctgattaggtactgctgctgt

SEQ ID NO: 203351 - DNA, 25 bp, Mus musculus
aggtctgcaagcaagagtcttcact

SEQ ID NO: 203352 - DNA, 25 bp, Mus musculus
aggtctgcaagctagagtcttcact

SEQ ID NO: 203353 - DNA, 25 bp, Mus musculus
aggtctgcaaggcagaacggcttta

SEQ ID NO: 203354 - DNA, 25 bp, Mus musculus
aggtctgcaagggagaacggcttta

SEQ ID NO: 203355 - DNA, 25 bp, Mus musculus
aggtctgcacacattaactacttct

SEQ ID NO: 203356 - DNA, 25 bp, Mus musculus
aggtctgcacactttaactacttct

SEQ ID NO: 203357 - DNA, 25 bp, Mus musculus
aggtctgcacgtagtctccttggga

SEQ ID NO: 203358 - DNA, 25 bp, Mus musculus
aggtctgcacgttgtctccttggga

SEQ ID NO: 203359 - DNA, 25 bp, Mus musculus
aggtctgcactactacaccttgcat

SEQ ID NO: 203360 - DNA, 25 bp, Mus musculus
aggtctgcactagtacaccttgcat

SEQ ID NO: 203361 - DNA, 25 bp, Mus musculus
aggtctgcagccaccaggctgtggc

SEQ ID NO: 203362 - DNA, 25 bp, Mus musculus
aggtctgcagccaggagtcttcact

SEQ ID NO: 203363 - DNA, 25 bp, Mus musculus
aggtctgcagcctccaggctgtggc

SEQ ID NO: 203364 - DNA, 25 bp, Mus musculus
aggtctgcagcctggagtcttcact

SEQ ID NO: 203365 - DNA, 25 bp, Mus musculus
aggtctgcagcgctgttgctataga

SEQ ID NO: 203366 - DNA, 25 bp, Mus musculus
aggtctgcagcggtgttgctataga

SEQ ID NO: 203367 - DNA, 25 bp, Mus musculus
aggtctgcaggtagacagccatcag

SEQ ID NO: 203368 - DNA, 25 bp, Mus musculus
aggtctgcaggttgacagccatcag

SEQ ID NO: 203369 - DNA, 25 bp, Mus musculus
aggtctgcattcctcaaggtgaagc

SEQ ID NO: 203370 - DNA, 25 bp, Mus musculus
aggtctgcattcgtcaaggtgaagc

SEQ ID NO: 203371 - DNA, 25 bp, Mus musculus
aggtctgccgcaacagtctgttaga

SEQ ID NO: 203372 - DNA, 25 bp, Mus musculus
aggtctgccgcatcagtctgttaga

SEQ ID NO: 203373 - DNA, 25 bp, Mus musculus
aggtctgcgtggacatgtaccatca

SEQ ID NO: 203374 - DNA, 25 bp, Mus musculus
aggtctgcgtggtcatgtaccatca

SEQ ID NO: 203375 - DNA, 25 bp, Mus musculus
aggtctgctaagctggtctacgtca

SEQ ID NO: 203376 - DNA, 25 bp, Mus musculus
aggtctgctaaggtggtctacgtca

SEQ ID NO: 203377 - DNA, 25 bp, Mus musculus
aggtctgctatgactcaagctggga

SEQ ID NO: 203378 - DNA, 25 bp, Mus musculus
aggtctgctatgtctcaagctggga

SEQ ID NO: 203379 - DNA, 25 bp, Mus musculus
aggtctgctcagcatgagactccca

SEQ ID NO: 203380 - DNA, 25 bp, Mus musculus
aggtctgctcaggatgagactccca

SEQ ID NO: 203381 - DNA, 25 bp, Mus musculus
aggtctgctcttcatactgttacta

SEQ ID NO: 203382 - DNA, 25 bp, Mus musculus
aggtctgctcttccatacagtcata

SEQ ID NO: 203383 - DNA, 25 bp, Mus musculus
aggtctgctcttgatactgttacta

SEQ ID NO: 203384 - DNA, 25 bp, Mus musculus
aggtctgctcttgcatacagtcata

SEQ ID NO: 203385 - DNA, 25 bp, Mus musculus
aggtctgctggaacaacgaaaccaa

SEQ ID NO: 203386 - DNA, 25 bp, Mus musculus
aggtctgctggatcaacgaaaccaa

SEQ ID NO: 203387 - DNA, 25 bp, Mus musculus
aggtctggagcacagccttttggac

SEQ ID NO: 203388 - DNA, 25 bp, Mus musculus
aggtctggagcagagccttttggac

SEQ ID NO: 203389 - DNA, 25 bp, Mus musculus
aggtctggagctcatgttgtgtctc

SEQ ID NO: 203390 - DNA, 25 bp, Mus musculus
aggtctggagctgatgttgtgtctc

SEQ ID NO: 203391 - DNA, 25 bp, Mus musculus
aggtctggatcaattggggcagatc

SEQ ID NO: 203392 - DNA, 25 bp, Mus musculus
aggtctggatcatttggggcagatc

SEQ ID NO: 203393 - DNA, 25 bp, Mus musculus
aggtctggatctagtgacctgtgac

SEQ ID NO: 203394 - DNA, 25 bp, Mus musculus
aggtctggatcttgtgacctgtgac

SEQ ID NO: 203395 - DNA, 25 bp, Mus musculus
aggtctggatggatctggtttgtgt

SEQ ID NO: 203396 - DNA, 25 bp, Mus musculus
aggtctggatggttctggtttgtgt

SEQ ID NO: 203397 - DNA, 25 bp, Mus musculus
aggtctggcattactgcccattaga

SEQ ID NO: 203398 - DNA, 25 bp, Mus musculus
aggtctggcatttctgcccattaga

SEQ ID NO: 203399 - DNA, 25 bp, Mus musculus
aggtctggccagcaagctcaaatga

SEQ ID NO: 203400 - DNA, 25 bp, Mus musculus
aggtctggccaggaagctcaaatga

SEQ ID NO: 203401 - DNA, 25 bp, Mus musculus
aggtctggccttcgatgattgaaga

SEQ ID NO: 203402 - DNA, 25 bp, Mus musculus
aggtctggccttggatgattgaaga

SEQ ID NO: 203403 - DNA, 25 bp, Mus musculus
aggtctggctcaactgtgttttcat

SEQ ID NO: 203404 - DNA, 25 bp, Mus musculus
aggtctggctcatctgtgttttcat

SEQ ID NO: 203405 - DNA, 25 bp, Mus musculus
aggtctggcttgagctaagttctgc

SEQ ID NO: 203406 - DNA, 25 bp, Mus musculus
aggtctggcttgtgctaagttctgc

SEQ ID NO: 203407 - DNA, 25 bp, Mus musculus
aggtctgggaagcatggacttcttt

SEQ ID NO: 203408 - DNA, 25 bp, Mus musculus
aggtctgggaaggatggacttcttt

SEQ ID NO: 203409 - DNA, 25 bp, Mus musculus
aggtctgggactcgatggccactcc

SEQ ID NO: 203410 - DNA, 25 bp, Mus musculus
aggtctgggactggatggccactcc

SEQ ID NO: 203411 - DNA, 25 bp, Mus musculus
aggtctgggcagcatgctcgtgagt

SEQ ID NO: 203412 - DNA, 25 bp, Mus musculus
aggtctgggcaggatgctcgtgagt

SEQ ID NO: 203413 - DNA, 25 bp, Mus musculus
aggtctgggccacaaccctgtgcag

SEQ ID NO: 203414 - DNA, 25 bp, Mus musculus
aggtctgggccagaaccctgtgcag

SEQ ID NO: 203415 - DNA, 25 bp, Mus musculus
aggtctggtattcacaatgcacaaa

SEQ ID NO: 203416 - DNA, 25 bp, Mus musculus
aggtctggtattgacaatgcacaaa

SEQ ID NO: 203417 - DNA, 25 bp, Mus musculus
aggtctggtctgagcagccggacat

SEQ ID NO: 203418 - DNA, 25 bp, Mus musculus
aggtctggtctgtgcagccggacat

SEQ ID NO: 203419 - DNA, 25 bp, Mus musculus
aggtctggtgaaagccacccagcgg

SEQ ID NO: 203420 - DNA, 25 bp, Mus musculus
aggtctggtgaatgccacccagcgg

SEQ ID NO: 203421 - DNA, 25 bp, Mus musculus
aggtctggtgctcaatatgtctcac

SEQ ID NO: 203422 - DNA, 25 bp, Mus musculus
aggtctggtgctgaatatgtctcac

SEQ ID NO: 203423 - DNA, 25 bp, Mus musculus
aggtctggttctaccctgtggagac

SEQ ID NO: 203424 - DNA, 25 bp, Mus musculus
aggtctggttcttccctgtggagac

SEQ ID NO: 203425 - DNA, 25 bp, Mus musculus
aggtctggttgaatgacgtcagtca

SEQ ID NO: 203426 - DNA, 25 bp, Mus musculus
aggtctggttgattgacgtcagtca

SEQ ID NO: 203427 - DNA, 25 bp, Mus musculus
aggtctggttggcagaacccacagt

SEQ ID NO: 203428 - DNA, 25 bp, Mus musculus
aggtctggttgggagaacccacagt

SEQ ID NO: 203429 - DNA, 25 bp, Mus musculus
aggtctgtcatacacagccagctgg

SEQ ID NO: 203430 - DNA, 25 bp, Mus musculus
aggtctgtcatagacagccagctgg

SEQ ID NO: 203431 - DNA, 25 bp, Mus musculus
aggtctgtcatgctcaatcacttaa

SEQ ID NO: 203432 - DNA, 25 bp, Mus musculus
aggtctgtcatggtcaatcacttaa

SEQ ID NO: 203433 - DNA, 25 bp, Mus musculus
aggtctgtccatctatgttttcaca

SEQ ID NO: 203434 - DNA, 25 bp, Mus musculus
aggtctgtccatgtatgttttcaca

SEQ ID NO: 203435 - DNA, 25 bp, Mus musculus
aggtctgtctgtatcctggtgcagg

SEQ ID NO: 203436 - DNA, 25 bp, Mus musculus
aggtctgtctgtttcctggtgcagg

SEQ ID NO: 203437 - DNA, 25 bp, Mus musculus
aggtctgtcttgatttcggtactaa

SEQ ID NO: 203438 - DNA, 25 bp, Mus musculus
aggtctgtcttgttttcggtactaa

SEQ ID NO: 203439 - DNA, 25 bp, Mus musculus
aggtctgtgagcagctgcttgttct

SEQ ID NO: 203440 - DNA, 25 bp, Mus musculus
aggtctgtgagctgctgcttgttct

SEQ ID NO: 203441 - DNA, 25 bp, Mus musculus
aggtctgtgagtccctatagccgga

SEQ ID NO: 203442 - DNA, 25 bp, Mus musculus
aggtctgtgagtgcctatagccgga

SEQ ID NO: 203443 - DNA, 25 bp, Mus musculus
aggtctgtgcacacagcaggcaaaa

SEQ ID NO: 203444 - DNA, 25 bp, Mus musculus
aggtctgtgcactcagcaggcaaaa

SEQ ID NO: 203445 - DNA, 25 bp, Mus musculus
aggtctgtggacatcctacagctgc

SEQ ID NO: 203446 - DNA, 25 bp, Mus musculus
aggtctgtggacttcctacagctgc

SEQ ID NO: 203447 - DNA, 25 bp, Mus musculus
aggtctgtggccctgctaactgagt

SEQ ID NO: 203448 - DNA, 25 bp, Mus musculus
aggtctgtggccgtgctaactgagt

SEQ ID NO: 203449 - DNA, 25 bp, Mus musculus
aggtctgtgtggctccaaagctcta

SEQ ID NO: 203450 - DNA, 25 bp, Mus musculus
aggtctgtgtgggtccaaagctcta

SEQ ID NO: 203451 - DNA, 25 bp, Mus musculus
aggtctgtgttgagtagctctagcc

SEQ ID NO: 203452 - DNA, 25 bp, Mus musculus
aggtctgtgttgtgtagctctagcc

SEQ ID NO: 203453 - DNA, 25 bp, Mus musculus
aggtctgtttttactggagcagtca

SEQ ID NO: 203454 - DNA, 25 bp, Mus musculus
aggtctgttttttctggagcagtca

SEQ ID NO: 203455 - DNA, 25 bp, Mus musculus
aggtcttaacacaacggtgccttcg

SEQ ID NO: 203456 - DNA, 25 bp, Mus musculus
aggtcttaacactacggtgccttcg

SEQ ID NO: 203457 - DNA, 25 bp, Mus musculus
aggtcttaccgacagggatggctcc

SEQ ID NO: 203458 - DNA, 25 bp, Mus musculus
aggtcttaccgagagggatggctcc

SEQ ID NO: 203459 - DNA, 25 bp, Mus musculus
aggtcttacctgcttgtggttcatt

SEQ ID NO: 203460 - DNA, 25 bp, Mus musculus
aggtcttacctggttgtggttcatt

SEQ ID NO: 203461 - DNA, 25 bp, Mus musculus
aggtcttagcgtaggcagagcttct

SEQ ID NO: 203462 - DNA, 25 bp, Mus musculus
aggtcttagcgttggcagagcttct

SEQ ID NO: 203463 - DNA, 25 bp, Mus musculus
aggtcttaggccaagtagtcctgac

SEQ ID NO: 203464 - DNA, 25 bp, Mus musculus
aggtcttaggcctagtagtcctgac

SEQ ID NO: 203465 - DNA, 25 bp, Mus musculus
aggtcttagtcaatcttttctcaaa

SEQ ID NO: 203466 - DNA, 25 bp, Mus musculus
aggtcttagtcattcttttctcaaa

SEQ ID NO: 203467 - DNA, 25 bp, Mus musculus
aggtcttatcggacgtccgcaagcg

SEQ ID NO: 203468 - DNA, 25 bp, Mus musculus
aggtcttatcggtcgtccgcaagcg

SEQ ID NO: 203469 - DNA, 25 bp, Mus musculus
aggtcttatgatctgcgcctgaccc

SEQ ID NO: 203470 - DNA, 25 bp, Mus musculus
aggtcttatgatgtgcgcctgaccc

SEQ ID NO: 203471 - DNA, 25 bp, Mus musculus
aggtcttatgtccaatcaggctcaa

SEQ ID NO: 203472 - DNA, 25 bp, Mus musculus
aggtcttatgtcgaatcaggctcaa

SEQ ID NO: 203473 - DNA, 25 bp, Mus musculus
aggtcttcaaagagctcaggcgtct

SEQ ID NO: 203474 - DNA, 25 bp, Mus musculus
aggtcttcaaagtgctcaggcgtct

SEQ ID NO: 203475 - DNA, 25 bp, Mus musculus
aggtcttcaaatacgagtatgtttc

SEQ ID NO: 203476 - DNA, 25 bp, Mus musculus
aggtcttcaaattcgagtatgtttc

SEQ ID NO: 203477 - DNA, 25 bp, Mus musculus
aggtcttcaaggctctagtctgcag

SEQ ID NO: 203478 - DNA, 25 bp, Mus musculus
aggtcttcaagggtctagtctgcag

SEQ ID NO: 203479 - DNA, 25 bp, Mus musculus
aggtcttcacacaagccctggagtg

SEQ ID NO: 203480 - DNA, 25 bp, Mus musculus
aggtcttcacactagccctggagtg

SEQ ID NO: 203481 - DNA, 25 bp, Mus musculus
aggtcttcagctaccagtctccgga

SEQ ID NO: 203482 - DNA, 25 bp, Mus musculus
aggtcttcagcttccagtctccgga

SEQ ID NO: 203483 - DNA, 25 bp, Mus musculus
aggtcttcatgaatactttctatag

SEQ ID NO: 203484 - DNA, 25 bp, Mus musculus
aggtcttcatgattactttctatag

SEQ ID NO: 203485 - DNA, 25 bp, Mus musculus
aggtcttcatgcagtcgctgacatc

SEQ ID NO: 203486 - DNA, 25 bp, Mus musculus
aggtcttcatgctgtcgctgacatc

SEQ ID NO: 203487 - DNA, 25 bp, Mus musculus
aggtcttccgtcagctatgctgcag

SEQ ID NO: 203488 - DNA, 25 bp, Mus musculus
aggtcttccgtctgctatgctgcag

SEQ ID NO: 203489 - DNA, 25 bp, Mus musculus
aggtcttcctggaggcaaatgagct

SEQ ID NO: 203490 - DNA, 25 bp, Mus musculus
aggtcttcctggctatccaagaact

SEQ ID NO: 203491 - DNA, 25 bp, Mus musculus
aggtcttcctgggtatccaagaact

SEQ ID NO: 203492 - DNA, 25 bp, Mus musculus
aggtcttcctggtggcaaatgagct

SEQ ID NO: 203493 - DNA, 25 bp, Mus musculus
aggtcttccttactgatatcattga

SEQ ID NO: 203494 - DNA, 25 bp, Mus musculus
aggtcttccttagtgatatcattga

SEQ ID NO: 203495 - DNA, 25 bp, Mus musculus
aggtcttctaaaactgtctcatatg

SEQ ID NO: 203496 - DNA, 25 bp, Mus musculus
aggtcttctaaatctgtctcatatg

SEQ ID NO: 203497 - DNA, 25 bp, Mus musculus
aggtcttctcaaccagagggacaac

SEQ ID NO: 203498 - DNA, 25 bp, Mus musculus
aggtcttctcaagcagagggacaac

SEQ ID NO: 203499 - DNA, 25 bp, Mus musculus
aggtcttctctgaataacacctcgg

SEQ ID NO: 203500 - DNA, 25 bp, Mus musculus
aggtcttctctgtataacacctcgg

SEQ ID NO: 203501 - DNA, 25 bp, Mus musculus
aggtcttctggactcactcctaatt

SEQ ID NO: 203502 - DNA, 25 bp, Mus musculus
aggtcttctggagtcactcctaatt

SEQ ID NO: 203503 - DNA, 25 bp, Mus musculus
aggtcttctgtgaataagcatttac

SEQ ID NO: 203504 - DNA, 25 bp, Mus musculus
aggtcttctgtgtataagcatttac

SEQ ID NO: 203505 - DNA, 25 bp, Mus musculus
aggtcttgatctatggaatgcatgc

SEQ ID NO: 203506 - DNA, 25 bp, Mus musculus
aggtcttgatctttggaatgcatgc

SEQ ID NO: 203507 - DNA, 25 bp, Mus musculus
aggtcttgcactcgtgtccacaggt

SEQ ID NO: 203508 - DNA, 25 bp, Mus musculus
aggtcttgcactggtgtccacaggt

SEQ ID NO: 203509 - DNA, 25 bp, Mus musculus
aggtcttgcatgagtcccttatgcc

SEQ ID NO: 203510 - DNA, 25 bp, Mus musculus
aggtcttgcatgtgtcccttatgcc

SEQ ID NO: 203511 - DNA, 25 bp, Mus musculus
aggtcttggactatgctcagcaata

SEQ ID NO: 203512 - DNA, 25 bp, Mus musculus
aggtcttggactttgctcagcaata

SEQ ID NO: 203513 - DNA, 25 bp, Mus musculus
aggtcttggcacaaatgctttggct

SEQ ID NO: 203514 - DNA, 25 bp, Mus musculus
aggtcttggcactaatgctttggct

SEQ ID NO: 203515 - DNA, 25 bp, Mus musculus
aggtcttggcttattcccatgcaaa

SEQ ID NO: 203516 - DNA, 25 bp, Mus musculus
aggtcttggctttttcccatgcaaa

SEQ ID NO: 203517 - DNA, 25 bp, Mus musculus
aggtcttgggccactcaaactcaag

SEQ ID NO: 203518 - DNA, 25 bp, Mus musculus
aggtcttgggcctctcaaactcaag

SEQ ID NO: 203519 - DNA, 25 bp, Mus musculus
aggtcttgggctcgtcacatggaat

SEQ ID NO: 203520 - DNA, 25 bp, Mus musculus
aggtcttgggctggtcacatggaat

SEQ ID NO: 203521 - DNA, 25 bp, Mus musculus
aggtcttggtttctacgtctgcaaa

SEQ ID NO: 203522 - DNA, 25 bp, Mus musculus
aggtcttggtttgtacgtctgcaaa

SEQ ID NO: 203523 - DNA, 25 bp, Mus musculus
aggtcttgtcagactttttctggtt

SEQ ID NO: 203524 - DNA, 25 bp, Mus musculus
aggtcttgtcagtctttttctggtt

SEQ ID NO: 203525 - DNA, 25 bp, Mus musculus
aggtcttgtcttctgcatgctagga

SEQ ID NO: 203526 - DNA, 25 bp, Mus musculus
aggtcttgtcttgtgcatgctagga

SEQ ID NO: 203527 - DNA, 25 bp, Mus musculus
aggtcttgtgagcttctggaatatt

SEQ ID NO: 203528 - DNA, 25 bp, Mus musculus
aggtcttgtgaggttctggaatatt

SEQ ID NO: 203529 - DNA, 25 bp, Mus musculus
aggtcttgtgcaactctgagattct

SEQ ID NO: 203530 - DNA, 25 bp, Mus musculus
aggtcttgtgcatctctgagattct

SEQ ID NO: 203531 - DNA, 25 bp, Mus musculus
aggtcttgtgttatgcctgcaattt

SEQ ID NO: 203532 - DNA, 25 bp, Mus musculus
aggtcttgtgttttgcctgcaattt

SEQ ID NO: 203533 - DNA, 25 bp, Mus musculus
aggtctttacttaggagcaggtccg

SEQ ID NO: 203534 - DNA, 25 bp, Mus musculus
aggtctttactttggagcaggtccg

SEQ ID NO: 203535 - DNA, 25 bp, Mus musculus
aggtctttatctactaagcaagcat

SEQ ID NO: 203536 - DNA, 25 bp, Mus musculus
aggtctttatcttctaagcaagcat

SEQ ID NO: 203537 - DNA, 25 bp, Mus musculus
aggtctttcagaccacagtgtcccg

SEQ ID NO: 203538 - DNA, 25 bp, Mus musculus
aggtctttcagagcacagtgtcccg

SEQ ID NO: 203539 - DNA, 25 bp, Mus musculus
aggtctttccatagcactttgtatt

SEQ ID NO: 203540 - DNA, 25 bp, Mus musculus
aggtctttccatccagggtctgtga

SEQ ID NO: 203541 - DNA, 25 bp, Mus musculus
aggtctttccatgcagggtctgtga

SEQ ID NO: 203542 - DNA, 25 bp, Mus musculus
aggtctttccattgcactttgtatt

SEQ ID NO: 203543 - DNA, 25 bp, Mus musculus
aggtctttcccaattgtgctgatca

SEQ ID NO: 203544 - DNA, 25 bp, Mus musculus
aggtctttcccatttgtgctgatca

SEQ ID NO: 203545 - DNA, 25 bp, Mus musculus
aggtctttctccctgtgaatggcag

SEQ ID NO: 203546 - DNA, 25 bp, Mus musculus
aggtctttctccgtgtgaatggcag

SEQ ID NO: 203547 - DNA, 25 bp, Mus musculus
aggtctttctggatatagtcttttc

SEQ ID NO: 203548 - DNA, 25 bp, Mus musculus
aggtctttctggttatagtcttttc

SEQ ID NO: 203549 - DNA, 25 bp, Mus musculus
aggtctttcttgctgcttgctaaac

SEQ ID NO: 203550 - DNA, 25 bp, Mus musculus
aggtctttcttggtgcttgctaaac

SEQ ID NO: 203551 - DNA, 25 bp, Mus musculus
aggtctttgactatgaggtgagcag

SEQ ID NO: 203552 - DNA, 25 bp, Mus musculus
aggtctttgactttgaggtgagcag

SEQ ID NO: 203553 - DNA, 25 bp, Mus musculus
aggtctttgcccctaatgtgctatg

SEQ ID NO: 203554 - DNA, 25 bp, Mus musculus
aggtctttgcccgtaatgtgctatg

SEQ ID NO: 203555 - DNA, 25 bp, Mus musculus
aggtctttgcggagtgcctcagtga

SEQ ID NO: 203556 - DNA, 25 bp, Mus musculus
aggtctttgcggtgtgcctcagtga

SEQ ID NO: 203557 - DNA, 25 bp, Mus musculus
aggtctttgtacagagtctggcttc

SEQ ID NO: 203558 - DNA, 25 bp, Mus musculus
aggtctttgtactgagtctggcttc

SEQ ID NO: 203559 - DNA, 25 bp, Mus musculus
aggtctttgtgcctctggaattaaa

SEQ ID NO: 203560 - DNA, 25 bp, Mus musculus
aggtctttgtgcgtctggaattaaa

SEQ ID NO: 203561 - DNA, 25 bp, Mus musculus
aggtctttgtggctattgatctttc

SEQ ID NO: 203562 - DNA, 25 bp, Mus musculus
aggtctttgtgggtattgatctttc

SEQ ID NO: 203563 - DNA, 25 bp, Mus musculus
aggtcttttgacatgctgatccagc

SEQ ID NO: 203564 - DNA, 25 bp, Mus musculus
aggtcttttgacttgctgatccagc

SEQ ID NO: 203565 - DNA, 25 bp, Mus musculus
aggtctttttgtaacaccctggatg

SEQ ID NO: 203566 - DNA, 25 bp, Mus musculus
aggtctttttgttacaccctggatg

SEQ ID NO: 203567 - DNA, 25 bp, Mus musculus
aggtgaaacgcacgaattccactcc

SEQ ID NO: 203568 - DNA, 25 bp, Mus musculus
aggtgaaacgcaggaattccactcc

SEQ ID NO: 203569 - DNA, 25 bp, Mus musculus
aggtgaaactcaacagcatcagctt

SEQ ID NO: 203570 - DNA, 25 bp, Mus musculus
aggtgaaactcaaccggagtcccgc

SEQ ID NO: 203571 - DNA, 25 bp, Mus musculus
aggtgaaactcatcagcatcagctt

SEQ ID NO: 203572 - DNA, 25 bp, Mus musculus
aggtgaaactcatccggagtcccgc

SEQ ID NO: 203573 - DNA, 25 bp, Mus musculus
aggtgaaacttcatcagtccctggg

SEQ ID NO: 203574 - DNA, 25 bp, Mus musculus
aggtgaaacttcttcagtccctggg

SEQ ID NO: 203575 - DNA, 25 bp, Mus musculus
aggtgaaagagtccctccgcagcat

SEQ ID NO: 203576 - DNA, 25 bp, Mus musculus
aggtgaaagagtgcctccgcagcat

SEQ ID NO: 203577 - DNA, 25 bp, Mus musculus
aggtgaaagcacactgtccatggtt

SEQ ID NO: 203578 - DNA, 25 bp, Mus musculus
aggtgaaagcacagcccgggccaga

SEQ ID NO: 203579 - DNA, 25 bp, Mus musculus
aggtgaaagcactctgtccatggtt

SEQ ID NO: 203580 - DNA, 25 bp, Mus musculus
aggtgaaagcactgcccgggccaga

SEQ ID NO: 203581 - DNA, 25 bp, Mus musculus
aggtgaaagggtatggctctactga

SEQ ID NO: 203582 - DNA, 25 bp, Mus musculus
aggtgaaagggtttggctctactga

SEQ ID NO: 203583 - DNA, 25 bp, Mus musculus
aggtgaaattctaggaccggcgcaa

SEQ ID NO: 203584 - DNA, 25 bp, Mus musculus
aggtgaaattcttggaccggcgcaa

SEQ ID NO: 203585 - DNA, 25 bp, Mus musculus
aggtgaacacgcaccgacgttacaa

SEQ ID NO: 203586 - DNA, 25 bp, Mus musculus
aggtgaacacgctccgacgttacaa

SEQ ID NO: 203587 - DNA, 25 bp, Mus musculus
aggtgaacactcctaccagtgtgga

SEQ ID NO: 203588 - DNA, 25 bp, Mus musculus
aggtgaacactcgtaccagtgtgga

SEQ ID NO: 203589 - DNA, 25 bp, Mus musculus
aggtgaacatccagcgcgagaggaa

SEQ ID NO: 203590 - DNA, 25 bp, Mus musculus
aggtgaacatcctgcgcgagaggaa

SEQ ID NO: 203591 - DNA, 25 bp, Mus musculus
aggtgaacattaaattccactccac

SEQ ID NO: 203592 - DNA, 25 bp, Mus musculus
aggtgaacattatattccactccac

SEQ ID NO: 203593 - DNA, 25 bp, Mus musculus
aggtgaacatttccctttaggccag

SEQ ID NO: 203594 - DNA, 25 bp, Mus musculus
aggtgaacatttgcctttaggccag

SEQ ID NO: 203595 - DNA, 25 bp, Mus musculus
aggtgaaccagtcaccagctctgat

SEQ ID NO: 203596 - DNA, 25 bp, Mus musculus
aggtgaaccagtgaccagctctgat

SEQ ID NO: 203597 - DNA, 25 bp, Mus musculus
aggtgaacctccagagttctcagcc

SEQ ID NO: 203598 - DNA, 25 bp, Mus musculus
aggtgaacctcctgagttctcagcc

SEQ ID NO: 203599 - DNA, 25 bp, Mus musculus
aggtgaaccttgcattgtcatccca

SEQ ID NO: 203600 - DNA, 25 bp, Mus musculus
aggtgaaccttggattgtcatccca

SEQ ID NO: 203601 - DNA, 25 bp, Mus musculus
aggtgaacgaccatcaggccacctt

SEQ ID NO: 203602 - DNA, 25 bp, Mus musculus
aggtgaacgaccttcaggccacctt

SEQ ID NO: 203603 - DNA, 25 bp, Mus musculus
aggtgaactgacctccggactcctt

SEQ ID NO: 203604 - DNA, 25 bp, Mus musculus
aggtgaactgacgtccggactcctt

SEQ ID NO: 203605 - DNA, 25 bp, Mus musculus
aggtgaacttctctccacctggaga

SEQ ID NO: 203606 - DNA, 25 bp, Mus musculus
aggtgaacttctgtccacctggaga

SEQ ID NO: 203607 - DNA, 25 bp, Mus musculus
aggtgaacttgtactcctggaggct

SEQ ID NO: 203608 - DNA, 25 bp, Mus musculus
aggtgaacttgttctcctggaggct

SEQ ID NO: 203609 - DNA, 25 bp, Mus musculus
aggtgaactttcagaggctatctca

SEQ ID NO: 203610 - DNA, 25 bp, Mus musculus
aggtgaactttctgaggctatctca

SEQ ID NO: 203611 - DNA, 25 bp, Mus musculus
aggtgaagaatcagcctgaggctaa

SEQ ID NO: 203612 - DNA, 25 bp, Mus musculus
aggtgaagaatctgcctgaggctaa

SEQ ID NO: 203613 - DNA, 25 bp, Mus musculus
aggtgaagactcagggtcctgacaa

SEQ ID NO: 203614 - DNA, 25 bp, Mus musculus
aggtgaagactctgggtcctgacaa

SEQ ID NO: 203615 - DNA, 25 bp, Mus musculus
aggtgaagagcacattccatcccag

SEQ ID NO: 203616 - DNA, 25 bp, Mus musculus
aggtgaagagcagattccatcccag

SEQ ID NO: 203617 - DNA, 25 bp, Mus musculus
aggtgaagcacgagtcatggacata

SEQ ID NO: 203618 - DNA, 25 bp, Mus musculus
aggtgaagcacgtgtcatggacata

SEQ ID NO: 203619 - DNA, 25 bp, Mus musculus
aggtgaagcattatccctgagctct

SEQ ID NO: 203620 - DNA, 25 bp, Mus musculus
aggtgaagcattttccctgagctct

SEQ ID NO: 203621 - DNA, 25 bp, Mus musculus
aggtgaagccggaccaactggccaa

SEQ ID NO: 203622 - DNA, 25 bp, Mus musculus
aggtgaagccggtccaactggccaa

SEQ ID NO: 203623 - DNA, 25 bp, Mus musculus
aggtgaagcgccacaagactcagcc

SEQ ID NO: 203624 - DNA, 25 bp, Mus musculus
aggtgaagcgcctcaagactcagcc

SEQ ID NO: 203625 - DNA, 25 bp, Mus musculus
aggtgaagctctagcaacagtctcc

SEQ ID NO: 203626 - DNA, 25 bp, Mus musculus
aggtgaagctcttgcaacagtctcc

SEQ ID NO: 203627 - DNA, 25 bp, Mus musculus
aggtgaaggacaagcaccccgagct

SEQ ID NO: 203628 - DNA, 25 bp, Mus musculus
aggtgaaggacatgcaccccgagct

SEQ ID NO: 203629 - DNA, 25 bp, Mus musculus
aggtgaaggactcacatgcattcat

SEQ ID NO: 203630 - DNA, 25 bp, Mus musculus
aggtgaaggactgacatgcattcat

SEQ ID NO: 203631 - DNA, 25 bp, Mus musculus
aggtgaaggcctcccagtcatcagg

SEQ ID NO: 203632 - DNA, 25 bp, Mus musculus
aggtgaaggcctgccagtcatcagg

SEQ ID NO: 203633 - DNA, 25 bp, Mus musculus
aggtgaagtcacatgcagagtcaga

SEQ ID NO: 203634 - DNA, 25 bp, Mus musculus
aggtgaagtcacttgcagagtcaga

SEQ ID NO: 203635 - DNA, 25 bp, Mus musculus
aggtgaagtgtccttctgacttcct

SEQ ID NO: 203636 - DNA, 25 bp, Mus musculus
aggtgaagtgtcgttctgacttcct

SEQ ID NO: 203637 - DNA, 25 bp, Mus musculus
aggtgaagtgtgctgatctttccct

SEQ ID NO: 203638 - DNA, 25 bp, Mus musculus
aggtgaagtgtggtgatctttccct

SEQ ID NO: 203639 - DNA, 25 bp, Mus musculus
aggtgaatactgaccatgcttgctc

SEQ ID NO: 203640 - DNA, 25 bp, Mus musculus
aggtgaatactgtccatgcttgctc

SEQ ID NO: 203641 - DNA, 25 bp, Mus musculus
aggtgaatagagagtctcgtctcca

SEQ ID NO: 203642 - DNA, 25 bp, Mus musculus
aggtgaatagagtgtctcgtctcca

SEQ ID NO: 203643 - DNA, 25 bp, Mus musculus
aggtgaatcagtaccggcagctgta

SEQ ID NO: 203644 - DNA, 25 bp, Mus musculus
aggtgaatcagttccggcagctgta

SEQ ID NO: 203645 - DNA, 25 bp, Mus musculus
aggtgaatctccctaggttcgaggc

SEQ ID NO: 203646 - DNA, 25 bp, Mus musculus
aggtgaatctccgtaggttcgaggc

SEQ ID NO: 203647 - DNA, 25 bp, Mus musculus
aggtgaatcttgctgcttaatggac

SEQ ID NO: 203648 - DNA, 25 bp, Mus musculus
aggtgaatcttggtgcttaatggac

SEQ ID NO: 203649 - DNA, 25 bp, Mus musculus
aggtgaatctttctagcccctacct

SEQ ID NO: 203650 - DNA, 25 bp, Mus musculus
aggtgaatctttgtagcccctacct

SEQ ID NO: 203651 - DNA, 25 bp, Mus musculus
aggtgaatgctgaaagcctccctct

SEQ ID NO: 203652 - DNA, 25 bp, Mus musculus
aggtgaatgctgtaagcctccctct

SEQ ID NO: 203653 - DNA, 25 bp, Mus musculus
aggtgaatgcttctctgcacagtct

SEQ ID NO: 203654 - DNA, 25 bp, Mus musculus
aggtgaatgcttgtctgcacagtct

SEQ ID NO: 203655 - DNA, 25 bp, Mus musculus
aggtgaatgggcatgctttgcccta

SEQ ID NO: 203656 - DNA, 25 bp, Mus musculus
aggtgaatgggcttgctttgcccta

SEQ ID NO: 203657 - DNA, 25 bp, Mus musculus
aggtgaattcctacagcaagtctga

SEQ ID NO: 203658 - DNA, 25 bp, Mus musculus
aggtgaattccttcagcaagtctga

SEQ ID NO: 203659 - DNA, 25 bp, Mus musculus
aggtgaatttgcacagccttgttgc

SEQ ID NO: 203660 - DNA, 25 bp, Mus musculus
aggtgaatttgctcagccttgttgc

SEQ ID NO: 203661 - DNA, 25 bp, Mus musculus
aggtgacacacacggacctggccat

SEQ ID NO: 203662 - DNA, 25 bp, Mus musculus
aggtgacacacagggacctggccat

SEQ ID NO: 203663 - DNA, 25 bp, Mus musculus
aggtgacacaccctagcagaggtct

SEQ ID NO: 203664 - DNA, 25 bp, Mus musculus
aggtgacacaccgtagcagaggtct

SEQ ID NO: 203665 - DNA, 25 bp, Mus musculus
aggtgacacactcttgcaggccttg

SEQ ID NO: 203666 - DNA, 25 bp, Mus musculus
aggtgacacactgttgcaggccttg

SEQ ID NO: 203667 - DNA, 25 bp, Mus musculus
aggtgacacagcagcctctgcaagg

SEQ ID NO: 203668 - DNA, 25 bp, Mus musculus
aggtgacacagctgcctctgcaagg

SEQ ID NO: 203669 - DNA, 25 bp, Mus musculus
aggtgacacatccattcacacaaaa

SEQ ID NO: 203670 - DNA, 25 bp, Mus musculus
aggtgacacatcgattcacacaaaa

SEQ ID NO: 203671 - DNA, 25 bp, Mus musculus
aggtgacaccatcctccaagattgt

SEQ ID NO: 203672 - DNA, 25 bp, Mus musculus
aggtgacaccatgctccaagattgt

SEQ ID NO: 203673 - DNA, 25 bp, Mus musculus
aggtgacacggtagagtgcttctgg

SEQ ID NO: 203674 - DNA, 25 bp, Mus musculus
aggtgacacggttgagtgcttctgg

SEQ ID NO: 203675 - DNA, 25 bp, Mus musculus
aggtgacactacacagttctaagcc

SEQ ID NO: 203676 - DNA, 25 bp, Mus musculus
aggtgacactactcagttctaagcc

SEQ ID NO: 203677 - DNA, 25 bp, Mus musculus
aggtgacagacaatctgccccagat

SEQ ID NO: 203678 - DNA, 25 bp, Mus musculus
aggtgacagacattctgccccagat

SEQ ID NO: 203679 - DNA, 25 bp, Mus musculus
aggtgacagaccaataactccccat

SEQ ID NO: 203680 - DNA, 25 bp, Mus musculus
aggtgacagacctataactccccat

SEQ ID NO: 203681 - DNA, 25 bp, Mus musculus
aggtgacagcaacctccaggaactc

SEQ ID NO: 203682 - DNA, 25 bp, Mus musculus
aggtgacagcaagctccaggaactc

SEQ ID NO: 203683 - DNA, 25 bp, Mus musculus
aggtgacagcatacttaaggattat

SEQ ID NO: 203684 - DNA, 25 bp, Mus musculus
aggtgacagcattcttaaggattat

SEQ ID NO: 203685 - DNA, 25 bp, Mus musculus
aggtgacagctgcaatctcctttgc

SEQ ID NO: 203686 - DNA, 25 bp, Mus musculus
aggtgacagctggaatctcctttgc

SEQ ID NO: 203687 - DNA, 25 bp, Mus musculus
aggtgacaggtcaacaaagctctgt

SEQ ID NO: 203688 - DNA, 25 bp, Mus musculus
aggtgacaggtctacaaagctctgt

SEQ ID NO: 203689 - DNA, 25 bp, Mus musculus
aggtgacagtgtcctgctgctacca

SEQ ID NO: 203690 - DNA, 25 bp, Mus musculus
aggtgacagtgtgctgctgctacca

SEQ ID NO: 203691 - DNA, 25 bp, Mus musculus
aggtgacatatgattctggttatag

SEQ ID NO: 203692 - DNA, 25 bp, Mus musculus
aggtgacatatgtttctggttatag

SEQ ID NO: 203693 - DNA, 25 bp, Mus musculus
aggtgacatcacaggctgcagctga

SEQ ID NO: 203694 - DNA, 25 bp, Mus musculus
aggtgacatcactggctgcagctga

SEQ ID NO: 203695 - DNA, 25 bp, Mus musculus
aggtgacatcagctgacagggattt

SEQ ID NO: 203696 - DNA, 25 bp, Mus musculus
aggtgacatcaggtgacagggattt

SEQ ID NO: 203697 - DNA, 25 bp, Mus musculus
aggtgacatcccacaggtttattca

SEQ ID NO: 203698 - DNA, 25 bp, Mus musculus
aggtgacatccctcaggtttattca

SEQ ID NO: 203699 - DNA, 25 bp, Mus musculus
aggtgacatgtcaggcaatccctcc

SEQ ID NO: 203700 - DNA, 25 bp, Mus musculus
aggtgacatgtctggcaatccctcc

SEQ ID NO: 203701 - DNA, 25 bp, Mus musculus
aggtgacattgtccccaggtataca

SEQ ID NO: 203702 - DNA, 25 bp, Mus musculus
aggtgacattgtgcccaggtataca

SEQ ID NO: 203703 - DNA, 25 bp, Mus musculus
aggtgaccaagcacgattgactgac

SEQ ID NO: 203704 - DNA, 25 bp, Mus musculus
aggtgaccaagctcgattgactgac

SEQ ID NO: 203705 - DNA, 25 bp, Mus musculus
aggtgaccacgcaggaggaactgct

SEQ ID NO: 203706 - DNA, 25 bp, Mus musculus
aggtgaccacgctggaggaactgct

SEQ ID NO: 203707 - DNA, 25 bp, Mus musculus
aggtgaccagagaatttccagccca

SEQ ID NO: 203708 - DNA, 25 bp, Mus musculus
aggtgaccagagtatttccagccca

SEQ ID NO: 203709 - DNA, 25 bp, Mus musculus
aggtgaccatgtccccggccggata

SEQ ID NO: 203710 - DNA, 25 bp, Mus musculus
aggtgaccatgtgcccggccggata

SEQ ID NO: 203711 - DNA, 25 bp, Mus musculus
aggtgaccattgaacccaggccact

SEQ ID NO: 203712 - DNA, 25 bp, Mus musculus
aggtgaccattgtacccaggccact

SEQ ID NO: 203713 - DNA, 25 bp, Mus musculus
aggtgacccataagtgactgtattt

SEQ ID NO: 203714 - DNA, 25 bp, Mus musculus
aggtgacccatatgtgactgtattt

SEQ ID NO: 203715 - DNA, 25 bp, Mus musculus
aggtgaccccagactggctatgaca

SEQ ID NO: 203716 - DNA, 25 bp, Mus musculus
aggtgaccccagtctggctatgaca

SEQ ID NO: 203717 - DNA, 25 bp, Mus musculus
aggtgaccctgacctatggcatgtt

SEQ ID NO: 203718 - DNA, 25 bp, Mus musculus
aggtgaccctgagctatggcatgtt

SEQ ID NO: 203719 - DNA, 25 bp, Mus musculus
aggtgacccttcacttgttgtgtga

SEQ ID NO: 203720 - DNA, 25 bp, Mus musculus
aggtgacccttctcttgttgtgtga

SEQ ID NO: 203721 - DNA, 25 bp, Mus musculus
aggtgacccttgattgcccttgcct

SEQ ID NO: 203722 - DNA, 25 bp, Mus musculus
aggtgacccttgtttgcccttgcct

SEQ ID NO: 203723 - DNA, 25 bp, Mus musculus
aggtgaccctttactgtcccaggag

SEQ ID NO: 203724 - DNA, 25 bp, Mus musculus
aggtgacccttttctgtcccaggag

SEQ ID NO: 203725 - DNA, 25 bp, Mus musculus
aggtgaccgattacatcaagtttgg

SEQ ID NO: 203726 - DNA, 25 bp, Mus musculus
aggtgaccgatttcatcaagtttgg

SEQ ID NO: 203727 - DNA, 25 bp, Mus musculus
aggtgaccgtgtctgtgttttcagc

SEQ ID NO: 203728 - DNA, 25 bp, Mus musculus
aggtgaccgtgtgtgtgttttcagc

SEQ ID NO: 203729 - DNA, 25 bp, Mus musculus
aggtgacctacaattggctgctttg

SEQ ID NO: 203730 - DNA, 25 bp, Mus musculus
aggtgacctacatttggctgctttg

SEQ ID NO: 203731 - DNA, 25 bp, Mus musculus
aggtgacctcagaagcaaatggcag

SEQ ID NO: 203732 - DNA, 25 bp, Mus musculus
aggtgacctcagcattcaggaagca

SEQ ID NO: 203733 - DNA, 25 bp, Mus musculus
aggtgacctcaggattcaggaagca

SEQ ID NO: 203734 - DNA, 25 bp, Mus musculus
aggtgacctcagtagcaaatggcag

SEQ ID NO: 203735 - DNA, 25 bp, Mus musculus
aggtgacctgccactgtgtctctgc

SEQ ID NO: 203736 - DNA, 25 bp, Mus musculus
aggtgacctgccaggcccaggagat

SEQ ID NO: 203737 - DNA, 25 bp, Mus musculus
aggtgacctgcctctgtgtctctgc

SEQ ID NO: 203738 - DNA, 25 bp, Mus musculus
aggtgacctgcctggcccaggagat

SEQ ID NO: 203739 - DNA, 25 bp, Mus musculus
aggtgacctgctacttcttgtctct

SEQ ID NO: 203740 - DNA, 25 bp, Mus musculus
aggtgacctgcttcttcttgtctct

SEQ ID NO: 203741 - DNA, 25 bp, Mus musculus
aggtgacctgtacctttggcacgtc

SEQ ID NO: 203742 - DNA, 25 bp, Mus musculus
aggtgacctgtagctttggcacgtc

SEQ ID NO: 203743 - DNA, 25 bp, Mus musculus
aggtgaccttcacacatgtcctttt

SEQ ID NO: 203744 - DNA, 25 bp, Mus musculus
aggtgaccttcagacatgtcctttt

SEQ ID NO: 203745 - DNA, 25 bp, Mus musculus
aggtgacgactcctgggatctgatc

SEQ ID NO: 203746 - DNA, 25 bp, Mus musculus
aggtgacgactcgtgggatctgatc

SEQ ID NO: 203747 - DNA, 25 bp, Mus musculus
aggtgacgagacaaaccacgcctct

SEQ ID NO: 203748 - DNA, 25 bp, Mus musculus
aggtgacgagactaaccacgcctct

SEQ ID NO: 203749 - DNA, 25 bp, Mus musculus
aggtgacgagcccagttcccaagaa

SEQ ID NO: 203750 - DNA, 25 bp, Mus musculus
aggtgacgagccgagttcccaagaa

SEQ ID NO: 203751 - DNA, 25 bp, Mus musculus
aggtgacgctgtccgccccggtggt

SEQ ID NO: 203752 - DNA, 25 bp, Mus musculus
aggtgacgctgtgcgccccggtggt

SEQ ID NO: 203753 - DNA, 25 bp, Mus musculus
aggtgacggaccaactgcgagcaga

SEQ ID NO: 203754 - DNA, 25 bp, Mus musculus
aggtgacggacctactgcgagcaga

SEQ ID NO: 203755 - DNA, 25 bp, Mus musculus
aggtgactaaccagctctgaactgt

SEQ ID NO: 203756 - DNA, 25 bp, Mus musculus
aggtgactaacctgctctgaactgt

SEQ ID NO: 203757 - DNA, 25 bp, Mus musculus
aggtgactactgaaactttcctatt

SEQ ID NO: 203758 - DNA, 25 bp, Mus musculus
aggtgactactgtaactttcctatt

SEQ ID NO: 203759 - DNA, 25 bp, Mus musculus
aggtgactacttctggacgacgctc

SEQ ID NO: 203760 - DNA, 25 bp, Mus musculus
aggtgactacttgtggacgacgctc

SEQ ID NO: 203761 - DNA, 25 bp, Mus musculus
aggtgactagcccacacatttttat

SEQ ID NO: 203762 - DNA, 25 bp, Mus musculus
aggtgactagccgacacatttttat

SEQ ID NO: 203763 - DNA, 25 bp, Mus musculus
aggtgactagctattgtgaacttaa

SEQ ID NO: 203764 - DNA, 25 bp, Mus musculus
aggtgactagcttttgtgaacttaa

SEQ ID NO: 203765 - DNA, 25 bp, Mus musculus
aggtgactaggcagacactgctgac

SEQ ID NO: 203766 - DNA, 25 bp, Mus musculus
aggtgactaggctgacactgctgac

SEQ ID NO: 203767 - DNA, 25 bp, Mus musculus
aggtgactatttatgatcctagaat

SEQ ID NO: 203768 - DNA, 25 bp, Mus musculus
aggtgactatttttgatcctagaat

SEQ ID NO: 203769 - DNA, 25 bp, Mus musculus
aggtgactcaaaagcatctataatg

SEQ ID NO: 203770 - DNA, 25 bp, Mus musculus
aggtgactcaaatgcatctataatg

SEQ ID NO: 203771 - DNA, 25 bp, Mus musculus
aggtgactcacacaagcaccagcag

SEQ ID NO: 203772 - DNA, 25 bp, Mus musculus
aggtgactcacagaagcaccagcag

SEQ ID NO: 203773 - DNA, 25 bp, Mus musculus
aggtgactccagatacactgacaaa

SEQ ID NO: 203774 - DNA, 25 bp, Mus musculus
aggtgactccagttacactgacaaa

SEQ ID NO: 203775 - DNA, 25 bp, Mus musculus
aggtgactcccacggtccagctatc

SEQ ID NO: 203776 - DNA, 25 bp, Mus musculus
aggtgactcccagggtccagctatc

SEQ ID NO: 203777 - DNA, 25 bp, Mus musculus
aggtgactctgcatgccgtaatggc

SEQ ID NO: 203778 - DNA, 25 bp, Mus musculus
aggtgactctgcttgccgtaatggc

SEQ ID NO: 203779 - DNA, 25 bp, Mus musculus
aggtgactgaacagctggctcgata

SEQ ID NO: 203780 - DNA, 25 bp, Mus musculus
aggtgactgaactgctggctcgata

SEQ ID NO: 203781 - DNA, 25 bp, Mus musculus
aggtgactgcagattgatccccaga

SEQ ID NO: 203782 - DNA, 25 bp, Mus musculus
aggtgactgcagtttgatccccaga

SEQ ID NO: 203783 - DNA, 25 bp, Mus musculus
aggtgactgcatcgtgcctggccct

SEQ ID NO: 203784 - DNA, 25 bp, Mus musculus
aggtgactgcatggtgcctggccct

SEQ ID NO: 203785 - DNA, 25 bp, Mus musculus
aggtgactgcccctttgaatgtaat

SEQ ID NO: 203786 - DNA, 25 bp, Mus musculus
aggtgactgcccgtttgaatgtaat

SEQ ID NO: 203787 - DNA, 25 bp, Mus musculus
aggtgactggttagttgcttactgc

SEQ ID NO: 203788 - DNA, 25 bp, Mus musculus
aggtgactggtttgttgcttactgc

SEQ ID NO: 203789 - DNA, 25 bp, Mus musculus
aggtgactgtcaatcctgtcaagat

SEQ ID NO: 203790 - DNA, 25 bp, Mus musculus
aggtgactgtcattcctgtcaagat

SEQ ID NO: 203791 - DNA, 25 bp, Mus musculus
aggtgactgtgtcgaatcccctgga

SEQ ID NO: 203792 - DNA, 25 bp, Mus musculus
aggtgactgtgtggaatcccctgga

SEQ ID NO: 203793 - DNA, 25 bp, Mus musculus
aggtgacttcacaaagctgtcttta

SEQ ID NO: 203794 - DNA, 25 bp, Mus musculus
aggtgacttcactaagctgtcttta

SEQ ID NO: 203795 - DNA, 25 bp, Mus musculus
aggtgacttccaacaggcaatacat

SEQ ID NO: 203796 - DNA, 25 bp, Mus musculus
aggtgacttccatcaggcaatacat

SEQ ID NO: 203797 - DNA, 25 bp, Mus musculus
aggtgacttgagcaccagcttccac

SEQ ID NO: 203798 - DNA, 25 bp, Mus musculus
aggtgacttgaggaccagcttccac

SEQ ID NO: 203799 - DNA, 25 bp, Mus musculus
aggtgacttgctctgtaacttccca

SEQ ID NO: 203800 - DNA, 25 bp, Mus musculus
aggtgacttgctgtgtaacttccca

SEQ ID NO: 203801 - DNA, 25 bp, Mus musculus
aggtgactttacatgtctcacagta

SEQ ID NO: 203802 - DNA, 25 bp, Mus musculus
aggtgactttacttgtctcacagta

SEQ ID NO: 203803 - DNA, 25 bp, Mus musculus
aggtgactttgcaccggtgttcgcg

SEQ ID NO: 203804 - DNA, 25 bp, Mus musculus
aggtgactttgctccggtgttcgcg

SEQ ID NO: 203805 - DNA, 25 bp, Mus musculus
aggtgagaagatacagggtcctgat

SEQ ID NO: 203806 - DNA, 25 bp, Mus musculus
aggtgagaagattcagggtcctgat

SEQ ID NO: 203807 - DNA, 25 bp, Mus musculus
aggtgagaagcccttgaactcccac

SEQ ID NO: 203808 - DNA, 25 bp, Mus musculus
aggtgagaagccgttgaactcccac

SEQ ID NO: 203809 - DNA, 25 bp, Mus musculus
aggtgagacatcagcatctcgctca

SEQ ID NO: 203810 - DNA, 25 bp, Mus musculus
aggtgagacatctgcatctcgctca

SEQ ID NO: 203811 - DNA, 25 bp, Mus musculus
aggtgagaccccactatggtgtccc

SEQ ID NO: 203812 - DNA, 25 bp, Mus musculus
aggtgagacccctctatggtgtccc

SEQ ID NO: 203813 - DNA, 25 bp, Mus musculus
aggtgagaccctacagaatgctctg

SEQ ID NO: 203814 - DNA, 25 bp, Mus musculus
aggtgagacccttcagaatgctctg

SEQ ID NO: 203815 - DNA, 25 bp, Mus musculus
aggtgagacgaacctcactccagtg

SEQ ID NO: 203816 - DNA, 25 bp, Mus musculus
aggtgagacgaagctcactccagtg

SEQ ID NO: 203817 - DNA, 25 bp, Mus musculus
aggtgagagagccagtcttgccaaa

SEQ ID NO: 203818 - DNA, 25 bp, Mus musculus
aggtgagagagcgagtcttgccaaa

SEQ ID NO: 203819 - DNA, 25 bp, Mus musculus
aggtgagatctgcaaccatctttga

SEQ ID NO: 203820 - DNA, 25 bp, Mus musculus
aggtgagatctggaaccatctttga

SEQ ID NO: 203821 - DNA, 25 bp, Mus musculus
aggtgagcaacgagcctcgcgccgc

SEQ ID NO: 203822 - DNA, 25 bp, Mus musculus
aggtgagcaacgtgcctcgcgccgc

SEQ ID NO: 203823 - DNA, 25 bp, Mus musculus
aggtgagcacttagctactgagccc

SEQ ID NO: 203824 - DNA, 25 bp, Mus musculus
aggtgagcactttgctactgagccc

SEQ ID NO: 203825 - DNA, 25 bp, Mus musculus
aggtgagcctgcagcaacacagtct

SEQ ID NO: 203826 - DNA, 25 bp, Mus musculus
aggtgagcctgctgcaacacagtct

SEQ ID NO: 203827 - DNA, 25 bp, Mus musculus
aggtgagccttcattcgcaagtgca

SEQ ID NO: 203828 - DNA, 25 bp, Mus musculus
aggtgagccttctttcgcaagtgca

SEQ ID NO: 203829 - DNA, 25 bp, Mus musculus
aggtgagctctcatgtcctaagaat

SEQ ID NO: 203830 - DNA, 25 bp, Mus musculus
aggtgagctctcttgtcctaagaat

SEQ ID NO: 203831 - DNA, 25 bp, Mus musculus
aggtgagctgttaacccacgcccag

SEQ ID NO: 203832 - DNA, 25 bp, Mus musculus
aggtgagctgtttacccacgcccag

SEQ ID NO: 203833 - DNA, 25 bp, Mus musculus
aggtgagcttccacttagccttgta

SEQ ID NO: 203834 - DNA, 25 bp, Mus musculus
aggtgagcttcctcttagccttgta

SEQ ID NO: 203835 - DNA, 25 bp, Mus musculus
aggtgagctttgaactgtagataat

SEQ ID NO: 203836 - DNA, 25 bp, Mus musculus
aggtgagctttgtactgtagataat

SEQ ID NO: 203837 - DNA, 25 bp, Mus musculus
aggtgaggacaaatccagaaaactg

SEQ ID NO: 203838 - DNA, 25 bp, Mus musculus
aggtgaggacaattccagaaaactg

SEQ ID NO: 203839 - DNA, 25 bp, Mus musculus
aggtgaggaccacttacttgctttc

SEQ ID NO: 203840 - DNA, 25 bp, Mus musculus
aggtgaggaccagttacttgctttc

SEQ ID NO: 203841 - DNA, 25 bp, Mus musculus
aggtgaggacgaatactacacggat

SEQ ID NO: 203842 - DNA, 25 bp, Mus musculus
aggtgaggacgattactacacggat

SEQ ID NO: 203843 - DNA, 25 bp, Mus musculus
aggtgaggatggagccaaaagctcc

SEQ ID NO: 203844 - DNA, 25 bp, Mus musculus
aggtgaggatggtgccaaaagctcc

SEQ ID NO: 203845 - DNA, 25 bp, Mus musculus
aggtgaggcccaacctggactacag

SEQ ID NO: 203846 - DNA, 25 bp, Mus musculus
aggtgaggcccatcctggactacag

SEQ ID NO: 203847 - DNA, 25 bp, Mus musculus
aggtgaggctcacaactctaactcc

SEQ ID NO: 203848 - DNA, 25 bp, Mus musculus
aggtgaggctcagaactctaactcc

SEQ ID NO: 203849 - DNA, 25 bp, Mus musculus
aggtgagggtccaaatccagttgcc

SEQ ID NO: 203850 - DNA, 25 bp, Mus musculus
aggtgagggtcctaatccagttgcc

SEQ ID NO: 203851 - DNA, 25 bp, Mus musculus
aggtgaggttgcataacatccgcct

SEQ ID NO: 203852 - DNA, 25 bp, Mus musculus
aggtgaggttgcttaacatccgcct

SEQ ID NO: 203853 - DNA, 25 bp, Mus musculus
aggtgagtatcaactggaactcctc

SEQ ID NO: 203854 - DNA, 25 bp, Mus musculus
aggtgagtatcatctggaactcctc

SEQ ID NO: 203855 - DNA, 25 bp, Mus musculus
aggtgagtcatcctagacttctgca

SEQ ID NO: 203856 - DNA, 25 bp, Mus musculus
aggtgagtcatcgtagacttctgca

SEQ ID NO: 203857 - DNA, 25 bp, Mus musculus
aggtgagtcccacgctaccgctgtt

SEQ ID NO: 203858 - DNA, 25 bp, Mus musculus
aggtgagtcccaggctaccgctgtt

SEQ ID NO: 203859 - DNA, 25 bp, Mus musculus
aggtgagtccttcgttctcagcttt

SEQ ID NO: 203860 - DNA, 25 bp, Mus musculus
aggtgagtccttggttctcagcttt

SEQ ID NO: 203861 - DNA, 25 bp, Mus musculus
aggtgagtctggcaaaccctcagca

SEQ ID NO: 203862 - DNA, 25 bp, Mus musculus
aggtgagtctgggaaaccctcagca

SEQ ID NO: 203863 - DNA, 25 bp, Mus musculus
aggtgagtgataaggtccctctacc

SEQ ID NO: 203864 - DNA, 25 bp, Mus musculus
aggtgagtgatatggtccctctacc

SEQ ID NO: 203865 - DNA, 25 bp, Mus musculus
aggtgagtgcagctgcatgtcccca

SEQ ID NO: 203866 - DNA, 25 bp, Mus musculus
aggtgagtgcaggtgcatgtcccca

SEQ ID NO: 203867 - DNA, 25 bp, Mus musculus
aggtgagtggtgactccaggctcca

SEQ ID NO: 203868 - DNA, 25 bp, Mus musculus
aggtgagtggtgtctccaggctcca

SEQ ID NO: 203869 - DNA, 25 bp, Mus musculus
aggtgagtgtacaagatccaggagt

SEQ ID NO: 203870 - DNA, 25 bp, Mus musculus
aggtgagtgtactagatccaggagt

SEQ ID NO: 203871 - DNA, 25 bp, Mus musculus
aggtgagttggcagctcttttatta

SEQ ID NO: 203872 - DNA, 25 bp, Mus musculus
aggtgagttggctgctcttttatta

SEQ ID NO: 203873 - DNA, 25 bp, Mus musculus
aggtgatagaccctggtactcctaa

SEQ ID NO: 203874 - DNA, 25 bp, Mus musculus
aggtgatagaccgtggtactcctaa

SEQ ID NO: 203875 - DNA, 25 bp, Mus musculus
aggtgatagatccagccatgatact

SEQ ID NO: 203876 - DNA, 25 bp, Mus musculus
aggtgatagatcgagccatgatact

SEQ ID NO: 203877 - DNA, 25 bp, Mus musculus
aggtgatataatctgtgggttttgt

SEQ ID NO: 203878 - DNA, 25 bp, Mus musculus
aggtgatataatgtgtgggttttgt

SEQ ID NO: 203879 - DNA, 25 bp, Mus musculus
aggtgatatcttacgttgagtctta

SEQ ID NO: 203880 - DNA, 25 bp, Mus musculus
aggtgatatctttcgttgagtctta

SEQ ID NO: 203881 - DNA, 25 bp, Mus musculus
aggtgatcaagcatctgtgtaaact

SEQ ID NO: 203882 - DNA, 25 bp, Mus musculus
aggtgatcaagcttctgtgtaaact

SEQ ID NO: 203883 - DNA, 25 bp, Mus musculus
aggtgatcagtgactgtgactagct

SEQ ID NO: 203884 - DNA, 25 bp, Mus musculus
aggtgatcagtgtctgtgactagct

SEQ ID NO: 203885 - DNA, 25 bp, Mus musculus
aggtgatccaagattagtaatgttt

SEQ ID NO: 203886 - DNA, 25 bp, Mus musculus
aggtgatccaagtttagtaatgttt

SEQ ID NO: 203887 - DNA, 25 bp, Mus musculus
aggtgatcccctccctcatgttaaa

SEQ ID NO: 203888 - DNA, 25 bp, Mus musculus
aggtgatcccctgcctcatgttaaa

SEQ ID NO: 203889 - DNA, 25 bp, Mus musculus
aggtgatcggggacaaattggcttc

SEQ ID NO: 203890 - DNA, 25 bp, Mus musculus
aggtgatcggggtcaaattggcttc

SEQ ID NO: 203891 - DNA, 25 bp, Mus musculus
aggtgatctgagctcttctatctat

SEQ ID NO: 203892 - DNA, 25 bp, Mus musculus
aggtgatctgaggtcttctatctat

SEQ ID NO: 203893 - DNA, 25 bp, Mus musculus
aggtgatctgtgacctcgctgtggt

SEQ ID NO: 203894 - DNA, 25 bp, Mus musculus
aggtgatctgtgtcctcgctgtggt

SEQ ID NO: 203895 - DNA, 25 bp, Mus musculus
aggtgatcttatactactactgtat

SEQ ID NO: 203896 - DNA, 25 bp, Mus musculus
aggtgatcttattctactactgtat

SEQ ID NO: 203897 - DNA, 25 bp, Mus musculus
aggtgatgacctaatgtgtttaagc

SEQ ID NO: 203898 - DNA, 25 bp, Mus musculus
aggtgatgaccttatgtgtttaagc

SEQ ID NO: 203899 - DNA, 25 bp, Mus musculus
aggtgatgcactatagctaccctgg

SEQ ID NO: 203900 - DNA, 25 bp, Mus musculus
aggtgatgcactttagctaccctgg

SEQ ID NO: 203901 - DNA, 25 bp, Mus musculus
aggtgatgccgtagctgccgcacac

SEQ ID NO: 203902 - DNA, 25 bp, Mus musculus
aggtgatgccgttgctgccgcacac

SEQ ID NO: 203903 - DNA, 25 bp, Mus musculus
aggtgatgctcactgttgtggtctt

SEQ ID NO: 203904 - DNA, 25 bp, Mus musculus
aggtgatgctcagtgttgtggtctt

SEQ ID NO: 203905 - DNA, 25 bp, Mus musculus
aggtgatgggacctacctctcccaa

SEQ ID NO: 203906 - DNA, 25 bp, Mus musculus
aggtgatgggacgtacctctcccaa

SEQ ID NO: 203907 - DNA, 25 bp, Mus musculus
aggtgatgggccactacccaggcac

SEQ ID NO: 203908 - DNA, 25 bp, Mus musculus
aggtgatgggcctctacccaggcac

SEQ ID NO: 203909 - DNA, 25 bp, Mus musculus
aggtgatggtccaggcccggaattc

SEQ ID NO: 203910 - DNA, 25 bp, Mus musculus
aggtgatggtcctggcccggaattc

SEQ ID NO: 203911 - DNA, 25 bp, Mus musculus
aggtgatgtactcgacaggtgcaca

SEQ ID NO: 203912 - DNA, 25 bp, Mus musculus
aggtgatgtactggacaggtgcaca

SEQ ID NO: 203913 - DNA, 25 bp, Mus musculus
aggtgatgtctaaggctcggccaca

SEQ ID NO: 203914 - DNA, 25 bp, Mus musculus
aggtgatgtctatggctcggccaca

SEQ ID NO: 203915 - DNA, 25 bp, Mus musculus
aggtgatgtgaacccttacctcttc

SEQ ID NO: 203916 - DNA, 25 bp, Mus musculus
aggtgatgtgaagccttacctcttc

SEQ ID NO: 203917 - DNA, 25 bp, Mus musculus
aggtgatgtgtgcatcctcaagccc

SEQ ID NO: 203918 - DNA, 25 bp, Mus musculus
aggtgatgtgtggatcctcaagccc

SEQ ID NO: 203919 - DNA, 25 bp, Mus musculus
aggtgatgttgacccttttcttcct

SEQ ID NO: 203920 - DNA, 25 bp, Mus musculus
aggtgatgttgagccttttcttcct

SEQ ID NO: 203921 - DNA, 25 bp, Mus musculus
aggtgatgtttgcacacaggctgtc

SEQ ID NO: 203922 - DNA, 25 bp, Mus musculus
aggtgatgtttggacacaggctgtc

SEQ ID NO: 203923 - DNA, 25 bp, Mus musculus
aggtgattcacacgtacacacatcc

SEQ ID NO: 203924 - DNA, 25 bp, Mus musculus
aggtgattcacaggtacacacatcc

SEQ ID NO: 203925 - DNA, 25 bp, Mus musculus
aggtgattcagacaagtgcttcctg

SEQ ID NO: 203926 - DNA, 25 bp, Mus musculus
aggtgattcagagaagtgcttcctg

SEQ ID NO: 203927 - DNA, 25 bp, Mus musculus
aggtgattctctaagaccacgaagg

SEQ ID NO: 203928 - DNA, 25 bp, Mus musculus
aggtgattctcttagaccacgaagg

SEQ ID NO: 203929 - DNA, 25 bp, Mus musculus
aggtgatttcagcttggttttgaga

SEQ ID NO: 203930 - DNA, 25 bp, Mus musculus
aggtgatttcaggttggttttgaga

SEQ ID NO: 203931 - DNA, 25 bp, Mus musculus
aggtgatttcttacagtgctctttc

SEQ ID NO: 203932 - DNA, 25 bp, Mus musculus
aggtgatttctttcagtgctctttc

SEQ ID NO: 203933 - DNA, 25 bp, Mus musculus
aggtgatttgccaatcattgtggat

SEQ ID NO: 203934 - DNA, 25 bp, Mus musculus
aggtgatttgcctatcattgtggat

SEQ ID NO: 203935 - DNA, 25 bp, Mus musculus
aggtgattttacctctctgccggtg

SEQ ID NO: 203936 - DNA, 25 bp, Mus musculus
aggtgattttacgtctctgccggtg

SEQ ID NO: 203937 - DNA, 25 bp, Mus musculus
aggtgcaaaatgagcttacagcaag

SEQ ID NO: 203938 - DNA, 25 bp, Mus musculus
aggtgcaaaatgtgcttacagcaag

SEQ ID NO: 203939 - DNA, 25 bp, Mus musculus
aggtgcaaacacataacagggaatt

SEQ ID NO: 203940 - DNA, 25 bp, Mus musculus
aggtgcaaacacttaacagggaatt

SEQ ID NO: 203941 - DNA, 25 bp, Mus musculus
aggtgcaaaccccacttcagactac

SEQ ID NO: 203942 - DNA, 25 bp, Mus musculus
aggtgcaaacccgacttcagactac

SEQ ID NO: 203943 - DNA, 25 bp, Mus musculus
aggtgcaaacctatagtatttcaat

SEQ ID NO: 203944 - DNA, 25 bp, Mus musculus
aggtgcaaacctttagtatttcaat

SEQ ID NO: 203945 - DNA, 25 bp, Mus musculus
aggtgcaaccttataatgtgacaaa

SEQ ID NO: 203946 - DNA, 25 bp, Mus musculus
aggtgcaaccttttaatgtgacaaa

SEQ ID NO: 203947 - DNA, 25 bp, Mus musculus
aggtgcaaggacagagccacttcac

SEQ ID NO: 203948 - DNA, 25 bp, Mus musculus
aggtgcaaggactgagccacttcac

SEQ ID NO: 203949 - DNA, 25 bp, Mus musculus
aggtgcaaggctcctagcatgtagt

SEQ ID NO: 203950 - DNA, 25 bp, Mus musculus
aggtgcaaggctgctagcatgtagt

SEQ ID NO: 203951 - DNA, 25 bp, Mus musculus
aggtgcaagggtcctttccgtgacc

SEQ ID NO: 203952 - DNA, 25 bp, Mus musculus
aggtgcaagggtgctttccgtgacc

SEQ ID NO: 203953 - DNA, 25 bp, Mus musculus
aggtgcaataagacgttcctgcaaa

SEQ ID NO: 203954 - DNA, 25 bp, Mus musculus
aggtgcaataagtcgttcctgcaaa

SEQ ID NO: 203955 - DNA, 25 bp, Mus musculus
aggtgcaatcataccactttgcctt

SEQ ID NO: 203956 - DNA, 25 bp, Mus musculus
aggtgcaatcattccactttgcctt

SEQ ID NO: 203957 - DNA, 25 bp, Mus musculus
aggtgcacacaactatgcccagttc

SEQ ID NO: 203958 - DNA, 25 bp, Mus musculus
aggtgcacacaagtatgcccagttc

SEQ ID NO: 203959 - DNA, 25 bp, Mus musculus
aggtgcacagctattaggtgatcac

SEQ ID NO: 203960 - DNA, 25 bp, Mus musculus
aggtgcacagcttttaggtgatcac

SEQ ID NO: 203961 - DNA, 25 bp, Mus musculus
aggtgcacatagatagccgggaagc

SEQ ID NO: 203962 - DNA, 25 bp, Mus musculus
aggtgcacatagttagccgggaagc

SEQ ID NO: 203963 - DNA, 25 bp, Mus musculus
aggtgcaccaatccatcgagcgctg

SEQ ID NO: 203964 - DNA, 25 bp, Mus musculus
aggtgcaccaatgcatcgagcgctg

SEQ ID NO: 203965 - DNA, 25 bp, Mus musculus
aggtgcacccatcgctgtggatttc

SEQ ID NO: 203966 - DNA, 25 bp, Mus musculus
aggtgcacccatggctgtggatttc

SEQ ID NO: 203967 - DNA, 25 bp, Mus musculus
aggtgcacccttcacctggacttga

SEQ ID NO: 203968 - DNA, 25 bp, Mus musculus
aggtgcacccttgacctggacttga

SEQ ID NO: 203969 - DNA, 25 bp, Mus musculus
aggtgcaccgtgactctgcaataaa

SEQ ID NO: 203970 - DNA, 25 bp, Mus musculus
aggtgcaccgtgtctctgcaataaa

SEQ ID NO: 203971 - DNA, 25 bp, Mus musculus
aggtgcacctgaagactgccccgga

SEQ ID NO: 203972 - DNA, 25 bp, Mus musculus
aggtgcacctgatgactgccccgga

SEQ ID NO: 203973 - DNA, 25 bp, Mus musculus
aggtgcacctgcaccagggaggtaa

SEQ ID NO: 203974 - DNA, 25 bp, Mus musculus
aggtgcacctgctccagggaggtaa

SEQ ID NO: 203975 - DNA, 25 bp, Mus musculus
aggtgcacggccaggtgctctacac

SEQ ID NO: 203976 - DNA, 25 bp, Mus musculus
aggtgcacggcctggtgctctacac

SEQ ID NO: 203977 - DNA, 25 bp, Mus musculus
aggtgcactatcctttaccatacta

SEQ ID NO: 203978 - DNA, 25 bp, Mus musculus
aggtgcactatcgtttaccatacta

SEQ ID NO: 203979 - DNA, 25 bp, Mus musculus
aggtgcactctcaataatacaatct

SEQ ID NO: 203980 - DNA, 25 bp, Mus musculus
aggtgcactctctataatacaatct

SEQ ID NO: 203981 - DNA, 25 bp, Mus musculus
aggtgcactgcactgctgtttacat

SEQ ID NO: 203982 - DNA, 25 bp, Mus musculus
aggtgcactgcagtgctgtttacat

SEQ ID NO: 203983 - DNA, 25 bp, Mus musculus
aggtgcactgtcagtgtgaagtcac

SEQ ID NO: 203984 - DNA, 25 bp, Mus musculus
aggtgcactgtctgtgtgaagtcac

SEQ ID NO: 203985 - DNA, 25 bp, Mus musculus
aggtgcacttaaactctagctaaaa

SEQ ID NO: 203986 - DNA, 25 bp, Mus musculus
aggtgcacttaatctctagctaaaa

SEQ ID NO: 203987 - DNA, 25 bp, Mus musculus
aggtgcagaaccaagccgattctct

SEQ ID NO: 203988 - DNA, 25 bp, Mus musculus
aggtgcagaacctagccgattctct

SEQ ID NO: 203989 - DNA, 25 bp, Mus musculus
aggtgcagaactatgttctcttcca

SEQ ID NO: 203990 - DNA, 25 bp, Mus musculus
aggtgcagaactttgttctcttcca

SEQ ID NO: 203991 - DNA, 25 bp, Mus musculus
aggtgcagacccctagctccgatga

SEQ ID NO: 203992 - DNA, 25 bp, Mus musculus
aggtgcagacccgtagctccgatga

SEQ ID NO: 203993 - DNA, 25 bp, Mus musculus
aggtgcagagagacaacggactttt

SEQ ID NO: 203994 - DNA, 25 bp, Mus musculus
aggtgcagagagtcaacggactttt

SEQ ID NO: 203995 - DNA, 25 bp, Mus musculus
aggtgcagagcgaaccggccggacg

SEQ ID NO: 203996 - DNA, 25 bp, Mus musculus
aggtgcagagcgtaccggccggacg

SEQ ID NO: 203997 - DNA, 25 bp, Mus musculus
aggtgcagatcactgccacccatgc

SEQ ID NO: 203998 - DNA, 25 bp, Mus musculus
aggtgcagatcagtgccacccatgc

SEQ ID NO: 203999 - DNA, 25 bp, Mus musculus
aggtgcagattaccaagactggcaa

SEQ ID NO: 204000 - DNA, 25 bp, Mus musculus
aggtgcagattagcaagactggcaa

SEQ ID NO: 204001 - DNA, 25 bp, Mus musculus
aggtgcagattgacgagccagctaa

SEQ ID NO: 204002 - DNA, 25 bp, Mus musculus
aggtgcagattgtcgagccagctaa

SEQ ID NO: 204003 - DNA, 25 bp, Mus musculus
aggtgcagcagaccattgccacgag

SEQ ID NO: 204004 - DNA, 25 bp, Mus musculus
aggtgcagcagagcattgccacgag

SEQ ID NO: 204005 - DNA, 25 bp, Mus musculus
aggtgcagccttaacaagccactgt

SEQ ID NO: 204006 - DNA, 25 bp, Mus musculus
aggtgcagcctttacaagccactgt

SEQ ID NO: 204007 - DNA, 25 bp, Mus musculus
aggtgcagctgtaatttcttctcca

SEQ ID NO: 204008 - DNA, 25 bp, Mus musculus
aggtgcagctgtcaaggttcctcca

SEQ ID NO: 204009 - DNA, 25 bp, Mus musculus
aggtgcagctgtgaaggttcctcca

SEQ ID NO: 204010 - DNA, 25 bp, Mus musculus
aggtgcagctgttatttcttctcca

SEQ ID NO: 204011 - DNA, 25 bp, Mus musculus
aggtgcagcttccagcttggaaacc

SEQ ID NO: 204012 - DNA, 25 bp, Mus musculus
aggtgcagcttcgagcttggaaacc

SEQ ID NO: 204013 - DNA, 25 bp, Mus musculus
aggtgcaggagaccaaatgcctgtt

SEQ ID NO: 204014 - DNA, 25 bp, Mus musculus
aggtgcaggagagcaaatgcctgtt

SEQ ID NO: 204015 - DNA, 25 bp, Mus musculus
aggtgcaggatcagaccccagccat

SEQ ID NO: 204016 - DNA, 25 bp, Mus musculus
aggtgcaggatctgaccccagccat

SEQ ID NO: 204017 - DNA, 25 bp, Mus musculus
aggtgcaggcaaacccttccagctg

SEQ ID NO: 204018 - DNA, 25 bp, Mus musculus
aggtgcaggcaatcccttccagctg

SEQ ID NO: 204019 - DNA, 25 bp, Mus musculus
aggtgcagtctccacttggtgctta

SEQ ID NO: 204020 - DNA, 25 bp, Mus musculus
aggtgcagtctcgacttggtgctta

SEQ ID NO: 204021 - DNA, 25 bp, Mus musculus
aggtgcagtgccattagacttaccg

SEQ ID NO: 204022 - DNA, 25 bp, Mus musculus
aggtgcagtgcctttagacttaccg

SEQ ID NO: 204023 - DNA, 25 bp, Mus musculus
aggtgcagtttgctttggcattccc

SEQ ID NO: 204024 - DNA, 25 bp, Mus musculus
aggtgcagtttggtttggcattccc

SEQ ID NO: 204025 - DNA, 25 bp, Mus musculus
aggtgcatacgcatgggcttgtcat

SEQ ID NO: 204026 - DNA, 25 bp, Mus musculus
aggtgcatacgcttgggcttgtcat

SEQ ID NO: 204027 - DNA, 25 bp, Mus musculus
aggtgcatactaaaatccaggttga

SEQ ID NO: 204028 - DNA, 25 bp, Mus musculus
aggtgcatactataatccaggttga

SEQ ID NO: 204029 - DNA, 25 bp, Mus musculus
aggtgcatattgacctgtcctttgt

SEQ ID NO: 204030 - DNA, 25 bp, Mus musculus
aggtgcatattgtcctgtcctttgt

SEQ ID NO: 204031 - DNA, 25 bp, Mus musculus
aggtgcatctatatgtcttttgaca

SEQ ID NO: 204032 - DNA, 25 bp, Mus musculus
aggtgcatctatttgtcttttgaca

SEQ ID NO: 204033 - DNA, 25 bp, Mus musculus
aggtgcatgcctcatggtagacatc

SEQ ID NO: 204034 - DNA, 25 bp, Mus musculus
aggtgcatgcctgatggtagacatc

SEQ ID NO: 204035 - DNA, 25 bp, Mus musculus
aggtgcatggagacacaagcagaca

SEQ ID NO: 204036 - DNA, 25 bp, Mus musculus
aggtgcatggagtcacaagcagaca

SEQ ID NO: 204037 - DNA, 25 bp, Mus musculus
aggtgcattccgcagcttagactct

SEQ ID NO: 204038 - DNA, 25 bp, Mus musculus
aggtgcattccggagcttagactct

SEQ ID NO: 204039 - DNA, 25 bp, Mus musculus
aggtgcattgccattcagactcagt

SEQ ID NO: 204040 - DNA, 25 bp, Mus musculus
aggtgcattgcctttcagactcagt

SEQ ID NO: 204041 - DNA, 25 bp, Mus musculus
aggtgcattgtgagctgttcccaaa

SEQ ID NO: 204042 - DNA, 25 bp, Mus musculus
aggtgcattgtgtgctgttcccaaa

SEQ ID NO: 204043 - DNA, 25 bp, Mus musculus
aggtgcattttcatatccaggttta

SEQ ID NO: 204044 - DNA, 25 bp, Mus musculus
aggtgcattttcttatccaggttta

SEQ ID NO: 204045 - DNA, 25 bp, Mus musculus
aggtgccaacctccagtgtgaggta

SEQ ID NO: 204046 - DNA, 25 bp, Mus musculus
aggtgccaacctgcagtgtgaggta

SEQ ID NO: 204047 - DNA, 25 bp, Mus musculus
aggtgccaacgcaaggtcacaggga

SEQ ID NO: 204048 - DNA, 25 bp, Mus musculus
aggtgccaacgctaggtcacaggga

SEQ ID NO: 204049 - DNA, 25 bp, Mus musculus
aggtgccaagttcccaggtatacaa

SEQ ID NO: 204050 - DNA, 25 bp, Mus musculus
aggtgccaagttgccaggtatacaa

SEQ ID NO: 204051 - DNA, 25 bp, Mus musculus
aggtgccacaccacaaccagaatgc

SEQ ID NO: 204052 - DNA, 25 bp, Mus musculus
aggtgccacacctcaaccagaatgc

SEQ ID NO: 204053 - DNA, 25 bp, Mus musculus
aggtgccacctaaccttatgacatc

SEQ ID NO: 204054 - DNA, 25 bp, Mus musculus
aggtgccacctatccttatgacatc

SEQ ID NO: 204055 - DNA, 25 bp, Mus musculus
aggtgccacgcaccttgtgtggaca

SEQ ID NO: 204056 - DNA, 25 bp, Mus musculus
aggtgccacgcagcttgtgtggaca

SEQ ID NO: 204057 - DNA, 25 bp, Mus musculus
aggtgccactggagtctttaccaat

SEQ ID NO: 204058 - DNA, 25 bp, Mus musculus
aggtgccactggtgtctttaccaat

SEQ ID NO: 204059 - DNA, 25 bp, Mus musculus
aggtgccagaccagatctgaagtgc

SEQ ID NO: 204060 - DNA, 25 bp, Mus musculus
aggtgccagacctgatctgaagtgc

SEQ ID NO: 204061 - DNA, 25 bp, Mus musculus
aggtgccagctcagacatcatccag

SEQ ID NO: 204062 - DNA, 25 bp, Mus musculus
aggtgccagctcagcctgttggctg

SEQ ID NO: 204063 - DNA, 25 bp, Mus musculus
aggtgccagctctgacatcatccag

SEQ ID NO: 204064 - DNA, 25 bp, Mus musculus
aggtgccagctctgcctgttggctg

SEQ ID NO: 204065 - DNA, 25 bp, Mus musculus
aggtgccaggaaccagtatctgccc

SEQ ID NO: 204066 - DNA, 25 bp, Mus musculus
aggtgccaggaagcagtatctgccc

SEQ ID NO: 204067 - DNA, 25 bp, Mus musculus
aggtgccaggtcagcctagcgttta

SEQ ID NO: 204068 - DNA, 25 bp, Mus musculus
aggtgccaggtctgcctagcgttta

SEQ ID NO: 204069 - DNA, 25 bp, Mus musculus
aggtgccatcgaacactatgtgaca

SEQ ID NO: 204070 - DNA, 25 bp, Mus musculus
aggtgccatcgatcactatgtgaca

SEQ ID NO: 204071 - DNA, 25 bp, Mus musculus
aggtgccatgaaactgaacaggtaa

SEQ ID NO: 204072 - DNA, 25 bp, Mus musculus
aggtgccatgaatctgaacaggtaa

SEQ ID NO: 204073 - DNA, 25 bp, Mus musculus
aggtgccatgatctgggccattgac

SEQ ID NO: 204074 - DNA, 25 bp, Mus musculus
aggtgccatgatgtgggccattgac

SEQ ID NO: 204075 - DNA, 25 bp, Mus musculus
aggtgccatgtcattgccgtacgtg

SEQ ID NO: 204076 - DNA, 25 bp, Mus musculus
aggtgccatgtctttgccgtacgtg

SEQ ID NO: 204077 - DNA, 25 bp, Mus musculus
aggtgccatgttatcctgaatgact

SEQ ID NO: 204078 - DNA, 25 bp, Mus musculus
aggtgccatgttttcctgaatgact

SEQ ID NO: 204079 - DNA, 25 bp, Mus musculus
aggtgccattgaaaacgctgctctt

SEQ ID NO: 204080 - DNA, 25 bp, Mus musculus
aggtgccattgataacgctgctctt

SEQ ID NO: 204081 - DNA, 25 bp, Mus musculus
aggtgcccaggccattgcagtagct

SEQ ID NO: 204082 - DNA, 25 bp, Mus musculus
aggtgcccaggcgattgcagtagct

SEQ ID NO: 204083 - DNA, 25 bp, Mus musculus
aggtgcccatctcaaggccatcgtg

SEQ ID NO: 204084 - DNA, 25 bp, Mus musculus
aggtgcccatctgaaggccatcgtg

SEQ ID NO: 204085 - DNA, 25 bp, Mus musculus
aggtgcccatgaccaagatcctgtg

SEQ ID NO: 204086 - DNA, 25 bp, Mus musculus
aggtgcccatgagcaagatcctgtg

SEQ ID NO: 204087 - DNA, 25 bp, Mus musculus
aggtgcccatggacccaaggctgtt

SEQ ID NO: 204088 - DNA, 25 bp, Mus musculus
aggtgcccatggtcccaaggctgtt

SEQ ID NO: 204089 - DNA, 25 bp, Mus musculus
aggtgccccacgcagctctgagctt

SEQ ID NO: 204090 - DNA, 25 bp, Mus musculus
aggtgccccacggagctctgagctt

SEQ ID NO: 204091 - DNA, 25 bp, Mus musculus
aggtgccccagccatggatcagcta

SEQ ID NO: 204092 - DNA, 25 bp, Mus musculus
aggtgccccagcgatggatcagcta

SEQ ID NO: 204093 - DNA, 25 bp, Mus musculus
aggtgccccctgagagaacgtactg

SEQ ID NO: 204094 - DNA, 25 bp, Mus musculus
aggtgccccctgtgagaacgtactg

SEQ ID NO: 204095 - DNA, 25 bp, Mus musculus
aggtgcccctggagtctgactctgt

SEQ ID NO: 204096 - DNA, 25 bp, Mus musculus
aggtgcccctggtgtctgactctgt

SEQ ID NO: 204097 - DNA, 25 bp, Mus musculus
aggtgcccgaagaacgtcatgatgc

SEQ ID NO: 204098 - DNA, 25 bp, Mus musculus
aggtgcccgaagtacgtcatgatgc

SEQ ID NO: 204099 - DNA, 25 bp, Mus musculus
aggtgcccgatgagtttgagatttc

SEQ ID NO: 204100 - DNA, 25 bp, Mus musculus
aggtgcccgatgtgtttgagatttc

SEQ ID NO: 204101 - DNA, 25 bp, Mus musculus
aggtgcccgcaacagccaaggaagt

SEQ ID NO: 204102 - DNA, 25 bp, Mus musculus
aggtgcccgcaagagccaaggaagt

SEQ ID NO: 204103 - DNA, 25 bp, Mus musculus
aggtgcccgttcatatactaatggt

SEQ ID NO: 204104 - DNA, 25 bp, Mus musculus
aggtgcccgttcttatactaatggt

SEQ ID NO: 204105 - DNA, 25 bp, Mus musculus
aggtgccgacttacgagatcacgtc

SEQ ID NO: 204106 - DNA, 25 bp, Mus musculus
aggtgccgactttcgagatcacgtc

SEQ ID NO: 204107 - DNA, 25 bp, Mus musculus
aggtgccgatgtactctgcgcaatg

SEQ ID NO: 204108 - DNA, 25 bp, Mus musculus
aggtgccgatgttctctgcgcaatg

SEQ ID NO: 204109 - DNA, 25 bp, Mus musculus
aggtgccgggcactgtaccaataca

SEQ ID NO: 204110 - DNA, 25 bp, Mus musculus
aggtgccgggcagtgtaccaataca

SEQ ID NO: 204111 - DNA, 25 bp, Mus musculus
aggtgccgtgtcatggtgtcagttc

SEQ ID NO: 204112 - DNA, 25 bp, Mus musculus
aggtgccgtgtcttggtgtcagttc

SEQ ID NO: 204113 - DNA, 25 bp, Mus musculus
aggtgccgtgttctcattgtgacat

SEQ ID NO: 204114 - DNA, 25 bp, Mus musculus
aggtgccgtgttgtcattgtgacat

SEQ ID NO: 204115 - DNA, 25 bp, Mus musculus
aggtgcctacttagctaacggacta

SEQ ID NO: 204116 - DNA, 25 bp, Mus musculus
aggtgcctactttgctaacggacta

SEQ ID NO: 204117 - DNA, 25 bp, Mus musculus
aggtgcctagtcaaggccaaccttt

SEQ ID NO: 204118 - DNA, 25 bp, Mus musculus
aggtgcctagtctaggccaaccttt

SEQ ID NO: 204119 - DNA, 25 bp, Mus musculus
aggtgcctcatccaccataaaatag

SEQ ID NO: 204120 - DNA, 25 bp, Mus musculus
aggtgcctcatcgaccataaaatag

SEQ ID NO: 204121 - DNA, 25 bp, Mus musculus
aggtgcctccaaatggtgcttcagc

SEQ ID NO: 204122 - DNA, 25 bp, Mus musculus
aggtgcctccaattggtgcttcagc

SEQ ID NO: 204123 - DNA, 25 bp, Mus musculus
aggtgcctcgggactgaggcacacc

SEQ ID NO: 204124 - DNA, 25 bp, Mus musculus
aggtgcctcgggtctgaggcacacc

SEQ ID NO: 204125 - DNA, 25 bp, Mus musculus
aggtgcctcgtacccttcatttggg

SEQ ID NO: 204126 - DNA, 25 bp, Mus musculus
aggtgcctcgtagccttcatttggg

SEQ ID NO: 204127 - DNA, 25 bp, Mus musculus
aggtgcctgatcaactggaaaacat

SEQ ID NO: 204128 - DNA, 25 bp, Mus musculus
aggtgcctgatctactggaaaacat

SEQ ID NO: 204129 - DNA, 25 bp, Mus musculus
aggtgcctgctacccaaactgaaaa

SEQ ID NO: 204130 - DNA, 25 bp, Mus musculus
aggtgcctgctacctgtgttaggac

SEQ ID NO: 204131 - DNA, 25 bp, Mus musculus
aggtgcctgctagccaaactgaaaa

SEQ ID NO: 204132 - DNA, 25 bp, Mus musculus
aggtgcctgctagctgtgttaggac

SEQ ID NO: 204133 - DNA, 25 bp, Mus musculus
aggtgcctgctgattataatgttga

SEQ ID NO: 204134 - DNA, 25 bp, Mus musculus
aggtgcctgctgtttataatgttga

SEQ ID NO: 204135 - DNA, 25 bp, Mus musculus
aggtgcctgggaagcaagcctccat

SEQ ID NO: 204136 - DNA, 25 bp, Mus musculus
aggtgcctgggatgcaagcctccat

SEQ ID NO: 204137 - DNA, 25 bp, Mus musculus
aggtgcctgtggagccttagatgcc

SEQ ID NO: 204138 - DNA, 25 bp, Mus musculus
aggtgcctgtggtgccttagatgcc

SEQ ID NO: 204139 - DNA, 25 bp, Mus musculus
aggtgccttattagtgtgcgaccac

SEQ ID NO: 204140 - DNA, 25 bp, Mus musculus
aggtgccttatttgtgtgcgaccac

SEQ ID NO: 204141 - DNA, 25 bp, Mus musculus
aggtgccttctcagtgttggactga

SEQ ID NO: 204142 - DNA, 25 bp, Mus musculus
aggtgccttctctgtgttggactga

SEQ ID NO: 204143 - DNA, 25 bp, Mus musculus
aggtgccttgagaatcctgaattca

SEQ ID NO: 204144 - DNA, 25 bp, Mus musculus
aggtgccttgagtatcctgaattca

SEQ ID NO: 204145 - DNA, 25 bp, Mus musculus
aggtgccttgttcatgccctgggtt

SEQ ID NO: 204146 - DNA, 25 bp, Mus musculus
aggtgccttgttgatgccctgggtt

SEQ ID NO: 204147 - DNA, 25 bp, Mus musculus
aggtgcctttgacgcctttgatacc

SEQ ID NO: 204148 - DNA, 25 bp, Mus musculus
aggtgcctttgaggcctttgatacc

SEQ ID NO: 204149 - DNA, 25 bp, Mus musculus
aggtgcgaggacagacttgagaaac

SEQ ID NO: 204150 - DNA, 25 bp, Mus musculus
aggtgcgaggactgacttgagaaac

SEQ ID NO: 204151 - DNA, 25 bp, Mus musculus
aggtgcgaggcacgactacatacaa

SEQ ID NO: 204152 - DNA, 25 bp, Mus musculus
aggtgcgaggcaggactacatacaa

SEQ ID NO: 204153 - DNA, 25 bp, Mus musculus
aggtgcgcaccaatgtggaagaagt

SEQ ID NO: 204154 - DNA, 25 bp, Mus musculus
aggtgcgcaccattgtggaagaagt

SEQ ID NO: 204155 - DNA, 25 bp, Mus musculus
aggtgcgcacgtacacgcgcctcag

SEQ ID NO: 204156 - DNA, 25 bp, Mus musculus
aggtgcgcacgttcacgcgcctcag

SEQ ID NO: 204157 - DNA, 25 bp, Mus musculus
aggtgcgccaagaggaaaccgcctg

SEQ ID NO: 204158 - DNA, 25 bp, Mus musculus
aggtgcgccaagtggaaaccgcctg

SEQ ID NO: 204159 - DNA, 25 bp, Mus musculus
aggtgcgccatccattcgactgttg

SEQ ID NO: 204160 - DNA, 25 bp, Mus musculus
aggtgcgccatcgattcgactgttg

SEQ ID NO: 204161 - DNA, 25 bp, Mus musculus
aggtgcgcccacaatccatgtgtta

SEQ ID NO: 204162 - DNA, 25 bp, Mus musculus
aggtgcgcccactatccatgtgtta

SEQ ID NO: 204163 - DNA, 25 bp, Mus musculus
aggtgcgccctcaagtgagatctga

SEQ ID NO: 204164 - DNA, 25 bp, Mus musculus
aggtgcgccctctagtgagatctga

SEQ ID NO: 204165 - DNA, 25 bp, Mus musculus
aggtgcgctaggagggaggctcgcc

SEQ ID NO: 204166 - DNA, 25 bp, Mus musculus
aggtgcgctaggtgggaggctcgcc

SEQ ID NO: 204167 - DNA, 25 bp, Mus musculus
aggtgcgctttcattacagtggctg

SEQ ID NO: 204168 - DNA, 25 bp, Mus musculus
aggtgcgctttctttacagtggctg

SEQ ID NO: 204169 - DNA, 25 bp, Mus musculus
aggtgcggataaatctcgttcttca

SEQ ID NO: 204170 - DNA, 25 bp, Mus musculus
aggtgcggataattctcgttcttca

SEQ ID NO: 204171 - DNA, 25 bp, Mus musculus
aggtgcgggctcatgccacagctaa

SEQ ID NO: 204172 - DNA, 25 bp, Mus musculus
aggtgcgggctcttgccacagctaa

SEQ ID NO: 204173 - DNA, 25 bp, Mus musculus
aggtgcgggtccatccatatccgtt

SEQ ID NO: 204174 - DNA, 25 bp, Mus musculus
aggtgcgggtccttccatatccgtt

SEQ ID NO: 204175 - DNA, 25 bp, Mus musculus
aggtgcgggtgaacctcaaggccat

SEQ ID NO: 204176 - DNA, 25 bp, Mus musculus
aggtgcgggtgatcctcaaggccat

SEQ ID NO: 204177 - DNA, 25 bp, Mus musculus
aggtgcggtttgcagccttgattac

SEQ ID NO: 204178 - DNA, 25 bp, Mus musculus
aggtgcggtttggagccttgattac

SEQ ID NO: 204179 - DNA, 25 bp, Mus musculus
aggtgcgtaagaacccagactgggt

SEQ ID NO: 204180 - DNA, 25 bp, Mus musculus
aggtgcgtaagatcccagactgggt

SEQ ID NO: 204181 - DNA, 25 bp, Mus musculus
aggtgcgtaagcaggaatctaccct

SEQ ID NO: 204182 - DNA, 25 bp, Mus musculus
aggtgcgtaagctggaatctaccct

SEQ ID NO: 204183 - DNA, 25 bp, Mus musculus
aggtgcgtaccaagctaacaggtcc

SEQ ID NO: 204184 - DNA, 25 bp, Mus musculus
aggtgcgtaccatgctaacaggtcc

SEQ ID NO: 204185 - DNA, 25 bp, Mus musculus
aggtgcgtttttctctttcctacat

SEQ ID NO: 204186 - DNA, 25 bp, Mus musculus
aggtgcgtttttgtctttcctacat

SEQ ID NO: 204187 - DNA, 25 bp, Mus musculus
aggtgctaacataggccctttgtaa

SEQ ID NO: 204188 - DNA, 25 bp, Mus musculus
aggtgctaacattggccctttgtaa

SEQ ID NO: 204189 - DNA, 25 bp, Mus musculus
aggtgctaagccaagccaacactgg

SEQ ID NO: 204190 - DNA, 25 bp, Mus musculus
aggtgctaagcctagccaacactgg

SEQ ID NO: 204191 - DNA, 25 bp, Mus musculus
aggtgctaatctcgccttattaagt

SEQ ID NO: 204192 - DNA, 25 bp, Mus musculus
aggtgctaatctggccttattaagt

SEQ ID NO: 204193 - DNA, 25 bp, Mus musculus
aggtgctaatgtctatccctggtgc

SEQ ID NO: 204194 - DNA, 25 bp, Mus musculus
aggtgctaatgtgtatccctggtgc

SEQ ID NO: 204195 - DNA, 25 bp, Mus musculus
aggtgctaccacagaccttcaattc

SEQ ID NO: 204196 - DNA, 25 bp, Mus musculus
aggtgctaccactgaccttcaattc

SEQ ID NO: 204197 - DNA, 25 bp, Mus musculus
aggtgctacttaagtgcctggcagg

SEQ ID NO: 204198 - DNA, 25 bp, Mus musculus
aggtgctacttaatttccaacattg

SEQ ID NO: 204199 - DNA, 25 bp, Mus musculus
aggtgctacttatgtgcctggcagg

SEQ ID NO: 204200 - DNA, 25 bp, Mus musculus
aggtgctacttattttccaacattg

SEQ ID NO: 204201 - DNA, 25 bp, Mus musculus
aggtgctagatccacagaaccgcga

SEQ ID NO: 204202 - DNA, 25 bp, Mus musculus
aggtgctagatcgacagaaccgcga

SEQ ID NO: 204203 - DNA, 25 bp, Mus musculus
aggtgctagccaagcagccgtcctt

SEQ ID NO: 204204 - DNA, 25 bp, Mus musculus
aggtgctagccatgcagccgtcctt

SEQ ID NO: 204205 - DNA, 25 bp, Mus musculus
aggtgctagcctcaggtcgagccat

SEQ ID NO: 204206 - DNA, 25 bp, Mus musculus
aggtgctagcctgaggtcgagccat

SEQ ID NO: 204207 - DNA, 25 bp, Mus musculus
aggtgctatctactggtataaacaa

SEQ ID NO: 204208 - DNA, 25 bp, Mus musculus
aggtgctatctagtggtataaacaa

SEQ ID NO: 204209 - DNA, 25 bp, Mus musculus
aggtgctatcttattcgacttcaaa

SEQ ID NO: 204210 - DNA, 25 bp, Mus musculus
aggtgctatctttttcgacttcaaa

SEQ ID NO: 204211 - DNA, 25 bp, Mus musculus
aggtgctatgctactgttgttattc

SEQ ID NO: 204212 - DNA, 25 bp, Mus musculus
aggtgctatgcttctgttgttattc

SEQ ID NO: 204213 - DNA, 25 bp, Mus musculus
aggtgctattggactcctggactta

SEQ ID NO: 204214 - DNA, 25 bp, Mus musculus
aggtgctattggtctcctggactta

SEQ ID NO: 204215 - DNA, 25 bp, Mus musculus
aggtgctcaactatccttgtactct

SEQ ID NO: 204216 - DNA, 25 bp, Mus musculus
aggtgctcaactcgatgctgcgcaa

SEQ ID NO: 204217 - DNA, 25 bp, Mus musculus
aggtgctcaactggatgctgcgcaa

SEQ ID NO: 204218 - DNA, 25 bp, Mus musculus
aggtgctcaactttccttgtactct

SEQ ID NO: 204219 - DNA, 25 bp, Mus musculus
aggtgctcaccgagaagccgactca

SEQ ID NO: 204220 - DNA, 25 bp, Mus musculus
aggtgctcaccgtgaagccgactca

SEQ ID NO: 204221 - DNA, 25 bp, Mus musculus
aggtgctcacctccttttgtgagag

SEQ ID NO: 204222 - DNA, 25 bp, Mus musculus
aggtgctcacctctcttgatacacc

SEQ ID NO: 204223 - DNA, 25 bp, Mus musculus
aggtgctcacctgcttttgtgagag

SEQ ID NO: 204224 - DNA, 25 bp, Mus musculus
aggtgctcacctgtcttgatacacc

SEQ ID NO: 204225 - DNA, 25 bp, Mus musculus
aggtgctcactactctgtttcattt

SEQ ID NO: 204226 - DNA, 25 bp, Mus musculus
aggtgctcactagtctgtttcattt

SEQ ID NO: 204227 - DNA, 25 bp, Mus musculus
aggtgctcagataacacccagcttt

SEQ ID NO: 204228 - DNA, 25 bp, Mus musculus
aggtgctcagattacacccagcttt

SEQ ID NO: 204229 - DNA, 25 bp, Mus musculus
aggtgctcagcgaatacctgcgtga

SEQ ID NO: 204230 - DNA, 25 bp, Mus musculus
aggtgctcagcgtatacctgcgtga

SEQ ID NO: 204231 - DNA, 25 bp, Mus musculus
aggtgctcaggacatctcaggctct

SEQ ID NO: 204232 - DNA, 25 bp, Mus musculus
aggtgctcaggagatctcaggctct

SEQ ID NO: 204233 - DNA, 25 bp, Mus musculus
aggtgctcaggcatagatttcttgg

SEQ ID NO: 204234 - DNA, 25 bp, Mus musculus
aggtgctcaggcttagatttcttgg

SEQ ID NO: 204235 - DNA, 25 bp, Mus musculus
aggtgctcataccatggcccatcat

SEQ ID NO: 204236 - DNA, 25 bp, Mus musculus
aggtgctcatacgatggcccatcat

SEQ ID NO: 204237 - DNA, 25 bp, Mus musculus
aggtgctccaggagcactcaggcag

SEQ ID NO: 204238 - DNA, 25 bp, Mus musculus
aggtgctccaggtgcactcaggcag

SEQ ID NO: 204239 - DNA, 25 bp, Mus musculus
aggtgctccatcactgaggctaagg

SEQ ID NO: 204240 - DNA, 25 bp, Mus musculus
aggtgctccatctctgaggctaagg

SEQ ID NO: 204241 - DNA, 25 bp, Mus musculus
aggtgctcctgaccagagcatctct

SEQ ID NO: 204242 - DNA, 25 bp, Mus musculus
aggtgctcctgagcagagcatctct

SEQ ID NO: 204243 - DNA, 25 bp, Mus musculus
aggtgctcgctgcacattcagggaa

SEQ ID NO: 204244 - DNA, 25 bp, Mus musculus
aggtgctcgctggacattcagggaa

SEQ ID NO: 204245 - DNA, 25 bp, Mus musculus
aggtgctctacacgctgaccagcga

SEQ ID NO: 204246 - DNA, 25 bp, Mus musculus
aggtgctctacaggctgaccagcga

SEQ ID NO: 204247 - DNA, 25 bp, Mus musculus
aggtgctctactctaatccacaaag

SEQ ID NO: 204248 - DNA, 25 bp, Mus musculus
aggtgctctactgtaatccacaaag

SEQ ID NO: 204249 - DNA, 25 bp, Mus musculus
aggtgctctgccaaacagctcaagg

SEQ ID NO: 204250 - DNA, 25 bp, Mus musculus
aggtgctctgcctaacagctcaagg

SEQ ID NO: 204251 - DNA, 25 bp, Mus musculus
aggtgctctgtaaaattggtctggt

SEQ ID NO: 204252 - DNA, 25 bp, Mus musculus
aggtgctctgtataattggtctggt

SEQ ID NO: 204253 - DNA, 25 bp, Mus musculus
aggtgctctgtgaacttaaccccag

SEQ ID NO: 204254 - DNA, 25 bp, Mus musculus
aggtgctctgtgtacttaaccccag

SEQ ID NO: 204255 - DNA, 25 bp, Mus musculus
aggtgctgaagtccaactgcgtctc

SEQ ID NO: 204256 - DNA, 25 bp, Mus musculus
aggtgctgaagtgcaactgcgtctc

SEQ ID NO: 204257 - DNA, 25 bp, Mus musculus
aggtgctgacctctcggacatgaac

SEQ ID NO: 204258 - DNA, 25 bp, Mus musculus
aggtgctgacctgtcggacatgaac

SEQ ID NO: 204259 - DNA, 25 bp, Mus musculus
aggtgctgagctccatgctgtcgtc

SEQ ID NO: 204260 - DNA, 25 bp, Mus musculus
aggtgctgagctgcatgctgtcgtc

SEQ ID NO: 204261 - DNA, 25 bp, Mus musculus
aggtgctgattcaccagctggtgaa

SEQ ID NO: 204262 - DNA, 25 bp, Mus musculus
aggtgctgattctccagctggtgaa

SEQ ID NO: 204263 - DNA, 25 bp, Mus musculus
aggtgctgatttaaccttgtcccaa

SEQ ID NO: 204264 - DNA, 25 bp, Mus musculus
aggtgctgattttaccttgtcccaa

SEQ ID NO: 204265 - DNA, 25 bp, Mus musculus
aggtgctgcagaagcagcctcattt

SEQ ID NO: 204266 - DNA, 25 bp, Mus musculus
aggtgctgcagatgcagcctcattt

SEQ ID NO: 204267 - DNA, 25 bp, Mus musculus
aggtgctgcctcagactgtatgtag

SEQ ID NO: 204268 - DNA, 25 bp, Mus musculus
aggtgctgcctctgactgtatgtag

SEQ ID NO: 204269 - DNA, 25 bp, Mus musculus
aggtgctgccttctgggaacactta

SEQ ID NO: 204270 - DNA, 25 bp, Mus musculus
aggtgctgccttgtgggaacactta

SEQ ID NO: 204271 - DNA, 25 bp, Mus musculus
aggtgctgcgcgatttgggcaaacc

SEQ ID NO: 204272 - DNA, 25 bp, Mus musculus
aggtgctgcgcgttttgggcaaacc

SEQ ID NO: 204273 - DNA, 25 bp, Mus musculus
aggtgctgctatactgggcaactat

SEQ ID NO: 204274 - DNA, 25 bp, Mus musculus
aggtgctgctattctgggcaactat

SEQ ID NO: 204275 - DNA, 25 bp, Mus musculus
aggtgctgctctcttccacaggaaa

SEQ ID NO: 204276 - DNA, 25 bp, Mus musculus
aggtgctgctctgttccacaggaaa

SEQ ID NO: 204277 - DNA, 25 bp, Mus musculus
aggtgctgcttgaccaacaggttca

SEQ ID NO: 204278 - DNA, 25 bp, Mus musculus
aggtgctgcttgtccaacaggttca

SEQ ID NO: 204279 - DNA, 25 bp, Mus musculus
aggtgctggactaatttcctcctgt

SEQ ID NO: 204280 - DNA, 25 bp, Mus musculus
aggtgctggacttatttcctcctgt

SEQ ID NO: 204281 - DNA, 25 bp, Mus musculus
aggtgctggcacatggctttgattc

SEQ ID NO: 204282 - DNA, 25 bp, Mus musculus
aggtgctggcacttggctttgattc

SEQ ID NO: 204283 - DNA, 25 bp, Mus musculus
aggtgctggcatatctactcaagag

SEQ ID NO: 204284 - DNA, 25 bp, Mus musculus
aggtgctggcatttctactcaagag

SEQ ID NO: 204285 - DNA, 25 bp, Mus musculus
aggtgctggtgtcatctgtttctcc

SEQ ID NO: 204286 - DNA, 25 bp, Mus musculus
aggtgctggtgtgatctgtttctcc

SEQ ID NO: 204287 - DNA, 25 bp, Mus musculus
aggtgctggtttagctcgaaatctc

SEQ ID NO: 204288 - DNA, 25 bp, Mus musculus
aggtgctggtttcccaactgacaaa

SEQ ID NO: 204289 - DNA, 25 bp, Mus musculus
aggtgctggtttgccaactgacaaa

SEQ ID NO: 204290 - DNA, 25 bp, Mus musculus
aggtgctggttttgctcgaaatctc

SEQ ID NO: 204291 - DNA, 25 bp, Mus musculus
aggtgctgtaacactactgtcgttg

SEQ ID NO: 204292 - DNA, 25 bp, Mus musculus
aggtgctgtaactctactgtcgttg

SEQ ID NO: 204293 - DNA, 25 bp, Mus musculus
aggtgctgtcagaaggtttccatgt

SEQ ID NO: 204294 - DNA, 25 bp, Mus musculus
aggtgctgtcagtaggtttccatgt

SEQ ID NO: 204295 - DNA, 25 bp, Mus musculus
aggtgctgtcccaaaggacggacaa

SEQ ID NO: 204296 - DNA, 25 bp, Mus musculus
aggtgctgtccctaaggacggacaa

SEQ ID NO: 204297 - DNA, 25 bp, Mus musculus
aggtgctgtgagactgtaatcctgg

SEQ ID NO: 204298 - DNA, 25 bp, Mus musculus
aggtgctgtgagtctgtaatcctgg

SEQ ID NO: 204299 - DNA, 25 bp, Mus musculus
aggtgctgtgatcacttcccagggc

SEQ ID NO: 204300 - DNA, 25 bp, Mus musculus
aggtgctgtgatgacttcccagggc

SEQ ID NO: 204301 - DNA, 25 bp, Mus musculus
aggtgctgttatcctgggagtccct

SEQ ID NO: 204302 - DNA, 25 bp, Mus musculus
aggtgctgttatgctgggagtccct

SEQ ID NO: 204303 - DNA, 25 bp, Mus musculus
aggtgctgtttgaactggctctgct

SEQ ID NO: 204304 - DNA, 25 bp, Mus musculus
aggtgctgtttgtactggctctgct

SEQ ID NO: 204305 - DNA, 25 bp, Mus musculus
aggtgcttagctctattgctttcaa

SEQ ID NO: 204306 - DNA, 25 bp, Mus musculus
aggtgcttagctgtattgctttcaa

SEQ ID NO: 204307 - DNA, 25 bp, Mus musculus
aggtgcttatgcctcttagtaaata

SEQ ID NO: 204308 - DNA, 25 bp, Mus musculus
aggtgcttatgcgtcttagtaaata

SEQ ID NO: 204309 - DNA, 25 bp, Mus musculus
aggtgcttcaagacatttccttctc

SEQ ID NO: 204310 - DNA, 25 bp, Mus musculus
aggtgcttcaagtcatttccttctc

SEQ ID NO: 204311 - DNA, 25 bp, Mus musculus
aggtgcttcagcattaattatacta

SEQ ID NO: 204312 - DNA, 25 bp, Mus musculus
aggtgcttcagccagcacggcaaat

SEQ ID NO: 204313 - DNA, 25 bp, Mus musculus
aggtgcttcagcgagcacggcaaat

SEQ ID NO: 204314 - DNA, 25 bp, Mus musculus
aggtgcttcagctttaattatacta

SEQ ID NO: 204315 - DNA, 25 bp, Mus musculus
aggtgcttcatgcagacatctgtac

SEQ ID NO: 204316 - DNA, 25 bp, Mus musculus
aggtgcttcatggagacatctgtac

SEQ ID NO: 204317 - DNA, 25 bp, Mus musculus
aggtgcttcgctacgacagcgctgt

SEQ ID NO: 204318 - DNA, 25 bp, Mus musculus
aggtgcttcgcttcgacagcgctgt

SEQ ID NO: 204319 - DNA, 25 bp, Mus musculus
aggtgcttcggaactgtccagtgaa

SEQ ID NO: 204320 - DNA, 25 bp, Mus musculus
aggtgcttcggatctgtccagtgaa

SEQ ID NO: 204321 - DNA, 25 bp, Mus musculus
aggtgcttgcaacctttatccgacc

SEQ ID NO: 204322 - DNA, 25 bp, Mus musculus
aggtgcttgcaagctttatccgacc

SEQ ID NO: 204323 - DNA, 25 bp, Mus musculus
aggtgcttgggccatcgaacgctcc

SEQ ID NO: 204324 - DNA, 25 bp, Mus musculus
aggtgcttgggcgatcgaacgctcc

SEQ ID NO: 204325 - DNA, 25 bp, Mus musculus
aggtgcttggtaaggttcctgttga

SEQ ID NO: 204326 - DNA, 25 bp, Mus musculus
aggtgcttggtatggttcctgttga

SEQ ID NO: 204327 - DNA, 25 bp, Mus musculus
aggtgcttgtggcatctgcacagaa

SEQ ID NO: 204328 - DNA, 25 bp, Mus musculus
aggtgcttgtgggatctgcacagaa

SEQ ID NO: 204329 - DNA, 25 bp, Mus musculus
aggtgctttactatgctttcatctg

SEQ ID NO: 204330 - DNA, 25 bp, Mus musculus
aggtgctttactttgctttcatctg

SEQ ID NO: 204331 - DNA, 25 bp, Mus musculus
aggtgctttcaaaggtgccccgttg

SEQ ID NO: 204332 - DNA, 25 bp, Mus musculus
aggtgctttcaatggtgccccgttg

SEQ ID NO: 204333 - DNA, 25 bp, Mus musculus
aggtgctttccccattgagaacatt

SEQ ID NO: 204334 - DNA, 25 bp, Mus musculus
aggtgctttcccgattgagaacatt

SEQ ID NO: 204335 - DNA, 25 bp, Mus musculus
aggtgctttctcacacagtgtttta

SEQ ID NO: 204336 - DNA, 25 bp, Mus musculus
aggtgctttctctcacagtgtttta

SEQ ID NO: 204337 - DNA, 25 bp, Mus musculus
aggtgctttggaatcccagcatcac

SEQ ID NO: 204338 - DNA, 25 bp, Mus musculus
aggtgctttggattcccagcatcac

SEQ ID NO: 204339 - DNA, 25 bp, Mus musculus
aggtgcttttctatcctatcattta

SEQ ID NO: 204340 - DNA, 25 bp, Mus musculus
aggtgcttttctttcctatcattta

SEQ ID NO: 204341 - DNA, 25 bp, Mus musculus
aggtggaaaccgagctgacgcctgc

SEQ ID NO: 204342 - DNA, 25 bp, Mus musculus
aggtggaaaccgtgctgacgcctgc

SEQ ID NO: 204343 - DNA, 25 bp, Mus musculus
aggtggaaagggatcattagctgcc

SEQ ID NO: 204344 - DNA, 25 bp, Mus musculus
aggtggaaagggttcattagctgcc

SEQ ID NO: 204345 - DNA, 25 bp, Mus musculus
aggtggaaccccactgtacggagct

SEQ ID NO: 204346 - DNA, 25 bp, Mus musculus
aggtggaacccctctgtacggagct

SEQ ID NO: 204347 - DNA, 25 bp, Mus musculus
aggtggaaccttctcatttgtgcag

SEQ ID NO: 204348 - DNA, 25 bp, Mus musculus
aggtggaaccttgtcatttgtgcag

SEQ ID NO: 204349 - DNA, 25 bp, Mus musculus
aggtggaacggcagatgacccctga

SEQ ID NO: 204350 - DNA, 25 bp, Mus musculus
aggtggaacggctgatgacccctga

SEQ ID NO: 204351 - DNA, 25 bp, Mus musculus
aggtggaactctacagcgtgtgctc

SEQ ID NO: 204352 - DNA, 25 bp, Mus musculus
aggtggaactcttcagcgtgtgctc

SEQ ID NO: 204353 - DNA, 25 bp, Mus musculus
aggtggaagcaccaggcgccctcta

SEQ ID NO: 204354 - DNA, 25 bp, Mus musculus
aggtggaagcacgaggcgccctcta

SEQ ID NO: 204355 - DNA, 25 bp, Mus musculus
aggtggaagcagacagcagcccttt

SEQ ID NO: 204356 - DNA, 25 bp, Mus musculus
aggtggaagcagtcagcagcccttt

SEQ ID NO: 204357 - DNA, 25 bp, Mus musculus
aggtggaatcacaaaaacgctctat

SEQ ID NO: 204358 - DNA, 25 bp, Mus musculus
aggtggaatcactaaaacgctctat

SEQ ID NO: 204359 - DNA, 25 bp, Mus musculus
aggtggacacgtacatgtatttgat

SEQ ID NO: 204360 - DNA, 25 bp, Mus musculus
aggtggacacgttcatgtatttgat

SEQ ID NO: 204361 - DNA, 25 bp, Mus musculus
aggtggacagatataagcttcctcc

SEQ ID NO: 204362 - DNA, 25 bp, Mus musculus
aggtggacagatttaagcttcctcc

SEQ ID NO: 204363 - DNA, 25 bp, Mus musculus
aggtggacatgcagcaagagccgct

SEQ ID NO: 204364 - DNA, 25 bp, Mus musculus
aggtggacatgctgcaagagccgct

SEQ ID NO: 204365 - DNA, 25 bp, Mus musculus
aggtggacatttaagcattcagtgc

SEQ ID NO: 204366 - DNA, 25 bp, Mus musculus
aggtggacattttagcattcagtgc

SEQ ID NO: 204367 - DNA, 25 bp, Mus musculus
aggtggaccatgacatctggcctga

SEQ ID NO: 204368 - DNA, 25 bp, Mus musculus
aggtggaccatgtcatctggcctga

SEQ ID NO: 204369 - DNA, 25 bp, Mus musculus
aggtggacccaaagccttttgtcat

SEQ ID NO: 204370 - DNA, 25 bp, Mus musculus
aggtggacccaatgccttttgtcat

SEQ ID NO: 204371 - DNA, 25 bp, Mus musculus
aggtggaccccaaatgctgggcata

SEQ ID NO: 204372 - DNA, 25 bp, Mus musculus
aggtggaccccatatgctgggcata

SEQ ID NO: 204373 - DNA, 25 bp, Mus musculus
aggtggacccctctggccttgtata

SEQ ID NO: 204374 - DNA, 25 bp, Mus musculus
aggtggacccctgtggccttgtata

SEQ ID NO: 204375 - DNA, 25 bp, Mus musculus
aggtggaccgcaacaaagaagccgt

SEQ ID NO: 204376 - DNA, 25 bp, Mus musculus
aggtggaccgcatcaaagaagccgt

SEQ ID NO: 204377 - DNA, 25 bp, Mus musculus
aggtggacctctagtgaatttagcc

SEQ ID NO: 204378 - DNA, 25 bp, Mus musculus
aggtggacctcttgtgaatttagcc

SEQ ID NO: 204379 - DNA, 25 bp, Mus musculus
aggtggacctttcgctggaaaacag

SEQ ID NO: 204380 - DNA, 25 bp, Mus musculus
aggtggacctttggctggaaaacag

SEQ ID NO: 204381 - DNA, 25 bp, Mus musculus
aggtggacgcggataacaaccctgc

SEQ ID NO: 204382 - DNA, 25 bp, Mus musculus
aggtggacgcggttaacaaccctgc

SEQ ID NO: 204383 - DNA, 25 bp, Mus musculus
aggtggacttccatgttggtggcca

SEQ ID NO: 204384 - DNA, 25 bp, Mus musculus
aggtggacttccttgttggtggcca

SEQ ID NO: 204385 - DNA, 25 bp, Mus musculus
aggtggacttgtcatggctattctt

SEQ ID NO: 204386 - DNA, 25 bp, Mus musculus
aggtggacttgtgatggctattctt

SEQ ID NO: 204387 - DNA, 25 bp, Mus musculus
aggtggagactgagccccatgccca

SEQ ID NO: 204388 - DNA, 25 bp, Mus musculus
aggtggagactgtgccccatgccca

SEQ ID NO: 204389 - DNA, 25 bp, Mus musculus
aggtggagatcactgcctgagcctc

SEQ ID NO: 204390 - DNA, 25 bp, Mus musculus
aggtggagatcagtgcctgagcctc

SEQ ID NO: 204391 - DNA, 25 bp, Mus musculus
aggtggagcatacgctttccctggt

SEQ ID NO: 204392 - DNA, 25 bp, Mus musculus
aggtggagcataggctttccctggt

SEQ ID NO: 204393 - DNA, 25 bp, Mus musculus
aggtggagcatgagctgccgaccta

SEQ ID NO: 204394 - DNA, 25 bp, Mus musculus
aggtggagcatgtgctgccgaccta

SEQ ID NO: 204395 - DNA, 25 bp, Mus musculus
aggtggagctgaaacacccctcggg

SEQ ID NO: 204396 - DNA, 25 bp, Mus musculus
aggtggagctgactcagcccacgct

SEQ ID NO: 204397 - DNA, 25 bp, Mus musculus
aggtggagctgagtcagcccacgct

SEQ ID NO: 204398 - DNA, 25 bp, Mus musculus
aggtggagctgatacacccctcggg

SEQ ID NO: 204399 - DNA, 25 bp, Mus musculus
aggtggagctgtaagtctgatagtc

SEQ ID NO: 204400 - DNA, 25 bp, Mus musculus
aggtggagctgttagtctgatagtc

SEQ ID NO: 204401 - DNA, 25 bp, Mus musculus
aggtggagcttgagttggtctttaa

SEQ ID NO: 204402 - DNA, 25 bp, Mus musculus
aggtggagcttgtgttggtctttaa

SEQ ID NO: 204403 - DNA, 25 bp, Mus musculus
aggtggagctttcgcccaggtcttc

SEQ ID NO: 204404 - DNA, 25 bp, Mus musculus
aggtggagctttggcccaggtcttc

SEQ ID NO: 204405 - DNA, 25 bp, Mus musculus
aggtggaggcaccttgcatctgttc

SEQ ID NO: 204406 - DNA, 25 bp, Mus musculus
aggtggaggcacgttgcatctgttc

SEQ ID NO: 204407 - DNA, 25 bp, Mus musculus
aggtggaggccccaagagaccatct

SEQ ID NO: 204408 - DNA, 25 bp, Mus musculus
aggtggaggcccgaagagaccatct

SEQ ID NO: 204409 - DNA, 25 bp, Mus musculus
aggtggaggcgtagcctctccagat

SEQ ID NO: 204410 - DNA, 25 bp, Mus musculus
aggtggaggcgttgcctctccagat

SEQ ID NO: 204411 - DNA, 25 bp, Mus musculus
aggtggagggttaagaagacttcag

SEQ ID NO: 204412 - DNA, 25 bp, Mus musculus
aggtggagggtttagaagacttcag

SEQ ID NO: 204413 - DNA, 25 bp, Mus musculus
aggtggagtcctatgctgtcagtca

SEQ ID NO: 204414 - DNA, 25 bp, Mus musculus
aggtggagtcctttgctgtcagtca

SEQ ID NO: 204415 - DNA, 25 bp, Mus musculus
aggtggataacgaccgtctgctccc

SEQ ID NO: 204416 - DNA, 25 bp, Mus musculus
aggtggataacgtccgtctgctccc

SEQ ID NO: 204417 - DNA, 25 bp, Mus musculus
aggtggatcaccatacccagacaat

SEQ ID NO: 204418 - DNA, 25 bp, Mus musculus
aggtggatcaccttacccagacaat

SEQ ID NO: 204419 - DNA, 25 bp, Mus musculus
aggtggatcatgctggccaggtgct

SEQ ID NO: 204420 - DNA, 25 bp, Mus musculus
aggtggatcatggtggccaggtgct

SEQ ID NO: 204421 - DNA, 25 bp, Mus musculus
aggtggatccacatcactgatgctg

SEQ ID NO: 204422 - DNA, 25 bp, Mus musculus
aggtggatccacttcactgatgctg

SEQ ID NO: 204423 - DNA, 25 bp, Mus musculus
aggtggatcccaaactacttgataa

SEQ ID NO: 204424 - DNA, 25 bp, Mus musculus
aggtggatcccaagtgtctgcagta

SEQ ID NO: 204425 - DNA, 25 bp, Mus musculus
aggtggatcccatactacttgataa

SEQ ID NO: 204426 - DNA, 25 bp, Mus musculus
aggtggatcccatgtgtctgcagta

SEQ ID NO: 204427 - DNA, 25 bp, Mus musculus
aggtggatcccgacaccaaggagat

SEQ ID NO: 204428 - DNA, 25 bp, Mus musculus
aggtggatcccgtcaccaaggagat

SEQ ID NO: 204429 - DNA, 25 bp, Mus musculus
aggtggatccgtccgtccttaacaa

SEQ ID NO: 204430 - DNA, 25 bp, Mus musculus
aggtggatccgtgcgtccttaacaa

SEQ ID NO: 204431 - DNA, 25 bp, Mus musculus
aggtggatgactactacgatgggat

SEQ ID NO: 204432 - DNA, 25 bp, Mus musculus
aggtggatgacttctacgatgggat

SEQ ID NO: 204433 - DNA, 25 bp, Mus musculus
aggtggatgcatccagtttgtcaaa

SEQ ID NO: 204434 - DNA, 25 bp, Mus musculus
aggtggatgcatgcagtttgtcaaa

SEQ ID NO: 204435 - DNA, 25 bp, Mus musculus
aggtggatgccaatcttcccgtcat

SEQ ID NO: 204436 - DNA, 25 bp, Mus musculus
aggtggatgccattcttcccgtcat

SEQ ID NO: 204437 - DNA, 25 bp, Mus musculus
aggtggatgccccaaaggatcagat

SEQ ID NO: 204438 - DNA, 25 bp, Mus musculus
aggtggatgcccgaaaggatcagat

SEQ ID NO: 204439 - DNA, 25 bp, Mus musculus
aggtggatgcttacccttgagtgcc

SEQ ID NO: 204440 - DNA, 25 bp, Mus musculus
aggtggatgctttcccttgagtgcc

SEQ ID NO: 204441 - DNA, 25 bp, Mus musculus
aggtggatggacatcagagccacac

SEQ ID NO: 204442 - DNA, 25 bp, Mus musculus
aggtggatggacttcagagccacac

SEQ ID NO: 204443 - DNA, 25 bp, Mus musculus
aggtggattccactcccggtgtcga

SEQ ID NO: 204444 - DNA, 25 bp, Mus musculus
aggtggattccagtcccggtgtcga

SEQ ID NO: 204445 - DNA, 25 bp, Mus musculus
aggtggattcctagggctcaatggc

SEQ ID NO: 204446 - DNA, 25 bp, Mus musculus
aggtggattccttgggctcaatggc

SEQ ID NO: 204447 - DNA, 25 bp, Mus musculus
aggtggatttgcagggatgtccata

SEQ ID NO: 204448 - DNA, 25 bp, Mus musculus
aggtggatttgctgggatgtccata

SEQ ID NO: 204449 - DNA, 25 bp, Mus musculus
aggtggatttttctcttgttgacaa

SEQ ID NO: 204450 - DNA, 25 bp, Mus musculus
aggtggatttttgtcttgttgacaa

SEQ ID NO: 204451 - DNA, 25 bp, Mus musculus
aggtggcaaagaacacgccgagcct

SEQ ID NO: 204452 - DNA, 25 bp, Mus musculus
aggtggcaaagacacccaggtcact

SEQ ID NO: 204453 - DNA, 25 bp, Mus musculus
aggtggcaaagagacccaggtcact

SEQ ID NO: 204454 - DNA, 25 bp, Mus musculus
aggtggcaaagatcacgccgagcct

SEQ ID NO: 204455 - DNA, 25 bp, Mus musculus
aggtggcaacctacatcagaagaat

SEQ ID NO: 204456 - DNA, 25 bp, Mus musculus
aggtggcaaccttcatcagaagaat

SEQ ID NO: 204457 - DNA, 25 bp, Mus musculus
aggtggcaatgcagacccttctagg

SEQ ID NO: 204458 - DNA, 25 bp, Mus musculus
aggtggcaatgctgacccttctagg

SEQ ID NO: 204459 - DNA, 25 bp, Mus musculus
aggtggcacacccagaggcttttgt

SEQ ID NO: 204460 - DNA, 25 bp, Mus musculus
aggtggcacaccgagaggcttttgt

SEQ ID NO: 204461 - DNA, 25 bp, Mus musculus
aggtggcacgtccagagaactccct

SEQ ID NO: 204462 - DNA, 25 bp, Mus musculus
aggtggcacgtcgagagaactccct

SEQ ID NO: 204463 - DNA, 25 bp, Mus musculus
aggtggcagacaattcaacagaaga

SEQ ID NO: 204464 - DNA, 25 bp, Mus musculus
aggtggcagacatttcaacagaaga

SEQ ID NO: 204465 - DNA, 25 bp, Mus musculus
aggtggcagactctgtttatctact

SEQ ID NO: 204466 - DNA, 25 bp, Mus musculus
aggtggcagactgtgtttatctact

SEQ ID NO: 204467 - DNA, 25 bp, Mus musculus
aggtggcagcaacagagctactgaa

SEQ ID NO: 204468 - DNA, 25 bp, Mus musculus
aggtggcagcaagagagctactgaa

SEQ ID NO: 204469 - DNA, 25 bp, Mus musculus
aggtggcagcttcaagtttcccaag

SEQ ID NO: 204470 - DNA, 25 bp, Mus musculus
aggtggcagcttgaagtttcccaag

SEQ ID NO: 204471 - DNA, 25 bp, Mus musculus
aggtggcaggctactcagggccctc

SEQ ID NO: 204472 - DNA, 25 bp, Mus musculus
aggtggcaggcttctcagggccctc

SEQ ID NO: 204473 - DNA, 25 bp, Mus musculus
aggtggcagtctatgctgtcacaca

SEQ ID NO: 204474 - DNA, 25 bp, Mus musculus
aggtggcagtctttgctgtcacaca

SEQ ID NO: 204475 - DNA, 25 bp, Mus musculus
aggtggcagttgaccatggcccctg

SEQ ID NO: 204476 - DNA, 25 bp, Mus musculus
aggtggcagttgtccatggcccctg

SEQ ID NO: 204477 - DNA, 25 bp, Mus musculus
aggtggcatccacggcgatatttaa

SEQ ID NO: 204478 - DNA, 25 bp, Mus musculus
aggtggcatccagggcgatatttaa

SEQ ID NO: 204479 - DNA, 25 bp, Mus musculus
aggtggcatggtaggctcagaccca

SEQ ID NO: 204480 - DNA, 25 bp, Mus musculus
aggtggcatggttggctcagaccca

SEQ ID NO: 204481 - DNA, 25 bp, Mus musculus
aggtggccacacatatttggagaca

SEQ ID NO: 204482 - DNA, 25 bp, Mus musculus
aggtggccacacctaagacttttga

SEQ ID NO: 204483 - DNA, 25 bp, Mus musculus
aggtggccacacgtaagacttttga

SEQ ID NO: 204484 - DNA, 25 bp, Mus musculus
aggtggccacacttatttggagaca

SEQ ID NO: 204485 - DNA, 25 bp, Mus musculus
aggtggccaccaaactaatattcta

SEQ ID NO: 204486 - DNA, 25 bp, Mus musculus
aggtggccaccatactaatattcta

SEQ ID NO: 204487 - DNA, 25 bp, Mus musculus
aggtggccactgaaaagcaccacag

SEQ ID NO: 204488 - DNA, 25 bp, Mus musculus
aggtggccactgtaaagcaccacag

SEQ ID NO: 204489 - DNA, 25 bp, Mus musculus
aggtggccagaaattactccctcag

SEQ ID NO: 204490 - DNA, 25 bp, Mus musculus
aggtggccagaatttactccctcag

SEQ ID NO: 204491 - DNA, 25 bp, Mus musculus
aggtggccaggcacctagcagtcac

SEQ ID NO: 204492 - DNA, 25 bp, Mus musculus
aggtggccaggctcctagcagtcac

SEQ ID NO: 204493 - DNA, 25 bp, Mus musculus
aggtggccatggagcggccccttct

SEQ ID NO: 204494 - DNA, 25 bp, Mus musculus
aggtggccatggtgcggccccttct

SEQ ID NO: 204495 - DNA, 25 bp, Mus musculus
aggtggccatgtaccgggagccttc

SEQ ID NO: 204496 - DNA, 25 bp, Mus musculus
aggtggccatgttccgggagccttc

SEQ ID NO: 204497 - DNA, 25 bp, Mus musculus
aggtggcccagaacgacctgtacat

SEQ ID NO: 204498 - DNA, 25 bp, Mus musculus
aggtggcccagatcgacctgtacat

SEQ ID NO: 204499 - DNA, 25 bp, Mus musculus
aggtggccccacatttgttgagaat

SEQ ID NO: 204500 - DNA, 25 bp, Mus musculus
aggtggccccacttttgttgagaat

SEQ ID NO: 204501 - DNA, 25 bp, Mus musculus
aggtggccccagaactgttgagaat

SEQ ID NO: 204502 - DNA, 25 bp, Mus musculus
aggtggccccagtactgttgagaat

SEQ ID NO: 204503 - DNA, 25 bp, Mus musculus
aggtggccccgtccagctctggcta

SEQ ID NO: 204504 - DNA, 25 bp, Mus musculus
aggtggccccgtgcagctctggcta

SEQ ID NO: 204505 - DNA, 25 bp, Mus musculus
aggtggccccttcctaagctcacag

SEQ ID NO: 204506 - DNA, 25 bp, Mus musculus
aggtggccccttgctaagctcacag

SEQ ID NO: 204507 - DNA, 25 bp, Mus musculus
aggtggcccgtaagctggtcatcat

SEQ ID NO: 204508 - DNA, 25 bp, Mus musculus
aggtggcccgtatgctggtcatcat

SEQ ID NO: 204509 - DNA, 25 bp, Mus musculus
aggtggccctctcataactggatcc

SEQ ID NO: 204510 - DNA, 25 bp, Mus musculus
aggtggccctctgataactggatcc

SEQ ID NO: 204511 - DNA, 25 bp, Mus musculus
aggtggccgacactttgtgtatctt

SEQ ID NO: 204512 - DNA, 25 bp, Mus musculus
aggtggccgacagtttgtgtatctt

SEQ ID NO: 204513 - DNA, 25 bp, Mus musculus
aggtggcctcggacgccaagagctt

SEQ ID NO: 204514 - DNA, 25 bp, Mus musculus
aggtggcctcggtcgccaagagctt

SEQ ID NO: 204515 - DNA, 25 bp, Mus musculus
aggtggcctctgactgtttatttaa

SEQ ID NO: 204516 - DNA, 25 bp, Mus musculus
aggtggcctctgtctgtttatttaa

SEQ ID NO: 204517 - DNA, 25 bp, Mus musculus
aggtggcctgcaatgctgtgtatga

SEQ ID NO: 204518 - DNA, 25 bp, Mus musculus
aggtggcctgcattgctgtgtatga

SEQ ID NO: 204519 - DNA, 25 bp, Mus musculus
aggtggcctgggagttttctgcaca

SEQ ID NO: 204520 - DNA, 25 bp, Mus musculus
aggtggcctgggtgttttctgcaca

SEQ ID NO: 204521 - DNA, 25 bp, Mus musculus
aggtggcctgtcactgtgctctatt

SEQ ID NO: 204522 - DNA, 25 bp, Mus musculus
aggtggcctgtctctgtgctctatt

SEQ ID NO: 204523 - DNA, 25 bp, Mus musculus
aggtggcctgttcaagtcagttgaa

SEQ ID NO: 204524 - DNA, 25 bp, Mus musculus
aggtggcctgttgaagtcagttgaa

SEQ ID NO: 204525 - DNA, 25 bp, Mus musculus
aggtggcgattacgactccaggtcc

SEQ ID NO: 204526 - DNA, 25 bp, Mus musculus
aggtggcgattaggactccaggtcc

SEQ ID NO: 204527 - DNA, 25 bp, Mus musculus
aggtggcgctgtaaatcattaggtc

SEQ ID NO: 204528 - DNA, 25 bp, Mus musculus
aggtggcgctgtcggcaatttttat

SEQ ID NO: 204529 - DNA, 25 bp, Mus musculus
aggtggcgctgtgggcaatttttat

SEQ ID NO: 204530 - DNA, 25 bp, Mus musculus
aggtggcgctgttaatcattaggtc

SEQ ID NO: 204531 - DNA, 25 bp, Mus musculus
aggtggcgtccacagcctccattcg

SEQ ID NO: 204532 - DNA, 25 bp, Mus musculus
aggtggcgtccagagcctccattcg

SEQ ID NO: 204533 - DNA, 25 bp, Mus musculus
aggtggctaaaaagctccgggagct

SEQ ID NO: 204534 - DNA, 25 bp, Mus musculus
aggtggctaaaatgctccgggagct

SEQ ID NO: 204535 - DNA, 25 bp, Mus musculus
aggtggctaaacacttggatctaaa

SEQ ID NO: 204536 - DNA, 25 bp, Mus musculus
aggtggctaaactcttggatctaaa

SEQ ID NO: 204537 - DNA, 25 bp, Mus musculus
aggtggctaactacgtgacgggcat

SEQ ID NO: 204538 - DNA, 25 bp, Mus musculus
aggtggctaacttcgtgacgggcat

SEQ ID NO: 204539 - DNA, 25 bp, Mus musculus
aggtggctacatagactcctgaggc

SEQ ID NO: 204540 - DNA, 25 bp, Mus musculus
aggtggctacattgactcctgaggc

SEQ ID NO: 204541 - DNA, 25 bp, Mus musculus
aggtggctaggcagttatcacccct

SEQ ID NO: 204542 - DNA, 25 bp, Mus musculus
aggtggctaggctgttatcacccct

SEQ ID NO: 204543 - DNA, 25 bp, Mus musculus
aggtggctatgtaatctcaggacgc

SEQ ID NO: 204544 - DNA, 25 bp, Mus musculus
aggtggctatgttatctcaggacgc

SEQ ID NO: 204545 - DNA, 25 bp, Mus musculus
aggtggctccacagaagtcttgcgg

SEQ ID NO: 204546 - DNA, 25 bp, Mus musculus
aggtggctccactgaagtcttgcgg

SEQ ID NO: 204547 - DNA, 25 bp, Mus musculus
aggtggctccagcagatggcttctc

SEQ ID NO: 204548 - DNA, 25 bp, Mus musculus
aggtggctccaggagatggcttctc

SEQ ID NO: 204549 - DNA, 25 bp, Mus musculus
aggtggctcgatactgtggctctca

SEQ ID NO: 204550 - DNA, 25 bp, Mus musculus
aggtggctcgattctgtggctctca

SEQ ID NO: 204551 - DNA, 25 bp, Mus musculus
aggtggctctcactgagtcttctga

SEQ ID NO: 204552 - DNA, 25 bp, Mus musculus
aggtggctctcagtgagtcttctga

SEQ ID NO: 204553 - DNA, 25 bp, Mus musculus
aggtggctgaccctgaggaatcctt

SEQ ID NO: 204554 - DNA, 25 bp, Mus musculus
aggtggctgaccgtgaggaatcctt

SEQ ID NO: 204555 - DNA, 25 bp, Mus musculus
aggtggctgactccagcccttttgc

SEQ ID NO: 204556 - DNA, 25 bp, Mus musculus
aggtggctgactgcagcccttttgc

SEQ ID NO: 204557 - DNA, 25 bp, Mus musculus
aggtggctgcagagatctttctcca

SEQ ID NO: 204558 - DNA, 25 bp, Mus musculus
aggtggctgcagtgatctttctcca

SEQ ID NO: 204559 - DNA, 25 bp, Mus musculus
aggtggctggaccatctttggaaat

SEQ ID NO: 204560 - DNA, 25 bp, Mus musculus
aggtggctggacgatctttggaaat

SEQ ID NO: 204561 - DNA, 25 bp, Mus musculus
aggtggctggccatcatgtgaccta

SEQ ID NO: 204562 - DNA, 25 bp, Mus musculus
aggtggctggccttcatgtgaccta

SEQ ID NO: 204563 - DNA, 25 bp, Mus musculus
aggtggcttattatgcccacacttt

SEQ ID NO: 204564 - DNA, 25 bp, Mus musculus
aggtggcttattttgcccacacttt

SEQ ID NO: 204565 - DNA, 25 bp, Mus musculus
aggtggcttcgtctctcttgcttta

SEQ ID NO: 204566 - DNA, 25 bp, Mus musculus
aggtggcttcgtgtctcttgcttta

SEQ ID NO: 204567 - DNA, 25 bp, Mus musculus
aggtggcttctcaagtcggctttac

SEQ ID NO: 204568 - DNA, 25 bp, Mus musculus
aggtggcttctctagtcggctttac

SEQ ID NO: 204569 - DNA, 25 bp, Mus musculus
aggtggcttgagagcctctgtaact

SEQ ID NO: 204570 - DNA, 25 bp, Mus musculus
aggtggcttgagtgcctctgtaact

SEQ ID NO: 204571 - DNA, 25 bp, Mus musculus
aggtggcttgtaaaacgctttggaa

SEQ ID NO: 204572 - DNA, 25 bp, Mus musculus
aggtggcttgtataacgctttggaa

SEQ ID NO: 204573 - DNA, 25 bp, Mus musculus
aggtggctttgtactgggcttttca

SEQ ID NO: 204574 - DNA, 25 bp, Mus musculus
aggtggctttgttctgggcttttca

SEQ ID NO: 204575 - DNA, 25 bp, Mus musculus
aggtgggaaacaccacttctgctct

SEQ ID NO: 204576 - DNA, 25 bp, Mus musculus
aggtgggaaacagcacttctgctct

SEQ ID NO: 204577 - DNA, 25 bp, Mus musculus
aggtgggaatccatgcttctgattt

SEQ ID NO: 204578 - DNA, 25 bp, Mus musculus
aggtgggaatccttgcttctgattt

SEQ ID NO: 204579 - DNA, 25 bp, Mus musculus
aggtgggacaggagcccgcctccta

SEQ ID NO: 204580 - DNA, 25 bp, Mus musculus
aggtgggacaggtgcccgcctccta

SEQ ID NO: 204581 - DNA, 25 bp, Mus musculus
aggtgggacatcaccatagggtgat

SEQ ID NO: 204582 - DNA, 25 bp, Mus musculus
aggtgggacatctccatagggtgat

SEQ ID NO: 204583 - DNA, 25 bp, Mus musculus
aggtgggaccatatatatctgagcc

SEQ ID NO: 204584 - DNA, 25 bp, Mus musculus
aggtgggaccatttatatctgagcc

SEQ ID NO: 204585 - DNA, 25 bp, Mus musculus
aggtgggaccctaatctgcagttcc

SEQ ID NO: 204586 - DNA, 25 bp, Mus musculus
aggtgggacccttatctgcagttcc

SEQ ID NO: 204587 - DNA, 25 bp, Mus musculus
aggtgggagagtacgatccatccaa

SEQ ID NO: 204588 - DNA, 25 bp, Mus musculus
aggtgggagagttcgatccatccaa

SEQ ID NO: 204589 - DNA, 25 bp, Mus musculus
aggtgggatatccatgacacttcat

SEQ ID NO: 204590 - DNA, 25 bp, Mus musculus
aggtgggatatcgatgacacttcat

SEQ ID NO: 204591 - DNA, 25 bp, Mus musculus
aggtgggatggcaactgctctcaat

SEQ ID NO: 204592 - DNA, 25 bp, Mus musculus
aggtgggatggctactgctctcaat

SEQ ID NO: 204593 - DNA, 25 bp, Mus musculus
aggtgggattcgattgtctatggaa

SEQ ID NO: 204594 - DNA, 25 bp, Mus musculus
aggtgggattcgtttgtctatggaa

SEQ ID NO: 204595 - DNA, 25 bp, Mus musculus
aggtgggcaataaccaaagagagca

SEQ ID NO: 204596 - DNA, 25 bp, Mus musculus
aggtgggcaatatccaaagagagca

SEQ ID NO: 204597 - DNA, 25 bp, Mus musculus
aggtgggcagcactaccaatgaagc

SEQ ID NO: 204598 - DNA, 25 bp, Mus musculus
aggtgggcagcagtaccaatgaagc

SEQ ID NO: 204599 - DNA, 25 bp, Mus musculus
aggtgggcagtaaccctgtgatcac

SEQ ID NO: 204600 - DNA, 25 bp, Mus musculus
aggtgggcagtatccctgtgatcac

SEQ ID NO: 204601 - DNA, 25 bp, Mus musculus
aggtgggccacaagcactgagtgtc

SEQ ID NO: 204602 - DNA, 25 bp, Mus musculus
aggtgggccacatgcactgagtgtc

SEQ ID NO: 204603 - DNA, 25 bp, Mus musculus
aggtgggccagtctgatcttctgcc

SEQ ID NO: 204604 - DNA, 25 bp, Mus musculus
aggtgggccagtgtgatcttctgcc

SEQ ID NO: 204605 - DNA, 25 bp, Mus musculus
aggtgggccgcacatttcagaagaa

SEQ ID NO: 204606 - DNA, 25 bp, Mus musculus
aggtgggccgcagatttcagaagaa

SEQ ID NO: 204607 - DNA, 25 bp, Mus musculus
aggtgggcctctctcagcatagttt

SEQ ID NO: 204608 - DNA, 25 bp, Mus musculus
aggtgggcctctgtcagcatagttt

SEQ ID NO: 204609 - DNA, 25 bp, Mus musculus
aggtgggcgcatacttgttcgtgag

SEQ ID NO: 204610 - DNA, 25 bp, Mus musculus
aggtgggcgcattcttgttcgtgag

SEQ ID NO: 204611 - DNA, 25 bp, Mus musculus
aggtgggctgaaagtctaagtcagt

SEQ ID NO: 204612 - DNA, 25 bp, Mus musculus
aggtgggctgaactccttggatcat

SEQ ID NO: 204613 - DNA, 25 bp, Mus musculus
aggtgggctgaagtccttggatcat

SEQ ID NO: 204614 - DNA, 25 bp, Mus musculus
aggtgggctgaatgtctaagtcagt

SEQ ID NO: 204615 - DNA, 25 bp, Mus musculus
aggtgggcttaacttgtaggctcca

SEQ ID NO: 204616 - DNA, 25 bp, Mus musculus
aggtgggcttaagttgtaggctcca

SEQ ID NO: 204617 - DNA, 25 bp, Mus musculus
aggtgggcttacattacaactagtt

SEQ ID NO: 204618 - DNA, 25 bp, Mus musculus
aggtgggcttactttacaactagtt

SEQ ID NO: 204619 - DNA, 25 bp, Mus musculus
aggtgggctttgcatcgtttgccac

SEQ ID NO: 204620 - DNA, 25 bp, Mus musculus
aggtgggctttggatcgtttgccac

SEQ ID NO: 204621 - DNA, 25 bp, Mus musculus
aggtgggtaataccctggtcatatt

SEQ ID NO: 204622 - DNA, 25 bp, Mus musculus
aggtgggtaatagcctggtcatatt

SEQ ID NO: 204623 - DNA, 25 bp, Mus musculus
aggtgggtactcacatcagaggcac

SEQ ID NO: 204624 - DNA, 25 bp, Mus musculus
aggtgggtactctcatcagaggcac

SEQ ID NO: 204625 - DNA, 25 bp, Mus musculus
aggtgggtactgacattcacgcccc

SEQ ID NO: 204626 - DNA, 25 bp, Mus musculus
aggtgggtactgtcattcacgcccc

SEQ ID NO: 204627 - DNA, 25 bp, Mus musculus
aggtgggtcaatcatccagatccaa

SEQ ID NO: 204628 - DNA, 25 bp, Mus musculus
aggtgggtcaatgatccagatccaa

SEQ ID NO: 204629 - DNA, 25 bp, Mus musculus
aggtgggtccatactgtccatgcca

SEQ ID NO: 204630 - DNA, 25 bp, Mus musculus
aggtgggtccattctgtccatgcca

SEQ ID NO: 204631 - DNA, 25 bp, Mus musculus
aggtgggtctctcaactatagattg

SEQ ID NO: 204632 - DNA, 25 bp, Mus musculus
aggtgggtctctctgtgtttgaaac

SEQ ID NO: 204633 - DNA, 25 bp, Mus musculus
aggtgggtctctgaactatagattg

SEQ ID NO: 204634 - DNA, 25 bp, Mus musculus
aggtgggtctctgtgtgtttgaaac

SEQ ID NO: 204635 - DNA, 25 bp, Mus musculus
aggtgggtgccacaagccaaagaca

SEQ ID NO: 204636 - DNA, 25 bp, Mus musculus
aggtgggtgccagaagccaaagaca

SEQ ID NO: 204637 - DNA, 25 bp, Mus musculus
aggtggtaatttactgtgctacagc

SEQ ID NO: 204638 - DNA, 25 bp, Mus musculus
aggtggtaattttctgtgctacagc

SEQ ID NO: 204639 - DNA, 25 bp, Mus musculus
aggtggtaccagctgggcatcatca

SEQ ID NO: 204640 - DNA, 25 bp, Mus musculus
aggtggtaccaggtgggcatcatca

SEQ ID NO: 204641 - DNA, 25 bp, Mus musculus
aggtggtacccaaagccatgagcca

SEQ ID NO: 204642 - DNA, 25 bp, Mus musculus
aggtggtacccatagccatgagcca

SEQ ID NO: 204643 - DNA, 25 bp, Mus musculus
aggtggtaccctagtgacgatggcc

SEQ ID NO: 204644 - DNA, 25 bp, Mus musculus
aggtggtacccttgtgacgatggcc

SEQ ID NO: 204645 - DNA, 25 bp, Mus musculus
aggtggtaccgccacacagtcctaa

SEQ ID NO: 204646 - DNA, 25 bp, Mus musculus
aggtggtaccgcgacacagtcctaa

SEQ ID NO: 204647 - DNA, 25 bp, Mus musculus
aggtggtagacaacatcctccatgc

SEQ ID NO: 204648 - DNA, 25 bp, Mus musculus
aggtggtagacatcatcctccatgc

SEQ ID NO: 204649 - DNA, 25 bp, Mus musculus
aggtggtagaccacaaggcccagct

SEQ ID NO: 204650 - DNA, 25 bp, Mus musculus
aggtggtagacctcaaggcccagct

SEQ ID NO: 204651 - DNA, 25 bp, Mus musculus
aggtggtagcccactagaacagtcc

SEQ ID NO: 204652 - DNA, 25 bp, Mus musculus
aggtggtagccctctagaacagtcc

SEQ ID NO: 204653 - DNA, 25 bp, Mus musculus
aggtggtaggctacagcttctaacc

SEQ ID NO: 204654 - DNA, 25 bp, Mus musculus
aggtggtaggcttcagcttctaacc

SEQ ID NO: 204655 - DNA, 25 bp, Mus musculus
aggtggtagttcattctgtgaggtt

SEQ ID NO: 204656 - DNA, 25 bp, Mus musculus
aggtggtagttctttctgtgaggtt

SEQ ID NO: 204657 - DNA, 25 bp, Mus musculus
aggtggtcactgcaacctgtcactt

SEQ ID NO: 204658 - DNA, 25 bp, Mus musculus
aggtggtcactggaacctgtcactt

SEQ ID NO: 204659 - DNA, 25 bp, Mus musculus
aggtggtcatcccacaagcccgagt

SEQ ID NO: 204660 - DNA, 25 bp, Mus musculus
aggtggtcatccgacaagcccgagt

SEQ ID NO: 204661 - DNA, 25 bp, Mus musculus
aggtggtcatctccaggatcctcat

SEQ ID NO: 204662 - DNA, 25 bp, Mus musculus
aggtggtcatctgcaggatcctcat

SEQ ID NO: 204663 - DNA, 25 bp, Mus musculus
aggtggtcattgcatgggctggtgt

SEQ ID NO: 204664 - DNA, 25 bp, Mus musculus
aggtggtcattggatgggctggtgt

SEQ ID NO: 204665 - DNA, 25 bp, Mus musculus
aggtggtccagcagatcgtgcacca

SEQ ID NO: 204666 - DNA, 25 bp, Mus musculus
aggtggtccagctgatcgtgcacca

SEQ ID NO: 204667 - DNA, 25 bp, Mus musculus
aggtggtccaggcagtaaagaactt

SEQ ID NO: 204668 - DNA, 25 bp, Mus musculus
aggtggtccagggagtaaagaactt

SEQ ID NO: 204669 - DNA, 25 bp, Mus musculus
aggtggtccccacatttgcactaat

SEQ ID NO: 204670 - DNA, 25 bp, Mus musculus
aggtggtccccagatttgcactaat

SEQ ID NO: 204671 - DNA, 25 bp, Mus musculus
aggtggtcgatgacaatttctagaa

SEQ ID NO: 204672 - DNA, 25 bp, Mus musculus
aggtggtcgatgtcaatttctagaa

SEQ ID NO: 204673 - DNA, 25 bp, Mus musculus
aggtggtcgtcaaccttcacaggca

SEQ ID NO: 204674 - DNA, 25 bp, Mus musculus
aggtggtcgtcatccttcacaggca

SEQ ID NO: 204675 - DNA, 25 bp, Mus musculus
aggtggtctacacatccctgcagtg

SEQ ID NO: 204676 - DNA, 25 bp, Mus musculus
aggtggtctacagatccctgcagtg

SEQ ID NO: 204677 - DNA, 25 bp, Mus musculus
aggtggtctcctccagaaactgtaa

SEQ ID NO: 204678 - DNA, 25 bp, Mus musculus
aggtggtctcctgcagaaactgtaa

SEQ ID NO: 204679 - DNA, 25 bp, Mus musculus
aggtggtctgccattatttgcatgt

SEQ ID NO: 204680 - DNA, 25 bp, Mus musculus
aggtggtctgcctttatttgcatgt

SEQ ID NO: 204681 - DNA, 25 bp, Mus musculus
aggtggtctttcaactggtgattag

SEQ ID NO: 204682 - DNA, 25 bp, Mus musculus
aggtggtctttctactggtgattag

SEQ ID NO: 204683 - DNA, 25 bp, Mus musculus
aggtggtgaaccagcccattgtaga

SEQ ID NO: 204684 - DNA, 25 bp, Mus musculus
aggtggtgaacctgcccattgtaga

SEQ ID NO: 204685 - DNA, 25 bp, Mus musculus
aggtggtgagacacctgcaaagccg

SEQ ID NO: 204686 - DNA, 25 bp, Mus musculus
aggtggtgagactcctgcaaagccg

SEQ ID NO: 204687 - DNA, 25 bp, Mus musculus
aggtggtgagcaatgactggatcat

SEQ ID NO: 204688 - DNA, 25 bp, Mus musculus
aggtggtgagcattgactggatcat

SEQ ID NO: 204689 - DNA, 25 bp, Mus musculus
aggtggtgatttcccttctttcaga

SEQ ID NO: 204690 - DNA, 25 bp, Mus musculus
aggtggtgatttgccttctttcaga

SEQ ID NO: 204691 - DNA, 25 bp, Mus musculus
aggtggtgcacccttgttgttgttt

SEQ ID NO: 204692 - DNA, 25 bp, Mus musculus
aggtggtgcaccgttgttgttgttt

SEQ ID NO: 204693 - DNA, 25 bp, Mus musculus
aggtggtgccaacatgttgtatgaa

SEQ ID NO: 204694 - DNA, 25 bp, Mus musculus
aggtggtgccaagatgttgtatgaa

SEQ ID NO: 204695 - DNA, 25 bp, Mus musculus
aggtggtgccttatataaccctcag

SEQ ID NO: 204696 - DNA, 25 bp, Mus musculus
aggtggtgccttttataaccctcag

SEQ ID NO: 204697 - DNA, 25 bp, Mus musculus
aggtggtggaatcctcacggtcctc

SEQ ID NO: 204698 - DNA, 25 bp, Mus musculus
aggtggtggaatgctcacggtcctc

SEQ ID NO: 204699 - DNA, 25 bp, Mus musculus
aggtggtggataccttgttccaaca

SEQ ID NO: 204700 - DNA, 25 bp, Mus musculus
aggtggtggatagcttgttccaaca

SEQ ID NO: 204701 - DNA, 25 bp, Mus musculus
aggtggtggcaaagtcttccactca

SEQ ID NO: 204702 - DNA, 25 bp, Mus musculus
aggtggtggcaatgtcttccactca

SEQ ID NO: 204703 - DNA, 25 bp, Mus musculus
aggtggtggtcaattctgtcactac

SEQ ID NO: 204704 - DNA, 25 bp, Mus musculus
aggtggtggtcatttctgtcactac

SEQ ID NO: 204705 - DNA, 25 bp, Mus musculus
aggtggtgtccacacacgagcagat

SEQ ID NO: 204706 - DNA, 25 bp, Mus musculus
aggtggtgtccagacacgagcagat

SEQ ID NO: 204707 - DNA, 25 bp, Mus musculus
aggtggttactgcagcccataccta

SEQ ID NO: 204708 - DNA, 25 bp, Mus musculus
aggtggttactggagcccataccta

SEQ ID NO: 204709 - DNA, 25 bp, Mus musculus
aggtggttagctcaagctctcagaa

SEQ ID NO: 204710 - DNA, 25 bp, Mus musculus
aggtggttagctgaagctctcagaa

SEQ ID NO: 204711 - DNA, 25 bp, Mus musculus
aggtggttatgaactgcccgcagag

SEQ ID NO: 204712 - DNA, 25 bp, Mus musculus
aggtggttatgatctgcccgcagag

SEQ ID NO: 204713 - DNA, 25 bp, Mus musculus
aggtggttcactacctcatctctgt

SEQ ID NO: 204714 - DNA, 25 bp, Mus musculus
aggtggttcacttcctcatctctgt

SEQ ID NO: 204715 - DNA, 25 bp, Mus musculus
aggtggttcggtagttttgctctgc

SEQ ID NO: 204716 - DNA, 25 bp, Mus musculus
aggtggttcggttgttttgctctgc

SEQ ID NO: 204717 - DNA, 25 bp, Mus musculus
aggtggttctctatcctctctaggg

SEQ ID NO: 204718 - DNA, 25 bp, Mus musculus
aggtggttctctttcctctctaggg

SEQ ID NO: 204719 - DNA, 25 bp, Mus musculus
aggtggttgcagaatgccagccctt

SEQ ID NO: 204720 - DNA, 25 bp, Mus musculus
aggtggttgcagtatgccagccctt

SEQ ID NO: 204721 - DNA, 25 bp, Mus musculus
aggtggttgccacaaactcctggag

SEQ ID NO: 204722 - DNA, 25 bp, Mus musculus
aggtggttgccagaaactcctggag

SEQ ID NO: 204723 - DNA, 25 bp, Mus musculus
aggtggttgtttcttagcagctacc

SEQ ID NO: 204724 - DNA, 25 bp, Mus musculus
aggtggttgtttgttagcagctacc

SEQ ID NO: 204725 - DNA, 25 bp, Mus musculus
aggtggtttacaactatcattctct

SEQ ID NO: 204726 - DNA, 25 bp, Mus musculus
aggtggtttacatctatcattctct

SEQ ID NO: 204727 - DNA, 25 bp, Mus musculus
aggtggtttctgcatgtgtttgaca

SEQ ID NO: 204728 - DNA, 25 bp, Mus musculus
aggtggtttctggatgtgtttgaca

SEQ ID NO: 204729 - DNA, 25 bp, Mus musculus
aggtgtaaaaggatgctatgctcat

SEQ ID NO: 204730 - DNA, 25 bp, Mus musculus
aggtgtaaaaggttgctatgctcat

SEQ ID NO: 204731 - DNA, 25 bp, Mus musculus
aggtgtaaagttctgcacatttaac

SEQ ID NO: 204732 - DNA, 25 bp, Mus musculus
aggtgtaaagttgtgcacatttaac

SEQ ID NO: 204733 - DNA, 25 bp, Mus musculus
aggtgtaactgtcaacttgctataa

SEQ ID NO: 204734 - DNA, 25 bp, Mus musculus
aggtgtaactgtgaacttgctataa

SEQ ID NO: 204735 - DNA, 25 bp, Mus musculus
aggtgtaagcatcggccttaccatc

SEQ ID NO: 204736 - DNA, 25 bp, Mus musculus
aggtgtaagcatgggccttaccatc

SEQ ID NO: 204737 - DNA, 25 bp, Mus musculus
aggtgtaaggccaatctgttctgtg

SEQ ID NO: 204738 - DNA, 25 bp, Mus musculus
aggtgtaaggcctatctgttctgtg

SEQ ID NO: 204739 - DNA, 25 bp, Mus musculus
aggtgtaagtgaatcccaagcccat

SEQ ID NO: 204740 - DNA, 25 bp, Mus musculus
aggtgtaagtgattcccaagcccat

SEQ ID NO: 204741 - DNA, 25 bp, Mus musculus
aggtgtaatcctagggagccctaga

SEQ ID NO: 204742 - DNA, 25 bp, Mus musculus
aggtgtaatccttgggagccctaga

SEQ ID NO: 204743 - DNA, 25 bp, Mus musculus
aggtgtaatgacatccaactggtat

SEQ ID NO: 204744 - DNA, 25 bp, Mus musculus
aggtgtaatgacttccaactggtat

SEQ ID NO: 204745 - DNA, 25 bp, Mus musculus
aggtgtacaagtctttcactgctgt

SEQ ID NO: 204746 - DNA, 25 bp, Mus musculus
aggtgtacaagtgtttcactgctgt

SEQ ID NO: 204747 - DNA, 25 bp, Mus musculus
aggtgtacacaacccctttaccata

SEQ ID NO: 204748 - DNA, 25 bp, Mus musculus
aggtgtacacaagccctttaccata

SEQ ID NO: 204749 - DNA, 25 bp, Mus musculus
aggtgtacaggaagccctgtcttga

SEQ ID NO: 204750 - DNA, 25 bp, Mus musculus
aggtgtacaggatgccctgtcttga

SEQ ID NO: 204751 - DNA, 25 bp, Mus musculus
aggtgtacatgccatccttactgga

SEQ ID NO: 204752 - DNA, 25 bp, Mus musculus
aggtgtacatgcgatccttactgga

SEQ ID NO: 204753 - DNA, 25 bp, Mus musculus
aggtgtacatttcgctgacgcgcta

SEQ ID NO: 204754 - DNA, 25 bp, Mus musculus
aggtgtacatttggctgacgcgcta

SEQ ID NO: 204755 - DNA, 25 bp, Mus musculus
aggtgtaccccaaagtgctgctcat

SEQ ID NO: 204756 - DNA, 25 bp, Mus musculus
aggtgtaccccatagtgctgctcat

SEQ ID NO: 204757 - DNA, 25 bp, Mus musculus
aggtgtaccctccaggtagccagtc

SEQ ID NO: 204758 - DNA, 25 bp, Mus musculus
aggtgtaccctcgaggtagccagtc

SEQ ID NO: 204759 - DNA, 25 bp, Mus musculus
aggtgtacctgcagtaattttgtac

SEQ ID NO: 204760 - DNA, 25 bp, Mus musculus
aggtgtacctgctgtaattttgtac

SEQ ID NO: 204761 - DNA, 25 bp, Mus musculus
aggtgtacgaaaacgtgcatagcaa

SEQ ID NO: 204762 - DNA, 25 bp, Mus musculus
aggtgtacgaaatcgtgcatagcaa

SEQ ID NO: 204763 - DNA, 25 bp, Mus musculus
aggtgtacgcagacacacgcgtgct

SEQ ID NO: 204764 - DNA, 25 bp, Mus musculus
aggtgtacgcagtcacacgcgtgct

SEQ ID NO: 204765 - DNA, 25 bp, Mus musculus
aggtgtactccaatattctcagcat

SEQ ID NO: 204766 - DNA, 25 bp, Mus musculus
aggtgtactccattattctcagcat

SEQ ID NO: 204767 - DNA, 25 bp, Mus musculus
aggtgtactctgaccactacatgag

SEQ ID NO: 204768 - DNA, 25 bp, Mus musculus
aggtgtactctgcactggagctagc

SEQ ID NO: 204769 - DNA, 25 bp, Mus musculus
aggtgtactctggactggagctagc

SEQ ID NO: 204770 - DNA, 25 bp, Mus musculus
aggtgtactctgtccactacatgag

SEQ ID NO: 204771 - DNA, 25 bp, Mus musculus
aggtgtactgcactcgctatgtcaa

SEQ ID NO: 204772 - DNA, 25 bp, Mus musculus
aggtgtactgcagtcgctatgtcaa

SEQ ID NO: 204773 - DNA, 25 bp, Mus musculus
aggtgtactttgagctcatttcaga

SEQ ID NO: 204774 - DNA, 25 bp, Mus musculus
aggtgtactttgtgctcatttcaga

SEQ ID NO: 204775 - DNA, 25 bp, Mus musculus
aggtgtagatcaagcctggctgctc

SEQ ID NO: 204776 - DNA, 25 bp, Mus musculus
aggtgtagatcatgcctggctgctc

SEQ ID NO: 204777 - DNA, 25 bp, Mus musculus
aggtgtagcaagacgcacaggcata

SEQ ID NO: 204778 - DNA, 25 bp, Mus musculus
aggtgtagcaagtcgcacaggcata

SEQ ID NO: 204779 - DNA, 25 bp, Mus musculus
aggtgtagctaaagccttggcctta

SEQ ID NO: 204780 - DNA, 25 bp, Mus musculus
aggtgtagctaatgccttggcctta

SEQ ID NO: 204781 - DNA, 25 bp, Mus musculus
aggtgtagctcacttggtaagtagt

SEQ ID NO: 204782 - DNA, 25 bp, Mus musculus
aggtgtagctcagttggtaagtagt

SEQ ID NO: 204783 - DNA, 25 bp, Mus musculus
aggtgtagtcctagtaagtatgtca

SEQ ID NO: 204784 - DNA, 25 bp, Mus musculus
aggtgtagtccttgtaagtatgtca

SEQ ID NO: 204785 - DNA, 25 bp, Mus musculus
aggtgtagttggcattcgttcttct

SEQ ID NO: 204786 - DNA, 25 bp, Mus musculus
aggtgtagttgggattcgttcttct

SEQ ID NO: 204787 - DNA, 25 bp, Mus musculus
aggtgtatatgcagtgtccgtcact

SEQ ID NO: 204788 - DNA, 25 bp, Mus musculus
aggtgtatatgctgtgtccgtcact

SEQ ID NO: 204789 - DNA, 25 bp, Mus musculus
aggtgtatcacactactgctggact

SEQ ID NO: 204790 - DNA, 25 bp, Mus musculus
aggtgtatcacagtactgctggact

SEQ ID NO: 204791 - DNA, 25 bp, Mus musculus
aggtgtatccaccaaaactgacgga

SEQ ID NO: 204792 - DNA, 25 bp, Mus musculus
aggtgtatccacgaaaactgacgga

SEQ ID NO: 204793 - DNA, 25 bp, Mus musculus
aggtgtatggctactgttgagtgca

SEQ ID NO: 204794 - DNA, 25 bp, Mus musculus
aggtgtatggcttctgttgagtgca

SEQ ID NO: 204795 - DNA, 25 bp, Mus musculus
aggtgtatggtaatagctgcatcac

SEQ ID NO: 204796 - DNA, 25 bp, Mus musculus
aggtgtatggtattagctgcatcac

SEQ ID NO: 204797 - DNA, 25 bp, Mus musculus
aggtgtatgtcactactgcttagct

SEQ ID NO: 204798 - DNA, 25 bp, Mus musculus
aggtgtatgtcagtactgcttagct

SEQ ID NO: 204799 - DNA, 25 bp, Mus musculus
aggtgtatgtgccatgtcttctact

SEQ ID NO: 204800 - DNA, 25 bp, Mus musculus
aggtgtatgtgcgatgtcttctact

SEQ ID NO: 204801 - DNA, 25 bp, Mus musculus
aggtgtattgcgctaagtgaacctt

SEQ ID NO: 204802 - DNA, 25 bp, Mus musculus
aggtgtattgcggtaagtgaacctt

SEQ ID NO: 204803 - DNA, 25 bp, Mus musculus
aggtgtatttgtactgcagtttggc

SEQ ID NO: 204804 - DNA, 25 bp, Mus musculus
aggtgtatttgttctgcagtttggc

SEQ ID NO: 204805 - DNA, 25 bp, Mus musculus
aggtgtcaaaacaccgatctcagct

SEQ ID NO: 204806 - DNA, 25 bp, Mus musculus
aggtgtcaaaactccgatctcagct

SEQ ID NO: 204807 - DNA, 25 bp, Mus musculus
aggtgtcaacctaccgctcaaaagg

SEQ ID NO: 204808 - DNA, 25 bp, Mus musculus
aggtgtcaaccttccgctcaaaagg

SEQ ID NO: 204809 - DNA, 25 bp, Mus musculus
aggtgtcaagccaaaggaggtgtca

SEQ ID NO: 204810 - DNA, 25 bp, Mus musculus
aggtgtcaagcctaaggaggtgtca

SEQ ID NO: 204811 - DNA, 25 bp, Mus musculus
aggtgtcaattaccgtgagcacagc

SEQ ID NO: 204812 - DNA, 25 bp, Mus musculus
aggtgtcaattagcgtgagcacagc

SEQ ID NO: 204813 - DNA, 25 bp, Mus musculus
aggtgtcaccacatatgttgagaat

SEQ ID NO: 204814 - DNA, 25 bp, Mus musculus
aggtgtcaccacttatgttgagaat

SEQ ID NO: 204815 - DNA, 25 bp, Mus musculus
aggtgtcacctaacattggcagggt

SEQ ID NO: 204816 - DNA, 25 bp, Mus musculus
aggtgtcacctatcattggcagggt

SEQ ID NO: 204817 - DNA, 25 bp, Mus musculus
aggtgtcactaaatactagccagaa

SEQ ID NO: 204818 - DNA, 25 bp, Mus musculus
aggtgtcactaattactagccagaa

SEQ ID NO: 204819 - DNA, 25 bp, Mus musculus
aggtgtcactttcggcctgtagtct

SEQ ID NO: 204820 - DNA, 25 bp, Mus musculus
aggtgtcactttgggcctgtagtct

SEQ ID NO: 204821 - DNA, 25 bp, Mus musculus
aggtgtcagacaaagccaagaattg

SEQ ID NO: 204822 - DNA, 25 bp, Mus musculus
aggtgtcagacatagccaagaattg

SEQ ID NO: 204823 - DNA, 25 bp, Mus musculus
aggtgtcagcagcttctaagactag

SEQ ID NO: 204824 - DNA, 25 bp, Mus musculus
aggtgtcagcaggttctaagactag

SEQ ID NO: 204825 - DNA, 25 bp, Mus musculus
aggtgtcaggttcctaattctccac

SEQ ID NO: 204826 - DNA, 25 bp, Mus musculus
aggtgtcaggttgctaattctccac

SEQ ID NO: 204827 - DNA, 25 bp, Mus musculus
aggtgtcagtgacgccactccagca

SEQ ID NO: 204828 - DNA, 25 bp, Mus musculus
aggtgtcagtgaggccactccagca

SEQ ID NO: 204829 - DNA, 25 bp, Mus musculus
aggtgtcatacaactgctgcagtca

SEQ ID NO: 204830 - DNA, 25 bp, Mus musculus
aggtgtcatacatctgctgcagtca

SEQ ID NO: 204831 - DNA, 25 bp, Mus musculus
aggtgtccaactcgtggatgtgcct

SEQ ID NO: 204832 - DNA, 25 bp, Mus musculus
aggtgtccaactggtggatgtgcct

SEQ ID NO: 204833 - DNA, 25 bp, Mus musculus
aggtgtccaataatatgcaggtaac

SEQ ID NO: 204834 - DNA, 25 bp, Mus musculus
aggtgtccaatattatgcaggtaac

SEQ ID NO: 204835 - DNA, 25 bp, Mus musculus
aggtgtccaattcccctatctctgg

SEQ ID NO: 204836 - DNA, 25 bp, Mus musculus
aggtgtccaattgccctatctctgg

SEQ ID NO: 204837 - DNA, 25 bp, Mus musculus
aggtgtccacacaagagaactactc

SEQ ID NO: 204838 - DNA, 25 bp, Mus musculus
aggtgtccacactagagaactactc

SEQ ID NO: 204839 - DNA, 25 bp, Mus musculus
aggtgtccacatagcactttcctgg

SEQ ID NO: 204840 - DNA, 25 bp, Mus musculus
aggtgtccacattgcactttcctgg

SEQ ID NO: 204841 - DNA, 25 bp, Mus musculus
aggtgtccactcacatacattgtca

SEQ ID NO: 204842 - DNA, 25 bp, Mus musculus
aggtgtccactctcatacattgtca

SEQ ID NO: 204843 - DNA, 25 bp, Mus musculus
aggtgtccagatacatagcaatcct

SEQ ID NO: 204844 - DNA, 25 bp, Mus musculus
aggtgtccagattcatagcaatcct

SEQ ID NO: 204845 - DNA, 25 bp, Mus musculus
aggtgtccatcccagaatggctgca

SEQ ID NO: 204846 - DNA, 25 bp, Mus musculus
aggtgtccatccgagaatggctgca

SEQ ID NO: 204847 - DNA, 25 bp, Mus musculus
aggtgtccattgaatgacgtatctc

SEQ ID NO: 204848 - DNA, 25 bp, Mus musculus
aggtgtccattgtatgacgtatctc

SEQ ID NO: 204849 - DNA, 25 bp, Mus musculus
aggtgtccctaaatgtctattcttt

SEQ ID NO: 204850 - DNA, 25 bp, Mus musculus
aggtgtccctaattgtctattcttt

SEQ ID NO: 204851 - DNA, 25 bp, Mus musculus
aggtgtccctatagcatatgataac

SEQ ID NO: 204852 - DNA, 25 bp, Mus musculus
aggtgtccctattgcatatgataac

SEQ ID NO: 204853 - DNA, 25 bp, Mus musculus
aggtgtccctcaacattaactacga

SEQ ID NO: 204854 - DNA, 25 bp, Mus musculus
aggtgtccctcatcattaactacga

SEQ ID NO: 204855 - DNA, 25 bp, Mus musculus
aggtgtccctgcaaggctgggtttt

SEQ ID NO: 204856 - DNA, 25 bp, Mus musculus
aggtgtccctgctaggctgggtttt

SEQ ID NO: 204857 - DNA, 25 bp, Mus musculus
aggtgtccgtcacatcctttttcaa

SEQ ID NO: 204858 - DNA, 25 bp, Mus musculus
aggtgtccgtcagatcctttttcaa

SEQ ID NO: 204859 - DNA, 25 bp, Mus musculus
aggtgtccgtgcaagtggctttcgc

SEQ ID NO: 204860 - DNA, 25 bp, Mus musculus
aggtgtccgtgctagtggctttcgc

SEQ ID NO: 204861 - DNA, 25 bp, Mus musculus
aggtgtcctaaaactctggagctga

SEQ ID NO: 204862 - DNA, 25 bp, Mus musculus
aggtgtcctaaatctctggagctga

SEQ ID NO: 204863 - DNA, 25 bp, Mus musculus
aggtgtcctacacccctgagtgaga

SEQ ID NO: 204864 - DNA, 25 bp, Mus musculus
aggtgtcctacagccctgagtgaga

SEQ ID NO: 204865 - DNA, 25 bp, Mus musculus
aggtgtcctcagagaaggccttatt

SEQ ID NO: 204866 - DNA, 25 bp, Mus musculus
aggtgtcctcagtgaaggccttatt

SEQ ID NO: 204867 - DNA, 25 bp, Mus musculus
aggtgtcctctcattgtatggactc

SEQ ID NO: 204868 - DNA, 25 bp, Mus musculus
aggtgtcctctctttgtatggactc

SEQ ID NO: 204869 - DNA, 25 bp, Mus musculus
aggtgtcctgcaaacaaggcagcta

SEQ ID NO: 204870 - DNA, 25 bp, Mus musculus
aggtgtcctgcatacaaggcagcta

SEQ ID NO: 204871 - DNA, 25 bp, Mus musculus
aggtgtcctgctaagcaatctgtgc

SEQ ID NO: 204872 - DNA, 25 bp, Mus musculus
aggtgtcctgcttagcaatctgtgc

SEQ ID NO: 204873 - DNA, 25 bp, Mus musculus
aggtgtcctgtgaacctccaggtat

SEQ ID NO: 204874 - DNA, 25 bp, Mus musculus
aggtgtcctgtgtacctccaggtat

SEQ ID NO: 204875 - DNA, 25 bp, Mus musculus
aggtgtccttcaagaccagcaagca

SEQ ID NO: 204876 - DNA, 25 bp, Mus musculus
aggtgtccttcatgaccagcaagca

SEQ ID NO: 204877 - DNA, 25 bp, Mus musculus
aggtgtcggaacagttttagtcaag

SEQ ID NO: 204878 - DNA, 25 bp, Mus musculus
aggtgtcggaactgttttagtcaag

SEQ ID NO: 204879 - DNA, 25 bp, Mus musculus
aggtgtctacatccgtgtgacttct

SEQ ID NO: 204880 - DNA, 25 bp, Mus musculus
aggtgtctacatgcgtgtgacttct

SEQ ID NO: 204881 - DNA, 25 bp, Mus musculus
aggtgtctagcactctcaggaggcc

SEQ ID NO: 204882 - DNA, 25 bp, Mus musculus
aggtgtctagcagtctcaggaggcc

SEQ ID NO: 204883 - DNA, 25 bp, Mus musculus
aggtgtctatatcgtaccctgcatc

SEQ ID NO: 204884 - DNA, 25 bp, Mus musculus
aggtgtctatatggtaccctgcatc

SEQ ID NO: 204885 - DNA, 25 bp, Mus musculus
aggtgtctcacccacgggctgtgat

SEQ ID NO: 204886 - DNA, 25 bp, Mus musculus
aggtgtctcaccgacgggctgtgat

SEQ ID NO: 204887 - DNA, 25 bp, Mus musculus
aggtgtctcatcatgtttccggaag

SEQ ID NO: 204888 - DNA, 25 bp, Mus musculus
aggtgtctcatcttgtttccggaag

SEQ ID NO: 204889 - DNA, 25 bp, Mus musculus
aggtgtctccatctcaacaaatatg

SEQ ID NO: 204890 - DNA, 25 bp, Mus musculus
aggtgtctccatgtcaacaaatatg

SEQ ID NO: 204891 - DNA, 25 bp, Mus musculus
aggtgtctcctaattgttctcttgc

SEQ ID NO: 204892 - DNA, 25 bp, Mus musculus
aggtgtctcctatttgttctcttgc

SEQ ID NO: 204893 - DNA, 25 bp, Mus musculus
aggtgtctctcaagtcacgtgtagc

SEQ ID NO: 204894 - DNA, 25 bp, Mus musculus
aggtgtctctcatgtcacgtgtagc

SEQ ID NO: 204895 - DNA, 25 bp, Mus musculus
aggtgtctctgaattactgggtgta

SEQ ID NO: 204896 - DNA, 25 bp, Mus musculus
aggtgtctctgatttactgggtgta

SEQ ID NO: 204897 - DNA, 25 bp, Mus musculus
aggtgtctctgtataggccgatgaa

SEQ ID NO: 204898 - DNA, 25 bp, Mus musculus
aggtgtctctgtttaggccgatgaa

SEQ ID NO: 204899 - DNA, 25 bp, Mus musculus
aggtgtctctttaaactgatcttag

SEQ ID NO: 204900 - DNA, 25 bp, Mus musculus
aggtgtctcttttaactgatcttag

SEQ ID NO: 204901 - DNA, 25 bp, Mus musculus
aggtgtctgaacaatgtccctcaac

SEQ ID NO: 204902 - DNA, 25 bp, Mus musculus
aggtgtctgaactatgtccctcaac

SEQ ID NO: 204903 - DNA, 25 bp, Mus musculus
aggtgtctgatgacacatcctcagg

SEQ ID NO: 204904 - DNA, 25 bp, Mus musculus
aggtgtctgatgcttccctcggtct

SEQ ID NO: 204905 - DNA, 25 bp, Mus musculus
aggtgtctgatggttccctcggtct

SEQ ID NO: 204906 - DNA, 25 bp, Mus musculus
aggtgtctgatgtcacatcctcagg

SEQ ID NO: 204907 - DNA, 25 bp, Mus musculus
aggtgtctgcaaatccatattggta

SEQ ID NO: 204908 - DNA, 25 bp, Mus musculus
aggtgtctgcaattccatattggta

SEQ ID NO: 204909 - DNA, 25 bp, Mus musculus
aggtgtctgcatctgtctttaactc

SEQ ID NO: 204910 - DNA, 25 bp, Mus musculus
aggtgtctgcatgtgtctttaactc

SEQ ID NO: 204911 - DNA, 25 bp, Mus musculus
aggtgtctggcccagcctgtgaata

SEQ ID NO: 204912 - DNA, 25 bp, Mus musculus
aggtgtctggccgagcctgtgaata

SEQ ID NO: 204913 - DNA, 25 bp, Mus musculus
aggtgtctgtgtatcttgctctcat

SEQ ID NO: 204914 - DNA, 25 bp, Mus musculus
aggtgtctgtgtcctgtatctctag

SEQ ID NO: 204915 - DNA, 25 bp, Mus musculus
aggtgtctgtgtgctgtatctctag

SEQ ID NO: 204916 - DNA, 25 bp, Mus musculus
aggtgtctgtgtttcttgctctcat

SEQ ID NO: 204917 - DNA, 25 bp, Mus musculus
aggtgtcttagacatggcctcactg

SEQ ID NO: 204918 - DNA, 25 bp, Mus musculus
aggtgtcttagagatggcctcactg

SEQ ID NO: 204919 - DNA, 25 bp, Mus musculus
aggtgtcttcatcctctttgcctct

SEQ ID NO: 204920 - DNA, 25 bp, Mus musculus
aggtgtcttcatgctctttgcctct

SEQ ID NO: 204921 - DNA, 25 bp, Mus musculus
aggtgtcttctgagaaggcgttgca

SEQ ID NO: 204922 - DNA, 25 bp, Mus musculus
aggtgtcttctgagaggaactaacc

SEQ ID NO: 204923 - DNA, 25 bp, Mus musculus
aggtgtcttctgtgaaggcgttgca

SEQ ID NO: 204924 - DNA, 25 bp, Mus musculus
aggtgtcttctgtgaggaactaacc

SEQ ID NO: 204925 - DNA, 25 bp, Mus musculus
aggtgtcttgaaaagctggcactgt

SEQ ID NO: 204926 - DNA, 25 bp, Mus musculus
aggtgtcttgaatagctggcactgt

SEQ ID NO: 204927 - DNA, 25 bp, Mus musculus
aggtgtcttgctccaggtaactaat

SEQ ID NO: 204928 - DNA, 25 bp, Mus musculus
aggtgtcttgctgcaggtaactaat

SEQ ID NO: 204929 - DNA, 25 bp, Mus musculus
aggtgtctttagatctgagggcaca

SEQ ID NO: 204930 - DNA, 25 bp, Mus musculus
aggtgtctttagttctgagggcaca

SEQ ID NO: 204931 - DNA, 25 bp, Mus musculus
aggtgtctttttctatctgagctcc

SEQ ID NO: 204932 - DNA, 25 bp, Mus musculus
aggtgtctttttgtatctgagctcc

SEQ ID NO: 204933 - DNA, 25 bp, Mus musculus
aggtgtgaacacacaatatctttga

SEQ ID NO: 204934 - DNA, 25 bp, Mus musculus
aggtgtgaacactcaatatctttga

SEQ ID NO: 204935 - DNA, 25 bp, Mus musculus
aggtgtgaacgtccctgcttattga

SEQ ID NO: 204936 - DNA, 25 bp, Mus musculus
aggtgtgaacgtgcctgcttattga

SEQ ID NO: 204937 - DNA, 25 bp, Mus musculus
aggtgtgaagacacagcctgacctc

SEQ ID NO: 204938 - DNA, 25 bp, Mus musculus
aggtgtgaagactcagcctgacctc

SEQ ID NO: 204939 - DNA, 25 bp, Mus musculus
aggtgtgaaggcagttggtttccat

SEQ ID NO: 204940 - DNA, 25 bp, Mus musculus
aggtgtgaaggctgttggtttccat

SEQ ID NO: 204941 - DNA, 25 bp, Mus musculus
aggtgtgaatgcaatctcccagctt

SEQ ID NO: 204942 - DNA, 25 bp, Mus musculus
aggtgtgaatgctatctcccagctt

SEQ ID NO: 204943 - DNA, 25 bp, Mus musculus
aggtgtgacaccctgaagctcactt

SEQ ID NO: 204944 - DNA, 25 bp, Mus musculus
aggtgtgacaccgtgaagctcactt

SEQ ID NO: 204945 - DNA, 25 bp, Mus musculus
aggtgtgaccttctggtccctctgt

SEQ ID NO: 204946 - DNA, 25 bp, Mus musculus
aggtgtgaccttgtggtccctctgt

SEQ ID NO: 204947 - DNA, 25 bp, Mus musculus
aggtgtgactgcattcctgtaaggt

SEQ ID NO: 204948 - DNA, 25 bp, Mus musculus
aggtgtgactgctttcctgtaaggt

SEQ ID NO: 204949 - DNA, 25 bp, Mus musculus
aggtgtgagcacacagacttccttc

SEQ ID NO: 204950 - DNA, 25 bp, Mus musculus
aggtgtgagcactcagacttccttc

SEQ ID NO: 204951 - DNA, 25 bp, Mus musculus
aggtgtgagcatccatccggtcacc

SEQ ID NO: 204952 - DNA, 25 bp, Mus musculus
aggtgtgagcatgcatccggtcacc

SEQ ID NO: 204953 - DNA, 25 bp, Mus musculus
aggtgtgagccaaccattcttatct

SEQ ID NO: 204954 - DNA, 25 bp, Mus musculus
aggtgtgagccatccattcttatct

SEQ ID NO: 204955 - DNA, 25 bp, Mus musculus
aggtgtgagcctcgagcagcagcag

SEQ ID NO: 204956 - DNA, 25 bp, Mus musculus
aggtgtgagcctggagcagcagcag

SEQ ID NO: 204957 - DNA, 25 bp, Mus musculus
aggtgtgatcgcagacagccctgga

SEQ ID NO: 204958 - DNA, 25 bp, Mus musculus
aggtgtgatcgctgacagccctgga

SEQ ID NO: 204959 - DNA, 25 bp, Mus musculus
aggtgtgatcttctgtattggtttt

SEQ ID NO: 204960 - DNA, 25 bp, Mus musculus
aggtgtgatcttgtgtattggtttt

SEQ ID NO: 204961 - DNA, 25 bp, Mus musculus
aggtgtgatgccctttaccaggcac

SEQ ID NO: 204962 - DNA, 25 bp, Mus musculus
aggtgtgatgccgtttaccaggcac

SEQ ID NO: 204963 - DNA, 25 bp, Mus musculus
aggtgtgatggcaacctcaccctga

SEQ ID NO: 204964 - DNA, 25 bp, Mus musculus
aggtgtgatggctacctcaccctga

SEQ ID NO: 204965 - DNA, 25 bp, Mus musculus
aggtgtgatttaacacagtcctgtg

SEQ ID NO: 204966 - DNA, 25 bp, Mus musculus
aggtgtgatttatcacagtcctgtg

SEQ ID NO: 204967 - DNA, 25 bp, Mus musculus
aggtgtgcacacatcaggaggcccc

SEQ ID NO: 204968 - DNA, 25 bp, Mus musculus
aggtgtgcacacttcaggaggcccc

SEQ ID NO: 204969 - DNA, 25 bp, Mus musculus
aggtgtgcacatattgctggacctt

SEQ ID NO: 204970 - DNA, 25 bp, Mus musculus
aggtgtgcacattttgctggacctt

SEQ ID NO: 204971 - DNA, 25 bp, Mus musculus
aggtgtgcaccacgctgtcctttgg

SEQ ID NO: 204972 - DNA, 25 bp, Mus musculus
aggtgtgcaccaggctgtcctttgg

SEQ ID NO: 204973 - DNA, 25 bp, Mus musculus
aggtgtgcacccaaacataaatgag

SEQ ID NO: 204974 - DNA, 25 bp, Mus musculus
aggtgtgcaccctaacataaatgag

SEQ ID NO: 204975 - DNA, 25 bp, Mus musculus
aggtgtgcacgtcggtcccatgtcc

SEQ ID NO: 204976 - DNA, 25 bp, Mus musculus
aggtgtgcacgtgggtcccatgtcc

SEQ ID NO: 204977 - DNA, 25 bp, Mus musculus
aggtgtgcagctagcttggtagcca

SEQ ID NO: 204978 - DNA, 25 bp, Mus musculus
aggtgtgcagcttgcttggtagcca

SEQ ID NO: 204979 - DNA, 25 bp, Mus musculus
aggtgtgcagtactgactctgtctc

SEQ ID NO: 204980 - DNA, 25 bp, Mus musculus
aggtgtgcagtagtgactctgtctc

SEQ ID NO: 204981 - DNA, 25 bp, Mus musculus
aggtgtgcatacatttatactttca

SEQ ID NO: 204982 - DNA, 25 bp, Mus musculus
aggtgtgcatacttttatactttca

SEQ ID NO: 204983 - DNA, 25 bp, Mus musculus
aggtgtgcatcactatggctcatct

SEQ ID NO: 204984 - DNA, 25 bp, Mus musculus
aggtgtgcatcactggctcttgtgc

SEQ ID NO: 204985 - DNA, 25 bp, Mus musculus
aggtgtgcatcagtatggctcatct

SEQ ID NO: 204986 - DNA, 25 bp, Mus musculus
aggtgtgcatcagtggctcttgtgc

SEQ ID NO: 204987 - DNA, 25 bp, Mus musculus
aggtgtgcatccctgagtgcctttg

SEQ ID NO: 204988 - DNA, 25 bp, Mus musculus
aggtgtgcatccgtgagtgcctttg

SEQ ID NO: 204989 - DNA, 25 bp, Mus musculus
aggtgtgcatgcctgtacagccagt

SEQ ID NO: 204990 - DNA, 25 bp, Mus musculus
aggtgtgcatgcgtgtacagccagt

SEQ ID NO: 204991 - DNA, 25 bp, Mus musculus
aggtgtgccatccacatcgtgcttt

SEQ ID NO: 204992 - DNA, 25 bp, Mus musculus
aggtgtgccatcgacatcgtgcttt

SEQ ID NO: 204993 - DNA, 25 bp, Mus musculus
aggtgtgccccaataaattatgctt

SEQ ID NO: 204994 - DNA, 25 bp, Mus musculus
aggtgtgccccaatactgcttggct

SEQ ID NO: 204995 - DNA, 25 bp, Mus musculus
aggtgtgccccattaaattatgctt

SEQ ID NO: 204996 - DNA, 25 bp, Mus musculus
aggtgtgccccattactgcttggct

SEQ ID NO: 204997 - DNA, 25 bp, Mus musculus
aggtgtgcctgcacatgcgggaaaa

SEQ ID NO: 204998 - DNA, 25 bp, Mus musculus
aggtgtgcctgctcatgcgggaaaa

SEQ ID NO: 204999 - DNA, 25 bp, Mus musculus
aggtgtgccttgaacgtcactcaac

SEQ ID NO: 205000 - DNA, 25 bp, Mus musculus
aggtgtgccttgtacgtcactcaac

SEQ ID NO: 205001 - DNA, 25 bp, Mus musculus
aggtgtgcctttcccttgggcgcac

SEQ ID NO: 205002 - DNA, 25 bp, Mus musculus
aggtgtgcctttgccttgggcgcac

SEQ ID NO: 205003 - DNA, 25 bp, Mus musculus
aggtgtgcggctctactacatcgga

SEQ ID NO: 205004 - DNA, 25 bp, Mus musculus
aggtgtgcggctgtactacatcgga

SEQ ID NO: 205005 - DNA, 25 bp, Mus musculus
aggtgtgcgggaacgcccttatgaa

SEQ ID NO: 205006 - DNA, 25 bp, Mus musculus
aggtgtgcgggatcgcccttatgaa

SEQ ID NO: 205007 - DNA, 25 bp, Mus musculus
aggtgtgctatcagtgggtattaat

SEQ ID NO: 205008 - DNA, 25 bp, Mus musculus
aggtgtgctatctgtgggtattaat

SEQ ID NO: 205009 - DNA, 25 bp, Mus musculus
aggtgtgctgaacaaacatgctacg

SEQ ID NO: 205010 - DNA, 25 bp, Mus musculus
aggtgtgctgaagaaacatgctacg

SEQ ID NO: 205011 - DNA, 25 bp, Mus musculus
aggtgtgctgtgacttgcaatcctc

SEQ ID NO: 205012 - DNA, 25 bp, Mus musculus
aggtgtgctgtgagactccccgaca

SEQ ID NO: 205013 - DNA, 25 bp, Mus musculus
aggtgtgctgtgtcttgcaatcctc

SEQ ID NO: 205014 - DNA, 25 bp, Mus musculus
aggtgtgctgtgtgactccccgaca

SEQ ID NO: 205015 - DNA, 25 bp, Mus musculus
aggtgtggaatcaggctaactgcaa

SEQ ID NO: 205016 - DNA, 25 bp, Mus musculus
aggtgtggaatctggctaactgcaa

SEQ ID NO: 205017 - DNA, 25 bp, Mus musculus
aggtgtggactgacaaggtgcacgt

SEQ ID NO: 205018 - DNA, 25 bp, Mus musculus
aggtgtggactgtcaaggtgcacgt

SEQ ID NO: 205019 - DNA, 25 bp, Mus musculus
aggtgtggatgcactctatttagcg

SEQ ID NO: 205020 - DNA, 25 bp, Mus musculus
aggtgtggatgctctctatttagcg

SEQ ID NO: 205021 - DNA, 25 bp, Mus musculus
aggtgtggatggcaactttctgata

SEQ ID NO: 205022 - DNA, 25 bp, Mus musculus
aggtgtggatgggaactttctgata

SEQ ID NO: 205023 - DNA, 25 bp, Mus musculus
aggtgtggatttagctacttagaac

SEQ ID NO: 205024 - DNA, 25 bp, Mus musculus
aggtgtggattttgctacttagaac

SEQ ID NO: 205025 - DNA, 25 bp, Mus musculus
aggtgtggcaggagatatcgcccca

SEQ ID NO: 205026 - DNA, 25 bp, Mus musculus
aggtgtggcaggtgatatcgcccca

SEQ ID NO: 205027 - DNA, 25 bp, Mus musculus
aggtgtggcatgaagtttcctctcc

SEQ ID NO: 205028 - DNA, 25 bp, Mus musculus
aggtgtggcatgcacagactccagt

SEQ ID NO: 205029 - DNA, 25 bp, Mus musculus
aggtgtggcatggacagactccagt

SEQ ID NO: 205030 - DNA, 25 bp, Mus musculus
aggtgtggcatgtagtttcctctcc

SEQ ID NO: 205031 - DNA, 25 bp, Mus musculus
aggtgtggcccaaggttagccattt

SEQ ID NO: 205032 - DNA, 25 bp, Mus musculus
aggtgtggcccatggttagccattt

SEQ ID NO: 205033 - DNA, 25 bp, Mus musculus
aggtgtggcctaccttctgagtgcc

SEQ ID NO: 205034 - DNA, 25 bp, Mus musculus
aggtgtggcctagcttctgagtgcc

SEQ ID NO: 205035 - DNA, 25 bp, Mus musculus
aggtgtggcctcaattacaaaggag

SEQ ID NO: 205036 - DNA, 25 bp, Mus musculus
aggtgtggcctctattacaaaggag

SEQ ID NO: 205037 - DNA, 25 bp, Mus musculus
aggtgtggctcactgcttgaagatc

SEQ ID NO: 205038 - DNA, 25 bp, Mus musculus
aggtgtggctcagtgcttgaagatc

SEQ ID NO: 205039 - DNA, 25 bp, Mus musculus
aggtgtggctggagctatccctctg

SEQ ID NO: 205040 - DNA, 25 bp, Mus musculus
aggtgtggctggtgctatccctctg

SEQ ID NO: 205041 - DNA, 25 bp, Mus musculus
aggtgtggctgtaagcttccaggct

SEQ ID NO: 205042 - DNA, 25 bp, Mus musculus
aggtgtggctgttagcttccaggct

SEQ ID NO: 205043 - DNA, 25 bp, Mus musculus
aggtgtgggattctctgtagccatt

SEQ ID NO: 205044 - DNA, 25 bp, Mus musculus
aggtgtgggattgtctgtagccatt

SEQ ID NO: 205045 - DNA, 25 bp, Mus musculus
aggtgtgggtccaccgccctcctga

SEQ ID NO: 205046 - DNA, 25 bp, Mus musculus
aggtgtgggtcctccgccctcctga

SEQ ID NO: 205047 - DNA, 25 bp, Mus musculus
aggtgtgggtttagcctgcacattc

SEQ ID NO: 205048 - DNA, 25 bp, Mus musculus
aggtgtgggttttgcctgcacattc

SEQ ID NO: 205049 - DNA, 25 bp, Mus musculus
aggtgtggtgacatactcaggaggc

SEQ ID NO: 205050 - DNA, 25 bp, Mus musculus
aggtgtggtgacttactcaggaggc

SEQ ID NO: 205051 - DNA, 25 bp, Mus musculus
aggtgtggtgcgatgcccgtgtgca

SEQ ID NO: 205052 - DNA, 25 bp, Mus musculus
aggtgtggtgcgttgcccgtgtgca

SEQ ID NO: 205053 - DNA, 25 bp, Mus musculus
aggtgtggtttgaagcgagtgcttt

SEQ ID NO: 205054 - DNA, 25 bp, Mus musculus
aggtgtggtttgtagcgagtgcttt

SEQ ID NO: 205055 - DNA, 25 bp, Mus musculus
aggtgtgtaacactcagccaatatt

SEQ ID NO: 205056 - DNA, 25 bp, Mus musculus
aggtgtgtaacagtcagccaatatt

SEQ ID NO: 205057 - DNA, 25 bp, Mus musculus
aggtgtgtaacgctctggactctct

SEQ ID NO: 205058 - DNA, 25 bp, Mus musculus
aggtgtgtaacggtctggactctct

SEQ ID NO: 205059 - DNA, 25 bp, Mus musculus
aggtgtgtagttattcatgtaattc

SEQ ID NO: 205060 - DNA, 25 bp, Mus musculus
aggtgtgtagttcatgctgctgctc

SEQ ID NO: 205061 - DNA, 25 bp, Mus musculus
aggtgtgtagttgatgctgctgctc

SEQ ID NO: 205062 - DNA, 25 bp, Mus musculus
aggtgtgtagtttttcatgtaattc

SEQ ID NO: 205063 - DNA, 25 bp, Mus musculus
aggtgtgtatttcagatgatgcttc

SEQ ID NO: 205064 - DNA, 25 bp, Mus musculus
aggtgtgtatttgagatgatgcttc

SEQ ID NO: 205065 - DNA, 25 bp, Mus musculus
aggtgtgtccaaagtgcagcgagca

SEQ ID NO: 205066 - DNA, 25 bp, Mus musculus
aggtgtgtccaatgtgcagcgagca

SEQ ID NO: 205067 - DNA, 25 bp, Mus musculus
aggtgtgtcccacattgtgcctggt

SEQ ID NO: 205068 - DNA, 25 bp, Mus musculus
aggtgtgtcccagattgtgcctggt

SEQ ID NO: 205069 - DNA, 25 bp, Mus musculus
aggtgtgtcctcagagcggctgctc

SEQ ID NO: 205070 - DNA, 25 bp, Mus musculus
aggtgtgtcctctgagcggctgctc

SEQ ID NO: 205071 - DNA, 25 bp, Mus musculus
aggtgtgtcctgaagagatgaagtt

SEQ ID NO: 205072 - DNA, 25 bp, Mus musculus
aggtgtgtcctgcttgtattggcac

SEQ ID NO: 205073 - DNA, 25 bp, Mus musculus
aggtgtgtcctggttgtattggcac

SEQ ID NO: 205074 - DNA, 25 bp, Mus musculus
aggtgtgtcctgtagagatgaagtt

SEQ ID NO: 205075 - DNA, 25 bp, Mus musculus
aggtgtgtccttcgccatttctaaa

SEQ ID NO: 205076 - DNA, 25 bp, Mus musculus
aggtgtgtccttggccatttctaaa

SEQ ID NO: 205077 - DNA, 25 bp, Mus musculus
aggtgtgtctgacctccggagctca

SEQ ID NO: 205078 - DNA, 25 bp, Mus musculus
aggtgtgtctgagctccggagctca

SEQ ID NO: 205079 - DNA, 25 bp, Mus musculus
aggtgtgtctggcagtagaccaact

SEQ ID NO: 205080 - DNA, 25 bp, Mus musculus
aggtgtgtctgggagtagaccaact

SEQ ID NO: 205081 - DNA, 25 bp, Mus musculus
aggtgtgtcttacaggagattctca

SEQ ID NO: 205082 - DNA, 25 bp, Mus musculus
aggtgtgtcttagaggagattctca

SEQ ID NO: 205083 - DNA, 25 bp, Mus musculus
aggtgtgtgacaactcaggacccca

SEQ ID NO: 205084 - DNA, 25 bp, Mus musculus
aggtgtgtgacatctcaggacccca

SEQ ID NO: 205085 - DNA, 25 bp, Mus musculus
aggtgtgtgcaaacactcttcagtg

SEQ ID NO: 205086 - DNA, 25 bp, Mus musculus
aggtgtgtgcaatcactcttcagtg

SEQ ID NO: 205087 - DNA, 25 bp, Mus musculus
aggtgtgtgcacagcctatgttcac

SEQ ID NO: 205088 - DNA, 25 bp, Mus musculus
aggtgtgtgcactgcctatgttcac

SEQ ID NO: 205089 - DNA, 25 bp, Mus musculus
aggtgtgtgcctaaaccctgctggt

SEQ ID NO: 205090 - DNA, 25 bp, Mus musculus
aggtgtgtgccttaaccctgctggt

SEQ ID NO: 205091 - DNA, 25 bp, Mus musculus
aggtgtgtgttcagaagcaaacaga

SEQ ID NO: 205092 - DNA, 25 bp, Mus musculus
aggtgtgtgttctgaagcaaacaga

SEQ ID NO: 205093 - DNA, 25 bp, Mus musculus
aggtgtgttcacattcgtgtataaa

SEQ ID NO: 205094 - DNA, 25 bp, Mus musculus
aggtgtgttcactttcgtgtataaa

SEQ ID NO: 205095 - DNA, 25 bp, Mus musculus
aggtgtgttcagaattttgttcaaa

SEQ ID NO: 205096 - DNA, 25 bp, Mus musculus
aggtgtgttcagtattttgttcaaa

SEQ ID NO: 205097 - DNA, 25 bp, Mus musculus
aggtgtgttcctatctaccaggtgt

SEQ ID NO: 205098 - DNA, 25 bp, Mus musculus
aggtgtgttcctttctaccaggtgt

SEQ ID NO: 205099 - DNA, 25 bp, Mus musculus
aggtgtgttctcaacagctttggtc

SEQ ID NO: 205100 - DNA, 25 bp, Mus musculus
aggtgtgttctctacagctttggtc

SEQ ID NO: 205101 - DNA, 25 bp, Mus musculus
aggtgtgttttcatggctgcatcgt

SEQ ID NO: 205102 - DNA, 25 bp, Mus musculus
aggtgtgttttcttggctgcatcgt

SEQ ID NO: 205103 - DNA, 25 bp, Mus musculus
aggtgttacagccttccaagacatc

SEQ ID NO: 205104 - DNA, 25 bp, Mus musculus
aggtgttacagcgttccaagacatc

SEQ ID NO: 205105 - DNA, 25 bp, Mus musculus
aggtgttaccagagttgctcaagat

SEQ ID NO: 205106 - DNA, 25 bp, Mus musculus
aggtgttaccagtgttgctcaagat

SEQ ID NO: 205107 - DNA, 25 bp, Mus musculus
aggtgttactgacccggaagcagct

SEQ ID NO: 205108 - DNA, 25 bp, Mus musculus
aggtgttactgagccggaagcagct

SEQ ID NO: 205109 - DNA, 25 bp, Mus musculus
aggtgttacttcctgacgtaggcgc

SEQ ID NO: 205110 - DNA, 25 bp, Mus musculus
aggtgttacttcgtgacgtaggcgc

SEQ ID NO: 205111 - DNA, 25 bp, Mus musculus
aggtgttatcctacacaaggcctgg

SEQ ID NO: 205112 - DNA, 25 bp, Mus musculus
aggtgttatccttcacaaggcctgg

SEQ ID NO: 205113 - DNA, 25 bp, Mus musculus
aggtgttatgccaactactacccta

SEQ ID NO: 205114 - DNA, 25 bp, Mus musculus
aggtgttatgcctactactacccta

SEQ ID NO: 205115 - DNA, 25 bp, Mus musculus
aggtgttcaaggactctcagagatc

SEQ ID NO: 205116 - DNA, 25 bp, Mus musculus
aggtgttcaaggtctctcagagatc

SEQ ID NO: 205117 - DNA, 25 bp, Mus musculus
aggtgttcaatgacaccagggacaa

SEQ ID NO: 205118 - DNA, 25 bp, Mus musculus
aggtgttcaatgtcaccagggacaa

SEQ ID NO: 205119 - DNA, 25 bp, Mus musculus
aggtgttcaggacctggagcttcct

SEQ ID NO: 205120 - DNA, 25 bp, Mus musculus
aggtgttcaggagctggagcttcct

SEQ ID NO: 205121 - DNA, 25 bp, Mus musculus
aggtgttcataaaatcccacctcac

SEQ ID NO: 205122 - DNA, 25 bp, Mus musculus
aggtgttcataatatcccacctcac

SEQ ID NO: 205123 - DNA, 25 bp, Mus musculus
aggtgttcatatcgtacctatccat

SEQ ID NO: 205124 - DNA, 25 bp, Mus musculus
aggtgttcatatggtacctatccat

SEQ ID NO: 205125 - DNA, 25 bp, Mus musculus
aggtgttcattcatctgcatcagca

SEQ ID NO: 205126 - DNA, 25 bp, Mus musculus
aggtgttcattcttctgcatcagca

SEQ ID NO: 205127 - DNA, 25 bp, Mus musculus
aggtgttccaacactgaactcaatc

SEQ ID NO: 205128 - DNA, 25 bp, Mus musculus
aggtgttccaactctgaactcaatc

SEQ ID NO: 205129 - DNA, 25 bp, Mus musculus
aggtgttccagcattgtcagtgaga

SEQ ID NO: 205130 - DNA, 25 bp, Mus musculus
aggtgttccagctttgtcagtgaga

SEQ ID NO: 205131 - DNA, 25 bp, Mus musculus
aggtgttccaggaggtcacactcgg

SEQ ID NO: 205132 - DNA, 25 bp, Mus musculus
aggtgttccaggatcctcctctggg

SEQ ID NO: 205133 - DNA, 25 bp, Mus musculus
aggtgttccaggtggtcacactcgg

SEQ ID NO: 205134 - DNA, 25 bp, Mus musculus
aggtgttccaggttcctcctctggg

SEQ ID NO: 205135 - DNA, 25 bp, Mus musculus
aggtgttccgcgctattctcgagga

SEQ ID NO: 205136 - DNA, 25 bp, Mus musculus
aggtgttccgcggtattctcgagga

SEQ ID NO: 205137 - DNA, 25 bp, Mus musculus
aggtgttccggcattccgtaggagc

SEQ ID NO: 205138 - DNA, 25 bp, Mus musculus
aggtgttccggctttccgtaggagc

SEQ ID NO: 205139 - DNA, 25 bp, Mus musculus
aggtgttcctcacactctaattcta

SEQ ID NO: 205140 - DNA, 25 bp, Mus musculus
aggtgttcctcagactctaattcta

SEQ ID NO: 205141 - DNA, 25 bp, Mus musculus
aggtgttcctcccaaggacaccaga

SEQ ID NO: 205142 - DNA, 25 bp, Mus musculus
aggtgttcctccgaaggacaccaga

SEQ ID NO: 205143 - DNA, 25 bp, Mus musculus
aggtgttccttcaggcttaagactt

SEQ ID NO: 205144 - DNA, 25 bp, Mus musculus
aggtgttccttcatgctgctgaact

SEQ ID NO: 205145 - DNA, 25 bp, Mus musculus
aggtgttccttctggcttaagactt

SEQ ID NO: 205146 - DNA, 25 bp, Mus musculus
aggtgttccttcttgctgctgaact

SEQ ID NO: 205147 - DNA, 25 bp, Mus musculus
aggtgttcgaggactctgccgctat

SEQ ID NO: 205148 - DNA, 25 bp, Mus musculus
aggtgttcgaggtctctgccgctat

SEQ ID NO: 205149 - DNA, 25 bp, Mus musculus
aggtgttctcccactgcaagtggaa

SEQ ID NO: 205150 - DNA, 25 bp, Mus musculus
aggtgttctccctctgcaagtggaa

SEQ ID NO: 205151 - DNA, 25 bp, Mus musculus
aggtgttctccgctgcacactcaca

SEQ ID NO: 205152 - DNA, 25 bp, Mus musculus
aggtgttctccggtgcacactcaca

SEQ ID NO: 205153 - DNA, 25 bp, Mus musculus
aggtgttctgtaacttgttctttgt

SEQ ID NO: 205154 - DNA, 25 bp, Mus musculus
aggtgttctgtacacatgggcccac

SEQ ID NO: 205155 - DNA, 25 bp, Mus musculus
aggtgttctgtagacatgggcccac

SEQ ID NO: 205156 - DNA, 25 bp, Mus musculus
aggtgttctgtatcttgttctttgt

SEQ ID NO: 205157 - DNA, 25 bp, Mus musculus
aggtgttcttccccacaaacatcct

SEQ ID NO: 205158 - DNA, 25 bp, Mus musculus
aggtgttcttccgcacaaacatcct

SEQ ID NO: 205159 - DNA, 25 bp, Mus musculus
aggtgttcttttcgaacgagtgtgt

SEQ ID NO: 205160 - DNA, 25 bp, Mus musculus
aggtgttcttttggaacgagtgtgt

SEQ ID NO: 205161 - DNA, 25 bp, Mus musculus
aggtgttgatctctacattggtaac

SEQ ID NO: 205162 - DNA, 25 bp, Mus musculus
aggtgttgatctgtacattggtaac

SEQ ID NO: 205163 - DNA, 25 bp, Mus musculus
aggtgttgcaaacttccttcctcaa

SEQ ID NO: 205164 - DNA, 25 bp, Mus musculus
aggtgttgcaaagttccttcctcaa

SEQ ID NO: 205165 - DNA, 25 bp, Mus musculus
aggtgttgcaccacagtggcgctga

SEQ ID NO: 205166 - DNA, 25 bp, Mus musculus
aggtgttgcacctcagtggcgctga

SEQ ID NO: 205167 - DNA, 25 bp, Mus musculus
aggtgttgcatgaggaatcctgaac

SEQ ID NO: 205168 - DNA, 25 bp, Mus musculus
aggtgttgcatgtggaatcctgaac

SEQ ID NO: 205169 - DNA, 25 bp, Mus musculus
aggtgttgccagaaactttccttgc

SEQ ID NO: 205170 - DNA, 25 bp, Mus musculus
aggtgttgccagtaactttccttgc

SEQ ID NO: 205171 - DNA, 25 bp, Mus musculus
aggtgttgctgtcaggcagttcctc

SEQ ID NO: 205172 - DNA, 25 bp, Mus musculus
aggtgttgctgtgaggcagttcctc

SEQ ID NO: 205173 - DNA, 25 bp, Mus musculus
aggtgttggcccagtgccttagctg

SEQ ID NO: 205174 - DNA, 25 bp, Mus musculus
aggtgttggccctgtgccttagctg

SEQ ID NO: 205175 - DNA, 25 bp, Mus musculus
aggtgttggcgaagacaaggacaaa

SEQ ID NO: 205176 - DNA, 25 bp, Mus musculus
aggtgttggcgatgacaaggacaaa

SEQ ID NO: 205177 - DNA, 25 bp, Mus musculus
aggtgttggtctcatcttgatttca

SEQ ID NO: 205178 - DNA, 25 bp, Mus musculus
aggtgttggtctgatcttgatttca

SEQ ID NO: 205179 - DNA, 25 bp, Mus musculus
aggtgttgtaacattcctctctcct

SEQ ID NO: 205180 - DNA, 25 bp, Mus musculus
aggtgttgtaactttcctctctcct

SEQ ID NO: 205181 - DNA, 25 bp, Mus musculus
aggtgttgtgccaggctctgctctg

SEQ ID NO: 205182 - DNA, 25 bp, Mus musculus
aggtgttgtgcctggctctgctctg

SEQ ID NO: 205183 - DNA, 25 bp, Mus musculus
aggtgtttacaccaacgtcagtgtc

SEQ ID NO: 205184 - DNA, 25 bp, Mus musculus
aggtgtttacaccaagtaatgctga

SEQ ID NO: 205185 - DNA, 25 bp, Mus musculus
aggtgtttacacgaacgtcagtgtc

SEQ ID NO: 205186 - DNA, 25 bp, Mus musculus
aggtgtttacacgaagtaatgctga

SEQ ID NO: 205187 - DNA, 25 bp, Mus musculus
aggtgtttactgcacacctggcctg

SEQ ID NO: 205188 - DNA, 25 bp, Mus musculus
aggtgtttactggacacctggcctg

SEQ ID NO: 205189 - DNA, 25 bp, Mus musculus
aggtgtttcagacgcaagccgtgcc

SEQ ID NO: 205190 - DNA, 25 bp, Mus musculus
aggtgtttcagaggcaagccgtgcc

SEQ ID NO: 205191 - DNA, 25 bp, Mus musculus
aggtgtttcctcaaagtgttaccat

SEQ ID NO: 205192 - DNA, 25 bp, Mus musculus
aggtgtttcctctaagtgttaccat

SEQ ID NO: 205193 - DNA, 25 bp, Mus musculus
aggtgtttcctgatagccttacttg

SEQ ID NO: 205194 - DNA, 25 bp, Mus musculus
aggtgtttcctgttagccttacttg

SEQ ID NO: 205195 - DNA, 25 bp, Mus musculus
aggtgtttcggaagtccctctacct

SEQ ID NO: 205196 - DNA, 25 bp, Mus musculus
aggtgtttcggatgtccctctacct

SEQ ID NO: 205197 - DNA, 25 bp, Mus musculus
aggtgtttctagatggtgtgttgtc

SEQ ID NO: 205198 - DNA, 25 bp, Mus musculus
aggtgtttctagttggtgtgttgtc

SEQ ID NO: 205199 - DNA, 25 bp, Mus musculus
aggtgtttctgactgcccaagcaag

SEQ ID NO: 205200 - DNA, 25 bp, Mus musculus
aggtgtttctgagtgcccaagcaag

SEQ ID NO: 205201 - DNA, 25 bp, Mus musculus
aggtgtttctgcagttgaagattcc

SEQ ID NO: 205202 - DNA, 25 bp, Mus musculus
aggtgtttctgctgttgaagattcc

SEQ ID NO: 205203 - DNA, 25 bp, Mus musculus
aggtgtttctttacaatagaccagg

SEQ ID NO: 205204 - DNA, 25 bp, Mus musculus
aggtgtttcttttcaatagaccagg

SEQ ID NO: 205205 - DNA, 25 bp, Mus musculus
aggtgtttgacaagctacctcgggt

SEQ ID NO: 205206 - DNA, 25 bp, Mus musculus
aggtgtttgacatgctacctcgggt

SEQ ID NO: 205207 - DNA, 25 bp, Mus musculus
aggtgtttgccaacacagcaagctt

SEQ ID NO: 205208 - DNA, 25 bp, Mus musculus
aggtgtttgccatcacagcaagctt

SEQ ID NO: 205209 - DNA, 25 bp, Mus musculus
aggtgtttggccaggacccatcagg

SEQ ID NO: 205210 - DNA, 25 bp, Mus musculus
aggtgtttggcctggacccatcagg

SEQ ID NO: 205211 - DNA, 25 bp, Mus musculus
aggtgtttggtcataaatctcagaa

SEQ ID NO: 205212 - DNA, 25 bp, Mus musculus
aggtgtttggtcttaaatctcagaa

SEQ ID NO: 205213 - DNA, 25 bp, Mus musculus
aggtgtttgtccattctctctgtac

SEQ ID NO: 205214 - DNA, 25 bp, Mus musculus
aggtgtttgtcctttctctctgtac

SEQ ID NO: 205215 - DNA, 25 bp, Mus musculus
aggtgttttattcttacgttagcag

SEQ ID NO: 205216 - DNA, 25 bp, Mus musculus
aggtgttttattgttacgttagcag

SEQ ID NO: 205217 - DNA, 25 bp, Mus musculus
aggtgttttccgatgaggtgcagca

SEQ ID NO: 205218 - DNA, 25 bp, Mus musculus
aggtgttttccgttgaggtgcagca

SEQ ID NO: 205219 - DNA, 25 bp, Mus musculus
aggtgttttctccagttaagttcag

SEQ ID NO: 205220 - DNA, 25 bp, Mus musculus
aggtgttttctcgagttaagttcag

SEQ ID NO: 205221 - DNA, 25 bp, Mus musculus
aggtgtttttgaacattgggctgct

SEQ ID NO: 205222 - DNA, 25 bp, Mus musculus
aggtgtttttgatcattgggctgct

SEQ ID NO: 205223 - DNA, 25 bp, Mus musculus
aggttaaacacaccccatgcacaaa

SEQ ID NO: 205224 - DNA, 25 bp, Mus musculus
aggttaaacacagcccatgcacaaa

SEQ ID NO: 205225 - DNA, 25 bp, Mus musculus
aggttaaacctgagacaagctgtgt

SEQ ID NO: 205226 - DNA, 25 bp, Mus musculus
aggttaaacctgtgacaagctgtgt

SEQ ID NO: 205227 - DNA, 25 bp, Mus musculus
aggttaacagttctctttcatggtt

SEQ ID NO: 205228 - DNA, 25 bp, Mus musculus
aggttaacagttgtctttcatggtt

SEQ ID NO: 205229 - DNA, 25 bp, Mus musculus
aggttaactaggacacgagcacttg

SEQ ID NO: 205230 - DNA, 25 bp, Mus musculus
aggttaactaggtcacgagcacttg

SEQ ID NO: 205231 - DNA, 25 bp, Mus musculus
aggttaagaaacagcccctgatcct

SEQ ID NO: 205232 - DNA, 25 bp, Mus musculus
aggttaagaaactgcccctgatcct

SEQ ID NO: 205233 - DNA, 25 bp, Mus musculus
aggttaagccatacgacaatttcaa

SEQ ID NO: 205234 - DNA, 25 bp, Mus musculus
aggttaagccattcgacaatttcaa

SEQ ID NO: 205235 - DNA, 25 bp, Mus musculus
aggttaaggagcactagtgccctct

SEQ ID NO: 205236 - DNA, 25 bp, Mus musculus
aggttaaggagctctagtgccctct

SEQ ID NO: 205237 - DNA, 25 bp, Mus musculus
aggttaatacgccatttgtcgacga

SEQ ID NO: 205238 - DNA, 25 bp, Mus musculus
aggttaatacgcgatttgtcgacga

SEQ ID NO: 205239 - DNA, 25 bp, Mus musculus
aggttaattcccatcttccagagga

SEQ ID NO: 205240 - DNA, 25 bp, Mus musculus
aggttaattcccttcttccagagga

SEQ ID NO: 205241 - DNA, 25 bp, Mus musculus
aggttacaagcacaacttcaaggtt

SEQ ID NO: 205242 - DNA, 25 bp, Mus musculus
aggttacaagcagaacttcaaggtt

SEQ ID NO: 205243 - DNA, 25 bp, Mus musculus
aggttacaattacagctgtgcttac

SEQ ID NO: 205244 - DNA, 25 bp, Mus musculus
aggttacaattagagctgtgcttac

SEQ ID NO: 205245 - DNA, 25 bp, Mus musculus
aggttacagagaatatggccctcct

SEQ ID NO: 205246 - DNA, 25 bp, Mus musculus
aggttacagagattatggccctcct

SEQ ID NO: 205247 - DNA, 25 bp, Mus musculus
aggttacaggaacatcctccggccg

SEQ ID NO: 205248 - DNA, 25 bp, Mus musculus
aggttacaggaagatcctccggccg

SEQ ID NO: 205249 - DNA, 25 bp, Mus musculus
aggttacatagcactgtacccatta

SEQ ID NO: 205250 - DNA, 25 bp, Mus musculus
aggttacatagctctgtacccatta

SEQ ID NO: 205251 - DNA, 25 bp, Mus musculus
aggttacatgtaccttgttctctgc

SEQ ID NO: 205252 - DNA, 25 bp, Mus musculus
aggttacatgtagcttgttctctgc

SEQ ID NO: 205253 - DNA, 25 bp, Mus musculus
aggttaccaacaagctctgctagca

SEQ ID NO: 205254 - DNA, 25 bp, Mus musculus
aggttaccaacatgctctgctagca

SEQ ID NO: 205255 - DNA, 25 bp, Mus musculus
aggttaccagatcttccagttacac

SEQ ID NO: 205256 - DNA, 25 bp, Mus musculus
aggttaccagatgttccagttacac

SEQ ID NO: 205257 - DNA, 25 bp, Mus musculus
aggttacccaccagagtcctcagta

SEQ ID NO: 205258 - DNA, 25 bp, Mus musculus
aggttacccacctgagtcctcagta

SEQ ID NO: 205259 - DNA, 25 bp, Mus musculus
aggttacccaggaaatttcagatga

SEQ ID NO: 205260 - DNA, 25 bp, Mus musculus
aggttacccaggtaatttcagatga

SEQ ID NO: 205261 - DNA, 25 bp, Mus musculus
aggttacctaccacaggctggctga

SEQ ID NO: 205262 - DNA, 25 bp, Mus musculus
aggttacctacctcaggctggctga

SEQ ID NO: 205263 - DNA, 25 bp, Mus musculus
aggttacctctgatagtattctatg

SEQ ID NO: 205264 - DNA, 25 bp, Mus musculus
aggttacctctgttagtattctatg

SEQ ID NO: 205265 - DNA, 25 bp, Mus musculus
aggttacctggaacagtcccagcag

SEQ ID NO: 205266 - DNA, 25 bp, Mus musculus
aggttacctggatcagtcccagcag

SEQ ID NO: 205267 - DNA, 25 bp, Mus musculus
aggttaccttttcagccaagggcat

SEQ ID NO: 205268 - DNA, 25 bp, Mus musculus
aggttaccttttgagccaagggcat

SEQ ID NO: 205269 - DNA, 25 bp, Mus musculus
aggttacgcttaaatgctctcttgt

SEQ ID NO: 205270 - DNA, 25 bp, Mus musculus
aggttacgcttatatgctctcttgt

SEQ ID NO: 205271 - DNA, 25 bp, Mus musculus
aggttacggcctcaagatagcttca

SEQ ID NO: 205272 - DNA, 25 bp, Mus musculus
aggttacggcctgaagatagcttca

SEQ ID NO: 205273 - DNA, 25 bp, Mus musculus
aggttacgtcatagtcatcacacac

SEQ ID NO: 205274 - DNA, 25 bp, Mus musculus
aggttacgtcattgtcatcacacac

SEQ ID NO: 205275 - DNA, 25 bp, Mus musculus
aggttactacctagagtcagcagta

SEQ ID NO: 205276 - DNA, 25 bp, Mus musculus
aggttactaccttgagtcagcagta

SEQ ID NO: 205277 - DNA, 25 bp, Mus musculus
aggttactcaatatgtagttcccat

SEQ ID NO: 205278 - DNA, 25 bp, Mus musculus
aggttactcaatttgtagttcccat

SEQ ID NO: 205279 - DNA, 25 bp, Mus musculus
aggttactccttagtgtcattttga

SEQ ID NO: 205280 - DNA, 25 bp, Mus musculus
aggttactcctttgtgtcattttga

SEQ ID NO: 205281 - DNA, 25 bp, Mus musculus
aggttactcttcagctgctggtttc

SEQ ID NO: 205282 - DNA, 25 bp, Mus musculus
aggttactcttctgctgctggtttc

SEQ ID NO: 205283 - DNA, 25 bp, Mus musculus
aggttactgctacattccaattcaa

SEQ ID NO: 205284 - DNA, 25 bp, Mus musculus
aggttactgctagattccaattcaa

SEQ ID NO: 205285 - DNA, 25 bp, Mus musculus
aggttacttagcacatggtgacagt

SEQ ID NO: 205286 - DNA, 25 bp, Mus musculus
aggttacttagctcatggtgacagt

SEQ ID NO: 205287 - DNA, 25 bp, Mus musculus
aggttacttcaaaggccacgtgccg

SEQ ID NO: 205288 - DNA, 25 bp, Mus musculus
aggttacttcaatggccacgtgccg

SEQ ID NO: 205289 - DNA, 25 bp, Mus musculus
aggttagaagctatccatcagtaaa

SEQ ID NO: 205290 - DNA, 25 bp, Mus musculus
aggttagaagctttccatcagtaaa

SEQ ID NO: 205291 - DNA, 25 bp, Mus musculus
aggttagagactctttgcatttcac

SEQ ID NO: 205292 - DNA, 25 bp, Mus musculus
aggttagagactgtttgcatttcac

SEQ ID NO: 205293 - DNA, 25 bp, Mus musculus
aggttagagagtaagacttcagaat

SEQ ID NO: 205294 - DNA, 25 bp, Mus musculus
aggttagagagttagacttcagaat

SEQ ID NO: 205295 - DNA, 25 bp, Mus musculus
aggttagagcacagttttcctggat

SEQ ID NO: 205296 - DNA, 25 bp, Mus musculus
aggttagagcactgttttcctggat

SEQ ID NO: 205297 - DNA, 25 bp, Mus musculus
aggttagatcctagcacagtcatag

SEQ ID NO: 205298 - DNA, 25 bp, Mus musculus
aggttagatccttgcacagtcatag

SEQ ID NO: 205299 - DNA, 25 bp, Mus musculus
aggttagatggacctgagcccgtcc

SEQ ID NO: 205300 - DNA, 25 bp, Mus musculus
aggttagatggagctgagcccgtcc

SEQ ID NO: 205301 - DNA, 25 bp, Mus musculus
aggttagatggcatccagtcctcca

SEQ ID NO: 205302 - DNA, 25 bp, Mus musculus
aggttagatggcttccagtcctcca

SEQ ID NO: 205303 - DNA, 25 bp, Mus musculus
aggttagattctccccaggttagct

SEQ ID NO: 205304 - DNA, 25 bp, Mus musculus
aggttagattctgcccaggttagct

SEQ ID NO: 205305 - DNA, 25 bp, Mus musculus
aggttagattttctgggatcccctg

SEQ ID NO: 205306 - DNA, 25 bp, Mus musculus
aggttagattttgtgggatcccctg

SEQ ID NO: 205307 - DNA, 25 bp, Mus musculus
aggttagcagcgcatcccaagagga

SEQ ID NO: 205308 - DNA, 25 bp, Mus musculus
aggttagcagcggatcccaagagga

SEQ ID NO: 205309 - DNA, 25 bp, Mus musculus
aggttagcccaacgctggctcatat

SEQ ID NO: 205310 - DNA, 25 bp, Mus musculus
aggttagcccaaggctggctcatat

SEQ ID NO: 205311 - DNA, 25 bp, Mus musculus
aggttagcccagatgctgttgctta

SEQ ID NO: 205312 - DNA, 25 bp, Mus musculus
aggttagcccagttgctgttgctta

SEQ ID NO: 205313 - DNA, 25 bp, Mus musculus
aggttagccccacagcggccaggac

SEQ ID NO: 205314 - DNA, 25 bp, Mus musculus
aggttagccccagagcggccaggac

SEQ ID NO: 205315 - DNA, 25 bp, Mus musculus
aggttagcctaactcctgctcatga

SEQ ID NO: 205316 - DNA, 25 bp, Mus musculus
aggttagcctaagtcctgctcatga

SEQ ID NO: 205317 - DNA, 25 bp, Mus musculus
aggttagcgcttagctggctttgga

SEQ ID NO: 205318 - DNA, 25 bp, Mus musculus
aggttagcgctttgctggctttgga

SEQ ID NO: 205319 - DNA, 25 bp, Mus musculus
aggttaggcctcaaagcaggtgtca

SEQ ID NO: 205320 - DNA, 25 bp, Mus musculus
aggttaggcctctaagcaggtgtca

SEQ ID NO: 205321 - DNA, 25 bp, Mus musculus
aggttaggccttctgcaagctgcct

SEQ ID NO: 205322 - DNA, 25 bp, Mus musculus
aggttaggccttgtgcaagctgcct

SEQ ID NO: 205323 - DNA, 25 bp, Mus musculus
aggttaggctcccagtaccatcaaa

SEQ ID NO: 205324 - DNA, 25 bp, Mus musculus
aggttaggctccgagtaccatcaaa

SEQ ID NO: 205325 - DNA, 25 bp, Mus musculus
aggttagggttgctcatagtctctc

SEQ ID NO: 205326 - DNA, 25 bp, Mus musculus
aggttagggttggtcatagtctctc

SEQ ID NO: 205327 - DNA, 25 bp, Mus musculus
aggttagtcaaaaactctactcttg

SEQ ID NO: 205328 - DNA, 25 bp, Mus musculus
aggttagtcaaatactctactcttg

SEQ ID NO: 205329 - DNA, 25 bp, Mus musculus
aggttagtcaagatagctgaggcag

SEQ ID NO: 205330 - DNA, 25 bp, Mus musculus
aggttagtcaagttagctgaggcag

SEQ ID NO: 205331 - DNA, 25 bp, Mus musculus
aggttagtcatgcatgttaggtttt

SEQ ID NO: 205332 - DNA, 25 bp, Mus musculus
aggttagtcatggatgttaggtttt

SEQ ID NO: 205333 - DNA, 25 bp, Mus musculus
aggttagtccacatgccctctcatc

SEQ ID NO: 205334 - DNA, 25 bp, Mus musculus
aggttagtccacttgccctctcatc

SEQ ID NO: 205335 - DNA, 25 bp, Mus musculus
aggttagtctgcattttgtgtctga

SEQ ID NO: 205336 - DNA, 25 bp, Mus musculus
aggttagtctgctttttgtgtctga

SEQ ID NO: 205337 - DNA, 25 bp, Mus musculus
aggttagtgagcacgttccctgttc

SEQ ID NO: 205338 - DNA, 25 bp, Mus musculus
aggttagtgagctcgttccctgttc

SEQ ID NO: 205339 - DNA, 25 bp, Mus musculus
aggttagtggcaaacgccgttcatc

SEQ ID NO: 205340 - DNA, 25 bp, Mus musculus
aggttagtggcatacgccgttcatc

SEQ ID NO: 205341 - DNA, 25 bp, Mus musculus
aggttagttatcagttgcttgcaat

SEQ ID NO: 205342 - DNA, 25 bp, Mus musculus
aggttagttatctgttgcttgcaat

SEQ ID NO: 205343 - DNA, 25 bp, Mus musculus
aggttagttctcatttctttgtgcc

SEQ ID NO: 205344 - DNA, 25 bp, Mus musculus
aggttagttctcttttctttgtgcc

SEQ ID NO: 205345 - DNA, 25 bp, Mus musculus
aggttatacatcctaatccctcgag

SEQ ID NO: 205346 - DNA, 25 bp, Mus musculus
aggttatacatcgtaatccctcgag

SEQ ID NO: 205347 - DNA, 25 bp, Mus musculus
aggttataccccacactgtgataag

SEQ ID NO: 205348 - DNA, 25 bp, Mus musculus
aggttatacccctcactgtgataag

SEQ ID NO: 205349 - DNA, 25 bp, Mus musculus
aggttataggagaccgccagccttc

SEQ ID NO: 205350 - DNA, 25 bp, Mus musculus
aggttataggagtccgccagccttc

SEQ ID NO: 205351 - DNA, 25 bp, Mus musculus
aggttatagtgccttcgacgtctcg

SEQ ID NO: 205352 - DNA, 25 bp, Mus musculus
aggttatagtgcgttcgacgtctcg

SEQ ID NO: 205353 - DNA, 25 bp, Mus musculus
aggttatatggaagcctactactat

SEQ ID NO: 205354 - DNA, 25 bp, Mus musculus
aggttatatggatgcctactactat

SEQ ID NO: 205355 - DNA, 25 bp, Mus musculus
aggttatatgtacgcaagactctgc

SEQ ID NO: 205356 - DNA, 25 bp, Mus musculus
aggttatatgtaggcaagactctgc

SEQ ID NO: 205357 - DNA, 25 bp, Mus musculus
aggttatcatgccacactcattctg

SEQ ID NO: 205358 - DNA, 25 bp, Mus musculus
aggttatcatgcgacactcattctg

SEQ ID NO: 205359 - DNA, 25 bp, Mus musculus
aggttatccacaaccctgaagctgg

SEQ ID NO: 205360 - DNA, 25 bp, Mus musculus
aggttatccacatccctgaagctgg

SEQ ID NO: 205361 - DNA, 25 bp, Mus musculus
aggttatcccaactaccagcagtac

SEQ ID NO: 205362 - DNA, 25 bp, Mus musculus
aggttatcccaagtaccagcagtac

SEQ ID NO: 205363 - DNA, 25 bp, Mus musculus
aggttatcccctagtcgtcatggtt

SEQ ID NO: 205364 - DNA, 25 bp, Mus musculus
aggttatccccttgtcgtcatggtt

SEQ ID NO: 205365 - DNA, 25 bp, Mus musculus
aggttatcctaacagctctcaccat

SEQ ID NO: 205366 - DNA, 25 bp, Mus musculus
aggttatcctaagagctctcaccat

SEQ ID NO: 205367 - DNA, 25 bp, Mus musculus
aggttatcctcacactccacacatg

SEQ ID NO: 205368 - DNA, 25 bp, Mus musculus
aggttatcctcacgtccaggctcaa

SEQ ID NO: 205369 - DNA, 25 bp, Mus musculus
aggttatcctcagactccacacatg

SEQ ID NO: 205370 - DNA, 25 bp, Mus musculus
aggttatcctcaggtccaggctcaa

SEQ ID NO: 205371 - DNA, 25 bp, Mus musculus
aggttatccttaacttgccgtgcaa

SEQ ID NO: 205372 - DNA, 25 bp, Mus musculus
aggttatccttatcttgccgtgcaa

SEQ ID NO: 205373 - DNA, 25 bp, Mus musculus
aggttatctattctcacttcacttg

SEQ ID NO: 205374 - DNA, 25 bp, Mus musculus
aggttatctattgtcacttcacttg

SEQ ID NO: 205375 - DNA, 25 bp, Mus musculus
aggttatctgacctcttctgggcag

SEQ ID NO: 205376 - DNA, 25 bp, Mus musculus
aggttatctgacgtcttctgggcag

SEQ ID NO: 205377 - DNA, 25 bp, Mus musculus
aggttatctgttacagaggcacctt

SEQ ID NO: 205378 - DNA, 25 bp, Mus musculus
aggttatctgtttcagaggcacctt

SEQ ID NO: 205379 - DNA, 25 bp, Mus musculus
aggttatgggaactaaggtctgatc

SEQ ID NO: 205380 - DNA, 25 bp, Mus musculus
aggttatgggaagtaaggtctgatc

SEQ ID NO: 205381 - DNA, 25 bp, Mus musculus
aggttattacttagccagtggtggt

SEQ ID NO: 205382 - DNA, 25 bp, Mus musculus
aggttattactttgccagtggtggt

SEQ ID NO: 205383 - DNA, 25 bp, Mus musculus
aggttattgaaaattctgctgcaga

SEQ ID NO: 205384 - DNA, 25 bp, Mus musculus
aggttattgaaatttctgctgcaga

SEQ ID NO: 205385 - DNA, 25 bp, Mus musculus
aggttattgatgagacgatgtgggc

SEQ ID NO: 205386 - DNA, 25 bp, Mus musculus
aggttattgatgtgacgatgtgggc

SEQ ID NO: 205387 - DNA, 25 bp, Mus musculus
aggttattgcttcctacgctgctac

SEQ ID NO: 205388 - DNA, 25 bp, Mus musculus
aggttattgcttgctacgctgctac

SEQ ID NO: 205389 - DNA, 25 bp, Mus musculus
aggttatttcctaagacaaagcaat

SEQ ID NO: 205390 - DNA, 25 bp, Mus musculus
aggttatttccttagacaaagcaat

SEQ ID NO: 205391 - DNA, 25 bp, Mus musculus
aggttatttgctcgctattgtcggc

SEQ ID NO: 205392 - DNA, 25 bp, Mus musculus
aggttatttgctggctattgtcggc

SEQ ID NO: 205393 - DNA, 25 bp, Mus musculus
aggttattttctcgctcactactta

SEQ ID NO: 205394 - DNA, 25 bp, Mus musculus
aggttattttctggctcactactta

SEQ ID NO: 205395 - DNA, 25 bp, Mus musculus
aggttcaaagacagcttctctgtga

SEQ ID NO: 205396 - DNA, 25 bp, Mus musculus
aggttcaaagactgcttctctgtga

SEQ ID NO: 205397 - DNA, 25 bp, Mus musculus
aggttcaatttgaggacatatccca

SEQ ID NO: 205398 - DNA, 25 bp, Mus musculus
aggttcaatttgtggacatatccca

SEQ ID NO: 205399 - DNA, 25 bp, Mus musculus
aggttcacacacatgcgcagctcag

SEQ ID NO: 205400 - DNA, 25 bp, Mus musculus
aggttcacacacttgcgcagctcag

SEQ ID NO: 205401 - DNA, 25 bp, Mus musculus
aggttcacagcaaggtggacctggt

SEQ ID NO: 205402 - DNA, 25 bp, Mus musculus
aggttcacagcatggtggacctggt

SEQ ID NO: 205403 - DNA, 25 bp, Mus musculus
aggttcacatacactgccctgaagg

SEQ ID NO: 205404 - DNA, 25 bp, Mus musculus
aggttcacatactctgccctgaagg

SEQ ID NO: 205405 - DNA, 25 bp, Mus musculus
aggttcacatgtaccgtacacgttc

SEQ ID NO: 205406 - DNA, 25 bp, Mus musculus
aggttcacatgtacctcccacgttc

SEQ ID NO: 205407 - DNA, 25 bp, Mus musculus
aggttcacatgttccgtacacgttc

SEQ ID NO: 205408 - DNA, 25 bp, Mus musculus
aggttcacatgttcctcccacgttc

SEQ ID NO: 205409 - DNA, 25 bp, Mus musculus
aggttcaccaccaaagaagtctcca

SEQ ID NO: 205410 - DNA, 25 bp, Mus musculus
aggttcaccacctaagaagtctcca

SEQ ID NO: 205411 - DNA, 25 bp, Mus musculus
aggttcaccttaacccagaagccat

SEQ ID NO: 205412 - DNA, 25 bp, Mus musculus
aggttcaccttatcccagaagccat

SEQ ID NO: 205413 - DNA, 25 bp, Mus musculus
aggttcactctgaagacaccagcac

SEQ ID NO: 205414 - DNA, 25 bp, Mus musculus
aggttcactctgactggattcctga

SEQ ID NO: 205415 - DNA, 25 bp, Mus musculus
aggttcactctgtagacaccagcac

SEQ ID NO: 205416 - DNA, 25 bp, Mus musculus
aggttcactctgtctggattcctga

SEQ ID NO: 205417 - DNA, 25 bp, Mus musculus
aggttcactgaacagattctgtctc

SEQ ID NO: 205418 - DNA, 25 bp, Mus musculus
aggttcactgaagagattctgtctc

SEQ ID NO: 205419 - DNA, 25 bp, Mus musculus
aggttcactgagcttccagactctt

SEQ ID NO: 205420 - DNA, 25 bp, Mus musculus
aggttcactgaggttccagactctt

SEQ ID NO: 205421 - DNA, 25 bp, Mus musculus
aggttcactgctcatgtccgatcgg

SEQ ID NO: 205422 - DNA, 25 bp, Mus musculus
aggttcactgctgatgtccgatcgg

SEQ ID NO: 205423 - DNA, 25 bp, Mus musculus
aggttcactggccattaggtcactg

SEQ ID NO: 205424 - DNA, 25 bp, Mus musculus
aggttcactggcgattaggtcactg

SEQ ID NO: 205425 - DNA, 25 bp, Mus musculus
aggttcacttgtagtactgggcttc

SEQ ID NO: 205426 - DNA, 25 bp, Mus musculus
aggttcacttgttgtactgggcttc

SEQ ID NO: 205427 - DNA, 25 bp, Mus musculus
aggttcagatccatgcagagttgca

SEQ ID NO: 205428 - DNA, 25 bp, Mus musculus
aggttcagatccttgcagagttgca

SEQ ID NO: 205429 - DNA, 25 bp, Mus musculus
aggttcagcaatcacatccagcaga

SEQ ID NO: 205430 - DNA, 25 bp, Mus musculus
aggttcagcaatgacatccagcaga

SEQ ID NO: 205431 - DNA, 25 bp, Mus musculus
aggttcagccacctcgtgggatatg

SEQ ID NO: 205432 - DNA, 25 bp, Mus musculus
aggttcagccacgtcgtgggatatg

SEQ ID NO: 205433 - DNA, 25 bp, Mus musculus
aggttcagccttctccccagaactg

SEQ ID NO: 205434 - DNA, 25 bp, Mus musculus
aggttcagccttgtccccagaactg

SEQ ID NO: 205435 - DNA, 25 bp, Mus musculus
aggttcagctccatctacacaggca

SEQ ID NO: 205436 - DNA, 25 bp, Mus musculus
aggttcagctcccacgcttgtctgt

SEQ ID NO: 205437 - DNA, 25 bp, Mus musculus
aggttcagctccgacgcttgtctgt

SEQ ID NO: 205438 - DNA, 25 bp, Mus musculus
aggttcagctccttctacacaggca

SEQ ID NO: 205439 - DNA, 25 bp, Mus musculus
aggttcaggctcacacggagctccc

SEQ ID NO: 205440 - DNA, 25 bp, Mus musculus
aggttcaggctctcacggagctccc

SEQ ID NO: 205441 - DNA, 25 bp, Mus musculus
aggttcagggctccaggaccccaga

SEQ ID NO: 205442 - DNA, 25 bp, Mus musculus
aggttcagggctgcaggaccccaga

SEQ ID NO: 205443 - DNA, 25 bp, Mus musculus
aggttcagtcttcggctttggataa

SEQ ID NO: 205444 - DNA, 25 bp, Mus musculus
aggttcagtcttgggctttggataa

SEQ ID NO: 205445 - DNA, 25 bp, Mus musculus
aggttcagtgtgagatccggtctct

SEQ ID NO: 205446 - DNA, 25 bp, Mus musculus
aggttcagtgtgtgatccggtctct

SEQ ID NO: 205447 - DNA, 25 bp, Mus musculus
aggttcagtgttcctagttgccctt

SEQ ID NO: 205448 - DNA, 25 bp, Mus musculus
aggttcagtgttgctagttgccctt

SEQ ID NO: 205449 - DNA, 25 bp, Mus musculus
aggttcatattgcaagccctatctg

SEQ ID NO: 205450 - DNA, 25 bp, Mus musculus
aggttcatattggaagccctatctg

SEQ ID NO: 205451 - DNA, 25 bp, Mus musculus
aggttcatcaccacaatctgtgcca

SEQ ID NO: 205452 - DNA, 25 bp, Mus musculus
aggttcatcacctcaatctgtgcca

SEQ ID NO: 205453 - DNA, 25 bp, Mus musculus
aggttcatcagcctgcacagccggt

SEQ ID NO: 205454 - DNA, 25 bp, Mus musculus
aggttcatcagcgtgcacagccggt

SEQ ID NO: 205455 - DNA, 25 bp, Mus musculus
aggttcatcattcccagtcactaga

SEQ ID NO: 205456 - DNA, 25 bp, Mus musculus
aggttcatcattcggttcagcactc

SEQ ID NO: 205457 - DNA, 25 bp, Mus musculus
aggttcatcattgccagtcactaga

SEQ ID NO: 205458 - DNA, 25 bp, Mus musculus
aggttcatcattgggttcagcactc

SEQ ID NO: 205459 - DNA, 25 bp, Mus musculus
aggttcatcgctattgagacactac

SEQ ID NO: 205460 - DNA, 25 bp, Mus musculus
aggttcatcgcttttgagacactac

SEQ ID NO: 205461 - DNA, 25 bp, Mus musculus
aggttcatcgggacaggctcctgat

SEQ ID NO: 205462 - DNA, 25 bp, Mus musculus
aggttcatcgggtcaggctcctgat

SEQ ID NO: 205463 - DNA, 25 bp, Mus musculus
aggttcatctaactcctagttctct

SEQ ID NO: 205464 - DNA, 25 bp, Mus musculus
aggttcatctaagtcctagttctct

SEQ ID NO: 205465 - DNA, 25 bp, Mus musculus
aggttcatctctatcggtcatttta

SEQ ID NO: 205466 - DNA, 25 bp, Mus musculus
aggttcatctctttcggtcatttta

SEQ ID NO: 205467 - DNA, 25 bp, Mus musculus
aggttcatgaagagaattgctgctt

SEQ ID NO: 205468 - DNA, 25 bp, Mus musculus
aggttcatgaagtgaattgctgctt

SEQ ID NO: 205469 - DNA, 25 bp, Mus musculus
aggttcatggctacttactcgattc

SEQ ID NO: 205470 - DNA, 25 bp, Mus musculus
aggttcatggcttcttactcgattc

SEQ ID NO: 205471 - DNA, 25 bp, Mus musculus
aggttcattaccacgttggaggagg

SEQ ID NO: 205472 - DNA, 25 bp, Mus musculus
aggttcattacctcgttggaggagg

SEQ ID NO: 205473 - DNA, 25 bp, Mus musculus
aggttcattcatcaaaggtcttaga

SEQ ID NO: 205474 - DNA, 25 bp, Mus musculus
aggttcattcatgaaaggtcttaga

SEQ ID NO: 205475 - DNA, 25 bp, Mus musculus
aggttcattcctacatagttgtaca

SEQ ID NO: 205476 - DNA, 25 bp, Mus musculus
aggttcattccttcatagttgtaca

SEQ ID NO: 205477 - DNA, 25 bp, Mus musculus
aggttccaagacctgggatcgattc

SEQ ID NO: 205478 - DNA, 25 bp, Mus musculus
aggttccaagacgtgggatcgattc

SEQ ID NO: 205479 - DNA, 25 bp, Mus musculus
aggttccaaggccactgcaaacatt

SEQ ID NO: 205480 - DNA, 25 bp, Mus musculus
aggttccaaggcgactgcaaacatt

SEQ ID NO: 205481 - DNA, 25 bp, Mus musculus
aggttccaagtcaaagagtttcagc

SEQ ID NO: 205482 - DNA, 25 bp, Mus musculus
aggttccaagtctaagagtttcagc

SEQ ID NO: 205483 - DNA, 25 bp, Mus musculus
aggttccaattgcagtgtcaccaca

SEQ ID NO: 205484 - DNA, 25 bp, Mus musculus
aggttccaattggagtgtcaccaca

SEQ ID NO: 205485 - DNA, 25 bp, Mus musculus
aggttccacaggctccatcacaaag

SEQ ID NO: 205486 - DNA, 25 bp, Mus musculus
aggttccacagggtccatcacaaag

SEQ ID NO: 205487 - DNA, 25 bp, Mus musculus
aggttccactccaagggttcagagg

SEQ ID NO: 205488 - DNA, 25 bp, Mus musculus
aggttccactcctagggttcagagg

SEQ ID NO: 205489 - DNA, 25 bp, Mus musculus
aggttccactgcatttggcttagtt

SEQ ID NO: 205490 - DNA, 25 bp, Mus musculus
aggttccactgcttttggcttagtt

SEQ ID NO: 205491 - DNA, 25 bp, Mus musculus
aggttccactggagacattgtgctg

SEQ ID NO: 205492 - DNA, 25 bp, Mus musculus
aggttccactggatattaccaccac

SEQ ID NO: 205493 - DNA, 25 bp, Mus musculus
aggttccactggtgacattgtgctg

SEQ ID NO: 205494 - DNA, 25 bp, Mus musculus
aggttccactggttattaccaccac

SEQ ID NO: 205495 - DNA, 25 bp, Mus musculus
aggttccacttcctcctaatggaca

SEQ ID NO: 205496 - DNA, 25 bp, Mus musculus
aggttccacttcgtcctaatggaca

SEQ ID NO: 205497 - DNA, 25 bp, Mus musculus
aggttccagacacgcatggctatac

SEQ ID NO: 205498 - DNA, 25 bp, Mus musculus
aggttccagacaggcatggctatac

SEQ ID NO: 205499 - DNA, 25 bp, Mus musculus
aggttccagatcacactggccagac

SEQ ID NO: 205500 - DNA, 25 bp, Mus musculus
aggttccagatctcactggccagac

SEQ ID NO: 205501 - DNA, 25 bp, Mus musculus
aggttccagatgatctagctgtggc

SEQ ID NO: 205502 - DNA, 25 bp, Mus musculus
aggttccagatgttctagctgtggc

SEQ ID NO: 205503 - DNA, 25 bp, Mus musculus
aggttccaggaacactgccattgct

SEQ ID NO: 205504 - DNA, 25 bp, Mus musculus
aggttccaggaagactgccattgct

SEQ ID NO: 205505 - DNA, 25 bp, Mus musculus
aggttccagggacacactctacctg

SEQ ID NO: 205506 - DNA, 25 bp, Mus musculus
aggttccagggagacactctacctg

SEQ ID NO: 205507 - DNA, 25 bp, Mus musculus
aggttccatagcagacattctgagg

SEQ ID NO: 205508 - DNA, 25 bp, Mus musculus
aggttccatagctgacattctgagg

SEQ ID NO: 205509 - DNA, 25 bp, Mus musculus
aggttccatcttaccaaatgtggtt

SEQ ID NO: 205510 - DNA, 25 bp, Mus musculus
aggttccatctttccaaatgtggtt

SEQ ID NO: 205511 - DNA, 25 bp, Mus musculus
aggttccatgcactttggacctctc

SEQ ID NO: 205512 - DNA, 25 bp, Mus musculus
aggttccatgcagtttggacctctc

SEQ ID NO: 205513 - DNA, 25 bp, Mus musculus
aggttccatttcacctcagatggca

SEQ ID NO: 205514 - DNA, 25 bp, Mus musculus
aggttccatttcatctttattcttg

SEQ ID NO: 205515 - DNA, 25 bp, Mus musculus
aggttccatttctcctcagatggca

SEQ ID NO: 205516 - DNA, 25 bp, Mus musculus
aggttccatttcttctttattcttg

SEQ ID NO: 205517 - DNA, 25 bp, Mus musculus
aggttcccaaccaatcaggcaaaag

SEQ ID NO: 205518 - DNA, 25 bp, Mus musculus
aggttcccaacctatcaggcaaaag

SEQ ID NO: 205519 - DNA, 25 bp, Mus musculus
aggttcccagaaaggacgtgcccat

SEQ ID NO: 205520 - DNA, 25 bp, Mus musculus
aggttcccagaatggacgtgcccat

SEQ ID NO: 205521 - DNA, 25 bp, Mus musculus
aggttcccaggaaacagcttccctt

SEQ ID NO: 205522 - DNA, 25 bp, Mus musculus
aggttcccaggatacagcttccctt

SEQ ID NO: 205523 - DNA, 25 bp, Mus musculus
aggttcccagtacatttccacaatg

SEQ ID NO: 205524 - DNA, 25 bp, Mus musculus
aggttcccagtagatttccacaatg

SEQ ID NO: 205525 - DNA, 25 bp, Mus musculus
aggttcccattgctttatacatttt

SEQ ID NO: 205526 - DNA, 25 bp, Mus musculus
aggttcccattggtttatacatttt

SEQ ID NO: 205527 - DNA, 25 bp, Mus musculus
aggttccccagaccccaagtgtgac

SEQ ID NO: 205528 - DNA, 25 bp, Mus musculus
aggttccccagagcccaagtgtgac

SEQ ID NO: 205529 - DNA, 25 bp, Mus musculus
aggttccccatcagagagatgctgt

SEQ ID NO: 205530 - DNA, 25 bp, Mus musculus
aggttccccatctgagagatgctgt

SEQ ID NO: 205531 - DNA, 25 bp, Mus musculus
aggttccccatgcagcctcaagaga

SEQ ID NO: 205532 - DNA, 25 bp, Mus musculus
aggttccccatggagcctcaagaga

SEQ ID NO: 205533 - DNA, 25 bp, Mus musculus
aggttcccgcctctgttgggatcag

SEQ ID NO: 205534 - DNA, 25 bp, Mus musculus
aggttcccgcctgtgttgggatcag

SEQ ID NO: 205535 - DNA, 25 bp, Mus musculus
aggttcccgctgaggaaaggagcac

SEQ ID NO: 205536 - DNA, 25 bp, Mus musculus
aggttcccgctgtggaaaggagcac

SEQ ID NO: 205537 - DNA, 25 bp, Mus musculus
aggttcccggacactatgacagggc

SEQ ID NO: 205538 - DNA, 25 bp, Mus musculus
aggttcccggactctatgacagggc

SEQ ID NO: 205539 - DNA, 25 bp, Mus musculus
aggttccctctacctaggtgtctag

SEQ ID NO: 205540 - DNA, 25 bp, Mus musculus
aggttccctctagctaggtgtctag

SEQ ID NO: 205541 - DNA, 25 bp, Mus musculus
aggttccctggtattcataagctat

SEQ ID NO: 205542 - DNA, 25 bp, Mus musculus
aggttccctggttttcataagctat

SEQ ID NO: 205543 - DNA, 25 bp, Mus musculus
aggttcccttccaagagctcagaag

SEQ ID NO: 205544 - DNA, 25 bp, Mus musculus
aggttcccttcctagagctcagaag

SEQ ID NO: 205545 - DNA, 25 bp, Mus musculus
aggttccgacaaaagctgggtggca

SEQ ID NO: 205546 - DNA, 25 bp, Mus musculus
aggttccgacaatagctgggtggca

SEQ ID NO: 205547 - DNA, 25 bp, Mus musculus
aggttcctacatctatagcctagct

SEQ ID NO: 205548 - DNA, 25 bp, Mus musculus
aggttcctacatgtatagcctagct

SEQ ID NO: 205549 - DNA, 25 bp, Mus musculus
aggttcctccaaaagtatgattttc

SEQ ID NO: 205550 - DNA, 25 bp, Mus musculus
aggttcctccaatagtatgattttc

SEQ ID NO: 205551 - DNA, 25 bp, Mus musculus
aggttcctcctcacagctgatttta

SEQ ID NO: 205552 - DNA, 25 bp, Mus musculus
aggttcctcctctcagctgatttta

SEQ ID NO: 205553 - DNA, 25 bp, Mus musculus
aggttcctctctagcaggagaactg

SEQ ID NO: 205554 - DNA, 25 bp, Mus musculus
aggttcctctctctgcataagcatt

SEQ ID NO: 205555 - DNA, 25 bp, Mus musculus
aggttcctctctgtgcataagcatt

SEQ ID NO: 205556 - DNA, 25 bp, Mus musculus
aggttcctctcttgcaggagaactg

SEQ ID NO: 205557 - DNA, 25 bp, Mus musculus
aggttcctgatgatgatactttttg

SEQ ID NO: 205558 - DNA, 25 bp, Mus musculus
aggttcctgatgttgatactttttg

SEQ ID NO: 205559 - DNA, 25 bp, Mus musculus
aggttcctgcacacattcgatggga

SEQ ID NO: 205560 - DNA, 25 bp, Mus musculus
aggttcctgcacagcttaacttcct

SEQ ID NO: 205561 - DNA, 25 bp, Mus musculus
aggttcctgcactcattcgatggga

SEQ ID NO: 205562 - DNA, 25 bp, Mus musculus
aggttcctgcactgcttaacttcct

SEQ ID NO: 205563 - DNA, 25 bp, Mus musculus
aggttcctgcagagtcggaatctaa

SEQ ID NO: 205564 - DNA, 25 bp, Mus musculus
aggttcctgcagctgggccatatga

SEQ ID NO: 205565 - DNA, 25 bp, Mus musculus
aggttcctgcaggtgggccatatga

SEQ ID NO: 205566 - DNA, 25 bp, Mus musculus
aggttcctgcagtgtcggaatctaa

SEQ ID NO: 205567 - DNA, 25 bp, Mus musculus
aggttcctgcctctaaagaaacaag

SEQ ID NO: 205568 - DNA, 25 bp, Mus musculus
aggttcctgcctgtaaagaaacaag

SEQ ID NO: 205569 - DNA, 25 bp, Mus musculus
aggttcctggaccatgagcgcatgc

SEQ ID NO: 205570 - DNA, 25 bp, Mus musculus
aggttcctggacgatgagcgcatgc

SEQ ID NO: 205571 - DNA, 25 bp, Mus musculus
aggttcctgggtccagtacaccaga

SEQ ID NO: 205572 - DNA, 25 bp, Mus musculus
aggttcctgggtctggatgcattac

SEQ ID NO: 205573 - DNA, 25 bp, Mus musculus
aggttcctgggtgcagtacaccaga

SEQ ID NO: 205574 - DNA, 25 bp, Mus musculus
aggttcctgggtgtggatgcattac

SEQ ID NO: 205575 - DNA, 25 bp, Mus musculus
aggttcctgtctccagagcatgaat

SEQ ID NO: 205576 - DNA, 25 bp, Mus musculus
aggttcctgtctgcagagcatgaat

SEQ ID NO: 205577 - DNA, 25 bp, Mus musculus
aggttcctgtttaggtttccagctg

SEQ ID NO: 205578 - DNA, 25 bp, Mus musculus
aggttcctgttttggtttccagctg

SEQ ID NO: 205579 - DNA, 25 bp, Mus musculus
aggttccttactccatgtcacacag

SEQ ID NO: 205580 - DNA, 25 bp, Mus musculus
aggttccttactgcatgtcacacag

SEQ ID NO: 205581 - DNA, 25 bp, Mus musculus
aggttccttcaacacctgttctgaa

SEQ ID NO: 205582 - DNA, 25 bp, Mus musculus
aggttccttcaagacctgttctgaa

SEQ ID NO: 205583 - DNA, 25 bp, Mus musculus
aggttccttcacatgcactctttaa

SEQ ID NO: 205584 - DNA, 25 bp, Mus musculus
aggttccttcacttgcactctttaa

SEQ ID NO: 205585 - DNA, 25 bp, Mus musculus
aggttccttcgtagtgttgatttcg

SEQ ID NO: 205586 - DNA, 25 bp, Mus musculus
aggttccttcgttgtgttgatttcg

SEQ ID NO: 205587 - DNA, 25 bp, Mus musculus
aggttccttctgattgaacactgtc

SEQ ID NO: 205588 - DNA, 25 bp, Mus musculus
aggttccttctgtttgaacactgtc

SEQ ID NO: 205589 - DNA, 25 bp, Mus musculus
aggttccttcttaccgagtgactct

SEQ ID NO: 205590 - DNA, 25 bp, Mus musculus
aggttccttctttccgagtgactct

SEQ ID NO: 205591 - DNA, 25 bp, Mus musculus
aggttccttggcagtttggactcag

SEQ ID NO: 205592 - DNA, 25 bp, Mus musculus
aggttccttggctgtttggactcag

SEQ ID NO: 205593 - DNA, 25 bp, Mus musculus
aggttcctttaaacagctttcctca

SEQ ID NO: 205594 - DNA, 25 bp, Mus musculus
aggttcctttaatcagctttcctca

SEQ ID NO: 205595 - DNA, 25 bp, Mus musculus
aggttcctttatatatgccgtcaca

SEQ ID NO: 205596 - DNA, 25 bp, Mus musculus
aggttcctttatttatgccgtcaca

SEQ ID NO: 205597 - DNA, 25 bp, Mus musculus
aggttcctttctagccgactggagg

SEQ ID NO: 205598 - DNA, 25 bp, Mus musculus
aggttcctttcttgccgactggagg

SEQ ID NO: 205599 - DNA, 25 bp, Mus musculus
aggttcctttggattcatccacaag

SEQ ID NO: 205600 - DNA, 25 bp, Mus musculus
aggttcctttggtttcatccacaag

SEQ ID NO: 205601 - DNA, 25 bp, Mus musculus
aggttcgaaaccctgacttcaggag

SEQ ID NO: 205602 - DNA, 25 bp, Mus musculus
aggttcgaaaccgtgacttcaggag

SEQ ID NO: 205603 - DNA, 25 bp, Mus musculus
aggttcgcgattatccaccacctgc

SEQ ID NO: 205604 - DNA, 25 bp, Mus musculus
aggttcgcgattttccaccacctgc

SEQ ID NO: 205605 - DNA, 25 bp, Mus musculus
aggttcgctcttagggctgactttc

SEQ ID NO: 205606 - DNA, 25 bp, Mus musculus
aggttcgctctttgggctgactttc

SEQ ID NO: 205607 - DNA, 25 bp, Mus musculus
aggttcgcttgtaggaatttcagtc

SEQ ID NO: 205608 - DNA, 25 bp, Mus musculus
aggttcgcttgttggaatttcagtc

SEQ ID NO: 205609 - DNA, 25 bp, Mus musculus
aggttcggagccacagacacaacaa

SEQ ID NO: 205610 - DNA, 25 bp, Mus musculus
aggttcggagcctcagacacaacaa

SEQ ID NO: 205611 - DNA, 25 bp, Mus musculus
aggttcgggaccagagtctgcagct

SEQ ID NO: 205612 - DNA, 25 bp, Mus musculus
aggttcgggacctgagtctgcagct

SEQ ID NO: 205613 - DNA, 25 bp, Mus musculus
aggttcgtcagactgcctgtagctg

SEQ ID NO: 205614 - DNA, 25 bp, Mus musculus
aggttcgtcagagtgcctgtagctg

SEQ ID NO: 205615 - DNA, 25 bp, Mus musculus
aggttcgtccagagtccagcgtgcg

SEQ ID NO: 205616 - DNA, 25 bp, Mus musculus
aggttcgtccagtgtccagcgtgcg

SEQ ID NO: 205617 - DNA, 25 bp, Mus musculus
aggttcgtcgcgctgaacactgaat

SEQ ID NO: 205618 - DNA, 25 bp, Mus musculus
aggttcgtcgcggtgaacactgaat

SEQ ID NO: 205619 - DNA, 25 bp, Mus musculus
aggttcgttccaccagcttcgaagg

SEQ ID NO: 205620 - DNA, 25 bp, Mus musculus
aggttcgttccagcagcttcgaagg

SEQ ID NO: 205621 - DNA, 25 bp, Mus musculus
aggttcgttgcacagcttcaggccc

SEQ ID NO: 205622 - DNA, 25 bp, Mus musculus
aggttcgttgcagagcttcaggccc

SEQ ID NO: 205623 - DNA, 25 bp, Mus musculus
aggttctacaccaagtactatatgt

SEQ ID NO: 205624 - DNA, 25 bp, Mus musculus
aggttctacacctagtactatatgt

SEQ ID NO: 205625 - DNA, 25 bp, Mus musculus
aggttctacgctagtcccttgtgct

SEQ ID NO: 205626 - DNA, 25 bp, Mus musculus
aggttctacgcttgtcccttgtgct

SEQ ID NO: 205627 - DNA, 25 bp, Mus musculus
aggttctactataatgaggctctat

SEQ ID NO: 205628 - DNA, 25 bp, Mus musculus
aggttctactattatgaggctctat

SEQ ID NO: 205629 - DNA, 25 bp, Mus musculus
aggttctactccacctgaatgagag

SEQ ID NO: 205630 - DNA, 25 bp, Mus musculus
aggttctactcctcctgaatgagag

SEQ ID NO: 205631 - DNA, 25 bp, Mus musculus
aggttctaggtacaacatccccaga

SEQ ID NO: 205632 - DNA, 25 bp, Mus musculus
aggttctaggtagaacatccccaga

SEQ ID NO: 205633 - DNA, 25 bp, Mus musculus
aggttctatagacagccctgtccac

SEQ ID NO: 205634 - DNA, 25 bp, Mus musculus
aggttctatagagagccctgtccac

SEQ ID NO: 205635 - DNA, 25 bp, Mus musculus
aggttctattaaaccctagcaccag

SEQ ID NO: 205636 - DNA, 25 bp, Mus musculus
aggttctattaatccctagcaccag

SEQ ID NO: 205637 - DNA, 25 bp, Mus musculus
aggttctcagcgcatatatagcaga

SEQ ID NO: 205638 - DNA, 25 bp, Mus musculus
aggttctcagcggatatatagcaga

SEQ ID NO: 205639 - DNA, 25 bp, Mus musculus
aggttctcaggaacccttccacagt

SEQ ID NO: 205640 - DNA, 25 bp, Mus musculus
aggttctcaggatcccttccacagt

SEQ ID NO: 205641 - DNA, 25 bp, Mus musculus
aggttctccatgaagcctaggcaag

SEQ ID NO: 205642 - DNA, 25 bp, Mus musculus
aggttctccatgctgatagacaacg

SEQ ID NO: 205643 - DNA, 25 bp, Mus musculus
aggttctccatggtgatagacaacg

SEQ ID NO: 205644 - DNA, 25 bp, Mus musculus
aggttctccatgtagcctaggcaag

SEQ ID NO: 205645 - DNA, 25 bp, Mus musculus
aggttctccccaatcaccattgacg

SEQ ID NO: 205646 - DNA, 25 bp, Mus musculus
aggttctccccattcaccattgacg

SEQ ID NO: 205647 - DNA, 25 bp, Mus musculus
aggttctcctaacggtcacaggctt

SEQ ID NO: 205648 - DNA, 25 bp, Mus musculus
aggttctcctaagggtcacaggctt

SEQ ID NO: 205649 - DNA, 25 bp, Mus musculus
aggttctctcagacggcggaagacc

SEQ ID NO: 205650 - DNA, 25 bp, Mus musculus
aggttctctcagtcggcggaagacc

SEQ ID NO: 205651 - DNA, 25 bp, Mus musculus
aggttctctcctctgtccatagaga

SEQ ID NO: 205652 - DNA, 25 bp, Mus musculus
aggttctctcctgtgtccatagaga

SEQ ID NO: 205653 - DNA, 25 bp, Mus musculus
aggttctcttctaagtgcctgcgac

SEQ ID NO: 205654 - DNA, 25 bp, Mus musculus
aggttctcttcttagtgcctgcgac

SEQ ID NO: 205655 - DNA, 25 bp, Mus musculus
aggttctcttggcacatcgtatcat

SEQ ID NO: 205656 - DNA, 25 bp, Mus musculus
aggttctcttgggacatcgtatcat

SEQ ID NO: 205657 - DNA, 25 bp, Mus musculus
aggttctgacctcgaggcctcgtgc

SEQ ID NO: 205658 - DNA, 25 bp, Mus musculus
aggttctgacctcgtgtgtctgaca

SEQ ID NO: 205659 - DNA, 25 bp, Mus musculus
aggttctgacctggaggcctcgtgc

SEQ ID NO: 205660 - DNA, 25 bp, Mus musculus
aggttctgacctggtgtgtctgaca

SEQ ID NO: 205661 - DNA, 25 bp, Mus musculus
aggttctgactcctcagtgcataag

SEQ ID NO: 205662 - DNA, 25 bp, Mus musculus
aggttctgactcgtcagtgcataag

SEQ ID NO: 205663 - DNA, 25 bp, Mus musculus
aggttctgacttcaggatggtccct

SEQ ID NO: 205664 - DNA, 25 bp, Mus musculus
aggttctgacttgaggatggtccct

SEQ ID NO: 205665 - DNA, 25 bp, Mus musculus
aggttctgagcgaccgtcctatagg

SEQ ID NO: 205666 - DNA, 25 bp, Mus musculus
aggttctgagcgtccgtcctatagg

SEQ ID NO: 205667 - DNA, 25 bp, Mus musculus
aggttctgattgatcctgaggatgt

SEQ ID NO: 205668 - DNA, 25 bp, Mus musculus
aggttctgattgttcctgaggatgt

SEQ ID NO: 205669 - DNA, 25 bp, Mus musculus
aggttctgcaccagagtctctgaca

SEQ ID NO: 205670 - DNA, 25 bp, Mus musculus
aggttctgcacctgagtctctgaca

SEQ ID NO: 205671 - DNA, 25 bp, Mus musculus
aggttctgccacaggggcctataat

SEQ ID NO: 205672 - DNA, 25 bp, Mus musculus
aggttctgccactggggcctataat

SEQ ID NO: 205673 - DNA, 25 bp, Mus musculus
aggttctgcctaattagccgctgac

SEQ ID NO: 205674 - DNA, 25 bp, Mus musculus
aggttctgcctatttagccgctgac

SEQ ID NO: 205675 - DNA, 25 bp, Mus musculus
aggttctgcctgagaaacccaagct

SEQ ID NO: 205676 - DNA, 25 bp, Mus musculus
aggttctgcctgtgaaacccaagct

SEQ ID NO: 205677 - DNA, 25 bp, Mus musculus
aggttctgctgactgctgagacaca

SEQ ID NO: 205678 - DNA, 25 bp, Mus musculus
aggttctgctgagtgctgagacaca

SEQ ID NO: 205679 - DNA, 25 bp, Mus musculus
aggttctgctgcactgggatgccgc

SEQ ID NO: 205680 - DNA, 25 bp, Mus musculus
aggttctgctgcatccacagataga

SEQ ID NO: 205681 - DNA, 25 bp, Mus musculus
aggttctgctgctctgggatgccgc

SEQ ID NO: 205682 - DNA, 25 bp, Mus musculus
aggttctgctgcttccacagataga

SEQ ID NO: 205683 - DNA, 25 bp, Mus musculus
aggttctggaggagaccctgagccc

SEQ ID NO: 205684 - DNA, 25 bp, Mus musculus
aggttctggaggtgaccctgagccc

SEQ ID NO: 205685 - DNA, 25 bp, Mus musculus
aggttctggcacacgggctaggttc

SEQ ID NO: 205686 - DNA, 25 bp, Mus musculus
aggttctggcactcgggctaggttc

SEQ ID NO: 205687 - DNA, 25 bp, Mus musculus
aggttctggccaacggtctagacaa

SEQ ID NO: 205688 - DNA, 25 bp, Mus musculus
aggttctggccatcggtctagacaa

SEQ ID NO: 205689 - DNA, 25 bp, Mus musculus
aggttctgggttctagtgtctgact

SEQ ID NO: 205690 - DNA, 25 bp, Mus musculus
aggttctgggttgtagtgtctgact

SEQ ID NO: 205691 - DNA, 25 bp, Mus musculus
aggttctggtaacagcactagcccc

SEQ ID NO: 205692 - DNA, 25 bp, Mus musculus
aggttctggtaagagcactagcccc

SEQ ID NO: 205693 - DNA, 25 bp, Mus musculus
aggttctggtttcttcaggactgaa

SEQ ID NO: 205694 - DNA, 25 bp, Mus musculus
aggttctggtttgttcaggactgaa

SEQ ID NO: 205695 - DNA, 25 bp, Mus musculus
aggttctgtatacgtcaggctgccc

SEQ ID NO: 205696 - DNA, 25 bp, Mus musculus
aggttctgtataggtcaggctgccc

SEQ ID NO: 205697 - DNA, 25 bp, Mus musculus
aggttctgtccaccaaacagcacag

SEQ ID NO: 205698 - DNA, 25 bp, Mus musculus
aggttctgtccagcaaacagcacag

SEQ ID NO: 205699 - DNA, 25 bp, Mus musculus
aggttctgtgagatgcctccagctc

SEQ ID NO: 205700 - DNA, 25 bp, Mus musculus
aggttctgtgagcagagagccctat

SEQ ID NO: 205701 - DNA, 25 bp, Mus musculus
aggttctgtgaggagagagccctat

SEQ ID NO: 205702 - DNA, 25 bp, Mus musculus
aggttctgtgagttgcctccagctc

SEQ ID NO: 205703 - DNA, 25 bp, Mus musculus
aggttctgtggccaacacgctggct

SEQ ID NO: 205704 - DNA, 25 bp, Mus musculus
aggttctgtggcgaacacgctggct

SEQ ID NO: 205705 - DNA, 25 bp, Mus musculus
aggttctgttacagactctttgtgt

SEQ ID NO: 205706 - DNA, 25 bp, Mus musculus
aggttctgttactgactctttgtgt

SEQ ID NO: 205707 - DNA, 25 bp, Mus musculus
aggttctgtttgcttgctgatgctg

SEQ ID NO: 205708 - DNA, 25 bp, Mus musculus
aggttctgtttggttgctgatgctg

SEQ ID NO: 205709 - DNA, 25 bp, Mus musculus
aggttcttactcatgggcactgcag

SEQ ID NO: 205710 - DNA, 25 bp, Mus musculus
aggttcttactcttgggcactgcag

SEQ ID NO: 205711 - DNA, 25 bp, Mus musculus
aggttcttactgactgctttctcca

SEQ ID NO: 205712 - DNA, 25 bp, Mus musculus
aggttcttactgtctgctttctcca

SEQ ID NO: 205713 - DNA, 25 bp, Mus musculus
aggttcttatctcacctccacactt

SEQ ID NO: 205714 - DNA, 25 bp, Mus musculus
aggttcttatctgacctccacactt

SEQ ID NO: 205715 - DNA, 25 bp, Mus musculus
aggttcttcaataacttcatgtgta

SEQ ID NO: 205716 - DNA, 25 bp, Mus musculus
aggttcttcaattacttcatgtgta

SEQ ID NO: 205717 - DNA, 25 bp, Mus musculus
aggttcttcacacaaagctcctttc

SEQ ID NO: 205718 - DNA, 25 bp, Mus musculus
aggttcttcacagaaagctcctttc

SEQ ID NO: 205719 - DNA, 25 bp, Mus musculus
aggttcttctatatgctaaagtaag

SEQ ID NO: 205720 - DNA, 25 bp, Mus musculus
aggttcttctatttgctaaagtaag

SEQ ID NO: 205721 - DNA, 25 bp, Mus musculus
aggttcttgacaccctggtgtatga

SEQ ID NO: 205722 - DNA, 25 bp, Mus musculus
aggttcttgacagcctggtgtatga

SEQ ID NO: 205723 - DNA, 25 bp, Mus musculus
aggttcttgattaggtatcatctca

SEQ ID NO: 205724 - DNA, 25 bp, Mus musculus
aggttcttgatttggtatcatctca

SEQ ID NO: 205725 - DNA, 25 bp, Mus musculus
aggttcttgcttcaaagtctgccat

SEQ ID NO: 205726 - DNA, 25 bp, Mus musculus
aggttcttgcttgaaagtctgccat

SEQ ID NO: 205727 - DNA, 25 bp, Mus musculus
aggttcttggcaaccatcaagattt

SEQ ID NO: 205728 - DNA, 25 bp, Mus musculus
aggttcttggcatccatcaagattt

SEQ ID NO: 205729 - DNA, 25 bp, Mus musculus
aggttcttgtctaaattcctctgcc

SEQ ID NO: 205730 - DNA, 25 bp, Mus musculus
aggttcttgtcttaattcctctgcc

SEQ ID NO: 205731 - DNA, 25 bp, Mus musculus
aggttctttacacaattgcttcaaa

SEQ ID NO: 205732 - DNA, 25 bp, Mus musculus
aggttctttacagaattgcttcaaa

SEQ ID NO: 205733 - DNA, 25 bp, Mus musculus
aggttctttaccatctccttgtggt

SEQ ID NO: 205734 - DNA, 25 bp, Mus musculus
aggttctttaccttctccttgtggt

SEQ ID NO: 205735 - DNA, 25 bp, Mus musculus
aggttcttttccagcatgggaccga

SEQ ID NO: 205736 - DNA, 25 bp, Mus musculus
aggttcttttcctgcatgggaccga

SEQ ID NO: 205737 - DNA, 25 bp, Mus musculus
aggttctttttaaatctgtctgcaa

SEQ ID NO: 205738 - DNA, 25 bp, Mus musculus
aggttctttttatatctgtctgcaa

SEQ ID NO: 205739 - DNA, 25 bp, Mus musculus
aggttgaaactcatgagcccaatgg

SEQ ID NO: 205740 - DNA, 25 bp, Mus musculus
aggttgaaactcttgagcccaatgg

SEQ ID NO: 205741 - DNA, 25 bp, Mus musculus
aggttgaactcaaatcgccaggctt

SEQ ID NO: 205742 - DNA, 25 bp, Mus musculus
aggttgaactcatatcgccaggctt

SEQ ID NO: 205743 - DNA, 25 bp, Mus musculus
aggttgaactctagccatggccagg

SEQ ID NO: 205744 - DNA, 25 bp, Mus musculus
aggttgaactcttgccatggccagg

SEQ ID NO: 205745 - DNA, 25 bp, Mus musculus
aggttgaaggccagccacgccactg

SEQ ID NO: 205746 - DNA, 25 bp, Mus musculus
aggttgaaggcctgccacgccactg

SEQ ID NO: 205747 - DNA, 25 bp, Mus musculus
aggttgaagggtccactccatagca

SEQ ID NO: 205748 - DNA, 25 bp, Mus musculus
aggttgaagggtgcactccatagca

SEQ ID NO: 205749 - DNA, 25 bp, Mus musculus
aggttgaatgttacgactccctcac

SEQ ID NO: 205750 - DNA, 25 bp, Mus musculus
aggttgaatgtttcgactccctcac

SEQ ID NO: 205751 - DNA, 25 bp, Mus musculus
aggttgaccagcaagcaagggctcc

SEQ ID NO: 205752 - DNA, 25 bp, Mus musculus
aggttgaccagctagcaagggctcc

SEQ ID NO: 205753 - DNA, 25 bp, Mus musculus
aggttgacccaactcattgctccag

SEQ ID NO: 205754 - DNA, 25 bp, Mus musculus
aggttgacccaagtcattgctccag

SEQ ID NO: 205755 - DNA, 25 bp, Mus musculus
aggttgacctgtcatctctgtatat

SEQ ID NO: 205756 - DNA, 25 bp, Mus musculus
aggttgacctgtgatctctgtatat

SEQ ID NO: 205757 - DNA, 25 bp, Mus musculus
aggttgacgtctccaggtcacctca

SEQ ID NO: 205758 - DNA, 25 bp, Mus musculus
aggttgacgtctgcaggtcacctca

SEQ ID NO: 205759 - DNA, 25 bp, Mus musculus
aggttgactgccacctcggtctggg

SEQ ID NO: 205760 - DNA, 25 bp, Mus musculus
aggttgactgcctcctcggtctggg

SEQ ID NO: 205761 - DNA, 25 bp, Mus musculus
aggttgagatgtaccttcttgccta

SEQ ID NO: 205762 - DNA, 25 bp, Mus musculus
aggttgagatgttccttcttgccta

SEQ ID NO: 205763 - DNA, 25 bp, Mus musculus
aggttgagcactctaccaggacacc

SEQ ID NO: 205764 - DNA, 25 bp, Mus musculus
aggttgagcactgtaccaggacacc

SEQ ID NO: 205765 - DNA, 25 bp, Mus musculus
aggttgaggaaacctggatttagac

SEQ ID NO: 205766 - DNA, 25 bp, Mus musculus
aggttgaggaaagctggatttagac

SEQ ID NO: 205767 - DNA, 25 bp, Mus musculus
aggttgaggcagataacaccccagc

SEQ ID NO: 205768 - DNA, 25 bp, Mus musculus
aggttgaggcagttaacaccccagc

SEQ ID NO: 205769 - DNA, 25 bp, Mus musculus
aggttgatacctccgggctcagacc

SEQ ID NO: 205770 - DNA, 25 bp, Mus musculus
aggttgatacctgcgggctcagacc

SEQ ID NO: 205771 - DNA, 25 bp, Mus musculus
aggttgatctaaagattgtgtttta

SEQ ID NO: 205772 - DNA, 25 bp, Mus musculus
aggttgatctaatgattgtgtttta

SEQ ID NO: 205773 - DNA, 25 bp, Mus musculus
aggttgatcttcatgtccctactaa

SEQ ID NO: 205774 - DNA, 25 bp, Mus musculus
aggttgatcttcttgtccctactaa

SEQ ID NO: 205775 - DNA, 25 bp, Mus musculus
aggttgatgatcaccttgagctgta

SEQ ID NO: 205776 - DNA, 25 bp, Mus musculus
aggttgatgatctccttgagctgta

SEQ ID NO: 205777 - DNA, 25 bp, Mus musculus
aggttgatgtttaaccagcctcata

SEQ ID NO: 205778 - DNA, 25 bp, Mus musculus
aggttgatgttttaccagcctcata

SEQ ID NO: 205779 - DNA, 25 bp, Mus musculus
aggttgcaaagcagcctagtcctgc

SEQ ID NO: 205780 - DNA, 25 bp, Mus musculus
aggttgcaaagctgcctagtcctgc

SEQ ID NO: 205781 - DNA, 25 bp, Mus musculus
aggttgcaatttagggcctggcttt

SEQ ID NO: 205782 - DNA, 25 bp, Mus musculus
aggttgcaattttgggcctggcttt

SEQ ID NO: 205783 - DNA, 25 bp, Mus musculus
aggttgcacaagagtcgactctgct

SEQ ID NO: 205784 - DNA, 25 bp, Mus musculus
aggttgcacaagtgtcgactctgct

SEQ ID NO: 205785 - DNA, 25 bp, Mus musculus
aggttgcaccatcacaacttcctga

SEQ ID NO: 205786 - DNA, 25 bp, Mus musculus
aggttgcaccatgacaacttcctga

SEQ ID NO: 205787 - DNA, 25 bp, Mus musculus
aggttgccaagtctgctccactggt

SEQ ID NO: 205788 - DNA, 25 bp, Mus musculus
aggttgccaagtgtgctccactggt

SEQ ID NO: 205789 - DNA, 25 bp, Mus musculus
aggttgccacccagtgggacccagg

SEQ ID NO: 205790 - DNA, 25 bp, Mus musculus
aggttgccaccctgtgggacccagg

SEQ ID NO: 205791 - DNA, 25 bp, Mus musculus
aggttgccagtgctgcagctctaca

SEQ ID NO: 205792 - DNA, 25 bp, Mus musculus
aggttgccagtggtgcagctctaca

SEQ ID NO: 205793 - DNA, 25 bp, Mus musculus
aggttgcccaggataattcccagct

SEQ ID NO: 205794 - DNA, 25 bp, Mus musculus
aggttgcccaggttaattcccagct

SEQ ID NO: 205795 - DNA, 25 bp, Mus musculus
aggttgccccttaatgtagcttcct

SEQ ID NO: 205796 - DNA, 25 bp, Mus musculus
aggttgcccctttatgtagcttcct

SEQ ID NO: 205797 - DNA, 25 bp, Mus musculus
aggttgcccgggactgtaacatgac

SEQ ID NO: 205798 - DNA, 25 bp, Mus musculus
aggttgcccgggtctgtaacatgac

SEQ ID NO: 205799 - DNA, 25 bp, Mus musculus
aggttgcctctcctttagacttggg

SEQ ID NO: 205800 - DNA, 25 bp, Mus musculus
aggttgcctctcgtttagacttggg

SEQ ID NO: 205801 - DNA, 25 bp, Mus musculus
aggttgccttacatgacagttggtg

SEQ ID NO: 205802 - DNA, 25 bp, Mus musculus
aggttgccttacttgacagttggtg

SEQ ID NO: 205803 - DNA, 25 bp, Mus musculus
aggttgccttttcttctatgcgatc

SEQ ID NO: 205804 - DNA, 25 bp, Mus musculus
aggttgccttttgttctatgcgatc

SEQ ID NO: 205805 - DNA, 25 bp, Mus musculus
aggttgcgcatcatggccttgtcgc

SEQ ID NO: 205806 - DNA, 25 bp, Mus musculus
aggttgcgcatcttggccttgtcgc

SEQ ID NO: 205807 - DNA, 25 bp, Mus musculus
aggttgcgtcctagatgttccagag

SEQ ID NO: 205808 - DNA, 25 bp, Mus musculus
aggttgcgtccttgatgttccagag

SEQ ID NO: 205809 - DNA, 25 bp, Mus musculus
aggttgctaagaacagctgtcctgt

SEQ ID NO: 205810 - DNA, 25 bp, Mus musculus
aggttgctaagatcagctgtcctgt

SEQ ID NO: 205811 - DNA, 25 bp, Mus musculus
aggttgctactacgcatgtgtcctc

SEQ ID NO: 205812 - DNA, 25 bp, Mus musculus
aggttgctactaggcatgtgtcctc

SEQ ID NO: 205813 - DNA, 25 bp, Mus musculus
aggttgctacttcgtgacatattca

SEQ ID NO: 205814 - DNA, 25 bp, Mus musculus
aggttgctacttggtgacatattca

SEQ ID NO: 205815 - DNA, 25 bp, Mus musculus
aggttgctcattcccactaggagtg

SEQ ID NO: 205816 - DNA, 25 bp, Mus musculus
aggttgctcattgccactaggagtg

SEQ ID NO: 205817 - DNA, 25 bp, Mus musculus
aggttgctccatatggtgtgtcgag

SEQ ID NO: 205818 - DNA, 25 bp, Mus musculus
aggttgctccatttggtgtgtcgag

SEQ ID NO: 205819 - DNA, 25 bp, Mus musculus
aggttgctcccaacatgccccaggg

SEQ ID NO: 205820 - DNA, 25 bp, Mus musculus
aggttgctcccatcatgccccaggg

SEQ ID NO: 205821 - DNA, 25 bp, Mus musculus
aggttgctccccagtcgttgaatac

SEQ ID NO: 205822 - DNA, 25 bp, Mus musculus
aggttgctcccctgtcgttgaatac

SEQ ID NO: 205823 - DNA, 25 bp, Mus musculus
aggttgctctatctggacggtgtct

SEQ ID NO: 205824 - DNA, 25 bp, Mus musculus
aggttgctctatgtggacggtgtct

SEQ ID NO: 205825 - DNA, 25 bp, Mus musculus
aggttgctctcaatccttggaagac

SEQ ID NO: 205826 - DNA, 25 bp, Mus musculus
aggttgctctcattccttggaagac

SEQ ID NO: 205827 - DNA, 25 bp, Mus musculus
aggttgctctggatttcataatgga

SEQ ID NO: 205828 - DNA, 25 bp, Mus musculus
aggttgctctggttttcataatgga

SEQ ID NO: 205829 - DNA, 25 bp, Mus musculus
aggttgctcttcaggacatcgatat

SEQ ID NO: 205830 - DNA, 25 bp, Mus musculus
aggttgctcttctggacatcgatat

SEQ ID NO: 205831 - DNA, 25 bp, Mus musculus
aggttgctgaacctagcccaagggc

SEQ ID NO: 205832 - DNA, 25 bp, Mus musculus
aggttgctgaacgtagcccaagggc

SEQ ID NO: 205833 - DNA, 25 bp, Mus musculus
aggttgctgactcttatgagtcatc

SEQ ID NO: 205834 - DNA, 25 bp, Mus musculus
aggttgctgactgttatgagtcatc

SEQ ID NO: 205835 - DNA, 25 bp, Mus musculus
aggttgctgcccctctttgtcagag

SEQ ID NO: 205836 - DNA, 25 bp, Mus musculus
aggttgctgcccgtctttgtcagag

SEQ ID NO: 205837 - DNA, 25 bp, Mus musculus
aggttgctgtagagttcctataaca

SEQ ID NO: 205838 - DNA, 25 bp, Mus musculus
aggttgctgtagtgttcctataaca

SEQ ID NO: 205839 - DNA, 25 bp, Mus musculus
aggttgcttgtaacttctggtacat

SEQ ID NO: 205840 - DNA, 25 bp, Mus musculus
aggttgcttgtatcttctggtacat

SEQ ID NO: 205841 - DNA, 25 bp, Mus musculus
aggttgctttagacactcttgctgc

SEQ ID NO: 205842 - DNA, 25 bp, Mus musculus
aggttgctttagtcactcttgctgc

SEQ ID NO: 205843 - DNA, 25 bp, Mus musculus
aggttgctttatcccgggttgctca

SEQ ID NO: 205844 - DNA, 25 bp, Mus musculus
aggttgctttatgccgggttgctca

SEQ ID NO: 205845 - DNA, 25 bp, Mus musculus
aggttgctttgcatgggtataccga

SEQ ID NO: 205846 - DNA, 25 bp, Mus musculus
aggttgctttgcatgttcattaaaa

SEQ ID NO: 205847 - DNA, 25 bp, Mus musculus
aggttgctttgcttgggtataccga

SEQ ID NO: 205848 - DNA, 25 bp, Mus musculus
aggttgctttgcttgttcattaaaa

SEQ ID NO: 205849 - DNA, 25 bp, Mus musculus
aggttggaaattcctgaccgtccct

SEQ ID NO: 205850 - DNA, 25 bp, Mus musculus
aggttggaaattgctgaccgtccct

SEQ ID NO: 205851 - DNA, 25 bp, Mus musculus
aggttggaacccacattacatcttc

SEQ ID NO: 205852 - DNA, 25 bp, Mus musculus
aggttggaaccctcattacatcttc

SEQ ID NO: 205853 - DNA, 25 bp, Mus musculus
aggttggaactgcataccaccattc

SEQ ID NO: 205854 - DNA, 25 bp, Mus musculus
aggttggaactggataccaccattc

SEQ ID NO: 205855 - DNA, 25 bp, Mus musculus
aggttggacacgcagagccctctga

SEQ ID NO: 205856 - DNA, 25 bp, Mus musculus
aggttggacacggagagccctctga

SEQ ID NO: 205857 - DNA, 25 bp, Mus musculus
aggttggacaggcacattccccttg

SEQ ID NO: 205858 - DNA, 25 bp, Mus musculus
aggttggacagggacattccccttg

SEQ ID NO: 205859 - DNA, 25 bp, Mus musculus
aggttggacccgagaagccctggca

SEQ ID NO: 205860 - DNA, 25 bp, Mus musculus
aggttggacccgtgaagccctggca

SEQ ID NO: 205861 - DNA, 25 bp, Mus musculus
aggttggactctcgtcaccttgagt

SEQ ID NO: 205862 - DNA, 25 bp, Mus musculus
aggttggactctggtcaccttgagt

SEQ ID NO: 205863 - DNA, 25 bp, Mus musculus
aggttggagagcctggtttctcatt

SEQ ID NO: 205864 - DNA, 25 bp, Mus musculus
aggttggagagcgtggtttctcatt

SEQ ID NO: 205865 - DNA, 25 bp, Mus musculus
aggttggagcctcgactactggact

SEQ ID NO: 205866 - DNA, 25 bp, Mus musculus
aggttggagcctggactactggact

SEQ ID NO: 205867 - DNA, 25 bp, Mus musculus
aggttggaggtcacaaacatgaaac

SEQ ID NO: 205868 - DNA, 25 bp, Mus musculus
aggttggaggtctcaaacatgaaac

SEQ ID NO: 205869 - DNA, 25 bp, Mus musculus
aggttggagttgctgcctttttctc

SEQ ID NO: 205870 - DNA, 25 bp, Mus musculus
aggttggagttggtgcctttttctc

SEQ ID NO: 205871 - DNA, 25 bp, Mus musculus
aggttggccccacactgtatacttt

SEQ ID NO: 205872 - DNA, 25 bp, Mus musculus
aggttggccccagactgtatacttt

SEQ ID NO: 205873 - DNA, 25 bp, Mus musculus
aggttggccctcaaatctcagagat

SEQ ID NO: 205874 - DNA, 25 bp, Mus musculus
aggttggccctctaatctcagagat

SEQ ID NO: 205875 - DNA, 25 bp, Mus musculus
aggttggccctgacagatgcttcga

SEQ ID NO: 205876 - DNA, 25 bp, Mus musculus
aggttggccctgtcagatgcttcga

SEQ ID NO: 205877 - DNA, 25 bp, Mus musculus
aggttggcctagatcacatacccgc

SEQ ID NO: 205878 - DNA, 25 bp, Mus musculus
aggttggcctagttcacatacccgc

SEQ ID NO: 205879 - DNA, 25 bp, Mus musculus
aggttggcctgtcgcatcattgcac

SEQ ID NO: 205880 - DNA, 25 bp, Mus musculus
aggttggcctgtggcatcattgcac

SEQ ID NO: 205881 - DNA, 25 bp, Mus musculus
aggttggccttcagtcttcttcgct

SEQ ID NO: 205882 - DNA, 25 bp, Mus musculus
aggttggccttctgtcttcttcgct

SEQ ID NO: 205883 - DNA, 25 bp, Mus musculus
aggttggccttgatctccgtattct

SEQ ID NO: 205884 - DNA, 25 bp, Mus musculus
aggttggccttgttctccgtattct

SEQ ID NO: 205885 - DNA, 25 bp, Mus musculus
aggttggcgttcagagcttcccaaa

SEQ ID NO: 205886 - DNA, 25 bp, Mus musculus
aggttggcgttctgagcttcccaaa

SEQ ID NO: 205887 - DNA, 25 bp, Mus musculus
aggttggcgttgagcccagctttca

SEQ ID NO: 205888 - DNA, 25 bp, Mus musculus
aggttggcgttgtgcccagctttca

SEQ ID NO: 205889 - DNA, 25 bp, Mus musculus
aggttggctcagaagcttctgttac

SEQ ID NO: 205890 - DNA, 25 bp, Mus musculus
aggttggctcagtagcttctgttac

SEQ ID NO: 205891 - DNA, 25 bp, Mus musculus
aggttggctcatacttttcttttca

SEQ ID NO: 205892 - DNA, 25 bp, Mus musculus
aggttggctcattcttttcttttca

SEQ ID NO: 205893 - DNA, 25 bp, Mus musculus
aggttggctccaactggattctgag

SEQ ID NO: 205894 - DNA, 25 bp, Mus musculus
aggttggctccatctggattctgag

SEQ ID NO: 205895 - DNA, 25 bp, Mus musculus
aggttggctctccttacggagctct

SEQ ID NO: 205896 - DNA, 25 bp, Mus musculus
aggttggctctcgttacggagctct

SEQ ID NO: 205897 - DNA, 25 bp, Mus musculus
aggttggctggcacgacccaggtgg

SEQ ID NO: 205898 - DNA, 25 bp, Mus musculus
aggttggctggctcgacccaggtgg

SEQ ID NO: 205899 - DNA, 25 bp, Mus musculus
aggttgggccgacaggctccattct

SEQ ID NO: 205900 - DNA, 25 bp, Mus musculus
aggttgggccgagaggctccattct

SEQ ID NO: 205901 - DNA, 25 bp, Mus musculus
aggttgggctatatgctaatgttta

SEQ ID NO: 205902 - DNA, 25 bp, Mus musculus
aggttgggctatttgctaatgttta

SEQ ID NO: 205903 - DNA, 25 bp, Mus musculus
aggttgggctctatccatcccattt

SEQ ID NO: 205904 - DNA, 25 bp, Mus musculus
aggttgggctctttccatcccattt

SEQ ID NO: 205905 - DNA, 25 bp, Mus musculus
aggttgggtcctaccaatggagtat

SEQ ID NO: 205906 - DNA, 25 bp, Mus musculus
aggttgggtccttccaatggagtat

SEQ ID NO: 205907 - DNA, 25 bp, Mus musculus
aggttgggtgggagcaggaagtggc

SEQ ID NO: 205908 - DNA, 25 bp, Mus musculus
aggttgggtgggtgcaggaagtggc

SEQ ID NO: 205909 - DNA, 25 bp, Mus musculus
aggttggtcccacttattttcagct

SEQ ID NO: 205910 - DNA, 25 bp, Mus musculus
aggttggtcccagttattttcagct

SEQ ID NO: 205911 - DNA, 25 bp, Mus musculus
aggttggtgaccagaacatgatccc

SEQ ID NO: 205912 - DNA, 25 bp, Mus musculus
aggttggtgacctgaacatgatccc

SEQ ID NO: 205913 - DNA, 25 bp, Mus musculus
aggttggtgtccacaaacagaccca

SEQ ID NO: 205914 - DNA, 25 bp, Mus musculus
aggttggtgtcctcaaacagaccca

SEQ ID NO: 205915 - DNA, 25 bp, Mus musculus
aggttggtttatacaggtacaagct

SEQ ID NO: 205916 - DNA, 25 bp, Mus musculus
aggttggtttattcaggtacaagct

SEQ ID NO: 205917 - DNA, 25 bp, Mus musculus
aggttgtaccaccggatgtagttat

SEQ ID NO: 205918 - DNA, 25 bp, Mus musculus
aggttgtaccacgggatgtagttat

SEQ ID NO: 205919 - DNA, 25 bp, Mus musculus
aggttgtagatcaagccatgctctg

SEQ ID NO: 205920 - DNA, 25 bp, Mus musculus
aggttgtagatctagccatgctctg

SEQ ID NO: 205921 - DNA, 25 bp, Mus musculus
aggttgtagcccctggactcacatg

SEQ ID NO: 205922 - DNA, 25 bp, Mus musculus
aggttgtagcccgtggactcacatg

SEQ ID NO: 205923 - DNA, 25 bp, Mus musculus
aggttgtatcctcccatgagtctga

SEQ ID NO: 205924 - DNA, 25 bp, Mus musculus
aggttgtatcctgccatgagtctga

SEQ ID NO: 205925 - DNA, 25 bp, Mus musculus
aggttgtcacctatgagctgggcga

SEQ ID NO: 205926 - DNA, 25 bp, Mus musculus
aggttgtcacctttgagctgggcga

SEQ ID NO: 205927 - DNA, 25 bp, Mus musculus
aggttgtcagagacagatggctcaa

SEQ ID NO: 205928 - DNA, 25 bp, Mus musculus
aggttgtcagagtcagatggctcaa

SEQ ID NO: 205929 - DNA, 25 bp, Mus musculus
aggttgtcagtcatcctatttggat

SEQ ID NO: 205930 - DNA, 25 bp, Mus musculus
aggttgtcagtcttcctatttggat

SEQ ID NO: 205931 - DNA, 25 bp, Mus musculus
aggttgtcattgatttctctttccc

SEQ ID NO: 205932 - DNA, 25 bp, Mus musculus
aggttgtcattgttttctctttccc

SEQ ID NO: 205933 - DNA, 25 bp, Mus musculus
aggttgtcctctaactgtatgtgca

SEQ ID NO: 205934 - DNA, 25 bp, Mus musculus
aggttgtcctcttactgtatgtgca

SEQ ID NO: 205935 - DNA, 25 bp, Mus musculus
aggttgtcctgtcacaagctctggg

SEQ ID NO: 205936 - DNA, 25 bp, Mus musculus
aggttgtcctgtgacaagctctggg

SEQ ID NO: 205937 - DNA, 25 bp, Mus musculus
aggttgtccttgaactgcgtgcgga

SEQ ID NO: 205938 - DNA, 25 bp, Mus musculus
aggttgtccttgtactgcgtgcgga

SEQ ID NO: 205939 - DNA, 25 bp, Mus musculus
aggttgtcggaactactaagcaatc

SEQ ID NO: 205940 - DNA, 25 bp, Mus musculus
aggttgtcggaagtactaagcaatc

SEQ ID NO: 205941 - DNA, 25 bp, Mus musculus
aggttgtctccaccttgagattttt

SEQ ID NO: 205942 - DNA, 25 bp, Mus musculus
aggttgtctccagcttgagattttt

SEQ ID NO: 205943 - DNA, 25 bp, Mus musculus
aggttgtctcctccgacttcaacag

SEQ ID NO: 205944 - DNA, 25 bp, Mus musculus
aggttgtctcctgcgacttcaacag

SEQ ID NO: 205945 - DNA, 25 bp, Mus musculus
aggttgtgaccacgttggcgtttct

SEQ ID NO: 205946 - DNA, 25 bp, Mus musculus
aggttgtgaccaggttggcgtttct

SEQ ID NO: 205947 - DNA, 25 bp, Mus musculus
aggttgtgactcacctagggctaca

SEQ ID NO: 205948 - DNA, 25 bp, Mus musculus
aggttgtgactctcctagggctaca

SEQ ID NO: 205949 - DNA, 25 bp, Mus musculus
aggttgtgagacagagcatgccccg

SEQ ID NO: 205950 - DNA, 25 bp, Mus musculus
aggttgtgagactgagcatgccccg

SEQ ID NO: 205951 - DNA, 25 bp, Mus musculus
aggttgtgagtgatcatctgtgact

SEQ ID NO: 205952 - DNA, 25 bp, Mus musculus
aggttgtgagtgttcatctgtgact

SEQ ID NO: 205953 - DNA, 25 bp, Mus musculus
aggttgtgccataaagagccactgt

SEQ ID NO: 205954 - DNA, 25 bp, Mus musculus
aggttgtgccattaagagccactgt

SEQ ID NO: 205955 - DNA, 25 bp, Mus musculus
aggttgtggcccacagcccatggtg

SEQ ID NO: 205956 - DNA, 25 bp, Mus musculus
aggttgtggccctcagcccatggtg

SEQ ID NO: 205957 - DNA, 25 bp, Mus musculus
aggttgtggctcagttctcagctaa

SEQ ID NO: 205958 - DNA, 25 bp, Mus musculus
aggttgtggctctgttctcagctaa

SEQ ID NO: 205959 - DNA, 25 bp, Mus musculus
aggttgtggttaccccaaggcctca

SEQ ID NO: 205960 - DNA, 25 bp, Mus musculus
aggttgtggttagcccaaggcctca

SEQ ID NO: 205961 - DNA, 25 bp, Mus musculus
aggttgtgtacaatcatggtccgtt

SEQ ID NO: 205962 - DNA, 25 bp, Mus musculus
aggttgtgtacattcatggtccgtt

SEQ ID NO: 205963 - DNA, 25 bp, Mus musculus
aggttgtgttgtaacttccctgatt

SEQ ID NO: 205964 - DNA, 25 bp, Mus musculus
aggttgtgttgttacttccctgatt

SEQ ID NO: 205965 - DNA, 25 bp, Mus musculus
aggttgttcatcctctcacacacta

SEQ ID NO: 205966 - DNA, 25 bp, Mus musculus
aggttgttcatcgtctcacacacta

SEQ ID NO: 205967 - DNA, 25 bp, Mus musculus
aggttgttcccaccgtgatcactaa

SEQ ID NO: 205968 - DNA, 25 bp, Mus musculus
aggttgttcccagcgtgatcactaa

SEQ ID NO: 205969 - DNA, 25 bp, Mus musculus
aggttgttccgtactgtggtgtcca

SEQ ID NO: 205970 - DNA, 25 bp, Mus musculus
aggttgttccgttctgtggtgtcca

SEQ ID NO: 205971 - DNA, 25 bp, Mus musculus
aggttgttcctacatgtcttaagga

SEQ ID NO: 205972 - DNA, 25 bp, Mus musculus
aggttgttcctagatgtcttaagga

SEQ ID NO: 205973 - DNA, 25 bp, Mus musculus
aggttgttgagcacatccacttgga

SEQ ID NO: 205974 - DNA, 25 bp, Mus musculus
aggttgttgagctcatccacttgga

SEQ ID NO: 205975 - DNA, 25 bp, Mus musculus
aggttgttgcccaacagtcagcacc

SEQ ID NO: 205976 - DNA, 25 bp, Mus musculus
aggttgttgccctacagtcagcacc

SEQ ID NO: 205977 - DNA, 25 bp, Mus musculus
aggttgttgtgaccttcctgtgctt

SEQ ID NO: 205978 - DNA, 25 bp, Mus musculus
aggttgttgtgagcttcctgtgctt

SEQ ID NO: 205979 - DNA, 25 bp, Mus musculus
aggttgtttacacctctgctgctga

SEQ ID NO: 205980 - DNA, 25 bp, Mus musculus
aggttgtttacagctctgctgctga

SEQ ID NO: 205981 - DNA, 25 bp, Mus musculus
aggttgtttctgagattacgtgaca

SEQ ID NO: 205982 - DNA, 25 bp, Mus musculus
aggttgtttctgtgattacgtgaca

SEQ ID NO: 205983 - DNA, 25 bp, Mus musculus
aggttgttttagatcctgttcaaag

SEQ ID NO: 205984 - DNA, 25 bp, Mus musculus
aggttgttttagttcctgttcaaag

SEQ ID NO: 205985 - DNA, 25 bp, Mus musculus
aggttgttttgcagagctattctaa

SEQ ID NO: 205986 - DNA, 25 bp, Mus musculus
aggttgttttgctgagctattctaa

SEQ ID NO: 205987 - DNA, 25 bp, Mus musculus
aggtttaaaatgctctggctgctga

SEQ ID NO: 205988 - DNA, 25 bp, Mus musculus
aggtttaaaatggtctggctgctga

SEQ ID NO: 205989 - DNA, 25 bp, Mus musculus
aggtttaagtgtactcccttggcat

SEQ ID NO: 205990 - DNA, 25 bp, Mus musculus
aggtttaagtgttctcccttggcat

SEQ ID NO: 205991 - DNA, 25 bp, Mus musculus
aggtttaatgttacactcatatcag

SEQ ID NO: 205992 - DNA, 25 bp, Mus musculus
aggtttaatgtttcactcatatcag

SEQ ID NO: 205993 - DNA, 25 bp, Mus musculus
aggtttacagatagcctgtcatcag

SEQ ID NO: 205994 - DNA, 25 bp, Mus musculus
aggtttacagattgcctgtcatcag

SEQ ID NO: 205995 - DNA, 25 bp, Mus musculus
aggtttacatgtactgctctcttac

SEQ ID NO: 205996 - DNA, 25 bp, Mus musculus
aggtttacatgttctgctctcttac

SEQ ID NO: 205997 - DNA, 25 bp, Mus musculus
aggtttacccacaatgccagatact

SEQ ID NO: 205998 - DNA, 25 bp, Mus musculus
aggtttacccactatgccagatact

SEQ ID NO: 205999 - DNA, 25 bp, Mus musculus
aggtttacccctcacaagtgtcagt

SEQ ID NO: 206000 - DNA, 25 bp, Mus musculus
aggtttacccctgacaagtgtcagt

SEQ ID NO: 206001 - DNA, 25 bp, Mus musculus
aggtttacgcaaaagcgacgcgctg

SEQ ID NO: 206002 - DNA, 25 bp, Mus musculus
aggtttacgcaatagcgacgcgctg

SEQ ID NO: 206003 - DNA, 25 bp, Mus musculus
aggtttactgcactgttatcctcta

SEQ ID NO: 206004 - DNA, 25 bp, Mus musculus
aggtttactgcagtgttatcctcta

SEQ ID NO: 206005 - DNA, 25 bp, Mus musculus
aggtttagacttcccatgctgtgaa

SEQ ID NO: 206006 - DNA, 25 bp, Mus musculus
aggtttagacttgccatgctgtgaa

SEQ ID NO: 206007 - DNA, 25 bp, Mus musculus
aggtttaggatcatgcagccttgcc

SEQ ID NO: 206008 - DNA, 25 bp, Mus musculus
aggtttaggatcttgcagccttgcc

SEQ ID NO: 206009 - DNA, 25 bp, Mus musculus
aggtttaggctgatgtgaccactga

SEQ ID NO: 206010 - DNA, 25 bp, Mus musculus
aggtttaggctgttgtgaccactga

SEQ ID NO: 206011 - DNA, 25 bp, Mus musculus
aggtttaggtatcttatttgcagta

SEQ ID NO: 206012 - DNA, 25 bp, Mus musculus
aggtttaggtatgttatttgcagta

SEQ ID NO: 206013 - DNA, 25 bp, Mus musculus
aggtttagtagaactcccattcggc

SEQ ID NO: 206014 - DNA, 25 bp, Mus musculus
aggtttagtagatctcccattcggc

SEQ ID NO: 206015 - DNA, 25 bp, Mus musculus
aggtttagtagcactgttttgtcag

SEQ ID NO: 206016 - DNA, 25 bp, Mus musculus
aggtttagtagctctgttttgtcag

SEQ ID NO: 206017 - DNA, 25 bp, Mus musculus
aggtttatatttcactagtctcaaa

SEQ ID NO: 206018 - DNA, 25 bp, Mus musculus
aggtttatatttgactagtctcaaa

SEQ ID NO: 206019 - DNA, 25 bp, Mus musculus
aggtttatccgacatgatcagctct

SEQ ID NO: 206020 - DNA, 25 bp, Mus musculus
aggtttatccgagatgatcagctct

SEQ ID NO: 206021 - DNA, 25 bp, Mus musculus
aggtttatctcaaagtccatcccca

SEQ ID NO: 206022 - DNA, 25 bp, Mus musculus
aggtttatctcatagtccatcccca

SEQ ID NO: 206023 - DNA, 25 bp, Mus musculus
aggtttatgtccactgtttgtctct

SEQ ID NO: 206024 - DNA, 25 bp, Mus musculus
aggtttatgtcctctgtttgtctct

SEQ ID NO: 206025 - DNA, 25 bp, Mus musculus
aggtttatgtgtcagttggtgcccc

SEQ ID NO: 206026 - DNA, 25 bp, Mus musculus
aggtttatgtgtgagttggtgcccc

SEQ ID NO: 206027 - DNA, 25 bp, Mus musculus
aggtttattttgagtgctgtgctca

SEQ ID NO: 206028 - DNA, 25 bp, Mus musculus
aggtttattttgtgtgctgtgctca

SEQ ID NO: 206029 - DNA, 25 bp, Mus musculus
aggtttcaaaatatcctcctgagag

SEQ ID NO: 206030 - DNA, 25 bp, Mus musculus
aggtttcaaaatttcctcctgagag

SEQ ID NO: 206031 - DNA, 25 bp, Mus musculus
aggtttcaaagtctccatccatttc

SEQ ID NO: 206032 - DNA, 25 bp, Mus musculus
aggtttcaaagtgtccatccatttc

SEQ ID NO: 206033 - DNA, 25 bp, Mus musculus
aggtttcaacaacgcctatgtcctg

SEQ ID NO: 206034 - DNA, 25 bp, Mus musculus
aggtttcaacaaggcctatgtcctg

SEQ ID NO: 206035 - DNA, 25 bp, Mus musculus
aggtttcaacccctcagagaccaag

SEQ ID NO: 206036 - DNA, 25 bp, Mus musculus
aggtttcaacccgtcagagaccaag

SEQ ID NO: 206037 - DNA, 25 bp, Mus musculus
aggtttcaacctacatcctttggtg

SEQ ID NO: 206038 - DNA, 25 bp, Mus musculus
aggtttcaaccttcatcctttggtg

SEQ ID NO: 206039 - DNA, 25 bp, Mus musculus
aggtttcaagaaccctagctcagga

SEQ ID NO: 206040 - DNA, 25 bp, Mus musculus
aggtttcaagaagcctagctcagga

SEQ ID NO: 206041 - DNA, 25 bp, Mus musculus
aggtttcacacaaaatttcttcaaa

SEQ ID NO: 206042 - DNA, 25 bp, Mus musculus
aggtttcacacaacctcaaagacag

SEQ ID NO: 206043 - DNA, 25 bp, Mus musculus
aggtttcacacataatttcttcaaa

SEQ ID NO: 206044 - DNA, 25 bp, Mus musculus
aggtttcacacatcctcaaagacag

SEQ ID NO: 206045 - DNA, 25 bp, Mus musculus
aggtttcacagcagtatggttcttt

SEQ ID NO: 206046 - DNA, 25 bp, Mus musculus
aggtttcacagctgtatggttcttt

SEQ ID NO: 206047 - DNA, 25 bp, Mus musculus
aggtttcaccagattgaggttgaat

SEQ ID NO: 206048 - DNA, 25 bp, Mus musculus
aggtttcaccagtttgaggttgaat

SEQ ID NO: 206049 - DNA, 25 bp, Mus musculus
aggtttcagacccagctctgcggtg

SEQ ID NO: 206050 - DNA, 25 bp, Mus musculus
aggtttcagaccgagctctgcggtg

SEQ ID NO: 206051 - DNA, 25 bp, Mus musculus
aggtttcagagtacctgctcagcaa

SEQ ID NO: 206052 - DNA, 25 bp, Mus musculus
aggtttcagagttcctgctcagcaa

SEQ ID NO: 206053 - DNA, 25 bp, Mus musculus
aggtttcagcccaaagcaggtctag

SEQ ID NO: 206054 - DNA, 25 bp, Mus musculus
aggtttcagccctaagcaggtctag

SEQ ID NO: 206055 - DNA, 25 bp, Mus musculus
aggtttcagctcatctgttggaaga

SEQ ID NO: 206056 - DNA, 25 bp, Mus musculus
aggtttcagctccacagtctttagg

SEQ ID NO: 206057 - DNA, 25 bp, Mus musculus
aggtttcagctcgacagtctttagg

SEQ ID NO: 206058 - DNA, 25 bp, Mus musculus
aggtttcagctcttctgttggaaga

SEQ ID NO: 206059 - DNA, 25 bp, Mus musculus
aggtttcaggcaacctccaagaaag

SEQ ID NO: 206060 - DNA, 25 bp, Mus musculus
aggtttcaggcatcctccaagaaag

SEQ ID NO: 206061 - DNA, 25 bp, Mus musculus
aggtttcagggcacagatcaaatta

SEQ ID NO: 206062 - DNA, 25 bp, Mus musculus
aggtttcagggctcagatcaaatta

SEQ ID NO: 206063 - DNA, 25 bp, Mus musculus
aggtttcagttgcaaagtttatcga

SEQ ID NO: 206064 - DNA, 25 bp, Mus musculus
aggtttcagttggaaagtttatcga

SEQ ID NO: 206065 - DNA, 25 bp, Mus musculus
aggtttcatactatctcagctttcc

SEQ ID NO: 206066 - DNA, 25 bp, Mus musculus
aggtttcatactttctcagctttcc

SEQ ID NO: 206067 - DNA, 25 bp, Mus musculus
aggtttcatcccacacggcagagca

SEQ ID NO: 206068 - DNA, 25 bp, Mus musculus
aggtttcatccctcacggcagagca

SEQ ID NO: 206069 - DNA, 25 bp, Mus musculus
aggtttcattgacacccctcaaggg

SEQ ID NO: 206070 - DNA, 25 bp, Mus musculus
aggtttcattgagacccctcaaggg

SEQ ID NO: 206071 - DNA, 25 bp, Mus musculus
aggtttccaaggcacttggcaaact

SEQ ID NO: 206072 - DNA, 25 bp, Mus musculus
aggtttccaagggacttggcaaact

SEQ ID NO: 206073 - DNA, 25 bp, Mus musculus
aggtttccactgctgcattgtggca

SEQ ID NO: 206074 - DNA, 25 bp, Mus musculus
aggtttccactggtgcattgtggca

SEQ ID NO: 206075 - DNA, 25 bp, Mus musculus
aggtttccagaaccgtagccaccac

SEQ ID NO: 206076 - DNA, 25 bp, Mus musculus
aggtttccagaagcgtagccaccac

SEQ ID NO: 206077 - DNA, 25 bp, Mus musculus
aggtttccagtacagaggcccatga

SEQ ID NO: 206078 - DNA, 25 bp, Mus musculus
aggtttccagtagagaggcccatga

SEQ ID NO: 206079 - DNA, 25 bp, Mus musculus
aggtttccatgacacttgccctggg

SEQ ID NO: 206080 - DNA, 25 bp, Mus musculus
aggtttccatgagacttgccctggg

SEQ ID NO: 206081 - DNA, 25 bp, Mus musculus
aggtttcccaggagcaacgtggaca

SEQ ID NO: 206082 - DNA, 25 bp, Mus musculus
aggtttcccaggtgcaacgtggaca

SEQ ID NO: 206083 - DNA, 25 bp, Mus musculus
aggtttccctgaacctagatgctca

SEQ ID NO: 206084 - DNA, 25 bp, Mus musculus
aggtttccctgatcctagatgctca

SEQ ID NO: 206085 - DNA, 25 bp, Mus musculus
aggtttccgaggagtcctgagctgt

SEQ ID NO: 206086 - DNA, 25 bp, Mus musculus
aggtttccgaggtgtcctgagctgt

SEQ ID NO: 206087 - DNA, 25 bp, Mus musculus
aggtttccgcaccaggcagaagtca

SEQ ID NO: 206088 - DNA, 25 bp, Mus musculus
aggtttccgcacgaggcagaagtca

SEQ ID NO: 206089 - DNA, 25 bp, Mus musculus
aggtttccgttgctccatcatctaa

SEQ ID NO: 206090 - DNA, 25 bp, Mus musculus
aggtttccgttggtccatcatctaa

SEQ ID NO: 206091 - DNA, 25 bp, Mus musculus
aggtttcctcccatgattttggatg

SEQ ID NO: 206092 - DNA, 25 bp, Mus musculus
aggtttcctcccttgattttggatg

SEQ ID NO: 206093 - DNA, 25 bp, Mus musculus
aggtttcctcctcccatgatggctt

SEQ ID NO: 206094 - DNA, 25 bp, Mus musculus
aggtttcctcctgccatgatggctt

SEQ ID NO: 206095 - DNA, 25 bp, Mus musculus
aggtttcctctcacaaaatcagggc

SEQ ID NO: 206096 - DNA, 25 bp, Mus musculus
aggtttcctctctcaaaatcagggc

SEQ ID NO: 206097 - DNA, 25 bp, Mus musculus
aggtttcctgtgctctaggtctcct

SEQ ID NO: 206098 - DNA, 25 bp, Mus musculus
aggtttcctgtggtctaggtctcct

SEQ ID NO: 206099 - DNA, 25 bp, Mus musculus
aggtttccttgtactgcagagcatt

SEQ ID NO: 206100 - DNA, 25 bp, Mus musculus
aggtttccttgttctgcagagcatt

SEQ ID NO: 206101 - DNA, 25 bp, Mus musculus
aggtttcgcaaaacatcctaattta

SEQ ID NO: 206102 - DNA, 25 bp, Mus musculus
aggtttcgcaaatcatcctaattta

SEQ ID NO: 206103 - DNA, 25 bp, Mus musculus
aggtttcgcccaagctgtgtcagaa

SEQ ID NO: 206104 - DNA, 25 bp, Mus musculus
aggtttcgcccatgctgtgtcagaa

SEQ ID NO: 206105 - DNA, 25 bp, Mus musculus
aggtttctaattccaggacctagat

SEQ ID NO: 206106 - DNA, 25 bp, Mus musculus
aggtttctaattgcaggacctagat

SEQ ID NO: 206107 - DNA, 25 bp, Mus musculus
aggtttctcaatacggcgacctggc

SEQ ID NO: 206108 - DNA, 25 bp, Mus musculus
aggtttctcaattcggcgacctggc

SEQ ID NO: 206109 - DNA, 25 bp, Mus musculus
aggtttctcactctcactaagtaac

SEQ ID NO: 206110 - DNA, 25 bp, Mus musculus
aggtttctcactgtcactaagtaac

SEQ ID NO: 206111 - DNA, 25 bp, Mus musculus
aggtttctcatgacaaattttgctg

SEQ ID NO: 206112 - DNA, 25 bp, Mus musculus
aggtttctcatgtcaaattttgctg

SEQ ID NO: 206113 - DNA, 25 bp, Mus musculus
aggtttctccctcagtctggatctt

SEQ ID NO: 206114 - DNA, 25 bp, Mus musculus
aggtttctccctgagtctggatctt

SEQ ID NO: 206115 - DNA, 25 bp, Mus musculus
aggtttctctccacacttttcatac

SEQ ID NO: 206116 - DNA, 25 bp, Mus musculus
aggtttctctcctcacttttcatac

SEQ ID NO: 206117 - DNA, 25 bp, Mus musculus
aggtttctctggatagtcctggcac

SEQ ID NO: 206118 - DNA, 25 bp, Mus musculus
aggtttctctggttagtcctggcac

SEQ ID NO: 206119 - DNA, 25 bp, Mus musculus
aggtttctcttcaccatcacaggtt

SEQ ID NO: 206120 - DNA, 25 bp, Mus musculus
aggtttctcttctccatcacaggtt

SEQ ID NO: 206121 - DNA, 25 bp, Mus musculus
aggtttctgcacactcgttaccaaa

SEQ ID NO: 206122 - DNA, 25 bp, Mus musculus
aggtttctgcactctcgttaccaaa

SEQ ID NO: 206123 - DNA, 25 bp, Mus musculus
aggtttctgcctcaggatcctgtga

SEQ ID NO: 206124 - DNA, 25 bp, Mus musculus
aggtttctgcctgaggatcctgtga

SEQ ID NO: 206125 - DNA, 25 bp, Mus musculus
aggtttctggagcacactggccact

SEQ ID NO: 206126 - DNA, 25 bp, Mus musculus
aggtttctggaggacactggccact

SEQ ID NO: 206127 - DNA, 25 bp, Mus musculus
aggtttctggccagacggaccaact

SEQ ID NO: 206128 - DNA, 25 bp, Mus musculus
aggtttctggcctgacggaccaact

SEQ ID NO: 206129 - DNA, 25 bp, Mus musculus
aggtttctggcgattgaagtcaaag

SEQ ID NO: 206130 - DNA, 25 bp, Mus musculus
aggtttctggcgtttgaagtcaaag

SEQ ID NO: 206131 - DNA, 25 bp, Mus musculus
aggtttctgtaaagtccacgtgtcc

SEQ ID NO: 206132 - DNA, 25 bp, Mus musculus
aggtttctgtaatgtccacgtgtcc

SEQ ID NO: 206133 - DNA, 25 bp, Mus musculus
aggtttctgtgcctttgatcattcc

SEQ ID NO: 206134 - DNA, 25 bp, Mus musculus
aggtttctgtgcgtttgatcattcc

SEQ ID NO: 206135 - DNA, 25 bp, Mus musculus
aggtttcttcgacctcactaattta

SEQ ID NO: 206136 - DNA, 25 bp, Mus musculus
aggtttcttcgagctcactaattta

SEQ ID NO: 206137 - DNA, 25 bp, Mus musculus
aggtttcttctgaaagtcatgtctt

SEQ ID NO: 206138 - DNA, 25 bp, Mus musculus
aggtttcttctgtaagtcatgtctt

SEQ ID NO: 206139 - DNA, 25 bp, Mus musculus
aggtttcttcttctgttcatcggct

SEQ ID NO: 206140 - DNA, 25 bp, Mus musculus
aggtttcttcttgtgttcatcggct

SEQ ID NO: 206141 - DNA, 25 bp, Mus musculus
aggtttctttgccaacagccagatg

SEQ ID NO: 206142 - DNA, 25 bp, Mus musculus
aggtttctttgcgaacagccagatg

SEQ ID NO: 206143 - DNA, 25 bp, Mus musculus
aggtttctttggaaagcatcctaag

SEQ ID NO: 206144 - DNA, 25 bp, Mus musculus
aggtttctttggtaagcatcctaag

SEQ ID NO: 206145 - DNA, 25 bp, Mus musculus
aggtttgaatgtcctgttctactcg

SEQ ID NO: 206146 - DNA, 25 bp, Mus musculus
aggtttgaatgtgctgttctactcg

SEQ ID NO: 206147 - DNA, 25 bp, Mus musculus
aggtttgacagacccggaattattt

SEQ ID NO: 206148 - DNA, 25 bp, Mus musculus
aggtttgacagagccggaattattt

SEQ ID NO: 206149 - DNA, 25 bp, Mus musculus
aggtttgacagcaatcagtgacttt

SEQ ID NO: 206150 - DNA, 25 bp, Mus musculus
aggtttgacagctatcagtgacttt

SEQ ID NO: 206151 - DNA, 25 bp, Mus musculus
aggtttgactccatatgaatataaa

SEQ ID NO: 206152 - DNA, 25 bp, Mus musculus
aggtttgactccttatgaatataaa

SEQ ID NO: 206153 - DNA, 25 bp, Mus musculus
aggtttgagctgaaggtctcatctc

SEQ ID NO: 206154 - DNA, 25 bp, Mus musculus
aggtttgagctgtaggtctcatctc

SEQ ID NO: 206155 - DNA, 25 bp, Mus musculus
aggtttgagtgcacaagccctttgt

SEQ ID NO: 206156 - DNA, 25 bp, Mus musculus
aggtttgagtgctcaagccctttgt

SEQ ID NO: 206157 - DNA, 25 bp, Mus musculus
aggtttgatcctcagagcctcatcc

SEQ ID NO: 206158 - DNA, 25 bp, Mus musculus
aggtttgatcctgagagcctcatcc

SEQ ID NO: 206159 - DNA, 25 bp, Mus musculus
aggtttgcaccaagacacccgactt

SEQ ID NO: 206160 - DNA, 25 bp, Mus musculus
aggtttgcaccatgacacccgactt

SEQ ID NO: 206161 - DNA, 25 bp, Mus musculus
aggtttgcactccttccactcagca

SEQ ID NO: 206162 - DNA, 25 bp, Mus musculus
aggtttgcactcgttccactcagca

SEQ ID NO: 206163 - DNA, 25 bp, Mus musculus
aggtttgcatacatctcacagcagg

SEQ ID NO: 206164 - DNA, 25 bp, Mus musculus
aggtttgcatacttctcacagcagg

SEQ ID NO: 206165 - DNA, 25 bp, Mus musculus
aggtttgccaaaagagaccacagtg

SEQ ID NO: 206166 - DNA, 25 bp, Mus musculus
aggtttgccaaatgagaccacagtg

SEQ ID NO: 206167 - DNA, 25 bp, Mus musculus
aggtttgccaagcttctgctgcgtc

SEQ ID NO: 206168 - DNA, 25 bp, Mus musculus
aggtttgccaaggttctgctgcgtc

SEQ ID NO: 206169 - DNA, 25 bp, Mus musculus
aggtttgccatgacatctggaataa

SEQ ID NO: 206170 - DNA, 25 bp, Mus musculus
aggtttgccatgtcatctggaataa

SEQ ID NO: 206171 - DNA, 25 bp, Mus musculus
aggtttgcgagtatgctctgtcttc

SEQ ID NO: 206172 - DNA, 25 bp, Mus musculus
aggtttgcgagtttgctctgtcttc

SEQ ID NO: 206173 - DNA, 25 bp, Mus musculus
aggtttgctctcataaacatgaaag

SEQ ID NO: 206174 - DNA, 25 bp, Mus musculus
aggtttgctctcttaaacatgaaag

SEQ ID NO: 206175 - DNA, 25 bp, Mus musculus
aggtttgctgaacctccagagccga

SEQ ID NO: 206176 - DNA, 25 bp, Mus musculus
aggtttgctgaagctccagagccga

SEQ ID NO: 206177 - DNA, 25 bp, Mus musculus
aggtttgctgcccaactgcgagagc

SEQ ID NO: 206178 - DNA, 25 bp, Mus musculus
aggtttgctgccgaactgcgagagc

SEQ ID NO: 206179 - DNA, 25 bp, Mus musculus
aggtttgcttcaccacactcagctt

SEQ ID NO: 206180 - DNA, 25 bp, Mus musculus
aggtttgcttcagcacactcagctt

SEQ ID NO: 206181 - DNA, 25 bp, Mus musculus
aggtttggaaacacattggcccaga

SEQ ID NO: 206182 - DNA, 25 bp, Mus musculus
aggtttggaaactcattggcccaga

SEQ ID NO: 206183 - DNA, 25 bp, Mus musculus
aggtttggaatcaccgagtcctgaa

SEQ ID NO: 206184 - DNA, 25 bp, Mus musculus
aggtttggaatctccgagtcctgaa

SEQ ID NO: 206185 - DNA, 25 bp, Mus musculus
aggtttggcagtccccacctttaat

SEQ ID NO: 206186 - DNA, 25 bp, Mus musculus
aggtttggcagtgcccacctttaat

SEQ ID NO: 206187 - DNA, 25 bp, Mus musculus
aggtttggcccaactttgatctcat

SEQ ID NO: 206188 - DNA, 25 bp, Mus musculus
aggtttggcccatctttgatctcat

SEQ ID NO: 206189 - DNA, 25 bp, Mus musculus
aggtttgggaaaatgctcctcctgc

SEQ ID NO: 206190 - DNA, 25 bp, Mus musculus
aggtttgggaaattgctcctcctgc

SEQ ID NO: 206191 - DNA, 25 bp, Mus musculus
aggtttgggctcagctattcaggaa

SEQ ID NO: 206192 - DNA, 25 bp, Mus musculus
aggtttgggctctgctattcaggaa

SEQ ID NO: 206193 - DNA, 25 bp, Mus musculus
aggtttggtccactcttgtgcttgc

SEQ ID NO: 206194 - DNA, 25 bp, Mus musculus
aggtttggtccagtcttgtgcttgc

SEQ ID NO: 206195 - DNA, 25 bp, Mus musculus
aggtttgtagttatgtagagccaca

SEQ ID NO: 206196 - DNA, 25 bp, Mus musculus
aggtttgtagttttgtagagccaca

SEQ ID NO: 206197 - DNA, 25 bp, Mus musculus
aggtttgtatccctaattgctccag

SEQ ID NO: 206198 - DNA, 25 bp, Mus musculus
aggtttgtatccgtaattgctccag

SEQ ID NO: 206199 - DNA, 25 bp, Mus musculus
aggtttgtcagcaagcctgatgacc

SEQ ID NO: 206200 - DNA, 25 bp, Mus musculus
aggtttgtcagctagcctgatgacc

SEQ ID NO: 206201 - DNA, 25 bp, Mus musculus
aggtttgtcattatgcaagttgcgt

SEQ ID NO: 206202 - DNA, 25 bp, Mus musculus
aggtttgtcattctaggtgggcttt

SEQ ID NO: 206203 - DNA, 25 bp, Mus musculus
aggtttgtcattgtaggtgggcttt

SEQ ID NO: 206204 - DNA, 25 bp, Mus musculus
aggtttgtcattttgcaagttgcgt

SEQ ID NO: 206205 - DNA, 25 bp, Mus musculus
aggtttgtctccagtgatacttttg

SEQ ID NO: 206206 - DNA, 25 bp, Mus musculus
aggtttgtctcctgtgatacttttg

SEQ ID NO: 206207 - DNA, 25 bp, Mus musculus
aggtttgtgagcatgctggccgacc

SEQ ID NO: 206208 - DNA, 25 bp, Mus musculus
aggtttgtgagcttgctggccgacc

SEQ ID NO: 206209 - DNA, 25 bp, Mus musculus
aggtttgtgccacagtgacagacac

SEQ ID NO: 206210 - DNA, 25 bp, Mus musculus
aggtttgtgccagagtgacagacac

SEQ ID NO: 206211 - DNA, 25 bp, Mus musculus
aggtttgttctaacttccctctaag

SEQ ID NO: 206212 - DNA, 25 bp, Mus musculus
aggtttgttctatcttccctctaag

SEQ ID NO: 206213 - DNA, 25 bp, Mus musculus
aggtttgttcttataacagctgaga

SEQ ID NO: 206214 - DNA, 25 bp, Mus musculus
aggtttgttcttccagttttatcac

SEQ ID NO: 206215 - DNA, 25 bp, Mus musculus
aggtttgttcttgcagttttatcac

SEQ ID NO: 206216 - DNA, 25 bp, Mus musculus
aggtttgttcttttaacagctgaga

SEQ ID NO: 206217 - DNA, 25 bp, Mus musculus
aggtttgttggtcctttgatattca

SEQ ID NO: 206218 - DNA, 25 bp, Mus musculus
aggtttgttggtgctttgatattca

SEQ ID NO: 206219 - DNA, 25 bp, Mus musculus
aggttttaagcccacaggtgctgtg

SEQ ID NO: 206220 - DNA, 25 bp, Mus musculus
aggttttaagccgacaggtgctgtg

SEQ ID NO: 206221 - DNA, 25 bp, Mus musculus
aggttttacactctactgatccaca

SEQ ID NO: 206222 - DNA, 25 bp, Mus musculus
aggttttacactgtactgatccaca

SEQ ID NO: 206223 - DNA, 25 bp, Mus musculus
aggttttacctgatgttgcgtccac

SEQ ID NO: 206224 - DNA, 25 bp, Mus musculus
aggttttacctgttgttgcgtccac

SEQ ID NO: 206225 - DNA, 25 bp, Mus musculus
aggttttacgccatctcctgcaagt

SEQ ID NO: 206226 - DNA, 25 bp, Mus musculus
aggttttacgccttctcctgcaagt

SEQ ID NO: 206227 - DNA, 25 bp, Mus musculus
aggttttagtgtcctaactccacag

SEQ ID NO: 206228 - DNA, 25 bp, Mus musculus
aggttttagtgtgctaactccacag

SEQ ID NO: 206229 - DNA, 25 bp, Mus musculus
aggttttatgaaagggccgcgcgcc

SEQ ID NO: 206230 - DNA, 25 bp, Mus musculus
aggttttatgaatgggccgcgcgcc

SEQ ID NO: 206231 - DNA, 25 bp, Mus musculus
aggttttatttgctgccagcatcta

SEQ ID NO: 206232 - DNA, 25 bp, Mus musculus
aggttttatttggtgccagcatcta

SEQ ID NO: 206233 - DNA, 25 bp, Mus musculus
aggttttcactcaagcatcagatgg

SEQ ID NO: 206234 - DNA, 25 bp, Mus musculus
aggttttcactctagcatcagatgg

SEQ ID NO: 206235 - DNA, 25 bp, Mus musculus
aggttttcagccctcatgataggag

SEQ ID NO: 206236 - DNA, 25 bp, Mus musculus
aggttttcagccgtcatgataggag

SEQ ID NO: 206237 - DNA, 25 bp, Mus musculus
aggttttcataacttcagctctgga

SEQ ID NO: 206238 - DNA, 25 bp, Mus musculus
aggttttcataagttcagctctgga

SEQ ID NO: 206239 - DNA, 25 bp, Mus musculus
aggttttcatttccttgagcagact

SEQ ID NO: 206240 - DNA, 25 bp, Mus musculus
aggttttcatttgcttgagcagact

SEQ ID NO: 206241 - DNA, 25 bp, Mus musculus
aggttttccactcttatggccatca

SEQ ID NO: 206242 - DNA, 25 bp, Mus musculus
aggttttccactgttatggccatca

SEQ ID NO: 206243 - DNA, 25 bp, Mus musculus
aggttttcccacactattcttctgt

SEQ ID NO: 206244 - DNA, 25 bp, Mus musculus
aggttttcccactctattcttctgt

SEQ ID NO: 206245 - DNA, 25 bp, Mus musculus
aggttttcccttcttgatatggcag

SEQ ID NO: 206246 - DNA, 25 bp, Mus musculus
aggttttcccttgttgatatggcag

SEQ ID NO: 206247 - DNA, 25 bp, Mus musculus
aggttttcctctcctagacacttgc

SEQ ID NO: 206248 - DNA, 25 bp, Mus musculus
aggttttcctctgctagacacttgc

SEQ ID NO: 206249 - DNA, 25 bp, Mus musculus
aggttttcctgcacgcggcccggct

SEQ ID NO: 206250 - DNA, 25 bp, Mus musculus
aggttttcctgctcgcggcccggct

SEQ ID NO: 206251 - DNA, 25 bp, Mus musculus
aggttttccttaatgatttcacaca

SEQ ID NO: 206252 - DNA, 25 bp, Mus musculus
aggttttccttattgatttcacaca

SEQ ID NO: 206253 - DNA, 25 bp, Mus musculus
aggttttcgactcggtggccattgt

SEQ ID NO: 206254 - DNA, 25 bp, Mus musculus
aggttttcgactgggtggccattgt

SEQ ID NO: 206255 - DNA, 25 bp, Mus musculus
aggttttctaatctctgccctgctt

SEQ ID NO: 206256 - DNA, 25 bp, Mus musculus
aggttttctaatgtctgccctgctt

SEQ ID NO: 206257 - DNA, 25 bp, Mus musculus
aggttttctatacgactagcagtca

SEQ ID NO: 206258 - DNA, 25 bp, Mus musculus
aggttttctataggactagcagtca

SEQ ID NO: 206259 - DNA, 25 bp, Mus musculus
aggttttctattagtcctgccttga

SEQ ID NO: 206260 - DNA, 25 bp, Mus musculus
aggttttctatttgtcctgccttga

SEQ ID NO: 206261 - DNA, 25 bp, Mus musculus
aggttttctcaactgtgctttcgca

SEQ ID NO: 206262 - DNA, 25 bp, Mus musculus
aggttttctcaagtgtgctttcgca

SEQ ID NO: 206263 - DNA, 25 bp, Mus musculus
aggttttctcctaatcagctgctga

SEQ ID NO: 206264 - DNA, 25 bp, Mus musculus
aggttttctccttatcagctgctga

SEQ ID NO: 206265 - DNA, 25 bp, Mus musculus
aggttttctctccttatcactgctt

SEQ ID NO: 206266 - DNA, 25 bp, Mus musculus
aggttttctctcgttatcactgctt

SEQ ID NO: 206267 - DNA, 25 bp, Mus musculus
aggttttctgctaagcctttttcat

SEQ ID NO: 206268 - DNA, 25 bp, Mus musculus
aggttttctgcttagcctttttcat

SEQ ID NO: 206269 - DNA, 25 bp, Mus musculus
aggttttctgtcaccaagcttgtat

SEQ ID NO: 206270 - DNA, 25 bp, Mus musculus
aggttttctgtctccaagcttgtat

SEQ ID NO: 206271 - DNA, 25 bp, Mus musculus
aggttttctgtgacttctgtaattg

SEQ ID NO: 206272 - DNA, 25 bp, Mus musculus
aggttttctgtgtcttctgtaattg

SEQ ID NO: 206273 - DNA, 25 bp, Mus musculus
aggttttcttatcattcattctcaa

SEQ ID NO: 206274 - DNA, 25 bp, Mus musculus
aggttttcttatgattcattctcaa

SEQ ID NO: 206275 - DNA, 25 bp, Mus musculus
aggttttcttgcagctgccctgttg

SEQ ID NO: 206276 - DNA, 25 bp, Mus musculus
aggttttcttgctgctgccctgttg

SEQ ID NO: 206277 - DNA, 25 bp, Mus musculus
aggttttcttgtcagctaatcactg

SEQ ID NO: 206278 - DNA, 25 bp, Mus musculus
aggttttcttgtgagctaatcactg

SEQ ID NO: 206279 - DNA, 25 bp, Mus musculus
aggttttgagatcttaccctctgaa

SEQ ID NO: 206280 - DNA, 25 bp, Mus musculus
aggttttgagatgttaccctctgaa

SEQ ID NO: 206281 - DNA, 25 bp, Mus musculus
aggttttgatgcagagccagggccc

SEQ ID NO: 206282 - DNA, 25 bp, Mus musculus
aggttttgatgctgagccagggccc

SEQ ID NO: 206283 - DNA, 25 bp, Mus musculus
aggttttgcacgcttctccacattt

SEQ ID NO: 206284 - DNA, 25 bp, Mus musculus
aggttttgcacggttctccacattt

SEQ ID NO: 206285 - DNA, 25 bp, Mus musculus
aggttttgcatcatcactgaatctg

SEQ ID NO: 206286 - DNA, 25 bp, Mus musculus
aggttttgcatcttcactgaatctg

SEQ ID NO: 206287 - DNA, 25 bp, Mus musculus
aggttttgccttaggcgttcaacag

SEQ ID NO: 206288 - DNA, 25 bp, Mus musculus
aggttttgcctttggcgttcaacag

SEQ ID NO: 206289 - DNA, 25 bp, Mus musculus
aggttttggctactaaatgatttag

SEQ ID NO: 206290 - DNA, 25 bp, Mus musculus
aggttttggctagtaaatgatttag

SEQ ID NO: 206291 - DNA, 25 bp, Mus musculus
aggttttggtccatgtgggccatgt

SEQ ID NO: 206292 - DNA, 25 bp, Mus musculus
aggttttggtccttgtgggccatgt

SEQ ID NO: 206293 - DNA, 25 bp, Mus musculus
aggttttggtctctaggccctgtat

SEQ ID NO: 206294 - DNA, 25 bp, Mus musculus
aggttttggtctgtaggccctgtat

SEQ ID NO: 206295 - DNA, 25 bp, Mus musculus
aggttttggttcatacatgtttcag

SEQ ID NO: 206296 - DNA, 25 bp, Mus musculus
aggttttggttcttacatgtttcag

SEQ ID NO: 206297 - DNA, 25 bp, Mus musculus
aggttttgtactatgaacactgcca

SEQ ID NO: 206298 - DNA, 25 bp, Mus musculus
aggttttgtactttgaacactgcca

SEQ ID NO: 206299 - DNA, 25 bp, Mus musculus
aggtttttagacaggcagcctcctc

SEQ ID NO: 206300 - DNA, 25 bp, Mus musculus
aggtttttagactggcagcctcctc

SEQ ID NO: 206301 - DNA, 25 bp, Mus musculus
aggtttttctgaccaagcactccca

SEQ ID NO: 206302 - DNA, 25 bp, Mus musculus
aggtttttctgagcaagcactccca

SEQ ID NO: 206303 - DNA, 25 bp, Mus musculus
aggtttttctggcttggacactact

SEQ ID NO: 206304 - DNA, 25 bp, Mus musculus
aggtttttctgggttggacactact

SEQ ID NO: 206305 - DNA, 25 bp, Mus musculus
aggtttttgactaatatccaggaca

SEQ ID NO: 206306 - DNA, 25 bp, Mus musculus
aggtttttgacttatatccaggaca

SEQ ID NO: 206307 - DNA, 25 bp, Mus musculus
aggtttttgatcatgcactttgcga

SEQ ID NO: 206308 - DNA, 25 bp, Mus musculus
aggtttttgatcttgcactttgcga

SEQ ID NO: 206309 - DNA, 25 bp, Mus musculus
aggtttttgatgagctctggctaat

SEQ ID NO: 206310 - DNA, 25 bp, Mus musculus
aggtttttgatgtgctctggctaat

SEQ ID NO: 206311 - DNA, 25 bp, Mus musculus
aggtttttgcacatgatgttctcca

SEQ ID NO: 206312 - DNA, 25 bp, Mus musculus
aggtttttgcacttgatgttctcca

SEQ ID NO: 206313 - DNA, 25 bp, Mus musculus
aggtttttgcctacaacttcacact

SEQ ID NO: 206314 - DNA, 25 bp, Mus musculus
aggtttttgccttcaacttcacact

SEQ ID NO: 206315 - DNA, 25 bp, Mus musculus
aggtttttgtctccgatttgactta

SEQ ID NO: 206316 - DNA, 25 bp, Mus musculus
aggtttttgtctgcgatttgactta

SEQ ID NO: 206317 - DNA, 25 bp, Mus musculus
agtaaaaacgttcacatcccagtgt

SEQ ID NO: 206318 - DNA, 25 bp, Mus musculus
agtaaaaacgttgacatcccagtgt

SEQ ID NO: 206319 - DNA, 25 bp, Mus musculus
agtaaaacacgtctggtctcctgct

SEQ ID NO: 206320 - DNA, 25 bp, Mus musculus
agtaaaacacgtgtggtctcctgct

SEQ ID NO: 206321 - DNA, 25 bp, Mus musculus
agtaaaaccactactctgctactct

SEQ ID NO: 206322 - DNA, 25 bp, Mus musculus
agtaaaaccacttctctgctactct

SEQ ID NO: 206323 - DNA, 25 bp, Mus musculus
agtaaaactggcctcccagatgtgt

SEQ ID NO: 206324 - DNA, 25 bp, Mus musculus
agtaaaactggcgtcccagatgtgt

SEQ ID NO: 206325 - DNA, 25 bp, Mus musculus
agtaaaagccacacagtcacctctt

SEQ ID NO: 206326 - DNA, 25 bp, Mus musculus
agtaaaagccactcagtcacctctt

SEQ ID NO: 206327 - DNA, 25 bp, Mus musculus
agtaaaagtcttagttctccataat

SEQ ID NO: 206328 - DNA, 25 bp, Mus musculus
agtaaaagtctttgttctccataat

SEQ ID NO: 206329 - DNA, 25 bp, Mus musculus
agtaaaatgctacttgtttcaactt

SEQ ID NO: 206330 - DNA, 25 bp, Mus musculus
agtaaaatgctagttgtttcaactt

SEQ ID NO: 206331 - DNA, 25 bp, Mus musculus
agtaaacacaaacatcagcttagat

SEQ ID NO: 206332 - DNA, 25 bp, Mus musculus
agtaaacacaaagatcagcttagat

SEQ ID NO: 206333 - DNA, 25 bp, Mus musculus
agtaaacacggccagagtccaccat

SEQ ID NO: 206334 - DNA, 25 bp, Mus musculus
agtaaacacggcgagagtccaccat

SEQ ID NO: 206335 - DNA, 25 bp, Mus musculus
agtaaacagactccgtgctgacttt

SEQ ID NO: 206336 - DNA, 25 bp, Mus musculus
agtaaacagactgcgtgctgacttt

SEQ ID NO: 206337 - DNA, 25 bp, Mus musculus
agtaaacagcacactgcctaccatg

SEQ ID NO: 206338 - DNA, 25 bp, Mus musculus
agtaaacagcactctgcctaccatg

SEQ ID NO: 206339 - DNA, 25 bp, Mus musculus
agtaaacagtatagctaacttcatg

SEQ ID NO: 206340 - DNA, 25 bp, Mus musculus
agtaaacagtattgctaacttcatg

SEQ ID NO: 206341 - DNA, 25 bp, Mus musculus
agtaaacatcttcccttggttcagg

SEQ ID NO: 206342 - DNA, 25 bp, Mus musculus
agtaaacatcttgccttggttcagg

SEQ ID NO: 206343 - DNA, 25 bp, Mus musculus
agtaaacatgctatggacttccaga

SEQ ID NO: 206344 - DNA, 25 bp, Mus musculus
agtaaacatgctttggacttccaga

SEQ ID NO: 206345 - DNA, 25 bp, Mus musculus
agtaaacatgttaccatgtcatttt

SEQ ID NO: 206346 - DNA, 25 bp, Mus musculus
agtaaacatgtttccatgtcatttt

SEQ ID NO: 206347 - DNA, 25 bp, Mus musculus
agtaaacattagagccccaggagtg

SEQ ID NO: 206348 - DNA, 25 bp, Mus musculus
agtaaacattagtgccccaggagtg

SEQ ID NO: 206349 - DNA, 25 bp, Mus musculus
agtaaacatttcagggactgtcaag

SEQ ID NO: 206350 - DNA, 25 bp, Mus musculus
agtaaacatttctgggactgtcaag

SEQ ID NO: 206351 - DNA, 25 bp, Mus musculus
agtaaaccagtgagttttctagcac

SEQ ID NO: 206352 - DNA, 25 bp, Mus musculus
agtaaaccagtgtgttttctagcac

SEQ ID NO: 206353 - DNA, 25 bp, Mus musculus
agtaaaccatggactttctcgaaga

SEQ ID NO: 206354 - DNA, 25 bp, Mus musculus
agtaaaccatggtctttctcgaaga

SEQ ID NO: 206355 - DNA, 25 bp, Mus musculus
agtaaacctgttaacttcctcactg

SEQ ID NO: 206356 - DNA, 25 bp, Mus musculus
agtaaacctgtttacttcctcactg

SEQ ID NO: 206357 - DNA, 25 bp, Mus musculus
agtaaacgaggtcgtcgtccgccag

SEQ ID NO: 206358 - DNA, 25 bp, Mus musculus
agtaaacgaggtggtcgtccgccag

SEQ ID NO: 206359 - DNA, 25 bp, Mus musculus
agtaaacgagtgacctcttgtgcct

SEQ ID NO: 206360 - DNA, 25 bp, Mus musculus
agtaaacgagtgtcctcttgtgcct

SEQ ID NO: 206361 - DNA, 25 bp, Mus musculus
agtaaacgagttcacctcggtcaca

SEQ ID NO: 206362 - DNA, 25 bp, Mus musculus
agtaaacgagttgacctcggtcaca

SEQ ID NO: 206363 - DNA, 25 bp, Mus musculus
agtaaacgctttaggtgacccatgt

SEQ ID NO: 206364 - DNA, 25 bp, Mus musculus
agtaaacgcttttggtgacccatgt

SEQ ID NO: 206365 - DNA, 25 bp, Mus musculus
agtaaacgtctccaatccacagatt

SEQ ID NO: 206366 - DNA, 25 bp, Mus musculus
agtaaacgtctcgaatccacagatt

SEQ ID NO: 206367 - DNA, 25 bp, Mus musculus
agtaaactaattcccagagagccag

SEQ ID NO: 206368 - DNA, 25 bp, Mus musculus
agtaaactaattgccagagagccag

SEQ ID NO: 206369 - DNA, 25 bp, Mus musculus
agtaaactcaggatgccagcagctt

SEQ ID NO: 206370 - DNA, 25 bp, Mus musculus
agtaaactcaggttgccagcagctt

SEQ ID NO: 206371 - DNA, 25 bp, Mus musculus
agtaaactccctcaatgtctctgcg

SEQ ID NO: 206372 - DNA, 25 bp, Mus musculus
agtaaactccctgaatgtctctgcg

SEQ ID NO: 206373 - DNA, 25 bp, Mus musculus
agtaaactctgcaggctttcaagcc

SEQ ID NO: 206374 - DNA, 25 bp, Mus musculus
agtaaactctgctggctttcaagcc

SEQ ID NO: 206375 - DNA, 25 bp, Mus musculus
agtaaactgaagcttctgagaacgt

SEQ ID NO: 206376 - DNA, 25 bp, Mus musculus
agtaaactgaaggttctgagaacgt

SEQ ID NO: 206377 - DNA, 25 bp, Mus musculus
agtaaactggcaactctgtgcctca

SEQ ID NO: 206378 - DNA, 25 bp, Mus musculus
agtaaactggcatctctgtgcctca

SEQ ID NO: 206379 - DNA, 25 bp, Mus musculus
agtaaactggcgcttcctgcctgaa

SEQ ID NO: 206380 - DNA, 25 bp, Mus musculus
agtaaactggcggttcctgcctgaa

SEQ ID NO: 206381 - DNA, 25 bp, Mus musculus
agtaaactggtgattcccttcatca

SEQ ID NO: 206382 - DNA, 25 bp, Mus musculus
agtaaactggtgtttcccttcatca

SEQ ID NO: 206383 - DNA, 25 bp, Mus musculus
agtaaactgtttccaagtcactagt

SEQ ID NO: 206384 - DNA, 25 bp, Mus musculus
agtaaactgtttgcaagtcactagt

SEQ ID NO: 206385 - DNA, 25 bp, Mus musculus
agtaaagacaggagacagctactca

SEQ ID NO: 206386 - DNA, 25 bp, Mus musculus
agtaaagacaggtgacagctactca

SEQ ID NO: 206387 - DNA, 25 bp, Mus musculus
agtaaagagccaactttttctccca

SEQ ID NO: 206388 - DNA, 25 bp, Mus musculus
agtaaagagccatctttttctccca

SEQ ID NO: 206389 - DNA, 25 bp, Mus musculus
agtaaagagcggagcgacagactga

SEQ ID NO: 206390 - DNA, 25 bp, Mus musculus
agtaaagagcggtgcgacagactga

SEQ ID NO: 206391 - DNA, 25 bp, Mus musculus
agtaaagagttcactctacccactg

SEQ ID NO: 206392 - DNA, 25 bp, Mus musculus
agtaaagagttctctctacccactg

SEQ ID NO: 206393 - DNA, 25 bp, Mus musculus
agtaaagccacaactagacaccacg

SEQ ID NO: 206394 - DNA, 25 bp, Mus musculus
agtaaagccacatctagacaccacg

SEQ ID NO: 206395 - DNA, 25 bp, Mus musculus
agtaaagcctgcatttctctgtttc

SEQ ID NO: 206396 - DNA, 25 bp, Mus musculus
agtaaagcctgcttttctctgtttc

SEQ ID NO: 206397 - DNA, 25 bp, Mus musculus
agtaaagccttcaccatgcaagagg

SEQ ID NO: 206398 - DNA, 25 bp, Mus musculus
agtaaagccttctccatgcaagagg

SEQ ID NO: 206399 - DNA, 25 bp, Mus musculus
agtaaagcttacattcccgttcctg

SEQ ID NO: 206400 - DNA, 25 bp, Mus musculus
agtaaagcttactttcccgttcctg

SEQ ID NO: 206401 - DNA, 25 bp, Mus musculus
agtaaagcttgtctaggccctgcct

SEQ ID NO: 206402 - DNA, 25 bp, Mus musculus
agtaaagcttgtgtaggccctgcct

SEQ ID NO: 206403 - DNA, 25 bp, Mus musculus
agtaaaggaaacagtgacatcatca

SEQ ID NO: 206404 - DNA, 25 bp, Mus musculus
agtaaaggaaactgtgacatcatca

SEQ ID NO: 206405 - DNA, 25 bp, Mus musculus
agtaaaggccacactgagctttgtg

SEQ ID NO: 206406 - DNA, 25 bp, Mus musculus
agtaaaggccactctgagctttgtg

SEQ ID NO: 206407 - DNA, 25 bp, Mus musculus
agtaaaggcgccatcttggttccct

SEQ ID NO: 206408 - DNA, 25 bp, Mus musculus
agtaaaggcgccttcttggttccct

SEQ ID NO: 206409 - DNA, 25 bp, Mus musculus
agtaaaggtccgagtgtgcaggtct

SEQ ID NO: 206410 - DNA, 25 bp, Mus musculus
agtaaaggtccgtgtgtgcaggtct

SEQ ID NO: 206411 - DNA, 25 bp, Mus musculus
agtaaaggtgttcacggctccctgc

SEQ ID NO: 206412 - DNA, 25 bp, Mus musculus
agtaaaggtgttgacggctccctgc

SEQ ID NO: 206413 - DNA, 25 bp, Mus musculus
agtaaagtaacaaccctcttattgt

SEQ ID NO: 206414 - DNA, 25 bp, Mus musculus
agtaaagtaacatccctcttattgt

SEQ ID NO: 206415 - DNA, 25 bp, Mus musculus
agtaaagtactccacatcctggcta

SEQ ID NO: 206416 - DNA, 25 bp, Mus musculus
agtaaagtactcgacatcctggcta

SEQ ID NO: 206417 - DNA, 25 bp, Mus musculus
agtaaagttctgcacggcgggtcta

SEQ ID NO: 206418 - DNA, 25 bp, Mus musculus
agtaaagttctggacggcgggtcta

SEQ ID NO: 206419 - DNA, 25 bp, Mus musculus
agtaaataaaccagcatcgtgccgc

SEQ ID NO: 206420 - DNA, 25 bp, Mus musculus
agtaaataaacctgcatcgtgccgc

SEQ ID NO: 206421 - DNA, 25 bp, Mus musculus
agtaaatactctagcaatccttaag

SEQ ID NO: 206422 - DNA, 25 bp, Mus musculus
agtaaatactcttgcaatccttaag

SEQ ID NO: 206423 - DNA, 25 bp, Mus musculus
agtaaatagaccagctttaagctac

SEQ ID NO: 206424 - DNA, 25 bp, Mus musculus
agtaaatagacctgctttaagctac

SEQ ID NO: 206425 - DNA, 25 bp, Mus musculus
agtaaatcacccagagcagacgctt

SEQ ID NO: 206426 - DNA, 25 bp, Mus musculus
agtaaatcaccctgagcagacgctt

SEQ ID NO: 206427 - DNA, 25 bp, Mus musculus
agtaaatccatcctccaggcgaggg

SEQ ID NO: 206428 - DNA, 25 bp, Mus musculus
agtaaatccatcgtccaggcgaggg

SEQ ID NO: 206429 - DNA, 25 bp, Mus musculus
agtaaatccgacaaagcctgcagac

SEQ ID NO: 206430 - DNA, 25 bp, Mus musculus
agtaaatccgactaagcctgcagac

SEQ ID NO: 206431 - DNA, 25 bp, Mus musculus
agtaaatcgacaagtgtggctggtg

SEQ ID NO: 206432 - DNA, 25 bp, Mus musculus
agtaaatcgacatgtgtggctggtg

SEQ ID NO: 206433 - DNA, 25 bp, Mus musculus
agtaaatcgtgcctttgctctatct

SEQ ID NO: 206434 - DNA, 25 bp, Mus musculus
agtaaatcgtgcgtttgctctatct

SEQ ID NO: 206435 - DNA, 25 bp, Mus musculus
agtaaatgccggcttaccatctcta

SEQ ID NO: 206436 - DNA, 25 bp, Mus musculus
agtaaatgccgggttaccatctcta

SEQ ID NO: 206437 - DNA, 25 bp, Mus musculus
agtaaatgggtcactgcgaaatgca

SEQ ID NO: 206438 - DNA, 25 bp, Mus musculus
agtaaatgggtctctgcgaaatgca

SEQ ID NO: 206439 - DNA, 25 bp, Mus musculus
agtaaatgtataaacctccataagg

SEQ ID NO: 206440 - DNA, 25 bp, Mus musculus
agtaaatgtatatacctccataagg

SEQ ID NO: 206441 - DNA, 25 bp, Mus musculus
agtaaatgtctccacttcctatatt

SEQ ID NO: 206442 - DNA, 25 bp, Mus musculus
agtaaatgtctcgacttcctatatt

SEQ ID NO: 206443 - DNA, 25 bp, Mus musculus
agtaaatgtgctcgcgcagatcctc

SEQ ID NO: 206444 - DNA, 25 bp, Mus musculus
agtaaatgtgctggcgcagatcctc

SEQ ID NO: 206445 - DNA, 25 bp, Mus musculus
agtaaatgtttcatccggctctgaa

SEQ ID NO: 206446 - DNA, 25 bp, Mus musculus
agtaaatgtttcttccggctctgaa

SEQ ID NO: 206447 - DNA, 25 bp, Mus musculus
agtaaattcatgactaggaccaggt

SEQ ID NO: 206448 - DNA, 25 bp, Mus musculus
agtaaattcatgtctaggaccaggt

SEQ ID NO: 206449 - DNA, 25 bp, Mus musculus
agtaaattcctgagtagggcagtga

SEQ ID NO: 206450 - DNA, 25 bp, Mus musculus
agtaaattcctgtgtagggcagtga

SEQ ID NO: 206451 - DNA, 25 bp, Mus musculus
agtaaatttatgatatacggctaca

SEQ ID NO: 206452 - DNA, 25 bp, Mus musculus
agtaaatttatgttatacggctaca

SEQ ID NO: 206453 - DNA, 25 bp, Mus musculus
agtaacaaagctagttcacggacaa

SEQ ID NO: 206454 - DNA, 25 bp, Mus musculus
agtaacaaagcttgttcacggacaa

SEQ ID NO: 206455 - DNA, 25 bp, Mus musculus
agtaacaaagttagcagctgagacg

SEQ ID NO: 206456 - DNA, 25 bp, Mus musculus
agtaacaaagtttgcagctgagacg

SEQ ID NO: 206457 - DNA, 25 bp, Mus musculus
agtaacaagactcccctcacagaga

SEQ ID NO: 206458 - DNA, 25 bp, Mus musculus
agtaacaagactgccctcacagaga

SEQ ID NO: 206459 - DNA, 25 bp, Mus musculus
agtaacacatctcgaacaattctgg

SEQ ID NO: 206460 - DNA, 25 bp, Mus musculus
agtaacacatctggaacaattctgg

SEQ ID NO: 206461 - DNA, 25 bp, Mus musculus
agtaacaccctaaccaagatatatg

SEQ ID NO: 206462 - DNA, 25 bp, Mus musculus
agtaacaccctatccaagatatatg

SEQ ID NO: 206463 - DNA, 25 bp, Mus musculus
agtaacaccgggacacaggtcaggc

SEQ ID NO: 206464 - DNA, 25 bp, Mus musculus
agtaacaccgggtcacaggtcaggc

SEQ ID NO: 206465 - DNA, 25 bp, Mus musculus
agtaacactgcaagtccatatccgc

SEQ ID NO: 206466 - DNA, 25 bp, Mus musculus
agtaacactgcatgtccatatccgc

SEQ ID NO: 206467 - DNA, 25 bp, Mus musculus
agtaacagacgtcgcctactctcat

SEQ ID NO: 206468 - DNA, 25 bp, Mus musculus
agtaacagacgtggcctactctcat

SEQ ID NO: 206469 - DNA, 25 bp, Mus musculus
agtaacagctcccatttaacttttg

SEQ ID NO: 206470 - DNA, 25 bp, Mus musculus
agtaacagctccgatttaacttttg

SEQ ID NO: 206471 - DNA, 25 bp, Mus musculus
agtaacaggatcactcttcaacgtt

SEQ ID NO: 206472 - DNA, 25 bp, Mus musculus
agtaacaggatctctcttcaacgtt

SEQ ID NO: 206473 - DNA, 25 bp, Mus musculus
agtaacaggcacagggtttggctct

SEQ ID NO: 206474 - DNA, 25 bp, Mus musculus
agtaacaggcactgggtttggctct

SEQ ID NO: 206475 - DNA, 25 bp, Mus musculus
agtaacaggccccagaatcttcctt

SEQ ID NO: 206476 - DNA, 25 bp, Mus musculus
agtaacaggcccgagaatcttcctt

SEQ ID NO: 206477 - DNA, 25 bp, Mus musculus
agtaacaggtagacattttctcatt

SEQ ID NO: 206478 - DNA, 25 bp, Mus musculus
agtaacaggtagtcattttctcatt

SEQ ID NO: 206479 - DNA, 25 bp, Mus musculus
agtaacagtggaagactccggcgaa

SEQ ID NO: 206480 - DNA, 25 bp, Mus musculus
agtaacagtggatgactccggcgaa

SEQ ID NO: 206481 - DNA, 25 bp, Mus musculus
agtaacatacccattggagaaccag

SEQ ID NO: 206482 - DNA, 25 bp, Mus musculus
agtaacataccctttggagaaccag

SEQ ID NO: 206483 - DNA, 25 bp, Mus musculus
agtaacatcatcattgcccatccct

SEQ ID NO: 206484 - DNA, 25 bp, Mus musculus
agtaacatcatctttgcccatccct

SEQ ID NO: 206485 - DNA, 25 bp, Mus musculus
agtaacatgggcagctcactcaaat

SEQ ID NO: 206486 - DNA, 25 bp, Mus musculus
agtaacatgggctgctcactcaaat

SEQ ID NO: 206487 - DNA, 25 bp, Mus musculus
agtaacattggtcggtccagcggcc

SEQ ID NO: 206488 - DNA, 25 bp, Mus musculus
agtaacattggtgggtccagcggcc

SEQ ID NO: 206489 - DNA, 25 bp, Mus musculus
agtaacatttgaaccatgctgctgt

SEQ ID NO: 206490 - DNA, 25 bp, Mus musculus
agtaacatttgatccatgctgctgt

SEQ ID NO: 206491 - DNA, 25 bp, Mus musculus
agtaaccagaggctgactaaccatt

SEQ ID NO: 206492 - DNA, 25 bp, Mus musculus
agtaaccagagggtgactaaccatt

SEQ ID NO: 206493 - DNA, 25 bp, Mus musculus
agtaaccagggtcgtctcggtgcct

SEQ ID NO: 206494 - DNA, 25 bp, Mus musculus
agtaaccagggtggtctcggtgcct

SEQ ID NO: 206495 - DNA, 25 bp, Mus musculus
agtaaccatagtaggcccagccaga

SEQ ID NO: 206496 - DNA, 25 bp, Mus musculus
agtaaccatagttggcccagccaga

SEQ ID NO: 206497 - DNA, 25 bp, Mus musculus
agtaaccccagaccttggaggcaga

SEQ ID NO: 206498 - DNA, 25 bp, Mus musculus
agtaaccccagagcttggaggcaga

SEQ ID NO: 206499 - DNA, 25 bp, Mus musculus
agtaacccggccacctgattgagca

SEQ ID NO: 206500 - DNA, 25 bp, Mus musculus
agtaacccggcctcctgattgagca

SEQ ID NO: 206501 - DNA, 25 bp, Mus musculus
agtaaccctgaacctgagcatagta

SEQ ID NO: 206502 - DNA, 25 bp, Mus musculus
agtaaccctgaagctgagcatagta

SEQ ID NO: 206503 - DNA, 25 bp, Mus musculus
agtaaccctgtcacacagcatgtgg

SEQ ID NO: 206504 - DNA, 25 bp, Mus musculus
agtaaccctgtctcacagcatgtgg

SEQ ID NO: 206505 - DNA, 25 bp, Mus musculus
agtaacctgactctggactgcttca

SEQ ID NO: 206506 - DNA, 25 bp, Mus musculus
agtaacctgactgtggactgcttca

SEQ ID NO: 206507 - DNA, 25 bp, Mus musculus
agtaacctgggtcatatttgtcaaa

SEQ ID NO: 206508 - DNA, 25 bp, Mus musculus
agtaacctgggtgatatttgtcaaa

SEQ ID NO: 206509 - DNA, 25 bp, Mus musculus
agtaacctgtttcatcacccaagat

SEQ ID NO: 206510 - DNA, 25 bp, Mus musculus
agtaacctgtttgatcacccaagat

SEQ ID NO: 206511 - DNA, 25 bp, Mus musculus
agtaacgaccaaactgtgatagagc

SEQ ID NO: 206512 - DNA, 25 bp, Mus musculus
agtaacgaccaatctgtgatagagc

SEQ ID NO: 206513 - DNA, 25 bp, Mus musculus
agtaacgagcaacggcgtcatttca

SEQ ID NO: 206514 - DNA, 25 bp, Mus musculus
agtaacgagcaagggcgtcatttca

SEQ ID NO: 206515 - DNA, 25 bp, Mus musculus
agtaacgaggttcacctggatgaac

SEQ ID NO: 206516 - DNA, 25 bp, Mus musculus
agtaacgaggttgacctggatgaac

SEQ ID NO: 206517 - DNA, 25 bp, Mus musculus
agtaacgcctagaagagcacatgag

SEQ ID NO: 206518 - DNA, 25 bp, Mus musculus
agtaacgcctagtagagcacatgag

SEQ ID NO: 206519 - DNA, 25 bp, Mus musculus
agtaacggtggcattttctctctta

SEQ ID NO: 206520 - DNA, 25 bp, Mus musculus
agtaacggtggctttttctctctta

SEQ ID NO: 206521 - DNA, 25 bp, Mus musculus
agtaacgtggccacagttgctctgg

SEQ ID NO: 206522 - DNA, 25 bp, Mus musculus
agtaacgtggcctcagttgctctgg

SEQ ID NO: 206523 - DNA, 25 bp, Mus musculus
agtaacgtttatccttccatttctg

SEQ ID NO: 206524 - DNA, 25 bp, Mus musculus
agtaacgtttatgcttccatttctg

SEQ ID NO: 206525 - DNA, 25 bp, Mus musculus
agtaactactaactctagatggtac

SEQ ID NO: 206526 - DNA, 25 bp, Mus musculus
agtaactactaagtctagatggtac

SEQ ID NO: 206527 - DNA, 25 bp, Mus musculus
agtaactatggccttcacgctgtac

SEQ ID NO: 206528 - DNA, 25 bp, Mus musculus
agtaactatggcgttcacgctgtac

SEQ ID NO: 206529 - DNA, 25 bp, Mus musculus
agtaactcagctcatggactgccct

SEQ ID NO: 206530 - DNA, 25 bp, Mus musculus
agtaactcagctgatggactgccct

SEQ ID NO: 206531 - DNA, 25 bp, Mus musculus
agtaactcaggaagggcacgtgctc

SEQ ID NO: 206532 - DNA, 25 bp, Mus musculus
agtaactcaggatgggcacgtgctc

SEQ ID NO: 206533 - DNA, 25 bp, Mus musculus
agtaactcccaaccagaatctctgt

SEQ ID NO: 206534 - DNA, 25 bp, Mus musculus
agtaactcccaagcagaatctctgt

SEQ ID NO: 206535 - DNA, 25 bp, Mus musculus
agtaactccctaaggttctgacaac

SEQ ID NO: 206536 - DNA, 25 bp, Mus musculus
agtaactccctatggttctgacaac

SEQ ID NO: 206537 - DNA, 25 bp, Mus musculus
agtaactcgaagatggctgtggctc

SEQ ID NO: 206538 - DNA, 25 bp, Mus musculus
agtaactcgaagttggctgtggctc

SEQ ID NO: 206539 - DNA, 25 bp, Mus musculus
agtaactcggacactgctggactac

SEQ ID NO: 206540 - DNA, 25 bp, Mus musculus
agtaactcggactctgctggactac

SEQ ID NO: 206541 - DNA, 25 bp, Mus musculus
agtaactcggatagcattttccaaa

SEQ ID NO: 206542 - DNA, 25 bp, Mus musculus
agtaactcggattgcattttccaaa

SEQ ID NO: 206543 - DNA, 25 bp, Mus musculus
agtaactcgtgcagttcctgaggga

SEQ ID NO: 206544 - DNA, 25 bp, Mus musculus
agtaactcgtgctgttcctgaggga

SEQ ID NO: 206545 - DNA, 25 bp, Mus musculus
agtaactctctgcaagtcttagaaa

SEQ ID NO: 206546 - DNA, 25 bp, Mus musculus
agtaactctctggaagtcttagaaa

SEQ ID NO: 206547 - DNA, 25 bp, Mus musculus
agtaactgaaatactgacactcccc

SEQ ID NO: 206548 - DNA, 25 bp, Mus musculus
agtaactgaaattctgacactcccc

SEQ ID NO: 206549 - DNA, 25 bp, Mus musculus
agtaactgactccacactcgtgtgt

SEQ ID NO: 206550 - DNA, 25 bp, Mus musculus
agtaactgactcgacactcgtgtgt

SEQ ID NO: 206551 - DNA, 25 bp, Mus musculus
agtaactgcacacaggtttgcctgc

SEQ ID NO: 206552 - DNA, 25 bp, Mus musculus
agtaactgcacagaggtttgcctgc

SEQ ID NO: 206553 - DNA, 25 bp, Mus musculus
agtaactgcatcctactcctagggt

SEQ ID NO: 206554 - DNA, 25 bp, Mus musculus
agtaactgcatcgtactcctagggt

SEQ ID NO: 206555 - DNA, 25 bp, Mus musculus
agtaactgctggagaatactaaccc

SEQ ID NO: 206556 - DNA, 25 bp, Mus musculus
agtaactgctggtgaatactaaccc

SEQ ID NO: 206557 - DNA, 25 bp, Mus musculus
agtaactgcttgcacttgacggcct

SEQ ID NO: 206558 - DNA, 25 bp, Mus musculus
agtaactgcttggacttgacggcct

SEQ ID NO: 206559 - DNA, 25 bp, Mus musculus
agtaactgtaccacacaggcctggg

SEQ ID NO: 206560 - DNA, 25 bp, Mus musculus
agtaactgtacctcacaggcctggg

SEQ ID NO: 206561 - DNA, 25 bp, Mus musculus
agtaactgtcccaagattatctgtg

SEQ ID NO: 206562 - DNA, 25 bp, Mus musculus
agtaactgtccctagattatctgtg

SEQ ID NO: 206563 - DNA, 25 bp, Mus musculus
agtaacttagtgaggtcatctcaaa

SEQ ID NO: 206564 - DNA, 25 bp, Mus musculus
agtaacttagtgtggtcatctcaaa

SEQ ID NO: 206565 - DNA, 25 bp, Mus musculus
agtaacttcagtcacacccaaagtc

SEQ ID NO: 206566 - DNA, 25 bp, Mus musculus
agtaacttcagtgacacccaaagtc

SEQ ID NO: 206567 - DNA, 25 bp, Mus musculus
agtaacttccctacggtgtgtgtgt

SEQ ID NO: 206568 - DNA, 25 bp, Mus musculus
agtaacttcccttcggtgtgtgtgt

SEQ ID NO: 206569 - DNA, 25 bp, Mus musculus
agtaactttagcactgttgaaactt

SEQ ID NO: 206570 - DNA, 25 bp, Mus musculus
agtaactttagctctgttgaaactt

SEQ ID NO: 206571 - DNA, 25 bp, Mus musculus
agtaactttgagagctcccattaag

SEQ ID NO: 206572 - DNA, 25 bp, Mus musculus
agtaactttgagtgctcccattaag

SEQ ID NO: 206573 - DNA, 25 bp, Mus musculus
agtaactttgtaaggcaatgtaaat

SEQ ID NO: 206574 - DNA, 25 bp, Mus musculus
agtaactttgtatggcaatgtaaat

SEQ ID NO: 206575 - DNA, 25 bp, Mus musculus
agtaacttttctcctcgacgtatta

SEQ ID NO: 206576 - DNA, 25 bp, Mus musculus
agtaacttttctgctcgacgtatta

SEQ ID NO: 206577 - DNA, 25 bp, Mus musculus
agtaagaaatcaacttgtttctgat

SEQ ID NO: 206578 - DNA, 25 bp, Mus musculus
agtaagaaatcatcttgtttctgat

SEQ ID NO: 206579 - DNA, 25 bp, Mus musculus
agtaagaactgtcccaggagacctg

SEQ ID NO: 206580 - DNA, 25 bp, Mus musculus
agtaagaactgtgccaggagacctg

SEQ ID NO: 206581 - DNA, 25 bp, Mus musculus
agtaagaagaatctgcgtgtgtcca

SEQ ID NO: 206582 - DNA, 25 bp, Mus musculus
agtaagaagaatgtgcgtgtgtcca

SEQ ID NO: 206583 - DNA, 25 bp, Mus musculus
agtaagaagagcacctccgtccact

SEQ ID NO: 206584 - DNA, 25 bp, Mus musculus
agtaagaagagctcctccgtccact

SEQ ID NO: 206585 - DNA, 25 bp, Mus musculus
agtaagaagcctcctactgcctgac

SEQ ID NO: 206586 - DNA, 25 bp, Mus musculus
agtaagaagcctgctactgcctgac

SEQ ID NO: 206587 - DNA, 25 bp, Mus musculus
agtaagaatcaccaccggcatgcca

SEQ ID NO: 206588 - DNA, 25 bp, Mus musculus
agtaagaatcacgaccggcatgcca

SEQ ID NO: 206589 - DNA, 25 bp, Mus musculus
agtaagacaccaccgcagtgggcga

SEQ ID NO: 206590 - DNA, 25 bp, Mus musculus
agtaagacaccactacatgagcatt

SEQ ID NO: 206591 - DNA, 25 bp, Mus musculus
agtaagacaccagcgcagtgggcga

SEQ ID NO: 206592 - DNA, 25 bp, Mus musculus
agtaagacaccagtacatgagcatt

SEQ ID NO: 206593 - DNA, 25 bp, Mus musculus
agtaagactatcctcaacgtagccc

SEQ ID NO: 206594 - DNA, 25 bp, Mus musculus
agtaagactatcgtcaacgtagccc

SEQ ID NO: 206595 - DNA, 25 bp, Mus musculus
agtaagactttcaggcacttcttcc

SEQ ID NO: 206596 - DNA, 25 bp, Mus musculus
agtaagactttctggcacttcttcc

SEQ ID NO: 206597 - DNA, 25 bp, Mus musculus
agtaagagcagcattgcctggcttg

SEQ ID NO: 206598 - DNA, 25 bp, Mus musculus
agtaagagcagctttgcctggcttg

SEQ ID NO: 206599 - DNA, 25 bp, Mus musculus
agtaagagccttcttttcttgttgg

SEQ ID NO: 206600 - DNA, 25 bp, Mus musculus
agtaagagccttgttttcttgttgg

SEQ ID NO: 206601 - DNA, 25 bp, Mus musculus
agtaagagctaaacctaggcggtgg

SEQ ID NO: 206602 - DNA, 25 bp, Mus musculus
agtaagagctaatcctaggcggtgg

SEQ ID NO: 206603 - DNA, 25 bp, Mus musculus
agtaagatgtctaggcagtttagcc

SEQ ID NO: 206604 - DNA, 25 bp, Mus musculus
agtaagatgtcttggcagtttagcc

SEQ ID NO: 206605 - DNA, 25 bp, Mus musculus
agtaagatttcacgtccccattggc

SEQ ID NO: 206606 - DNA, 25 bp, Mus musculus
agtaagatttcaggtccccattggc

SEQ ID NO: 206607 - DNA, 25 bp, Mus musculus
agtaagattttaacacagctgcaca

SEQ ID NO: 206608 - DNA, 25 bp, Mus musculus
agtaagattttatcacagctgcaca

SEQ ID NO: 206609 - DNA, 25 bp, Mus musculus
agtaagcacactcggactctacatg

SEQ ID NO: 206610 - DNA, 25 bp, Mus musculus
agtaagcacactgggactctacatg

SEQ ID NO: 206611 - DNA, 25 bp, Mus musculus
agtaagcagaagagccttgccccaa

SEQ ID NO: 206612 - DNA, 25 bp, Mus musculus
agtaagcagaagtgccttgccccaa

SEQ ID NO: 206613 - DNA, 25 bp, Mus musculus
agtaagcagcttccatgtgttgcct

SEQ ID NO: 206614 - DNA, 25 bp, Mus musculus
agtaagcagcttgcatgtgttgcct

SEQ ID NO: 206615 - DNA, 25 bp, Mus musculus
agtaagcaggccatggttggctagt

SEQ ID NO: 206616 - DNA, 25 bp, Mus musculus
agtaagcaggccttggttggctagt

SEQ ID NO: 206617 - DNA, 25 bp, Mus musculus
agtaagcatgctcggaggccgtctc

SEQ ID NO: 206618 - DNA, 25 bp, Mus musculus
agtaagcatgctgggaggccgtctc

SEQ ID NO: 206619 - DNA, 25 bp, Mus musculus
agtaagccacctccaaaaggacccg

SEQ ID NO: 206620 - DNA, 25 bp, Mus musculus
agtaagccacctgcaaaaggacccg

SEQ ID NO: 206621 - DNA, 25 bp, Mus musculus
agtaagccagcccgtgcacctacga

SEQ ID NO: 206622 - DNA, 25 bp, Mus musculus
agtaagccagccggtgcacctacga

SEQ ID NO: 206623 - DNA, 25 bp, Mus musculus
agtaagccaggccagagtcccatgg

SEQ ID NO: 206624 - DNA, 25 bp, Mus musculus
agtaagccaggcgagagtcccatgg

SEQ ID NO: 206625 - DNA, 25 bp, Mus musculus
agtaagccccaacatagcctgagct

SEQ ID NO: 206626 - DNA, 25 bp, Mus musculus
agtaagccccaagatagcctgagct

SEQ ID NO: 206627 - DNA, 25 bp, Mus musculus
agtaagccgaagctgccagcttctt

SEQ ID NO: 206628 - DNA, 25 bp, Mus musculus
agtaagccgaaggtgccagcttctt

SEQ ID NO: 206629 - DNA, 25 bp, Mus musculus
agtaagcctgagaattgggaaaaca

SEQ ID NO: 206630 - DNA, 25 bp, Mus musculus
agtaagcctgagtattgggaaaaca

SEQ ID NO: 206631 - DNA, 25 bp, Mus musculus
agtaagccttagagcaagtcttggg

SEQ ID NO: 206632 - DNA, 25 bp, Mus musculus
agtaagccttagtgcaagtcttggg

SEQ ID NO: 206633 - DNA, 25 bp, Mus musculus
agtaagcctttacaactctctagtt

SEQ ID NO: 206634 - DNA, 25 bp, Mus musculus
agtaagcctttagaactctctagtt

SEQ ID NO: 206635 - DNA, 25 bp, Mus musculus
agtaagctaaggctcccgggagtct

SEQ ID NO: 206636 - DNA, 25 bp, Mus musculus
agtaagctaagggtcccgggagtct

SEQ ID NO: 206637 - DNA, 25 bp, Mus musculus
agtaagctagacattcttcaccgct

SEQ ID NO: 206638 - DNA, 25 bp, Mus musculus
agtaagctagactttcttcaccgct

SEQ ID NO: 206639 - DNA, 25 bp, Mus musculus
agtaagctgactattctgtggtgaa

SEQ ID NO: 206640 - DNA, 25 bp, Mus musculus
agtaagctgacttttctgtggtgaa

SEQ ID NO: 206641 - DNA, 25 bp, Mus musculus
agtaagctggttcttgacctttcct

SEQ ID NO: 206642 - DNA, 25 bp, Mus musculus
agtaagctggttgttgacctttcct

SEQ ID NO: 206643 - DNA, 25 bp, Mus musculus
agtaagctgtttcagatctcctcag

SEQ ID NO: 206644 - DNA, 25 bp, Mus musculus
agtaagctgtttgagatctcctcag

SEQ ID NO: 206645 - DNA, 25 bp, Mus musculus
agtaagcttacactgtggatgacct

SEQ ID NO: 206646 - DNA, 25 bp, Mus musculus
agtaagcttacagtgtggatgacct

SEQ ID NO: 206647 - DNA, 25 bp, Mus musculus
agtaagcttggtatctgccgctgca

SEQ ID NO: 206648 - DNA, 25 bp, Mus musculus
agtaagcttggtttctgccgctgca

SEQ ID NO: 206649 - DNA, 25 bp, Mus musculus
agtaaggaccggctcaggcactgac

SEQ ID NO: 206650 - DNA, 25 bp, Mus musculus
agtaaggaccgggtcaggcactgac

SEQ ID NO: 206651 - DNA, 25 bp, Mus musculus
agtaaggacctcagcgttcgcgagt

SEQ ID NO: 206652 - DNA, 25 bp, Mus musculus
agtaaggacctctgcgttcgcgagt

SEQ ID NO: 206653 - DNA, 25 bp, Mus musculus
agtaaggactgaagggttgttccca

SEQ ID NO: 206654 - DNA, 25 bp, Mus musculus
agtaaggactgatgggttgttccca

SEQ ID NO: 206655 - DNA, 25 bp, Mus musculus
agtaaggagcggcaggtccacttca

SEQ ID NO: 206656 - DNA, 25 bp, Mus musculus
agtaaggagcgggaggtccacttca

SEQ ID NO: 206657 - DNA, 25 bp, Mus musculus
agtaaggattggattcagtagcaca

SEQ ID NO: 206658 - DNA, 25 bp, Mus musculus
agtaaggattggtttcagtagcaca

SEQ ID NO: 206659 - DNA, 25 bp, Mus musculus
agtaaggcatcgattccggatcaac

SEQ ID NO: 206660 - DNA, 25 bp, Mus musculus
agtaaggcatcgtttccggatcaac

SEQ ID NO: 206661 - DNA, 25 bp, Mus musculus
agtaaggccataatctgttttgatt

SEQ ID NO: 206662 - DNA, 25 bp, Mus musculus
agtaaggccatattctgttttgatt

SEQ ID NO: 206663 - DNA, 25 bp, Mus musculus
agtaaggcccacctatgcggattgg

SEQ ID NO: 206664 - DNA, 25 bp, Mus musculus
agtaaggcccacgtatgcggattgg

SEQ ID NO: 206665 - DNA, 25 bp, Mus musculus
agtaaggcctcgagactgtggtcac

SEQ ID NO: 206666 - DNA, 25 bp, Mus musculus
agtaaggcctcgtgactgtggtcac

SEQ ID NO: 206667 - DNA, 25 bp, Mus musculus
agtaaggcctctatacactctgact

SEQ ID NO: 206668 - DNA, 25 bp, Mus musculus
agtaaggcctctttacactctgact

SEQ ID NO: 206669 - DNA, 25 bp, Mus musculus
agtaaggcctgcatgcacctgagga

SEQ ID NO: 206670 - DNA, 25 bp, Mus musculus
agtaaggcctgcttgcacctgagga

SEQ ID NO: 206671 - DNA, 25 bp, Mus musculus
agtaaggctgagatccttcattcat

SEQ ID NO: 206672 - DNA, 25 bp, Mus musculus
agtaaggctgagttccttcattcat

SEQ ID NO: 206673 - DNA, 25 bp, Mus musculus
agtaagggagctccatccatctcca

SEQ ID NO: 206674 - DNA, 25 bp, Mus musculus
agtaagggagctgcatccatctcca

SEQ ID NO: 206675 - DNA, 25 bp, Mus musculus
agtaagggaggcacccagctgtgca

SEQ ID NO: 206676 - DNA, 25 bp, Mus musculus
agtaagggaggctcccagctgtgca

SEQ ID NO: 206677 - DNA, 25 bp, Mus musculus
agtaagggcatactttgaacccaag

SEQ ID NO: 206678 - DNA, 25 bp, Mus musculus
agtaagggcatagtttgaacccaag

SEQ ID NO: 206679 - DNA, 25 bp, Mus musculus
agtaagggccttcacaaactgctcc

SEQ ID NO: 206680 - DNA, 25 bp, Mus musculus
agtaagggccttgacaaactgctcc

SEQ ID NO: 206681 - DNA, 25 bp, Mus musculus
agtaagggtcggactgtggtcatat

SEQ ID NO: 206682 - DNA, 25 bp, Mus musculus
agtaagggtcggtctgtggtcatat

SEQ ID NO: 206683 - DNA, 25 bp, Mus musculus
agtaaggtatttatgttggtcccag

SEQ ID NO: 206684 - DNA, 25 bp, Mus musculus
agtaaggtatttttgttggtcccag

SEQ ID NO: 206685 - DNA, 25 bp, Mus musculus
agtaaggtcagtatggttcgtctct

SEQ ID NO: 206686 - DNA, 25 bp, Mus musculus
agtaaggtcagtttggttcgtctct

SEQ ID NO: 206687 - DNA, 25 bp, Mus musculus
agtaaggtgcctagtggcttctcac

SEQ ID NO: 206688 - DNA, 25 bp, Mus musculus
agtaaggtgccttgtggcttctcac

SEQ ID NO: 206689 - DNA, 25 bp, Mus musculus
agtaaggtgtgcaaatgagggcctg

SEQ ID NO: 206690 - DNA, 25 bp, Mus musculus
agtaaggtgtgctaatgagggcctg

SEQ ID NO: 206691 - DNA, 25 bp, Mus musculus
agtaaggtgtgtactctgacgtcag

SEQ ID NO: 206692 - DNA, 25 bp, Mus musculus
agtaaggtgtgttctctgacgtcag

SEQ ID NO: 206693 - DNA, 25 bp, Mus musculus
agtaaggttgctatgtgcacccaca

SEQ ID NO: 206694 - DNA, 25 bp, Mus musculus
agtaaggttgctttgtgcacccaca

SEQ ID NO: 206695 - DNA, 25 bp, Mus musculus
agtaagtaaactcttctgaaggatt

SEQ ID NO: 206696 - DNA, 25 bp, Mus musculus
agtaagtaaactgttctgaaggatt

SEQ ID NO: 206697 - DNA, 25 bp, Mus musculus
agtaagtactccctgcccaagtggg

SEQ ID NO: 206698 - DNA, 25 bp, Mus musculus
agtaagtactccgtgcccaagtggg

SEQ ID NO: 206699 - DNA, 25 bp, Mus musculus
agtaagtatagcctgcccactgtga

SEQ ID NO: 206700 - DNA, 25 bp, Mus musculus
agtaagtatagcgtgcccactgtga

SEQ ID NO: 206701 - DNA, 25 bp, Mus musculus
agtaagtcacatatccccatgcgtt

SEQ ID NO: 206702 - DNA, 25 bp, Mus musculus
agtaagtcacatttccccatgcgtt

SEQ ID NO: 206703 - DNA, 25 bp, Mus musculus
agtaagtccataccagcttggcctt

SEQ ID NO: 206704 - DNA, 25 bp, Mus musculus
agtaagtccatagcagcttggcctt

SEQ ID NO: 206705 - DNA, 25 bp, Mus musculus
agtaagtcctctcccagtgccaaga

SEQ ID NO: 206706 - DNA, 25 bp, Mus musculus
agtaagtcctctgccagtgccaaga

SEQ ID NO: 206707 - DNA, 25 bp, Mus musculus
agtaagtcctttatgtccctgtgag

SEQ ID NO: 206708 - DNA, 25 bp, Mus musculus
agtaagtcctttttgtccctgtgag

SEQ ID NO: 206709 - DNA, 25 bp, Mus musculus
agtaagtctttgagcctgagtgagc

SEQ ID NO: 206710 - DNA, 25 bp, Mus musculus
agtaagtctttgtgcctgagtgagc

SEQ ID NO: 206711 - DNA, 25 bp, Mus musculus
agtaagtgcagacggcctgatctct

SEQ ID NO: 206712 - DNA, 25 bp, Mus musculus
agtaagtgcagagggcctgatctct

SEQ ID NO: 206713 - DNA, 25 bp, Mus musculus
agtaagtgctttccctgctgtggga

SEQ ID NO: 206714 - DNA, 25 bp, Mus musculus
agtaagtgctttgcctgctgtggga

SEQ ID NO: 206715 - DNA, 25 bp, Mus musculus
agtaagtggcttactgggctctggc

SEQ ID NO: 206716 - DNA, 25 bp, Mus musculus
agtaagtggctttctgggctctggc

SEQ ID NO: 206717 - DNA, 25 bp, Mus musculus
agtaagtgtgccaatgctatacaag

SEQ ID NO: 206718 - DNA, 25 bp, Mus musculus
agtaagtgtgcctatgctatacaag

SEQ ID NO: 206719 - DNA, 25 bp, Mus musculus
agtaagtgtggcagcactcccagga

SEQ ID NO: 206720 - DNA, 25 bp, Mus musculus
agtaagtgtggctgcactcccagga

SEQ ID NO: 206721 - DNA, 25 bp, Mus musculus
agtaagtgtgtcacagtgctcagct

SEQ ID NO: 206722 - DNA, 25 bp, Mus musculus
agtaagtgtgtctcagtgctcagct

SEQ ID NO: 206723 - DNA, 25 bp, Mus musculus
agtaagttactgcatgcgggtccct

SEQ ID NO: 206724 - DNA, 25 bp, Mus musculus
agtaagttactggatgcgggtccct

SEQ ID NO: 206725 - DNA, 25 bp, Mus musculus
agtaagttagacactggagccattt

SEQ ID NO: 206726 - DNA, 25 bp, Mus musculus
agtaagttagactctggagccattt

SEQ ID NO: 206727 - DNA, 25 bp, Mus musculus
agtaagttcatcactatctgccgtg

SEQ ID NO: 206728 - DNA, 25 bp, Mus musculus
agtaagttcatctctatctgccgtg

SEQ ID NO: 206729 - DNA, 25 bp, Mus musculus
agtaataaacttctctctctcccaa

SEQ ID NO: 206730 - DNA, 25 bp, Mus musculus
agtaataaacttgtctctctcccaa

SEQ ID NO: 206731 - DNA, 25 bp, Mus musculus
agtaataaatctctcctgcatggta

SEQ ID NO: 206732 - DNA, 25 bp, Mus musculus
agtaataaatctgtcctgcatggta

SEQ ID NO: 206733 - DNA, 25 bp, Mus musculus
agtaataactgcattccttttccca

SEQ ID NO: 206734 - DNA, 25 bp, Mus musculus
agtaataactgctttccttttccca

SEQ ID NO: 206735 - DNA, 25 bp, Mus musculus
agtaatactcaaattccatcctcct

SEQ ID NO: 206736 - DNA, 25 bp, Mus musculus
agtaatactcaatttccatcctcct

SEQ ID NO: 206737 - DNA, 25 bp, Mus musculus
agtaatagattgaacattcagtgtg

SEQ ID NO: 206738 - DNA, 25 bp, Mus musculus
agtaatagattgtacattcagtgtg

SEQ ID NO: 206739 - DNA, 25 bp, Mus musculus
agtaatagctatatgggaccagaca

SEQ ID NO: 206740 - DNA, 25 bp, Mus musculus
agtaatagctatttgggaccagaca

SEQ ID NO: 206741 - DNA, 25 bp, Mus musculus
agtaatatatgcagacttctgcaag

SEQ ID NO: 206742 - DNA, 25 bp, Mus musculus
agtaatatatgctgacttctgcaag

SEQ ID NO: 206743 - DNA, 25 bp, Mus musculus
agtaatatccagacacagatggccc

SEQ ID NO: 206744 - DNA, 25 bp, Mus musculus
agtaatatccagtcacagatggccc

SEQ ID NO: 206745 - DNA, 25 bp, Mus musculus
agtaatatctataatcagtgtttct

SEQ ID NO: 206746 - DNA, 25 bp, Mus musculus
agtaatatctattatcagtgtttct

SEQ ID NO: 206747 - DNA, 25 bp, Mus musculus
agtaatatctgtctggctggctaca

SEQ ID NO: 206748 - DNA, 25 bp, Mus musculus
agtaatatctgtgtggctggctaca

SEQ ID NO: 206749 - DNA, 25 bp, Mus musculus
agtaatatgattccccacctcaacc

SEQ ID NO: 206750 - DNA, 25 bp, Mus musculus
agtaatatgattgcccacctcaacc

SEQ ID NO: 206751 - DNA, 25 bp, Mus musculus
agtaatatgtgcactgtgaccaccc

SEQ ID NO: 206752 - DNA, 25 bp, Mus musculus
agtaatatgtgctctgtgaccaccc

SEQ ID NO: 206753 - DNA, 25 bp, Mus musculus
agtaatattgtccagagccatgcct

SEQ ID NO: 206754 - DNA, 25 bp, Mus musculus
agtaatattgtcgagagccatgcct

SEQ ID NO: 206755 - DNA, 25 bp, Mus musculus
agtaatcaaacacccttcatctcct

SEQ ID NO: 206756 - DNA, 25 bp, Mus musculus
agtaatcaaacagccttcatctcct

SEQ ID NO: 206757 - DNA, 25 bp, Mus musculus
agtaatcattagaagactgttgcct

SEQ ID NO: 206758 - DNA, 25 bp, Mus musculus
agtaatcattagtagactgttgcct

SEQ ID NO: 206759 - DNA, 25 bp, Mus musculus
agtaatcccaataccattatcctcg

SEQ ID NO: 206760 - DNA, 25 bp, Mus musculus
agtaatcccaattccattatcctcg

SEQ ID NO: 206761 - DNA, 25 bp, Mus musculus
agtaatcctgacactctcatgaaga

SEQ ID NO: 206762 - DNA, 25 bp, Mus musculus
agtaatcctgactctctcatgaaga

SEQ ID NO: 206763 - DNA, 25 bp, Mus musculus
agtaatcctgagaaccctcagcaaa

SEQ ID NO: 206764 - DNA, 25 bp, Mus musculus
agtaatcctgagtaccctcagcaaa

SEQ ID NO: 206765 - DNA, 25 bp, Mus musculus
agtaatcgagcaatcgagctgcgtt

SEQ ID NO: 206766 - DNA, 25 bp, Mus musculus
agtaatcgagcattcgagctgcgtt

SEQ ID NO: 206767 - DNA, 25 bp, Mus musculus
agtaatctagccatcctaacagcag

SEQ ID NO: 206768 - DNA, 25 bp, Mus musculus
agtaatctagccttcctaacagcag

SEQ ID NO: 206769 - DNA, 25 bp, Mus musculus
agtaatctaggaaagtccccagaat

SEQ ID NO: 206770 - DNA, 25 bp, Mus musculus
agtaatctaggatagtccccagaat

SEQ ID NO: 206771 - DNA, 25 bp, Mus musculus
agtaatctgcatactcctttgcact

SEQ ID NO: 206772 - DNA, 25 bp, Mus musculus
agtaatctgcattctcctttgcact

SEQ ID NO: 206773 - DNA, 25 bp, Mus musculus
agtaatctgcttatatgctttgtat

SEQ ID NO: 206774 - DNA, 25 bp, Mus musculus
agtaatctgcttttatgctttgtat

SEQ ID NO: 206775 - DNA, 25 bp, Mus musculus
agtaatctggcgactttctgtaaaa

SEQ ID NO: 206776 - DNA, 25 bp, Mus musculus
agtaatctggcgtctttctgtaaaa

SEQ ID NO: 206777 - DNA, 25 bp, Mus musculus
agtaatcttgctactgcataaatgt

SEQ ID NO: 206778 - DNA, 25 bp, Mus musculus
agtaatcttgcttctgcataaatgt

SEQ ID NO: 206779 - DNA, 25 bp, Mus musculus
agtaatcttggcagaccctaggagc

SEQ ID NO: 206780 - DNA, 25 bp, Mus musculus
agtaatcttggctgaccctaggagc

SEQ ID NO: 206781 - DNA, 25 bp, Mus musculus
agtaatgaacatcactgccttccag

SEQ ID NO: 206782 - DNA, 25 bp, Mus musculus
agtaatgaacatgactgccttccag

SEQ ID NO: 206783 - DNA, 25 bp, Mus musculus
agtaatgaatttccccgagactata

SEQ ID NO: 206784 - DNA, 25 bp, Mus musculus
agtaatgaatttgcccgagactata

SEQ ID NO: 206785 - DNA, 25 bp, Mus musculus
agtaatgcacagcagcagccgagct

SEQ ID NO: 206786 - DNA, 25 bp, Mus musculus
agtaatgcacaggagcagccgagct

SEQ ID NO: 206787 - DNA, 25 bp, Mus musculus
agtaatgccagacgcatggatgcac

SEQ ID NO: 206788 - DNA, 25 bp, Mus musculus
agtaatgccagaggcatggatgcac

SEQ ID NO: 206789 - DNA, 25 bp, Mus musculus
agtaatgctgatactccatagtgag

SEQ ID NO: 206790 - DNA, 25 bp, Mus musculus
agtaatgctgattctccatagtgag

SEQ ID NO: 206791 - DNA, 25 bp, Mus musculus
agtaatgcttagatcgagacctgcg

SEQ ID NO: 206792 - DNA, 25 bp, Mus musculus
agtaatgcttagttcgagacctgcg

SEQ ID NO: 206793 - DNA, 25 bp, Mus musculus
agtaatggcccacttctggatatct

SEQ ID NO: 206794 - DNA, 25 bp, Mus musculus
agtaatggcccagttctggatatct

SEQ ID NO: 206795 - DNA, 25 bp, Mus musculus
agtaatggccttacactgctgaacg

SEQ ID NO: 206796 - DNA, 25 bp, Mus musculus
agtaatggcctttcactgctgaacg

SEQ ID NO: 206797 - DNA, 25 bp, Mus musculus
agtaatggctgtacgccctggatga

SEQ ID NO: 206798 - DNA, 25 bp, Mus musculus
agtaatggctgttcgccctggatga

SEQ ID NO: 206799 - DNA, 25 bp, Mus musculus
agtaatgggttcacctatggcctgt

SEQ ID NO: 206800 - DNA, 25 bp, Mus musculus
agtaatgggttctcctatggcctgt

SEQ ID NO: 206801 - DNA, 25 bp, Mus musculus
agtaatgtattcacgctttctctct

SEQ ID NO: 206802 - DNA, 25 bp, Mus musculus
agtaatgtattctcgctttctctct

SEQ ID NO: 206803 - DNA, 25 bp, Mus musculus
agtaatgtcacaactagtttggatt

SEQ ID NO: 206804 - DNA, 25 bp, Mus musculus
agtaatgtcacatctagtttggatt

SEQ ID NO: 206805 - DNA, 25 bp, Mus musculus
agtaatgtcttcagccgaggtctgg

SEQ ID NO: 206806 - DNA, 25 bp, Mus musculus
agtaatgtcttctgccgaggtctgg

SEQ ID NO: 206807 - DNA, 25 bp, Mus musculus
agtaatgtgcccagccagtaactac

SEQ ID NO: 206808 - DNA, 25 bp, Mus musculus
agtaatgtgccctgccagtaactac

SEQ ID NO: 206809 - DNA, 25 bp, Mus musculus
agtaatgttcacaactcgactctgt

SEQ ID NO: 206810 - DNA, 25 bp, Mus musculus
agtaatgttcactactcgactctgt

SEQ ID NO: 206811 - DNA, 25 bp, Mus musculus
agtaatgttcgcacatgacaccctt

SEQ ID NO: 206812 - DNA, 25 bp, Mus musculus
agtaatgttcgctcatgacaccctt

SEQ ID NO: 206813 - DNA, 25 bp, Mus musculus
agtaatgtttgtcatgcctcccata

SEQ ID NO: 206814 - DNA, 25 bp, Mus musculus
agtaatgtttgtgatgcctcccata

SEQ ID NO: 206815 - DNA, 25 bp, Mus musculus
agtaatgttttgacgccctgtggta

SEQ ID NO: 206816 - DNA, 25 bp, Mus musculus
agtaatgttttgtcgccctgtggta

SEQ ID NO: 206817 - DNA, 25 bp, Mus musculus
agtaattatgaaacctccctttggg

SEQ ID NO: 206818 - DNA, 25 bp, Mus musculus
agtaattatgaatcctccctttggg

SEQ ID NO: 206819 - DNA, 25 bp, Mus musculus
agtaattatggtccacttttttcgc

SEQ ID NO: 206820 - DNA, 25 bp, Mus musculus
agtaattatggtgcacttttttcgc

SEQ ID NO: 206821 - DNA, 25 bp, Mus musculus
agtaattcacagcaatccctgctca

SEQ ID NO: 206822 - DNA, 25 bp, Mus musculus
agtaattcacaggaatccctgctca

SEQ ID NO: 206823 - DNA, 25 bp, Mus musculus
agtaattcatcactaggttttcctt

SEQ ID NO: 206824 - DNA, 25 bp, Mus musculus
agtaattcatcagtaggttttcctt

SEQ ID NO: 206825 - DNA, 25 bp, Mus musculus
agtaattcattaccgcctttttcct

SEQ ID NO: 206826 - DNA, 25 bp, Mus musculus
agtaattcattagcgcctttttcct

SEQ ID NO: 206827 - DNA, 25 bp, Mus musculus
agtaattccacgaaggcctggactt

SEQ ID NO: 206828 - DNA, 25 bp, Mus musculus
agtaattccacgtaggcctggactt

SEQ ID NO: 206829 - DNA, 25 bp, Mus musculus
agtaattccactcccttatttatta

SEQ ID NO: 206830 - DNA, 25 bp, Mus musculus
agtaattccactgccttatttatta

SEQ ID NO: 206831 - DNA, 25 bp, Mus musculus
agtaattccgaaccacaggcccaat

SEQ ID NO: 206832 - DNA, 25 bp, Mus musculus
agtaattccgaagcacaggcccaat

SEQ ID NO: 206833 - DNA, 25 bp, Mus musculus
agtaattcctcactgttttaacact

SEQ ID NO: 206834 - DNA, 25 bp, Mus musculus
agtaattcctcagtgttttaacact

SEQ ID NO: 206835 - DNA, 25 bp, Mus musculus
agtaattcctgcctgaacccctttg

SEQ ID NO: 206836 - DNA, 25 bp, Mus musculus
agtaattcctgcgtgaacccctttg

SEQ ID NO: 206837 - DNA, 25 bp, Mus musculus
agtaattcgttgcttcttattccca

SEQ ID NO: 206838 - DNA, 25 bp, Mus musculus
agtaattcgttggttcttattccca

SEQ ID NO: 206839 - DNA, 25 bp, Mus musculus
agtaattctagtcacgggcgaccct

SEQ ID NO: 206840 - DNA, 25 bp, Mus musculus
agtaattctagtgacgggcgaccct

SEQ ID NO: 206841 - DNA, 25 bp, Mus musculus
agtaattctctgacaacttgtacaa

SEQ ID NO: 206842 - DNA, 25 bp, Mus musculus
agtaattctctgtcaacttgtacaa

SEQ ID NO: 206843 - DNA, 25 bp, Mus musculus
agtaattctgctcttggtcatgtga

SEQ ID NO: 206844 - DNA, 25 bp, Mus musculus
agtaattctgctgttggtcatgtga

SEQ ID NO: 206845 - DNA, 25 bp, Mus musculus
agtaattgaacacctacctccttca

SEQ ID NO: 206846 - DNA, 25 bp, Mus musculus
agtaattgaacagctacctccttca

SEQ ID NO: 206847 - DNA, 25 bp, Mus musculus
agtaattgcgtaccgcttaacccag

SEQ ID NO: 206848 - DNA, 25 bp, Mus musculus
agtaattgcgtagcgcttaacccag

SEQ ID NO: 206849 - DNA, 25 bp, Mus musculus
agtaattggctcaagactctcattg

SEQ ID NO: 206850 - DNA, 25 bp, Mus musculus
agtaattggctctagactctcattg

SEQ ID NO: 206851 - DNA, 25 bp, Mus musculus
agtaattgtactcgcttgttgtgtg

SEQ ID NO: 206852 - DNA, 25 bp, Mus musculus
agtaattgtactggcttgttgtgtg

SEQ ID NO: 206853 - DNA, 25 bp, Mus musculus
agtaatttacctctaaacacagatc

SEQ ID NO: 206854 - DNA, 25 bp, Mus musculus
agtaatttacctgtaaacacagatc

SEQ ID NO: 206855 - DNA, 25 bp, Mus musculus
agtaatttctacaaattgtcctctg

SEQ ID NO: 206856 - DNA, 25 bp, Mus musculus
agtaatttctactaattgtcctctg

SEQ ID NO: 206857 - DNA, 25 bp, Mus musculus
agtaattttctcaacagcctgtggg

SEQ ID NO: 206858 - DNA, 25 bp, Mus musculus
agtaattttctctacagcctgtggg

SEQ ID NO: 206859 - DNA, 25 bp, Mus musculus
agtaattttgtaactgctggcatac

SEQ ID NO: 206860 - DNA, 25 bp, Mus musculus
agtaattttgtatctgctggcatac

SEQ ID NO: 206861 - DNA, 25 bp, Mus musculus
agtacaaagtcaacctctacagtgt

SEQ ID NO: 206862 - DNA, 25 bp, Mus musculus
agtacaaagtcatcctctacagtgt

SEQ ID NO: 206863 - DNA, 25 bp, Mus musculus
agtacaaatatcctcccttcaacat

SEQ ID NO: 206864 - DNA, 25 bp, Mus musculus
agtacaaatatcgtcccttcaacat

SEQ ID NO: 206865 - DNA, 25 bp, Mus musculus
agtacaaatcatacgtgaagcagat

SEQ ID NO: 206866 - DNA, 25 bp, Mus musculus
agtacaaatcattcgtgaagcagat

SEQ ID NO: 206867 - DNA, 25 bp, Mus musculus
agtacaaattctctggtatgctctt

SEQ ID NO: 206868 - DNA, 25 bp, Mus musculus
agtacaaattctgtggtatgctctt

SEQ ID NO: 206869 - DNA, 25 bp, Mus musculus
agtacaacagcacccctcactttgg

SEQ ID NO: 206870 - DNA, 25 bp, Mus musculus
agtacaacagcagccctcactttgg

SEQ ID NO: 206871 - DNA, 25 bp, Mus musculus
agtacaacccttcggagcatgctgc

SEQ ID NO: 206872 - DNA, 25 bp, Mus musculus
agtacaacccttgggagcatgctgc

SEQ ID NO: 206873 - DNA, 25 bp, Mus musculus
agtacaaccgcgaatgcaagctcct

SEQ ID NO: 206874 - DNA, 25 bp, Mus musculus
agtacaaccgcgtatgcaagctcct

SEQ ID NO: 206875 - DNA, 25 bp, Mus musculus
agtacaacgatgactcacggaccct

SEQ ID NO: 206876 - DNA, 25 bp, Mus musculus
agtacaacgatgtctcacggaccct

SEQ ID NO: 206877 - DNA, 25 bp, Mus musculus
agtacaacgcagaacccttggttgg

SEQ ID NO: 206878 - DNA, 25 bp, Mus musculus
agtacaacgcagtacccttggttgg

SEQ ID NO: 206879 - DNA, 25 bp, Mus musculus
agtacaactgtgaattctaggtgag

SEQ ID NO: 206880 - DNA, 25 bp, Mus musculus
agtacaactgtgtattctaggtgag

SEQ ID NO: 206881 - DNA, 25 bp, Mus musculus
agtacaacttcacgtgcgatcgctg

SEQ ID NO: 206882 - DNA, 25 bp, Mus musculus
agtacaacttcaggtgcgatcgctg

SEQ ID NO: 206883 - DNA, 25 bp, Mus musculus
agtacaacttgtcgagtatgaggcc

SEQ ID NO: 206884 - DNA, 25 bp, Mus musculus
agtacaacttgtggagtatgaggcc

SEQ ID NO: 206885 - DNA, 25 bp, Mus musculus
agtacaagaactatctggcctcagc

SEQ ID NO: 206886 - DNA, 25 bp, Mus musculus
agtacaagaactttctggcctcagc

SEQ ID NO: 206887 - DNA, 25 bp, Mus musculus
agtacaagctgtcatggcggcccga

SEQ ID NO: 206888 - DNA, 25 bp, Mus musculus
agtacaagctgtgatggcggcccga

SEQ ID NO: 206889 - DNA, 25 bp, Mus musculus
agtacaaggcgcatcacccgaaggt

SEQ ID NO: 206890 - DNA, 25 bp, Mus musculus
agtacaaggcgcttcacccgaaggt

SEQ ID NO: 206891 - DNA, 25 bp, Mus musculus
agtacaagtggcagttgtgtgtcca

SEQ ID NO: 206892 - DNA, 25 bp, Mus musculus
agtacaagtggctgttgtgtgtcca

SEQ ID NO: 206893 - DNA, 25 bp, Mus musculus
agtacaataaataaaagctggccat

SEQ ID NO: 206894 - DNA, 25 bp, Mus musculus
agtacaataaattaaagctggccat

SEQ ID NO: 206895 - DNA, 25 bp, Mus musculus
agtacaatccgcagaagctccaaga

SEQ ID NO: 206896 - DNA, 25 bp, Mus musculus
agtacaatccgctgaagctccaaga

SEQ ID NO: 206897 - DNA, 25 bp, Mus musculus
agtacaatctggactaaccgtgcct

SEQ ID NO: 206898 - DNA, 25 bp, Mus musculus
agtacaatctggtctaaccgtgcct

SEQ ID NO: 206899 - DNA, 25 bp, Mus musculus
agtacaatgggaacatccaggtacc

SEQ ID NO: 206900 - DNA, 25 bp, Mus musculus
agtacaatgggatcatccaggtacc

SEQ ID NO: 206901 - DNA, 25 bp, Mus musculus
agtacaattgttaagcacccgaggg

SEQ ID NO: 206902 - DNA, 25 bp, Mus musculus
agtacaattgtttagcacccgaggg

SEQ ID NO: 206903 - DNA, 25 bp, Mus musculus
agtacacaaagtcactagcaagaat

SEQ ID NO: 206904 - DNA, 25 bp, Mus musculus
agtacacaaagtgactagcaagaat

SEQ ID NO: 206905 - DNA, 25 bp, Mus musculus
agtacacacaaaacaggctggcctt

SEQ ID NO: 206906 - DNA, 25 bp, Mus musculus
agtacacacaaatcaggctggcctt

SEQ ID NO: 206907 - DNA, 25 bp, Mus musculus
agtacacacacaaccagcttttctt

SEQ ID NO: 206908 - DNA, 25 bp, Mus musculus
agtacacacacatccagcttttctt

SEQ ID NO: 206909 - DNA, 25 bp, Mus musculus
agtacacacagtatggccacaacca

SEQ ID NO: 206910 - DNA, 25 bp, Mus musculus
agtacacacagtttggccacaacca

SEQ ID NO: 206911 - DNA, 25 bp, Mus musculus
agtacacactcacaccacacatatt

SEQ ID NO: 206912 - DNA, 25 bp, Mus musculus
agtacacactcagaccacacatatt

SEQ ID NO: 206913 - DNA, 25 bp, Mus musculus
agtacacactgaagccagcgtctgc

SEQ ID NO: 206914 - DNA, 25 bp, Mus musculus
agtacacactgatgccagcgtctgc

SEQ ID NO: 206915 - DNA, 25 bp, Mus musculus
agtacacagacaatcactcctcttt

SEQ ID NO: 206916 - DNA, 25 bp, Mus musculus
agtacacagacattcactcctcttt

SEQ ID NO: 206917 - DNA, 25 bp, Mus musculus
agtacacaggctagagtgtgagctt

SEQ ID NO: 206918 - DNA, 25 bp, Mus musculus
agtacacaggcttgagtgtgagctt

SEQ ID NO: 206919 - DNA, 25 bp, Mus musculus
agtacaccaaacagaatgctgttgt

SEQ ID NO: 206920 - DNA, 25 bp, Mus musculus
agtacaccaaactgaatgctgttgt

SEQ ID NO: 206921 - DNA, 25 bp, Mus musculus
agtacaccagacctcagaactgtta

SEQ ID NO: 206922 - DNA, 25 bp, Mus musculus
agtacaccagacgtcagaactgtta

SEQ ID NO: 206923 - DNA, 25 bp, Mus musculus
agtacaccatgaccttcgtgcccat

SEQ ID NO: 206924 - DNA, 25 bp, Mus musculus
agtacaccatgagcttcgtgcccat

SEQ ID NO: 206925 - DNA, 25 bp, Mus musculus
agtacaccattgactcttggagaat

SEQ ID NO: 206926 - DNA, 25 bp, Mus musculus
agtacaccattgtctcttggagaat

SEQ ID NO: 206927 - DNA, 25 bp, Mus musculus
agtacaccccaaccaatgagtcagg

SEQ ID NO: 206928 - DNA, 25 bp, Mus musculus
agtacaccccaagcaatgagtcagg

SEQ ID NO: 206929 - DNA, 25 bp, Mus musculus
agtacaccctctaggtaggactgct

SEQ ID NO: 206930 - DNA, 25 bp, Mus musculus
agtacaccctcttggtaggactgct

SEQ ID NO: 206931 - DNA, 25 bp, Mus musculus
agtacaccggcaatctctgctgctg

SEQ ID NO: 206932 - DNA, 25 bp, Mus musculus
agtacaccggcattctctgctgctg

SEQ ID NO: 206933 - DNA, 25 bp, Mus musculus
agtacaccgtctaagtgccatttgt

SEQ ID NO: 206934 - DNA, 25 bp, Mus musculus
agtacaccgtcttagtgccatttgt

SEQ ID NO: 206935 - DNA, 25 bp, Mus musculus
agtacacctacgaacgtaccttcag

SEQ ID NO: 206936 - DNA, 25 bp, Mus musculus
agtacacctacgtacgtaccttcag

SEQ ID NO: 206937 - DNA, 25 bp, Mus musculus
agtacacgatgcagcactcacagtt

SEQ ID NO: 206938 - DNA, 25 bp, Mus musculus
agtacacgatgctgcactcacagtt

SEQ ID NO: 206939 - DNA, 25 bp, Mus musculus
agtacacgcctgacattttgggcag

SEQ ID NO: 206940 - DNA, 25 bp, Mus musculus
agtacacgcctgtcattttgggcag

SEQ ID NO: 206941 - DNA, 25 bp, Mus musculus
agtacacggagcaggcggaggccga

SEQ ID NO: 206942 - DNA, 25 bp, Mus musculus
agtacacggagctggcggaggccga

SEQ ID NO: 206943 - DNA, 25 bp, Mus musculus
agtacacgtgagcagtgatccatgt

SEQ ID NO: 206944 - DNA, 25 bp, Mus musculus
agtacacgtgaggagtgatccatgt

SEQ ID NO: 206945 - DNA, 25 bp, Mus musculus
agtacacgtgggatccggacacgct

SEQ ID NO: 206946 - DNA, 25 bp, Mus musculus
agtacacgtgggttccggacacgct

SEQ ID NO: 206947 - DNA, 25 bp, Mus musculus
agtacactaactcgcatcctaacgt

SEQ ID NO: 206948 - DNA, 25 bp, Mus musculus
agtacactaactggcatcctaacgt

SEQ ID NO: 206949 - DNA, 25 bp, Mus musculus
agtacactcagacttcagtacccat

SEQ ID NO: 206950 - DNA, 25 bp, Mus musculus
agtacactcagagttcagtacccat

SEQ ID NO: 206951 - DNA, 25 bp, Mus musculus
agtacactcatcaactgatgctgcg

SEQ ID NO: 206952 - DNA, 25 bp, Mus musculus
agtacactcatctactgatgctgcg

SEQ ID NO: 206953 - DNA, 25 bp, Mus musculus
agtacactctgcagggctatcttta

SEQ ID NO: 206954 - DNA, 25 bp, Mus musculus
agtacactctgctgggctatcttta

SEQ ID NO: 206955 - DNA, 25 bp, Mus musculus
agtacacttcatcaactatggtcta

SEQ ID NO: 206956 - DNA, 25 bp, Mus musculus
agtacacttcatgaactatggtcta

SEQ ID NO: 206957 - DNA, 25 bp, Mus musculus
agtacacttgagattggatccccag

SEQ ID NO: 206958 - DNA, 25 bp, Mus musculus
agtacacttgagtttggatccccag

SEQ ID NO: 206959 - DNA, 25 bp, Mus musculus
agtacactttagaaagtctcttcaa

SEQ ID NO: 206960 - DNA, 25 bp, Mus musculus
agtacactttagtaagtctcttcaa

SEQ ID NO: 206961 - DNA, 25 bp, Mus musculus
agtacactttggcagtcaaattcca

SEQ ID NO: 206962 - DNA, 25 bp, Mus musculus
agtacactttgggagtcaaattcca

SEQ ID NO: 206963 - DNA, 25 bp, Mus musculus
agtacacttttaattgaggccaaat

SEQ ID NO: 206964 - DNA, 25 bp, Mus musculus
agtacacttttatttgaggccaaat

SEQ ID NO: 206965 - DNA, 25 bp, Mus musculus
agtacagaactcaaccggcagtcaa

SEQ ID NO: 206966 - DNA, 25 bp, Mus musculus
agtacagaactctaccggcagtcaa

SEQ ID NO: 206967 - DNA, 25 bp, Mus musculus
agtacagaactgacaggctctcctt

SEQ ID NO: 206968 - DNA, 25 bp, Mus musculus
agtacagaactgtcaggctctcctt

SEQ ID NO: 206969 - DNA, 25 bp, Mus musculus
agtacagacactcagcaggcacctg

SEQ ID NO: 206970 - DNA, 25 bp, Mus musculus
agtacagacactgagcaggcacctg

SEQ ID NO: 206971 - DNA, 25 bp, Mus musculus
agtacagagtgtcaagccgagtgct

SEQ ID NO: 206972 - DNA, 25 bp, Mus musculus
agtacagagtgtgaagccgagtgct

SEQ ID NO: 206973 - DNA, 25 bp, Mus musculus
agtacagatcgtcttcaagaacccc

SEQ ID NO: 206974 - DNA, 25 bp, Mus musculus
agtacagatcgtgttcaagaacccc

SEQ ID NO: 206975 - DNA, 25 bp, Mus musculus
agtacagattgtactcgcccatgaa

SEQ ID NO: 206976 - DNA, 25 bp, Mus musculus
agtacagattgttctcgcccatgaa

SEQ ID NO: 206977 - DNA, 25 bp, Mus musculus
agtacagcaactaggtagccattta

SEQ ID NO: 206978 - DNA, 25 bp, Mus musculus
agtacagcaacttggtagccattta

SEQ ID NO: 206979 - DNA, 25 bp, Mus musculus
agtacagcagccctagtcgcaggac

SEQ ID NO: 206980 - DNA, 25 bp, Mus musculus
agtacagcagccgtagtcgcaggac

SEQ ID NO: 206981 - DNA, 25 bp, Mus musculus
agtacagccgccagctggcctgatg

SEQ ID NO: 206982 - DNA, 25 bp, Mus musculus
agtacagccgcctgctggcctgatg

SEQ ID NO: 206983 - DNA, 25 bp, Mus musculus
agtacagcgagtacagcgaagtcct

SEQ ID NO: 206984 - DNA, 25 bp, Mus musculus
agtacagcgagttcagcgaagtcct

SEQ ID NO: 206985 - DNA, 25 bp, Mus musculus
agtacagcgtggagacattgtgtca

SEQ ID NO: 206986 - DNA, 25 bp, Mus musculus
agtacagcgtggtgacattgtgtca

SEQ ID NO: 206987 - DNA, 25 bp, Mus musculus
agtacagctcacagccaagacaaag

SEQ ID NO: 206988 - DNA, 25 bp, Mus musculus
agtacagctcactgccaagacaaag

SEQ ID NO: 206989 - DNA, 25 bp, Mus musculus
agtacagctgatagtgtgcctggct

SEQ ID NO: 206990 - DNA, 25 bp, Mus musculus
agtacagctgatatgtggttttcct

SEQ ID NO: 206991 - DNA, 25 bp, Mus musculus
agtacagctgattgtgtgcctggct

SEQ ID NO: 206992 - DNA, 25 bp, Mus musculus
agtacagctgatttgtggttttcct

SEQ ID NO: 206993 - DNA, 25 bp, Mus musculus
agtacagctggcatctgtatctcta

SEQ ID NO: 206994 - DNA, 25 bp, Mus musculus
agtacagctggcttctgtatctcta

SEQ ID NO: 206995 - DNA, 25 bp, Mus musculus
agtacaggacttcggctgcatccct

SEQ ID NO: 206996 - DNA, 25 bp, Mus musculus
agtacaggacttgggctgcatccct

SEQ ID NO: 206997 - DNA, 25 bp, Mus musculus
agtacaggagagctcccttgcccaa

SEQ ID NO: 206998 - DNA, 25 bp, Mus musculus
agtacaggagaggtcccttgcccaa

SEQ ID NO: 206999 - DNA, 25 bp, Mus musculus
agtacaggcaacatccaccaggctg

SEQ ID NO: 207000 - DNA, 25 bp, Mus musculus
agtacaggcaacttccaccaggctg

SEQ ID NO: 207001 - DNA, 25 bp, Mus musculus
agtacaggccagagttggatcccac

SEQ ID NO: 207002 - DNA, 25 bp, Mus musculus
agtacaggccagtgttggatcccac

SEQ ID NO: 207003 - DNA, 25 bp, Mus musculus
agtacaggccctcattctgacccaa

SEQ ID NO: 207004 - DNA, 25 bp, Mus musculus
agtacaggccctgattctgacccaa

SEQ ID NO: 207005 - DNA, 25 bp, Mus musculus
agtacaggctgtactgttggtaaca

SEQ ID NO: 207006 - DNA, 25 bp, Mus musculus
agtacaggctgttctgttggtaaca

SEQ ID NO: 207007 - DNA, 25 bp, Mus musculus
agtacagggacacacttcgcttctt

SEQ ID NO: 207008 - DNA, 25 bp, Mus musculus
agtacagggacagacttcgcttctt

SEQ ID NO: 207009 - DNA, 25 bp, Mus musculus
agtacagggctcacagatgcaccca

SEQ ID NO: 207010 - DNA, 25 bp, Mus musculus
agtacagggctctcagatgcaccca

SEQ ID NO: 207011 - DNA, 25 bp, Mus musculus
agtacagggtgtcctggcaccctac

SEQ ID NO: 207012 - DNA, 25 bp, Mus musculus
agtacagggtgtgctggcaccctac

SEQ ID NO: 207013 - DNA, 25 bp, Mus musculus
agtacaggtattcaacagttctttc

SEQ ID NO: 207014 - DNA, 25 bp, Mus musculus
agtacaggtattgaacagttctttc

SEQ ID NO: 207015 - DNA, 25 bp, Mus musculus
agtacaggtttgcttgtctttaact

SEQ ID NO: 207016 - DNA, 25 bp, Mus musculus
agtacaggtttggttgtctttaact

SEQ ID NO: 207017 - DNA, 25 bp, Mus musculus
agtacagtcccacaggtgctgagtt

SEQ ID NO: 207018 - DNA, 25 bp, Mus musculus
agtacagtcccagaggtgctgagtt

SEQ ID NO: 207019 - DNA, 25 bp, Mus musculus
agtacagtctctatccagaggtcgg

SEQ ID NO: 207020 - DNA, 25 bp, Mus musculus
agtacagtctctttccagaggtcgg

SEQ ID NO: 207021 - DNA, 25 bp, Mus musculus
agtacagtgcagagacatcttgatt

SEQ ID NO: 207022 - DNA, 25 bp, Mus musculus
agtacagtgcagtgacatcttgatt

SEQ ID NO: 207023 - DNA, 25 bp, Mus musculus
agtacagtgcccataggaccagcaa

SEQ ID NO: 207024 - DNA, 25 bp, Mus musculus
agtacagtgcccttaggaccagcaa

SEQ ID NO: 207025 - DNA, 25 bp, Mus musculus
agtacagtgcgccttcccattggta

SEQ ID NO: 207026 - DNA, 25 bp, Mus musculus
agtacagtgcgcgttcccattggta

SEQ ID NO: 207027 - DNA, 25 bp, Mus musculus
agtacagtgctaaagtggttaccag

SEQ ID NO: 207028 - DNA, 25 bp, Mus musculus
agtacagtgctatagtggttaccag

SEQ ID NO: 207029 - DNA, 25 bp, Mus musculus
agtacagtggttcatttccctatcc

SEQ ID NO: 207030 - DNA, 25 bp, Mus musculus
agtacagtggttgatttccctatcc

SEQ ID NO: 207031 - DNA, 25 bp, Mus musculus
agtacagttacacctggcttcttgg

SEQ ID NO: 207032 - DNA, 25 bp, Mus musculus
agtacagttacagctggcttcttgg

SEQ ID NO: 207033 - DNA, 25 bp, Mus musculus
agtacagttgagacaccttgcctta

SEQ ID NO: 207034 - DNA, 25 bp, Mus musculus
agtacagttgagtcaccttgcctta

SEQ ID NO: 207035 - DNA, 25 bp, Mus musculus
agtacagttgcacatgccgtgggct

SEQ ID NO: 207036 - DNA, 25 bp, Mus musculus
agtacagttgcagatgccgtgggct

SEQ ID NO: 207037 - DNA, 25 bp, Mus musculus
agtacagtttaaagttacaacagat

SEQ ID NO: 207038 - DNA, 25 bp, Mus musculus
agtacagtttaatgttacaacagat

SEQ ID NO: 207039 - DNA, 25 bp, Mus musculus
agtacatacctaaaaggcctcctga

SEQ ID NO: 207040 - DNA, 25 bp, Mus musculus
agtacatacctataaggcctcctga

SEQ ID NO: 207041 - DNA, 25 bp, Mus musculus
agtacatactccattttatcccata

SEQ ID NO: 207042 - DNA, 25 bp, Mus musculus
agtacatactcctttttatcccata

SEQ ID NO: 207043 - DNA, 25 bp, Mus musculus
agtacataggtcacgcttgaatgaa

SEQ ID NO: 207044 - DNA, 25 bp, Mus musculus
agtacataggtctcgcttgaatgaa

SEQ ID NO: 207045 - DNA, 25 bp, Mus musculus
agtacatattagatccaagcgtgga

SEQ ID NO: 207046 - DNA, 25 bp, Mus musculus
agtacatattagttccaagcgtgga

SEQ ID NO: 207047 - DNA, 25 bp, Mus musculus
agtacatatttcaacaatgttgggt

SEQ ID NO: 207048 - DNA, 25 bp, Mus musculus
agtacatatttctacaatgttgggt

SEQ ID NO: 207049 - DNA, 25 bp, Mus musculus
agtacatcatctctaccctgaaccg

SEQ ID NO: 207050 - DNA, 25 bp, Mus musculus
agtacatcatctgtaccctgaaccg

SEQ ID NO: 207051 - DNA, 25 bp, Mus musculus
agtacatcatgcatttcagggccat

SEQ ID NO: 207052 - DNA, 25 bp, Mus musculus
agtacatcatgcttttcagggccat

SEQ ID NO: 207053 - DNA, 25 bp, Mus musculus
agtacatccgtgagcttacacgctc

SEQ ID NO: 207054 - DNA, 25 bp, Mus musculus
agtacatccgtgtgcttacacgctc

SEQ ID NO: 207055 - DNA, 25 bp, Mus musculus
agtacatctcagataaccggcacag

SEQ ID NO: 207056 - DNA, 25 bp, Mus musculus
agtacatctcagttaaccggcacag

SEQ ID NO: 207057 - DNA, 25 bp, Mus musculus
agtacatctgacatcctccatgtct

SEQ ID NO: 207058 - DNA, 25 bp, Mus musculus
agtacatctgacttcctccatgtct

SEQ ID NO: 207059 - DNA, 25 bp, Mus musculus
agtacatcttctataatcatccctg

SEQ ID NO: 207060 - DNA, 25 bp, Mus musculus
agtacatcttctttaatcatccctg

SEQ ID NO: 207061 - DNA, 25 bp, Mus musculus
agtacatcttgtcggaggcttcagt

SEQ ID NO: 207062 - DNA, 25 bp, Mus musculus
agtacatcttgtgggaggcttcagt

SEQ ID NO: 207063 - DNA, 25 bp, Mus musculus
agtacatgaagcacacgaggctctt

SEQ ID NO: 207064 - DNA, 25 bp, Mus musculus
agtacatgaagctcacgaggctctt

SEQ ID NO: 207065 - DNA, 25 bp, Mus musculus
agtacatgatctccattccacatcc

SEQ ID NO: 207066 - DNA, 25 bp, Mus musculus
agtacatgatctgcattccacatcc

SEQ ID NO: 207067 - DNA, 25 bp, Mus musculus
agtacatgattcctcagtgtggatc

SEQ ID NO: 207068 - DNA, 25 bp, Mus musculus
agtacatgattcgtcagtgtggatc

SEQ ID NO: 207069 - DNA, 25 bp, Mus musculus
agtacatgcaaacctgcctaccgtg

SEQ ID NO: 207070 - DNA, 25 bp, Mus musculus
agtacatgcaaagctgcctaccgtg

SEQ ID NO: 207071 - DNA, 25 bp, Mus musculus
agtacatgcagccaacgaagcgcca

SEQ ID NO: 207072 - DNA, 25 bp, Mus musculus
agtacatgcagcgaacgaagcgcca

SEQ ID NO: 207073 - DNA, 25 bp, Mus musculus
agtacatgcgtgataactccagttc

SEQ ID NO: 207074 - DNA, 25 bp, Mus musculus
agtacatgcgtgttaactccagttc

SEQ ID NO: 207075 - DNA, 25 bp, Mus musculus
agtacatggtagcttctgcctcagt

SEQ ID NO: 207076 - DNA, 25 bp, Mus musculus
agtacatggtaggttctgcctcagt

SEQ ID NO: 207077 - DNA, 25 bp, Mus musculus
agtacatggtgaccctggagaacct

SEQ ID NO: 207078 - DNA, 25 bp, Mus musculus
agtacatggtgagcctggagaacct

SEQ ID NO: 207079 - DNA, 25 bp, Mus musculus
agtacatgtgtactcactcacctgc

SEQ ID NO: 207080 - DNA, 25 bp, Mus musculus
agtacatgtgtagtcactcacctgc

SEQ ID NO: 207081 - DNA, 25 bp, Mus musculus
agtacatgtgtcagccaggtttcca

SEQ ID NO: 207082 - DNA, 25 bp, Mus musculus
agtacatgtgtctgccaggtttcca

SEQ ID NO: 207083 - DNA, 25 bp, Mus musculus
agtacatgtgtgagggtccatctct

SEQ ID NO: 207084 - DNA, 25 bp, Mus musculus
agtacatgtgtgtgggtccatctct

SEQ ID NO: 207085 - DNA, 25 bp, Mus musculus
agtacattaactctcaagccgggcg

SEQ ID NO: 207086 - DNA, 25 bp, Mus musculus
agtacattaactgtcaagccgggcg

SEQ ID NO: 207087 - DNA, 25 bp, Mus musculus
agtacattcacgatctgactgaagg

SEQ ID NO: 207088 - DNA, 25 bp, Mus musculus
agtacattcacgttctgactgaagg

SEQ ID NO: 207089 - DNA, 25 bp, Mus musculus
agtacattgtggatgccaccttctc

SEQ ID NO: 207090 - DNA, 25 bp, Mus musculus
agtacattgtggttgccaccttctc

SEQ ID NO: 207091 - DNA, 25 bp, Mus musculus
agtacatttatcctcctctgagagt

SEQ ID NO: 207092 - DNA, 25 bp, Mus musculus
agtacatttatcgtcctctgagagt

SEQ ID NO: 207093 - DNA, 25 bp, Mus musculus
agtacatttccaaatttgcactccc

SEQ ID NO: 207094 - DNA, 25 bp, Mus musculus
agtacatttccatatttgcactccc

SEQ ID NO: 207095 - DNA, 25 bp, Mus musculus
agtacattttccagaggaggatatc

SEQ ID NO: 207096 - DNA, 25 bp, Mus musculus
agtacattttcctgaggaggatatc

SEQ ID NO: 207097 - DNA, 25 bp, Mus musculus
agtacattttgccttctctttcatt

SEQ ID NO: 207098 - DNA, 25 bp, Mus musculus
agtacattttgcgttctctttcatt

SEQ ID NO: 207099 - DNA, 25 bp, Mus musculus
agtacatttttgctgctctgaacat

SEQ ID NO: 207100 - DNA, 25 bp, Mus musculus
agtacatttttggtgctctgaacat

SEQ ID NO: 207101 - DNA, 25 bp, Mus musculus
agtaccaaagtgcattcttcaatgt

SEQ ID NO: 207102 - DNA, 25 bp, Mus musculus
agtaccaaagtggattcttcaatgt

SEQ ID NO: 207103 - DNA, 25 bp, Mus musculus
agtaccaaatcacgccatattcaca

SEQ ID NO: 207104 - DNA, 25 bp, Mus musculus
agtaccaaatcaggccatattcaca

SEQ ID NO: 207105 - DNA, 25 bp, Mus musculus
agtaccaacttcacctgtttgtttg

SEQ ID NO: 207106 - DNA, 25 bp, Mus musculus
agtaccaacttctcctgtttgtttg

SEQ ID NO: 207107 - DNA, 25 bp, Mus musculus
agtaccaagatgacacagtccgtgt

SEQ ID NO: 207108 - DNA, 25 bp, Mus musculus
agtaccaagatgtcacagtccgtgt

SEQ ID NO: 207109 - DNA, 25 bp, Mus musculus
agtaccaagcctatatgcctatgag

SEQ ID NO: 207110 - DNA, 25 bp, Mus musculus
agtaccaagcctttatgcctatgag

SEQ ID NO: 207111 - DNA, 25 bp, Mus musculus
agtaccaagcgtagcccctatgagg

SEQ ID NO: 207112 - DNA, 25 bp, Mus musculus
agtaccaagcgttgcccctatgagg

SEQ ID NO: 207113 - DNA, 25 bp, Mus musculus
agtaccaagtccatggcctcaggga

SEQ ID NO: 207114 - DNA, 25 bp, Mus musculus
agtaccaagtccttggcctcaggga

SEQ ID NO: 207115 - DNA, 25 bp, Mus musculus
agtaccaataaaacattgcttttgt

SEQ ID NO: 207116 - DNA, 25 bp, Mus musculus
agtaccaataaatcattgcttttgt

SEQ ID NO: 207117 - DNA, 25 bp, Mus musculus
agtaccaatggtccagaccgtccaa

SEQ ID NO: 207118 - DNA, 25 bp, Mus musculus
agtaccaatggtgcagaccgtccaa

SEQ ID NO: 207119 - DNA, 25 bp, Mus musculus
agtaccaattgaactagcttgtttt

SEQ ID NO: 207120 - DNA, 25 bp, Mus musculus
agtaccaattgatctagcttgtttt

SEQ ID NO: 207121 - DNA, 25 bp, Mus musculus
agtaccacactgaccttttgtgctt

SEQ ID NO: 207122 - DNA, 25 bp, Mus musculus
agtaccacactgtccttttgtgctt

SEQ ID NO: 207123 - DNA, 25 bp, Mus musculus
agtaccacagcaagatgtccaagaa

SEQ ID NO: 207124 - DNA, 25 bp, Mus musculus
agtaccacagcatgatgtccaagaa

SEQ ID NO: 207125 - DNA, 25 bp, Mus musculus
agtaccacagcgcaggtcactgtgc

SEQ ID NO: 207126 - DNA, 25 bp, Mus musculus
agtaccacagcggaggtcactgtgc

SEQ ID NO: 207127 - DNA, 25 bp, Mus musculus
agtaccacattcagaggcacagagt

SEQ ID NO: 207128 - DNA, 25 bp, Mus musculus
agtaccacattctgaggcacagagt

SEQ ID NO: 207129 - DNA, 25 bp, Mus musculus
agtaccaccaagagtcccttaagca

SEQ ID NO: 207130 - DNA, 25 bp, Mus musculus
agtaccaccaagtgtcccttaagca

SEQ ID NO: 207131 - DNA, 25 bp, Mus musculus
agtaccaccatgctgaattgcccat

SEQ ID NO: 207132 - DNA, 25 bp, Mus musculus
agtaccaccatggtgaattgcccat

SEQ ID NO: 207133 - DNA, 25 bp, Mus musculus
agtaccaccccacagagcctatatt

SEQ ID NO: 207134 - DNA, 25 bp, Mus musculus
agtaccaccccagagagcctatatt

SEQ ID NO: 207135 - DNA, 25 bp, Mus musculus
agtaccacctggagatttataacta

SEQ ID NO: 207136 - DNA, 25 bp, Mus musculus
agtaccacctggtgatttataacta

SEQ ID NO: 207137 - DNA, 25 bp, Mus musculus
agtaccacgcggacatctatgacaa

SEQ ID NO: 207138 - DNA, 25 bp, Mus musculus
agtaccacgcggtcatctatgacaa

SEQ ID NO: 207139 - DNA, 25 bp, Mus musculus
agtaccacggagcttgactttgacc

SEQ ID NO: 207140 - DNA, 25 bp, Mus musculus
agtaccacggaggttgactttgacc

SEQ ID NO: 207141 - DNA, 25 bp, Mus musculus
agtaccactcccactggttggtgat

SEQ ID NO: 207142 - DNA, 25 bp, Mus musculus
agtaccactccctctggttggtgat

SEQ ID NO: 207143 - DNA, 25 bp, Mus musculus
agtaccactgaaatgttaccttctg

SEQ ID NO: 207144 - DNA, 25 bp, Mus musculus
agtaccactgaattgttaccttctg

SEQ ID NO: 207145 - DNA, 25 bp, Mus musculus
agtaccacttatcaattcgataagt

SEQ ID NO: 207146 - DNA, 25 bp, Mus musculus
agtaccacttatgaattcgataagt

SEQ ID NO: 207147 - DNA, 25 bp, Mus musculus
agtaccagcaacagcccgtgaagac

SEQ ID NO: 207148 - DNA, 25 bp, Mus musculus
agtaccagcaactgcccgtgaagac

SEQ ID NO: 207149 - DNA, 25 bp, Mus musculus
agtaccagcccgacaggagggtcag

SEQ ID NO: 207150 - DNA, 25 bp, Mus musculus
agtaccagcccgtcaggagggtcag

SEQ ID NO: 207151 - DNA, 25 bp, Mus musculus
agtaccagcctacgagactcggatg

SEQ ID NO: 207152 - DNA, 25 bp, Mus musculus
agtaccagcctaggagactcggatg

SEQ ID NO: 207153 - DNA, 25 bp, Mus musculus
agtaccagggtcacagtagtccact

SEQ ID NO: 207154 - DNA, 25 bp, Mus musculus
agtaccagggtctcagtagtccact

SEQ ID NO: 207155 - DNA, 25 bp, Mus musculus
agtaccaggtacacgtccagtgcct

SEQ ID NO: 207156 - DNA, 25 bp, Mus musculus
agtaccaggtactcgtccagtgcct

SEQ ID NO: 207157 - DNA, 25 bp, Mus musculus
agtaccagtatcacagccaactaca

SEQ ID NO: 207158 - DNA, 25 bp, Mus musculus
agtaccagtatctcagccaactaca

SEQ ID NO: 207159 - DNA, 25 bp, Mus musculus
agtaccagtgttacgatgtgcttta

SEQ ID NO: 207160 - DNA, 25 bp, Mus musculus
agtaccagtgtttcgatgtgcttta

SEQ ID NO: 207161 - DNA, 25 bp, Mus musculus
agtaccataaggctccctgctgagc

SEQ ID NO: 207162 - DNA, 25 bp, Mus musculus
agtaccataagggtccctgctgagc

SEQ ID NO: 207163 - DNA, 25 bp, Mus musculus
agtaccatactgacaggtgtggcgg

SEQ ID NO: 207164 - DNA, 25 bp, Mus musculus
agtaccatactgtcaggtgtggcgg

SEQ ID NO: 207165 - DNA, 25 bp, Mus musculus
agtaccatacttcgcagtctcaaaa

SEQ ID NO: 207166 - DNA, 25 bp, Mus musculus
agtaccatacttggcagtctcaaaa

SEQ ID NO: 207167 - DNA, 25 bp, Mus musculus
agtaccataggtatgcagtctttta

SEQ ID NO: 207168 - DNA, 25 bp, Mus musculus
agtaccataggtttgcagtctttta

SEQ ID NO: 207169 - DNA, 25 bp, Mus musculus
agtaccatagtcattgaggccaatt

SEQ ID NO: 207170 - DNA, 25 bp, Mus musculus
agtaccatagtctttgaggccaatt

SEQ ID NO: 207171 - DNA, 25 bp, Mus musculus
agtaccatccggcttgctgagagat

SEQ ID NO: 207172 - DNA, 25 bp, Mus musculus
agtaccatccgggttgctgagagat

SEQ ID NO: 207173 - DNA, 25 bp, Mus musculus
agtaccatctgcagtcgtgaggacc

SEQ ID NO: 207174 - DNA, 25 bp, Mus musculus
agtaccatctgctgtcgtgaggacc

SEQ ID NO: 207175 - DNA, 25 bp, Mus musculus
agtaccatgatcacgttgccagctg

SEQ ID NO: 207176 - DNA, 25 bp, Mus musculus
agtaccatgatctcgttgccagctg

SEQ ID NO: 207177 - DNA, 25 bp, Mus musculus
agtaccatgtcccagtacagaccat

SEQ ID NO: 207178 - DNA, 25 bp, Mus musculus
agtaccatgtccgagtacagaccat

SEQ ID NO: 207179 - DNA, 25 bp, Mus musculus
agtaccatgtgccttatatctgtaa

SEQ ID NO: 207180 - DNA, 25 bp, Mus musculus
agtaccatgtgcgttatatctgtaa

SEQ ID NO: 207181 - DNA, 25 bp, Mus musculus
agtaccattcacatgatctgcagat

SEQ ID NO: 207182 - DNA, 25 bp, Mus musculus
agtaccattcacttgatctgcagat

SEQ ID NO: 207183 - DNA, 25 bp, Mus musculus
agtaccatttgtattgaccacccag

SEQ ID NO: 207184 - DNA, 25 bp, Mus musculus
agtaccatttgttttgaccacccag

SEQ ID NO: 207185 - DNA, 25 bp, Mus musculus
agtacccaacaacagctgtttttga

SEQ ID NO: 207186 - DNA, 25 bp, Mus musculus
agtacccaacaagagctgtttttga

SEQ ID NO: 207187 - DNA, 25 bp, Mus musculus
agtacccaagcacaactcagtgtgg

SEQ ID NO: 207188 - DNA, 25 bp, Mus musculus
agtacccaagcagaactcagtgtgg

SEQ ID NO: 207189 - DNA, 25 bp, Mus musculus
agtacccaatagagctgccccggca

SEQ ID NO: 207190 - DNA, 25 bp, Mus musculus
agtacccaatagtgctgccccggca

SEQ ID NO: 207191 - DNA, 25 bp, Mus musculus
agtacccaccagagaccaacagaag

SEQ ID NO: 207192 - DNA, 25 bp, Mus musculus
agtacccaccagtgaccaacagaag

SEQ ID NO: 207193 - DNA, 25 bp, Mus musculus
agtacccacttacctatcctgtctt

SEQ ID NO: 207194 - DNA, 25 bp, Mus musculus
agtacccacttagctatcctgtctt

SEQ ID NO: 207195 - DNA, 25 bp, Mus musculus
agtacccagcacagaggcacagctg

SEQ ID NO: 207196 - DNA, 25 bp, Mus musculus
agtacccagcactgaggcacagctg

SEQ ID NO: 207197 - DNA, 25 bp, Mus musculus
agtacccagtacaacatcctagaag

SEQ ID NO: 207198 - DNA, 25 bp, Mus musculus
agtacccagtactacatcctagaag

SEQ ID NO: 207199 - DNA, 25 bp, Mus musculus
agtacccatggcaagcaacctgcaa

SEQ ID NO: 207200 - DNA, 25 bp, Mus musculus
agtacccatggctagcaacctgcaa

SEQ ID NO: 207201 - DNA, 25 bp, Mus musculus
agtacccatttcagcaaggatgtgc

SEQ ID NO: 207202 - DNA, 25 bp, Mus musculus
agtacccatttctgcaaggatgtgc

SEQ ID NO: 207203 - DNA, 25 bp, Mus musculus
agtaccccactcatccattgaggtt

SEQ ID NO: 207204 - DNA, 25 bp, Mus musculus
agtaccccactcttccattgaggtt

SEQ ID NO: 207205 - DNA, 25 bp, Mus musculus
agtaccccagccatggtgttgggca

SEQ ID NO: 207206 - DNA, 25 bp, Mus musculus
agtaccccagccttggtgttgggca

SEQ ID NO: 207207 - DNA, 25 bp, Mus musculus
agtaccccatcaattccgagtgtaa

SEQ ID NO: 207208 - DNA, 25 bp, Mus musculus
agtaccccatcatttccgagtgtaa

SEQ ID NO: 207209 - DNA, 25 bp, Mus musculus
agtaccccattgaacatggcattgt

SEQ ID NO: 207210 - DNA, 25 bp, Mus musculus
agtaccccattgtacatggcattgt

SEQ ID NO: 207211 - DNA, 25 bp, Mus musculus
agtaccccgcatcacttaaaaacag

SEQ ID NO: 207212 - DNA, 25 bp, Mus musculus
agtaccccgcatgacttaaaaacag

SEQ ID NO: 207213 - DNA, 25 bp, Mus musculus
agtaccccgtccagagcactgtgaa

SEQ ID NO: 207214 - DNA, 25 bp, Mus musculus
agtaccccgtcctgagcactgtgaa

SEQ ID NO: 207215 - DNA, 25 bp, Mus musculus
agtacccgatttcgcaccgaggaag

SEQ ID NO: 207216 - DNA, 25 bp, Mus musculus
agtacccgatttggcaccgaggaag

SEQ ID NO: 207217 - DNA, 25 bp, Mus musculus
agtacccggattctcctggatgtca

SEQ ID NO: 207218 - DNA, 25 bp, Mus musculus
agtacccggattgtcctggatgtca

SEQ ID NO: 207219 - DNA, 25 bp, Mus musculus
agtacccgtggaatggatttgtaag

SEQ ID NO: 207220 - DNA, 25 bp, Mus musculus
agtacccgtggattggatttgtaag

SEQ ID NO: 207221 - DNA, 25 bp, Mus musculus
agtacccgtggcactctgtgagaaa

SEQ ID NO: 207222 - DNA, 25 bp, Mus musculus
agtacccgtggctctctgtgagaaa

SEQ ID NO: 207223 - DNA, 25 bp, Mus musculus
agtaccctagctacgtgcttatggc

SEQ ID NO: 207224 - DNA, 25 bp, Mus musculus
agtaccctagcttcgtgcttatggc

SEQ ID NO: 207225 - DNA, 25 bp, Mus musculus
agtaccctagttccctctgagattg

SEQ ID NO: 207226 - DNA, 25 bp, Mus musculus
agtaccctagttgcctctgagattg

SEQ ID NO: 207227 - DNA, 25 bp, Mus musculus
agtaccctcaaacctgtggacccga

SEQ ID NO: 207228 - DNA, 25 bp, Mus musculus
agtaccctcaaagctgtggacccga

SEQ ID NO: 207229 - DNA, 25 bp, Mus musculus
agtaccctccacaccgttctaggtg

SEQ ID NO: 207230 - DNA, 25 bp, Mus musculus
agtaccctccactccgttctaggtg

SEQ ID NO: 207231 - DNA, 25 bp, Mus musculus
agtaccctccttccaggacattgac

SEQ ID NO: 207232 - DNA, 25 bp, Mus musculus
agtaccctccttgcaggacattgac

SEQ ID NO: 207233 - DNA, 25 bp, Mus musculus
agtaccctggctaccgtgggctgca

SEQ ID NO: 207234 - DNA, 25 bp, Mus musculus
agtaccctggcttccgtgggctgca

SEQ ID NO: 207235 - DNA, 25 bp, Mus musculus
agtacccttaccagccatttaatat

SEQ ID NO: 207236 - DNA, 25 bp, Mus musculus
agtacccttacctgccatttaatat

SEQ ID NO: 207237 - DNA, 25 bp, Mus musculus
agtacccttattccaataggccagg

SEQ ID NO: 207238 - DNA, 25 bp, Mus musculus
agtacccttattgcaataggccagg

SEQ ID NO: 207239 - DNA, 25 bp, Mus musculus
agtacccttcccattacatgttcat

SEQ ID NO: 207240 - DNA, 25 bp, Mus musculus
agtacccttccctttacatgttcat

SEQ ID NO: 207241 - DNA, 25 bp, Mus musculus
agtacccttccgagggcagatgcaa

SEQ ID NO: 207242 - DNA, 25 bp, Mus musculus
agtacccttccgtgggcagatgcaa

SEQ ID NO: 207243 - DNA, 25 bp, Mus musculus
agtacccttgtcaatccggcttggc

SEQ ID NO: 207244 - DNA, 25 bp, Mus musculus
agtacccttgtctatccggcttggc

SEQ ID NO: 207245 - DNA, 25 bp, Mus musculus
agtaccgactccactgacacagaga

SEQ ID NO: 207246 - DNA, 25 bp, Mus musculus
agtaccgactcctctgacacagaga

SEQ ID NO: 207247 - DNA, 25 bp, Mus musculus
agtaccgactgaatggatgtgcttt

SEQ ID NO: 207248 - DNA, 25 bp, Mus musculus
agtaccgactgattggatgtgcttt

SEQ ID NO: 207249 - DNA, 25 bp, Mus musculus
agtaccgagaacaattcctggcgct

SEQ ID NO: 207250 - DNA, 25 bp, Mus musculus
agtaccgagaactattcctggcgct

SEQ ID NO: 207251 - DNA, 25 bp, Mus musculus
agtaccgagtacctggctgggccct

SEQ ID NO: 207252 - DNA, 25 bp, Mus musculus
agtaccgagtacgtggctgggccct

SEQ ID NO: 207253 - DNA, 25 bp, Mus musculus
agtaccgatcacagaagacctcccg

SEQ ID NO: 207254 - DNA, 25 bp, Mus musculus
agtaccgatcactgaagacctcccg

SEQ ID NO: 207255 - DNA, 25 bp, Mus musculus
agtaccgcagcaccctggagaggat

SEQ ID NO: 207256 - DNA, 25 bp, Mus musculus
agtaccgcagcagcctggagaggat

SEQ ID NO: 207257 - DNA, 25 bp, Mus musculus
agtaccgcagccaagggaagtcctt

SEQ ID NO: 207258 - DNA, 25 bp, Mus musculus
agtaccgcagcctagggaagtcctt

SEQ ID NO: 207259 - DNA, 25 bp, Mus musculus
agtaccgcccagatggacttcggag

SEQ ID NO: 207260 - DNA, 25 bp, Mus musculus
agtaccgcccagttggacttcggag

SEQ ID NO: 207261 - DNA, 25 bp, Mus musculus
agtaccgctactacagaggctgctt

SEQ ID NO: 207262 - DNA, 25 bp, Mus musculus
agtaccgctacttcagaggctgctt

SEQ ID NO: 207263 - DNA, 25 bp, Mus musculus
agtaccggcaatctagacctttcca

SEQ ID NO: 207264 - DNA, 25 bp, Mus musculus
agtaccggcaatgtagacctttcca

SEQ ID NO: 207265 - DNA, 25 bp, Mus musculus
agtaccgggagtaccacagactgta

SEQ ID NO: 207266 - DNA, 25 bp, Mus musculus
agtaccgggagttccacagactgta

SEQ ID NO: 207267 - DNA, 25 bp, Mus musculus
agtaccgggatgactctgttacctg

SEQ ID NO: 207268 - DNA, 25 bp, Mus musculus
agtaccgggatgtctctgttacctg

SEQ ID NO: 207269 - DNA, 25 bp, Mus musculus
agtaccggtactatgcttgcttgat

SEQ ID NO: 207270 - DNA, 25 bp, Mus musculus
agtaccggtactttgcttgcttgat

SEQ ID NO: 207271 - DNA, 25 bp, Mus musculus
agtaccgtcgccaggttcgcgattt

SEQ ID NO: 207272 - DNA, 25 bp, Mus musculus
agtaccgtcgcctggttcgcgattt

SEQ ID NO: 207273 - DNA, 25 bp, Mus musculus
agtaccgtgtatatcggtcgatggt

SEQ ID NO: 207274 - DNA, 25 bp, Mus musculus
agtaccgtgtatttcggtcgatggt

SEQ ID NO: 207275 - DNA, 25 bp, Mus musculus
agtacctaaaccacatctctcagat

SEQ ID NO: 207276 - DNA, 25 bp, Mus musculus
agtacctaaacctcatctctcagat

SEQ ID NO: 207277 - DNA, 25 bp, Mus musculus
agtacctacgtcagatagccactac

SEQ ID NO: 207278 - DNA, 25 bp, Mus musculus
agtacctacgtctgatagccactac

SEQ ID NO: 207279 - DNA, 25 bp, Mus musculus
agtacctagtgcaattcagcctctt

SEQ ID NO: 207280 - DNA, 25 bp, Mus musculus
agtacctagtgctattcagcctctt

SEQ ID NO: 207281 - DNA, 25 bp, Mus musculus
agtacctataccatgtggtgtccga

SEQ ID NO: 207282 - DNA, 25 bp, Mus musculus
agtacctataccttgtggtgtccga

SEQ ID NO: 207283 - DNA, 25 bp, Mus musculus
agtacctcaaataaatcagcccagc

SEQ ID NO: 207284 - DNA, 25 bp, Mus musculus
agtacctcaaattaatcagcccagc

SEQ ID NO: 207285 - DNA, 25 bp, Mus musculus
agtacctcaaggcaaagcatacatc

SEQ ID NO: 207286 - DNA, 25 bp, Mus musculus
agtacctcaagggaaagcatacatc

SEQ ID NO: 207287 - DNA, 25 bp, Mus musculus
agtacctcagccagatccacagttg

SEQ ID NO: 207288 - DNA, 25 bp, Mus musculus
agtacctcagcctgatccacagttg

SEQ ID NO: 207289 - DNA, 25 bp, Mus musculus
agtacctcaggtagtcacagactag

SEQ ID NO: 207290 - DNA, 25 bp, Mus musculus
agtacctcaggttgtcacagactag

SEQ ID NO: 207291 - DNA, 25 bp, Mus musculus
agtacctcatgcaactcaacacaat

SEQ ID NO: 207292 - DNA, 25 bp, Mus musculus
agtacctcatgctactcaacacaat

SEQ ID NO: 207293 - DNA, 25 bp, Mus musculus
agtacctccacacaacatgacgttg

SEQ ID NO: 207294 - DNA, 25 bp, Mus musculus
agtacctccacagaacatgacgttg

SEQ ID NO: 207295 - DNA, 25 bp, Mus musculus
agtacctcccagaatcttgtatctg

SEQ ID NO: 207296 - DNA, 25 bp, Mus musculus
agtacctcccagtatcttgtatctg

SEQ ID NO: 207297 - DNA, 25 bp, Mus musculus
agtacctcgggcaatctcttcatcc

SEQ ID NO: 207298 - DNA, 25 bp, Mus musculus
agtacctcgggctatctcttcatcc

SEQ ID NO: 207299 - DNA, 25 bp, Mus musculus
agtacctctgttccccaacagttgt

SEQ ID NO: 207300 - DNA, 25 bp, Mus musculus
agtacctctgttgcccaacagttgt

SEQ ID NO: 207301 - DNA, 25 bp, Mus musculus
agtacctcttcacttactgttccta

SEQ ID NO: 207302 - DNA, 25 bp, Mus musculus
agtacctcttcagttactgttccta

SEQ ID NO: 207303 - DNA, 25 bp, Mus musculus
agtacctcttggatgaatcccttca

SEQ ID NO: 207304 - DNA, 25 bp, Mus musculus
agtacctcttggttgaatcccttca

SEQ ID NO: 207305 - DNA, 25 bp, Mus musculus
agtacctgaagaagctccacacaca

SEQ ID NO: 207306 - DNA, 25 bp, Mus musculus
agtacctgaagatgctccacacaca

SEQ ID NO: 207307 - DNA, 25 bp, Mus musculus
agtacctgactgacctatttttagc

SEQ ID NO: 207308 - DNA, 25 bp, Mus musculus
agtacctgactgtcctatttttagc

SEQ ID NO: 207309 - DNA, 25 bp, Mus musculus
agtacctgacttcccagtcatttaa

SEQ ID NO: 207310 - DNA, 25 bp, Mus musculus
agtacctgacttgccagtcatttaa

SEQ ID NO: 207311 - DNA, 25 bp, Mus musculus
agtacctgatggagctgacgctcgt

SEQ ID NO: 207312 - DNA, 25 bp, Mus musculus
agtacctgatggtgctgacgctcgt

SEQ ID NO: 207313 - DNA, 25 bp, Mus musculus
agtacctgatttccacttgaaccag

SEQ ID NO: 207314 - DNA, 25 bp, Mus musculus
agtacctgatttgcacttgaaccag

SEQ ID NO: 207315 - DNA, 25 bp, Mus musculus
agtacctgcaaaagtatgagctttt

SEQ ID NO: 207316 - DNA, 25 bp, Mus musculus
agtacctgcaaatgtatgagctttt

SEQ ID NO: 207317 - DNA, 25 bp, Mus musculus
agtacctgcacaccaacattgggct

SEQ ID NO: 207318 - DNA, 25 bp, Mus musculus
agtacctgcacagcaacattgggct

SEQ ID NO: 207319 - DNA, 25 bp, Mus musculus
agtacctgcccgacgcagtgaaggg

SEQ ID NO: 207320 - DNA, 25 bp, Mus musculus
agtacctgcccgtcgcagtgaaggg

SEQ ID NO: 207321 - DNA, 25 bp, Mus musculus
agtacctgcgcaaccctgatgagat

SEQ ID NO: 207322 - DNA, 25 bp, Mus musculus
agtacctgcgcatccctgatgagat

SEQ ID NO: 207323 - DNA, 25 bp, Mus musculus
agtacctgctggaggcttatggtgt

SEQ ID NO: 207324 - DNA, 25 bp, Mus musculus
agtacctgctggtggcttatggtgt

SEQ ID NO: 207325 - DNA, 25 bp, Mus musculus
agtacctgggacaacgacaacgata

SEQ ID NO: 207326 - DNA, 25 bp, Mus musculus
agtacctgggactacgacaacgata

SEQ ID NO: 207327 - DNA, 25 bp, Mus musculus
agtacctggtacactcttagagcac

SEQ ID NO: 207328 - DNA, 25 bp, Mus musculus
agtacctggtactctcttagagcac

SEQ ID NO: 207329 - DNA, 25 bp, Mus musculus
agtacctgtactacattctccagaa

SEQ ID NO: 207330 - DNA, 25 bp, Mus musculus
agtacctgtacttcattctccagaa

SEQ ID NO: 207331 - DNA, 25 bp, Mus musculus
agtacctgtgatcttggtctccttc

SEQ ID NO: 207332 - DNA, 25 bp, Mus musculus
agtacctgtgatgttggtctccttc

SEQ ID NO: 207333 - DNA, 25 bp, Mus musculus
agtacctgtgcaagcggacggagct

SEQ ID NO: 207334 - DNA, 25 bp, Mus musculus
agtacctgtgcatgcggacggagct

SEQ ID NO: 207335 - DNA, 25 bp, Mus musculus
agtacctgtgccagttctgtgagca

SEQ ID NO: 207336 - DNA, 25 bp, Mus musculus
agtacctgtgcctgttctgtgagca

SEQ ID NO: 207337 - DNA, 25 bp, Mus musculus
agtacctgtgtaaagcatccaaagt

SEQ ID NO: 207338 - DNA, 25 bp, Mus musculus
agtacctgtgtatagcatccaaagt

SEQ ID NO: 207339 - DNA, 25 bp, Mus musculus
agtacctgtgttagtatgtgggaat

SEQ ID NO: 207340 - DNA, 25 bp, Mus musculus
agtacctgtgttctctaaggccttt

SEQ ID NO: 207341 - DNA, 25 bp, Mus musculus
agtacctgtgttgtctaaggccttt

SEQ ID NO: 207342 - DNA, 25 bp, Mus musculus
agtacctgtgtttgtatgtgggaat

SEQ ID NO: 207343 - DNA, 25 bp, Mus musculus
agtacctgttaaagttctgccctag

SEQ ID NO: 207344 - DNA, 25 bp, Mus musculus
agtacctgttaatgttctgccctag

SEQ ID NO: 207345 - DNA, 25 bp, Mus musculus
agtacctgttgaatactcagcccac

SEQ ID NO: 207346 - DNA, 25 bp, Mus musculus
agtacctgttgattactcagcccac

SEQ ID NO: 207347 - DNA, 25 bp, Mus musculus
agtaccttacagatgccaaatcttg

SEQ ID NO: 207348 - DNA, 25 bp, Mus musculus
agtaccttacagttgccaaatcttg

SEQ ID NO: 207349 - DNA, 25 bp, Mus musculus
agtaccttagacatcagcatcatcc

SEQ ID NO: 207350 - DNA, 25 bp, Mus musculus
agtaccttagacttcagcatcatcc

SEQ ID NO: 207351 - DNA, 25 bp, Mus musculus
agtaccttccacacgaggagctgct

SEQ ID NO: 207352 - DNA, 25 bp, Mus musculus
agtaccttccactcgaggagctgct

SEQ ID NO: 207353 - DNA, 25 bp, Mus musculus
agtaccttcggactgtccatctgac

SEQ ID NO: 207354 - DNA, 25 bp, Mus musculus
agtaccttcggagtgtccatctgac

SEQ ID NO: 207355 - DNA, 25 bp, Mus musculus
agtaccttctgaattcctctatgtg

SEQ ID NO: 207356 - DNA, 25 bp, Mus musculus
agtaccttctgatttcctctatgtg

SEQ ID NO: 207357 - DNA, 25 bp, Mus musculus
agtaccttgcaactggtcaacctgt

SEQ ID NO: 207358 - DNA, 25 bp, Mus musculus
agtaccttgcaagtggtcaacctgt

SEQ ID NO: 207359 - DNA, 25 bp, Mus musculus
agtaccttggctagcgttacagaag

SEQ ID NO: 207360 - DNA, 25 bp, Mus musculus
agtaccttggcttgcgttacagaag

SEQ ID NO: 207361 - DNA, 25 bp, Mus musculus
agtaccttgtacagctaacctttag

SEQ ID NO: 207362 - DNA, 25 bp, Mus musculus
agtaccttgtactgctaacctttag

SEQ ID NO: 207363 - DNA, 25 bp, Mus musculus
agtaccttgtttagatcatttccac

SEQ ID NO: 207364 - DNA, 25 bp, Mus musculus
agtaccttgttttgatcatttccac

SEQ ID NO: 207365 - DNA, 25 bp, Mus musculus
agtacctttatgagtttacgtgcca

SEQ ID NO: 207366 - DNA, 25 bp, Mus musculus
agtacctttatgtgtttacgtgcca

SEQ ID NO: 207367 - DNA, 25 bp, Mus musculus
agtacctttcaaacatcagcgcttt

SEQ ID NO: 207368 - DNA, 25 bp, Mus musculus
agtacctttcaatcatcagcgcttt

SEQ ID NO: 207369 - DNA, 25 bp, Mus musculus
agtacctttctgctcacgccattta

SEQ ID NO: 207370 - DNA, 25 bp, Mus musculus
agtacctttctggtcacgccattta

SEQ ID NO: 207371 - DNA, 25 bp, Mus musculus
agtacgaaccctatgatctatcatg

SEQ ID NO: 207372 - DNA, 25 bp, Mus musculus
agtacgaaccctttgatctatcatg

SEQ ID NO: 207373 - DNA, 25 bp, Mus musculus
agtacgaagagcacggcattggttg

SEQ ID NO: 207374 - DNA, 25 bp, Mus musculus
agtacgaagagctcggcattggttg

SEQ ID NO: 207375 - DNA, 25 bp, Mus musculus
agtacgaagttcatggcaaccccag

SEQ ID NO: 207376 - DNA, 25 bp, Mus musculus
agtacgaagttcttggcaaccccag

SEQ ID NO: 207377 - DNA, 25 bp, Mus musculus
agtacgactgtacccggaatgagct

SEQ ID NO: 207378 - DNA, 25 bp, Mus musculus
agtacgactgtagccggaatgagct

SEQ ID NO: 207379 - DNA, 25 bp, Mus musculus
agtacgagggctacacgccaagtgc

SEQ ID NO: 207380 - DNA, 25 bp, Mus musculus
agtacgagggcttcacgccaagtgc

SEQ ID NO: 207381 - DNA, 25 bp, Mus musculus
agtacgatagatacctcctgcttga

SEQ ID NO: 207382 - DNA, 25 bp, Mus musculus
agtacgatagattcctcctgcttga

SEQ ID NO: 207383 - DNA, 25 bp, Mus musculus
agtacgcacacacagctggcactgt

SEQ ID NO: 207384 - DNA, 25 bp, Mus musculus
agtacgcacacagagctggcactgt

SEQ ID NO: 207385 - DNA, 25 bp, Mus musculus
agtacgcagagcatctcagaggcag

SEQ ID NO: 207386 - DNA, 25 bp, Mus musculus
agtacgcagagcttctcagaggcag

SEQ ID NO: 207387 - DNA, 25 bp, Mus musculus
agtacgcagcttcccgtggcccgga

SEQ ID NO: 207388 - DNA, 25 bp, Mus musculus
agtacgcagcttgccgtggcccgga

SEQ ID NO: 207389 - DNA, 25 bp, Mus musculus
agtacgcctgccctgacctggtgtc

SEQ ID NO: 207390 - DNA, 25 bp, Mus musculus
agtacgcctgccgtgacctggtgtc

SEQ ID NO: 207391 - DNA, 25 bp, Mus musculus
agtacgctaggtcattctctggttt

SEQ ID NO: 207392 - DNA, 25 bp, Mus musculus
agtacgctaggtgattctctggttt

SEQ ID NO: 207393 - DNA, 25 bp, Mus musculus
agtacgctggaccatgccacggatg

SEQ ID NO: 207394 - DNA, 25 bp, Mus musculus
agtacgctggacgatgccacggatg

SEQ ID NO: 207395 - DNA, 25 bp, Mus musculus
agtacggcacatcagatgagtcact

SEQ ID NO: 207396 - DNA, 25 bp, Mus musculus
agtacggcacatgagatgagtcact

SEQ ID NO: 207397 - DNA, 25 bp, Mus musculus
agtacggccttcagggttcaatgac

SEQ ID NO: 207398 - DNA, 25 bp, Mus musculus
agtacggccttctgggttcaatgac

SEQ ID NO: 207399 - DNA, 25 bp, Mus musculus
agtacggtactcacatccaagcatc

SEQ ID NO: 207400 - DNA, 25 bp, Mus musculus
agtacggtactctcatccaagcatc

SEQ ID NO: 207401 - DNA, 25 bp, Mus musculus
agtacggtggccaagaacacctgga

SEQ ID NO: 207402 - DNA, 25 bp, Mus musculus
agtacggtggcctagaacacctgga

SEQ ID NO: 207403 - DNA, 25 bp, Mus musculus
agtacgtcacccctggagcaggctc

SEQ ID NO: 207404 - DNA, 25 bp, Mus musculus
agtacgtcacccgtggagcaggctc

SEQ ID NO: 207405 - DNA, 25 bp, Mus musculus
agtacgtcaccgatcaggagcctga

SEQ ID NO: 207406 - DNA, 25 bp, Mus musculus
agtacgtcaccgttcaggagcctga

SEQ ID NO: 207407 - DNA, 25 bp, Mus musculus
agtacgtccataccgatcctgtgtg

SEQ ID NO: 207408 - DNA, 25 bp, Mus musculus
agtacgtccatagcgatcctgtgtg

SEQ ID NO: 207409 - DNA, 25 bp, Mus musculus
agtacgtccccacaattgtgtttgt

SEQ ID NO: 207410 - DNA, 25 bp, Mus musculus
agtacgtccccagaattgtgtttgt

SEQ ID NO: 207411 - DNA, 25 bp, Mus musculus
agtacgtccgtccatctatggcatc

SEQ ID NO: 207412 - DNA, 25 bp, Mus musculus
agtacgtccgtcgatctatggcatc

SEQ ID NO: 207413 - DNA, 25 bp, Mus musculus
agtacgtgcccacgatcatgtttgt

SEQ ID NO: 207414 - DNA, 25 bp, Mus musculus
agtacgtgcccaggatcatgtttgt

SEQ ID NO: 207415 - DNA, 25 bp, Mus musculus
agtacgtgggaacctgaaactggaa

SEQ ID NO: 207416 - DNA, 25 bp, Mus musculus
agtacgtgggaagctgaaactggaa

SEQ ID NO: 207417 - DNA, 25 bp, Mus musculus
agtacgtggtccctcagtcaagaag

SEQ ID NO: 207418 - DNA, 25 bp, Mus musculus
agtacgtggtccgtcagtcaagaag

SEQ ID NO: 207419 - DNA, 25 bp, Mus musculus
agtacgttagagcatgtccttcctg

SEQ ID NO: 207420 - DNA, 25 bp, Mus musculus
agtacgttagaggatgtccttcctg

SEQ ID NO: 207421 - DNA, 25 bp, Mus musculus
agtacgttcacacaggctcttcagg

SEQ ID NO: 207422 - DNA, 25 bp, Mus musculus
agtacgttcacagaggctcttcagg

SEQ ID NO: 207423 - DNA, 25 bp, Mus musculus
agtacgttcttcctggcccttccag

SEQ ID NO: 207424 - DNA, 25 bp, Mus musculus
agtacgttcttcgtggcccttccag

SEQ ID NO: 207425 - DNA, 25 bp, Mus musculus
agtacgtttgtacatttgaatgccc

SEQ ID NO: 207426 - DNA, 25 bp, Mus musculus
agtacgtttgtagatttgaatgccc

SEQ ID NO: 207427 - DNA, 25 bp, Mus musculus
agtacgtttgtgctttgtatggtta

SEQ ID NO: 207428 - DNA, 25 bp, Mus musculus
agtacgtttgtggtttgtatggtta

SEQ ID NO: 207429 - DNA, 25 bp, Mus musculus
agtactaactatagagccatcccac

SEQ ID NO: 207430 - DNA, 25 bp, Mus musculus
agtactaactattgagccatcccac

SEQ ID NO: 207431 - DNA, 25 bp, Mus musculus
agtactaagacaccgtcctcctgta

SEQ ID NO: 207432 - DNA, 25 bp, Mus musculus
agtactaagacagcgtcctcctgta

SEQ ID NO: 207433 - DNA, 25 bp, Mus musculus
agtactaaggcaagtttcttgactt

SEQ ID NO: 207434 - DNA, 25 bp, Mus musculus
agtactaaggcatgtttcttgactt

SEQ ID NO: 207435 - DNA, 25 bp, Mus musculus
agtactaatcacatgggttcggcaa

SEQ ID NO: 207436 - DNA, 25 bp, Mus musculus
agtactaatcacttgggttcggcaa

SEQ ID NO: 207437 - DNA, 25 bp, Mus musculus
agtactacacctcttcctacaaatt

SEQ ID NO: 207438 - DNA, 25 bp, Mus musculus
agtactacacctgttcctacaaatt

SEQ ID NO: 207439 - DNA, 25 bp, Mus musculus
agtactacagcccagtgtccctgag

SEQ ID NO: 207440 - DNA, 25 bp, Mus musculus
agtactacagccgagtgtccctgag

SEQ ID NO: 207441 - DNA, 25 bp, Mus musculus
agtactaccagtctagcctgatgtc

SEQ ID NO: 207442 - DNA, 25 bp, Mus musculus
agtactaccagtgtagcctgatgtc

SEQ ID NO: 207443 - DNA, 25 bp, Mus musculus
agtactaccatccaaactacagctc

SEQ ID NO: 207444 - DNA, 25 bp, Mus musculus
agtactaccatcgaaactacagctc

SEQ ID NO: 207445 - DNA, 25 bp, Mus musculus
agtactacccggctccgcagcgatg

SEQ ID NO: 207446 - DNA, 25 bp, Mus musculus
agtactacccgggtccgcagcgatg

SEQ ID NO: 207447 - DNA, 25 bp, Mus musculus
agtactacctgactttggacataga

SEQ ID NO: 207448 - DNA, 25 bp, Mus musculus
agtactacctgagtttggacataga

SEQ ID NO: 207449 - DNA, 25 bp, Mus musculus
agtactacgctccatgagccgaaga

SEQ ID NO: 207450 - DNA, 25 bp, Mus musculus
agtactacgctcgatgagccgaaga

SEQ ID NO: 207451 - DNA, 25 bp, Mus musculus
agtactactcttacatgcacacatg

SEQ ID NO: 207452 - DNA, 25 bp, Mus musculus
agtactactctttcatgcacacatg

SEQ ID NO: 207453 - DNA, 25 bp, Mus musculus
agtactactttcagaaggcccttca

SEQ ID NO: 207454 - DNA, 25 bp, Mus musculus
agtactactttctgaaggcccttca

SEQ ID NO: 207455 - DNA, 25 bp, Mus musculus
agtactagactaccctctgtggtat

SEQ ID NO: 207456 - DNA, 25 bp, Mus musculus
agtactagactagcctctgtggtat

SEQ ID NO: 207457 - DNA, 25 bp, Mus musculus
agtactagctggagcatctctcttg

SEQ ID NO: 207458 - DNA, 25 bp, Mus musculus
agtactagctggtgcatctctcttg

SEQ ID NO: 207459 - DNA, 25 bp, Mus musculus
agtactaggaggcatatgtgagttt

SEQ ID NO: 207460 - DNA, 25 bp, Mus musculus
agtactaggagggatatgtgagttt

SEQ ID NO: 207461 - DNA, 25 bp, Mus musculus
agtactatatccatgacctgtctga

SEQ ID NO: 207462 - DNA, 25 bp, Mus musculus
agtactatatccttgacctgtctga

SEQ ID NO: 207463 - DNA, 25 bp, Mus musculus
agtactatcaccatacatagctaaa

SEQ ID NO: 207464 - DNA, 25 bp, Mus musculus
agtactatcaccttacatagctaaa

SEQ ID NO: 207465 - DNA, 25 bp, Mus musculus
agtactatcccaaacatggtccact

SEQ ID NO: 207466 - DNA, 25 bp, Mus musculus
agtactatcccatacatggtccact

SEQ ID NO: 207467 - DNA, 25 bp, Mus musculus
agtactatcttactgtgcaccagag

SEQ ID NO: 207468 - DNA, 25 bp, Mus musculus
agtactatcttagtgtgcaccagag

SEQ ID NO: 207469 - DNA, 25 bp, Mus musculus
agtactatgccacccaaggtatcag

SEQ ID NO: 207470 - DNA, 25 bp, Mus musculus
agtactatgccagccaaggtatcag

SEQ ID NO: 207471 - DNA, 25 bp, Mus musculus
agtactatgcggacattcgccagag

SEQ ID NO: 207472 - DNA, 25 bp, Mus musculus
agtactatgcggtcattcgccagag

SEQ ID NO: 207473 - DNA, 25 bp, Mus musculus
agtactatgtacagaaaatcccagt

SEQ ID NO: 207474 - DNA, 25 bp, Mus musculus
agtactatgtactgaaaatcccagt

SEQ ID NO: 207475 - DNA, 25 bp, Mus musculus
agtactattattccttccatgatta

SEQ ID NO: 207476 - DNA, 25 bp, Mus musculus
agtactattattgcttccatgatta

SEQ ID NO: 207477 - DNA, 25 bp, Mus musculus
agtactattcccaaatggccagaca

SEQ ID NO: 207478 - DNA, 25 bp, Mus musculus
agtactattccctaatggccagaca

SEQ ID NO: 207479 - DNA, 25 bp, Mus musculus
agtactattctcacatagaaatcat

SEQ ID NO: 207480 - DNA, 25 bp, Mus musculus
agtactattctctcatagaaatcat

SEQ ID NO: 207481 - DNA, 25 bp, Mus musculus
agtactcaaccaaaactcctgttaa

SEQ ID NO: 207482 - DNA, 25 bp, Mus musculus
agtactcaaccataactcctgttaa

SEQ ID NO: 207483 - DNA, 25 bp, Mus musculus
agtactcaagagaggtcctcaaata

SEQ ID NO: 207484 - DNA, 25 bp, Mus musculus
agtactcaagagtggtcctcaaata

SEQ ID NO: 207485 - DNA, 25 bp, Mus musculus
agtactcacagtacctgaggcttcg

SEQ ID NO: 207486 - DNA, 25 bp, Mus musculus
agtactcacagttcctgaggcttcg

SEQ ID NO: 207487 - DNA, 25 bp, Mus musculus
agtactcactgtattgggtcccaag

SEQ ID NO: 207488 - DNA, 25 bp, Mus musculus
agtactcactgttttgggtcccaag

SEQ ID NO: 207489 - DNA, 25 bp, Mus musculus
agtactcagctaatgctacagctcc

SEQ ID NO: 207490 - DNA, 25 bp, Mus musculus
agtactcagctattgctacagctcc

SEQ ID NO: 207491 - DNA, 25 bp, Mus musculus
agtactcaggagaggttctgtgctg

SEQ ID NO: 207492 - DNA, 25 bp, Mus musculus
agtactcaggagtggttctgtgctg

SEQ ID NO: 207493 - DNA, 25 bp, Mus musculus
agtactcaggcactgctgggttaca

SEQ ID NO: 207494 - DNA, 25 bp, Mus musculus
agtactcaggcagtgctgggttaca

SEQ ID NO: 207495 - DNA, 25 bp, Mus musculus
agtactcatgtaacctatctttgct

SEQ ID NO: 207496 - DNA, 25 bp, Mus musculus
agtactcatgtatcctatctttgct

SEQ ID NO: 207497 - DNA, 25 bp, Mus musculus
agtactcattgtacagtagccactg

SEQ ID NO: 207498 - DNA, 25 bp, Mus musculus
agtactcattgttcagtagccactg

SEQ ID NO: 207499 - DNA, 25 bp, Mus musculus
agtactccacccatgaaggattcag

SEQ ID NO: 207500 - DNA, 25 bp, Mus musculus
agtactccacccttgaaggattcag

SEQ ID NO: 207501 - DNA, 25 bp, Mus musculus
agtactccatccaggatctgaccag

SEQ ID NO: 207502 - DNA, 25 bp, Mus musculus
agtactccatcctggatctgaccag

SEQ ID NO: 207503 - DNA, 25 bp, Mus musculus
agtactcccgctctgaccagtggag

SEQ ID NO: 207504 - DNA, 25 bp, Mus musculus
agtactcccgctgtgaccagtggag

SEQ ID NO: 207505 - DNA, 25 bp, Mus musculus
agtactccctgaaagaggccctctg

SEQ ID NO: 207506 - DNA, 25 bp, Mus musculus
agtactccctgatagaggccctctg

SEQ ID NO: 207507 - DNA, 25 bp, Mus musculus
agtactcctaggcagcctgtggaca

SEQ ID NO: 207508 - DNA, 25 bp, Mus musculus
agtactcctagggagcctgtggaca

SEQ ID NO: 207509 - DNA, 25 bp, Mus musculus
agtactcctattccatgtctccaaa

SEQ ID NO: 207510 - DNA, 25 bp, Mus musculus
agtactcctattgcatgtctccaaa

SEQ ID NO: 207511 - DNA, 25 bp, Mus musculus
agtactcctcaactcctaatgattg

SEQ ID NO: 207512 - DNA, 25 bp, Mus musculus
agtactcctcaagtcctaatgattg

SEQ ID NO: 207513 - DNA, 25 bp, Mus musculus
agtactcctccacaactaggtaagc

SEQ ID NO: 207514 - DNA, 25 bp, Mus musculus
agtactcctccagaactaggtaagc

SEQ ID NO: 207515 - DNA, 25 bp, Mus musculus
agtactcctctgctgggttggctgc

SEQ ID NO: 207516 - DNA, 25 bp, Mus musculus
agtactcctctggtgggttggctgc

SEQ ID NO: 207517 - DNA, 25 bp, Mus musculus
agtactcctgcaaggtgggccacga

SEQ ID NO: 207518 - DNA, 25 bp, Mus musculus
agtactcctgcatggtgggccacga

SEQ ID NO: 207519 - DNA, 25 bp, Mus musculus
agtactcctggaagagcctgatggt

SEQ ID NO: 207520 - DNA, 25 bp, Mus musculus
agtactcctggatgagcctgatggt

SEQ ID NO: 207521 - DNA, 25 bp, Mus musculus
agtactcctgtactcagatcatgat

SEQ ID NO: 207522 - DNA, 25 bp, Mus musculus
agtactcctgtagtcagatcatgat

SEQ ID NO: 207523 - DNA, 25 bp, Mus musculus
agtactcctgttactaatcttatga

SEQ ID NO: 207524 - DNA, 25 bp, Mus musculus
agtactcctgtttctaatcttatga

SEQ ID NO: 207525 - DNA, 25 bp, Mus musculus
agtactcgaagcagattggcaccca

SEQ ID NO: 207526 - DNA, 25 bp, Mus musculus
agtactcgaagctgattggcaccca

SEQ ID NO: 207527 - DNA, 25 bp, Mus musculus
agtactcggattcaggaagccagca

SEQ ID NO: 207528 - DNA, 25 bp, Mus musculus
agtactcggattgaggaagccagca

SEQ ID NO: 207529 - DNA, 25 bp, Mus musculus
agtactcggccactgtcctgaggga

SEQ ID NO: 207530 - DNA, 25 bp, Mus musculus
agtactcggccagtgtcctgaggga

SEQ ID NO: 207531 - DNA, 25 bp, Mus musculus
agtactcgtgggacatcatggagcc

SEQ ID NO: 207532 - DNA, 25 bp, Mus musculus
agtactcgtgggtcatcatggagcc

SEQ ID NO: 207533 - DNA, 25 bp, Mus musculus
agtactctaaaacctgacaccccag

SEQ ID NO: 207534 - DNA, 25 bp, Mus musculus
agtactctaaaagctgacaccccag

SEQ ID NO: 207535 - DNA, 25 bp, Mus musculus
agtactctcaataatacctgccatc

SEQ ID NO: 207536 - DNA, 25 bp, Mus musculus
agtactctcaattatacctgccatc

SEQ ID NO: 207537 - DNA, 25 bp, Mus musculus
agtactctctaaatcacctttgtgt

SEQ ID NO: 207538 - DNA, 25 bp, Mus musculus
agtactctctaattcacctttgtgt

SEQ ID NO: 207539 - DNA, 25 bp, Mus musculus
agtactctgacaaaggtgccacaag

SEQ ID NO: 207540 - DNA, 25 bp, Mus musculus
agtactctgacataggtgccacaag

SEQ ID NO: 207541 - DNA, 25 bp, Mus musculus
agtactctgccacctgtgttgtgga

SEQ ID NO: 207542 - DNA, 25 bp, Mus musculus
agtactctgccagctgtgttgtgga

SEQ ID NO: 207543 - DNA, 25 bp, Mus musculus
agtactctgtgaactaacatctgaa

SEQ ID NO: 207544 - DNA, 25 bp, Mus musculus
agtactctgtgatctaacatctgaa

SEQ ID NO: 207545 - DNA, 25 bp, Mus musculus
agtactctgtgcagtgacaatgcca

SEQ ID NO: 207546 - DNA, 25 bp, Mus musculus
agtactctgtgctgtgacaatgcca

SEQ ID NO: 207547 - DNA, 25 bp, Mus musculus
agtactctgttgagaatgtctttaa

SEQ ID NO: 207548 - DNA, 25 bp, Mus musculus
agtactctgttgtgaatgtctttaa

SEQ ID NO: 207549 - DNA, 25 bp, Mus musculus
agtactcttagtattcaccagcata

SEQ ID NO: 207550 - DNA, 25 bp, Mus musculus
agtactcttagttttcaccagcata

SEQ ID NO: 207551 - DNA, 25 bp, Mus musculus
agtactcttggtatgacattgtgaa

SEQ ID NO: 207552 - DNA, 25 bp, Mus musculus
agtactcttggtttgacattgtgaa

SEQ ID NO: 207553 - DNA, 25 bp, Mus musculus
agtactgaaatgatccaccctgtta

SEQ ID NO: 207554 - DNA, 25 bp, Mus musculus
agtactgaaatgttccaccctgtta

SEQ ID NO: 207555 - DNA, 25 bp, Mus musculus
agtactgaactgagtgctcttgggt

SEQ ID NO: 207556 - DNA, 25 bp, Mus musculus
agtactgaactgtgtgctcttgggt

SEQ ID NO: 207557 - DNA, 25 bp, Mus musculus
agtactgaagttctgagctccgtga

SEQ ID NO: 207558 - DNA, 25 bp, Mus musculus
agtactgaagttgtgagctccgtga

SEQ ID NO: 207559 - DNA, 25 bp, Mus musculus
agtactgacagcaaatagccattgt

SEQ ID NO: 207560 - DNA, 25 bp, Mus musculus
agtactgacagctaatagccattgt

SEQ ID NO: 207561 - DNA, 25 bp, Mus musculus
agtactgacattcccgtggagctag

SEQ ID NO: 207562 - DNA, 25 bp, Mus musculus
agtactgacattgccgtggagctag

SEQ ID NO: 207563 - DNA, 25 bp, Mus musculus
agtactgaccatctcctgatcaagg

SEQ ID NO: 207564 - DNA, 25 bp, Mus musculus
agtactgaccatgtcctgatcaagg

SEQ ID NO: 207565 - DNA, 25 bp, Mus musculus
agtactgactctactcgggatgcct

SEQ ID NO: 207566 - DNA, 25 bp, Mus musculus
agtactgactcttctcgggatgcct

SEQ ID NO: 207567 - DNA, 25 bp, Mus musculus
agtactgagcataatttcctttttt

SEQ ID NO: 207568 - DNA, 25 bp, Mus musculus
agtactgagcattatttcctttttt

SEQ ID NO: 207569 - DNA, 25 bp, Mus musculus
agtactgagctcatgtctctttgaa

SEQ ID NO: 207570 - DNA, 25 bp, Mus musculus
agtactgagctcttgtctctttgaa

SEQ ID NO: 207571 - DNA, 25 bp, Mus musculus
agtactgaggatccaacccagtgcc

SEQ ID NO: 207572 - DNA, 25 bp, Mus musculus
agtactgaggatgcaacccagtgcc

SEQ ID NO: 207573 - DNA, 25 bp, Mus musculus
agtactgaggctaccgactttgcgg

SEQ ID NO: 207574 - DNA, 25 bp, Mus musculus
agtactgaggcttccgactttgcgg

SEQ ID NO: 207575 - DNA, 25 bp, Mus musculus
agtactgatggaagacaccgactgt

SEQ ID NO: 207576 - DNA, 25 bp, Mus musculus
agtactgatggatgacaccgactgt

SEQ ID NO: 207577 - DNA, 25 bp, Mus musculus
agtactgcagtcctgggcttttgta

SEQ ID NO: 207578 - DNA, 25 bp, Mus musculus
agtactgcagtcctgtattcacact

SEQ ID NO: 207579 - DNA, 25 bp, Mus musculus
agtactgcagtcgtgggcttttgta

SEQ ID NO: 207580 - DNA, 25 bp, Mus musculus
agtactgcagtcgtgtattcacact

SEQ ID NO: 207581 - DNA, 25 bp, Mus musculus
agtactgcagttcctgtagtctaac

SEQ ID NO: 207582 - DNA, 25 bp, Mus musculus
agtactgcagttgctgtagtctaac

SEQ ID NO: 207583 - DNA, 25 bp, Mus musculus
agtactgcatcgcaagaatggcccc

SEQ ID NO: 207584 - DNA, 25 bp, Mus musculus
agtactgcatcggaagaatggcccc

SEQ ID NO: 207585 - DNA, 25 bp, Mus musculus
agtactgcatgcatttctcagaggt

SEQ ID NO: 207586 - DNA, 25 bp, Mus musculus
agtactgcatgcttttctcagaggt

SEQ ID NO: 207587 - DNA, 25 bp, Mus musculus
agtactgccattcccttaggttgaa

SEQ ID NO: 207588 - DNA, 25 bp, Mus musculus
agtactgccattgccttaggttgaa

SEQ ID NO: 207589 - DNA, 25 bp, Mus musculus
agtactgccggcaggagaattctca

SEQ ID NO: 207590 - DNA, 25 bp, Mus musculus
agtactgccggctggagaattctca

SEQ ID NO: 207591 - DNA, 25 bp, Mus musculus
agtactgcctccagtttacaatcag

SEQ ID NO: 207592 - DNA, 25 bp, Mus musculus
agtactgcctcctgtttacaatcag

SEQ ID NO: 207593 - DNA, 25 bp, Mus musculus
agtactgccttcatcaccagtctgt

SEQ ID NO: 207594 - DNA, 25 bp, Mus musculus
agtactgccttcttcaccagtctgt

SEQ ID NO: 207595 - DNA, 25 bp, Mus musculus
agtactgcgcctactcgagagaaat

SEQ ID NO: 207596 - DNA, 25 bp, Mus musculus
agtactgcgccttctcgagagaaat

SEQ ID NO: 207597 - DNA, 25 bp, Mus musculus
agtactgcgtccctgccaagcgagg

SEQ ID NO: 207598 - DNA, 25 bp, Mus musculus
agtactgcgtccgtgccaagcgagg

SEQ ID NO: 207599 - DNA, 25 bp, Mus musculus
agtactgctcataatccgtgatggg

SEQ ID NO: 207600 - DNA, 25 bp, Mus musculus
agtactgctcattatccgtgatggg

SEQ ID NO: 207601 - DNA, 25 bp, Mus musculus
agtactgctcccattgttgactggg

SEQ ID NO: 207602 - DNA, 25 bp, Mus musculus
agtactgctccctttgttgactggg

SEQ ID NO: 207603 - DNA, 25 bp, Mus musculus
agtactgctgaactcaacctactcc

SEQ ID NO: 207604 - DNA, 25 bp, Mus musculus
agtactgctgaagtcaacctactcc

SEQ ID NO: 207605 - DNA, 25 bp, Mus musculus
agtactgctgctcccttcaggacag

SEQ ID NO: 207606 - DNA, 25 bp, Mus musculus
agtactgctgctgccttcaggacag

SEQ ID NO: 207607 - DNA, 25 bp, Mus musculus
agtactgctggacccttatgccaaa

SEQ ID NO: 207608 - DNA, 25 bp, Mus musculus
agtactgctggagccttatgccaaa

SEQ ID NO: 207609 - DNA, 25 bp, Mus musculus
agtactgcttacagtcactggctcc

SEQ ID NO: 207610 - DNA, 25 bp, Mus musculus
agtactgcttactgtcactggctcc

SEQ ID NO: 207611 - DNA, 25 bp, Mus musculus
agtactgcttcgctctcagtgggta

SEQ ID NO: 207612 - DNA, 25 bp, Mus musculus
agtactgcttcggtctcagtgggta

SEQ ID NO: 207613 - DNA, 25 bp, Mus musculus
agtactggaggcattccgtgcacat

SEQ ID NO: 207614 - DNA, 25 bp, Mus musculus
agtactggaggctttccgtgcacat

SEQ ID NO: 207615 - DNA, 25 bp, Mus musculus
agtactggccaccaaagggtcttgt

SEQ ID NO: 207616 - DNA, 25 bp, Mus musculus
agtactggccacgaaagggtcttgt

SEQ ID NO: 207617 - DNA, 25 bp, Mus musculus
agtactggcctcataatattgatta

SEQ ID NO: 207618 - DNA, 25 bp, Mus musculus
agtactggcctcttaatattgatta

SEQ ID NO: 207619 - DNA, 25 bp, Mus musculus
agtactggcctgagaagacctccgg

SEQ ID NO: 207620 - DNA, 25 bp, Mus musculus
agtactggcctgtgaagacctccgg

SEQ ID NO: 207621 - DNA, 25 bp, Mus musculus
agtactggcgtgattggacaccact

SEQ ID NO: 207622 - DNA, 25 bp, Mus musculus
agtactggcgtgtttggacaccact

SEQ ID NO: 207623 - DNA, 25 bp, Mus musculus
agtactggctccacatagaccgaag

SEQ ID NO: 207624 - DNA, 25 bp, Mus musculus
agtactggctcctcatagaccgaag

SEQ ID NO: 207625 - DNA, 25 bp, Mus musculus
agtactggctctcgtgggtgttctt

SEQ ID NO: 207626 - DNA, 25 bp, Mus musculus
agtactggctctggtgggtgttctt

SEQ ID NO: 207627 - DNA, 25 bp, Mus musculus
agtactgggagacgtatctatcaaa

SEQ ID NO: 207628 - DNA, 25 bp, Mus musculus
agtactgggagaggtatctatcaaa

SEQ ID NO: 207629 - DNA, 25 bp, Mus musculus
agtactgggcacagctcagggacac

SEQ ID NO: 207630 - DNA, 25 bp, Mus musculus
agtactgggcactgctcagggacac

SEQ ID NO: 207631 - DNA, 25 bp, Mus musculus
agtactgggctgaaatgtccttttt

SEQ ID NO: 207632 - DNA, 25 bp, Mus musculus
agtactgggctgtaatgtccttttt

SEQ ID NO: 207633 - DNA, 25 bp, Mus musculus
agtactggtacaacatgtccaactt

SEQ ID NO: 207634 - DNA, 25 bp, Mus musculus
agtactggtacatcatgtccaactt

SEQ ID NO: 207635 - DNA, 25 bp, Mus musculus
agtactggtagtccagactccccat

SEQ ID NO: 207636 - DNA, 25 bp, Mus musculus
agtactggtagtgcagactccccat

SEQ ID NO: 207637 - DNA, 25 bp, Mus musculus
agtactggtgtaagtctgacccaaa

SEQ ID NO: 207638 - DNA, 25 bp, Mus musculus
agtactggtgtatgtctgacccaaa

SEQ ID NO: 207639 - DNA, 25 bp, Mus musculus
agtactgtactaacacacgtaaggt

SEQ ID NO: 207640 - DNA, 25 bp, Mus musculus
agtactgtactatcacacgtaaggt

SEQ ID NO: 207641 - DNA, 25 bp, Mus musculus
agtactgtcaccattactcactggg

SEQ ID NO: 207642 - DNA, 25 bp, Mus musculus
agtactgtcacctttactcactggg

SEQ ID NO: 207643 - DNA, 25 bp, Mus musculus
agtactgtcactattctgccttaag

SEQ ID NO: 207644 - DNA, 25 bp, Mus musculus
agtactgtcacttttctgccttaag

SEQ ID NO: 207645 - DNA, 25 bp, Mus musculus
agtactgtcagtaaccagggcctct

SEQ ID NO: 207646 - DNA, 25 bp, Mus musculus
agtactgtcagttaccagggcctct

SEQ ID NO: 207647 - DNA, 25 bp, Mus musculus
agtactgtccctcttttctgaacca

SEQ ID NO: 207648 - DNA, 25 bp, Mus musculus
agtactgtccctgttttctgaacca

SEQ ID NO: 207649 - DNA, 25 bp, Mus musculus
agtactgtctacaaccaccaactac

SEQ ID NO: 207650 - DNA, 25 bp, Mus musculus
agtactgtctactaccaccaactac

SEQ ID NO: 207651 - DNA, 25 bp, Mus musculus
agtactgtgaaaatacccacgctgc

SEQ ID NO: 207652 - DNA, 25 bp, Mus musculus
agtactgtgaaattacccacgctgc

SEQ ID NO: 207653 - DNA, 25 bp, Mus musculus
agtactgtgcctccttgggacacaa

SEQ ID NO: 207654 - DNA, 25 bp, Mus musculus
agtactgtgcctgcttgggacacaa

SEQ ID NO: 207655 - DNA, 25 bp, Mus musculus
agtactgtgctgctgtcttattccc

SEQ ID NO: 207656 - DNA, 25 bp, Mus musculus
agtactgtgctggtgtcttattccc

SEQ ID NO: 207657 - DNA, 25 bp, Mus musculus
agtactgtggagctgcatgcacctg

SEQ ID NO: 207658 - DNA, 25 bp, Mus musculus
agtactgtggaggtgcatgcacctg

SEQ ID NO: 207659 - DNA, 25 bp, Mus musculus
agtactgtgtctagcttttgtaagc

SEQ ID NO: 207660 - DNA, 25 bp, Mus musculus
agtactgtgtcttgcttttgtaagc

SEQ ID NO: 207661 - DNA, 25 bp, Mus musculus
agtactgtgtttcgtaccagcattt

SEQ ID NO: 207662 - DNA, 25 bp, Mus musculus
agtactgtgtttggtaccagcattt

SEQ ID NO: 207663 - DNA, 25 bp, Mus musculus
agtactgttaagagtctctgcttcc

SEQ ID NO: 207664 - DNA, 25 bp, Mus musculus
agtactgttaagtgtctctgcttcc

SEQ ID NO: 207665 - DNA, 25 bp, Mus musculus
agtactgttagacctgtcccagctg

SEQ ID NO: 207666 - DNA, 25 bp, Mus musculus
agtactgttagagctgtcccagctg

SEQ ID NO: 207667 - DNA, 25 bp, Mus musculus
agtactgttccccacttcgggcatc

SEQ ID NO: 207668 - DNA, 25 bp, Mus musculus
agtactgttcccgacttcgggcatc

SEQ ID NO: 207669 - DNA, 25 bp, Mus musculus
agtactgttgtaattgttcccctct

SEQ ID NO: 207670 - DNA, 25 bp, Mus musculus
agtactgttgtatttgttcccctct

SEQ ID NO: 207671 - DNA, 25 bp, Mus musculus
agtactgtttctagttaaggtgtgc

SEQ ID NO: 207672 - DNA, 25 bp, Mus musculus
agtactgtttcttgttaaggtgtgc

SEQ ID NO: 207673 - DNA, 25 bp, Mus musculus
agtactgtttgcctgttttctcgat

SEQ ID NO: 207674 - DNA, 25 bp, Mus musculus
agtactgtttgcgtgttttctcgat

SEQ ID NO: 207675 - DNA, 25 bp, Mus musculus
agtactgttttcagggctccagctg

SEQ ID NO: 207676 - DNA, 25 bp, Mus musculus
agtactgttttctgggctccagctg

SEQ ID NO: 207677 - DNA, 25 bp, Mus musculus
agtacttaaagcacgttccccagcg

SEQ ID NO: 207678 - DNA, 25 bp, Mus musculus
agtacttaaagctcgttccccagcg

SEQ ID NO: 207679 - DNA, 25 bp, Mus musculus
agtacttaccaacagactcacttct

SEQ ID NO: 207680 - DNA, 25 bp, Mus musculus
agtacttaccaagagactcacttct

SEQ ID NO: 207681 - DNA, 25 bp, Mus musculus
agtacttacccaatctgtcacatta

SEQ ID NO: 207682 - DNA, 25 bp, Mus musculus
agtacttacccattctgtcacatta

SEQ ID NO: 207683 - DNA, 25 bp, Mus musculus
agtacttagaaacaccccttgacat

SEQ ID NO: 207684 - DNA, 25 bp, Mus musculus
agtacttagaaagaccccttgacat

SEQ ID NO: 207685 - DNA, 25 bp, Mus musculus
agtacttaggctctgaatctcggaa

SEQ ID NO: 207686 - DNA, 25 bp, Mus musculus
agtacttaggctgtgaatctcggaa

SEQ ID NO: 207687 - DNA, 25 bp, Mus musculus
agtacttagtttcccaacattattg

SEQ ID NO: 207688 - DNA, 25 bp, Mus musculus
agtacttagtttgccaacattattg

SEQ ID NO: 207689 - DNA, 25 bp, Mus musculus
agtacttattgcagtgtctcttcta

SEQ ID NO: 207690 - DNA, 25 bp, Mus musculus
agtacttattgctgtgtctcttcta

SEQ ID NO: 207691 - DNA, 25 bp, Mus musculus
agtacttcaagaccctgcacaggtt

SEQ ID NO: 207692 - DNA, 25 bp, Mus musculus
agtacttcaagagcctgcacaggtt

SEQ ID NO: 207693 - DNA, 25 bp, Mus musculus
agtacttcaatcaaatgggaccagg

SEQ ID NO: 207694 - DNA, 25 bp, Mus musculus
agtacttcaatctaatgggaccagg

SEQ ID NO: 207695 - DNA, 25 bp, Mus musculus
agtacttcacacatatatttgctgt

SEQ ID NO: 207696 - DNA, 25 bp, Mus musculus
agtacttcacacttatatttgctgt

SEQ ID NO: 207697 - DNA, 25 bp, Mus musculus
agtacttcacgtccttggcttcctg

SEQ ID NO: 207698 - DNA, 25 bp, Mus musculus
agtacttcacgtgcttggcttcctg

SEQ ID NO: 207699 - DNA, 25 bp, Mus musculus
agtacttccagcagtgccatgggtt

SEQ ID NO: 207700 - DNA, 25 bp, Mus musculus
agtacttccagcataaaacaaccag

SEQ ID NO: 207701 - DNA, 25 bp, Mus musculus
agtacttccagctgtgccatgggtt

SEQ ID NO: 207702 - DNA, 25 bp, Mus musculus
agtacttccagcttaaaacaaccag

SEQ ID NO: 207703 - DNA, 25 bp, Mus musculus
agtacttcccagattttagctgtga

SEQ ID NO: 207704 - DNA, 25 bp, Mus musculus
agtacttcccagtttttagctgtga

SEQ ID NO: 207705 - DNA, 25 bp, Mus musculus
agtacttcctaacgtcacactcaca

SEQ ID NO: 207706 - DNA, 25 bp, Mus musculus
agtacttcctaaggtcacactcaca

SEQ ID NO: 207707 - DNA, 25 bp, Mus musculus
agtacttcctagagagtctgtcaca

SEQ ID NO: 207708 - DNA, 25 bp, Mus musculus
agtacttcctagtgagtctgtcaca

SEQ ID NO: 207709 - DNA, 25 bp, Mus musculus
agtacttcctcacgacaacctgtgg

SEQ ID NO: 207710 - DNA, 25 bp, Mus musculus
agtacttcctcaggacaacctgtgg

SEQ ID NO: 207711 - DNA, 25 bp, Mus musculus
agtacttcctctactacaactagta

SEQ ID NO: 207712 - DNA, 25 bp, Mus musculus
agtacttcctcttctacaactagta

SEQ ID NO: 207713 - DNA, 25 bp, Mus musculus
agtacttcggctatgacactcattg

SEQ ID NO: 207714 - DNA, 25 bp, Mus musculus
agtacttcggctttgacactcattg

SEQ ID NO: 207715 - DNA, 25 bp, Mus musculus
agtacttctcagacatgcgctttgc

SEQ ID NO: 207716 - DNA, 25 bp, Mus musculus
agtacttctcagtcatgcgctttgc

SEQ ID NO: 207717 - DNA, 25 bp, Mus musculus
agtacttctctgaagtttaagacta

SEQ ID NO: 207718 - DNA, 25 bp, Mus musculus
agtacttctctgtagtttaagacta

SEQ ID NO: 207719 - DNA, 25 bp, Mus musculus
agtacttctgtaactggcaatatca

SEQ ID NO: 207720 - DNA, 25 bp, Mus musculus
agtacttctgtatctggcaatatca

SEQ ID NO: 207721 - DNA, 25 bp, Mus musculus
agtacttcttagcaacctagggcag

SEQ ID NO: 207722 - DNA, 25 bp, Mus musculus
agtacttcttaggaacctagggcag

SEQ ID NO: 207723 - DNA, 25 bp, Mus musculus
agtacttgagaaaccactgcagggt

SEQ ID NO: 207724 - DNA, 25 bp, Mus musculus
agtacttgagaatccactgcagggt

SEQ ID NO: 207725 - DNA, 25 bp, Mus musculus
agtacttgctttctcaatttctctg

SEQ ID NO: 207726 - DNA, 25 bp, Mus musculus
agtacttgctttgtcaatttctctg

SEQ ID NO: 207727 - DNA, 25 bp, Mus musculus
agtacttggaacctagagcctggtc

SEQ ID NO: 207728 - DNA, 25 bp, Mus musculus
agtacttggaacgtagagcctggtc

SEQ ID NO: 207729 - DNA, 25 bp, Mus musculus
agtacttggcctccgaaactgtgct

SEQ ID NO: 207730 - DNA, 25 bp, Mus musculus
agtacttggcctgcgaaactgtgct

SEQ ID NO: 207731 - DNA, 25 bp, Mus musculus
agtacttggctgcttttcttagtaa

SEQ ID NO: 207732 - DNA, 25 bp, Mus musculus
agtacttggctggttttcttagtaa

SEQ ID NO: 207733 - DNA, 25 bp, Mus musculus
agtacttggtcgagcccaggagcct

SEQ ID NO: 207734 - DNA, 25 bp, Mus musculus
agtacttggtcgtgcccaggagcct

SEQ ID NO: 207735 - DNA, 25 bp, Mus musculus
agtacttgtgacaacacagtcatta

SEQ ID NO: 207736 - DNA, 25 bp, Mus musculus
agtacttgtgactacacagtcatta

SEQ ID NO: 207737 - DNA, 25 bp, Mus musculus
agtactttaaccacatggtgaagat

SEQ ID NO: 207738 - DNA, 25 bp, Mus musculus
agtactttaacctcatggtgaagat

SEQ ID NO: 207739 - DNA, 25 bp, Mus musculus
agtactttacttatggtcgagacct

SEQ ID NO: 207740 - DNA, 25 bp, Mus musculus
agtactttacttttggtcgagacct

SEQ ID NO: 207741 - DNA, 25 bp, Mus musculus
agtactttagcactgtgtcctgtgg

SEQ ID NO: 207742 - DNA, 25 bp, Mus musculus
agtactttagcagtgtgtcctgtgg

SEQ ID NO: 207743 - DNA, 25 bp, Mus musculus
agtactttcgttaagtctcaccctg

SEQ ID NO: 207744 - DNA, 25 bp, Mus musculus
agtactttcgttaatcttgctgctt

SEQ ID NO: 207745 - DNA, 25 bp, Mus musculus
agtactttcgtttagtctcaccctg

SEQ ID NO: 207746 - DNA, 25 bp, Mus musculus
agtactttcgtttatcttgctgctt

SEQ ID NO: 207747 - DNA, 25 bp, Mus musculus
agtactttctaaaatctcctaaatg

SEQ ID NO: 207748 - DNA, 25 bp, Mus musculus
agtactttctaatatctcctaaatg

SEQ ID NO: 207749 - DNA, 25 bp, Mus musculus
agtactttgagtacgagtttgaggc

SEQ ID NO: 207750 - DNA, 25 bp, Mus musculus
agtactttgagttcgagtttgaggc

SEQ ID NO: 207751 - DNA, 25 bp, Mus musculus
agtactttgatgatgctctgccttc

SEQ ID NO: 207752 - DNA, 25 bp, Mus musculus
agtactttgatgttgctctgccttc

SEQ ID NO: 207753 - DNA, 25 bp, Mus musculus
agtactttgctgactgggagtagca

SEQ ID NO: 207754 - DNA, 25 bp, Mus musculus
agtactttgctgtctgggagtagca

SEQ ID NO: 207755 - DNA, 25 bp, Mus musculus
agtactttgtacctttatgagatgt

SEQ ID NO: 207756 - DNA, 25 bp, Mus musculus
agtactttgtacgtttatgagatgt

SEQ ID NO: 207757 - DNA, 25 bp, Mus musculus
agtagaaacttacgccttgagaatt

SEQ ID NO: 207758 - DNA, 25 bp, Mus musculus
agtagaaacttaggccttgagaatt

SEQ ID NO: 207759 - DNA, 25 bp, Mus musculus
agtagaaacttcagccttgctttga

SEQ ID NO: 207760 - DNA, 25 bp, Mus musculus
agtagaaacttctgccttgctttga

SEQ ID NO: 207761 - DNA, 25 bp, Mus musculus
agtagaacacaaccataactgtttt

SEQ ID NO: 207762 - DNA, 25 bp, Mus musculus
agtagaacacaagcataactgtttt

SEQ ID NO: 207763 - DNA, 25 bp, Mus musculus
agtagaacacacaagctgcctcaga

SEQ ID NO: 207764 - DNA, 25 bp, Mus musculus
agtagaacacactagctgcctcaga

SEQ ID NO: 207765 - DNA, 25 bp, Mus musculus
agtagaacagtgctcatgtccagat

SEQ ID NO: 207766 - DNA, 25 bp, Mus musculus
agtagaacagtggtcatgtccagat

SEQ ID NO: 207767 - DNA, 25 bp, Mus musculus
agtagaaccagaattttctccctca

SEQ ID NO: 207768 - DNA, 25 bp, Mus musculus
agtagaaccagatttttctccctca

SEQ ID NO: 207769 - DNA, 25 bp, Mus musculus
agtagaaccaggagctctgctccta

SEQ ID NO: 207770 - DNA, 25 bp, Mus musculus
agtagaaccaggtgctctgctccta

SEQ ID NO: 207771 - DNA, 25 bp, Mus musculus
agtagaacctgtcttgcctgcttta

SEQ ID NO: 207772 - DNA, 25 bp, Mus musculus
agtagaacctgtgttgcctgcttta

SEQ ID NO: 207773 - DNA, 25 bp, Mus musculus
agtagaacgttcacaggctgcagcg

SEQ ID NO: 207774 - DNA, 25 bp, Mus musculus
agtagaacgttctcaggctgcagcg

SEQ ID NO: 207775 - DNA, 25 bp, Mus musculus
agtagaactacacctcacaggagac

SEQ ID NO: 207776 - DNA, 25 bp, Mus musculus
agtagaactacagctcacaggagac

SEQ ID NO: 207777 - DNA, 25 bp, Mus musculus
agtagaactgacagtccctttgggc

SEQ ID NO: 207778 - DNA, 25 bp, Mus musculus
agtagaactgactgtccctttgggc

SEQ ID NO: 207779 - DNA, 25 bp, Mus musculus
agtagaactgcacatctgttcctca

SEQ ID NO: 207780 - DNA, 25 bp, Mus musculus
agtagaactgcagatctgttcctca

SEQ ID NO: 207781 - DNA, 25 bp, Mus musculus
agtagaacttggcatggcccctgtc

SEQ ID NO: 207782 - DNA, 25 bp, Mus musculus
agtagaacttgggatggcccctgtc

SEQ ID NO: 207783 - DNA, 25 bp, Mus musculus
agtagaagacttccgggtctgcgtt

SEQ ID NO: 207784 - DNA, 25 bp, Mus musculus
agtagaagacttgcgggtctgcgtt

SEQ ID NO: 207785 - DNA, 25 bp, Mus musculus
agtagaagcaacaagatcaaggcca

SEQ ID NO: 207786 - DNA, 25 bp, Mus musculus
agtagaagcaactagatcaaggcca

SEQ ID NO: 207787 - DNA, 25 bp, Mus musculus
agtagaagccatccggaaggaacga

SEQ ID NO: 207788 - DNA, 25 bp, Mus musculus
agtagaagccatgcggaaggaacga

SEQ ID NO: 207789 - DNA, 25 bp, Mus musculus
agtagaagctagactccaactccta

SEQ ID NO: 207790 - DNA, 25 bp, Mus musculus
agtagaagctagtctccaactccta

SEQ ID NO: 207791 - DNA, 25 bp, Mus musculus
agtagaagctctcagaatccacaga

SEQ ID NO: 207792 - DNA, 25 bp, Mus musculus
agtagaagctctgagaatccacaga

SEQ ID NO: 207793 - DNA, 25 bp, Mus musculus
agtagaagtgcgacctgttttcgcc

SEQ ID NO: 207794 - DNA, 25 bp, Mus musculus
agtagaagtgcgtcctgttttcgcc

SEQ ID NO: 207795 - DNA, 25 bp, Mus musculus
agtagaagtgtcagcctttccattt

SEQ ID NO: 207796 - DNA, 25 bp, Mus musculus
agtagaagtgtctgcctttccattt

SEQ ID NO: 207797 - DNA, 25 bp, Mus musculus
agtagaatccaccagtgcaacctgc

SEQ ID NO: 207798 - DNA, 25 bp, Mus musculus
agtagaatccacgagtgcaacctgc

SEQ ID NO: 207799 - DNA, 25 bp, Mus musculus
agtagaatcttgattctgtgtctta

SEQ ID NO: 207800 - DNA, 25 bp, Mus musculus
agtagaatcttgtttctgtgtctta

SEQ ID NO: 207801 - DNA, 25 bp, Mus musculus
agtagaatgttaccacctcctgtgt

SEQ ID NO: 207802 - DNA, 25 bp, Mus musculus
agtagaatgttagcacctcctgtgt

SEQ ID NO: 207803 - DNA, 25 bp, Mus musculus
agtagaattgagaggctctgccctc

SEQ ID NO: 207804 - DNA, 25 bp, Mus musculus
agtagaattgagtggctctgccctc

SEQ ID NO: 207805 - DNA, 25 bp, Mus musculus
agtagaattgcaaggaaccgtgggt

SEQ ID NO: 207806 - DNA, 25 bp, Mus musculus
agtagaattgcatggaaccgtgggt

SEQ ID NO: 207807 - DNA, 25 bp, Mus musculus
agtagacaagatccggcttcggcca

SEQ ID NO: 207808 - DNA, 25 bp, Mus musculus
agtagacaagatgcggcttcggcca

SEQ ID NO: 207809 - DNA, 25 bp, Mus musculus
agtagacacactcttttcgcctttg

SEQ ID NO: 207810 - DNA, 25 bp, Mus musculus
agtagacacactgttttcgcctttg

SEQ ID NO: 207811 - DNA, 25 bp, Mus musculus
agtagacaccaactatcggcacaag

SEQ ID NO: 207812 - DNA, 25 bp, Mus musculus
agtagacaccaagtatcggcacaag

SEQ ID NO: 207813 - DNA, 25 bp, Mus musculus
agtagacactggcacgtgatttttt

SEQ ID NO: 207814 - DNA, 25 bp, Mus musculus
agtagacactgggacgtgatttttt

SEQ ID NO: 207815 - DNA, 25 bp, Mus musculus
agtagacatactatcctagttaaca

SEQ ID NO: 207816 - DNA, 25 bp, Mus musculus
agtagacatactttcctagttaaca

SEQ ID NO: 207817 - DNA, 25 bp, Mus musculus
agtagacattgaccagtgcctcagg

SEQ ID NO: 207818 - DNA, 25 bp, Mus musculus
agtagacattgagcagtgcctcagg

SEQ ID NO: 207819 - DNA, 25 bp, Mus musculus
agtagaccaatcaagcaagccaaca

SEQ ID NO: 207820 - DNA, 25 bp, Mus musculus
agtagaccaatctagcaagccaaca

SEQ ID NO: 207821 - DNA, 25 bp, Mus musculus
agtagaccacaacatctgaactccc

SEQ ID NO: 207822 - DNA, 25 bp, Mus musculus
agtagaccacaagatctgaactccc

SEQ ID NO: 207823 - DNA, 25 bp, Mus musculus
agtagaccagctagatcccttagtt

SEQ ID NO: 207824 - DNA, 25 bp, Mus musculus
agtagaccagcttgatcccttagtt

SEQ ID NO: 207825 - DNA, 25 bp, Mus musculus
agtagaccagtaagacccaccatta

SEQ ID NO: 207826 - DNA, 25 bp, Mus musculus
agtagaccagtatgacccaccatta

SEQ ID NO: 207827 - DNA, 25 bp, Mus musculus
agtagaccagttcctctttgcttca

SEQ ID NO: 207828 - DNA, 25 bp, Mus musculus
agtagaccagttgctctttgcttca

SEQ ID NO: 207829 - DNA, 25 bp, Mus musculus
agtagaccatgcacagttctgaccg

SEQ ID NO: 207830 - DNA, 25 bp, Mus musculus
agtagaccatgctcagttctgaccg

SEQ ID NO: 207831 - DNA, 25 bp, Mus musculus
agtagaccccgtcctggtatcggct

SEQ ID NO: 207832 - DNA, 25 bp, Mus musculus
agtagaccccgtgctggtatcggct

SEQ ID NO: 207833 - DNA, 25 bp, Mus musculus
agtagaccgctacttggagcctgtt

SEQ ID NO: 207834 - DNA, 25 bp, Mus musculus
agtagaccgctagttggagcctgtt

SEQ ID NO: 207835 - DNA, 25 bp, Mus musculus
agtagacctaaacctcaccaagttc

SEQ ID NO: 207836 - DNA, 25 bp, Mus musculus
agtagacctaaagctcaccaagttc

SEQ ID NO: 207837 - DNA, 25 bp, Mus musculus
agtagacctatcagagggactccaa

SEQ ID NO: 207838 - DNA, 25 bp, Mus musculus
agtagacctatctgagggactccaa

SEQ ID NO: 207839 - DNA, 25 bp, Mus musculus
agtagacctgccagggaagcctaag

SEQ ID NO: 207840 - DNA, 25 bp, Mus musculus
agtagacctgcctgggaagcctaag

SEQ ID NO: 207841 - DNA, 25 bp, Mus musculus
agtagacgagcaaagccagctgcgc

SEQ ID NO: 207842 - DNA, 25 bp, Mus musculus
agtagacgagcatagccagctgcgc

SEQ ID NO: 207843 - DNA, 25 bp, Mus musculus
agtagacgagtaccagagtcccctc

SEQ ID NO: 207844 - DNA, 25 bp, Mus musculus
agtagacgagtagcagagtcccctc

SEQ ID NO: 207845 - DNA, 25 bp, Mus musculus
agtagacgccaaccctgtgttcacg

SEQ ID NO: 207846 - DNA, 25 bp, Mus musculus
agtagacgccaagcctgtgttcacg

SEQ ID NO: 207847 - DNA, 25 bp, Mus musculus
agtagactctgcagtgactggtcca

SEQ ID NO: 207848 - DNA, 25 bp, Mus musculus
agtagactctgctgtgactggtcca

SEQ ID NO: 207849 - DNA, 25 bp, Mus musculus
agtagactcttgcttattttgggtg

SEQ ID NO: 207850 - DNA, 25 bp, Mus musculus
agtagactcttggttattttgggtg

SEQ ID NO: 207851 - DNA, 25 bp, Mus musculus
agtagactgctgattccaacgtgag

SEQ ID NO: 207852 - DNA, 25 bp, Mus musculus
agtagactgctgtttccaacgtgag

SEQ ID NO: 207853 - DNA, 25 bp, Mus musculus
agtagactggacattgtgatacaaa

SEQ ID NO: 207854 - DNA, 25 bp, Mus musculus
agtagactggactttgtgatacaaa

SEQ ID NO: 207855 - DNA, 25 bp, Mus musculus
agtagactggtcacagcgcttgctt

SEQ ID NO: 207856 - DNA, 25 bp, Mus musculus
agtagactggtctcagcgcttgctt

SEQ ID NO: 207857 - DNA, 25 bp, Mus musculus
agtagactgttaactcgggcccaga

SEQ ID NO: 207858 - DNA, 25 bp, Mus musculus
agtagactgttatctcgggcccaga

SEQ ID NO: 207859 - DNA, 25 bp, Mus musculus
agtagacttccaaatacacaccatt

SEQ ID NO: 207860 - DNA, 25 bp, Mus musculus
agtagacttccatatacacaccatt

SEQ ID NO: 207861 - DNA, 25 bp, Mus musculus
agtagactttagcatccccagggct

SEQ ID NO: 207862 - DNA, 25 bp, Mus musculus
agtagactttaggatccccagggct

SEQ ID NO: 207863 - DNA, 25 bp, Mus musculus
agtagagaatatacctgccacccta

SEQ ID NO: 207864 - DNA, 25 bp, Mus musculus
agtagagaatattcctgccacccta

SEQ ID NO: 207865 - DNA, 25 bp, Mus musculus
agtagagaccatacactgagcaata

SEQ ID NO: 207866 - DNA, 25 bp, Mus musculus
agtagagaccattcactgagcaata

SEQ ID NO: 207867 - DNA, 25 bp, Mus musculus
agtagagaccggacacttcacccat

SEQ ID NO: 207868 - DNA, 25 bp, Mus musculus
agtagagaccggtcacttcacccat

SEQ ID NO: 207869 - DNA, 25 bp, Mus musculus
agtagagactacactctgcccccag

SEQ ID NO: 207870 - DNA, 25 bp, Mus musculus
agtagagactactctctgcccccag

SEQ ID NO: 207871 - DNA, 25 bp, Mus musculus
agtagagagctcagcaatgggccca

SEQ ID NO: 207872 - DNA, 25 bp, Mus musculus
agtagagagctctgcaatgggccca

SEQ ID NO: 207873 - DNA, 25 bp, Mus musculus
agtagagaggctccaacacacatat

SEQ ID NO: 207874 - DNA, 25 bp, Mus musculus
agtagagaggctgcaacacacatat

SEQ ID NO: 207875 - DNA, 25 bp, Mus musculus
agtagagaggttagatttgattgat

SEQ ID NO: 207876 - DNA, 25 bp, Mus musculus
agtagagaggtttgatttgattgat

SEQ ID NO: 207877 - DNA, 25 bp, Mus musculus
agtagagatcttccaatccggtgcc

SEQ ID NO: 207878 - DNA, 25 bp, Mus musculus
agtagagatcttgcaatccggtgcc

SEQ ID NO: 207879 - DNA, 25 bp, Mus musculus
agtagagatgttagcgcggagtccc

SEQ ID NO: 207880 - DNA, 25 bp, Mus musculus
agtagagatgtttgcgcggagtccc

SEQ ID NO: 207881 - DNA, 25 bp, Mus musculus
agtagagcaatgacacctggctggt

SEQ ID NO: 207882 - DNA, 25 bp, Mus musculus
agtagagcaatgtcacctggctggt

SEQ ID NO: 207883 - DNA, 25 bp, Mus musculus
agtagagcacccactcagaagtagg

SEQ ID NO: 207884 - DNA, 25 bp, Mus musculus
agtagagcaccctctcagaagtagg

SEQ ID NO: 207885 - DNA, 25 bp, Mus musculus
agtagagcacgtcgccgagatgaag

SEQ ID NO: 207886 - DNA, 25 bp, Mus musculus
agtagagcacgtggccgagatgaag

SEQ ID NO: 207887 - DNA, 25 bp, Mus musculus
agtagagcactccagccatgtacat

SEQ ID NO: 207888 - DNA, 25 bp, Mus musculus
agtagagcactcgagccatgtacat

SEQ ID NO: 207889 - DNA, 25 bp, Mus musculus
agtagagcacttatgatcacacgtt

SEQ ID NO: 207890 - DNA, 25 bp, Mus musculus
agtagagcacttttgatcacacgtt

SEQ ID NO: 207891 - DNA, 25 bp, Mus musculus
agtagagcagcaacaggtgcccact

SEQ ID NO: 207892 - DNA, 25 bp, Mus musculus
agtagagcagcatcaggtgcccact

SEQ ID NO: 207893 - DNA, 25 bp, Mus musculus
agtagagcagctagtgaacttgtta

SEQ ID NO: 207894 - DNA, 25 bp, Mus musculus
agtagagcagcttgtgaacttgtta

SEQ ID NO: 207895 - DNA, 25 bp, Mus musculus
agtagagcatcaagtatttggtatt

SEQ ID NO: 207896 - DNA, 25 bp, Mus musculus
agtagagcatcatgtatttggtatt

SEQ ID NO: 207897 - DNA, 25 bp, Mus musculus
agtagagcccaacctggatgcagct

SEQ ID NO: 207898 - DNA, 25 bp, Mus musculus
agtagagcccaagctggatgcagct

SEQ ID NO: 207899 - DNA, 25 bp, Mus musculus
agtagagcccggatgagcagacgcc

SEQ ID NO: 207900 - DNA, 25 bp, Mus musculus
agtagagcccggttgagcagacgcc

SEQ ID NO: 207901 - DNA, 25 bp, Mus musculus
agtagagccctaagtgtcactagta

SEQ ID NO: 207902 - DNA, 25 bp, Mus musculus
agtagagccctatgtgtcactagta

SEQ ID NO: 207903 - DNA, 25 bp, Mus musculus
agtagagcctctcgattttcatgag

SEQ ID NO: 207904 - DNA, 25 bp, Mus musculus
agtagagcctctggattttcatgag

SEQ ID NO: 207905 - DNA, 25 bp, Mus musculus
agtagagccttcatctcctttatga

SEQ ID NO: 207906 - DNA, 25 bp, Mus musculus
agtagagccttcttctcctttatga

SEQ ID NO: 207907 - DNA, 25 bp, Mus musculus
agtagagcgcatacttgcctctgct

SEQ ID NO: 207908 - DNA, 25 bp, Mus musculus
agtagagcgcattcttgcctctgct

SEQ ID NO: 207909 - DNA, 25 bp, Mus musculus
agtagagctcaacacacagtaggta

SEQ ID NO: 207910 - DNA, 25 bp, Mus musculus
agtagagctcaagacacagtaggta

SEQ ID NO: 207911 - DNA, 25 bp, Mus musculus
agtagagctctcctgaaacatctgg

SEQ ID NO: 207912 - DNA, 25 bp, Mus musculus
agtagagctctcgtgaaacatctgg

SEQ ID NO: 207913 - DNA, 25 bp, Mus musculus
agtagagctgccaaaaatcctgtgt

SEQ ID NO: 207914 - DNA, 25 bp, Mus musculus
agtagagctgcctaaaatcctgtgt

SEQ ID NO: 207915 - DNA, 25 bp, Mus musculus
agtagagcttcgattgcttctgcca

SEQ ID NO: 207916 - DNA, 25 bp, Mus musculus
agtagagcttcgtttgcttctgcca

SEQ ID NO: 207917 - DNA, 25 bp, Mus musculus
agtagaggatttcccctgtctgagc

SEQ ID NO: 207918 - DNA, 25 bp, Mus musculus
agtagaggatttgccctgtctgagc

SEQ ID NO: 207919 - DNA, 25 bp, Mus musculus
agtagaggcattacctgccaagcct

SEQ ID NO: 207920 - DNA, 25 bp, Mus musculus
agtagaggcatttcctgccaagcct

SEQ ID NO: 207921 - DNA, 25 bp, Mus musculus
agtagaggcccaatagtcgtgcaaa

SEQ ID NO: 207922 - DNA, 25 bp, Mus musculus
agtagaggcccattagtcgtgcaaa

SEQ ID NO: 207923 - DNA, 25 bp, Mus musculus
agtagaggccccacccattttcctg

SEQ ID NO: 207924 - DNA, 25 bp, Mus musculus
agtagaggcccctcccattttcctg

SEQ ID NO: 207925 - DNA, 25 bp, Mus musculus
agtagaggcctcagttccagcagtg

SEQ ID NO: 207926 - DNA, 25 bp, Mus musculus
agtagaggcctctgttccagcagtg

SEQ ID NO: 207927 - DNA, 25 bp, Mus musculus
agtagaggctcacggctcctgagac

SEQ ID NO: 207928 - DNA, 25 bp, Mus musculus
agtagaggctcagggctcctgagac

SEQ ID NO: 207929 - DNA, 25 bp, Mus musculus
agtagaggctgcaccagccgatcac

SEQ ID NO: 207930 - DNA, 25 bp, Mus musculus
agtagaggctgctccagccgatcac

SEQ ID NO: 207931 - DNA, 25 bp, Mus musculus
agtagagggaacactcagccttagg

SEQ ID NO: 207932 - DNA, 25 bp, Mus musculus
agtagagggaactctcagccttagg

SEQ ID NO: 207933 - DNA, 25 bp, Mus musculus
agtagagtacacacaggctgccatt

SEQ ID NO: 207934 - DNA, 25 bp, Mus musculus
agtagagtacactcaggctgccatt

SEQ ID NO: 207935 - DNA, 25 bp, Mus musculus
agtagagtccacagcggcaaacatc

SEQ ID NO: 207936 - DNA, 25 bp, Mus musculus
agtagagtccactgcggcaaacatc

SEQ ID NO: 207937 - DNA, 25 bp, Mus musculus
agtagagtgtcccatttgtcgaaag

SEQ ID NO: 207938 - DNA, 25 bp, Mus musculus
agtagagtgtccgatttgtcgaaag

SEQ ID NO: 207939 - DNA, 25 bp, Mus musculus
agtagagttcttcctgtccgtgaaa

SEQ ID NO: 207940 - DNA, 25 bp, Mus musculus
agtagagttcttgctgtccgtgaaa

SEQ ID NO: 207941 - DNA, 25 bp, Mus musculus
agtagagttgccatcattgaaggga

SEQ ID NO: 207942 - DNA, 25 bp, Mus musculus
agtagagttgccttcattgaaggga

SEQ ID NO: 207943 - DNA, 25 bp, Mus musculus
agtagatacaggatttccaggagca

SEQ ID NO: 207944 - DNA, 25 bp, Mus musculus
agtagatacaggttttccaggagca

SEQ ID NO: 207945 - DNA, 25 bp, Mus musculus
agtagatacagtccaagctttcctt

SEQ ID NO: 207946 - DNA, 25 bp, Mus musculus
agtagatacagtgcaagctttcctt

SEQ ID NO: 207947 - DNA, 25 bp, Mus musculus
agtagatacatcctcaggcctgagt

SEQ ID NO: 207948 - DNA, 25 bp, Mus musculus
agtagatacatcgtcaggcctgagt

SEQ ID NO: 207949 - DNA, 25 bp, Mus musculus
agtagataccaactccccaggagct

SEQ ID NO: 207950 - DNA, 25 bp, Mus musculus
agtagataccaagtccccaggagct

SEQ ID NO: 207951 - DNA, 25 bp, Mus musculus
agtagataccacaagctgcgggctc

SEQ ID NO: 207952 - DNA, 25 bp, Mus musculus
agtagataccactagctgcgggctc

SEQ ID NO: 207953 - DNA, 25 bp, Mus musculus
agtagataccctaagccctgaagag

SEQ ID NO: 207954 - DNA, 25 bp, Mus musculus
agtagatacccttagccctgaagag

SEQ ID NO: 207955 - DNA, 25 bp, Mus musculus
agtagatacgatatttgaggcaaat

SEQ ID NO: 207956 - DNA, 25 bp, Mus musculus
agtagatacgatttttgaggcaaat

SEQ ID NO: 207957 - DNA, 25 bp, Mus musculus
agtagatagagcacagcacccgcac

SEQ ID NO: 207958 - DNA, 25 bp, Mus musculus
agtagatagagctcagcacccgcac

SEQ ID NO: 207959 - DNA, 25 bp, Mus musculus
agtagatagcccatttccacgttct

SEQ ID NO: 207960 - DNA, 25 bp, Mus musculus
agtagatagcccttttccacgttct

SEQ ID NO: 207961 - DNA, 25 bp, Mus musculus
agtagatagcctcagtctttctgcc

SEQ ID NO: 207962 - DNA, 25 bp, Mus musculus
agtagatagcctgagtctttctgcc

SEQ ID NO: 207963 - DNA, 25 bp, Mus musculus
agtagatatcttccccaatgggtat

SEQ ID NO: 207964 - DNA, 25 bp, Mus musculus
agtagatatcttgcccaatgggtat

SEQ ID NO: 207965 - DNA, 25 bp, Mus musculus
agtagatattcacctccatgtcaca

SEQ ID NO: 207966 - DNA, 25 bp, Mus musculus
agtagatattcagctccatgtcaca

SEQ ID NO: 207967 - DNA, 25 bp, Mus musculus
agtagatcacagagcgtgcctggca

SEQ ID NO: 207968 - DNA, 25 bp, Mus musculus
agtagatcacagtgcgtgcctggca

SEQ ID NO: 207969 - DNA, 25 bp, Mus musculus
agtagatcaggacccctagcaacaa

SEQ ID NO: 207970 - DNA, 25 bp, Mus musculus
agtagatcaggagccctagcaacaa

SEQ ID NO: 207971 - DNA, 25 bp, Mus musculus
agtagatcccaaactgctttctcag

SEQ ID NO: 207972 - DNA, 25 bp, Mus musculus
agtagatcccaatctgctttctcag

SEQ ID NO: 207973 - DNA, 25 bp, Mus musculus
agtagatctctacagcttgctggcc

SEQ ID NO: 207974 - DNA, 25 bp, Mus musculus
agtagatctctagagcttgctggcc

SEQ ID NO: 207975 - DNA, 25 bp, Mus musculus
agtagatctctgcagttcaccgctc

SEQ ID NO: 207976 - DNA, 25 bp, Mus musculus
agtagatctctggagttcaccgctc

SEQ ID NO: 207977 - DNA, 25 bp, Mus musculus
agtagatgaaatacctgcgacttta

SEQ ID NO: 207978 - DNA, 25 bp, Mus musculus
agtagatgaaattcctgcgacttta

SEQ ID NO: 207979 - DNA, 25 bp, Mus musculus
agtagatgacctacggtctcgacac

SEQ ID NO: 207980 - DNA, 25 bp, Mus musculus
agtagatgaccttcggtctcgacac

SEQ ID NO: 207981 - DNA, 25 bp, Mus musculus
agtagatgattgactccgattaaga

SEQ ID NO: 207982 - DNA, 25 bp, Mus musculus
agtagatgattgtctccgattaaga

SEQ ID NO: 207983 - DNA, 25 bp, Mus musculus
agtagatgcgtaactgtgcaaacag

SEQ ID NO: 207984 - DNA, 25 bp, Mus musculus
agtagatgcgtatctgtgcaaacag

SEQ ID NO: 207985 - DNA, 25 bp, Mus musculus
agtagatggaagactccactccacc

SEQ ID NO: 207986 - DNA, 25 bp, Mus musculus
agtagatggaagtctccactccacc

SEQ ID NO: 207987 - DNA, 25 bp, Mus musculus
agtagatggacactggcagctttgt

SEQ ID NO: 207988 - DNA, 25 bp, Mus musculus
agtagatggacagtggcagctttgt

SEQ ID NO: 207989 - DNA, 25 bp, Mus musculus
agtagatggcagcatggactcctaa

SEQ ID NO: 207990 - DNA, 25 bp, Mus musculus
agtagatggcaggatggactcctaa

SEQ ID NO: 207991 - DNA, 25 bp, Mus musculus
agtagatgggcccaagcacagcctc

SEQ ID NO: 207992 - DNA, 25 bp, Mus musculus
agtagatgggccgaagcacagcctc

SEQ ID NO: 207993 - DNA, 25 bp, Mus musculus
agtagatggtgacctataccctcct

SEQ ID NO: 207994 - DNA, 25 bp, Mus musculus
agtagatggtgagctataccctcct

SEQ ID NO: 207995 - DNA, 25 bp, Mus musculus
agtagatgtaagcacccacctgcca

SEQ ID NO: 207996 - DNA, 25 bp, Mus musculus
agtagatgtaaggacccacctgcca

SEQ ID NO: 207997 - DNA, 25 bp, Mus musculus
agtagatgtgcaccctaaggattta

SEQ ID NO: 207998 - DNA, 25 bp, Mus musculus
agtagatgtgcagcctaaggattta

SEQ ID NO: 207999 - DNA, 25 bp, Mus musculus
agtagatgttccctatggcataaag

SEQ ID NO: 208000 - DNA, 25 bp, Mus musculus
agtagatgttccgtatggcataaag

SEQ ID NO: 208001 - DNA, 25 bp, Mus musculus
agtagattaaatcctccccatacgt

SEQ ID NO: 208002 - DNA, 25 bp, Mus musculus
agtagattaaatgctccccatacgt

SEQ ID NO: 208003 - DNA, 25 bp, Mus musculus
agtagattaccacccatttgccagc

SEQ ID NO: 208004 - DNA, 25 bp, Mus musculus
agtagattaccagccatttgccagc

SEQ ID NO: 208005 - DNA, 25 bp, Mus musculus
agtagattcagcactctggcaatga

SEQ ID NO: 208006 - DNA, 25 bp, Mus musculus
agtagattcagctctctggcaatga

SEQ ID NO: 208007 - DNA, 25 bp, Mus musculus
agtagattcccaagtcactgctgtg

SEQ ID NO: 208008 - DNA, 25 bp, Mus musculus
agtagattcccatgtcactgctgtg

SEQ ID NO: 208009 - DNA, 25 bp, Mus musculus
agtagattccctacagaatcctcta

SEQ ID NO: 208010 - DNA, 25 bp, Mus musculus
agtagattcccttcagaatcctcta

SEQ ID NO: 208011 - DNA, 25 bp, Mus musculus
agtagattcctgaaggcctcctcga

SEQ ID NO: 208012 - DNA, 25 bp, Mus musculus
agtagattcctgtaggcctcctcga

SEQ ID NO: 208013 - DNA, 25 bp, Mus musculus
agtagattcgagacttaccttaatt

SEQ ID NO: 208014 - DNA, 25 bp, Mus musculus
agtagattcgagtcttaccttaatt

SEQ ID NO: 208015 - DNA, 25 bp, Mus musculus
agtagattgagaaaccccccaaact

SEQ ID NO: 208016 - DNA, 25 bp, Mus musculus
agtagattgagataccccccaaact

SEQ ID NO: 208017 - DNA, 25 bp, Mus musculus
agtagatttcacatccttgtgcttt

SEQ ID NO: 208018 - DNA, 25 bp, Mus musculus
agtagatttcacttccttgtgcttt

SEQ ID NO: 208019 - DNA, 25 bp, Mus musculus
agtagatttcttaggtctggtacct

SEQ ID NO: 208020 - DNA, 25 bp, Mus musculus
agtagatttctttggtctggtacct

SEQ ID NO: 208021 - DNA, 25 bp, Mus musculus
agtagatttggtaccttgcagccac

SEQ ID NO: 208022 - DNA, 25 bp, Mus musculus
agtagatttggttccttgcagccac

SEQ ID NO: 208023 - DNA, 25 bp, Mus musculus
agtagatttgtaccgtatcccactt

SEQ ID NO: 208024 - DNA, 25 bp, Mus musculus
agtagatttgtagcgtatcccactt

SEQ ID NO: 208025 - DNA, 25 bp, Mus musculus
agtagcaaaagacccgagccctgct

SEQ ID NO: 208026 - DNA, 25 bp, Mus musculus
agtagcaaaagagccgagccctgct

SEQ ID NO: 208027 - DNA, 25 bp, Mus musculus
agtagcaaaatcatcttccaccgca

SEQ ID NO: 208028 - DNA, 25 bp, Mus musculus
agtagcaaaatcttcttccaccgca

SEQ ID NO: 208029 - DNA, 25 bp, Mus musculus
agtagcaacaacaaagccaacgtgt

SEQ ID NO: 208030 - DNA, 25 bp, Mus musculus
agtagcaacaactaagccaacgtgt

SEQ ID NO: 208031 - DNA, 25 bp, Mus musculus
agtagcaaccctaactggactaaag

SEQ ID NO: 208032 - DNA, 25 bp, Mus musculus
agtagcaacccttactggactaaag

SEQ ID NO: 208033 - DNA, 25 bp, Mus musculus
agtagcaaggaacccctggagtctt

SEQ ID NO: 208034 - DNA, 25 bp, Mus musculus
agtagcaaggaagccctggagtctt

SEQ ID NO: 208035 - DNA, 25 bp, Mus musculus
agtagcaaggctactccttctcagt

SEQ ID NO: 208036 - DNA, 25 bp, Mus musculus
agtagcaaggctcccgggctgacct

SEQ ID NO: 208037 - DNA, 25 bp, Mus musculus
agtagcaaggctgccgggctgacct

SEQ ID NO: 208038 - DNA, 25 bp, Mus musculus
agtagcaaggcttctccttctcagt

SEQ ID NO: 208039 - DNA, 25 bp, Mus musculus
agtagcaaggttccaaatgtggcaa

SEQ ID NO: 208040 - DNA, 25 bp, Mus musculus
agtagcaaggttgcaaatgtggcaa

SEQ ID NO: 208041 - DNA, 25 bp, Mus musculus
agtagcaagtgtccccatgaaggtg

SEQ ID NO: 208042 - DNA, 25 bp, Mus musculus
agtagcaagtgtgcccatgaaggtg

SEQ ID NO: 208043 - DNA, 25 bp, Mus musculus
agtagcaatcccacaatgcactgta

SEQ ID NO: 208044 - DNA, 25 bp, Mus musculus
agtagcaatccctcaatgcactgta

SEQ ID NO: 208045 - DNA, 25 bp, Mus musculus
agtagcacacagatacctgcaactc

SEQ ID NO: 208046 - DNA, 25 bp, Mus musculus
agtagcacacagcttgtagttccct

SEQ ID NO: 208047 - DNA, 25 bp, Mus musculus
agtagcacacaggttgtagttccct

SEQ ID NO: 208048 - DNA, 25 bp, Mus musculus
agtagcacacagttacctgcaactc

SEQ ID NO: 208049 - DNA, 25 bp, Mus musculus
agtagcacatgccatcatcatcttc

SEQ ID NO: 208050 - DNA, 25 bp, Mus musculus
agtagcacatgcgatcatcatcttc

SEQ ID NO: 208051 - DNA, 25 bp, Mus musculus
agtagcaccataataagtcttgtta

SEQ ID NO: 208052 - DNA, 25 bp, Mus musculus
agtagcaccatattaagtcttgtta

SEQ ID NO: 208053 - DNA, 25 bp, Mus musculus
agtagcacccataacagacttaatt

SEQ ID NO: 208054 - DNA, 25 bp, Mus musculus
agtagcacccattacagacttaatt

SEQ ID NO: 208055 - DNA, 25 bp, Mus musculus
agtagcaccttgctaacatccctgg

SEQ ID NO: 208056 - DNA, 25 bp, Mus musculus
agtagcaccttggtaacatccctgg

SEQ ID NO: 208057 - DNA, 25 bp, Mus musculus
agtagcacggtacatgtccctttga

SEQ ID NO: 208058 - DNA, 25 bp, Mus musculus
agtagcacggtagatgtccctttga

SEQ ID NO: 208059 - DNA, 25 bp, Mus musculus
agtagcactagtctagggttcctac

SEQ ID NO: 208060 - DNA, 25 bp, Mus musculus
agtagcactagtgtagggttcctac

SEQ ID NO: 208061 - DNA, 25 bp, Mus musculus
agtagcacttctactggatttgaat

SEQ ID NO: 208062 - DNA, 25 bp, Mus musculus
agtagcacttcttctggatttgaat

SEQ ID NO: 208063 - DNA, 25 bp, Mus musculus
agtagcactttacaatggaacatgt

SEQ ID NO: 208064 - DNA, 25 bp, Mus musculus
agtagcactttagaatggaacatgt

SEQ ID NO: 208065 - DNA, 25 bp, Mus musculus
agtagcagacctctatgcttgcctc

SEQ ID NO: 208066 - DNA, 25 bp, Mus musculus
agtagcagacctgtatgcttgcctc

SEQ ID NO: 208067 - DNA, 25 bp, Mus musculus
agtagcagatgcaggcccacagtca

SEQ ID NO: 208068 - DNA, 25 bp, Mus musculus
agtagcagatgctggcccacagtca

SEQ ID NO: 208069 - DNA, 25 bp, Mus musculus
agtagcagcactcggtggcctaacc

SEQ ID NO: 208070 - DNA, 25 bp, Mus musculus
agtagcagcactgggtggcctaacc

SEQ ID NO: 208071 - DNA, 25 bp, Mus musculus
agtagcagccgtagcctttgggaag

SEQ ID NO: 208072 - DNA, 25 bp, Mus musculus
agtagcagccgttgcctttgggaag

SEQ ID NO: 208073 - DNA, 25 bp, Mus musculus
agtagcagggtcaaccagctctggg

SEQ ID NO: 208074 - DNA, 25 bp, Mus musculus
agtagcagggtctaccagctctggg

SEQ ID NO: 208075 - DNA, 25 bp, Mus musculus
agtagcaggttgactctgagcagat

SEQ ID NO: 208076 - DNA, 25 bp, Mus musculus
agtagcaggttgtctctgagcagat

SEQ ID NO: 208077 - DNA, 25 bp, Mus musculus
agtagcagtactccttacaaattgt

SEQ ID NO: 208078 - DNA, 25 bp, Mus musculus
agtagcagtactgcttacaaattgt

SEQ ID NO: 208079 - DNA, 25 bp, Mus musculus
agtagcagtctgagtcccatggtaa

SEQ ID NO: 208080 - DNA, 25 bp, Mus musculus
agtagcagtctgtgtcccatggtaa

SEQ ID NO: 208081 - DNA, 25 bp, Mus musculus
agtagcatactccaacccatctatc

SEQ ID NO: 208082 - DNA, 25 bp, Mus musculus
agtagcatactcgaacccatctatc

SEQ ID NO: 208083 - DNA, 25 bp, Mus musculus
agtagcatcctgagtgtgtgcggtt

SEQ ID NO: 208084 - DNA, 25 bp, Mus musculus
agtagcatcctgtgtgtgtgcggtt

SEQ ID NO: 208085 - DNA, 25 bp, Mus musculus
agtagcatgccaccccataaaccag

SEQ ID NO: 208086 - DNA, 25 bp, Mus musculus
agtagcatgccagcccataaaccag

SEQ ID NO: 208087 - DNA, 25 bp, Mus musculus
agtagcatggcaccgattgggtcca

SEQ ID NO: 208088 - DNA, 25 bp, Mus musculus
agtagcatggcagcgattgggtcca

SEQ ID NO: 208089 - DNA, 25 bp, Mus musculus
agtagcatgtaacattaccctctgg

SEQ ID NO: 208090 - DNA, 25 bp, Mus musculus
agtagcatgtaagattaccctctgg

SEQ ID NO: 208091 - DNA, 25 bp, Mus musculus
agtagcattaccctctatcgaaagc

SEQ ID NO: 208092 - DNA, 25 bp, Mus musculus
agtagcattaccgtctatcgaaagc

SEQ ID NO: 208093 - DNA, 25 bp, Mus musculus
agtagcattccaactcattgtaagt

SEQ ID NO: 208094 - DNA, 25 bp, Mus musculus
agtagcattccatctcattgtaagt

SEQ ID NO: 208095 - DNA, 25 bp, Mus musculus
agtagccaacttattccagatcaaa

SEQ ID NO: 208096 - DNA, 25 bp, Mus musculus
agtagccaactttttccagatcaaa

SEQ ID NO: 208097 - DNA, 25 bp, Mus musculus
agtagccacaccaaccagtaattag

SEQ ID NO: 208098 - DNA, 25 bp, Mus musculus
agtagccacacctaccagtaattag

SEQ ID NO: 208099 - DNA, 25 bp, Mus musculus
agtagccacgtaccagaagtctgaa

SEQ ID NO: 208100 - DNA, 25 bp, Mus musculus
agtagccacgtagcagaagtctgaa

SEQ ID NO: 208101 - DNA, 25 bp, Mus musculus
agtagccactggcagtcaccacctt

SEQ ID NO: 208102 - DNA, 25 bp, Mus musculus
agtagccactgggagtcaccacctt

SEQ ID NO: 208103 - DNA, 25 bp, Mus musculus
agtagccactgtccttatttcttgg

SEQ ID NO: 208104 - DNA, 25 bp, Mus musculus
agtagccactgtgcttatttcttgg

SEQ ID NO: 208105 - DNA, 25 bp, Mus musculus
agtagccaggctagataagagttaa

SEQ ID NO: 208106 - DNA, 25 bp, Mus musculus
agtagccaggcttgataagagttaa

SEQ ID NO: 208107 - DNA, 25 bp, Mus musculus
agtagccagtgaagactggatctga

SEQ ID NO: 208108 - DNA, 25 bp, Mus musculus
agtagccagtgatgactggatctga

SEQ ID NO: 208109 - DNA, 25 bp, Mus musculus
agtagccatatcagccatcttattg

SEQ ID NO: 208110 - DNA, 25 bp, Mus musculus
agtagccatatctgccatcttattg

SEQ ID NO: 208111 - DNA, 25 bp, Mus musculus
agtagccatgctcttgattgtgaca

SEQ ID NO: 208112 - DNA, 25 bp, Mus musculus
agtagccatgctgttgattgtgaca

SEQ ID NO: 208113 - DNA, 25 bp, Mus musculus
agtagccatgggagcagtgcctgta

SEQ ID NO: 208114 - DNA, 25 bp, Mus musculus
agtagccatgggtgcagtgcctgta

SEQ ID NO: 208115 - DNA, 25 bp, Mus musculus
agtagccatgttactttctctgtat

SEQ ID NO: 208116 - DNA, 25 bp, Mus musculus
agtagccatgtttctttctctgtat

SEQ ID NO: 208117 - DNA, 25 bp, Mus musculus
agtagcccagggacatctaataaac

SEQ ID NO: 208118 - DNA, 25 bp, Mus musculus
agtagcccagggtcatctaataaac

SEQ ID NO: 208119 - DNA, 25 bp, Mus musculus
agtagcccagtaatgccttaaataa

SEQ ID NO: 208120 - DNA, 25 bp, Mus musculus
agtagcccagtattgccttaaataa

SEQ ID NO: 208121 - DNA, 25 bp, Mus musculus
agtagcccctttaggaccagatgct

SEQ ID NO: 208122 - DNA, 25 bp, Mus musculus
agtagccccttttggaccagatgct

SEQ ID NO: 208123 - DNA, 25 bp, Mus musculus
agtagccctcttactgttctcagga

SEQ ID NO: 208124 - DNA, 25 bp, Mus musculus
agtagccctctttctgttctcagga

SEQ ID NO: 208125 - DNA, 25 bp, Mus musculus
agtagccctgagattggaaagccgc

SEQ ID NO: 208126 - DNA, 25 bp, Mus musculus
agtagccctgagtttggaaagccgc

SEQ ID NO: 208127 - DNA, 25 bp, Mus musculus
agtagccgatgacgccacaggtgcc

SEQ ID NO: 208128 - DNA, 25 bp, Mus musculus
agtagccgatgaggccacaggtgcc

SEQ ID NO: 208129 - DNA, 25 bp, Mus musculus
agtagccgatgcattggagcctgtc

SEQ ID NO: 208130 - DNA, 25 bp, Mus musculus
agtagccgatgctttggagcctgtc

SEQ ID NO: 208131 - DNA, 25 bp, Mus musculus
agtagccgatgtatgtgcctccaat

SEQ ID NO: 208132 - DNA, 25 bp, Mus musculus
agtagccgatgtttgtgcctccaat

SEQ ID NO: 208133 - DNA, 25 bp, Mus musculus
agtagccgtccactacttggcagat

SEQ ID NO: 208134 - DNA, 25 bp, Mus musculus
agtagccgtccagtacttggcagat

SEQ ID NO: 208135 - DNA, 25 bp, Mus musculus
agtagccgttgtagctgcagatcaa

SEQ ID NO: 208136 - DNA, 25 bp, Mus musculus
agtagccgttgttgctgcagatcaa

SEQ ID NO: 208137 - DNA, 25 bp, Mus musculus
agtagcctaagactgggtgccagaa

SEQ ID NO: 208138 - DNA, 25 bp, Mus musculus
agtagcctaagagtgggtgccagaa

SEQ ID NO: 208139 - DNA, 25 bp, Mus musculus
agtagcctactacctagagccttta

SEQ ID NO: 208140 - DNA, 25 bp, Mus musculus
agtagcctactagctagagccttta

SEQ ID NO: 208141 - DNA, 25 bp, Mus musculus
agtagcctcaatcggatcacagaaa

SEQ ID NO: 208142 - DNA, 25 bp, Mus musculus
agtagcctcaatgggatcacagaaa

SEQ ID NO: 208143 - DNA, 25 bp, Mus musculus
agtagcctcacactgttcatattca

SEQ ID NO: 208144 - DNA, 25 bp, Mus musculus
agtagcctcacagtgttcatattca

SEQ ID NO: 208145 - DNA, 25 bp, Mus musculus
agtagcctctttagaatctcccttt

SEQ ID NO: 208146 - DNA, 25 bp, Mus musculus
agtagcctcttttgaatctcccttt

SEQ ID NO: 208147 - DNA, 25 bp, Mus musculus
agtagcctgcatagagactccaaga

SEQ ID NO: 208148 - DNA, 25 bp, Mus musculus
agtagcctgcattgagactccaaga

SEQ ID NO: 208149 - DNA, 25 bp, Mus musculus
agtagcctgtatctgtaaccccaga

SEQ ID NO: 208150 - DNA, 25 bp, Mus musculus
agtagcctgtatgtgtaaccccaga

SEQ ID NO: 208151 - DNA, 25 bp, Mus musculus
agtagcctgtcacaagtacttcgag

SEQ ID NO: 208152 - DNA, 25 bp, Mus musculus
agtagcctgtcacacggatagtaca

SEQ ID NO: 208153 - DNA, 25 bp, Mus musculus
agtagcctgtcagaagtacttcgag

SEQ ID NO: 208154 - DNA, 25 bp, Mus musculus
agtagcctgtcagacggatagtaca

SEQ ID NO: 208155 - DNA, 25 bp, Mus musculus
agtagccttagcattccatgatttg

SEQ ID NO: 208156 - DNA, 25 bp, Mus musculus
agtagccttagctttccatgatttg

SEQ ID NO: 208157 - DNA, 25 bp, Mus musculus
agtagccttctactcatttctttct

SEQ ID NO: 208158 - DNA, 25 bp, Mus musculus
agtagccttctagtcatttctttct

SEQ ID NO: 208159 - DNA, 25 bp, Mus musculus
agtagccttgcgaattctgctgagc

SEQ ID NO: 208160 - DNA, 25 bp, Mus musculus
agtagccttgcgtattctgctgagc

SEQ ID NO: 208161 - DNA, 25 bp, Mus musculus
agtagccttggtagagatctcacgg

SEQ ID NO: 208162 - DNA, 25 bp, Mus musculus
agtagccttggttgagatctcacgg

SEQ ID NO: 208163 - DNA, 25 bp, Mus musculus
agtagccttgtacctttcctgatac

SEQ ID NO: 208164 - DNA, 25 bp, Mus musculus
agtagccttgtagctttcctgatac

SEQ ID NO: 208165 - DNA, 25 bp, Mus musculus
agtagcctttcacttcctgatggaa

SEQ ID NO: 208166 - DNA, 25 bp, Mus musculus
agtagcctttcagttcctgatggaa

SEQ ID NO: 208167 - DNA, 25 bp, Mus musculus
agtagcgatactaattgtccccagc

SEQ ID NO: 208168 - DNA, 25 bp, Mus musculus
agtagcgatacttattgtccccagc

SEQ ID NO: 208169 - DNA, 25 bp, Mus musculus
agtagcgattccaacacggactttt

SEQ ID NO: 208170 - DNA, 25 bp, Mus musculus
agtagcgattcctacacggactttt

SEQ ID NO: 208171 - DNA, 25 bp, Mus musculus
agtagcgcctcaaagtctcattaaa

SEQ ID NO: 208172 - DNA, 25 bp, Mus musculus
agtagcgcctcatagtctcattaaa

SEQ ID NO: 208173 - DNA, 25 bp, Mus musculus
agtagcgcctttccctatggagtac

SEQ ID NO: 208174 - DNA, 25 bp, Mus musculus
agtagcgcctttgcctatggagtac

SEQ ID NO: 208175 - DNA, 25 bp, Mus musculus
agtagcggcagcaccagtagcggca

SEQ ID NO: 208176 - DNA, 25 bp, Mus musculus
agtagcggcagctccagtagcggca

SEQ ID NO: 208177 - DNA, 25 bp, Mus musculus
agtagcgtagttatagagatgtcaa

SEQ ID NO: 208178 - DNA, 25 bp, Mus musculus
agtagcgtagttttagagatgtcaa

SEQ ID NO: 208179 - DNA, 25 bp, Mus musculus
agtagcgtccatatcctatttcagc

SEQ ID NO: 208180 - DNA, 25 bp, Mus musculus
agtagcgtccatttcctatttcagc

SEQ ID NO: 208181 - DNA, 25 bp, Mus musculus
agtagctaaactccctttcagttct

SEQ ID NO: 208182 - DNA, 25 bp, Mus musculus
agtagctaaactgcctttcagttct

SEQ ID NO: 208183 - DNA, 25 bp, Mus musculus
agtagctaaggaagtcgccaccttc

SEQ ID NO: 208184 - DNA, 25 bp, Mus musculus
agtagctaaggatgtcgccaccttc

SEQ ID NO: 208185 - DNA, 25 bp, Mus musculus
agtagctaatgcacggtgccctggt

SEQ ID NO: 208186 - DNA, 25 bp, Mus musculus
agtagctaatgctcggtgccctggt

SEQ ID NO: 208187 - DNA, 25 bp, Mus musculus
agtagctacacaagcagtgcgcgcg

SEQ ID NO: 208188 - DNA, 25 bp, Mus musculus
agtagctacacatgcagtgcgcgcg

SEQ ID NO: 208189 - DNA, 25 bp, Mus musculus
agtagctaccttcatactctgtgac

SEQ ID NO: 208190 - DNA, 25 bp, Mus musculus
agtagctaccttgatactctgtgac

SEQ ID NO: 208191 - DNA, 25 bp, Mus musculus
agtagctactggatcttccgtggag

SEQ ID NO: 208192 - DNA, 25 bp, Mus musculus
agtagctactggttcttccgtggag

SEQ ID NO: 208193 - DNA, 25 bp, Mus musculus
agtagctataatatcccaagggtca

SEQ ID NO: 208194 - DNA, 25 bp, Mus musculus
agtagctataatttcccaagggtca

SEQ ID NO: 208195 - DNA, 25 bp, Mus musculus
agtagctatggtagcctgcacaaaa

SEQ ID NO: 208196 - DNA, 25 bp, Mus musculus
agtagctatggttgcctgcacaaaa

SEQ ID NO: 208197 - DNA, 25 bp, Mus musculus
agtagctatgtcatacctgtgtccc

SEQ ID NO: 208198 - DNA, 25 bp, Mus musculus
agtagctatgtcttacctgtgtccc

SEQ ID NO: 208199 - DNA, 25 bp, Mus musculus
agtagctcctgactgatccacacat

SEQ ID NO: 208200 - DNA, 25 bp, Mus musculus
agtagctcctgagtgatccacacat

SEQ ID NO: 208201 - DNA, 25 bp, Mus musculus
agtagctcctggctctaaagaggct

SEQ ID NO: 208202 - DNA, 25 bp, Mus musculus
agtagctcctgggtctaaagaggct

SEQ ID NO: 208203 - DNA, 25 bp, Mus musculus
agtagctcgaggctgcacgcacatc

SEQ ID NO: 208204 - DNA, 25 bp, Mus musculus
agtagctcgagggtgcacgcacatc

SEQ ID NO: 208205 - DNA, 25 bp, Mus musculus
agtagctcgctgatgccctttggaa

SEQ ID NO: 208206 - DNA, 25 bp, Mus musculus
agtagctcgctgttgccctttggaa

SEQ ID NO: 208207 - DNA, 25 bp, Mus musculus
agtagctctctcagttcagtatggc

SEQ ID NO: 208208 - DNA, 25 bp, Mus musculus
agtagctctctctgttcagtatggc

SEQ ID NO: 208209 - DNA, 25 bp, Mus musculus
agtagctctggtcaggcaggcacac

SEQ ID NO: 208210 - DNA, 25 bp, Mus musculus
agtagctctggtgaggcaggcacac

SEQ ID NO: 208211 - DNA, 25 bp, Mus musculus
agtagctctgtaagtgttacccaat

SEQ ID NO: 208212 - DNA, 25 bp, Mus musculus
agtagctctgtatgtgttacccaat

SEQ ID NO: 208213 - DNA, 25 bp, Mus musculus
agtagctgagcgagtcttgatgaga

SEQ ID NO: 208214 - DNA, 25 bp, Mus musculus
agtagctgagcgtgtcttgatgaga

SEQ ID NO: 208215 - DNA, 25 bp, Mus musculus
agtagctgatatcaagttctcctct

SEQ ID NO: 208216 - DNA, 25 bp, Mus musculus
agtagctgatatgaagttctcctct

SEQ ID NO: 208217 - DNA, 25 bp, Mus musculus
agtagctgccccagctttctttgcc

SEQ ID NO: 208218 - DNA, 25 bp, Mus musculus
agtagctgcccctgctttctttgcc

SEQ ID NO: 208219 - DNA, 25 bp, Mus musculus
agtagctgccgaaagcccaggatgt

SEQ ID NO: 208220 - DNA, 25 bp, Mus musculus
agtagctgccgatagcccaggatgt

SEQ ID NO: 208221 - DNA, 25 bp, Mus musculus
agtagctgctaactccagcttctcc

SEQ ID NO: 208222 - DNA, 25 bp, Mus musculus
agtagctgctaagtccagcttctcc

SEQ ID NO: 208223 - DNA, 25 bp, Mus musculus
agtagctggctgcagtcgtgtcaca

SEQ ID NO: 208224 - DNA, 25 bp, Mus musculus
agtagctggctggagtcgtgtcaca

SEQ ID NO: 208225 - DNA, 25 bp, Mus musculus
agtagctgggttatgcctatgcctc

SEQ ID NO: 208226 - DNA, 25 bp, Mus musculus
agtagctgggttttgcctatgcctc

SEQ ID NO: 208227 - DNA, 25 bp, Mus musculus
agtagctgtcacaatctttgtctct

SEQ ID NO: 208228 - DNA, 25 bp, Mus musculus
agtagctgtcactatctttgtctct

SEQ ID NO: 208229 - DNA, 25 bp, Mus musculus
agtagctgtcttaatcctggctgag

SEQ ID NO: 208230 - DNA, 25 bp, Mus musculus
agtagctgtctttatcctggctgag

SEQ ID NO: 208231 - DNA, 25 bp, Mus musculus
agtagctgtgctctgggcttcctac

SEQ ID NO: 208232 - DNA, 25 bp, Mus musculus
agtagctgtgctgtgggcttcctac

SEQ ID NO: 208233 - DNA, 25 bp, Mus musculus
agtagctgtggtcttcactgccctc

SEQ ID NO: 208234 - DNA, 25 bp, Mus musculus
agtagctgtggtgttcactgccctc

SEQ ID NO: 208235 - DNA, 25 bp, Mus musculus
agtagctgtgttatagccactaaat

SEQ ID NO: 208236 - DNA, 25 bp, Mus musculus
agtagctgtgttttagccactaaat

SEQ ID NO: 208237 - DNA, 25 bp, Mus musculus
agtagctgttaaccctcaggcagag

SEQ ID NO: 208238 - DNA, 25 bp, Mus musculus
agtagctgttaagcctcaggcagag

SEQ ID NO: 208239 - DNA, 25 bp, Mus musculus
agtagctgttacagatttttcaaaa

SEQ ID NO: 208240 - DNA, 25 bp, Mus musculus
agtagctgttactgatttttcaaaa

SEQ ID NO: 208241 - DNA, 25 bp, Mus musculus
agtagcttacacagctcacactggc

SEQ ID NO: 208242 - DNA, 25 bp, Mus musculus
agtagcttacactgctcacactggc

SEQ ID NO: 208243 - DNA, 25 bp, Mus musculus
agtagcttatttatcaggtcctgat

SEQ ID NO: 208244 - DNA, 25 bp, Mus musculus
agtagcttatttttcaggtcctgat

SEQ ID NO: 208245 - DNA, 25 bp, Mus musculus
agtagcttcaacaacaggcatatgc

SEQ ID NO: 208246 - DNA, 25 bp, Mus musculus
agtagcttcaactacaggcatatgc

SEQ ID NO: 208247 - DNA, 25 bp, Mus musculus
agtagcttcaatagtttgtttcaga

SEQ ID NO: 208248 - DNA, 25 bp, Mus musculus
agtagcttcaattgtttgtttcaga

SEQ ID NO: 208249 - DNA, 25 bp, Mus musculus
agtagcttcccgaggcttcaaatga

SEQ ID NO: 208250 - DNA, 25 bp, Mus musculus
agtagcttcccgtggcttcaaatga

SEQ ID NO: 208251 - DNA, 25 bp, Mus musculus
agtagcttccttacactggagattt

SEQ ID NO: 208252 - DNA, 25 bp, Mus musculus
agtagcttcctttcactggagattt

SEQ ID NO: 208253 - DNA, 25 bp, Mus musculus
agtagcttcggtatttctgatctgt

SEQ ID NO: 208254 - DNA, 25 bp, Mus musculus
agtagcttcggtttttctgatctgt

SEQ ID NO: 208255 - DNA, 25 bp, Mus musculus
agtagcttctccactaccaagacgg

SEQ ID NO: 208256 - DNA, 25 bp, Mus musculus
agtagcttctcctctaccaagacgg

SEQ ID NO: 208257 - DNA, 25 bp, Mus musculus
agtagcttgttacaggcagtcctgt

SEQ ID NO: 208258 - DNA, 25 bp, Mus musculus
agtagcttgttagaggcagtcctgt

SEQ ID NO: 208259 - DNA, 25 bp, Mus musculus
agtagctttatgaggtgttgtcaaa

SEQ ID NO: 208260 - DNA, 25 bp, Mus musculus
agtagctttatgtggtgttgtcaaa

SEQ ID NO: 208261 - DNA, 25 bp, Mus musculus
agtagctttggcatcaagttctcag

SEQ ID NO: 208262 - DNA, 25 bp, Mus musculus
agtagctttggcttcaagttctcag

SEQ ID NO: 208263 - DNA, 25 bp, Mus musculus
agtagctttgtgaatgtttgctctc

SEQ ID NO: 208264 - DNA, 25 bp, Mus musculus
agtagctttgtgtatgtttgctctc

SEQ ID NO: 208265 - DNA, 25 bp, Mus musculus
agtaggaaccccatcttccaggact

SEQ ID NO: 208266 - DNA, 25 bp, Mus musculus
agtaggaaccccttcttccaggact

SEQ ID NO: 208267 - DNA, 25 bp, Mus musculus
agtaggaactccacctatgcctgga

SEQ ID NO: 208268 - DNA, 25 bp, Mus musculus
agtaggaactcctcctatgcctgga

SEQ ID NO: 208269 - DNA, 25 bp, Mus musculus
agtaggaagctactgtgtcttcagt

SEQ ID NO: 208270 - DNA, 25 bp, Mus musculus
agtaggaagctagtgtgtcttcagt

SEQ ID NO: 208271 - DNA, 25 bp, Mus musculus
agtaggacatgtccagtcccacctg

SEQ ID NO: 208272 - DNA, 25 bp, Mus musculus
agtaggacatgtgcagtcccacctg

SEQ ID NO: 208273 - DNA, 25 bp, Mus musculus
agtaggacattacctggctgcttct

SEQ ID NO: 208274 - DNA, 25 bp, Mus musculus
agtaggacattagctggctgcttct

SEQ ID NO: 208275 - DNA, 25 bp, Mus musculus
agtaggacccccacggagagattcg

SEQ ID NO: 208276 - DNA, 25 bp, Mus musculus
agtaggaccccctcggagagattcg

SEQ ID NO: 208277 - DNA, 25 bp, Mus musculus
agtaggactcccaagcgatcaatgc

SEQ ID NO: 208278 - DNA, 25 bp, Mus musculus
agtaggactccctagcgatcaatgc

SEQ ID NO: 208279 - DNA, 25 bp, Mus musculus
agtaggactgacaggccattgaggt

SEQ ID NO: 208280 - DNA, 25 bp, Mus musculus
agtaggactgactggccattgaggt

SEQ ID NO: 208281 - DNA, 25 bp, Mus musculus
agtaggagaacaaccaacctcatag

SEQ ID NO: 208282 - DNA, 25 bp, Mus musculus
agtaggagaacatccaacctcatag

SEQ ID NO: 208283 - DNA, 25 bp, Mus musculus
agtaggaggaccagccgcatcaggt

SEQ ID NO: 208284 - DNA, 25 bp, Mus musculus
agtaggaggacctgccgcatcaggt

SEQ ID NO: 208285 - DNA, 25 bp, Mus musculus
agtaggagtcaaactctggcctctc

SEQ ID NO: 208286 - DNA, 25 bp, Mus musculus
agtaggagtcaatctctggcctctc

SEQ ID NO: 208287 - DNA, 25 bp, Mus musculus
agtaggagtcagagagaccctggtc

SEQ ID NO: 208288 - DNA, 25 bp, Mus musculus
agtaggagtcagtgagaccctggtc

SEQ ID NO: 208289 - DNA, 25 bp, Mus musculus
agtaggagttttctcactgcaccag

SEQ ID NO: 208290 - DNA, 25 bp, Mus musculus
agtaggagttttgtcactgcaccag

SEQ ID NO: 208291 - DNA, 25 bp, Mus musculus
agtaggatactgacttttcttgata

SEQ ID NO: 208292 - DNA, 25 bp, Mus musculus
agtaggatactgtcttttcttgata

SEQ ID NO: 208293 - DNA, 25 bp, Mus musculus
agtaggatcaccatacaccatgctg

SEQ ID NO: 208294 - DNA, 25 bp, Mus musculus
agtaggatcaccttacaccatgctg

SEQ ID NO: 208295 - DNA, 25 bp, Mus musculus
agtaggatcaggctgaacagtttca

SEQ ID NO: 208296 - DNA, 25 bp, Mus musculus
agtaggatcagggtgaacagtttca

SEQ ID NO: 208297 - DNA, 25 bp, Mus musculus
agtaggatcattacaggcctggcct

SEQ ID NO: 208298 - DNA, 25 bp, Mus musculus
agtaggatcatttcaggcctggcct

SEQ ID NO: 208299 - DNA, 25 bp, Mus musculus
agtaggatctatcggcctcagacag

SEQ ID NO: 208300 - DNA, 25 bp, Mus musculus
agtaggatctatgggcctcagacag

SEQ ID NO: 208301 - DNA, 25 bp, Mus musculus
agtaggatctcacgaaccacccatt

SEQ ID NO: 208302 - DNA, 25 bp, Mus musculus
agtaggatctcaggaaccacccatt

SEQ ID NO: 208303 - DNA, 25 bp, Mus musculus
agtaggatgactccttagcttaaat

SEQ ID NO: 208304 - DNA, 25 bp, Mus musculus
agtaggatgactgcttagcttaaat

SEQ ID NO: 208305 - DNA, 25 bp, Mus musculus
agtaggatgtacatgtcccttcagt

SEQ ID NO: 208306 - DNA, 25 bp, Mus musculus
agtaggatgtacttgtcccttcagt

SEQ ID NO: 208307 - DNA, 25 bp, Mus musculus
agtaggattaagacagctgctgtgt

SEQ ID NO: 208308 - DNA, 25 bp, Mus musculus
agtaggattaagtcagctgctgtgt

SEQ ID NO: 208309 - DNA, 25 bp, Mus musculus
agtaggattgttatgcttgttaagt

SEQ ID NO: 208310 - DNA, 25 bp, Mus musculus
agtaggattgttttgcttgttaagt

SEQ ID NO: 208311 - DNA, 25 bp, Mus musculus
agtaggcaagacactgtccagcctt

SEQ ID NO: 208312 - DNA, 25 bp, Mus musculus
agtaggcaagactctgtccagcctt

SEQ ID NO: 208313 - DNA, 25 bp, Mus musculus
agtaggcaataaaccctcttctttg

SEQ ID NO: 208314 - DNA, 25 bp, Mus musculus
agtaggcaataatccctcttctttg

SEQ ID NO: 208315 - DNA, 25 bp, Mus musculus
agtaggcaatgcagatctgttatca

SEQ ID NO: 208316 - DNA, 25 bp, Mus musculus
agtaggcaatgctgatctgttatca

SEQ ID NO: 208317 - DNA, 25 bp, Mus musculus
agtaggcacacgctgtagccctgag

SEQ ID NO: 208318 - DNA, 25 bp, Mus musculus
agtaggcacacggtgtagccctgag

SEQ ID NO: 208319 - DNA, 25 bp, Mus musculus
agtaggcagagccactctcctatag

SEQ ID NO: 208320 - DNA, 25 bp, Mus musculus
agtaggcagagcgactctcctatag

SEQ ID NO: 208321 - DNA, 25 bp, Mus musculus
agtaggcagcgacctgtagcctttc

SEQ ID NO: 208322 - DNA, 25 bp, Mus musculus
agtaggcagcgagctgtagcctttc

SEQ ID NO: 208323 - DNA, 25 bp, Mus musculus
agtaggcaggctccattcctagttc

SEQ ID NO: 208324 - DNA, 25 bp, Mus musculus
agtaggcaggctgcattcctagttc

SEQ ID NO: 208325 - DNA, 25 bp, Mus musculus
agtaggcatatcagaagggcaagta

SEQ ID NO: 208326 - DNA, 25 bp, Mus musculus
agtaggcatatctgaagggcaagta

SEQ ID NO: 208327 - DNA, 25 bp, Mus musculus
agtaggcatgcacatactgggtgaa

SEQ ID NO: 208328 - DNA, 25 bp, Mus musculus
agtaggcatgcagatactgggtgaa

SEQ ID NO: 208329 - DNA, 25 bp, Mus musculus
agtaggcattctcttgatgtccatg

SEQ ID NO: 208330 - DNA, 25 bp, Mus musculus
agtaggcattctgttgatgtccatg

SEQ ID NO: 208331 - DNA, 25 bp, Mus musculus
agtaggccaagaactgcccctcata

SEQ ID NO: 208332 - DNA, 25 bp, Mus musculus
agtaggccaagatctgcccctcata

SEQ ID NO: 208333 - DNA, 25 bp, Mus musculus
agtaggcctaatcttcatctaactt

SEQ ID NO: 208334 - DNA, 25 bp, Mus musculus
agtaggcctaatgttcatctaactt

SEQ ID NO: 208335 - DNA, 25 bp, Mus musculus
agtaggcctgttaaagagtcttgag

SEQ ID NO: 208336 - DNA, 25 bp, Mus musculus
agtaggcctgtttaagagtcttgag

SEQ ID NO: 208337 - DNA, 25 bp, Mus musculus
agtaggccttgtagcggttcctcca

SEQ ID NO: 208338 - DNA, 25 bp, Mus musculus
agtaggccttgtatttcagcttcct

SEQ ID NO: 208339 - DNA, 25 bp, Mus musculus
agtaggccttgttgcggttcctcca

SEQ ID NO: 208340 - DNA, 25 bp, Mus musculus
agtaggccttgtttttcagcttcct

SEQ ID NO: 208341 - DNA, 25 bp, Mus musculus
agtaggcctttgctttaccattcaa

SEQ ID NO: 208342 - DNA, 25 bp, Mus musculus
agtaggcctttggtttaccattcaa

SEQ ID NO: 208343 - DNA, 25 bp, Mus musculus
agtaggctacagactgtgccatgtt

SEQ ID NO: 208344 - DNA, 25 bp, Mus musculus
agtaggctacagtctgtgccatgtt

SEQ ID NO: 208345 - DNA, 25 bp, Mus musculus
agtaggctacctagtctcaaagagt

SEQ ID NO: 208346 - DNA, 25 bp, Mus musculus
agtaggctaccttgtctcaaagagt

SEQ ID NO: 208347 - DNA, 25 bp, Mus musculus
agtaggctactgctcacccattgga

SEQ ID NO: 208348 - DNA, 25 bp, Mus musculus
agtaggctactggtcacccattgga

SEQ ID NO: 208349 - DNA, 25 bp, Mus musculus
agtaggctcacaattacatggcagt

SEQ ID NO: 208350 - DNA, 25 bp, Mus musculus
agtaggctcacatttacatggcagt

SEQ ID NO: 208351 - DNA, 25 bp, Mus musculus
agtaggctctccacattctggctta

SEQ ID NO: 208352 - DNA, 25 bp, Mus musculus
agtaggctctcctcattctggctta

SEQ ID NO: 208353 - DNA, 25 bp, Mus musculus
agtaggctggctcgagttagaccct

SEQ ID NO: 208354 - DNA, 25 bp, Mus musculus
agtaggctggctggagttagaccct

SEQ ID NO: 208355 - DNA, 25 bp, Mus musculus
agtaggctgggtaagcatcttggca

SEQ ID NO: 208356 - DNA, 25 bp, Mus musculus
agtaggctgggttagcatcttggca

SEQ ID NO: 208357 - DNA, 25 bp, Mus musculus
agtaggctttacaccagtgaggcca

SEQ ID NO: 208358 - DNA, 25 bp, Mus musculus
agtaggctttactccagtgaggcca

SEQ ID NO: 208359 - DNA, 25 bp, Mus musculus
agtaggctttgtcagggactcctcc

SEQ ID NO: 208360 - DNA, 25 bp, Mus musculus
agtaggctttgtgagggactcctcc

SEQ ID NO: 208361 - DNA, 25 bp, Mus musculus
agtagggacatcattcttttgaagt

SEQ ID NO: 208362 - DNA, 25 bp, Mus musculus
agtagggacatctttcttttgaagt

SEQ ID NO: 208363 - DNA, 25 bp, Mus musculus
agtagggaccctcactgattgtgtc

SEQ ID NO: 208364 - DNA, 25 bp, Mus musculus
agtagggaccctgactgattgtgtc

SEQ ID NO: 208365 - DNA, 25 bp, Mus musculus
agtagggagcttccgctcacgttcg

SEQ ID NO: 208366 - DNA, 25 bp, Mus musculus
agtagggagcttgcgctcacgttcg

SEQ ID NO: 208367 - DNA, 25 bp, Mus musculus
agtagggcacgtctaacctgcatcc

SEQ ID NO: 208368 - DNA, 25 bp, Mus musculus
agtagggcacgtgtaacctgcatcc

SEQ ID NO: 208369 - DNA, 25 bp, Mus musculus
agtagggcccacctctgatggacag

SEQ ID NO: 208370 - DNA, 25 bp, Mus musculus
agtagggcccacgtctgatggacag

SEQ ID NO: 208371 - DNA, 25 bp, Mus musculus
agtagggccccaacttatttctcat

SEQ ID NO: 208372 - DNA, 25 bp, Mus musculus
agtagggccccatcttatttctcat

SEQ ID NO: 208373 - DNA, 25 bp, Mus musculus
agtagggccctaactgttctaagca

SEQ ID NO: 208374 - DNA, 25 bp, Mus musculus
agtagggccctatctgttctaagca

SEQ ID NO: 208375 - DNA, 25 bp, Mus musculus
agtagggccggtccaagccttgctt

SEQ ID NO: 208376 - DNA, 25 bp, Mus musculus
agtagggccggtgcaagccttgctt

SEQ ID NO: 208377 - DNA, 25 bp, Mus musculus
agtagggcgtttcactctgtgcaga

SEQ ID NO: 208378 - DNA, 25 bp, Mus musculus
agtagggcgtttgactctgtgcaga

SEQ ID NO: 208379 - DNA, 25 bp, Mus musculus
agtagggcttctctaatgatgaaag

SEQ ID NO: 208380 - DNA, 25 bp, Mus musculus
agtagggcttctgtaatgatgaaag

SEQ ID NO: 208381 - DNA, 25 bp, Mus musculus
agtagggggtgcacagcatctccaa

SEQ ID NO: 208382 - DNA, 25 bp, Mus musculus
agtagggggtgctcagcatctccaa

SEQ ID NO: 208383 - DNA, 25 bp, Mus musculus
agtaggggtcatccagcccactaga

SEQ ID NO: 208384 - DNA, 25 bp, Mus musculus
agtaggggtcatgcagcccactaga

SEQ ID NO: 208385 - DNA, 25 bp, Mus musculus
agtagggtctggagctagcctgctc

SEQ ID NO: 208386 - DNA, 25 bp, Mus musculus
agtagggtctggtgctagcctgctc

SEQ ID NO: 208387 - DNA, 25 bp, Mus musculus
agtagggtggtgagacccttcctgg

SEQ ID NO: 208388 - DNA, 25 bp, Mus musculus
agtagggtggtgtgacccttcctgg

SEQ ID NO: 208389 - DNA, 25 bp, Mus musculus
agtagggttcctcttagacttgaat

SEQ ID NO: 208390 - DNA, 25 bp, Mus musculus
agtagggttcctgttagacttgaat

SEQ ID NO: 208391 - DNA, 25 bp, Mus musculus
agtagggtttcaagtatcccttgct

SEQ ID NO: 208392 - DNA, 25 bp, Mus musculus
agtagggtttcatgtatcccttgct

SEQ ID NO: 208393 - DNA, 25 bp, Mus musculus
agtaggtacaaacccctcactttgg

SEQ ID NO: 208394 - DNA, 25 bp, Mus musculus
agtaggtacaaagccctcactttgg

SEQ ID NO: 208395 - DNA, 25 bp, Mus musculus
agtaggtactgtcaacccctcagga

SEQ ID NO: 208396 - DNA, 25 bp, Mus musculus
agtaggtactgtgaacccctcagga

SEQ ID NO: 208397 - DNA, 25 bp, Mus musculus
agtaggtactttaggcttctgcagg

SEQ ID NO: 208398 - DNA, 25 bp, Mus musculus
agtaggtacttttggcttctgcagg

SEQ ID NO: 208399 - DNA, 25 bp, Mus musculus
agtaggtagaagaaccagccatgcc

SEQ ID NO: 208400 - DNA, 25 bp, Mus musculus
agtaggtagaagtaccagccatgcc

SEQ ID NO: 208401 - DNA, 25 bp, Mus musculus
agtaggtagctaccttgcttctttc

SEQ ID NO: 208402 - DNA, 25 bp, Mus musculus
agtaggtagctagcttgcttctttc

SEQ ID NO: 208403 - DNA, 25 bp, Mus musculus
agtaggtaggacattactgattaaa

SEQ ID NO: 208404 - DNA, 25 bp, Mus musculus
agtaggtaggactttactgattaaa

SEQ ID NO: 208405 - DNA, 25 bp, Mus musculus
agtaggtatcttaggctgttgtctc

SEQ ID NO: 208406 - DNA, 25 bp, Mus musculus
agtaggtatctttggctgttgtctc

SEQ ID NO: 208407 - DNA, 25 bp, Mus musculus
agtaggtcacctacaacccaaccat

SEQ ID NO: 208408 - DNA, 25 bp, Mus musculus
agtaggtcaccttcaacccaaccat

SEQ ID NO: 208409 - DNA, 25 bp, Mus musculus
agtaggtcaggcagctccagtagcg

SEQ ID NO: 208410 - DNA, 25 bp, Mus musculus
agtaggtcaggctgctccagtagcg

SEQ ID NO: 208411 - DNA, 25 bp, Mus musculus
agtaggtcagtcatgccagctttgt

SEQ ID NO: 208412 - DNA, 25 bp, Mus musculus
agtaggtcagtcttgccagctttgt

SEQ ID NO: 208413 - DNA, 25 bp, Mus musculus
agtaggtccgagagcctccaggccc

SEQ ID NO: 208414 - DNA, 25 bp, Mus musculus
agtaggtccgagtgcctccaggccc

SEQ ID NO: 208415 - DNA, 25 bp, Mus musculus
agtaggtcctgaacagtaatctcca

SEQ ID NO: 208416 - DNA, 25 bp, Mus musculus
agtaggtcctgatcagtaatctcca

SEQ ID NO: 208417 - DNA, 25 bp, Mus musculus
agtaggtcgttgcacatctcggagc

SEQ ID NO: 208418 - DNA, 25 bp, Mus musculus
agtaggtcgttggacatctcggagc

SEQ ID NO: 208419 - DNA, 25 bp, Mus musculus
agtaggtctctaaatcttccacttc

SEQ ID NO: 208420 - DNA, 25 bp, Mus musculus
agtaggtctctatatcttccacttc

SEQ ID NO: 208421 - DNA, 25 bp, Mus musculus
agtaggtgacctcaaggctgctccc

SEQ ID NO: 208422 - DNA, 25 bp, Mus musculus
agtaggtgacctgaaggctgctccc

SEQ ID NO: 208423 - DNA, 25 bp, Mus musculus
agtaggtggcctatagacttgcaaa

SEQ ID NO: 208424 - DNA, 25 bp, Mus musculus
agtaggtggcctttagacttgcaaa

SEQ ID NO: 208425 - DNA, 25 bp, Mus musculus
agtaggtgggtgcagcctatcttca

SEQ ID NO: 208426 - DNA, 25 bp, Mus musculus
agtaggtgggtggagcctatcttca

SEQ ID NO: 208427 - DNA, 25 bp, Mus musculus
agtaggttaacacctagctcccatc

SEQ ID NO: 208428 - DNA, 25 bp, Mus musculus
agtaggttaacagctagctcccatc

SEQ ID NO: 208429 - DNA, 25 bp, Mus musculus
agtaggttaagcagccatacgtgtt

SEQ ID NO: 208430 - DNA, 25 bp, Mus musculus
agtaggttaagctgccatacgtgtt

SEQ ID NO: 208431 - DNA, 25 bp, Mus musculus
agtaggttatccaccagcaacaaag

SEQ ID NO: 208432 - DNA, 25 bp, Mus musculus
agtaggttatcctccagcaacaaag

SEQ ID NO: 208433 - DNA, 25 bp, Mus musculus
agtaggttttatctgcagagcatgt

SEQ ID NO: 208434 - DNA, 25 bp, Mus musculus
agtaggttttatgtgcagagcatgt

SEQ ID NO: 208435 - DNA, 25 bp, Mus musculus
agtaggttttgcatcttagtaatag

SEQ ID NO: 208436 - DNA, 25 bp, Mus musculus
agtaggttttgcttcttagtaatag

SEQ ID NO: 208437 - DNA, 25 bp, Mus musculus
agtagtaaccctcgatcgctgagcc

SEQ ID NO: 208438 - DNA, 25 bp, Mus musculus
agtagtaaccctggatcgctgagcc

SEQ ID NO: 208439 - DNA, 25 bp, Mus musculus
agtagtaactcgaccctggatcttt

SEQ ID NO: 208440 - DNA, 25 bp, Mus musculus
agtagtaactcgtccctggatcttt

SEQ ID NO: 208441 - DNA, 25 bp, Mus musculus
agtagtaagtccagctgtcggccgc

SEQ ID NO: 208442 - DNA, 25 bp, Mus musculus
agtagtaagtcctgctgtcggccgc

SEQ ID NO: 208443 - DNA, 25 bp, Mus musculus
agtagtaattcccagctgtactctg

SEQ ID NO: 208444 - DNA, 25 bp, Mus musculus
agtagtaattccgagctgtactctg

SEQ ID NO: 208445 - DNA, 25 bp, Mus musculus
agtagtacagcacatgacctttcct

SEQ ID NO: 208446 - DNA, 25 bp, Mus musculus
agtagtacagcagatgacctttcct

SEQ ID NO: 208447 - DNA, 25 bp, Mus musculus
agtagtacgtataccagttgggtat

SEQ ID NO: 208448 - DNA, 25 bp, Mus musculus
agtagtacgtattccagttgggtat

SEQ ID NO: 208449 - DNA, 25 bp, Mus musculus
agtagtactgtccttttgttgcttg

SEQ ID NO: 208450 - DNA, 25 bp, Mus musculus
agtagtactgtcgttttgttgcttg

SEQ ID NO: 208451 - DNA, 25 bp, Mus musculus
agtagtagcttccagggagcagcct

SEQ ID NO: 208452 - DNA, 25 bp, Mus musculus
agtagtagcttcgagggagcagcct

SEQ ID NO: 208453 - DNA, 25 bp, Mus musculus
agtagtaggctccacacttgttttt

SEQ ID NO: 208454 - DNA, 25 bp, Mus musculus
agtagtaggctcgacacttgttttt

SEQ ID NO: 208455 - DNA, 25 bp, Mus musculus
agtagtagtcaaccgaagcctttca

SEQ ID NO: 208456 - DNA, 25 bp, Mus musculus
agtagtagtcaagcgaagcctttca

SEQ ID NO: 208457 - DNA, 25 bp, Mus musculus
agtagtagtcatccaataagcactt

SEQ ID NO: 208458 - DNA, 25 bp, Mus musculus
agtagtagtcatgcaataagcactt

SEQ ID NO: 208459 - DNA, 25 bp, Mus musculus
agtagtatactcatgtaagcccagt

SEQ ID NO: 208460 - DNA, 25 bp, Mus musculus
agtagtatactcttgtaagcccagt

SEQ ID NO: 208461 - DNA, 25 bp, Mus musculus
agtagtatcacacatggctcatctg

SEQ ID NO: 208462 - DNA, 25 bp, Mus musculus
agtagtatcacagatggctcatctg

SEQ ID NO: 208463 - DNA, 25 bp, Mus musculus
agtagtatccccaatttctgcttac

SEQ ID NO: 208464 - DNA, 25 bp, Mus musculus
agtagtatcccctatttctgcttac

SEQ ID NO: 208465 - DNA, 25 bp, Mus musculus
agtagtatgactaccctgggtaccg

SEQ ID NO: 208466 - DNA, 25 bp, Mus musculus
agtagtatgacttccctgggtaccg

SEQ ID NO: 208467 - DNA, 25 bp, Mus musculus
agtagtatgagtacaaccacatttg

SEQ ID NO: 208468 - DNA, 25 bp, Mus musculus
agtagtatgagttcaaccacatttg

SEQ ID NO: 208469 - DNA, 25 bp, Mus musculus
agtagtatgctacatcttctctcac

SEQ ID NO: 208470 - DNA, 25 bp, Mus musculus
agtagtatgctagatcttctctcac

SEQ ID NO: 208471 - DNA, 25 bp, Mus musculus
agtagtatttaacctctgtcctgta

SEQ ID NO: 208472 - DNA, 25 bp, Mus musculus
agtagtatttaagctctgtcctgta

SEQ ID NO: 208473 - DNA, 25 bp, Mus musculus
agtagtatttccagtcatgcttcca

SEQ ID NO: 208474 - DNA, 25 bp, Mus musculus
agtagtatttcctgtcatgcttcca

SEQ ID NO: 208475 - DNA, 25 bp, Mus musculus
agtagtatttctcactttcctccta

SEQ ID NO: 208476 - DNA, 25 bp, Mus musculus
agtagtatttctgactttcctccta

SEQ ID NO: 208477 - DNA, 25 bp, Mus musculus
agtagtcaatgacggccaagtctta

SEQ ID NO: 208478 - DNA, 25 bp, Mus musculus
agtagtcaatgagggccaagtctta

SEQ ID NO: 208479 - DNA, 25 bp, Mus musculus
agtagtcacactctagatctgccca

SEQ ID NO: 208480 - DNA, 25 bp, Mus musculus
agtagtcacactgtagatctgccca

SEQ ID NO: 208481 - DNA, 25 bp, Mus musculus
agtagtcactagactctatcttgtt

SEQ ID NO: 208482 - DNA, 25 bp, Mus musculus
agtagtcactagtctctatcttgtt

SEQ ID NO: 208483 - DNA, 25 bp, Mus musculus
agtagtcagacaacatgtgggtgct

SEQ ID NO: 208484 - DNA, 25 bp, Mus musculus
agtagtcagacatcatgtgggtgct

SEQ ID NO: 208485 - DNA, 25 bp, Mus musculus
agtagtcagctaaacccaatctcca

SEQ ID NO: 208486 - DNA, 25 bp, Mus musculus
agtagtcagctatacccaatctcca

SEQ ID NO: 208487 - DNA, 25 bp, Mus musculus
agtagtcatcatatggccaccaact

SEQ ID NO: 208488 - DNA, 25 bp, Mus musculus
agtagtcatcatttggccaccaact

SEQ ID NO: 208489 - DNA, 25 bp, Mus musculus
agtagtccaccaagacctcgaagga

SEQ ID NO: 208490 - DNA, 25 bp, Mus musculus
agtagtccaccatgacctcgaagga

SEQ ID NO: 208491 - DNA, 25 bp, Mus musculus
agtagtccaggacgatcccaggctt

SEQ ID NO: 208492 - DNA, 25 bp, Mus musculus
agtagtccaggaggatcccaggctt

SEQ ID NO: 208493 - DNA, 25 bp, Mus musculus
agtagtccgcccattgtcagcttgg

SEQ ID NO: 208494 - DNA, 25 bp, Mus musculus
agtagtccgccctttgtcagcttgg

SEQ ID NO: 208495 - DNA, 25 bp, Mus musculus
agtagtcctagtactgatcgcatta

SEQ ID NO: 208496 - DNA, 25 bp, Mus musculus
agtagtcctagttctgatcgcatta

SEQ ID NO: 208497 - DNA, 25 bp, Mus musculus
agtagtcctgacctgtagaaatcag

SEQ ID NO: 208498 - DNA, 25 bp, Mus musculus
agtagtcctgacgtgtagaaatcag

SEQ ID NO: 208499 - DNA, 25 bp, Mus musculus
agtagtctaagaagctaagctggaa

SEQ ID NO: 208500 - DNA, 25 bp, Mus musculus
agtagtctaagatgctaagctggaa

SEQ ID NO: 208501 - DNA, 25 bp, Mus musculus
agtagtctcatcatacagcatctgc

SEQ ID NO: 208502 - DNA, 25 bp, Mus musculus
agtagtctcatcttacagcatctgc

SEQ ID NO: 208503 - DNA, 25 bp, Mus musculus
agtagtctcattccactctagggtg

SEQ ID NO: 208504 - DNA, 25 bp, Mus musculus
agtagtctcattgcactctagggtg

SEQ ID NO: 208505 - DNA, 25 bp, Mus musculus
agtagtctcccaaggttggctgaca

SEQ ID NO: 208506 - DNA, 25 bp, Mus musculus
agtagtctcccatggttggctgaca

SEQ ID NO: 208507 - DNA, 25 bp, Mus musculus
agtagtctcgatacatcagtggatt

SEQ ID NO: 208508 - DNA, 25 bp, Mus musculus
agtagtctcgattcatcagtggatt

SEQ ID NO: 208509 - DNA, 25 bp, Mus musculus
agtagtctggccacagtaaaccaag

SEQ ID NO: 208510 - DNA, 25 bp, Mus musculus
agtagtctggcctcagtaaaccaag

SEQ ID NO: 208511 - DNA, 25 bp, Mus musculus
agtagtctttaaaagtaatccagat

SEQ ID NO: 208512 - DNA, 25 bp, Mus musculus
agtagtctttaatagtaatccagat

SEQ ID NO: 208513 - DNA, 25 bp, Mus musculus
agtagtcttttgagtatttgttgaa

SEQ ID NO: 208514 - DNA, 25 bp, Mus musculus
agtagtcttttgtgtatttgttgaa

SEQ ID NO: 208515 - DNA, 25 bp, Mus musculus
agtagtgaactaacctcagtgcctg

SEQ ID NO: 208516 - DNA, 25 bp, Mus musculus
agtagtgaactatcctcagtgcctg

SEQ ID NO: 208517 - DNA, 25 bp, Mus musculus
agtagtgaagaaccccaagcccaag

SEQ ID NO: 208518 - DNA, 25 bp, Mus musculus
agtagtgaagaagcccaagcccaag

SEQ ID NO: 208519 - DNA, 25 bp, Mus musculus
agtagtgactctctttggtgttcct

SEQ ID NO: 208520 - DNA, 25 bp, Mus musculus
agtagtgactctgtttggtgttcct

SEQ ID NO: 208521 - DNA, 25 bp, Mus musculus
agtagtgagagccactgcatcttag

SEQ ID NO: 208522 - DNA, 25 bp, Mus musculus
agtagtgagagcgactgcatcttag

SEQ ID NO: 208523 - DNA, 25 bp, Mus musculus
agtagtgagcagagccaagtgttga

SEQ ID NO: 208524 - DNA, 25 bp, Mus musculus
agtagtgagcagtgccaagtgttga

SEQ ID NO: 208525 - DNA, 25 bp, Mus musculus
agtagtgagcataaagtccctgtgt

SEQ ID NO: 208526 - DNA, 25 bp, Mus musculus
agtagtgagcattaagtccctgtgt

SEQ ID NO: 208527 - DNA, 25 bp, Mus musculus
agtagtgcacatcgtggctgccaac

SEQ ID NO: 208528 - DNA, 25 bp, Mus musculus
agtagtgcacatggtggctgccaac

SEQ ID NO: 208529 - DNA, 25 bp, Mus musculus
agtagtgccaacctagtgtagcctc

SEQ ID NO: 208530 - DNA, 25 bp, Mus musculus
agtagtgccaacgtagtgtagcctc

SEQ ID NO: 208531 - DNA, 25 bp, Mus musculus
agtagtgctcccatttgactcagta

SEQ ID NO: 208532 - DNA, 25 bp, Mus musculus
agtagtgctcccttttgactcagta

SEQ ID NO: 208533 - DNA, 25 bp, Mus musculus
agtagtgctgccatattctaggacc

SEQ ID NO: 208534 - DNA, 25 bp, Mus musculus
agtagtgctgccttattctaggacc

SEQ ID NO: 208535 - DNA, 25 bp, Mus musculus
agtagtggagacagccctgctcagg

SEQ ID NO: 208536 - DNA, 25 bp, Mus musculus
agtagtggagactgccctgctcagg

SEQ ID NO: 208537 - DNA, 25 bp, Mus musculus
agtagtggccatctctgatgcctgt

SEQ ID NO: 208538 - DNA, 25 bp, Mus musculus
agtagtggccatgtctgatgcctgt

SEQ ID NO: 208539 - DNA, 25 bp, Mus musculus
agtagtgggctcatttctgcttcac

SEQ ID NO: 208540 - DNA, 25 bp, Mus musculus
agtagtgggctcttttctgcttcac

SEQ ID NO: 208541 - DNA, 25 bp, Mus musculus
agtagtgggtgcatctgttccccaa

SEQ ID NO: 208542 - DNA, 25 bp, Mus musculus
agtagtgggtgcttctgttccccaa

SEQ ID NO: 208543 - DNA, 25 bp, Mus musculus
agtagtgtaaagcttcccatcccga

SEQ ID NO: 208544 - DNA, 25 bp, Mus musculus
agtagtgtaaaggttcccatcccga

SEQ ID NO: 208545 - DNA, 25 bp, Mus musculus
agtagtgtaagtaggatggtgacca

SEQ ID NO: 208546 - DNA, 25 bp, Mus musculus
agtagtgtaagttggatggtgacca

SEQ ID NO: 208547 - DNA, 25 bp, Mus musculus
agtagtgtactgagatgaagtttca

SEQ ID NO: 208548 - DNA, 25 bp, Mus musculus
agtagtgtactgtgatgaagtttca

SEQ ID NO: 208549 - DNA, 25 bp, Mus musculus
agtagtgtacttactcatgcacaac

SEQ ID NO: 208550 - DNA, 25 bp, Mus musculus
agtagtgtactttctcatgcacaac

SEQ ID NO: 208551 - DNA, 25 bp, Mus musculus
agtagtgtaggaatctgagagcaga

SEQ ID NO: 208552 - DNA, 25 bp, Mus musculus
agtagtgtaggattctgagagcaga

SEQ ID NO: 208553 - DNA, 25 bp, Mus musculus
agtagtgtaggtcttgattcccaat

SEQ ID NO: 208554 - DNA, 25 bp, Mus musculus
agtagtgtaggtgttgattcccaat

SEQ ID NO: 208555 - DNA, 25 bp, Mus musculus
agtagtgtattcatggtcaccccag

SEQ ID NO: 208556 - DNA, 25 bp, Mus musculus
agtagtgtattcttggtcaccccag

SEQ ID NO: 208557 - DNA, 25 bp, Mus musculus
agtagtgtctaaccaccctggactg

SEQ ID NO: 208558 - DNA, 25 bp, Mus musculus
agtagtgtctaagcaccctggactg

SEQ ID NO: 208559 - DNA, 25 bp, Mus musculus
agtagtgtctttcttctgctttgta

SEQ ID NO: 208560 - DNA, 25 bp, Mus musculus
agtagtgtctttgttctgctttgta

SEQ ID NO: 208561 - DNA, 25 bp, Mus musculus
agtagtgtgcctagcaatcactgca

SEQ ID NO: 208562 - DNA, 25 bp, Mus musculus
agtagtgtgccttgcaatcactgca

SEQ ID NO: 208563 - DNA, 25 bp, Mus musculus
agtagtgtgctcaacagctgagcca

SEQ ID NO: 208564 - DNA, 25 bp, Mus musculus
agtagtgtgctctacagctgagcca

SEQ ID NO: 208565 - DNA, 25 bp, Mus musculus
agtagtgtggctcttattttggaat

SEQ ID NO: 208566 - DNA, 25 bp, Mus musculus
agtagtgtggctgttattttggaat

SEQ ID NO: 208567 - DNA, 25 bp, Mus musculus
agtagtgtgtggcatcactagtgct

SEQ ID NO: 208568 - DNA, 25 bp, Mus musculus
agtagtgtgtgggatcactagtgct

SEQ ID NO: 208569 - DNA, 25 bp, Mus musculus
agtagtgttactcctgtccaagaaa

SEQ ID NO: 208570 - DNA, 25 bp, Mus musculus
agtagtgttactgctgtccaagaaa

SEQ ID NO: 208571 - DNA, 25 bp, Mus musculus
agtagtgttgtccaccatgaaccca

SEQ ID NO: 208572 - DNA, 25 bp, Mus musculus
agtagtgttgtcgaccatgaaccca

SEQ ID NO: 208573 - DNA, 25 bp, Mus musculus
agtagtgtttgcagcttatccccta

SEQ ID NO: 208574 - DNA, 25 bp, Mus musculus
agtagtgtttgctgcttatccccta

SEQ ID NO: 208575 - DNA, 25 bp, Mus musculus
agtagttaactccaccatctttgta

SEQ ID NO: 208576 - DNA, 25 bp, Mus musculus
agtagttaactcgaccatctttgta

SEQ ID NO: 208577 - DNA, 25 bp, Mus musculus
agtagttaattgatccaagtacagg

SEQ ID NO: 208578 - DNA, 25 bp, Mus musculus
agtagttaattgttccaagtacagg

SEQ ID NO: 208579 - DNA, 25 bp, Mus musculus
agtagttatatacagtgcctaatac

SEQ ID NO: 208580 - DNA, 25 bp, Mus musculus
agtagttatatagagtgcctaatac

SEQ ID NO: 208581 - DNA, 25 bp, Mus musculus
agtagttcaggaaggcgaggcaccc

SEQ ID NO: 208582 - DNA, 25 bp, Mus musculus
agtagttcaggatggcgaggcaccc

SEQ ID NO: 208583 - DNA, 25 bp, Mus musculus
agtagttcatcccaacactgtacac

SEQ ID NO: 208584 - DNA, 25 bp, Mus musculus
agtagttcatccgaacactgtacac

SEQ ID NO: 208585 - DNA, 25 bp, Mus musculus
agtagttcccacagattcgagacca

SEQ ID NO: 208586 - DNA, 25 bp, Mus musculus
agtagttcccactgattcgagacca

SEQ ID NO: 208587 - DNA, 25 bp, Mus musculus
agtagttcccgaagtagctgtgttt

SEQ ID NO: 208588 - DNA, 25 bp, Mus musculus
agtagttcccgatgtagctgtgttt

SEQ ID NO: 208589 - DNA, 25 bp, Mus musculus
agtagttccctcatactccagcaca

SEQ ID NO: 208590 - DNA, 25 bp, Mus musculus
agtagttccctcttactccagcaca

SEQ ID NO: 208591 - DNA, 25 bp, Mus musculus
agtagttctcatcggctcaacgagc

SEQ ID NO: 208592 - DNA, 25 bp, Mus musculus
agtagttctcatgggctcaacgagc

SEQ ID NO: 208593 - DNA, 25 bp, Mus musculus
agtagttctcctatgactcacatct

SEQ ID NO: 208594 - DNA, 25 bp, Mus musculus
agtagttctcctttgactcacatct

SEQ ID NO: 208595 - DNA, 25 bp, Mus musculus
agtagttctgataccttgctggaga

SEQ ID NO: 208596 - DNA, 25 bp, Mus musculus
agtagttctgattccttgctggaga

SEQ ID NO: 208597 - DNA, 25 bp, Mus musculus
agtagttctggtcaaatctcatgca

SEQ ID NO: 208598 - DNA, 25 bp, Mus musculus
agtagttctggtcctgtgctgccta

SEQ ID NO: 208599 - DNA, 25 bp, Mus musculus
agtagttctggtgaaatctcatgca

SEQ ID NO: 208600 - DNA, 25 bp, Mus musculus
agtagttctggtgctgtgctgccta

SEQ ID NO: 208601 - DNA, 25 bp, Mus musculus
agtagttctgtgcttggcctctctt

SEQ ID NO: 208602 - DNA, 25 bp, Mus musculus
agtagttctgtggttggcctctctt

SEQ ID NO: 208603 - DNA, 25 bp, Mus musculus
agtagttctttcatgatacccctct

SEQ ID NO: 208604 - DNA, 25 bp, Mus musculus
agtagttctttcttgatacccctct

SEQ ID NO: 208605 - DNA, 25 bp, Mus musculus
agtagttggcccctgtctaactcct

SEQ ID NO: 208606 - DNA, 25 bp, Mus musculus
agtagttggcccgtgtctaactcct

SEQ ID NO: 208607 - DNA, 25 bp, Mus musculus
agtagttggttcatctccttagtct

SEQ ID NO: 208608 - DNA, 25 bp, Mus musculus
agtagttggttcttctccttagtct

SEQ ID NO: 208609 - DNA, 25 bp, Mus musculus
agtagtttagagctgttccctgcct

SEQ ID NO: 208610 - DNA, 25 bp, Mus musculus
agtagtttagaggtgttccctgcct

SEQ ID NO: 208611 - DNA, 25 bp, Mus musculus
agtagtttagtgactgtgcccagca

SEQ ID NO: 208612 - DNA, 25 bp, Mus musculus
agtagtttagtgtctgtgcccagca

SEQ ID NO: 208613 - DNA, 25 bp, Mus musculus
agtagtttcatcatgctagggccaa

SEQ ID NO: 208614 - DNA, 25 bp, Mus musculus
agtagtttcatcttgctagggccaa

SEQ ID NO: 208615 - DNA, 25 bp, Mus musculus
agtagtttccctccagtggtggagt

SEQ ID NO: 208616 - DNA, 25 bp, Mus musculus
agtagtttccctgcagtggtggagt

SEQ ID NO: 208617 - DNA, 25 bp, Mus musculus
agtagtttcctactgctcctggagc

SEQ ID NO: 208618 - DNA, 25 bp, Mus musculus
agtagtttcctagtgctcctggagc

SEQ ID NO: 208619 - DNA, 25 bp, Mus musculus
agtagtttctgactgcatgggccag

SEQ ID NO: 208620 - DNA, 25 bp, Mus musculus
agtagtttctgagtgcatgggccag

SEQ ID NO: 208621 - DNA, 25 bp, Mus musculus
agtagtttgactcttttgcccaacg

SEQ ID NO: 208622 - DNA, 25 bp, Mus musculus
agtagtttgactgttttgcccaacg

SEQ ID NO: 208623 - DNA, 25 bp, Mus musculus
agtagtttgtgacctatcctgcact

SEQ ID NO: 208624 - DNA, 25 bp, Mus musculus
agtagtttgtgagctatcctgcact

SEQ ID NO: 208625 - DNA, 25 bp, Mus musculus
agtagtttgtgtaacctgctctgtc

SEQ ID NO: 208626 - DNA, 25 bp, Mus musculus
agtagtttgtgttacctgctctgtc

SEQ ID NO: 208627 - DNA, 25 bp, Mus musculus
agtagttttctcattgcgctgggca

SEQ ID NO: 208628 - DNA, 25 bp, Mus musculus
agtagttttctctttgcgctgggca

SEQ ID NO: 208629 - DNA, 25 bp, Mus musculus
agtagttttcttcatccagcagcct

SEQ ID NO: 208630 - DNA, 25 bp, Mus musculus
agtagttttcttgatccagcagcct

SEQ ID NO: 208631 - DNA, 25 bp, Mus musculus
agtataaaacacagacattgtttct

SEQ ID NO: 208632 - DNA, 25 bp, Mus musculus
agtataaaacactgacattgtttct

SEQ ID NO: 208633 - DNA, 25 bp, Mus musculus
agtataaacctgctgcctggcagct

SEQ ID NO: 208634 - DNA, 25 bp, Mus musculus
agtataaacctggtgcctggcagct

SEQ ID NO: 208635 - DNA, 25 bp, Mus musculus
agtataaagttcaagtcgtccaagg

SEQ ID NO: 208636 - DNA, 25 bp, Mus musculus
agtataaagttctagtcgtccaagg

SEQ ID NO: 208637 - DNA, 25 bp, Mus musculus
agtataaatcatactgtcttccaca

SEQ ID NO: 208638 - DNA, 25 bp, Mus musculus
agtataaatcattctgtcttccaca

SEQ ID NO: 208639 - DNA, 25 bp, Mus musculus
agtataaatgccatgcgcttcctca

SEQ ID NO: 208640 - DNA, 25 bp, Mus musculus
agtataaatgccttgcgcttcctca

SEQ ID NO: 208641 - DNA, 25 bp, Mus musculus
agtataacactcagggctcaccaac

SEQ ID NO: 208642 - DNA, 25 bp, Mus musculus
agtataacactctgggctcaccaac

SEQ ID NO: 208643 - DNA, 25 bp, Mus musculus
agtataacggaaagcacactcgccc

SEQ ID NO: 208644 - DNA, 25 bp, Mus musculus
agtataacggaatgcacactcgccc

SEQ ID NO: 208645 - DNA, 25 bp, Mus musculus
agtataagccacaccatgactgttc

SEQ ID NO: 208646 - DNA, 25 bp, Mus musculus
agtataagccactccatgactgttc

SEQ ID NO: 208647 - DNA, 25 bp, Mus musculus
agtataagctaacactcctggccta

SEQ ID NO: 208648 - DNA, 25 bp, Mus musculus
agtataagctaagactcctggccta

SEQ ID NO: 208649 - DNA, 25 bp, Mus musculus
agtataagtattacctttctgtgac

SEQ ID NO: 208650 - DNA, 25 bp, Mus musculus
agtataagtatttcctttctgtgac

SEQ ID NO: 208651 - DNA, 25 bp, Mus musculus
agtataataacccagccatgcttca

SEQ ID NO: 208652 - DNA, 25 bp, Mus musculus
agtataataaccgagccatgcttca

SEQ ID NO: 208653 - DNA, 25 bp, Mus musculus
agtataatataaacacctcatcaaa

SEQ ID NO: 208654 - DNA, 25 bp, Mus musculus
agtataatataatcacctcatcaaa

SEQ ID NO: 208655 - DNA, 25 bp, Mus musculus
agtataatggcgctgaatgtcaaaa

SEQ ID NO: 208656 - DNA, 25 bp, Mus musculus
agtataatggcggtgaatgtcaaaa

SEQ ID NO: 208657 - DNA, 25 bp, Mus musculus
agtataatgttgaacatgtgtgtat

SEQ ID NO: 208658 - DNA, 25 bp, Mus musculus
agtataatgttgtacatgtgtgtat

SEQ ID NO: 208659 - DNA, 25 bp, Mus musculus
agtataattactacagtctccctgc

SEQ ID NO: 208660 - DNA, 25 bp, Mus musculus
agtataattacttcagtctccctgc

SEQ ID NO: 208661 - DNA, 25 bp, Mus musculus
agtataattcccaaagatggtcttg

SEQ ID NO: 208662 - DNA, 25 bp, Mus musculus
agtataattccctaagatggtcttg

SEQ ID NO: 208663 - DNA, 25 bp, Mus musculus
agtatacaatggacttccttcccag

SEQ ID NO: 208664 - DNA, 25 bp, Mus musculus
agtatacaatggtcttccttcccag

SEQ ID NO: 208665 - DNA, 25 bp, Mus musculus
agtatacacctgataacctttcgtg

SEQ ID NO: 208666 - DNA, 25 bp, Mus musculus
agtatacacctgttaacctttcgtg

SEQ ID NO: 208667 - DNA, 25 bp, Mus musculus
agtatacatactcgtgcttgctgat

SEQ ID NO: 208668 - DNA, 25 bp, Mus musculus
agtatacatactggtgcttgctgat

SEQ ID NO: 208669 - DNA, 25 bp, Mus musculus
agtatacatctacaagcactcttgt

SEQ ID NO: 208670 - DNA, 25 bp, Mus musculus
agtatacatctagaagcactcttgt

SEQ ID NO: 208671 - DNA, 25 bp, Mus musculus
agtataccaccactttctagcttgt

SEQ ID NO: 208672 - DNA, 25 bp, Mus musculus
agtataccaccagtttctagcttgt

SEQ ID NO: 208673 - DNA, 25 bp, Mus musculus
agtataccgagacctttctttctga

SEQ ID NO: 208674 - DNA, 25 bp, Mus musculus
agtataccgagagctttctttctga

SEQ ID NO: 208675 - DNA, 25 bp, Mus musculus
agtatacctcacatctataagcctc

SEQ ID NO: 208676 - DNA, 25 bp, Mus musculus
agtatacctcacttctataagcctc

SEQ ID NO: 208677 - DNA, 25 bp, Mus musculus
agtatacctttgagggccataagtt

SEQ ID NO: 208678 - DNA, 25 bp, Mus musculus
agtatacctttgtgggccataagtt

SEQ ID NO: 208679 - DNA, 25 bp, Mus musculus
agtatactcataagcccatttccgt

SEQ ID NO: 208680 - DNA, 25 bp, Mus musculus
agtatactcatatgcccatttccgt

SEQ ID NO: 208681 - DNA, 25 bp, Mus musculus
agtatacttaggaacacttgacact

SEQ ID NO: 208682 - DNA, 25 bp, Mus musculus
agtatacttaggtacacttgacact

SEQ ID NO: 208683 - DNA, 25 bp, Mus musculus
agtatagactgtcacttactgtgta

SEQ ID NO: 208684 - DNA, 25 bp, Mus musculus
agtatagactgtgacttactgtgta

SEQ ID NO: 208685 - DNA, 25 bp, Mus musculus
agtatagagccccttagaccttgac

SEQ ID NO: 208686 - DNA, 25 bp, Mus musculus
agtatagagcccgttagaccttgac

SEQ ID NO: 208687 - DNA, 25 bp, Mus musculus
agtatagcacagaagccttccctgt

SEQ ID NO: 208688 - DNA, 25 bp, Mus musculus
agtatagcacagtagccttccctgt

SEQ ID NO: 208689 - DNA, 25 bp, Mus musculus
agtatagcatctagatttttgtgga

SEQ ID NO: 208690 - DNA, 25 bp, Mus musculus
agtatagcatcttgatttttgtgga

SEQ ID NO: 208691 - DNA, 25 bp, Mus musculus
agtataggcagaactctccctcata

SEQ ID NO: 208692 - DNA, 25 bp, Mus musculus
agtataggcagatctctccctcata

SEQ ID NO: 208693 - DNA, 25 bp, Mus musculus
agtataggtcagaccctttacctct

SEQ ID NO: 208694 - DNA, 25 bp, Mus musculus
agtataggtcagtccctttacctct

SEQ ID NO: 208695 - DNA, 25 bp, Mus musculus
agtatagtaactccttcttttccct

SEQ ID NO: 208696 - DNA, 25 bp, Mus musculus
agtatagtaactgcttcttttccct

SEQ ID NO: 208697 - DNA, 25 bp, Mus musculus
agtatagtcggtacgtctgtcttct

SEQ ID NO: 208698 - DNA, 25 bp, Mus musculus
agtatagtcggttcgtctgtcttct

SEQ ID NO: 208699 - DNA, 25 bp, Mus musculus
agtatagttaatccaaccctgtcac

SEQ ID NO: 208700 - DNA, 25 bp, Mus musculus
agtatagttaatgcaaccctgtcac

SEQ ID NO: 208701 - DNA, 25 bp, Mus musculus
agtatagtttacacacagcacacct

SEQ ID NO: 208702 - DNA, 25 bp, Mus musculus
agtatagtttactcacagcacacct

SEQ ID NO: 208703 - DNA, 25 bp, Mus musculus
agtatataccagacatctccacttt

SEQ ID NO: 208704 - DNA, 25 bp, Mus musculus
agtatataccagtcatctccacttt

SEQ ID NO: 208705 - DNA, 25 bp, Mus musculus
agtatatcaaaaatccccaatcatt

SEQ ID NO: 208706 - DNA, 25 bp, Mus musculus
agtatatcaaaattccccaatcatt

SEQ ID NO: 208707 - DNA, 25 bp, Mus musculus
agtatatcacctataaccaccgagt

SEQ ID NO: 208708 - DNA, 25 bp, Mus musculus
agtatatcacctttaaccaccgagt

SEQ ID NO: 208709 - DNA, 25 bp, Mus musculus
agtatatcatcaatggttcccatgc

SEQ ID NO: 208710 - DNA, 25 bp, Mus musculus
agtatatcatcattggttcccatgc

SEQ ID NO: 208711 - DNA, 25 bp, Mus musculus
agtatatcattaatcattgctttta

SEQ ID NO: 208712 - DNA, 25 bp, Mus musculus
agtatatcattattcattgctttta

SEQ ID NO: 208713 - DNA, 25 bp, Mus musculus
agtatatccaggacgtctaccttca

SEQ ID NO: 208714 - DNA, 25 bp, Mus musculus
agtatatccaggtcgtctaccttca

SEQ ID NO: 208715 - DNA, 25 bp, Mus musculus
agtatatcctgaattctgtgcctca

SEQ ID NO: 208716 - DNA, 25 bp, Mus musculus
agtatatcctgatttctgtgcctca

SEQ ID NO: 208717 - DNA, 25 bp, Mus musculus
agtatatctcctatccagcttcaat

SEQ ID NO: 208718 - DNA, 25 bp, Mus musculus
agtatatctcctctttgtgttttga

SEQ ID NO: 208719 - DNA, 25 bp, Mus musculus
agtatatctcctgtttgtgttttga

SEQ ID NO: 208720 - DNA, 25 bp, Mus musculus
agtatatctcctttccagcttcaat

SEQ ID NO: 208721 - DNA, 25 bp, Mus musculus
agtatatcttctcccatcaagttca

SEQ ID NO: 208722 - DNA, 25 bp, Mus musculus
agtatatcttctgccatcaagttca

SEQ ID NO: 208723 - DNA, 25 bp, Mus musculus
agtatatgcactatcagaatccctc

SEQ ID NO: 208724 - DNA, 25 bp, Mus musculus
agtatatgcactttcagaatccctc

SEQ ID NO: 208725 - DNA, 25 bp, Mus musculus
agtatatgccaacctgggccgcatg

SEQ ID NO: 208726 - DNA, 25 bp, Mus musculus
agtatatgccaagctgggccgcatg

SEQ ID NO: 208727 - DNA, 25 bp, Mus musculus
agtatatgctttctgctttgatcaa

SEQ ID NO: 208728 - DNA, 25 bp, Mus musculus
agtatatgctttgtgctttgatcaa

SEQ ID NO: 208729 - DNA, 25 bp, Mus musculus
agtatatggaccagcttcaccggta

SEQ ID NO: 208730 - DNA, 25 bp, Mus musculus
agtatatggacctgcttcaccggta

SEQ ID NO: 208731 - DNA, 25 bp, Mus musculus
agtatatgttcactctacccacatt

SEQ ID NO: 208732 - DNA, 25 bp, Mus musculus
agtatatgttcagtctacccacatt

SEQ ID NO: 208733 - DNA, 25 bp, Mus musculus
agtatattcgcccagtcctccagca

SEQ ID NO: 208734 - DNA, 25 bp, Mus musculus
agtatattcgccgagtcctccagca

SEQ ID NO: 208735 - DNA, 25 bp, Mus musculus
agtatattctgaatgtactctcccc

SEQ ID NO: 208736 - DNA, 25 bp, Mus musculus
agtatattctgattgtactctcccc

SEQ ID NO: 208737 - DNA, 25 bp, Mus musculus
agtatattgctgatcctagaatcaa

SEQ ID NO: 208738 - DNA, 25 bp, Mus musculus
agtatattgctgttcctagaatcaa

SEQ ID NO: 208739 - DNA, 25 bp, Mus musculus
agtatattgttcatgcctctcttct

SEQ ID NO: 208740 - DNA, 25 bp, Mus musculus
agtatattgttcttgcctctcttct

SEQ ID NO: 208741 - DNA, 25 bp, Mus musculus
agtatatttctaactcagctccaga

SEQ ID NO: 208742 - DNA, 25 bp, Mus musculus
agtatatttctatctcagctccaga

SEQ ID NO: 208743 - DNA, 25 bp, Mus musculus
agtatatttttaacccgttgaatgg

SEQ ID NO: 208744 - DNA, 25 bp, Mus musculus
agtatatttttatcccgttgaatgg

SEQ ID NO: 208745 - DNA, 25 bp, Mus musculus
agtatcaatagcatcatttcataga

SEQ ID NO: 208746 - DNA, 25 bp, Mus musculus
agtatcaatagcttcatttcataga

SEQ ID NO: 208747 - DNA, 25 bp, Mus musculus
agtatcaatgacagtgacccccaat

SEQ ID NO: 208748 - DNA, 25 bp, Mus musculus
agtatcaatgactgtgacccccaat

SEQ ID NO: 208749 - DNA, 25 bp, Mus musculus
agtatcaatgtcaccaaagtctccc

SEQ ID NO: 208750 - DNA, 25 bp, Mus musculus
agtatcaatgtctccaaagtctccc

SEQ ID NO: 208751 - DNA, 25 bp, Mus musculus
agtatcaattgcaactccaccagga

SEQ ID NO: 208752 - DNA, 25 bp, Mus musculus
agtatcaattgctactccaccagga

SEQ ID NO: 208753 - DNA, 25 bp, Mus musculus
agtatcaatttgagttttatgcccc

SEQ ID NO: 208754 - DNA, 25 bp, Mus musculus
agtatcaatttgtgttttatgcccc

SEQ ID NO: 208755 - DNA, 25 bp, Mus musculus
agtatcacaaagctctcatcacagg

SEQ ID NO: 208756 - DNA, 25 bp, Mus musculus
agtatcacaaaggtctcatcacagg

SEQ ID NO: 208757 - DNA, 25 bp, Mus musculus
agtatcacacccctagttgaccact

SEQ ID NO: 208758 - DNA, 25 bp, Mus musculus
agtatcacacccgtagttgaccact

SEQ ID NO: 208759 - DNA, 25 bp, Mus musculus
agtatcacagacaccagttgcgact

SEQ ID NO: 208760 - DNA, 25 bp, Mus musculus
agtatcacagactccagttgcgact

SEQ ID NO: 208761 - DNA, 25 bp, Mus musculus
agtatcaccaacacaaatcaataga

SEQ ID NO: 208762 - DNA, 25 bp, Mus musculus
agtatcaccaactcaaatcaataga

SEQ ID NO: 208763 - DNA, 25 bp, Mus musculus
agtatcacccagcttacatcaactt

SEQ ID NO: 208764 - DNA, 25 bp, Mus musculus
agtatcacccaggttacatcaactt

SEQ ID NO: 208765 - DNA, 25 bp, Mus musculus
agtatcacggtgcttgctgttgctt

SEQ ID NO: 208766 - DNA, 25 bp, Mus musculus
agtatcacggtggttgctgttgctt

SEQ ID NO: 208767 - DNA, 25 bp, Mus musculus
agtatcacgtgaatcccctgcgcaa

SEQ ID NO: 208768 - DNA, 25 bp, Mus musculus
agtatcacgtgattcccctgcgcaa

SEQ ID NO: 208769 - DNA, 25 bp, Mus musculus
agtatcacgtttacagccatgttgt

SEQ ID NO: 208770 - DNA, 25 bp, Mus musculus
agtatcacgttttcagccatgttgt

SEQ ID NO: 208771 - DNA, 25 bp, Mus musculus
agtatcactcgtcccctttatgaga

SEQ ID NO: 208772 - DNA, 25 bp, Mus musculus
agtatcactcgtgccctttatgaga

SEQ ID NO: 208773 - DNA, 25 bp, Mus musculus
agtatcacttaccattattaacctg

SEQ ID NO: 208774 - DNA, 25 bp, Mus musculus
agtatcacttacgattattaacctg

SEQ ID NO: 208775 - DNA, 25 bp, Mus musculus
agtatcagatctcccgtggaattgg

SEQ ID NO: 208776 - DNA, 25 bp, Mus musculus
agtatcagatctgccgtggaattgg

SEQ ID NO: 208777 - DNA, 25 bp, Mus musculus
agtatcagcggacccttttaaatga

SEQ ID NO: 208778 - DNA, 25 bp, Mus musculus
agtatcagcggagccttttaaatga

SEQ ID NO: 208779 - DNA, 25 bp, Mus musculus
agtatcagctccagttctaaacacc

SEQ ID NO: 208780 - DNA, 25 bp, Mus musculus
agtatcagctcctgttctaaacacc

SEQ ID NO: 208781 - DNA, 25 bp, Mus musculus
agtatcagtattcggcctagggcct

SEQ ID NO: 208782 - DNA, 25 bp, Mus musculus
agtatcagtattgggcctagggcct

SEQ ID NO: 208783 - DNA, 25 bp, Mus musculus
agtatcatccctagtatctgctctg

SEQ ID NO: 208784 - DNA, 25 bp, Mus musculus
agtatcatcccttgtatctgctctg

SEQ ID NO: 208785 - DNA, 25 bp, Mus musculus
agtatcatggtgactacagctttta

SEQ ID NO: 208786 - DNA, 25 bp, Mus musculus
agtatcatggtgtctacagctttta

SEQ ID NO: 208787 - DNA, 25 bp, Mus musculus
agtatcatttctatctgtaaccctg

SEQ ID NO: 208788 - DNA, 25 bp, Mus musculus
agtatcatttctttctgtaaccctg

SEQ ID NO: 208789 - DNA, 25 bp, Mus musculus
agtatccacgatccagtcctgggca

SEQ ID NO: 208790 - DNA, 25 bp, Mus musculus
agtatccacgatgcagtcctgggca

SEQ ID NO: 208791 - DNA, 25 bp, Mus musculus
agtatccagattcagtggcccgtgg

SEQ ID NO: 208792 - DNA, 25 bp, Mus musculus
agtatccagattgagtggcccgtgg

SEQ ID NO: 208793 - DNA, 25 bp, Mus musculus
agtatccagcatatgttcctcttca

SEQ ID NO: 208794 - DNA, 25 bp, Mus musculus
agtatccagcatttgttcctcttca

SEQ ID NO: 208795 - DNA, 25 bp, Mus musculus
agtatccagtgacgcctgcagaggc

SEQ ID NO: 208796 - DNA, 25 bp, Mus musculus
agtatccagtgaggcctgcagaggc

SEQ ID NO: 208797 - DNA, 25 bp, Mus musculus
agtatccatcccaatgatggtccca

SEQ ID NO: 208798 - DNA, 25 bp, Mus musculus
agtatccatccctatgatggtccca

SEQ ID NO: 208799 - DNA, 25 bp, Mus musculus
agtatccatctaactgccaacggct

SEQ ID NO: 208800 - DNA, 25 bp, Mus musculus
agtatccatctatctgccaacggct

SEQ ID NO: 208801 - DNA, 25 bp, Mus musculus
agtatccatgcacagcaagctcgac

SEQ ID NO: 208802 - DNA, 25 bp, Mus musculus
agtatccatgcagagcaagctcgac

SEQ ID NO: 208803 - DNA, 25 bp, Mus musculus
agtatccatggcactgccttgtttc

SEQ ID NO: 208804 - DNA, 25 bp, Mus musculus
agtatccatggctctgccttgtttc

SEQ ID NO: 208805 - DNA, 25 bp, Mus musculus
agtatcccaacacgagagacaagct

SEQ ID NO: 208806 - DNA, 25 bp, Mus musculus
agtatcccaacaggagagacaagct

SEQ ID NO: 208807 - DNA, 25 bp, Mus musculus
agtatcccaacccttccttcttgtg

SEQ ID NO: 208808 - DNA, 25 bp, Mus musculus
agtatcccaaccgttccttcttgtg

SEQ ID NO: 208809 - DNA, 25 bp, Mus musculus
agtatcccaatactctcaacagtgg

SEQ ID NO: 208810 - DNA, 25 bp, Mus musculus
agtatcccaatagtctcaacagtgg

SEQ ID NO: 208811 - DNA, 25 bp, Mus musculus
agtatcccacttcgaccaggtaggc

SEQ ID NO: 208812 - DNA, 25 bp, Mus musculus
agtatcccacttggaccaggtaggc

SEQ ID NO: 208813 - DNA, 25 bp, Mus musculus
agtatcccagcacacattgtttttg

SEQ ID NO: 208814 - DNA, 25 bp, Mus musculus
agtatcccagcagacattgtttttg

SEQ ID NO: 208815 - DNA, 25 bp, Mus musculus
agtatcccctaaaagtcacatgcat

SEQ ID NO: 208816 - DNA, 25 bp, Mus musculus
agtatcccctaatagtcacatgcat

SEQ ID NO: 208817 - DNA, 25 bp, Mus musculus
agtatccccttgatttgaaacctca

SEQ ID NO: 208818 - DNA, 25 bp, Mus musculus
agtatccccttgttttgaaacctca

SEQ ID NO: 208819 - DNA, 25 bp, Mus musculus
agtatccctaagaatcactttgaag

SEQ ID NO: 208820 - DNA, 25 bp, Mus musculus
agtatccctaagtatcactttgaag

SEQ ID NO: 208821 - DNA, 25 bp, Mus musculus
agtatccctcacataccaagaggag

SEQ ID NO: 208822 - DNA, 25 bp, Mus musculus
agtatccctcacttaccaagaggag

SEQ ID NO: 208823 - DNA, 25 bp, Mus musculus
agtatccctctgatatctcctacat

SEQ ID NO: 208824 - DNA, 25 bp, Mus musculus
agtatccctctgttatctcctacat

SEQ ID NO: 208825 - DNA, 25 bp, Mus musculus
agtatcccttcacttgccagggtga

SEQ ID NO: 208826 - DNA, 25 bp, Mus musculus
agtatcccttcagttgccagggtga

SEQ ID NO: 208827 - DNA, 25 bp, Mus musculus
agtatcccttctatcttacttcaag

SEQ ID NO: 208828 - DNA, 25 bp, Mus musculus
agtatcccttctttcttacttcaag

SEQ ID NO: 208829 - DNA, 25 bp, Mus musculus
agtatccgcaggaaacttctcttct

SEQ ID NO: 208830 - DNA, 25 bp, Mus musculus
agtatccgcaggtaacttctcttct

SEQ ID NO: 208831 - DNA, 25 bp, Mus musculus
agtatccggaacagccaggcaggtt

SEQ ID NO: 208832 - DNA, 25 bp, Mus musculus
agtatccggaactgccaggcaggtt

SEQ ID NO: 208833 - DNA, 25 bp, Mus musculus
agtatcctaagacatgacagacaag

SEQ ID NO: 208834 - DNA, 25 bp, Mus musculus
agtatcctaagagatgacagacaag

SEQ ID NO: 208835 - DNA, 25 bp, Mus musculus
agtatcctactcctgaagcgtcata

SEQ ID NO: 208836 - DNA, 25 bp, Mus musculus
agtatcctactcgtgaagcgtcata

SEQ ID NO: 208837 - DNA, 25 bp, Mus musculus
agtatcctcaccctcgcagaggata

SEQ ID NO: 208838 - DNA, 25 bp, Mus musculus
agtatcctcaccgtcgcagaggata

SEQ ID NO: 208839 - DNA, 25 bp, Mus musculus
agtatcctctgcatggatgctggta

SEQ ID NO: 208840 - DNA, 25 bp, Mus musculus
agtatcctctgcttggatgctggta

SEQ ID NO: 208841 - DNA, 25 bp, Mus musculus
agtatcctgacaactgggctcgaga

SEQ ID NO: 208842 - DNA, 25 bp, Mus musculus
agtatcctgacatctgggctcgaga

SEQ ID NO: 208843 - DNA, 25 bp, Mus musculus
agtatcctggcaaagattctctcct

SEQ ID NO: 208844 - DNA, 25 bp, Mus musculus
agtatcctggcatagattctctcct

SEQ ID NO: 208845 - DNA, 25 bp, Mus musculus
agtatcctgtaaatgcatccaccct

SEQ ID NO: 208846 - DNA, 25 bp, Mus musculus
agtatcctgtaattgcatccaccct

SEQ ID NO: 208847 - DNA, 25 bp, Mus musculus
agtatccttagcaacttcagcacct

SEQ ID NO: 208848 - DNA, 25 bp, Mus musculus
agtatccttagctacttcagcacct

SEQ ID NO: 208849 - DNA, 25 bp, Mus musculus
agtatccttgtcatgtttcttatct

SEQ ID NO: 208850 - DNA, 25 bp, Mus musculus
agtatccttgtcttgtttcttatct

SEQ ID NO: 208851 - DNA, 25 bp, Mus musculus
agtatcctttctcgctcaaactgac

SEQ ID NO: 208852 - DNA, 25 bp, Mus musculus
agtatcctttctggctcaaactgac

SEQ ID NO: 208853 - DNA, 25 bp, Mus musculus
agtatcgatgccatgcggagattgt

SEQ ID NO: 208854 - DNA, 25 bp, Mus musculus
agtatcgatgccttgcggagattgt

SEQ ID NO: 208855 - DNA, 25 bp, Mus musculus
agtatcgcattccatgacgcaggag

SEQ ID NO: 208856 - DNA, 25 bp, Mus musculus
agtatcgcattcgatgacgcaggag

SEQ ID NO: 208857 - DNA, 25 bp, Mus musculus
agtatcgctgcgaggtgaagcctat

SEQ ID NO: 208858 - DNA, 25 bp, Mus musculus
agtatcgctgcgtggtgaagcctat

SEQ ID NO: 208859 - DNA, 25 bp, Mus musculus
agtatcgctgggaggccattgtcta

SEQ ID NO: 208860 - DNA, 25 bp, Mus musculus
agtatcgctgggtggccattgtcta

SEQ ID NO: 208861 - DNA, 25 bp, Mus musculus
agtatcggctgtcccatagatttta

SEQ ID NO: 208862 - DNA, 25 bp, Mus musculus
agtatcggctgtgccatagatttta

SEQ ID NO: 208863 - DNA, 25 bp, Mus musculus
agtatctaaaaacagccctccttgt

SEQ ID NO: 208864 - DNA, 25 bp, Mus musculus
agtatctaaaaagagccctccttgt

SEQ ID NO: 208865 - DNA, 25 bp, Mus musculus
agtatctaaggaacccaagggcctc

SEQ ID NO: 208866 - DNA, 25 bp, Mus musculus
agtatctaaggatcccaagggcctc

SEQ ID NO: 208867 - DNA, 25 bp, Mus musculus
agtatctacctgctgtcacggcact

SEQ ID NO: 208868 - DNA, 25 bp, Mus musculus
agtatctacctggtgtcacggcact

SEQ ID NO: 208869 - DNA, 25 bp, Mus musculus
agtatctactacctgtgtctctgaa

SEQ ID NO: 208870 - DNA, 25 bp, Mus musculus
agtatctactacgtgtgtctctgaa

SEQ ID NO: 208871 - DNA, 25 bp, Mus musculus
agtatctatattagtcttctgccag

SEQ ID NO: 208872 - DNA, 25 bp, Mus musculus
agtatctatatttgtcttctgccag

SEQ ID NO: 208873 - DNA, 25 bp, Mus musculus
agtatctatgaccaacagtggcagt

SEQ ID NO: 208874 - DNA, 25 bp, Mus musculus
agtatctatgacctatctgcagaag

SEQ ID NO: 208875 - DNA, 25 bp, Mus musculus
agtatctatgacgaacagtggcagt

SEQ ID NO: 208876 - DNA, 25 bp, Mus musculus
agtatctatgacgtatctgcagaag

SEQ ID NO: 208877 - DNA, 25 bp, Mus musculus
agtatctattgtacctgtctccaag

SEQ ID NO: 208878 - DNA, 25 bp, Mus musculus
agtatctattgttcctgtctccaag

SEQ ID NO: 208879 - DNA, 25 bp, Mus musculus
agtatctcaatcatttggtttgttt

SEQ ID NO: 208880 - DNA, 25 bp, Mus musculus
agtatctcaatcttttggtttgttt

SEQ ID NO: 208881 - DNA, 25 bp, Mus musculus
agtatctcccatcttcaagttgttg

SEQ ID NO: 208882 - DNA, 25 bp, Mus musculus
agtatctcccatgttcaagttgttg

SEQ ID NO: 208883 - DNA, 25 bp, Mus musculus
agtatctcctcgctcttcgaacgga

SEQ ID NO: 208884 - DNA, 25 bp, Mus musculus
agtatctcctcgctttttgaaagtt

SEQ ID NO: 208885 - DNA, 25 bp, Mus musculus
agtatctcctcggtcttcgaacgga

SEQ ID NO: 208886 - DNA, 25 bp, Mus musculus
agtatctcctcggtttttgaaagtt

SEQ ID NO: 208887 - DNA, 25 bp, Mus musculus
agtatctctgagatttcattcccca

SEQ ID NO: 208888 - DNA, 25 bp, Mus musculus
agtatctctgagttttcattcccca

SEQ ID NO: 208889 - DNA, 25 bp, Mus musculus
agtatctctgctcagaatcccttgc

SEQ ID NO: 208890 - DNA, 25 bp, Mus musculus
agtatctctgctgagaatcccttgc

SEQ ID NO: 208891 - DNA, 25 bp, Mus musculus
agtatctctttgagcgcctcactct

SEQ ID NO: 208892 - DNA, 25 bp, Mus musculus
agtatctctttgtgcgcctcactct

SEQ ID NO: 208893 - DNA, 25 bp, Mus musculus
agtatctgcacacgactggttggag

SEQ ID NO: 208894 - DNA, 25 bp, Mus musculus
agtatctgcacaggactggttggag

SEQ ID NO: 208895 - DNA, 25 bp, Mus musculus
agtatctgctggctccagcctcagt

SEQ ID NO: 208896 - DNA, 25 bp, Mus musculus
agtatctgctgggtccagcctcagt

SEQ ID NO: 208897 - DNA, 25 bp, Mus musculus
agtatctggctgagccatagatttt

SEQ ID NO: 208898 - DNA, 25 bp, Mus musculus
agtatctggctgtgccatagatttt

SEQ ID NO: 208899 - DNA, 25 bp, Mus musculus
agtatctggtcaaccctgagggaca

SEQ ID NO: 208900 - DNA, 25 bp, Mus musculus
agtatctggtcatccctgagggaca

SEQ ID NO: 208901 - DNA, 25 bp, Mus musculus
agtatctgtctcatctggtgggcca

SEQ ID NO: 208902 - DNA, 25 bp, Mus musculus
agtatctgtctcttctggtgggcca

SEQ ID NO: 208903 - DNA, 25 bp, Mus musculus
agtatctgtgacacccacgatgtgg

SEQ ID NO: 208904 - DNA, 25 bp, Mus musculus
agtatctgtgactcccacgatgtgg

SEQ ID NO: 208905 - DNA, 25 bp, Mus musculus
agtatctgtgttagtggttgggcta

SEQ ID NO: 208906 - DNA, 25 bp, Mus musculus
agtatctgtgtttgtggttgggcta

SEQ ID NO: 208907 - DNA, 25 bp, Mus musculus
agtatctgttctatggagctagcct

SEQ ID NO: 208908 - DNA, 25 bp, Mus musculus
agtatctgttctttggagctagcct

SEQ ID NO: 208909 - DNA, 25 bp, Mus musculus
agtatctgtttcacgtgttgggcca

SEQ ID NO: 208910 - DNA, 25 bp, Mus musculus
agtatctgtttctcgtgttgggcca

SEQ ID NO: 208911 - DNA, 25 bp, Mus musculus
agtatcttcactaacgcaacagcag

SEQ ID NO: 208912 - DNA, 25 bp, Mus musculus
agtatcttcacttacgcaacagcag

SEQ ID NO: 208913 - DNA, 25 bp, Mus musculus
agtatctttagtcctctggtggcgc

SEQ ID NO: 208914 - DNA, 25 bp, Mus musculus
agtatctttagtgctctggtggcgc

SEQ ID NO: 208915 - DNA, 25 bp, Mus musculus
agtatctttccaaatgattgccaag

SEQ ID NO: 208916 - DNA, 25 bp, Mus musculus
agtatctttccatatgattgccaag

SEQ ID NO: 208917 - DNA, 25 bp, Mus musculus
agtatctttctaagaactcatgtct

SEQ ID NO: 208918 - DNA, 25 bp, Mus musculus
agtatctttctatgaactcatgtct

SEQ ID NO: 208919 - DNA, 25 bp, Mus musculus
agtatctttgtaatagaacctgaat

SEQ ID NO: 208920 - DNA, 25 bp, Mus musculus
agtatctttgtattagaacctgaat

SEQ ID NO: 208921 - DNA, 25 bp, Mus musculus
agtatcttttggatggcagctccca

SEQ ID NO: 208922 - DNA, 25 bp, Mus musculus
agtatcttttggttggcagctccca

SEQ ID NO: 208923 - DNA, 25 bp, Mus musculus
agtatgaaatccctggcaatcccac

SEQ ID NO: 208924 - DNA, 25 bp, Mus musculus
agtatgaaatccgtggcaatcccac

SEQ ID NO: 208925 - DNA, 25 bp, Mus musculus
agtatgaacgtgacgtgttatgcag

SEQ ID NO: 208926 - DNA, 25 bp, Mus musculus
agtatgaacgtgtcgtgttatgcag

SEQ ID NO: 208927 - DNA, 25 bp, Mus musculus
agtatgaactgtcgctctcacttct

SEQ ID NO: 208928 - DNA, 25 bp, Mus musculus
agtatgaactgtggctctcacttct

SEQ ID NO: 208929 - DNA, 25 bp, Mus musculus
agtatgaagacaacctcagcctctg

SEQ ID NO: 208930 - DNA, 25 bp, Mus musculus
agtatgaagacatcctcagcctctg

SEQ ID NO: 208931 - DNA, 25 bp, Mus musculus
agtatgacacctcttactatctcag

SEQ ID NO: 208932 - DNA, 25 bp, Mus musculus
agtatgacacctgttactatctcag

SEQ ID NO: 208933 - DNA, 25 bp, Mus musculus
agtatgacagctctataccaagtgt

SEQ ID NO: 208934 - DNA, 25 bp, Mus musculus
agtatgacagctgtataccaagtgt

SEQ ID NO: 208935 - DNA, 25 bp, Mus musculus
agtatgaccattaccatctgcaagc

SEQ ID NO: 208936 - DNA, 25 bp, Mus musculus
agtatgaccatttccatctgcaagc

SEQ ID NO: 208937 - DNA, 25 bp, Mus musculus
agtatgactccactcacggcaaatt

SEQ ID NO: 208938 - DNA, 25 bp, Mus musculus
agtatgactccagtcacggcaaatt

SEQ ID NO: 208939 - DNA, 25 bp, Mus musculus
agtatgacttacagcttgccttcca

SEQ ID NO: 208940 - DNA, 25 bp, Mus musculus
agtatgacttactgcttgccttcca

SEQ ID NO: 208941 - DNA, 25 bp, Mus musculus
agtatgacttgcattgccttttcct

SEQ ID NO: 208942 - DNA, 25 bp, Mus musculus
agtatgacttgctttgccttttcct

SEQ ID NO: 208943 - DNA, 25 bp, Mus musculus
agtatgagacttcccttttctctct

SEQ ID NO: 208944 - DNA, 25 bp, Mus musculus
agtatgagacttgccttttctctct

SEQ ID NO: 208945 - DNA, 25 bp, Mus musculus
agtatgagggcaacaccttcgagga

SEQ ID NO: 208946 - DNA, 25 bp, Mus musculus
agtatgagggcatcaccttcgagga

SEQ ID NO: 208947 - DNA, 25 bp, Mus musculus
agtatgagtcctattctgttttcat

SEQ ID NO: 208948 - DNA, 25 bp, Mus musculus
agtatgagtccttttctgttttcat

SEQ ID NO: 208949 - DNA, 25 bp, Mus musculus
agtatgattactccaagcccatcca

SEQ ID NO: 208950 - DNA, 25 bp, Mus musculus
agtatgattactgcaagcccatcca

SEQ ID NO: 208951 - DNA, 25 bp, Mus musculus
agtatgattcatctagccttccagc

SEQ ID NO: 208952 - DNA, 25 bp, Mus musculus
agtatgattcatgtagccttccagc

SEQ ID NO: 208953 - DNA, 25 bp, Mus musculus
agtatgattgtacagcctgctgggc

SEQ ID NO: 208954 - DNA, 25 bp, Mus musculus
agtatgattgtagagcctgctgggc

SEQ ID NO: 208955 - DNA, 25 bp, Mus musculus
agtatgcagaatagtccctgcccac

SEQ ID NO: 208956 - DNA, 25 bp, Mus musculus
agtatgcagaattgtccctgcccac

SEQ ID NO: 208957 - DNA, 25 bp, Mus musculus
agtatgcagagaccactccactgga

SEQ ID NO: 208958 - DNA, 25 bp, Mus musculus
agtatgcagagagcactccactgga

SEQ ID NO: 208959 - DNA, 25 bp, Mus musculus
agtatgcagcttccgaacagcgact

SEQ ID NO: 208960 - DNA, 25 bp, Mus musculus
agtatgcagcttgcgaacagcgact

SEQ ID NO: 208961 - DNA, 25 bp, Mus musculus
agtatgcagggactttgcccagcac

SEQ ID NO: 208962 - DNA, 25 bp, Mus musculus
agtatgcagggagtttgcccagcac

SEQ ID NO: 208963 - DNA, 25 bp, Mus musculus
agtatgcatctgagtgggtctgtgc

SEQ ID NO: 208964 - DNA, 25 bp, Mus musculus
agtatgcatctgtgtgggtctgtgc

SEQ ID NO: 208965 - DNA, 25 bp, Mus musculus
agtatgccaaggatttcagccccat

SEQ ID NO: 208966 - DNA, 25 bp, Mus musculus
agtatgccaaggttttcagccccat

SEQ ID NO: 208967 - DNA, 25 bp, Mus musculus
agtatgccagttattgagcacgggt

SEQ ID NO: 208968 - DNA, 25 bp, Mus musculus
agtatgccagtttttgagcacgggt

SEQ ID NO: 208969 - DNA, 25 bp, Mus musculus
agtatgcccaatctcggttccagtt

SEQ ID NO: 208970 - DNA, 25 bp, Mus musculus
agtatgcccaatgtcggttccagtt

SEQ ID NO: 208971 - DNA, 25 bp, Mus musculus
agtatgcccacaatccagacaggat

SEQ ID NO: 208972 - DNA, 25 bp, Mus musculus
agtatgcccacattccagacaggat

SEQ ID NO: 208973 - DNA, 25 bp, Mus musculus
agtatgcccaccacagcgagtcctg

SEQ ID NO: 208974 - DNA, 25 bp, Mus musculus
agtatgcccacctcagcgagtcctg

SEQ ID NO: 208975 - DNA, 25 bp, Mus musculus
agtatgcccattacctcaattgtta

SEQ ID NO: 208976 - DNA, 25 bp, Mus musculus
agtatgcccatttcctcaattgtta

SEQ ID NO: 208977 - DNA, 25 bp, Mus musculus
agtatgcctacactgacaacagcct

SEQ ID NO: 208978 - DNA, 25 bp, Mus musculus
agtatgcctacagtgacaacagcct

SEQ ID NO: 208979 - DNA, 25 bp, Mus musculus
agtatgcctcacactttcgaaatag

SEQ ID NO: 208980 - DNA, 25 bp, Mus musculus
agtatgcctcactctttcgaaatag

SEQ ID NO: 208981 - DNA, 25 bp, Mus musculus
agtatgcctcatcctggccctgagt

SEQ ID NO: 208982 - DNA, 25 bp, Mus musculus
agtatgcctcatgctggccctgagt

SEQ ID NO: 208983 - DNA, 25 bp, Mus musculus
agtatgcctgtccagtggtctcaca

SEQ ID NO: 208984 - DNA, 25 bp, Mus musculus
agtatgcctgtcgagtggtctcaca

SEQ ID NO: 208985 - DNA, 25 bp, Mus musculus
agtatgctaactaacgtctccaagt

SEQ ID NO: 208986 - DNA, 25 bp, Mus musculus
agtatgctaacttacgtctccaagt

SEQ ID NO: 208987 - DNA, 25 bp, Mus musculus
agtatgctcaaactctgggaacctg

SEQ ID NO: 208988 - DNA, 25 bp, Mus musculus
agtatgctcaaagtctgggaacctg

SEQ ID NO: 208989 - DNA, 25 bp, Mus musculus
agtatgctcagccttaacctaagaa

SEQ ID NO: 208990 - DNA, 25 bp, Mus musculus
agtatgctcagcgttaacctaagaa

SEQ ID NO: 208991 - DNA, 25 bp, Mus musculus
agtatgctccctaggcagatgtcaa

SEQ ID NO: 208992 - DNA, 25 bp, Mus musculus
agtatgctcccttggcagatgtcaa

SEQ ID NO: 208993 - DNA, 25 bp, Mus musculus
agtatgctccttcttttttctaatc

SEQ ID NO: 208994 - DNA, 25 bp, Mus musculus
agtatgctccttgttttttctaatc

SEQ ID NO: 208995 - DNA, 25 bp, Mus musculus
agtatgctgaacaataatttcccca

SEQ ID NO: 208996 - DNA, 25 bp, Mus musculus
agtatgctgaactataatttcccca

SEQ ID NO: 208997 - DNA, 25 bp, Mus musculus
agtatgctgacgagcgtgtgctgca

SEQ ID NO: 208998 - DNA, 25 bp, Mus musculus
agtatgctgacgtgcgtgtgctgca

SEQ ID NO: 208999 - DNA, 25 bp, Mus musculus
agtatgctgagcagctcccggtggc

SEQ ID NO: 209000 - DNA, 25 bp, Mus musculus
agtatgctgagctgctcccggtggc

SEQ ID NO: 209001 - DNA, 25 bp, Mus musculus
agtatgctgaggaacattctcccgt

SEQ ID NO: 209002 - DNA, 25 bp, Mus musculus
agtatgctgaggtacattctcccgt

SEQ ID NO: 209003 - DNA, 25 bp, Mus musculus
agtatgctgcaacgtctagactctg

SEQ ID NO: 209004 - DNA, 25 bp, Mus musculus
agtatgctgcaaggtctagactctg

SEQ ID NO: 209005 - DNA, 25 bp, Mus musculus
agtatgctgcagacaattttgtctc

SEQ ID NO: 209006 - DNA, 25 bp, Mus musculus
agtatgctgcagtcaattttgtctc

SEQ ID NO: 209007 - DNA, 25 bp, Mus musculus
agtatgctgtggctgtctccagaca

SEQ ID NO: 209008 - DNA, 25 bp, Mus musculus
agtatgctgtgggtgtctccagaca

SEQ ID NO: 209009 - DNA, 25 bp, Mus musculus
agtatgcttccgacttttatggtaa

SEQ ID NO: 209010 - DNA, 25 bp, Mus musculus
agtatgcttccgtcttttatggtaa

SEQ ID NO: 209011 - DNA, 25 bp, Mus musculus
agtatgcttctgatgttgtccttca

SEQ ID NO: 209012 - DNA, 25 bp, Mus musculus
agtatgcttctgttgttgtccttca

SEQ ID NO: 209013 - DNA, 25 bp, Mus musculus
agtatgcttgttcctgcttggtttt

SEQ ID NO: 209014 - DNA, 25 bp, Mus musculus
agtatgcttgttgctgcttggtttt

SEQ ID NO: 209015 - DNA, 25 bp, Mus musculus
agtatgctttagaggctgcctgtgc

SEQ ID NO: 209016 - DNA, 25 bp, Mus musculus
agtatgctttagtggctgcctgtgc

SEQ ID NO: 209017 - DNA, 25 bp, Mus musculus
agtatgctttggaatccttctctct

SEQ ID NO: 209018 - DNA, 25 bp, Mus musculus
agtatgctttggtatccttctctct

SEQ ID NO: 209019 - DNA, 25 bp, Mus musculus
agtatgctttgtaaggcctgtaggt

SEQ ID NO: 209020 - DNA, 25 bp, Mus musculus
agtatgctttgttaggcctgtaggt

SEQ ID NO: 209021 - DNA, 25 bp, Mus musculus
agtatggaaaccatgcctcatgtct

SEQ ID NO: 209022 - DNA, 25 bp, Mus musculus
agtatggaaaccttgcctcatgtct

SEQ ID NO: 209023 - DNA, 25 bp, Mus musculus
agtatggaacttatcaatgcactta

SEQ ID NO: 209024 - DNA, 25 bp, Mus musculus
agtatggaacttttcaatgcactta

SEQ ID NO: 209025 - DNA, 25 bp, Mus musculus
agtatggaagcaccggacacacgtt

SEQ ID NO: 209026 - DNA, 25 bp, Mus musculus
agtatggaagcagcggacacacgtt

SEQ ID NO: 209027 - DNA, 25 bp, Mus musculus
agtatggaccatcagaccctatttc

SEQ ID NO: 209028 - DNA, 25 bp, Mus musculus
agtatggaccatgagaccctatttc

SEQ ID NO: 209029 - DNA, 25 bp, Mus musculus
agtatggacgccatgatacagttca

SEQ ID NO: 209030 - DNA, 25 bp, Mus musculus
agtatggacgccttgatacagttca

SEQ ID NO: 209031 - DNA, 25 bp, Mus musculus
agtatggagataagaggcctttaca

SEQ ID NO: 209032 - DNA, 25 bp, Mus musculus
agtatggagatatgaggcctttaca

SEQ ID NO: 209033 - DNA, 25 bp, Mus musculus
agtatggagccactttgaccacttt

SEQ ID NO: 209034 - DNA, 25 bp, Mus musculus
agtatggagccagtttgaccacttt

SEQ ID NO: 209035 - DNA, 25 bp, Mus musculus
agtatggatcgcagggactctacgt

SEQ ID NO: 209036 - DNA, 25 bp, Mus musculus
agtatggatcgctgggactctacgt

SEQ ID NO: 209037 - DNA, 25 bp, Mus musculus
agtatggcaggtcctttgcttggca

SEQ ID NO: 209038 - DNA, 25 bp, Mus musculus
agtatggcaggtgctttgcttggca

SEQ ID NO: 209039 - DNA, 25 bp, Mus musculus
agtatggcatcaacacagatcctcc

SEQ ID NO: 209040 - DNA, 25 bp, Mus musculus
agtatggcatcacttggtttacaac

SEQ ID NO: 209041 - DNA, 25 bp, Mus musculus
agtatggcatcagttggtttacaac

SEQ ID NO: 209042 - DNA, 25 bp, Mus musculus
agtatggcatcatcacagatcctcc

SEQ ID NO: 209043 - DNA, 25 bp, Mus musculus
agtatggccagactctcaggcccat

SEQ ID NO: 209044 - DNA, 25 bp, Mus musculus
agtatggccagagtctcaggcccat

SEQ ID NO: 209045 - DNA, 25 bp, Mus musculus
agtatggccatcattaacgctgctt

SEQ ID NO: 209046 - DNA, 25 bp, Mus musculus
agtatggccatctttaacgctgctt

SEQ ID NO: 209047 - DNA, 25 bp, Mus musculus
agtatggccggcactttgctgtcgt

SEQ ID NO: 209048 - DNA, 25 bp, Mus musculus
agtatggccggctctttgctgtcgt

SEQ ID NO: 209049 - DNA, 25 bp, Mus musculus
agtatggcctacagctaaatcctga

SEQ ID NO: 209050 - DNA, 25 bp, Mus musculus
agtatggcctactgctaaatcctga

SEQ ID NO: 209051 - DNA, 25 bp, Mus musculus
agtatggcgagtactcggagctcca

SEQ ID NO: 209052 - DNA, 25 bp, Mus musculus
agtatggcgagttctcggagctcca

SEQ ID NO: 209053 - DNA, 25 bp, Mus musculus
agtatggctacacccagagcaccat

SEQ ID NO: 209054 - DNA, 25 bp, Mus musculus
agtatggctacagccagagcaccat

SEQ ID NO: 209055 - DNA, 25 bp, Mus musculus
agtatggctgacaatcttcacaatc

SEQ ID NO: 209056 - DNA, 25 bp, Mus musculus
agtatggctgactatcttcacaatc

SEQ ID NO: 209057 - DNA, 25 bp, Mus musculus
agtatggctgggatgttactggcca

SEQ ID NO: 209058 - DNA, 25 bp, Mus musculus
agtatggctgggttgttactggcca

SEQ ID NO: 209059 - DNA, 25 bp, Mus musculus
agtatggcttacagcttcctgtgag

SEQ ID NO: 209060 - DNA, 25 bp, Mus musculus
agtatggcttactgcttcctgtgag

SEQ ID NO: 209061 - DNA, 25 bp, Mus musculus
agtatggctttaccctgggttatac

SEQ ID NO: 209062 - DNA, 25 bp, Mus musculus
agtatggctttagcctgggttatac

SEQ ID NO: 209063 - DNA, 25 bp, Mus musculus
agtatgggcgcactattccctagga

SEQ ID NO: 209064 - DNA, 25 bp, Mus musculus
agtatgggcgcagtattccctagga

SEQ ID NO: 209065 - DNA, 25 bp, Mus musculus
agtatgggcttcattgggcactacc

SEQ ID NO: 209066 - DNA, 25 bp, Mus musculus
agtatgggcttctttgggcactacc

SEQ ID NO: 209067 - DNA, 25 bp, Mus musculus
agtatggtactgatctgactcctcc

SEQ ID NO: 209068 - DNA, 25 bp, Mus musculus
agtatggtactgttctgactcctcc

SEQ ID NO: 209069 - DNA, 25 bp, Mus musculus
agtatggtagtgactacctgtgtgt

SEQ ID NO: 209070 - DNA, 25 bp, Mus musculus
agtatggtagtgtctacctgtgtgt

SEQ ID NO: 209071 - DNA, 25 bp, Mus musculus
agtatggtatcaacccggagcgcac

SEQ ID NO: 209072 - DNA, 25 bp, Mus musculus
agtatggtatcatcccggagcgcac

SEQ ID NO: 209073 - DNA, 25 bp, Mus musculus
agtatggtgacaccagcagccttca

SEQ ID NO: 209074 - DNA, 25 bp, Mus musculus
agtatggtgacagcagcagccttca

SEQ ID NO: 209075 - DNA, 25 bp, Mus musculus
agtatggtgatccatttgatgcttc

SEQ ID NO: 209076 - DNA, 25 bp, Mus musculus
agtatggtgatcgatttgatgcttc

SEQ ID NO: 209077 - DNA, 25 bp, Mus musculus
agtatggtgcctcgacccagaccaa

SEQ ID NO: 209078 - DNA, 25 bp, Mus musculus
agtatggtgcctggacccagaccaa

SEQ ID NO: 209079 - DNA, 25 bp, Mus musculus
agtatggttaccacctcgatggcca

SEQ ID NO: 209080 - DNA, 25 bp, Mus musculus
agtatggttacctcctcgatggcca

SEQ ID NO: 209081 - DNA, 25 bp, Mus musculus
agtatggttgaacggcccactcaat

SEQ ID NO: 209082 - DNA, 25 bp, Mus musculus
agtatggttgaagggcccactcaat

SEQ ID NO: 209083 - DNA, 25 bp, Mus musculus
agtatggttttgaacatccctctca

SEQ ID NO: 209084 - DNA, 25 bp, Mus musculus
agtatggttttgtacatccctctca

SEQ ID NO: 209085 - DNA, 25 bp, Mus musculus
agtatgtaaaaacatgtcggcttcc

SEQ ID NO: 209086 - DNA, 25 bp, Mus musculus
agtatgtaaaaagatgtcggcttcc

SEQ ID NO: 209087 - DNA, 25 bp, Mus musculus
agtatgtaaacaacactgtgactaa

SEQ ID NO: 209088 - DNA, 25 bp, Mus musculus
agtatgtaaacatcactgtgactaa

SEQ ID NO: 209089 - DNA, 25 bp, Mus musculus
agtatgtaacaaaccaccttcttaa

SEQ ID NO: 209090 - DNA, 25 bp, Mus musculus
agtatgtaacaatccaccttcttaa

SEQ ID NO: 209091 - DNA, 25 bp, Mus musculus
agtatgtaacccctgtgtatggccc

SEQ ID NO: 209092 - DNA, 25 bp, Mus musculus
agtatgtaacccgtgtgtatggccc

SEQ ID NO: 209093 - DNA, 25 bp, Mus musculus
agtatgtaacctaagctgacctgaa

SEQ ID NO: 209094 - DNA, 25 bp, Mus musculus
agtatgtaaccttagctgacctgaa

SEQ ID NO: 209095 - DNA, 25 bp, Mus musculus
agtatgtacaaacccatcacctaca

SEQ ID NO: 209096 - DNA, 25 bp, Mus musculus
agtatgtacaaagccatcacctaca

SEQ ID NO: 209097 - DNA, 25 bp, Mus musculus
agtatgtacttaatcttgctttaaa

SEQ ID NO: 209098 - DNA, 25 bp, Mus musculus
agtatgtacttattcttgctttaaa

SEQ ID NO: 209099 - DNA, 25 bp, Mus musculus
agtatgtaggacatgcctcccagcg

SEQ ID NO: 209100 - DNA, 25 bp, Mus musculus
agtatgtaggacttgcctcccagcg

SEQ ID NO: 209101 - DNA, 25 bp, Mus musculus
agtatgtatcccatcactggcggct

SEQ ID NO: 209102 - DNA, 25 bp, Mus musculus
agtatgtatcccttcactggcggct

SEQ ID NO: 209103 - DNA, 25 bp, Mus musculus
agtatgtattctacaggactgtgac

SEQ ID NO: 209104 - DNA, 25 bp, Mus musculus
agtatgtattcttcaggactgtgac

SEQ ID NO: 209105 - DNA, 25 bp, Mus musculus
agtatgtatttaatgtcagttctca

SEQ ID NO: 209106 - DNA, 25 bp, Mus musculus
agtatgtatttattgtcagttctca

SEQ ID NO: 209107 - DNA, 25 bp, Mus musculus
agtatgtccagcaggcgcctgtgag

SEQ ID NO: 209108 - DNA, 25 bp, Mus musculus
agtatgtccagctggcgcctgtgag

SEQ ID NO: 209109 - DNA, 25 bp, Mus musculus
agtatgtcctggctcctaactgctg

SEQ ID NO: 209110 - DNA, 25 bp, Mus musculus
agtatgtcctgggtcctaactgctg

SEQ ID NO: 209111 - DNA, 25 bp, Mus musculus
agtatgtccttgaaactaactgata

SEQ ID NO: 209112 - DNA, 25 bp, Mus musculus
agtatgtccttgtaactaactgata

SEQ ID NO: 209113 - DNA, 25 bp, Mus musculus
agtatgtcttgaacactgtgccagg

SEQ ID NO: 209114 - DNA, 25 bp, Mus musculus
agtatgtcttgatcactgtgccagg

SEQ ID NO: 209115 - DNA, 25 bp, Mus musculus
agtatgtgatgaagcccacctacca

SEQ ID NO: 209116 - DNA, 25 bp, Mus musculus
agtatgtgatgatgcccacctacca

SEQ ID NO: 209117 - DNA, 25 bp, Mus musculus
agtatgtgccatagcctgtctgacc

SEQ ID NO: 209118 - DNA, 25 bp, Mus musculus
agtatgtgccatatgctgggaccca

SEQ ID NO: 209119 - DNA, 25 bp, Mus musculus
agtatgtgccattgcctgtctgacc

SEQ ID NO: 209120 - DNA, 25 bp, Mus musculus
agtatgtgccatttgctgggaccca

SEQ ID NO: 209121 - DNA, 25 bp, Mus musculus
agtatgtgctatatgccctacctcc

SEQ ID NO: 209122 - DNA, 25 bp, Mus musculus
agtatgtgctatttgccctacctcc

SEQ ID NO: 209123 - DNA, 25 bp, Mus musculus
agtatgtgctcaaggctgccacggc

SEQ ID NO: 209124 - DNA, 25 bp, Mus musculus
agtatgtgctcatggctgccacggc

SEQ ID NO: 209125 - DNA, 25 bp, Mus musculus
agtatgtgctgcactgagctacccc

SEQ ID NO: 209126 - DNA, 25 bp, Mus musculus
agtatgtgctgctctgagctacccc

SEQ ID NO: 209127 - DNA, 25 bp, Mus musculus
agtatgtggatcagttgcccgtgac

SEQ ID NO: 209128 - DNA, 25 bp, Mus musculus
agtatgtggatctgttgcccgtgac

SEQ ID NO: 209129 - DNA, 25 bp, Mus musculus
agtatgtgggaaagtcttctgtttt

SEQ ID NO: 209130 - DNA, 25 bp, Mus musculus
agtatgtgggaatgtcttctgtttt

SEQ ID NO: 209131 - DNA, 25 bp, Mus musculus
agtatgtgtctaccagagccaccaa

SEQ ID NO: 209132 - DNA, 25 bp, Mus musculus
agtatgtgtctagcagagccaccaa

SEQ ID NO: 209133 - DNA, 25 bp, Mus musculus
agtatgtgtctcctgcaaagcaagt

SEQ ID NO: 209134 - DNA, 25 bp, Mus musculus
agtatgtgtctcgtgcaaagcaagt

SEQ ID NO: 209135 - DNA, 25 bp, Mus musculus
agtatgtgtcttagttcatcttcaa

SEQ ID NO: 209136 - DNA, 25 bp, Mus musculus
agtatgtgtctttgttcatcttcaa

SEQ ID NO: 209137 - DNA, 25 bp, Mus musculus
agtatgtgtggcacagccttggcac

SEQ ID NO: 209138 - DNA, 25 bp, Mus musculus
agtatgtgtggctcagccttggcac

SEQ ID NO: 209139 - DNA, 25 bp, Mus musculus
agtatgttctcactatcctgccata

SEQ ID NO: 209140 - DNA, 25 bp, Mus musculus
agtatgttctcagtatcctgccata

SEQ ID NO: 209141 - DNA, 25 bp, Mus musculus
agtatgttgacaaatccctttgtgc

SEQ ID NO: 209142 - DNA, 25 bp, Mus musculus
agtatgttgacatatccctttgtgc

SEQ ID NO: 209143 - DNA, 25 bp, Mus musculus
agtatgttggcacgctgactggctt

SEQ ID NO: 209144 - DNA, 25 bp, Mus musculus
agtatgttggcaggctgactggctt

SEQ ID NO: 209145 - DNA, 25 bp, Mus musculus
agtatgttgtgcaggtggctgctct

SEQ ID NO: 209146 - DNA, 25 bp, Mus musculus
agtatgttgtgctggtggctgctct

SEQ ID NO: 209147 - DNA, 25 bp, Mus musculus
agtattaactggaggcatgcgtggt

SEQ ID NO: 209148 - DNA, 25 bp, Mus musculus
agtattaactggtggcatgcgtggt

SEQ ID NO: 209149 - DNA, 25 bp, Mus musculus
agtattaatctgacagagcctcaat

SEQ ID NO: 209150 - DNA, 25 bp, Mus musculus
agtattaatctgtcagagcctcaat

SEQ ID NO: 209151 - DNA, 25 bp, Mus musculus
agtattaccaccagacagatcccag

SEQ ID NO: 209152 - DNA, 25 bp, Mus musculus
agtattaccacctgacagatcccag

SEQ ID NO: 209153 - DNA, 25 bp, Mus musculus
agtattacctcgacagagccctcca

SEQ ID NO: 209154 - DNA, 25 bp, Mus musculus
agtattacctcgtcagagccctcca

SEQ ID NO: 209155 - DNA, 25 bp, Mus musculus
agtattacgaaaccctcagcgagct

SEQ ID NO: 209156 - DNA, 25 bp, Mus musculus
agtattacgaaagcctcagcgagct

SEQ ID NO: 209157 - DNA, 25 bp, Mus musculus
agtattactatcagagcgggtgcct

SEQ ID NO: 209158 - DNA, 25 bp, Mus musculus
agtattactatctgagcgggtgcct

SEQ ID NO: 209159 - DNA, 25 bp, Mus musculus
agtattactgaacgctcctctcttg

SEQ ID NO: 209160 - DNA, 25 bp, Mus musculus
agtattactgaaggctcctctcttg

SEQ ID NO: 209161 - DNA, 25 bp, Mus musculus
agtattactgacacacgtttgcttg

SEQ ID NO: 209162 - DNA, 25 bp, Mus musculus
agtattactgactcacgtttgcttg

SEQ ID NO: 209163 - DNA, 25 bp, Mus musculus
agtattagccatcatgtgtccctgt

SEQ ID NO: 209164 - DNA, 25 bp, Mus musculus
agtattagccatgatgtgtccctgt

SEQ ID NO: 209165 - DNA, 25 bp, Mus musculus
agtattagtagtcagcccagcttgg

SEQ ID NO: 209166 - DNA, 25 bp, Mus musculus
agtattagtagtgagcccagcttgg

SEQ ID NO: 209167 - DNA, 25 bp, Mus musculus
agtattatccccagggctttttgtg

SEQ ID NO: 209168 - DNA, 25 bp, Mus musculus
agtattatcccctgggctttttgtg

SEQ ID NO: 209169 - DNA, 25 bp, Mus musculus
agtattatggtaacacatcattgaa

SEQ ID NO: 209170 - DNA, 25 bp, Mus musculus
agtattatggtatcacatcattgaa

SEQ ID NO: 209171 - DNA, 25 bp, Mus musculus
agtattatttgaatggagctgttta

SEQ ID NO: 209172 - DNA, 25 bp, Mus musculus
agtattatttgattggagctgttta

SEQ ID NO: 209173 - DNA, 25 bp, Mus musculus
agtattcaataaaccactgcgtgtt

SEQ ID NO: 209174 - DNA, 25 bp, Mus musculus
agtattcaataatccactgcgtgtt

SEQ ID NO: 209175 - DNA, 25 bp, Mus musculus
agtattcacacaatcaccagctgtc

SEQ ID NO: 209176 - DNA, 25 bp, Mus musculus
agtattcacacattcaccagctgtc

SEQ ID NO: 209177 - DNA, 25 bp, Mus musculus
agtattcacatcctgccgtttcttg

SEQ ID NO: 209178 - DNA, 25 bp, Mus musculus
agtattcacatcgtgccgtttcttg

SEQ ID NO: 209179 - DNA, 25 bp, Mus musculus
agtattcaccccaaatctatcggac

SEQ ID NO: 209180 - DNA, 25 bp, Mus musculus
agtattcacccctaatctatcggac

SEQ ID NO: 209181 - DNA, 25 bp, Mus musculus
agtattcaccttactcacagagcta

SEQ ID NO: 209182 - DNA, 25 bp, Mus musculus
agtattcacctttctcacagagcta

SEQ ID NO: 209183 - DNA, 25 bp, Mus musculus
agtattcacttactcctgtgcccag

SEQ ID NO: 209184 - DNA, 25 bp, Mus musculus
agtattcacttagtcctgtgcccag

SEQ ID NO: 209185 - DNA, 25 bp, Mus musculus
agtattcagacacagacccagagtt

SEQ ID NO: 209186 - DNA, 25 bp, Mus musculus
agtattcagacagagacccagagtt

SEQ ID NO: 209187 - DNA, 25 bp, Mus musculus
agtattcagattaggcctttcgaca

SEQ ID NO: 209188 - DNA, 25 bp, Mus musculus
agtattcagatttggcctttcgaca

SEQ ID NO: 209189 - DNA, 25 bp, Mus musculus
agtattcagcttccatagccctgag

SEQ ID NO: 209190 - DNA, 25 bp, Mus musculus
agtattcagcttgcatagccctgag

SEQ ID NO: 209191 - DNA, 25 bp, Mus musculus
agtattcagggcctgttctgtttcc

SEQ ID NO: 209192 - DNA, 25 bp, Mus musculus
agtattcagggcgtgttctgtttcc

SEQ ID NO: 209193 - DNA, 25 bp, Mus musculus
agtattcagtgaccgatgcccttga

SEQ ID NO: 209194 - DNA, 25 bp, Mus musculus
agtattcagtgagcgatgcccttga

SEQ ID NO: 209195 - DNA, 25 bp, Mus musculus
agtattcatataatcctagtgggac

SEQ ID NO: 209196 - DNA, 25 bp, Mus musculus
agtattcatatattcctagtgggac

SEQ ID NO: 209197 - DNA, 25 bp, Mus musculus
agtattcatatgcatgtggtccagc

SEQ ID NO: 209198 - DNA, 25 bp, Mus musculus
agtattcatatggatgtggtccagc

SEQ ID NO: 209199 - DNA, 25 bp, Mus musculus
agtattcatcatacaattcattcag

SEQ ID NO: 209200 - DNA, 25 bp, Mus musculus
agtattcatcattcaattcattcag

SEQ ID NO: 209201 - DNA, 25 bp, Mus musculus
agtattcatctgctgacactggctt

SEQ ID NO: 209202 - DNA, 25 bp, Mus musculus
agtattcatctggtgacactggctt

SEQ ID NO: 209203 - DNA, 25 bp, Mus musculus
agtattcattccactcgaggaccca

SEQ ID NO: 209204 - DNA, 25 bp, Mus musculus
agtattcattccacttctatttgct

SEQ ID NO: 209205 - DNA, 25 bp, Mus musculus
agtattcattcctctcgaggaccca

SEQ ID NO: 209206 - DNA, 25 bp, Mus musculus
agtattcattcctcttctatttgct

SEQ ID NO: 209207 - DNA, 25 bp, Mus musculus
agtattccaaagctagccaccattt

SEQ ID NO: 209208 - DNA, 25 bp, Mus musculus
agtattccaaaggtagccaccattt

SEQ ID NO: 209209 - DNA, 25 bp, Mus musculus
agtattccatccctgtacagcaatg

SEQ ID NO: 209210 - DNA, 25 bp, Mus musculus
agtattccatccgtgtacagcaatg

SEQ ID NO: 209211 - DNA, 25 bp, Mus musculus
agtattccatgcatccttgtaaaat

SEQ ID NO: 209212 - DNA, 25 bp, Mus musculus
agtattccatgcttccttgtaaaat

SEQ ID NO: 209213 - DNA, 25 bp, Mus musculus
agtattccctagatgcttgtggaat

SEQ ID NO: 209214 - DNA, 25 bp, Mus musculus
agtattccctagttgcttgtggaat

SEQ ID NO: 209215 - DNA, 25 bp, Mus musculus
agtattccctcaagatcaacagcct

SEQ ID NO: 209216 - DNA, 25 bp, Mus musculus
agtattccctcatgatcaacagcct

SEQ ID NO: 209217 - DNA, 25 bp, Mus musculus
agtattccgaaacgcagaagtggta

SEQ ID NO: 209218 - DNA, 25 bp, Mus musculus
agtattccgaaaggcagaagtggta

SEQ ID NO: 209219 - DNA, 25 bp, Mus musculus
agtattccgaacacagcgcattgac

SEQ ID NO: 209220 - DNA, 25 bp, Mus musculus
agtattccgaactcagcgcattgac

SEQ ID NO: 209221 - DNA, 25 bp, Mus musculus
agtattcctcatcccctgtgctaat

SEQ ID NO: 209222 - DNA, 25 bp, Mus musculus
agtattcctcatgccctgtgctaat

SEQ ID NO: 209223 - DNA, 25 bp, Mus musculus
agtattctaaagaaactgatgtttc

SEQ ID NO: 209224 - DNA, 25 bp, Mus musculus
agtattctaaagtaactgatgtttc

SEQ ID NO: 209225 - DNA, 25 bp, Mus musculus
agtattctagacagaaggtggctca

SEQ ID NO: 209226 - DNA, 25 bp, Mus musculus
agtattctagactgaaggtggctca

SEQ ID NO: 209227 - DNA, 25 bp, Mus musculus
agtattctatagagctgtccaaatt

SEQ ID NO: 209228 - DNA, 25 bp, Mus musculus
agtattctatagtgctgtccaaatt

SEQ ID NO: 209229 - DNA, 25 bp, Mus musculus
agtattctatctccttataagtcat

SEQ ID NO: 209230 - DNA, 25 bp, Mus musculus
agtattctatctgcttataagtcat

SEQ ID NO: 209231 - DNA, 25 bp, Mus musculus
agtattctcaatatccttgtcatgt

SEQ ID NO: 209232 - DNA, 25 bp, Mus musculus
agtattctcaatttccttgtcatgt

SEQ ID NO: 209233 - DNA, 25 bp, Mus musculus
agtattctcagaaatgatttcaaaa

SEQ ID NO: 209234 - DNA, 25 bp, Mus musculus
agtattctcagaagtggctcctacc

SEQ ID NO: 209235 - DNA, 25 bp, Mus musculus
agtattctcagatatgatttcaaaa

SEQ ID NO: 209236 - DNA, 25 bp, Mus musculus
agtattctcagatgtggctcctacc

SEQ ID NO: 209237 - DNA, 25 bp, Mus musculus
agtattctctagcttccttggacac

SEQ ID NO: 209238 - DNA, 25 bp, Mus musculus
agtattctctaggttccttggacac

SEQ ID NO: 209239 - DNA, 25 bp, Mus musculus
agtattctgaaacgcttgtgcactt

SEQ ID NO: 209240 - DNA, 25 bp, Mus musculus
agtattctgaaaggcttgtgcactt

SEQ ID NO: 209241 - DNA, 25 bp, Mus musculus
agtattctgcctattgtcgcttaga

SEQ ID NO: 209242 - DNA, 25 bp, Mus musculus
agtattctgccttttgtcgcttaga

SEQ ID NO: 209243 - DNA, 25 bp, Mus musculus
agtattctggatcgtgtctctaccc

SEQ ID NO: 209244 - DNA, 25 bp, Mus musculus
agtattctggatggtgtctctaccc

SEQ ID NO: 209245 - DNA, 25 bp, Mus musculus
agtattctggtaaatctttttggca

SEQ ID NO: 209246 - DNA, 25 bp, Mus musculus
agtattctggtatatctttttggca

SEQ ID NO: 209247 - DNA, 25 bp, Mus musculus
agtattctgtatcccttcagtgcct

SEQ ID NO: 209248 - DNA, 25 bp, Mus musculus
agtattctgtatgccttcagtgcct

SEQ ID NO: 209249 - DNA, 25 bp, Mus musculus
agtattctgtttacactgagagtta

SEQ ID NO: 209250 - DNA, 25 bp, Mus musculus
agtattctgttttcactgagagtta

SEQ ID NO: 209251 - DNA, 25 bp, Mus musculus
agtattcttctgcagtttgttatga

SEQ ID NO: 209252 - DNA, 25 bp, Mus musculus
agtattcttctggagtttgttatga

SEQ ID NO: 209253 - DNA, 25 bp, Mus musculus
agtattcttgtgatgtgatctccct

SEQ ID NO: 209254 - DNA, 25 bp, Mus musculus
agtattcttgtgttgtgatctccct

SEQ ID NO: 209255 - DNA, 25 bp, Mus musculus
agtattgaagatcacctgcagccct

SEQ ID NO: 209256 - DNA, 25 bp, Mus musculus
agtattgaagatgacctgcagccct

SEQ ID NO: 209257 - DNA, 25 bp, Mus musculus
agtattgaccagagtatgtgcctaa

SEQ ID NO: 209258 - DNA, 25 bp, Mus musculus
agtattgaccagtgtatgtgcctaa

SEQ ID NO: 209259 - DNA, 25 bp, Mus musculus
agtattgagaccctgcagcgatgct

SEQ ID NO: 209260 - DNA, 25 bp, Mus musculus
agtattgagaccgtgcagcgatgct

SEQ ID NO: 209261 - DNA, 25 bp, Mus musculus
agtattgatacaaagggctacactc

SEQ ID NO: 209262 - DNA, 25 bp, Mus musculus
agtattgatacatagggctacactc

SEQ ID NO: 209263 - DNA, 25 bp, Mus musculus
agtattgatactcttctccacacag

SEQ ID NO: 209264 - DNA, 25 bp, Mus musculus
agtattgatactgttctccacacag

SEQ ID NO: 209265 - DNA, 25 bp, Mus musculus
agtattgatctaagttctgttgtta

SEQ ID NO: 209266 - DNA, 25 bp, Mus musculus
agtattgatctatgttctgttgtta

SEQ ID NO: 209267 - DNA, 25 bp, Mus musculus
agtattgcactaaactgaggagggc

SEQ ID NO: 209268 - DNA, 25 bp, Mus musculus
agtattgcactatactgaggagggc

SEQ ID NO: 209269 - DNA, 25 bp, Mus musculus
agtattgcagtcagagatcattcct

SEQ ID NO: 209270 - DNA, 25 bp, Mus musculus
agtattgcagtctgagatcattcct

SEQ ID NO: 209271 - DNA, 25 bp, Mus musculus
agtattgcattcaaagtctcttgga

SEQ ID NO: 209272 - DNA, 25 bp, Mus musculus
agtattgcattctaagtctcttgga

SEQ ID NO: 209273 - DNA, 25 bp, Mus musculus
agtattgccaagaagacctctcctt

SEQ ID NO: 209274 - DNA, 25 bp, Mus musculus
agtattgccaagtagacctctcctt

SEQ ID NO: 209275 - DNA, 25 bp, Mus musculus
agtattgccatgatgcacagtccag

SEQ ID NO: 209276 - DNA, 25 bp, Mus musculus
agtattgccatgttgcacagtccag

SEQ ID NO: 209277 - DNA, 25 bp, Mus musculus
agtattgccattcattagcatcctt

SEQ ID NO: 209278 - DNA, 25 bp, Mus musculus
agtattgccattgattagcatcctt

SEQ ID NO: 209279 - DNA, 25 bp, Mus musculus
agtattgccgcaagtttgaagccat

SEQ ID NO: 209280 - DNA, 25 bp, Mus musculus
agtattgccgcatgtttgaagccat

SEQ ID NO: 209281 - DNA, 25 bp, Mus musculus
agtattgcctctacaagaccctgca

SEQ ID NO: 209282 - DNA, 25 bp, Mus musculus
agtattgcctcttcaagaccctgca

SEQ ID NO: 209283 - DNA, 25 bp, Mus musculus
agtattgctattacccagaaataaa

SEQ ID NO: 209284 - DNA, 25 bp, Mus musculus
agtattgctatttcccagaaataaa

SEQ ID NO: 209285 - DNA, 25 bp, Mus musculus
agtattgctggtacattaccccatg

SEQ ID NO: 209286 - DNA, 25 bp, Mus musculus
agtattgctggttcattaccccatg

SEQ ID NO: 209287 - DNA, 25 bp, Mus musculus
agtattggagaaaccctgaaacaag

SEQ ID NO: 209288 - DNA, 25 bp, Mus musculus
agtattggagaatccctgaaacaag

SEQ ID NO: 209289 - DNA, 25 bp, Mus musculus
agtattgggctcatcctgaaagaca

SEQ ID NO: 209290 - DNA, 25 bp, Mus musculus
agtattgggctcttcctgaaagaca

SEQ ID NO: 209291 - DNA, 25 bp, Mus musculus
agtattgggtgcactgatgtggaaa

SEQ ID NO: 209292 - DNA, 25 bp, Mus musculus
agtattgggtgctctgatgtggaaa

SEQ ID NO: 209293 - DNA, 25 bp, Mus musculus
agtattggtgacaggctgcatctaa

SEQ ID NO: 209294 - DNA, 25 bp, Mus musculus
agtattggtgactggctgcatctaa

SEQ ID NO: 209295 - DNA, 25 bp, Mus musculus
agtattggttacaagagatatgatt

SEQ ID NO: 209296 - DNA, 25 bp, Mus musculus
agtattggttactagagatatgatt

SEQ ID NO: 209297 - DNA, 25 bp, Mus musculus
agtattggtttgctctgcatgtcta

SEQ ID NO: 209298 - DNA, 25 bp, Mus musculus
agtattggtttggtctgcatgtcta

SEQ ID NO: 209299 - DNA, 25 bp, Mus musculus
agtattgtacaacctatcatcccac

SEQ ID NO: 209300 - DNA, 25 bp, Mus musculus
agtattgtacaagctatcatcccac

SEQ ID NO: 209301 - DNA, 25 bp, Mus musculus
agtattgtacccaccttagtgttgt

SEQ ID NO: 209302 - DNA, 25 bp, Mus musculus
agtattgtaccctccttagtgttgt

SEQ ID NO: 209303 - DNA, 25 bp, Mus musculus
agtattgtagctcgtctgtgccact

SEQ ID NO: 209304 - DNA, 25 bp, Mus musculus
agtattgtagctggtctgtgccact

SEQ ID NO: 209305 - DNA, 25 bp, Mus musculus
agtattgtcacgatggcactctcac

SEQ ID NO: 209306 - DNA, 25 bp, Mus musculus
agtattgtcacgttggcactctcac

SEQ ID NO: 209307 - DNA, 25 bp, Mus musculus
agtattgtcatcacttttccaacca

SEQ ID NO: 209308 - DNA, 25 bp, Mus musculus
agtattgtcatctcttttccaacca

SEQ ID NO: 209309 - DNA, 25 bp, Mus musculus
agtattgtcttcagagaacgctgaa

SEQ ID NO: 209310 - DNA, 25 bp, Mus musculus
agtattgtcttctgagaacgctgaa

SEQ ID NO: 209311 - DNA, 25 bp, Mus musculus
agtattgtgacacctggcccgatgt

SEQ ID NO: 209312 - DNA, 25 bp, Mus musculus
agtattgtgacagctggcccgatgt

SEQ ID NO: 209313 - DNA, 25 bp, Mus musculus
agtattgtgcttagtcttgacagaa

SEQ ID NO: 209314 - DNA, 25 bp, Mus musculus
agtattgtgctttgtcttgacagaa

SEQ ID NO: 209315 - DNA, 25 bp, Mus musculus
agtattgtgtgtctgaaattgttca

SEQ ID NO: 209316 - DNA, 25 bp, Mus musculus
agtattgtgtgtgtgaaattgttca

SEQ ID NO: 209317 - DNA, 25 bp, Mus musculus
agtattgttataccgaatcctattt

SEQ ID NO: 209318 - DNA, 25 bp, Mus musculus
agtattgttatagcgaatcctattt

SEQ ID NO: 209319 - DNA, 25 bp, Mus musculus
agtattgttatcaagttcctaatag

SEQ ID NO: 209320 - DNA, 25 bp, Mus musculus
agtattgttatctagttcctaatag

SEQ ID NO: 209321 - DNA, 25 bp, Mus musculus
agtattgttctgatgcacgcctgca

SEQ ID NO: 209322 - DNA, 25 bp, Mus musculus
agtattgttctgttgcacgcctgca

SEQ ID NO: 209323 - DNA, 25 bp, Mus musculus
agtattgttgtcctgattggcctca

SEQ ID NO: 209324 - DNA, 25 bp, Mus musculus
agtattgttgtcgtgattggcctca

SEQ ID NO: 209325 - DNA, 25 bp, Mus musculus
agtattgtttctacatgcaaaccca

SEQ ID NO: 209326 - DNA, 25 bp, Mus musculus
agtattgtttcttcatgcaaaccca

SEQ ID NO: 209327 - DNA, 25 bp, Mus musculus
agtattgttttacctatttatcata

SEQ ID NO: 209328 - DNA, 25 bp, Mus musculus
agtattgttttagctatttatcata

SEQ ID NO: 209329 - DNA, 25 bp, Mus musculus
agtatttaaatccatagggcccagg

SEQ ID NO: 209330 - DNA, 25 bp, Mus musculus
agtatttaaatcgatagggcccagg

SEQ ID NO: 209331 - DNA, 25 bp, Mus musculus
agtatttaacacattctaagacagt

SEQ ID NO: 209332 - DNA, 25 bp, Mus musculus
agtatttaacactttctaagacagt

SEQ ID NO: 209333 - DNA, 25 bp, Mus musculus
agtatttaacatactggagccccag

SEQ ID NO: 209334 - DNA, 25 bp, Mus musculus
agtatttaacattctggagccccag

SEQ ID NO: 209335 - DNA, 25 bp, Mus musculus
agtatttaacccatgtaccactcca

SEQ ID NO: 209336 - DNA, 25 bp, Mus musculus
agtatttaacccttgtaccactcca

SEQ ID NO: 209337 - DNA, 25 bp, Mus musculus
agtatttacccaactcaggttcctc

SEQ ID NO: 209338 - DNA, 25 bp, Mus musculus
agtatttacccatctcaggttcctc

SEQ ID NO: 209339 - DNA, 25 bp, Mus musculus
agtatttacccgactgtgtgtgact

SEQ ID NO: 209340 - DNA, 25 bp, Mus musculus
agtatttacccgtctgtgtgtgact

SEQ ID NO: 209341 - DNA, 25 bp, Mus musculus
agtatttacttcagccattccgaga

SEQ ID NO: 209342 - DNA, 25 bp, Mus musculus
agtatttacttctgccattccgaga

SEQ ID NO: 209343 - DNA, 25 bp, Mus musculus
agtatttagctgctgcccttttctc

SEQ ID NO: 209344 - DNA, 25 bp, Mus musculus
agtatttagctggtgcccttttctc

SEQ ID NO: 209345 - DNA, 25 bp, Mus musculus
agtatttaggttacccatatatctc

SEQ ID NO: 209346 - DNA, 25 bp, Mus musculus
agtatttaggtttcccatatatctc

SEQ ID NO: 209347 - DNA, 25 bp, Mus musculus
agtatttataccactcccaaacaat

SEQ ID NO: 209348 - DNA, 25 bp, Mus musculus
agtatttatacctctcccaaacaat

SEQ ID NO: 209349 - DNA, 25 bp, Mus musculus
agtatttattatcctctgccacctc

SEQ ID NO: 209350 - DNA, 25 bp, Mus musculus
agtatttattatgctctgccacctc

SEQ ID NO: 209351 - DNA, 25 bp, Mus musculus
agtatttcacaaacttttcaaagga

SEQ ID NO: 209352 - DNA, 25 bp, Mus musculus
agtatttcacaatcttttcaaagga

SEQ ID NO: 209353 - DNA, 25 bp, Mus musculus
agtatttcacatctgctgcaatggg

SEQ ID NO: 209354 - DNA, 25 bp, Mus musculus
agtatttcacatgtgctgcaatggg

SEQ ID NO: 209355 - DNA, 25 bp, Mus musculus
agtatttcagctctaccttcatgat

SEQ ID NO: 209356 - DNA, 25 bp, Mus musculus
agtatttcagctgtaccttcatgat

SEQ ID NO: 209357 - DNA, 25 bp, Mus musculus
agtatttcagtaacttcatagctag

SEQ ID NO: 209358 - DNA, 25 bp, Mus musculus
agtatttcagtatcttcatagctag

SEQ ID NO: 209359 - DNA, 25 bp, Mus musculus
agtatttccgatccacaactccaat

SEQ ID NO: 209360 - DNA, 25 bp, Mus musculus
agtatttccgatgcacaactccaat

SEQ ID NO: 209361 - DNA, 25 bp, Mus musculus
agtatttcctttctccaagtcctct

SEQ ID NO: 209362 - DNA, 25 bp, Mus musculus
agtatttcctttgtccaagtcctct

SEQ ID NO: 209363 - DNA, 25 bp, Mus musculus
agtatttcgcttctggaggctccga

SEQ ID NO: 209364 - DNA, 25 bp, Mus musculus
agtatttcgcttgtggaggctccga

SEQ ID NO: 209365 - DNA, 25 bp, Mus musculus
agtatttctacaagccctttggatc

SEQ ID NO: 209366 - DNA, 25 bp, Mus musculus
agtatttctacatgccctttggatc

SEQ ID NO: 209367 - DNA, 25 bp, Mus musculus
agtatttcttaaaacctgccattat

SEQ ID NO: 209368 - DNA, 25 bp, Mus musculus
agtatttcttaatacctgccattat

SEQ ID NO: 209369 - DNA, 25 bp, Mus musculus
agtatttcttttaccatcattccca

SEQ ID NO: 209370 - DNA, 25 bp, Mus musculus
agtatttctttttccatcattccca

SEQ ID NO: 209371 - DNA, 25 bp, Mus musculus
agtatttgagcccaggttatgtaaa

SEQ ID NO: 209372 - DNA, 25 bp, Mus musculus
agtatttgagccgaggttatgtaaa

SEQ ID NO: 209373 - DNA, 25 bp, Mus musculus
agtatttggagcatccctaccagaa

SEQ ID NO: 209374 - DNA, 25 bp, Mus musculus
agtatttggagcttccctaccagaa

SEQ ID NO: 209375 - DNA, 25 bp, Mus musculus
agtatttggatcctggcagtagctc

SEQ ID NO: 209376 - DNA, 25 bp, Mus musculus
agtatttggatcgtggcagtagctc

SEQ ID NO: 209377 - DNA, 25 bp, Mus musculus
agtatttggccaatcgtccatccat

SEQ ID NO: 209378 - DNA, 25 bp, Mus musculus
agtatttggccattcgtccatccat

SEQ ID NO: 209379 - DNA, 25 bp, Mus musculus
agtatttgggatcctctctattaaa

SEQ ID NO: 209380 - DNA, 25 bp, Mus musculus
agtatttgggatgctctctattaaa

SEQ ID NO: 209381 - DNA, 25 bp, Mus musculus
agtatttggtgaccagtctggttcc

SEQ ID NO: 209382 - DNA, 25 bp, Mus musculus
agtatttggtgagcagtctggttcc

SEQ ID NO: 209383 - DNA, 25 bp, Mus musculus
agtatttgtctcattatgctcccac

SEQ ID NO: 209384 - DNA, 25 bp, Mus musculus
agtatttgtctctttatgctcccac

SEQ ID NO: 209385 - DNA, 25 bp, Mus musculus
agtatttgtcttcagagggccacca

SEQ ID NO: 209386 - DNA, 25 bp, Mus musculus
agtatttgtcttgagagggccacca

SEQ ID NO: 209387 - DNA, 25 bp, Mus musculus
agtatttgtggactccaggcgcctg

SEQ ID NO: 209388 - DNA, 25 bp, Mus musculus
agtatttgtggagtccaggcgcctg

SEQ ID NO: 209389 - DNA, 25 bp, Mus musculus
agtatttgttgtcaggtggaccccg

SEQ ID NO: 209390 - DNA, 25 bp, Mus musculus
agtatttgttgtgaggtggaccccg

SEQ ID NO: 209391 - DNA, 25 bp, Mus musculus
agtattttactcaaactctgttggg

SEQ ID NO: 209392 - DNA, 25 bp, Mus musculus
agtattttactctaactctgttggg

SEQ ID NO: 209393 - DNA, 25 bp, Mus musculus
agtattttagctatgcctttctgta

SEQ ID NO: 209394 - DNA, 25 bp, Mus musculus
agtattttagctttgcctttctgta

SEQ ID NO: 209395 - DNA, 25 bp, Mus musculus
agtattttcagaatcttcgtcctcc

SEQ ID NO: 209396 - DNA, 25 bp, Mus musculus
agtattttcagattcttcgtcctcc

SEQ ID NO: 209397 - DNA, 25 bp, Mus musculus
agtattttcatacacctatagttgc

SEQ ID NO: 209398 - DNA, 25 bp, Mus musculus
agtattttcataccaaccttcagat

SEQ ID NO: 209399 - DNA, 25 bp, Mus musculus
agtattttcatagacctatagttgc

SEQ ID NO: 209400 - DNA, 25 bp, Mus musculus
agtattttcatagcaaccttcagat

SEQ ID NO: 209401 - DNA, 25 bp, Mus musculus
agtattttcctaagtcctacatgta

SEQ ID NO: 209402 - DNA, 25 bp, Mus musculus
agtattttcctatgtcctacatgta

SEQ ID NO: 209403 - DNA, 25 bp, Mus musculus
agtattttctgtacatggtgccaac

SEQ ID NO: 209404 - DNA, 25 bp, Mus musculus
agtattttctgtagctggaaacagc

SEQ ID NO: 209405 - DNA, 25 bp, Mus musculus
agtattttctgttcatggtgccaac

SEQ ID NO: 209406 - DNA, 25 bp, Mus musculus
agtattttctgttgctggaaacagc

SEQ ID NO: 209407 - DNA, 25 bp, Mus musculus
agtattttcttaaatgatagccgca

SEQ ID NO: 209408 - DNA, 25 bp, Mus musculus
agtattttcttatatgatagccgca

SEQ ID NO: 209409 - DNA, 25 bp, Mus musculus
agtattttcttcagtaattgtgcac

SEQ ID NO: 209410 - DNA, 25 bp, Mus musculus
agtattttcttctgtaattgtgcac

SEQ ID NO: 209411 - DNA, 25 bp, Mus musculus
agtattttgcaaatctctttctgga

SEQ ID NO: 209412 - DNA, 25 bp, Mus musculus
agtattttgcaattctctttctgga

SEQ ID NO: 209413 - DNA, 25 bp, Mus musculus
agtattttgcagaggccacagctga

SEQ ID NO: 209414 - DNA, 25 bp, Mus musculus
agtattttgcagtggccacagctga

SEQ ID NO: 209415 - DNA, 25 bp, Mus musculus
agtattttgctcactcacaggagga

SEQ ID NO: 209416 - DNA, 25 bp, Mus musculus
agtattttgctctctcacaggagga

SEQ ID NO: 209417 - DNA, 25 bp, Mus musculus
agtattttgtcaactgtgccgggca

SEQ ID NO: 209418 - DNA, 25 bp, Mus musculus
agtattttgtcatctgtgccgggca

SEQ ID NO: 209419 - DNA, 25 bp, Mus musculus
agtatttttactatgcatgggctgg

SEQ ID NO: 209420 - DNA, 25 bp, Mus musculus
agtatttttactttgcatgggctgg

SEQ ID NO: 209421 - DNA, 25 bp, Mus musculus
agtatttttgatccgtagtgtttat

SEQ ID NO: 209422 - DNA, 25 bp, Mus musculus
agtatttttgatgcgtagtgtttat

SEQ ID NO: 209423 - DNA, 25 bp, Mus musculus
agtatttttgcaactgtgggacctt

SEQ ID NO: 209424 - DNA, 25 bp, Mus musculus
agtatttttgcatctgtgggacctt

SEQ ID NO: 209425 - DNA, 25 bp, Mus musculus
agtatttttgctctggtttcctatt

SEQ ID NO: 209426 - DNA, 25 bp, Mus musculus
agtatttttgctgtggtttcctatt

SEQ ID NO: 209427 - DNA, 25 bp, Mus musculus
agtatttttgtactcgtgctgggag

SEQ ID NO: 209428 - DNA, 25 bp, Mus musculus
agtatttttgtagtcgtgctgggag

SEQ ID NO: 209429 - DNA, 25 bp, Mus musculus
agtattttttacctgaacctcatag

SEQ ID NO: 209430 - DNA, 25 bp, Mus musculus
agtattttttacgtgaacctcatag

SEQ ID NO: 209431 - DNA, 25 bp, Mus musculus
agtattttttccatgtgagatgtat

SEQ ID NO: 209432 - DNA, 25 bp, Mus musculus
agtattttttccttgtgagatgtat

SEQ ID NO: 209433 - DNA, 25 bp, Mus musculus
agtcaaaaagtgctctgtggagcaa

SEQ ID NO: 209434 - DNA, 25 bp, Mus musculus
agtcaaaaagtggtctgtggagcaa

SEQ ID NO: 209435 - DNA, 25 bp, Mus musculus
agtcaaaaccgtcgctggaacctct

SEQ ID NO: 209436 - DNA, 25 bp, Mus musculus
agtcaaaaccgtggctggaacctct

SEQ ID NO: 209437 - DNA, 25 bp, Mus musculus
agtcaaaatctcagctgctggcgag

SEQ ID NO: 209438 - DNA, 25 bp, Mus musculus
agtcaaaatctctgctgctggcgag

SEQ ID NO: 209439 - DNA, 25 bp, Mus musculus
agtcaaaattcgaggttcatgtaga

SEQ ID NO: 209440 - DNA, 25 bp, Mus musculus
agtcaaaattcgtggttcatgtaga

SEQ ID NO: 209441 - DNA, 25 bp, Mus musculus
agtcaaaccacaacctgcctagaat

SEQ ID NO: 209442 - DNA, 25 bp, Mus musculus
agtcaaaccacatcctgcctagaat

SEQ ID NO: 209443 - DNA, 25 bp, Mus musculus
agtcaaaccataaccattggtgatt

SEQ ID NO: 209444 - DNA, 25 bp, Mus musculus
agtcaaaccatatccattggtgatt

SEQ ID NO: 209445 - DNA, 25 bp, Mus musculus
agtcaaactcgcagtctcaagcatg

SEQ ID NO: 209446 - DNA, 25 bp, Mus musculus
agtcaaactcgctgtctcaagcatg

SEQ ID NO: 209447 - DNA, 25 bp, Mus musculus
agtcaaacttggaacacccgtgcca

SEQ ID NO: 209448 - DNA, 25 bp, Mus musculus
agtcaaacttggtacacccgtgcca

SEQ ID NO: 209449 - DNA, 25 bp, Mus musculus
agtcaaagatctctctggcgtggat

SEQ ID NO: 209450 - DNA, 25 bp, Mus musculus
agtcaaagatctgtctggcgtggat

SEQ ID NO: 209451 - DNA, 25 bp, Mus musculus
agtcaaagcgttcattacccttcac

SEQ ID NO: 209452 - DNA, 25 bp, Mus musculus
agtcaaagcgttgattacccttcac

SEQ ID NO: 209453 - DNA, 25 bp, Mus musculus
agtcaaagctgtcgccaagcggatt

SEQ ID NO: 209454 - DNA, 25 bp, Mus musculus
agtcaaagctgtggccaagcggatt

SEQ ID NO: 209455 - DNA, 25 bp, Mus musculus
agtcaaaggaacagcgtcctcacct

SEQ ID NO: 209456 - DNA, 25 bp, Mus musculus
agtcaaaggaactgcgtcctcacct

SEQ ID NO: 209457 - DNA, 25 bp, Mus musculus
agtcaaagttgtcgccctgtgtgct

SEQ ID NO: 209458 - DNA, 25 bp, Mus musculus
agtcaaagttgtggccctgtgtgct

SEQ ID NO: 209459 - DNA, 25 bp, Mus musculus
agtcaaatacctcctaagaaccctg

SEQ ID NO: 209460 - DNA, 25 bp, Mus musculus
agtcaaatacctgctaagaaccctg

SEQ ID NO: 209461 - DNA, 25 bp, Mus musculus
agtcaaatatacatgctgttcttgc

SEQ ID NO: 209462 - DNA, 25 bp, Mus musculus
agtcaaatatacttgctgttcttgc

SEQ ID NO: 209463 - DNA, 25 bp, Mus musculus
agtcaaatccagagaaaatgctttc

SEQ ID NO: 209464 - DNA, 25 bp, Mus musculus
agtcaaatccagtgaaaatgctttc

SEQ ID NO: 209465 - DNA, 25 bp, Mus musculus
agtcaaatcttacacggtcttcaaa

SEQ ID NO: 209466 - DNA, 25 bp, Mus musculus
agtcaaatcttagacggtcttcaaa

SEQ ID NO: 209467 - DNA, 25 bp, Mus musculus
agtcaaatgctgaatcctctaacca

SEQ ID NO: 209468 - DNA, 25 bp, Mus musculus
agtcaaatgctgtatcctctaacca

SEQ ID NO: 209469 - DNA, 25 bp, Mus musculus
agtcaaattaccatctttgtgttca

SEQ ID NO: 209470 - DNA, 25 bp, Mus musculus
agtcaaattaccttctttgtgttca

SEQ ID NO: 209471 - DNA, 25 bp, Mus musculus
agtcaaattggaatcctggaacgat

SEQ ID NO: 209472 - DNA, 25 bp, Mus musculus
agtcaaattggattcctggaacgat

SEQ ID NO: 209473 - DNA, 25 bp, Mus musculus
agtcaacacgtgctctgggctcgga

SEQ ID NO: 209474 - DNA, 25 bp, Mus musculus
agtcaacacgtggtctgggctcgga

SEQ ID NO: 209475 - DNA, 25 bp, Mus musculus
agtcaacactggaagcaatggctgc

SEQ ID NO: 209476 - DNA, 25 bp, Mus musculus
agtcaacactggtagcaatggctgc

SEQ ID NO: 209477 - DNA, 25 bp, Mus musculus
agtcaacagcaaatttccatctccc

SEQ ID NO: 209478 - DNA, 25 bp, Mus musculus
agtcaacagcaattttccatctccc

SEQ ID NO: 209479 - DNA, 25 bp, Mus musculus
agtcaacagcggctctgctttaaag

SEQ ID NO: 209480 - DNA, 25 bp, Mus musculus
agtcaacagcgggtctgctttaaag

SEQ ID NO: 209481 - DNA, 25 bp, Mus musculus
agtcaacaggaaacccaccgtggtg

SEQ ID NO: 209482 - DNA, 25 bp, Mus musculus
agtcaacaggaatcccaccgtggtg

SEQ ID NO: 209483 - DNA, 25 bp, Mus musculus
agtcaacagtcacctttatcctatt

SEQ ID NO: 209484 - DNA, 25 bp, Mus musculus
agtcaacagtcagctttatcctatt

SEQ ID NO: 209485 - DNA, 25 bp, Mus musculus
agtcaacatggtcattactttccca

SEQ ID NO: 209486 - DNA, 25 bp, Mus musculus
agtcaacatggtgattactttccca

SEQ ID NO: 209487 - DNA, 25 bp, Mus musculus
agtcaacattaacatcttccaactt

SEQ ID NO: 209488 - DNA, 25 bp, Mus musculus
agtcaacattaagatcttccaactt

SEQ ID NO: 209489 - DNA, 25 bp, Mus musculus
agtcaaccaaaactcccaggcaggg

SEQ ID NO: 209490 - DNA, 25 bp, Mus musculus
agtcaaccaaaagtcccaggcaggg

SEQ ID NO: 209491 - DNA, 25 bp, Mus musculus
agtcaacctctgaactgattggcca

SEQ ID NO: 209492 - DNA, 25 bp, Mus musculus
agtcaacctctgtactgattggcca

SEQ ID NO: 209493 - DNA, 25 bp, Mus musculus
agtcaacctgacctggccctttatg

SEQ ID NO: 209494 - DNA, 25 bp, Mus musculus
agtcaacctgacgtggccctttatg

SEQ ID NO: 209495 - DNA, 25 bp, Mus musculus
agtcaacctgagcatacacgcctga

SEQ ID NO: 209496 - DNA, 25 bp, Mus musculus
agtcaacctgaggatacacgcctga

SEQ ID NO: 209497 - DNA, 25 bp, Mus musculus
agtcaaccttgcagctccagccaaa

SEQ ID NO: 209498 - DNA, 25 bp, Mus musculus
agtcaaccttgctgctccagccaaa

SEQ ID NO: 209499 - DNA, 25 bp, Mus musculus
agtcaacctttcaggctcgattgaa

SEQ ID NO: 209500 - DNA, 25 bp, Mus musculus
agtcaacctttctggctcgattgaa

SEQ ID NO: 209501 - DNA, 25 bp, Mus musculus
agtcaacctttgattgggagacagt

SEQ ID NO: 209502 - DNA, 25 bp, Mus musculus
agtcaacctttgtttgggagacagt

SEQ ID NO: 209503 - DNA, 25 bp, Mus musculus
agtcaacgtctcctcatctgatctc

SEQ ID NO: 209504 - DNA, 25 bp, Mus musculus
agtcaacgtctcgtcatctgatctc

SEQ ID NO: 209505 - DNA, 25 bp, Mus musculus
agtcaactgagtacccgcctacagg

SEQ ID NO: 209506 - DNA, 25 bp, Mus musculus
agtcaactgagttcccgcctacagg

SEQ ID NO: 209507 - DNA, 25 bp, Mus musculus
agtcaactggtcctttgggtacaca

SEQ ID NO: 209508 - DNA, 25 bp, Mus musculus
agtcaactggtcgtttgggtacaca

SEQ ID NO: 209509 - DNA, 25 bp, Mus musculus
agtcaactgtacagctttgcttttt

SEQ ID NO: 209510 - DNA, 25 bp, Mus musculus
agtcaactgtactgctttgcttttt

SEQ ID NO: 209511 - DNA, 25 bp, Mus musculus
agtcaactgtgccttctatatgctc

SEQ ID NO: 209512 - DNA, 25 bp, Mus musculus
agtcaactgtgcgttctatatgctc

SEQ ID NO: 209513 - DNA, 25 bp, Mus musculus
agtcaactgtgtccctggttccagg

SEQ ID NO: 209514 - DNA, 25 bp, Mus musculus
agtcaactgtgtgcctggttccagg

SEQ ID NO: 209515 - DNA, 25 bp, Mus musculus
agtcaacttgtgctggcaaggtcta

SEQ ID NO: 209516 - DNA, 25 bp, Mus musculus
agtcaacttgtggtggcaaggtcta

SEQ ID NO: 209517 - DNA, 25 bp, Mus musculus
agtcaacttttcaccttagcatttc

SEQ ID NO: 209518 - DNA, 25 bp, Mus musculus
agtcaacttttctccttagcatttc

SEQ ID NO: 209519 - DNA, 25 bp, Mus musculus
agtcaagaaaccagtgctgtcccca

SEQ ID NO: 209520 - DNA, 25 bp, Mus musculus
agtcaagaaacctgtgctgtcccca

SEQ ID NO: 209521 - DNA, 25 bp, Mus musculus
agtcaagaatccagtcgattgccct

SEQ ID NO: 209522 - DNA, 25 bp, Mus musculus
agtcaagaatcctgtcgattgccct

SEQ ID NO: 209523 - DNA, 25 bp, Mus musculus
agtcaagacaacatttccctgtcat

SEQ ID NO: 209524 - DNA, 25 bp, Mus musculus
agtcaagacaacttttccctgtcat

SEQ ID NO: 209525 - DNA, 25 bp, Mus musculus
agtcaagacagcatatggccaatgt

SEQ ID NO: 209526 - DNA, 25 bp, Mus musculus
agtcaagacagcttatggccaatgt

SEQ ID NO: 209527 - DNA, 25 bp, Mus musculus
agtcaagacctcctggctggatggc

SEQ ID NO: 209528 - DNA, 25 bp, Mus musculus
agtcaagacctcgtggctggatggc

SEQ ID NO: 209529 - DNA, 25 bp, Mus musculus
agtcaagactcgattcctgggaatc

SEQ ID NO: 209530 - DNA, 25 bp, Mus musculus
agtcaagactcgtttcctgggaatc

SEQ ID NO: 209531 - DNA, 25 bp, Mus musculus
agtcaagaggacacctggaattcct

SEQ ID NO: 209532 - DNA, 25 bp, Mus musculus
agtcaagaggactcctggaattcct

SEQ ID NO: 209533 - DNA, 25 bp, Mus musculus
agtcaagatcaaacgtctggccctg

SEQ ID NO: 209534 - DNA, 25 bp, Mus musculus
agtcaagatcaatcgtctggccctg

SEQ ID NO: 209535 - DNA, 25 bp, Mus musculus
agtcaagatgtcagtccagcggaga

SEQ ID NO: 209536 - DNA, 25 bp, Mus musculus
agtcaagatgtctgtccagcggaga

SEQ ID NO: 209537 - DNA, 25 bp, Mus musculus
agtcaagcccagatgatcgacccat

SEQ ID NO: 209538 - DNA, 25 bp, Mus musculus
agtcaagcccagttgatcgacccat

SEQ ID NO: 209539 - DNA, 25 bp, Mus musculus
agtcaagccgccacgcgtagggcct

SEQ ID NO: 209540 - DNA, 25 bp, Mus musculus
agtcaagccgcctcgcgtagggcct

SEQ ID NO: 209541 - DNA, 25 bp, Mus musculus
agtcaagcctctcccacagtagctt

SEQ ID NO: 209542 - DNA, 25 bp, Mus musculus
agtcaagcctctgccacagtagctt

SEQ ID NO: 209543 - DNA, 25 bp, Mus musculus
agtcaagctctgaaaaccatgtaag

SEQ ID NO: 209544 - DNA, 25 bp, Mus musculus
agtcaagctctgtaaaccatgtaag

SEQ ID NO: 209545 - DNA, 25 bp, Mus musculus
agtcaagctgttacactccttttct

SEQ ID NO: 209546 - DNA, 25 bp, Mus musculus
agtcaagctgtttcactccttttct

SEQ ID NO: 209547 - DNA, 25 bp, Mus musculus
agtcaagcttggagttggcactcaa

SEQ ID NO: 209548 - DNA, 25 bp, Mus musculus
agtcaagcttggtgttggcactcaa

SEQ ID NO: 209549 - DNA, 25 bp, Mus musculus
agtcaaggaggcatgagcttcggca

SEQ ID NO: 209550 - DNA, 25 bp, Mus musculus
agtcaaggaggcttgagcttcggca

SEQ ID NO: 209551 - DNA, 25 bp, Mus musculus
agtcaaggcctgctctgtgtctctt

SEQ ID NO: 209552 - DNA, 25 bp, Mus musculus
agtcaaggcctggtctgtgtctctt

SEQ ID NO: 209553 - DNA, 25 bp, Mus musculus
agtcaaggctttagatctctttctt

SEQ ID NO: 209554 - DNA, 25 bp, Mus musculus
agtcaaggctttagtcctgcactgc

SEQ ID NO: 209555 - DNA, 25 bp, Mus musculus
agtcaaggcttttgatctctttctt

SEQ ID NO: 209556 - DNA, 25 bp, Mus musculus
agtcaaggcttttgtcctgcactgc

SEQ ID NO: 209557 - DNA, 25 bp, Mus musculus
agtcaagggagtattcggagccaga

SEQ ID NO: 209558 - DNA, 25 bp, Mus musculus
agtcaagggagttttcggagccaga

SEQ ID NO: 209559 - DNA, 25 bp, Mus musculus
agtcaagggcatactgtccactgca

SEQ ID NO: 209560 - DNA, 25 bp, Mus musculus
agtcaagggcattctgtccactgca

SEQ ID NO: 209561 - DNA, 25 bp, Mus musculus
agtcaagggccgaggcgaaacgaat

SEQ ID NO: 209562 - DNA, 25 bp, Mus musculus
agtcaagggccgtggcgaaacgaat

SEQ ID NO: 209563 - DNA, 25 bp, Mus musculus
agtcaaggtttaacgtcaactctag

SEQ ID NO: 209564 - DNA, 25 bp, Mus musculus
agtcaaggtttatcgtcaactctag

SEQ ID NO: 209565 - DNA, 25 bp, Mus musculus
agtcaagtactcatgctccaacata

SEQ ID NO: 209566 - DNA, 25 bp, Mus musculus
agtcaagtactcttgctccaacata

SEQ ID NO: 209567 - DNA, 25 bp, Mus musculus
agtcaagtcctaacggatgcctccg

SEQ ID NO: 209568 - DNA, 25 bp, Mus musculus
agtcaagtcctatcggatgcctccg

SEQ ID NO: 209569 - DNA, 25 bp, Mus musculus
agtcaagtcctcatgtggagcccac

SEQ ID NO: 209570 - DNA, 25 bp, Mus musculus
agtcaagtcctcttgtggagcccac

SEQ ID NO: 209571 - DNA, 25 bp, Mus musculus
agtcaagtcttgatcatccctgagg

SEQ ID NO: 209572 - DNA, 25 bp, Mus musculus
agtcaagtcttgttcatccctgagg

SEQ ID NO: 209573 - DNA, 25 bp, Mus musculus
agtcaagtctttctcactgcactgg

SEQ ID NO: 209574 - DNA, 25 bp, Mus musculus
agtcaagtctttgtcactgcactgg

SEQ ID NO: 209575 - DNA, 25 bp, Mus musculus
agtcaagtgcacactctgcctctgt

SEQ ID NO: 209576 - DNA, 25 bp, Mus musculus
agtcaagtgcactctctgcctctgt

SEQ ID NO: 209577 - DNA, 25 bp, Mus musculus
agtcaagtgtcaatagcctccaacc

SEQ ID NO: 209578 - DNA, 25 bp, Mus musculus
agtcaagtgtcattagcctccaacc

SEQ ID NO: 209579 - DNA, 25 bp, Mus musculus
agtcaagttgaaaagctggcctaaa

SEQ ID NO: 209580 - DNA, 25 bp, Mus musculus
agtcaagttgaatagctggcctaaa

SEQ ID NO: 209581 - DNA, 25 bp, Mus musculus
agtcaataacggatggcctccctga

SEQ ID NO: 209582 - DNA, 25 bp, Mus musculus
agtcaataacggttggcctccctga

SEQ ID NO: 209583 - DNA, 25 bp, Mus musculus
agtcaatacatcagctgcccgtcgg

SEQ ID NO: 209584 - DNA, 25 bp, Mus musculus
agtcaatacatctgctgcccgtcgg

SEQ ID NO: 209585 - DNA, 25 bp, Mus musculus
agtcaataccaaattatccccaggg

SEQ ID NO: 209586 - DNA, 25 bp, Mus musculus
agtcaataccaatttatccccaggg

SEQ ID NO: 209587 - DNA, 25 bp, Mus musculus
agtcaatcaacaagtgggccttcga

SEQ ID NO: 209588 - DNA, 25 bp, Mus musculus
agtcaatcaacatgtgggccttcga

SEQ ID NO: 209589 - DNA, 25 bp, Mus musculus
agtcaatccattagtcctgagctct

SEQ ID NO: 209590 - DNA, 25 bp, Mus musculus
agtcaatccatttgtcctgagctct

SEQ ID NO: 209591 - DNA, 25 bp, Mus musculus
agtcaatcctgcatcctgttcctag

SEQ ID NO: 209592 - DNA, 25 bp, Mus musculus
agtcaatcctgcttcctgttcctag

SEQ ID NO: 209593 - DNA, 25 bp, Mus musculus
agtcaatcctttccccaccggttat

SEQ ID NO: 209594 - DNA, 25 bp, Mus musculus
agtcaatcctttgcccaccggttat

SEQ ID NO: 209595 - DNA, 25 bp, Mus musculus
agtcaatctgcaccgaaagcccaag

SEQ ID NO: 209596 - DNA, 25 bp, Mus musculus
agtcaatctgcagcgaaagcccaag

SEQ ID NO: 209597 - DNA, 25 bp, Mus musculus
agtcaatgaatgcacccaatttttt

SEQ ID NO: 209598 - DNA, 25 bp, Mus musculus
agtcaatgaatggacccaatttttt

SEQ ID NO: 209599 - DNA, 25 bp, Mus musculus
agtcaatgccacatggatgccattc

SEQ ID NO: 209600 - DNA, 25 bp, Mus musculus
agtcaatgccacttggatgccattc

SEQ ID NO: 209601 - DNA, 25 bp, Mus musculus
agtcaatgccttctgctaaactttc

SEQ ID NO: 209602 - DNA, 25 bp, Mus musculus
agtcaatgccttgtgctaaactttc

SEQ ID NO: 209603 - DNA, 25 bp, Mus musculus
agtcaatgctacacactgataggta

SEQ ID NO: 209604 - DNA, 25 bp, Mus musculus
agtcaatgctactcactgataggta

SEQ ID NO: 209605 - DNA, 25 bp, Mus musculus
agtcaatggtggagtcacatcccca

SEQ ID NO: 209606 - DNA, 25 bp, Mus musculus
agtcaatggtggtgtcacatcccca

SEQ ID NO: 209607 - DNA, 25 bp, Mus musculus
agtcaatgtcagaagaccttctgtg

SEQ ID NO: 209608 - DNA, 25 bp, Mus musculus
agtcaatgtcagtagaccttctgtg

SEQ ID NO: 209609 - DNA, 25 bp, Mus musculus
agtcaattacctcctcagtaggacc

SEQ ID NO: 209610 - DNA, 25 bp, Mus musculus
agtcaattacctgctcagtaggacc

SEQ ID NO: 209611 - DNA, 25 bp, Mus musculus
agtcaattataacctcttcttcacg

SEQ ID NO: 209612 - DNA, 25 bp, Mus musculus
agtcaattataagctcttcttcacg

SEQ ID NO: 209613 - DNA, 25 bp, Mus musculus
agtcaattctggctctcttcatctg

SEQ ID NO: 209614 - DNA, 25 bp, Mus musculus
agtcaattctgggtctcttcatctg

SEQ ID NO: 209615 - DNA, 25 bp, Mus musculus
agtcaatttgtcagatgccttcacc

SEQ ID NO: 209616 - DNA, 25 bp, Mus musculus
agtcaatttgtctgatgccttcacc

SEQ ID NO: 209617 - DNA, 25 bp, Mus musculus
agtcacaacactcaaggcggcctca

SEQ ID NO: 209618 - DNA, 25 bp, Mus musculus
agtcacaacactgaaggcggcctca

SEQ ID NO: 209619 - DNA, 25 bp, Mus musculus
agtcacaaccctattagatgttatc

SEQ ID NO: 209620 - DNA, 25 bp, Mus musculus
agtcacaacccttttagatgttatc

SEQ ID NO: 209621 - DNA, 25 bp, Mus musculus
agtcacaactccacgaaacttcgga

SEQ ID NO: 209622 - DNA, 25 bp, Mus musculus
agtcacaactcctcgaaacttcgga

SEQ ID NO: 209623 - DNA, 25 bp, Mus musculus
agtcacaagactccggatgcaccag

SEQ ID NO: 209624 - DNA, 25 bp, Mus musculus
agtcacaagactgcggatgcaccag

SEQ ID NO: 209625 - DNA, 25 bp, Mus musculus
agtcacaagcttcagcgagtccagg

SEQ ID NO: 209626 - DNA, 25 bp, Mus musculus
agtcacaagcttgagcgagtccagg

SEQ ID NO: 209627 - DNA, 25 bp, Mus musculus
agtcacaagttcaccatcagttaca

SEQ ID NO: 209628 - DNA, 25 bp, Mus musculus
agtcacaagttctccatcagttaca

SEQ ID NO: 209629 - DNA, 25 bp, Mus musculus
agtcacacagtgattctaactttag

SEQ ID NO: 209630 - DNA, 25 bp, Mus musculus
agtcacacagtgtttctaactttag

SEQ ID NO: 209631 - DNA, 25 bp, Mus musculus
agtcacacatgccaggccctggaaa

SEQ ID NO: 209632 - DNA, 25 bp, Mus musculus
agtcacacatgcgaggccctggaaa

SEQ ID NO: 209633 - DNA, 25 bp, Mus musculus
agtcacaccaaaacacctggcttaa

SEQ ID NO: 209634 - DNA, 25 bp, Mus musculus
agtcacaccaaatcacctggcttaa

SEQ ID NO: 209635 - DNA, 25 bp, Mus musculus
agtcacaccacacaacaaacatcgt

SEQ ID NO: 209636 - DNA, 25 bp, Mus musculus
agtcacaccacagaacaaacatcgt

SEQ ID NO: 209637 - DNA, 25 bp, Mus musculus
agtcacaccagtaaggaattcctac

SEQ ID NO: 209638 - DNA, 25 bp, Mus musculus
agtcacaccagttaggaattcctac

SEQ ID NO: 209639 - DNA, 25 bp, Mus musculus
agtcacaccccacgatcatgagaag

SEQ ID NO: 209640 - DNA, 25 bp, Mus musculus
agtcacaccccaggatcatgagaag

SEQ ID NO: 209641 - DNA, 25 bp, Mus musculus
agtcacacctacagataccttgaaa

SEQ ID NO: 209642 - DNA, 25 bp, Mus musculus
agtcacacctactgataccttgaaa

SEQ ID NO: 209643 - DNA, 25 bp, Mus musculus
agtcacaccttgagagacacagtga

SEQ ID NO: 209644 - DNA, 25 bp, Mus musculus
agtcacaccttgtgagacacagtga

SEQ ID NO: 209645 - DNA, 25 bp, Mus musculus
agtcacacgactccttacaaattgg

SEQ ID NO: 209646 - DNA, 25 bp, Mus musculus
agtcacacgactgcttacaaattgg

SEQ ID NO: 209647 - DNA, 25 bp, Mus musculus
agtcacagaaaacaacctgttaatt

SEQ ID NO: 209648 - DNA, 25 bp, Mus musculus
agtcacagaaaagaacctgttaatt

SEQ ID NO: 209649 - DNA, 25 bp, Mus musculus
agtcacagaagaaaggttaatgcct

SEQ ID NO: 209650 - DNA, 25 bp, Mus musculus
agtcacagaagataggttaatgcct

SEQ ID NO: 209651 - DNA, 25 bp, Mus musculus
agtcacagacaaccgctttatgctt

SEQ ID NO: 209652 - DNA, 25 bp, Mus musculus
agtcacagacaagcgctttatgctt

SEQ ID NO: 209653 - DNA, 25 bp, Mus musculus
agtcacagagttcggccttgtagga

SEQ ID NO: 209654 - DNA, 25 bp, Mus musculus
agtcacagagttgggccttgtagga

SEQ ID NO: 209655 - DNA, 25 bp, Mus musculus
agtcacagccacacatggctatgtg

SEQ ID NO: 209656 - DNA, 25 bp, Mus musculus
agtcacagccactcatggctatgtg

SEQ ID NO: 209657 - DNA, 25 bp, Mus musculus
agtcacagcccgataaagtctgcgt

SEQ ID NO: 209658 - DNA, 25 bp, Mus musculus
agtcacagcccgttaaagtctgcgt

SEQ ID NO: 209659 - DNA, 25 bp, Mus musculus
agtcacaggtagctacacctcttct

SEQ ID NO: 209660 - DNA, 25 bp, Mus musculus
agtcacaggtaggtacacctcttct

SEQ ID NO: 209661 - DNA, 25 bp, Mus musculus
agtcacagtcatatcacagcaaata

SEQ ID NO: 209662 - DNA, 25 bp, Mus musculus
agtcacagtcatttcacagcaaata

SEQ ID NO: 209663 - DNA, 25 bp, Mus musculus
agtcacagtctccacaggttagggc

SEQ ID NO: 209664 - DNA, 25 bp, Mus musculus
agtcacagtctcgacaggttagggc

SEQ ID NO: 209665 - DNA, 25 bp, Mus musculus
agtcacagtgacctcagacaccaga

SEQ ID NO: 209666 - DNA, 25 bp, Mus musculus
agtcacagtgacgtcagacaccaga

SEQ ID NO: 209667 - DNA, 25 bp, Mus musculus
agtcacagtgtacctggagtcccca

SEQ ID NO: 209668 - DNA, 25 bp, Mus musculus
agtcacagtgtagctggagtcccca

SEQ ID NO: 209669 - DNA, 25 bp, Mus musculus
agtcacagttctcatcttactctgc

SEQ ID NO: 209670 - DNA, 25 bp, Mus musculus
agtcacagttctgatcttactctgc

SEQ ID NO: 209671 - DNA, 25 bp, Mus musculus
agtcacagtttcaaagtggcactct

SEQ ID NO: 209672 - DNA, 25 bp, Mus musculus
agtcacagtttctaagtggcactct

SEQ ID NO: 209673 - DNA, 25 bp, Mus musculus
agtcacataggaccagtgccaagcc

SEQ ID NO: 209674 - DNA, 25 bp, Mus musculus
agtcacataggagcagtgccaagcc

SEQ ID NO: 209675 - DNA, 25 bp, Mus musculus
agtcacatatcaagacatcccctta

SEQ ID NO: 209676 - DNA, 25 bp, Mus musculus
agtcacatatcatgacatcccctta

SEQ ID NO: 209677 - DNA, 25 bp, Mus musculus
agtcacatatgtctcctggattcag

SEQ ID NO: 209678 - DNA, 25 bp, Mus musculus
agtcacatatgtgtcctggattcag

SEQ ID NO: 209679 - DNA, 25 bp, Mus musculus
agtcacatcaacacactgtgcttat

SEQ ID NO: 209680 - DNA, 25 bp, Mus musculus
agtcacatcaactcactgtgcttat

SEQ ID NO: 209681 - DNA, 25 bp, Mus musculus
agtcacatccaacacatgcctggaa

SEQ ID NO: 209682 - DNA, 25 bp, Mus musculus
agtcacatccaagacatgcctggaa

SEQ ID NO: 209683 - DNA, 25 bp, Mus musculus
agtcacatccacactatttaaatag

SEQ ID NO: 209684 - DNA, 25 bp, Mus musculus
agtcacatccactctatttaaatag

SEQ ID NO: 209685 - DNA, 25 bp, Mus musculus
agtcacatgacacttttctccatca

SEQ ID NO: 209686 - DNA, 25 bp, Mus musculus
agtcacatgacagttttctccatca

SEQ ID NO: 209687 - DNA, 25 bp, Mus musculus
agtcacatgaccaacacgcgcatta

SEQ ID NO: 209688 - DNA, 25 bp, Mus musculus
agtcacatgacctacacgcgcatta

SEQ ID NO: 209689 - DNA, 25 bp, Mus musculus
agtcacatgagaaacactagtctgt

SEQ ID NO: 209690 - DNA, 25 bp, Mus musculus
agtcacatgagatacactagtctgt

SEQ ID NO: 209691 - DNA, 25 bp, Mus musculus
agtcacatgattcccactaaactgc

SEQ ID NO: 209692 - DNA, 25 bp, Mus musculus
agtcacatgattgccactaaactgc

SEQ ID NO: 209693 - DNA, 25 bp, Mus musculus
agtcacatgcccacaagaagtatga

SEQ ID NO: 209694 - DNA, 25 bp, Mus musculus
agtcacatgccctcaagaagtatga

SEQ ID NO: 209695 - DNA, 25 bp, Mus musculus
agtcacatggccaaatctatcacag

SEQ ID NO: 209696 - DNA, 25 bp, Mus musculus
agtcacatggcctaatctatcacag

SEQ ID NO: 209697 - DNA, 25 bp, Mus musculus
agtcacatggttcccagttactcca

SEQ ID NO: 209698 - DNA, 25 bp, Mus musculus
agtcacatggttgccagttactcca

SEQ ID NO: 209699 - DNA, 25 bp, Mus musculus
agtcacattcacattactctcaggc

SEQ ID NO: 209700 - DNA, 25 bp, Mus musculus
agtcacattcactttactctcaggc

SEQ ID NO: 209701 - DNA, 25 bp, Mus musculus
agtcacattgctctatttgaaaaca

SEQ ID NO: 209702 - DNA, 25 bp, Mus musculus
agtcacattgctgtatttgaaaaca

SEQ ID NO: 209703 - DNA, 25 bp, Mus musculus
agtcacattgtgaactcatctctcc

SEQ ID NO: 209704 - DNA, 25 bp, Mus musculus
agtcacattgtgtactcatctctcc

SEQ ID NO: 209705 - DNA, 25 bp, Mus musculus
agtcacattgttcaggttatctctt

SEQ ID NO: 209706 - DNA, 25 bp, Mus musculus
agtcacattgttgaggttatctctt

SEQ ID NO: 209707 - DNA, 25 bp, Mus musculus
agtcacatttctatactgcttatgt

SEQ ID NO: 209708 - DNA, 25 bp, Mus musculus
agtcacatttctttactgcttatgt

SEQ ID NO: 209709 - DNA, 25 bp, Mus musculus
agtcaccaagacacctttaggcaaa

SEQ ID NO: 209710 - DNA, 25 bp, Mus musculus
agtcaccaagactcctttaggcaaa

SEQ ID NO: 209711 - DNA, 25 bp, Mus musculus
agtcaccaagctaattcccaaccaa

SEQ ID NO: 209712 - DNA, 25 bp, Mus musculus
agtcaccaagcttattcccaaccaa

SEQ ID NO: 209713 - DNA, 25 bp, Mus musculus
agtcaccacttcatcttacagattc

SEQ ID NO: 209714 - DNA, 25 bp, Mus musculus
agtcaccacttcttcttacagattc

SEQ ID NO: 209715 - DNA, 25 bp, Mus musculus
agtcaccagattacacaatggcccc

SEQ ID NO: 209716 - DNA, 25 bp, Mus musculus
agtcaccagatttcacaatggcccc

SEQ ID NO: 209717 - DNA, 25 bp, Mus musculus
agtcaccagcgaagtcatggccatg

SEQ ID NO: 209718 - DNA, 25 bp, Mus musculus
agtcaccagcgatgtcatggccatg

SEQ ID NO: 209719 - DNA, 25 bp, Mus musculus
agtcaccagctcagcgggtgagaag

SEQ ID NO: 209720 - DNA, 25 bp, Mus musculus
agtcaccagctctgcgggtgagaag

SEQ ID NO: 209721 - DNA, 25 bp, Mus musculus
agtcaccagtcactcaacagtttgg

SEQ ID NO: 209722 - DNA, 25 bp, Mus musculus
agtcaccagtcagtcaacagtttgg

SEQ ID NO: 209723 - DNA, 25 bp, Mus musculus
agtcaccatctcctgaacgctggga

SEQ ID NO: 209724 - DNA, 25 bp, Mus musculus
agtcaccatctcgtgaacgctggga

SEQ ID NO: 209725 - DNA, 25 bp, Mus musculus
agtcaccatctgagcttgggcaaaa

SEQ ID NO: 209726 - DNA, 25 bp, Mus musculus
agtcaccatctgtgcttgggcaaaa

SEQ ID NO: 209727 - DNA, 25 bp, Mus musculus
agtcaccatcttctgttattggcgc

SEQ ID NO: 209728 - DNA, 25 bp, Mus musculus
agtcaccatcttgtgttattggcgc

SEQ ID NO: 209729 - DNA, 25 bp, Mus musculus
agtcaccattgaagaatcctctgtt

SEQ ID NO: 209730 - DNA, 25 bp, Mus musculus
agtcaccattgatgaatcctctgtt

SEQ ID NO: 209731 - DNA, 25 bp, Mus musculus
agtcacccaaaacctgggcacttag

SEQ ID NO: 209732 - DNA, 25 bp, Mus musculus
agtcacccaaaagctgggcacttag

SEQ ID NO: 209733 - DNA, 25 bp, Mus musculus
agtcacccacggaagttcggccagg

SEQ ID NO: 209734 - DNA, 25 bp, Mus musculus
agtcacccacggtagttcggccagg

SEQ ID NO: 209735 - DNA, 25 bp, Mus musculus
agtcacccaggcagactggacaata

SEQ ID NO: 209736 - DNA, 25 bp, Mus musculus
agtcacccaggctgactggacaata

SEQ ID NO: 209737 - DNA, 25 bp, Mus musculus
agtcacccaggtaagaagcaaatca

SEQ ID NO: 209738 - DNA, 25 bp, Mus musculus
agtcacccaggttagaagcaaatca

SEQ ID NO: 209739 - DNA, 25 bp, Mus musculus
agtcacccatctcacaaaatcttga

SEQ ID NO: 209740 - DNA, 25 bp, Mus musculus
agtcacccatctgacaaaatcttga

SEQ ID NO: 209741 - DNA, 25 bp, Mus musculus
agtcacccatgccagaggcagtgtt

SEQ ID NO: 209742 - DNA, 25 bp, Mus musculus
agtcacccatgcgagaggcagtgtt

SEQ ID NO: 209743 - DNA, 25 bp, Mus musculus
agtcaccccggtagcattagcaggg

SEQ ID NO: 209744 - DNA, 25 bp, Mus musculus
agtcaccccggttgcattagcaggg

SEQ ID NO: 209745 - DNA, 25 bp, Mus musculus
agtcaccctatcaccatgggaggtg

SEQ ID NO: 209746 - DNA, 25 bp, Mus musculus
agtcaccctatctccatgggaggtg

SEQ ID NO: 209747 - DNA, 25 bp, Mus musculus
agtcaccctctccagttatcagaaa

SEQ ID NO: 209748 - DNA, 25 bp, Mus musculus
agtcaccctctcgagttatcagaaa

SEQ ID NO: 209749 - DNA, 25 bp, Mus musculus
agtcaccctgagatagtccagcttg

SEQ ID NO: 209750 - DNA, 25 bp, Mus musculus
agtcaccctgagttagtccagcttg

SEQ ID NO: 209751 - DNA, 25 bp, Mus musculus
agtcaccctgtgaacagaccatcta

SEQ ID NO: 209752 - DNA, 25 bp, Mus musculus
agtcaccctgtgtacagaccatcta

SEQ ID NO: 209753 - DNA, 25 bp, Mus musculus
agtcaccgaggtctatagtttctga

SEQ ID NO: 209754 - DNA, 25 bp, Mus musculus
agtcaccgaggtgtatagtttctga

SEQ ID NO: 209755 - DNA, 25 bp, Mus musculus
agtcaccgccctatgggtagaggag

SEQ ID NO: 209756 - DNA, 25 bp, Mus musculus
agtcaccgccctttgggtagaggag

SEQ ID NO: 209757 - DNA, 25 bp, Mus musculus
agtcaccgcttgacgtgcttattta

SEQ ID NO: 209758 - DNA, 25 bp, Mus musculus
agtcaccgcttgtcgtgcttattta

SEQ ID NO: 209759 - DNA, 25 bp, Mus musculus
agtcaccgggcgatccaccttagtc

SEQ ID NO: 209760 - DNA, 25 bp, Mus musculus
agtcaccgggcgttccaccttagtc

SEQ ID NO: 209761 - DNA, 25 bp, Mus musculus
agtcaccgtctgaggacatgcgccc

SEQ ID NO: 209762 - DNA, 25 bp, Mus musculus
agtcaccgtctgtggacatgcgccc

SEQ ID NO: 209763 - DNA, 25 bp, Mus musculus
agtcaccgttccctttgatgccaaa

SEQ ID NO: 209764 - DNA, 25 bp, Mus musculus
agtcaccgttccgtttgatgccaaa

SEQ ID NO: 209765 - DNA, 25 bp, Mus musculus
agtcacctagaacagcaagctcaga

SEQ ID NO: 209766 - DNA, 25 bp, Mus musculus
agtcacctagaagagcaagctcaga

SEQ ID NO: 209767 - DNA, 25 bp, Mus musculus
agtcacctaggtctgagtcccattt

SEQ ID NO: 209768 - DNA, 25 bp, Mus musculus
agtcacctaggtgtgagtcccattt

SEQ ID NO: 209769 - DNA, 25 bp, Mus musculus
agtcacctcggaagaaacgccatgg

SEQ ID NO: 209770 - DNA, 25 bp, Mus musculus
agtcacctcggatgaaacgccatgg

SEQ ID NO: 209771 - DNA, 25 bp, Mus musculus
agtcacctctgacctccctaggagg

SEQ ID NO: 209772 - DNA, 25 bp, Mus musculus
agtcacctctgagctccctaggagg

SEQ ID NO: 209773 - DNA, 25 bp, Mus musculus
agtcacctcttcaaattctgtctat

SEQ ID NO: 209774 - DNA, 25 bp, Mus musculus
agtcacctcttcattataatgccag

SEQ ID NO: 209775 - DNA, 25 bp, Mus musculus
agtcacctcttctaattctgtctat

SEQ ID NO: 209776 - DNA, 25 bp, Mus musculus
agtcacctcttctttataatgccag

SEQ ID NO: 209777 - DNA, 25 bp, Mus musculus
agtcacctctttaattgtttccttg

SEQ ID NO: 209778 - DNA, 25 bp, Mus musculus
agtcacctcttttattgtttccttg

SEQ ID NO: 209779 - DNA, 25 bp, Mus musculus
agtcacctggaacacattacgagca

SEQ ID NO: 209780 - DNA, 25 bp, Mus musculus
agtcacctggaagacattacgagca

SEQ ID NO: 209781 - DNA, 25 bp, Mus musculus
agtcacctgtccactcgaactgaga

SEQ ID NO: 209782 - DNA, 25 bp, Mus musculus
agtcacctgtcctctcgaactgaga

SEQ ID NO: 209783 - DNA, 25 bp, Mus musculus
agtcaccttcataatgagagcaatt

SEQ ID NO: 209784 - DNA, 25 bp, Mus musculus
agtcaccttcattatgagagcaatt

SEQ ID NO: 209785 - DNA, 25 bp, Mus musculus
agtcaccttccccaagtgcaaaggg

SEQ ID NO: 209786 - DNA, 25 bp, Mus musculus
agtcaccttcccgaagtgcaaaggg

SEQ ID NO: 209787 - DNA, 25 bp, Mus musculus
agtcaccttctgaagctgtaagacc

SEQ ID NO: 209788 - DNA, 25 bp, Mus musculus
agtcaccttctgtagctgtaagacc

SEQ ID NO: 209789 - DNA, 25 bp, Mus musculus
agtcaccttgacagtgtctttatga

SEQ ID NO: 209790 - DNA, 25 bp, Mus musculus
agtcaccttgactgtgtctttatga

SEQ ID NO: 209791 - DNA, 25 bp, Mus musculus
agtcaccttgccattagatcagatg

SEQ ID NO: 209792 - DNA, 25 bp, Mus musculus
agtcaccttgcctttagatcagatg

SEQ ID NO: 209793 - DNA, 25 bp, Mus musculus
agtcaccttggacggaccacgcagg

SEQ ID NO: 209794 - DNA, 25 bp, Mus musculus
agtcaccttggagggaccacgcagg

SEQ ID NO: 209795 - DNA, 25 bp, Mus musculus
agtcacctttatacctgatctcatg

SEQ ID NO: 209796 - DNA, 25 bp, Mus musculus
agtcacctttattcctgatctcatg

SEQ ID NO: 209797 - DNA, 25 bp, Mus musculus
agtcacctttggaccttcgacctag

SEQ ID NO: 209798 - DNA, 25 bp, Mus musculus
agtcacctttggtccttcgacctag

SEQ ID NO: 209799 - DNA, 25 bp, Mus musculus
agtcacgaagatactggtccagccg

SEQ ID NO: 209800 - DNA, 25 bp, Mus musculus
agtcacgaagattctggtccagccg

SEQ ID NO: 209801 - DNA, 25 bp, Mus musculus
agtcacgaagttagcgctctggatg

SEQ ID NO: 209802 - DNA, 25 bp, Mus musculus
agtcacgaagtttgcgctctggatg

SEQ ID NO: 209803 - DNA, 25 bp, Mus musculus
agtcacgacctccatactctgtgat

SEQ ID NO: 209804 - DNA, 25 bp, Mus musculus
agtcacgacctcgatactctgtgat

SEQ ID NO: 209805 - DNA, 25 bp, Mus musculus
agtcacgagtacatgcagctctgat

SEQ ID NO: 209806 - DNA, 25 bp, Mus musculus
agtcacgagtacttgcagctctgat

SEQ ID NO: 209807 - DNA, 25 bp, Mus musculus
agtcacgcgcgacggagcccgatga

SEQ ID NO: 209808 - DNA, 25 bp, Mus musculus
agtcacgcgcgagggagcccgatga

SEQ ID NO: 209809 - DNA, 25 bp, Mus musculus
agtcacgctaaactgatccacacaa

SEQ ID NO: 209810 - DNA, 25 bp, Mus musculus
agtcacgctaaagtgatccacacaa

SEQ ID NO: 209811 - DNA, 25 bp, Mus musculus
agtcacggacgacagggaccctcat

SEQ ID NO: 209812 - DNA, 25 bp, Mus musculus
agtcacggacgagagggaccctcat

SEQ ID NO: 209813 - DNA, 25 bp, Mus musculus
agtcacggccccacagggcttggag

SEQ ID NO: 209814 - DNA, 25 bp, Mus musculus
agtcacggcccctcagggcttggag

SEQ ID NO: 209815 - DNA, 25 bp, Mus musculus
agtcacgggctaatccaggaacatg

SEQ ID NO: 209816 - DNA, 25 bp, Mus musculus
agtcacgggctattccaggaacatg

SEQ ID NO: 209817 - DNA, 25 bp, Mus musculus
agtcacggtgtgatccctgtgccta

SEQ ID NO: 209818 - DNA, 25 bp, Mus musculus
agtcacggtgtgttccctgtgccta

SEQ ID NO: 209819 - DNA, 25 bp, Mus musculus
agtcacggttgtcaggagcctccaa

SEQ ID NO: 209820 - DNA, 25 bp, Mus musculus
agtcacggttgtgaggagcctccaa

SEQ ID NO: 209821 - DNA, 25 bp, Mus musculus
agtcacgtgggccagacacacatgg

SEQ ID NO: 209822 - DNA, 25 bp, Mus musculus
agtcacgtgggcgagacacacatgg

SEQ ID NO: 209823 - DNA, 25 bp, Mus musculus
agtcacgtgtggcacttcaatcaca

SEQ ID NO: 209824 - DNA, 25 bp, Mus musculus
agtcacgtgtgggacttcaatcaca

SEQ ID NO: 209825 - DNA, 25 bp, Mus musculus
agtcacgttgtcattgctgagttgt

SEQ ID NO: 209826 - DNA, 25 bp, Mus musculus
agtcacgttgtctttgctgagttgt

SEQ ID NO: 209827 - DNA, 25 bp, Mus musculus
agtcacgtttcaactaactccttag

SEQ ID NO: 209828 - DNA, 25 bp, Mus musculus
agtcacgtttcatctaactccttag

SEQ ID NO: 209829 - DNA, 25 bp, Mus musculus
agtcactaaagaatcctcacctggg

SEQ ID NO: 209830 - DNA, 25 bp, Mus musculus
agtcactaaagattcctcacctggg

SEQ ID NO: 209831 - DNA, 25 bp, Mus musculus
agtcactaacccactcacaaacttg

SEQ ID NO: 209832 - DNA, 25 bp, Mus musculus
agtcactaaccctctcacaaacttg

SEQ ID NO: 209833 - DNA, 25 bp, Mus musculus
agtcactaagagatccagggccagc

SEQ ID NO: 209834 - DNA, 25 bp, Mus musculus
agtcactaagagttccagggccagc

SEQ ID NO: 209835 - DNA, 25 bp, Mus musculus
agtcactaaggaccactcatggtaa

SEQ ID NO: 209836 - DNA, 25 bp, Mus musculus
agtcactaaggagcactcatggtaa

SEQ ID NO: 209837 - DNA, 25 bp, Mus musculus
agtcactaatccactcctgattgat

SEQ ID NO: 209838 - DNA, 25 bp, Mus musculus
agtcactaatcctctcctgattgat

SEQ ID NO: 209839 - DNA, 25 bp, Mus musculus
agtcactaattcagccaccttatta

SEQ ID NO: 209840 - DNA, 25 bp, Mus musculus
agtcactaattctgccaccttatta

SEQ ID NO: 209841 - DNA, 25 bp, Mus musculus
agtcactacaccagattctcttgct

SEQ ID NO: 209842 - DNA, 25 bp, Mus musculus
agtcactacacctgattctcttgct

SEQ ID NO: 209843 - DNA, 25 bp, Mus musculus
agtcactacccaaatttacactgaa

SEQ ID NO: 209844 - DNA, 25 bp, Mus musculus
agtcactacccatatttacactgaa

SEQ ID NO: 209845 - DNA, 25 bp, Mus musculus
agtcactactgtatggcccaggaac

SEQ ID NO: 209846 - DNA, 25 bp, Mus musculus
agtcactactgtttggcccaggaac

SEQ ID NO: 209847 - DNA, 25 bp, Mus musculus
agtcactagctgaatcccctgcagg

SEQ ID NO: 209848 - DNA, 25 bp, Mus musculus
agtcactagctgtatcccctgcagg

SEQ ID NO: 209849 - DNA, 25 bp, Mus musculus
agtcactatccgaacagctgggttg

SEQ ID NO: 209850 - DNA, 25 bp, Mus musculus
agtcactatccgtacagctgggttg

SEQ ID NO: 209851 - DNA, 25 bp, Mus musculus
agtcactatgtacactgccttcacc

SEQ ID NO: 209852 - DNA, 25 bp, Mus musculus
agtcactatgtagactgccttcacc

SEQ ID NO: 209853 - DNA, 25 bp, Mus musculus
agtcactattgaatccggacaccca

SEQ ID NO: 209854 - DNA, 25 bp, Mus musculus
agtcactattgattccggacaccca

SEQ ID NO: 209855 - DNA, 25 bp, Mus musculus
agtcactattttcaccaactctggg

SEQ ID NO: 209856 - DNA, 25 bp, Mus musculus
agtcactattttgaccaactctggg

SEQ ID NO: 209857 - DNA, 25 bp, Mus musculus
agtcactccttcatgaggatgcttt

SEQ ID NO: 209858 - DNA, 25 bp, Mus musculus
agtcactccttcttgaggatgcttt

SEQ ID NO: 209859 - DNA, 25 bp, Mus musculus
agtcactcgaggcatcaccaaaggt

SEQ ID NO: 209860 - DNA, 25 bp, Mus musculus
agtcactcgagggatcaccaaaggt

SEQ ID NO: 209861 - DNA, 25 bp, Mus musculus
agtcactcggtgagggctttgccac

SEQ ID NO: 209862 - DNA, 25 bp, Mus musculus
agtcactcggtgtgggctttgccac

SEQ ID NO: 209863 - DNA, 25 bp, Mus musculus
agtcactcgtacaagcgcagccttc

SEQ ID NO: 209864 - DNA, 25 bp, Mus musculus
agtcactcgtactagcgcagccttc

SEQ ID NO: 209865 - DNA, 25 bp, Mus musculus
agtcactctagaacatagtctctgt

SEQ ID NO: 209866 - DNA, 25 bp, Mus musculus
agtcactctagatcatagtctctgt

SEQ ID NO: 209867 - DNA, 25 bp, Mus musculus
agtcactctcagaggcgtggtctct

SEQ ID NO: 209868 - DNA, 25 bp, Mus musculus
agtcactctcagtggcgtggtctct

SEQ ID NO: 209869 - DNA, 25 bp, Mus musculus
agtcactctggaaacctggctgaag

SEQ ID NO: 209870 - DNA, 25 bp, Mus musculus
agtcactctggatacctggctgaag

SEQ ID NO: 209871 - DNA, 25 bp, Mus musculus
agtcactctgttctttgggaccatc

SEQ ID NO: 209872 - DNA, 25 bp, Mus musculus
agtcactctgttgtttgggaccatc

SEQ ID NO: 209873 - DNA, 25 bp, Mus musculus
agtcactcttacctagaaatcctct

SEQ ID NO: 209874 - DNA, 25 bp, Mus musculus
agtcactcttacgtagaaatcctct

SEQ ID NO: 209875 - DNA, 25 bp, Mus musculus
agtcactgacaacctctccgtgtga

SEQ ID NO: 209876 - DNA, 25 bp, Mus musculus
agtcactgacaagctctccgtgtga

SEQ ID NO: 209877 - DNA, 25 bp, Mus musculus
agtcactgacatatcttcaccgaga

SEQ ID NO: 209878 - DNA, 25 bp, Mus musculus
agtcactgacatttcttcaccgaga

SEQ ID NO: 209879 - DNA, 25 bp, Mus musculus
agtcactgactgacgcagaagcaga

SEQ ID NO: 209880 - DNA, 25 bp, Mus musculus
agtcactgactgtcgcagaagcaga

SEQ ID NO: 209881 - DNA, 25 bp, Mus musculus
agtcactgatttatcaacctgcact

SEQ ID NO: 209882 - DNA, 25 bp, Mus musculus
agtcactgatttttcaacctgcact

SEQ ID NO: 209883 - DNA, 25 bp, Mus musculus
agtcactgcagcctcaatggcggaa

SEQ ID NO: 209884 - DNA, 25 bp, Mus musculus
agtcactgcagcgtcaatggcggaa

SEQ ID NO: 209885 - DNA, 25 bp, Mus musculus
agtcactgccatcatgaggtggtct

SEQ ID NO: 209886 - DNA, 25 bp, Mus musculus
agtcactgccatgatgaggtggtct

SEQ ID NO: 209887 - DNA, 25 bp, Mus musculus
agtcactgccgtaagctttcagtgt

SEQ ID NO: 209888 - DNA, 25 bp, Mus musculus
agtcactgccgttagctttcagtgt

SEQ ID NO: 209889 - DNA, 25 bp, Mus musculus
agtcactggagcacatgcagtacct

SEQ ID NO: 209890 - DNA, 25 bp, Mus musculus
agtcactggagctcatgcagtacct

SEQ ID NO: 209891 - DNA, 25 bp, Mus musculus
agtcactggcaaaacgggtttaaag

SEQ ID NO: 209892 - DNA, 25 bp, Mus musculus
agtcactggcaatacgggtttaaag

SEQ ID NO: 209893 - DNA, 25 bp, Mus musculus
agtcactggcccaattcactcttgg

SEQ ID NO: 209894 - DNA, 25 bp, Mus musculus
agtcactggccctattcactcttgg

SEQ ID NO: 209895 - DNA, 25 bp, Mus musculus
agtcactgggacctctggcgacttc

SEQ ID NO: 209896 - DNA, 25 bp, Mus musculus
agtcactgggacgtctggcgacttc

SEQ ID NO: 209897 - DNA, 25 bp, Mus musculus
agtcactgggagacactaattttct

SEQ ID NO: 209898 - DNA, 25 bp, Mus musculus
agtcactgggagtcactaattttct

SEQ ID NO: 209899 - DNA, 25 bp, Mus musculus
agtcactggtgcaaagactgcaata

SEQ ID NO: 209900 - DNA, 25 bp, Mus musculus
agtcactggtgctaagactgcaata

SEQ ID NO: 209901 - DNA, 25 bp, Mus musculus
agtcactgtgacctgagcctcctgg

SEQ ID NO: 209902 - DNA, 25 bp, Mus musculus
agtcactgtgacgtgagcctcctgg

SEQ ID NO: 209903 - DNA, 25 bp, Mus musculus
agtcactgttacctactgacattag

SEQ ID NO: 209904 - DNA, 25 bp, Mus musculus
agtcactgttacgtactgacattag

SEQ ID NO: 209905 - DNA, 25 bp, Mus musculus
agtcacttacaactgtatcccactt

SEQ ID NO: 209906 - DNA, 25 bp, Mus musculus
agtcacttacaagtgtatcccactt

SEQ ID NO: 209907 - DNA, 25 bp, Mus musculus
agtcacttacccaaggttccaatgc

SEQ ID NO: 209908 - DNA, 25 bp, Mus musculus
agtcacttaccctaggttccaatgc

SEQ ID NO: 209909 - DNA, 25 bp, Mus musculus
agtcacttactaacgcatggcttat

SEQ ID NO: 209910 - DNA, 25 bp, Mus musculus
agtcacttactatcgcatggcttat

SEQ ID NO: 209911 - DNA, 25 bp, Mus musculus
agtcacttagtgatggttctcaaat

SEQ ID NO: 209912 - DNA, 25 bp, Mus musculus
agtcacttagtgttggttctcaaat

SEQ ID NO: 209913 - DNA, 25 bp, Mus musculus
agtcacttcacaagtatttcctttt

SEQ ID NO: 209914 - DNA, 25 bp, Mus musculus
agtcacttcacaccttagccttggg

SEQ ID NO: 209915 - DNA, 25 bp, Mus musculus
agtcacttcacagcttagccttggg

SEQ ID NO: 209916 - DNA, 25 bp, Mus musculus
agtcacttcacatgtatttcctttt

SEQ ID NO: 209917 - DNA, 25 bp, Mus musculus
agtcacttcctactctgcggtggtt

SEQ ID NO: 209918 - DNA, 25 bp, Mus musculus
agtcacttcctagtctgcggtggtt

SEQ ID NO: 209919 - DNA, 25 bp, Mus musculus
agtcacttcctgacagagagccgga

SEQ ID NO: 209920 - DNA, 25 bp, Mus musculus
agtcacttcctgtcagagagccgga

SEQ ID NO: 209921 - DNA, 25 bp, Mus musculus
agtcacttcgacagaggcacaagaa

SEQ ID NO: 209922 - DNA, 25 bp, Mus musculus
agtcacttcgactgaggcacaagaa

SEQ ID NO: 209923 - DNA, 25 bp, Mus musculus
agtcacttctgtactctgtgattgt

SEQ ID NO: 209924 - DNA, 25 bp, Mus musculus
agtcacttctgttctctgtgattgt

SEQ ID NO: 209925 - DNA, 25 bp, Mus musculus
agtcacttggctatggacctgcaga

SEQ ID NO: 209926 - DNA, 25 bp, Mus musculus
agtcacttggctttggacctgcaga

SEQ ID NO: 209927 - DNA, 25 bp, Mus musculus
agtcacttgtagaatccaaagataa

SEQ ID NO: 209928 - DNA, 25 bp, Mus musculus
agtcacttgtagatgctgattcact

SEQ ID NO: 209929 - DNA, 25 bp, Mus musculus
agtcacttgtagtatccaaagataa

SEQ ID NO: 209930 - DNA, 25 bp, Mus musculus
agtcacttgtagttgctgattcact

SEQ ID NO: 209931 - DNA, 25 bp, Mus musculus
agtcacttgtctaacttgagtcctc

SEQ ID NO: 209932 - DNA, 25 bp, Mus musculus
agtcacttgtcttacttgagtcctc

SEQ ID NO: 209933 - DNA, 25 bp, Mus musculus
agtcacttgtggatttcactctctg

SEQ ID NO: 209934 - DNA, 25 bp, Mus musculus
agtcacttgtggttttcactctctg

SEQ ID NO: 209935 - DNA, 25 bp, Mus musculus
agtcactttatcatccactcttatc

SEQ ID NO: 209936 - DNA, 25 bp, Mus musculus
agtcactttatcttccactcttatc

SEQ ID NO: 209937 - DNA, 25 bp, Mus musculus
agtcactttcacaggcgttccggtg

SEQ ID NO: 209938 - DNA, 25 bp, Mus musculus
agtcactttcactggcgttccggtg

SEQ ID NO: 209939 - DNA, 25 bp, Mus musculus
agtcactttctgaaccttcctggta

SEQ ID NO: 209940 - DNA, 25 bp, Mus musculus
agtcactttctgtaccttcctggta

SEQ ID NO: 209941 - DNA, 25 bp, Mus musculus
agtcactttcttcaaccattttttg

SEQ ID NO: 209942 - DNA, 25 bp, Mus musculus
agtcactttcttgaaccattttttg

SEQ ID NO: 209943 - DNA, 25 bp, Mus musculus
agtcactttgagaatccctaggtga

SEQ ID NO: 209944 - DNA, 25 bp, Mus musculus
agtcactttgagtatccctaggtga

SEQ ID NO: 209945 - DNA, 25 bp, Mus musculus
agtcactttggcacaggtgtcgtgg

SEQ ID NO: 209946 - DNA, 25 bp, Mus musculus
agtcactttggctcaggtgtcgtgg

SEQ ID NO: 209947 - DNA, 25 bp, Mus musculus
agtcactttgtgctagtgtggctga

SEQ ID NO: 209948 - DNA, 25 bp, Mus musculus
agtcactttgtggtagtgtggctga

SEQ ID NO: 209949 - DNA, 25 bp, Mus musculus
agtcactttgttcccaggttcatat

SEQ ID NO: 209950 - DNA, 25 bp, Mus musculus
agtcactttgttgccaggttcatat

SEQ ID NO: 209951 - DNA, 25 bp, Mus musculus
agtcagaaagacataacactcccac

SEQ ID NO: 209952 - DNA, 25 bp, Mus musculus
agtcagaaagacttaacactcccac

SEQ ID NO: 209953 - DNA, 25 bp, Mus musculus
agtcagaaagtcagtgcctcgtctt

SEQ ID NO: 209954 - DNA, 25 bp, Mus musculus
agtcagaaagtctgtgcctcgtctt

SEQ ID NO: 209955 - DNA, 25 bp, Mus musculus
agtcagaacacacgacctcctctgg

SEQ ID NO: 209956 - DNA, 25 bp, Mus musculus
agtcagaacacaggacctcctctgg

SEQ ID NO: 209957 - DNA, 25 bp, Mus musculus
agtcagaaccacatcggacttcgat

SEQ ID NO: 209958 - DNA, 25 bp, Mus musculus
agtcagaaccacttcggacttcgat

SEQ ID NO: 209959 - DNA, 25 bp, Mus musculus
agtcagaagcccaggtcgcattggc

SEQ ID NO: 209960 - DNA, 25 bp, Mus musculus
agtcagaagccctggtcgcattggc

SEQ ID NO: 209961 - DNA, 25 bp, Mus musculus
agtcagaaggacacgttccactatc

SEQ ID NO: 209962 - DNA, 25 bp, Mus musculus
agtcagaaggactcgttccactatc

SEQ ID NO: 209963 - DNA, 25 bp, Mus musculus
agtcagaagggcattacagagtctc

SEQ ID NO: 209964 - DNA, 25 bp, Mus musculus
agtcagaagggctttacagagtctc

SEQ ID NO: 209965 - DNA, 25 bp, Mus musculus
agtcagaatacaaacaccctctctt

SEQ ID NO: 209966 - DNA, 25 bp, Mus musculus
agtcagaatacatacaccctctctt

SEQ ID NO: 209967 - DNA, 25 bp, Mus musculus
agtcagacaacaccatggatcttat

SEQ ID NO: 209968 - DNA, 25 bp, Mus musculus
agtcagacaacagcatggatcttat

SEQ ID NO: 209969 - DNA, 25 bp, Mus musculus
agtcagacagagctcagcggtgcac

SEQ ID NO: 209970 - DNA, 25 bp, Mus musculus
agtcagacagaggtcagcggtgcac

SEQ ID NO: 209971 - DNA, 25 bp, Mus musculus
agtcagacctgaagccatttgttgt

SEQ ID NO: 209972 - DNA, 25 bp, Mus musculus
agtcagacctgatgccatttgttgt

SEQ ID NO: 209973 - DNA, 25 bp, Mus musculus
agtcagacgaagacacctggtggaa

SEQ ID NO: 209974 - DNA, 25 bp, Mus musculus
agtcagacgaagtcacctggtggaa

SEQ ID NO: 209975 - DNA, 25 bp, Mus musculus
agtcagactatgctgatgggcacaa

SEQ ID NO: 209976 - DNA, 25 bp, Mus musculus
agtcagactatggtgatgggcacaa

SEQ ID NO: 209977 - DNA, 25 bp, Mus musculus
agtcagactcttaatctgagtggtc

SEQ ID NO: 209978 - DNA, 25 bp, Mus musculus
agtcagactctttatctgagtggtc

SEQ ID NO: 209979 - DNA, 25 bp, Mus musculus
agtcagacttcacggcctttgctgg

SEQ ID NO: 209980 - DNA, 25 bp, Mus musculus
agtcagacttcagggcctttgctgg

SEQ ID NO: 209981 - DNA, 25 bp, Mus musculus
agtcagagaaccaacgtggctccgt

SEQ ID NO: 209982 - DNA, 25 bp, Mus musculus
agtcagagaacctacgtggctccgt

SEQ ID NO: 209983 - DNA, 25 bp, Mus musculus
agtcagagaccgcttccgaagcagg

SEQ ID NO: 209984 - DNA, 25 bp, Mus musculus
agtcagagaccggttccgaagcagg

SEQ ID NO: 209985 - DNA, 25 bp, Mus musculus
agtcagagcagacgtctctcttaca

SEQ ID NO: 209986 - DNA, 25 bp, Mus musculus
agtcagagcagaggtctctcttaca

SEQ ID NO: 209987 - DNA, 25 bp, Mus musculus
agtcagagctggatgcacagagaaa

SEQ ID NO: 209988 - DNA, 25 bp, Mus musculus
agtcagagctggttgcacagagaaa

SEQ ID NO: 209989 - DNA, 25 bp, Mus musculus
agtcagagctgtaggaaagcaccct

SEQ ID NO: 209990 - DNA, 25 bp, Mus musculus
agtcagagctgttggaaagcaccct

SEQ ID NO: 209991 - DNA, 25 bp, Mus musculus
agtcagagcttcaatgacccattcc

SEQ ID NO: 209992 - DNA, 25 bp, Mus musculus
agtcagagcttctatgacccattcc

SEQ ID NO: 209993 - DNA, 25 bp, Mus musculus
agtcagaggaagatgctccctccca

SEQ ID NO: 209994 - DNA, 25 bp, Mus musculus
agtcagaggaagttgctccctccca

SEQ ID NO: 209995 - DNA, 25 bp, Mus musculus
agtcagaggctaagcgtccatcagg

SEQ ID NO: 209996 - DNA, 25 bp, Mus musculus
agtcagaggctatgcgtccatcagg

SEQ ID NO: 209997 - DNA, 25 bp, Mus musculus
agtcagagttctatggcccaggagg

SEQ ID NO: 209998 - DNA, 25 bp, Mus musculus
agtcagagttctttggcccaggagg

SEQ ID NO: 209999 - DNA, 25 bp, Mus musculus
agtcagatcattaggcttggcaaca

SEQ ID NO: 210000 - DNA, 25 bp, Mus musculus
agtcagatcatttggcttggcaaca

SEQ ID NO: 210001 - DNA, 25 bp, Mus musculus
agtcagatccgaagcagctgtgcag

SEQ ID NO: 210002 - DNA, 25 bp, Mus musculus
agtcagatccgatgcagctgtgcag

SEQ ID NO: 210003 - DNA, 25 bp, Mus musculus
agtcagatctgactgccattttccc

SEQ ID NO: 210004 - DNA, 25 bp, Mus musculus
agtcagatctgagtgccattttccc

SEQ ID NO: 210005 - DNA, 25 bp, Mus musculus
agtcagatctgcaaagcccttgggc

SEQ ID NO: 210006 - DNA, 25 bp, Mus musculus
agtcagatctgctaagcccttgggc

SEQ ID NO: 210007 - DNA, 25 bp, Mus musculus
agtcagatgattatattttccgatt

SEQ ID NO: 210008 - DNA, 25 bp, Mus musculus
agtcagatgattttattttccgatt

SEQ ID NO: 210009 - DNA, 25 bp, Mus musculus
agtcagatgttccaggcccctccga

SEQ ID NO: 210010 - DNA, 25 bp, Mus musculus
agtcagatgttcgaggcccctccga

SEQ ID NO: 210011 - DNA, 25 bp, Mus musculus
agtcagatgtttcgaactgtttccc

SEQ ID NO: 210012 - DNA, 25 bp, Mus musculus
agtcagatgtttggaactgtttccc

SEQ ID NO: 210013 - DNA, 25 bp, Mus musculus
agtcagattaccctggccctgcgga

SEQ ID NO: 210014 - DNA, 25 bp, Mus musculus
agtcagattaccgtggccctgcgga

SEQ ID NO: 210015 - DNA, 25 bp, Mus musculus
agtcagattcagagatcccataccc

SEQ ID NO: 210016 - DNA, 25 bp, Mus musculus
agtcagattcagtgatcccataccc

SEQ ID NO: 210017 - DNA, 25 bp, Mus musculus
agtcagattcctccggtcttagcta

SEQ ID NO: 210018 - DNA, 25 bp, Mus musculus
agtcagattcctgcggtcttagcta

SEQ ID NO: 210019 - DNA, 25 bp, Mus musculus
agtcagattgccaataaatgagcct

SEQ ID NO: 210020 - DNA, 25 bp, Mus musculus
agtcagattgcctataaatgagcct

SEQ ID NO: 210021 - DNA, 25 bp, Mus musculus
agtcagatttacactgcgtatccag

SEQ ID NO: 210022 - DNA, 25 bp, Mus musculus
agtcagatttactctgcgtatccag

SEQ ID NO: 210023 - DNA, 25 bp, Mus musculus
agtcagcaacttatcactgaatttg

SEQ ID NO: 210024 - DNA, 25 bp, Mus musculus
agtcagcaacttttcactgaatttg

SEQ ID NO: 210025 - DNA, 25 bp, Mus musculus
agtcagcaagtgcacatgggctcgc

SEQ ID NO: 210026 - DNA, 25 bp, Mus musculus
agtcagcaagtggacatgggctcgc

SEQ ID NO: 210027 - DNA, 25 bp, Mus musculus
agtcagcacactaactgtggacaga

SEQ ID NO: 210028 - DNA, 25 bp, Mus musculus
agtcagcacacttactgtggacaga

SEQ ID NO: 210029 - DNA, 25 bp, Mus musculus
agtcagcacctgacaaacactttga

SEQ ID NO: 210030 - DNA, 25 bp, Mus musculus
agtcagcacctgtcaaacactttga

SEQ ID NO: 210031 - DNA, 25 bp, Mus musculus
agtcagcaccttactgccggagcag

SEQ ID NO: 210032 - DNA, 25 bp, Mus musculus
agtcagcacctttctgccggagcag

SEQ ID NO: 210033 - DNA, 25 bp, Mus musculus
agtcagcactggagagagcccatgt

SEQ ID NO: 210034 - DNA, 25 bp, Mus musculus
agtcagcactggtgagagcccatgt

SEQ ID NO: 210035 - DNA, 25 bp, Mus musculus
agtcagcagaagatcctttctcctg

SEQ ID NO: 210036 - DNA, 25 bp, Mus musculus
agtcagcagaagttcctttctcctg

SEQ ID NO: 210037 - DNA, 25 bp, Mus musculus
agtcagcagagcatactccctctca

SEQ ID NO: 210038 - DNA, 25 bp, Mus musculus
agtcagcagagcttactccctctca

SEQ ID NO: 210039 - DNA, 25 bp, Mus musculus
agtcagcagccaagtgtcctttact

SEQ ID NO: 210040 - DNA, 25 bp, Mus musculus
agtcagcagccatgtgtcctttact

SEQ ID NO: 210041 - DNA, 25 bp, Mus musculus
agtcagcaggttcccacagcacagg

SEQ ID NO: 210042 - DNA, 25 bp, Mus musculus
agtcagcaggttgccacagcacagg

SEQ ID NO: 210043 - DNA, 25 bp, Mus musculus
agtcagcatgagactgggccagcct

SEQ ID NO: 210044 - DNA, 25 bp, Mus musculus
agtcagcatgagtctgggccagcct

SEQ ID NO: 210045 - DNA, 25 bp, Mus musculus
agtcagcattgtcacatcctctgta

SEQ ID NO: 210046 - DNA, 25 bp, Mus musculus
agtcagcattgtcttccagtgttaa

SEQ ID NO: 210047 - DNA, 25 bp, Mus musculus
agtcagcattgtgacatcctctgta

SEQ ID NO: 210048 - DNA, 25 bp, Mus musculus
agtcagcattgtgttccagtgttaa

SEQ ID NO: 210049 - DNA, 25 bp, Mus musculus
agtcagccaacacaatgatcaccac

SEQ ID NO: 210050 - DNA, 25 bp, Mus musculus
agtcagccaacagaatgatcaccac

SEQ ID NO: 210051 - DNA, 25 bp, Mus musculus
agtcagccaagcaaaccgagttagt

SEQ ID NO: 210052 - DNA, 25 bp, Mus musculus
agtcagccaagctaaccgagttagt

SEQ ID NO: 210053 - DNA, 25 bp, Mus musculus
agtcagccaagtagacctcagtggt

SEQ ID NO: 210054 - DNA, 25 bp, Mus musculus
agtcagccaagttgacctcagtggt

SEQ ID NO: 210055 - DNA, 25 bp, Mus musculus
agtcagccaggacagtcaacttagg

SEQ ID NO: 210056 - DNA, 25 bp, Mus musculus
agtcagccaggagagtcaacttagg

SEQ ID NO: 210057 - DNA, 25 bp, Mus musculus
agtcagccatccagccagtggacgt

SEQ ID NO: 210058 - DNA, 25 bp, Mus musculus
agtcagccatcctgccagtggacgt

SEQ ID NO: 210059 - DNA, 25 bp, Mus musculus
agtcagccattacctttacacttga

SEQ ID NO: 210060 - DNA, 25 bp, Mus musculus
agtcagccattagctttacacttga

SEQ ID NO: 210061 - DNA, 25 bp, Mus musculus
agtcagccattccagtggattcctg

SEQ ID NO: 210062 - DNA, 25 bp, Mus musculus
agtcagccattcgagtggattcctg

SEQ ID NO: 210063 - DNA, 25 bp, Mus musculus
agtcagcccagtaggaaactcttcc

SEQ ID NO: 210064 - DNA, 25 bp, Mus musculus
agtcagcccagttggaaactcttcc

SEQ ID NO: 210065 - DNA, 25 bp, Mus musculus
agtcagccctaaaggtttcctacat

SEQ ID NO: 210066 - DNA, 25 bp, Mus musculus
agtcagccctaatggtttcctacat

SEQ ID NO: 210067 - DNA, 25 bp, Mus musculus
agtcagccctcactggatttgtgta

SEQ ID NO: 210068 - DNA, 25 bp, Mus musculus
agtcagccctcagtggatttgtgta

SEQ ID NO: 210069 - DNA, 25 bp, Mus musculus
agtcagccctgaactcaagtcttat

SEQ ID NO: 210070 - DNA, 25 bp, Mus musculus
agtcagccctgatctcaagtcttat

SEQ ID NO: 210071 - DNA, 25 bp, Mus musculus
agtcagccgcggaggagaagttcct

SEQ ID NO: 210072 - DNA, 25 bp, Mus musculus
agtcagccgcggtggagaagttcct

SEQ ID NO: 210073 - DNA, 25 bp, Mus musculus
agtcagccttatagtactttccata

SEQ ID NO: 210074 - DNA, 25 bp, Mus musculus
agtcagccttattgtactttccata

SEQ ID NO: 210075 - DNA, 25 bp, Mus musculus
agtcagcgccgaatcttgtggacac

SEQ ID NO: 210076 - DNA, 25 bp, Mus musculus
agtcagcgccgattcttgtggacac

SEQ ID NO: 210077 - DNA, 25 bp, Mus musculus
agtcagcgctcccactgagcaaggc

SEQ ID NO: 210078 - DNA, 25 bp, Mus musculus
agtcagcgctccgactgagcaaggc

SEQ ID NO: 210079 - DNA, 25 bp, Mus musculus
agtcagcgggccatggacgacacct

SEQ ID NO: 210080 - DNA, 25 bp, Mus musculus
agtcagcgggccttggacgacacct

SEQ ID NO: 210081 - DNA, 25 bp, Mus musculus
agtcagcgttcccactgtgggcata

SEQ ID NO: 210082 - DNA, 25 bp, Mus musculus
agtcagcgttccgactgtgggcata

SEQ ID NO: 210083 - DNA, 25 bp, Mus musculus
agtcagctaataaaaaatgaactcc

SEQ ID NO: 210084 - DNA, 25 bp, Mus musculus
agtcagctaatataaaatgaactcc

SEQ ID NO: 210085 - DNA, 25 bp, Mus musculus
agtcagctaccgagtactcacatta

SEQ ID NO: 210086 - DNA, 25 bp, Mus musculus
agtcagctaccgcatctgtgcggtc

SEQ ID NO: 210087 - DNA, 25 bp, Mus musculus
agtcagctaccggatctgtgcggtc

SEQ ID NO: 210088 - DNA, 25 bp, Mus musculus
agtcagctaccgtgtactcacatta

SEQ ID NO: 210089 - DNA, 25 bp, Mus musculus
agtcagctattaaaagcccagttat

SEQ ID NO: 210090 - DNA, 25 bp, Mus musculus
agtcagctattataagcccagttat

SEQ ID NO: 210091 - DNA, 25 bp, Mus musculus
agtcagctcagtcctcagggtttaa

SEQ ID NO: 210092 - DNA, 25 bp, Mus musculus
agtcagctcagtgctcagggtttaa

SEQ ID NO: 210093 - DNA, 25 bp, Mus musculus
agtcagctcatcatcaaataggtag

SEQ ID NO: 210094 - DNA, 25 bp, Mus musculus
agtcagctcatcttcaaataggtag

SEQ ID NO: 210095 - DNA, 25 bp, Mus musculus
agtcagctccctctgaaactctgag

SEQ ID NO: 210096 - DNA, 25 bp, Mus musculus
agtcagctccctgtgaaactctgag

SEQ ID NO: 210097 - DNA, 25 bp, Mus musculus
agtcagctccgtatttcatcccaac

SEQ ID NO: 210098 - DNA, 25 bp, Mus musculus
agtcagctccgtttttcatcccaac

SEQ ID NO: 210099 - DNA, 25 bp, Mus musculus
agtcagctcctcagggtggaaccaa

SEQ ID NO: 210100 - DNA, 25 bp, Mus musculus
agtcagctcctctgggtggaaccaa

SEQ ID NO: 210101 - DNA, 25 bp, Mus musculus
agtcagctcgacaagccagggaact

SEQ ID NO: 210102 - DNA, 25 bp, Mus musculus
agtcagctcgactagccagggaact

SEQ ID NO: 210103 - DNA, 25 bp, Mus musculus
agtcagctgcagacagccgagagct

SEQ ID NO: 210104 - DNA, 25 bp, Mus musculus
agtcagctgcagtcagccgagagct

SEQ ID NO: 210105 - DNA, 25 bp, Mus musculus
agtcagctgctgaagaaccaaaccc

SEQ ID NO: 210106 - DNA, 25 bp, Mus musculus
agtcagctgctgtagaaccaaaccc

SEQ ID NO: 210107 - DNA, 25 bp, Mus musculus
agtcagctggaaactctcaaattag

SEQ ID NO: 210108 - DNA, 25 bp, Mus musculus
agtcagctggaatctctcaaattag

SEQ ID NO: 210109 - DNA, 25 bp, Mus musculus
agtcagcttatgagcaaggttgcga

SEQ ID NO: 210110 - DNA, 25 bp, Mus musculus
agtcagcttatgtgcaaggttgcga

SEQ ID NO: 210111 - DNA, 25 bp, Mus musculus
agtcagcttctcatggcacaatccc

SEQ ID NO: 210112 - DNA, 25 bp, Mus musculus
agtcagcttctcttggcacaatccc

SEQ ID NO: 210113 - DNA, 25 bp, Mus musculus
agtcagcttgtgacctcttgagtca

SEQ ID NO: 210114 - DNA, 25 bp, Mus musculus
agtcagcttgtgtcctcttgagtca

SEQ ID NO: 210115 - DNA, 25 bp, Mus musculus
agtcagctttcacggcattatgtct

SEQ ID NO: 210116 - DNA, 25 bp, Mus musculus
agtcagctttcagggcattatgtct

SEQ ID NO: 210117 - DNA, 25 bp, Mus musculus
agtcaggactctccagaccagctga

SEQ ID NO: 210118 - DNA, 25 bp, Mus musculus
agtcaggactctgcagaccagctga

SEQ ID NO: 210119 - DNA, 25 bp, Mus musculus
agtcaggactggctgactgcagcct

SEQ ID NO: 210120 - DNA, 25 bp, Mus musculus
agtcaggactgggtgactgcagcct

SEQ ID NO: 210121 - DNA, 25 bp, Mus musculus
agtcaggagagcctggctgccccta

SEQ ID NO: 210122 - DNA, 25 bp, Mus musculus
agtcaggagagcgtggctgccccta

SEQ ID NO: 210123 - DNA, 25 bp, Mus musculus
agtcaggagccaaagggtcaaccgt

SEQ ID NO: 210124 - DNA, 25 bp, Mus musculus
agtcaggagccaagcttgtggcttc

SEQ ID NO: 210125 - DNA, 25 bp, Mus musculus
agtcaggagccatagggtcaaccgt

SEQ ID NO: 210126 - DNA, 25 bp, Mus musculus
agtcaggagccatgcttgtggcttc

SEQ ID NO: 210127 - DNA, 25 bp, Mus musculus
agtcaggagcgaacaagacagccct

SEQ ID NO: 210128 - DNA, 25 bp, Mus musculus
agtcaggagcgatcaagacagccct

SEQ ID NO: 210129 - DNA, 25 bp, Mus musculus
agtcaggagtagactgacttatttt

SEQ ID NO: 210130 - DNA, 25 bp, Mus musculus
agtcaggagtagtctgacttatttt

SEQ ID NO: 210131 - DNA, 25 bp, Mus musculus
agtcaggatatgatgtccgctcctt

SEQ ID NO: 210132 - DNA, 25 bp, Mus musculus
agtcaggatatgttgtccgctcctt

SEQ ID NO: 210133 - DNA, 25 bp, Mus musculus
agtcaggattgcagcacagggaatc

SEQ ID NO: 210134 - DNA, 25 bp, Mus musculus
agtcaggattgctgcacagggaatc

SEQ ID NO: 210135 - DNA, 25 bp, Mus musculus
agtcaggcacatcacttggctctgt

SEQ ID NO: 210136 - DNA, 25 bp, Mus musculus
agtcaggcacatgacttggctctgt

SEQ ID NO: 210137 - DNA, 25 bp, Mus musculus
agtcaggcactgagcagcaccgggt

SEQ ID NO: 210138 - DNA, 25 bp, Mus musculus
agtcaggcactgtgcagcaccgggt

SEQ ID NO: 210139 - DNA, 25 bp, Mus musculus
agtcaggcaggccaattcagtgtgc

SEQ ID NO: 210140 - DNA, 25 bp, Mus musculus
agtcaggcaggcgaattcagtgtgc

SEQ ID NO: 210141 - DNA, 25 bp, Mus musculus
agtcaggcatgacggacactaatcc

SEQ ID NO: 210142 - DNA, 25 bp, Mus musculus
agtcaggcatgagggacactaatcc

SEQ ID NO: 210143 - DNA, 25 bp, Mus musculus
agtcaggcatttcctgctcagcggg

SEQ ID NO: 210144 - DNA, 25 bp, Mus musculus
agtcaggcatttgctgctcagcggg

SEQ ID NO: 210145 - DNA, 25 bp, Mus musculus
agtcaggccagcaagctgggtgtct

SEQ ID NO: 210146 - DNA, 25 bp, Mus musculus
agtcaggccagctagctgggtgtct

SEQ ID NO: 210147 - DNA, 25 bp, Mus musculus
agtcaggcggcaccagagcacctgc

SEQ ID NO: 210148 - DNA, 25 bp, Mus musculus
agtcaggcggcagcagagcacctgc

SEQ ID NO: 210149 - DNA, 25 bp, Mus musculus
agtcaggctatcatgctgcgctctg

SEQ ID NO: 210150 - DNA, 25 bp, Mus musculus
agtcaggctatcttgctgcgctctg

SEQ ID NO: 210151 - DNA, 25 bp, Mus musculus
agtcaggctcccattcccatgagca

SEQ ID NO: 210152 - DNA, 25 bp, Mus musculus
agtcaggctccctttcccatgagca

SEQ ID NO: 210153 - DNA, 25 bp, Mus musculus
agtcaggctgagagttctgccgaca

SEQ ID NO: 210154 - DNA, 25 bp, Mus musculus
agtcaggctgagtgttctgccgaca

SEQ ID NO: 210155 - DNA, 25 bp, Mus musculus
agtcaggctgcaaactccaggttag

SEQ ID NO: 210156 - DNA, 25 bp, Mus musculus
agtcaggctgcatactccaggttag

SEQ ID NO: 210157 - DNA, 25 bp, Mus musculus
agtcagggactcaggtagctcacag

SEQ ID NO: 210158 - DNA, 25 bp, Mus musculus
agtcagggactctggtagctcacag

SEQ ID NO: 210159 - DNA, 25 bp, Mus musculus
agtcagggaggacccacaagcacag

SEQ ID NO: 210160 - DNA, 25 bp, Mus musculus
agtcagggaggagccacaagcacag

SEQ ID NO: 210161 - DNA, 25 bp, Mus musculus
agtcagggagttctcggagccaacc

SEQ ID NO: 210162 - DNA, 25 bp, Mus musculus
agtcagggagttgtcggagccaacc

SEQ ID NO: 210163 - DNA, 25 bp, Mus musculus
agtcagggcaatcgcagcgctgact

SEQ ID NO: 210164 - DNA, 25 bp, Mus musculus
agtcagggcaatggcagcgctgact

SEQ ID NO: 210165 - DNA, 25 bp, Mus musculus
agtcagggcagcactaatggagatc

SEQ ID NO: 210166 - DNA, 25 bp, Mus musculus
agtcagggcagctctaatggagatc

SEQ ID NO: 210167 - DNA, 25 bp, Mus musculus
agtcagggccagaacgcgcagcttc

SEQ ID NO: 210168 - DNA, 25 bp, Mus musculus
agtcagggccagtacgcgcagcttc

SEQ ID NO: 210169 - DNA, 25 bp, Mus musculus
agtcagggcctaacttctaacgaaa

SEQ ID NO: 210170 - DNA, 25 bp, Mus musculus
agtcagggcctatcttctaacgaaa

SEQ ID NO: 210171 - DNA, 25 bp, Mus musculus
agtcagggcgttctctcagcatttg

SEQ ID NO: 210172 - DNA, 25 bp, Mus musculus
agtcagggcgttgtctcagcatttg

SEQ ID NO: 210173 - DNA, 25 bp, Mus musculus
agtcagggctttacggctctgcaga

SEQ ID NO: 210174 - DNA, 25 bp, Mus musculus
agtcagggcttttcggctctgcaga

SEQ ID NO: 210175 - DNA, 25 bp, Mus musculus
agtcagggtttaattttgtagctct

SEQ ID NO: 210176 - DNA, 25 bp, Mus musculus
agtcagggtttatttttgtagctct

SEQ ID NO: 210177 - DNA, 25 bp, Mus musculus
agtcagggtttcaggctttcacctc

SEQ ID NO: 210178 - DNA, 25 bp, Mus musculus
agtcagggtttctggctttcacctc

SEQ ID NO: 210179 - DNA, 25 bp, Mus musculus
agtcaggtagcaaagccacaggccc

SEQ ID NO: 210180 - DNA, 25 bp, Mus musculus
agtcaggtagcatagccacaggccc

SEQ ID NO: 210181 - DNA, 25 bp, Mus musculus
agtcaggtagccaaagatctcccac

SEQ ID NO: 210182 - DNA, 25 bp, Mus musculus
agtcaggtagcctaagatctcccac

SEQ ID NO: 210183 - DNA, 25 bp, Mus musculus
agtcaggtatacactgctgcctcag

SEQ ID NO: 210184 - DNA, 25 bp, Mus musculus
agtcaggtatactctgctgcctcag

SEQ ID NO: 210185 - DNA, 25 bp, Mus musculus
agtcaggtccttattcttacacggc

SEQ ID NO: 210186 - DNA, 25 bp, Mus musculus
agtcaggtcctttttcttacacggc

SEQ ID NO: 210187 - DNA, 25 bp, Mus musculus
agtcaggtctaacacattccaggct

SEQ ID NO: 210188 - DNA, 25 bp, Mus musculus
agtcaggtctaagacattccaggct

SEQ ID NO: 210189 - DNA, 25 bp, Mus musculus
agtcaggtctgaccagccagttttg

SEQ ID NO: 210190 - DNA, 25 bp, Mus musculus
agtcaggtctgagcagccagttttg

SEQ ID NO: 210191 - DNA, 25 bp, Mus musculus
agtcaggtctgcaattccacgtgca

SEQ ID NO: 210192 - DNA, 25 bp, Mus musculus
agtcaggtctgctattccacgtgca

SEQ ID NO: 210193 - DNA, 25 bp, Mus musculus
agtcaggtctttagcacacagggct

SEQ ID NO: 210194 - DNA, 25 bp, Mus musculus
agtcaggtcttttgcacacagggct

SEQ ID NO: 210195 - DNA, 25 bp, Mus musculus
agtcaggtgaatatttatgagtttc

SEQ ID NO: 210196 - DNA, 25 bp, Mus musculus
agtcaggtgaatttttatgagtttc

SEQ ID NO: 210197 - DNA, 25 bp, Mus musculus
agtcaggtgaccctttcaaaagcaa

SEQ ID NO: 210198 - DNA, 25 bp, Mus musculus
agtcaggtgaccgtttcaaaagcaa

SEQ ID NO: 210199 - DNA, 25 bp, Mus musculus
agtcaggtgccgacagattcacagt

SEQ ID NO: 210200 - DNA, 25 bp, Mus musculus
agtcaggtgccgtcagattcacagt

SEQ ID NO: 210201 - DNA, 25 bp, Mus musculus
agtcaggtggacaggcagcttacta

SEQ ID NO: 210202 - DNA, 25 bp, Mus musculus
agtcaggtggactggcagcttacta

SEQ ID NO: 210203 - DNA, 25 bp, Mus musculus
agtcaggtggagactgctgagataa

SEQ ID NO: 210204 - DNA, 25 bp, Mus musculus
agtcaggtggagtctgctgagataa

SEQ ID NO: 210205 - DNA, 25 bp, Mus musculus
agtcaggtgttcagatggttcccat

SEQ ID NO: 210206 - DNA, 25 bp, Mus musculus
agtcaggtgttctgatggttcccat

SEQ ID NO: 210207 - DNA, 25 bp, Mus musculus
agtcaggttaggctcatccttgcca

SEQ ID NO: 210208 - DNA, 25 bp, Mus musculus
agtcaggttagggtcatccttgcca

SEQ ID NO: 210209 - DNA, 25 bp, Mus musculus
agtcaggttgcgaagttaccctcgg

SEQ ID NO: 210210 - DNA, 25 bp, Mus musculus
agtcaggttgcgtagttaccctcgg

SEQ ID NO: 210211 - DNA, 25 bp, Mus musculus
agtcagtaaagtccacgctctaccc

SEQ ID NO: 210212 - DNA, 25 bp, Mus musculus
agtcagtaaagtgcacgctctaccc

SEQ ID NO: 210213 - DNA, 25 bp, Mus musculus
agtcagtaacacaatcctccttttt

SEQ ID NO: 210214 - DNA, 25 bp, Mus musculus
agtcagtaacactatcctccttttt

SEQ ID NO: 210215 - DNA, 25 bp, Mus musculus
agtcagtaagtaacccagcctttat

SEQ ID NO: 210216 - DNA, 25 bp, Mus musculus
agtcagtaagtatcccagcctttat

SEQ ID NO: 210217 - DNA, 25 bp, Mus musculus
agtcagtacaaccaagagtcccaag

SEQ ID NO: 210218 - DNA, 25 bp, Mus musculus
agtcagtacaacgaagagtcccaag

SEQ ID NO: 210219 - DNA, 25 bp, Mus musculus
agtcagtactctcgtgggtggcact

SEQ ID NO: 210220 - DNA, 25 bp, Mus musculus
agtcagtactctggtgggtggcact

SEQ ID NO: 210221 - DNA, 25 bp, Mus musculus
agtcagtactgtcatgaatccaagc

SEQ ID NO: 210222 - DNA, 25 bp, Mus musculus
agtcagtactgtgatgaatccaagc

SEQ ID NO: 210223 - DNA, 25 bp, Mus musculus
agtcagtagagtcctgcatctgcaa

SEQ ID NO: 210224 - DNA, 25 bp, Mus musculus
agtcagtagagtgctgcatctgcaa

SEQ ID NO: 210225 - DNA, 25 bp, Mus musculus
agtcagtagtggcacaccgatcaaa

SEQ ID NO: 210226 - DNA, 25 bp, Mus musculus
agtcagtagtgggacaccgatcaaa

SEQ ID NO: 210227 - DNA, 25 bp, Mus musculus
agtcagtatttgactcctattccct

SEQ ID NO: 210228 - DNA, 25 bp, Mus musculus
agtcagtatttgtctcctattccct

SEQ ID NO: 210229 - DNA, 25 bp, Mus musculus
agtcagtcaactccctaatgggcta

SEQ ID NO: 210230 - DNA, 25 bp, Mus musculus
agtcagtcaactgcctaatgggcta

SEQ ID NO: 210231 - DNA, 25 bp, Mus musculus
agtcagtcacctagtcctaatttag

SEQ ID NO: 210232 - DNA, 25 bp, Mus musculus
agtcagtcaccttgtcctaatttag

SEQ ID NO: 210233 - DNA, 25 bp, Mus musculus
agtcagtcactgctgcatggattta

SEQ ID NO: 210234 - DNA, 25 bp, Mus musculus
agtcagtcactggtgcatggattta

SEQ ID NO: 210235 - DNA, 25 bp, Mus musculus
agtcagtcagcgacaaggctcccag

SEQ ID NO: 210236 - DNA, 25 bp, Mus musculus
agtcagtcagcgtcaaggctcccag

SEQ ID NO: 210237 - DNA, 25 bp, Mus musculus
agtcagtcagttcccgtgacaggaa

SEQ ID NO: 210238 - DNA, 25 bp, Mus musculus
agtcagtcagttgccgtgacaggaa

SEQ ID NO: 210239 - DNA, 25 bp, Mus musculus
agtcagtcatgtcctttgtgcccgt

SEQ ID NO: 210240 - DNA, 25 bp, Mus musculus
agtcagtcatgtgctttgtgcccgt

SEQ ID NO: 210241 - DNA, 25 bp, Mus musculus
agtcagtccacaacacagaaacagt

SEQ ID NO: 210242 - DNA, 25 bp, Mus musculus
agtcagtccacatcacagaaacagt

SEQ ID NO: 210243 - DNA, 25 bp, Mus musculus
agtcagtccaccctgtcctgtgtga

SEQ ID NO: 210244 - DNA, 25 bp, Mus musculus
agtcagtccaccgtgtcctgtgtga

SEQ ID NO: 210245 - DNA, 25 bp, Mus musculus
agtcagtctggtacctgagccaaaa

SEQ ID NO: 210246 - DNA, 25 bp, Mus musculus
agtcagtctggttcctgagccaaaa

SEQ ID NO: 210247 - DNA, 25 bp, Mus musculus
agtcagtgcaacctctacatggcag

SEQ ID NO: 210248 - DNA, 25 bp, Mus musculus
agtcagtgcaacgtctacatggcag

SEQ ID NO: 210249 - DNA, 25 bp, Mus musculus
agtcagtgcaatcccttgtttcttc

SEQ ID NO: 210250 - DNA, 25 bp, Mus musculus
agtcagtgcaatgccttgtttcttc

SEQ ID NO: 210251 - DNA, 25 bp, Mus musculus
agtcagtgcactaacaattatgtac

SEQ ID NO: 210252 - DNA, 25 bp, Mus musculus
agtcagtgcacttacaattatgtac

SEQ ID NO: 210253 - DNA, 25 bp, Mus musculus
agtcagtgcagcctgttggaacact

SEQ ID NO: 210254 - DNA, 25 bp, Mus musculus
agtcagtgcagcgtgttggaacact

SEQ ID NO: 210255 - DNA, 25 bp, Mus musculus
agtcagtgcggcatgtccatgagct

SEQ ID NO: 210256 - DNA, 25 bp, Mus musculus
agtcagtgcggcttgtccatgagct

SEQ ID NO: 210257 - DNA, 25 bp, Mus musculus
agtcagtgctgaccaatagcgtata

SEQ ID NO: 210258 - DNA, 25 bp, Mus musculus
agtcagtgctgacgccttcatttgg

SEQ ID NO: 210259 - DNA, 25 bp, Mus musculus
agtcagtgctgagcaatagcgtata

SEQ ID NO: 210260 - DNA, 25 bp, Mus musculus
agtcagtgctgaggccttcatttgg

SEQ ID NO: 210261 - DNA, 25 bp, Mus musculus
agtcagtggagacaatccggtcttc

SEQ ID NO: 210262 - DNA, 25 bp, Mus musculus
agtcagtggagagaatccggtcttc

SEQ ID NO: 210263 - DNA, 25 bp, Mus musculus
agtcagtgggagaccctgcctatga

SEQ ID NO: 210264 - DNA, 25 bp, Mus musculus
agtcagtgggagtccctgcctatga

SEQ ID NO: 210265 - DNA, 25 bp, Mus musculus
agtcagtgggtaagtctgccagcgc

SEQ ID NO: 210266 - DNA, 25 bp, Mus musculus
agtcagtgggtatgtctgccagcgc

SEQ ID NO: 210267 - DNA, 25 bp, Mus musculus
agtcagtgtgtcatgtcgacctttt

SEQ ID NO: 210268 - DNA, 25 bp, Mus musculus
agtcagtgtgtcttgtcgacctttt

SEQ ID NO: 210269 - DNA, 25 bp, Mus musculus
agtcagttacgcagctggagcactc

SEQ ID NO: 210270 - DNA, 25 bp, Mus musculus
agtcagttacgctgctggagcactc

SEQ ID NO: 210271 - DNA, 25 bp, Mus musculus
agtcagttattacccaacttgccca

SEQ ID NO: 210272 - DNA, 25 bp, Mus musculus
agtcagttattagccaacttgccca

SEQ ID NO: 210273 - DNA, 25 bp, Mus musculus
agtcagttcataatcttttagagca

SEQ ID NO: 210274 - DNA, 25 bp, Mus musculus
agtcagttcatacctctgcaggtta

SEQ ID NO: 210275 - DNA, 25 bp, Mus musculus
agtcagttcatagctctgcaggtta

SEQ ID NO: 210276 - DNA, 25 bp, Mus musculus
agtcagttcatattcttttagagca

SEQ ID NO: 210277 - DNA, 25 bp, Mus musculus
agtcagttccacaggacagaccctc

SEQ ID NO: 210278 - DNA, 25 bp, Mus musculus
agtcagttccactggacagaccctc

SEQ ID NO: 210279 - DNA, 25 bp, Mus musculus
agtcagttccttaaacagacctgag

SEQ ID NO: 210280 - DNA, 25 bp, Mus musculus
agtcagttcctttaacagacctgag

SEQ ID NO: 210281 - DNA, 25 bp, Mus musculus
agtcagttctgaaactagcgaactt

SEQ ID NO: 210282 - DNA, 25 bp, Mus musculus
agtcagttctgatactagcgaactt

SEQ ID NO: 210283 - DNA, 25 bp, Mus musculus
agtcagttggaaacagccccttaag

SEQ ID NO: 210284 - DNA, 25 bp, Mus musculus
agtcagttggaatcagccccttaag

SEQ ID NO: 210285 - DNA, 25 bp, Mus musculus
agtcagtttgcgaactcacctccat

SEQ ID NO: 210286 - DNA, 25 bp, Mus musculus
agtcagtttgcgtactcacctccat

SEQ ID NO: 210287 - DNA, 25 bp, Mus musculus
agtcagttttctaaagtgccaagtt

SEQ ID NO: 210288 - DNA, 25 bp, Mus musculus
agtcagttttcttaagtgccaagtt

SEQ ID NO: 210289 - DNA, 25 bp, Mus musculus
agtcagtttttcagtccatccatcc

SEQ ID NO: 210290 - DNA, 25 bp, Mus musculus
agtcagtttttctgtccatccatcc

SEQ ID NO: 210291 - DNA, 25 bp, Mus musculus
agtcataaaatgaatccctccctgc

SEQ ID NO: 210292 - DNA, 25 bp, Mus musculus
agtcataaaatgtatccctccctgc

SEQ ID NO: 210293 - DNA, 25 bp, Mus musculus
agtcataacaggattacagctttgg

SEQ ID NO: 210294 - DNA, 25 bp, Mus musculus
agtcataacaggtttacagctttgg

SEQ ID NO: 210295 - DNA, 25 bp, Mus musculus
agtcataacatcacgttcgctgctt

SEQ ID NO: 210296 - DNA, 25 bp, Mus musculus
agtcataacatctcgttcgctgctt

SEQ ID NO: 210297 - DNA, 25 bp, Mus musculus
agtcataacccgaattctcttactg

SEQ ID NO: 210298 - DNA, 25 bp, Mus musculus
agtcataacccgtattctcttactg

SEQ ID NO: 210299 - DNA, 25 bp, Mus musculus
agtcataagacaccccaaacatggc

SEQ ID NO: 210300 - DNA, 25 bp, Mus musculus
agtcataagacagcccaaacatggc

SEQ ID NO: 210301 - DNA, 25 bp, Mus musculus
agtcataaggtgagctaggccagct

SEQ ID NO: 210302 - DNA, 25 bp, Mus musculus
agtcataaggtgtgctaggccagct

SEQ ID NO: 210303 - DNA, 25 bp, Mus musculus
agtcataatcctctttcagtgtttt

SEQ ID NO: 210304 - DNA, 25 bp, Mus musculus
agtcataatcctgtttcagtgtttt

SEQ ID NO: 210305 - DNA, 25 bp, Mus musculus
agtcataatttgctatttatcacag

SEQ ID NO: 210306 - DNA, 25 bp, Mus musculus
agtcataatttggtatttatcacag

SEQ ID NO: 210307 - DNA, 25 bp, Mus musculus
agtcatacgcatcgcttaactgttc

SEQ ID NO: 210308 - DNA, 25 bp, Mus musculus
agtcatacgcatggcttaactgttc

SEQ ID NO: 210309 - DNA, 25 bp, Mus musculus
agtcatactccacggctctgctagg

SEQ ID NO: 210310 - DNA, 25 bp, Mus musculus
agtcatactccagggctctgctagg

SEQ ID NO: 210311 - DNA, 25 bp, Mus musculus
agtcatacttcaagactgtggtggt

SEQ ID NO: 210312 - DNA, 25 bp, Mus musculus
agtcatacttcatgactgtggtggt

SEQ ID NO: 210313 - DNA, 25 bp, Mus musculus
agtcataggaacactttgttggcaa

SEQ ID NO: 210314 - DNA, 25 bp, Mus musculus
agtcataggaactctttgttggcaa

SEQ ID NO: 210315 - DNA, 25 bp, Mus musculus
agtcatagtgtcaccgagagccgac

SEQ ID NO: 210316 - DNA, 25 bp, Mus musculus
agtcatagtgtctccgagagccgac

SEQ ID NO: 210317 - DNA, 25 bp, Mus musculus
agtcatatttagactcttctgtagt

SEQ ID NO: 210318 - DNA, 25 bp, Mus musculus
agtcatatttagtctcttctgtagt

SEQ ID NO: 210319 - DNA, 25 bp, Mus musculus
agtcatcaacaaccactcgttcaat

SEQ ID NO: 210320 - DNA, 25 bp, Mus musculus
agtcatcaacaagcactcgttcaat

SEQ ID NO: 210321 - DNA, 25 bp, Mus musculus
agtcatcaatcccaactacttcttt

SEQ ID NO: 210322 - DNA, 25 bp, Mus musculus
agtcatcaatccgaactacttcttt

SEQ ID NO: 210323 - DNA, 25 bp, Mus musculus
agtcatcacaagacaagaagttcac

SEQ ID NO: 210324 - DNA, 25 bp, Mus musculus
agtcatcacaagtcaagaagttcac

SEQ ID NO: 210325 - DNA, 25 bp, Mus musculus
agtcatcacctgaatttggctggga

SEQ ID NO: 210326 - DNA, 25 bp, Mus musculus
agtcatcacctgtatttggctggga

SEQ ID NO: 210327 - DNA, 25 bp, Mus musculus
agtcatcagatgacccctggaattg

SEQ ID NO: 210328 - DNA, 25 bp, Mus musculus
agtcatcagatgtcccctggaattg

SEQ ID NO: 210329 - DNA, 25 bp, Mus musculus
agtcatcagcgaagccagagaggct

SEQ ID NO: 210330 - DNA, 25 bp, Mus musculus
agtcatcagcgatgccagagaggct

SEQ ID NO: 210331 - DNA, 25 bp, Mus musculus
agtcatcagctcctgtctggtttca

SEQ ID NO: 210332 - DNA, 25 bp, Mus musculus
agtcatcagctcgtgtctggtttca

SEQ ID NO: 210333 - DNA, 25 bp, Mus musculus
agtcatcatcaaattctcggtccgt

SEQ ID NO: 210334 - DNA, 25 bp, Mus musculus
agtcatcatcaatttctcggtccgt

SEQ ID NO: 210335 - DNA, 25 bp, Mus musculus
agtcatcatgagctctattttggaa

SEQ ID NO: 210336 - DNA, 25 bp, Mus musculus
agtcatcatgaggtctattttggaa

SEQ ID NO: 210337 - DNA, 25 bp, Mus musculus
agtcatccaaggagtccaggtcggg

SEQ ID NO: 210338 - DNA, 25 bp, Mus musculus
agtcatccaaggtgtccaggtcggg

SEQ ID NO: 210339 - DNA, 25 bp, Mus musculus
agtcatccaatcagacctgaagggc

SEQ ID NO: 210340 - DNA, 25 bp, Mus musculus
agtcatccaatctgacctgaagggc

SEQ ID NO: 210341 - DNA, 25 bp, Mus musculus
agtcatccagacagcgggggtgtcc

SEQ ID NO: 210342 - DNA, 25 bp, Mus musculus
agtcatccagacagtgaaccatgtt

SEQ ID NO: 210343 - DNA, 25 bp, Mus musculus
agtcatccagactgcgggggtgtcc

SEQ ID NO: 210344 - DNA, 25 bp, Mus musculus
agtcatccagactgtgaaccatgtt

SEQ ID NO: 210345 - DNA, 25 bp, Mus musculus
agtcatcccaccaacataatcagaa

SEQ ID NO: 210346 - DNA, 25 bp, Mus musculus
agtcatcccaccacagggcttggag

SEQ ID NO: 210347 - DNA, 25 bp, Mus musculus
agtcatcccacctacataatcagaa

SEQ ID NO: 210348 - DNA, 25 bp, Mus musculus
agtcatcccacctcagggcttggag

SEQ ID NO: 210349 - DNA, 25 bp, Mus musculus
agtcatcccacgcaatgccgcaggg

SEQ ID NO: 210350 - DNA, 25 bp, Mus musculus
agtcatcccacggaatgccgcaggg

SEQ ID NO: 210351 - DNA, 25 bp, Mus musculus
agtcatccctgtacctagcggatat

SEQ ID NO: 210352 - DNA, 25 bp, Mus musculus
agtcatccctgttcctagcggatat

SEQ ID NO: 210353 - DNA, 25 bp, Mus musculus
agtcatcccttgatttctctttact

SEQ ID NO: 210354 - DNA, 25 bp, Mus musculus
agtcatcccttgttttctctttact

SEQ ID NO: 210355 - DNA, 25 bp, Mus musculus
agtcatccgcttacttgatagtccg

SEQ ID NO: 210356 - DNA, 25 bp, Mus musculus
agtcatccgctttcttgatagtccg

SEQ ID NO: 210357 - DNA, 25 bp, Mus musculus
agtcatcctacaacactgctctgta

SEQ ID NO: 210358 - DNA, 25 bp, Mus musculus
agtcatcctacatcactgctctgta

SEQ ID NO: 210359 - DNA, 25 bp, Mus musculus
agtcatcctctaaccttactcagac

SEQ ID NO: 210360 - DNA, 25 bp, Mus musculus
agtcatcctctatccttactcagac

SEQ ID NO: 210361 - DNA, 25 bp, Mus musculus
agtcatcctcttacactttgttgtt

SEQ ID NO: 210362 - DNA, 25 bp, Mus musculus
agtcatcctctttcactttgttgtt

SEQ ID NO: 210363 - DNA, 25 bp, Mus musculus
agtcatcctgagacaagataaccca

SEQ ID NO: 210364 - DNA, 25 bp, Mus musculus
agtcatcctgagtcaagataaccca

SEQ ID NO: 210365 - DNA, 25 bp, Mus musculus
agtcatcctgcacagtcatcaagca

SEQ ID NO: 210366 - DNA, 25 bp, Mus musculus
agtcatcctgcagagtcatcaagca

SEQ ID NO: 210367 - DNA, 25 bp, Mus musculus
agtcatcctgtcaggcacatagagg

SEQ ID NO: 210368 - DNA, 25 bp, Mus musculus
agtcatcctgtccaagacgacggag

SEQ ID NO: 210369 - DNA, 25 bp, Mus musculus
agtcatcctgtcgaagacgacggag

SEQ ID NO: 210370 - DNA, 25 bp, Mus musculus
agtcatcctgtctggcacatagagg

SEQ ID NO: 210371 - DNA, 25 bp, Mus musculus
agtcatccttccacaggcaaatctg

SEQ ID NO: 210372 - DNA, 25 bp, Mus musculus
agtcatccttcctcaggcaaatctg

SEQ ID NO: 210373 - DNA, 25 bp, Mus musculus
agtcatccttggcacagttcttaga

SEQ ID NO: 210374 - DNA, 25 bp, Mus musculus
agtcatccttgggacagttcttaga

SEQ ID NO: 210375 - DNA, 25 bp, Mus musculus
agtcatcctttacctttgcggtgat

SEQ ID NO: 210376 - DNA, 25 bp, Mus musculus
agtcatcctttagctttgcggtgat

SEQ ID NO: 210377 - DNA, 25 bp, Mus musculus
agtcatcgaagcagccggcgtttgg

SEQ ID NO: 210378 - DNA, 25 bp, Mus musculus
agtcatcgaagctgccggcgtttgg

SEQ ID NO: 210379 - DNA, 25 bp, Mus musculus
agtcatcgtcctcccttaaaattag

SEQ ID NO: 210380 - DNA, 25 bp, Mus musculus
agtcatcgtcctgccttaaaattag

SEQ ID NO: 210381 - DNA, 25 bp, Mus musculus
agtcatctagggaaaagccctgtat

SEQ ID NO: 210382 - DNA, 25 bp, Mus musculus
agtcatctagggtaaagccctgtat

SEQ ID NO: 210383 - DNA, 25 bp, Mus musculus
agtcatctcaggcattcttttctaa

SEQ ID NO: 210384 - DNA, 25 bp, Mus musculus
agtcatctcagggattcttttctaa

SEQ ID NO: 210385 - DNA, 25 bp, Mus musculus
agtcatctcatacctttctgtgtga

SEQ ID NO: 210386 - DNA, 25 bp, Mus musculus
agtcatctcatagctttctgtgtga

SEQ ID NO: 210387 - DNA, 25 bp, Mus musculus
agtcatctccatcttagttgctctc

SEQ ID NO: 210388 - DNA, 25 bp, Mus musculus
agtcatctccatgttagttgctctc

SEQ ID NO: 210389 - DNA, 25 bp, Mus musculus
agtcatctcctactattcccaatat

SEQ ID NO: 210390 - DNA, 25 bp, Mus musculus
agtcatctcctagtattcccaatat

SEQ ID NO: 210391 - DNA, 25 bp, Mus musculus
agtcatctcgggagaccctcactct

SEQ ID NO: 210392 - DNA, 25 bp, Mus musculus
agtcatctcgggtgaccctcactct

SEQ ID NO: 210393 - DNA, 25 bp, Mus musculus
agtcatctctcgctcttaatatgga

SEQ ID NO: 210394 - DNA, 25 bp, Mus musculus
agtcatctctcggtcttaatatgga

SEQ ID NO: 210395 - DNA, 25 bp, Mus musculus
agtcatctctctatcactgttctga

SEQ ID NO: 210396 - DNA, 25 bp, Mus musculus
agtcatctctctttcactgttctga

SEQ ID NO: 210397 - DNA, 25 bp, Mus musculus
agtcatctgaccctcaaatactgct

SEQ ID NO: 210398 - DNA, 25 bp, Mus musculus
agtcatctgaccgtcaaatactgct

SEQ ID NO: 210399 - DNA, 25 bp, Mus musculus
agtcatctgacgcagtgggctccag

SEQ ID NO: 210400 - DNA, 25 bp, Mus musculus
agtcatctgacggagtgggctccag

SEQ ID NO: 210401 - DNA, 25 bp, Mus musculus
agtcatctgactcggctgatccctg

SEQ ID NO: 210402 - DNA, 25 bp, Mus musculus
agtcatctgactgggctgatccctg

SEQ ID NO: 210403 - DNA, 25 bp, Mus musculus
agtcatctgtggagagagcctggct

SEQ ID NO: 210404 - DNA, 25 bp, Mus musculus
agtcatctgtggtgagagcctggct

SEQ ID NO: 210405 - DNA, 25 bp, Mus musculus
agtcatctgttcatatgttctaaag

SEQ ID NO: 210406 - DNA, 25 bp, Mus musculus
agtcatctgttcttatgttctaaag

SEQ ID NO: 210407 - DNA, 25 bp, Mus musculus
agtcatcttaaacccgtgcttttat

SEQ ID NO: 210408 - DNA, 25 bp, Mus musculus
agtcatcttaaagccgtgcttttat

SEQ ID NO: 210409 - DNA, 25 bp, Mus musculus
agtcatcttccgacagactgtggtg

SEQ ID NO: 210410 - DNA, 25 bp, Mus musculus
agtcatcttccgtcagactgtggtg

SEQ ID NO: 210411 - DNA, 25 bp, Mus musculus
agtcatctttgacccaatcattcaa

SEQ ID NO: 210412 - DNA, 25 bp, Mus musculus
agtcatctttgagccaatcattcaa

SEQ ID NO: 210413 - DNA, 25 bp, Mus musculus
agtcatgaaaccactgtcttcactc

SEQ ID NO: 210414 - DNA, 25 bp, Mus musculus
agtcatgaaacctctgtcttcactc

SEQ ID NO: 210415 - DNA, 25 bp, Mus musculus
agtcatgaacacctttgctcacaag

SEQ ID NO: 210416 - DNA, 25 bp, Mus musculus
agtcatgaacacgtttgctcacaag

SEQ ID NO: 210417 - DNA, 25 bp, Mus musculus
agtcatgaactccattccctaagtt

SEQ ID NO: 210418 - DNA, 25 bp, Mus musculus
agtcatgaactcgattccctaagtt

SEQ ID NO: 210419 - DNA, 25 bp, Mus musculus
agtcatgaacttaccttccaggaga

SEQ ID NO: 210420 - DNA, 25 bp, Mus musculus
agtcatgaactttccttccaggaga

SEQ ID NO: 210421 - DNA, 25 bp, Mus musculus
agtcatgaatgacgcccggcctgtt

SEQ ID NO: 210422 - DNA, 25 bp, Mus musculus
agtcatgaatgaggcccggcctgtt

SEQ ID NO: 210423 - DNA, 25 bp, Mus musculus
agtcatgacagcatatgctcctggc

SEQ ID NO: 210424 - DNA, 25 bp, Mus musculus
agtcatgacagcttatgctcctggc

SEQ ID NO: 210425 - DNA, 25 bp, Mus musculus
agtcatgacatcatgagttccttaa

SEQ ID NO: 210426 - DNA, 25 bp, Mus musculus
agtcatgacatcttgagttccttaa

SEQ ID NO: 210427 - DNA, 25 bp, Mus musculus
agtcatgaccttacttggacagtac

SEQ ID NO: 210428 - DNA, 25 bp, Mus musculus
agtcatgaccttcgaatgttggatc

SEQ ID NO: 210429 - DNA, 25 bp, Mus musculus
agtcatgaccttggaatgttggatc

SEQ ID NO: 210430 - DNA, 25 bp, Mus musculus
agtcatgacctttcttggacagtac

SEQ ID NO: 210431 - DNA, 25 bp, Mus musculus
agtcatgactctaccgggaactcta

SEQ ID NO: 210432 - DNA, 25 bp, Mus musculus
agtcatgactcttccgggaactcta

SEQ ID NO: 210433 - DNA, 25 bp, Mus musculus
agtcatgaggtcactagcttcctgt

SEQ ID NO: 210434 - DNA, 25 bp, Mus musculus
agtcatgaggtctctagcttcctgt

SEQ ID NO: 210435 - DNA, 25 bp, Mus musculus
agtcatgagtgtatgctccgtgcct

SEQ ID NO: 210436 - DNA, 25 bp, Mus musculus
agtcatgagtgtttgctccgtgcct

SEQ ID NO: 210437 - DNA, 25 bp, Mus musculus
agtcatgatatgcagacctccaatt

SEQ ID NO: 210438 - DNA, 25 bp, Mus musculus
agtcatgatatggagacctccaatt

SEQ ID NO: 210439 - DNA, 25 bp, Mus musculus
agtcatgatcacatttggctgctgt

SEQ ID NO: 210440 - DNA, 25 bp, Mus musculus
agtcatgatcacttttggctgctgt

SEQ ID NO: 210441 - DNA, 25 bp, Mus musculus
agtcatgatggcatcagcagcccct

SEQ ID NO: 210442 - DNA, 25 bp, Mus musculus
agtcatgatggcttcagcagcccct

SEQ ID NO: 210443 - DNA, 25 bp, Mus musculus
agtcatgattggagtgtacctcctc

SEQ ID NO: 210444 - DNA, 25 bp, Mus musculus
agtcatgattggtgtgtacctcctc

SEQ ID NO: 210445 - DNA, 25 bp, Mus musculus
agtcatgcaactagtggcagagccc

SEQ ID NO: 210446 - DNA, 25 bp, Mus musculus
agtcatgcaacttgtggcagagccc

SEQ ID NO: 210447 - DNA, 25 bp, Mus musculus
agtcatgcactgaccaatggaggca

SEQ ID NO: 210448 - DNA, 25 bp, Mus musculus
agtcatgcactgtccaatggaggca

SEQ ID NO: 210449 - DNA, 25 bp, Mus musculus
agtcatgcacttacttcagacgcat

SEQ ID NO: 210450 - DNA, 25 bp, Mus musculus
agtcatgcactttcttcagacgcat

SEQ ID NO: 210451 - DNA, 25 bp, Mus musculus
agtcatgcatgtatactctttgtga

SEQ ID NO: 210452 - DNA, 25 bp, Mus musculus
agtcatgcatgtttactctttgtga

SEQ ID NO: 210453 - DNA, 25 bp, Mus musculus
agtcatgccatgctgcctagactag

SEQ ID NO: 210454 - DNA, 25 bp, Mus musculus
agtcatgccatggtgcctagactag

SEQ ID NO: 210455 - DNA, 25 bp, Mus musculus
agtcatgccctaccttcaggtgtta

SEQ ID NO: 210456 - DNA, 25 bp, Mus musculus
agtcatgccctagcttcaggtgtta

SEQ ID NO: 210457 - DNA, 25 bp, Mus musculus
agtcatgctacaaggtgctggaaga

SEQ ID NO: 210458 - DNA, 25 bp, Mus musculus
agtcatgctacatggtgctggaaga

SEQ ID NO: 210459 - DNA, 25 bp, Mus musculus
agtcatgctattcttacacctgcta

SEQ ID NO: 210460 - DNA, 25 bp, Mus musculus
agtcatgctattgttacacctgcta

SEQ ID NO: 210461 - DNA, 25 bp, Mus musculus
agtcatgctgttatctatcaccaaa

SEQ ID NO: 210462 - DNA, 25 bp, Mus musculus
agtcatgctgttttctatcaccaaa

SEQ ID NO: 210463 - DNA, 25 bp, Mus musculus
agtcatggacctagctctggtgaga

SEQ ID NO: 210464 - DNA, 25 bp, Mus musculus
agtcatggaccttgctctggtgaga

SEQ ID NO: 210465 - DNA, 25 bp, Mus musculus
agtcatggagccaactcaatgtgca

SEQ ID NO: 210466 - DNA, 25 bp, Mus musculus
agtcatggagcctactcaatgtgca

SEQ ID NO: 210467 - DNA, 25 bp, Mus musculus
agtcatggatctagctgtagttttg

SEQ ID NO: 210468 - DNA, 25 bp, Mus musculus
agtcatggatcttgctgtagttttg

SEQ ID NO: 210469 - DNA, 25 bp, Mus musculus
agtcatggcatgcaaatactgctga

SEQ ID NO: 210470 - DNA, 25 bp, Mus musculus
agtcatggcatgctgtcttcgagag

SEQ ID NO: 210471 - DNA, 25 bp, Mus musculus
agtcatggcatggaaatactgctga

SEQ ID NO: 210472 - DNA, 25 bp, Mus musculus
agtcatggcatggtgtcttcgagag

SEQ ID NO: 210473 - DNA, 25 bp, Mus musculus
agtcatggcctcatgctggaaaggt

SEQ ID NO: 210474 - DNA, 25 bp, Mus musculus
agtcatggcctcttgctggaaaggt

SEQ ID NO: 210475 - DNA, 25 bp, Mus musculus
agtcatggctggacaagcttttagg

SEQ ID NO: 210476 - DNA, 25 bp, Mus musculus
agtcatggctggcacatgaggcttc

SEQ ID NO: 210477 - DNA, 25 bp, Mus musculus
agtcatggctgggacatgaggcttc

SEQ ID NO: 210478 - DNA, 25 bp, Mus musculus
agtcatggctggtcaagcttttagg

SEQ ID NO: 210479 - DNA, 25 bp, Mus musculus
agtcatgggatgactttccactcac

SEQ ID NO: 210480 - DNA, 25 bp, Mus musculus
agtcatgggatgtctttccactcac

SEQ ID NO: 210481 - DNA, 25 bp, Mus musculus
agtcatgggcaccaaatctctgtat

SEQ ID NO: 210482 - DNA, 25 bp, Mus musculus
agtcatgggcacgaaatctctgtat

SEQ ID NO: 210483 - DNA, 25 bp, Mus musculus
agtcatgggccgctcactctttcag

SEQ ID NO: 210484 - DNA, 25 bp, Mus musculus
agtcatgggccggtcactctttcag

SEQ ID NO: 210485 - DNA, 25 bp, Mus musculus
agtcatgggtccattatttgtttga

SEQ ID NO: 210486 - DNA, 25 bp, Mus musculus
agtcatgggtcctttatttgtttga

SEQ ID NO: 210487 - DNA, 25 bp, Mus musculus
agtcatgggtgtctttctagcgcac

SEQ ID NO: 210488 - DNA, 25 bp, Mus musculus
agtcatgggtgtgtttctagcgcac

SEQ ID NO: 210489 - DNA, 25 bp, Mus musculus
agtcatggtagtacttgtcattttc

SEQ ID NO: 210490 - DNA, 25 bp, Mus musculus
agtcatggtagttcttgtcattttc

SEQ ID NO: 210491 - DNA, 25 bp, Mus musculus
agtcatgtaggccagattctgcata

SEQ ID NO: 210492 - DNA, 25 bp, Mus musculus
agtcatgtaggcgagattctgcata

SEQ ID NO: 210493 - DNA, 25 bp, Mus musculus
agtcatgtattcctctttgttcaga

SEQ ID NO: 210494 - DNA, 25 bp, Mus musculus
agtcatgtattcgtctttgttcaga

SEQ ID NO: 210495 - DNA, 25 bp, Mus musculus
agtcatgtccccaacctaataaatt

SEQ ID NO: 210496 - DNA, 25 bp, Mus musculus
agtcatgtcccctacctaataaatt

SEQ ID NO: 210497 - DNA, 25 bp, Mus musculus
agtcatgtgaacacgtactactgtt

SEQ ID NO: 210498 - DNA, 25 bp, Mus musculus
agtcatgtgaactcgtactactgtt

SEQ ID NO: 210499 - DNA, 25 bp, Mus musculus
agtcatgtgactctagtggagaaac

SEQ ID NO: 210500 - DNA, 25 bp, Mus musculus
agtcatgtgactgtagtggagaaac

SEQ ID NO: 210501 - DNA, 25 bp, Mus musculus
agtcatgtgcctatgaggaaccctg

SEQ ID NO: 210502 - DNA, 25 bp, Mus musculus
agtcatgtgcctttgaggaaccctg

SEQ ID NO: 210503 - DNA, 25 bp, Mus musculus
agtcatgtgctcagtaacgttccat

SEQ ID NO: 210504 - DNA, 25 bp, Mus musculus
agtcatgtgctctgtaacgttccat

SEQ ID NO: 210505 - DNA, 25 bp, Mus musculus
agtcatgtgtcaactgcggccggga

SEQ ID NO: 210506 - DNA, 25 bp, Mus musculus
agtcatgtgtcatctgcggccggga

SEQ ID NO: 210507 - DNA, 25 bp, Mus musculus
agtcatgtgtgtatttcttaggcca

SEQ ID NO: 210508 - DNA, 25 bp, Mus musculus
agtcatgtgtgtttttcttaggcca

SEQ ID NO: 210509 - DNA, 25 bp, Mus musculus
agtcatgtgttcatcaggcctgagt

SEQ ID NO: 210510 - DNA, 25 bp, Mus musculus
agtcatgtgttcttcaggcctgagt

SEQ ID NO: 210511 - DNA, 25 bp, Mus musculus
agtcatgttcatagctctgtcttga

SEQ ID NO: 210512 - DNA, 25 bp, Mus musculus
agtcatgttcattgctctgtcttga

SEQ ID NO: 210513 - DNA, 25 bp, Mus musculus
agtcatgttcctcgtggtacagtac

SEQ ID NO: 210514 - DNA, 25 bp, Mus musculus
agtcatgttcctggtggtacagtac

SEQ ID NO: 210515 - DNA, 25 bp, Mus musculus
agtcatgtttaaaagctatcaggat

SEQ ID NO: 210516 - DNA, 25 bp, Mus musculus
agtcatgtttaatagctatcaggat

SEQ ID NO: 210517 - DNA, 25 bp, Mus musculus
agtcattaacagactgctccatatg

SEQ ID NO: 210518 - DNA, 25 bp, Mus musculus
agtcattaacagtctgctccatatg

SEQ ID NO: 210519 - DNA, 25 bp, Mus musculus
agtcattaatccctttctgttctgt

SEQ ID NO: 210520 - DNA, 25 bp, Mus musculus
agtcattaatccgtttctgttctgt

SEQ ID NO: 210521 - DNA, 25 bp, Mus musculus
agtcattacaaactgtctctccctg

SEQ ID NO: 210522 - DNA, 25 bp, Mus musculus
agtcattacaaagtgtctctccctg

SEQ ID NO: 210523 - DNA, 25 bp, Mus musculus
agtcattacatcactgcttctaagc

SEQ ID NO: 210524 - DNA, 25 bp, Mus musculus
agtcattacatctctgcttctaagc

SEQ ID NO: 210525 - DNA, 25 bp, Mus musculus
agtcattactttcaacgcctccctt

SEQ ID NO: 210526 - DNA, 25 bp, Mus musculus
agtcattactttgaacgcctccctt

SEQ ID NO: 210527 - DNA, 25 bp, Mus musculus
agtcattagcgtcaccctgtataat

SEQ ID NO: 210528 - DNA, 25 bp, Mus musculus
agtcattagcgtgaccctgtataat

SEQ ID NO: 210529 - DNA, 25 bp, Mus musculus
agtcattcaacaagcaccactgggt

SEQ ID NO: 210530 - DNA, 25 bp, Mus musculus
agtcattcaacatgcaccactgggt

SEQ ID NO: 210531 - DNA, 25 bp, Mus musculus
agtcattcacagatttagaacttaa

SEQ ID NO: 210532 - DNA, 25 bp, Mus musculus
agtcattcacagttttagaacttaa

SEQ ID NO: 210533 - DNA, 25 bp, Mus musculus
agtcattcactgaagatcttactga

SEQ ID NO: 210534 - DNA, 25 bp, Mus musculus
agtcattcactgtagatcttactga

SEQ ID NO: 210535 - DNA, 25 bp, Mus musculus
agtcattcacttaccatctacagag

SEQ ID NO: 210536 - DNA, 25 bp, Mus musculus
agtcattcactttccatctacagag

SEQ ID NO: 210537 - DNA, 25 bp, Mus musculus
agtcattccaaaagcatttcacggg

SEQ ID NO: 210538 - DNA, 25 bp, Mus musculus
agtcattccaaatgcatttcacggg

SEQ ID NO: 210539 - DNA, 25 bp, Mus musculus
agtcattccagacggatctgagttt

SEQ ID NO: 210540 - DNA, 25 bp, Mus musculus
agtcattccagagggatctgagttt

SEQ ID NO: 210541 - DNA, 25 bp, Mus musculus
agtcattcctcaagttcttgtttaa

SEQ ID NO: 210542 - DNA, 25 bp, Mus musculus
agtcattcctcatgttcttgtttaa

SEQ ID NO: 210543 - DNA, 25 bp, Mus musculus
agtcattcctgacacatttcaattg

SEQ ID NO: 210544 - DNA, 25 bp, Mus musculus
agtcattcctgagacatttcaattg

SEQ ID NO: 210545 - DNA, 25 bp, Mus musculus
agtcattccttcagtgacatgagca

SEQ ID NO: 210546 - DNA, 25 bp, Mus musculus
agtcattccttctgtgacatgagca

SEQ ID NO: 210547 - DNA, 25 bp, Mus musculus
agtcattctgatcgctgtacccagt

SEQ ID NO: 210548 - DNA, 25 bp, Mus musculus
agtcattctgatggctgtacccagt

SEQ ID NO: 210549 - DNA, 25 bp, Mus musculus
agtcattctgcccaagccaggatgc

SEQ ID NO: 210550 - DNA, 25 bp, Mus musculus
agtcattctgccgaagccaggatgc

SEQ ID NO: 210551 - DNA, 25 bp, Mus musculus
agtcattctggacttatggttgctc

SEQ ID NO: 210552 - DNA, 25 bp, Mus musculus
agtcattctggagttatggttgctc

SEQ ID NO: 210553 - DNA, 25 bp, Mus musculus
agtcattcttaactttctcatgggt

SEQ ID NO: 210554 - DNA, 25 bp, Mus musculus
agtcattcttaagtttctcatgggt

SEQ ID NO: 210555 - DNA, 25 bp, Mus musculus
agtcattctttaaagtaagcgtagg

SEQ ID NO: 210556 - DNA, 25 bp, Mus musculus
agtcattctttatagtaagcgtagg

SEQ ID NO: 210557 - DNA, 25 bp, Mus musculus
agtcattgacatatctctccaacac

SEQ ID NO: 210558 - DNA, 25 bp, Mus musculus
agtcattgacatttctctccaacac

SEQ ID NO: 210559 - DNA, 25 bp, Mus musculus
agtcattgcctcacaccttctggaa

SEQ ID NO: 210560 - DNA, 25 bp, Mus musculus
agtcattgcctctcaccttctggaa

SEQ ID NO: 210561 - DNA, 25 bp, Mus musculus
agtcattgccttaatcacatttgtg

SEQ ID NO: 210562 - DNA, 25 bp, Mus musculus
agtcattgcctttatcacatttgtg

SEQ ID NO: 210563 - DNA, 25 bp, Mus musculus
agtcattgctgaccctggaaatata

SEQ ID NO: 210564 - DNA, 25 bp, Mus musculus
agtcattgctgagcctggaaatata

SEQ ID NO: 210565 - DNA, 25 bp, Mus musculus
agtcattggaccactgttcttcttt

SEQ ID NO: 210566 - DNA, 25 bp, Mus musculus
agtcattggacctctgttcttcttt

SEQ ID NO: 210567 - DNA, 25 bp, Mus musculus
agtcattggccgctggtaattttat

SEQ ID NO: 210568 - DNA, 25 bp, Mus musculus
agtcattggccggtggtaattttat

SEQ ID NO: 210569 - DNA, 25 bp, Mus musculus
agtcattggctacccatagcaacag

SEQ ID NO: 210570 - DNA, 25 bp, Mus musculus
agtcattggctagccatagcaacag

SEQ ID NO: 210571 - DNA, 25 bp, Mus musculus
agtcattggtctattttcggcagta

SEQ ID NO: 210572 - DNA, 25 bp, Mus musculus
agtcattggtcttttttcggcagta

SEQ ID NO: 210573 - DNA, 25 bp, Mus musculus
agtcattgtaaaactctagcccgca

SEQ ID NO: 210574 - DNA, 25 bp, Mus musculus
agtcattgtaaatctctagcccgca

SEQ ID NO: 210575 - DNA, 25 bp, Mus musculus
agtcattgtgcccactgagatcaag

SEQ ID NO: 210576 - DNA, 25 bp, Mus musculus
agtcattgtgccgactgagatcaag

SEQ ID NO: 210577 - DNA, 25 bp, Mus musculus
agtcattgtggaccctaatcaaata

SEQ ID NO: 210578 - DNA, 25 bp, Mus musculus
agtcattgtggagcctaatcaaata

SEQ ID NO: 210579 - DNA, 25 bp, Mus musculus
agtcattgttttccgttacatacct

SEQ ID NO: 210580 - DNA, 25 bp, Mus musculus
agtcattgttttgcgttacatacct

SEQ ID NO: 210581 - DNA, 25 bp, Mus musculus
agtcatttactgactttatgagtta

SEQ ID NO: 210582 - DNA, 25 bp, Mus musculus
agtcatttactgtctttatgagtta

SEQ ID NO: 210583 - DNA, 25 bp, Mus musculus
agtcatttagtcatcacttatgcaa

SEQ ID NO: 210584 - DNA, 25 bp, Mus musculus
agtcatttagtcttcacttatgcaa

SEQ ID NO: 210585 - DNA, 25 bp, Mus musculus
agtcatttcactctcatgctggaag

SEQ ID NO: 210586 - DNA, 25 bp, Mus musculus
agtcatttcactgtcatgctggaag

SEQ ID NO: 210587 - DNA, 25 bp, Mus musculus
agtcatttccctcgtgcttcctttt

SEQ ID NO: 210588 - DNA, 25 bp, Mus musculus
agtcatttccctggtgcttcctttt

SEQ ID NO: 210589 - DNA, 25 bp, Mus musculus
agtcatttccgtctcattttcagtt

SEQ ID NO: 210590 - DNA, 25 bp, Mus musculus
agtcatttccgtgtcattttcagtt

SEQ ID NO: 210591 - DNA, 25 bp, Mus musculus
agtcatttgaccacagacttctcct

SEQ ID NO: 210592 - DNA, 25 bp, Mus musculus
agtcatttgacctcagacttctcct

SEQ ID NO: 210593 - DNA, 25 bp, Mus musculus
agtcatttgcttatagattctatcc

SEQ ID NO: 210594 - DNA, 25 bp, Mus musculus
agtcatttgcttttagattctatcc

SEQ ID NO: 210595 - DNA, 25 bp, Mus musculus
agtcatttgtagaaagtatcagaga

SEQ ID NO: 210596 - DNA, 25 bp, Mus musculus
agtcatttgtagtaagtatcagaga

SEQ ID NO: 210597 - DNA, 25 bp, Mus musculus
agtcatttgtgaacctgcggtaacc

SEQ ID NO: 210598 - DNA, 25 bp, Mus musculus
agtcatttgtgatcctgcggtaacc

SEQ ID NO: 210599 - DNA, 25 bp, Mus musculus
agtcattttaaaccacatctagctt

SEQ ID NO: 210600 - DNA, 25 bp, Mus musculus
agtcattttaaagcacatctagctt

SEQ ID NO: 210601 - DNA, 25 bp, Mus musculus
agtcattttaccacattctactggt

SEQ ID NO: 210602 - DNA, 25 bp, Mus musculus
agtcattttaccagtagctttctaa

SEQ ID NO: 210603 - DNA, 25 bp, Mus musculus
agtcattttacctcattctactggt

SEQ ID NO: 210604 - DNA, 25 bp, Mus musculus
agtcattttacctgtagctttctaa

SEQ ID NO: 210605 - DNA, 25 bp, Mus musculus
agtcattttagactcaccatcccat

SEQ ID NO: 210606 - DNA, 25 bp, Mus musculus
agtcattttagagtcaccatcccat

SEQ ID NO: 210607 - DNA, 25 bp, Mus musculus
agtcattttataatgaggccacaaa

SEQ ID NO: 210608 - DNA, 25 bp, Mus musculus
agtcattttatattgaggccacaaa

SEQ ID NO: 210609 - DNA, 25 bp, Mus musculus
agtcattttatgatgtcttctcttg

SEQ ID NO: 210610 - DNA, 25 bp, Mus musculus
agtcattttatgttgtcttctcttg

SEQ ID NO: 210611 - DNA, 25 bp, Mus musculus
agtcattttgcacaagtccactttc

SEQ ID NO: 210612 - DNA, 25 bp, Mus musculus
agtcattttgcagaagtccactttc

SEQ ID NO: 210613 - DNA, 25 bp, Mus musculus
agtcattttgtgaattagttttgca

SEQ ID NO: 210614 - DNA, 25 bp, Mus musculus
agtcattttgtgtattagttttgca

SEQ ID NO: 210615 - DNA, 25 bp, Mus musculus
agtcatttttccctgcaggagaagg

SEQ ID NO: 210616 - DNA, 25 bp, Mus musculus
agtcatttttccgtgcaggagaagg

SEQ ID NO: 210617 - DNA, 25 bp, Mus musculus
agtcatttttctcatcctcccagcc

SEQ ID NO: 210618 - DNA, 25 bp, Mus musculus
agtcatttttctgatcctcccagcc

SEQ ID NO: 210619 - DNA, 25 bp, Mus musculus
agtcatttttgcaccagggaaaagc

SEQ ID NO: 210620 - DNA, 25 bp, Mus musculus
agtcatttttgctccagggaaaagc

SEQ ID NO: 210621 - DNA, 25 bp, Mus musculus
agtccaaaccccaaatgattgccaa

SEQ ID NO: 210622 - DNA, 25 bp, Mus musculus
agtccaaacccctaatgattgccaa

SEQ ID NO: 210623 - DNA, 25 bp, Mus musculus
agtccaaacccgacttctcagaaag

SEQ ID NO: 210624 - DNA, 25 bp, Mus musculus
agtccaaacccgtcttctcagaaag

SEQ ID NO: 210625 - DNA, 25 bp, Mus musculus
agtccaaaccctcagagtggtcttt

SEQ ID NO: 210626 - DNA, 25 bp, Mus musculus
agtccaaaccctgagagtggtcttt

SEQ ID NO: 210627 - DNA, 25 bp, Mus musculus
agtccaaaccttctgacctggttat

SEQ ID NO: 210628 - DNA, 25 bp, Mus musculus
agtccaaaccttgtgacctggttat

SEQ ID NO: 210629 - DNA, 25 bp, Mus musculus
agtccaaacttgcattctatcacag

SEQ ID NO: 210630 - DNA, 25 bp, Mus musculus
agtccaaacttggattctatcacag

SEQ ID NO: 210631 - DNA, 25 bp, Mus musculus
agtccaaagactcgccccatgctgg

SEQ ID NO: 210632 - DNA, 25 bp, Mus musculus
agtccaaagactggccccatgctgg

SEQ ID NO: 210633 - DNA, 25 bp, Mus musculus
agtccaaagtccacaaactcactgt

SEQ ID NO: 210634 - DNA, 25 bp, Mus musculus
agtccaaagtcctcaaactcactgt

SEQ ID NO: 210635 - DNA, 25 bp, Mus musculus
agtccaaatagaagctactcgggtt

SEQ ID NO: 210636 - DNA, 25 bp, Mus musculus
agtccaaatagatgctactcgggtt

SEQ ID NO: 210637 - DNA, 25 bp, Mus musculus
agtccaaatcctcgaggcagcctca

SEQ ID NO: 210638 - DNA, 25 bp, Mus musculus
agtccaaatcctggaggcagcctca

SEQ ID NO: 210639 - DNA, 25 bp, Mus musculus
agtccaaattggagcgaacacccca

SEQ ID NO: 210640 - DNA, 25 bp, Mus musculus
agtccaaattggtgcgaacacccca

SEQ ID NO: 210641 - DNA, 25 bp, Mus musculus
agtccaaccactatctgtttgtctg

SEQ ID NO: 210642 - DNA, 25 bp, Mus musculus
agtccaaccactttctgtttgtctg

SEQ ID NO: 210643 - DNA, 25 bp, Mus musculus
agtccaacctatcatgtgtcttcca

SEQ ID NO: 210644 - DNA, 25 bp, Mus musculus
agtccaacctatgatgtgtcttcca

SEQ ID NO: 210645 - DNA, 25 bp, Mus musculus
agtccaactgttatgcactgtgatt

SEQ ID NO: 210646 - DNA, 25 bp, Mus musculus
agtccaactgttttgcactgtgatt

SEQ ID NO: 210647 - DNA, 25 bp, Mus musculus
agtccaagaaggctacatctctttt

SEQ ID NO: 210648 - DNA, 25 bp, Mus musculus
agtccaagaagggtacatctctttt

SEQ ID NO: 210649 - DNA, 25 bp, Mus musculus
agtccaagagatctcgtcgtagcca

SEQ ID NO: 210650 - DNA, 25 bp, Mus musculus
agtccaagagatgtcgtcgtagcca

SEQ ID NO: 210651 - DNA, 25 bp, Mus musculus
agtccaagagctcagggcctgttct

SEQ ID NO: 210652 - DNA, 25 bp, Mus musculus
agtccaagagctgagggcctgttct

SEQ ID NO: 210653 - DNA, 25 bp, Mus musculus
agtccaagagtgaagcagtggccgt

SEQ ID NO: 210654 - DNA, 25 bp, Mus musculus
agtccaagagtgtagcagtggccgt

SEQ ID NO: 210655 - DNA, 25 bp, Mus musculus
agtccaagcagcctacaaatccttc

SEQ ID NO: 210656 - DNA, 25 bp, Mus musculus
agtccaagcagcgtacaaatccttc

SEQ ID NO: 210657 - DNA, 25 bp, Mus musculus
agtccaaggcaaccatgaactgcat

SEQ ID NO: 210658 - DNA, 25 bp, Mus musculus
agtccaaggcaagcatgaactgcat

SEQ ID NO: 210659 - DNA, 25 bp, Mus musculus
agtccaaggcttcctctgaagggaa

SEQ ID NO: 210660 - DNA, 25 bp, Mus musculus
agtccaaggcttgctctgaagggaa

SEQ ID NO: 210661 - DNA, 25 bp, Mus musculus
agtccaagggacagctcaggcccag

SEQ ID NO: 210662 - DNA, 25 bp, Mus musculus
agtccaagggactgctcaggcccag

SEQ ID NO: 210663 - DNA, 25 bp, Mus musculus
agtccaagggcaacagttgtgtaat

SEQ ID NO: 210664 - DNA, 25 bp, Mus musculus
agtccaagggcatcagttgtgtaat

SEQ ID NO: 210665 - DNA, 25 bp, Mus musculus
agtccaagtctgctgttgcaactta

SEQ ID NO: 210666 - DNA, 25 bp, Mus musculus
agtccaagtctggtgttgcaactta

SEQ ID NO: 210667 - DNA, 25 bp, Mus musculus
agtccaagtgtgaggctgttggttt

SEQ ID NO: 210668 - DNA, 25 bp, Mus musculus
agtccaagtgtgtggctgttggttt

SEQ ID NO: 210669 - DNA, 25 bp, Mus musculus
agtccaagtttaacaggagttagtg

SEQ ID NO: 210670 - DNA, 25 bp, Mus musculus
agtccaagtttatcaggagttagtg

SEQ ID NO: 210671 - DNA, 25 bp, Mus musculus
agtccaataattaagcctgggaaga

SEQ ID NO: 210672 - DNA, 25 bp, Mus musculus
agtccaataatttagcctgggaaga

SEQ ID NO: 210673 - DNA, 25 bp, Mus musculus
agtccaatatggaggccactacatt

SEQ ID NO: 210674 - DNA, 25 bp, Mus musculus
agtccaatatggtggccactacatt

SEQ ID NO: 210675 - DNA, 25 bp, Mus musculus
agtccaatcactcctactatttttt

SEQ ID NO: 210676 - DNA, 25 bp, Mus musculus
agtccaatcactgctactatttttt

SEQ ID NO: 210677 - DNA, 25 bp, Mus musculus
agtccaatcattatcctccttttgg

SEQ ID NO: 210678 - DNA, 25 bp, Mus musculus
agtccaatcattttcctccttttgg

SEQ ID NO: 210679 - DNA, 25 bp, Mus musculus
agtccaatggtaccgtctttgttcg

SEQ ID NO: 210680 - DNA, 25 bp, Mus musculus
agtccaatggtagcgtctttgttcg

SEQ ID NO: 210681 - DNA, 25 bp, Mus musculus
agtccaattgccactaacttcctaa

SEQ ID NO: 210682 - DNA, 25 bp, Mus musculus
agtccaattgcctctaacttcctaa

SEQ ID NO: 210683 - DNA, 25 bp, Mus musculus
agtccaatttgtcctgtttgtccat

SEQ ID NO: 210684 - DNA, 25 bp, Mus musculus
agtccaatttgtgctgtttgtccat

SEQ ID NO: 210685 - DNA, 25 bp, Mus musculus
agtccacaagagatgctcagtccat

SEQ ID NO: 210686 - DNA, 25 bp, Mus musculus
agtccacaagagttgctcagtccat

SEQ ID NO: 210687 - DNA, 25 bp, Mus musculus
agtccacaattgacaccccaaagaa

SEQ ID NO: 210688 - DNA, 25 bp, Mus musculus
agtccacaattgtcaccccaaagaa

SEQ ID NO: 210689 - DNA, 25 bp, Mus musculus
agtccacacagaagacaggccactt

SEQ ID NO: 210690 - DNA, 25 bp, Mus musculus
agtccacacagatgacaggccactt

SEQ ID NO: 210691 - DNA, 25 bp, Mus musculus
agtccacaccaacttgtccaggaat

SEQ ID NO: 210692 - DNA, 25 bp, Mus musculus
agtccacaccaagttgtccaggaat

SEQ ID NO: 210693 - DNA, 25 bp, Mus musculus
agtccacacctcctgtttacataga

SEQ ID NO: 210694 - DNA, 25 bp, Mus musculus
agtccacacctcgtgtttacataga

SEQ ID NO: 210695 - DNA, 25 bp, Mus musculus
agtccacacgtgactggtccagaaa

SEQ ID NO: 210696 - DNA, 25 bp, Mus musculus
agtccacacgtgtctggtccagaaa

SEQ ID NO: 210697 - DNA, 25 bp, Mus musculus
agtccacacttaagggcttgcttta

SEQ ID NO: 210698 - DNA, 25 bp, Mus musculus
agtccacacttatgggcttgcttta

SEQ ID NO: 210699 - DNA, 25 bp, Mus musculus
agtccacacttccagcgaaatgcca

SEQ ID NO: 210700 - DNA, 25 bp, Mus musculus
agtccacacttcgagcgaaatgcca

SEQ ID NO: 210701 - DNA, 25 bp, Mus musculus
agtccacagcaacagatgtcccagg

SEQ ID NO: 210702 - DNA, 25 bp, Mus musculus
agtccacagcaagagatgtcccagg

SEQ ID NO: 210703 - DNA, 25 bp, Mus musculus
agtccacagcagctggcaacgccaa

SEQ ID NO: 210704 - DNA, 25 bp, Mus musculus
agtccacagcaggtggcaacgccaa

SEQ ID NO: 210705 - DNA, 25 bp, Mus musculus
agtccacaggcacctatgattccat

SEQ ID NO: 210706 - DNA, 25 bp, Mus musculus
agtccacaggcagctatgattccat

SEQ ID NO: 210707 - DNA, 25 bp, Mus musculus
agtccacatactccacttggtttat

SEQ ID NO: 210708 - DNA, 25 bp, Mus musculus
agtccacatactgcacttggtttat

SEQ ID NO: 210709 - DNA, 25 bp, Mus musculus
agtccacatagcctcctgctggaaa

SEQ ID NO: 210710 - DNA, 25 bp, Mus musculus
agtccacatagcgtcctgctggaaa

SEQ ID NO: 210711 - DNA, 25 bp, Mus musculus
agtccacatctcacatggtgttgaa

SEQ ID NO: 210712 - DNA, 25 bp, Mus musculus
agtccacatctctcatggtgttgaa

SEQ ID NO: 210713 - DNA, 25 bp, Mus musculus
agtccacatgcgaaaatattctaat

SEQ ID NO: 210714 - DNA, 25 bp, Mus musculus
agtccacatgcgtaaatattctaat

SEQ ID NO: 210715 - DNA, 25 bp, Mus musculus
agtccaccacatatccgagataaaa

SEQ ID NO: 210716 - DNA, 25 bp, Mus musculus
agtccaccacatttccgagataaaa

SEQ ID NO: 210717 - DNA, 25 bp, Mus musculus
agtccaccagggagacacctcgtgg

SEQ ID NO: 210718 - DNA, 25 bp, Mus musculus
agtccaccagggtgacacctcgtgg

SEQ ID NO: 210719 - DNA, 25 bp, Mus musculus
agtccaccatgtcttgtgtgtgtgt

SEQ ID NO: 210720 - DNA, 25 bp, Mus musculus
agtccaccatgtgttgtgtgtgtgt

SEQ ID NO: 210721 - DNA, 25 bp, Mus musculus
agtccacccggcaggtagaacggag

SEQ ID NO: 210722 - DNA, 25 bp, Mus musculus
agtccacccggctggtagaacggag

SEQ ID NO: 210723 - DNA, 25 bp, Mus musculus
agtccaccggagagttcctgcaagt

SEQ ID NO: 210724 - DNA, 25 bp, Mus musculus
agtccaccggagtgttcctgcaagt

SEQ ID NO: 210725 - DNA, 25 bp, Mus musculus
agtccacctcccatcagaggcagaa

SEQ ID NO: 210726 - DNA, 25 bp, Mus musculus
agtccacctcccttcagaggcagaa

SEQ ID NO: 210727 - DNA, 25 bp, Mus musculus
agtccacctgggagtctgatattca

SEQ ID NO: 210728 - DNA, 25 bp, Mus musculus
agtccacctgggtgtctgatattca

SEQ ID NO: 210729 - DNA, 25 bp, Mus musculus
agtccacctggtatgattcagcaac

SEQ ID NO: 210730 - DNA, 25 bp, Mus musculus
agtccacctggtttgattcagcaac

SEQ ID NO: 210731 - DNA, 25 bp, Mus musculus
agtccaccttgtcggacaagtccaa

SEQ ID NO: 210732 - DNA, 25 bp, Mus musculus
agtccaccttgtgggacaagtccaa

SEQ ID NO: 210733 - DNA, 25 bp, Mus musculus
agtccacctttgctctcattgcaaa

SEQ ID NO: 210734 - DNA, 25 bp, Mus musculus
agtccacctttggtctcattgcaaa

SEQ ID NO: 210735 - DNA, 25 bp, Mus musculus
agtccacgagttaacagagtgctta

SEQ ID NO: 210736 - DNA, 25 bp, Mus musculus
agtccacgagttaagtagacactta

SEQ ID NO: 210737 - DNA, 25 bp, Mus musculus
agtccacgagtttacagagtgctta

SEQ ID NO: 210738 - DNA, 25 bp, Mus musculus
agtccacgagtttagtagacactta

SEQ ID NO: 210739 - DNA, 25 bp, Mus musculus
agtccacgctcacggaggccaagca

SEQ ID NO: 210740 - DNA, 25 bp, Mus musculus
agtccacgctcagggaggccaagca

SEQ ID NO: 210741 - DNA, 25 bp, Mus musculus
agtccacggtgaaggaggtgccctc

SEQ ID NO: 210742 - DNA, 25 bp, Mus musculus
agtccacggtgatggaggtgccctc

SEQ ID NO: 210743 - DNA, 25 bp, Mus musculus
agtccacgttcaacaggagttagta

SEQ ID NO: 210744 - DNA, 25 bp, Mus musculus
agtccacgttcatcaggagttagta

SEQ ID NO: 210745 - DNA, 25 bp, Mus musculus
agtccacgttttaacttgtccatgt

SEQ ID NO: 210746 - DNA, 25 bp, Mus musculus
agtccacgtttttacttgtccatgt

SEQ ID NO: 210747 - DNA, 25 bp, Mus musculus
agtccactcaagatttgatgccttt

SEQ ID NO: 210748 - DNA, 25 bp, Mus musculus
agtccactcaagttttgatgccttt

SEQ ID NO: 210749 - DNA, 25 bp, Mus musculus
agtccactccagaagatttcggcat

SEQ ID NO: 210750 - DNA, 25 bp, Mus musculus
agtccactccagtagatttcggcat

SEQ ID NO: 210751 - DNA, 25 bp, Mus musculus
agtccactctcgcaggacagattca

SEQ ID NO: 210752 - DNA, 25 bp, Mus musculus
agtccactctcggaggacagattca

SEQ ID NO: 210753 - DNA, 25 bp, Mus musculus
agtccactcttcagtggcaggcaaa

SEQ ID NO: 210754 - DNA, 25 bp, Mus musculus
agtccactcttctgtggcaggcaaa

SEQ ID NO: 210755 - DNA, 25 bp, Mus musculus
agtccactgaacatctgatccgcaa

SEQ ID NO: 210756 - DNA, 25 bp, Mus musculus
agtccactgaacttctgatccgcaa

SEQ ID NO: 210757 - DNA, 25 bp, Mus musculus
agtccactgacacccttgacattgt

SEQ ID NO: 210758 - DNA, 25 bp, Mus musculus
agtccactgacagccttgacattgt

SEQ ID NO: 210759 - DNA, 25 bp, Mus musculus
agtccactgcatagttctgcttact

SEQ ID NO: 210760 - DNA, 25 bp, Mus musculus
agtccactgcattgttctgcttact

SEQ ID NO: 210761 - DNA, 25 bp, Mus musculus
agtccactggctccatttgtgttac

SEQ ID NO: 210762 - DNA, 25 bp, Mus musculus
agtccactggctgcatttgtgttac

SEQ ID NO: 210763 - DNA, 25 bp, Mus musculus
agtccacttgatcattcctttctaa

SEQ ID NO: 210764 - DNA, 25 bp, Mus musculus
agtccacttgatgattcctttctaa

SEQ ID NO: 210765 - DNA, 25 bp, Mus musculus
agtccacttgccaagagtttcccag

SEQ ID NO: 210766 - DNA, 25 bp, Mus musculus
agtccacttgcctagagtttcccag

SEQ ID NO: 210767 - DNA, 25 bp, Mus musculus
agtccactttagctccaatatttta

SEQ ID NO: 210768 - DNA, 25 bp, Mus musculus
agtccactttaggtccaatatttta

SEQ ID NO: 210769 - DNA, 25 bp, Mus musculus
agtccacttttaatgctaggcacaa

SEQ ID NO: 210770 - DNA, 25 bp, Mus musculus
agtccacttttattgctaggcacaa

SEQ ID NO: 210771 - DNA, 25 bp, Mus musculus
agtccacttttccatggccttttgt

SEQ ID NO: 210772 - DNA, 25 bp, Mus musculus
agtccacttttcgatggccttttgt

SEQ ID NO: 210773 - DNA, 25 bp, Mus musculus
agtccagaaatcacttgccttttaa

SEQ ID NO: 210774 - DNA, 25 bp, Mus musculus
agtccagaaatctcttgccttttaa

SEQ ID NO: 210775 - DNA, 25 bp, Mus musculus
agtccagaactaatgtaacttgctg

SEQ ID NO: 210776 - DNA, 25 bp, Mus musculus
agtccagaactattgtaacttgctg

SEQ ID NO: 210777 - DNA, 25 bp, Mus musculus
agtccagaactcacagccatttttt

SEQ ID NO: 210778 - DNA, 25 bp, Mus musculus
agtccagaactctcagccatttttt

SEQ ID NO: 210779 - DNA, 25 bp, Mus musculus
agtccagaactgactctagtcctca

SEQ ID NO: 210780 - DNA, 25 bp, Mus musculus
agtccagaactgtctctagtcctca

SEQ ID NO: 210781 - DNA, 25 bp, Mus musculus
agtccagaagtcatggattctatgg

SEQ ID NO: 210782 - DNA, 25 bp, Mus musculus
agtccagaagtcttggattctatgg

SEQ ID NO: 210783 - DNA, 25 bp, Mus musculus
agtccagaatccatgcgaagagtgc

SEQ ID NO: 210784 - DNA, 25 bp, Mus musculus
agtccagaatccttgcgaagagtgc

SEQ ID NO: 210785 - DNA, 25 bp, Mus musculus
agtccagactatctgccgatccagg

SEQ ID NO: 210786 - DNA, 25 bp, Mus musculus
agtccagactatgtgccgatccagg

SEQ ID NO: 210787 - DNA, 25 bp, Mus musculus
agtccagactgaaccccagtgtggg

SEQ ID NO: 210788 - DNA, 25 bp, Mus musculus
agtccagactgatccccagtgtggg

SEQ ID NO: 210789 - DNA, 25 bp, Mus musculus
agtccagactgcacccagggcggct

SEQ ID NO: 210790 - DNA, 25 bp, Mus musculus
agtccagactgcattctgtccactt

SEQ ID NO: 210791 - DNA, 25 bp, Mus musculus
agtccagactgctcccagggcggct

SEQ ID NO: 210792 - DNA, 25 bp, Mus musculus
agtccagactgctttctgtccactt

SEQ ID NO: 210793 - DNA, 25 bp, Mus musculus
agtccagactgtatctctgtcagca

SEQ ID NO: 210794 - DNA, 25 bp, Mus musculus
agtccagactgtttctctgtcagca

SEQ ID NO: 210795 - DNA, 25 bp, Mus musculus
agtccagagacgaccatgtttgaaa

SEQ ID NO: 210796 - DNA, 25 bp, Mus musculus
agtccagagacgtccatgtttgaaa

SEQ ID NO: 210797 - DNA, 25 bp, Mus musculus
agtccagagcagcaacaccaaccag

SEQ ID NO: 210798 - DNA, 25 bp, Mus musculus
agtccagagcaggaacaccaaccag

SEQ ID NO: 210799 - DNA, 25 bp, Mus musculus
agtccagagcatatcttggctttca

SEQ ID NO: 210800 - DNA, 25 bp, Mus musculus
agtccagagcatttcttggctttca

SEQ ID NO: 210801 - DNA, 25 bp, Mus musculus
agtccagagccgagtccacgcgagg

SEQ ID NO: 210802 - DNA, 25 bp, Mus musculus
agtccagagccgtgtccacgcgagg

SEQ ID NO: 210803 - DNA, 25 bp, Mus musculus
agtccagagtgaccacatttccctt

SEQ ID NO: 210804 - DNA, 25 bp, Mus musculus
agtccagagtgagcacatttccctt

SEQ ID NO: 210805 - DNA, 25 bp, Mus musculus
agtccagatccaattctgcttagtc

SEQ ID NO: 210806 - DNA, 25 bp, Mus musculus
agtccagatccatttctgcttagtc

SEQ ID NO: 210807 - DNA, 25 bp, Mus musculus
agtccagatggcaaattctaaatat

SEQ ID NO: 210808 - DNA, 25 bp, Mus musculus
agtccagatggctaattctaaatat

SEQ ID NO: 210809 - DNA, 25 bp, Mus musculus
agtccagattgtccttccttcagat

SEQ ID NO: 210810 - DNA, 25 bp, Mus musculus
agtccagattgtgcttccttcagat

SEQ ID NO: 210811 - DNA, 25 bp, Mus musculus
agtccagcaaacatctgtgagtgtt

SEQ ID NO: 210812 - DNA, 25 bp, Mus musculus
agtccagcaaacttctgtgagtgtt

SEQ ID NO: 210813 - DNA, 25 bp, Mus musculus
agtccagcacttctacaacatcaaa

SEQ ID NO: 210814 - DNA, 25 bp, Mus musculus
agtccagcacttgtacaacatcaaa

SEQ ID NO: 210815 - DNA, 25 bp, Mus musculus
agtccagcagctccctaggaaaagt

SEQ ID NO: 210816 - DNA, 25 bp, Mus musculus
agtccagcagctgcctaggaaaagt

SEQ ID NO: 210817 - DNA, 25 bp, Mus musculus
agtccagcagtgagtcagtcttcca

SEQ ID NO: 210818 - DNA, 25 bp, Mus musculus
agtccagcagtgtgtcagtcttcca

SEQ ID NO: 210819 - DNA, 25 bp, Mus musculus
agtccagcatctctaacctggtctt

SEQ ID NO: 210820 - DNA, 25 bp, Mus musculus
agtccagcatctgtaacctggtctt

SEQ ID NO: 210821 - DNA, 25 bp, Mus musculus
agtccagcccatatcagtttgtcac

SEQ ID NO: 210822 - DNA, 25 bp, Mus musculus
agtccagcccatttcagtttgtcac

SEQ ID NO: 210823 - DNA, 25 bp, Mus musculus
agtccagccccaaggtaccgtaaat

SEQ ID NO: 210824 - DNA, 25 bp, Mus musculus
agtccagccccatggtaccgtaaat

SEQ ID NO: 210825 - DNA, 25 bp, Mus musculus
agtccagccctgaggaaagagcaag

SEQ ID NO: 210826 - DNA, 25 bp, Mus musculus
agtccagccctgtggaaagagcaag

SEQ ID NO: 210827 - DNA, 25 bp, Mus musculus
agtccagcgagtatctgccctgcgt

SEQ ID NO: 210828 - DNA, 25 bp, Mus musculus
agtccagcgagtttctgccctgcgt

SEQ ID NO: 210829 - DNA, 25 bp, Mus musculus
agtccagcgttaatcggtgaccccg

SEQ ID NO: 210830 - DNA, 25 bp, Mus musculus
agtccagcgttattcggtgaccccg

SEQ ID NO: 210831 - DNA, 25 bp, Mus musculus
agtccagctactcctcactcaggag

SEQ ID NO: 210832 - DNA, 25 bp, Mus musculus
agtccagctactgctcactcaggag

SEQ ID NO: 210833 - DNA, 25 bp, Mus musculus
agtccagctcacaccagatgatgat

SEQ ID NO: 210834 - DNA, 25 bp, Mus musculus
agtccagctcactccagatgatgat

SEQ ID NO: 210835 - DNA, 25 bp, Mus musculus
agtccagctctgctctctgtatttt

SEQ ID NO: 210836 - DNA, 25 bp, Mus musculus
agtccagctctggtctctgtatttt

SEQ ID NO: 210837 - DNA, 25 bp, Mus musculus
agtccagcttcaaaatctgagccat

SEQ ID NO: 210838 - DNA, 25 bp, Mus musculus
agtccagcttcataatctgagccat

SEQ ID NO: 210839 - DNA, 25 bp, Mus musculus
agtccagcttgtctgagtcagctca

SEQ ID NO: 210840 - DNA, 25 bp, Mus musculus
agtccagcttgtgtgagtcagctca

SEQ ID NO: 210841 - DNA, 25 bp, Mus musculus
agtccaggagccaggcttccagaaa

SEQ ID NO: 210842 - DNA, 25 bp, Mus musculus
agtccaggagcctggcttccagaaa

SEQ ID NO: 210843 - DNA, 25 bp, Mus musculus
agtccaggaggcattactcttccct

SEQ ID NO: 210844 - DNA, 25 bp, Mus musculus
agtccaggaggctttactcttccct

SEQ ID NO: 210845 - DNA, 25 bp, Mus musculus
agtccaggatatctgctcgatctca

SEQ ID NO: 210846 - DNA, 25 bp, Mus musculus
agtccaggatatgtgctcgatctca

SEQ ID NO: 210847 - DNA, 25 bp, Mus musculus
agtccaggatcaccagagtggaaat

SEQ ID NO: 210848 - DNA, 25 bp, Mus musculus
agtccaggatcagcagagtggaaat

SEQ ID NO: 210849 - DNA, 25 bp, Mus musculus
agtccaggatttactgatccccaag

SEQ ID NO: 210850 - DNA, 25 bp, Mus musculus
agtccaggattttctgatccccaag

SEQ ID NO: 210851 - DNA, 25 bp, Mus musculus
agtccaggcaagactaaaatacatt

SEQ ID NO: 210852 - DNA, 25 bp, Mus musculus
agtccaggcaagtctaaaatacatt

SEQ ID NO: 210853 - DNA, 25 bp, Mus musculus
agtccaggcaatcgcattcccagag

SEQ ID NO: 210854 - DNA, 25 bp, Mus musculus
agtccaggcaatggcattcccagag

SEQ ID NO: 210855 - DNA, 25 bp, Mus musculus
agtccaggcccaagctgaggataga

SEQ ID NO: 210856 - DNA, 25 bp, Mus musculus
agtccaggcccatgctgaggataga

SEQ ID NO: 210857 - DNA, 25 bp, Mus musculus
agtccaggccctatgtgggaaggca

SEQ ID NO: 210858 - DNA, 25 bp, Mus musculus
agtccaggccctttgtgggaaggca

SEQ ID NO: 210859 - DNA, 25 bp, Mus musculus
agtccaggccttacagtatacagac

SEQ ID NO: 210860 - DNA, 25 bp, Mus musculus
agtccaggccttagtgagccctagg

SEQ ID NO: 210861 - DNA, 25 bp, Mus musculus
agtccaggcctttcagtatacagac

SEQ ID NO: 210862 - DNA, 25 bp, Mus musculus
agtccaggcctttgtgagccctagg

SEQ ID NO: 210863 - DNA, 25 bp, Mus musculus
agtccaggctcccatttagggagtt

SEQ ID NO: 210864 - DNA, 25 bp, Mus musculus
agtccaggctccgatttagggagtt

SEQ ID NO: 210865 - DNA, 25 bp, Mus musculus
agtccaggctgacgctcatgctcag

SEQ ID NO: 210866 - DNA, 25 bp, Mus musculus
agtccaggctgaggctcatgctcag

SEQ ID NO: 210867 - DNA, 25 bp, Mus musculus
agtccaggctgcatggcatcctgcc

SEQ ID NO: 210868 - DNA, 25 bp, Mus musculus
agtccaggctgcttggcatcctgcc

SEQ ID NO: 210869 - DNA, 25 bp, Mus musculus
agtccaggctggatccttccaaggt

SEQ ID NO: 210870 - DNA, 25 bp, Mus musculus
agtccaggctggttccttccaaggt

SEQ ID NO: 210871 - DNA, 25 bp, Mus musculus
agtccagggcaaattgagctacaga

SEQ ID NO: 210872 - DNA, 25 bp, Mus musculus
agtccagggcaatttgagctacaga

SEQ ID NO: 210873 - DNA, 25 bp, Mus musculus
agtccagggcccatggctatacaaa

SEQ ID NO: 210874 - DNA, 25 bp, Mus musculus
agtccagggcccttggctatacaaa

SEQ ID NO: 210875 - DNA, 25 bp, Mus musculus
agtccagggtctaaggtgaaagcct

SEQ ID NO: 210876 - DNA, 25 bp, Mus musculus
agtccagggtctcccaagaatacac

SEQ ID NO: 210877 - DNA, 25 bp, Mus musculus
agtccagggtctgccaagaatacac

SEQ ID NO: 210878 - DNA, 25 bp, Mus musculus
agtccagggtcttaggtgaaagcct

SEQ ID NO: 210879 - DNA, 25 bp, Mus musculus
agtccaggtaaaacattcctattgg

SEQ ID NO: 210880 - DNA, 25 bp, Mus musculus
agtccaggtaaatcattcctattgg

SEQ ID NO: 210881 - DNA, 25 bp, Mus musculus
agtccaggtaccaccagtgcttaca

SEQ ID NO: 210882 - DNA, 25 bp, Mus musculus
agtccaggtacctccagtgcttaca

SEQ ID NO: 210883 - DNA, 25 bp, Mus musculus
agtccaggtctgaatgagtcacaag

SEQ ID NO: 210884 - DNA, 25 bp, Mus musculus
agtccaggtctgtatgagtcacaag

SEQ ID NO: 210885 - DNA, 25 bp, Mus musculus
agtccaggtgtgatactcaggcaaa

SEQ ID NO: 210886 - DNA, 25 bp, Mus musculus
agtccaggtgtgttactcaggcaaa

SEQ ID NO: 210887 - DNA, 25 bp, Mus musculus
agtccaggttgaaggacctcatctg

SEQ ID NO: 210888 - DNA, 25 bp, Mus musculus
agtccaggttgatggacctcatctg

SEQ ID NO: 210889 - DNA, 25 bp, Mus musculus
agtccagtaactattgcaccattta

SEQ ID NO: 210890 - DNA, 25 bp, Mus musculus
agtccagtaacttttgcaccattta

SEQ ID NO: 210891 - DNA, 25 bp, Mus musculus
agtccagtaagaaatcctccaattg

SEQ ID NO: 210892 - DNA, 25 bp, Mus musculus
agtccagtaagatatcctccaattg

SEQ ID NO: 210893 - DNA, 25 bp, Mus musculus
agtccagtaagcagtctgtcactca

SEQ ID NO: 210894 - DNA, 25 bp, Mus musculus
agtccagtaagctgtctgtcactca

SEQ ID NO: 210895 - DNA, 25 bp, Mus musculus
agtccagtacgaattgcctttaaca

SEQ ID NO: 210896 - DNA, 25 bp, Mus musculus
agtccagtacgatttgcctttaaca

SEQ ID NO: 210897 - DNA, 25 bp, Mus musculus
agtccagtatagagctgagcctcag

SEQ ID NO: 210898 - DNA, 25 bp, Mus musculus
agtccagtatagtgctgagcctcag

SEQ ID NO: 210899 - DNA, 25 bp, Mus musculus
agtccagtcacactgccccagggat

SEQ ID NO: 210900 - DNA, 25 bp, Mus musculus
agtccagtcacagtgccccagggat

SEQ ID NO: 210901 - DNA, 25 bp, Mus musculus
agtccagtccaacgcaattgtatta

SEQ ID NO: 210902 - DNA, 25 bp, Mus musculus
agtccagtccaaggcaattgtatta

SEQ ID NO: 210903 - DNA, 25 bp, Mus musculus
agtccagtccttatactgtgaggcg

SEQ ID NO: 210904 - DNA, 25 bp, Mus musculus
agtccagtccttttactgtgaggcg

SEQ ID NO: 210905 - DNA, 25 bp, Mus musculus
agtccagtcttaatttacatagcaa

SEQ ID NO: 210906 - DNA, 25 bp, Mus musculus
agtccagtcttattttacatagcaa

SEQ ID NO: 210907 - DNA, 25 bp, Mus musculus
agtccagtcttcaagaggatctatt

SEQ ID NO: 210908 - DNA, 25 bp, Mus musculus
agtccagtcttctagaggatctatt

SEQ ID NO: 210909 - DNA, 25 bp, Mus musculus
agtccagtgcgtacccaaggagcct

SEQ ID NO: 210910 - DNA, 25 bp, Mus musculus
agtccagtgcgttcccaaggagcct

SEQ ID NO: 210911 - DNA, 25 bp, Mus musculus
agtccagtgcttcttgtgccttgtg

SEQ ID NO: 210912 - DNA, 25 bp, Mus musculus
agtccagtgcttgttgtgccttgtg

SEQ ID NO: 210913 - DNA, 25 bp, Mus musculus
agtccagtggagagtttcctatccc

SEQ ID NO: 210914 - DNA, 25 bp, Mus musculus
agtccagtggagtgtttcctatccc

SEQ ID NO: 210915 - DNA, 25 bp, Mus musculus
agtccagtgtagcatccatcgttga

SEQ ID NO: 210916 - DNA, 25 bp, Mus musculus
agtccagtgtaggatccatcgttga

SEQ ID NO: 210917 - DNA, 25 bp, Mus musculus
agtccagtgtggcaacaggtcttct

SEQ ID NO: 210918 - DNA, 25 bp, Mus musculus
agtccagtgtgggaacaggtcttct

SEQ ID NO: 210919 - DNA, 25 bp, Mus musculus
agtccagtgttaactgtgctcactc

SEQ ID NO: 210920 - DNA, 25 bp, Mus musculus
agtccagtgttatctgtgctcactc

SEQ ID NO: 210921 - DNA, 25 bp, Mus musculus
agtccagtgttcaagaagaggcggt

SEQ ID NO: 210922 - DNA, 25 bp, Mus musculus
agtccagtgttcaccatgatgtatc

SEQ ID NO: 210923 - DNA, 25 bp, Mus musculus
agtccagtgttctagaagaggcggt

SEQ ID NO: 210924 - DNA, 25 bp, Mus musculus
agtccagtgttctccatgatgtatc

SEQ ID NO: 210925 - DNA, 25 bp, Mus musculus
agtccagttctcattttaaaagtca

SEQ ID NO: 210926 - DNA, 25 bp, Mus musculus
agtccagttctctttttaaaagtca

SEQ ID NO: 210927 - DNA, 25 bp, Mus musculus
agtccagttcttccatagtctcata

SEQ ID NO: 210928 - DNA, 25 bp, Mus musculus
agtccagttcttgcatagtctcata

SEQ ID NO: 210929 - DNA, 25 bp, Mus musculus
agtccagttgataaggtgctcccct

SEQ ID NO: 210930 - DNA, 25 bp, Mus musculus
agtccagttgattaggtgctcccct

SEQ ID NO: 210931 - DNA, 25 bp, Mus musculus
agtccagttgcacctactactaata

SEQ ID NO: 210932 - DNA, 25 bp, Mus musculus
agtccagttgcagctactactaata

SEQ ID NO: 210933 - DNA, 25 bp, Mus musculus
agtccagttgccaaagctttacttt

SEQ ID NO: 210934 - DNA, 25 bp, Mus musculus
agtccagttgcctaagctttacttt

SEQ ID NO: 210935 - DNA, 25 bp, Mus musculus
agtccagttggtcccttgtccttgt

SEQ ID NO: 210936 - DNA, 25 bp, Mus musculus
agtccagttggtgccttgtccttgt

SEQ ID NO: 210937 - DNA, 25 bp, Mus musculus
agtccagttgtcacagtatcgctag

SEQ ID NO: 210938 - DNA, 25 bp, Mus musculus
agtccagttgtctcagtatcgctag

SEQ ID NO: 210939 - DNA, 25 bp, Mus musculus
agtccagtttaacgtcttattgcag

SEQ ID NO: 210940 - DNA, 25 bp, Mus musculus
agtccagtttaaggtcttattgcag

SEQ ID NO: 210941 - DNA, 25 bp, Mus musculus
agtccagtttccaaaggtgcctctt

SEQ ID NO: 210942 - DNA, 25 bp, Mus musculus
agtccagtttcctaaggtgcctctt

SEQ ID NO: 210943 - DNA, 25 bp, Mus musculus
agtccagtttggagcacctgagcct

SEQ ID NO: 210944 - DNA, 25 bp, Mus musculus
agtccagtttggtgcacctgagcct

SEQ ID NO: 210945 - DNA, 25 bp, Mus musculus
agtccataaaccagctcaagatcca

SEQ ID NO: 210946 - DNA, 25 bp, Mus musculus
agtccataaacctgctcaagatcca

SEQ ID NO: 210947 - DNA, 25 bp, Mus musculus
agtccatacagcaggtttccttgat

SEQ ID NO: 210948 - DNA, 25 bp, Mus musculus
agtccatacagctggtttccttgat

SEQ ID NO: 210949 - DNA, 25 bp, Mus musculus
agtccatacatgaactactttcaga

SEQ ID NO: 210950 - DNA, 25 bp, Mus musculus
agtccatacatgtactactttcaga

SEQ ID NO: 210951 - DNA, 25 bp, Mus musculus
agtccatacggaacatcatgaccct

SEQ ID NO: 210952 - DNA, 25 bp, Mus musculus
agtccatacggatcatcatgaccct

SEQ ID NO: 210953 - DNA, 25 bp, Mus musculus
agtccatagctcctacatctttcaa

SEQ ID NO: 210954 - DNA, 25 bp, Mus musculus
agtccatagctcgtacatctttcaa

SEQ ID NO: 210955 - DNA, 25 bp, Mus musculus
agtccatagtgaagtgtcttctctt

SEQ ID NO: 210956 - DNA, 25 bp, Mus musculus
agtccatagtgatgtgtcttctctt

SEQ ID NO: 210957 - DNA, 25 bp, Mus musculus
agtccatatctgcacttgctcatag

SEQ ID NO: 210958 - DNA, 25 bp, Mus musculus
agtccatatctggacttgctcatag

SEQ ID NO: 210959 - DNA, 25 bp, Mus musculus
agtccatatggtcaactcatcctga

SEQ ID NO: 210960 - DNA, 25 bp, Mus musculus
agtccatatggtgaactcatcctga

SEQ ID NO: 210961 - DNA, 25 bp, Mus musculus
agtccatcaactcggtgctcttgag

SEQ ID NO: 210962 - DNA, 25 bp, Mus musculus
agtccatcaactgggtgctcttgag

SEQ ID NO: 210963 - DNA, 25 bp, Mus musculus
agtccatcaagcatgttgttcctat

SEQ ID NO: 210964 - DNA, 25 bp, Mus musculus
agtccatcaagcttgttgttcctat

SEQ ID NO: 210965 - DNA, 25 bp, Mus musculus
agtccatcacctagcactgagctgt

SEQ ID NO: 210966 - DNA, 25 bp, Mus musculus
agtccatcaccttgcactgagctgt

SEQ ID NO: 210967 - DNA, 25 bp, Mus musculus
agtccatcactacacagcagagcag

SEQ ID NO: 210968 - DNA, 25 bp, Mus musculus
agtccatcactagacagcagagcag

SEQ ID NO: 210969 - DNA, 25 bp, Mus musculus
agtccatcagatatatccctgtctc

SEQ ID NO: 210970 - DNA, 25 bp, Mus musculus
agtccatcagatttatccctgtctc

SEQ ID NO: 210971 - DNA, 25 bp, Mus musculus
agtccatcagggaggtggtctcgcc

SEQ ID NO: 210972 - DNA, 25 bp, Mus musculus
agtccatcagggtggtggtctcgcc

SEQ ID NO: 210973 - DNA, 25 bp, Mus musculus
agtccatcatttaactctcttgaag

SEQ ID NO: 210974 - DNA, 25 bp, Mus musculus
agtccatcatttatgaagagtaaag

SEQ ID NO: 210975 - DNA, 25 bp, Mus musculus
agtccatcattttactctcttgaag

SEQ ID NO: 210976 - DNA, 25 bp, Mus musculus
agtccatcatttttgaagagtaaag

SEQ ID NO: 210977 - DNA, 25 bp, Mus musculus
agtccatccaagagggcaaggcatg

SEQ ID NO: 210978 - DNA, 25 bp, Mus musculus
agtccatccaagtgggcaaggcatg

SEQ ID NO: 210979 - DNA, 25 bp, Mus musculus
agtccatccaatctcaaacagtcat

SEQ ID NO: 210980 - DNA, 25 bp, Mus musculus
agtccatccaatgtcaaacagtcat

SEQ ID NO: 210981 - DNA, 25 bp, Mus musculus
agtccatccatgagtccattgttag

SEQ ID NO: 210982 - DNA, 25 bp, Mus musculus
agtccatccatgtgtccattgttag

SEQ ID NO: 210983 - DNA, 25 bp, Mus musculus
agtccatccctgcagaaagtttttg

SEQ ID NO: 210984 - DNA, 25 bp, Mus musculus
agtccatccctggagaaagtttttg

SEQ ID NO: 210985 - DNA, 25 bp, Mus musculus
agtccatccttccagttctgtggct

SEQ ID NO: 210986 - DNA, 25 bp, Mus musculus
agtccatccttcgagttctgtggct

SEQ ID NO: 210987 - DNA, 25 bp, Mus musculus
agtccatcgtgaccggatgtcagga

SEQ ID NO: 210988 - DNA, 25 bp, Mus musculus
agtccatcgtgagcggatgtcagga

SEQ ID NO: 210989 - DNA, 25 bp, Mus musculus
agtccatctaagcaaccccatagtg

SEQ ID NO: 210990 - DNA, 25 bp, Mus musculus
agtccatctaaggaaccccatagtg

SEQ ID NO: 210991 - DNA, 25 bp, Mus musculus
agtccatctcttcctcaactgaaaa

SEQ ID NO: 210992 - DNA, 25 bp, Mus musculus
agtccatctcttgctcaactgaaaa

SEQ ID NO: 210993 - DNA, 25 bp, Mus musculus
agtccatctgcaccatgttactcat

SEQ ID NO: 210994 - DNA, 25 bp, Mus musculus
agtccatctgcagcatgttactcat

SEQ ID NO: 210995 - DNA, 25 bp, Mus musculus
agtccatctgctagtgcaagttcca

SEQ ID NO: 210996 - DNA, 25 bp, Mus musculus
agtccatctgcttgtgcaagttcca

SEQ ID NO: 210997 - DNA, 25 bp, Mus musculus
agtccatctgtcctggagtttcccg

SEQ ID NO: 210998 - DNA, 25 bp, Mus musculus
agtccatctgtcgtggagtttcccg

SEQ ID NO: 210999 - DNA, 25 bp, Mus musculus
agtccatcttccattgtttactgaa

SEQ ID NO: 211000 - DNA, 25 bp, Mus musculus
agtccatcttcctttgtttactgaa

SEQ ID NO: 211001 - DNA, 25 bp, Mus musculus
agtccatcttgtactcaggcagagg

SEQ ID NO: 211002 - DNA, 25 bp, Mus musculus
agtccatcttgttctcaggcagagg

SEQ ID NO: 211003 - DNA, 25 bp, Mus musculus
agtccatgacacatagtccagcctt

SEQ ID NO: 211004 - DNA, 25 bp, Mus musculus
agtccatgacacttagtccagcctt

SEQ ID NO: 211005 - DNA, 25 bp, Mus musculus
agtccatgagtaatgaattcccaga

SEQ ID NO: 211006 - DNA, 25 bp, Mus musculus
agtccatgagtattgaattcccaga

SEQ ID NO: 211007 - DNA, 25 bp, Mus musculus
agtccatgatccacctagtaagggt

SEQ ID NO: 211008 - DNA, 25 bp, Mus musculus
agtccatgatcctcctagtaagggt

SEQ ID NO: 211009 - DNA, 25 bp, Mus musculus
agtccatgatggagtggtccccagt

SEQ ID NO: 211010 - DNA, 25 bp, Mus musculus
agtccatgatggtgtggtccccagt

SEQ ID NO: 211011 - DNA, 25 bp, Mus musculus
agtccatgcaggcttccagtacgag

SEQ ID NO: 211012 - DNA, 25 bp, Mus musculus
agtccatgcagggttccagtacgag

SEQ ID NO: 211013 - DNA, 25 bp, Mus musculus
agtccatgcatcattgcatctctaa

SEQ ID NO: 211014 - DNA, 25 bp, Mus musculus
agtccatgcatctttgcatctctaa

SEQ ID NO: 211015 - DNA, 25 bp, Mus musculus
agtccatgcctgacatagacatctt

SEQ ID NO: 211016 - DNA, 25 bp, Mus musculus
agtccatgcctgcatcttgcggata

SEQ ID NO: 211017 - DNA, 25 bp, Mus musculus
agtccatgcctggatcttgcggata

SEQ ID NO: 211018 - DNA, 25 bp, Mus musculus
agtccatgcctgtcatagacatctt

SEQ ID NO: 211019 - DNA, 25 bp, Mus musculus
agtccatggcttatacttctcttaa

SEQ ID NO: 211020 - DNA, 25 bp, Mus musculus
agtccatggcttttacttctcttaa

SEQ ID NO: 211021 - DNA, 25 bp, Mus musculus
agtccatgggacagttgcctacaca

SEQ ID NO: 211022 - DNA, 25 bp, Mus musculus
agtccatgggactgttgcctacaca

SEQ ID NO: 211023 - DNA, 25 bp, Mus musculus
agtccatgggctaggctacttctga

SEQ ID NO: 211024 - DNA, 25 bp, Mus musculus
agtccatgggcttggctacttctga

SEQ ID NO: 211025 - DNA, 25 bp, Mus musculus
agtccatgtcctaccttttcagaaa

SEQ ID NO: 211026 - DNA, 25 bp, Mus musculus
agtccatgtccttccttttcagaaa

SEQ ID NO: 211027 - DNA, 25 bp, Mus musculus
agtccatgtgtcaaaggtttagctt

SEQ ID NO: 211028 - DNA, 25 bp, Mus musculus
agtccatgtgtctaaggtttagctt

SEQ ID NO: 211029 - DNA, 25 bp, Mus musculus
agtccatgtgtgatctgagtcccaa

SEQ ID NO: 211030 - DNA, 25 bp, Mus musculus
agtccatgtgtgttctgagtcccaa

SEQ ID NO: 211031 - DNA, 25 bp, Mus musculus
agtccatgttctcatagctttatat

SEQ ID NO: 211032 - DNA, 25 bp, Mus musculus
agtccatgttctgatagctttatat

SEQ ID NO: 211033 - DNA, 25 bp, Mus musculus
agtccatgtttcaatcatttagcag

SEQ ID NO: 211034 - DNA, 25 bp, Mus musculus
agtccatgtttctatcatttagcag

SEQ ID NO: 211035 - DNA, 25 bp, Mus musculus
agtccatgttttctgagccatccaa

SEQ ID NO: 211036 - DNA, 25 bp, Mus musculus
agtccatgttttgtgagccatccaa

SEQ ID NO: 211037 - DNA, 25 bp, Mus musculus
agtccattatccaaactgagtcgtt

SEQ ID NO: 211038 - DNA, 25 bp, Mus musculus
agtccattatcctaactgagtcgtt

SEQ ID NO: 211039 - DNA, 25 bp, Mus musculus
agtccattccatagcttgtttctca

SEQ ID NO: 211040 - DNA, 25 bp, Mus musculus
agtccattccattgcttgtttctca

SEQ ID NO: 211041 - DNA, 25 bp, Mus musculus
agtccattcccaagcagagtcgtgg

SEQ ID NO: 211042 - DNA, 25 bp, Mus musculus
agtccattcccatgcagagtcgtgg

SEQ ID NO: 211043 - DNA, 25 bp, Mus musculus
agtccattctggacaggtgacaact

SEQ ID NO: 211044 - DNA, 25 bp, Mus musculus
agtccattctggtcaggtgacaact

SEQ ID NO: 211045 - DNA, 25 bp, Mus musculus
agtccattgatacccgtgtgtgtgt

SEQ ID NO: 211046 - DNA, 25 bp, Mus musculus
agtccattgatagccgtgtgtgtgt

SEQ ID NO: 211047 - DNA, 25 bp, Mus musculus
agtccattgatgaatctcttctctg

SEQ ID NO: 211048 - DNA, 25 bp, Mus musculus
agtccattgatgtatctcttctctg

SEQ ID NO: 211049 - DNA, 25 bp, Mus musculus
agtccattgtcaactagttgtcctt

SEQ ID NO: 211050 - DNA, 25 bp, Mus musculus
agtccattgtcatctagttgtcctt

SEQ ID NO: 211051 - DNA, 25 bp, Mus musculus
agtccattgttcatgagctctaggc

SEQ ID NO: 211052 - DNA, 25 bp, Mus musculus
agtccattgttcttgagctctaggc

SEQ ID NO: 211053 - DNA, 25 bp, Mus musculus
agtccattgttgaaggaacacctgc

SEQ ID NO: 211054 - DNA, 25 bp, Mus musculus
agtccattgttgacctccaaagaaa

SEQ ID NO: 211055 - DNA, 25 bp, Mus musculus
agtccattgttgtaggaacacctgc

SEQ ID NO: 211056 - DNA, 25 bp, Mus musculus
agtccattgttgtcctccaaagaaa

SEQ ID NO: 211057 - DNA, 25 bp, Mus musculus
agtccatttaataaggccgtatcaa

SEQ ID NO: 211058 - DNA, 25 bp, Mus musculus
agtccatttaattaggccgtatcaa

SEQ ID NO: 211059 - DNA, 25 bp, Mus musculus
agtccatttactaaaccagctataa

SEQ ID NO: 211060 - DNA, 25 bp, Mus musculus
agtccatttacttaaccagctataa

SEQ ID NO: 211061 - DNA, 25 bp, Mus musculus
agtccatttcatctttttggccaaa

SEQ ID NO: 211062 - DNA, 25 bp, Mus musculus
agtccatttcatgtttttggccaaa

SEQ ID NO: 211063 - DNA, 25 bp, Mus musculus
agtccatttctgctgaacatgcaaa

SEQ ID NO: 211064 - DNA, 25 bp, Mus musculus
agtccatttctggtgaacatgcaaa

SEQ ID NO: 211065 - DNA, 25 bp, Mus musculus
agtccatttgccctacatagaagat

SEQ ID NO: 211066 - DNA, 25 bp, Mus musculus
agtccatttgccgtacatagaagat

SEQ ID NO: 211067 - DNA, 25 bp, Mus musculus
agtcccaaagctcggaggcagcgaa

SEQ ID NO: 211068 - DNA, 25 bp, Mus musculus
agtcccaaagctgggaggcagcgaa

SEQ ID NO: 211069 - DNA, 25 bp, Mus musculus
agtcccaacatgaatgagtctgacg

SEQ ID NO: 211070 - DNA, 25 bp, Mus musculus
agtcccaacatgtatgagtctgacg

SEQ ID NO: 211071 - DNA, 25 bp, Mus musculus
agtcccaaccgtctgtttgctttat

SEQ ID NO: 211072 - DNA, 25 bp, Mus musculus
agtcccaaccgtgtgtttgctttat

SEQ ID NO: 211073 - DNA, 25 bp, Mus musculus
agtcccaagaggctcattctaaagc

SEQ ID NO: 211074 - DNA, 25 bp, Mus musculus
agtcccaagagggtcattctaaagc

SEQ ID NO: 211075 - DNA, 25 bp, Mus musculus
agtcccaagatcagtcccatattat

SEQ ID NO: 211076 - DNA, 25 bp, Mus musculus
agtcccaagatctgtcccatattat

SEQ ID NO: 211077 - DNA, 25 bp, Mus musculus
agtcccaagcacagtctgtagcaga

SEQ ID NO: 211078 - DNA, 25 bp, Mus musculus
agtcccaagcactgtctgtagcaga

SEQ ID NO: 211079 - DNA, 25 bp, Mus musculus
agtcccaagctcattcattggcttc

SEQ ID NO: 211080 - DNA, 25 bp, Mus musculus
agtcccaagctctttcattggcttc

SEQ ID NO: 211081 - DNA, 25 bp, Mus musculus
agtcccaaggtcaccatgactttat

SEQ ID NO: 211082 - DNA, 25 bp, Mus musculus
agtcccaaggtctccatgactttat

SEQ ID NO: 211083 - DNA, 25 bp, Mus musculus
agtcccaagtgtatacctgcagagg

SEQ ID NO: 211084 - DNA, 25 bp, Mus musculus
agtcccaagtgtttacctgcagagg

SEQ ID NO: 211085 - DNA, 25 bp, Mus musculus
agtcccacaaatccccagttgtagg

SEQ ID NO: 211086 - DNA, 25 bp, Mus musculus
agtcccacaaatgcccagttgtagg

SEQ ID NO: 211087 - DNA, 25 bp, Mus musculus
agtcccacaggcaacatatccttat

SEQ ID NO: 211088 - DNA, 25 bp, Mus musculus
agtcccacaggctacatatccttat

SEQ ID NO: 211089 - DNA, 25 bp, Mus musculus
agtcccacagtcctgcatggaggaa

SEQ ID NO: 211090 - DNA, 25 bp, Mus musculus
agtcccacagtcgtgcatggaggaa

SEQ ID NO: 211091 - DNA, 25 bp, Mus musculus
agtcccacatgcctcatgtcttggt

SEQ ID NO: 211092 - DNA, 25 bp, Mus musculus
agtcccacatgcgtcatgtcttggt

SEQ ID NO: 211093 - DNA, 25 bp, Mus musculus
agtcccaccacaatccaggttggaa

SEQ ID NO: 211094 - DNA, 25 bp, Mus musculus
agtcccaccacattccaggttggaa

SEQ ID NO: 211095 - DNA, 25 bp, Mus musculus
agtcccaccaggatgacaagatgat

SEQ ID NO: 211096 - DNA, 25 bp, Mus musculus
agtcccaccaggcttatatattgag

SEQ ID NO: 211097 - DNA, 25 bp, Mus musculus
agtcccaccagggttatatattgag

SEQ ID NO: 211098 - DNA, 25 bp, Mus musculus
agtcccaccaggttgacaagatgat

SEQ ID NO: 211099 - DNA, 25 bp, Mus musculus
agtcccaccatgctcgagtttcttc

SEQ ID NO: 211100 - DNA, 25 bp, Mus musculus
agtcccaccatggtcgagtttcttc

SEQ ID NO: 211101 - DNA, 25 bp, Mus musculus
agtcccacggctctattgctgtgaa

SEQ ID NO: 211102 - DNA, 25 bp, Mus musculus
agtcccacggctgtattgctgtgaa

SEQ ID NO: 211103 - DNA, 25 bp, Mus musculus
agtcccacgggccttgagagctttg

SEQ ID NO: 211104 - DNA, 25 bp, Mus musculus
agtcccacgggcgttgagagctttg

SEQ ID NO: 211105 - DNA, 25 bp, Mus musculus
agtcccactgagacccaggtgagat

SEQ ID NO: 211106 - DNA, 25 bp, Mus musculus
agtcccactgagtcccaggtgagat

SEQ ID NO: 211107 - DNA, 25 bp, Mus musculus
agtcccactgtacatatctgtattt

SEQ ID NO: 211108 - DNA, 25 bp, Mus musculus
agtcccactgtagatatctgtattt

SEQ ID NO: 211109 - DNA, 25 bp, Mus musculus
agtcccacttacacaagctgcagct

SEQ ID NO: 211110 - DNA, 25 bp, Mus musculus
agtcccacttactcaagctgcagct

SEQ ID NO: 211111 - DNA, 25 bp, Mus musculus
agtcccagaagacctcagggtggct

SEQ ID NO: 211112 - DNA, 25 bp, Mus musculus
agtcccagaagagctcagggtggct

SEQ ID NO: 211113 - DNA, 25 bp, Mus musculus
agtcccagactaccttggcagtgca

SEQ ID NO: 211114 - DNA, 25 bp, Mus musculus
agtcccagactagcttggcagtgca

SEQ ID NO: 211115 - DNA, 25 bp, Mus musculus
agtcccagagccattatcgccgcag

SEQ ID NO: 211116 - DNA, 25 bp, Mus musculus
agtcccagagcctttatcgccgcag

SEQ ID NO: 211117 - DNA, 25 bp, Mus musculus
agtcccagaggtcacactgtcaagt

SEQ ID NO: 211118 - DNA, 25 bp, Mus musculus
agtcccagaggtgacactgtcaagt

SEQ ID NO: 211119 - DNA, 25 bp, Mus musculus
agtcccagatctaacttctttgaca

SEQ ID NO: 211120 - DNA, 25 bp, Mus musculus
agtcccagatcttacttctttgaca

SEQ ID NO: 211121 - DNA, 25 bp, Mus musculus
agtcccagcaggcaggcttgctgaa

SEQ ID NO: 211122 - DNA, 25 bp, Mus musculus
agtcccagcagggaggcttgctgaa

SEQ ID NO: 211123 - DNA, 25 bp, Mus musculus
agtcccagcccgagagaccaaaggc

SEQ ID NO: 211124 - DNA, 25 bp, Mus musculus
agtcccagcccgtgagaccaaaggc

SEQ ID NO: 211125 - DNA, 25 bp, Mus musculus
agtcccagcctactttggtgctcga

SEQ ID NO: 211126 - DNA, 25 bp, Mus musculus
agtcccagcctagtttggtgctcga

SEQ ID NO: 211127 - DNA, 25 bp, Mus musculus
agtcccagcctgcatattgtgttga

SEQ ID NO: 211128 - DNA, 25 bp, Mus musculus
agtcccagcctggatattgtgttga

SEQ ID NO: 211129 - DNA, 25 bp, Mus musculus
agtcccagctacaatcacaaatgtc

SEQ ID NO: 211130 - DNA, 25 bp, Mus musculus
agtcccagctactatcacaaatgtc

SEQ ID NO: 211131 - DNA, 25 bp, Mus musculus
agtcccaggagacctcacagaacag

SEQ ID NO: 211132 - DNA, 25 bp, Mus musculus
agtcccaggagagctcacagaacag

SEQ ID NO: 211133 - DNA, 25 bp, Mus musculus
agtcccaggcagaccgattttttag

SEQ ID NO: 211134 - DNA, 25 bp, Mus musculus
agtcccaggcagtccgattttttag

SEQ ID NO: 211135 - DNA, 25 bp, Mus musculus
agtcccaggcatccttctgtatctg

SEQ ID NO: 211136 - DNA, 25 bp, Mus musculus
agtcccaggcatgcttctgtatctg

SEQ ID NO: 211137 - DNA, 25 bp, Mus musculus
agtcccaggctaccgtgggctacat

SEQ ID NO: 211138 - DNA, 25 bp, Mus musculus
agtcccaggctagcgtgggctacat

SEQ ID NO: 211139 - DNA, 25 bp, Mus musculus
agtcccaggttcacaattctagttg

SEQ ID NO: 211140 - DNA, 25 bp, Mus musculus
agtcccaggttctcaattctagttg

SEQ ID NO: 211141 - DNA, 25 bp, Mus musculus
agtcccataaacagatccttccagg

SEQ ID NO: 211142 - DNA, 25 bp, Mus musculus
agtcccataaactgatccttccagg

SEQ ID NO: 211143 - DNA, 25 bp, Mus musculus
agtcccatcaagagtggctgacctc

SEQ ID NO: 211144 - DNA, 25 bp, Mus musculus
agtcccatcaagatctttctctctg

SEQ ID NO: 211145 - DNA, 25 bp, Mus musculus
agtcccatcaagtgtggctgacctc

SEQ ID NO: 211146 - DNA, 25 bp, Mus musculus
agtcccatcaagttctttctctctg

SEQ ID NO: 211147 - DNA, 25 bp, Mus musculus
agtcccatcagcagcaaacctggat

SEQ ID NO: 211148 - DNA, 25 bp, Mus musculus
agtcccatcagctgcaaacctggat

SEQ ID NO: 211149 - DNA, 25 bp, Mus musculus
agtcccatcataccacctcttagag

SEQ ID NO: 211150 - DNA, 25 bp, Mus musculus
agtcccatcatagcacctcttagag

SEQ ID NO: 211151 - DNA, 25 bp, Mus musculus
agtcccatctgaagttgccacattg

SEQ ID NO: 211152 - DNA, 25 bp, Mus musculus
agtcccatctgatgttgccacattg

SEQ ID NO: 211153 - DNA, 25 bp, Mus musculus
agtcccatggtcactgtttctaata

SEQ ID NO: 211154 - DNA, 25 bp, Mus musculus
agtcccatggtctctgtttctaata

SEQ ID NO: 211155 - DNA, 25 bp, Mus musculus
agtcccatgtatccacagggctgaa

SEQ ID NO: 211156 - DNA, 25 bp, Mus musculus
agtcccatgtatgcacagggctgaa

SEQ ID NO: 211157 - DNA, 25 bp, Mus musculus
agtcccatgtctacagatctgctga

SEQ ID NO: 211158 - DNA, 25 bp, Mus musculus
agtcccatgtctatttccacacttt

SEQ ID NO: 211159 - DNA, 25 bp, Mus musculus
agtcccatgtctcattgttggttcc

SEQ ID NO: 211160 - DNA, 25 bp, Mus musculus
agtcccatgtctgattgttggttcc

SEQ ID NO: 211161 - DNA, 25 bp, Mus musculus
agtcccatgtcttcagatctgctga

SEQ ID NO: 211162 - DNA, 25 bp, Mus musculus
agtcccatgtctttttccacacttt

SEQ ID NO: 211163 - DNA, 25 bp, Mus musculus
agtcccatgttcacatttgcttcag

SEQ ID NO: 211164 - DNA, 25 bp, Mus musculus
agtcccatgttctcatttgcttcag

SEQ ID NO: 211165 - DNA, 25 bp, Mus musculus
agtcccattaccatttggcaaggca

SEQ ID NO: 211166 - DNA, 25 bp, Mus musculus
agtcccattaccttttggcaaggca

SEQ ID NO: 211167 - DNA, 25 bp, Mus musculus
agtcccattttgaccaccgaataga

SEQ ID NO: 211168 - DNA, 25 bp, Mus musculus
agtcccattttgattgtcttatctg

SEQ ID NO: 211169 - DNA, 25 bp, Mus musculus
agtcccattttgtccaccgaataga

SEQ ID NO: 211170 - DNA, 25 bp, Mus musculus
agtcccattttgtttgtcttatctg

SEQ ID NO: 211171 - DNA, 25 bp, Mus musculus
agtcccatttttacaaggtcttgtg

SEQ ID NO: 211172 - DNA, 25 bp, Mus musculus
agtcccattttttcaaggtcttgtg

SEQ ID NO: 211173 - DNA, 25 bp, Mus musculus
agtccccaaatcagtcacactgtgt

SEQ ID NO: 211174 - DNA, 25 bp, Mus musculus
agtccccaaatcctagaaacctctg

SEQ ID NO: 211175 - DNA, 25 bp, Mus musculus
agtccccaaatcgtagaaacctctg

SEQ ID NO: 211176 - DNA, 25 bp, Mus musculus
agtccccaaatctgtcacactgtgt

SEQ ID NO: 211177 - DNA, 25 bp, Mus musculus
agtccccaaattccatgtggtagga

SEQ ID NO: 211178 - DNA, 25 bp, Mus musculus
agtccccaaattgcatgtggtagga

SEQ ID NO: 211179 - DNA, 25 bp, Mus musculus
agtccccaagagcagctctgtggat

SEQ ID NO: 211180 - DNA, 25 bp, Mus musculus
agtccccaagaggagctctgtggat

SEQ ID NO: 211181 - DNA, 25 bp, Mus musculus
agtccccacagcctctggtgtgtgc

SEQ ID NO: 211182 - DNA, 25 bp, Mus musculus
agtccccacagcgtctggtgtgtgc

SEQ ID NO: 211183 - DNA, 25 bp, Mus musculus
agtccccaccgcagtatattttgat

SEQ ID NO: 211184 - DNA, 25 bp, Mus musculus
agtccccaccgctgtatattttgat

SEQ ID NO: 211185 - DNA, 25 bp, Mus musculus
agtccccacctcagtagaggctgtc

SEQ ID NO: 211186 - DNA, 25 bp, Mus musculus
agtccccacctctgtagaggctgtc

SEQ ID NO: 211187 - DNA, 25 bp, Mus musculus
agtccccactagcaggaacaagcag

SEQ ID NO: 211188 - DNA, 25 bp, Mus musculus
agtccccactaggaggaacaagcag

SEQ ID NO: 211189 - DNA, 25 bp, Mus musculus
agtccccactttctgttcatcacat

SEQ ID NO: 211190 - DNA, 25 bp, Mus musculus
agtccccactttgtgttcatcacat

SEQ ID NO: 211191 - DNA, 25 bp, Mus musculus
agtccccagagccaatcagaagctt

SEQ ID NO: 211192 - DNA, 25 bp, Mus musculus
agtccccagagcgaatcagaagctt

SEQ ID NO: 211193 - DNA, 25 bp, Mus musculus
agtccccaggagagggcacatctta

SEQ ID NO: 211194 - DNA, 25 bp, Mus musculus
agtccccaggagtgggcacatctta

SEQ ID NO: 211195 - DNA, 25 bp, Mus musculus
agtccccatcagagtgttcattttg

SEQ ID NO: 211196 - DNA, 25 bp, Mus musculus
agtccccatcagtgtgttcattttg

SEQ ID NO: 211197 - DNA, 25 bp, Mus musculus
agtccccatccaagcaccatttttt

SEQ ID NO: 211198 - DNA, 25 bp, Mus musculus
agtccccatccatgcaccatttttt

SEQ ID NO: 211199 - DNA, 25 bp, Mus musculus
agtccccatgacagtacattctact

SEQ ID NO: 211200 - DNA, 25 bp, Mus musculus
agtccccatgactgtacattctact

SEQ ID NO: 211201 - DNA, 25 bp, Mus musculus
agtccccatgcacactagaaaagtg

SEQ ID NO: 211202 - DNA, 25 bp, Mus musculus
agtccccatgcagactagaaaagtg

SEQ ID NO: 211203 - DNA, 25 bp, Mus musculus
agtccccattaaccacatagagaag

SEQ ID NO: 211204 - DNA, 25 bp, Mus musculus
agtccccattaagcacatagagaag

SEQ ID NO: 211205 - DNA, 25 bp, Mus musculus
agtccccattcaatttcctgagttc

SEQ ID NO: 211206 - DNA, 25 bp, Mus musculus
agtccccattcattttcctgagttc

SEQ ID NO: 211207 - DNA, 25 bp, Mus musculus
agtccccgagatccgacttgggaga

SEQ ID NO: 211208 - DNA, 25 bp, Mus musculus
agtccccgagatgcgacttgggaga

SEQ ID NO: 211209 - DNA, 25 bp, Mus musculus
agtccccgagcgctcttgttggttt

SEQ ID NO: 211210 - DNA, 25 bp, Mus musculus
agtccccgagcggtcttgttggttt

SEQ ID NO: 211211 - DNA, 25 bp, Mus musculus
agtccccggagccaggtgagtcatc

SEQ ID NO: 211212 - DNA, 25 bp, Mus musculus
agtccccggagcgaggtgagtcatc

SEQ ID NO: 211213 - DNA, 25 bp, Mus musculus
agtccccggatgattcgtcagctct

SEQ ID NO: 211214 - DNA, 25 bp, Mus musculus
agtccccggatgtttcgtcagctct

SEQ ID NO: 211215 - DNA, 25 bp, Mus musculus
agtccccggtgtatctcagggatgt

SEQ ID NO: 211216 - DNA, 25 bp, Mus musculus
agtccccggtgtttctcagggatgt

SEQ ID NO: 211217 - DNA, 25 bp, Mus musculus
agtccccgtggaaagtctctgaaga

SEQ ID NO: 211218 - DNA, 25 bp, Mus musculus
agtccccgtggatagtctctgaaga

SEQ ID NO: 211219 - DNA, 25 bp, Mus musculus
agtcccctagatcgtaccttctgtg

SEQ ID NO: 211220 - DNA, 25 bp, Mus musculus
agtcccctagatggtaccttctgtg

SEQ ID NO: 211221 - DNA, 25 bp, Mus musculus
agtcccctatcccaggagatggttt

SEQ ID NO: 211222 - DNA, 25 bp, Mus musculus
agtcccctatccgaggagatggttt

SEQ ID NO: 211223 - DNA, 25 bp, Mus musculus
agtcccctcatcaggcttctgtagc

SEQ ID NO: 211224 - DNA, 25 bp, Mus musculus
agtcccctcatctggcttctgtagc

SEQ ID NO: 211225 - DNA, 25 bp, Mus musculus
agtcccctctgtctgccaagagctg

SEQ ID NO: 211226 - DNA, 25 bp, Mus musculus
agtcccctctgtgtgccaagagctg

SEQ ID NO: 211227 - DNA, 25 bp, Mus musculus
agtcccctgagtcattctattccca

SEQ ID NO: 211228 - DNA, 25 bp, Mus musculus
agtcccctgagtgattctattccca

SEQ ID NO: 211229 - DNA, 25 bp, Mus musculus
agtcccctgctgaaaaagcttctat

SEQ ID NO: 211230 - DNA, 25 bp, Mus musculus
agtcccctgctgtaaaagcttctat

SEQ ID NO: 211231 - DNA, 25 bp, Mus musculus
agtcccctggaaagatttgtatcta

SEQ ID NO: 211232 - DNA, 25 bp, Mus musculus
agtcccctggaatgatttgtatcta

SEQ ID NO: 211233 - DNA, 25 bp, Mus musculus
agtcccctggtcagtcacttaagga

SEQ ID NO: 211234 - DNA, 25 bp, Mus musculus
agtcccctggtctgtcacttaagga

SEQ ID NO: 211235 - DNA, 25 bp, Mus musculus
agtccccttcacaaccggtggtcag

SEQ ID NO: 211236 - DNA, 25 bp, Mus musculus
agtccccttcactaccggtggtcag

SEQ ID NO: 211237 - DNA, 25 bp, Mus musculus
agtccccttcttatcaagacatctg

SEQ ID NO: 211238 - DNA, 25 bp, Mus musculus
agtccccttcttttcaagacatctg

SEQ ID NO: 211239 - DNA, 25 bp, Mus musculus
agtccccttgataatgagctccata

SEQ ID NO: 211240 - DNA, 25 bp, Mus musculus
agtccccttgattatgagctccata

SEQ ID NO: 211241 - DNA, 25 bp, Mus musculus
agtcccctttcgctagtgatggttg

SEQ ID NO: 211242 - DNA, 25 bp, Mus musculus
agtcccctttcggtagtgatggttg

SEQ ID NO: 211243 - DNA, 25 bp, Mus musculus
agtcccctttgaattgtgatcttgt

SEQ ID NO: 211244 - DNA, 25 bp, Mus musculus
agtcccctttgatttgtgatcttgt

SEQ ID NO: 211245 - DNA, 25 bp, Mus musculus
agtcccctttggcattttcatgtat

SEQ ID NO: 211246 - DNA, 25 bp, Mus musculus
agtcccctttgggattttcatgtat

SEQ ID NO: 211247 - DNA, 25 bp, Mus musculus
agtcccgacactagatgccttattg

SEQ ID NO: 211248 - DNA, 25 bp, Mus musculus
agtcccgacacttgatgccttattg

SEQ ID NO: 211249 - DNA, 25 bp, Mus musculus
agtcccgagaagaactcagcttcat

SEQ ID NO: 211250 - DNA, 25 bp, Mus musculus
agtcccgagaagtactcagcttcat

SEQ ID NO: 211251 - DNA, 25 bp, Mus musculus
agtcccgagacgctctgctgctgcg

SEQ ID NO: 211252 - DNA, 25 bp, Mus musculus
agtcccgagacggtctgctgctgcg

SEQ ID NO: 211253 - DNA, 25 bp, Mus musculus
agtcccgagactaggctaaggcatt

SEQ ID NO: 211254 - DNA, 25 bp, Mus musculus
agtcccgagacttggctaaggcatt

SEQ ID NO: 211255 - DNA, 25 bp, Mus musculus
agtcccgagagtacagagatgccca

SEQ ID NO: 211256 - DNA, 25 bp, Mus musculus
agtcccgagagttcagagatgccca

SEQ ID NO: 211257 - DNA, 25 bp, Mus musculus
agtcccgagatactccatgtggttt

SEQ ID NO: 211258 - DNA, 25 bp, Mus musculus
agtcccgagatagtccatgtggttt

SEQ ID NO: 211259 - DNA, 25 bp, Mus musculus
agtcccgagtgcagactcatgtgca

SEQ ID NO: 211260 - DNA, 25 bp, Mus musculus
agtcccgagtgctgactcatgtgca

SEQ ID NO: 211261 - DNA, 25 bp, Mus musculus
agtcccgcagccagagcagcattgt

SEQ ID NO: 211262 - DNA, 25 bp, Mus musculus
agtcccgcagcctgagcagcattgt

SEQ ID NO: 211263 - DNA, 25 bp, Mus musculus
agtcccgccctgagcagaatgaatg

SEQ ID NO: 211264 - DNA, 25 bp, Mus musculus
agtcccgccctgtgcagaatgaatg

SEQ ID NO: 211265 - DNA, 25 bp, Mus musculus
agtcccgccgatatagattggtcca

SEQ ID NO: 211266 - DNA, 25 bp, Mus musculus
agtcccgccgatttagattggtcca

SEQ ID NO: 211267 - DNA, 25 bp, Mus musculus
agtcccgcgattaaggcgaccgagc

SEQ ID NO: 211268 - DNA, 25 bp, Mus musculus
agtcccgcgatttaggcgaccgagc

SEQ ID NO: 211269 - DNA, 25 bp, Mus musculus
agtcccgcgtttcaaagcaacagca

SEQ ID NO: 211270 - DNA, 25 bp, Mus musculus
agtcccgcgtttgaaagcaacagca

SEQ ID NO: 211271 - DNA, 25 bp, Mus musculus
agtcccgctccgacaaggtgaagat

SEQ ID NO: 211272 - DNA, 25 bp, Mus musculus
agtcccgctccgtcaaggtgaagat

SEQ ID NO: 211273 - DNA, 25 bp, Mus musculus
agtcccgctgtgcagtggccttgca

SEQ ID NO: 211274 - DNA, 25 bp, Mus musculus
agtcccgctgtggagtggccttgca

SEQ ID NO: 211275 - DNA, 25 bp, Mus musculus
agtcccggaagacttctgactgtta

SEQ ID NO: 211276 - DNA, 25 bp, Mus musculus
agtcccggaagagttctgactgtta

SEQ ID NO: 211277 - DNA, 25 bp, Mus musculus
agtcccggatgaagatcccagattg

SEQ ID NO: 211278 - DNA, 25 bp, Mus musculus
agtcccggatgatgatcccagattg

SEQ ID NO: 211279 - DNA, 25 bp, Mus musculus
agtcccggcctcatctcggagggaa

SEQ ID NO: 211280 - DNA, 25 bp, Mus musculus
agtcccggcctcttctcggagggaa

SEQ ID NO: 211281 - DNA, 25 bp, Mus musculus
agtcccggctggatttccactgagc

SEQ ID NO: 211282 - DNA, 25 bp, Mus musculus
agtcccggctggttttccactgagc

SEQ ID NO: 211283 - DNA, 25 bp, Mus musculus
agtcccgtcactatcagctgcatga

SEQ ID NO: 211284 - DNA, 25 bp, Mus musculus
agtcccgtcactttcagctgcatga

SEQ ID NO: 211285 - DNA, 25 bp, Mus musculus
agtcccgtgcctagccatcagtatg

SEQ ID NO: 211286 - DNA, 25 bp, Mus musculus
agtcccgtgccttgccatcagtatg

SEQ ID NO: 211287 - DNA, 25 bp, Mus musculus
agtcccgttcaaatacacaatctgc

SEQ ID NO: 211288 - DNA, 25 bp, Mus musculus
agtcccgttcaattacacaatctgc

SEQ ID NO: 211289 - DNA, 25 bp, Mus musculus
agtccctaagggactgaggtacaga

SEQ ID NO: 211290 - DNA, 25 bp, Mus musculus
agtccctaagggtctgaggtacaga

SEQ ID NO: 211291 - DNA, 25 bp, Mus musculus
agtccctaagtcattggcttcatgc

SEQ ID NO: 211292 - DNA, 25 bp, Mus musculus
agtccctaagtctttggcttcatgc

SEQ ID NO: 211293 - DNA, 25 bp, Mus musculus
agtccctacaataaagtcctctggt

SEQ ID NO: 211294 - DNA, 25 bp, Mus musculus
agtccctacaattaagtcctctggt

SEQ ID NO: 211295 - DNA, 25 bp, Mus musculus
agtccctagctgctggcacagagat

SEQ ID NO: 211296 - DNA, 25 bp, Mus musculus
agtccctagctggtggcacagagat

SEQ ID NO: 211297 - DNA, 25 bp, Mus musculus
agtccctagtcaaaacaatgagtct

SEQ ID NO: 211298 - DNA, 25 bp, Mus musculus
agtccctagtcataacaatgagtct

SEQ ID NO: 211299 - DNA, 25 bp, Mus musculus
agtccctagtccatgtcattcaggt

SEQ ID NO: 211300 - DNA, 25 bp, Mus musculus
agtccctagtccttgtcattcaggt

SEQ ID NO: 211301 - DNA, 25 bp, Mus musculus
agtccctcaactagtcacgtcagaa

SEQ ID NO: 211302 - DNA, 25 bp, Mus musculus
agtccctcaacttgtcacgtcagaa

SEQ ID NO: 211303 - DNA, 25 bp, Mus musculus
agtccctcactcagtcttggataaa

SEQ ID NO: 211304 - DNA, 25 bp, Mus musculus
agtccctcactctgtcttggataaa

SEQ ID NO: 211305 - DNA, 25 bp, Mus musculus
agtccctcagctcttcttgtttaaa

SEQ ID NO: 211306 - DNA, 25 bp, Mus musculus
agtccctcagctgttcttgtttaaa

SEQ ID NO: 211307 - DNA, 25 bp, Mus musculus
agtccctcaggcatcctgcatctgg

SEQ ID NO: 211308 - DNA, 25 bp, Mus musculus
agtccctcaggcttcctgcatctgg

SEQ ID NO: 211309 - DNA, 25 bp, Mus musculus
agtccctcatagcactggtgaatga

SEQ ID NO: 211310 - DNA, 25 bp, Mus musculus
agtccctcataggactggtgaatga

SEQ ID NO: 211311 - DNA, 25 bp, Mus musculus
agtccctcatatcgcgttcacataa

SEQ ID NO: 211312 - DNA, 25 bp, Mus musculus
agtccctcatatggcgttcacataa

SEQ ID NO: 211313 - DNA, 25 bp, Mus musculus
agtccctcatgcagtggccacagga

SEQ ID NO: 211314 - DNA, 25 bp, Mus musculus
agtccctcatgctgtggccacagga

SEQ ID NO: 211315 - DNA, 25 bp, Mus musculus
agtccctccaaactgctttaagtgt

SEQ ID NO: 211316 - DNA, 25 bp, Mus musculus
agtccctccaaagtgctttaagtgt

SEQ ID NO: 211317 - DNA, 25 bp, Mus musculus
agtccctccatgcatactgcatgct

SEQ ID NO: 211318 - DNA, 25 bp, Mus musculus
agtccctccatggatactgcatgct

SEQ ID NO: 211319 - DNA, 25 bp, Mus musculus
agtccctcccagagatgagtctgag

SEQ ID NO: 211320 - DNA, 25 bp, Mus musculus
agtccctcccagtgatgagtctgag

SEQ ID NO: 211321 - DNA, 25 bp, Mus musculus
agtccctccgatctaaagcttcgta

SEQ ID NO: 211322 - DNA, 25 bp, Mus musculus
agtccctccgatgtaaagcttcgta

SEQ ID NO: 211323 - DNA, 25 bp, Mus musculus
agtccctctctaaaggctcagaatt

SEQ ID NO: 211324 - DNA, 25 bp, Mus musculus
agtccctctctataggctcagaatt

SEQ ID NO: 211325 - DNA, 25 bp, Mus musculus
agtccctctgagctgccagtgtcag

SEQ ID NO: 211326 - DNA, 25 bp, Mus musculus
agtccctctgaggtgccagtgtcag

SEQ ID NO: 211327 - DNA, 25 bp, Mus musculus
agtccctctgccaccaggaaagttt

SEQ ID NO: 211328 - DNA, 25 bp, Mus musculus
agtccctctgcctccaggaaagttt

SEQ ID NO: 211329 - DNA, 25 bp, Mus musculus
agtccctctgtaaaatgatcttcat

SEQ ID NO: 211330 - DNA, 25 bp, Mus musculus
agtccctctgtataatgatcttcat

SEQ ID NO: 211331 - DNA, 25 bp, Mus musculus
agtccctcttctaaggtctgaacta

SEQ ID NO: 211332 - DNA, 25 bp, Mus musculus
agtccctcttcttaggtctgaacta

SEQ ID NO: 211333 - DNA, 25 bp, Mus musculus
agtccctgaattcatgattcctgta

SEQ ID NO: 211334 - DNA, 25 bp, Mus musculus
agtccctgaattgatgattcctgta

SEQ ID NO: 211335 - DNA, 25 bp, Mus musculus
agtccctgacagagagcgtcttgga

SEQ ID NO: 211336 - DNA, 25 bp, Mus musculus
agtccctgacagtgagcgtcttgga

SEQ ID NO: 211337 - DNA, 25 bp, Mus musculus
agtccctgatccatgaaagctctga

SEQ ID NO: 211338 - DNA, 25 bp, Mus musculus
agtccctgatccttgaaagctctga

SEQ ID NO: 211339 - DNA, 25 bp, Mus musculus
agtccctgatctatgatggctgagc

SEQ ID NO: 211340 - DNA, 25 bp, Mus musculus
agtccctgatctttgatggctgagc

SEQ ID NO: 211341 - DNA, 25 bp, Mus musculus
agtccctgattgctgttttccaaaa

SEQ ID NO: 211342 - DNA, 25 bp, Mus musculus
agtccctgattggtgttttccaaaa

SEQ ID NO: 211343 - DNA, 25 bp, Mus musculus
agtccctgccagcttgtaatagata

SEQ ID NO: 211344 - DNA, 25 bp, Mus musculus
agtccctgccaggttgtaatagata

SEQ ID NO: 211345 - DNA, 25 bp, Mus musculus
agtccctgcctgaaagcgcgataag

SEQ ID NO: 211346 - DNA, 25 bp, Mus musculus
agtccctgcctgtaagcgcgataag

SEQ ID NO: 211347 - DNA, 25 bp, Mus musculus
agtccctggaaaccactcgtcaatt

SEQ ID NO: 211348 - DNA, 25 bp, Mus musculus
agtccctggaaagcactcgtcaatt

SEQ ID NO: 211349 - DNA, 25 bp, Mus musculus
agtccctggaccagtgaggctagca

SEQ ID NO: 211350 - DNA, 25 bp, Mus musculus
agtccctggacctgtgaggctagca

SEQ ID NO: 211351 - DNA, 25 bp, Mus musculus
agtccctggatcctacacagctaat

SEQ ID NO: 211352 - DNA, 25 bp, Mus musculus
agtccctggatcgtacacagctaat

SEQ ID NO: 211353 - DNA, 25 bp, Mus musculus
agtccctggcaaccttcaaatccaa

SEQ ID NO: 211354 - DNA, 25 bp, Mus musculus
agtccctggcaagcttcaaatccaa

SEQ ID NO: 211355 - DNA, 25 bp, Mus musculus
agtccctgggacacatcgtgaaaga

SEQ ID NO: 211356 - DNA, 25 bp, Mus musculus
agtccctgggactcatcgtgaaaga

SEQ ID NO: 211357 - DNA, 25 bp, Mus musculus
agtccctgggtcctgagcctaatca

SEQ ID NO: 211358 - DNA, 25 bp, Mus musculus
agtccctgggtcgtgagcctaatca

SEQ ID NO: 211359 - DNA, 25 bp, Mus musculus
agtccctgtaggaaactcgcatccg

SEQ ID NO: 211360 - DNA, 25 bp, Mus musculus
agtccctgtaggtaactcgcatccg

SEQ ID NO: 211361 - DNA, 25 bp, Mus musculus
agtccctgttgaagaaggcttgcca

SEQ ID NO: 211362 - DNA, 25 bp, Mus musculus
agtccctgttgatgaaggcttgcca

SEQ ID NO: 211363 - DNA, 25 bp, Mus musculus
agtccctgttgcagatacctttgag

SEQ ID NO: 211364 - DNA, 25 bp, Mus musculus
agtccctgttgctgatacctttgag

SEQ ID NO: 211365 - DNA, 25 bp, Mus musculus
agtcccttaccgagtgattgaggct

SEQ ID NO: 211366 - DNA, 25 bp, Mus musculus
agtcccttaccgtgtgattgaggct

SEQ ID NO: 211367 - DNA, 25 bp, Mus musculus
agtcccttagtgaacatcagagaat

SEQ ID NO: 211368 - DNA, 25 bp, Mus musculus
agtcccttagtgtacatcagagaat

SEQ ID NO: 211369 - DNA, 25 bp, Mus musculus
agtcccttagttcgctgtttctact

SEQ ID NO: 211370 - DNA, 25 bp, Mus musculus
agtcccttagttggctgtttctact

SEQ ID NO: 211371 - DNA, 25 bp, Mus musculus
agtcccttatctaacaccaggaata

SEQ ID NO: 211372 - DNA, 25 bp, Mus musculus
agtcccttatctccaggacatcagt

SEQ ID NO: 211373 - DNA, 25 bp, Mus musculus
agtcccttatctgcaggacatcagt

SEQ ID NO: 211374 - DNA, 25 bp, Mus musculus
agtcccttatcttacaccaggaata

SEQ ID NO: 211375 - DNA, 25 bp, Mus musculus
agtcccttccaacaggcgagtgctt

SEQ ID NO: 211376 - DNA, 25 bp, Mus musculus
agtcccttccaagaggcgagtgctt

SEQ ID NO: 211377 - DNA, 25 bp, Mus musculus
agtcccttcctacaatcattatttc

SEQ ID NO: 211378 - DNA, 25 bp, Mus musculus
agtcccttcctagaatcattatttc

SEQ ID NO: 211379 - DNA, 25 bp, Mus musculus
agtcccttccttcttcgatgatgca

SEQ ID NO: 211380 - DNA, 25 bp, Mus musculus
agtcccttccttgttcgatgatgca

SEQ ID NO: 211381 - DNA, 25 bp, Mus musculus
agtcccttcgaactagtggctcagt

SEQ ID NO: 211382 - DNA, 25 bp, Mus musculus
agtcccttcgaagtagtggctcagt

SEQ ID NO: 211383 - DNA, 25 bp, Mus musculus
agtcccttctgacctggttcaggag

SEQ ID NO: 211384 - DNA, 25 bp, Mus musculus
agtcccttctgagctggttcaggag

SEQ ID NO: 211385 - DNA, 25 bp, Mus musculus
agtcccttgctaatcacttctatag

SEQ ID NO: 211386 - DNA, 25 bp, Mus musculus
agtcccttgctattcacttctatag

SEQ ID NO: 211387 - DNA, 25 bp, Mus musculus
agtcccttgggtagcaatgtcgtac

SEQ ID NO: 211388 - DNA, 25 bp, Mus musculus
agtcccttgggtcgtgagtctaatc

SEQ ID NO: 211389 - DNA, 25 bp, Mus musculus
agtcccttgggtggtgagtctaatc

SEQ ID NO: 211390 - DNA, 25 bp, Mus musculus
agtcccttgggttgcaatgtcgtac

SEQ ID NO: 211391 - DNA, 25 bp, Mus musculus
agtcccttgtcaacatcaatgtcaa

SEQ ID NO: 211392 - DNA, 25 bp, Mus musculus
agtcccttgtcatcatcaatgtcaa

SEQ ID NO: 211393 - DNA, 25 bp, Mus musculus
agtcccttgtccagtgtaaacatgg

SEQ ID NO: 211394 - DNA, 25 bp, Mus musculus
agtcccttgtcctgtgtaaacatgg

SEQ ID NO: 211395 - DNA, 25 bp, Mus musculus
agtcccttgttccagtacttctttg

SEQ ID NO: 211396 - DNA, 25 bp, Mus musculus
agtcccttgttcgagtacttctttg

SEQ ID NO: 211397 - DNA, 25 bp, Mus musculus
agtccctttctcaagctaggcaaga

SEQ ID NO: 211398 - DNA, 25 bp, Mus musculus
agtccctttctctagctaggcaaga

SEQ ID NO: 211399 - DNA, 25 bp, Mus musculus
agtccctttctgacagcactgagcc

SEQ ID NO: 211400 - DNA, 25 bp, Mus musculus
agtccctttctgtcagcactgagcc

SEQ ID NO: 211401 - DNA, 25 bp, Mus musculus
agtccctttgtgatgttgtcattca

SEQ ID NO: 211402 - DNA, 25 bp, Mus musculus
agtccctttgtgttgttgtcattca

SEQ ID NO: 211403 - DNA, 25 bp, Mus musculus
agtccctttgttattgaggctgtct

SEQ ID NO: 211404 - DNA, 25 bp, Mus musculus
agtccctttgtttttgaggctgtct

SEQ ID NO: 211405 - DNA, 25 bp, Mus musculus
agtcccttttatcagtgccccagct

SEQ ID NO: 211406 - DNA, 25 bp, Mus musculus
agtcccttttatgagtgccccagct

SEQ ID NO: 211407 - DNA, 25 bp, Mus musculus
agtcccttttctcagtgtgcatgca

SEQ ID NO: 211408 - DNA, 25 bp, Mus musculus
agtcccttttctgagtgtgcatgca

SEQ ID NO: 211409 - DNA, 25 bp, Mus musculus
agtccgaactctcctgtgagtgtgc

SEQ ID NO: 211410 - DNA, 25 bp, Mus musculus
agtccgaactctgctgtgagtgtgc

SEQ ID NO: 211411 - DNA, 25 bp, Mus musculus
agtccgacatatctcacctttggaa

SEQ ID NO: 211412 - DNA, 25 bp, Mus musculus
agtccgacatatgtcacctttggaa

SEQ ID NO: 211413 - DNA, 25 bp, Mus musculus
agtccgactgatcacagagctccac

SEQ ID NO: 211414 - DNA, 25 bp, Mus musculus
agtccgactgatgacagagctccac

SEQ ID NO: 211415 - DNA, 25 bp, Mus musculus
agtccgagagttcattgctgaggca

SEQ ID NO: 211416 - DNA, 25 bp, Mus musculus
agtccgagagttgattgctgaggca

SEQ ID NO: 211417 - DNA, 25 bp, Mus musculus
agtccgagcgcaacgcgtcgtgcgc

SEQ ID NO: 211418 - DNA, 25 bp, Mus musculus
agtccgagcgcatcgcgtcgtgcgc

SEQ ID NO: 211419 - DNA, 25 bp, Mus musculus
agtccgatggtgactgggctgacct

SEQ ID NO: 211420 - DNA, 25 bp, Mus musculus
agtccgatggtgtctgggctgacct

SEQ ID NO: 211421 - DNA, 25 bp, Mus musculus
agtccgatgtctatttggtggagca

SEQ ID NO: 211422 - DNA, 25 bp, Mus musculus
agtccgatgtctttttggtggagca

SEQ ID NO: 211423 - DNA, 25 bp, Mus musculus
agtccgcccacaagtataatcctgt

SEQ ID NO: 211424 - DNA, 25 bp, Mus musculus
agtccgcccacatgtataatcctgt

SEQ ID NO: 211425 - DNA, 25 bp, Mus musculus
agtccgccctgaaatgacctaacaa

SEQ ID NO: 211426 - DNA, 25 bp, Mus musculus
agtccgccctgatatgacctaacaa

SEQ ID NO: 211427 - DNA, 25 bp, Mus musculus
agtccgctcagcaatatcttggagg

SEQ ID NO: 211428 - DNA, 25 bp, Mus musculus
agtccgctcagctatatcttggagg

SEQ ID NO: 211429 - DNA, 25 bp, Mus musculus
agtccggagcccacccagtgaattt

SEQ ID NO: 211430 - DNA, 25 bp, Mus musculus
agtccggagccctcccagtgaattt

SEQ ID NO: 211431 - DNA, 25 bp, Mus musculus
agtccggcaagcctatgacggcaga

SEQ ID NO: 211432 - DNA, 25 bp, Mus musculus
agtccggcaagcgtatgacggcaga

SEQ ID NO: 211433 - DNA, 25 bp, Mus musculus
agtccggccttccaacaatgtggtt

SEQ ID NO: 211434 - DNA, 25 bp, Mus musculus
agtccggccttcgaacaatgtggtt

SEQ ID NO: 211435 - DNA, 25 bp, Mus musculus
agtccgggagtaatggctgccatca

SEQ ID NO: 211436 - DNA, 25 bp, Mus musculus
agtccgggagtattggctgccatca

SEQ ID NO: 211437 - DNA, 25 bp, Mus musculus
agtccgggcctcaatggctacgaga

SEQ ID NO: 211438 - DNA, 25 bp, Mus musculus
agtccgggcctctatggctacgaga

SEQ ID NO: 211439 - DNA, 25 bp, Mus musculus
agtccgggtcttccaaaatgtgcaa

SEQ ID NO: 211440 - DNA, 25 bp, Mus musculus
agtccgggtcttgcaaaatgtgcaa

SEQ ID NO: 211441 - DNA, 25 bp, Mus musculus
agtccgggtgtaatcagcctgcagc

SEQ ID NO: 211442 - DNA, 25 bp, Mus musculus
agtccgggtgtattcagcctgcagc

SEQ ID NO: 211443 - DNA, 25 bp, Mus musculus
agtccggtgcggacaccgtgaccag

SEQ ID NO: 211444 - DNA, 25 bp, Mus musculus
agtccggtgcggtcaccgtgaccag

SEQ ID NO: 211445 - DNA, 25 bp, Mus musculus
agtccggtttggatgctggccacag

SEQ ID NO: 211446 - DNA, 25 bp, Mus musculus
agtccggtttggttgctggccacag

SEQ ID NO: 211447 - DNA, 25 bp, Mus musculus
agtccgtagattcagttggttggta

SEQ ID NO: 211448 - DNA, 25 bp, Mus musculus
agtccgtagattgagttggttggta

SEQ ID NO: 211449 - DNA, 25 bp, Mus musculus
agtccgtcacgcaggcggtggtgta

SEQ ID NO: 211450 - DNA, 25 bp, Mus musculus
agtccgtcacgctggcggtggtgta

SEQ ID NO: 211451 - DNA, 25 bp, Mus musculus
agtccgtgagcacatgagagtctgt

SEQ ID NO: 211452 - DNA, 25 bp, Mus musculus
agtccgtgagcagatgagagtctgt

SEQ ID NO: 211453 - DNA, 25 bp, Mus musculus
agtccgtgctcacgctggctcttag

SEQ ID NO: 211454 - DNA, 25 bp, Mus musculus
agtccgtgctcaggctggctcttag

SEQ ID NO: 211455 - DNA, 25 bp, Mus musculus
agtccgtggacacccaagcatggga

SEQ ID NO: 211456 - DNA, 25 bp, Mus musculus
agtccgtggacagccaagcatggga

SEQ ID NO: 211457 - DNA, 25 bp, Mus musculus
agtccgtggaccagatgtcctgtgt

SEQ ID NO: 211458 - DNA, 25 bp, Mus musculus
agtccgtggacctgatgtcctgtgt

SEQ ID NO: 211459 - DNA, 25 bp, Mus musculus
agtccgtggccaagccgatagagtc

SEQ ID NO: 211460 - DNA, 25 bp, Mus musculus
agtccgtggccatgccgatagagtc

SEQ ID NO: 211461 - DNA, 25 bp, Mus musculus
agtccgtgggcactagagttcttgc

SEQ ID NO: 211462 - DNA, 25 bp, Mus musculus
agtccgtgggcagtagagttcttgc

SEQ ID NO: 211463 - DNA, 25 bp, Mus musculus
agtccgtggtcccttagaacgcagg

SEQ ID NO: 211464 - DNA, 25 bp, Mus musculus
agtccgtggtccgttagaacgcagg

SEQ ID NO: 211465 - DNA, 25 bp, Mus musculus
agtccgtgtcttcggtatgcaaatc

SEQ ID NO: 211466 - DNA, 25 bp, Mus musculus
agtccgtgtcttgggtatgcaaatc

SEQ ID NO: 211467 - DNA, 25 bp, Mus musculus
agtccgtgttcaccacaaaggcctt

SEQ ID NO: 211468 - DNA, 25 bp, Mus musculus
agtccgtgttcagcacaaaggcctt

SEQ ID NO: 211469 - DNA, 25 bp, Mus musculus
agtccgttagtactcagtgccgtcc

SEQ ID NO: 211470 - DNA, 25 bp, Mus musculus
agtccgttagtagtcagtgccgtcc

SEQ ID NO: 211471 - DNA, 25 bp, Mus musculus
agtccgttcctccaggattagcttc

SEQ ID NO: 211472 - DNA, 25 bp, Mus musculus
agtccgttcctcgaggattagcttc

SEQ ID NO: 211473 - DNA, 25 bp, Mus musculus
agtccgttgggaattgaagctcatg

SEQ ID NO: 211474 - DNA, 25 bp, Mus musculus
agtccgttgggatttgaagctcatg

SEQ ID NO: 211475 - DNA, 25 bp, Mus musculus
agtcctaaacgtctgtgtggccaac

SEQ ID NO: 211476 - DNA, 25 bp, Mus musculus
agtcctaaacgtgtgtgtggccaac

SEQ ID NO: 211477 - DNA, 25 bp, Mus musculus
agtcctaacaaacaaatgcgctctt

SEQ ID NO: 211478 - DNA, 25 bp, Mus musculus
agtcctaacaaagaaatgcgctctt

SEQ ID NO: 211479 - DNA, 25 bp, Mus musculus
agtcctaacaggcatggtaagttgt

SEQ ID NO: 211480 - DNA, 25 bp, Mus musculus
agtcctaacagggatggtaagttgt

SEQ ID NO: 211481 - DNA, 25 bp, Mus musculus
agtcctaaccttaactcagagtgat

SEQ ID NO: 211482 - DNA, 25 bp, Mus musculus
agtcctaacctttactcagagtgat

SEQ ID NO: 211483 - DNA, 25 bp, Mus musculus
agtcctaacggcattctcgggagat

SEQ ID NO: 211484 - DNA, 25 bp, Mus musculus
agtcctaacggctttctcgggagat

SEQ ID NO: 211485 - DNA, 25 bp, Mus musculus
agtcctaagatcagtgatattcaaa

SEQ ID NO: 211486 - DNA, 25 bp, Mus musculus
agtcctaagatctgtgatattcaaa

SEQ ID NO: 211487 - DNA, 25 bp, Mus musculus
agtcctaagatgcaaggagccctac

SEQ ID NO: 211488 - DNA, 25 bp, Mus musculus
agtcctaagatggaaggagccctac

SEQ ID NO: 211489 - DNA, 25 bp, Mus musculus
agtcctaagattcctccactataag

SEQ ID NO: 211490 - DNA, 25 bp, Mus musculus
agtcctaagattgctccactataag

SEQ ID NO: 211491 - DNA, 25 bp, Mus musculus
agtcctaagcccaagatttcctggt

SEQ ID NO: 211492 - DNA, 25 bp, Mus musculus
agtcctaagccctagatttcctggt

SEQ ID NO: 211493 - DNA, 25 bp, Mus musculus
agtcctaagctgaccactggagaca

SEQ ID NO: 211494 - DNA, 25 bp, Mus musculus
agtcctaagctgtccactggagaca

SEQ ID NO: 211495 - DNA, 25 bp, Mus musculus
agtcctaagtcacggtctcttttgt

SEQ ID NO: 211496 - DNA, 25 bp, Mus musculus
agtcctaagtcagggtctcttttgt

SEQ ID NO: 211497 - DNA, 25 bp, Mus musculus
agtcctaatttgactaggcctcata

SEQ ID NO: 211498 - DNA, 25 bp, Mus musculus
agtcctaatttgtctaggcctcata

SEQ ID NO: 211499 - DNA, 25 bp, Mus musculus
agtcctacaaaaatatacctgaatg

SEQ ID NO: 211500 - DNA, 25 bp, Mus musculus
agtcctacaaaattatacctgaatg

SEQ ID NO: 211501 - DNA, 25 bp, Mus musculus
agtcctacacagaaatgtcccctgt

SEQ ID NO: 211502 - DNA, 25 bp, Mus musculus
agtcctacacagtaatgtcccctgt

SEQ ID NO: 211503 - DNA, 25 bp, Mus musculus
agtcctacacgaagatgtgcgaccc

SEQ ID NO: 211504 - DNA, 25 bp, Mus musculus
agtcctacacgatgatgtgcgaccc

SEQ ID NO: 211505 - DNA, 25 bp, Mus musculus
agtcctacagacaagaggccctggg

SEQ ID NO: 211506 - DNA, 25 bp, Mus musculus
agtcctacagactagaggccctggg

SEQ ID NO: 211507 - DNA, 25 bp, Mus musculus
agtcctacatgtaacactatccaag

SEQ ID NO: 211508 - DNA, 25 bp, Mus musculus
agtcctacatgttacactatccaag

SEQ ID NO: 211509 - DNA, 25 bp, Mus musculus
agtcctaccactcccaaggatctgt

SEQ ID NO: 211510 - DNA, 25 bp, Mus musculus
agtcctaccactgccaaggatctgt

SEQ ID NO: 211511 - DNA, 25 bp, Mus musculus
agtcctaccctgaggccaacgggat

SEQ ID NO: 211512 - DNA, 25 bp, Mus musculus
agtcctaccctgtggccaacgggat

SEQ ID NO: 211513 - DNA, 25 bp, Mus musculus
agtcctacctgcagttttgtatatt

SEQ ID NO: 211514 - DNA, 25 bp, Mus musculus
agtcctacctgctgttttgtatatt

SEQ ID NO: 211515 - DNA, 25 bp, Mus musculus
agtcctaccttaaccatgagcacat

SEQ ID NO: 211516 - DNA, 25 bp, Mus musculus
agtcctaccttatccatgagcacat

SEQ ID NO: 211517 - DNA, 25 bp, Mus musculus
agtcctagctctatgtctcctacat

SEQ ID NO: 211518 - DNA, 25 bp, Mus musculus
agtcctagctctttgtctcctacat

SEQ ID NO: 211519 - DNA, 25 bp, Mus musculus
agtcctagcttgagttgcactgcat

SEQ ID NO: 211520 - DNA, 25 bp, Mus musculus
agtcctagcttgtgttgcactgcat

SEQ ID NO: 211521 - DNA, 25 bp, Mus musculus
agtcctagtaccacttttatggcaa

SEQ ID NO: 211522 - DNA, 25 bp, Mus musculus
agtcctagtacctcttttatggcaa

SEQ ID NO: 211523 - DNA, 25 bp, Mus musculus
agtcctagtcatctctcggtcagta

SEQ ID NO: 211524 - DNA, 25 bp, Mus musculus
agtcctagtcatgtctcggtcagta

SEQ ID NO: 211525 - DNA, 25 bp, Mus musculus
agtcctatccaacgtacctctggag

SEQ ID NO: 211526 - DNA, 25 bp, Mus musculus
agtcctatccaaggtacctctggag

SEQ ID NO: 211527 - DNA, 25 bp, Mus musculus
agtcctatgggaagttgagaatgca

SEQ ID NO: 211528 - DNA, 25 bp, Mus musculus
agtcctatgggatgttgagaatgca

SEQ ID NO: 211529 - DNA, 25 bp, Mus musculus
agtcctatgggccaagcctggtagt

SEQ ID NO: 211530 - DNA, 25 bp, Mus musculus
agtcctatgggcgaagcctggtagt

SEQ ID NO: 211531 - DNA, 25 bp, Mus musculus
agtcctatgtccagtcaaactgtca

SEQ ID NO: 211532 - DNA, 25 bp, Mus musculus
agtcctatgtcctgtcaaactgtca

SEQ ID NO: 211533 - DNA, 25 bp, Mus musculus
agtcctatttttctactataccaat

SEQ ID NO: 211534 - DNA, 25 bp, Mus musculus
agtcctatttttgtactataccaat

SEQ ID NO: 211535 - DNA, 25 bp, Mus musculus
agtcctcaaacgaccaaatctgtat

SEQ ID NO: 211536 - DNA, 25 bp, Mus musculus
agtcctcaaacgtccaaatctgtat

SEQ ID NO: 211537 - DNA, 25 bp, Mus musculus
agtcctcaaactctggcgaacatgg

SEQ ID NO: 211538 - DNA, 25 bp, Mus musculus
agtcctcaaactgtggcgaacatgg

SEQ ID NO: 211539 - DNA, 25 bp, Mus musculus
agtcctcaaatgcttcagatccaac

SEQ ID NO: 211540 - DNA, 25 bp, Mus musculus
agtcctcaaatggttcagatccaac

SEQ ID NO: 211541 - DNA, 25 bp, Mus musculus
agtcctcaaggcagttcagtattca

SEQ ID NO: 211542 - DNA, 25 bp, Mus musculus
agtcctcaaggctgttcagtattca

SEQ ID NO: 211543 - DNA, 25 bp, Mus musculus
agtcctcacgctctgaacgtggaca

SEQ ID NO: 211544 - DNA, 25 bp, Mus musculus
agtcctcacgctgtgaacgtggaca

SEQ ID NO: 211545 - DNA, 25 bp, Mus musculus
agtcctcactccctgaagataggca

SEQ ID NO: 211546 - DNA, 25 bp, Mus musculus
agtcctcactccgtgaagataggca

SEQ ID NO: 211547 - DNA, 25 bp, Mus musculus
agtcctcagaagactttggctgggt

SEQ ID NO: 211548 - DNA, 25 bp, Mus musculus
agtcctcagaagtctttggctgggt

SEQ ID NO: 211549 - DNA, 25 bp, Mus musculus
agtcctcagatgaggtacttttgaa

SEQ ID NO: 211550 - DNA, 25 bp, Mus musculus
agtcctcagatgtggtacttttgaa

SEQ ID NO: 211551 - DNA, 25 bp, Mus musculus
agtcctcagcgtacacacgtacaga

SEQ ID NO: 211552 - DNA, 25 bp, Mus musculus
agtcctcagcgttcacacgtacaga

SEQ ID NO: 211553 - DNA, 25 bp, Mus musculus
agtcctcagctcagacagttgtggg

SEQ ID NO: 211554 - DNA, 25 bp, Mus musculus
agtcctcagctctgacagttgtggg

SEQ ID NO: 211555 - DNA, 25 bp, Mus musculus
agtcctcaggaaaaggcatcttcga

SEQ ID NO: 211556 - DNA, 25 bp, Mus musculus
agtcctcaggaataggcatcttcga

SEQ ID NO: 211557 - DNA, 25 bp, Mus musculus
agtcctcaggcactgcggctgaaat

SEQ ID NO: 211558 - DNA, 25 bp, Mus musculus
agtcctcaggcagtgcggctgaaat

SEQ ID NO: 211559 - DNA, 25 bp, Mus musculus
agtcctcaggccatgccggaagaga

SEQ ID NO: 211560 - DNA, 25 bp, Mus musculus
agtcctcaggccttgccggaagaga

SEQ ID NO: 211561 - DNA, 25 bp, Mus musculus
agtcctcagtgcacacggttctgag

SEQ ID NO: 211562 - DNA, 25 bp, Mus musculus
agtcctcagtgctcacggttctgag

SEQ ID NO: 211563 - DNA, 25 bp, Mus musculus
agtcctcataaaatttctatccctc

SEQ ID NO: 211564 - DNA, 25 bp, Mus musculus
agtcctcataaattttctatccctc

SEQ ID NO: 211565 - DNA, 25 bp, Mus musculus
agtcctcatcacacttggagccaaa

SEQ ID NO: 211566 - DNA, 25 bp, Mus musculus
agtcctcatcactcttggagccaaa

SEQ ID NO: 211567 - DNA, 25 bp, Mus musculus
agtcctcatctcctgtgtgatagca

SEQ ID NO: 211568 - DNA, 25 bp, Mus musculus
agtcctcatctcgtgtgtgatagca

SEQ ID NO: 211569 - DNA, 25 bp, Mus musculus
agtcctcatgatatattcctagttc

SEQ ID NO: 211570 - DNA, 25 bp, Mus musculus
agtcctcatgatttattcctagttc

SEQ ID NO: 211571 - DNA, 25 bp, Mus musculus
agtcctcatggacctaatctctcaa

SEQ ID NO: 211572 - DNA, 25 bp, Mus musculus
agtcctcatggagctaatctctcaa

SEQ ID NO: 211573 - DNA, 25 bp, Mus musculus
agtcctccagagctgatgctcgtct

SEQ ID NO: 211574 - DNA, 25 bp, Mus musculus
agtcctccagaggtgatgctcgtct

SEQ ID NO: 211575 - DNA, 25 bp, Mus musculus
agtcctccagttagggctgattcta

SEQ ID NO: 211576 - DNA, 25 bp, Mus musculus
agtcctccagtttgggctgattcta

SEQ ID NO: 211577 - DNA, 25 bp, Mus musculus
agtcctcccaaaaagttctgcaaac

SEQ ID NO: 211578 - DNA, 25 bp, Mus musculus
agtcctcccaaatagttctgcaaac

SEQ ID NO: 211579 - DNA, 25 bp, Mus musculus
agtcctccccagaaagctgcgagaa

SEQ ID NO: 211580 - DNA, 25 bp, Mus musculus
agtcctccccagtaagctgcgagaa

SEQ ID NO: 211581 - DNA, 25 bp, Mus musculus
agtcctccctccactcaaaaagagg

SEQ ID NO: 211582 - DNA, 25 bp, Mus musculus
agtcctccctcctctcaaaaagagg

SEQ ID NO: 211583 - DNA, 25 bp, Mus musculus
agtcctcctagacccatggaataac

SEQ ID NO: 211584 - DNA, 25 bp, Mus musculus
agtcctcctagagccatggaataac

SEQ ID NO: 211585 - DNA, 25 bp, Mus musculus
agtcctcctcctcgtacattttggt

SEQ ID NO: 211586 - DNA, 25 bp, Mus musculus
agtcctcctcctggtacattttggt

SEQ ID NO: 211587 - DNA, 25 bp, Mus musculus
agtcctcctcggattgaatcggtat

SEQ ID NO: 211588 - DNA, 25 bp, Mus musculus
agtcctcctcggtttgaatcggtat

SEQ ID NO: 211589 - DNA, 25 bp, Mus musculus
agtcctcctctgagaaggctttaga

SEQ ID NO: 211590 - DNA, 25 bp, Mus musculus
agtcctcctctgtgaaggctttaga

SEQ ID NO: 211591 - DNA, 25 bp, Mus musculus
agtcctcctggtcgcgtgcaatatt

SEQ ID NO: 211592 - DNA, 25 bp, Mus musculus
agtcctcctggtggcgtgcaatatt

SEQ ID NO: 211593 - DNA, 25 bp, Mus musculus
agtcctccttttccacttgttattg

SEQ ID NO: 211594 - DNA, 25 bp, Mus musculus
agtcctccttttgcacttgttattg

SEQ ID NO: 211595 - DNA, 25 bp, Mus musculus
agtcctcgctctaacagttagcagg

SEQ ID NO: 211596 - DNA, 25 bp, Mus musculus
agtcctcgctcttacagttagcagg

SEQ ID NO: 211597 - DNA, 25 bp, Mus musculus
agtcctcggaatcatggcggtagcc

SEQ ID NO: 211598 - DNA, 25 bp, Mus musculus
agtcctcggaatgatggcggtagcc

SEQ ID NO: 211599 - DNA, 25 bp, Mus musculus
agtcctcgtttcacaagtcagcctg

SEQ ID NO: 211600 - DNA, 25 bp, Mus musculus
agtcctcgtttctcaagtcagcctg

SEQ ID NO: 211601 - DNA, 25 bp, Mus musculus
agtcctctaaaaccattcttcactt

SEQ ID NO: 211602 - DNA, 25 bp, Mus musculus
agtcctctaaaagcattcttcactt

SEQ ID NO: 211603 - DNA, 25 bp, Mus musculus
agtcctctacaaactgagctgtctc

SEQ ID NO: 211604 - DNA, 25 bp, Mus musculus
agtcctctacaatctgagctgtctc

SEQ ID NO: 211605 - DNA, 25 bp, Mus musculus
agtcctctactacatcgtttccaaa

SEQ ID NO: 211606 - DNA, 25 bp, Mus musculus
agtcctctactagatcgtttccaaa

SEQ ID NO: 211607 - DNA, 25 bp, Mus musculus
agtcctctagagaactttccgtggc

SEQ ID NO: 211608 - DNA, 25 bp, Mus musculus
agtcctctagagtactttccgtggc

SEQ ID NO: 211609 - DNA, 25 bp, Mus musculus
agtcctctagtacctgagacactgt

SEQ ID NO: 211610 - DNA, 25 bp, Mus musculus
agtcctctagtagctgagacactgt

SEQ ID NO: 211611 - DNA, 25 bp, Mus musculus
agtcctctatccaggctggtttata

SEQ ID NO: 211612 - DNA, 25 bp, Mus musculus
agtcctctatcctggctggtttata

SEQ ID NO: 211613 - DNA, 25 bp, Mus musculus
agtcctctctatagctcaactctga

SEQ ID NO: 211614 - DNA, 25 bp, Mus musculus
agtcctctctattgctcaactctga

SEQ ID NO: 211615 - DNA, 25 bp, Mus musculus
agtcctctgaggcttcattttctac

SEQ ID NO: 211616 - DNA, 25 bp, Mus musculus
agtcctctgagggttcattttctac

SEQ ID NO: 211617 - DNA, 25 bp, Mus musculus
agtcctctgatgagcactcctgacc

SEQ ID NO: 211618 - DNA, 25 bp, Mus musculus
agtcctctgatgtgcactcctgacc

SEQ ID NO: 211619 - DNA, 25 bp, Mus musculus
agtcctctgggtctcatttccagat

SEQ ID NO: 211620 - DNA, 25 bp, Mus musculus
agtcctctgggtgtcatttccagat

SEQ ID NO: 211621 - DNA, 25 bp, Mus musculus
agtcctctggtcacttgaatgtagc

SEQ ID NO: 211622 - DNA, 25 bp, Mus musculus
agtcctctggtctcttgaatgtagc

SEQ ID NO: 211623 - DNA, 25 bp, Mus musculus
agtcctctgtcccacgagaatggat

SEQ ID NO: 211624 - DNA, 25 bp, Mus musculus
agtcctctgtccgacgagaatggat

SEQ ID NO: 211625 - DNA, 25 bp, Mus musculus
agtcctctgtttcctgttgaagaca

SEQ ID NO: 211626 - DNA, 25 bp, Mus musculus
agtcctctgtttgctgttgaagaca

SEQ ID NO: 211627 - DNA, 25 bp, Mus musculus
agtcctcttagtcagcatctacctt

SEQ ID NO: 211628 - DNA, 25 bp, Mus musculus
agtcctcttagtgagcatctacctt

SEQ ID NO: 211629 - DNA, 25 bp, Mus musculus
agtcctcttgagatccctaggaaga

SEQ ID NO: 211630 - DNA, 25 bp, Mus musculus
agtcctcttgagttccctaggaaga

SEQ ID NO: 211631 - DNA, 25 bp, Mus musculus
agtcctcttgctccacagttgacta

SEQ ID NO: 211632 - DNA, 25 bp, Mus musculus
agtcctcttgctgcacagttgacta

SEQ ID NO: 211633 - DNA, 25 bp, Mus musculus
agtcctcttttgaatgccaaaccca

SEQ ID NO: 211634 - DNA, 25 bp, Mus musculus
agtcctcttttgtatgccaaaccca

SEQ ID NO: 211635 - DNA, 25 bp, Mus musculus
agtcctgaacacacaactgaattat

SEQ ID NO: 211636 - DNA, 25 bp, Mus musculus
agtcctgaacactcaactgaattat

SEQ ID NO: 211637 - DNA, 25 bp, Mus musculus
agtcctgaaccacatgagatcattg

SEQ ID NO: 211638 - DNA, 25 bp, Mus musculus
agtcctgaaccagatgagatcattg

SEQ ID NO: 211639 - DNA, 25 bp, Mus musculus
agtcctgaacctctggactcagcat

SEQ ID NO: 211640 - DNA, 25 bp, Mus musculus
agtcctgaacctgtggactcagcat

SEQ ID NO: 211641 - DNA, 25 bp, Mus musculus
agtcctgaagaacagacattccggg

SEQ ID NO: 211642 - DNA, 25 bp, Mus musculus
agtcctgaagaagagacattccggg

SEQ ID NO: 211643 - DNA, 25 bp, Mus musculus
agtcctgaagacattctcatatttg

SEQ ID NO: 211644 - DNA, 25 bp, Mus musculus
agtcctgaagactttctcatatttg

SEQ ID NO: 211645 - DNA, 25 bp, Mus musculus
agtcctgaatatcacatgccacctg

SEQ ID NO: 211646 - DNA, 25 bp, Mus musculus
agtcctgaatatgacatgccacctg

SEQ ID NO: 211647 - DNA, 25 bp, Mus musculus
agtcctgacactctattagcactga

SEQ ID NO: 211648 - DNA, 25 bp, Mus musculus
agtcctgacactgtattagcactga

SEQ ID NO: 211649 - DNA, 25 bp, Mus musculus
agtcctgaccctctttgaagtgtag

SEQ ID NO: 211650 - DNA, 25 bp, Mus musculus
agtcctgaccctgtttgaagtgtag

SEQ ID NO: 211651 - DNA, 25 bp, Mus musculus
agtcctgactaacccacatggctgc

SEQ ID NO: 211652 - DNA, 25 bp, Mus musculus
agtcctgactaagccacatggctgc

SEQ ID NO: 211653 - DNA, 25 bp, Mus musculus
agtcctgactatatttctatcctta

SEQ ID NO: 211654 - DNA, 25 bp, Mus musculus
agtcctgactatttttctatcctta

SEQ ID NO: 211655 - DNA, 25 bp, Mus musculus
agtcctgactctatgctgcaagaga

SEQ ID NO: 211656 - DNA, 25 bp, Mus musculus
agtcctgactctttgctgcaagaga

SEQ ID NO: 211657 - DNA, 25 bp, Mus musculus
agtcctgactgaaagtcaccctgct

SEQ ID NO: 211658 - DNA, 25 bp, Mus musculus
agtcctgactgatagtcaccctgct

SEQ ID NO: 211659 - DNA, 25 bp, Mus musculus
agtcctgagaggaagctttcacgtt

SEQ ID NO: 211660 - DNA, 25 bp, Mus musculus
agtcctgagaggtagctttcacgtt

SEQ ID NO: 211661 - DNA, 25 bp, Mus musculus
agtcctgagccacacagcgtttatt

SEQ ID NO: 211662 - DNA, 25 bp, Mus musculus
agtcctgagccagacagcgtttatt

SEQ ID NO: 211663 - DNA, 25 bp, Mus musculus
agtcctgagcctatttgtgcttgac

SEQ ID NO: 211664 - DNA, 25 bp, Mus musculus
agtcctgagcctttttgtgcttgac

SEQ ID NO: 211665 - DNA, 25 bp, Mus musculus
agtcctgagctgagatgtgtgcctg

SEQ ID NO: 211666 - DNA, 25 bp, Mus musculus
agtcctgagctgtgatgtgtgcctg

SEQ ID NO: 211667 - DNA, 25 bp, Mus musculus
agtcctgagtgaagccccattatat

SEQ ID NO: 211668 - DNA, 25 bp, Mus musculus
agtcctgagtgaattctgatggtat

SEQ ID NO: 211669 - DNA, 25 bp, Mus musculus
agtcctgagtgatgccccattatat

SEQ ID NO: 211670 - DNA, 25 bp, Mus musculus
agtcctgagtgatttctgatggtat

SEQ ID NO: 211671 - DNA, 25 bp, Mus musculus
agtcctgatttcagttccttgtttc

SEQ ID NO: 211672 - DNA, 25 bp, Mus musculus
agtcctgatttctgttccttgtttc

SEQ ID NO: 211673 - DNA, 25 bp, Mus musculus
agtcctgattttataagccctttgt

SEQ ID NO: 211674 - DNA, 25 bp, Mus musculus
agtcctgattttttaagccctttgt

SEQ ID NO: 211675 - DNA, 25 bp, Mus musculus
agtcctgcaacacccatcaagatac

SEQ ID NO: 211676 - DNA, 25 bp, Mus musculus
agtcctgcaacagccatcaagatac

SEQ ID NO: 211677 - DNA, 25 bp, Mus musculus
agtcctgcagatacaacaaattcca

SEQ ID NO: 211678 - DNA, 25 bp, Mus musculus
agtcctgcagattcaacaaattcca

SEQ ID NO: 211679 - DNA, 25 bp, Mus musculus
agtcctgcatctactgtgtagtaac

SEQ ID NO: 211680 - DNA, 25 bp, Mus musculus
agtcctgcatcttctgtgtagtaac

SEQ ID NO: 211681 - DNA, 25 bp, Mus musculus
agtcctgcattaatttcttcttgtt

SEQ ID NO: 211682 - DNA, 25 bp, Mus musculus
agtcctgcattattttcttcttgtt

SEQ ID NO: 211683 - DNA, 25 bp, Mus musculus
agtcctgccaacataaacctcgtgg

SEQ ID NO: 211684 - DNA, 25 bp, Mus musculus
agtcctgccaacttaaacctcgtgg

SEQ ID NO: 211685 - DNA, 25 bp, Mus musculus
agtcctgcccagaattgctgcagta

SEQ ID NO: 211686 - DNA, 25 bp, Mus musculus
agtcctgcccagtattgctgcagta

SEQ ID NO: 211687 - DNA, 25 bp, Mus musculus
agtcctgccgacatgtataaaatgc

SEQ ID NO: 211688 - DNA, 25 bp, Mus musculus
agtcctgccgacttgtataaaatgc

SEQ ID NO: 211689 - DNA, 25 bp, Mus musculus
agtcctgccgttacctccagaagaa

SEQ ID NO: 211690 - DNA, 25 bp, Mus musculus
agtcctgccgtttcctccagaagaa

SEQ ID NO: 211691 - DNA, 25 bp, Mus musculus
agtcctgcctatcgatgtgcacaag

SEQ ID NO: 211692 - DNA, 25 bp, Mus musculus
agtcctgcctatggatgtgcacaag

SEQ ID NO: 211693 - DNA, 25 bp, Mus musculus
agtcctgcctctagcgactatggat

SEQ ID NO: 211694 - DNA, 25 bp, Mus musculus
agtcctgcctcttgcgactatggat

SEQ ID NO: 211695 - DNA, 25 bp, Mus musculus
agtcctgcctgaaacttctgtaagc

SEQ ID NO: 211696 - DNA, 25 bp, Mus musculus
agtcctgcctgatacttctgtaagc

SEQ ID NO: 211697 - DNA, 25 bp, Mus musculus
agtcctgcctgtaagaggaattaat

SEQ ID NO: 211698 - DNA, 25 bp, Mus musculus
agtcctgcctgttagaggaattaat

SEQ ID NO: 211699 - DNA, 25 bp, Mus musculus
agtcctgccttgattgcacttcgat

SEQ ID NO: 211700 - DNA, 25 bp, Mus musculus
agtcctgccttgtttgcacttcgat

SEQ ID NO: 211701 - DNA, 25 bp, Mus musculus
agtcctgcgggaattcaagctcttc

SEQ ID NO: 211702 - DNA, 25 bp, Mus musculus
agtcctgcgggatttcaagctcttc

SEQ ID NO: 211703 - DNA, 25 bp, Mus musculus
agtcctgctaagatatcaggctatg

SEQ ID NO: 211704 - DNA, 25 bp, Mus musculus
agtcctgctaagttatcaggctatg

SEQ ID NO: 211705 - DNA, 25 bp, Mus musculus
agtcctgctcaaacttgccaatgaa

SEQ ID NO: 211706 - DNA, 25 bp, Mus musculus
agtcctgctcaatcttgccaatgaa

SEQ ID NO: 211707 - DNA, 25 bp, Mus musculus
agtcctgctgaaatcgggctccgag

SEQ ID NO: 211708 - DNA, 25 bp, Mus musculus
agtcctgctgaattcgggctccgag

SEQ ID NO: 211709 - DNA, 25 bp, Mus musculus
agtcctgctggcaagtcaaaagaat

SEQ ID NO: 211710 - DNA, 25 bp, Mus musculus
agtcctgctggctagtcaaaagaat

SEQ ID NO: 211711 - DNA, 25 bp, Mus musculus
agtcctgcttcccatgtgccaagtg

SEQ ID NO: 211712 - DNA, 25 bp, Mus musculus
agtcctgcttccgatgtgccaagtg

SEQ ID NO: 211713 - DNA, 25 bp, Mus musculus
agtcctggaaaacctgacaccctct

SEQ ID NO: 211714 - DNA, 25 bp, Mus musculus
agtcctggaaaagctgacaccctct

SEQ ID NO: 211715 - DNA, 25 bp, Mus musculus
agtcctggaaataatttgtggtaag

SEQ ID NO: 211716 - DNA, 25 bp, Mus musculus
agtcctggaaattatttgtggtaag

SEQ ID NO: 211717 - DNA, 25 bp, Mus musculus
agtcctggaatgctgatattactca

SEQ ID NO: 211718 - DNA, 25 bp, Mus musculus
agtcctggaatggtgatattactca

SEQ ID NO: 211719 - DNA, 25 bp, Mus musculus
agtcctggaccacatgtcacataac

SEQ ID NO: 211720 - DNA, 25 bp, Mus musculus
agtcctggaccagatgtcacataac

SEQ ID NO: 211721 - DNA, 25 bp, Mus musculus
agtcctggaggcaagttcctcagaa

SEQ ID NO: 211722 - DNA, 25 bp, Mus musculus
agtcctggaggctagttcctcagaa

SEQ ID NO: 211723 - DNA, 25 bp, Mus musculus
agtcctggatctcgcccaaaggcag

SEQ ID NO: 211724 - DNA, 25 bp, Mus musculus
agtcctggatctggcccaaaggcag

SEQ ID NO: 211725 - DNA, 25 bp, Mus musculus
agtcctggcaaaactgtcttcacaa

SEQ ID NO: 211726 - DNA, 25 bp, Mus musculus
agtcctggcaaatctgtcttcacaa

SEQ ID NO: 211727 - DNA, 25 bp, Mus musculus
agtcctggccctcagaatgttgctg

SEQ ID NO: 211728 - DNA, 25 bp, Mus musculus
agtcctggccctgagaatgttgctg

SEQ ID NO: 211729 - DNA, 25 bp, Mus musculus
agtcctggccgtaccagtaacaaat

SEQ ID NO: 211730 - DNA, 25 bp, Mus musculus
agtcctggccgttccagtaacaaat

SEQ ID NO: 211731 - DNA, 25 bp, Mus musculus
agtcctggcgcaaggtttcagcaag

SEQ ID NO: 211732 - DNA, 25 bp, Mus musculus
agtcctggcgcatggtttcagcaag

SEQ ID NO: 211733 - DNA, 25 bp, Mus musculus
agtcctggctagcacctttggtaaa

SEQ ID NO: 211734 - DNA, 25 bp, Mus musculus
agtcctggctaggacctttggtaaa

SEQ ID NO: 211735 - DNA, 25 bp, Mus musculus
agtcctggctccaagtcaggattgt

SEQ ID NO: 211736 - DNA, 25 bp, Mus musculus
agtcctggctccatggtggcctcgg

SEQ ID NO: 211737 - DNA, 25 bp, Mus musculus
agtcctggctcctagtcaggattgt

SEQ ID NO: 211738 - DNA, 25 bp, Mus musculus
agtcctggctccttggtggcctcgg

SEQ ID NO: 211739 - DNA, 25 bp, Mus musculus
agtcctggcttcaggctactgctga

SEQ ID NO: 211740 - DNA, 25 bp, Mus musculus
agtcctggcttctggctactgctga

SEQ ID NO: 211741 - DNA, 25 bp, Mus musculus
agtcctgggcagagcacaagtgtcc

SEQ ID NO: 211742 - DNA, 25 bp, Mus musculus
agtcctgggcagtgcacaagtgtcc

SEQ ID NO: 211743 - DNA, 25 bp, Mus musculus
agtcctgggcatacctgctgacagt

SEQ ID NO: 211744 - DNA, 25 bp, Mus musculus
agtcctgggcattcctgctgacagt

SEQ ID NO: 211745 - DNA, 25 bp, Mus musculus
agtcctgggtgcctcactgcagtca

SEQ ID NO: 211746 - DNA, 25 bp, Mus musculus
agtcctgggtgcgtcactgcagtca

SEQ ID NO: 211747 - DNA, 25 bp, Mus musculus
agtcctggtgctaagaggagcccat

SEQ ID NO: 211748 - DNA, 25 bp, Mus musculus
agtcctggtgcttagaggagcccat

SEQ ID NO: 211749 - DNA, 25 bp, Mus musculus
agtcctggttggctttttgaacctg

SEQ ID NO: 211750 - DNA, 25 bp, Mus musculus
agtcctggttgggtttttgaacctg

SEQ ID NO: 211751 - DNA, 25 bp, Mus musculus
agtcctgtaggaccagagggctcca

SEQ ID NO: 211752 - DNA, 25 bp, Mus musculus
agtcctgtaggagcagagggctcca

SEQ ID NO: 211753 - DNA, 25 bp, Mus musculus
agtcctgtagtgctagctagctcat

SEQ ID NO: 211754 - DNA, 25 bp, Mus musculus
agtcctgtagtggtagctagctcat

SEQ ID NO: 211755 - DNA, 25 bp, Mus musculus
agtcctgtattgcttattgcttaat

SEQ ID NO: 211756 - DNA, 25 bp, Mus musculus
agtcctgtattggttattgcttaat

SEQ ID NO: 211757 - DNA, 25 bp, Mus musculus
agtcctgtcaggctttggtccgact

SEQ ID NO: 211758 - DNA, 25 bp, Mus musculus
agtcctgtcagggtttggtccgact

SEQ ID NO: 211759 - DNA, 25 bp, Mus musculus
agtcctgtcgggagtaagcctgagc

SEQ ID NO: 211760 - DNA, 25 bp, Mus musculus
agtcctgtcgggtgtaagcctgagc

SEQ ID NO: 211761 - DNA, 25 bp, Mus musculus
agtcctgtcttacccatgattagaa

SEQ ID NO: 211762 - DNA, 25 bp, Mus musculus
agtcctgtcttagccatgattagaa

SEQ ID NO: 211763 - DNA, 25 bp, Mus musculus
agtcctgtgaacaacaactctcatg

SEQ ID NO: 211764 - DNA, 25 bp, Mus musculus
agtcctgtgaactacaactctcatg

SEQ ID NO: 211765 - DNA, 25 bp, Mus musculus
agtcctgtgagcagcagaccaatgt

SEQ ID NO: 211766 - DNA, 25 bp, Mus musculus
agtcctgtgagctgcagaccaatgt

SEQ ID NO: 211767 - DNA, 25 bp, Mus musculus
agtcctgtgcagaccagagaacctg

SEQ ID NO: 211768 - DNA, 25 bp, Mus musculus
agtcctgtgcagtccagagaacctg

SEQ ID NO: 211769 - DNA, 25 bp, Mus musculus
agtcctgtgctaatggtgatcggca

SEQ ID NO: 211770 - DNA, 25 bp, Mus musculus
agtcctgtgctattggtgatcggca

SEQ ID NO: 211771 - DNA, 25 bp, Mus musculus
agtcctgtggaaacgggtcttacgt

SEQ ID NO: 211772 - DNA, 25 bp, Mus musculus
agtcctgtggaatcgggtcttacgt

SEQ ID NO: 211773 - DNA, 25 bp, Mus musculus
agtcctgtggttctgctgtagtcta

SEQ ID NO: 211774 - DNA, 25 bp, Mus musculus
agtcctgtggttgtgctgtagtcta

SEQ ID NO: 211775 - DNA, 25 bp, Mus musculus
agtcctgtgtcaatcactagctaag

SEQ ID NO: 211776 - DNA, 25 bp, Mus musculus
agtcctgtgtcattcactagctaag

SEQ ID NO: 211777 - DNA, 25 bp, Mus musculus
agtcctgtgtccagctttctgttat

SEQ ID NO: 211778 - DNA, 25 bp, Mus musculus
agtcctgtgtcctgctttctgttat

SEQ ID NO: 211779 - DNA, 25 bp, Mus musculus
agtcctgtgttaccttgcttttgtg

SEQ ID NO: 211780 - DNA, 25 bp, Mus musculus
agtcctgtgttagcttgcttttgtg

SEQ ID NO: 211781 - DNA, 25 bp, Mus musculus
agtcctgttcaaatctacctgtgag

SEQ ID NO: 211782 - DNA, 25 bp, Mus musculus
agtcctgttcaattctacctgtgag

SEQ ID NO: 211783 - DNA, 25 bp, Mus musculus
agtcctgttccacatcttgttatta

SEQ ID NO: 211784 - DNA, 25 bp, Mus musculus
agtcctgttccagatcttgttatta

SEQ ID NO: 211785 - DNA, 25 bp, Mus musculus
agtcctgttctaagtctcctaatga

SEQ ID NO: 211786 - DNA, 25 bp, Mus musculus
agtcctgttctatgtctcctaatga

SEQ ID NO: 211787 - DNA, 25 bp, Mus musculus
agtcctgttgctaggagaatggatc

SEQ ID NO: 211788 - DNA, 25 bp, Mus musculus
agtcctgttgctaggctgtcattgt

SEQ ID NO: 211789 - DNA, 25 bp, Mus musculus
agtcctgttgctccagtagtgtctg

SEQ ID NO: 211790 - DNA, 25 bp, Mus musculus
agtcctgttgctgcagtagtgtctg

SEQ ID NO: 211791 - DNA, 25 bp, Mus musculus
agtcctgttgcttggagaatggatc

SEQ ID NO: 211792 - DNA, 25 bp, Mus musculus
agtcctgttgcttggctgtcattgt

SEQ ID NO: 211793 - DNA, 25 bp, Mus musculus
agtcctgttgttcgaccttgaccaa

SEQ ID NO: 211794 - DNA, 25 bp, Mus musculus
agtcctgttgttggaccttgaccaa

SEQ ID NO: 211795 - DNA, 25 bp, Mus musculus
agtccttaaacaacagcgctctttg

SEQ ID NO: 211796 - DNA, 25 bp, Mus musculus
agtccttaaacatcagcgctctttg

SEQ ID NO: 211797 - DNA, 25 bp, Mus musculus
agtccttaagaccatcctcacagat

SEQ ID NO: 211798 - DNA, 25 bp, Mus musculus
agtccttaagacgatcctcacagat

SEQ ID NO: 211799 - DNA, 25 bp, Mus musculus
agtccttaagtccattgagtccacc

SEQ ID NO: 211800 - DNA, 25 bp, Mus musculus
agtccttaagtcgattgagtccacc

SEQ ID NO: 211801 - DNA, 25 bp, Mus musculus
agtccttacctgactccaaggaatg

SEQ ID NO: 211802 - DNA, 25 bp, Mus musculus
agtccttacctgtctccaaggaatg

SEQ ID NO: 211803 - DNA, 25 bp, Mus musculus
agtccttactttagcactttcagaa

SEQ ID NO: 211804 - DNA, 25 bp, Mus musculus
agtccttacttttgcactttcagaa

SEQ ID NO: 211805 - DNA, 25 bp, Mus musculus
agtccttagtaacgctgaggcagct

SEQ ID NO: 211806 - DNA, 25 bp, Mus musculus
agtccttagtaaggctgaggcagct

SEQ ID NO: 211807 - DNA, 25 bp, Mus musculus
agtccttagttcatgtggctcggtc

SEQ ID NO: 211808 - DNA, 25 bp, Mus musculus
agtccttagttcttgtggctcggtc

SEQ ID NO: 211809 - DNA, 25 bp, Mus musculus
agtccttatctgaatttcatagcaa

SEQ ID NO: 211810 - DNA, 25 bp, Mus musculus
agtccttatctgtatttcatagcaa

SEQ ID NO: 211811 - DNA, 25 bp, Mus musculus
agtccttattctatgtgcttaccta

SEQ ID NO: 211812 - DNA, 25 bp, Mus musculus
agtccttattctttgtgcttaccta

SEQ ID NO: 211813 - DNA, 25 bp, Mus musculus
agtccttcaattactcattgtcagg

SEQ ID NO: 211814 - DNA, 25 bp, Mus musculus
agtccttcaatttctcattgtcagg

SEQ ID NO: 211815 - DNA, 25 bp, Mus musculus
agtccttcagcgacaatgttcattg

SEQ ID NO: 211816 - DNA, 25 bp, Mus musculus
agtccttcagcgctgcagagcagta

SEQ ID NO: 211817 - DNA, 25 bp, Mus musculus
agtccttcagcggtgcagagcagta

SEQ ID NO: 211818 - DNA, 25 bp, Mus musculus
agtccttcagcgtcaatgttcattg

SEQ ID NO: 211819 - DNA, 25 bp, Mus musculus
agtccttcagtcattatcctgtctt

SEQ ID NO: 211820 - DNA, 25 bp, Mus musculus
agtccttcagtctttatcctgtctt

SEQ ID NO: 211821 - DNA, 25 bp, Mus musculus
agtccttcagtgataggcaacctag

SEQ ID NO: 211822 - DNA, 25 bp, Mus musculus
agtccttcagtgatggtatagtgcc

SEQ ID NO: 211823 - DNA, 25 bp, Mus musculus
agtccttcagtgttaggcaacctag

SEQ ID NO: 211824 - DNA, 25 bp, Mus musculus
agtccttcagtgttggtatagtgcc

SEQ ID NO: 211825 - DNA, 25 bp, Mus musculus
agtccttcatcgatggtgaccagat

SEQ ID NO: 211826 - DNA, 25 bp, Mus musculus
agtccttcatcgttggtgaccagat

SEQ ID NO: 211827 - DNA, 25 bp, Mus musculus
agtccttcatgtaggaagctccaaa

SEQ ID NO: 211828 - DNA, 25 bp, Mus musculus
agtccttcatgtcgcctcgatgaat

SEQ ID NO: 211829 - DNA, 25 bp, Mus musculus
agtccttcatgtggcctcgatgaat

SEQ ID NO: 211830 - DNA, 25 bp, Mus musculus
agtccttcatgttggaagctccaaa

SEQ ID NO: 211831 - DNA, 25 bp, Mus musculus
agtccttccctcattaacagtggag

SEQ ID NO: 211832 - DNA, 25 bp, Mus musculus
agtccttccctctttaacagtggag

SEQ ID NO: 211833 - DNA, 25 bp, Mus musculus
agtccttcctatcccattagctata

SEQ ID NO: 211834 - DNA, 25 bp, Mus musculus
agtccttcctatgccattagctata

SEQ ID NO: 211835 - DNA, 25 bp, Mus musculus
agtccttcctgtaatggatctttta

SEQ ID NO: 211836 - DNA, 25 bp, Mus musculus
agtccttcctgttatggatctttta

SEQ ID NO: 211837 - DNA, 25 bp, Mus musculus
agtccttccttcagcgttgggagtc

SEQ ID NO: 211838 - DNA, 25 bp, Mus musculus
agtccttccttctgcgttgggagtc

SEQ ID NO: 211839 - DNA, 25 bp, Mus musculus
agtccttcctttcacagaaggagac

SEQ ID NO: 211840 - DNA, 25 bp, Mus musculus
agtccttcctttgacagaaggagac

SEQ ID NO: 211841 - DNA, 25 bp, Mus musculus
agtccttcgtgtaggccagtgagct

SEQ ID NO: 211842 - DNA, 25 bp, Mus musculus
agtccttcgtgttggccagtgagct

SEQ ID NO: 211843 - DNA, 25 bp, Mus musculus
agtccttctaaccatgcttccatgt

SEQ ID NO: 211844 - DNA, 25 bp, Mus musculus
agtccttctaacgatgcttccatgt

SEQ ID NO: 211845 - DNA, 25 bp, Mus musculus
agtccttctcagctacagatcagtc

SEQ ID NO: 211846 - DNA, 25 bp, Mus musculus
agtccttctcaggtacagatcagtc

SEQ ID NO: 211847 - DNA, 25 bp, Mus musculus
agtccttgaaagatcgcctacctgt

SEQ ID NO: 211848 - DNA, 25 bp, Mus musculus
agtccttgaaagttcgcctacctgt

SEQ ID NO: 211849 - DNA, 25 bp, Mus musculus
agtccttgaactccaaaaactctag

SEQ ID NO: 211850 - DNA, 25 bp, Mus musculus
agtccttgaactgcaaaaactctag

SEQ ID NO: 211851 - DNA, 25 bp, Mus musculus
agtccttgaagacaacaataattta

SEQ ID NO: 211852 - DNA, 25 bp, Mus musculus
agtccttgaagagaacaataattta

SEQ ID NO: 211853 - DNA, 25 bp, Mus musculus
agtccttgacacaatctgatccaga

SEQ ID NO: 211854 - DNA, 25 bp, Mus musculus
agtccttgacactatctgatccaga

SEQ ID NO: 211855 - DNA, 25 bp, Mus musculus
agtccttgaggtaacgcagcaggaa

SEQ ID NO: 211856 - DNA, 25 bp, Mus musculus
agtccttgaggttacgcagcaggaa

SEQ ID NO: 211857 - DNA, 25 bp, Mus musculus
agtccttgcatcaggtgctaggtga

SEQ ID NO: 211858 - DNA, 25 bp, Mus musculus
agtccttgcatctggtgctaggtga

SEQ ID NO: 211859 - DNA, 25 bp, Mus musculus
agtccttgcggtcactgcgaaggtt

SEQ ID NO: 211860 - DNA, 25 bp, Mus musculus
agtccttgcggtgactgcgaaggtt

SEQ ID NO: 211861 - DNA, 25 bp, Mus musculus
agtccttgcgtacagccaaactcag

SEQ ID NO: 211862 - DNA, 25 bp, Mus musculus
agtccttgcgtagagccaaactcag

SEQ ID NO: 211863 - DNA, 25 bp, Mus musculus
agtccttgctcactacactgccaat

SEQ ID NO: 211864 - DNA, 25 bp, Mus musculus
agtccttgctcagtacactgccaat

SEQ ID NO: 211865 - DNA, 25 bp, Mus musculus
agtccttggaagctgtacatatatg

SEQ ID NO: 211866 - DNA, 25 bp, Mus musculus
agtccttggaaggtgtacatatatg

SEQ ID NO: 211867 - DNA, 25 bp, Mus musculus
agtccttggactagcgttagaagct

SEQ ID NO: 211868 - DNA, 25 bp, Mus musculus
agtccttggacttgcgttagaagct

SEQ ID NO: 211869 - DNA, 25 bp, Mus musculus
agtccttggcccacatatggctggt

SEQ ID NO: 211870 - DNA, 25 bp, Mus musculus
agtccttggccctcatatggctggt

SEQ ID NO: 211871 - DNA, 25 bp, Mus musculus
agtccttggcttcaatctctactgt

SEQ ID NO: 211872 - DNA, 25 bp, Mus musculus
agtccttggcttgaatctctactgt

SEQ ID NO: 211873 - DNA, 25 bp, Mus musculus
agtccttgggtaattcacagacaac

SEQ ID NO: 211874 - DNA, 25 bp, Mus musculus
agtccttgggtatttcacagacaac

SEQ ID NO: 211875 - DNA, 25 bp, Mus musculus
agtccttggtgacatgagcggttaa

SEQ ID NO: 211876 - DNA, 25 bp, Mus musculus
agtccttggtgagatgagcggttaa

SEQ ID NO: 211877 - DNA, 25 bp, Mus musculus
agtccttgtataattctcctgtcta

SEQ ID NO: 211878 - DNA, 25 bp, Mus musculus
agtccttgtatatttctcctgtcta

SEQ ID NO: 211879 - DNA, 25 bp, Mus musculus
agtccttgtcatctgctgtgcagca

SEQ ID NO: 211880 - DNA, 25 bp, Mus musculus
agtccttgtcatgtgctgtgcagca

SEQ ID NO: 211881 - DNA, 25 bp, Mus musculus
agtccttgtcctccaagccgtgagg

SEQ ID NO: 211882 - DNA, 25 bp, Mus musculus
agtccttgtcctgcaagccgtgagg

SEQ ID NO: 211883 - DNA, 25 bp, Mus musculus
agtccttgtgaaaccatctaatgtc

SEQ ID NO: 211884 - DNA, 25 bp, Mus musculus
agtccttgtgaatccatctaatgtc

SEQ ID NO: 211885 - DNA, 25 bp, Mus musculus
agtccttgtgacaggcatcgagtgt

SEQ ID NO: 211886 - DNA, 25 bp, Mus musculus
agtccttgtgactggcatcgagtgt

SEQ ID NO: 211887 - DNA, 25 bp, Mus musculus
agtccttgtgccacagtatgacgga

SEQ ID NO: 211888 - DNA, 25 bp, Mus musculus
agtccttgtgcctcagtatgacgga

SEQ ID NO: 211889 - DNA, 25 bp, Mus musculus
agtccttgtgtcatgtcttggctca

SEQ ID NO: 211890 - DNA, 25 bp, Mus musculus
agtccttgtgtcttgtcttggctca

SEQ ID NO: 211891 - DNA, 25 bp, Mus musculus
agtcctttaggacaggtgctctcat

SEQ ID NO: 211892 - DNA, 25 bp, Mus musculus
agtcctttaggagaggtgctctcat

SEQ ID NO: 211893 - DNA, 25 bp, Mus musculus
agtcctttaggtcaagtcttaatca

SEQ ID NO: 211894 - DNA, 25 bp, Mus musculus
agtcctttaggtgaagtcttaatca

SEQ ID NO: 211895 - DNA, 25 bp, Mus musculus
agtcctttagtgatctgagtttcat

SEQ ID NO: 211896 - DNA, 25 bp, Mus musculus
agtcctttagtgttctgagtttcat

SEQ ID NO: 211897 - DNA, 25 bp, Mus musculus
agtcctttattccttacacctgagg

SEQ ID NO: 211898 - DNA, 25 bp, Mus musculus
agtcctttattcgttacacctgagg

SEQ ID NO: 211899 - DNA, 25 bp, Mus musculus
agtcctttcaccacttgggtagtcg

SEQ ID NO: 211900 - DNA, 25 bp, Mus musculus
agtcctttcacctcttgggtagtcg

SEQ ID NO: 211901 - DNA, 25 bp, Mus musculus
agtcctttccagatcctactcgaac

SEQ ID NO: 211902 - DNA, 25 bp, Mus musculus
agtcctttccagttcctactcgaac

SEQ ID NO: 211903 - DNA, 25 bp, Mus musculus
agtcctttctaacatgattaagcag

SEQ ID NO: 211904 - DNA, 25 bp, Mus musculus
agtcctttctaagatgattaagcag

SEQ ID NO: 211905 - DNA, 25 bp, Mus musculus
agtcctttctctctctgagctaact

SEQ ID NO: 211906 - DNA, 25 bp, Mus musculus
agtcctttctctgtctgagctaact

SEQ ID NO: 211907 - DNA, 25 bp, Mus musculus
agtcctttgctcaggtatgtatttt

SEQ ID NO: 211908 - DNA, 25 bp, Mus musculus
agtcctttgctctggtatgtatttt

SEQ ID NO: 211909 - DNA, 25 bp, Mus musculus
agtcctttggctaagtcatacttca

SEQ ID NO: 211910 - DNA, 25 bp, Mus musculus
agtcctttggcttagtcatacttca

SEQ ID NO: 211911 - DNA, 25 bp, Mus musculus
agtcctttgggaccctgtcaggaga

SEQ ID NO: 211912 - DNA, 25 bp, Mus musculus
agtcctttgggagcctgtcaggaga

SEQ ID NO: 211913 - DNA, 25 bp, Mus musculus
agtcctttgtagagacaccctggta

SEQ ID NO: 211914 - DNA, 25 bp, Mus musculus
agtcctttgtagtgacaccctggta

SEQ ID NO: 211915 - DNA, 25 bp, Mus musculus
agtcctttgtccaatgattcccttg

SEQ ID NO: 211916 - DNA, 25 bp, Mus musculus
agtcctttgtcctatgattcccttg

SEQ ID NO: 211917 - DNA, 25 bp, Mus musculus
agtccttttctaaagctgtcctctt

SEQ ID NO: 211918 - DNA, 25 bp, Mus musculus
agtccttttctacacagcatccaaa

SEQ ID NO: 211919 - DNA, 25 bp, Mus musculus
agtccttttctagacagcatccaaa

SEQ ID NO: 211920 - DNA, 25 bp, Mus musculus
agtccttttctatagctgtcctctt

SEQ ID NO: 211921 - DNA, 25 bp, Mus musculus
agtccttttcttcgcaatgaccaca

SEQ ID NO: 211922 - DNA, 25 bp, Mus musculus
agtccttttcttggcaatgaccaca

SEQ ID NO: 211923 - DNA, 25 bp, Mus musculus
agtcgaaagccaaataacccctcat

SEQ ID NO: 211924 - DNA, 25 bp, Mus musculus
agtcgaaagccatataacccctcat

SEQ ID NO: 211925 - DNA, 25 bp, Mus musculus
agtcgaaagcctatgtattaaagat

SEQ ID NO: 211926 - DNA, 25 bp, Mus musculus
agtcgaaagcctttgtattaaagat

SEQ ID NO: 211927 - DNA, 25 bp, Mus musculus
agtcgaacacctcggcggcagctgt

SEQ ID NO: 211928 - DNA, 25 bp, Mus musculus
agtcgaacacctgggcggcagctgt

SEQ ID NO: 211929 - DNA, 25 bp, Mus musculus
agtcgaaccggcagacgcgcctgga

SEQ ID NO: 211930 - DNA, 25 bp, Mus musculus
agtcgaaccggctgacgcgcctgga

SEQ ID NO: 211931 - DNA, 25 bp, Mus musculus
agtcgaacggtcacccggtatcctg

SEQ ID NO: 211932 - DNA, 25 bp, Mus musculus
agtcgaacggtctcccggtatcctg

SEQ ID NO: 211933 - DNA, 25 bp, Mus musculus
agtcgaagacgaccggcagacatgt

SEQ ID NO: 211934 - DNA, 25 bp, Mus musculus
agtcgaagacgagcggcagacatgt

SEQ ID NO: 211935 - DNA, 25 bp, Mus musculus
agtcgaatccaaagccgtagctgcg

SEQ ID NO: 211936 - DNA, 25 bp, Mus musculus
agtcgaatccaatgccgtagctgcg

SEQ ID NO: 211937 - DNA, 25 bp, Mus musculus
agtcgaccgagcagctgatccgcaa

SEQ ID NO: 211938 - DNA, 25 bp, Mus musculus
agtcgaccgagctgctgatccgcaa

SEQ ID NO: 211939 - DNA, 25 bp, Mus musculus
agtcgagaatacagccttggcatgg

SEQ ID NO: 211940 - DNA, 25 bp, Mus musculus
agtcgagaatactgccttggcatgg

SEQ ID NO: 211941 - DNA, 25 bp, Mus musculus
agtcgagactctagggctctggcga

SEQ ID NO: 211942 - DNA, 25 bp, Mus musculus
agtcgagactcttgggctctggcga

SEQ ID NO: 211943 - DNA, 25 bp, Mus musculus
agtcgagagtacagttcctcccgaa

SEQ ID NO: 211944 - DNA, 25 bp, Mus musculus
agtcgagagtactgttcctcccgaa

SEQ ID NO: 211945 - DNA, 25 bp, Mus musculus
agtcgagggtttccaggtctccatc

SEQ ID NO: 211946 - DNA, 25 bp, Mus musculus
agtcgagggtttgcaggtctccatc

SEQ ID NO: 211947 - DNA, 25 bp, Mus musculus
agtcgaggttacatgttctgctcag

SEQ ID NO: 211948 - DNA, 25 bp, Mus musculus
agtcgaggttacttgttctgctcag

SEQ ID NO: 211949 - DNA, 25 bp, Mus musculus
agtcgagtcccactagtctagagaa

SEQ ID NO: 211950 - DNA, 25 bp, Mus musculus
agtcgagtcccagtagtctagagaa

SEQ ID NO: 211951 - DNA, 25 bp, Mus musculus
agtcgagttgaaatgtgtggcctaa

SEQ ID NO: 211952 - DNA, 25 bp, Mus musculus
agtcgagttgaattgtgtggcctaa

SEQ ID NO: 211953 - DNA, 25 bp, Mus musculus
agtcgatacatcaccatcaggagga

SEQ ID NO: 211954 - DNA, 25 bp, Mus musculus
agtcgatacatctccatcaggagga

SEQ ID NO: 211955 - DNA, 25 bp, Mus musculus
agtcgatccgtgcttcctttggata

SEQ ID NO: 211956 - DNA, 25 bp, Mus musculus
agtcgatccgtggttcctttggata

SEQ ID NO: 211957 - DNA, 25 bp, Mus musculus
agtcgatctgtgaacagtaagcagc

SEQ ID NO: 211958 - DNA, 25 bp, Mus musculus
agtcgatctgtgtacagtaagcagc

SEQ ID NO: 211959 - DNA, 25 bp, Mus musculus
agtcgatgactcctggctccaacac

SEQ ID NO: 211960 - DNA, 25 bp, Mus musculus
agtcgatgactcgtggctccaacac

SEQ ID NO: 211961 - DNA, 25 bp, Mus musculus
agtcgatgatagaggcttgtacaaa

SEQ ID NO: 211962 - DNA, 25 bp, Mus musculus
agtcgatgatagtggcttgtacaaa

SEQ ID NO: 211963 - DNA, 25 bp, Mus musculus
agtcgatgcccaataaacgtgtgtt

SEQ ID NO: 211964 - DNA, 25 bp, Mus musculus
agtcgatgcccattaaacgtgtgtt

SEQ ID NO: 211965 - DNA, 25 bp, Mus musculus
agtcgatggcaactctcagtcacgg

SEQ ID NO: 211966 - DNA, 25 bp, Mus musculus
agtcgatggcaagtctcagtcacgg

SEQ ID NO: 211967 - DNA, 25 bp, Mus musculus
agtcgattcctcaaaagacccaaat

SEQ ID NO: 211968 - DNA, 25 bp, Mus musculus
agtcgattcctctaaagacccaaat

SEQ ID NO: 211969 - DNA, 25 bp, Mus musculus
agtcgatttgacactggacccagca

SEQ ID NO: 211970 - DNA, 25 bp, Mus musculus
agtcgatttgactctggacccagca

SEQ ID NO: 211971 - DNA, 25 bp, Mus musculus
agtcgcaaagatatcaggcctatgt

SEQ ID NO: 211972 - DNA, 25 bp, Mus musculus
agtcgcaaagatttcaggcctatgt

SEQ ID NO: 211973 - DNA, 25 bp, Mus musculus
agtcgcaatccacctccatgatttc

SEQ ID NO: 211974 - DNA, 25 bp, Mus musculus
agtcgcaatccagctccatgatttc

SEQ ID NO: 211975 - DNA, 25 bp, Mus musculus
agtcgcacacaaattctacacttat

SEQ ID NO: 211976 - DNA, 25 bp, Mus musculus
agtcgcacacaatttctacacttat

SEQ ID NO: 211977 - DNA, 25 bp, Mus musculus
agtcgcagagataagtagtctctct

SEQ ID NO: 211978 - DNA, 25 bp, Mus musculus
agtcgcagagattagtagtctctct

SEQ ID NO: 211979 - DNA, 25 bp, Mus musculus
agtcgcagcatgcacttggattagt

SEQ ID NO: 211980 - DNA, 25 bp, Mus musculus
agtcgcagcatggacttggattagt

SEQ ID NO: 211981 - DNA, 25 bp, Mus musculus
agtcgcagcggtatcgttttcccag

SEQ ID NO: 211982 - DNA, 25 bp, Mus musculus
agtcgcagcggtttcgttttcccag

SEQ ID NO: 211983 - DNA, 25 bp, Mus musculus
agtcgcaggtgcagaaacaggtttc

SEQ ID NO: 211984 - DNA, 25 bp, Mus musculus
agtcgcaggtgctgaaacaggtttc

SEQ ID NO: 211985 - DNA, 25 bp, Mus musculus
agtcgcatagacactgttctcttct

SEQ ID NO: 211986 - DNA, 25 bp, Mus musculus
agtcgcatagactctgttctcttct

SEQ ID NO: 211987 - DNA, 25 bp, Mus musculus
agtcgcatctcactgcaggagcggc

SEQ ID NO: 211988 - DNA, 25 bp, Mus musculus
agtcgcatctcagtgcaggagcggc

SEQ ID NO: 211989 - DNA, 25 bp, Mus musculus
agtcgcatctgcctaacgtgatttc

SEQ ID NO: 211990 - DNA, 25 bp, Mus musculus
agtcgcatctgcgtaacgtgatttc

SEQ ID NO: 211991 - DNA, 25 bp, Mus musculus
agtcgcatggcgaggctagaacgca

SEQ ID NO: 211992 - DNA, 25 bp, Mus musculus
agtcgcatggcgtggctagaacgca

SEQ ID NO: 211993 - DNA, 25 bp, Mus musculus
agtcgccagaaccagtacctgtcat

SEQ ID NO: 211994 - DNA, 25 bp, Mus musculus
agtcgccagaacgagtacctgtcat

SEQ ID NO: 211995 - DNA, 25 bp, Mus musculus
agtcgccagagccttcagtctgcat

SEQ ID NO: 211996 - DNA, 25 bp, Mus musculus
agtcgccagagcgttcagtctgcat

SEQ ID NO: 211997 - DNA, 25 bp, Mus musculus
agtcgccataagaagaactgttaaa

SEQ ID NO: 211998 - DNA, 25 bp, Mus musculus
agtcgccataagtagaactgttaaa

SEQ ID NO: 211999 - DNA, 25 bp, Mus musculus
agtcgccatgggaccacgtgtgatg

SEQ ID NO: 212000 - DNA, 25 bp, Mus musculus
agtcgccatgggtccacgtgtgatg

SEQ ID NO: 212001 - DNA, 25 bp, Mus musculus
agtcgccccagaatttcaagcccag

SEQ ID NO: 212002 - DNA, 25 bp, Mus musculus
agtcgccccagattttcaagcccag

SEQ ID NO: 212003 - DNA, 25 bp, Mus musculus
agtcgccctcagatacacattaagt

SEQ ID NO: 212004 - DNA, 25 bp, Mus musculus
agtcgccctcagttacacattaagt

SEQ ID NO: 212005 - DNA, 25 bp, Mus musculus
agtcgccgtggaataggtctctagt

SEQ ID NO: 212006 - DNA, 25 bp, Mus musculus
agtcgccgtggattaggtctctagt

SEQ ID NO: 212007 - DNA, 25 bp, Mus musculus
agtcgcctattgaatgccgtgagct

SEQ ID NO: 212008 - DNA, 25 bp, Mus musculus
agtcgcctattgtatgccgtgagct

SEQ ID NO: 212009 - DNA, 25 bp, Mus musculus
agtcgcctcaatcacgagctgcagg

SEQ ID NO: 212010 - DNA, 25 bp, Mus musculus
agtcgcctcaatgacgagctgcagg

SEQ ID NO: 212011 - DNA, 25 bp, Mus musculus
agtcgcctgctccaaagtggttgaa

SEQ ID NO: 212012 - DNA, 25 bp, Mus musculus
agtcgcctgctcgaaagtggttgaa

SEQ ID NO: 212013 - DNA, 25 bp, Mus musculus
agtcgcctggtcattggtgactgta

SEQ ID NO: 212014 - DNA, 25 bp, Mus musculus
agtcgcctggtctttggtgactgta

SEQ ID NO: 212015 - DNA, 25 bp, Mus musculus
agtcgcctgtatatccacaatgtag

SEQ ID NO: 212016 - DNA, 25 bp, Mus musculus
agtcgcctgtatttccacaatgtag

SEQ ID NO: 212017 - DNA, 25 bp, Mus musculus
agtcgccttggtacgttgttgatgg

SEQ ID NO: 212018 - DNA, 25 bp, Mus musculus
agtcgccttggttcgttgttgatgg

SEQ ID NO: 212019 - DNA, 25 bp, Mus musculus
agtcgcgacctgaacgaggccaagc

SEQ ID NO: 212020 - DNA, 25 bp, Mus musculus
agtcgcgacctgtacgaggccaagc

SEQ ID NO: 212021 - DNA, 25 bp, Mus musculus
agtcgcgaggccagtcatcctgtga

SEQ ID NO: 212022 - DNA, 25 bp, Mus musculus
agtcgcgaggcctgtcatcctgtga

SEQ ID NO: 212023 - DNA, 25 bp, Mus musculus
agtcgcgcagagactctggcgaacg

SEQ ID NO: 212024 - DNA, 25 bp, Mus musculus
agtcgcgcagagtctctggcgaacg

SEQ ID NO: 212025 - DNA, 25 bp, Mus musculus
agtcgcggctggcttttaccagtga

SEQ ID NO: 212026 - DNA, 25 bp, Mus musculus
agtcgcggctgggttttaccagtga

SEQ ID NO: 212027 - DNA, 25 bp, Mus musculus
agtcgcggtgttaactttaagcact

SEQ ID NO: 212028 - DNA, 25 bp, Mus musculus
agtcgcggtgtttactttaagcact

SEQ ID NO: 212029 - DNA, 25 bp, Mus musculus
agtcgcgtctgaccatgttagttaa

SEQ ID NO: 212030 - DNA, 25 bp, Mus musculus
agtcgcgtctgagcatgttagttaa

SEQ ID NO: 212031 - DNA, 25 bp, Mus musculus
agtcgctacagtatcacttcagttt

SEQ ID NO: 212032 - DNA, 25 bp, Mus musculus
agtcgctacagtttcacttcagttt

SEQ ID NO: 212033 - DNA, 25 bp, Mus musculus
agtcgctataccatagcaccgtggg

SEQ ID NO: 212034 - DNA, 25 bp, Mus musculus
agtcgctataccttagcaccgtggg

SEQ ID NO: 212035 - DNA, 25 bp, Mus musculus
agtcgctcagagctttgggcacttc

SEQ ID NO: 212036 - DNA, 25 bp, Mus musculus
agtcgctcagaggtttgggcacttc

SEQ ID NO: 212037 - DNA, 25 bp, Mus musculus
agtcgctcagcccaatcagctcgtg

SEQ ID NO: 212038 - DNA, 25 bp, Mus musculus
agtcgctcagccgaatcagctcgtg

SEQ ID NO: 212039 - DNA, 25 bp, Mus musculus
agtcgctccagccttaatttgaaag

SEQ ID NO: 212040 - DNA, 25 bp, Mus musculus
agtcgctccagcgttaatttgaaag

SEQ ID NO: 212041 - DNA, 25 bp, Mus musculus
agtcgctcctgccaacatgcaggaa

SEQ ID NO: 212042 - DNA, 25 bp, Mus musculus
agtcgctcctgcgaacatgcaggaa

SEQ ID NO: 212043 - DNA, 25 bp, Mus musculus
agtcgctgatccacttgtgaattcc

SEQ ID NO: 212044 - DNA, 25 bp, Mus musculus
agtcgctgatcctcttgtgaattcc

SEQ ID NO: 212045 - DNA, 25 bp, Mus musculus
agtcgctgccatcggagtcactaaa

SEQ ID NO: 212046 - DNA, 25 bp, Mus musculus
agtcgctgccatgggagtcactaaa

SEQ ID NO: 212047 - DNA, 25 bp, Mus musculus
agtcgctggagtccaggctgttcct

SEQ ID NO: 212048 - DNA, 25 bp, Mus musculus
agtcgctggagtgcaggctgttcct

SEQ ID NO: 212049 - DNA, 25 bp, Mus musculus
agtcgctgggttagctggtcatgaa

SEQ ID NO: 212050 - DNA, 25 bp, Mus musculus
agtcgctgggtttgctggtcatgaa

SEQ ID NO: 212051 - DNA, 25 bp, Mus musculus
agtcgctggtgaactgagctcacaa

SEQ ID NO: 212052 - DNA, 25 bp, Mus musculus
agtcgctggtgatctgagctcacaa

SEQ ID NO: 212053 - DNA, 25 bp, Mus musculus
agtcgctgtcatacatgtggaggtc

SEQ ID NO: 212054 - DNA, 25 bp, Mus musculus
agtcgctgtcattcatgtggaggtc

SEQ ID NO: 212055 - DNA, 25 bp, Mus musculus
agtcgctgtggcacggatccattca

SEQ ID NO: 212056 - DNA, 25 bp, Mus musculus
agtcgctgtggctcggatccattca

SEQ ID NO: 212057 - DNA, 25 bp, Mus musculus
agtcgcttagagctcacatcgtgag

SEQ ID NO: 212058 - DNA, 25 bp, Mus musculus
agtcgcttagaggtcacatcgtgag

SEQ ID NO: 212059 - DNA, 25 bp, Mus musculus
agtcggaacctaaagatgtcctcag

SEQ ID NO: 212060 - DNA, 25 bp, Mus musculus
agtcggaacctatagatgtcctcag

SEQ ID NO: 212061 - DNA, 25 bp, Mus musculus
agtcggaactgcagatcgctctcat

SEQ ID NO: 212062 - DNA, 25 bp, Mus musculus
agtcggaactgctgatcgctctcat

SEQ ID NO: 212063 - DNA, 25 bp, Mus musculus
agtcggaagtttactcacgcggagc

SEQ ID NO: 212064 - DNA, 25 bp, Mus musculus
agtcggaagttttctcacgcggagc

SEQ ID NO: 212065 - DNA, 25 bp, Mus musculus
agtcggacatctacccagtgctttt

SEQ ID NO: 212066 - DNA, 25 bp, Mus musculus
agtcggacatcttcccagtgctttt

SEQ ID NO: 212067 - DNA, 25 bp, Mus musculus
agtcggacctctcagaacttagagt

SEQ ID NO: 212068 - DNA, 25 bp, Mus musculus
agtcggacctctgagaacttagagt

SEQ ID NO: 212069 - DNA, 25 bp, Mus musculus
agtcggacgccgacctggtggacaa

SEQ ID NO: 212070 - DNA, 25 bp, Mus musculus
agtcggacgccgagcagcctcggct

SEQ ID NO: 212071 - DNA, 25 bp, Mus musculus
agtcggacgccgtcctggtggacaa

SEQ ID NO: 212072 - DNA, 25 bp, Mus musculus
agtcggacgccgtgcagcctcggct

SEQ ID NO: 212073 - DNA, 25 bp, Mus musculus
agtcggagacgcagctgctagagca

SEQ ID NO: 212074 - DNA, 25 bp, Mus musculus
agtcggagacgctgctgctagagca

SEQ ID NO: 212075 - DNA, 25 bp, Mus musculus
agtcggagctgtacccggagctgca

SEQ ID NO: 212076 - DNA, 25 bp, Mus musculus
agtcggagctgttcccggagctgca

SEQ ID NO: 212077 - DNA, 25 bp, Mus musculus
agtcggaggaacagcttctcgcgca

SEQ ID NO: 212078 - DNA, 25 bp, Mus musculus
agtcggaggaactgcttctcgcgca

SEQ ID NO: 212079 - DNA, 25 bp, Mus musculus
agtcggaggatgcttcacaagctat

SEQ ID NO: 212080 - DNA, 25 bp, Mus musculus
agtcggaggatggttcacaagctat

SEQ ID NO: 212081 - DNA, 25 bp, Mus musculus
agtcggatagaaatccgagctgatc

SEQ ID NO: 212082 - DNA, 25 bp, Mus musculus
agtcggatagaattccgagctgatc

SEQ ID NO: 212083 - DNA, 25 bp, Mus musculus
agtcggatcatcctggcatcagtat

SEQ ID NO: 212084 - DNA, 25 bp, Mus musculus
agtcggatcatcgtggcatcagtat

SEQ ID NO: 212085 - DNA, 25 bp, Mus musculus
agtcggattgctcggattgccttcc

SEQ ID NO: 212086 - DNA, 25 bp, Mus musculus
agtcggattgctgggattgccttcc

SEQ ID NO: 212087 - DNA, 25 bp, Mus musculus
agtcggcaactcaggcgccatggag

SEQ ID NO: 212088 - DNA, 25 bp, Mus musculus
agtcggcaactctggcgccatggag

SEQ ID NO: 212089 - DNA, 25 bp, Mus musculus
agtcggcaagccaggtttcatagcg

SEQ ID NO: 212090 - DNA, 25 bp, Mus musculus
agtcggcaagcctggtttcatagcg

SEQ ID NO: 212091 - DNA, 25 bp, Mus musculus
agtcggcaatgaccacaggaccatt

SEQ ID NO: 212092 - DNA, 25 bp, Mus musculus
agtcggcaatgagcacaggaccatt

SEQ ID NO: 212093 - DNA, 25 bp, Mus musculus
agtcggccggatacacttactggaa

SEQ ID NO: 212094 - DNA, 25 bp, Mus musculus
agtcggccggattcacttactggaa

SEQ ID NO: 212095 - DNA, 25 bp, Mus musculus
agtcggcctcggcagaaactcttca

SEQ ID NO: 212096 - DNA, 25 bp, Mus musculus
agtcggcctcgggagaaactcttca

SEQ ID NO: 212097 - DNA, 25 bp, Mus musculus
agtcggcgtgagaagaatcccagaa

SEQ ID NO: 212098 - DNA, 25 bp, Mus musculus
agtcggcgtgagtagaatcccagaa

SEQ ID NO: 212099 - DNA, 25 bp, Mus musculus
agtcggcttgctcagacacttcaga

SEQ ID NO: 212100 - DNA, 25 bp, Mus musculus
agtcggcttgctgagacacttcaga

SEQ ID NO: 212101 - DNA, 25 bp, Mus musculus
agtcggcttttgcaatgtgcagtac

SEQ ID NO: 212102 - DNA, 25 bp, Mus musculus
agtcggcttttggaatgtgcagtac

SEQ ID NO: 212103 - DNA, 25 bp, Mus musculus
agtcgggaatgtctctcatctccta

SEQ ID NO: 212104 - DNA, 25 bp, Mus musculus
agtcgggaatgtgtctcatctccta

SEQ ID NO: 212105 - DNA, 25 bp, Mus musculus
agtcgggtgcccagtgtctgtatga

SEQ ID NO: 212106 - DNA, 25 bp, Mus musculus
agtcgggtgccctgtgtctgtatga

SEQ ID NO: 212107 - DNA, 25 bp, Mus musculus
agtcgggttgaccattgctgctgca

SEQ ID NO: 212108 - DNA, 25 bp, Mus musculus
agtcgggttgacgattgctgctgca

SEQ ID NO: 212109 - DNA, 25 bp, Mus musculus
agtcggtcttaaagaggatgggcct

SEQ ID NO: 212110 - DNA, 25 bp, Mus musculus
agtcggtcttaatgaggatgggcct

SEQ ID NO: 212111 - DNA, 25 bp, Mus musculus
agtcggtcttatatgctcgcagcca

SEQ ID NO: 212112 - DNA, 25 bp, Mus musculus
agtcggtcttatttgctcgcagcca

SEQ ID NO: 212113 - DNA, 25 bp, Mus musculus
agtcggtgatacactgaccttctca

SEQ ID NO: 212114 - DNA, 25 bp, Mus musculus
agtcggtgatactctgaccttctca

SEQ ID NO: 212115 - DNA, 25 bp, Mus musculus
agtcggtgctagagcccacttctcg

SEQ ID NO: 212116 - DNA, 25 bp, Mus musculus
agtcggtgctagtgcccacttctcg

SEQ ID NO: 212117 - DNA, 25 bp, Mus musculus
agtcggtgcttaagtgggctccttc

SEQ ID NO: 212118 - DNA, 25 bp, Mus musculus
agtcggtgcttatgtgggctccttc

SEQ ID NO: 212119 - DNA, 25 bp, Mus musculus
agtcggtggagcagcactctccgca

SEQ ID NO: 212120 - DNA, 25 bp, Mus musculus
agtcggtggagctgcactctccgca

SEQ ID NO: 212121 - DNA, 25 bp, Mus musculus
agtcggtggctaatccccagcttcg

SEQ ID NO: 212122 - DNA, 25 bp, Mus musculus
agtcggtggctattccccagcttcg

SEQ ID NO: 212123 - DNA, 25 bp, Mus musculus
agtcggttattgaagaagccgtaat

SEQ ID NO: 212124 - DNA, 25 bp, Mus musculus
agtcggttattgtagaagccgtaat

SEQ ID NO: 212125 - DNA, 25 bp, Mus musculus
agtcggttctggagggaggtggtca

SEQ ID NO: 212126 - DNA, 25 bp, Mus musculus
agtcggttctggtgggaggtggtca

SEQ ID NO: 212127 - DNA, 25 bp, Mus musculus
agtcggttgttgcagtctgagcttt

SEQ ID NO: 212128 - DNA, 25 bp, Mus musculus
agtcggttgttggagtctgagcttt

SEQ ID NO: 212129 - DNA, 25 bp, Mus musculus
agtcgtacacgaaagcatttgagag

SEQ ID NO: 212130 - DNA, 25 bp, Mus musculus
agtcgtacacgatagcatttgagag

SEQ ID NO: 212131 - DNA, 25 bp, Mus musculus
agtcgtacatctcccaaccggattt

SEQ ID NO: 212132 - DNA, 25 bp, Mus musculus
agtcgtacatctgccaaccggattt

SEQ ID NO: 212133 - DNA, 25 bp, Mus musculus
agtcgtaggctcagcttcagtggaa

SEQ ID NO: 212134 - DNA, 25 bp, Mus musculus
agtcgtaggctctgcttcagtggaa

SEQ ID NO: 212135 - DNA, 25 bp, Mus musculus
agtcgtagggcgatatagtttctgt

SEQ ID NO: 212136 - DNA, 25 bp, Mus musculus
agtcgtagggcgttatagtttctgt

SEQ ID NO: 212137 - DNA, 25 bp, Mus musculus
agtcgtattctgatgttcagtcctc

SEQ ID NO: 212138 - DNA, 25 bp, Mus musculus
agtcgtattctgttgttcagtcctc

SEQ ID NO: 212139 - DNA, 25 bp, Mus musculus
agtcgtcagagcagcacgtgggtaa

SEQ ID NO: 212140 - DNA, 25 bp, Mus musculus
agtcgtcagagctgcacgtgggtaa

SEQ ID NO: 212141 - DNA, 25 bp, Mus musculus
agtcgtcatttcagtgacaccctga

SEQ ID NO: 212142 - DNA, 25 bp, Mus musculus
agtcgtcatttctgtgacaccctga

SEQ ID NO: 212143 - DNA, 25 bp, Mus musculus
agtcgtccatttccgaaaggcctct

SEQ ID NO: 212144 - DNA, 25 bp, Mus musculus
agtcgtccatttgcgaaaggcctct

SEQ ID NO: 212145 - DNA, 25 bp, Mus musculus
agtcgtcccactctgatcatcctgg

SEQ ID NO: 212146 - DNA, 25 bp, Mus musculus
agtcgtcccactgtgatcatcctgg

SEQ ID NO: 212147 - DNA, 25 bp, Mus musculus
agtcgtcccctaataaatcgcacaa

SEQ ID NO: 212148 - DNA, 25 bp, Mus musculus
agtcgtcccctattaaatcgcacaa

SEQ ID NO: 212149 - DNA, 25 bp, Mus musculus
agtcgtcgtaacaatgaccaccagc

SEQ ID NO: 212150 - DNA, 25 bp, Mus musculus
agtcgtcgtaactatgaccaccagc

SEQ ID NO: 212151 - DNA, 25 bp, Mus musculus
agtcgtctcactaaaaagctcacct

SEQ ID NO: 212152 - DNA, 25 bp, Mus musculus
agtcgtctcacttaaaagctcacct

SEQ ID NO: 212153 - DNA, 25 bp, Mus musculus
agtcgtctcataaacgtctgatgac

SEQ ID NO: 212154 - DNA, 25 bp, Mus musculus
agtcgtctcatatacgtctgatgac

SEQ ID NO: 212155 - DNA, 25 bp, Mus musculus
agtcgtctctacatgcctggatcta

SEQ ID NO: 212156 - DNA, 25 bp, Mus musculus
agtcgtctctacttgcctggatcta

SEQ ID NO: 212157 - DNA, 25 bp, Mus musculus
agtcgtctctttcggatttgggcat

SEQ ID NO: 212158 - DNA, 25 bp, Mus musculus
agtcgtctctttgggatttgggcat

SEQ ID NO: 212159 - DNA, 25 bp, Mus musculus
agtcgtctgcccatttgtatatggt

SEQ ID NO: 212160 - DNA, 25 bp, Mus musculus
agtcgtctgcccttttgtatatggt

SEQ ID NO: 212161 - DNA, 25 bp, Mus musculus
agtcgtcttgttcctggaaagttag

SEQ ID NO: 212162 - DNA, 25 bp, Mus musculus
agtcgtcttgttgctggaaagttag

SEQ ID NO: 212163 - DNA, 25 bp, Mus musculus
agtcgtctttggagctatcttgtac

SEQ ID NO: 212164 - DNA, 25 bp, Mus musculus
agtcgtctttggtgctatcttgtac

SEQ ID NO: 212165 - DNA, 25 bp, Mus musculus
agtcgtgcagctacagagaacccaa

SEQ ID NO: 212166 - DNA, 25 bp, Mus musculus
agtcgtgcagcttcagagaacccaa

SEQ ID NO: 212167 - DNA, 25 bp, Mus musculus
agtcgtgcagtaaggcagcatttca

SEQ ID NO: 212168 - DNA, 25 bp, Mus musculus
agtcgtgcagtatggcagcatttca

SEQ ID NO: 212169 - DNA, 25 bp, Mus musculus
agtcgtgcattcctgtctgaaatat

SEQ ID NO: 212170 - DNA, 25 bp, Mus musculus
agtcgtgcattcgtgtctgaaatat

SEQ ID NO: 212171 - DNA, 25 bp, Mus musculus
agtcgtgccttccacatagggacag

SEQ ID NO: 212172 - DNA, 25 bp, Mus musculus
agtcgtgccttcgacatagggacag

SEQ ID NO: 212173 - DNA, 25 bp, Mus musculus
agtcgtgcgcctctgttcagagaaa

SEQ ID NO: 212174 - DNA, 25 bp, Mus musculus
agtcgtgcgcctgtgttcagagaaa

SEQ ID NO: 212175 - DNA, 25 bp, Mus musculus
agtcgtgtcactcttctagaaacgg

SEQ ID NO: 212176 - DNA, 25 bp, Mus musculus
agtcgtgtcactgttctagaaacgg

SEQ ID NO: 212177 - DNA, 25 bp, Mus musculus
agtcgttagcgacaaagggcacctt

SEQ ID NO: 212178 - DNA, 25 bp, Mus musculus
agtcgttagcgagaaagggcacctt

SEQ ID NO: 212179 - DNA, 25 bp, Mus musculus
agtcgttcccatatctgagagtttt

SEQ ID NO: 212180 - DNA, 25 bp, Mus musculus
agtcgttcccatttctgagagtttt

SEQ ID NO: 212181 - DNA, 25 bp, Mus musculus
agtcgttcctcacctagggctgggt

SEQ ID NO: 212182 - DNA, 25 bp, Mus musculus
agtcgttcctcagctagggctgggt

SEQ ID NO: 212183 - DNA, 25 bp, Mus musculus
agtcgttcttgcacttcgagggcga

SEQ ID NO: 212184 - DNA, 25 bp, Mus musculus
agtcgttcttgctcttcgagggcga

SEQ ID NO: 212185 - DNA, 25 bp, Mus musculus
agtcgttgaaatatccagactccaa

SEQ ID NO: 212186 - DNA, 25 bp, Mus musculus
agtcgttgaaatttccagactccaa

SEQ ID NO: 212187 - DNA, 25 bp, Mus musculus
agtcgttgacgaagctctggtttac

SEQ ID NO: 212188 - DNA, 25 bp, Mus musculus
agtcgttgacgatgctctggtttac

SEQ ID NO: 212189 - DNA, 25 bp, Mus musculus
agtcgttgctggacaaaatttgttc

SEQ ID NO: 212190 - DNA, 25 bp, Mus musculus
agtcgttgctggtcaaaatttgttc

SEQ ID NO: 212191 - DNA, 25 bp, Mus musculus
agtcgttggtatcctctttgaagaa

SEQ ID NO: 212192 - DNA, 25 bp, Mus musculus
agtcgttggtatgctctttgaagaa

SEQ ID NO: 212193 - DNA, 25 bp, Mus musculus
agtcgtttggacagttcagcactat

SEQ ID NO: 212194 - DNA, 25 bp, Mus musculus
agtcgtttggactgttcagcactat

SEQ ID NO: 212195 - DNA, 25 bp, Mus musculus
agtctaaaaccgctgcacaagattt

SEQ ID NO: 212196 - DNA, 25 bp, Mus musculus
agtctaaaaccggtgcacaagattt

SEQ ID NO: 212197 - DNA, 25 bp, Mus musculus
agtctaaaatcccaagccaacagtc

SEQ ID NO: 212198 - DNA, 25 bp, Mus musculus
agtctaaaatccgaagccaacagtc

SEQ ID NO: 212199 - DNA, 25 bp, Mus musculus
agtctaaacatgctgggcacctctg

SEQ ID NO: 212200 - DNA, 25 bp, Mus musculus
agtctaaacatggtgggcacctctg

SEQ ID NO: 212201 - DNA, 25 bp, Mus musculus
agtctaaagtgtatcagctgctgca

SEQ ID NO: 212202 - DNA, 25 bp, Mus musculus
agtctaaagtgtttcagctgctgca

SEQ ID NO: 212203 - DNA, 25 bp, Mus musculus
agtctaaatcagcactcactatccc

SEQ ID NO: 212204 - DNA, 25 bp, Mus musculus
agtctaaatcaggactcactatccc

SEQ ID NO: 212205 - DNA, 25 bp, Mus musculus
agtctaacaggtcccagcccagttc

SEQ ID NO: 212206 - DNA, 25 bp, Mus musculus
agtctaacaggtgccagcccagttc

SEQ ID NO: 212207 - DNA, 25 bp, Mus musculus
agtctaaccacacaacctgggctaa

SEQ ID NO: 212208 - DNA, 25 bp, Mus musculus
agtctaaccacagaacctgggctaa

SEQ ID NO: 212209 - DNA, 25 bp, Mus musculus
agtctaaccctgcagcatctgagta

SEQ ID NO: 212210 - DNA, 25 bp, Mus musculus
agtctaaccctggagcatctgagta

SEQ ID NO: 212211 - DNA, 25 bp, Mus musculus
agtctaacctacccgagatacgtct

SEQ ID NO: 212212 - DNA, 25 bp, Mus musculus
agtctaacctacgcgagatacgtct

SEQ ID NO: 212213 - DNA, 25 bp, Mus musculus
agtctaacttgcatcagggatctct

SEQ ID NO: 212214 - DNA, 25 bp, Mus musculus
agtctaacttgcttcagggatctct

SEQ ID NO: 212215 - DNA, 25 bp, Mus musculus
agtctaagaatcctcatcttcaccc

SEQ ID NO: 212216 - DNA, 25 bp, Mus musculus
agtctaagaatcgtcatcttcaccc

SEQ ID NO: 212217 - DNA, 25 bp, Mus musculus
agtctaagctggacctaggagtcaa

SEQ ID NO: 212218 - DNA, 25 bp, Mus musculus
agtctaagctggtcctaggagtcaa

SEQ ID NO: 212219 - DNA, 25 bp, Mus musculus
agtctaaggcatcgctttaaccggt

SEQ ID NO: 212220 - DNA, 25 bp, Mus musculus
agtctaaggcatggctttaaccggt

SEQ ID NO: 212221 - DNA, 25 bp, Mus musculus
agtctaaggctcacctggaagggta

SEQ ID NO: 212222 - DNA, 25 bp, Mus musculus
agtctaaggctctcctggaagggta

SEQ ID NO: 212223 - DNA, 25 bp, Mus musculus
agtctaagtcttaccagtgttcacc

SEQ ID NO: 212224 - DNA, 25 bp, Mus musculus
agtctaagtctttccagtgttcacc

SEQ ID NO: 212225 - DNA, 25 bp, Mus musculus
agtctaatagacagctgcacctaga

SEQ ID NO: 212226 - DNA, 25 bp, Mus musculus
agtctaatagactgctgcacctaga

SEQ ID NO: 212227 - DNA, 25 bp, Mus musculus
agtctaatccacacataacacctat

SEQ ID NO: 212228 - DNA, 25 bp, Mus musculus
agtctaatccactcataacacctat

SEQ ID NO: 212229 - DNA, 25 bp, Mus musculus
agtctaatttgacctcacctagctt

SEQ ID NO: 212230 - DNA, 25 bp, Mus musculus
agtctaatttgagctcacctagctt

SEQ ID NO: 212231 - DNA, 25 bp, Mus musculus
agtctacaactactcctgtgaacca

SEQ ID NO: 212232 - DNA, 25 bp, Mus musculus
agtctacaactagtcctgtgaacca

SEQ ID NO: 212233 - DNA, 25 bp, Mus musculus
agtctacaagttacctgtcagggct

SEQ ID NO: 212234 - DNA, 25 bp, Mus musculus
agtctacaagtttcctgtcagggct

SEQ ID NO: 212235 - DNA, 25 bp, Mus musculus
agtctacactagaccaaagtgagaa

SEQ ID NO: 212236 - DNA, 25 bp, Mus musculus
agtctacactagtccaaagtgagaa

SEQ ID NO: 212237 - DNA, 25 bp, Mus musculus
agtctacagcaacggtatccacgcg

SEQ ID NO: 212238 - DNA, 25 bp, Mus musculus
agtctacagcaagggtatccacgcg

SEQ ID NO: 212239 - DNA, 25 bp, Mus musculus
agtctacagttcaagctgtcctgga

SEQ ID NO: 212240 - DNA, 25 bp, Mus musculus
agtctacagttctagctgtcctgga

SEQ ID NO: 212241 - DNA, 25 bp, Mus musculus
agtctacattccctcagcatatcat

SEQ ID NO: 212242 - DNA, 25 bp, Mus musculus
agtctacattccgtcagcatatcat

SEQ ID NO: 212243 - DNA, 25 bp, Mus musculus
agtctaccaactagtaaactagtgg

SEQ ID NO: 212244 - DNA, 25 bp, Mus musculus
agtctaccaacttgtaaactagtgg

SEQ ID NO: 212245 - DNA, 25 bp, Mus musculus
agtctaccctttatgctgggacagt

SEQ ID NO: 212246 - DNA, 25 bp, Mus musculus
agtctaccctttcgcctctctggaa

SEQ ID NO: 212247 - DNA, 25 bp, Mus musculus
agtctaccctttggcctctctggaa

SEQ ID NO: 212248 - DNA, 25 bp, Mus musculus
agtctaccctttttgctgggacagt

SEQ ID NO: 212249 - DNA, 25 bp, Mus musculus
agtctaccgggcagtgagggatttt

SEQ ID NO: 212250 - DNA, 25 bp, Mus musculus
agtctaccgggctgtgagggatttt

SEQ ID NO: 212251 - DNA, 25 bp, Mus musculus
agtctacctgacaaatctttagcat

SEQ ID NO: 212252 - DNA, 25 bp, Mus musculus
agtctacctgactaatctttagcat

SEQ ID NO: 212253 - DNA, 25 bp, Mus musculus
agtctacgcactccatttcttccaa

SEQ ID NO: 212254 - DNA, 25 bp, Mus musculus
agtctacgcactgcatttcttccaa

SEQ ID NO: 212255 - DNA, 25 bp, Mus musculus
agtctactactgaactgcaccatct

SEQ ID NO: 212256 - DNA, 25 bp, Mus musculus
agtctactactgtactgcaccatct

SEQ ID NO: 212257 - DNA, 25 bp, Mus musculus
agtctactatcccagcaaccatttt

SEQ ID NO: 212258 - DNA, 25 bp, Mus musculus
agtctactatccgagcaaccatttt

SEQ ID NO: 212259 - DNA, 25 bp, Mus musculus
agtctactcccgactgtttatattt

SEQ ID NO: 212260 - DNA, 25 bp, Mus musculus
agtctactcccgtctgtttatattt

SEQ ID NO: 212261 - DNA, 25 bp, Mus musculus
agtctactccttatgttatatttac

SEQ ID NO: 212262 - DNA, 25 bp, Mus musculus
agtctactccttttgttatatttac

SEQ ID NO: 212263 - DNA, 25 bp, Mus musculus
agtctactggtgacttcaccaccat

SEQ ID NO: 212264 - DNA, 25 bp, Mus musculus
agtctactggtgtcttcaccaccat

SEQ ID NO: 212265 - DNA, 25 bp, Mus musculus
agtctactgtagagtacatgcatgt

SEQ ID NO: 212266 - DNA, 25 bp, Mus musculus
agtctactgtagtgtacatgcatgt

SEQ ID NO: 212267 - DNA, 25 bp, Mus musculus
agtctactgtatattctctgggccg

SEQ ID NO: 212268 - DNA, 25 bp, Mus musculus
agtctactgtattttctctgggccg

SEQ ID NO: 212269 - DNA, 25 bp, Mus musculus
agtctactgtccctccagaagagat

SEQ ID NO: 212270 - DNA, 25 bp, Mus musculus
agtctactgtccgtccagaagagat

SEQ ID NO: 212271 - DNA, 25 bp, Mus musculus
agtctactgttcatgatgctgattt

SEQ ID NO: 212272 - DNA, 25 bp, Mus musculus
agtctactgttcttgatgctgattt

SEQ ID NO: 212273 - DNA, 25 bp, Mus musculus
agtctacttaatatatcaagtcatg

SEQ ID NO: 212274 - DNA, 25 bp, Mus musculus
agtctacttaatcctgtgaatcaca

SEQ ID NO: 212275 - DNA, 25 bp, Mus musculus
agtctacttaatgctgtgaatcaca

SEQ ID NO: 212276 - DNA, 25 bp, Mus musculus
agtctacttaatttatcaagtcatg

SEQ ID NO: 212277 - DNA, 25 bp, Mus musculus
agtctagacaacacttgccatctgt

SEQ ID NO: 212278 - DNA, 25 bp, Mus musculus
agtctagacaactcttgccatctgt

SEQ ID NO: 212279 - DNA, 25 bp, Mus musculus
agtctagaggagctcttgtctgccc

SEQ ID NO: 212280 - DNA, 25 bp, Mus musculus
agtctagaggaggtcttgtctgccc

SEQ ID NO: 212281 - DNA, 25 bp, Mus musculus
agtctagaggctctgaaagctctta

SEQ ID NO: 212282 - DNA, 25 bp, Mus musculus
agtctagaggctgtgaaagctctta

SEQ ID NO: 212283 - DNA, 25 bp, Mus musculus
agtctagagtaacgagctgttgttt

SEQ ID NO: 212284 - DNA, 25 bp, Mus musculus
agtctagagtaaggagctgttgttt

SEQ ID NO: 212285 - DNA, 25 bp, Mus musculus
agtctagatctgaagcaactataat

SEQ ID NO: 212286 - DNA, 25 bp, Mus musculus
agtctagatctgtagcaactataat

SEQ ID NO: 212287 - DNA, 25 bp, Mus musculus
agtctagattggacctcatacctct

SEQ ID NO: 212288 - DNA, 25 bp, Mus musculus
agtctagattggtcctcatacctct

SEQ ID NO: 212289 - DNA, 25 bp, Mus musculus
agtctagcaggtcgccagcttcatc

SEQ ID NO: 212290 - DNA, 25 bp, Mus musculus
agtctagcaggtggccagcttcatc

SEQ ID NO: 212291 - DNA, 25 bp, Mus musculus
agtctagcatgcacataagtgcaaa

SEQ ID NO: 212292 - DNA, 25 bp, Mus musculus
agtctagcatgctcataagtgcaaa

SEQ ID NO: 212293 - DNA, 25 bp, Mus musculus
agtctagccaagaaggtgcctatgt

SEQ ID NO: 212294 - DNA, 25 bp, Mus musculus
agtctagccaagtaggtgcctatgt

SEQ ID NO: 212295 - DNA, 25 bp, Mus musculus
agtctagccctaagatttgtagtca

SEQ ID NO: 212296 - DNA, 25 bp, Mus musculus
agtctagccctatgatttgtagtca

SEQ ID NO: 212297 - DNA, 25 bp, Mus musculus
agtctagccgtaatataaacacatg

SEQ ID NO: 212298 - DNA, 25 bp, Mus musculus
agtctagccgtattataaacacatg

SEQ ID NO: 212299 - DNA, 25 bp, Mus musculus
agtctagcctagaccattctgtcca

SEQ ID NO: 212300 - DNA, 25 bp, Mus musculus
agtctagcctagtccattctgtcca

SEQ ID NO: 212301 - DNA, 25 bp, Mus musculus
agtctagctattcacccagctctgg

SEQ ID NO: 212302 - DNA, 25 bp, Mus musculus
agtctagctattgacccagctctgg

SEQ ID NO: 212303 - DNA, 25 bp, Mus musculus
agtctagctcccacaatgcgacttt

SEQ ID NO: 212304 - DNA, 25 bp, Mus musculus
agtctagctccctcaatgcgacttt

SEQ ID NO: 212305 - DNA, 25 bp, Mus musculus
agtctagctctaccatgggttttat

SEQ ID NO: 212306 - DNA, 25 bp, Mus musculus
agtctagctctagcatgggttttat

SEQ ID NO: 212307 - DNA, 25 bp, Mus musculus
agtctagcttggcatgtgattctta

SEQ ID NO: 212308 - DNA, 25 bp, Mus musculus
agtctagcttgggatgtgattctta

SEQ ID NO: 212309 - DNA, 25 bp, Mus musculus
agtctaggatctcgtcaccaagttt

SEQ ID NO: 212310 - DNA, 25 bp, Mus musculus
agtctaggatctggtcaccaagttt

SEQ ID NO: 212311 - DNA, 25 bp, Mus musculus
agtctaggatgcagtcttcatggtc

SEQ ID NO: 212312 - DNA, 25 bp, Mus musculus
agtctaggatgctgtcttcatggtc

SEQ ID NO: 212313 - DNA, 25 bp, Mus musculus
agtctaggcttcaggcccgcagcag

SEQ ID NO: 212314 - DNA, 25 bp, Mus musculus
agtctaggcttccaccgtgtcattg

SEQ ID NO: 212315 - DNA, 25 bp, Mus musculus
agtctaggcttcgaccgtgtcattg

SEQ ID NO: 212316 - DNA, 25 bp, Mus musculus
agtctaggcttctggcccgcagcag

SEQ ID NO: 212317 - DNA, 25 bp, Mus musculus
agtctagggcaccttacaccagtga

SEQ ID NO: 212318 - DNA, 25 bp, Mus musculus
agtctagggcacgttacaccagtga

SEQ ID NO: 212319 - DNA, 25 bp, Mus musculus
agtctaggtgtaagagttctctctt

SEQ ID NO: 212320 - DNA, 25 bp, Mus musculus
agtctaggtgtatgagttctctctt

SEQ ID NO: 212321 - DNA, 25 bp, Mus musculus
agtctagtctggatcattcggctct

SEQ ID NO: 212322 - DNA, 25 bp, Mus musculus
agtctagtctggttcattcggctct

SEQ ID NO: 212323 - DNA, 25 bp, Mus musculus
agtctagtgaccataaactgaatga

SEQ ID NO: 212324 - DNA, 25 bp, Mus musculus
agtctagtgaccttaaactgaatga

SEQ ID NO: 212325 - DNA, 25 bp, Mus musculus
agtctagtgggtatgtggcatgatc

SEQ ID NO: 212326 - DNA, 25 bp, Mus musculus
agtctagtgggtttgtggcatgatc

SEQ ID NO: 212327 - DNA, 25 bp, Mus musculus
agtctagtggtaccaacagcgttga

SEQ ID NO: 212328 - DNA, 25 bp, Mus musculus
agtctagtggtagcaacagcgttga

SEQ ID NO: 212329 - DNA, 25 bp, Mus musculus
agtctagtgtggctgtgttcttcca

SEQ ID NO: 212330 - DNA, 25 bp, Mus musculus
agtctagtgtgggtgtgttcttcca

SEQ ID NO: 212331 - DNA, 25 bp, Mus musculus
agtctagttcatcggctctgttcac

SEQ ID NO: 212332 - DNA, 25 bp, Mus musculus
agtctagttcatgggctctgttcac

SEQ ID NO: 212333 - DNA, 25 bp, Mus musculus
agtctagttcttagcccagggcctt

SEQ ID NO: 212334 - DNA, 25 bp, Mus musculus
agtctagttctttgcccagggcctt

SEQ ID NO: 212335 - DNA, 25 bp, Mus musculus
agtctagttgaaatgctggccttca

SEQ ID NO: 212336 - DNA, 25 bp, Mus musculus
agtctagttgaattgctggccttca

SEQ ID NO: 212337 - DNA, 25 bp, Mus musculus
agtctataacaacctctttcatttt

SEQ ID NO: 212338 - DNA, 25 bp, Mus musculus
agtctataacaagctctttcatttt

SEQ ID NO: 212339 - DNA, 25 bp, Mus musculus
agtctatacccgatccacaggagaa

SEQ ID NO: 212340 - DNA, 25 bp, Mus musculus
agtctatacccgttccacaggagaa

SEQ ID NO: 212341 - DNA, 25 bp, Mus musculus
agtctatattaaagcgacgcatcac

SEQ ID NO: 212342 - DNA, 25 bp, Mus musculus
agtctatattaatgcgacgcatcac

SEQ ID NO: 212343 - DNA, 25 bp, Mus musculus
agtctatcaaaccttccatggtcca

SEQ ID NO: 212344 - DNA, 25 bp, Mus musculus
agtctatcaaacgttccatggtcca

SEQ ID NO: 212345 - DNA, 25 bp, Mus musculus
agtctatcactgagctaaagcccca

SEQ ID NO: 212346 - DNA, 25 bp, Mus musculus
agtctatcactgtgctaaagcccca

SEQ ID NO: 212347 - DNA, 25 bp, Mus musculus
agtctatcacttcccattatatttc

SEQ ID NO: 212348 - DNA, 25 bp, Mus musculus
agtctatcacttgccattatatttc

SEQ ID NO: 212349 - DNA, 25 bp, Mus musculus
agtctatccacaagttacctaggat

SEQ ID NO: 212350 - DNA, 25 bp, Mus musculus
agtctatccacatgttacctaggat

SEQ ID NO: 212351 - DNA, 25 bp, Mus musculus
agtctatccagcatccttgctacaa

SEQ ID NO: 212352 - DNA, 25 bp, Mus musculus
agtctatccagcttccttgctacaa

SEQ ID NO: 212353 - DNA, 25 bp, Mus musculus
agtctatcctgtattgaatcccaca

SEQ ID NO: 212354 - DNA, 25 bp, Mus musculus
agtctatcctgttttgaatcccaca

SEQ ID NO: 212355 - DNA, 25 bp, Mus musculus
agtctatcgcgaattatttccccag

SEQ ID NO: 212356 - DNA, 25 bp, Mus musculus
agtctatcgcgatttatttccccag

SEQ ID NO: 212357 - DNA, 25 bp, Mus musculus
agtctatcttcaccacaaacttatg

SEQ ID NO: 212358 - DNA, 25 bp, Mus musculus
agtctatcttcagcacaaacttatg

SEQ ID NO: 212359 - DNA, 25 bp, Mus musculus
agtctatgacctacgatccgatcct

SEQ ID NO: 212360 - DNA, 25 bp, Mus musculus
agtctatgaccttcgatccgatcct

SEQ ID NO: 212361 - DNA, 25 bp, Mus musculus
agtctatgccatcaactattagttt

SEQ ID NO: 212362 - DNA, 25 bp, Mus musculus
agtctatgccatgaactattagttt

SEQ ID NO: 212363 - DNA, 25 bp, Mus musculus
agtctatgccttccaacttagtaag

SEQ ID NO: 212364 - DNA, 25 bp, Mus musculus
agtctatgccttgcaacttagtaag

SEQ ID NO: 212365 - DNA, 25 bp, Mus musculus
agtctatgcgtaatccaatgtgcgt

SEQ ID NO: 212366 - DNA, 25 bp, Mus musculus
agtctatgcgtattccaatgtgcgt

SEQ ID NO: 212367 - DNA, 25 bp, Mus musculus
agtctatgctgcatcgtctaagtat

SEQ ID NO: 212368 - DNA, 25 bp, Mus musculus
agtctatgctgcttcgtctaagtat

SEQ ID NO: 212369 - DNA, 25 bp, Mus musculus
agtctatggatccaggttatcccag

SEQ ID NO: 212370 - DNA, 25 bp, Mus musculus
agtctatggatcgaggttatcccag

SEQ ID NO: 212371 - DNA, 25 bp, Mus musculus
agtctatggcttcttattacttcaa

SEQ ID NO: 212372 - DNA, 25 bp, Mus musculus
agtctatggcttgttattacttcaa

SEQ ID NO: 212373 - DNA, 25 bp, Mus musculus
agtctattgattaggctaggctggc

SEQ ID NO: 212374 - DNA, 25 bp, Mus musculus
agtctattgatttggctaggctggc

SEQ ID NO: 212375 - DNA, 25 bp, Mus musculus
agtctatttattctgcccagctcac

SEQ ID NO: 212376 - DNA, 25 bp, Mus musculus
agtctatttattgtgcccagctcac

SEQ ID NO: 212377 - DNA, 25 bp, Mus musculus
agtctatttcttactgtatacctga

SEQ ID NO: 212378 - DNA, 25 bp, Mus musculus
agtctatttctttctgtatacctga

SEQ ID NO: 212379 - DNA, 25 bp, Mus musculus
agtctcaaagttagtaccacagtta

SEQ ID NO: 212380 - DNA, 25 bp, Mus musculus
agtctcaaagtttgtaccacagtta

SEQ ID NO: 212381 - DNA, 25 bp, Mus musculus
agtctcaacactatggtgatcacca

SEQ ID NO: 212382 - DNA, 25 bp, Mus musculus
agtctcaacactttggtgatcacca

SEQ ID NO: 212383 - DNA, 25 bp, Mus musculus
agtctcaacagtatggtctttgccc

SEQ ID NO: 212384 - DNA, 25 bp, Mus musculus
agtctcaacagtttggtctttgccc

SEQ ID NO: 212385 - DNA, 25 bp, Mus musculus
agtctcaaggagaaactggccaagg

SEQ ID NO: 212386 - DNA, 25 bp, Mus musculus
agtctcaaggagtaactggccaagg

SEQ ID NO: 212387 - DNA, 25 bp, Mus musculus
agtctcaagtcacccttttgtcagc

SEQ ID NO: 212388 - DNA, 25 bp, Mus musculus
agtctcaagtcagccttttgtcagc

SEQ ID NO: 212389 - DNA, 25 bp, Mus musculus
agtctcaagttgaacccccagaggt

SEQ ID NO: 212390 - DNA, 25 bp, Mus musculus
agtctcaagttgtacccccagaggt

SEQ ID NO: 212391 - DNA, 25 bp, Mus musculus
agtctcaattctagggtcttctatt

SEQ ID NO: 212392 - DNA, 25 bp, Mus musculus
agtctcaattcttgggtcttctatt

SEQ ID NO: 212393 - DNA, 25 bp, Mus musculus
agtctcacaaatcggttcttctgct

SEQ ID NO: 212394 - DNA, 25 bp, Mus musculus
agtctcacaaatgggttcttctgct

SEQ ID NO: 212395 - DNA, 25 bp, Mus musculus
agtctcacacacatcgaggtacaga

SEQ ID NO: 212396 - DNA, 25 bp, Mus musculus
agtctcacacacttcgaggtacaga

SEQ ID NO: 212397 - DNA, 25 bp, Mus musculus
agtctcacagccaaagtctctgttt

SEQ ID NO: 212398 - DNA, 25 bp, Mus musculus
agtctcacagcctaagtctctgttt

SEQ ID NO: 212399 - DNA, 25 bp, Mus musculus
agtctcacagctacctgacagaatt

SEQ ID NO: 212400 - DNA, 25 bp, Mus musculus
agtctcacagcttcctgacagaatt

SEQ ID NO: 212401 - DNA, 25 bp, Mus musculus
agtctcacaggtacacttgtcccgg

SEQ ID NO: 212402 - DNA, 25 bp, Mus musculus
agtctcacaggttcacttgtcccgg

SEQ ID NO: 212403 - DNA, 25 bp, Mus musculus
agtctcacatcaacctgaccagtct

SEQ ID NO: 212404 - DNA, 25 bp, Mus musculus
agtctcacatcatcctgaccagtct

SEQ ID NO: 212405 - DNA, 25 bp, Mus musculus
agtctcaccaggatctcggtctgtt

SEQ ID NO: 212406 - DNA, 25 bp, Mus musculus
agtctcaccaggttctcggtctgtt

SEQ ID NO: 212407 - DNA, 25 bp, Mus musculus
agtctcaccctgaaagttttgcttt

SEQ ID NO: 212408 - DNA, 25 bp, Mus musculus
agtctcaccctgtaagttttgcttt

SEQ ID NO: 212409 - DNA, 25 bp, Mus musculus
agtctcacggagcttcctccatggt

SEQ ID NO: 212410 - DNA, 25 bp, Mus musculus
agtctcacggaggttcctccatggt

SEQ ID NO: 212411 - DNA, 25 bp, Mus musculus
agtctcacgtaaacatcacccttat

SEQ ID NO: 212412 - DNA, 25 bp, Mus musculus
agtctcacgtaatcatcacccttat

SEQ ID NO: 212413 - DNA, 25 bp, Mus musculus
agtctcacgttcctaccacagaaag

SEQ ID NO: 212414 - DNA, 25 bp, Mus musculus
agtctcacgttcgtaccacagaaag

SEQ ID NO: 212415 - DNA, 25 bp, Mus musculus
agtctcactcagctggttccgatgg

SEQ ID NO: 212416 - DNA, 25 bp, Mus musculus
agtctcactcaggtggttccgatgg

SEQ ID NO: 212417 - DNA, 25 bp, Mus musculus
agtctcactctcagtcaggcatcat

SEQ ID NO: 212418 - DNA, 25 bp, Mus musculus
agtctcactctctgtcaggcatcat

SEQ ID NO: 212419 - DNA, 25 bp, Mus musculus
agtctcactgtaatctagcatccca

SEQ ID NO: 212420 - DNA, 25 bp, Mus musculus
agtctcactgtattctagcatccca

SEQ ID NO: 212421 - DNA, 25 bp, Mus musculus
agtctcagaaacaccatgtcttttg

SEQ ID NO: 212422 - DNA, 25 bp, Mus musculus
agtctcagaaactccatgtcttttg

SEQ ID NO: 212423 - DNA, 25 bp, Mus musculus
agtctcagacaacctactatgcaca

SEQ ID NO: 212424 - DNA, 25 bp, Mus musculus
agtctcagacaagctactatgcaca

SEQ ID NO: 212425 - DNA, 25 bp, Mus musculus
agtctcagagacaacaatcacattt

SEQ ID NO: 212426 - DNA, 25 bp, Mus musculus
agtctcagagaccttatttttcttc

SEQ ID NO: 212427 - DNA, 25 bp, Mus musculus
agtctcagagacgttatttttcttc

SEQ ID NO: 212428 - DNA, 25 bp, Mus musculus
agtctcagagactacaatcacattt

SEQ ID NO: 212429 - DNA, 25 bp, Mus musculus
agtctcagagtaacttggccctggg

SEQ ID NO: 212430 - DNA, 25 bp, Mus musculus
agtctcagagtatcttggccctggg

SEQ ID NO: 212431 - DNA, 25 bp, Mus musculus
agtctcagatatattgctgcaggtt

SEQ ID NO: 212432 - DNA, 25 bp, Mus musculus
agtctcagatattttgctgcaggtt

SEQ ID NO: 212433 - DNA, 25 bp, Mus musculus
agtctcagccacagagaacaaggat

SEQ ID NO: 212434 - DNA, 25 bp, Mus musculus
agtctcagccactgagaacaaggat

SEQ ID NO: 212435 - DNA, 25 bp, Mus musculus
agtctcagcgtgctatgggctacat

SEQ ID NO: 212436 - DNA, 25 bp, Mus musculus
agtctcagcgtggtatgggctacat

SEQ ID NO: 212437 - DNA, 25 bp, Mus musculus
agtctcagctctaggccagtgtcat

SEQ ID NO: 212438 - DNA, 25 bp, Mus musculus
agtctcagctctctcgtgacattat

SEQ ID NO: 212439 - DNA, 25 bp, Mus musculus
agtctcagctctgtcgtgacattat

SEQ ID NO: 212440 - DNA, 25 bp, Mus musculus
agtctcagctcttggccagtgtcat

SEQ ID NO: 212441 - DNA, 25 bp, Mus musculus
agtctcagctgacggcatgcagcag

SEQ ID NO: 212442 - DNA, 25 bp, Mus musculus
agtctcagctgagggcatgcagcag

SEQ ID NO: 212443 - DNA, 25 bp, Mus musculus
agtctcaggaggagcagtgagacaa

SEQ ID NO: 212444 - DNA, 25 bp, Mus musculus
agtctcaggaggtgcagtgagacaa

SEQ ID NO: 212445 - DNA, 25 bp, Mus musculus
agtctcaggagtctttcttagtgca

SEQ ID NO: 212446 - DNA, 25 bp, Mus musculus
agtctcaggagtgtttcttagtgca

SEQ ID NO: 212447 - DNA, 25 bp, Mus musculus
agtctcaggctgagtaacatggcaa

SEQ ID NO: 212448 - DNA, 25 bp, Mus musculus
agtctcaggctgtgtaacatggcaa

SEQ ID NO: 212449 - DNA, 25 bp, Mus musculus
agtctcaggcttagtctggaggaca

SEQ ID NO: 212450 - DNA, 25 bp, Mus musculus
agtctcaggctttgtctggaggaca

SEQ ID NO: 212451 - DNA, 25 bp, Mus musculus
agtctcaggttcatggtcctgtgta

SEQ ID NO: 212452 - DNA, 25 bp, Mus musculus
agtctcaggttcttggtcctgtgta

SEQ ID NO: 212453 - DNA, 25 bp, Mus musculus
agtctcagtatgctgcgatgttccg

SEQ ID NO: 212454 - DNA, 25 bp, Mus musculus
agtctcagtatggtgcgatgttccg

SEQ ID NO: 212455 - DNA, 25 bp, Mus musculus
agtctcagtctacctgtctctgaac

SEQ ID NO: 212456 - DNA, 25 bp, Mus musculus
agtctcagtctagctgtctctgaac

SEQ ID NO: 212457 - DNA, 25 bp, Mus musculus
agtctcagtgtgaggccaaaggcct

SEQ ID NO: 212458 - DNA, 25 bp, Mus musculus
agtctcagtgtgtggccaaaggcct

SEQ ID NO: 212459 - DNA, 25 bp, Mus musculus
agtctcagtttcactttttatgcag

SEQ ID NO: 212460 - DNA, 25 bp, Mus musculus
agtctcagtttcagttggtgtgacc

SEQ ID NO: 212461 - DNA, 25 bp, Mus musculus
agtctcagtttctctttttatgcag

SEQ ID NO: 212462 - DNA, 25 bp, Mus musculus
agtctcagtttctgttggtgtgacc

SEQ ID NO: 212463 - DNA, 25 bp, Mus musculus
agtctcatactcagaatacactccc

SEQ ID NO: 212464 - DNA, 25 bp, Mus musculus
agtctcatactctgaatacactccc

SEQ ID NO: 212465 - DNA, 25 bp, Mus musculus
agtctcatgcagatgtgccatcttg

SEQ ID NO: 212466 - DNA, 25 bp, Mus musculus
agtctcatgcagttgtgccatcttg

SEQ ID NO: 212467 - DNA, 25 bp, Mus musculus
agtctcatggagagcactgcgctgc

SEQ ID NO: 212468 - DNA, 25 bp, Mus musculus
agtctcatggagtgcactgcgctgc

SEQ ID NO: 212469 - DNA, 25 bp, Mus musculus
agtctcattagccactgcaacattt

SEQ ID NO: 212470 - DNA, 25 bp, Mus musculus
agtctcattagcgactgcaacattt

SEQ ID NO: 212471 - DNA, 25 bp, Mus musculus
agtctcattaggaacaccaacccct

SEQ ID NO: 212472 - DNA, 25 bp, Mus musculus
agtctcattaggtacaccaacccct

SEQ ID NO: 212473 - DNA, 25 bp, Mus musculus
agtctcattatgagcccaagctgac

SEQ ID NO: 212474 - DNA, 25 bp, Mus musculus
agtctcattatgtgcccaagctgac

SEQ ID NO: 212475 - DNA, 25 bp, Mus musculus
agtctccaaacaagcatcggcgtgt

SEQ ID NO: 212476 - DNA, 25 bp, Mus musculus
agtctccaaacatgcatcggcgtgt

SEQ ID NO: 212477 - DNA, 25 bp, Mus musculus
agtctccaaactccgtgggcaacag

SEQ ID NO: 212478 - DNA, 25 bp, Mus musculus
agtctccaaactgcgtgggcaacag

SEQ ID NO: 212479 - DNA, 25 bp, Mus musculus
agtctccaaagaatgtccacctctt

SEQ ID NO: 212480 - DNA, 25 bp, Mus musculus
agtctccaaagattgtccacctctt

SEQ ID NO: 212481 - DNA, 25 bp, Mus musculus
agtctccacaggcatctatcaagtg

SEQ ID NO: 212482 - DNA, 25 bp, Mus musculus
agtctccacagggatctatcaagtg

SEQ ID NO: 212483 - DNA, 25 bp, Mus musculus
agtctccaccagattcttgatgaag

SEQ ID NO: 212484 - DNA, 25 bp, Mus musculus
agtctccaccagctgttggctcaac

SEQ ID NO: 212485 - DNA, 25 bp, Mus musculus
agtctccaccaggtgttggctcaac

SEQ ID NO: 212486 - DNA, 25 bp, Mus musculus
agtctccaccagtttcttgatgaag

SEQ ID NO: 212487 - DNA, 25 bp, Mus musculus
agtctccacctcagggattaaggca

SEQ ID NO: 212488 - DNA, 25 bp, Mus musculus
agtctccacctctgggattaaggca

SEQ ID NO: 212489 - DNA, 25 bp, Mus musculus
agtctccactgaccaggctcaggga

SEQ ID NO: 212490 - DNA, 25 bp, Mus musculus
agtctccactgagcaggctcaggga

SEQ ID NO: 212491 - DNA, 25 bp, Mus musculus
agtctccagaagaccccttccaaat

SEQ ID NO: 212492 - DNA, 25 bp, Mus musculus
agtctccagaagtccccttccaaat

SEQ ID NO: 212493 - DNA, 25 bp, Mus musculus
agtctccagagcagcaaggagagtg

SEQ ID NO: 212494 - DNA, 25 bp, Mus musculus
agtctccagagctgcaaggagagtg

SEQ ID NO: 212495 - DNA, 25 bp, Mus musculus
agtctccagcacaccgggtgggaac

SEQ ID NO: 212496 - DNA, 25 bp, Mus musculus
agtctccagcactccgggtgggaac

SEQ ID NO: 212497 - DNA, 25 bp, Mus musculus
agtctccagcatccacaggatggca

SEQ ID NO: 212498 - DNA, 25 bp, Mus musculus
agtctccagcatgcacaggatggca

SEQ ID NO: 212499 - DNA, 25 bp, Mus musculus
agtctccagccaaggtacatcagtt

SEQ ID NO: 212500 - DNA, 25 bp, Mus musculus
agtctccagccatggtacatcagtt

SEQ ID NO: 212501 - DNA, 25 bp, Mus musculus
agtctccagtaaaatcagcgtccgc

SEQ ID NO: 212502 - DNA, 25 bp, Mus musculus
agtctccagtaatatcagcgtccgc

SEQ ID NO: 212503 - DNA, 25 bp, Mus musculus
agtctccagtccattcgagcagatg

SEQ ID NO: 212504 - DNA, 25 bp, Mus musculus
agtctccagtcctttcgagcagatg

SEQ ID NO: 212505 - DNA, 25 bp, Mus musculus
agtctccatcccaaaattctgattg

SEQ ID NO: 212506 - DNA, 25 bp, Mus musculus
agtctccatccctaaattctgattg

SEQ ID NO: 212507 - DNA, 25 bp, Mus musculus
agtctccatctaatcaagtgtcccc

SEQ ID NO: 212508 - DNA, 25 bp, Mus musculus
agtctccatctattcaagtgtcccc

SEQ ID NO: 212509 - DNA, 25 bp, Mus musculus
agtctccatcttccatatatgcatc

SEQ ID NO: 212510 - DNA, 25 bp, Mus musculus
agtctccatcttgcatatatgcatc

SEQ ID NO: 212511 - DNA, 25 bp, Mus musculus
agtctccatgagcttcacctaatgc

SEQ ID NO: 212512 - DNA, 25 bp, Mus musculus
agtctccatgaggttcacctaatgc

SEQ ID NO: 212513 - DNA, 25 bp, Mus musculus
agtctccatgttcactgtctcatgc

SEQ ID NO: 212514 - DNA, 25 bp, Mus musculus
agtctccatgttgactgtctcatgc

SEQ ID NO: 212515 - DNA, 25 bp, Mus musculus
agtctccattggaagctggccaggt

SEQ ID NO: 212516 - DNA, 25 bp, Mus musculus
agtctccattggacctcagccagga

SEQ ID NO: 212517 - DNA, 25 bp, Mus musculus
agtctccattggtagctggccaggt

SEQ ID NO: 212518 - DNA, 25 bp, Mus musculus
agtctccattggtcctcagccagga

SEQ ID NO: 212519 - DNA, 25 bp, Mus musculus
agtctcccaaagagcccaggcgtcg

SEQ ID NO: 212520 - DNA, 25 bp, Mus musculus
agtctcccaaagtgcccaggcgtcg

SEQ ID NO: 212521 - DNA, 25 bp, Mus musculus
agtctcccaactattcataattcta

SEQ ID NO: 212522 - DNA, 25 bp, Mus musculus
agtctcccaacttttcataattcta

SEQ ID NO: 212523 - DNA, 25 bp, Mus musculus
agtctcccacacagtgcgagtcgga

SEQ ID NO: 212524 - DNA, 25 bp, Mus musculus
agtctcccacactgtgcgagtcgga

SEQ ID NO: 212525 - DNA, 25 bp, Mus musculus
agtctcccagagacatgtcttctct

SEQ ID NO: 212526 - DNA, 25 bp, Mus musculus
agtctcccagagtcatgtcttctct

SEQ ID NO: 212527 - DNA, 25 bp, Mus musculus
agtctcccagccaggtatatagcag

SEQ ID NO: 212528 - DNA, 25 bp, Mus musculus
agtctcccagcctggtatatagcag

SEQ ID NO: 212529 - DNA, 25 bp, Mus musculus
agtctccccaggcagttcacaattg

SEQ ID NO: 212530 - DNA, 25 bp, Mus musculus
agtctccccagggagttcacaattg

SEQ ID NO: 212531 - DNA, 25 bp, Mus musculus
agtctcccctatctgaaatgcttgt

SEQ ID NO: 212532 - DNA, 25 bp, Mus musculus
agtctcccctatgtgaaatgcttgt

SEQ ID NO: 212533 - DNA, 25 bp, Mus musculus
agtctcccctgacctatttatgcag

SEQ ID NO: 212534 - DNA, 25 bp, Mus musculus
agtctcccctgagctatttatgcag

SEQ ID NO: 212535 - DNA, 25 bp, Mus musculus
agtctccccttgctgagacctaatt

SEQ ID NO: 212536 - DNA, 25 bp, Mus musculus
agtctccccttggtgagacctaatt

SEQ ID NO: 212537 - DNA, 25 bp, Mus musculus
agtctcccgagtatctgggtctaca

SEQ ID NO: 212538 - DNA, 25 bp, Mus musculus
agtctcccgagtctcagtgttggat

SEQ ID NO: 212539 - DNA, 25 bp, Mus musculus
agtctcccgagtgtcagtgttggat

SEQ ID NO: 212540 - DNA, 25 bp, Mus musculus
agtctcccgagtttctgggtctaca

SEQ ID NO: 212541 - DNA, 25 bp, Mus musculus
agtctcccggctctgtgagtcaggc

SEQ ID NO: 212542 - DNA, 25 bp, Mus musculus
agtctcccggctgtgtgagtcaggc

SEQ ID NO: 212543 - DNA, 25 bp, Mus musculus
agtctcccgggaaggtattcttttg

SEQ ID NO: 212544 - DNA, 25 bp, Mus musculus
agtctcccgggatggtattcttttg

SEQ ID NO: 212545 - DNA, 25 bp, Mus musculus
agtctccctagtcttggcattacag

SEQ ID NO: 212546 - DNA, 25 bp, Mus musculus
agtctccctagtgttggcattacag

SEQ ID NO: 212547 - DNA, 25 bp, Mus musculus
agtctccctatcatcgagtttcttt

SEQ ID NO: 212548 - DNA, 25 bp, Mus musculus
agtctccctatcttcgagtttcttt

SEQ ID NO: 212549 - DNA, 25 bp, Mus musculus
agtctccctgctctggtgatagaga

SEQ ID NO: 212550 - DNA, 25 bp, Mus musculus
agtctccctgctgtggtgatagaga

SEQ ID NO: 212551 - DNA, 25 bp, Mus musculus
agtctccctgtcatgtttcatttta

SEQ ID NO: 212552 - DNA, 25 bp, Mus musculus
agtctccctgtcttgtttcatttta

SEQ ID NO: 212553 - DNA, 25 bp, Mus musculus
agtctcccttccagtgtgagcgagg

SEQ ID NO: 212554 - DNA, 25 bp, Mus musculus
agtctcccttcctgtgtgagcgagg

SEQ ID NO: 212555 - DNA, 25 bp, Mus musculus
agtctccgaagacccatttggacag

SEQ ID NO: 212556 - DNA, 25 bp, Mus musculus
agtctccgaagagccatttggacag

SEQ ID NO: 212557 - DNA, 25 bp, Mus musculus
agtctccgcaaacagcatgaggctg

SEQ ID NO: 212558 - DNA, 25 bp, Mus musculus
agtctccgcaaagagcatgaggctg

SEQ ID NO: 212559 - DNA, 25 bp, Mus musculus
agtctccgcaagcttgctgggcata

SEQ ID NO: 212560 - DNA, 25 bp, Mus musculus
agtctccgcaaggttgctgggcata

SEQ ID NO: 212561 - DNA, 25 bp, Mus musculus
agtctccgccagacctaatcagagg

SEQ ID NO: 212562 - DNA, 25 bp, Mus musculus
agtctccgccagtcctaatcagagg

SEQ ID NO: 212563 - DNA, 25 bp, Mus musculus
agtctccgctgcaagtcagtgcgga

SEQ ID NO: 212564 - DNA, 25 bp, Mus musculus
agtctccgctgctagtcagtgcgga

SEQ ID NO: 212565 - DNA, 25 bp, Mus musculus
agtctccggcacagcaaggaggagc

SEQ ID NO: 212566 - DNA, 25 bp, Mus musculus
agtctccggcactgcaaggaggagc

SEQ ID NO: 212567 - DNA, 25 bp, Mus musculus
agtctccggcgcaggcgcctatggt

SEQ ID NO: 212568 - DNA, 25 bp, Mus musculus
agtctccggcgctggcgcctatggt

SEQ ID NO: 212569 - DNA, 25 bp, Mus musculus
agtctccgggcacatctgtggtcac

SEQ ID NO: 212570 - DNA, 25 bp, Mus musculus
agtctccgggcagatctgtggtcac

SEQ ID NO: 212571 - DNA, 25 bp, Mus musculus
agtctcctaacaacagtatccacat

SEQ ID NO: 212572 - DNA, 25 bp, Mus musculus
agtctcctaacatcagtatccacat

SEQ ID NO: 212573 - DNA, 25 bp, Mus musculus
agtctcctacagaattgtctctcag

SEQ ID NO: 212574 - DNA, 25 bp, Mus musculus
agtctcctacagtattgtctctcag

SEQ ID NO: 212575 - DNA, 25 bp, Mus musculus
agtctcctactgacattggcaggca

SEQ ID NO: 212576 - DNA, 25 bp, Mus musculus
agtctcctactgtcattggcaggca

SEQ ID NO: 212577 - DNA, 25 bp, Mus musculus
agtctcctagctaacctgcagagta

SEQ ID NO: 212578 - DNA, 25 bp, Mus musculus
agtctcctagcttacctgcagagta

SEQ ID NO: 212579 - DNA, 25 bp, Mus musculus
agtctcctcaagagcagcctttggc

SEQ ID NO: 212580 - DNA, 25 bp, Mus musculus
agtctcctcaagtgcagcctttggc

SEQ ID NO: 212581 - DNA, 25 bp, Mus musculus
agtctcctcactctctaaggaccga

SEQ ID NO: 212582 - DNA, 25 bp, Mus musculus
agtctcctcactgtctaaggaccga

SEQ ID NO: 212583 - DNA, 25 bp, Mus musculus
agtctcctcagcctgagaggtcaaa

SEQ ID NO: 212584 - DNA, 25 bp, Mus musculus
agtctcctcagcgtgagaggtcaaa

SEQ ID NO: 212585 - DNA, 25 bp, Mus musculus
agtctcctgctgcactacatgagaa

SEQ ID NO: 212586 - DNA, 25 bp, Mus musculus
agtctcctgctggactacatgagaa

SEQ ID NO: 212587 - DNA, 25 bp, Mus musculus
agtctcctggcaagtactctaagtg

SEQ ID NO: 212588 - DNA, 25 bp, Mus musculus
agtctcctggcatgtactctaagtg

SEQ ID NO: 212589 - DNA, 25 bp, Mus musculus
agtctcctggctcctcaaagcatag

SEQ ID NO: 212590 - DNA, 25 bp, Mus musculus
agtctcctggctgctcaaagcatag

SEQ ID NO: 212591 - DNA, 25 bp, Mus musculus
agtctcctgggcagggaactactca

SEQ ID NO: 212592 - DNA, 25 bp, Mus musculus
agtctcctgggctgggaactactca

SEQ ID NO: 212593 - DNA, 25 bp, Mus musculus
agtctcctgggtctattaggcttct

SEQ ID NO: 212594 - DNA, 25 bp, Mus musculus
agtctcctgggtgtattaggcttct

SEQ ID NO: 212595 - DNA, 25 bp, Mus musculus
agtctcctggtgcttattttagaag

SEQ ID NO: 212596 - DNA, 25 bp, Mus musculus
agtctcctggtggttattttagaag

SEQ ID NO: 212597 - DNA, 25 bp, Mus musculus
agtctcctgttgctacccaagatgc

SEQ ID NO: 212598 - DNA, 25 bp, Mus musculus
agtctcctgttggtacccaagatgc

SEQ ID NO: 212599 - DNA, 25 bp, Mus musculus
agtctccttaagctagccattcaga

SEQ ID NO: 212600 - DNA, 25 bp, Mus musculus
agtctccttaaggtagccattcaga

SEQ ID NO: 212601 - DNA, 25 bp, Mus musculus
agtctccttactcctgtcatttgaa

SEQ ID NO: 212602 - DNA, 25 bp, Mus musculus
agtctccttactgctgtcatttgaa

SEQ ID NO: 212603 - DNA, 25 bp, Mus musculus
agtctccttcatctttaactccgat

SEQ ID NO: 212604 - DNA, 25 bp, Mus musculus
agtctccttcatgtttaactccgat

SEQ ID NO: 212605 - DNA, 25 bp, Mus musculus
agtctccttcgcagtgttcaattta

SEQ ID NO: 212606 - DNA, 25 bp, Mus musculus
agtctccttcgctgtgttcaattta

SEQ ID NO: 212607 - DNA, 25 bp, Mus musculus
agtctccttttcaattggtcttgct

SEQ ID NO: 212608 - DNA, 25 bp, Mus musculus
agtctccttttctattggtcttgct

SEQ ID NO: 212609 - DNA, 25 bp, Mus musculus
agtctcgacgtgcaccaagggcaca

SEQ ID NO: 212610 - DNA, 25 bp, Mus musculus
agtctcgacgtggaccaagggcaca

SEQ ID NO: 212611 - DNA, 25 bp, Mus musculus
agtctcgactgtcgctggctatcat

SEQ ID NO: 212612 - DNA, 25 bp, Mus musculus
agtctcgactgtggctggctatcat

SEQ ID NO: 212613 - DNA, 25 bp, Mus musculus
agtctcgagtggacacttggtccag

SEQ ID NO: 212614 - DNA, 25 bp, Mus musculus
agtctcgagtggtcacttggtccag

SEQ ID NO: 212615 - DNA, 25 bp, Mus musculus
agtctcgatatcattcctgtccaga

SEQ ID NO: 212616 - DNA, 25 bp, Mus musculus
agtctcgatatctttcctgtccaga

SEQ ID NO: 212617 - DNA, 25 bp, Mus musculus
agtctcgatcatcagcatctacagg

SEQ ID NO: 212618 - DNA, 25 bp, Mus musculus
agtctcgatcatgagcatctacagg

SEQ ID NO: 212619 - DNA, 25 bp, Mus musculus
agtctcgatgacatctcatgggctt

SEQ ID NO: 212620 - DNA, 25 bp, Mus musculus
agtctcgatgacttctcatgggctt

SEQ ID NO: 212621 - DNA, 25 bp, Mus musculus
agtctcgcccctatgacaggttcct

SEQ ID NO: 212622 - DNA, 25 bp, Mus musculus
agtctcgcccctttgacaggttcct

SEQ ID NO: 212623 - DNA, 25 bp, Mus musculus
agtctcgctgacactggacttaagc

SEQ ID NO: 212624 - DNA, 25 bp, Mus musculus
agtctcgctgactctggacttaagc

SEQ ID NO: 212625 - DNA, 25 bp, Mus musculus
agtctcgggagtactgggcccatta

SEQ ID NO: 212626 - DNA, 25 bp, Mus musculus
agtctcgggagttctgggcccatta

SEQ ID NO: 212627 - DNA, 25 bp, Mus musculus
agtctcggtcttaattccctttctg

SEQ ID NO: 212628 - DNA, 25 bp, Mus musculus
agtctcggtctttattccctttctg

SEQ ID NO: 212629 - DNA, 25 bp, Mus musculus
agtctctacaccaaattcacagctt

SEQ ID NO: 212630 - DNA, 25 bp, Mus musculus
agtctctacacctaattcacagctt

SEQ ID NO: 212631 - DNA, 25 bp, Mus musculus
agtctctacatgattgtttgtccat

SEQ ID NO: 212632 - DNA, 25 bp, Mus musculus
agtctctacatgtttgtttgtccat

SEQ ID NO: 212633 - DNA, 25 bp, Mus musculus
agtctctacctgctcactgtcaaca

SEQ ID NO: 212634 - DNA, 25 bp, Mus musculus
agtctctacctggtcactgtcaaca

SEQ ID NO: 212635 - DNA, 25 bp, Mus musculus
agtctctactccagggtaaccctgg

SEQ ID NO: 212636 - DNA, 25 bp, Mus musculus
agtctctactcctgggtaaccctgg

SEQ ID NO: 212637 - DNA, 25 bp, Mus musculus
agtctctacttacccttgggtatcc

SEQ ID NO: 212638 - DNA, 25 bp, Mus musculus
agtctctacttagccttgggtatcc

SEQ ID NO: 212639 - DNA, 25 bp, Mus musculus
agtctctagcataccagattccaag

SEQ ID NO: 212640 - DNA, 25 bp, Mus musculus
agtctctagcatatcagtcttctac

SEQ ID NO: 212641 - DNA, 25 bp, Mus musculus
agtctctagcatccacgtatcagta

SEQ ID NO: 212642 - DNA, 25 bp, Mus musculus
agtctctagcatgcacgtatcagta

SEQ ID NO: 212643 - DNA, 25 bp, Mus musculus
agtctctagcattccagattccaag

SEQ ID NO: 212644 - DNA, 25 bp, Mus musculus
agtctctagcatttcagtcttctac

SEQ ID NO: 212645 - DNA, 25 bp, Mus musculus
agtctctaggcgagaactcctcaga

SEQ ID NO: 212646 - DNA, 25 bp, Mus musculus
agtctctaggcgtgaactcctcaga

SEQ ID NO: 212647 - DNA, 25 bp, Mus musculus
agtctctagtaacttcctggcacag

SEQ ID NO: 212648 - DNA, 25 bp, Mus musculus
agtctctagtaagttcctggcacag

SEQ ID NO: 212649 - DNA, 25 bp, Mus musculus
agtctctatagcactcaactcatat

SEQ ID NO: 212650 - DNA, 25 bp, Mus musculus
agtctctatagctctcaactcatat

SEQ ID NO: 212651 - DNA, 25 bp, Mus musculus
agtctctatcctccaggactcaagg

SEQ ID NO: 212652 - DNA, 25 bp, Mus musculus
agtctctatcctgcaggactcaagg

SEQ ID NO: 212653 - DNA, 25 bp, Mus musculus
agtctctcaaagattgtttttcctc

SEQ ID NO: 212654 - DNA, 25 bp, Mus musculus
agtctctcaaagtttgtttttcctc

SEQ ID NO: 212655 - DNA, 25 bp, Mus musculus
agtctctcaaatacactgtgaacag

SEQ ID NO: 212656 - DNA, 25 bp, Mus musculus
agtctctcaaattcactgtgaacag

SEQ ID NO: 212657 - DNA, 25 bp, Mus musculus
agtctctcactcagtttgtagccta

SEQ ID NO: 212658 - DNA, 25 bp, Mus musculus
agtctctcactctgtttgtagccta

SEQ ID NO: 212659 - DNA, 25 bp, Mus musculus
agtctctcactgatgtagctggaaa

SEQ ID NO: 212660 - DNA, 25 bp, Mus musculus
agtctctcactgttgtagctggaaa

SEQ ID NO: 212661 - DNA, 25 bp, Mus musculus
agtctctccattccttcatgaaaat

SEQ ID NO: 212662 - DNA, 25 bp, Mus musculus
agtctctccattgcttcatgaaaat

SEQ ID NO: 212663 - DNA, 25 bp, Mus musculus
agtctctccctcagaatgacaggtc

SEQ ID NO: 212664 - DNA, 25 bp, Mus musculus
agtctctccctctgaatgacaggtc

SEQ ID NO: 212665 - DNA, 25 bp, Mus musculus
agtctctccgtcagcacaatgggct

SEQ ID NO: 212666 - DNA, 25 bp, Mus musculus
agtctctccgtctgcacaatgggct

SEQ ID NO: 212667 - DNA, 25 bp, Mus musculus
agtctctccttgaccaatctggctt

SEQ ID NO: 212668 - DNA, 25 bp, Mus musculus
agtctctccttgtccaatctggctt

SEQ ID NO: 212669 - DNA, 25 bp, Mus musculus
agtctctcctttctttagccctgtc

SEQ ID NO: 212670 - DNA, 25 bp, Mus musculus
agtctctcctttgtttagccctgtc

SEQ ID NO: 212671 - DNA, 25 bp, Mus musculus
agtctctcgtggacgtcactgggca

SEQ ID NO: 212672 - DNA, 25 bp, Mus musculus
agtctctcgtggtcgtcactgggca

SEQ ID NO: 212673 - DNA, 25 bp, Mus musculus
agtctctctcagatcagtcgataaa

SEQ ID NO: 212674 - DNA, 25 bp, Mus musculus
agtctctctcagttcagtcgataaa

SEQ ID NO: 212675 - DNA, 25 bp, Mus musculus
agtctctctctacactctctctaga

SEQ ID NO: 212676 - DNA, 25 bp, Mus musculus
agtctctctctagactctctctaga

SEQ ID NO: 212677 - DNA, 25 bp, Mus musculus
agtctctctgttcccttacaagagg

SEQ ID NO: 212678 - DNA, 25 bp, Mus musculus
agtctctctgttgccttacaagagg

SEQ ID NO: 212679 - DNA, 25 bp, Mus musculus
agtctctcttgtatggttgcccaaa

SEQ ID NO: 212680 - DNA, 25 bp, Mus musculus
agtctctcttgtttggttgcccaaa

SEQ ID NO: 212681 - DNA, 25 bp, Mus musculus
agtctctgaactcccttagttgcta

SEQ ID NO: 212682 - DNA, 25 bp, Mus musculus
agtctctgaactgccttagttgcta

SEQ ID NO: 212683 - DNA, 25 bp, Mus musculus
agtctctgaaggatgcctgggcctc

SEQ ID NO: 212684 - DNA, 25 bp, Mus musculus
agtctctgaaggttgcctgggcctc

SEQ ID NO: 212685 - DNA, 25 bp, Mus musculus
agtctctgaccgaagctgagctgtg

SEQ ID NO: 212686 - DNA, 25 bp, Mus musculus
agtctctgaccgtagctgagctgtg

SEQ ID NO: 212687 - DNA, 25 bp, Mus musculus
agtctctgactgctccagcccaaag

SEQ ID NO: 212688 - DNA, 25 bp, Mus musculus
agtctctgactggtccagcccaaag

SEQ ID NO: 212689 - DNA, 25 bp, Mus musculus
agtctctgagctaagatcttaccca

SEQ ID NO: 212690 - DNA, 25 bp, Mus musculus
agtctctgagctctgcgtttgtact

SEQ ID NO: 212691 - DNA, 25 bp, Mus musculus
agtctctgagctgtgcgtttgtact

SEQ ID NO: 212692 - DNA, 25 bp, Mus musculus
agtctctgagcttagatcttaccca

SEQ ID NO: 212693 - DNA, 25 bp, Mus musculus
agtctctgaggtagtggccgccaca

SEQ ID NO: 212694 - DNA, 25 bp, Mus musculus
agtctctgaggttgtggccgccaca

SEQ ID NO: 212695 - DNA, 25 bp, Mus musculus
agtctctgcagaagccgtgcattac

SEQ ID NO: 212696 - DNA, 25 bp, Mus musculus
agtctctgcagatgccgtgcattac

SEQ ID NO: 212697 - DNA, 25 bp, Mus musculus
agtctctgccctccgatgaagaagg

SEQ ID NO: 212698 - DNA, 25 bp, Mus musculus
agtctctgccctgcgatgaagaagg

SEQ ID NO: 212699 - DNA, 25 bp, Mus musculus
agtctctgcctacaacacttcggag

SEQ ID NO: 212700 - DNA, 25 bp, Mus musculus
agtctctgcctagaacacttcggag

SEQ ID NO: 212701 - DNA, 25 bp, Mus musculus
agtctctgctccatcaagttccact

SEQ ID NO: 212702 - DNA, 25 bp, Mus musculus
agtctctgctccattgtggtcactt

SEQ ID NO: 212703 - DNA, 25 bp, Mus musculus
agtctctgctccttcaagttccact

SEQ ID NO: 212704 - DNA, 25 bp, Mus musculus
agtctctgctcctttgtggtcactt

SEQ ID NO: 212705 - DNA, 25 bp, Mus musculus
agtctctgctctaatgtctgccata

SEQ ID NO: 212706 - DNA, 25 bp, Mus musculus
agtctctgctcttatgtctgccata

SEQ ID NO: 212707 - DNA, 25 bp, Mus musculus
agtctctggcttcctagtacaggag

SEQ ID NO: 212708 - DNA, 25 bp, Mus musculus
agtctctggcttgctagtacaggag

SEQ ID NO: 212709 - DNA, 25 bp, Mus musculus
agtctctgggcaacaccagctgagg

SEQ ID NO: 212710 - DNA, 25 bp, Mus musculus
agtctctgggcaaggaaaggctctt

SEQ ID NO: 212711 - DNA, 25 bp, Mus musculus
agtctctgggcatcaccagctgagg

SEQ ID NO: 212712 - DNA, 25 bp, Mus musculus
agtctctgggcatggaaaggctctt

SEQ ID NO: 212713 - DNA, 25 bp, Mus musculus
agtctctgtaagacctcagtttccc

SEQ ID NO: 212714 - DNA, 25 bp, Mus musculus
agtctctgtaagtcctcagtttccc

SEQ ID NO: 212715 - DNA, 25 bp, Mus musculus
agtctctgtaccagactagtctctg

SEQ ID NO: 212716 - DNA, 25 bp, Mus musculus
agtctctgtacctgactagtctctg

SEQ ID NO: 212717 - DNA, 25 bp, Mus musculus
agtctctgtcccctgacattttagg

SEQ ID NO: 212718 - DNA, 25 bp, Mus musculus
agtctctgtcccgtgacattttagg

SEQ ID NO: 212719 - DNA, 25 bp, Mus musculus
agtctctgtgcccagtgcttgttgc

SEQ ID NO: 212720 - DNA, 25 bp, Mus musculus
agtctctgtgccgagtgcttgttgc

SEQ ID NO: 212721 - DNA, 25 bp, Mus musculus
agtctctgtttaccctgtctgagac

SEQ ID NO: 212722 - DNA, 25 bp, Mus musculus
agtctctgtttagcctgtctgagac

SEQ ID NO: 212723 - DNA, 25 bp, Mus musculus
agtctcttacccagagtgtttcgaa

SEQ ID NO: 212724 - DNA, 25 bp, Mus musculus
agtctcttaccctgagtgtttcgaa

SEQ ID NO: 212725 - DNA, 25 bp, Mus musculus
agtctcttactcagtcgcacaacaa

SEQ ID NO: 212726 - DNA, 25 bp, Mus musculus
agtctcttactcattattcttcacc

SEQ ID NO: 212727 - DNA, 25 bp, Mus musculus
agtctcttactctgtcgcacaacaa

SEQ ID NO: 212728 - DNA, 25 bp, Mus musculus
agtctcttactctttattcttcacc

SEQ ID NO: 212729 - DNA, 25 bp, Mus musculus
agtctcttagcacagttcctcatga

SEQ ID NO: 212730 - DNA, 25 bp, Mus musculus
agtctcttagcagagttcctcatga

SEQ ID NO: 212731 - DNA, 25 bp, Mus musculus
agtctcttcaataagatgtctagga

SEQ ID NO: 212732 - DNA, 25 bp, Mus musculus
agtctcttcaatccctgcctgcaaa

SEQ ID NO: 212733 - DNA, 25 bp, Mus musculus
agtctcttcaatgcctgcctgcaaa

SEQ ID NO: 212734 - DNA, 25 bp, Mus musculus
agtctcttcaattagatgtctagga

SEQ ID NO: 212735 - DNA, 25 bp, Mus musculus
agtctcttcacaacagctgcatgaa

SEQ ID NO: 212736 - DNA, 25 bp, Mus musculus
agtctcttcacatcagctgcatgaa

SEQ ID NO: 212737 - DNA, 25 bp, Mus musculus
agtctcttcaggctgcattgtgcat

SEQ ID NO: 212738 - DNA, 25 bp, Mus musculus
agtctcttcagggtgcattgtgcat

SEQ ID NO: 212739 - DNA, 25 bp, Mus musculus
agtctcttcatcaccgggacaggca

SEQ ID NO: 212740 - DNA, 25 bp, Mus musculus
agtctcttcatctccgggacaggca

SEQ ID NO: 212741 - DNA, 25 bp, Mus musculus
agtctcttccgaccacacgaagttg

SEQ ID NO: 212742 - DNA, 25 bp, Mus musculus
agtctcttccgagcacacgaagttg

SEQ ID NO: 212743 - DNA, 25 bp, Mus musculus
agtctcttcggtatcctggaattca

SEQ ID NO: 212744 - DNA, 25 bp, Mus musculus
agtctcttcggtttcctggaattca

SEQ ID NO: 212745 - DNA, 25 bp, Mus musculus
agtctcttctagaaacggcttcaga

SEQ ID NO: 212746 - DNA, 25 bp, Mus musculus
agtctcttctagtaacggcttcaga

SEQ ID NO: 212747 - DNA, 25 bp, Mus musculus
agtctcttctctctgctgagtctgt

SEQ ID NO: 212748 - DNA, 25 bp, Mus musculus
agtctcttctctgtgctgagtctgt

SEQ ID NO: 212749 - DNA, 25 bp, Mus musculus
agtctcttctggccttgcattcctg

SEQ ID NO: 212750 - DNA, 25 bp, Mus musculus
agtctcttctgggcttgcattcctg

SEQ ID NO: 212751 - DNA, 25 bp, Mus musculus
agtctcttgcatctctgttccctaa

SEQ ID NO: 212752 - DNA, 25 bp, Mus musculus
agtctcttgcatgtctgttccctaa

SEQ ID NO: 212753 - DNA, 25 bp, Mus musculus
agtctcttgctgatgcattctgacc

SEQ ID NO: 212754 - DNA, 25 bp, Mus musculus
agtctcttgctgttgcattctgacc

SEQ ID NO: 212755 - DNA, 25 bp, Mus musculus
agtctcttgggcacaaatttcctgt

SEQ ID NO: 212756 - DNA, 25 bp, Mus musculus
agtctcttgggctcaaatttcctgt

SEQ ID NO: 212757 - DNA, 25 bp, Mus musculus
agtctcttgtggattttactctatc

SEQ ID NO: 212758 - DNA, 25 bp, Mus musculus
agtctcttgtggtttttactctatc

SEQ ID NO: 212759 - DNA, 25 bp, Mus musculus
agtctcttgtttccactgtagctct

SEQ ID NO: 212760 - DNA, 25 bp, Mus musculus
agtctcttgtttgcactgtagctct

SEQ ID NO: 212761 - DNA, 25 bp, Mus musculus
agtctctttaagatgcctaggttgg

SEQ ID NO: 212762 - DNA, 25 bp, Mus musculus
agtctctttaagttgcctaggttgg

SEQ ID NO: 212763 - DNA, 25 bp, Mus musculus
agtctctttaggattctcagtctca

SEQ ID NO: 212764 - DNA, 25 bp, Mus musculus
agtctctttaggtttctcagtctca

SEQ ID NO: 212765 - DNA, 25 bp, Mus musculus
agtctctttccgactatgttagtcc

SEQ ID NO: 212766 - DNA, 25 bp, Mus musculus
agtctctttccgtctatgttagtcc

SEQ ID NO: 212767 - DNA, 25 bp, Mus musculus
agtctgaaaactacggtgcgtaata

SEQ ID NO: 212768 - DNA, 25 bp, Mus musculus
agtctgaaaacttcggtgcgtaata

SEQ ID NO: 212769 - DNA, 25 bp, Mus musculus
agtctgaaacgtcctattcttaaag

SEQ ID NO: 212770 - DNA, 25 bp, Mus musculus
agtctgaaacgtgctattcttaaag

SEQ ID NO: 212771 - DNA, 25 bp, Mus musculus
agtctgaagactcctcctctacaaa

SEQ ID NO: 212772 - DNA, 25 bp, Mus musculus
agtctgaagactgctcctctacaaa

SEQ ID NO: 212773 - DNA, 25 bp, Mus musculus
agtctgaagctgaagcccacacatc

SEQ ID NO: 212774 - DNA, 25 bp, Mus musculus
agtctgaagctgtagcccacacatc

SEQ ID NO: 212775 - DNA, 25 bp, Mus musculus
agtctgaagcttatctatggcaaaa

SEQ ID NO: 212776 - DNA, 25 bp, Mus musculus
agtctgaagcttcttaggcaccaca

SEQ ID NO: 212777 - DNA, 25 bp, Mus musculus
agtctgaagcttgttaggcaccaca

SEQ ID NO: 212778 - DNA, 25 bp, Mus musculus
agtctgaagcttttctatggcaaaa

SEQ ID NO: 212779 - DNA, 25 bp, Mus musculus
agtctgaaggccctcctgtatctca

SEQ ID NO: 212780 - DNA, 25 bp, Mus musculus
agtctgaaggccgtcctgtatctca

SEQ ID NO: 212781 - DNA, 25 bp, Mus musculus
agtctgaagggcatgttctctaccc

SEQ ID NO: 212782 - DNA, 25 bp, Mus musculus
agtctgaagggcttgttctctaccc

SEQ ID NO: 212783 - DNA, 25 bp, Mus musculus
agtctgaagtcacggcattgtttct

SEQ ID NO: 212784 - DNA, 25 bp, Mus musculus
agtctgaagtcagggcattgtttct

SEQ ID NO: 212785 - DNA, 25 bp, Mus musculus
agtctgaatctcaagcggctttaag

SEQ ID NO: 212786 - DNA, 25 bp, Mus musculus
agtctgaatctctagcggctttaag

SEQ ID NO: 212787 - DNA, 25 bp, Mus musculus
agtctgaatgtaactttctccccat

SEQ ID NO: 212788 - DNA, 25 bp, Mus musculus
agtctgaatgtatctttctccccat

SEQ ID NO: 212789 - DNA, 25 bp, Mus musculus
agtctgaatttcagggctgaccccg

SEQ ID NO: 212790 - DNA, 25 bp, Mus musculus
agtctgaatttctgggctgaccccg

SEQ ID NO: 212791 - DNA, 25 bp, Mus musculus
agtctgacaagccaacattgcccag

SEQ ID NO: 212792 - DNA, 25 bp, Mus musculus
agtctgacaagcgaacattgcccag

SEQ ID NO: 212793 - DNA, 25 bp, Mus musculus
agtctgacccagctgacttacttgg

SEQ ID NO: 212794 - DNA, 25 bp, Mus musculus
agtctgacccaggtgacttacttgg

SEQ ID NO: 212795 - DNA, 25 bp, Mus musculus
agtctgaccttactgtgtgtttgag

SEQ ID NO: 212796 - DNA, 25 bp, Mus musculus
agtctgaccttagtgtgtgtttgag

SEQ ID NO: 212797 - DNA, 25 bp, Mus musculus
agtctgactaatccatgttttcatc

SEQ ID NO: 212798 - DNA, 25 bp, Mus musculus
agtctgactaatgcatgttttcatc

SEQ ID NO: 212799 - DNA, 25 bp, Mus musculus
agtctgactccaaatcctgagtttt

SEQ ID NO: 212800 - DNA, 25 bp, Mus musculus
agtctgactccatatcctgagtttt

SEQ ID NO: 212801 - DNA, 25 bp, Mus musculus
agtctgactcttagagagcaccttt

SEQ ID NO: 212802 - DNA, 25 bp, Mus musculus
agtctgactctttgagagcaccttt

SEQ ID NO: 212803 - DNA, 25 bp, Mus musculus
agtctgactgcacagagcgcctctg

SEQ ID NO: 212804 - DNA, 25 bp, Mus musculus
agtctgactgcagagagcgcctctg

SEQ ID NO: 212805 - DNA, 25 bp, Mus musculus
agtctgactgtaaactttgcctaag

SEQ ID NO: 212806 - DNA, 25 bp, Mus musculus
agtctgactgtatactttgcctaag

SEQ ID NO: 212807 - DNA, 25 bp, Mus musculus
agtctgacttacctgtaccttgttc

SEQ ID NO: 212808 - DNA, 25 bp, Mus musculus
agtctgacttacgtgtaccttgttc

SEQ ID NO: 212809 - DNA, 25 bp, Mus musculus
agtctgagccaaccctggtccacat

SEQ ID NO: 212810 - DNA, 25 bp, Mus musculus
agtctgagccaagcctggtccacat

SEQ ID NO: 212811 - DNA, 25 bp, Mus musculus
agtctgagcgagaactaaccctggg

SEQ ID NO: 212812 - DNA, 25 bp, Mus musculus
agtctgagcgagtactaaccctggg

SEQ ID NO: 212813 - DNA, 25 bp, Mus musculus
agtctgaggctcaggtgattatcga

SEQ ID NO: 212814 - DNA, 25 bp, Mus musculus
agtctgaggctctggtgattatcga

SEQ ID NO: 212815 - DNA, 25 bp, Mus musculus
agtctgagtgagagacctgctccca

SEQ ID NO: 212816 - DNA, 25 bp, Mus musculus
agtctgagtgagtgacctgctccca

SEQ ID NO: 212817 - DNA, 25 bp, Mus musculus
agtctgagtgctctcaatccagcct

SEQ ID NO: 212818 - DNA, 25 bp, Mus musculus
agtctgagtgctgtcaatccagcct

SEQ ID NO: 212819 - DNA, 25 bp, Mus musculus
agtctgagttggaactgttcctgca

SEQ ID NO: 212820 - DNA, 25 bp, Mus musculus
agtctgagttggtactgttcctgca

SEQ ID NO: 212821 - DNA, 25 bp, Mus musculus
agtctgagttgtctgactttgctct

SEQ ID NO: 212822 - DNA, 25 bp, Mus musculus
agtctgagttgtgtgactttgctct

SEQ ID NO: 212823 - DNA, 25 bp, Mus musculus
agtctgatacagaggcgccttagta

SEQ ID NO: 212824 - DNA, 25 bp, Mus musculus
agtctgatacagtggcgccttagta

SEQ ID NO: 212825 - DNA, 25 bp, Mus musculus
agtctgatattcacccatatctggg

SEQ ID NO: 212826 - DNA, 25 bp, Mus musculus
agtctgatattctcccatatctggg

SEQ ID NO: 212827 - DNA, 25 bp, Mus musculus
agtctgatccaccacacagggacag

SEQ ID NO: 212828 - DNA, 25 bp, Mus musculus
agtctgatccacgacacagggacag

SEQ ID NO: 212829 - DNA, 25 bp, Mus musculus
agtctgatcccaataagtgtttctg

SEQ ID NO: 212830 - DNA, 25 bp, Mus musculus
agtctgatcccattaagtgtttctg

SEQ ID NO: 212831 - DNA, 25 bp, Mus musculus
agtctgatgatccacgcttcaacga

SEQ ID NO: 212832 - DNA, 25 bp, Mus musculus
agtctgatgatcgacgcttcaacga

SEQ ID NO: 212833 - DNA, 25 bp, Mus musculus
agtctgatgctaagacacgggcaca

SEQ ID NO: 212834 - DNA, 25 bp, Mus musculus
agtctgatgctatgacacgggcaca

SEQ ID NO: 212835 - DNA, 25 bp, Mus musculus
agtctgatggcacctggaatcctct

SEQ ID NO: 212836 - DNA, 25 bp, Mus musculus
agtctgatggcagctggaatcctct

SEQ ID NO: 212837 - DNA, 25 bp, Mus musculus
agtctgatgtcaaagtgcctgtaca

SEQ ID NO: 212838 - DNA, 25 bp, Mus musculus
agtctgatgtcatagtgcctgtaca

SEQ ID NO: 212839 - DNA, 25 bp, Mus musculus
agtctgattaaacccctggtggtgc

SEQ ID NO: 212840 - DNA, 25 bp, Mus musculus
agtctgattaaagccctggtggtgc

SEQ ID NO: 212841 - DNA, 25 bp, Mus musculus
agtctgattcagatgtacaattgtc

SEQ ID NO: 212842 - DNA, 25 bp, Mus musculus
agtctgattcagttgtacaattgtc

SEQ ID NO: 212843 - DNA, 25 bp, Mus musculus
agtctgattctgagagcccgcaagc

SEQ ID NO: 212844 - DNA, 25 bp, Mus musculus
agtctgattctgtgagcccgcaagc

SEQ ID NO: 212845 - DNA, 25 bp, Mus musculus
agtctgattgctcctatggaaatgt

SEQ ID NO: 212846 - DNA, 25 bp, Mus musculus
agtctgattgctgctatggaaatgt

SEQ ID NO: 212847 - DNA, 25 bp, Mus musculus
agtctgatttgcataagggctttca

SEQ ID NO: 212848 - DNA, 25 bp, Mus musculus
agtctgatttgcttaagggctttca

SEQ ID NO: 212849 - DNA, 25 bp, Mus musculus
agtctgcaaatactacttcctctac

SEQ ID NO: 212850 - DNA, 25 bp, Mus musculus
agtctgcaaatagtacttcctctac

SEQ ID NO: 212851 - DNA, 25 bp, Mus musculus
agtctgcaaggacgcggctctccta

SEQ ID NO: 212852 - DNA, 25 bp, Mus musculus
agtctgcaaggaggcggctctccta

SEQ ID NO: 212853 - DNA, 25 bp, Mus musculus
agtctgcacaacctgggttcccaaa

SEQ ID NO: 212854 - DNA, 25 bp, Mus musculus
agtctgcacaacgtgggttcccaaa

SEQ ID NO: 212855 - DNA, 25 bp, Mus musculus
agtctgcactatcccaaggccctta

SEQ ID NO: 212856 - DNA, 25 bp, Mus musculus
agtctgcactatgccaaggccctta

SEQ ID NO: 212857 - DNA, 25 bp, Mus musculus
agtctgcagtgcaggcaggcgccaa

SEQ ID NO: 212858 - DNA, 25 bp, Mus musculus
agtctgcagtgctggcaggcgccaa

SEQ ID NO: 212859 - DNA, 25 bp, Mus musculus
agtctgcatacactgccaccaaagg

SEQ ID NO: 212860 - DNA, 25 bp, Mus musculus
agtctgcatacagtgccaccaaagg

SEQ ID NO: 212861 - DNA, 25 bp, Mus musculus
agtctgcatggacctcctgtctaga

SEQ ID NO: 212862 - DNA, 25 bp, Mus musculus
agtctgcatggagctcctgtctaga

SEQ ID NO: 212863 - DNA, 25 bp, Mus musculus
agtctgcatggcactcctctgaagt

SEQ ID NO: 212864 - DNA, 25 bp, Mus musculus
agtctgcatggctctcctctgaagt

SEQ ID NO: 212865 - DNA, 25 bp, Mus musculus
agtctgcatgtaaagctgggaaaat

SEQ ID NO: 212866 - DNA, 25 bp, Mus musculus
agtctgcatgtatagctgggaaaat

SEQ ID NO: 212867 - DNA, 25 bp, Mus musculus
agtctgccaaatcctgtcggcaaca

SEQ ID NO: 212868 - DNA, 25 bp, Mus musculus
agtctgccaaatgctgtcggcaaca

SEQ ID NO: 212869 - DNA, 25 bp, Mus musculus
agtctgccaaggaaggtcggaaagt

SEQ ID NO: 212870 - DNA, 25 bp, Mus musculus
agtctgccaaggtaggtcggaaagt

SEQ ID NO: 212871 - DNA, 25 bp, Mus musculus
agtctgccaagtcggctgtactcta

SEQ ID NO: 212872 - DNA, 25 bp, Mus musculus
agtctgccaagtgggctgtactcta

SEQ ID NO: 212873 - DNA, 25 bp, Mus musculus
agtctgccaggcaaggttttgcgca

SEQ ID NO: 212874 - DNA, 25 bp, Mus musculus
agtctgccaggctaggttttgcgca

SEQ ID NO: 212875 - DNA, 25 bp, Mus musculus
agtctgccatttaactcctttgtag

SEQ ID NO: 212876 - DNA, 25 bp, Mus musculus
agtctgccatttcggactctaggaa

SEQ ID NO: 212877 - DNA, 25 bp, Mus musculus
agtctgccatttgggactctaggaa

SEQ ID NO: 212878 - DNA, 25 bp, Mus musculus
agtctgccattttactcctttgtag

SEQ ID NO: 212879 - DNA, 25 bp, Mus musculus
agtctgcccatgctgtcttagtagt

SEQ ID NO: 212880 - DNA, 25 bp, Mus musculus
agtctgcccatggtgtcttagtagt

SEQ ID NO: 212881 - DNA, 25 bp, Mus musculus
agtctgcccggcctctttggaaatt

SEQ ID NO: 212882 - DNA, 25 bp, Mus musculus
agtctgcccggcgtctttggaaatt

SEQ ID NO: 212883 - DNA, 25 bp, Mus musculus
agtctgccctagaacttagcttttg

SEQ ID NO: 212884 - DNA, 25 bp, Mus musculus
agtctgccctagtacttagcttttg

SEQ ID NO: 212885 - DNA, 25 bp, Mus musculus
agtctgccctgcagtgtcccagtac

SEQ ID NO: 212886 - DNA, 25 bp, Mus musculus
agtctgccctgctgtgtcccagtac

SEQ ID NO: 212887 - DNA, 25 bp, Mus musculus
agtctgccgccaagtgtggatgaga

SEQ ID NO: 212888 - DNA, 25 bp, Mus musculus
agtctgccgccatgtgtggatgaga

SEQ ID NO: 212889 - DNA, 25 bp, Mus musculus
agtctgcctttcaagagacctccat

SEQ ID NO: 212890 - DNA, 25 bp, Mus musculus
agtctgcctttctagagacctccat

SEQ ID NO: 212891 - DNA, 25 bp, Mus musculus
agtctgcctttgctgtgcttcctgt

SEQ ID NO: 212892 - DNA, 25 bp, Mus musculus
agtctgcctttggtgtgcttcctgt

SEQ ID NO: 212893 - DNA, 25 bp, Mus musculus
agtctgcgacacctggccagtgaag

SEQ ID NO: 212894 - DNA, 25 bp, Mus musculus
agtctgcgacacgtggccagtgaag

SEQ ID NO: 212895 - DNA, 25 bp, Mus musculus
agtctgcgatcgcttctgaacccac

SEQ ID NO: 212896 - DNA, 25 bp, Mus musculus
agtctgcgatcggttctgaacccac

SEQ ID NO: 212897 - DNA, 25 bp, Mus musculus
agtctgcgatggaaacgtcagcgga

SEQ ID NO: 212898 - DNA, 25 bp, Mus musculus
agtctgcgatggtaacgtcagcgga

SEQ ID NO: 212899 - DNA, 25 bp, Mus musculus
agtctgcggctacattgggaatgat

SEQ ID NO: 212900 - DNA, 25 bp, Mus musculus
agtctgcggctagattgggaatgat

SEQ ID NO: 212901 - DNA, 25 bp, Mus musculus
agtctgcgggctcaaagtgaagaac

SEQ ID NO: 212902 - DNA, 25 bp, Mus musculus
agtctgcgggctgaaagtgaagaac

SEQ ID NO: 212903 - DNA, 25 bp, Mus musculus
agtctgcgtcatccagcccggtttt

SEQ ID NO: 212904 - DNA, 25 bp, Mus musculus
agtctgcgtcatgcagcccggtttt

SEQ ID NO: 212905 - DNA, 25 bp, Mus musculus
agtctgctcaaactggacatgcccg

SEQ ID NO: 212906 - DNA, 25 bp, Mus musculus
agtctgctcaaagtggacatgcccg

SEQ ID NO: 212907 - DNA, 25 bp, Mus musculus
agtctgctctcacatttctcctttt

SEQ ID NO: 212908 - DNA, 25 bp, Mus musculus
agtctgctctcagatttctcctttt

SEQ ID NO: 212909 - DNA, 25 bp, Mus musculus
agtctgctcttcaagtgacacttgt

SEQ ID NO: 212910 - DNA, 25 bp, Mus musculus
agtctgctcttcaggcatttaatgc

SEQ ID NO: 212911 - DNA, 25 bp, Mus musculus
agtctgctcttctagtgacacttgt

SEQ ID NO: 212912 - DNA, 25 bp, Mus musculus
agtctgctcttctggcatttaatgc

SEQ ID NO: 212913 - DNA, 25 bp, Mus musculus
agtctgctgatgacaatacccgcta

SEQ ID NO: 212914 - DNA, 25 bp, Mus musculus
agtctgctgatgtcaatacccgcta

SEQ ID NO: 212915 - DNA, 25 bp, Mus musculus
agtctgctgcaaaccagtctggcca

SEQ ID NO: 212916 - DNA, 25 bp, Mus musculus
agtctgctgcaatccagtctggcca

SEQ ID NO: 212917 - DNA, 25 bp, Mus musculus
agtctgctgccacggagtcctggct

SEQ ID NO: 212918 - DNA, 25 bp, Mus musculus
agtctgctgccagggagtcctggct

SEQ ID NO: 212919 - DNA, 25 bp, Mus musculus
agtctgctgcgcctggttttcagct

SEQ ID NO: 212920 - DNA, 25 bp, Mus musculus
agtctgctgcgcgtggttttcagct

SEQ ID NO: 212921 - DNA, 25 bp, Mus musculus
agtctgctggagaaccttatgccat

SEQ ID NO: 212922 - DNA, 25 bp, Mus musculus
agtctgctggagtaccttatgccat

SEQ ID NO: 212923 - DNA, 25 bp, Mus musculus
agtctgctgtaacctgaagccacgt

SEQ ID NO: 212924 - DNA, 25 bp, Mus musculus
agtctgctgtaagctgaagccacgt

SEQ ID NO: 212925 - DNA, 25 bp, Mus musculus
agtctgctgtcaaatgcttttttac

SEQ ID NO: 212926 - DNA, 25 bp, Mus musculus
agtctgctgtcacctgacatggtaa

SEQ ID NO: 212927 - DNA, 25 bp, Mus musculus
agtctgctgtcagctgacatggtaa

SEQ ID NO: 212928 - DNA, 25 bp, Mus musculus
agtctgctgtcatatgcttttttac

SEQ ID NO: 212929 - DNA, 25 bp, Mus musculus
agtctgcttatgctttgcaatgatc

SEQ ID NO: 212930 - DNA, 25 bp, Mus musculus
agtctgcttatggtttgcaatgatc

SEQ ID NO: 212931 - DNA, 25 bp, Mus musculus
agtctgcttcggcctgggatggtct

SEQ ID NO: 212932 - DNA, 25 bp, Mus musculus
agtctgcttcgggctgggatggtct

SEQ ID NO: 212933 - DNA, 25 bp, Mus musculus
agtctgcttgatctgttgttggcct

SEQ ID NO: 212934 - DNA, 25 bp, Mus musculus
agtctgcttgatgtgttgttggcct

SEQ ID NO: 212935 - DNA, 25 bp, Mus musculus
agtctgcttggcatgaaacccatcc

SEQ ID NO: 212936 - DNA, 25 bp, Mus musculus
agtctgcttggcttgaaacccatcc

SEQ ID NO: 212937 - DNA, 25 bp, Mus musculus
agtctgctttttagctctggcttct

SEQ ID NO: 212938 - DNA, 25 bp, Mus musculus
agtctgcttttttgctctggcttct

SEQ ID NO: 212939 - DNA, 25 bp, Mus musculus
agtctggaaacaatcattcaggcag

SEQ ID NO: 212940 - DNA, 25 bp, Mus musculus
agtctggaaacattcattcaggcag

SEQ ID NO: 212941 - DNA, 25 bp, Mus musculus
agtctggaatttctgatactttatc

SEQ ID NO: 212942 - DNA, 25 bp, Mus musculus
agtctggaatttgtgatactttatc

SEQ ID NO: 212943 - DNA, 25 bp, Mus musculus
agtctggaccaccagatgccggtaa

SEQ ID NO: 212944 - DNA, 25 bp, Mus musculus
agtctggaccacgagatgccggtaa

SEQ ID NO: 212945 - DNA, 25 bp, Mus musculus
agtctggactctacactatgagcag

SEQ ID NO: 212946 - DNA, 25 bp, Mus musculus
agtctggactctacagatgaactga

SEQ ID NO: 212947 - DNA, 25 bp, Mus musculus
agtctggactcttcactatgagcag

SEQ ID NO: 212948 - DNA, 25 bp, Mus musculus
agtctggactcttcagatgaactga

SEQ ID NO: 212949 - DNA, 25 bp, Mus musculus
agtctggactgacttcttcgtgagt

SEQ ID NO: 212950 - DNA, 25 bp, Mus musculus
agtctggactgagttcttcgtgagt

SEQ ID NO: 212951 - DNA, 25 bp, Mus musculus
agtctggagagcaccctgaaggctt

SEQ ID NO: 212952 - DNA, 25 bp, Mus musculus
agtctggagagctccctgaaggctt

SEQ ID NO: 212953 - DNA, 25 bp, Mus musculus
agtctggagcgcagctgctactgga

SEQ ID NO: 212954 - DNA, 25 bp, Mus musculus
agtctggagcgctgctgctactgga

SEQ ID NO: 212955 - DNA, 25 bp, Mus musculus
agtctggaggctactcaaccgatag

SEQ ID NO: 212956 - DNA, 25 bp, Mus musculus
agtctggaggcttctcaaccgatag

SEQ ID NO: 212957 - DNA, 25 bp, Mus musculus
agtctggatagaatctcttgataga

SEQ ID NO: 212958 - DNA, 25 bp, Mus musculus
agtctggatagattctcttgataga

SEQ ID NO: 212959 - DNA, 25 bp, Mus musculus
agtctggatcctacatgaggactta

SEQ ID NO: 212960 - DNA, 25 bp, Mus musculus
agtctggatccttcatgaggactta

SEQ ID NO: 212961 - DNA, 25 bp, Mus musculus
agtctggattccctgattacagcgc

SEQ ID NO: 212962 - DNA, 25 bp, Mus musculus
agtctggattccgtgattacagcgc

SEQ ID NO: 212963 - DNA, 25 bp, Mus musculus
agtctggcaagtcccttgaacacaa

SEQ ID NO: 212964 - DNA, 25 bp, Mus musculus
agtctggcaagtgccttgaacacaa

SEQ ID NO: 212965 - DNA, 25 bp, Mus musculus
agtctggcaggcatcgagcacgagc

SEQ ID NO: 212966 - DNA, 25 bp, Mus musculus
agtctggcaggcttcgagcacgagc

SEQ ID NO: 212967 - DNA, 25 bp, Mus musculus
agtctggcattcaaagggcttaccg

SEQ ID NO: 212968 - DNA, 25 bp, Mus musculus
agtctggcattctaagggcttaccg

SEQ ID NO: 212969 - DNA, 25 bp, Mus musculus
agtctggccaatcttcctcatctga

SEQ ID NO: 212970 - DNA, 25 bp, Mus musculus
agtctggccaatgttcctcatctga

SEQ ID NO: 212971 - DNA, 25 bp, Mus musculus
agtctggcccagcacacctgtgaga

SEQ ID NO: 212972 - DNA, 25 bp, Mus musculus
agtctggcccaggacacctgtgaga

SEQ ID NO: 212973 - DNA, 25 bp, Mus musculus
agtctggccttcatttcttattcta

SEQ ID NO: 212974 - DNA, 25 bp, Mus musculus
agtctggccttcttttcttattcta

SEQ ID NO: 212975 - DNA, 25 bp, Mus musculus
agtctggctgaaaggtaactctcac

SEQ ID NO: 212976 - DNA, 25 bp, Mus musculus
agtctggctgaatggtaactctcac

SEQ ID NO: 212977 - DNA, 25 bp, Mus musculus
agtctggctgcaacggtgactctgg

SEQ ID NO: 212978 - DNA, 25 bp, Mus musculus
agtctggctgcatcggtgactctgg

SEQ ID NO: 212979 - DNA, 25 bp, Mus musculus
agtctggctgctcttttacggagga

SEQ ID NO: 212980 - DNA, 25 bp, Mus musculus
agtctggctgctgttttacggagga

SEQ ID NO: 212981 - DNA, 25 bp, Mus musculus
agtctggctgggactctcacatgtt

SEQ ID NO: 212982 - DNA, 25 bp, Mus musculus
agtctggctgggtctctcacatgtt

SEQ ID NO: 212983 - DNA, 25 bp, Mus musculus
agtctggcttaccttgccttaagag

SEQ ID NO: 212984 - DNA, 25 bp, Mus musculus
agtctggcttacgttgccttaagag

SEQ ID NO: 212985 - DNA, 25 bp, Mus musculus
agtctggcttgtcttgggcagcctt

SEQ ID NO: 212986 - DNA, 25 bp, Mus musculus
agtctggcttgtgttgggcagcctt

SEQ ID NO: 212987 - DNA, 25 bp, Mus musculus
agtctgggaccaaagctgctttaaa

SEQ ID NO: 212988 - DNA, 25 bp, Mus musculus
agtctgggaccatagctgctttaaa

SEQ ID NO: 212989 - DNA, 25 bp, Mus musculus
agtctgggagaaccccatctcggac

SEQ ID NO: 212990 - DNA, 25 bp, Mus musculus
agtctgggagaagcccatctcggac

SEQ ID NO: 212991 - DNA, 25 bp, Mus musculus
agtctgggatatctagtactagttc

SEQ ID NO: 212992 - DNA, 25 bp, Mus musculus
agtctgggatatgtagtactagttc

SEQ ID NO: 212993 - DNA, 25 bp, Mus musculus
agtctgggctcaccgttccagacca

SEQ ID NO: 212994 - DNA, 25 bp, Mus musculus
agtctgggctcagcgttccagacca

SEQ ID NO: 212995 - DNA, 25 bp, Mus musculus
agtctgggtccacccaaatcacatt

SEQ ID NO: 212996 - DNA, 25 bp, Mus musculus
agtctgggtccagccaaatcacatt

SEQ ID NO: 212997 - DNA, 25 bp, Mus musculus
agtctgggtgcacgccaccgcgaca

SEQ ID NO: 212998 - DNA, 25 bp, Mus musculus
agtctgggtgcaggccaccgcgaca

SEQ ID NO: 212999 - DNA, 25 bp, Mus musculus
agtctgggttgcagttcactgctgg

SEQ ID NO: 213000 - DNA, 25 bp, Mus musculus
agtctgggttgctgttcactgctgg

SEQ ID NO: 213001 - DNA, 25 bp, Mus musculus
agtctggtaattagcccatgcttct

SEQ ID NO: 213002 - DNA, 25 bp, Mus musculus
agtctggtaatttgcccatgcttct

SEQ ID NO: 213003 - DNA, 25 bp, Mus musculus
agtctggtcactataaccctcagtg

SEQ ID NO: 213004 - DNA, 25 bp, Mus musculus
agtctggtcactttaaccctcagtg

SEQ ID NO: 213005 - DNA, 25 bp, Mus musculus
agtctggtcaggctctttaccacat

SEQ ID NO: 213006 - DNA, 25 bp, Mus musculus
agtctggtcagggtctttaccacat

SEQ ID NO: 213007 - DNA, 25 bp, Mus musculus
agtctggtcatacttcgctctatga

SEQ ID NO: 213008 - DNA, 25 bp, Mus musculus
agtctggtcatagttcgctctatga

SEQ ID NO: 213009 - DNA, 25 bp, Mus musculus
agtctggtccacaacatcgttgcat

SEQ ID NO: 213010 - DNA, 25 bp, Mus musculus
agtctggtccactacatcgttgcat

SEQ ID NO: 213011 - DNA, 25 bp, Mus musculus
agtctggtccatcccaggtctgaga

SEQ ID NO: 213012 - DNA, 25 bp, Mus musculus
agtctggtccatgccaggtctgaga

SEQ ID NO: 213013 - DNA, 25 bp, Mus musculus
agtctggtcctgctgactctggatg

SEQ ID NO: 213014 - DNA, 25 bp, Mus musculus
agtctggtcctggtgactctggatg

SEQ ID NO: 213015 - DNA, 25 bp, Mus musculus
agtctggtctacacaactataccct

SEQ ID NO: 213016 - DNA, 25 bp, Mus musculus
agtctggtctacagtaacttgttgt

SEQ ID NO: 213017 - DNA, 25 bp, Mus musculus
agtctggtctactcaactataccct

SEQ ID NO: 213018 - DNA, 25 bp, Mus musculus
agtctggtctactgtaacttgttgt

SEQ ID NO: 213019 - DNA, 25 bp, Mus musculus
agtctggtctccatgatctttgtct

SEQ ID NO: 213020 - DNA, 25 bp, Mus musculus
agtctggtctccattggtccatggc

SEQ ID NO: 213021 - DNA, 25 bp, Mus musculus
agtctggtctccttgatctttgtct

SEQ ID NO: 213022 - DNA, 25 bp, Mus musculus
agtctggtctcctttggtccatggc

SEQ ID NO: 213023 - DNA, 25 bp, Mus musculus
agtctggtctgtacatcctgtaaga

SEQ ID NO: 213024 - DNA, 25 bp, Mus musculus
agtctggtctgttcatcctgtaaga

SEQ ID NO: 213025 - DNA, 25 bp, Mus musculus
agtctggtgctacattagcctgcat

SEQ ID NO: 213026 - DNA, 25 bp, Mus musculus
agtctggtgctagattagcctgcat

SEQ ID NO: 213027 - DNA, 25 bp, Mus musculus
agtctggttctcctggtgcttttca

SEQ ID NO: 213028 - DNA, 25 bp, Mus musculus
agtctggttctcgtggtgcttttca

SEQ ID NO: 213029 - DNA, 25 bp, Mus musculus
agtctgtaaagcactcttgagtctc

SEQ ID NO: 213030 - DNA, 25 bp, Mus musculus
agtctgtaaagctctcttgagtctc

SEQ ID NO: 213031 - DNA, 25 bp, Mus musculus
agtctgtaacttcggctgtttaagc

SEQ ID NO: 213032 - DNA, 25 bp, Mus musculus
agtctgtaacttgggctgtttaagc

SEQ ID NO: 213033 - DNA, 25 bp, Mus musculus
agtctgtaagctcccaagactgtct

SEQ ID NO: 213034 - DNA, 25 bp, Mus musculus
agtctgtaagctgccaagactgtct

SEQ ID NO: 213035 - DNA, 25 bp, Mus musculus
agtctgtaatgtctctggaagccct

SEQ ID NO: 213036 - DNA, 25 bp, Mus musculus
agtctgtaatgtgtctggaagccct

SEQ ID NO: 213037 - DNA, 25 bp, Mus musculus
agtctgtacaagatggtatccccat

SEQ ID NO: 213038 - DNA, 25 bp, Mus musculus
agtctgtacaagttggtatccccat

SEQ ID NO: 213039 - DNA, 25 bp, Mus musculus
agtctgtaccatcactaaaggcttg

SEQ ID NO: 213040 - DNA, 25 bp, Mus musculus
agtctgtaccatgactaaaggcttg

SEQ ID NO: 213041 - DNA, 25 bp, Mus musculus
agtctgtacctaaagttgtctccca

SEQ ID NO: 213042 - DNA, 25 bp, Mus musculus
agtctgtacctatagttgtctccca

SEQ ID NO: 213043 - DNA, 25 bp, Mus musculus
agtctgtaccttcagtgctctggaa

SEQ ID NO: 213044 - DNA, 25 bp, Mus musculus
agtctgtaccttgagtgctctggaa

SEQ ID NO: 213045 - DNA, 25 bp, Mus musculus
agtctgtactctctgttctcaagga

SEQ ID NO: 213046 - DNA, 25 bp, Mus musculus
agtctgtactctgtgttctcaagga

SEQ ID NO: 213047 - DNA, 25 bp, Mus musculus
agtctgtacttcaagctctttcatc

SEQ ID NO: 213048 - DNA, 25 bp, Mus musculus
agtctgtacttctagctctttcatc

SEQ ID NO: 213049 - DNA, 25 bp, Mus musculus
agtctgtagtctatctccaaggcac

SEQ ID NO: 213050 - DNA, 25 bp, Mus musculus
agtctgtagtctttctccaaggcac

SEQ ID NO: 213051 - DNA, 25 bp, Mus musculus
agtctgtatggacccatcctgttca

SEQ ID NO: 213052 - DNA, 25 bp, Mus musculus
agtctgtatggagccatcctgttca

SEQ ID NO: 213053 - DNA, 25 bp, Mus musculus
agtctgtatgttctactgtaatggg

SEQ ID NO: 213054 - DNA, 25 bp, Mus musculus
agtctgtatgttgtactgtaatggg

SEQ ID NO: 213055 - DNA, 25 bp, Mus musculus
agtctgtcaacaaatcttctctgcc

SEQ ID NO: 213056 - DNA, 25 bp, Mus musculus
agtctgtcaacatatcttctctgcc

SEQ ID NO: 213057 - DNA, 25 bp, Mus musculus
agtctgtcaagtctcagctttcctg

SEQ ID NO: 213058 - DNA, 25 bp, Mus musculus
agtctgtcaagtgtcagctttcctg

SEQ ID NO: 213059 - DNA, 25 bp, Mus musculus
agtctgtcactcaatcgctggccga

SEQ ID NO: 213060 - DNA, 25 bp, Mus musculus
agtctgtcactctatcgctggccga

SEQ ID NO: 213061 - DNA, 25 bp, Mus musculus
agtctgtcactgctgtcgctggcct

SEQ ID NO: 213062 - DNA, 25 bp, Mus musculus
agtctgtcactggtgtcgctggcct

SEQ ID NO: 213063 - DNA, 25 bp, Mus musculus
agtctgtcagttaattgccctgggc

SEQ ID NO: 213064 - DNA, 25 bp, Mus musculus
agtctgtcagtttattgccctgggc

SEQ ID NO: 213065 - DNA, 25 bp, Mus musculus
agtctgtcattcacacatggcatgt

SEQ ID NO: 213066 - DNA, 25 bp, Mus musculus
agtctgtcattctcacatggcatgt

SEQ ID NO: 213067 - DNA, 25 bp, Mus musculus
agtctgtccacgagttcaattcatg

SEQ ID NO: 213068 - DNA, 25 bp, Mus musculus
agtctgtccacgtgttcaattcatg

SEQ ID NO: 213069 - DNA, 25 bp, Mus musculus
agtctgtccagaagttgtctgctgt

SEQ ID NO: 213070 - DNA, 25 bp, Mus musculus
agtctgtccagatgttgtctgctgt

SEQ ID NO: 213071 - DNA, 25 bp, Mus musculus
agtctgtcccatctcagtttgcaaa

SEQ ID NO: 213072 - DNA, 25 bp, Mus musculus
agtctgtcccatgtcagtttgcaaa

SEQ ID NO: 213073 - DNA, 25 bp, Mus musculus
agtctgtccgttacagtcgaactta

SEQ ID NO: 213074 - DNA, 25 bp, Mus musculus
agtctgtccgtttcagtcgaactta

SEQ ID NO: 213075 - DNA, 25 bp, Mus musculus
agtctgtctactctggtgattttta

SEQ ID NO: 213076 - DNA, 25 bp, Mus musculus
agtctgtctactgtggtgattttta

SEQ ID NO: 213077 - DNA, 25 bp, Mus musculus
agtctgtctccactcattaatcctg

SEQ ID NO: 213078 - DNA, 25 bp, Mus musculus
agtctgtctccagtcattaatcctg

SEQ ID NO: 213079 - DNA, 25 bp, Mus musculus
agtctgtctgacagtcctgtgtgcc

SEQ ID NO: 213080 - DNA, 25 bp, Mus musculus
agtctgtctgactgtcctgtgtgcc

SEQ ID NO: 213081 - DNA, 25 bp, Mus musculus
agtctgtcttacagctcatgtctat

SEQ ID NO: 213082 - DNA, 25 bp, Mus musculus
agtctgtcttactgctcatgtctat

SEQ ID NO: 213083 - DNA, 25 bp, Mus musculus
agtctgtcttcaagccttggcactc

SEQ ID NO: 213084 - DNA, 25 bp, Mus musculus
agtctgtcttcatgccttggcactc

SEQ ID NO: 213085 - DNA, 25 bp, Mus musculus
agtctgtcttccatggcatcgtggt

SEQ ID NO: 213086 - DNA, 25 bp, Mus musculus
agtctgtcttccttggcatcgtggt

SEQ ID NO: 213087 - DNA, 25 bp, Mus musculus
agtctgtcttttcagactccagtca

SEQ ID NO: 213088 - DNA, 25 bp, Mus musculus
agtctgtcttttgagactccagtca

SEQ ID NO: 213089 - DNA, 25 bp, Mus musculus
agtctgtgaaccatagactctcttg

SEQ ID NO: 213090 - DNA, 25 bp, Mus musculus
agtctgtgaaccttagactctcttg

SEQ ID NO: 213091 - DNA, 25 bp, Mus musculus
agtctgtgattgaacacttcagcaa

SEQ ID NO: 213092 - DNA, 25 bp, Mus musculus
agtctgtgattgtacacttcagcaa

SEQ ID NO: 213093 - DNA, 25 bp, Mus musculus
agtctgtgcaatcactctcccgtgt

SEQ ID NO: 213094 - DNA, 25 bp, Mus musculus
agtctgtgcaatgactctcccgtgt

SEQ ID NO: 213095 - DNA, 25 bp, Mus musculus
agtctgtgccctcgaggattggcct

SEQ ID NO: 213096 - DNA, 25 bp, Mus musculus
agtctgtgccctggaggattggcct

SEQ ID NO: 213097 - DNA, 25 bp, Mus musculus
agtctgtggcagctttctttttcat

SEQ ID NO: 213098 - DNA, 25 bp, Mus musculus
agtctgtggcaggtttctttttcat

SEQ ID NO: 213099 - DNA, 25 bp, Mus musculus
agtctgtgggccatctacactttaa

SEQ ID NO: 213100 - DNA, 25 bp, Mus musculus
agtctgtgggccttctacactttaa

SEQ ID NO: 213101 - DNA, 25 bp, Mus musculus
agtctgtgggtactccctgcactca

SEQ ID NO: 213102 - DNA, 25 bp, Mus musculus
agtctgtgggtagtccctgcactca

SEQ ID NO: 213103 - DNA, 25 bp, Mus musculus
agtctgtggtacaggcttctagaaa

SEQ ID NO: 213104 - DNA, 25 bp, Mus musculus
agtctgtggtactggcttctagaaa

SEQ ID NO: 213105 - DNA, 25 bp, Mus musculus
agtctgtgtatgctcttagttcctc

SEQ ID NO: 213106 - DNA, 25 bp, Mus musculus
agtctgtgtatggtcttagttcctc

SEQ ID NO: 213107 - DNA, 25 bp, Mus musculus
agtctgtgtctgattctctttagtt

SEQ ID NO: 213108 - DNA, 25 bp, Mus musculus
agtctgtgtctgtttctctttagtt

SEQ ID NO: 213109 - DNA, 25 bp, Mus musculus
agtctgtgtgccaaaatcatcgtgc

SEQ ID NO: 213110 - DNA, 25 bp, Mus musculus
agtctgtgtgcctaaatcatcgtgc

SEQ ID NO: 213111 - DNA, 25 bp, Mus musculus
agtctgtgtgtcagaatgtttcctc

SEQ ID NO: 213112 - DNA, 25 bp, Mus musculus
agtctgtgtgtctgaatgtttcctc

SEQ ID NO: 213113 - DNA, 25 bp, Mus musculus
agtctgttaatcagagcaagttcca

SEQ ID NO: 213114 - DNA, 25 bp, Mus musculus
agtctgttaatctgagcaagttcca

SEQ ID NO: 213115 - DNA, 25 bp, Mus musculus
agtctgttatggctgggaagtcaca

SEQ ID NO: 213116 - DNA, 25 bp, Mus musculus
agtctgttatgggtgggaagtcaca

SEQ ID NO: 213117 - DNA, 25 bp, Mus musculus
agtctgttatgtctacttccatgaa

SEQ ID NO: 213118 - DNA, 25 bp, Mus musculus
agtctgttatgtgtacttccatgaa

SEQ ID NO: 213119 - DNA, 25 bp, Mus musculus
agtctgttctttctataggcaccac

SEQ ID NO: 213120 - DNA, 25 bp, Mus musculus
agtctgttctttgtataggcaccac

SEQ ID NO: 213121 - DNA, 25 bp, Mus musculus
agtctgttgacacgcctatctggtt

SEQ ID NO: 213122 - DNA, 25 bp, Mus musculus
agtctgttgacaggcctatctggtt

SEQ ID NO: 213123 - DNA, 25 bp, Mus musculus
agtctgttgccaaggtttctagtgt

SEQ ID NO: 213124 - DNA, 25 bp, Mus musculus
agtctgttgccatggtttctagtgt

SEQ ID NO: 213125 - DNA, 25 bp, Mus musculus
agtctgttttcccagcattggtcca

SEQ ID NO: 213126 - DNA, 25 bp, Mus musculus
agtctgttttccgagcattggtcca

SEQ ID NO: 213127 - DNA, 25 bp, Mus musculus
agtctgtttttgcattcctcagttc

SEQ ID NO: 213128 - DNA, 25 bp, Mus musculus
agtctgtttttggattcctcagttc

SEQ ID NO: 213129 - DNA, 25 bp, Mus musculus
agtcttaaaatgaccatagttcatg

SEQ ID NO: 213130 - DNA, 25 bp, Mus musculus
agtcttaaaatgtccatagttcatg

SEQ ID NO: 213131 - DNA, 25 bp, Mus musculus
agtcttaaagcacccatacttcaag

SEQ ID NO: 213132 - DNA, 25 bp, Mus musculus
agtcttaaagcagccatacttcaag

SEQ ID NO: 213133 - DNA, 25 bp, Mus musculus
agtcttaaatgtactgctttgctgt

SEQ ID NO: 213134 - DNA, 25 bp, Mus musculus
agtcttaaatgttctgctttgctgt

SEQ ID NO: 213135 - DNA, 25 bp, Mus musculus
agtcttaaccttagtggcatcgggc

SEQ ID NO: 213136 - DNA, 25 bp, Mus musculus
agtcttaacctttgtggcatcgggc

SEQ ID NO: 213137 - DNA, 25 bp, Mus musculus
agtcttaacgatagtcctttctcct

SEQ ID NO: 213138 - DNA, 25 bp, Mus musculus
agtcttaacgattgtcctttctcct

SEQ ID NO: 213139 - DNA, 25 bp, Mus musculus
agtcttaactatattctcaaggtaa

SEQ ID NO: 213140 - DNA, 25 bp, Mus musculus
agtcttaactattttctcaaggtaa

SEQ ID NO: 213141 - DNA, 25 bp, Mus musculus
agtcttaatatgctgtggttcctgg

SEQ ID NO: 213142 - DNA, 25 bp, Mus musculus
agtcttaatatggtgtggttcctgg

SEQ ID NO: 213143 - DNA, 25 bp, Mus musculus
agtcttaatcctcacaatgcaattg

SEQ ID NO: 213144 - DNA, 25 bp, Mus musculus
agtcttaatcctgacaatgcaattg

SEQ ID NO: 213145 - DNA, 25 bp, Mus musculus
agtcttaattgtaacgatttgaaat

SEQ ID NO: 213146 - DNA, 25 bp, Mus musculus
agtcttaattgttacgatttgaaat

SEQ ID NO: 213147 - DNA, 25 bp, Mus musculus
agtcttacacagaacctcatatagt

SEQ ID NO: 213148 - DNA, 25 bp, Mus musculus
agtcttacacagtacctcatatagt

SEQ ID NO: 213149 - DNA, 25 bp, Mus musculus
agtcttacagtaacacacatgcatg

SEQ ID NO: 213150 - DNA, 25 bp, Mus musculus
agtcttacagtatcacacatgcatg

SEQ ID NO: 213151 - DNA, 25 bp, Mus musculus
agtcttacatagcatcccgtcaggg

SEQ ID NO: 213152 - DNA, 25 bp, Mus musculus
agtcttacataggatcccgtcaggg

SEQ ID NO: 213153 - DNA, 25 bp, Mus musculus
agtcttaccaatcacgtaacagttt

SEQ ID NO: 213154 - DNA, 25 bp, Mus musculus
agtcttaccaatgacgtaacagttt

SEQ ID NO: 213155 - DNA, 25 bp, Mus musculus
agtcttaccctgaaagctatgcttt

SEQ ID NO: 213156 - DNA, 25 bp, Mus musculus
agtcttaccctgtaagctatgcttt

SEQ ID NO: 213157 - DNA, 25 bp, Mus musculus
agtcttacgattcgccataagtata

SEQ ID NO: 213158 - DNA, 25 bp, Mus musculus
agtcttacgattggccataagtata

SEQ ID NO: 213159 - DNA, 25 bp, Mus musculus
agtcttactcccaaaggcttgagcc

SEQ ID NO: 213160 - DNA, 25 bp, Mus musculus
agtcttactccctaaggcttgagcc

SEQ ID NO: 213161 - DNA, 25 bp, Mus musculus
agtcttactgcaacagcgcttcatg

SEQ ID NO: 213162 - DNA, 25 bp, Mus musculus
agtcttactgcatcagcgcttcatg

SEQ ID NO: 213163 - DNA, 25 bp, Mus musculus
agtcttactgtgatcctgtttgttg

SEQ ID NO: 213164 - DNA, 25 bp, Mus musculus
agtcttactgtgttcctgtttgttg

SEQ ID NO: 213165 - DNA, 25 bp, Mus musculus
agtcttactgttctagggctcaaaa

SEQ ID NO: 213166 - DNA, 25 bp, Mus musculus
agtcttactgttgtagggctcaaaa

SEQ ID NO: 213167 - DNA, 25 bp, Mus musculus
agtcttagactcatcctgtgggtat

SEQ ID NO: 213168 - DNA, 25 bp, Mus musculus
agtcttagactcttcctgtgggtat

SEQ ID NO: 213169 - DNA, 25 bp, Mus musculus
agtcttagctttacgaatcggcact

SEQ ID NO: 213170 - DNA, 25 bp, Mus musculus
agtcttagcttttcgaatcggcact

SEQ ID NO: 213171 - DNA, 25 bp, Mus musculus
agtcttatccctcatgtcgtacctt

SEQ ID NO: 213172 - DNA, 25 bp, Mus musculus
agtcttatccctgatgtcgtacctt

SEQ ID NO: 213173 - DNA, 25 bp, Mus musculus
agtcttatcggcactatctgttgaa

SEQ ID NO: 213174 - DNA, 25 bp, Mus musculus
agtcttatcggctctatctgttgaa

SEQ ID NO: 213175 - DNA, 25 bp, Mus musculus
agtcttatcgtcagttgtctaacct

SEQ ID NO: 213176 - DNA, 25 bp, Mus musculus
agtcttatcgtctgttgtctaacct

SEQ ID NO: 213177 - DNA, 25 bp, Mus musculus
agtcttatctgtctcaaccctctgc

SEQ ID NO: 213178 - DNA, 25 bp, Mus musculus
agtcttatctgtgtcaaccctctgc

SEQ ID NO: 213179 - DNA, 25 bp, Mus musculus
agtcttatctttcggcatgtcgcta

SEQ ID NO: 213180 - DNA, 25 bp, Mus musculus
agtcttatctttgggcatgtcgcta

SEQ ID NO: 213181 - DNA, 25 bp, Mus musculus
agtcttatgaaaatccaagcccagg

SEQ ID NO: 213182 - DNA, 25 bp, Mus musculus
agtcttatgaaattccaagcccagg

SEQ ID NO: 213183 - DNA, 25 bp, Mus musculus
agtcttatggctatccactcatgtc

SEQ ID NO: 213184 - DNA, 25 bp, Mus musculus
agtcttatggctttccactcatgtc

SEQ ID NO: 213185 - DNA, 25 bp, Mus musculus
agtcttattcctattacccatctct

SEQ ID NO: 213186 - DNA, 25 bp, Mus musculus
agtcttattccttttacccatctct

SEQ ID NO: 213187 - DNA, 25 bp, Mus musculus
agtcttcaaaaaagtcacagcctcg

SEQ ID NO: 213188 - DNA, 25 bp, Mus musculus
agtcttcaaaaatgtcacagcctcg

SEQ ID NO: 213189 - DNA, 25 bp, Mus musculus
agtcttcaattgcttgtcaggttgt

SEQ ID NO: 213190 - DNA, 25 bp, Mus musculus
agtcttcaattggttgtcaggttgt

SEQ ID NO: 213191 - DNA, 25 bp, Mus musculus
agtcttcacaaacccagttccttgc

SEQ ID NO: 213192 - DNA, 25 bp, Mus musculus
agtcttcacaaagccagttccttgc

SEQ ID NO: 213193 - DNA, 25 bp, Mus musculus
agtcttcacatacttctacaaggga

SEQ ID NO: 213194 - DNA, 25 bp, Mus musculus
agtcttcacatagttctacaaggga

SEQ ID NO: 213195 - DNA, 25 bp, Mus musculus
agtcttcacgtgcttcagtttcatc

SEQ ID NO: 213196 - DNA, 25 bp, Mus musculus
agtcttcacgtggttcagtttcatc

SEQ ID NO: 213197 - DNA, 25 bp, Mus musculus
agtcttcactctctgtcctacacat

SEQ ID NO: 213198 - DNA, 25 bp, Mus musculus
agtcttcactctgtgtcctacacat

SEQ ID NO: 213199 - DNA, 25 bp, Mus musculus
agtcttcactttcatggactgaata

SEQ ID NO: 213200 - DNA, 25 bp, Mus musculus
agtcttcactttgatggactgaata

SEQ ID NO: 213201 - DNA, 25 bp, Mus musculus
agtcttcagaggctttgtaattaaa

SEQ ID NO: 213202 - DNA, 25 bp, Mus musculus
agtcttcagagggtttgtaattaaa

SEQ ID NO: 213203 - DNA, 25 bp, Mus musculus
agtcttcaggcacttaccattagaa

SEQ ID NO: 213204 - DNA, 25 bp, Mus musculus
agtcttcaggcagttaccattagaa

SEQ ID NO: 213205 - DNA, 25 bp, Mus musculus
agtcttcaggcgagctaggcatgta

SEQ ID NO: 213206 - DNA, 25 bp, Mus musculus
agtcttcaggcgtgctaggcatgta

SEQ ID NO: 213207 - DNA, 25 bp, Mus musculus
agtcttcatgcacaggccactactt

SEQ ID NO: 213208 - DNA, 25 bp, Mus musculus
agtcttcatgcagaggccactactt

SEQ ID NO: 213209 - DNA, 25 bp, Mus musculus
agtcttcatgcgattctgttttaca

SEQ ID NO: 213210 - DNA, 25 bp, Mus musculus
agtcttcatgcgtttctgttttaca

SEQ ID NO: 213211 - DNA, 25 bp, Mus musculus
agtcttcattcccagcacagtgggc

SEQ ID NO: 213212 - DNA, 25 bp, Mus musculus
agtcttcattccgagcacagtgggc

SEQ ID NO: 213213 - DNA, 25 bp, Mus musculus
agtcttccaataacctgctttggcc

SEQ ID NO: 213214 - DNA, 25 bp, Mus musculus
agtcttccaatatcctgctttggcc

SEQ ID NO: 213215 - DNA, 25 bp, Mus musculus
agtcttccaattatgggccgatgaa

SEQ ID NO: 213216 - DNA, 25 bp, Mus musculus
agtcttccaattttgggccgatgaa

SEQ ID NO: 213217 - DNA, 25 bp, Mus musculus
agtcttccacatagcctggtaccta

SEQ ID NO: 213218 - DNA, 25 bp, Mus musculus
agtcttccacattgcctggtaccta

SEQ ID NO: 213219 - DNA, 25 bp, Mus musculus
agtcttccagacacgtacgtgtcgc

SEQ ID NO: 213220 - DNA, 25 bp, Mus musculus
agtcttccagactcgtacgtgtcgc

SEQ ID NO: 213221 - DNA, 25 bp, Mus musculus
agtcttccagagatagggctccaga

SEQ ID NO: 213222 - DNA, 25 bp, Mus musculus
agtcttccagagttagggctccaga

SEQ ID NO: 213223 - DNA, 25 bp, Mus musculus
agtcttccagtaagagcacatcctc

SEQ ID NO: 213224 - DNA, 25 bp, Mus musculus
agtcttccagtatgagcacatcctc

SEQ ID NO: 213225 - DNA, 25 bp, Mus musculus
agtcttccatgcctgacaaattgga

SEQ ID NO: 213226 - DNA, 25 bp, Mus musculus
agtcttccatgcgtgacaaattgga

SEQ ID NO: 213227 - DNA, 25 bp, Mus musculus
agtcttccatgtaactcaacctcat

SEQ ID NO: 213228 - DNA, 25 bp, Mus musculus
agtcttccatgttactcaacctcat

SEQ ID NO: 213229 - DNA, 25 bp, Mus musculus
agtcttcccagaacccctttgtgat

SEQ ID NO: 213230 - DNA, 25 bp, Mus musculus
agtcttcccagatcccctttgtgat

SEQ ID NO: 213231 - DNA, 25 bp, Mus musculus
agtcttcccattatacagtgggtgg

SEQ ID NO: 213232 - DNA, 25 bp, Mus musculus
agtcttcccattttacagtgggtgg

SEQ ID NO: 213233 - DNA, 25 bp, Mus musculus
agtcttccccgacagtattctcaaa

SEQ ID NO: 213234 - DNA, 25 bp, Mus musculus
agtcttccccgagagtattctcaaa

SEQ ID NO: 213235 - DNA, 25 bp, Mus musculus
agtcttccggaacattgtccttcaa

SEQ ID NO: 213236 - DNA, 25 bp, Mus musculus
agtcttccggaagattgtccttcaa

SEQ ID NO: 213237 - DNA, 25 bp, Mus musculus
agtcttcctaaaactgcacagcttt

SEQ ID NO: 213238 - DNA, 25 bp, Mus musculus
agtcttcctaaatctgcacagcttt

SEQ ID NO: 213239 - DNA, 25 bp, Mus musculus
agtcttcctaagacatttaactcat

SEQ ID NO: 213240 - DNA, 25 bp, Mus musculus
agtcttcctaagtcatttaactcat

SEQ ID NO: 213241 - DNA, 25 bp, Mus musculus
agtcttcctacacctctagtgctaa

SEQ ID NO: 213242 - DNA, 25 bp, Mus musculus
agtcttcctacagctctagtgctaa

SEQ ID NO: 213243 - DNA, 25 bp, Mus musculus
agtcttcctcagcattggtacctag

SEQ ID NO: 213244 - DNA, 25 bp, Mus musculus
agtcttcctcaggattggtacctag

SEQ ID NO: 213245 - DNA, 25 bp, Mus musculus
agtcttcctggtcctcatcttgtta

SEQ ID NO: 213246 - DNA, 25 bp, Mus musculus
agtcttcctggtgctcatcttgtta

SEQ ID NO: 213247 - DNA, 25 bp, Mus musculus
agtcttcctgtcatagatacccaaa

SEQ ID NO: 213248 - DNA, 25 bp, Mus musculus
agtcttcctgtcttagatacccaaa

SEQ ID NO: 213249 - DNA, 25 bp, Mus musculus
agtcttccttagactctggacctag

SEQ ID NO: 213250 - DNA, 25 bp, Mus musculus
agtcttccttagtctctggacctag

SEQ ID NO: 213251 - DNA, 25 bp, Mus musculus
agtcttccttatatgaatacttgaa

SEQ ID NO: 213252 - DNA, 25 bp, Mus musculus
agtcttccttatttgaatacttgaa

SEQ ID NO: 213253 - DNA, 25 bp, Mus musculus
agtcttcctttgatctgcatgaatg

SEQ ID NO: 213254 - DNA, 25 bp, Mus musculus
agtcttcctttgttctgcatgaatg

SEQ ID NO: 213255 - DNA, 25 bp, Mus musculus
agtcttcgaaggagatcgccggcac

SEQ ID NO: 213256 - DNA, 25 bp, Mus musculus
agtcttcgaaggtgatcgccggcac

SEQ ID NO: 213257 - DNA, 25 bp, Mus musculus
agtcttcgagatccggtggagggtt

SEQ ID NO: 213258 - DNA, 25 bp, Mus musculus
agtcttcgagatgcggtggagggtt

SEQ ID NO: 213259 - DNA, 25 bp, Mus musculus
agtcttcgtatccaagagtgacaac

SEQ ID NO: 213260 - DNA, 25 bp, Mus musculus
agtcttcgtatcgaagagtgacaac

SEQ ID NO: 213261 - DNA, 25 bp, Mus musculus
agtcttcgtgccaacagtggaatgt

SEQ ID NO: 213262 - DNA, 25 bp, Mus musculus
agtcttcgtgcctacagtggaatgt

SEQ ID NO: 213263 - DNA, 25 bp, Mus musculus
agtcttcgtgggaaccaagggcatc

SEQ ID NO: 213264 - DNA, 25 bp, Mus musculus
agtcttcgtgggtaccaagggcatc

SEQ ID NO: 213265 - DNA, 25 bp, Mus musculus
agtcttctactaacatgggtcccta

SEQ ID NO: 213266 - DNA, 25 bp, Mus musculus
agtcttctactatcatgggtcccta

SEQ ID NO: 213267 - DNA, 25 bp, Mus musculus
agtcttctcaccactgagcctcggg

SEQ ID NO: 213268 - DNA, 25 bp, Mus musculus
agtcttctcacctctgagcctcggg

SEQ ID NO: 213269 - DNA, 25 bp, Mus musculus
agtcttctccagacagtggatccac

SEQ ID NO: 213270 - DNA, 25 bp, Mus musculus
agtcttctccagcttgcccatcatt

SEQ ID NO: 213271 - DNA, 25 bp, Mus musculus
agtcttctccaggttgcccatcatt

SEQ ID NO: 213272 - DNA, 25 bp, Mus musculus
agtcttctccagtcagtggatccac

SEQ ID NO: 213273 - DNA, 25 bp, Mus musculus
agtcttctccctagggctcttcaac

SEQ ID NO: 213274 - DNA, 25 bp, Mus musculus
agtcttctcccttgggctcttcaac

SEQ ID NO: 213275 - DNA, 25 bp, Mus musculus
agtcttctccttatagctgtggtga

SEQ ID NO: 213276 - DNA, 25 bp, Mus musculus
agtcttctccttttagctgtggtga

SEQ ID NO: 213277 - DNA, 25 bp, Mus musculus
agtcttctcgaacttcaaagaggca

SEQ ID NO: 213278 - DNA, 25 bp, Mus musculus
agtcttctcgaagttcaaagaggca

SEQ ID NO: 213279 - DNA, 25 bp, Mus musculus
agtcttctctggaggttgcagacac

SEQ ID NO: 213280 - DNA, 25 bp, Mus musculus
agtcttctctggtggttgcagacac

SEQ ID NO: 213281 - DNA, 25 bp, Mus musculus
agtcttctgaacatatctgtcatgt

SEQ ID NO: 213282 - DNA, 25 bp, Mus musculus
agtcttctgaacttatctgtcatgt

SEQ ID NO: 213283 - DNA, 25 bp, Mus musculus
agtcttctgctcatggtcagggagt

SEQ ID NO: 213284 - DNA, 25 bp, Mus musculus
agtcttctgctcttggtcagggagt

SEQ ID NO: 213285 - DNA, 25 bp, Mus musculus
agtcttctggaaactcaggaggcaa

SEQ ID NO: 213286 - DNA, 25 bp, Mus musculus
agtcttctggaatctcaggaggcaa

SEQ ID NO: 213287 - DNA, 25 bp, Mus musculus
agtcttctggtcagcactgtcatga

SEQ ID NO: 213288 - DNA, 25 bp, Mus musculus
agtcttctggtctgcactgtcatga

SEQ ID NO: 213289 - DNA, 25 bp, Mus musculus
agtcttcttgaactgcctttttggc

SEQ ID NO: 213290 - DNA, 25 bp, Mus musculus
agtcttcttgaagtgcctttttggc

SEQ ID NO: 213291 - DNA, 25 bp, Mus musculus
agtcttcttggaacccatttctcgg

SEQ ID NO: 213292 - DNA, 25 bp, Mus musculus
agtcttcttggatcccatttctcgg

SEQ ID NO: 213293 - DNA, 25 bp, Mus musculus
agtcttcttgttctatgctgtttgc

SEQ ID NO: 213294 - DNA, 25 bp, Mus musculus
agtcttcttgttgtatgctgtttgc

SEQ ID NO: 213295 - DNA, 25 bp, Mus musculus
agtcttgaacatcttattgcagtca

SEQ ID NO: 213296 - DNA, 25 bp, Mus musculus
agtcttgaacatgttattgcagtca

SEQ ID NO: 213297 - DNA, 25 bp, Mus musculus
agtcttgaactgatttcggaggcca

SEQ ID NO: 213298 - DNA, 25 bp, Mus musculus
agtcttgaactgttttcggaggcca

SEQ ID NO: 213299 - DNA, 25 bp, Mus musculus
agtcttgaagccctaaactcaactt

SEQ ID NO: 213300 - DNA, 25 bp, Mus musculus
agtcttgaagccgtaaactcaactt

SEQ ID NO: 213301 - DNA, 25 bp, Mus musculus
agtcttgacatgaaactcaggttag

SEQ ID NO: 213302 - DNA, 25 bp, Mus musculus
agtcttgacatgtaactcaggttag

SEQ ID NO: 213303 - DNA, 25 bp, Mus musculus
agtcttgaccttactccgggctgca

SEQ ID NO: 213304 - DNA, 25 bp, Mus musculus
agtcttgaccttcaggcctgttctc

SEQ ID NO: 213305 - DNA, 25 bp, Mus musculus
agtcttgaccttgaggcctgttctc

SEQ ID NO: 213306 - DNA, 25 bp, Mus musculus
agtcttgacctttctccgggctgca

SEQ ID NO: 213307 - DNA, 25 bp, Mus musculus
agtcttgagaagatccaggtctttc

SEQ ID NO: 213308 - DNA, 25 bp, Mus musculus
agtcttgagaagttccaggtctttc

SEQ ID NO: 213309 - DNA, 25 bp, Mus musculus
agtcttgaggagatcttgttgccct

SEQ ID NO: 213310 - DNA, 25 bp, Mus musculus
agtcttgaggagttcttgttgccct

SEQ ID NO: 213311 - DNA, 25 bp, Mus musculus
agtcttgattatacagctactgatc

SEQ ID NO: 213312 - DNA, 25 bp, Mus musculus
agtcttgattattcagctactgatc

SEQ ID NO: 213313 - DNA, 25 bp, Mus musculus
agtcttgcatagcttgggctgacct

SEQ ID NO: 213314 - DNA, 25 bp, Mus musculus
agtcttgcataggttgggctgacct

SEQ ID NO: 213315 - DNA, 25 bp, Mus musculus
agtcttgcatggaagcggcttcaga

SEQ ID NO: 213316 - DNA, 25 bp, Mus musculus
agtcttgcatggtagcggcttcaga

SEQ ID NO: 213317 - DNA, 25 bp, Mus musculus
agtcttgccaacaggactccagggt

SEQ ID NO: 213318 - DNA, 25 bp, Mus musculus
agtcttgccaactggactccagggt

SEQ ID NO: 213319 - DNA, 25 bp, Mus musculus
agtcttgcccggcttaccctgagta

SEQ ID NO: 213320 - DNA, 25 bp, Mus musculus
agtcttgcccgggttaccctgagta

SEQ ID NO: 213321 - DNA, 25 bp, Mus musculus
agtcttgccgtcagtataccttgtt

SEQ ID NO: 213322 - DNA, 25 bp, Mus musculus
agtcttgccgtctgtataccttgtt

SEQ ID NO: 213323 - DNA, 25 bp, Mus musculus
agtcttgcctataacccttggaggt

SEQ ID NO: 213324 - DNA, 25 bp, Mus musculus
agtcttgcctatctgagccatgagc

SEQ ID NO: 213325 - DNA, 25 bp, Mus musculus
agtcttgcctatgtgagccatgagc

SEQ ID NO: 213326 - DNA, 25 bp, Mus musculus
agtcttgcctattacccttggaggt

SEQ ID NO: 213327 - DNA, 25 bp, Mus musculus
agtcttgcctctagcctgttagaaa

SEQ ID NO: 213328 - DNA, 25 bp, Mus musculus
agtcttgcctcttgcctgttagaaa

SEQ ID NO: 213329 - DNA, 25 bp, Mus musculus
agtcttgccttcaggatgcactcaa

SEQ ID NO: 213330 - DNA, 25 bp, Mus musculus
agtcttgccttctggatgcactcaa

SEQ ID NO: 213331 - DNA, 25 bp, Mus musculus
agtcttgctactcagcccaggctct

SEQ ID NO: 213332 - DNA, 25 bp, Mus musculus
agtcttgctactgagcccaggctct

SEQ ID NO: 213333 - DNA, 25 bp, Mus musculus
agtcttgctagcaggctgcaggaga

SEQ ID NO: 213334 - DNA, 25 bp, Mus musculus
agtcttgctagctggctgcaggaga

SEQ ID NO: 213335 - DNA, 25 bp, Mus musculus
agtcttgctagtatgtctgcgctca

SEQ ID NO: 213336 - DNA, 25 bp, Mus musculus
agtcttgctagtttgtctgcgctca

SEQ ID NO: 213337 - DNA, 25 bp, Mus musculus
agtcttgctcttccgaggttttata

SEQ ID NO: 213338 - DNA, 25 bp, Mus musculus
agtcttgctcttgcgaggttttata

SEQ ID NO: 213339 - DNA, 25 bp, Mus musculus
agtcttgctgccatagacttagcaa

SEQ ID NO: 213340 - DNA, 25 bp, Mus musculus
agtcttgctgccttagacttagcaa

SEQ ID NO: 213341 - DNA, 25 bp, Mus musculus
agtcttgctgctatggctgctgctg

SEQ ID NO: 213342 - DNA, 25 bp, Mus musculus
agtcttgctgctcgtcctgattgag

SEQ ID NO: 213343 - DNA, 25 bp, Mus musculus
agtcttgctgctcgtttgtccttct

SEQ ID NO: 213344 - DNA, 25 bp, Mus musculus
agtcttgctgctggtcctgattgag

SEQ ID NO: 213345 - DNA, 25 bp, Mus musculus
agtcttgctgctggtttgtccttct

SEQ ID NO: 213346 - DNA, 25 bp, Mus musculus
agtcttgctgctttggctgctgctg

SEQ ID NO: 213347 - DNA, 25 bp, Mus musculus
agtcttgctggcacagtggtgcata

SEQ ID NO: 213348 - DNA, 25 bp, Mus musculus
agtcttgctggctcagtggtgcata

SEQ ID NO: 213349 - DNA, 25 bp, Mus musculus
agtcttgctgtcacttggctgagaa

SEQ ID NO: 213350 - DNA, 25 bp, Mus musculus
agtcttgctgtctcttggctgagaa

SEQ ID NO: 213351 - DNA, 25 bp, Mus musculus
agtcttgctttccttagtcttgctg

SEQ ID NO: 213352 - DNA, 25 bp, Mus musculus
agtcttgctttcgttagtcttgctg

SEQ ID NO: 213353 - DNA, 25 bp, Mus musculus
agtcttggaagtctctcggcaaccg

SEQ ID NO: 213354 - DNA, 25 bp, Mus musculus
agtcttggaagtgtctcggcaaccg

SEQ ID NO: 213355 - DNA, 25 bp, Mus musculus
agtcttggacgtactgttggatcac

SEQ ID NO: 213356 - DNA, 25 bp, Mus musculus
agtcttggacgttctgttggatcac

SEQ ID NO: 213357 - DNA, 25 bp, Mus musculus
agtcttggagatcaagcctccatct

SEQ ID NO: 213358 - DNA, 25 bp, Mus musculus
agtcttggagatgaagcctccatct

SEQ ID NO: 213359 - DNA, 25 bp, Mus musculus
agtcttggcttcatttgggtggcta

SEQ ID NO: 213360 - DNA, 25 bp, Mus musculus
agtcttggcttcttttgggtggcta

SEQ ID NO: 213361 - DNA, 25 bp, Mus musculus
agtcttgggcagagtgacactgtcc

SEQ ID NO: 213362 - DNA, 25 bp, Mus musculus
agtcttgggcagtgtgacactgtcc

SEQ ID NO: 213363 - DNA, 25 bp, Mus musculus
agtcttggtactcacatggtccctg

SEQ ID NO: 213364 - DNA, 25 bp, Mus musculus
agtcttggtactgacatggtccctg

SEQ ID NO: 213365 - DNA, 25 bp, Mus musculus
agtcttggtccacgatcaacagcca

SEQ ID NO: 213366 - DNA, 25 bp, Mus musculus
agtcttggtccaggatcaacagcca

SEQ ID NO: 213367 - DNA, 25 bp, Mus musculus
agtcttggttatcaggataccgctg

SEQ ID NO: 213368 - DNA, 25 bp, Mus musculus
agtcttggttatgaggataccgctg

SEQ ID NO: 213369 - DNA, 25 bp, Mus musculus
agtcttgtaatcatggcatgtggga

SEQ ID NO: 213370 - DNA, 25 bp, Mus musculus
agtcttgtaatcttggcatgtggga

SEQ ID NO: 213371 - DNA, 25 bp, Mus musculus
agtcttgtacaaaacagtctcttct

SEQ ID NO: 213372 - DNA, 25 bp, Mus musculus
agtcttgtacaatacagtctcttct

SEQ ID NO: 213373 - DNA, 25 bp, Mus musculus
agtcttgtactccaaggccatcttt

SEQ ID NO: 213374 - DNA, 25 bp, Mus musculus
agtcttgtactcgaaggccatcttt

SEQ ID NO: 213375 - DNA, 25 bp, Mus musculus
agtcttgtagttaaaatgggtgtct

SEQ ID NO: 213376 - DNA, 25 bp, Mus musculus
agtcttgtagtttaaatgggtgtct

SEQ ID NO: 213377 - DNA, 25 bp, Mus musculus
agtcttgtcccaatctcgaaaacgt

SEQ ID NO: 213378 - DNA, 25 bp, Mus musculus
agtcttgtcccattctcgaaaacgt

SEQ ID NO: 213379 - DNA, 25 bp, Mus musculus
agtcttgtcctgcaatcaacactta

SEQ ID NO: 213380 - DNA, 25 bp, Mus musculus
agtcttgtcctggaatcaacactta

SEQ ID NO: 213381 - DNA, 25 bp, Mus musculus
agtcttgtcggaaggttgccatgag

SEQ ID NO: 213382 - DNA, 25 bp, Mus musculus
agtcttgtcggatggttgccatgag

SEQ ID NO: 213383 - DNA, 25 bp, Mus musculus
agtcttgtctcgcttgtccatatca

SEQ ID NO: 213384 - DNA, 25 bp, Mus musculus
agtcttgtctcggttgtccatatca

SEQ ID NO: 213385 - DNA, 25 bp, Mus musculus
agtcttgtcttgaatgccagcttag

SEQ ID NO: 213386 - DNA, 25 bp, Mus musculus
agtcttgtcttgtatgccagcttag

SEQ ID NO: 213387 - DNA, 25 bp, Mus musculus
agtcttgtgagaagtccccttttga

SEQ ID NO: 213388 - DNA, 25 bp, Mus musculus
agtcttgtgagatgtccccttttga

SEQ ID NO: 213389 - DNA, 25 bp, Mus musculus
agtcttgtgctcaaggctgtacttc

SEQ ID NO: 213390 - DNA, 25 bp, Mus musculus
agtcttgtgctctaggctgtacttc

SEQ ID NO: 213391 - DNA, 25 bp, Mus musculus
agtcttgttattcaggttgctgccg

SEQ ID NO: 213392 - DNA, 25 bp, Mus musculus
agtcttgttattgaggttgctgccg

SEQ ID NO: 213393 - DNA, 25 bp, Mus musculus
agtctttaacatcctgattcaccct

SEQ ID NO: 213394 - DNA, 25 bp, Mus musculus
agtctttaacatgctgattcaccct

SEQ ID NO: 213395 - DNA, 25 bp, Mus musculus
agtctttaagtaactgctctatcaa

SEQ ID NO: 213396 - DNA, 25 bp, Mus musculus
agtctttaagtatctgctctatcaa

SEQ ID NO: 213397 - DNA, 25 bp, Mus musculus
agtctttacaccagcctagagctaa

SEQ ID NO: 213398 - DNA, 25 bp, Mus musculus
agtctttacacctgcctagagctaa

SEQ ID NO: 213399 - DNA, 25 bp, Mus musculus
agtctttaccatagagattctcctg

SEQ ID NO: 213400 - DNA, 25 bp, Mus musculus
agtctttaccattgagattctcctg

SEQ ID NO: 213401 - DNA, 25 bp, Mus musculus
agtctttagccacttcctatgtgtt

SEQ ID NO: 213402 - DNA, 25 bp, Mus musculus
agtctttagccagttcctatgtgtt

SEQ ID NO: 213403 - DNA, 25 bp, Mus musculus
agtctttaggaaaagtgcatccttc

SEQ ID NO: 213404 - DNA, 25 bp, Mus musculus
agtctttaggaatagtgcatccttc

SEQ ID NO: 213405 - DNA, 25 bp, Mus musculus
agtctttatagcacattctttcaca

SEQ ID NO: 213406 - DNA, 25 bp, Mus musculus
agtctttatagctcattctttcaca

SEQ ID NO: 213407 - DNA, 25 bp, Mus musculus
agtctttatgccctccttacatagg

SEQ ID NO: 213408 - DNA, 25 bp, Mus musculus
agtctttatgccgtccttacatagg

SEQ ID NO: 213409 - DNA, 25 bp, Mus musculus
agtctttattcacgccccaggtcag

SEQ ID NO: 213410 - DNA, 25 bp, Mus musculus
agtctttattcaggccccaggtcag

SEQ ID NO: 213411 - DNA, 25 bp, Mus musculus
agtctttatttaagaacacacacac

SEQ ID NO: 213412 - DNA, 25 bp, Mus musculus
agtctttatttatgaacacacacac

SEQ ID NO: 213413 - DNA, 25 bp, Mus musculus
agtctttcaactcagtgtctgtcca

SEQ ID NO: 213414 - DNA, 25 bp, Mus musculus
agtctttcaactgagtgtctgtcca

SEQ ID NO: 213415 - DNA, 25 bp, Mus musculus
agtctttcaagacctcaagaacgag

SEQ ID NO: 213416 - DNA, 25 bp, Mus musculus
agtctttcaagagctcaagaacgag

SEQ ID NO: 213417 - DNA, 25 bp, Mus musculus
agtctttcagatctctttgctttga

SEQ ID NO: 213418 - DNA, 25 bp, Mus musculus
agtctttcagatgtctttgctttga

SEQ ID NO: 213419 - DNA, 25 bp, Mus musculus
agtctttcagccaactctgacccag

SEQ ID NO: 213420 - DNA, 25 bp, Mus musculus
agtctttcagcctactctgacccag

SEQ ID NO: 213421 - DNA, 25 bp, Mus musculus
agtctttcattgacactgctacaaa

SEQ ID NO: 213422 - DNA, 25 bp, Mus musculus
agtctttcattgtcactgctacaaa

SEQ ID NO: 213423 - DNA, 25 bp, Mus musculus
agtctttccactagcttatttcttt

SEQ ID NO: 213424 - DNA, 25 bp, Mus musculus
agtctttccactcgtctgtgccaga

SEQ ID NO: 213425 - DNA, 25 bp, Mus musculus
agtctttccactggtctgtgccaga

SEQ ID NO: 213426 - DNA, 25 bp, Mus musculus
agtctttccacttgcttatttcttt

SEQ ID NO: 213427 - DNA, 25 bp, Mus musculus
agtctttccaggagggctgtttcca

SEQ ID NO: 213428 - DNA, 25 bp, Mus musculus
agtctttccaggtgggctgtttcca

SEQ ID NO: 213429 - DNA, 25 bp, Mus musculus
agtctttcccctctagtagttgatt

SEQ ID NO: 213430 - DNA, 25 bp, Mus musculus
agtctttcccctgtagtagttgatt

SEQ ID NO: 213431 - DNA, 25 bp, Mus musculus
agtctttcctaactcagctgcagtc

SEQ ID NO: 213432 - DNA, 25 bp, Mus musculus
agtctttcctaagtcagctgcagtc

SEQ ID NO: 213433 - DNA, 25 bp, Mus musculus
agtctttccttcatgtacaaccaga

SEQ ID NO: 213434 - DNA, 25 bp, Mus musculus
agtctttccttcttgtacaaccaga

SEQ ID NO: 213435 - DNA, 25 bp, Mus musculus
agtctttctcctctgtcagaatctt

SEQ ID NO: 213436 - DNA, 25 bp, Mus musculus
agtctttctcctgtgtcagaatctt

SEQ ID NO: 213437 - DNA, 25 bp, Mus musculus
agtctttctctgagttcctaattca

SEQ ID NO: 213438 - DNA, 25 bp, Mus musculus
agtctttctctgtgttcctaattca

SEQ ID NO: 213439 - DNA, 25 bp, Mus musculus
agtctttctcttcccagcctgaagg

SEQ ID NO: 213440 - DNA, 25 bp, Mus musculus
agtctttctcttgccagcctgaagg

SEQ ID NO: 213441 - DNA, 25 bp, Mus musculus
agtctttctgatctgcttgatttta

SEQ ID NO: 213442 - DNA, 25 bp, Mus musculus
agtctttctgatgtgcttgatttta

SEQ ID NO: 213443 - DNA, 25 bp, Mus musculus
agtctttctgctagggatactgaca

SEQ ID NO: 213444 - DNA, 25 bp, Mus musculus
agtctttctgcttgggatactgaca

SEQ ID NO: 213445 - DNA, 25 bp, Mus musculus
agtctttctgggaggctcttcagtg

SEQ ID NO: 213446 - DNA, 25 bp, Mus musculus
agtctttctgggtggctcttcagtg

SEQ ID NO: 213447 - DNA, 25 bp, Mus musculus
agtctttctgttagtgcttcatgta

SEQ ID NO: 213448 - DNA, 25 bp, Mus musculus
agtctttctgtttgtgcttcatgta

SEQ ID NO: 213449 - DNA, 25 bp, Mus musculus
agtctttcttgaaaagccttctccc

SEQ ID NO: 213450 - DNA, 25 bp, Mus musculus
agtctttcttgataagccttctccc

SEQ ID NO: 213451 - DNA, 25 bp, Mus musculus
agtctttctttcaatgcaggtttgt

SEQ ID NO: 213452 - DNA, 25 bp, Mus musculus
agtctttctttcagcatcgggttat

SEQ ID NO: 213453 - DNA, 25 bp, Mus musculus
agtctttctttctatgcaggtttgt

SEQ ID NO: 213454 - DNA, 25 bp, Mus musculus
agtctttctttctgcatcgggttat

SEQ ID NO: 213455 - DNA, 25 bp, Mus musculus
agtctttgagggaaaaagcctccag

SEQ ID NO: 213456 - DNA, 25 bp, Mus musculus
agtctttgagggtaaaagcctccag

SEQ ID NO: 213457 - DNA, 25 bp, Mus musculus
agtctttgagttactgtttggtgca

SEQ ID NO: 213458 - DNA, 25 bp, Mus musculus
agtctttgagtttctgtttggtgca

SEQ ID NO: 213459 - DNA, 25 bp, Mus musculus
agtctttgatccatgctacaggcag

SEQ ID NO: 213460 - DNA, 25 bp, Mus musculus
agtctttgatccttgctacaggcag

SEQ ID NO: 213461 - DNA, 25 bp, Mus musculus
agtctttgatgtagtcatgccttct

SEQ ID NO: 213462 - DNA, 25 bp, Mus musculus
agtctttgatgttgtcatgccttct

SEQ ID NO: 213463 - DNA, 25 bp, Mus musculus
agtctttgattcctttctgacgtca

SEQ ID NO: 213464 - DNA, 25 bp, Mus musculus
agtctttgattcgtttctgacgtca

SEQ ID NO: 213465 - DNA, 25 bp, Mus musculus
agtctttgccaaccttgtccagttt

SEQ ID NO: 213466 - DNA, 25 bp, Mus musculus
agtctttgccaagcttgtccagttt

SEQ ID NO: 213467 - DNA, 25 bp, Mus musculus
agtctttgctttaaacagtgccgca

SEQ ID NO: 213468 - DNA, 25 bp, Mus musculus
agtctttgcttttaacagtgccgca

SEQ ID NO: 213469 - DNA, 25 bp, Mus musculus
agtctttggatacgtgctgcttcct

SEQ ID NO: 213470 - DNA, 25 bp, Mus musculus
agtctttggataggtgctgcttcct

SEQ ID NO: 213471 - DNA, 25 bp, Mus musculus
agtctttgtcgcagtggcagtcata

SEQ ID NO: 213472 - DNA, 25 bp, Mus musculus
agtctttgtcgctgtggcagtcata

SEQ ID NO: 213473 - DNA, 25 bp, Mus musculus
agtctttgtctgctcttggaaatgt

SEQ ID NO: 213474 - DNA, 25 bp, Mus musculus
agtctttgtctggtcttggaaatgt

SEQ ID NO: 213475 - DNA, 25 bp, Mus musculus
agtctttgtggtctcatgagcttga

SEQ ID NO: 213476 - DNA, 25 bp, Mus musculus
agtctttgtggtgtcatgagcttga

SEQ ID NO: 213477 - DNA, 25 bp, Mus musculus
agtctttgtgtaacttacttgtaaa

SEQ ID NO: 213478 - DNA, 25 bp, Mus musculus
agtctttgtgtatcttacttgtaaa

SEQ ID NO: 213479 - DNA, 25 bp, Mus musculus
agtctttgttctattttgtgtgtaa

SEQ ID NO: 213480 - DNA, 25 bp, Mus musculus
agtctttgttcttttttgtgtgtaa

SEQ ID NO: 213481 - DNA, 25 bp, Mus musculus
agtctttgttttcttagggctcctg

SEQ ID NO: 213482 - DNA, 25 bp, Mus musculus
agtctttgttttgttagggctcctg

SEQ ID NO: 213483 - DNA, 25 bp, Mus musculus
agtcttttcaacagctgatgatttc

SEQ ID NO: 213484 - DNA, 25 bp, Mus musculus
agtcttttcaactgctgatgatttc

SEQ ID NO: 213485 - DNA, 25 bp, Mus musculus
agtcttttccgtacaagtgctacag

SEQ ID NO: 213486 - DNA, 25 bp, Mus musculus
agtcttttccgttcaagtgctacag

SEQ ID NO: 213487 - DNA, 25 bp, Mus musculus
agtcttttgcaaagctggtcaaaca

SEQ ID NO: 213488 - DNA, 25 bp, Mus musculus
agtcttttgcaatgctggtcaaaca

SEQ ID NO: 213489 - DNA, 25 bp, Mus musculus
agtcttttgcttcttgctgttttgt

SEQ ID NO: 213490 - DNA, 25 bp, Mus musculus
agtcttttgcttgttgctgttttgt

SEQ ID NO: 213491 - DNA, 25 bp, Mus musculus
agtcttttgtccatgttacctcaat

SEQ ID NO: 213492 - DNA, 25 bp, Mus musculus
agtcttttgtccttgttacctcaat

SEQ ID NO: 213493 - DNA, 25 bp, Mus musculus
agtctttttggcaacagaatcgagc

SEQ ID NO: 213494 - DNA, 25 bp, Mus musculus
agtctttttggctacagaatcgagc

SEQ ID NO: 213495 - DNA, 25 bp, Mus musculus
agtcttttttatcctgcgatgtcat

SEQ ID NO: 213496 - DNA, 25 bp, Mus musculus
agtcttttttatgctgcgatgtcat

SEQ ID NO: 213497 - DNA, 25 bp, Mus musculus
agtgaaaacatccactaccctacag

SEQ ID NO: 213498 - DNA, 25 bp, Mus musculus
agtgaaaacatcgactaccctacag

SEQ ID NO: 213499 - DNA, 25 bp, Mus musculus
agtgaaaacgctcaattctgctgtt

SEQ ID NO: 213500 - DNA, 25 bp, Mus musculus
agtgaaaacgctgaattctgctgtt

SEQ ID NO: 213501 - DNA, 25 bp, Mus musculus
agtgaaaagacaacctcttctgcca

SEQ ID NO: 213502 - DNA, 25 bp, Mus musculus
agtgaaaagacatcctcttctgcca

SEQ ID NO: 213503 - DNA, 25 bp, Mus musculus
agtgaaaaggctagcatccctccag

SEQ ID NO: 213504 - DNA, 25 bp, Mus musculus
agtgaaaaggcttgcatccctccag

SEQ ID NO: 213505 - DNA, 25 bp, Mus musculus
agtgaaacaaacaagctcctgctta

SEQ ID NO: 213506 - DNA, 25 bp, Mus musculus
agtgaaacaaactagctcctgctta

SEQ ID NO: 213507 - DNA, 25 bp, Mus musculus
agtgaaacatcaacaccacctttgt

SEQ ID NO: 213508 - DNA, 25 bp, Mus musculus
agtgaaacatcatcaccacctttgt

SEQ ID NO: 213509 - DNA, 25 bp, Mus musculus
agtgaaacatgtagctttagcgtaa

SEQ ID NO: 213510 - DNA, 25 bp, Mus musculus
agtgaaacatgttgctttagcgtaa

SEQ ID NO: 213511 - DNA, 25 bp, Mus musculus
agtgaaaccctcactaagacagtga

SEQ ID NO: 213512 - DNA, 25 bp, Mus musculus
agtgaaaccctctctaagacagtga

SEQ ID NO: 213513 - DNA, 25 bp, Mus musculus
agtgaaaccttgagggaaacccatg

SEQ ID NO: 213514 - DNA, 25 bp, Mus musculus
agtgaaaccttgtgggaaacccatg

SEQ ID NO: 213515 - DNA, 25 bp, Mus musculus
agtgaaactcacatagtccttgcta

SEQ ID NO: 213516 - DNA, 25 bp, Mus musculus
agtgaaactcacttagtccttgcta

SEQ ID NO: 213517 - DNA, 25 bp, Mus musculus
agtgaaactccactgtttctctgcc

SEQ ID NO: 213518 - DNA, 25 bp, Mus musculus
agtgaaactccagtgtttctctgcc

SEQ ID NO: 213519 - DNA, 25 bp, Mus musculus
agtgaaactgccactgcttagcggg

SEQ ID NO: 213520 - DNA, 25 bp, Mus musculus
agtgaaactgcctctgcttagcggg

SEQ ID NO: 213521 - DNA, 25 bp, Mus musculus
agtgaaactgcgaatggctcattaa

SEQ ID NO: 213522 - DNA, 25 bp, Mus musculus
agtgaaactgcgtatggctcattaa

SEQ ID NO: 213523 - DNA, 25 bp, Mus musculus
agtgaaactttcaggccgtgcagat

SEQ ID NO: 213524 - DNA, 25 bp, Mus musculus
agtgaaactttctggccgtgcagat

SEQ ID NO: 213525 - DNA, 25 bp, Mus musculus
agtgaaagaactacctgtgcttttg

SEQ ID NO: 213526 - DNA, 25 bp, Mus musculus
agtgaaagaacttcctgtgcttttg

SEQ ID NO: 213527 - DNA, 25 bp, Mus musculus
agtgaaagccagaacccctatttgc

SEQ ID NO: 213528 - DNA, 25 bp, Mus musculus
agtgaaagccagtacccctatttgc

SEQ ID NO: 213529 - DNA, 25 bp, Mus musculus
agtgaaagcggcagccacctgagca

SEQ ID NO: 213530 - DNA, 25 bp, Mus musculus
agtgaaagcggctgccacctgagca

SEQ ID NO: 213531 - DNA, 25 bp, Mus musculus
agtgaaagctgtccttcctgtattc

SEQ ID NO: 213532 - DNA, 25 bp, Mus musculus
agtgaaagctgtgcttcctgtattc

SEQ ID NO: 213533 - DNA, 25 bp, Mus musculus
agtgaaaggactcggcttatagatc

SEQ ID NO: 213534 - DNA, 25 bp, Mus musculus
agtgaaaggactgggcttatagatc

SEQ ID NO: 213535 - DNA, 25 bp, Mus musculus
agtgaaaggcgactctctgagttca

SEQ ID NO: 213536 - DNA, 25 bp, Mus musculus
agtgaaaggcgagtctctgagttca

SEQ ID NO: 213537 - DNA, 25 bp, Mus musculus
agtgaaaggtccagagttctcctcc

SEQ ID NO: 213538 - DNA, 25 bp, Mus musculus
agtgaaaggtcctgagttctcctcc

SEQ ID NO: 213539 - DNA, 25 bp, Mus musculus
agtgaaaggttgacagtggtttcca

SEQ ID NO: 213540 - DNA, 25 bp, Mus musculus
agtgaaaggttgtcagtggtttcca

SEQ ID NO: 213541 - DNA, 25 bp, Mus musculus
agtgaaagtaatcagctgctgttcc

SEQ ID NO: 213542 - DNA, 25 bp, Mus musculus
agtgaaagtaatgagctgctgttcc

SEQ ID NO: 213543 - DNA, 25 bp, Mus musculus
agtgaaagtagacagcagcaggacc

SEQ ID NO: 213544 - DNA, 25 bp, Mus musculus
agtgaaagtagagagcagcaggacc

SEQ ID NO: 213545 - DNA, 25 bp, Mus musculus
agtgaaagtctcagcccattgacct

SEQ ID NO: 213546 - DNA, 25 bp, Mus musculus
agtgaaagtctctgcccattgacct

SEQ ID NO: 213547 - DNA, 25 bp, Mus musculus
agtgaaagtgcaaccctggctgcgt

SEQ ID NO: 213548 - DNA, 25 bp, Mus musculus
agtgaaagtgcatccctggctgcgt

SEQ ID NO: 213549 - DNA, 25 bp, Mus musculus
agtgaaataactatcttgtgagctg

SEQ ID NO: 213550 - DNA, 25 bp, Mus musculus
agtgaaataactctcccaaggtcgg

SEQ ID NO: 213551 - DNA, 25 bp, Mus musculus
agtgaaataactgtcccaaggtcgg

SEQ ID NO: 213552 - DNA, 25 bp, Mus musculus
agtgaaataactttcttgtgagctg

SEQ ID NO: 213553 - DNA, 25 bp, Mus musculus
agtgaaatcccaagacagcctaggc

SEQ ID NO: 213554 - DNA, 25 bp, Mus musculus
agtgaaatcccatgacagcctaggc

SEQ ID NO: 213555 - DNA, 25 bp, Mus musculus
agtgaaatcggcacacactcacaca

SEQ ID NO: 213556 - DNA, 25 bp, Mus musculus
agtgaaatcggctcacactcacaca

SEQ ID NO: 213557 - DNA, 25 bp, Mus musculus
agtgaaatctttacgcgcagcgcta

SEQ ID NO: 213558 - DNA, 25 bp, Mus musculus
agtgaaatcttttcgcgcagcgcta

SEQ ID NO: 213559 - DNA, 25 bp, Mus musculus
agtgaaattctcaagcactgtattt

SEQ ID NO: 213560 - DNA, 25 bp, Mus musculus
agtgaaattctctagcactgtattt

SEQ ID NO: 213561 - DNA, 25 bp, Mus musculus
agtgaacacacacccttagcatcgt

SEQ ID NO: 213562 - DNA, 25 bp, Mus musculus
agtgaacacacagccttagcatcgt

SEQ ID NO: 213563 - DNA, 25 bp, Mus musculus
agtgaacacactacaggagcagctc

SEQ ID NO: 213564 - DNA, 25 bp, Mus musculus
agtgaacacactattcttgatttgt

SEQ ID NO: 213565 - DNA, 25 bp, Mus musculus
agtgaacacacttcaggagcagctc

SEQ ID NO: 213566 - DNA, 25 bp, Mus musculus
agtgaacacacttttcttgatttgt

SEQ ID NO: 213567 - DNA, 25 bp, Mus musculus
agtgaacacagaccacacagtttgt

SEQ ID NO: 213568 - DNA, 25 bp, Mus musculus
agtgaacacagagcacacagtttgt

SEQ ID NO: 213569 - DNA, 25 bp, Mus musculus
agtgaacaccaacttcttaagaagg

SEQ ID NO: 213570 - DNA, 25 bp, Mus musculus
agtgaacaccaagttcttaagaagg

SEQ ID NO: 213571 - DNA, 25 bp, Mus musculus
agtgaacaccttagaccgctttgtg

SEQ ID NO: 213572 - DNA, 25 bp, Mus musculus
agtgaacacctttgaccgctttgtg

SEQ ID NO: 213573 - DNA, 25 bp, Mus musculus
agtgaacagaccctcttctgctacc

SEQ ID NO: 213574 - DNA, 25 bp, Mus musculus
agtgaacagaccgtcttctgctacc

SEQ ID NO: 213575 - DNA, 25 bp, Mus musculus
agtgaacagactccggcgctacctt

SEQ ID NO: 213576 - DNA, 25 bp, Mus musculus
agtgaacagactgcggcgctacctt

SEQ ID NO: 213577 - DNA, 25 bp, Mus musculus
agtgaacagagccttgtgcattaaa

SEQ ID NO: 213578 - DNA, 25 bp, Mus musculus
agtgaacagagcgttgtgcattaaa

SEQ ID NO: 213579 - DNA, 25 bp, Mus musculus
agtgaacagcccagtcattgtcaca

SEQ ID NO: 213580 - DNA, 25 bp, Mus musculus
agtgaacagccctgtcattgtcaca

SEQ ID NO: 213581 - DNA, 25 bp, Mus musculus
agtgaacagcctacccacaggaggt

SEQ ID NO: 213582 - DNA, 25 bp, Mus musculus
agtgaacagccttcccacaggaggt

SEQ ID NO: 213583 - DNA, 25 bp, Mus musculus
agtgaacagggaacttcctccacca

SEQ ID NO: 213584 - DNA, 25 bp, Mus musculus
agtgaacagggacggacacaagcca

SEQ ID NO: 213585 - DNA, 25 bp, Mus musculus
agtgaacagggagggacacaagcca

SEQ ID NO: 213586 - DNA, 25 bp, Mus musculus
agtgaacagggatcttcctccacca

SEQ ID NO: 213587 - DNA, 25 bp, Mus musculus
agtgaacatccaattcagaagaaaa

SEQ ID NO: 213588 - DNA, 25 bp, Mus musculus
agtgaacatccatttcagaagaaaa

SEQ ID NO: 213589 - DNA, 25 bp, Mus musculus
agtgaacatgaacagcggcctgctg

SEQ ID NO: 213590 - DNA, 25 bp, Mus musculus
agtgaacatgaagagcggcctgctg

SEQ ID NO: 213591 - DNA, 25 bp, Mus musculus
agtgaacatggcaacctccaacacg

SEQ ID NO: 213592 - DNA, 25 bp, Mus musculus
agtgaacatggccacaccgttccta

SEQ ID NO: 213593 - DNA, 25 bp, Mus musculus
agtgaacatggcgacaccgttccta

SEQ ID NO: 213594 - DNA, 25 bp, Mus musculus
agtgaacatggctacctccaacacg

SEQ ID NO: 213595 - DNA, 25 bp, Mus musculus
agtgaaccaagacagaccctggctc

SEQ ID NO: 213596 - DNA, 25 bp, Mus musculus
agtgaaccaagagagaccctggctc

SEQ ID NO: 213597 - DNA, 25 bp, Mus musculus
agtgaaccaccaatgagggcgttta

SEQ ID NO: 213598 - DNA, 25 bp, Mus musculus
agtgaaccaccattgagggcgttta

SEQ ID NO: 213599 - DNA, 25 bp, Mus musculus
agtgaaccaccccagacttgatgct

SEQ ID NO: 213600 - DNA, 25 bp, Mus musculus
agtgaaccacccgagacttgatgct

SEQ ID NO: 213601 - DNA, 25 bp, Mus musculus
agtgaaccactaaggagggccttta

SEQ ID NO: 213602 - DNA, 25 bp, Mus musculus
agtgaaccactatggagggccttta

SEQ ID NO: 213603 - DNA, 25 bp, Mus musculus
agtgaaccattcatgagcaattaaa

SEQ ID NO: 213604 - DNA, 25 bp, Mus musculus
agtgaaccattcttgagcaattaaa

SEQ ID NO: 213605 - DNA, 25 bp, Mus musculus
agtgaacccgacagacgggtgcaga

SEQ ID NO: 213606 - DNA, 25 bp, Mus musculus
agtgaacccgactgacgggtgcaga

SEQ ID NO: 213607 - DNA, 25 bp, Mus musculus
agtgaacctgtgcactgtggcttcg

SEQ ID NO: 213608 - DNA, 25 bp, Mus musculus
agtgaacctgtggactgtggcttcg

SEQ ID NO: 213609 - DNA, 25 bp, Mus musculus
agtgaacgctaaacaggtcggtggt

SEQ ID NO: 213610 - DNA, 25 bp, Mus musculus
agtgaacgctaatcaggtcggtggt

SEQ ID NO: 213611 - DNA, 25 bp, Mus musculus
agtgaacgcttgaggacctgttttt

SEQ ID NO: 213612 - DNA, 25 bp, Mus musculus
agtgaacgcttgtggacctgttttt

SEQ ID NO: 213613 - DNA, 25 bp, Mus musculus
agtgaacggcccctatggcttacat

SEQ ID NO: 213614 - DNA, 25 bp, Mus musculus
agtgaacggcccgtatggcttacat

SEQ ID NO: 213615 - DNA, 25 bp, Mus musculus
agtgaactaagaaactctcctccca

SEQ ID NO: 213616 - DNA, 25 bp, Mus musculus
agtgaactaagatactctcctccca

SEQ ID NO: 213617 - DNA, 25 bp, Mus musculus
agtgaactaattaaaggtcgatgtc

SEQ ID NO: 213618 - DNA, 25 bp, Mus musculus
agtgaactaatttaaggtcgatgtc

SEQ ID NO: 213619 - DNA, 25 bp, Mus musculus
agtgaactacctacctagccatgaa

SEQ ID NO: 213620 - DNA, 25 bp, Mus musculus
agtgaactaccttcctagccatgaa

SEQ ID NO: 213621 - DNA, 25 bp, Mus musculus
agtgaactatctcggttttgcaagg

SEQ ID NO: 213622 - DNA, 25 bp, Mus musculus
agtgaactatctgggttttgcaagg

SEQ ID NO: 213623 - DNA, 25 bp, Mus musculus
agtgaactcagacaggctggcccct

SEQ ID NO: 213624 - DNA, 25 bp, Mus musculus
agtgaactcagagaggctggcccct

SEQ ID NO: 213625 - DNA, 25 bp, Mus musculus
agtgaactgaaaattgtccccaaag

SEQ ID NO: 213626 - DNA, 25 bp, Mus musculus
agtgaactgaaatttgtccccaaag

SEQ ID NO: 213627 - DNA, 25 bp, Mus musculus
agtgaactggaaaggagtctagcaa

SEQ ID NO: 213628 - DNA, 25 bp, Mus musculus
agtgaactggaatggagtctagcaa

SEQ ID NO: 213629 - DNA, 25 bp, Mus musculus
agtgaacttgatctgcgtgacgctt

SEQ ID NO: 213630 - DNA, 25 bp, Mus musculus
agtgaacttgatgtgcgtgacgctt

SEQ ID NO: 213631 - DNA, 25 bp, Mus musculus
agtgaactttggataccagcctctg

SEQ ID NO: 213632 - DNA, 25 bp, Mus musculus
agtgaactttggttaccagcctctg

SEQ ID NO: 213633 - DNA, 25 bp, Mus musculus
agtgaacttttgaaatttgaattgg

SEQ ID NO: 213634 - DNA, 25 bp, Mus musculus
agtgaacttttgtaatttgaattgg

SEQ ID NO: 213635 - DNA, 25 bp, Mus musculus
agtgaagaaccactgagacccacct

SEQ ID NO: 213636 - DNA, 25 bp, Mus musculus
agtgaagaaccagtgagacccacct

SEQ ID NO: 213637 - DNA, 25 bp, Mus musculus
agtgaagaaccgactccagaaagtt

SEQ ID NO: 213638 - DNA, 25 bp, Mus musculus
agtgaagaaccgtctccagaaagtt

SEQ ID NO: 213639 - DNA, 25 bp, Mus musculus
agtgaagaattcacccatgggccgt

SEQ ID NO: 213640 - DNA, 25 bp, Mus musculus
agtgaagaattctcccatgggccgt

SEQ ID NO: 213641 - DNA, 25 bp, Mus musculus
agtgaagacactacagaccctggac

SEQ ID NO: 213642 - DNA, 25 bp, Mus musculus
agtgaagacacttcagaccctggac

SEQ ID NO: 213643 - DNA, 25 bp, Mus musculus
agtgaagaccacatatcaacattta

SEQ ID NO: 213644 - DNA, 25 bp, Mus musculus
agtgaagaccacttatcaacattta

SEQ ID NO: 213645 - DNA, 25 bp, Mus musculus
agtgaagaccttaaccaccgctgtc

SEQ ID NO: 213646 - DNA, 25 bp, Mus musculus
agtgaagacctttaccaccgctgtc

SEQ ID NO: 213647 - DNA, 25 bp, Mus musculus
agtgaagactcaccaatccccgtgt

SEQ ID NO: 213648 - DNA, 25 bp, Mus musculus
agtgaagactcacctgtcaccctga

SEQ ID NO: 213649 - DNA, 25 bp, Mus musculus
agtgaagactcagcaatccccgtgt

SEQ ID NO: 213650 - DNA, 25 bp, Mus musculus
agtgaagactcagctgtcaccctga

SEQ ID NO: 213651 - DNA, 25 bp, Mus musculus
agtgaagacttacgatccctctggt

SEQ ID NO: 213652 - DNA, 25 bp, Mus musculus
agtgaagacttaggatccctctggt

SEQ ID NO: 213653 - DNA, 25 bp, Mus musculus
agtgaagatcccatacccttgtaat

SEQ ID NO: 213654 - DNA, 25 bp, Mus musculus
agtgaagatcccttacccttgtaat

SEQ ID NO: 213655 - DNA, 25 bp, Mus musculus
agtgaagatgttcccactctcagtg

SEQ ID NO: 213656 - DNA, 25 bp, Mus musculus
agtgaagatgttgccactctcagtg

SEQ ID NO: 213657 - DNA, 25 bp, Mus musculus
agtgaagcacgtacctgataggcag

SEQ ID NO: 213658 - DNA, 25 bp, Mus musculus
agtgaagcacgttcctgataggcag

SEQ ID NO: 213659 - DNA, 25 bp, Mus musculus
agtgaagcagccactacagcaggat

SEQ ID NO: 213660 - DNA, 25 bp, Mus musculus
agtgaagcagcctctacagcaggat

SEQ ID NO: 213661 - DNA, 25 bp, Mus musculus
agtgaagcagtactcccagcaatga

SEQ ID NO: 213662 - DNA, 25 bp, Mus musculus
agtgaagcagtagtcccagcaatga

SEQ ID NO: 213663 - DNA, 25 bp, Mus musculus
agtgaagcatgcctgcagtctcagc

SEQ ID NO: 213664 - DNA, 25 bp, Mus musculus
agtgaagcatgcgtgcagtctcagc

SEQ ID NO: 213665 - DNA, 25 bp, Mus musculus
agtgaagccagccagagggtcctaa

SEQ ID NO: 213666 - DNA, 25 bp, Mus musculus
agtgaagccagcgagagggtcctaa

SEQ ID NO: 213667 - DNA, 25 bp, Mus musculus
agtgaagccagtctgtctgccgaac

SEQ ID NO: 213668 - DNA, 25 bp, Mus musculus
agtgaagccagtgtgtctgccgaac

SEQ ID NO: 213669 - DNA, 25 bp, Mus musculus
agtgaagcccttctgaacacaggaa

SEQ ID NO: 213670 - DNA, 25 bp, Mus musculus
agtgaagcccttgtgaacacaggaa

SEQ ID NO: 213671 - DNA, 25 bp, Mus musculus
agtgaagccgctctgctctgttttg

SEQ ID NO: 213672 - DNA, 25 bp, Mus musculus
agtgaagccgctgtgctctgttttg

SEQ ID NO: 213673 - DNA, 25 bp, Mus musculus
agtgaagcgttaactagtcctgaga

SEQ ID NO: 213674 - DNA, 25 bp, Mus musculus
agtgaagcgttatctagtcctgaga

SEQ ID NO: 213675 - DNA, 25 bp, Mus musculus
agtgaagctaggctctgcacgtgct

SEQ ID NO: 213676 - DNA, 25 bp, Mus musculus
agtgaagctagggtctgcacgtgct

SEQ ID NO: 213677 - DNA, 25 bp, Mus musculus
agtgaagctcacaccatgtagcata

SEQ ID NO: 213678 - DNA, 25 bp, Mus musculus
agtgaagctcactccatgtagcata

SEQ ID NO: 213679 - DNA, 25 bp, Mus musculus
agtgaagctgtcagcccggttgtag

SEQ ID NO: 213680 - DNA, 25 bp, Mus musculus
agtgaagctgtctgcccggttgtag

SEQ ID NO: 213681 - DNA, 25 bp, Mus musculus
agtgaaggatacagcaacttgctca

SEQ ID NO: 213682 - DNA, 25 bp, Mus musculus
agtgaaggatactgcaacttgctca

SEQ ID NO: 213683 - DNA, 25 bp, Mus musculus
agtgaaggccctctaccaagtgagc

SEQ ID NO: 213684 - DNA, 25 bp, Mus musculus
agtgaaggccctgtaccaagtgagc

SEQ ID NO: 213685 - DNA, 25 bp, Mus musculus
agtgaaggctcaactagtcatcatc

SEQ ID NO: 213686 - DNA, 25 bp, Mus musculus
agtgaaggctcatctagtcatcatc

SEQ ID NO: 213687 - DNA, 25 bp, Mus musculus
agtgaaggctgacctcctttcgtca

SEQ ID NO: 213688 - DNA, 25 bp, Mus musculus
agtgaaggctgagctcctttcgtca

SEQ ID NO: 213689 - DNA, 25 bp, Mus musculus
agtgaagggagcagtcttccctcat

SEQ ID NO: 213690 - DNA, 25 bp, Mus musculus
agtgaagggagctgtcttccctcat

SEQ ID NO: 213691 - DNA, 25 bp, Mus musculus
agtgaagggcagcaggtccccaata

SEQ ID NO: 213692 - DNA, 25 bp, Mus musculus
agtgaagggcaggaggtccccaata

SEQ ID NO: 213693 - DNA, 25 bp, Mus musculus
agtgaagggctcagtgggcgggccc

SEQ ID NO: 213694 - DNA, 25 bp, Mus musculus
agtgaagggctctgtgggcgggccc

SEQ ID NO: 213695 - DNA, 25 bp, Mus musculus
agtgaaggtctcagtgtctgcagcc

SEQ ID NO: 213696 - DNA, 25 bp, Mus musculus
agtgaaggtctctgtgtctgcagcc

SEQ ID NO: 213697 - DNA, 25 bp, Mus musculus
agtgaaggtgctcttgtgcattccc

SEQ ID NO: 213698 - DNA, 25 bp, Mus musculus
agtgaaggtgctgttgtgcattccc

SEQ ID NO: 213699 - DNA, 25 bp, Mus musculus
agtgaagtagaaacatctgtaccca

SEQ ID NO: 213700 - DNA, 25 bp, Mus musculus
agtgaagtagaatcatctgtaccca

SEQ ID NO: 213701 - DNA, 25 bp, Mus musculus
agtgaagtcatgatccatacagttc

SEQ ID NO: 213702 - DNA, 25 bp, Mus musculus
agtgaagtcatgttccatacagttc

SEQ ID NO: 213703 - DNA, 25 bp, Mus musculus
agtgaagtccccataagccgacaag

SEQ ID NO: 213704 - DNA, 25 bp, Mus musculus
agtgaagtccccttaagccgacaag

SEQ ID NO: 213705 - DNA, 25 bp, Mus musculus
agtgaagtccttcttggcatcgacc

SEQ ID NO: 213706 - DNA, 25 bp, Mus musculus
agtgaagtccttgttggcatcgacc

SEQ ID NO: 213707 - DNA, 25 bp, Mus musculus
agtgaagtctcacatttctttctca

SEQ ID NO: 213708 - DNA, 25 bp, Mus musculus
agtgaagtctcagatttctttctca

SEQ ID NO: 213709 - DNA, 25 bp, Mus musculus
agtgaagtgactagtttaactccta

SEQ ID NO: 213710 - DNA, 25 bp, Mus musculus
agtgaagtgacttgtttaactccta

SEQ ID NO: 213711 - DNA, 25 bp, Mus musculus
agtgaagtgctcacgaagcctacac

SEQ ID NO: 213712 - DNA, 25 bp, Mus musculus
agtgaagtgctctcgaagcctacac

SEQ ID NO: 213713 - DNA, 25 bp, Mus musculus
agtgaagtggtcaagatttatttat

SEQ ID NO: 213714 - DNA, 25 bp, Mus musculus
agtgaagtggtctagatttatttat

SEQ ID NO: 213715 - DNA, 25 bp, Mus musculus
agtgaagtgtctactcttgacagtc

SEQ ID NO: 213716 - DNA, 25 bp, Mus musculus
agtgaagtgtcttctcttgacagtc

SEQ ID NO: 213717 - DNA, 25 bp, Mus musculus
agtgaagttaagatgcctgagacct

SEQ ID NO: 213718 - DNA, 25 bp, Mus musculus
agtgaagttaagttgcctgagacct

SEQ ID NO: 213719 - DNA, 25 bp, Mus musculus
agtgaagttcttattggttgatgaa

SEQ ID NO: 213720 - DNA, 25 bp, Mus musculus
agtgaagttctttttggttgatgaa

SEQ ID NO: 213721 - DNA, 25 bp, Mus musculus
agtgaagtttggatcagtcctgaat

SEQ ID NO: 213722 - DNA, 25 bp, Mus musculus
agtgaagtttggttcagtcctgaat

SEQ ID NO: 213723 - DNA, 25 bp, Mus musculus
agtgaataaacaactctgagtcagg

SEQ ID NO: 213724 - DNA, 25 bp, Mus musculus
agtgaataaacatctctgagtcagg

SEQ ID NO: 213725 - DNA, 25 bp, Mus musculus
agtgaataaatgcaggcccctcgca

SEQ ID NO: 213726 - DNA, 25 bp, Mus musculus
agtgaataaatggaggcccctcgca

SEQ ID NO: 213727 - DNA, 25 bp, Mus musculus
agtgaatactctctgcagcaaacca

SEQ ID NO: 213728 - DNA, 25 bp, Mus musculus
agtgaatactctgtgcagcaaacca

SEQ ID NO: 213729 - DNA, 25 bp, Mus musculus
agtgaatagcacagccctctggtgg

SEQ ID NO: 213730 - DNA, 25 bp, Mus musculus
agtgaatagcactgccctctggtgg

SEQ ID NO: 213731 - DNA, 25 bp, Mus musculus
agtgaatagccaaagggttttgttt

SEQ ID NO: 213732 - DNA, 25 bp, Mus musculus
agtgaatagccatagggttttgttt

SEQ ID NO: 213733 - DNA, 25 bp, Mus musculus
agtgaatcacagcagcccttccagg

SEQ ID NO: 213734 - DNA, 25 bp, Mus musculus
agtgaatcacaggagcccttccagg

SEQ ID NO: 213735 - DNA, 25 bp, Mus musculus
agtgaatcaggcaggcactagctcc

SEQ ID NO: 213736 - DNA, 25 bp, Mus musculus
agtgaatcaggctggcactagctcc

SEQ ID NO: 213737 - DNA, 25 bp, Mus musculus
agtgaatcattcaggtggcaggcca

SEQ ID NO: 213738 - DNA, 25 bp, Mus musculus
agtgaatcattctggtggcaggcca

SEQ ID NO: 213739 - DNA, 25 bp, Mus musculus
agtgaatccctgaacttggttccct

SEQ ID NO: 213740 - DNA, 25 bp, Mus musculus
agtgaatccctgtacttggttccct

SEQ ID NO: 213741 - DNA, 25 bp, Mus musculus
agtgaatctcataccaggtcctgct

SEQ ID NO: 213742 - DNA, 25 bp, Mus musculus
agtgaatctcattccaggtcctgct

SEQ ID NO: 213743 - DNA, 25 bp, Mus musculus
agtgaatctctcatcatctctaacc

SEQ ID NO: 213744 - DNA, 25 bp, Mus musculus
agtgaatctctcttcatctctaacc

SEQ ID NO: 213745 - DNA, 25 bp, Mus musculus
agtgaatctctgcaggttggaaaag

SEQ ID NO: 213746 - DNA, 25 bp, Mus musculus
agtgaatctctggaggttggaaaag

SEQ ID NO: 213747 - DNA, 25 bp, Mus musculus
agtgaatctgcccagagactcagca

SEQ ID NO: 213748 - DNA, 25 bp, Mus musculus
agtgaatctgccgagagactcagca

SEQ ID NO: 213749 - DNA, 25 bp, Mus musculus
agtgaatcttcgcttcctgagttcc

SEQ ID NO: 213750 - DNA, 25 bp, Mus musculus
agtgaatcttcggttcctgagttcc

SEQ ID NO: 213751 - DNA, 25 bp, Mus musculus
agtgaatctttaacctggtgagtca

SEQ ID NO: 213752 - DNA, 25 bp, Mus musculus
agtgaatctttatcctggtgagtca

SEQ ID NO: 213753 - DNA, 25 bp, Mus musculus
agtgaatgaccacctcgaatccggc

SEQ ID NO: 213754 - DNA, 25 bp, Mus musculus
agtgaatgaccagctcgaatccggc

SEQ ID NO: 213755 - DNA, 25 bp, Mus musculus
agtgaatgcttaccctgtgtagaga

SEQ ID NO: 213756 - DNA, 25 bp, Mus musculus
agtgaatgcttagcctgtgtagaga

SEQ ID NO: 213757 - DNA, 25 bp, Mus musculus
agtgaatggcttacagtctgaaaca

SEQ ID NO: 213758 - DNA, 25 bp, Mus musculus
agtgaatggctttcagtctgaaaca

SEQ ID NO: 213759 - DNA, 25 bp, Mus musculus
agtgaatggtctcggcttttaagca

SEQ ID NO: 213760 - DNA, 25 bp, Mus musculus
agtgaatggtctgggcttttaagca

SEQ ID NO: 213761 - DNA, 25 bp, Mus musculus
agtgaatgtgcaatggaccctcttc

SEQ ID NO: 213762 - DNA, 25 bp, Mus musculus
agtgaatgtgcattggaccctcttc

SEQ ID NO: 213763 - DNA, 25 bp, Mus musculus
agtgaatgtggtcccatttctgttt

SEQ ID NO: 213764 - DNA, 25 bp, Mus musculus
agtgaatgtggtgccatttctgttt

SEQ ID NO: 213765 - DNA, 25 bp, Mus musculus
agtgaattagttccttcattctcct

SEQ ID NO: 213766 - DNA, 25 bp, Mus musculus
agtgaattagttgcttcattctcct

SEQ ID NO: 213767 - DNA, 25 bp, Mus musculus
agtgaattatgcatgaaagtctgtg

SEQ ID NO: 213768 - DNA, 25 bp, Mus musculus
agtgaattatgcttgaaagtctgtg

SEQ ID NO: 213769 - DNA, 25 bp, Mus musculus
agtgaattcagtcttgtctcccaga

SEQ ID NO: 213770 - DNA, 25 bp, Mus musculus
agtgaattcagtgttgtctcccaga

SEQ ID NO: 213771 - DNA, 25 bp, Mus musculus
agtgaattcggaatattgccggagt

SEQ ID NO: 213772 - DNA, 25 bp, Mus musculus
agtgaattcggattattgccggagt

SEQ ID NO: 213773 - DNA, 25 bp, Mus musculus
agtgaattctcaccaccaatcggca

SEQ ID NO: 213774 - DNA, 25 bp, Mus musculus
agtgaattctcagcaccaatcggca

SEQ ID NO: 213775 - DNA, 25 bp, Mus musculus
agtgaattctgcatcaagagtggtc

SEQ ID NO: 213776 - DNA, 25 bp, Mus musculus
agtgaattctgcttcaagagtggtc

SEQ ID NO: 213777 - DNA, 25 bp, Mus musculus
agtgaatttacacatttccaggaat

SEQ ID NO: 213778 - DNA, 25 bp, Mus musculus
agtgaatttacagatttccaggaat

SEQ ID NO: 213779 - DNA, 25 bp, Mus musculus
agtgacaaagagaccagtatggaat

SEQ ID NO: 213780 - DNA, 25 bp, Mus musculus
agtgacaaagagtccagtatggaat

SEQ ID NO: 213781 - DNA, 25 bp, Mus musculus
agtgacaacagcagtcacgtcatgg

SEQ ID NO: 213782 - DNA, 25 bp, Mus musculus
agtgacaacagctgtcacgtcatgg

SEQ ID NO: 213783 - DNA, 25 bp, Mus musculus
agtgacaaccttacttgtttatttg

SEQ ID NO: 213784 - DNA, 25 bp, Mus musculus
agtgacaacctttcttgtttatttg

SEQ ID NO: 213785 - DNA, 25 bp, Mus musculus
agtgacaactacattttcctacctc

SEQ ID NO: 213786 - DNA, 25 bp, Mus musculus
agtgacaactactttttcctacctc

SEQ ID NO: 213787 - DNA, 25 bp, Mus musculus
agtgacaactccaaagcaacctgca

SEQ ID NO: 213788 - DNA, 25 bp, Mus musculus
agtgacaactcctaagcaacctgca

SEQ ID NO: 213789 - DNA, 25 bp, Mus musculus
agtgacaactctacttcccttctct

SEQ ID NO: 213790 - DNA, 25 bp, Mus musculus
agtgacaactcttcttcccttctct

SEQ ID NO: 213791 - DNA, 25 bp, Mus musculus
agtgacaagagtcaggctgccctgc

SEQ ID NO: 213792 - DNA, 25 bp, Mus musculus
agtgacaagagtgaggctgccctgc

SEQ ID NO: 213793 - DNA, 25 bp, Mus musculus
agtgacaagcccagactagcacagt

SEQ ID NO: 213794 - DNA, 25 bp, Mus musculus
agtgacaagccctgactagcacagt

SEQ ID NO: 213795 - DNA, 25 bp, Mus musculus
agtgacaagccgagattgacaggaa

SEQ ID NO: 213796 - DNA, 25 bp, Mus musculus
agtgacaagccgtgattgacaggaa

SEQ ID NO: 213797 - DNA, 25 bp, Mus musculus
agtgacaaggtacccctgccaagaa

SEQ ID NO: 213798 - DNA, 25 bp, Mus musculus
agtgacaaggtagccctgccaagaa

SEQ ID NO: 213799 - DNA, 25 bp, Mus musculus
agtgacaagtaccttccacacgagg

SEQ ID NO: 213800 - DNA, 25 bp, Mus musculus
agtgacaagtacgttccacacgagg

SEQ ID NO: 213801 - DNA, 25 bp, Mus musculus
agtgacaatcctaaggttctccctg

SEQ ID NO: 213802 - DNA, 25 bp, Mus musculus
agtgacaatccttaggttctccctg

SEQ ID NO: 213803 - DNA, 25 bp, Mus musculus
agtgacaatctgaatatgtagtatt

SEQ ID NO: 213804 - DNA, 25 bp, Mus musculus
agtgacaatctgtatatgtagtatt

SEQ ID NO: 213805 - DNA, 25 bp, Mus musculus
agtgacaattcacctaccataaaat

SEQ ID NO: 213806 - DNA, 25 bp, Mus musculus
agtgacaattcagctaccataaaat

SEQ ID NO: 213807 - DNA, 25 bp, Mus musculus
agtgacaattctaaagagagcttac

SEQ ID NO: 213808 - DNA, 25 bp, Mus musculus
agtgacaattcttaagagagcttac

SEQ ID NO: 213809 - DNA, 25 bp, Mus musculus
agtgacacaagcagcaacttctctc

SEQ ID NO: 213810 - DNA, 25 bp, Mus musculus
agtgacacaagctgcaacttctctc

SEQ ID NO: 213811 - DNA, 25 bp, Mus musculus
agtgacacacaaccagcgtcgtcgt

SEQ ID NO: 213812 - DNA, 25 bp, Mus musculus
agtgacacacaagcagcgtcgtcgt

SEQ ID NO: 213813 - DNA, 25 bp, Mus musculus
agtgacacacttctgtttttctgtg

SEQ ID NO: 213814 - DNA, 25 bp, Mus musculus
agtgacacacttgtgtttttctgtg

SEQ ID NO: 213815 - DNA, 25 bp, Mus musculus
agtgacacagacatccctctaaagt

SEQ ID NO: 213816 - DNA, 25 bp, Mus musculus
agtgacacagacttccctctaaagt

SEQ ID NO: 213817 - DNA, 25 bp, Mus musculus
agtgacacagttcttgtcccacacg

SEQ ID NO: 213818 - DNA, 25 bp, Mus musculus
agtgacacagttgttgtcccacacg

SEQ ID NO: 213819 - DNA, 25 bp, Mus musculus
agtgacaccatccttagagtacctc

SEQ ID NO: 213820 - DNA, 25 bp, Mus musculus
agtgacaccatcgttagagtacctc

SEQ ID NO: 213821 - DNA, 25 bp, Mus musculus
agtgacaccatgaagactctttgag

SEQ ID NO: 213822 - DNA, 25 bp, Mus musculus
agtgacaccatgtagactctttgag

SEQ ID NO: 213823 - DNA, 25 bp, Mus musculus
agtgacaccctaacttctaaaataa

SEQ ID NO: 213824 - DNA, 25 bp, Mus musculus
agtgacaccctatcttctaaaataa

SEQ ID NO: 213825 - DNA, 25 bp, Mus musculus
agtgacaccgatcggcagaacctgc

SEQ ID NO: 213826 - DNA, 25 bp, Mus musculus
agtgacaccgatgggcagaacctgc

SEQ ID NO: 213827 - DNA, 25 bp, Mus musculus
agtgacacctacaaagacttgttgg

SEQ ID NO: 213828 - DNA, 25 bp, Mus musculus
agtgacacctactaagacttgttgg

SEQ ID NO: 213829 - DNA, 25 bp, Mus musculus
agtgacacctgtcatctccaacaat

SEQ ID NO: 213830 - DNA, 25 bp, Mus musculus
agtgacacctgtgatctccaacaat

SEQ ID NO: 213831 - DNA, 25 bp, Mus musculus
agtgacaccttactccattgttttc

SEQ ID NO: 213832 - DNA, 25 bp, Mus musculus
agtgacaccttagtccattgttttc

SEQ ID NO: 213833 - DNA, 25 bp, Mus musculus
agtgacacggacactaccaccagtg

SEQ ID NO: 213834 - DNA, 25 bp, Mus musculus
agtgacacggactctaccaccagtg

SEQ ID NO: 213835 - DNA, 25 bp, Mus musculus
agtgacacgtgtcaggacccagctc

SEQ ID NO: 213836 - DNA, 25 bp, Mus musculus
agtgacacgtgtgaggacccagctc

SEQ ID NO: 213837 - DNA, 25 bp, Mus musculus
agtgacactaaaatattctggcatt

SEQ ID NO: 213838 - DNA, 25 bp, Mus musculus
agtgacactaaattattctggcatt

SEQ ID NO: 213839 - DNA, 25 bp, Mus musculus
agtgacactggcacagaagtatgaa

SEQ ID NO: 213840 - DNA, 25 bp, Mus musculus
agtgacactggctcagaagtatgaa

SEQ ID NO: 213841 - DNA, 25 bp, Mus musculus
agtgacacttttcgttgtgtccctc

SEQ ID NO: 213842 - DNA, 25 bp, Mus musculus
agtgacacttttggttgtgtccctc

SEQ ID NO: 213843 - DNA, 25 bp, Mus musculus
agtgacagacatatcccagaggctc

SEQ ID NO: 213844 - DNA, 25 bp, Mus musculus
agtgacagacatttcccagaggctc

SEQ ID NO: 213845 - DNA, 25 bp, Mus musculus
agtgacagacttcgagatggtagca

SEQ ID NO: 213846 - DNA, 25 bp, Mus musculus
agtgacagacttggagatggtagca

SEQ ID NO: 213847 - DNA, 25 bp, Mus musculus
agtgacagcacaagctcggtggcac

SEQ ID NO: 213848 - DNA, 25 bp, Mus musculus
agtgacagcacatgctcggtggcac

SEQ ID NO: 213849 - DNA, 25 bp, Mus musculus
agtgacagccctagatctggttttg

SEQ ID NO: 213850 - DNA, 25 bp, Mus musculus
agtgacagcccttgatctggttttg

SEQ ID NO: 213851 - DNA, 25 bp, Mus musculus
agtgacagctatcataccttcagcc

SEQ ID NO: 213852 - DNA, 25 bp, Mus musculus
agtgacagctatgataccttcagcc

SEQ ID NO: 213853 - DNA, 25 bp, Mus musculus
agtgacagctccagggtccttgttc

SEQ ID NO: 213854 - DNA, 25 bp, Mus musculus
agtgacagctcctgggtccttgttc

SEQ ID NO: 213855 - DNA, 25 bp, Mus musculus
agtgacaggaggcaatcctgccaag

SEQ ID NO: 213856 - DNA, 25 bp, Mus musculus
agtgacaggagggaatcctgccaag

SEQ ID NO: 213857 - DNA, 25 bp, Mus musculus
agtgacaggcgtcgctgctaccaac

SEQ ID NO: 213858 - DNA, 25 bp, Mus musculus
agtgacaggcgtggctgctaccaac

SEQ ID NO: 213859 - DNA, 25 bp, Mus musculus
agtgacaggcttagagggcaaagac

SEQ ID NO: 213860 - DNA, 25 bp, Mus musculus
agtgacaggctttgagggcaaagac

SEQ ID NO: 213861 - DNA, 25 bp, Mus musculus
agtgacaggtttacacacggcccct

SEQ ID NO: 213862 - DNA, 25 bp, Mus musculus
agtgacaggttttcacacggcccct

SEQ ID NO: 213863 - DNA, 25 bp, Mus musculus
agtgacagtggtcctgatcttgcaa

SEQ ID NO: 213864 - DNA, 25 bp, Mus musculus
agtgacagtggtgctgatcttgcaa

SEQ ID NO: 213865 - DNA, 25 bp, Mus musculus
agtgacataagaattctatgctcct

SEQ ID NO: 213866 - DNA, 25 bp, Mus musculus
agtgacataagatttctatgctcct

SEQ ID NO: 213867 - DNA, 25 bp, Mus musculus
agtgacatcatcctttagccccatt

SEQ ID NO: 213868 - DNA, 25 bp, Mus musculus
agtgacatcatcgtttagccccatt

SEQ ID NO: 213869 - DNA, 25 bp, Mus musculus
agtgacatcgcccttgggatgacga

SEQ ID NO: 213870 - DNA, 25 bp, Mus musculus
agtgacatcgccgttgggatgacga

SEQ ID NO: 213871 - DNA, 25 bp, Mus musculus
agtgacatctttaaggtgcttgaag

SEQ ID NO: 213872 - DNA, 25 bp, Mus musculus
agtgacatcttttaggtgcttgaag

SEQ ID NO: 213873 - DNA, 25 bp, Mus musculus
agtgacatgaccagctgggcctaca

SEQ ID NO: 213874 - DNA, 25 bp, Mus musculus
agtgacatgacctgctgggcctaca

SEQ ID NO: 213875 - DNA, 25 bp, Mus musculus
agtgacatgatccacagtcctgcat

SEQ ID NO: 213876 - DNA, 25 bp, Mus musculus
agtgacatgatcgacagtcctgcat

SEQ ID NO: 213877 - DNA, 25 bp, Mus musculus
agtgacatgccacatctaagccacg

SEQ ID NO: 213878 - DNA, 25 bp, Mus musculus
agtgacatgccagatctaagccacg

SEQ ID NO: 213879 - DNA, 25 bp, Mus musculus
agtgacatggaccaaatccttgcag

SEQ ID NO: 213880 - DNA, 25 bp, Mus musculus
agtgacatggacgaaatccttgcag

SEQ ID NO: 213881 - DNA, 25 bp, Mus musculus
agtgacatggatacaaaggctggcc

SEQ ID NO: 213882 - DNA, 25 bp, Mus musculus
agtgacatggattcaaaggctggcc

SEQ ID NO: 213883 - DNA, 25 bp, Mus musculus
agtgacatgggtacctcctcctgga

SEQ ID NO: 213884 - DNA, 25 bp, Mus musculus
agtgacatgggttcctcctcctgga

SEQ ID NO: 213885 - DNA, 25 bp, Mus musculus
agtgacatgtctcccaattttgttc

SEQ ID NO: 213886 - DNA, 25 bp, Mus musculus
agtgacatgtctgccaattttgttc

SEQ ID NO: 213887 - DNA, 25 bp, Mus musculus
agtgacatgttaaccctgactttat

SEQ ID NO: 213888 - DNA, 25 bp, Mus musculus
agtgacatgttatccctgactttat

SEQ ID NO: 213889 - DNA, 25 bp, Mus musculus
agtgacattagacatcaccaggtct

SEQ ID NO: 213890 - DNA, 25 bp, Mus musculus
agtgacattagagatcaccaggtct

SEQ ID NO: 213891 - DNA, 25 bp, Mus musculus
agtgacattgtgaggagttgctgcc

SEQ ID NO: 213892 - DNA, 25 bp, Mus musculus
agtgacattgtgtggagttgctgcc

SEQ ID NO: 213893 - DNA, 25 bp, Mus musculus
agtgacatttccctcttcttcagaa

SEQ ID NO: 213894 - DNA, 25 bp, Mus musculus
agtgacatttccgtcttcttcagaa

SEQ ID NO: 213895 - DNA, 25 bp, Mus musculus
agtgacattttccatccactcagcc

SEQ ID NO: 213896 - DNA, 25 bp, Mus musculus
agtgacattttcgatccactcagcc

SEQ ID NO: 213897 - DNA, 25 bp, Mus musculus
agtgaccaaattatctgtgcattta

SEQ ID NO: 213898 - DNA, 25 bp, Mus musculus
agtgaccaaattttctgtgcattta

SEQ ID NO: 213899 - DNA, 25 bp, Mus musculus
agtgaccaacttccaggtgggccca

SEQ ID NO: 213900 - DNA, 25 bp, Mus musculus
agtgaccaacttgcaggtgggccca

SEQ ID NO: 213901 - DNA, 25 bp, Mus musculus
agtgaccaagatctgtgcccagtgt

SEQ ID NO: 213902 - DNA, 25 bp, Mus musculus
agtgaccaagatgtgtgcccagtgt

SEQ ID NO: 213903 - DNA, 25 bp, Mus musculus
agtgaccaatgcagccatcattctg

SEQ ID NO: 213904 - DNA, 25 bp, Mus musculus
agtgaccaatgctgccatcattctg

SEQ ID NO: 213905 - DNA, 25 bp, Mus musculus
agtgaccaatgtataaggctgttaa

SEQ ID NO: 213906 - DNA, 25 bp, Mus musculus
agtgaccaatgtttaaggctgttaa

SEQ ID NO: 213907 - DNA, 25 bp, Mus musculus
agtgaccacctcagtgtttctggag

SEQ ID NO: 213908 - DNA, 25 bp, Mus musculus
agtgaccacctctgtgtttctggag

SEQ ID NO: 213909 - DNA, 25 bp, Mus musculus
agtgaccagcataactccccagtga

SEQ ID NO: 213910 - DNA, 25 bp, Mus musculus
agtgaccagcattactccccagtga

SEQ ID NO: 213911 - DNA, 25 bp, Mus musculus
agtgaccaggacatggacgcctact

SEQ ID NO: 213912 - DNA, 25 bp, Mus musculus
agtgaccaggacttggacgcctact

SEQ ID NO: 213913 - DNA, 25 bp, Mus musculus
agtgaccaggcactgagctgtgact

SEQ ID NO: 213914 - DNA, 25 bp, Mus musculus
agtgaccaggcagtgagctgtgact

SEQ ID NO: 213915 - DNA, 25 bp, Mus musculus
agtgaccaggtcaactactgtctca

SEQ ID NO: 213916 - DNA, 25 bp, Mus musculus
agtgaccaggtctactactgtctca

SEQ ID NO: 213917 - DNA, 25 bp, Mus musculus
agtgaccaggttagcctgtattcca

SEQ ID NO: 213918 - DNA, 25 bp, Mus musculus
agtgaccaggttatattgcaggcaa

SEQ ID NO: 213919 - DNA, 25 bp, Mus musculus
agtgaccaggtttgcctgtattcca

SEQ ID NO: 213920 - DNA, 25 bp, Mus musculus
agtgaccaggttttattgcaggcaa

SEQ ID NO: 213921 - DNA, 25 bp, Mus musculus
agtgaccagtcaattcttgtacaaa

SEQ ID NO: 213922 - DNA, 25 bp, Mus musculus
agtgaccagtcatttcttgtacaaa

SEQ ID NO: 213923 - DNA, 25 bp, Mus musculus
agtgaccagtgactcatagcccact

SEQ ID NO: 213924 - DNA, 25 bp, Mus musculus
agtgaccagtgagtcatagcccact

SEQ ID NO: 213925 - DNA, 25 bp, Mus musculus
agtgaccatactctcttctgtgcaa

SEQ ID NO: 213926 - DNA, 25 bp, Mus musculus
agtgaccatactgtcttctgtgcaa

SEQ ID NO: 213927 - DNA, 25 bp, Mus musculus
agtgaccatattagggcagttccca

SEQ ID NO: 213928 - DNA, 25 bp, Mus musculus
agtgaccatatttgggcagttccca

SEQ ID NO: 213929 - DNA, 25 bp, Mus musculus
agtgaccatcagagacttgtccctg

SEQ ID NO: 213930 - DNA, 25 bp, Mus musculus
agtgaccatcagtgacttgtccctg

SEQ ID NO: 213931 - DNA, 25 bp, Mus musculus
agtgaccatcctctgtacattaaca

SEQ ID NO: 213932 - DNA, 25 bp, Mus musculus
agtgaccatcctgtgtacattaaca

SEQ ID NO: 213933 - DNA, 25 bp, Mus musculus
agtgaccatcgtaatgacaagctca

SEQ ID NO: 213934 - DNA, 25 bp, Mus musculus
agtgaccatcgttatgacaagctca

SEQ ID NO: 213935 - DNA, 25 bp, Mus musculus
agtgaccatgaactactgtgtgtaa

SEQ ID NO: 213936 - DNA, 25 bp, Mus musculus
agtgaccatgaagtactgtgtgtaa

SEQ ID NO: 213937 - DNA, 25 bp, Mus musculus
agtgaccatgcaaatctactcctac

SEQ ID NO: 213938 - DNA, 25 bp, Mus musculus
agtgaccatgcatatctactcctac

SEQ ID NO: 213939 - DNA, 25 bp, Mus musculus
agtgaccattaccagtcatttttaa

SEQ ID NO: 213940 - DNA, 25 bp, Mus musculus
agtgaccattacgagtcatttttaa

SEQ ID NO: 213941 - DNA, 25 bp, Mus musculus
agtgaccattccagtggctccaact

SEQ ID NO: 213942 - DNA, 25 bp, Mus musculus
agtgaccattcctgtggctccaact

SEQ ID NO: 213943 - DNA, 25 bp, Mus musculus
agtgacccaaggcattcaggcagct

SEQ ID NO: 213944 - DNA, 25 bp, Mus musculus
agtgacccaagggattcaggcagct

SEQ ID NO: 213945 - DNA, 25 bp, Mus musculus
agtgacccaattagccctgtaacat

SEQ ID NO: 213946 - DNA, 25 bp, Mus musculus
agtgacccaatttgccctgtaacat

SEQ ID NO: 213947 - DNA, 25 bp, Mus musculus
agtgacccaccgaccagctttgtac

SEQ ID NO: 213948 - DNA, 25 bp, Mus musculus
agtgacccaccgtccagctttgtac

SEQ ID NO: 213949 - DNA, 25 bp, Mus musculus
agtgacccagacaccacctatgttt

SEQ ID NO: 213950 - DNA, 25 bp, Mus musculus
agtgacccagactccacctatgttt

SEQ ID NO: 213951 - DNA, 25 bp, Mus musculus
agtgacccagagagagcgtcttgtc

SEQ ID NO: 213952 - DNA, 25 bp, Mus musculus
agtgacccagagtgagcgtcttgtc

SEQ ID NO: 213953 - DNA, 25 bp, Mus musculus
agtgacccatttactggcttctcgg

SEQ ID NO: 213954 - DNA, 25 bp, Mus musculus
agtgacccattttctggcttctcgg

SEQ ID NO: 213955 - DNA, 25 bp, Mus musculus
agtgaccccacaccatacctgtaag

SEQ ID NO: 213956 - DNA, 25 bp, Mus musculus
agtgaccccacagcatacctgtaag

SEQ ID NO: 213957 - DNA, 25 bp, Mus musculus
agtgaccccgtgctaatcatggaac

SEQ ID NO: 213958 - DNA, 25 bp, Mus musculus
agtgaccccgtggtaatcatggaac

SEQ ID NO: 213959 - DNA, 25 bp, Mus musculus
agtgacccgagacagtctgagcaat

SEQ ID NO: 213960 - DNA, 25 bp, Mus musculus
agtgacccgagagagtctgagcaat

SEQ ID NO: 213961 - DNA, 25 bp, Mus musculus
agtgacccggataatggtctccctc

SEQ ID NO: 213962 - DNA, 25 bp, Mus musculus
agtgacccggattatggtctccctc

SEQ ID NO: 213963 - DNA, 25 bp, Mus musculus
agtgacccgggaccttgtctagtaa

SEQ ID NO: 213964 - DNA, 25 bp, Mus musculus
agtgacccgggagcttgtctagtaa

SEQ ID NO: 213965 - DNA, 25 bp, Mus musculus
agtgaccctggccaagtgcaaagcc

SEQ ID NO: 213966 - DNA, 25 bp, Mus musculus
agtgaccctggcgaagtgcaaagcc

SEQ ID NO: 213967 - DNA, 25 bp, Mus musculus
agtgaccctgggactcctgatccct

SEQ ID NO: 213968 - DNA, 25 bp, Mus musculus
agtgaccctgggtctcctgatccct

SEQ ID NO: 213969 - DNA, 25 bp, Mus musculus
agtgaccctgtcacatattgggcaa

SEQ ID NO: 213970 - DNA, 25 bp, Mus musculus
agtgaccctgtcataagtctttcag

SEQ ID NO: 213971 - DNA, 25 bp, Mus musculus
agtgaccctgtctcatattgggcaa

SEQ ID NO: 213972 - DNA, 25 bp, Mus musculus
agtgaccctgtcttaagtctttcag

SEQ ID NO: 213973 - DNA, 25 bp, Mus musculus
agtgaccctgtgaaatcctcctttg

SEQ ID NO: 213974 - DNA, 25 bp, Mus musculus
agtgaccctgtgtaatcctcctttg

SEQ ID NO: 213975 - DNA, 25 bp, Mus musculus
agtgacccttagatgacctcctcaa

SEQ ID NO: 213976 - DNA, 25 bp, Mus musculus
agtgacccttagttgacctcctcaa

SEQ ID NO: 213977 - DNA, 25 bp, Mus musculus
agtgacccttgtaccaggctaggag

SEQ ID NO: 213978 - DNA, 25 bp, Mus musculus
agtgacccttgttccaggctaggag

SEQ ID NO: 213979 - DNA, 25 bp, Mus musculus
agtgaccgaaggacaggccagctgt

SEQ ID NO: 213980 - DNA, 25 bp, Mus musculus
agtgaccgaaggtcaggccagctgt

SEQ ID NO: 213981 - DNA, 25 bp, Mus musculus
agtgaccgatttactattcctttgc

SEQ ID NO: 213982 - DNA, 25 bp, Mus musculus
agtgaccgattttctattcctttgc

SEQ ID NO: 213983 - DNA, 25 bp, Mus musculus
agtgaccggcacattcgcatttgga

SEQ ID NO: 213984 - DNA, 25 bp, Mus musculus
agtgaccggcactttcgcatttgga

SEQ ID NO: 213985 - DNA, 25 bp, Mus musculus
agtgaccgtccccagctgttgcgct

SEQ ID NO: 213986 - DNA, 25 bp, Mus musculus
agtgaccgtcccgagctgttgcgct

SEQ ID NO: 213987 - DNA, 25 bp, Mus musculus
agtgaccgtgcacactgtggatgct

SEQ ID NO: 213988 - DNA, 25 bp, Mus musculus
agtgaccgtgcagactgtggatgct

SEQ ID NO: 213989 - DNA, 25 bp, Mus musculus
agtgaccgtggccagtatgatgact

SEQ ID NO: 213990 - DNA, 25 bp, Mus musculus
agtgaccgtggcgagtatgatgact

SEQ ID NO: 213991 - DNA, 25 bp, Mus musculus
agtgacctaattacattttctgatg

SEQ ID NO: 213992 - DNA, 25 bp, Mus musculus
agtgacctaatttcattttctgatg

SEQ ID NO: 213993 - DNA, 25 bp, Mus musculus
agtgacctaccacgaccagcaaaac

SEQ ID NO: 213994 - DNA, 25 bp, Mus musculus
agtgacctaccaggaccagcaaaac

SEQ ID NO: 213995 - DNA, 25 bp, Mus musculus
agtgacctacgacggcgagtgccat

SEQ ID NO: 213996 - DNA, 25 bp, Mus musculus
agtgacctacgagggcgagtgccat

SEQ ID NO: 213997 - DNA, 25 bp, Mus musculus
agtgacctagagactggcagatatc

SEQ ID NO: 213998 - DNA, 25 bp, Mus musculus
agtgacctagagtctggcagatatc

SEQ ID NO: 213999 - DNA, 25 bp, Mus musculus
agtgacctcagacaccagaaggtga

SEQ ID NO: 214000 - DNA, 25 bp, Mus musculus
agtgacctcagagaccagaaggtga

SEQ ID NO: 214001 - DNA, 25 bp, Mus musculus
agtgacctccttacctcagtttgca

SEQ ID NO: 214002 - DNA, 25 bp, Mus musculus
agtgacctcctttcctcagtttgca

SEQ ID NO: 214003 - DNA, 25 bp, Mus musculus
agtgacctctagaatgtcctttcag

SEQ ID NO: 214004 - DNA, 25 bp, Mus musculus
agtgacctctagtatgtcctttcag

SEQ ID NO: 214005 - DNA, 25 bp, Mus musculus
agtgacctctgtcttattgcttcaa

SEQ ID NO: 214006 - DNA, 25 bp, Mus musculus
agtgacctctgtgttattgcttcaa

SEQ ID NO: 214007 - DNA, 25 bp, Mus musculus
agtgacctcttccatgcctatgatt

SEQ ID NO: 214008 - DNA, 25 bp, Mus musculus
agtgacctcttcgatgcctatgatt

SEQ ID NO: 214009 - DNA, 25 bp, Mus musculus
agtgacctgctgactgagaatcctc

SEQ ID NO: 214010 - DNA, 25 bp, Mus musculus
agtgacctgctgtctgagaatcctc

SEQ ID NO: 214011 - DNA, 25 bp, Mus musculus
agtgacctggacaggattcgactca

SEQ ID NO: 214012 - DNA, 25 bp, Mus musculus
agtgacctggactggattcgactca

SEQ ID NO: 214013 - DNA, 25 bp, Mus musculus
agtgacctggagacgccatgggtcc

SEQ ID NO: 214014 - DNA, 25 bp, Mus musculus
agtgacctggagtcgccatgggtcc

SEQ ID NO: 214015 - DNA, 25 bp, Mus musculus
agtgacctggatcagtcgcaaagat

SEQ ID NO: 214016 - DNA, 25 bp, Mus musculus
agtgacctggatgagtcgcaaagat

SEQ ID NO: 214017 - DNA, 25 bp, Mus musculus
agtgacctggtcattgagaatcgcc

SEQ ID NO: 214018 - DNA, 25 bp, Mus musculus
agtgacctggtctttgagaatcgcc

SEQ ID NO: 214019 - DNA, 25 bp, Mus musculus
agtgacctgtgtagccatgaggcgt

SEQ ID NO: 214020 - DNA, 25 bp, Mus musculus
agtgacctgtgttgccatgaggcgt

SEQ ID NO: 214021 - DNA, 25 bp, Mus musculus
agtgaccttagtcctggtagcctga

SEQ ID NO: 214022 - DNA, 25 bp, Mus musculus
agtgaccttagtgctggtagcctga

SEQ ID NO: 214023 - DNA, 25 bp, Mus musculus
agtgaccttatgaggaagggagctc

SEQ ID NO: 214024 - DNA, 25 bp, Mus musculus
agtgaccttatgtggaagggagctc

SEQ ID NO: 214025 - DNA, 25 bp, Mus musculus
agtgaccttcatacagacttgcctc

SEQ ID NO: 214026 - DNA, 25 bp, Mus musculus
agtgaccttcattcagacttgcctc

SEQ ID NO: 214027 - DNA, 25 bp, Mus musculus
agtgaccttgagactgctcgccagt

SEQ ID NO: 214028 - DNA, 25 bp, Mus musculus
agtgaccttgagtctgctcgccagt

SEQ ID NO: 214029 - DNA, 25 bp, Mus musculus
agtgaccttgccctacaggtgtggc

SEQ ID NO: 214030 - DNA, 25 bp, Mus musculus
agtgaccttgccgtacaggtgtggc

SEQ ID NO: 214031 - DNA, 25 bp, Mus musculus
agtgaccttggcaaagtccccaagt

SEQ ID NO: 214032 - DNA, 25 bp, Mus musculus
agtgaccttggctaagtccccaagt

SEQ ID NO: 214033 - DNA, 25 bp, Mus musculus
agtgaccttgtgatcgaaagctgag

SEQ ID NO: 214034 - DNA, 25 bp, Mus musculus
agtgaccttgtgttcgaaagctgag

SEQ ID NO: 214035 - DNA, 25 bp, Mus musculus
agtgacgaagtcagcctctggttac

SEQ ID NO: 214036 - DNA, 25 bp, Mus musculus
agtgacgaagtctgcctctggttac

SEQ ID NO: 214037 - DNA, 25 bp, Mus musculus
agtgacgacacgcagctgcgatact

SEQ ID NO: 214038 - DNA, 25 bp, Mus musculus
agtgacgacacggagctgcgatact

SEQ ID NO: 214039 - DNA, 25 bp, Mus musculus
agtgacgacatccacactgctctca

SEQ ID NO: 214040 - DNA, 25 bp, Mus musculus
agtgacgacatcgacactgctctca

SEQ ID NO: 214041 - DNA, 25 bp, Mus musculus
agtgacgacgcgcaatgcattcaga

SEQ ID NO: 214042 - DNA, 25 bp, Mus musculus
agtgacgacgcggaatgcattcaga

SEQ ID NO: 214043 - DNA, 25 bp, Mus musculus
agtgacgagagcctgcgttcttctg

SEQ ID NO: 214044 - DNA, 25 bp, Mus musculus
agtgacgagagcgtgcgttcttctg

SEQ ID NO: 214045 - DNA, 25 bp, Mus musculus
agtgacgatcgtctcagatgaggct

SEQ ID NO: 214046 - DNA, 25 bp, Mus musculus
agtgacgatcgtgtcagatgaggct

SEQ ID NO: 214047 - DNA, 25 bp, Mus musculus
agtgacgatctaaaggaaaccttgt

SEQ ID NO: 214048 - DNA, 25 bp, Mus musculus
agtgacgatctataggaaaccttgt

SEQ ID NO: 214049 - DNA, 25 bp, Mus musculus
agtgacgattgtcgccacatccgct

SEQ ID NO: 214050 - DNA, 25 bp, Mus musculus
agtgacgattgtggccacatccgct

SEQ ID NO: 214051 - DNA, 25 bp, Mus musculus
agtgacgcagtcaggtaatcccatc

SEQ ID NO: 214052 - DNA, 25 bp, Mus musculus
agtgacgcagtctggtaatcccatc

SEQ ID NO: 214053 - DNA, 25 bp, Mus musculus
agtgacgcatacatgggctgtgacc

SEQ ID NO: 214054 - DNA, 25 bp, Mus musculus
agtgacgcatacttgggctgtgacc

SEQ ID NO: 214055 - DNA, 25 bp, Mus musculus
agtgacgccactaccatccaatgag

SEQ ID NO: 214056 - DNA, 25 bp, Mus musculus
agtgacgccacttccatccaatgag

SEQ ID NO: 214057 - DNA, 25 bp, Mus musculus
agtgacgctgttcccgtgacctttg

SEQ ID NO: 214058 - DNA, 25 bp, Mus musculus
agtgacgctgttgccgtgacctttg

SEQ ID NO: 214059 - DNA, 25 bp, Mus musculus
agtgacggactgatacctggaagta

SEQ ID NO: 214060 - DNA, 25 bp, Mus musculus
agtgacggactgttacctggaagta

SEQ ID NO: 214061 - DNA, 25 bp, Mus musculus
agtgacggtgccatcggccattact

SEQ ID NO: 214062 - DNA, 25 bp, Mus musculus
agtgacggtgccttcggccattact

SEQ ID NO: 214063 - DNA, 25 bp, Mus musculus
agtgacggtgctcatgcgagccctc

SEQ ID NO: 214064 - DNA, 25 bp, Mus musculus
agtgacggtgctgatgcgagccctc

SEQ ID NO: 214065 - DNA, 25 bp, Mus musculus
agtgacggttgaactatgtttctcc

SEQ ID NO: 214066 - DNA, 25 bp, Mus musculus
agtgacggttgatctatgtttctcc

SEQ ID NO: 214067 - DNA, 25 bp, Mus musculus
agtgacgtacgtacagtggactatc

SEQ ID NO: 214068 - DNA, 25 bp, Mus musculus
agtgacgtacgttcagtggactatc

SEQ ID NO: 214069 - DNA, 25 bp, Mus musculus
agtgacgtagatacttgtagccaga

SEQ ID NO: 214070 - DNA, 25 bp, Mus musculus
agtgacgtagattcttgtagccaga

SEQ ID NO: 214071 - DNA, 25 bp, Mus musculus
agtgacgtcagacgtggacgcaccc

SEQ ID NO: 214072 - DNA, 25 bp, Mus musculus
agtgacgtcagaggtggacgcaccc

SEQ ID NO: 214073 - DNA, 25 bp, Mus musculus
agtgacgtcctgagcaaggctggcc

SEQ ID NO: 214074 - DNA, 25 bp, Mus musculus
agtgacgtcctgtgcaaggctggcc

SEQ ID NO: 214075 - DNA, 25 bp, Mus musculus
agtgacgtctccatcgacttccgag

SEQ ID NO: 214076 - DNA, 25 bp, Mus musculus
agtgacgtctccttcgacttccgag

SEQ ID NO: 214077 - DNA, 25 bp, Mus musculus
agtgacgtctgaatagcgatccctt

SEQ ID NO: 214078 - DNA, 25 bp, Mus musculus
agtgacgtctgattagcgatccctt

SEQ ID NO: 214079 - DNA, 25 bp, Mus musculus
agtgacgtctttcccttctttctgc

SEQ ID NO: 214080 - DNA, 25 bp, Mus musculus
agtgacgtctttgccttctttctgc

SEQ ID NO: 214081 - DNA, 25 bp, Mus musculus
agtgacgtgctgacagccatggaag

SEQ ID NO: 214082 - DNA, 25 bp, Mus musculus
agtgacgtgctgtcagccatggaag

SEQ ID NO: 214083 - DNA, 25 bp, Mus musculus
agtgacgtgggtacaaactccaggt

SEQ ID NO: 214084 - DNA, 25 bp, Mus musculus
agtgacgtgggttcaaactccaggt

SEQ ID NO: 214085 - DNA, 25 bp, Mus musculus
agtgacgtgttcagggctcctcgga

SEQ ID NO: 214086 - DNA, 25 bp, Mus musculus
agtgacgtgttctgggctcctcgga

SEQ ID NO: 214087 - DNA, 25 bp, Mus musculus
agtgactaaagcctaccaggaccgc

SEQ ID NO: 214088 - DNA, 25 bp, Mus musculus
agtgactaaagcgtaccaggaccgc

SEQ ID NO: 214089 - DNA, 25 bp, Mus musculus
agtgactaacacagcttaccaccaa

SEQ ID NO: 214090 - DNA, 25 bp, Mus musculus
agtgactaacactgcttaccaccaa

SEQ ID NO: 214091 - DNA, 25 bp, Mus musculus
agtgactaacatactctggtggaga

SEQ ID NO: 214092 - DNA, 25 bp, Mus musculus
agtgactaacattctctggtggaga

SEQ ID NO: 214093 - DNA, 25 bp, Mus musculus
agtgactaatcaactgtctgttatg

SEQ ID NO: 214094 - DNA, 25 bp, Mus musculus
agtgactaatcatctgtctgttatg

SEQ ID NO: 214095 - DNA, 25 bp, Mus musculus
agtgactaattccatttggcccttc

SEQ ID NO: 214096 - DNA, 25 bp, Mus musculus
agtgactaattcgatttggcccttc

SEQ ID NO: 214097 - DNA, 25 bp, Mus musculus
agtgactacatgctgtccaacgccc

SEQ ID NO: 214098 - DNA, 25 bp, Mus musculus
agtgactacatggtgtccaacgccc

SEQ ID NO: 214099 - DNA, 25 bp, Mus musculus
agtgactaccaacattccccaaatc

SEQ ID NO: 214100 - DNA, 25 bp, Mus musculus
agtgactaccaagattccccaaatc

SEQ ID NO: 214101 - DNA, 25 bp, Mus musculus
agtgactaccacctcagcagctgta

SEQ ID NO: 214102 - DNA, 25 bp, Mus musculus
agtgactaccacgtcagcagctgta

SEQ ID NO: 214103 - DNA, 25 bp, Mus musculus
agtgactacctcatgctccttcttt

SEQ ID NO: 214104 - DNA, 25 bp, Mus musculus
agtgactacctcttgctccttcttt

SEQ ID NO: 214105 - DNA, 25 bp, Mus musculus
agtgactactccaccaggaagtggg

SEQ ID NO: 214106 - DNA, 25 bp, Mus musculus
agtgactactcctccaggaagtggg

SEQ ID NO: 214107 - DNA, 25 bp, Mus musculus
agtgactactgaccctctggtgcca

SEQ ID NO: 214108 - DNA, 25 bp, Mus musculus
agtgactactgagcctctggtgcca

SEQ ID NO: 214109 - DNA, 25 bp, Mus musculus
agtgactacttacactgctctggga

SEQ ID NO: 214110 - DNA, 25 bp, Mus musculus
agtgactacttagactgctctggga

SEQ ID NO: 214111 - DNA, 25 bp, Mus musculus
agtgactagactcatgtcccagaat

SEQ ID NO: 214112 - DNA, 25 bp, Mus musculus
agtgactagactgatgtcccagaat

SEQ ID NO: 214113 - DNA, 25 bp, Mus musculus
agtgactagtacatggattccagga

SEQ ID NO: 214114 - DNA, 25 bp, Mus musculus
agtgactagtacttggattccagga

SEQ ID NO: 214115 - DNA, 25 bp, Mus musculus
agtgactattggctgttcagtcctc

SEQ ID NO: 214116 - DNA, 25 bp, Mus musculus
agtgactattgggtgttcagtcctc

SEQ ID NO: 214117 - DNA, 25 bp, Mus musculus
agtgactattttctgtgatttcctt

SEQ ID NO: 214118 - DNA, 25 bp, Mus musculus
agtgactattttgtgtgatttcctt

SEQ ID NO: 214119 - DNA, 25 bp, Mus musculus
agtgactcaagtactatacccagga

SEQ ID NO: 214120 - DNA, 25 bp, Mus musculus
agtgactcaagtctggccattctgt

SEQ ID NO: 214121 - DNA, 25 bp, Mus musculus
agtgactcaagtgtggccattctgt

SEQ ID NO: 214122 - DNA, 25 bp, Mus musculus
agtgactcaagttctatacccagga

SEQ ID NO: 214123 - DNA, 25 bp, Mus musculus
agtgactcacaacctctctctcggg

SEQ ID NO: 214124 - DNA, 25 bp, Mus musculus
agtgactcacaagctctctctcggg

SEQ ID NO: 214125 - DNA, 25 bp, Mus musculus
agtgactcacgtcgctcttcagtta

SEQ ID NO: 214126 - DNA, 25 bp, Mus musculus
agtgactcacgtggctcttcagtta

SEQ ID NO: 214127 - DNA, 25 bp, Mus musculus
agtgactcagaacggatctcatcca

SEQ ID NO: 214128 - DNA, 25 bp, Mus musculus
agtgactcagaagggatctcatcca

SEQ ID NO: 214129 - DNA, 25 bp, Mus musculus
agtgactcagagattgtgtccccag

SEQ ID NO: 214130 - DNA, 25 bp, Mus musculus
agtgactcagagtttgtgtccccag

SEQ ID NO: 214131 - DNA, 25 bp, Mus musculus
agtgactcagggaaaagcttctcct

SEQ ID NO: 214132 - DNA, 25 bp, Mus musculus
agtgactcagggtaaagcttctcct

SEQ ID NO: 214133 - DNA, 25 bp, Mus musculus
agtgactcatggcacactggccatt

SEQ ID NO: 214134 - DNA, 25 bp, Mus musculus
agtgactcatgggacactggccatt

SEQ ID NO: 214135 - DNA, 25 bp, Mus musculus
agtgactccagaatcaatcaaagta

SEQ ID NO: 214136 - DNA, 25 bp, Mus musculus
agtgactccagattcaatcaaagta

SEQ ID NO: 214137 - DNA, 25 bp, Mus musculus
agtgactccataagggacttcctcc

SEQ ID NO: 214138 - DNA, 25 bp, Mus musculus
agtgactccatatgggacttcctcc

SEQ ID NO: 214139 - DNA, 25 bp, Mus musculus
agtgactcccacctgtacatacatt

SEQ ID NO: 214140 - DNA, 25 bp, Mus musculus
agtgactcccacgtgtacatacatt

SEQ ID NO: 214141 - DNA, 25 bp, Mus musculus
agtgactccctgcacctggacgggt

SEQ ID NO: 214142 - DNA, 25 bp, Mus musculus
agtgactccctggacctggacgggt

SEQ ID NO: 214143 - DNA, 25 bp, Mus musculus
agtgactcctgtagctccgaggtga

SEQ ID NO: 214144 - DNA, 25 bp, Mus musculus
agtgactcctgttgctccgaggtga

SEQ ID NO: 214145 - DNA, 25 bp, Mus musculus
agtgactcggacaatctttgccatt

SEQ ID NO: 214146 - DNA, 25 bp, Mus musculus
agtgactcggactatctttgccatt

SEQ ID NO: 214147 - DNA, 25 bp, Mus musculus
agtgactctatcatgcatcaggcct

SEQ ID NO: 214148 - DNA, 25 bp, Mus musculus
agtgactctatcttgcatcaggcct

SEQ ID NO: 214149 - DNA, 25 bp, Mus musculus
agtgactctcacagatgttactttt

SEQ ID NO: 214150 - DNA, 25 bp, Mus musculus
agtgactctcactgatgttactttt

SEQ ID NO: 214151 - DNA, 25 bp, Mus musculus
agtgactctcatcaataaggactgc

SEQ ID NO: 214152 - DNA, 25 bp, Mus musculus
agtgactctcatgaataaggactgc

SEQ ID NO: 214153 - DNA, 25 bp, Mus musculus
agtgactctctcatcacaagcagat

SEQ ID NO: 214154 - DNA, 25 bp, Mus musculus
agtgactctctcttcacaagcagat

SEQ ID NO: 214155 - DNA, 25 bp, Mus musculus
agtgactctgaccacttttgttctc

SEQ ID NO: 214156 - DNA, 25 bp, Mus musculus
agtgactctgacgacttttgttctc

SEQ ID NO: 214157 - DNA, 25 bp, Mus musculus
agtgactctgatactcttgtgatct

SEQ ID NO: 214158 - DNA, 25 bp, Mus musculus
agtgactctgattctcttgtgatct

SEQ ID NO: 214159 - DNA, 25 bp, Mus musculus
agtgactcttgactactttggtcgg

SEQ ID NO: 214160 - DNA, 25 bp, Mus musculus
agtgactcttgagtactttggtcgg

SEQ ID NO: 214161 - DNA, 25 bp, Mus musculus
agtgactctttcaaggtccctactg

SEQ ID NO: 214162 - DNA, 25 bp, Mus musculus
agtgactctttctaggtccctactg

SEQ ID NO: 214163 - DNA, 25 bp, Mus musculus
agtgactgaaaactagctactggca

SEQ ID NO: 214164 - DNA, 25 bp, Mus musculus
agtgactgaaaagtagctactggca

SEQ ID NO: 214165 - DNA, 25 bp, Mus musculus
agtgactgacctcctgactccttag

SEQ ID NO: 214166 - DNA, 25 bp, Mus musculus
agtgactgacctgctgactccttag

SEQ ID NO: 214167 - DNA, 25 bp, Mus musculus
agtgactgactcctgtgtcggaata

SEQ ID NO: 214168 - DNA, 25 bp, Mus musculus
agtgactgactcgtgtgtcggaata

SEQ ID NO: 214169 - DNA, 25 bp, Mus musculus
agtgactgacttcgcaaagctgttt

SEQ ID NO: 214170 - DNA, 25 bp, Mus musculus
agtgactgacttggcaaagctgttt

SEQ ID NO: 214171 - DNA, 25 bp, Mus musculus
agtgactgaggacgaccccagtgtc

SEQ ID NO: 214172 - DNA, 25 bp, Mus musculus
agtgactgaggaggaccccagtgtc

SEQ ID NO: 214173 - DNA, 25 bp, Mus musculus
agtgactgaggccacgtcttacctc

SEQ ID NO: 214174 - DNA, 25 bp, Mus musculus
agtgactgaggcgacgtcttacctc

SEQ ID NO: 214175 - DNA, 25 bp, Mus musculus
agtgactgatacactcagagcccgg

SEQ ID NO: 214176 - DNA, 25 bp, Mus musculus
agtgactgatactctcagagcccgg

SEQ ID NO: 214177 - DNA, 25 bp, Mus musculus
agtgactgattcctgtggctgctaa

SEQ ID NO: 214178 - DNA, 25 bp, Mus musculus
agtgactgattcgtgtggctgctaa

SEQ ID NO: 214179 - DNA, 25 bp, Mus musculus
agtgactgcacacttgtatttaagt

SEQ ID NO: 214180 - DNA, 25 bp, Mus musculus
agtgactgcacagttgtatttaagt

SEQ ID NO: 214181 - DNA, 25 bp, Mus musculus
agtgactgcactcactctcccaggg

SEQ ID NO: 214182 - DNA, 25 bp, Mus musculus
agtgactgcactgactctcccaggg

SEQ ID NO: 214183 - DNA, 25 bp, Mus musculus
agtgactgccacaagttctgacttg

SEQ ID NO: 214184 - DNA, 25 bp, Mus musculus
agtgactgccactagttctgacttg

SEQ ID NO: 214185 - DNA, 25 bp, Mus musculus
agtgactgccttagcactatttcac

SEQ ID NO: 214186 - DNA, 25 bp, Mus musculus
agtgactgcctttgcactatttcac

SEQ ID NO: 214187 - DNA, 25 bp, Mus musculus
agtgactgctctatctcacttcatt

SEQ ID NO: 214188 - DNA, 25 bp, Mus musculus
agtgactgctctttctcacttcatt

SEQ ID NO: 214189 - DNA, 25 bp, Mus musculus
agtgactggacaacccttgcatcag

SEQ ID NO: 214190 - DNA, 25 bp, Mus musculus
agtgactggacatcccttgcatcag

SEQ ID NO: 214191 - DNA, 25 bp, Mus musculus
agtgactggagaaaacattcaactt

SEQ ID NO: 214192 - DNA, 25 bp, Mus musculus
agtgactggagataacattcaactt

SEQ ID NO: 214193 - DNA, 25 bp, Mus musculus
agtgactggcacatcccatgtccct

SEQ ID NO: 214194 - DNA, 25 bp, Mus musculus
agtgactggcacttcccatgtccct

SEQ ID NO: 214195 - DNA, 25 bp, Mus musculus
agtgactggccaagtgttcatccta

SEQ ID NO: 214196 - DNA, 25 bp, Mus musculus
agtgactggccatgtgttcatccta

SEQ ID NO: 214197 - DNA, 25 bp, Mus musculus
agtgactggctccagtggaccccag

SEQ ID NO: 214198 - DNA, 25 bp, Mus musculus
agtgactggctcgagtggaccccag

SEQ ID NO: 214199 - DNA, 25 bp, Mus musculus
agtgactggttccagagccttgccc

SEQ ID NO: 214200 - DNA, 25 bp, Mus musculus
agtgactggttcgagagccttgccc

SEQ ID NO: 214201 - DNA, 25 bp, Mus musculus
agtgacttaaaaccatcattgcctg

SEQ ID NO: 214202 - DNA, 25 bp, Mus musculus
agtgacttaaaagcatcattgcctg

SEQ ID NO: 214203 - DNA, 25 bp, Mus musculus
agtgacttagccctgtcttgtgccc

SEQ ID NO: 214204 - DNA, 25 bp, Mus musculus
agtgacttagccgtgtcttgtgccc

SEQ ID NO: 214205 - DNA, 25 bp, Mus musculus
agtgacttatctattcacccaaaga

SEQ ID NO: 214206 - DNA, 25 bp, Mus musculus
agtgacttatcttttcacccaaaga

SEQ ID NO: 214207 - DNA, 25 bp, Mus musculus
agtgacttctaaatggcggaaacca

SEQ ID NO: 214208 - DNA, 25 bp, Mus musculus
agtgacttctaattggcggaaacca

SEQ ID NO: 214209 - DNA, 25 bp, Mus musculus
agtgacttctccaggtggtctcggc

SEQ ID NO: 214210 - DNA, 25 bp, Mus musculus
agtgacttctcctggtggtctcggc

SEQ ID NO: 214211 - DNA, 25 bp, Mus musculus
agtgacttctctccattctcacagc

SEQ ID NO: 214212 - DNA, 25 bp, Mus musculus
agtgacttctctgcattctcacagc

SEQ ID NO: 214213 - DNA, 25 bp, Mus musculus
agtgacttctgacggctgttcttca

SEQ ID NO: 214214 - DNA, 25 bp, Mus musculus
agtgacttctgagggctgttcttca

SEQ ID NO: 214215 - DNA, 25 bp, Mus musculus
agtgacttctggcatccttttgcaa

SEQ ID NO: 214216 - DNA, 25 bp, Mus musculus
agtgacttctgggatccttttgcaa

SEQ ID NO: 214217 - DNA, 25 bp, Mus musculus
agtgacttcttcctatggacacaag

SEQ ID NO: 214218 - DNA, 25 bp, Mus musculus
agtgacttcttcgtatggacacaag

SEQ ID NO: 214219 - DNA, 25 bp, Mus musculus
agtgacttctttccatctatctaac

SEQ ID NO: 214220 - DNA, 25 bp, Mus musculus
agtgacttctttgcatctatctaac

SEQ ID NO: 214221 - DNA, 25 bp, Mus musculus
agtgacttgactccagaagaattca

SEQ ID NO: 214222 - DNA, 25 bp, Mus musculus
agtgacttgactgcagaagaattca

SEQ ID NO: 214223 - DNA, 25 bp, Mus musculus
agtgacttgggtactgattattgac

SEQ ID NO: 214224 - DNA, 25 bp, Mus musculus
agtgacttgggttctgattattgac

SEQ ID NO: 214225 - DNA, 25 bp, Mus musculus
agtgacttgtaacgcctgaaccctg

SEQ ID NO: 214226 - DNA, 25 bp, Mus musculus
agtgacttgtaaggcctgaaccctg

SEQ ID NO: 214227 - DNA, 25 bp, Mus musculus
agtgacttgtctaaacttccatgac

SEQ ID NO: 214228 - DNA, 25 bp, Mus musculus
agtgacttgtcttaacttccatgac

SEQ ID NO: 214229 - DNA, 25 bp, Mus musculus
agtgacttgtgaacgcatgcttcct

SEQ ID NO: 214230 - DNA, 25 bp, Mus musculus
agtgacttgtgatcgcatgcttcct

SEQ ID NO: 214231 - DNA, 25 bp, Mus musculus
agtgacttgtttctggcctctccag

SEQ ID NO: 214232 - DNA, 25 bp, Mus musculus
agtgacttgtttgtggcctctccag

SEQ ID NO: 214233 - DNA, 25 bp, Mus musculus
agtgactttcacatgagaactcaga

SEQ ID NO: 214234 - DNA, 25 bp, Mus musculus
agtgactttcacttgagaactcaga

SEQ ID NO: 214235 - DNA, 25 bp, Mus musculus
agtgactttcatcccagttgcaaag

SEQ ID NO: 214236 - DNA, 25 bp, Mus musculus
agtgactttcatgccagttgcaaag

SEQ ID NO: 214237 - DNA, 25 bp, Mus musculus
agtgactttgaacctatcctaggat

SEQ ID NO: 214238 - DNA, 25 bp, Mus musculus
agtgactttgaagctatcctaggat

SEQ ID NO: 214239 - DNA, 25 bp, Mus musculus
agtgactttgagattcagctattaa

SEQ ID NO: 214240 - DNA, 25 bp, Mus musculus
agtgactttgagtttcagctattaa

SEQ ID NO: 214241 - DNA, 25 bp, Mus musculus
agtgactttgcaaatcctgaggaat

SEQ ID NO: 214242 - DNA, 25 bp, Mus musculus
agtgactttgcatatcctgaggaat

SEQ ID NO: 214243 - DNA, 25 bp, Mus musculus
agtgacttttaacctactccaaata

SEQ ID NO: 214244 - DNA, 25 bp, Mus musculus
agtgacttttaagctactccaaata

SEQ ID NO: 214245 - DNA, 25 bp, Mus musculus
agtgacttttagcacacacccttaa

SEQ ID NO: 214246 - DNA, 25 bp, Mus musculus
agtgacttttaggacacacccttaa

SEQ ID NO: 214247 - DNA, 25 bp, Mus musculus
agtgacttttgtaccctagcagcct

SEQ ID NO: 214248 - DNA, 25 bp, Mus musculus
agtgacttttgttccctagcagcct

SEQ ID NO: 214249 - DNA, 25 bp, Mus musculus
agtgagaacccaagagaaccccgtg

SEQ ID NO: 214250 - DNA, 25 bp, Mus musculus
agtgagaacccatgagaaccccgtg

SEQ ID NO: 214251 - DNA, 25 bp, Mus musculus
agtgagaactgacgtccgttccttt

SEQ ID NO: 214252 - DNA, 25 bp, Mus musculus
agtgagaactgaggtccgttccttt

SEQ ID NO: 214253 - DNA, 25 bp, Mus musculus
agtgagaagagtctctcccctcgct

SEQ ID NO: 214254 - DNA, 25 bp, Mus musculus
agtgagaagagtgtctcccctcgct

SEQ ID NO: 214255 - DNA, 25 bp, Mus musculus
agtgagaagcaaccctcctattcct

SEQ ID NO: 214256 - DNA, 25 bp, Mus musculus
agtgagaagcaagcctcctattcct

SEQ ID NO: 214257 - DNA, 25 bp, Mus musculus
agtgagaagctgagcctgccactgc

SEQ ID NO: 214258 - DNA, 25 bp, Mus musculus
agtgagaagctgtgcctgccactgc

SEQ ID NO: 214259 - DNA, 25 bp, Mus musculus
agtgagaagtcccagtaatgcgatt

SEQ ID NO: 214260 - DNA, 25 bp, Mus musculus
agtgagaagtccgagtaatgcgatt

SEQ ID NO: 214261 - DNA, 25 bp, Mus musculus
agtgagaatggccttctcctggtcc

SEQ ID NO: 214262 - DNA, 25 bp, Mus musculus
agtgagaatggcgttctcctggtcc

SEQ ID NO: 214263 - DNA, 25 bp, Mus musculus
agtgagaccaacacgacacagacca

SEQ ID NO: 214264 - DNA, 25 bp, Mus musculus
agtgagaccaactcgacacagacca

SEQ ID NO: 214265 - DNA, 25 bp, Mus musculus
agtgagaccccaaccaagaagcaag

SEQ ID NO: 214266 - DNA, 25 bp, Mus musculus
agtgagaccccatccaagaagcaag

SEQ ID NO: 214267 - DNA, 25 bp, Mus musculus
agtgagacctctccagcttttaggc

SEQ ID NO: 214268 - DNA, 25 bp, Mus musculus
agtgagacctctgcagcttttaggc

SEQ ID NO: 214269 - DNA, 25 bp, Mus musculus
agtgagacggctcgccgctacatca

SEQ ID NO: 214270 - DNA, 25 bp, Mus musculus
agtgagacggctggccgctacatca

SEQ ID NO: 214271 - DNA, 25 bp, Mus musculus
agtgagactacaattctgctcctgt

SEQ ID NO: 214272 - DNA, 25 bp, Mus musculus
agtgagactacatttctgctcctgt

SEQ ID NO: 214273 - DNA, 25 bp, Mus musculus
agtgagactagaatcacctccccat

SEQ ID NO: 214274 - DNA, 25 bp, Mus musculus
agtgagactagattcacctccccat

SEQ ID NO: 214275 - DNA, 25 bp, Mus musculus
agtgagactcaaccacccaagtgtc

SEQ ID NO: 214276 - DNA, 25 bp, Mus musculus
agtgagactcaagcacccaagtgtc

SEQ ID NO: 214277 - DNA, 25 bp, Mus musculus
agtgagactcctccattgtggtgca

SEQ ID NO: 214278 - DNA, 25 bp, Mus musculus
agtgagactcctgcattgtggtgca

SEQ ID NO: 214279 - DNA, 25 bp, Mus musculus
agtgagactctcattattttcgccc

SEQ ID NO: 214280 - DNA, 25 bp, Mus musculus
agtgagactctctttattttcgccc

SEQ ID NO: 214281 - DNA, 25 bp, Mus musculus
agtgagactgctcggctcgccctaa

SEQ ID NO: 214282 - DNA, 25 bp, Mus musculus
agtgagactgctgggctcgccctaa

SEQ ID NO: 214283 - DNA, 25 bp, Mus musculus
agtgagacttggagcacttcctgca

SEQ ID NO: 214284 - DNA, 25 bp, Mus musculus
agtgagacttggtgcacttcctgca

SEQ ID NO: 214285 - DNA, 25 bp, Mus musculus
agtgagagagtacccatgcacccag

SEQ ID NO: 214286 - DNA, 25 bp, Mus musculus
agtgagagagtagccatgcacccag

SEQ ID NO: 214287 - DNA, 25 bp, Mus musculus
agtgagagcacacatgggccatgta

SEQ ID NO: 214288 - DNA, 25 bp, Mus musculus
agtgagagcacagatgggccatgta

SEQ ID NO: 214289 - DNA, 25 bp, Mus musculus
agtgagagcgctaactcgggccctg

SEQ ID NO: 214290 - DNA, 25 bp, Mus musculus
agtgagagcgcttactcgggccctg

SEQ ID NO: 214291 - DNA, 25 bp, Mus musculus
agtgagagctgcacacacgagcctc

SEQ ID NO: 214292 - DNA, 25 bp, Mus musculus
agtgagagctgctcacacgagcctc

SEQ ID NO: 214293 - DNA, 25 bp, Mus musculus
agtgagaggctcagactcagtcagt

SEQ ID NO: 214294 - DNA, 25 bp, Mus musculus
agtgagaggctctgactcagtcagt

SEQ ID NO: 214295 - DNA, 25 bp, Mus musculus
agtgagaggtgactcagacactcct

SEQ ID NO: 214296 - DNA, 25 bp, Mus musculus
agtgagaggtgagtcagacactcct

SEQ ID NO: 214297 - DNA, 25 bp, Mus musculus
agtgagatcaacatgcagctgagcc

SEQ ID NO: 214298 - DNA, 25 bp, Mus musculus
agtgagatcaacttgcagctgagcc

SEQ ID NO: 214299 - DNA, 25 bp, Mus musculus
agtgagatcaatctagaccccacca

SEQ ID NO: 214300 - DNA, 25 bp, Mus musculus
agtgagatcaatgtagaccccacca

SEQ ID NO: 214301 - DNA, 25 bp, Mus musculus
agtgagatccatctgaacctccaaa

SEQ ID NO: 214302 - DNA, 25 bp, Mus musculus
agtgagatccatgtgaacctccaaa

SEQ ID NO: 214303 - DNA, 25 bp, Mus musculus
agtgagatccctattgcttgtgctt

SEQ ID NO: 214304 - DNA, 25 bp, Mus musculus
agtgagatcccttttgcttgtgctt

SEQ ID NO: 214305 - DNA, 25 bp, Mus musculus
agtgagatcctcaggcatcgatgcc

SEQ ID NO: 214306 - DNA, 25 bp, Mus musculus
agtgagatcctctggcatcgatgcc

SEQ ID NO: 214307 - DNA, 25 bp, Mus musculus
agtgagatcctgatgctgtctcaaa

SEQ ID NO: 214308 - DNA, 25 bp, Mus musculus
agtgagatcctgttgctgtctcaaa

SEQ ID NO: 214309 - DNA, 25 bp, Mus musculus
agtgagatgcttcggttcctaggaa

SEQ ID NO: 214310 - DNA, 25 bp, Mus musculus
agtgagatgcttgggttcctaggaa

SEQ ID NO: 214311 - DNA, 25 bp, Mus musculus
agtgagatggtcacctttcctctga

SEQ ID NO: 214312 - DNA, 25 bp, Mus musculus
agtgagatggtctcctttcctctga

SEQ ID NO: 214313 - DNA, 25 bp, Mus musculus
agtgagatgtggactcccacatcaa

SEQ ID NO: 214314 - DNA, 25 bp, Mus musculus
agtgagatgtggtctcccacatcaa

SEQ ID NO: 214315 - DNA, 25 bp, Mus musculus
agtgagatgtgtctaaatcctgtac

SEQ ID NO: 214316 - DNA, 25 bp, Mus musculus
agtgagatgtgtgtaaatcctgtac

SEQ ID NO: 214317 - DNA, 25 bp, Mus musculus
agtgagattctgacatctcctcttc

SEQ ID NO: 214318 - DNA, 25 bp, Mus musculus
agtgagattctgtcatctcctcttc

SEQ ID NO: 214319 - DNA, 25 bp, Mus musculus
agtgagattgtcctccaagcaacaa

SEQ ID NO: 214320 - DNA, 25 bp, Mus musculus
agtgagattgtcgtccaagcaacaa

SEQ ID NO: 214321 - DNA, 25 bp, Mus musculus
agtgagatttttctcctcattcccc

SEQ ID NO: 214322 - DNA, 25 bp, Mus musculus
agtgagatttttgtcctcattcccc

SEQ ID NO: 214323 - DNA, 25 bp, Mus musculus
agtgagcaacctaggctacttgcag

SEQ ID NO: 214324 - DNA, 25 bp, Mus musculus
agtgagcaaccttggctacttgcag

SEQ ID NO: 214325 - DNA, 25 bp, Mus musculus
agtgagcaactgagtgatcccttca

SEQ ID NO: 214326 - DNA, 25 bp, Mus musculus
agtgagcaactgtgtgatcccttca

SEQ ID NO: 214327 - DNA, 25 bp, Mus musculus
agtgagcaagagatctctcagcccc

SEQ ID NO: 214328 - DNA, 25 bp, Mus musculus
agtgagcaagagttctctcagcccc

SEQ ID NO: 214329 - DNA, 25 bp, Mus musculus
agtgagcaagtgacttcgattgaaa

SEQ ID NO: 214330 - DNA, 25 bp, Mus musculus
agtgagcaagtgtcttcgattgaaa

SEQ ID NO: 214331 - DNA, 25 bp, Mus musculus
agtgagcacctgcagccttaccttg

SEQ ID NO: 214332 - DNA, 25 bp, Mus musculus
agtgagcacctggagccttaccttg

SEQ ID NO: 214333 - DNA, 25 bp, Mus musculus
agtgagcactctcagattctcccaa

SEQ ID NO: 214334 - DNA, 25 bp, Mus musculus
agtgagcactctgagattctcccaa

SEQ ID NO: 214335 - DNA, 25 bp, Mus musculus
agtgagcagaacagccacttcctgt

SEQ ID NO: 214336 - DNA, 25 bp, Mus musculus
agtgagcagaactgccacttcctgt

SEQ ID NO: 214337 - DNA, 25 bp, Mus musculus
agtgagcagagtcccatccttatgg

SEQ ID NO: 214338 - DNA, 25 bp, Mus musculus
agtgagcagagtgccatccttatgg

SEQ ID NO: 214339 - DNA, 25 bp, Mus musculus
agtgagcagctcaagcatttacaga

SEQ ID NO: 214340 - DNA, 25 bp, Mus musculus
agtgagcagctctagcatttacaga

SEQ ID NO: 214341 - DNA, 25 bp, Mus musculus
agtgagcagtttaaccgattcccca

SEQ ID NO: 214342 - DNA, 25 bp, Mus musculus
agtgagcagttttaccgattcccca

SEQ ID NO: 214343 - DNA, 25 bp, Mus musculus
agtgagcataatctgtccgtctgtc

SEQ ID NO: 214344 - DNA, 25 bp, Mus musculus
agtgagcataatgtgtccgtctgtc

SEQ ID NO: 214345 - DNA, 25 bp, Mus musculus
agtgagcatgctcaacgtgttcctc

SEQ ID NO: 214346 - DNA, 25 bp, Mus musculus
agtgagcatgctgaacgtgttcctc

SEQ ID NO: 214347 - DNA, 25 bp, Mus musculus
agtgagcattagatcctggtacaga

SEQ ID NO: 214348 - DNA, 25 bp, Mus musculus
agtgagcattagttcctggtacaga

SEQ ID NO: 214349 - DNA, 25 bp, Mus musculus
agtgagccacacacagctcgaaggc

SEQ ID NO: 214350 - DNA, 25 bp, Mus musculus
agtgagccacactcagctcgaaggc

SEQ ID NO: 214351 - DNA, 25 bp, Mus musculus
agtgagccacagatcagcagctcct

SEQ ID NO: 214352 - DNA, 25 bp, Mus musculus
agtgagccacagttcagcagctcct

SEQ ID NO: 214353 - DNA, 25 bp, Mus musculus
agtgagccagctagcatttgaacag

SEQ ID NO: 214354 - DNA, 25 bp, Mus musculus
agtgagccagctcagtctactcatc

SEQ ID NO: 214355 - DNA, 25 bp, Mus musculus
agtgagccagctgagtctactcatc

SEQ ID NO: 214356 - DNA, 25 bp, Mus musculus
agtgagccagcttgcatttgaacag

SEQ ID NO: 214357 - DNA, 25 bp, Mus musculus
agtgagccatcgataccacaacaca

SEQ ID NO: 214358 - DNA, 25 bp, Mus musculus
agtgagccatcgttaccacaacaca

SEQ ID NO: 214359 - DNA, 25 bp, Mus musculus
agtgagcccatcatgtgtttataaa

SEQ ID NO: 214360 - DNA, 25 bp, Mus musculus
agtgagcccatcttgtgtttataaa

SEQ ID NO: 214361 - DNA, 25 bp, Mus musculus
agtgagccccatcgagtatcttgct

SEQ ID NO: 214362 - DNA, 25 bp, Mus musculus
agtgagccccatggagtatcttgct

SEQ ID NO: 214363 - DNA, 25 bp, Mus musculus
agtgagcccgacagggtggtccaca

SEQ ID NO: 214364 - DNA, 25 bp, Mus musculus
agtgagcccgactgggtggtccaca

SEQ ID NO: 214365 - DNA, 25 bp, Mus musculus
agtgagccctgcacagcaaggtaat

SEQ ID NO: 214366 - DNA, 25 bp, Mus musculus
agtgagccctgctcagcaaggtaat

SEQ ID NO: 214367 - DNA, 25 bp, Mus musculus
agtgagcccttcacaatctccctag

SEQ ID NO: 214368 - DNA, 25 bp, Mus musculus
agtgagcccttctcaatctccctag

SEQ ID NO: 214369 - DNA, 25 bp, Mus musculus
agtgagcctatcaatttccctgtgt

SEQ ID NO: 214370 - DNA, 25 bp, Mus musculus
agtgagcctatctatttccctgtgt

SEQ ID NO: 214371 - DNA, 25 bp, Mus musculus
agtgagcctctgctctttggaagtc

SEQ ID NO: 214372 - DNA, 25 bp, Mus musculus
agtgagcctctggtctttggaagtc

SEQ ID NO: 214373 - DNA, 25 bp, Mus musculus
agtgagcctgtgacactactcatca

SEQ ID NO: 214374 - DNA, 25 bp, Mus musculus
agtgagcctgtgtcactactcatca

SEQ ID NO: 214375 - DNA, 25 bp, Mus musculus
agtgagcgatcacaggtcctaaaaa

SEQ ID NO: 214376 - DNA, 25 bp, Mus musculus
agtgagcgatcagaggtcctaaaaa

SEQ ID NO: 214377 - DNA, 25 bp, Mus musculus
agtgagcgcctgatcagtcacactg

SEQ ID NO: 214378 - DNA, 25 bp, Mus musculus
agtgagcgcctgttcagtcacactg

SEQ ID NO: 214379 - DNA, 25 bp, Mus musculus
agtgagcgcgacacacatgtggtca

SEQ ID NO: 214380 - DNA, 25 bp, Mus musculus
agtgagcgcgactcacatgtggtca

SEQ ID NO: 214381 - DNA, 25 bp, Mus musculus
agtgagcgctttactgctgagccgt

SEQ ID NO: 214382 - DNA, 25 bp, Mus musculus
agtgagcgcttttctgctgagccgt

SEQ ID NO: 214383 - DNA, 25 bp, Mus musculus
agtgagcgtctgcagcttctctcgg

SEQ ID NO: 214384 - DNA, 25 bp, Mus musculus
agtgagcgtctggagcttctctcgg

SEQ ID NO: 214385 - DNA, 25 bp, Mus musculus
agtgagctacaaactccattgggct

SEQ ID NO: 214386 - DNA, 25 bp, Mus musculus
agtgagctacaatctccattgggct

SEQ ID NO: 214387 - DNA, 25 bp, Mus musculus
agtgagctactcacaaggcccatgc

SEQ ID NO: 214388 - DNA, 25 bp, Mus musculus
agtgagctactctcaaggcccatgc

SEQ ID NO: 214389 - DNA, 25 bp, Mus musculus
agtgagctactgaaaatgcattttt

SEQ ID NO: 214390 - DNA, 25 bp, Mus musculus
agtgagctactgtaaatgcattttt

SEQ ID NO: 214391 - DNA, 25 bp, Mus musculus
agtgagctagcgcagcaaactcctt

SEQ ID NO: 214392 - DNA, 25 bp, Mus musculus
agtgagctagcggagcaaactcctt

SEQ ID NO: 214393 - DNA, 25 bp, Mus musculus
agtgagctatggaatctgtgactta

SEQ ID NO: 214394 - DNA, 25 bp, Mus musculus
agtgagctatggtatctgtgactta

SEQ ID NO: 214395 - DNA, 25 bp, Mus musculus
agtgagctcaatatagtgtctgggt

SEQ ID NO: 214396 - DNA, 25 bp, Mus musculus
agtgagctcaatttagtgtctgggt

SEQ ID NO: 214397 - DNA, 25 bp, Mus musculus
agtgagctcgtcagtagggcttcca

SEQ ID NO: 214398 - DNA, 25 bp, Mus musculus
agtgagctcgtctgtagggcttcca

SEQ ID NO: 214399 - DNA, 25 bp, Mus musculus
agtgagctcttcatggctagacccc

SEQ ID NO: 214400 - DNA, 25 bp, Mus musculus
agtgagctcttcttggctagacccc

SEQ ID NO: 214401 - DNA, 25 bp, Mus musculus
agtgagctgagtcccatccttatgg

SEQ ID NO: 214402 - DNA, 25 bp, Mus musculus
agtgagctgagtcgcggcacacact

SEQ ID NO: 214403 - DNA, 25 bp, Mus musculus
agtgagctgagtgccatccttatgg

SEQ ID NO: 214404 - DNA, 25 bp, Mus musculus
agtgagctgagtggcggcacacact

SEQ ID NO: 214405 - DNA, 25 bp, Mus musculus
agtgagctgatgaggctagcccaga

SEQ ID NO: 214406 - DNA, 25 bp, Mus musculus
agtgagctgatgtggctagcccaga

SEQ ID NO: 214407 - DNA, 25 bp, Mus musculus
agtgagctgccaattttgattttgt

SEQ ID NO: 214408 - DNA, 25 bp, Mus musculus
agtgagctgccatttttgattttgt

SEQ ID NO: 214409 - DNA, 25 bp, Mus musculus
agtgagctggatcagccagagttct

SEQ ID NO: 214410 - DNA, 25 bp, Mus musculus
agtgagctggatgagccagagttct

SEQ ID NO: 214411 - DNA, 25 bp, Mus musculus
agtgagctttaactggcggcccaca

SEQ ID NO: 214412 - DNA, 25 bp, Mus musculus
agtgagctttaagtggcggcccaca

SEQ ID NO: 214413 - DNA, 25 bp, Mus musculus
agtgaggaacccattgtgcttcttt

SEQ ID NO: 214414 - DNA, 25 bp, Mus musculus
agtgaggaaccctttgtgcttcttt

SEQ ID NO: 214415 - DNA, 25 bp, Mus musculus
agtgaggaacctccttcaagattaa

SEQ ID NO: 214416 - DNA, 25 bp, Mus musculus
agtgaggaacctgcttcaagattaa

SEQ ID NO: 214417 - DNA, 25 bp, Mus musculus
agtgaggaatccagatctctcgccc

SEQ ID NO: 214418 - DNA, 25 bp, Mus musculus
agtgaggaatcctgatctctcgccc

SEQ ID NO: 214419 - DNA, 25 bp, Mus musculus
agtgaggaattcagtctcttgccca

SEQ ID NO: 214420 - DNA, 25 bp, Mus musculus
agtgaggaattctgtctcttgccca

SEQ ID NO: 214421 - DNA, 25 bp, Mus musculus
agtgaggacgccaacacagtgctga

SEQ ID NO: 214422 - DNA, 25 bp, Mus musculus
agtgaggacgcctacacagtgctga

SEQ ID NO: 214423 - DNA, 25 bp, Mus musculus
agtgaggagaacagctcccgcatgg

SEQ ID NO: 214424 - DNA, 25 bp, Mus musculus
agtgaggagaactgctcccgcatgg

SEQ ID NO: 214425 - DNA, 25 bp, Mus musculus
agtgaggagatcaacgccgatcctt

SEQ ID NO: 214426 - DNA, 25 bp, Mus musculus
agtgaggagatctacgccgatcctt

SEQ ID NO: 214427 - DNA, 25 bp, Mus musculus
agtgaggaggacatgcggctctcca

SEQ ID NO: 214428 - DNA, 25 bp, Mus musculus
agtgaggaggacttgcggctctcca

SEQ ID NO: 214429 - DNA, 25 bp, Mus musculus
agtgaggagtcaaacccaactcatg

SEQ ID NO: 214430 - DNA, 25 bp, Mus musculus
agtgaggagtcatacccaactcatg

SEQ ID NO: 214431 - DNA, 25 bp, Mus musculus
agtgaggatccgcaacgctgcccct

SEQ ID NO: 214432 - DNA, 25 bp, Mus musculus
agtgaggatccggaacgctgcccct

SEQ ID NO: 214433 - DNA, 25 bp, Mus musculus
agtgaggattacagatgttcacagt

SEQ ID NO: 214434 - DNA, 25 bp, Mus musculus
agtgaggattactgatgttcacagt

SEQ ID NO: 214435 - DNA, 25 bp, Mus musculus
agtgaggccaggaatgtccctccag

SEQ ID NO: 214436 - DNA, 25 bp, Mus musculus
agtgaggccaggtatgtccctccag

SEQ ID NO: 214437 - DNA, 25 bp, Mus musculus
agtgaggccagtcctctttggctaa

SEQ ID NO: 214438 - DNA, 25 bp, Mus musculus
agtgaggccagtcgacagagacaaa

SEQ ID NO: 214439 - DNA, 25 bp, Mus musculus
agtgaggccagtgctctttggctaa

SEQ ID NO: 214440 - DNA, 25 bp, Mus musculus
agtgaggccagtggacagagacaaa

SEQ ID NO: 214441 - DNA, 25 bp, Mus musculus
agtgaggccatcagcatgttcagca

SEQ ID NO: 214442 - DNA, 25 bp, Mus musculus
agtgaggccatctgcatgttcagca

SEQ ID NO: 214443 - DNA, 25 bp, Mus musculus
agtgaggccgagacctggcgtcctt

SEQ ID NO: 214444 - DNA, 25 bp, Mus musculus
agtgaggccgagtcctggcgtcctt

SEQ ID NO: 214445 - DNA, 25 bp, Mus musculus
agtgaggcgccaagaacccttctta

SEQ ID NO: 214446 - DNA, 25 bp, Mus musculus
agtgaggcgccatgaacccttctta

SEQ ID NO: 214447 - DNA, 25 bp, Mus musculus
agtgaggcgtcaccgagcttgcttt

SEQ ID NO: 214448 - DNA, 25 bp, Mus musculus
agtgaggcgtcagcgagcttgcttt

SEQ ID NO: 214449 - DNA, 25 bp, Mus musculus
agtgaggctcacctttaagctagag

SEQ ID NO: 214450 - DNA, 25 bp, Mus musculus
agtgaggctcacgtttaagctagag

SEQ ID NO: 214451 - DNA, 25 bp, Mus musculus
agtgaggctccacgaggctttccta

SEQ ID NO: 214452 - DNA, 25 bp, Mus musculus
agtgaggctccaggaggctttccta

SEQ ID NO: 214453 - DNA, 25 bp, Mus musculus
agtgaggctctcattctttttggtt

SEQ ID NO: 214454 - DNA, 25 bp, Mus musculus
agtgaggctctctttctttttggtt

SEQ ID NO: 214455 - DNA, 25 bp, Mus musculus
agtgaggctgttactatattctgtt

SEQ ID NO: 214456 - DNA, 25 bp, Mus musculus
agtgaggctgtttctatattctgtt

SEQ ID NO: 214457 - DNA, 25 bp, Mus musculus
agtgaggcttacacacagccagcta

SEQ ID NO: 214458 - DNA, 25 bp, Mus musculus
agtgaggcttactcacagccagcta

SEQ ID NO: 214459 - DNA, 25 bp, Mus musculus
agtgaggcttctcggtgcataccag

SEQ ID NO: 214460 - DNA, 25 bp, Mus musculus
agtgaggcttctgggtgcataccag

SEQ ID NO: 214461 - DNA, 25 bp, Mus musculus
agtgagggagcgacaagacaacaga

SEQ ID NO: 214462 - DNA, 25 bp, Mus musculus
agtgagggagcgtcaagacaacaga

SEQ ID NO: 214463 - DNA, 25 bp, Mus musculus
agtgagggattacctggctgccata

SEQ ID NO: 214464 - DNA, 25 bp, Mus musculus
agtgagggattagctggctgccata

SEQ ID NO: 214465 - DNA, 25 bp, Mus musculus
agtgagggcactcggcatgccaact

SEQ ID NO: 214466 - DNA, 25 bp, Mus musculus
agtgagggcactgggcatgccaact

SEQ ID NO: 214467 - DNA, 25 bp, Mus musculus
agtgagggctggctctccaagtctt

SEQ ID NO: 214468 - DNA, 25 bp, Mus musculus
agtgagggctgggtctccaagtctt

SEQ ID NO: 214469 - DNA, 25 bp, Mus musculus
agtgagggcttcaaagttgcgctcc

SEQ ID NO: 214470 - DNA, 25 bp, Mus musculus
agtgagggcttctaagttgcgctcc

SEQ ID NO: 214471 - DNA, 25 bp, Mus musculus
agtgagggtcacaagccacagccta

SEQ ID NO: 214472 - DNA, 25 bp, Mus musculus
agtgagggtcactagccacagccta

SEQ ID NO: 214473 - DNA, 25 bp, Mus musculus
agtgagggtgaccaggtttaagctc

SEQ ID NO: 214474 - DNA, 25 bp, Mus musculus
agtgagggtgacgaggtttaagctc

SEQ ID NO: 214475 - DNA, 25 bp, Mus musculus
agtgagggttgaaagaagaccttgt

SEQ ID NO: 214476 - DNA, 25 bp, Mus musculus
agtgagggttgatagaagaccttgt

SEQ ID NO: 214477 - DNA, 25 bp, Mus musculus
agtgaggtcaccaaagcttgaaagg

SEQ ID NO: 214478 - DNA, 25 bp, Mus musculus
agtgaggtcacctaagcttgaaagg

SEQ ID NO: 214479 - DNA, 25 bp, Mus musculus
agtgaggtcattaccacccggtgtc

SEQ ID NO: 214480 - DNA, 25 bp, Mus musculus
agtgaggtcattagtgctgggtttc

SEQ ID NO: 214481 - DNA, 25 bp, Mus musculus
agtgaggtcatttccacccggtgtc

SEQ ID NO: 214482 - DNA, 25 bp, Mus musculus
agtgaggtcatttgtgctgggtttc

SEQ ID NO: 214483 - DNA, 25 bp, Mus musculus
agtgaggtccggctgtggctccgta

SEQ ID NO: 214484 - DNA, 25 bp, Mus musculus
agtgaggtccgggtgtggctccgta

SEQ ID NO: 214485 - DNA, 25 bp, Mus musculus
agtgaggtctacagtagcaccccag

SEQ ID NO: 214486 - DNA, 25 bp, Mus musculus
agtgaggtctactgtagcaccccag

SEQ ID NO: 214487 - DNA, 25 bp, Mus musculus
agtgaggtctctcgtgtgcattaac

SEQ ID NO: 214488 - DNA, 25 bp, Mus musculus
agtgaggtctctggtgtgcattaac

SEQ ID NO: 214489 - DNA, 25 bp, Mus musculus
agtgaggtcttcagcagtcatcagg

SEQ ID NO: 214490 - DNA, 25 bp, Mus musculus
agtgaggtcttctgcagtcatcagg

SEQ ID NO: 214491 - DNA, 25 bp, Mus musculus
agtgaggtgaccatcatttccagtc

SEQ ID NO: 214492 - DNA, 25 bp, Mus musculus
agtgaggtgaccttcatttccagtc

SEQ ID NO: 214493 - DNA, 25 bp, Mus musculus
agtgaggtgcatatactctctcctt

SEQ ID NO: 214494 - DNA, 25 bp, Mus musculus
agtgaggtgcatttactctctcctt

SEQ ID NO: 214495 - DNA, 25 bp, Mus musculus
agtgaggtggtgaggaatcaacaac

SEQ ID NO: 214496 - DNA, 25 bp, Mus musculus
agtgaggtggtgtggaatcaacaac

SEQ ID NO: 214497 - DNA, 25 bp, Mus musculus
agtgaggtgttcatctcccttccat

SEQ ID NO: 214498 - DNA, 25 bp, Mus musculus
agtgaggtgttcttctcccttccat

SEQ ID NO: 214499 - DNA, 25 bp, Mus musculus
agtgaggttccacacaggcatggct

SEQ ID NO: 214500 - DNA, 25 bp, Mus musculus
agtgaggttccagacaggcatggct

SEQ ID NO: 214501 - DNA, 25 bp, Mus musculus
agtgagtaaactagcccacttcctc

SEQ ID NO: 214502 - DNA, 25 bp, Mus musculus
agtgagtaaacttgcccacttcctc

SEQ ID NO: 214503 - DNA, 25 bp, Mus musculus
agtgagtaagctactcctttttatt

SEQ ID NO: 214504 - DNA, 25 bp, Mus musculus
agtgagtaagcttctcctttttatt

SEQ ID NO: 214505 - DNA, 25 bp, Mus musculus
agtgagtaataccactggttgctct

SEQ ID NO: 214506 - DNA, 25 bp, Mus musculus
agtgagtaatacgactggttgctct

SEQ ID NO: 214507 - DNA, 25 bp, Mus musculus
agtgagtacttccacgactataggt

SEQ ID NO: 214508 - DNA, 25 bp, Mus musculus
agtgagtacttcgacgactataggt

SEQ ID NO: 214509 - DNA, 25 bp, Mus musculus
agtgagtatctcacggccggttccc

SEQ ID NO: 214510 - DNA, 25 bp, Mus musculus
agtgagtatctctcggccggttccc

SEQ ID NO: 214511 - DNA, 25 bp, Mus musculus
agtgagtattcacgaccataaaaca

SEQ ID NO: 214512 - DNA, 25 bp, Mus musculus
agtgagtattcaggaccataaaaca

SEQ ID NO: 214513 - DNA, 25 bp, Mus musculus
agtgagtcactcaggaacttaatgc

SEQ ID NO: 214514 - DNA, 25 bp, Mus musculus
agtgagtcactctggaacttaatgc

SEQ ID NO: 214515 - DNA, 25 bp, Mus musculus
agtgagtcatgtcgtgccctgtctg

SEQ ID NO: 214516 - DNA, 25 bp, Mus musculus
agtgagtcatgtggtgccctgtctg

SEQ ID NO: 214517 - DNA, 25 bp, Mus musculus
agtgagtccatcagaccctgcctca

SEQ ID NO: 214518 - DNA, 25 bp, Mus musculus
agtgagtccatctgaccctgcctca

SEQ ID NO: 214519 - DNA, 25 bp, Mus musculus
agtgagtcccctaggtgatttattt

SEQ ID NO: 214520 - DNA, 25 bp, Mus musculus
agtgagtccccttggtgatttattt

SEQ ID NO: 214521 - DNA, 25 bp, Mus musculus
agtgagtccctacatactgacctgt

SEQ ID NO: 214522 - DNA, 25 bp, Mus musculus
agtgagtccctagatactgacctgt

SEQ ID NO: 214523 - DNA, 25 bp, Mus musculus
agtgagtcctgccattcttgagtta

SEQ ID NO: 214524 - DNA, 25 bp, Mus musculus
agtgagtcctgcgattcttgagtta

SEQ ID NO: 214525 - DNA, 25 bp, Mus musculus
agtgagtcggtaatctgtattccta

SEQ ID NO: 214526 - DNA, 25 bp, Mus musculus
agtgagtcggtattctgtattccta

SEQ ID NO: 214527 - DNA, 25 bp, Mus musculus
agtgagtctgagatctgccttgcag

SEQ ID NO: 214528 - DNA, 25 bp, Mus musculus
agtgagtctgagttctgccttgcag

SEQ ID NO: 214529 - DNA, 25 bp, Mus musculus
agtgagtctgatccaaagttcaatc

SEQ ID NO: 214530 - DNA, 25 bp, Mus musculus
agtgagtctgatgcaaagttcaatc

SEQ ID NO: 214531 - DNA, 25 bp, Mus musculus
agtgagtcttcaccgtttctctgtc

SEQ ID NO: 214532 - DNA, 25 bp, Mus musculus
agtgagtcttcagcgtttctctgtc

SEQ ID NO: 214533 - DNA, 25 bp, Mus musculus
agtgagtgagccagactatcgttga

SEQ ID NO: 214534 - DNA, 25 bp, Mus musculus
agtgagtgagcctgactatcgttga

SEQ ID NO: 214535 - DNA, 25 bp, Mus musculus
agtgagtgatgtaatgcagcaggca

SEQ ID NO: 214536 - DNA, 25 bp, Mus musculus
agtgagtgatgttatgcagcaggca

SEQ ID NO: 214537 - DNA, 25 bp, Mus musculus
agtgagtgattactcatgcattatc

SEQ ID NO: 214538 - DNA, 25 bp, Mus musculus
agtgagtgattagtcatgcattatc

SEQ ID NO: 214539 - DNA, 25 bp, Mus musculus
agtgagtgcagcaagctctctggct

SEQ ID NO: 214540 - DNA, 25 bp, Mus musculus
agtgagtgcagctagctctctggct

SEQ ID NO: 214541 - DNA, 25 bp, Mus musculus
agtgagtgcaggatgctcttgtctc

SEQ ID NO: 214542 - DNA, 25 bp, Mus musculus
agtgagtgcaggttgctcttgtctc

SEQ ID NO: 214543 - DNA, 25 bp, Mus musculus
agtgagtgcatgactagggttccca

SEQ ID NO: 214544 - DNA, 25 bp, Mus musculus
agtgagtgcatgtctagggttccca

SEQ ID NO: 214545 - DNA, 25 bp, Mus musculus
agtgagtgccctaacattccactgt

SEQ ID NO: 214546 - DNA, 25 bp, Mus musculus
agtgagtgcccttacattccactgt

SEQ ID NO: 214547 - DNA, 25 bp, Mus musculus
agtgagtgcgtgagtccagtatgtt

SEQ ID NO: 214548 - DNA, 25 bp, Mus musculus
agtgagtgcgtgtgtccagtatgtt

SEQ ID NO: 214549 - DNA, 25 bp, Mus musculus
agtgagtgctcaccgaattccaaag

SEQ ID NO: 214550 - DNA, 25 bp, Mus musculus
agtgagtgctcagcgaattccaaag

SEQ ID NO: 214551 - DNA, 25 bp, Mus musculus
agtgagtgctgcagaccgccagtga

SEQ ID NO: 214552 - DNA, 25 bp, Mus musculus
agtgagtgctgctgaccgccagtga

SEQ ID NO: 214553 - DNA, 25 bp, Mus musculus
agtgagtgcttcaactgcggaaagt

SEQ ID NO: 214554 - DNA, 25 bp, Mus musculus
agtgagtgcttctactgcggaaagt

SEQ ID NO: 214555 - DNA, 25 bp, Mus musculus
agtgagtggaacagccctgggactc

SEQ ID NO: 214556 - DNA, 25 bp, Mus musculus
agtgagtggaactgccctgggactc

SEQ ID NO: 214557 - DNA, 25 bp, Mus musculus
agtgagtggacccagcagagctctc

SEQ ID NO: 214558 - DNA, 25 bp, Mus musculus
agtgagtggaccgagcagagctctc

SEQ ID NO: 214559 - DNA, 25 bp, Mus musculus
agtgagtggcttaatgccctgacca

SEQ ID NO: 214560 - DNA, 25 bp, Mus musculus
agtgagtggctttatgccctgacca

SEQ ID NO: 214561 - DNA, 25 bp, Mus musculus
agtgagtgtctacgtttcgtggccc

SEQ ID NO: 214562 - DNA, 25 bp, Mus musculus
agtgagtgtctaggtttcgtggccc

SEQ ID NO: 214563 - DNA, 25 bp, Mus musculus
agtgagttacaaagcacagctgtct

SEQ ID NO: 214564 - DNA, 25 bp, Mus musculus
agtgagttacaatgcacagctgtct

SEQ ID NO: 214565 - DNA, 25 bp, Mus musculus
agtgagttaggtctccagccgtgtc

SEQ ID NO: 214566 - DNA, 25 bp, Mus musculus
agtgagttaggtgtccagccgtgtc

SEQ ID NO: 214567 - DNA, 25 bp, Mus musculus
agtgagttcagcagtagtccttgcc

SEQ ID NO: 214568 - DNA, 25 bp, Mus musculus
agtgagttcagctgtagtccttgcc

SEQ ID NO: 214569 - DNA, 25 bp, Mus musculus
agtgagttccacagaactgtccctt

SEQ ID NO: 214570 - DNA, 25 bp, Mus musculus
agtgagttccactgaactgtccctt

SEQ ID NO: 214571 - DNA, 25 bp, Mus musculus
agtgagttccatcccataattcttt

SEQ ID NO: 214572 - DNA, 25 bp, Mus musculus
agtgagttccatgccataattcttt

SEQ ID NO: 214573 - DNA, 25 bp, Mus musculus
agtgagttgaggctcttcagcaaaa

SEQ ID NO: 214574 - DNA, 25 bp, Mus musculus
agtgagttgagggtcttcagcaaaa

SEQ ID NO: 214575 - DNA, 25 bp, Mus musculus
agtgagttgtcccaagcttcagcag

SEQ ID NO: 214576 - DNA, 25 bp, Mus musculus
agtgagttgtccgaagcttcagcag

SEQ ID NO: 214577 - DNA, 25 bp, Mus musculus
agtgagtttactaacatgttgtctg

SEQ ID NO: 214578 - DNA, 25 bp, Mus musculus
agtgagtttacttacatgttgtctg

SEQ ID NO: 214579 - DNA, 25 bp, Mus musculus
agtgagtttcacaagtgtctcttac

SEQ ID NO: 214580 - DNA, 25 bp, Mus musculus
agtgagtttcactagtgtctcttac

SEQ ID NO: 214581 - DNA, 25 bp, Mus musculus
agtgagttttgtctccactcttgca

SEQ ID NO: 214582 - DNA, 25 bp, Mus musculus
agtgagttttgtgtccactcttgca

SEQ ID NO: 214583 - DNA, 25 bp, Mus musculus
agtgagtttttcctgtgtgatgtgt

SEQ ID NO: 214584 - DNA, 25 bp, Mus musculus
agtgagtttttcgtgtgtgatgtgt

SEQ ID NO: 214585 - DNA, 25 bp, Mus musculus
agtgataaaactcggcctgtagctc

SEQ ID NO: 214586 - DNA, 25 bp, Mus musculus
agtgataaaactgggcctgtagctc

SEQ ID NO: 214587 - DNA, 25 bp, Mus musculus
agtgataaaccacagaatacttttg

SEQ ID NO: 214588 - DNA, 25 bp, Mus musculus
agtgataaaccagagaatacttttg

SEQ ID NO: 214589 - DNA, 25 bp, Mus musculus
agtgataacaccatatctgtgctat

SEQ ID NO: 214590 - DNA, 25 bp, Mus musculus
agtgataacaccttatctgtgctat

SEQ ID NO: 214591 - DNA, 25 bp, Mus musculus
agtgataactgcaatccccagccag

SEQ ID NO: 214592 - DNA, 25 bp, Mus musculus
agtgataactgctatccccagccag

SEQ ID NO: 214593 - DNA, 25 bp, Mus musculus
agtgataattgcagtaacttggcta

SEQ ID NO: 214594 - DNA, 25 bp, Mus musculus
agtgataattgctgtaacttggcta

SEQ ID NO: 214595 - DNA, 25 bp, Mus musculus
agtgatacaactctcctgctgccaa

SEQ ID NO: 214596 - DNA, 25 bp, Mus musculus
agtgatacaactgtcctgctgccaa

SEQ ID NO: 214597 - DNA, 25 bp, Mus musculus
agtgataccaaccaagggaagccga

SEQ ID NO: 214598 - DNA, 25 bp, Mus musculus
agtgataccaacgaagggaagccga

SEQ ID NO: 214599 - DNA, 25 bp, Mus musculus
agtgataccattcagctgattctcc

SEQ ID NO: 214600 - DNA, 25 bp, Mus musculus
agtgataccattgagctgattctcc

SEQ ID NO: 214601 - DNA, 25 bp, Mus musculus
agtgataccccacgcgtgagagtgt

SEQ ID NO: 214602 - DNA, 25 bp, Mus musculus
agtgataccccaggcgtgagagtgt

SEQ ID NO: 214603 - DNA, 25 bp, Mus musculus
agtgatactcccctgtaggaggaga

SEQ ID NO: 214604 - DNA, 25 bp, Mus musculus
agtgatactcccgtgtaggaggaga

SEQ ID NO: 214605 - DNA, 25 bp, Mus musculus
agtgatactgcaatgaccagctgaa

SEQ ID NO: 214606 - DNA, 25 bp, Mus musculus
agtgatactgcattgaccagctgaa

SEQ ID NO: 214607 - DNA, 25 bp, Mus musculus
agtgatacttgaatgcccatacccc

SEQ ID NO: 214608 - DNA, 25 bp, Mus musculus
agtgatacttgattgcccatacccc

SEQ ID NO: 214609 - DNA, 25 bp, Mus musculus
agtgatagccttcttaactaagttt

SEQ ID NO: 214610 - DNA, 25 bp, Mus musculus
agtgatagccttgttaactaagttt

SEQ ID NO: 214611 - DNA, 25 bp, Mus musculus
agtgatatatccagtagctccaata

SEQ ID NO: 214612 - DNA, 25 bp, Mus musculus
agtgatatatcctgtagctccaata

SEQ ID NO: 214613 - DNA, 25 bp, Mus musculus
agtgatatcgctatctgggtgtccc

SEQ ID NO: 214614 - DNA, 25 bp, Mus musculus
agtgatatcgctttctgggtgtccc

SEQ ID NO: 214615 - DNA, 25 bp, Mus musculus
agtgatattcacatctgcctctgga

SEQ ID NO: 214616 - DNA, 25 bp, Mus musculus
agtgatattcacttctgcctctgga

SEQ ID NO: 214617 - DNA, 25 bp, Mus musculus
agtgatcaacggcatcctctgtgcg

SEQ ID NO: 214618 - DNA, 25 bp, Mus musculus
agtgatcaacgggatcctctgtgcg

SEQ ID NO: 214619 - DNA, 25 bp, Mus musculus
agtgatcaatacacagggctgacct

SEQ ID NO: 214620 - DNA, 25 bp, Mus musculus
agtgatcaatactcagggctgacct

SEQ ID NO: 214621 - DNA, 25 bp, Mus musculus
agtgatcacggcagaacctttaaga

SEQ ID NO: 214622 - DNA, 25 bp, Mus musculus
agtgatcacggctgaacctttaaga

SEQ ID NO: 214623 - DNA, 25 bp, Mus musculus
agtgatcacttgcatacccctgcaa

SEQ ID NO: 214624 - DNA, 25 bp, Mus musculus
agtgatcacttggatacccctgcaa

SEQ ID NO: 214625 - DNA, 25 bp, Mus musculus
agtgatcagaaacagctgcctttga

SEQ ID NO: 214626 - DNA, 25 bp, Mus musculus
agtgatcagaaagagctgcctttga

SEQ ID NO: 214627 - DNA, 25 bp, Mus musculus
agtgatcaggtgattccaggagtca

SEQ ID NO: 214628 - DNA, 25 bp, Mus musculus
agtgatcaggtgtttccaggagtca

SEQ ID NO: 214629 - DNA, 25 bp, Mus musculus
agtgatcatcttcctctgtgtcctt

SEQ ID NO: 214630 - DNA, 25 bp, Mus musculus
agtgatcatcttgctctgtgtcctt

SEQ ID NO: 214631 - DNA, 25 bp, Mus musculus
agtgatccatctcacggactcattt

SEQ ID NO: 214632 - DNA, 25 bp, Mus musculus
agtgatccatctgacggactcattt

SEQ ID NO: 214633 - DNA, 25 bp, Mus musculus
agtgatcccaacagttcaaattcgg

SEQ ID NO: 214634 - DNA, 25 bp, Mus musculus
agtgatcccaactgttcaaattcgg

SEQ ID NO: 214635 - DNA, 25 bp, Mus musculus
agtgatccctgaagatacccacatc

SEQ ID NO: 214636 - DNA, 25 bp, Mus musculus
agtgatccctgatgatacccacatc

SEQ ID NO: 214637 - DNA, 25 bp, Mus musculus
agtgatcctagcaaagactcctagt

SEQ ID NO: 214638 - DNA, 25 bp, Mus musculus
agtgatcctagcaagtctggccatg

SEQ ID NO: 214639 - DNA, 25 bp, Mus musculus
agtgatcctagctaagactcctagt

SEQ ID NO: 214640 - DNA, 25 bp, Mus musculus
agtgatcctagctagtctggccatg

SEQ ID NO: 214641 - DNA, 25 bp, Mus musculus
agtgatcctataatgctgctccgag

SEQ ID NO: 214642 - DNA, 25 bp, Mus musculus
agtgatcctatattgctgctccgag

SEQ ID NO: 214643 - DNA, 25 bp, Mus musculus
agtgatcctcccattgaagtgcgtg

SEQ ID NO: 214644 - DNA, 25 bp, Mus musculus
agtgatcctccctttgaagtgcgtg

SEQ ID NO: 214645 - DNA, 25 bp, Mus musculus
agtgatcctgctctatccattcgca

SEQ ID NO: 214646 - DNA, 25 bp, Mus musculus
agtgatcctgctgtatccattcgca

SEQ ID NO: 214647 - DNA, 25 bp, Mus musculus
agtgatcgacacaggaactgcccca

SEQ ID NO: 214648 - DNA, 25 bp, Mus musculus
agtgatcgacactggaactgcccca

SEQ ID NO: 214649 - DNA, 25 bp, Mus musculus
agtgatctaggccagcagcctccct

SEQ ID NO: 214650 - DNA, 25 bp, Mus musculus
agtgatctaggcgagcagcctccct

SEQ ID NO: 214651 - DNA, 25 bp, Mus musculus
agtgatctcatgagctcagatagtc

SEQ ID NO: 214652 - DNA, 25 bp, Mus musculus
agtgatctcatgtgctcagatagtc

SEQ ID NO: 214653 - DNA, 25 bp, Mus musculus
agtgatctccagagtcgcttggaat

SEQ ID NO: 214654 - DNA, 25 bp, Mus musculus
agtgatctccagtgtcgcttggaat

SEQ ID NO: 214655 - DNA, 25 bp, Mus musculus
agtgatctctagcacaatcagggct

SEQ ID NO: 214656 - DNA, 25 bp, Mus musculus
agtgatctctaggacaatcagggct

SEQ ID NO: 214657 - DNA, 25 bp, Mus musculus
agtgatctctcaaagctatttaaaa

SEQ ID NO: 214658 - DNA, 25 bp, Mus musculus
agtgatctctcatagctatttaaaa

SEQ ID NO: 214659 - DNA, 25 bp, Mus musculus
agtgatctctggatctactcaagtg

SEQ ID NO: 214660 - DNA, 25 bp, Mus musculus
agtgatctctggttctactcaagtg

SEQ ID NO: 214661 - DNA, 25 bp, Mus musculus
agtgatctctttcctacaagctgct

SEQ ID NO: 214662 - DNA, 25 bp, Mus musculus
agtgatctctttgctacaagctgct

SEQ ID NO: 214663 - DNA, 25 bp, Mus musculus
agtgatctgggcattcgtctgcagg

SEQ ID NO: 214664 - DNA, 25 bp, Mus musculus
agtgatctgggctttcgtctgcagg

SEQ ID NO: 214665 - DNA, 25 bp, Mus musculus
agtgatctgtgacatttttaatgtt

SEQ ID NO: 214666 - DNA, 25 bp, Mus musculus
agtgatctgtgagatttttaatgtt

SEQ ID NO: 214667 - DNA, 25 bp, Mus musculus
agtgatgaacaccaacctgaacaaa

SEQ ID NO: 214668 - DNA, 25 bp, Mus musculus
agtgatgaacacgaacctgaacaaa

SEQ ID NO: 214669 - DNA, 25 bp, Mus musculus
agtgatgaacttcgtggtccgctac

SEQ ID NO: 214670 - DNA, 25 bp, Mus musculus
agtgatgaacttggtggtccgctac

SEQ ID NO: 214671 - DNA, 25 bp, Mus musculus
agtgatgaagacattggtgtgagaa

SEQ ID NO: 214672 - DNA, 25 bp, Mus musculus
agtgatgaagactttggtgtgagaa

SEQ ID NO: 214673 - DNA, 25 bp, Mus musculus
agtgatgaagccctgctctgggcaa

SEQ ID NO: 214674 - DNA, 25 bp, Mus musculus
agtgatgaagccgtgctctgggcaa

SEQ ID NO: 214675 - DNA, 25 bp, Mus musculus
agtgatgacaacacgtttcttcaaa

SEQ ID NO: 214676 - DNA, 25 bp, Mus musculus
agtgatgacaactcgtttcttcaaa

SEQ ID NO: 214677 - DNA, 25 bp, Mus musculus
agtgatgaccagagcccttgtagaa

SEQ ID NO: 214678 - DNA, 25 bp, Mus musculus
agtgatgaccagtgcccttgtagaa

SEQ ID NO: 214679 - DNA, 25 bp, Mus musculus
agtgatgactagatgcctgtgatgc

SEQ ID NO: 214680 - DNA, 25 bp, Mus musculus
agtgatgactagttgcctgtgatgc

SEQ ID NO: 214681 - DNA, 25 bp, Mus musculus
agtgatgactgcattgatccaagaa

SEQ ID NO: 214682 - DNA, 25 bp, Mus musculus
agtgatgactgctttgatccaagaa

SEQ ID NO: 214683 - DNA, 25 bp, Mus musculus
agtgatgaggccaaagcttacctgc

SEQ ID NO: 214684 - DNA, 25 bp, Mus musculus
agtgatgaggccaggatagctccct

SEQ ID NO: 214685 - DNA, 25 bp, Mus musculus
agtgatgaggcctaagcttacctgc

SEQ ID NO: 214686 - DNA, 25 bp, Mus musculus
agtgatgaggcctggatagctccct

SEQ ID NO: 214687 - DNA, 25 bp, Mus musculus
agtgatgatcctcttcattggccac

SEQ ID NO: 214688 - DNA, 25 bp, Mus musculus
agtgatgatcctgttcattggccac

SEQ ID NO: 214689 - DNA, 25 bp, Mus musculus
agtgatgatggtatgctaatcgcta

SEQ ID NO: 214690 - DNA, 25 bp, Mus musculus
agtgatgatggtttgctaatcgcta

SEQ ID NO: 214691 - DNA, 25 bp, Mus musculus
agtgatgatgttcaatgtgccttat

SEQ ID NO: 214692 - DNA, 25 bp, Mus musculus
agtgatgatgttgaatgtgccttat

SEQ ID NO: 214693 - DNA, 25 bp, Mus musculus
agtgatgcaagtactccaaccagaa

SEQ ID NO: 214694 - DNA, 25 bp, Mus musculus
agtgatgcaagttctccaaccagaa

SEQ ID NO: 214695 - DNA, 25 bp, Mus musculus
agtgatgcaggccaggagacatcat

SEQ ID NO: 214696 - DNA, 25 bp, Mus musculus
agtgatgcaggcgaggagacatcat

SEQ ID NO: 214697 - DNA, 25 bp, Mus musculus
agtgatgcatgcaggtactctaggc

SEQ ID NO: 214698 - DNA, 25 bp, Mus musculus
agtgatgcatgctggtactctaggc

SEQ ID NO: 214699 - DNA, 25 bp, Mus musculus
agtgatgcatggaacctctcccagt

SEQ ID NO: 214700 - DNA, 25 bp, Mus musculus
agtgatgcatggtacctctcccagt

SEQ ID NO: 214701 - DNA, 25 bp, Mus musculus
agtgatgccaaaccctggagcaact

SEQ ID NO: 214702 - DNA, 25 bp, Mus musculus
agtgatgccaaagcctggagcaact

SEQ ID NO: 214703 - DNA, 25 bp, Mus musculus
agtgatgccactctccctgtgtgac

SEQ ID NO: 214704 - DNA, 25 bp, Mus musculus
agtgatgccactgtccctgtgtgac

SEQ ID NO: 214705 - DNA, 25 bp, Mus musculus
agtgatgccagcaagaaacggctga

SEQ ID NO: 214706 - DNA, 25 bp, Mus musculus
agtgatgccagctagaaacggctga

SEQ ID NO: 214707 - DNA, 25 bp, Mus musculus
agtgatgccattctccagtccaaac

SEQ ID NO: 214708 - DNA, 25 bp, Mus musculus
agtgatgccattgtccagtccaaac

SEQ ID NO: 214709 - DNA, 25 bp, Mus musculus
agtgatgcccacaacatggatacaa

SEQ ID NO: 214710 - DNA, 25 bp, Mus musculus
agtgatgcccactacatggatacaa

SEQ ID NO: 214711 - DNA, 25 bp, Mus musculus
agtgatgctcaaacagaatcctgtg

SEQ ID NO: 214712 - DNA, 25 bp, Mus musculus
agtgatgctcaatcagaatcctgtg

SEQ ID NO: 214713 - DNA, 25 bp, Mus musculus
agtgatgctgacatcttgcccatat

SEQ ID NO: 214714 - DNA, 25 bp, Mus musculus
agtgatgctgacttcttgcccatat

SEQ ID NO: 214715 - DNA, 25 bp, Mus musculus
agtgatgctgataatgtcctgagac

SEQ ID NO: 214716 - DNA, 25 bp, Mus musculus
agtgatgctgattatgtcctgagac

SEQ ID NO: 214717 - DNA, 25 bp, Mus musculus
agtgatgctgcaattattgttatga

SEQ ID NO: 214718 - DNA, 25 bp, Mus musculus
agtgatgctgcacttatcttcaaga

SEQ ID NO: 214719 - DNA, 25 bp, Mus musculus
agtgatgctgcagttatcttcaaga

SEQ ID NO: 214720 - DNA, 25 bp, Mus musculus
agtgatgctgcatttattgttatga

SEQ ID NO: 214721 - DNA, 25 bp, Mus musculus
agtgatgctggcaaagtcctgtgga

SEQ ID NO: 214722 - DNA, 25 bp, Mus musculus
agtgatgctggctaagtcctgtgga

SEQ ID NO: 214723 - DNA, 25 bp, Mus musculus
agtgatggaactcacacctgagcag

SEQ ID NO: 214724 - DNA, 25 bp, Mus musculus
agtgatggaactgacacctgagcag

SEQ ID NO: 214725 - DNA, 25 bp, Mus musculus
agtgatggaagcaacctcttcaatc

SEQ ID NO: 214726 - DNA, 25 bp, Mus musculus
agtgatggaagctacctcttcaatc

SEQ ID NO: 214727 - DNA, 25 bp, Mus musculus
agtgatggaatgacctggcctgtgc

SEQ ID NO: 214728 - DNA, 25 bp, Mus musculus
agtgatggaatgtcctggcctgtgc

SEQ ID NO: 214729 - DNA, 25 bp, Mus musculus
agtgatggagaacaacttccctctc

SEQ ID NO: 214730 - DNA, 25 bp, Mus musculus
agtgatggagaagaacttccctctc

SEQ ID NO: 214731 - DNA, 25 bp, Mus musculus
agtgatggatgcatcaccataccct

SEQ ID NO: 214732 - DNA, 25 bp, Mus musculus
agtgatggatgcttcaccataccct

SEQ ID NO: 214733 - DNA, 25 bp, Mus musculus
agtgatggcatgaggctctattcct

SEQ ID NO: 214734 - DNA, 25 bp, Mus musculus
agtgatggcatgtggctctattcct

SEQ ID NO: 214735 - DNA, 25 bp, Mus musculus
agtgatggccacacttaagatttga

SEQ ID NO: 214736 - DNA, 25 bp, Mus musculus
agtgatggccactcttaagatttga

SEQ ID NO: 214737 - DNA, 25 bp, Mus musculus
agtgatggccatatttgcacgcccc

SEQ ID NO: 214738 - DNA, 25 bp, Mus musculus
agtgatggccatttttgcacgcccc

SEQ ID NO: 214739 - DNA, 25 bp, Mus musculus
agtgatggccgacttaatggttttg

SEQ ID NO: 214740 - DNA, 25 bp, Mus musculus
agtgatggccgagttaatggttttg

SEQ ID NO: 214741 - DNA, 25 bp, Mus musculus
agtgatggctccattctcatgtcag

SEQ ID NO: 214742 - DNA, 25 bp, Mus musculus
agtgatggctcctttctcatgtcag

SEQ ID NO: 214743 - DNA, 25 bp, Mus musculus
agtgatggctcgcactctcagagag

SEQ ID NO: 214744 - DNA, 25 bp, Mus musculus
agtgatggctcggactctcagagag

SEQ ID NO: 214745 - DNA, 25 bp, Mus musculus
agtgatggctgcaacgtgcaacttc

SEQ ID NO: 214746 - DNA, 25 bp, Mus musculus
agtgatggctgctacgtgcaacttc

SEQ ID NO: 214747 - DNA, 25 bp, Mus musculus
agtgatgggcacagttctcaccagg

SEQ ID NO: 214748 - DNA, 25 bp, Mus musculus
agtgatgggcactgttctcaccagg

SEQ ID NO: 214749 - DNA, 25 bp, Mus musculus
agtgatggtgctagtggtccctata

SEQ ID NO: 214750 - DNA, 25 bp, Mus musculus
agtgatggtgcttgtggtccctata

SEQ ID NO: 214751 - DNA, 25 bp, Mus musculus
agtgatggtggtaggtttccctcca

SEQ ID NO: 214752 - DNA, 25 bp, Mus musculus
agtgatggtggttggtttccctcca

SEQ ID NO: 214753 - DNA, 25 bp, Mus musculus
agtgatgtaggaacagggcctcttc

SEQ ID NO: 214754 - DNA, 25 bp, Mus musculus
agtgatgtaggatcagggcctcttc

SEQ ID NO: 214755 - DNA, 25 bp, Mus musculus
agtgatgtatgcctttttatttgaa

SEQ ID NO: 214756 - DNA, 25 bp, Mus musculus
agtgatgtatgcgtttttatttgaa

SEQ ID NO: 214757 - DNA, 25 bp, Mus musculus
agtgatgtcacccacgaaagcacac

SEQ ID NO: 214758 - DNA, 25 bp, Mus musculus
agtgatgtcaccgacgaaagcacac

SEQ ID NO: 214759 - DNA, 25 bp, Mus musculus
agtgatgtcattctatcgtgcgctc

SEQ ID NO: 214760 - DNA, 25 bp, Mus musculus
agtgatgtcattgtatcgtgcgctc

SEQ ID NO: 214761 - DNA, 25 bp, Mus musculus
agtgatgtcccacaaggcgcagtct

SEQ ID NO: 214762 - DNA, 25 bp, Mus musculus
agtgatgtcccagaaggcgcagtct

SEQ ID NO: 214763 - DNA, 25 bp, Mus musculus
agtgatgtcctacatcagttcccca

SEQ ID NO: 214764 - DNA, 25 bp, Mus musculus
agtgatgtcctagatcagttcccca

SEQ ID NO: 214765 - DNA, 25 bp, Mus musculus
agtgatgtcctgctagttccagata

SEQ ID NO: 214766 - DNA, 25 bp, Mus musculus
agtgatgtcctggtagttccagata

SEQ ID NO: 214767 - DNA, 25 bp, Mus musculus
agtgatgtctcacacttatggagaa

SEQ ID NO: 214768 - DNA, 25 bp, Mus musculus
agtgatgtctcagacttatggagaa

SEQ ID NO: 214769 - DNA, 25 bp, Mus musculus
agtgatgtgaagacgcctgagctcc

SEQ ID NO: 214770 - DNA, 25 bp, Mus musculus
agtgatgtgaagtcgcctgagctcc

SEQ ID NO: 214771 - DNA, 25 bp, Mus musculus
agtgatgtgattatcaatcctattc

SEQ ID NO: 214772 - DNA, 25 bp, Mus musculus
agtgatgtgattttcaatcctattc

SEQ ID NO: 214773 - DNA, 25 bp, Mus musculus
agtgatgtgcaaattgcctcctgct

SEQ ID NO: 214774 - DNA, 25 bp, Mus musculus
agtgatgtgcaacttggctcctctc

SEQ ID NO: 214775 - DNA, 25 bp, Mus musculus
agtgatgtgcaagttggctcctctc

SEQ ID NO: 214776 - DNA, 25 bp, Mus musculus
agtgatgtgcaatttgcctcctgct

SEQ ID NO: 214777 - DNA, 25 bp, Mus musculus
agtgatgtgcatcggcttataggcc

SEQ ID NO: 214778 - DNA, 25 bp, Mus musculus
agtgatgtgcatgggcttataggcc

SEQ ID NO: 214779 - DNA, 25 bp, Mus musculus
agtgatgtgcgacacgcctcacaag

SEQ ID NO: 214780 - DNA, 25 bp, Mus musculus
agtgatgtgcgagacgcctcacaag

SEQ ID NO: 214781 - DNA, 25 bp, Mus musculus
agtgatgtgtaaatccttgggagtc

SEQ ID NO: 214782 - DNA, 25 bp, Mus musculus
agtgatgtgtaattccttgggagtc

SEQ ID NO: 214783 - DNA, 25 bp, Mus musculus
agtgatgtgtagagaacctcccgtg

SEQ ID NO: 214784 - DNA, 25 bp, Mus musculus
agtgatgtgtagtgaacctcccgtg

SEQ ID NO: 214785 - DNA, 25 bp, Mus musculus
agtgatgtgtcaccactgtgcagaa

SEQ ID NO: 214786 - DNA, 25 bp, Mus musculus
agtgatgtgtcagcactgtgcagaa

SEQ ID NO: 214787 - DNA, 25 bp, Mus musculus
agtgatgttagtctagccctgctac

SEQ ID NO: 214788 - DNA, 25 bp, Mus musculus
agtgatgttagtgtagccctgctac

SEQ ID NO: 214789 - DNA, 25 bp, Mus musculus
agtgatgttctacaccacagcatgt

SEQ ID NO: 214790 - DNA, 25 bp, Mus musculus
agtgatgttctagaccacagcatgt

SEQ ID NO: 214791 - DNA, 25 bp, Mus musculus
agtgatgtttcacgtcctggacacc

SEQ ID NO: 214792 - DNA, 25 bp, Mus musculus
agtgatgtttcaggtcctggacacc

SEQ ID NO: 214793 - DNA, 25 bp, Mus musculus
agtgattaactgattatcttgtgca

SEQ ID NO: 214794 - DNA, 25 bp, Mus musculus
agtgattaactgtttatcttgtgca

SEQ ID NO: 214795 - DNA, 25 bp, Mus musculus
agtgattaatggaggtctctctccc

SEQ ID NO: 214796 - DNA, 25 bp, Mus musculus
agtgattaatggtggtctctctccc

SEQ ID NO: 214797 - DNA, 25 bp, Mus musculus
agtgattatgcccttgtactttaac

SEQ ID NO: 214798 - DNA, 25 bp, Mus musculus
agtgattatgccgttgtactttaac

SEQ ID NO: 214799 - DNA, 25 bp, Mus musculus
agtgattcaacacaacccagcgctc

SEQ ID NO: 214800 - DNA, 25 bp, Mus musculus
agtgattcaacagaacccagcgctc

SEQ ID NO: 214801 - DNA, 25 bp, Mus musculus
agtgattcatgtatatgagcagagt

SEQ ID NO: 214802 - DNA, 25 bp, Mus musculus
agtgattcatgtctttgggctcaga

SEQ ID NO: 214803 - DNA, 25 bp, Mus musculus
agtgattcatgtgtttgggctcaga

SEQ ID NO: 214804 - DNA, 25 bp, Mus musculus
agtgattcatgtttatgagcagagt

SEQ ID NO: 214805 - DNA, 25 bp, Mus musculus
agtgattccaacacagaggacaccc

SEQ ID NO: 214806 - DNA, 25 bp, Mus musculus
agtgattccaactcagaggacaccc

SEQ ID NO: 214807 - DNA, 25 bp, Mus musculus
agtgattccatccagctcatcagag

SEQ ID NO: 214808 - DNA, 25 bp, Mus musculus
agtgattccatcgagctcatcagag

SEQ ID NO: 214809 - DNA, 25 bp, Mus musculus
agtgattcccagctgtgttttgttt

SEQ ID NO: 214810 - DNA, 25 bp, Mus musculus
agtgattcccaggtgtgttttgttt

SEQ ID NO: 214811 - DNA, 25 bp, Mus musculus
agtgattccctccaacgactaagat

SEQ ID NO: 214812 - DNA, 25 bp, Mus musculus
agtgattccctcgaacgactaagat

SEQ ID NO: 214813 - DNA, 25 bp, Mus musculus
agtgattcctatctgctttactgcc

SEQ ID NO: 214814 - DNA, 25 bp, Mus musculus
agtgattcctatgtgctttactgcc

SEQ ID NO: 214815 - DNA, 25 bp, Mus musculus
agtgattcctcaattactgttttaa

SEQ ID NO: 214816 - DNA, 25 bp, Mus musculus
agtgattcctcatttactgttttaa

SEQ ID NO: 214817 - DNA, 25 bp, Mus musculus
agtgattccttgaccagtgagctgc

SEQ ID NO: 214818 - DNA, 25 bp, Mus musculus
agtgattccttgtccagtgagctgc

SEQ ID NO: 214819 - DNA, 25 bp, Mus musculus
agtgattcggaacccgcgactgtta

SEQ ID NO: 214820 - DNA, 25 bp, Mus musculus
agtgattcggaagccgcgactgtta

SEQ ID NO: 214821 - DNA, 25 bp, Mus musculus
agtgattctgtcagcctatgatgag

SEQ ID NO: 214822 - DNA, 25 bp, Mus musculus
agtgattctgtctgcctatgatgag

SEQ ID NO: 214823 - DNA, 25 bp, Mus musculus
agtgattcttaacccagtgtgcttc

SEQ ID NO: 214824 - DNA, 25 bp, Mus musculus
agtgattcttaagccagtgtgcttc

SEQ ID NO: 214825 - DNA, 25 bp, Mus musculus
agtgattcttgcaggtcctaaccaa

SEQ ID NO: 214826 - DNA, 25 bp, Mus musculus
agtgattcttgctggtcctaaccaa

SEQ ID NO: 214827 - DNA, 25 bp, Mus musculus
agtgattgccctcctacacaaagca

SEQ ID NO: 214828 - DNA, 25 bp, Mus musculus
agtgattgccctgctacacaaagca

SEQ ID NO: 214829 - DNA, 25 bp, Mus musculus
agtgattgctaacctctgaccagaa

SEQ ID NO: 214830 - DNA, 25 bp, Mus musculus
agtgattgctaagctctgaccagaa

SEQ ID NO: 214831 - DNA, 25 bp, Mus musculus
agtgattgctctccggagtccatca

SEQ ID NO: 214832 - DNA, 25 bp, Mus musculus
agtgattgctctgcggagtccatca

SEQ ID NO: 214833 - DNA, 25 bp, Mus musculus
agtgattgctgcctgtatcacagct

SEQ ID NO: 214834 - DNA, 25 bp, Mus musculus
agtgattgctgcgtgtatcacagct

SEQ ID NO: 214835 - DNA, 25 bp, Mus musculus
agtgattgctgtaactgaatgttgc

SEQ ID NO: 214836 - DNA, 25 bp, Mus musculus
agtgattgctgttactgaatgttgc

SEQ ID NO: 214837 - DNA, 25 bp, Mus musculus
agtgattggacaccagctgcgctcc

SEQ ID NO: 214838 - DNA, 25 bp, Mus musculus
agtgattggacagcagctgcgctcc

SEQ ID NO: 214839 - DNA, 25 bp, Mus musculus
agtgattggccactcgaagcatccc

SEQ ID NO: 214840 - DNA, 25 bp, Mus musculus
agtgattggccagtcgaagcatccc

SEQ ID NO: 214841 - DNA, 25 bp, Mus musculus
agtgattggctcacgacagctcagc

SEQ ID NO: 214842 - DNA, 25 bp, Mus musculus
agtgattggctctcgacagctcagc

SEQ ID NO: 214843 - DNA, 25 bp, Mus musculus
agtgattgtgatcctattctgtaat

SEQ ID NO: 214844 - DNA, 25 bp, Mus musculus
agtgattgtgatgctattctgtaat

SEQ ID NO: 214845 - DNA, 25 bp, Mus musculus
agtgatttaaagactctgcctccct

SEQ ID NO: 214846 - DNA, 25 bp, Mus musculus
agtgatttaaagtctctgcctccct

SEQ ID NO: 214847 - DNA, 25 bp, Mus musculus
agtgatttacctctgccgacgggac

SEQ ID NO: 214848 - DNA, 25 bp, Mus musculus
agtgatttacctgtgccgacgggac

SEQ ID NO: 214849 - DNA, 25 bp, Mus musculus
agtgatttctccctctaatcgcaat

SEQ ID NO: 214850 - DNA, 25 bp, Mus musculus
agtgatttctccgtctaatcgcaat

SEQ ID NO: 214851 - DNA, 25 bp, Mus musculus
agtgatttgcaacgcaatggagcga

SEQ ID NO: 214852 - DNA, 25 bp, Mus musculus
agtgatttgcaaggcaatggagcga

SEQ ID NO: 214853 - DNA, 25 bp, Mus musculus
agtgatttgtccatcatgtcttcag

SEQ ID NO: 214854 - DNA, 25 bp, Mus musculus
agtgatttgtccttcatgtcttcag

SEQ ID NO: 214855 - DNA, 25 bp, Mus musculus
agtgattttatccatggcaggctca

SEQ ID NO: 214856 - DNA, 25 bp, Mus musculus
agtgattttatcgatggcaggctca

SEQ ID NO: 214857 - DNA, 25 bp, Mus musculus
agtgattttctgctcctaagctgca

SEQ ID NO: 214858 - DNA, 25 bp, Mus musculus
agtgattttctggtcctaagctgca

SEQ ID NO: 214859 - DNA, 25 bp, Mus musculus
agtgcaaaaccaaagcctgtctgtc

SEQ ID NO: 214860 - DNA, 25 bp, Mus musculus
agtgcaaaaccatagcctgtctgtc

SEQ ID NO: 214861 - DNA, 25 bp, Mus musculus
agtgcaaagggtccctcaaagatat

SEQ ID NO: 214862 - DNA, 25 bp, Mus musculus
agtgcaaagggtgcctcaaagatat

SEQ ID NO: 214863 - DNA, 25 bp, Mus musculus
agtgcaaagtgcagtcttgcctcct

SEQ ID NO: 214864 - DNA, 25 bp, Mus musculus
agtgcaaagtgctgtcttgcctcct

SEQ ID NO: 214865 - DNA, 25 bp, Mus musculus
agtgcaaagttgaattcattgtact

SEQ ID NO: 214866 - DNA, 25 bp, Mus musculus
agtgcaaagttgtattcattgtact

SEQ ID NO: 214867 - DNA, 25 bp, Mus musculus
agtgcaacacaccaagtatttttac

SEQ ID NO: 214868 - DNA, 25 bp, Mus musculus
agtgcaacacacgaagtatttttac

SEQ ID NO: 214869 - DNA, 25 bp, Mus musculus
agtgcaacacttaggagcaaaggca

SEQ ID NO: 214870 - DNA, 25 bp, Mus musculus
agtgcaacactttggagcaaaggca

SEQ ID NO: 214871 - DNA, 25 bp, Mus musculus
agtgcaaccagtcgactcgcgtggc

SEQ ID NO: 214872 - DNA, 25 bp, Mus musculus
agtgcaaccagtggactcgcgtggc

SEQ ID NO: 214873 - DNA, 25 bp, Mus musculus
agtgcaacccagcaaggcttctttt

SEQ ID NO: 214874 - DNA, 25 bp, Mus musculus
agtgcaacccaggaaggcttctttt

SEQ ID NO: 214875 - DNA, 25 bp, Mus musculus
agtgcaaccggcctatcagagattg

SEQ ID NO: 214876 - DNA, 25 bp, Mus musculus
agtgcaaccggcgtatcagagattg

SEQ ID NO: 214877 - DNA, 25 bp, Mus musculus
agtgcaactcaaccgttacatcagt

SEQ ID NO: 214878 - DNA, 25 bp, Mus musculus
agtgcaactcaagcgttacatcagt

SEQ ID NO: 214879 - DNA, 25 bp, Mus musculus
agtgcaactgcccagaccttgactt

SEQ ID NO: 214880 - DNA, 25 bp, Mus musculus
agtgcaactgccgagaccttgactt

SEQ ID NO: 214881 - DNA, 25 bp, Mus musculus
agtgcaacttgcctatcatcttctc

SEQ ID NO: 214882 - DNA, 25 bp, Mus musculus
agtgcaacttgcgtatcatcttctc

SEQ ID NO: 214883 - DNA, 25 bp, Mus musculus
agtgcaactttcctcaggctttggc

SEQ ID NO: 214884 - DNA, 25 bp, Mus musculus
agtgcaactttcgtcaggctttggc

SEQ ID NO: 214885 - DNA, 25 bp, Mus musculus
agtgcaagaacaatgaacctggctg

SEQ ID NO: 214886 - DNA, 25 bp, Mus musculus
agtgcaagaacattgaacctggctg

SEQ ID NO: 214887 - DNA, 25 bp, Mus musculus
agtgcaagaagcctcttcctatcat

SEQ ID NO: 214888 - DNA, 25 bp, Mus musculus
agtgcaagaagcgtcttcctatcat

SEQ ID NO: 214889 - DNA, 25 bp, Mus musculus
agtgcaagacggaccctgactcctt

SEQ ID NO: 214890 - DNA, 25 bp, Mus musculus
agtgcaagacggtccctgactcctt

SEQ ID NO: 214891 - DNA, 25 bp, Mus musculus
agtgcaagactcagtagcctacctt

SEQ ID NO: 214892 - DNA, 25 bp, Mus musculus
agtgcaagactctgtagcctacctt

SEQ ID NO: 214893 - DNA, 25 bp, Mus musculus
agtgcaagagccctgcatttttaaa

SEQ ID NO: 214894 - DNA, 25 bp, Mus musculus
agtgcaagagccgtgcatttttaaa

SEQ ID NO: 214895 - DNA, 25 bp, Mus musculus
agtgcaagaggtacacccgtcagca

SEQ ID NO: 214896 - DNA, 25 bp, Mus musculus
agtgcaagaggttcacccgtcagca

SEQ ID NO: 214897 - DNA, 25 bp, Mus musculus
agtgcaagccagagcgaggcctcgt

SEQ ID NO: 214898 - DNA, 25 bp, Mus musculus
agtgcaagccagtgcgaggcctcgt

SEQ ID NO: 214899 - DNA, 25 bp, Mus musculus
agtgcaagccgtacaggagagactt

SEQ ID NO: 214900 - DNA, 25 bp, Mus musculus
agtgcaagccgttcaggagagactt

SEQ ID NO: 214901 - DNA, 25 bp, Mus musculus
agtgcaagcgagacagcttccccaa

SEQ ID NO: 214902 - DNA, 25 bp, Mus musculus
agtgcaagcgagtcagcttccccaa

SEQ ID NO: 214903 - DNA, 25 bp, Mus musculus
agtgcaagctgccttactctctgtt

SEQ ID NO: 214904 - DNA, 25 bp, Mus musculus
agtgcaagctgcgttactctctgtt

SEQ ID NO: 214905 - DNA, 25 bp, Mus musculus
agtgcaaggaagcatgggcccctcc

SEQ ID NO: 214906 - DNA, 25 bp, Mus musculus
agtgcaaggaaggatgggcccctcc

SEQ ID NO: 214907 - DNA, 25 bp, Mus musculus
agtgcaatactgagtgtgcctcatt

SEQ ID NO: 214908 - DNA, 25 bp, Mus musculus
agtgcaatactgtgtgtgcctcatt

SEQ ID NO: 214909 - DNA, 25 bp, Mus musculus
agtgcaatcagtctttctgcgctct

SEQ ID NO: 214910 - DNA, 25 bp, Mus musculus
agtgcaatcagtgtttctgcgctct

SEQ ID NO: 214911 - DNA, 25 bp, Mus musculus
agtgcaatcattatagcctcgcttc

SEQ ID NO: 214912 - DNA, 25 bp, Mus musculus
agtgcaatcattttagcctcgcttc

SEQ ID NO: 214913 - DNA, 25 bp, Mus musculus
agtgcaatccgtaaacatccgacct

SEQ ID NO: 214914 - DNA, 25 bp, Mus musculus
agtgcaatccgttaacatccgacct

SEQ ID NO: 214915 - DNA, 25 bp, Mus musculus
agtgcaatgcaaaggctcacgccat

SEQ ID NO: 214916 - DNA, 25 bp, Mus musculus
agtgcaatgcaatggctcacgccat

SEQ ID NO: 214917 - DNA, 25 bp, Mus musculus
agtgcaatgcctagtttcttcatga

SEQ ID NO: 214918 - DNA, 25 bp, Mus musculus
agtgcaatgccttgtttcttcatga

SEQ ID NO: 214919 - DNA, 25 bp, Mus musculus
agtgcaatggccacaggtggtgtct

SEQ ID NO: 214920 - DNA, 25 bp, Mus musculus
agtgcaatggcctcaggtggtgtct

SEQ ID NO: 214921 - DNA, 25 bp, Mus musculus
agtgcaattctcacattgtctatta

SEQ ID NO: 214922 - DNA, 25 bp, Mus musculus
agtgcaattctctcattgtctatta

SEQ ID NO: 214923 - DNA, 25 bp, Mus musculus
agtgcaattgaactaaccccttctc

SEQ ID NO: 214924 - DNA, 25 bp, Mus musculus
agtgcaattgaagtaaccccttctc

SEQ ID NO: 214925 - DNA, 25 bp, Mus musculus
agtgcaatttccatcaccatgaatg

SEQ ID NO: 214926 - DNA, 25 bp, Mus musculus
agtgcaatttccttcaccatgaatg

SEQ ID NO: 214927 - DNA, 25 bp, Mus musculus
agtgcacaacctatcattttccttc

SEQ ID NO: 214928 - DNA, 25 bp, Mus musculus
agtgcacaacctttcattttccttc

SEQ ID NO: 214929 - DNA, 25 bp, Mus musculus
agtgcacaatgaaaggtttccccaa

SEQ ID NO: 214930 - DNA, 25 bp, Mus musculus
agtgcacaatgataggtttccccaa

SEQ ID NO: 214931 - DNA, 25 bp, Mus musculus
agtgcacacaatcttcctggagaat

SEQ ID NO: 214932 - DNA, 25 bp, Mus musculus
agtgcacacaatgttcctggagaat

SEQ ID NO: 214933 - DNA, 25 bp, Mus musculus
agtgcacacatcacactagtctatc

SEQ ID NO: 214934 - DNA, 25 bp, Mus musculus
agtgcacacatctcactagtctatc

SEQ ID NO: 214935 - DNA, 25 bp, Mus musculus
agtgcacacctgatctagtttgggc

SEQ ID NO: 214936 - DNA, 25 bp, Mus musculus
agtgcacacctgttctagtttgggc

SEQ ID NO: 214937 - DNA, 25 bp, Mus musculus
agtgcacacgtgaggacacgtactg

SEQ ID NO: 214938 - DNA, 25 bp, Mus musculus
agtgcacacgtgtggacacgtactg

SEQ ID NO: 214939 - DNA, 25 bp, Mus musculus
agtgcacactaacacacgctgcagg

SEQ ID NO: 214940 - DNA, 25 bp, Mus musculus
agtgcacactaagacacgctgcagg

SEQ ID NO: 214941 - DNA, 25 bp, Mus musculus
agtgcacacttacacatggctcagc

SEQ ID NO: 214942 - DNA, 25 bp, Mus musculus
agtgcacacttagacatggctcagc

SEQ ID NO: 214943 - DNA, 25 bp, Mus musculus
agtgcacactttctctcattccttt

SEQ ID NO: 214944 - DNA, 25 bp, Mus musculus
agtgcacactttgtctcattccttt

SEQ ID NO: 214945 - DNA, 25 bp, Mus musculus
agtgcacagagaccccttctgatga

SEQ ID NO: 214946 - DNA, 25 bp, Mus musculus
agtgcacagagagcccttctgatga

SEQ ID NO: 214947 - DNA, 25 bp, Mus musculus
agtgcacaggacagcggagacctta

SEQ ID NO: 214948 - DNA, 25 bp, Mus musculus
agtgcacaggactgcggagacctta

SEQ ID NO: 214949 - DNA, 25 bp, Mus musculus
agtgcacagggtctctacatcaagt

SEQ ID NO: 214950 - DNA, 25 bp, Mus musculus
agtgcacagggtgtctacatcaagt

SEQ ID NO: 214951 - DNA, 25 bp, Mus musculus
agtgcacaggtgaggtgactccaaa

SEQ ID NO: 214952 - DNA, 25 bp, Mus musculus
agtgcacaggtgtggtgactccaaa

SEQ ID NO: 214953 - DNA, 25 bp, Mus musculus
agtgcacagtcgctcccctaagaat

SEQ ID NO: 214954 - DNA, 25 bp, Mus musculus
agtgcacagtcggtcccctaagaat

SEQ ID NO: 214955 - DNA, 25 bp, Mus musculus
agtgcacatctgacagcgtggagga

SEQ ID NO: 214956 - DNA, 25 bp, Mus musculus
agtgcacatctgtcagcgtggagga

SEQ ID NO: 214957 - DNA, 25 bp, Mus musculus
agtgcacatgcaaacctactcagat

SEQ ID NO: 214958 - DNA, 25 bp, Mus musculus
agtgcacatgcatacctactcagat

SEQ ID NO: 214959 - DNA, 25 bp, Mus musculus
agtgcacatgccaccagcatgctag

SEQ ID NO: 214960 - DNA, 25 bp, Mus musculus
agtgcacatgcctccagcatgctag

SEQ ID NO: 214961 - DNA, 25 bp, Mus musculus
agtgcacatgtgctgcgtcagaaat

SEQ ID NO: 214962 - DNA, 25 bp, Mus musculus
agtgcacatgtggtgcgtcagaaat

SEQ ID NO: 214963 - DNA, 25 bp, Mus musculus
agtgcacattgcattctggaccaac

SEQ ID NO: 214964 - DNA, 25 bp, Mus musculus
agtgcacattgctttctggaccaac

SEQ ID NO: 214965 - DNA, 25 bp, Mus musculus
agtgcaccacacatgtgtcttacag

SEQ ID NO: 214966 - DNA, 25 bp, Mus musculus
agtgcaccacacttgtgtcttacag

SEQ ID NO: 214967 - DNA, 25 bp, Mus musculus
agtgcaccagcacgtcctttggctc

SEQ ID NO: 214968 - DNA, 25 bp, Mus musculus
agtgcaccagcaggtcctttggctc

SEQ ID NO: 214969 - DNA, 25 bp, Mus musculus
agtgcaccaggtagtacccattaga

SEQ ID NO: 214970 - DNA, 25 bp, Mus musculus
agtgcaccaggttgtacccattaga

SEQ ID NO: 214971 - DNA, 25 bp, Mus musculus
agtgcacccatcaatgagttccggt

SEQ ID NO: 214972 - DNA, 25 bp, Mus musculus
agtgcacccatctatgagttccggt

SEQ ID NO: 214973 - DNA, 25 bp, Mus musculus
agtgcacccatgcttggtacccaaa

SEQ ID NO: 214974 - DNA, 25 bp, Mus musculus
agtgcacccatggttggtacccaaa

SEQ ID NO: 214975 - DNA, 25 bp, Mus musculus
agtgcaccccaactatctaaagttt

SEQ ID NO: 214976 - DNA, 25 bp, Mus musculus
agtgcaccccaagtatctaaagttt

SEQ ID NO: 214977 - DNA, 25 bp, Mus musculus
agtgcaccccttcttccacattgat

SEQ ID NO: 214978 - DNA, 25 bp, Mus musculus
agtgcaccccttgttccacattgat

SEQ ID NO: 214979 - DNA, 25 bp, Mus musculus
agtgcacccgcaccattgagacagg

SEQ ID NO: 214980 - DNA, 25 bp, Mus musculus
agtgcacccgcagcattgagacagg

SEQ ID NO: 214981 - DNA, 25 bp, Mus musculus
agtgcaccctgaaaccagggcacaa

SEQ ID NO: 214982 - DNA, 25 bp, Mus musculus
agtgcaccctgataccagggcacaa

SEQ ID NO: 214983 - DNA, 25 bp, Mus musculus
agtgcaccgaaacctccccagggag

SEQ ID NO: 214984 - DNA, 25 bp, Mus musculus
agtgcaccgaaagctccccagggag

SEQ ID NO: 214985 - DNA, 25 bp, Mus musculus
agtgcaccgtggagcagcagtcagt

SEQ ID NO: 214986 - DNA, 25 bp, Mus musculus
agtgcaccgtggtgcagcagtcagt

SEQ ID NO: 214987 - DNA, 25 bp, Mus musculus
agtgcacctgtgcagatgcatgccg

SEQ ID NO: 214988 - DNA, 25 bp, Mus musculus
agtgcacctgtggagatgcatgccg

SEQ ID NO: 214989 - DNA, 25 bp, Mus musculus
agtgcaccttccatgccagggcagt

SEQ ID NO: 214990 - DNA, 25 bp, Mus musculus
agtgcaccttccttgccagggcagt

SEQ ID NO: 214991 - DNA, 25 bp, Mus musculus
agtgcacgaggccaccagagacaaa

SEQ ID NO: 214992 - DNA, 25 bp, Mus musculus
agtgcacgaggcgaccagagacaaa

SEQ ID NO: 214993 - DNA, 25 bp, Mus musculus
agtgcacgcgcccatgactggccag

SEQ ID NO: 214994 - DNA, 25 bp, Mus musculus
agtgcacgcgccgatgactggccag

SEQ ID NO: 214995 - DNA, 25 bp, Mus musculus
agtgcacgttgtagtgtccacctcc

SEQ ID NO: 214996 - DNA, 25 bp, Mus musculus
agtgcacgttgttgtgtccacctcc

SEQ ID NO: 214997 - DNA, 25 bp, Mus musculus
agtgcactcagacatgacccctttt

SEQ ID NO: 214998 - DNA, 25 bp, Mus musculus
agtgcactcagagatgacccctttt

SEQ ID NO: 214999 - DNA, 25 bp, Mus musculus
agtgcactccccaacgcacatgtgt

SEQ ID NO: 215000 - DNA, 25 bp, Mus musculus
agtgcactcccctacgcacatgtgt

SEQ ID NO: 215001 - DNA, 25 bp, Mus musculus
agtgcactcctaccaacctggtaac

SEQ ID NO: 215002 - DNA, 25 bp, Mus musculus
agtgcactcctagcaacctggtaac

SEQ ID NO: 215003 - DNA, 25 bp, Mus musculus
agtgcactcctcatttcatgaatgc

SEQ ID NO: 215004 - DNA, 25 bp, Mus musculus
agtgcactcctcttttcatgaatgc

SEQ ID NO: 215005 - DNA, 25 bp, Mus musculus
agtgcactcggacccagccggaagt

SEQ ID NO: 215006 - DNA, 25 bp, Mus musculus
agtgcactcggagccagccggaagt

SEQ ID NO: 215007 - DNA, 25 bp, Mus musculus
agtgcactctgaaatccagcctgga

SEQ ID NO: 215008 - DNA, 25 bp, Mus musculus
agtgcactctgatatccagcctgga

SEQ ID NO: 215009 - DNA, 25 bp, Mus musculus
agtgcactctttacagttggaccct

SEQ ID NO: 215010 - DNA, 25 bp, Mus musculus
agtgcactcttttcagttggaccct

SEQ ID NO: 215011 - DNA, 25 bp, Mus musculus
agtgcactgagcagactgtcttaac

SEQ ID NO: 215012 - DNA, 25 bp, Mus musculus
agtgcactgagctgactgtcttaac

SEQ ID NO: 215013 - DNA, 25 bp, Mus musculus
agtgcactgtgacttgttcttcaga

SEQ ID NO: 215014 - DNA, 25 bp, Mus musculus
agtgcactgtgagttgttcttcaga

SEQ ID NO: 215015 - DNA, 25 bp, Mus musculus
agtgcactgtggccttcggagacca

SEQ ID NO: 215016 - DNA, 25 bp, Mus musculus
agtgcactgtgggcttcggagacca

SEQ ID NO: 215017 - DNA, 25 bp, Mus musculus
agtgcacttccacccagagttgctc

SEQ ID NO: 215018 - DNA, 25 bp, Mus musculus
agtgcacttccagccagagttgctc

SEQ ID NO: 215019 - DNA, 25 bp, Mus musculus
agtgcacttgatataaccctgctca

SEQ ID NO: 215020 - DNA, 25 bp, Mus musculus
agtgcacttgatttaaccctgctca

SEQ ID NO: 215021 - DNA, 25 bp, Mus musculus
agtgcacttggccttcacagatctg

SEQ ID NO: 215022 - DNA, 25 bp, Mus musculus
agtgcacttggcgttcacagatctg

SEQ ID NO: 215023 - DNA, 25 bp, Mus musculus
agtgcacttgttaacttgtggttac

SEQ ID NO: 215024 - DNA, 25 bp, Mus musculus
agtgcacttgtttacttgtggttac

SEQ ID NO: 215025 - DNA, 25 bp, Mus musculus
agtgcagaaatcatggaccttgtaa

SEQ ID NO: 215026 - DNA, 25 bp, Mus musculus
agtgcagaaatcttggaccttgtaa

SEQ ID NO: 215027 - DNA, 25 bp, Mus musculus
agtgcagaagatcaaaccccgggtc

SEQ ID NO: 215028 - DNA, 25 bp, Mus musculus
agtgcagaagatgaaaccccgggtc

SEQ ID NO: 215029 - DNA, 25 bp, Mus musculus
agtgcagaatatcggtcagctcttc

SEQ ID NO: 215030 - DNA, 25 bp, Mus musculus
agtgcagaatatgggtcagctcttc

SEQ ID NO: 215031 - DNA, 25 bp, Mus musculus
agtgcagacaccatgagtgtgtata

SEQ ID NO: 215032 - DNA, 25 bp, Mus musculus
agtgcagacaccttgagtgtgtata

SEQ ID NO: 215033 - DNA, 25 bp, Mus musculus
agtgcagaccaactgtgttttctta

SEQ ID NO: 215034 - DNA, 25 bp, Mus musculus
agtgcagaccaagtgtgttttctta

SEQ ID NO: 215035 - DNA, 25 bp, Mus musculus
agtgcagacggcctgatctctctgc

SEQ ID NO: 215036 - DNA, 25 bp, Mus musculus
agtgcagacggcgtgatctctctgc

SEQ ID NO: 215037 - DNA, 25 bp, Mus musculus
agtgcagacgggacttgacctctta

SEQ ID NO: 215038 - DNA, 25 bp, Mus musculus
agtgcagacgggtcttgacctctta

SEQ ID NO: 215039 - DNA, 25 bp, Mus musculus
agtgcagagcagagtgtccaccgag

SEQ ID NO: 215040 - DNA, 25 bp, Mus musculus
agtgcagagcagtgtgtccaccgag

SEQ ID NO: 215041 - DNA, 25 bp, Mus musculus
agtgcagagttcacagcctccgagg

SEQ ID NO: 215042 - DNA, 25 bp, Mus musculus
agtgcagagttctcagcctccgagg

SEQ ID NO: 215043 - DNA, 25 bp, Mus musculus
agtgcagatacaatccacctgctgc

SEQ ID NO: 215044 - DNA, 25 bp, Mus musculus
agtgcagatacattccacctgctgc

SEQ ID NO: 215045 - DNA, 25 bp, Mus musculus
agtgcagcaccaccactcaaagtga

SEQ ID NO: 215046 - DNA, 25 bp, Mus musculus
agtgcagcaccagcactcaaagtga

SEQ ID NO: 215047 - DNA, 25 bp, Mus musculus
agtgcagcacttacaggcccaagaa

SEQ ID NO: 215048 - DNA, 25 bp, Mus musculus
agtgcagcactttcaggcccaagaa

SEQ ID NO: 215049 - DNA, 25 bp, Mus musculus
agtgcagcagatcatcgggcagatc

SEQ ID NO: 215050 - DNA, 25 bp, Mus musculus
agtgcagcagatgatcgggcagatc

SEQ ID NO: 215051 - DNA, 25 bp, Mus musculus
agtgcagcagctctgagccctttgc

SEQ ID NO: 215052 - DNA, 25 bp, Mus musculus
agtgcagcagctgtgagccctttgc

SEQ ID NO: 215053 - DNA, 25 bp, Mus musculus
agtgcagcatctatcattcaatatg

SEQ ID NO: 215054 - DNA, 25 bp, Mus musculus
agtgcagcatctttcattcaatatg

SEQ ID NO: 215055 - DNA, 25 bp, Mus musculus
agtgcagcgaagaccctctggaaca

SEQ ID NO: 215056 - DNA, 25 bp, Mus musculus
agtgcagcgaagtccctctggaaca

SEQ ID NO: 215057 - DNA, 25 bp, Mus musculus
agtgcagcgcctatgaggctctggg

SEQ ID NO: 215058 - DNA, 25 bp, Mus musculus
agtgcagcgcctttgaggctctggg

SEQ ID NO: 215059 - DNA, 25 bp, Mus musculus
agtgcagcgtgcaagcagacaggca

SEQ ID NO: 215060 - DNA, 25 bp, Mus musculus
agtgcagcgtgctagcagacaggca

SEQ ID NO: 215061 - DNA, 25 bp, Mus musculus
agtgcagctaagctgccagggccat

SEQ ID NO: 215062 - DNA, 25 bp, Mus musculus
agtgcagctaaggtgccagggccat

SEQ ID NO: 215063 - DNA, 25 bp, Mus musculus
agtgcagctaatccctgtgtatcca

SEQ ID NO: 215064 - DNA, 25 bp, Mus musculus
agtgcagctaatgcctgtgtatcca

SEQ ID NO: 215065 - DNA, 25 bp, Mus musculus
agtgcagctactcctgttccagcaa

SEQ ID NO: 215066 - DNA, 25 bp, Mus musculus
agtgcagctactgctgttccagcaa

SEQ ID NO: 215067 - DNA, 25 bp, Mus musculus
agtgcagctagaaccacccaacttt

SEQ ID NO: 215068 - DNA, 25 bp, Mus musculus
agtgcagctagatccacccaacttt

SEQ ID NO: 215069 - DNA, 25 bp, Mus musculus
agtgcagctccaagtaaacctacag

SEQ ID NO: 215070 - DNA, 25 bp, Mus musculus
agtgcagctccatgtaaacctacag

SEQ ID NO: 215071 - DNA, 25 bp, Mus musculus
agtgcagctggacaggctagcctca

SEQ ID NO: 215072 - DNA, 25 bp, Mus musculus
agtgcagctggagaggctagcctca

SEQ ID NO: 215073 - DNA, 25 bp, Mus musculus
agtgcagctggcagtttgatcgcaa

SEQ ID NO: 215074 - DNA, 25 bp, Mus musculus
agtgcagctggctgtttgatcgcaa

SEQ ID NO: 215075 - DNA, 25 bp, Mus musculus
agtgcagcttctagtgtgccttgta

SEQ ID NO: 215076 - DNA, 25 bp, Mus musculus
agtgcagcttcttgtgtgccttgta

SEQ ID NO: 215077 - DNA, 25 bp, Mus musculus
agtgcaggaaaccagctccgtcttt

SEQ ID NO: 215078 - DNA, 25 bp, Mus musculus
agtgcaggaaacgagctccgtcttt

SEQ ID NO: 215079 - DNA, 25 bp, Mus musculus
agtgcaggcaacctggatggcctat

SEQ ID NO: 215080 - DNA, 25 bp, Mus musculus
agtgcaggcaacgtggatggcctat

SEQ ID NO: 215081 - DNA, 25 bp, Mus musculus
agtgcaggccagaccgtgctaatgc

SEQ ID NO: 215082 - DNA, 25 bp, Mus musculus
agtgcaggccagtccgtgctaatgc

SEQ ID NO: 215083 - DNA, 25 bp, Mus musculus
agtgcaggccccagagcaagactgt

SEQ ID NO: 215084 - DNA, 25 bp, Mus musculus
agtgcaggcccctgagcaagactgt

SEQ ID NO: 215085 - DNA, 25 bp, Mus musculus
agtgcagggaacctttagtccagca

SEQ ID NO: 215086 - DNA, 25 bp, Mus musculus
agtgcagggaacgtttagtccagca

SEQ ID NO: 215087 - DNA, 25 bp, Mus musculus
agtgcaggtcctcagggtttgaccc

SEQ ID NO: 215088 - DNA, 25 bp, Mus musculus
agtgcaggtcctgagggtttgaccc

SEQ ID NO: 215089 - DNA, 25 bp, Mus musculus
agtgcaggtgccatttgaagccaga

SEQ ID NO: 215090 - DNA, 25 bp, Mus musculus
agtgcaggtgccttttgaagccaga

SEQ ID NO: 215091 - DNA, 25 bp, Mus musculus
agtgcaggttctagcttttgcctaa

SEQ ID NO: 215092 - DNA, 25 bp, Mus musculus
agtgcaggttcttgcttttgcctaa

SEQ ID NO: 215093 - DNA, 25 bp, Mus musculus
agtgcagtacttcgaaattgttctt

SEQ ID NO: 215094 - DNA, 25 bp, Mus musculus
agtgcagtacttggaaattgttctt

SEQ ID NO: 215095 - DNA, 25 bp, Mus musculus
agtgcagtagctccctgtgatccca

SEQ ID NO: 215096 - DNA, 25 bp, Mus musculus
agtgcagtagctgcctgtgatccca

SEQ ID NO: 215097 - DNA, 25 bp, Mus musculus
agtgcagtagttactttcagacccc

SEQ ID NO: 215098 - DNA, 25 bp, Mus musculus
agtgcagtagtttctttcagacccc

SEQ ID NO: 215099 - DNA, 25 bp, Mus musculus
agtgcagtatgtcttctagttcctt

SEQ ID NO: 215100 - DNA, 25 bp, Mus musculus
agtgcagtatgtgttctagttcctt

SEQ ID NO: 215101 - DNA, 25 bp, Mus musculus
agtgcagtcacactcaggcagctga

SEQ ID NO: 215102 - DNA, 25 bp, Mus musculus
agtgcagtcacagtcaggcagctga

SEQ ID NO: 215103 - DNA, 25 bp, Mus musculus
agtgcagtcattaatacacctactt

SEQ ID NO: 215104 - DNA, 25 bp, Mus musculus
agtgcagtcattatcttggttatca

SEQ ID NO: 215105 - DNA, 25 bp, Mus musculus
agtgcagtcatttatacacctactt

SEQ ID NO: 215106 - DNA, 25 bp, Mus musculus
agtgcagtcattttcttggttatca

SEQ ID NO: 215107 - DNA, 25 bp, Mus musculus
agtgcagtgatacgcaacttgtgga

SEQ ID NO: 215108 - DNA, 25 bp, Mus musculus
agtgcagtgataggcaacttgtgga

SEQ ID NO: 215109 - DNA, 25 bp, Mus musculus
agtgcagtgcacaccacattgacac

SEQ ID NO: 215110 - DNA, 25 bp, Mus musculus
agtgcagtgcactccacattgacac

SEQ ID NO: 215111 - DNA, 25 bp, Mus musculus
agtgcagtgcagattgccactttcc

SEQ ID NO: 215112 - DNA, 25 bp, Mus musculus
agtgcagtgcagtttgccactttcc

SEQ ID NO: 215113 - DNA, 25 bp, Mus musculus
agtgcagtgctaagattcttaggtt

SEQ ID NO: 215114 - DNA, 25 bp, Mus musculus
agtgcagtgctaatggcgcaggcat

SEQ ID NO: 215115 - DNA, 25 bp, Mus musculus
agtgcagtgctatgattcttaggtt

SEQ ID NO: 215116 - DNA, 25 bp, Mus musculus
agtgcagtgctattggcgcaggcat

SEQ ID NO: 215117 - DNA, 25 bp, Mus musculus
agtgcagtgctcctatacaaaggga

SEQ ID NO: 215118 - DNA, 25 bp, Mus musculus
agtgcagtgctcgtatacaaaggga

SEQ ID NO: 215119 - DNA, 25 bp, Mus musculus
agtgcagtggcgagaaccctggtca

SEQ ID NO: 215120 - DNA, 25 bp, Mus musculus
agtgcagtggcgtgaaccctggtca

SEQ ID NO: 215121 - DNA, 25 bp, Mus musculus
agtgcagtggtaatggtacccgctt

SEQ ID NO: 215122 - DNA, 25 bp, Mus musculus
agtgcagtggtattggtacccgctt

SEQ ID NO: 215123 - DNA, 25 bp, Mus musculus
agtgcagtgtagctttagattcaaa

SEQ ID NO: 215124 - DNA, 25 bp, Mus musculus
agtgcagtgtaggtttagattcaaa

SEQ ID NO: 215125 - DNA, 25 bp, Mus musculus
agtgcagttctcctgcttggacctt

SEQ ID NO: 215126 - DNA, 25 bp, Mus musculus
agtgcagttctcgtgcttggacctt

SEQ ID NO: 215127 - DNA, 25 bp, Mus musculus
agtgcataccacagtcaagctaatt

SEQ ID NO: 215128 - DNA, 25 bp, Mus musculus
agtgcataccactgtcaagctaatt

SEQ ID NO: 215129 - DNA, 25 bp, Mus musculus
agtgcatacgttattgttcagagtg

SEQ ID NO: 215130 - DNA, 25 bp, Mus musculus
agtgcatacgtttttgttcagagtg

SEQ ID NO: 215131 - DNA, 25 bp, Mus musculus
agtgcatactgcaggcaagccacgt

SEQ ID NO: 215132 - DNA, 25 bp, Mus musculus
agtgcatactgctggcaagccacgt

SEQ ID NO: 215133 - DNA, 25 bp, Mus musculus
agtgcatagcgacagtcctgacgtt

SEQ ID NO: 215134 - DNA, 25 bp, Mus musculus
agtgcatagcgagagtcctgacgtt

SEQ ID NO: 215135 - DNA, 25 bp, Mus musculus
agtgcatagctaaaccctacgtgta

SEQ ID NO: 215136 - DNA, 25 bp, Mus musculus
agtgcatagctataccctacgtgta

SEQ ID NO: 215137 - DNA, 25 bp, Mus musculus
agtgcatatactccagagcctatgg

SEQ ID NO: 215138 - DNA, 25 bp, Mus musculus
agtgcatatactgcagagcctatgg

SEQ ID NO: 215139 - DNA, 25 bp, Mus musculus
agtgcatatgccacaatgtcatgtg

SEQ ID NO: 215140 - DNA, 25 bp, Mus musculus
agtgcatatgcctcaatgtcatgtg

SEQ ID NO: 215141 - DNA, 25 bp, Mus musculus
agtgcatattctcatttctcctgtg

SEQ ID NO: 215142 - DNA, 25 bp, Mus musculus
agtgcatattctgatttctcctgtg

SEQ ID NO: 215143 - DNA, 25 bp, Mus musculus
agtgcatcattactacttcatcaat

SEQ ID NO: 215144 - DNA, 25 bp, Mus musculus
agtgcatcattagtacttcatcaat

SEQ ID NO: 215145 - DNA, 25 bp, Mus musculus
agtgcatcattgactgctgtcaaga

SEQ ID NO: 215146 - DNA, 25 bp, Mus musculus
agtgcatcattgtctgctgtcaaga

SEQ ID NO: 215147 - DNA, 25 bp, Mus musculus
agtgcatccagaacccatcaagtgg

SEQ ID NO: 215148 - DNA, 25 bp, Mus musculus
agtgcatccagatcccatcaagtgg

SEQ ID NO: 215149 - DNA, 25 bp, Mus musculus
agtgcatccttacttagattcccgg

SEQ ID NO: 215150 - DNA, 25 bp, Mus musculus
agtgcatccttagttagattcccgg

SEQ ID NO: 215151 - DNA, 25 bp, Mus musculus
agtgcatcgcaacctagcctggtgg

SEQ ID NO: 215152 - DNA, 25 bp, Mus musculus
agtgcatcgcaagctagcctggtgg

SEQ ID NO: 215153 - DNA, 25 bp, Mus musculus
agtgcatcgctgagccatggtcttc

SEQ ID NO: 215154 - DNA, 25 bp, Mus musculus
agtgcatcgctgtgccatggtcttc

SEQ ID NO: 215155 - DNA, 25 bp, Mus musculus
agtgcatcgtacaggaagacagggt

SEQ ID NO: 215156 - DNA, 25 bp, Mus musculus
agtgcatcgtactggaagacagggt

SEQ ID NO: 215157 - DNA, 25 bp, Mus musculus
agtgcatcgtttctgtccaacacca

SEQ ID NO: 215158 - DNA, 25 bp, Mus musculus
agtgcatcgtttgtgtccaacacca

SEQ ID NO: 215159 - DNA, 25 bp, Mus musculus
agtgcatctaccactaaacctgaat

SEQ ID NO: 215160 - DNA, 25 bp, Mus musculus
agtgcatctacctctaaacctgaat

SEQ ID NO: 215161 - DNA, 25 bp, Mus musculus
agtgcatctattacatcactacagt

SEQ ID NO: 215162 - DNA, 25 bp, Mus musculus
agtgcatctatttcatcactacagt

SEQ ID NO: 215163 - DNA, 25 bp, Mus musculus
agtgcatctgctcctcagtagatgc

SEQ ID NO: 215164 - DNA, 25 bp, Mus musculus
agtgcatctgctgctcagtagatgc

SEQ ID NO: 215165 - DNA, 25 bp, Mus musculus
agtgcatctttaactcttccatttc

SEQ ID NO: 215166 - DNA, 25 bp, Mus musculus
agtgcatctttatctcttccatttc

SEQ ID NO: 215167 - DNA, 25 bp, Mus musculus
agtgcatgatcgatgtacacagtgg

SEQ ID NO: 215168 - DNA, 25 bp, Mus musculus
agtgcatgatcgttgtacacagtgg

SEQ ID NO: 215169 - DNA, 25 bp, Mus musculus
agtgcatgccccataaactgcgctt

SEQ ID NO: 215170 - DNA, 25 bp, Mus musculus
agtgcatgccccttaaactgcgctt

SEQ ID NO: 215171 - DNA, 25 bp, Mus musculus
agtgcatgctgcactccttgtgagg

SEQ ID NO: 215172 - DNA, 25 bp, Mus musculus
agtgcatgctgctctccttgtgagg

SEQ ID NO: 215173 - DNA, 25 bp, Mus musculus
agtgcatgctgtcccttacgtgagt

SEQ ID NO: 215174 - DNA, 25 bp, Mus musculus
agtgcatgctgtgccttacgtgagt

SEQ ID NO: 215175 - DNA, 25 bp, Mus musculus
agtgcatggattaacccttcctttt

SEQ ID NO: 215176 - DNA, 25 bp, Mus musculus
agtgcatggattatggcttcatcaa

SEQ ID NO: 215177 - DNA, 25 bp, Mus musculus
agtgcatggatttacccttcctttt

SEQ ID NO: 215178 - DNA, 25 bp, Mus musculus
agtgcatggattttggcttcatcaa

SEQ ID NO: 215179 - DNA, 25 bp, Mus musculus
agtgcatggtctccatggccacgcg

SEQ ID NO: 215180 - DNA, 25 bp, Mus musculus
agtgcatggtctgcatggccacgcg

SEQ ID NO: 215181 - DNA, 25 bp, Mus musculus
agtgcatggtgcagcctagcatcct

SEQ ID NO: 215182 - DNA, 25 bp, Mus musculus
agtgcatggtgctgcctagcatcct

SEQ ID NO: 215183 - DNA, 25 bp, Mus musculus
agtgcatggtgtatcaggctggctg

SEQ ID NO: 215184 - DNA, 25 bp, Mus musculus
agtgcatggtgtttcaggctggctg

SEQ ID NO: 215185 - DNA, 25 bp, Mus musculus
agtgcatgtagcctcacatcttgga

SEQ ID NO: 215186 - DNA, 25 bp, Mus musculus
agtgcatgtagcgtcacatcttgga

SEQ ID NO: 215187 - DNA, 25 bp, Mus musculus
agtgcatgtccgattagctcttaaa

SEQ ID NO: 215188 - DNA, 25 bp, Mus musculus
agtgcatgtccgtttagctcttaaa

SEQ ID NO: 215189 - DNA, 25 bp, Mus musculus
agtgcatgtgccagacttggactct

SEQ ID NO: 215190 - DNA, 25 bp, Mus musculus
agtgcatgtgccaggcttggtgcac

SEQ ID NO: 215191 - DNA, 25 bp, Mus musculus
agtgcatgtgcctgacttggactct

SEQ ID NO: 215192 - DNA, 25 bp, Mus musculus
agtgcatgtgcctggcttggtgcac

SEQ ID NO: 215193 - DNA, 25 bp, Mus musculus
agtgcatgtgggaagaggaggagtc

SEQ ID NO: 215194 - DNA, 25 bp, Mus musculus
agtgcatgtgggtagaggaggagtc

SEQ ID NO: 215195 - DNA, 25 bp, Mus musculus
agtgcattatgacaagggtcacacc

SEQ ID NO: 215196 - DNA, 25 bp, Mus musculus
agtgcattatgagaagggtcacacc

SEQ ID NO: 215197 - DNA, 25 bp, Mus musculus
agtgcattcacaatcatctttaaaa

SEQ ID NO: 215198 - DNA, 25 bp, Mus musculus
agtgcattcacattcatctttaaaa

SEQ ID NO: 215199 - DNA, 25 bp, Mus musculus
agtgcattcaggcttaggctcccag

SEQ ID NO: 215200 - DNA, 25 bp, Mus musculus
agtgcattcagggttaggctcccag

SEQ ID NO: 215201 - DNA, 25 bp, Mus musculus
agtgcattccttcagctaattccag

SEQ ID NO: 215202 - DNA, 25 bp, Mus musculus
agtgcattccttgagctaattccag

SEQ ID NO: 215203 - DNA, 25 bp, Mus musculus
agtgcattcgacatgtttttctgta

SEQ ID NO: 215204 - DNA, 25 bp, Mus musculus
agtgcattcgacttgtttttctgta

SEQ ID NO: 215205 - DNA, 25 bp, Mus musculus
agtgcattctgcatcatgcttccat

SEQ ID NO: 215206 - DNA, 25 bp, Mus musculus
agtgcattctgcttcatgcttccat

SEQ ID NO: 215207 - DNA, 25 bp, Mus musculus
agtgcattcttgaatattgtacaca

SEQ ID NO: 215208 - DNA, 25 bp, Mus musculus
agtgcattcttgtatattgtacaca

SEQ ID NO: 215209 - DNA, 25 bp, Mus musculus
agtgcattgcctctctagttattta

SEQ ID NO: 215210 - DNA, 25 bp, Mus musculus
agtgcattgcctgtctagttattta

SEQ ID NO: 215211 - DNA, 25 bp, Mus musculus
agtgcattgcgtctttctgttgagt

SEQ ID NO: 215212 - DNA, 25 bp, Mus musculus
agtgcattgcgtgtttctgttgagt

SEQ ID NO: 215213 - DNA, 25 bp, Mus musculus
agtgcattgctcctttatctctttt

SEQ ID NO: 215214 - DNA, 25 bp, Mus musculus
agtgcattgctcgtttatctctttt

SEQ ID NO: 215215 - DNA, 25 bp, Mus musculus
agtgcattgtaaattgctgccctgc

SEQ ID NO: 215216 - DNA, 25 bp, Mus musculus
agtgcattgtaatttgctgccctgc

SEQ ID NO: 215217 - DNA, 25 bp, Mus musculus
agtgcattgtgacctcctttttggt

SEQ ID NO: 215218 - DNA, 25 bp, Mus musculus
agtgcattgtgagctcctttttggt

SEQ ID NO: 215219 - DNA, 25 bp, Mus musculus
agtgcatttaccactccaaagcatt

SEQ ID NO: 215220 - DNA, 25 bp, Mus musculus
agtgcatttacctctccaaagcatt

SEQ ID NO: 215221 - DNA, 25 bp, Mus musculus
agtgcatttcctccaagcaggcttc

SEQ ID NO: 215222 - DNA, 25 bp, Mus musculus
agtgcatttcctgcaagcaggcttc

SEQ ID NO: 215223 - DNA, 25 bp, Mus musculus
agtgcatttgggacagaaactcgag

SEQ ID NO: 215224 - DNA, 25 bp, Mus musculus
agtgcatttgggtcagaaactcgag

SEQ ID NO: 215225 - DNA, 25 bp, Mus musculus
agtgccaaaggcaacagtttttaat

SEQ ID NO: 215226 - DNA, 25 bp, Mus musculus
agtgccaaaggctacagtttttaat

SEQ ID NO: 215227 - DNA, 25 bp, Mus musculus
agtgccaaaggtacaacttaatgta

SEQ ID NO: 215228 - DNA, 25 bp, Mus musculus
agtgccaaaggtacacttcagtgta

SEQ ID NO: 215229 - DNA, 25 bp, Mus musculus
agtgccaaaggttcaacttaatgta

SEQ ID NO: 215230 - DNA, 25 bp, Mus musculus
agtgccaaaggttcacttcagtgta

SEQ ID NO: 215231 - DNA, 25 bp, Mus musculus
agtgccaaattgcttcgttgcttta

SEQ ID NO: 215232 - DNA, 25 bp, Mus musculus
agtgccaaattggttcgttgcttta

SEQ ID NO: 215233 - DNA, 25 bp, Mus musculus
agtgccaacctgctgtgatggtctt

SEQ ID NO: 215234 - DNA, 25 bp, Mus musculus
agtgccaacctggtgtgatggtctt

SEQ ID NO: 215235 - DNA, 25 bp, Mus musculus
agtgccaacgcgaatctgaccaggt

SEQ ID NO: 215236 - DNA, 25 bp, Mus musculus
agtgccaacgcgtatctgaccaggt

SEQ ID NO: 215237 - DNA, 25 bp, Mus musculus
agtgccaactcccaaagtgtgtatt

SEQ ID NO: 215238 - DNA, 25 bp, Mus musculus
agtgccaactccgaaagtgtgtatt

SEQ ID NO: 215239 - DNA, 25 bp, Mus musculus
agtgccaactctcgatacgtactgt

SEQ ID NO: 215240 - DNA, 25 bp, Mus musculus
agtgccaactctggatacgtactgt

SEQ ID NO: 215241 - DNA, 25 bp, Mus musculus
agtgccaactttagatggctccatt

SEQ ID NO: 215242 - DNA, 25 bp, Mus musculus
agtgccaactttagtttctgtcctc

SEQ ID NO: 215243 - DNA, 25 bp, Mus musculus
agtgccaacttttgatggctccatt

SEQ ID NO: 215244 - DNA, 25 bp, Mus musculus
agtgccaacttttgtttctgtcctc

SEQ ID NO: 215245 - DNA, 25 bp, Mus musculus
agtgccaaggacaggaatcccggat

SEQ ID NO: 215246 - DNA, 25 bp, Mus musculus
agtgccaaggactggaatcccggat

SEQ ID NO: 215247 - DNA, 25 bp, Mus musculus
agtgccaaggagctgatctgcctgt

SEQ ID NO: 215248 - DNA, 25 bp, Mus musculus
agtgccaaggaggtgatctgcctgt

SEQ ID NO: 215249 - DNA, 25 bp, Mus musculus
agtgccaaggcaacttttataaagc

SEQ ID NO: 215250 - DNA, 25 bp, Mus musculus
agtgccaaggcatcttttataaagc

SEQ ID NO: 215251 - DNA, 25 bp, Mus musculus
agtgccaagtcccaggttccacaat

SEQ ID NO: 215252 - DNA, 25 bp, Mus musculus
agtgccaagtccgaggttccacaat

SEQ ID NO: 215253 - DNA, 25 bp, Mus musculus
agtgccaagtgtcgactagcatgat

SEQ ID NO: 215254 - DNA, 25 bp, Mus musculus
agtgccaagtgtggactagcatgat

SEQ ID NO: 215255 - DNA, 25 bp, Mus musculus
agtgccaataatctagtctcaagga

SEQ ID NO: 215256 - DNA, 25 bp, Mus musculus
agtgccaataatgtagtctcaagga

SEQ ID NO: 215257 - DNA, 25 bp, Mus musculus
agtgccaatgagatccaggctgttc

SEQ ID NO: 215258 - DNA, 25 bp, Mus musculus
agtgccaatgagttccaggctgttc

SEQ ID NO: 215259 - DNA, 25 bp, Mus musculus
agtgccaatggcagtggctctgaca

SEQ ID NO: 215260 - DNA, 25 bp, Mus musculus
agtgccaatggctgtggctctgaca

SEQ ID NO: 215261 - DNA, 25 bp, Mus musculus
agtgccaatggtcttgttgccatcc

SEQ ID NO: 215262 - DNA, 25 bp, Mus musculus
agtgccaatggtgttgttgccatcc

SEQ ID NO: 215263 - DNA, 25 bp, Mus musculus
agtgccaatgtcaatgtgcccctgc

SEQ ID NO: 215264 - DNA, 25 bp, Mus musculus
agtgccaatgtctatgtgcccctgc

SEQ ID NO: 215265 - DNA, 25 bp, Mus musculus
agtgccacacacaatccagcagatg

SEQ ID NO: 215266 - DNA, 25 bp, Mus musculus
agtgccacacactatccagcagatg

SEQ ID NO: 215267 - DNA, 25 bp, Mus musculus
agtgccacacttccaacctgaatgg

SEQ ID NO: 215268 - DNA, 25 bp, Mus musculus
agtgccacacttgcaacctgaatgg

SEQ ID NO: 215269 - DNA, 25 bp, Mus musculus
agtgccacagcacagtcctaaggtg

SEQ ID NO: 215270 - DNA, 25 bp, Mus musculus
agtgccacagcagagtcctaaggtg

SEQ ID NO: 215271 - DNA, 25 bp, Mus musculus
agtgccacaggcaaggccgtggaac

SEQ ID NO: 215272 - DNA, 25 bp, Mus musculus
agtgccacaggctaggccgtggaac

SEQ ID NO: 215273 - DNA, 25 bp, Mus musculus
agtgccacaggtcccacagtggttg

SEQ ID NO: 215274 - DNA, 25 bp, Mus musculus
agtgccacaggtgccacagtggttg

SEQ ID NO: 215275 - DNA, 25 bp, Mus musculus
agtgccacagtgcactacactgata

SEQ ID NO: 215276 - DNA, 25 bp, Mus musculus
agtgccacagtggactacactgata

SEQ ID NO: 215277 - DNA, 25 bp, Mus musculus
agtgccacatcccaatcagtaggtc

SEQ ID NO: 215278 - DNA, 25 bp, Mus musculus
agtgccacatccgaatcagtaggtc

SEQ ID NO: 215279 - DNA, 25 bp, Mus musculus
agtgccacatctccttcaagacctt

SEQ ID NO: 215280 - DNA, 25 bp, Mus musculus
agtgccacatctgcttcaagacctt

SEQ ID NO: 215281 - DNA, 25 bp, Mus musculus
agtgccaccaaaccattgtggattt

SEQ ID NO: 215282 - DNA, 25 bp, Mus musculus
agtgccaccaaagcattgtggattt

SEQ ID NO: 215283 - DNA, 25 bp, Mus musculus
agtgccaccaacaccttcaacgaaa

SEQ ID NO: 215284 - DNA, 25 bp, Mus musculus
agtgccaccaacagaagacaggtgt

SEQ ID NO: 215285 - DNA, 25 bp, Mus musculus
agtgccaccaactccttcaacgaaa

SEQ ID NO: 215286 - DNA, 25 bp, Mus musculus
agtgccaccaactgaagacaggtgt

SEQ ID NO: 215287 - DNA, 25 bp, Mus musculus
agtgccaccacccatacgatatgga

SEQ ID NO: 215288 - DNA, 25 bp, Mus musculus
agtgccaccaccgatacgatatgga

SEQ ID NO: 215289 - DNA, 25 bp, Mus musculus
agtgccaccagtctctagaattgta

SEQ ID NO: 215290 - DNA, 25 bp, Mus musculus
agtgccaccagtgtctagaattgta

SEQ ID NO: 215291 - DNA, 25 bp, Mus musculus
agtgccaccgatcctgtgtgacgtg

SEQ ID NO: 215292 - DNA, 25 bp, Mus musculus
agtgccaccgatgctgtgtgacgtg

SEQ ID NO: 215293 - DNA, 25 bp, Mus musculus
agtgccaccggcagagaatccaatc

SEQ ID NO: 215294 - DNA, 25 bp, Mus musculus
agtgccaccggctgagaatccaatc

SEQ ID NO: 215295 - DNA, 25 bp, Mus musculus
agtgccaccttgagcctatgtggaa

SEQ ID NO: 215296 - DNA, 25 bp, Mus musculus
agtgccaccttgtgcctatgtggaa

SEQ ID NO: 215297 - DNA, 25 bp, Mus musculus
agtgccacgccccataagcctatgg

SEQ ID NO: 215298 - DNA, 25 bp, Mus musculus
agtgccacgcccgataagcctatgg

SEQ ID NO: 215299 - DNA, 25 bp, Mus musculus
agtgccacggacaagatagcattga

SEQ ID NO: 215300 - DNA, 25 bp, Mus musculus
agtgccacggactagatagcattga

SEQ ID NO: 215301 - DNA, 25 bp, Mus musculus
agtgccactcacactgcagggttat

SEQ ID NO: 215302 - DNA, 25 bp, Mus musculus
agtgccactcactctgcagggttat

SEQ ID NO: 215303 - DNA, 25 bp, Mus musculus
agtgccactcgtagctgtttggata

SEQ ID NO: 215304 - DNA, 25 bp, Mus musculus
agtgccactcgttgctgtttggata

SEQ ID NO: 215305 - DNA, 25 bp, Mus musculus
agtgccacttaaagtatgttaccaa

SEQ ID NO: 215306 - DNA, 25 bp, Mus musculus
agtgccacttaatgtatgttaccaa

SEQ ID NO: 215307 - DNA, 25 bp, Mus musculus
agtgccagaaagctcagatcttcac

SEQ ID NO: 215308 - DNA, 25 bp, Mus musculus
agtgccagaaaggtcagatcttcac

SEQ ID NO: 215309 - DNA, 25 bp, Mus musculus
agtgccagaagtatgctagctcaga

SEQ ID NO: 215310 - DNA, 25 bp, Mus musculus
agtgccagaagtttgctagctcaga

SEQ ID NO: 215311 - DNA, 25 bp, Mus musculus
agtgccagacacaccagagctgtga

SEQ ID NO: 215312 - DNA, 25 bp, Mus musculus
agtgccagacactccagagctgtga

SEQ ID NO: 215313 - DNA, 25 bp, Mus musculus
agtgccagagagcagttttgcctgc

SEQ ID NO: 215314 - DNA, 25 bp, Mus musculus
agtgccagagaggagttttgcctgc

SEQ ID NO: 215315 - DNA, 25 bp, Mus musculus
agtgccagaggactgtgccacatcc

SEQ ID NO: 215316 - DNA, 25 bp, Mus musculus
agtgccagaggagtgtgccacatcc

SEQ ID NO: 215317 - DNA, 25 bp, Mus musculus
agtgccagagtgctgttgacagtcc

SEQ ID NO: 215318 - DNA, 25 bp, Mus musculus
agtgccagagtggtgttgacagtcc

SEQ ID NO: 215319 - DNA, 25 bp, Mus musculus
agtgccagcaagcactctctgagca

SEQ ID NO: 215320 - DNA, 25 bp, Mus musculus
agtgccagcaaggactctctgagca

SEQ ID NO: 215321 - DNA, 25 bp, Mus musculus
agtgccagcactatgcacctttgct

SEQ ID NO: 215322 - DNA, 25 bp, Mus musculus
agtgccagcactttgcacctttgct

SEQ ID NO: 215323 - DNA, 25 bp, Mus musculus
agtgccagccatagtgctacaggac

SEQ ID NO: 215324 - DNA, 25 bp, Mus musculus
agtgccagccattgtgctacaggac

SEQ ID NO: 215325 - DNA, 25 bp, Mus musculus
agtgccagcgagcacccaccagaga

SEQ ID NO: 215326 - DNA, 25 bp, Mus musculus
agtgccagcgaggacccaccagaga

SEQ ID NO: 215327 - DNA, 25 bp, Mus musculus
agtgccagcggaatgaagcccaacg

SEQ ID NO: 215328 - DNA, 25 bp, Mus musculus
agtgccagcggattgaagcccaacg

SEQ ID NO: 215329 - DNA, 25 bp, Mus musculus
agtgccagctggaggttctttgcca

SEQ ID NO: 215330 - DNA, 25 bp, Mus musculus
agtgccagctggtggttctttgcca

SEQ ID NO: 215331 - DNA, 25 bp, Mus musculus
agtgccaggaccacaacctggttaa

SEQ ID NO: 215332 - DNA, 25 bp, Mus musculus
agtgccaggacctcaacctggttaa

SEQ ID NO: 215333 - DNA, 25 bp, Mus musculus
agtgccaggcagagtgagccactca

SEQ ID NO: 215334 - DNA, 25 bp, Mus musculus
agtgccaggcagtgtgagccactca

SEQ ID NO: 215335 - DNA, 25 bp, Mus musculus
agtgccaggcttccaagacagtgaa

SEQ ID NO: 215336 - DNA, 25 bp, Mus musculus
agtgccaggcttgcaagacagtgaa

SEQ ID NO: 215337 - DNA, 25 bp, Mus musculus
agtgccaggtgcattctgccccatg

SEQ ID NO: 215338 - DNA, 25 bp, Mus musculus
agtgccaggtgctttctgccccatg

SEQ ID NO: 215339 - DNA, 25 bp, Mus musculus
agtgccaggtggagctcaacaggaa

SEQ ID NO: 215340 - DNA, 25 bp, Mus musculus
agtgccaggtggtgctcaacaggaa

SEQ ID NO: 215341 - DNA, 25 bp, Mus musculus
agtgccagtaaaactcagctatgtg

SEQ ID NO: 215342 - DNA, 25 bp, Mus musculus
agtgccagtaaatctcagctatgtg

SEQ ID NO: 215343 - DNA, 25 bp, Mus musculus
agtgccagtcaacaggcctgtcaag

SEQ ID NO: 215344 - DNA, 25 bp, Mus musculus
agtgccagtcaagaggcctgtcaag

SEQ ID NO: 215345 - DNA, 25 bp, Mus musculus
agtgccagtcttactactgcacgag

SEQ ID NO: 215346 - DNA, 25 bp, Mus musculus
agtgccagtctttctactgcacgag

SEQ ID NO: 215347 - DNA, 25 bp, Mus musculus
agtgccagtgataacccttcagtga

SEQ ID NO: 215348 - DNA, 25 bp, Mus musculus
agtgccagtgattacccttcagtga

SEQ ID NO: 215349 - DNA, 25 bp, Mus musculus
agtgccagtgctccataaaccatag

SEQ ID NO: 215350 - DNA, 25 bp, Mus musculus
agtgccagtgctgcataaaccatag

SEQ ID NO: 215351 - DNA, 25 bp, Mus musculus
agtgccagtgtcaaactctccttcg

SEQ ID NO: 215352 - DNA, 25 bp, Mus musculus
agtgccagtgtctaactctccttcg

SEQ ID NO: 215353 - DNA, 25 bp, Mus musculus
agtgccatacccagatccaaagatt

SEQ ID NO: 215354 - DNA, 25 bp, Mus musculus
agtgccataccctgatccaaagatt

SEQ ID NO: 215355 - DNA, 25 bp, Mus musculus
agtgccatatggaaccctgtatttt

SEQ ID NO: 215356 - DNA, 25 bp, Mus musculus
agtgccatatggtaccctgtatttt

SEQ ID NO: 215357 - DNA, 25 bp, Mus musculus
agtgccatatttactgttctccaat

SEQ ID NO: 215358 - DNA, 25 bp, Mus musculus
agtgccatattttctgttctccaat

SEQ ID NO: 215359 - DNA, 25 bp, Mus musculus
agtgccatcaatagtaatgcagtgt

SEQ ID NO: 215360 - DNA, 25 bp, Mus musculus
agtgccatcaattgtaatgcagtgt

SEQ ID NO: 215361 - DNA, 25 bp, Mus musculus
agtgccatcaccagcagttgcttag

SEQ ID NO: 215362 - DNA, 25 bp, Mus musculus
agtgccatcacctgcagttgcttag

SEQ ID NO: 215363 - DNA, 25 bp, Mus musculus
agtgccatccagaatgtctgcccca

SEQ ID NO: 215364 - DNA, 25 bp, Mus musculus
agtgccatccagagtcgatgctgct

SEQ ID NO: 215365 - DNA, 25 bp, Mus musculus
agtgccatccagtatgtctgcccca

SEQ ID NO: 215366 - DNA, 25 bp, Mus musculus
agtgccatccagtgtcgatgctgct

SEQ ID NO: 215367 - DNA, 25 bp, Mus musculus
agtgccatcctgactgccgtcagta

SEQ ID NO: 215368 - DNA, 25 bp, Mus musculus
agtgccatcctgtctgccgtcagta

SEQ ID NO: 215369 - DNA, 25 bp, Mus musculus
agtgccatccttcgaagccagaagc

SEQ ID NO: 215370 - DNA, 25 bp, Mus musculus
agtgccatccttggaagccagaagc

SEQ ID NO: 215371 - DNA, 25 bp, Mus musculus
agtgccatcgagacaggttccagta

SEQ ID NO: 215372 - DNA, 25 bp, Mus musculus
agtgccatcgagtcaggttccagta

SEQ ID NO: 215373 - DNA, 25 bp, Mus musculus
agtgccatctatctgtgctcctttc

SEQ ID NO: 215374 - DNA, 25 bp, Mus musculus
agtgccatctatgtgtgctcctttc

SEQ ID NO: 215375 - DNA, 25 bp, Mus musculus
agtgccatctctaagtgagcgctaa

SEQ ID NO: 215376 - DNA, 25 bp, Mus musculus
agtgccatctcttagtgagcgctaa

SEQ ID NO: 215377 - DNA, 25 bp, Mus musculus
agtgccatcttcatattcatatgaa

SEQ ID NO: 215378 - DNA, 25 bp, Mus musculus
agtgccatcttcttattcatatgaa

SEQ ID NO: 215379 - DNA, 25 bp, Mus musculus
agtgccatgagaatggccctggtgt

SEQ ID NO: 215380 - DNA, 25 bp, Mus musculus
agtgccatgagattggccctggtgt

SEQ ID NO: 215381 - DNA, 25 bp, Mus musculus
agtgccatgagcagggagccaagtc

SEQ ID NO: 215382 - DNA, 25 bp, Mus musculus
agtgccatgagctgggagccaagtc

SEQ ID NO: 215383 - DNA, 25 bp, Mus musculus
agtgccatgcacagcgtgagcagca

SEQ ID NO: 215384 - DNA, 25 bp, Mus musculus
agtgccatgcactgcgtgagcagca

SEQ ID NO: 215385 - DNA, 25 bp, Mus musculus
agtgccatgcgtacgctgaaaggca

SEQ ID NO: 215386 - DNA, 25 bp, Mus musculus
agtgccatgcgttcgctgaaaggca

SEQ ID NO: 215387 - DNA, 25 bp, Mus musculus
agtgccatgggtccacctcagagga

SEQ ID NO: 215388 - DNA, 25 bp, Mus musculus
agtgccatgggtgcacctcagagga

SEQ ID NO: 215389 - DNA, 25 bp, Mus musculus
agtgccatggttactgtctttataa

SEQ ID NO: 215390 - DNA, 25 bp, Mus musculus
agtgccatggtttctgtctttataa

SEQ ID NO: 215391 - DNA, 25 bp, Mus musculus
agtgccatgtttctacagggtgccc

SEQ ID NO: 215392 - DNA, 25 bp, Mus musculus
agtgccatgtttgtacagggtgccc

SEQ ID NO: 215393 - DNA, 25 bp, Mus musculus
agtgccattcctccgacttttacat

SEQ ID NO: 215394 - DNA, 25 bp, Mus musculus
agtgccattcctgcgacttttacat

SEQ ID NO: 215395 - DNA, 25 bp, Mus musculus
agtgccattgtcaaacttgttttca

SEQ ID NO: 215396 - DNA, 25 bp, Mus musculus
agtgccattgtctaacttgttttca

SEQ ID NO: 215397 - DNA, 25 bp, Mus musculus
agtgcccaaactatcaacctgactt

SEQ ID NO: 215398 - DNA, 25 bp, Mus musculus
agtgcccaaactttcaacctgactt

SEQ ID NO: 215399 - DNA, 25 bp, Mus musculus
agtgcccaaatcactacttaccagg

SEQ ID NO: 215400 - DNA, 25 bp, Mus musculus
agtgcccaaatctctacttaccagg

SEQ ID NO: 215401 - DNA, 25 bp, Mus musculus
agtgcccaaatgatcataaagccag

SEQ ID NO: 215402 - DNA, 25 bp, Mus musculus
agtgcccaaatgttcataaagccag

SEQ ID NO: 215403 - DNA, 25 bp, Mus musculus
agtgcccaagtgagcgagctgaaga

SEQ ID NO: 215404 - DNA, 25 bp, Mus musculus
agtgcccaagtgtgcgagctgaaga

SEQ ID NO: 215405 - DNA, 25 bp, Mus musculus
agtgcccaatggacagcccaggcct

SEQ ID NO: 215406 - DNA, 25 bp, Mus musculus
agtgcccaatggtcagcccaggcct

SEQ ID NO: 215407 - DNA, 25 bp, Mus musculus
agtgcccacattaatcacaactgcc

SEQ ID NO: 215408 - DNA, 25 bp, Mus musculus
agtgcccacatttatcacaactgcc

SEQ ID NO: 215409 - DNA, 25 bp, Mus musculus
agtgcccacggtacctgacggctga

SEQ ID NO: 215410 - DNA, 25 bp, Mus musculus
agtgcccacggttcctgacggctga

SEQ ID NO: 215411 - DNA, 25 bp, Mus musculus
agtgcccacttcagttatgactgga

SEQ ID NO: 215412 - DNA, 25 bp, Mus musculus
agtgcccacttctgttatgactgga

SEQ ID NO: 215413 - DNA, 25 bp, Mus musculus
agtgcccagaccaagtttcaagtga

SEQ ID NO: 215414 - DNA, 25 bp, Mus musculus
agtgcccagacctagtttcaagtga

SEQ ID NO: 215415 - DNA, 25 bp, Mus musculus
agtgcccaggacaaatgccctctgt

SEQ ID NO: 215416 - DNA, 25 bp, Mus musculus
agtgcccaggactaatgccctctgt

SEQ ID NO: 215417 - DNA, 25 bp, Mus musculus
agtgcccaggagaccccacagggtc

SEQ ID NO: 215418 - DNA, 25 bp, Mus musculus
agtgcccaggagtccccacagggtc

SEQ ID NO: 215419 - DNA, 25 bp, Mus musculus
agtgcccaggatcttttcattcatg

SEQ ID NO: 215420 - DNA, 25 bp, Mus musculus
agtgcccaggatgttttcattcatg

SEQ ID NO: 215421 - DNA, 25 bp, Mus musculus
agtgcccaggcaaccaaacacgcag

SEQ ID NO: 215422 - DNA, 25 bp, Mus musculus
agtgcccaggcatccaaacacgcag

SEQ ID NO: 215423 - DNA, 25 bp, Mus musculus
agtgcccagtggacatccttgagaa

SEQ ID NO: 215424 - DNA, 25 bp, Mus musculus
agtgcccagtggtcatccttgagaa

SEQ ID NO: 215425 - DNA, 25 bp, Mus musculus
agtgcccagtgtatggtattggtta

SEQ ID NO: 215426 - DNA, 25 bp, Mus musculus
agtgcccagtgtttggtattggtta

SEQ ID NO: 215427 - DNA, 25 bp, Mus musculus
agtgcccatcacataatctgtgtcc

SEQ ID NO: 215428 - DNA, 25 bp, Mus musculus
agtgcccatcacttaatctgtgtcc

SEQ ID NO: 215429 - DNA, 25 bp, Mus musculus
agtgcccatcagatactcgggtatc

SEQ ID NO: 215430 - DNA, 25 bp, Mus musculus
agtgcccatcagttactcgggtatc

SEQ ID NO: 215431 - DNA, 25 bp, Mus musculus
agtgcccatgatcatctttgctaag

SEQ ID NO: 215432 - DNA, 25 bp, Mus musculus
agtgcccatgatgatctttgctaag

SEQ ID NO: 215433 - DNA, 25 bp, Mus musculus
agtgcccatgctacagtcggatcat

SEQ ID NO: 215434 - DNA, 25 bp, Mus musculus
agtgcccatgcttcagtcggatcat

SEQ ID NO: 215435 - DNA, 25 bp, Mus musculus
agtgcccattaaatgtcttcacatt

SEQ ID NO: 215436 - DNA, 25 bp, Mus musculus
agtgcccattaattgtcttcacatt

SEQ ID NO: 215437 - DNA, 25 bp, Mus musculus
agtgcccattttatcatgttaacgg

SEQ ID NO: 215438 - DNA, 25 bp, Mus musculus
agtgcccattttttcatgttaacgg

SEQ ID NO: 215439 - DNA, 25 bp, Mus musculus
agtgccccagggatatcataaactg

SEQ ID NO: 215440 - DNA, 25 bp, Mus musculus
agtgccccagggatggccgatttgt

SEQ ID NO: 215441 - DNA, 25 bp, Mus musculus
agtgccccagggttatcataaactg

SEQ ID NO: 215442 - DNA, 25 bp, Mus musculus
agtgccccagggttggccgatttgt

SEQ ID NO: 215443 - DNA, 25 bp, Mus musculus
agtgccccaggtcgtgcgcaactac

SEQ ID NO: 215444 - DNA, 25 bp, Mus musculus
agtgccccaggtggtgcgcaactac

SEQ ID NO: 215445 - DNA, 25 bp, Mus musculus
agtgccccataaagatcatttccct

SEQ ID NO: 215446 - DNA, 25 bp, Mus musculus
agtgccccataatgatcatttccct

SEQ ID NO: 215447 - DNA, 25 bp, Mus musculus
agtgccccatgcagcgggaatgtgg

SEQ ID NO: 215448 - DNA, 25 bp, Mus musculus
agtgccccatgctgcgggaatgtgg

SEQ ID NO: 215449 - DNA, 25 bp, Mus musculus
agtgccccccaaccaggagttcgaa

SEQ ID NO: 215450 - DNA, 25 bp, Mus musculus
agtgccccccaagcaggagttcgaa

SEQ ID NO: 215451 - DNA, 25 bp, Mus musculus
agtgcccctatcaatgtgtgtctgt

SEQ ID NO: 215452 - DNA, 25 bp, Mus musculus
agtgcccctatctatgtgtgtctgt

SEQ ID NO: 215453 - DNA, 25 bp, Mus musculus
agtgcccctgctaactgtgggtagg

SEQ ID NO: 215454 - DNA, 25 bp, Mus musculus
agtgcccctgcttactgtgggtagg

SEQ ID NO: 215455 - DNA, 25 bp, Mus musculus
agtgccccttcacagctggctggga

SEQ ID NO: 215456 - DNA, 25 bp, Mus musculus
agtgccccttcagagctggctggga

SEQ ID NO: 215457 - DNA, 25 bp, Mus musculus
agtgcccgaagcagccattgtgcaa

SEQ ID NO: 215458 - DNA, 25 bp, Mus musculus
agtgcccgaagctgccattgtgcaa

SEQ ID NO: 215459 - DNA, 25 bp, Mus musculus
agtgcccgattccaagtgtgtctac

SEQ ID NO: 215460 - DNA, 25 bp, Mus musculus
agtgcccgattcgaagtgtgtctac

SEQ ID NO: 215461 - DNA, 25 bp, Mus musculus
agtgcccgccagaagtatgtccgaa

SEQ ID NO: 215462 - DNA, 25 bp, Mus musculus
agtgcccgccagtagtatgtccgaa

SEQ ID NO: 215463 - DNA, 25 bp, Mus musculus
agtgcccggagtccgctgacatcct

SEQ ID NO: 215464 - DNA, 25 bp, Mus musculus
agtgcccggagtgcgctgacatcct

SEQ ID NO: 215465 - DNA, 25 bp, Mus musculus
agtgcccggcaaccagcgattcggc

SEQ ID NO: 215466 - DNA, 25 bp, Mus musculus
agtgcccggcaagcagcgattcggc

SEQ ID NO: 215467 - DNA, 25 bp, Mus musculus
agtgcccgggacacggactatgaca

SEQ ID NO: 215468 - DNA, 25 bp, Mus musculus
agtgcccgggactcggactatgaca

SEQ ID NO: 215469 - DNA, 25 bp, Mus musculus
agtgcccgtagcattcaactgtgca

SEQ ID NO: 215470 - DNA, 25 bp, Mus musculus
agtgcccgtagctttcaactgtgca

SEQ ID NO: 215471 - DNA, 25 bp, Mus musculus
agtgcccgtctacctcaaagatggg

SEQ ID NO: 215472 - DNA, 25 bp, Mus musculus
agtgcccgtctagctcaaagatggg

SEQ ID NO: 215473 - DNA, 25 bp, Mus musculus
agtgccctacatcatgccgtgagac

SEQ ID NO: 215474 - DNA, 25 bp, Mus musculus
agtgccctacatgatgccgtgagac

SEQ ID NO: 215475 - DNA, 25 bp, Mus musculus
agtgccctacccacattgtgcatgg

SEQ ID NO: 215476 - DNA, 25 bp, Mus musculus
agtgccctaccctcattgtgcatgg

SEQ ID NO: 215477 - DNA, 25 bp, Mus musculus
agtgccctactaaagtggtcttgct

SEQ ID NO: 215478 - DNA, 25 bp, Mus musculus
agtgccctactatagtggtcttgct

SEQ ID NO: 215479 - DNA, 25 bp, Mus musculus
agtgccctacttaactggtatgatc

SEQ ID NO: 215480 - DNA, 25 bp, Mus musculus
agtgccctactttactggtatgatc

SEQ ID NO: 215481 - DNA, 25 bp, Mus musculus
agtgccctaggtcacacagtgtaca

SEQ ID NO: 215482 - DNA, 25 bp, Mus musculus
agtgccctaggtgacacagtgtaca

SEQ ID NO: 215483 - DNA, 25 bp, Mus musculus
agtgccctatttcggtgtgtctaga

SEQ ID NO: 215484 - DNA, 25 bp, Mus musculus
agtgccctatttgggtgtgtctaga

SEQ ID NO: 215485 - DNA, 25 bp, Mus musculus
agtgccctcaccctggaagttagag

SEQ ID NO: 215486 - DNA, 25 bp, Mus musculus
agtgccctcaccgtggaagttagag

SEQ ID NO: 215487 - DNA, 25 bp, Mus musculus
agtgccctcatgatgggttgtggaa

SEQ ID NO: 215488 - DNA, 25 bp, Mus musculus
agtgccctcatgttgggttgtggaa

SEQ ID NO: 215489 - DNA, 25 bp, Mus musculus
agtgccctccttctgatgaagactg

SEQ ID NO: 215490 - DNA, 25 bp, Mus musculus
agtgccctccttgtgatgaagactg

SEQ ID NO: 215491 - DNA, 25 bp, Mus musculus
agtgccctgacacccctaccaaggc

SEQ ID NO: 215492 - DNA, 25 bp, Mus musculus
agtgccctgacagccctaccaaggc

SEQ ID NO: 215493 - DNA, 25 bp, Mus musculus
agtgccctgatcacacgcagaatga

SEQ ID NO: 215494 - DNA, 25 bp, Mus musculus
agtgccctgatctcacgcagaatga

SEQ ID NO: 215495 - DNA, 25 bp, Mus musculus
agtgccctgatgcagtgacctttac

SEQ ID NO: 215496 - DNA, 25 bp, Mus musculus
agtgccctgatggagtgacctttac

SEQ ID NO: 215497 - DNA, 25 bp, Mus musculus
agtgccctgcccagttccaaggatg

SEQ ID NO: 215498 - DNA, 25 bp, Mus musculus
agtgccctgccctgttccaaggatg

SEQ ID NO: 215499 - DNA, 25 bp, Mus musculus
agtgccctggacagacttgcttttg

SEQ ID NO: 215500 - DNA, 25 bp, Mus musculus
agtgccctggactgacttgcttttg

SEQ ID NO: 215501 - DNA, 25 bp, Mus musculus
agtgccctggatcatcacctttctc

SEQ ID NO: 215502 - DNA, 25 bp, Mus musculus
agtgccctggatcccgagagcgaat

SEQ ID NO: 215503 - DNA, 25 bp, Mus musculus
agtgccctggatgatcacctttctc

SEQ ID NO: 215504 - DNA, 25 bp, Mus musculus
agtgccctggatgccgagagcgaat

SEQ ID NO: 215505 - DNA, 25 bp, Mus musculus
agtgccctgggcactgcaacatctg

SEQ ID NO: 215506 - DNA, 25 bp, Mus musculus
agtgccctgggctctgcaacatctg

SEQ ID NO: 215507 - DNA, 25 bp, Mus musculus
agtgccctgggtcatcctttctgat

SEQ ID NO: 215508 - DNA, 25 bp, Mus musculus
agtgccctgggtgatcctttctgat

SEQ ID NO: 215509 - DNA, 25 bp, Mus musculus
agtgccctggttatccagatgtgga

SEQ ID NO: 215510 - DNA, 25 bp, Mus musculus
agtgccctggttttccagatgtgga

SEQ ID NO: 215511 - DNA, 25 bp, Mus musculus
agtgcccttcttacctgagaggttt

SEQ ID NO: 215512 - DNA, 25 bp, Mus musculus
agtgcccttctttcctgagaggttt

SEQ ID NO: 215513 - DNA, 25 bp, Mus musculus
agtgcccttgacaaagctccagcat

SEQ ID NO: 215514 - DNA, 25 bp, Mus musculus
agtgcccttgactaagctccagcat

SEQ ID NO: 215515 - DNA, 25 bp, Mus musculus
agtgcccttgtgaacatgaggctga

SEQ ID NO: 215516 - DNA, 25 bp, Mus musculus
agtgcccttgtgtacatgaggctga

SEQ ID NO: 215517 - DNA, 25 bp, Mus musculus
agtgccctttaaccattgagtcacc

SEQ ID NO: 215518 - DNA, 25 bp, Mus musculus
agtgccctttaagcattgagtcacc

SEQ ID NO: 215519 - DNA, 25 bp, Mus musculus
agtgccctttcccaaagtagatctt

SEQ ID NO: 215520 - DNA, 25 bp, Mus musculus
agtgccctttccgaaagtagatctt

SEQ ID NO: 215521 - DNA, 25 bp, Mus musculus
agtgcccttttactctgtctttatt

SEQ ID NO: 215522 - DNA, 25 bp, Mus musculus
agtgcccttttagtctgtctttatt

SEQ ID NO: 215523 - DNA, 25 bp, Mus musculus
agtgccgaccgcatcacaatgaact

SEQ ID NO: 215524 - DNA, 25 bp, Mus musculus
agtgccgaccgcttcacaatgaact

SEQ ID NO: 215525 - DNA, 25 bp, Mus musculus
agtgccgactggaccacgaggtttt

SEQ ID NO: 215526 - DNA, 25 bp, Mus musculus
agtgccgactggtccacgaggtttt

SEQ ID NO: 215527 - DNA, 25 bp, Mus musculus
agtgccgactttcacagcctgaaga

SEQ ID NO: 215528 - DNA, 25 bp, Mus musculus
agtgccgactttgacagcctgaaga

SEQ ID NO: 215529 - DNA, 25 bp, Mus musculus
agtgccgagctacacgagtctcgtc

SEQ ID NO: 215530 - DNA, 25 bp, Mus musculus
agtgccgagctagacgagtctcgtc

SEQ ID NO: 215531 - DNA, 25 bp, Mus musculus
agtgccgagctgaccagagaactgt

SEQ ID NO: 215532 - DNA, 25 bp, Mus musculus
agtgccgagctgtccagagaactgt

SEQ ID NO: 215533 - DNA, 25 bp, Mus musculus
agtgccgattagctttcctgggctt

SEQ ID NO: 215534 - DNA, 25 bp, Mus musculus
agtgccgattaggtttcctgggctt

SEQ ID NO: 215535 - DNA, 25 bp, Mus musculus
agtgccgcaaggatcttaccaagat

SEQ ID NO: 215536 - DNA, 25 bp, Mus musculus
agtgccgcaaggttcttaccaagat

SEQ ID NO: 215537 - DNA, 25 bp, Mus musculus
agtgccgccaacatctagtcacaaa

SEQ ID NO: 215538 - DNA, 25 bp, Mus musculus
agtgccgccaacttctagtcacaaa

SEQ ID NO: 215539 - DNA, 25 bp, Mus musculus
agtgccgccactaggcttttatgtg

SEQ ID NO: 215540 - DNA, 25 bp, Mus musculus
agtgccgccacttggcttttatgtg

SEQ ID NO: 215541 - DNA, 25 bp, Mus musculus
agtgccgcgcatctctatggatatc

SEQ ID NO: 215542 - DNA, 25 bp, Mus musculus
agtgccgcgcatgtctatggatatc

SEQ ID NO: 215543 - DNA, 25 bp, Mus musculus
agtgccgctcggattcatgaatcca

SEQ ID NO: 215544 - DNA, 25 bp, Mus musculus
agtgccgctcggtttcatgaatcca

SEQ ID NO: 215545 - DNA, 25 bp, Mus musculus
agtgccgctgggatgactctgtcac

SEQ ID NO: 215546 - DNA, 25 bp, Mus musculus
agtgccgctgggttgactctgtcac

SEQ ID NO: 215547 - DNA, 25 bp, Mus musculus
agtgccggacggaatgctgccaagc

SEQ ID NO: 215548 - DNA, 25 bp, Mus musculus
agtgccggacggtatgctgccaagc

SEQ ID NO: 215549 - DNA, 25 bp, Mus musculus
agtgccggacttactcctggcatag

SEQ ID NO: 215550 - DNA, 25 bp, Mus musculus
agtgccggactttctcctggcatag

SEQ ID NO: 215551 - DNA, 25 bp, Mus musculus
agtgccgggaatcaaccctgctgac

SEQ ID NO: 215552 - DNA, 25 bp, Mus musculus
agtgccgggaatgaaccctgctgac

SEQ ID NO: 215553 - DNA, 25 bp, Mus musculus
agtgccgggaccaggagaaccatca

SEQ ID NO: 215554 - DNA, 25 bp, Mus musculus
agtgccgggacctggagaaccatca

SEQ ID NO: 215555 - DNA, 25 bp, Mus musculus
agtgccgggttcctacgaagactag

SEQ ID NO: 215556 - DNA, 25 bp, Mus musculus
agtgccgggttcgtacgaagactag

SEQ ID NO: 215557 - DNA, 25 bp, Mus musculus
agtgccggtacactctttgtcagag

SEQ ID NO: 215558 - DNA, 25 bp, Mus musculus
agtgccggtacagtctttgtcagag

SEQ ID NO: 215559 - DNA, 25 bp, Mus musculus
agtgccgtagctcagcaagttcttg

SEQ ID NO: 215560 - DNA, 25 bp, Mus musculus
agtgccgtagctgagcaagttcttg

SEQ ID NO: 215561 - DNA, 25 bp, Mus musculus
agtgccgtccttagctgctggcaga

SEQ ID NO: 215562 - DNA, 25 bp, Mus musculus
agtgccgtcctttgctgctggcaga

SEQ ID NO: 215563 - DNA, 25 bp, Mus musculus
agtgccgtggttacaattccaatgc

SEQ ID NO: 215564 - DNA, 25 bp, Mus musculus
agtgccgtggtttcaattccaatgc

SEQ ID NO: 215565 - DNA, 25 bp, Mus musculus
agtgccgttcatctcttcccaagtt

SEQ ID NO: 215566 - DNA, 25 bp, Mus musculus
agtgccgttcatgtcttcccaagtt

SEQ ID NO: 215567 - DNA, 25 bp, Mus musculus
agtgcctaaagaacagctccggaga

SEQ ID NO: 215568 - DNA, 25 bp, Mus musculus
agtgcctaaagatcagctccggaga

SEQ ID NO: 215569 - DNA, 25 bp, Mus musculus
agtgcctaaagcagtgccatcttct

SEQ ID NO: 215570 - DNA, 25 bp, Mus musculus
agtgcctaaagctgtgccatcttct

SEQ ID NO: 215571 - DNA, 25 bp, Mus musculus
agtgcctaacatcactacaattaag

SEQ ID NO: 215572 - DNA, 25 bp, Mus musculus
agtgcctaacatgactacaattaag

SEQ ID NO: 215573 - DNA, 25 bp, Mus musculus
agtgcctacaccaagtcagagaccg

SEQ ID NO: 215574 - DNA, 25 bp, Mus musculus
agtgcctacacctagtcagagaccg

SEQ ID NO: 215575 - DNA, 25 bp, Mus musculus
agtgcctaggacagacttgaagtga

SEQ ID NO: 215576 - DNA, 25 bp, Mus musculus
agtgcctaggactgacttgaagtga

SEQ ID NO: 215577 - DNA, 25 bp, Mus musculus
agtgcctaggccaatctactatcta

SEQ ID NO: 215578 - DNA, 25 bp, Mus musculus
agtgcctaggccaggcggtgagccc

SEQ ID NO: 215579 - DNA, 25 bp, Mus musculus
agtgcctaggcctatctactatcta

SEQ ID NO: 215580 - DNA, 25 bp, Mus musculus
agtgcctaggcctggcggtgagccc

SEQ ID NO: 215581 - DNA, 25 bp, Mus musculus
agtgcctatcctcccggaaatacaa

SEQ ID NO: 215582 - DNA, 25 bp, Mus musculus
agtgcctatcctgccggaaatacaa

SEQ ID NO: 215583 - DNA, 25 bp, Mus musculus
agtgcctatcttcgctgctcagaga

SEQ ID NO: 215584 - DNA, 25 bp, Mus musculus
agtgcctatcttggctgctcagaga

SEQ ID NO: 215585 - DNA, 25 bp, Mus musculus
agtgcctatgaaaatcctcgggata

SEQ ID NO: 215586 - DNA, 25 bp, Mus musculus
agtgcctatgaatatcctcgggata

SEQ ID NO: 215587 - DNA, 25 bp, Mus musculus
agtgcctatgagacccgtagcttta

SEQ ID NO: 215588 - DNA, 25 bp, Mus musculus
agtgcctatgagtcccgtagcttta

SEQ ID NO: 215589 - DNA, 25 bp, Mus musculus
agtgcctcacagctggaacaactga

SEQ ID NO: 215590 - DNA, 25 bp, Mus musculus
agtgcctcacaggtggaacaactga

SEQ ID NO: 215591 - DNA, 25 bp, Mus musculus
agtgcctccacgctgtggttccgtt

SEQ ID NO: 215592 - DNA, 25 bp, Mus musculus
agtgcctccacggtgtggttccgtt

SEQ ID NO: 215593 - DNA, 25 bp, Mus musculus
agtgcctccctgataactttgtaga

SEQ ID NO: 215594 - DNA, 25 bp, Mus musculus
agtgcctccctgttaactttgtaga

SEQ ID NO: 215595 - DNA, 25 bp, Mus musculus
agtgcctcctacaggcagcaagcca

SEQ ID NO: 215596 - DNA, 25 bp, Mus musculus
agtgcctcctacagtatggtttcct

SEQ ID NO: 215597 - DNA, 25 bp, Mus musculus
agtgcctcctactggcagcaagcca

SEQ ID NO: 215598 - DNA, 25 bp, Mus musculus
agtgcctcctactgtatggtttcct

SEQ ID NO: 215599 - DNA, 25 bp, Mus musculus
agtgcctcctgaacttgcagaagac

SEQ ID NO: 215600 - DNA, 25 bp, Mus musculus
agtgcctcctgatcttgcagaagac

SEQ ID NO: 215601 - DNA, 25 bp, Mus musculus
agtgcctcctggctggtcgcctgaa

SEQ ID NO: 215602 - DNA, 25 bp, Mus musculus
agtgcctcctgggtggtcgcctgaa

SEQ ID NO: 215603 - DNA, 25 bp, Mus musculus
agtgcctcctgtcatcatctgtgag

SEQ ID NO: 215604 - DNA, 25 bp, Mus musculus
agtgcctcctgtgatcatctgtgag

SEQ ID NO: 215605 - DNA, 25 bp, Mus musculus
agtgcctccttgagcatagaacttc

SEQ ID NO: 215606 - DNA, 25 bp, Mus musculus
agtgcctccttgtgcatagaacttc

SEQ ID NO: 215607 - DNA, 25 bp, Mus musculus
agtgcctcctttcggtatcagctgg

SEQ ID NO: 215608 - DNA, 25 bp, Mus musculus
agtgcctcctttgggtatcagctgg

SEQ ID NO: 215609 - DNA, 25 bp, Mus musculus
agtgcctcgcagcaagcttgtacag

SEQ ID NO: 215610 - DNA, 25 bp, Mus musculus
agtgcctcgcaggaagcttgtacag

SEQ ID NO: 215611 - DNA, 25 bp, Mus musculus
agtgcctcggcactgggaaaatcct

SEQ ID NO: 215612 - DNA, 25 bp, Mus musculus
agtgcctcggcagtgggaaaatcct

SEQ ID NO: 215613 - DNA, 25 bp, Mus musculus
agtgcctctgacctaaatcaggcgt

SEQ ID NO: 215614 - DNA, 25 bp, Mus musculus
agtgcctctgacctatgtggcccca

SEQ ID NO: 215615 - DNA, 25 bp, Mus musculus
agtgcctctgacgtaaatcaggcgt

SEQ ID NO: 215616 - DNA, 25 bp, Mus musculus
agtgcctctgacgtatgtggcccca

SEQ ID NO: 215617 - DNA, 25 bp, Mus musculus
agtgcctctgggagtactaatttcc

SEQ ID NO: 215618 - DNA, 25 bp, Mus musculus
agtgcctctgggtgtactaatttcc

SEQ ID NO: 215619 - DNA, 25 bp, Mus musculus
agtgcctgaaatactgtcctttaaa

SEQ ID NO: 215620 - DNA, 25 bp, Mus musculus
agtgcctgaaattctgtcctttaaa

SEQ ID NO: 215621 - DNA, 25 bp, Mus musculus
agtgcctgacgccaagaagcccaaa

SEQ ID NO: 215622 - DNA, 25 bp, Mus musculus
agtgcctgacgcgaagaagcccaaa

SEQ ID NO: 215623 - DNA, 25 bp, Mus musculus
agtgcctgatgaattggctgccctc

SEQ ID NO: 215624 - DNA, 25 bp, Mus musculus
agtgcctgatgatttggctgccctc

SEQ ID NO: 215625 - DNA, 25 bp, Mus musculus
agtgcctgatgtctggatcctgaga

SEQ ID NO: 215626 - DNA, 25 bp, Mus musculus
agtgcctgatgtgtggatcctgaga

SEQ ID NO: 215627 - DNA, 25 bp, Mus musculus
agtgcctgcacaatctgcaagtagt

SEQ ID NO: 215628 - DNA, 25 bp, Mus musculus
agtgcctgcacattctgcaagtagt

SEQ ID NO: 215629 - DNA, 25 bp, Mus musculus
agtgcctgcatcagattagcccata

SEQ ID NO: 215630 - DNA, 25 bp, Mus musculus
agtgcctgcatctgattagcccata

SEQ ID NO: 215631 - DNA, 25 bp, Mus musculus
agtgcctgcatgacacaataaccag

SEQ ID NO: 215632 - DNA, 25 bp, Mus musculus
agtgcctgcatgtcacaataaccag

SEQ ID NO: 215633 - DNA, 25 bp, Mus musculus
agtgcctgcctcattaggttacttt

SEQ ID NO: 215634 - DNA, 25 bp, Mus musculus
agtgcctgcctctttaggttacttt

SEQ ID NO: 215635 - DNA, 25 bp, Mus musculus
agtgcctgccttacagtcaaactca

SEQ ID NO: 215636 - DNA, 25 bp, Mus musculus
agtgcctgcctttcagtcaaactca

SEQ ID NO: 215637 - DNA, 25 bp, Mus musculus
agtgcctgcgcaagtttgtgcctct

SEQ ID NO: 215638 - DNA, 25 bp, Mus musculus
agtgcctgcgcatgtttgtgcctct

SEQ ID NO: 215639 - DNA, 25 bp, Mus musculus
agtgcctgctccacaaacatgagta

SEQ ID NO: 215640 - DNA, 25 bp, Mus musculus
agtgcctgctcctcaaacatgagta

SEQ ID NO: 215641 - DNA, 25 bp, Mus musculus
agtgcctgctctaagtgccgagaag

SEQ ID NO: 215642 - DNA, 25 bp, Mus musculus
agtgcctgctcttagtgccgagaag

SEQ ID NO: 215643 - DNA, 25 bp, Mus musculus
agtgcctggcatccgtatgtaccaa

SEQ ID NO: 215644 - DNA, 25 bp, Mus musculus
agtgcctggcatgcgtatgtaccaa

SEQ ID NO: 215645 - DNA, 25 bp, Mus musculus
agtgcctggctcaagaattaattgt

SEQ ID NO: 215646 - DNA, 25 bp, Mus musculus
agtgcctggctctagaattaattgt

SEQ ID NO: 215647 - DNA, 25 bp, Mus musculus
agtgcctgggcacagagcttcctgt

SEQ ID NO: 215648 - DNA, 25 bp, Mus musculus
agtgcctgggcagagagcttcctgt

SEQ ID NO: 215649 - DNA, 25 bp, Mus musculus
agtgcctgggctaggaacagttccc

SEQ ID NO: 215650 - DNA, 25 bp, Mus musculus
agtgcctgggcttggaacagttccc

SEQ ID NO: 215651 - DNA, 25 bp, Mus musculus
agtgcctggtggcaattttatgtca

SEQ ID NO: 215652 - DNA, 25 bp, Mus musculus
agtgcctggtgggaattttatgtca

SEQ ID NO: 215653 - DNA, 25 bp, Mus musculus
agtgcctgtaatacagcgttctgaa

SEQ ID NO: 215654 - DNA, 25 bp, Mus musculus
agtgcctgtaattcagcgttctgaa

SEQ ID NO: 215655 - DNA, 25 bp, Mus musculus
agtgcctgtactcgtgcctaccata

SEQ ID NO: 215656 - DNA, 25 bp, Mus musculus
agtgcctgtactggtgcctaccata

SEQ ID NO: 215657 - DNA, 25 bp, Mus musculus
agtgcctgtcacaacggtgtcccat

SEQ ID NO: 215658 - DNA, 25 bp, Mus musculus
agtgcctgtcacagtcacttttctc

SEQ ID NO: 215659 - DNA, 25 bp, Mus musculus
agtgcctgtcaccaaatcagtcatt

SEQ ID NO: 215660 - DNA, 25 bp, Mus musculus
agtgcctgtcacgaaatcagtcatt

SEQ ID NO: 215661 - DNA, 25 bp, Mus musculus
agtgcctgtcactacggtgtcccat

SEQ ID NO: 215662 - DNA, 25 bp, Mus musculus
agtgcctgtcactgtcacttttctc

SEQ ID NO: 215663 - DNA, 25 bp, Mus musculus
agtgcctgtcctatcttaggatgca

SEQ ID NO: 215664 - DNA, 25 bp, Mus musculus
agtgcctgtcctttcttaggatgca

SEQ ID NO: 215665 - DNA, 25 bp, Mus musculus
agtgcctgtgagaacacggtgcaaa

SEQ ID NO: 215666 - DNA, 25 bp, Mus musculus
agtgcctgtgagtacacggtgcaaa

SEQ ID NO: 215667 - DNA, 25 bp, Mus musculus
agtgcctgtgatctggtagctgcaa

SEQ ID NO: 215668 - DNA, 25 bp, Mus musculus
agtgcctgtgatgtggtagctgcaa

SEQ ID NO: 215669 - DNA, 25 bp, Mus musculus
agtgcctgtgtaaagccttcccagt

SEQ ID NO: 215670 - DNA, 25 bp, Mus musculus
agtgcctgtgtatagccttcccagt

SEQ ID NO: 215671 - DNA, 25 bp, Mus musculus
agtgcctgtgtgatctgtttagtgt

SEQ ID NO: 215672 - DNA, 25 bp, Mus musculus
agtgcctgtgtgttctgtttagtgt

SEQ ID NO: 215673 - DNA, 25 bp, Mus musculus
agtgcctgttctcgctgataaacgg

SEQ ID NO: 215674 - DNA, 25 bp, Mus musculus
agtgcctgttctggctgataaacgg

SEQ ID NO: 215675 - DNA, 25 bp, Mus musculus
agtgcctgttggataacaccccagt

SEQ ID NO: 215676 - DNA, 25 bp, Mus musculus
agtgcctgttggttaacaccccagt

SEQ ID NO: 215677 - DNA, 25 bp, Mus musculus
agtgccttacacactgtggagatgg

SEQ ID NO: 215678 - DNA, 25 bp, Mus musculus
agtgccttacactctgtggagatgg

SEQ ID NO: 215679 - DNA, 25 bp, Mus musculus
agtgccttaccacttatctctgtga

SEQ ID NO: 215680 - DNA, 25 bp, Mus musculus
agtgccttaccagttatctctgtga

SEQ ID NO: 215681 - DNA, 25 bp, Mus musculus
agtgccttactcaagttcttttcct

SEQ ID NO: 215682 - DNA, 25 bp, Mus musculus
agtgccttactctagttcttttcct

SEQ ID NO: 215683 - DNA, 25 bp, Mus musculus
agtgccttagtcagtgcatggtgca

SEQ ID NO: 215684 - DNA, 25 bp, Mus musculus
agtgccttagtctgtgcatggtgca

SEQ ID NO: 215685 - DNA, 25 bp, Mus musculus
agtgccttatggagtagtgactccc

SEQ ID NO: 215686 - DNA, 25 bp, Mus musculus
agtgccttatggtgtagtgactccc

SEQ ID NO: 215687 - DNA, 25 bp, Mus musculus
agtgccttcaaaactgtgtcccaga

SEQ ID NO: 215688 - DNA, 25 bp, Mus musculus
agtgccttcaaatctgtgtcccaga

SEQ ID NO: 215689 - DNA, 25 bp, Mus musculus
agtgccttcaggatggtgtctgcca

SEQ ID NO: 215690 - DNA, 25 bp, Mus musculus
agtgccttcaggctccattgactag

SEQ ID NO: 215691 - DNA, 25 bp, Mus musculus
agtgccttcagggtccattgactag

SEQ ID NO: 215692 - DNA, 25 bp, Mus musculus
agtgccttcaggttggtgtctgcca

SEQ ID NO: 215693 - DNA, 25 bp, Mus musculus
agtgccttcagtaacttttgtccca

SEQ ID NO: 215694 - DNA, 25 bp, Mus musculus
agtgccttcagttacttttgtccca

SEQ ID NO: 215695 - DNA, 25 bp, Mus musculus
agtgccttcatacggcccgaacttg

SEQ ID NO: 215696 - DNA, 25 bp, Mus musculus
agtgccttcatagggcccgaacttg

SEQ ID NO: 215697 - DNA, 25 bp, Mus musculus
agtgccttcgctaccatgtttttgg

SEQ ID NO: 215698 - DNA, 25 bp, Mus musculus
agtgccttcgcttccatgtttttgg

SEQ ID NO: 215699 - DNA, 25 bp, Mus musculus
agtgccttcgtgcatcgatgtggac

SEQ ID NO: 215700 - DNA, 25 bp, Mus musculus
agtgccttcgtggatcgatgtggac

SEQ ID NO: 215701 - DNA, 25 bp, Mus musculus
agtgccttctctcagtgtgttgtgt

SEQ ID NO: 215702 - DNA, 25 bp, Mus musculus
agtgccttctctgagtgtgttgtgt

SEQ ID NO: 215703 - DNA, 25 bp, Mus musculus
agtgccttcttcattgctgggacag

SEQ ID NO: 215704 - DNA, 25 bp, Mus musculus
agtgccttcttctttgctgggacag

SEQ ID NO: 215705 - DNA, 25 bp, Mus musculus
agtgccttctttcctctcgggttgt

SEQ ID NO: 215706 - DNA, 25 bp, Mus musculus
agtgccttctttgctctcgggttgt

SEQ ID NO: 215707 - DNA, 25 bp, Mus musculus
agtgccttgactcagccaaagccca

SEQ ID NO: 215708 - DNA, 25 bp, Mus musculus
agtgccttgactgagccaaagccca

SEQ ID NO: 215709 - DNA, 25 bp, Mus musculus
agtgccttgcagatgagctcattaa

SEQ ID NO: 215710 - DNA, 25 bp, Mus musculus
agtgccttgcagttgagctcattaa

SEQ ID NO: 215711 - DNA, 25 bp, Mus musculus
agtgccttggaaagatgggccacat

SEQ ID NO: 215712 - DNA, 25 bp, Mus musculus
agtgccttggaatgatgggccacat

SEQ ID NO: 215713 - DNA, 25 bp, Mus musculus
agtgccttggccagtggtcattatg

SEQ ID NO: 215714 - DNA, 25 bp, Mus musculus
agtgccttggcctgtggtcattatg

SEQ ID NO: 215715 - DNA, 25 bp, Mus musculus
agtgccttggctactgctgaataaa

SEQ ID NO: 215716 - DNA, 25 bp, Mus musculus
agtgccttggcttctgctgaataaa

SEQ ID NO: 215717 - DNA, 25 bp, Mus musculus
agtgccttgtggccacgtttagccg

SEQ ID NO: 215718 - DNA, 25 bp, Mus musculus
agtgccttgtgggcacgtttagccg

SEQ ID NO: 215719 - DNA, 25 bp, Mus musculus
agtgcctttaagaacctgagatcag

SEQ ID NO: 215720 - DNA, 25 bp, Mus musculus
agtgcctttaagtacctgagatcag

SEQ ID NO: 215721 - DNA, 25 bp, Mus musculus
agtgcctttcccaaggtgaccttca

SEQ ID NO: 215722 - DNA, 25 bp, Mus musculus
agtgcctttccctaggtgaccttca

SEQ ID NO: 215723 - DNA, 25 bp, Mus musculus
agtgccttttatactgtagattgta

SEQ ID NO: 215724 - DNA, 25 bp, Mus musculus
agtgccttttattctgtagattgta

SEQ ID NO: 215725 - DNA, 25 bp, Mus musculus
agtgccttttggctcttgagtcaga

SEQ ID NO: 215726 - DNA, 25 bp, Mus musculus
agtgccttttgggtcttgagtcaga

SEQ ID NO: 215727 - DNA, 25 bp, Mus musculus
agtgcgaagcagagtgcagcaagca

SEQ ID NO: 215728 - DNA, 25 bp, Mus musculus
agtgcgaagcagtgtgcagcaagca

SEQ ID NO: 215729 - DNA, 25 bp, Mus musculus
agtgcgagaaacacgccaactccgg

SEQ ID NO: 215730 - DNA, 25 bp, Mus musculus
agtgcgagaaactcgccaactccgg

SEQ ID NO: 215731 - DNA, 25 bp, Mus musculus
agtgcgagcgtgaaggcatactctc

SEQ ID NO: 215732 - DNA, 25 bp, Mus musculus
agtgcgagcgtgtaggcatactctc

SEQ ID NO: 215733 - DNA, 25 bp, Mus musculus
agtgcgagctgtccaactacgcgtg

SEQ ID NO: 215734 - DNA, 25 bp, Mus musculus
agtgcgagctgtgcaactacgcgtg

SEQ ID NO: 215735 - DNA, 25 bp, Mus musculus
agtgcgatcttgcttacttttgatg

SEQ ID NO: 215736 - DNA, 25 bp, Mus musculus
agtgcgatcttggttacttttgatg

SEQ ID NO: 215737 - DNA, 25 bp, Mus musculus
agtgcgatgtccaggcctatgagaa

SEQ ID NO: 215738 - DNA, 25 bp, Mus musculus
agtgcgatgtcctggcctatgagaa

SEQ ID NO: 215739 - DNA, 25 bp, Mus musculus
agtgcgcaagtgcaataatttaaag

SEQ ID NO: 215740 - DNA, 25 bp, Mus musculus
agtgcgcaagtggaataatttaaag

SEQ ID NO: 215741 - DNA, 25 bp, Mus musculus
agtgcgcataaccagctcacctctt

SEQ ID NO: 215742 - DNA, 25 bp, Mus musculus
agtgcgcataacgagctcacctctt

SEQ ID NO: 215743 - DNA, 25 bp, Mus musculus
agtgcgcatgggagctaattaagga

SEQ ID NO: 215744 - DNA, 25 bp, Mus musculus
agtgcgcatgggtgctaattaagga

SEQ ID NO: 215745 - DNA, 25 bp, Mus musculus
agtgcgccagaactaccaccaggac

SEQ ID NO: 215746 - DNA, 25 bp, Mus musculus
agtgcgccagaagtaccaccaggac

SEQ ID NO: 215747 - DNA, 25 bp, Mus musculus
agtgcgccgcttccagcagctgctg

SEQ ID NO: 215748 - DNA, 25 bp, Mus musculus
agtgcgccgcttgcagcagctgctg

SEQ ID NO: 215749 - DNA, 25 bp, Mus musculus
agtgcgcgatgccgggatcaaagtc

SEQ ID NO: 215750 - DNA, 25 bp, Mus musculus
agtgcgcgatgcggggatcaaagtc

SEQ ID NO: 215751 - DNA, 25 bp, Mus musculus
agtgcgcgcgcactttctacgtgtg

SEQ ID NO: 215752 - DNA, 25 bp, Mus musculus
agtgcgcgcgcagtttctacgtgtg

SEQ ID NO: 215753 - DNA, 25 bp, Mus musculus
agtgcgcgtgcgagtgatgctacct

SEQ ID NO: 215754 - DNA, 25 bp, Mus musculus
agtgcgcgtgcgtgtgatgctacct

SEQ ID NO: 215755 - DNA, 25 bp, Mus musculus
agtgcgctacccaggcgttggagaa

SEQ ID NO: 215756 - DNA, 25 bp, Mus musculus
agtgcgctaccctggcgttggagaa

SEQ ID NO: 215757 - DNA, 25 bp, Mus musculus
agtgcgctcaccatagagctgttca

SEQ ID NO: 215758 - DNA, 25 bp, Mus musculus
agtgcgctcaccttagagctgttca

SEQ ID NO: 215759 - DNA, 25 bp, Mus musculus
agtgcgcttggaatcttgtgtgtca

SEQ ID NO: 215760 - DNA, 25 bp, Mus musculus
agtgcgcttggattcttgtgtgtca

SEQ ID NO: 215761 - DNA, 25 bp, Mus musculus
agtgcggcaactctagagacacgga

SEQ ID NO: 215762 - DNA, 25 bp, Mus musculus
agtgcggcaactgtagagacacgga

SEQ ID NO: 215763 - DNA, 25 bp, Mus musculus
agtgcggcaggccacagatgtccac

SEQ ID NO: 215764 - DNA, 25 bp, Mus musculus
agtgcggcaggcgacagatgtccac

SEQ ID NO: 215765 - DNA, 25 bp, Mus musculus
agtgcggcgtcaatagtgtaagtgt

SEQ ID NO: 215766 - DNA, 25 bp, Mus musculus
agtgcggcgtcattagtgtaagtgt

SEQ ID NO: 215767 - DNA, 25 bp, Mus musculus
agtgcggctaggacttgcctaccat

SEQ ID NO: 215768 - DNA, 25 bp, Mus musculus
agtgcggctaggtcttgcctaccat

SEQ ID NO: 215769 - DNA, 25 bp, Mus musculus
agtgcggctcgtagtcgcgcgccca

SEQ ID NO: 215770 - DNA, 25 bp, Mus musculus
agtgcggctcgttgtcgcgcgccca

SEQ ID NO: 215771 - DNA, 25 bp, Mus musculus
agtgcggctttgcttcacagtcacc

SEQ ID NO: 215772 - DNA, 25 bp, Mus musculus
agtgcggctttggttcacagtcacc

SEQ ID NO: 215773 - DNA, 25 bp, Mus musculus
agtgcgggaagcctttcaccaacaa

SEQ ID NO: 215774 - DNA, 25 bp, Mus musculus
agtgcgggaagcgtttcaccaacaa

SEQ ID NO: 215775 - DNA, 25 bp, Mus musculus
agtgcgggacccactggtcacctat

SEQ ID NO: 215776 - DNA, 25 bp, Mus musculus
agtgcgggaccctctggtcacctat

SEQ ID NO: 215777 - DNA, 25 bp, Mus musculus
agtgcgggcccacactcacgcgggt

SEQ ID NO: 215778 - DNA, 25 bp, Mus musculus
agtgcgggcccagactcacgcgggt

SEQ ID NO: 215779 - DNA, 25 bp, Mus musculus
agtgcgggtcataagcttgcgttga

SEQ ID NO: 215780 - DNA, 25 bp, Mus musculus
agtgcgggtcattagcttgcgttga

SEQ ID NO: 215781 - DNA, 25 bp, Mus musculus
agtgcggtaggaagggttcccactt

SEQ ID NO: 215782 - DNA, 25 bp, Mus musculus
agtgcggtaggatgggttcccactt

SEQ ID NO: 215783 - DNA, 25 bp, Mus musculus
agtgcggtcactagcatacgtggct

SEQ ID NO: 215784 - DNA, 25 bp, Mus musculus
agtgcggtcacttgcatacgtggct

SEQ ID NO: 215785 - DNA, 25 bp, Mus musculus
agtgcggtgcttaacagaatgctca

SEQ ID NO: 215786 - DNA, 25 bp, Mus musculus
agtgcggtgctttacagaatgctca

SEQ ID NO: 215787 - DNA, 25 bp, Mus musculus
agtgcggtggaaccagctacctgcc

SEQ ID NO: 215788 - DNA, 25 bp, Mus musculus
agtgcggtggaagcagctacctgcc

SEQ ID NO: 215789 - DNA, 25 bp, Mus musculus
agtgcggttcgtcagctagtcctgc

SEQ ID NO: 215790 - DNA, 25 bp, Mus musculus
agtgcggttcgtgagctagtcctgc

SEQ ID NO: 215791 - DNA, 25 bp, Mus musculus
agtgcgtaaagtccttaccccacaa

SEQ ID NO: 215792 - DNA, 25 bp, Mus musculus
agtgcgtaaagtgcttaccccacaa

SEQ ID NO: 215793 - DNA, 25 bp, Mus musculus
agtgcgtaactcatacagcaggatc

SEQ ID NO: 215794 - DNA, 25 bp, Mus musculus
agtgcgtaactcttacagcaggatc

SEQ ID NO: 215795 - DNA, 25 bp, Mus musculus
agtgcgtccaaaagagtatctatga

SEQ ID NO: 215796 - DNA, 25 bp, Mus musculus
agtgcgtccaaatgagtatctatga

SEQ ID NO: 215797 - DNA, 25 bp, Mus musculus
agtgcgtgagcgacagcagcatctt

SEQ ID NO: 215798 - DNA, 25 bp, Mus musculus
agtgcgtgagcgtcagcagcatctt

SEQ ID NO: 215799 - DNA, 25 bp, Mus musculus
agtgcgtgccctaccatgtaacttg

SEQ ID NO: 215800 - DNA, 25 bp, Mus musculus
agtgcgtgcccttccatgtaacttg

SEQ ID NO: 215801 - DNA, 25 bp, Mus musculus
agtgcgtgtgcaccaccaacgtttg

SEQ ID NO: 215802 - DNA, 25 bp, Mus musculus
agtgcgtgtgcagcaccaacgtttg

SEQ ID NO: 215803 - DNA, 25 bp, Mus musculus
agtgcgttacctaagcaactgataa

SEQ ID NO: 215804 - DNA, 25 bp, Mus musculus
agtgcgttaccttagcaactgataa

SEQ ID NO: 215805 - DNA, 25 bp, Mus musculus
agtgctaaacttagaccctgtgaac

SEQ ID NO: 215806 - DNA, 25 bp, Mus musculus
agtgctaaactttgaccctgtgaac

SEQ ID NO: 215807 - DNA, 25 bp, Mus musculus
agtgctaaagtcattccttgggcta

SEQ ID NO: 215808 - DNA, 25 bp, Mus musculus
agtgctaaagtctttccttgggcta

SEQ ID NO: 215809 - DNA, 25 bp, Mus musculus
agtgctaacaagaccttacaggctg

SEQ ID NO: 215810 - DNA, 25 bp, Mus musculus
agtgctaacaagtccttacaggctg

SEQ ID NO: 215811 - DNA, 25 bp, Mus musculus
agtgctaagactcgaaacggtccct

SEQ ID NO: 215812 - DNA, 25 bp, Mus musculus
agtgctaagactggaaacggtccct

SEQ ID NO: 215813 - DNA, 25 bp, Mus musculus
agtgctaaggacagttccactctct

SEQ ID NO: 215814 - DNA, 25 bp, Mus musculus
agtgctaaggactgttccactctct

SEQ ID NO: 215815 - DNA, 25 bp, Mus musculus
agtgctaaggttcagctccgacgct

SEQ ID NO: 215816 - DNA, 25 bp, Mus musculus
agtgctaaggttgagctccgacgct

SEQ ID NO: 215817 - DNA, 25 bp, Mus musculus
agtgctacaaggacttcctggattt

SEQ ID NO: 215818 - DNA, 25 bp, Mus musculus
agtgctacaaggtcttcctggattt

SEQ ID NO: 215819 - DNA, 25 bp, Mus musculus
agtgctacacagacactgttccgtt

SEQ ID NO: 215820 - DNA, 25 bp, Mus musculus
agtgctacacagtcactgttccgtt

SEQ ID NO: 215821 - DNA, 25 bp, Mus musculus
agtgctacacctctgcgaatcctgt

SEQ ID NO: 215822 - DNA, 25 bp, Mus musculus
agtgctacacctgtgcgaatcctgt

SEQ ID NO: 215823 - DNA, 25 bp, Mus musculus
agtgctacagatcgtataagttttt

SEQ ID NO: 215824 - DNA, 25 bp, Mus musculus
agtgctacagatggtataagttttt

SEQ ID NO: 215825 - DNA, 25 bp, Mus musculus
agtgctacatacaagcccaaggcct

SEQ ID NO: 215826 - DNA, 25 bp, Mus musculus
agtgctacatactagcccaaggcct

SEQ ID NO: 215827 - DNA, 25 bp, Mus musculus
agtgctacatccagtcacgagatta

SEQ ID NO: 215828 - DNA, 25 bp, Mus musculus
agtgctacatcctgtcacgagatta

SEQ ID NO: 215829 - DNA, 25 bp, Mus musculus
agtgctaccactacagcctgatgtg

SEQ ID NO: 215830 - DNA, 25 bp, Mus musculus
agtgctaccacttcagcctgatgtg

SEQ ID NO: 215831 - DNA, 25 bp, Mus musculus
agtgctacccctcacctgataactt

SEQ ID NO: 215832 - DNA, 25 bp, Mus musculus
agtgctacccctgacctgataactt

SEQ ID NO: 215833 - DNA, 25 bp, Mus musculus
agtgctaccctcagggtcgatctga

SEQ ID NO: 215834 - DNA, 25 bp, Mus musculus
agtgctaccctctgggtcgatctga

SEQ ID NO: 215835 - DNA, 25 bp, Mus musculus
agtgctacgagaaatttcctttgga

SEQ ID NO: 215836 - DNA, 25 bp, Mus musculus
agtgctacgagatatttcctttgga

SEQ ID NO: 215837 - DNA, 25 bp, Mus musculus
agtgctactagcatgtgccgttctg

SEQ ID NO: 215838 - DNA, 25 bp, Mus musculus
agtgctactagcttgtgccgttctg

SEQ ID NO: 215839 - DNA, 25 bp, Mus musculus
agtgctactgctcctcagagctggc

SEQ ID NO: 215840 - DNA, 25 bp, Mus musculus
agtgctactgctgctcagagctggc

SEQ ID NO: 215841 - DNA, 25 bp, Mus musculus
agtgctactgtactgtgggacttca

SEQ ID NO: 215842 - DNA, 25 bp, Mus musculus
agtgctactgtagtgtgggacttca

SEQ ID NO: 215843 - DNA, 25 bp, Mus musculus
agtgctacttctattacagactaca

SEQ ID NO: 215844 - DNA, 25 bp, Mus musculus
agtgctacttcttttacagactaca

SEQ ID NO: 215845 - DNA, 25 bp, Mus musculus
agtgctactttacgagcccaggtct

SEQ ID NO: 215846 - DNA, 25 bp, Mus musculus
agtgctactttaggagcccaggtct

SEQ ID NO: 215847 - DNA, 25 bp, Mus musculus
agtgctagactaacatgtgttcata

SEQ ID NO: 215848 - DNA, 25 bp, Mus musculus
agtgctagactatcatgtgttcata

SEQ ID NO: 215849 - DNA, 25 bp, Mus musculus
agtgctagaggcatgggttcccctg

SEQ ID NO: 215850 - DNA, 25 bp, Mus musculus
agtgctagaggcttgggttcccctg

SEQ ID NO: 215851 - DNA, 25 bp, Mus musculus
agtgctagcattaggaggttctgta

SEQ ID NO: 215852 - DNA, 25 bp, Mus musculus
agtgctagcatttggaggttctgta

SEQ ID NO: 215853 - DNA, 25 bp, Mus musculus
agtgctagccagatatttaacatgc

SEQ ID NO: 215854 - DNA, 25 bp, Mus musculus
agtgctagccagttatttaacatgc

SEQ ID NO: 215855 - DNA, 25 bp, Mus musculus
agtgctagcctcaatatttactatg

SEQ ID NO: 215856 - DNA, 25 bp, Mus musculus
agtgctagcctctatatttactatg

SEQ ID NO: 215857 - DNA, 25 bp, Mus musculus
agtgctagcctgattcaacaccaga

SEQ ID NO: 215858 - DNA, 25 bp, Mus musculus
agtgctagcctgtttcaacaccaga

SEQ ID NO: 215859 - DNA, 25 bp, Mus musculus
agtgctagcgtcagtcttctcagtg

SEQ ID NO: 215860 - DNA, 25 bp, Mus musculus
agtgctagcgtctgtcttctcagtg

SEQ ID NO: 215861 - DNA, 25 bp, Mus musculus
agtgctaggaacagaacctgggccc

SEQ ID NO: 215862 - DNA, 25 bp, Mus musculus
agtgctaggaaccatacccaggacc

SEQ ID NO: 215863 - DNA, 25 bp, Mus musculus
agtgctaggaacgatacccaggacc

SEQ ID NO: 215864 - DNA, 25 bp, Mus musculus
agtgctaggaactgaacctgggccc

SEQ ID NO: 215865 - DNA, 25 bp, Mus musculus
agtgctaggagaccatctcatttct

SEQ ID NO: 215866 - DNA, 25 bp, Mus musculus
agtgctaggagagcatctcatttct

SEQ ID NO: 215867 - DNA, 25 bp, Mus musculus
agtgctagttctagatgcttcttta

SEQ ID NO: 215868 - DNA, 25 bp, Mus musculus
agtgctagttcttgatgcttcttta

SEQ ID NO: 215869 - DNA, 25 bp, Mus musculus
agtgctatagaaagcccgacctaga

SEQ ID NO: 215870 - DNA, 25 bp, Mus musculus
agtgctatagaatgcccgacctaga

SEQ ID NO: 215871 - DNA, 25 bp, Mus musculus
agtgctatagcactgaactttatac

SEQ ID NO: 215872 - DNA, 25 bp, Mus musculus
agtgctatagcagtgaactttatac

SEQ ID NO: 215873 - DNA, 25 bp, Mus musculus
agtgctatcaagaagccttagttag

SEQ ID NO: 215874 - DNA, 25 bp, Mus musculus
agtgctatcaagtagccttagttag

SEQ ID NO: 215875 - DNA, 25 bp, Mus musculus
agtgctatgcatagaaacttgtttt

SEQ ID NO: 215876 - DNA, 25 bp, Mus musculus
agtgctatgcattgaaacttgtttt

SEQ ID NO: 215877 - DNA, 25 bp, Mus musculus
agtgctattaccaagctcaagatca

SEQ ID NO: 215878 - DNA, 25 bp, Mus musculus
agtgctattacctagctcaagatca

SEQ ID NO: 215879 - DNA, 25 bp, Mus musculus
agtgctattctccttgtatccagaa

SEQ ID NO: 215880 - DNA, 25 bp, Mus musculus
agtgctattctcgttgtatccagaa

SEQ ID NO: 215881 - DNA, 25 bp, Mus musculus
agtgctattgatccttcttgatgta

SEQ ID NO: 215882 - DNA, 25 bp, Mus musculus
agtgctattgatgcttcttgatgta

SEQ ID NO: 215883 - DNA, 25 bp, Mus musculus
agtgctattggcagctgtgggcttc

SEQ ID NO: 215884 - DNA, 25 bp, Mus musculus
agtgctattggctgctgtgggcttc

SEQ ID NO: 215885 - DNA, 25 bp, Mus musculus
agtgctattgtacctactgtgttag

SEQ ID NO: 215886 - DNA, 25 bp, Mus musculus
agtgctattgtagctactgtgttag

SEQ ID NO: 215887 - DNA, 25 bp, Mus musculus
agtgctatttcactgctcctgggct

SEQ ID NO: 215888 - DNA, 25 bp, Mus musculus
agtgctatttcagtgctcctgggct

SEQ ID NO: 215889 - DNA, 25 bp, Mus musculus
agtgctcaaaagacgtggccgtcca

SEQ ID NO: 215890 - DNA, 25 bp, Mus musculus
agtgctcaaaagtcgtggccgtcca

SEQ ID NO: 215891 - DNA, 25 bp, Mus musculus
agtgctcaaactcacacctgtggct

SEQ ID NO: 215892 - DNA, 25 bp, Mus musculus
agtgctcaaactgacacctgtggct

SEQ ID NO: 215893 - DNA, 25 bp, Mus musculus
agtgctcaacccagtgactatggtc

SEQ ID NO: 215894 - DNA, 25 bp, Mus musculus
agtgctcaaccctgtgactatggtc

SEQ ID NO: 215895 - DNA, 25 bp, Mus musculus
agtgctcaactccagaccaggagtc

SEQ ID NO: 215896 - DNA, 25 bp, Mus musculus
agtgctcaactcgagaccaggagtc

SEQ ID NO: 215897 - DNA, 25 bp, Mus musculus
agtgctcaactgatatgtcattcag

SEQ ID NO: 215898 - DNA, 25 bp, Mus musculus
agtgctcaactgttatgtcattcag

SEQ ID NO: 215899 - DNA, 25 bp, Mus musculus
agtgctcacaggacagttgttacca

SEQ ID NO: 215900 - DNA, 25 bp, Mus musculus
agtgctcacaggtcagttgttacca

SEQ ID NO: 215901 - DNA, 25 bp, Mus musculus
agtgctcaccggaaggttcatacag

SEQ ID NO: 215902 - DNA, 25 bp, Mus musculus
agtgctcaccggtaggttcatacag

SEQ ID NO: 215903 - DNA, 25 bp, Mus musculus
agtgctcacctcaaagcctaaggag

SEQ ID NO: 215904 - DNA, 25 bp, Mus musculus
agtgctcacctcatatagctttcaa

SEQ ID NO: 215905 - DNA, 25 bp, Mus musculus
agtgctcacctctaagcctaaggag

SEQ ID NO: 215906 - DNA, 25 bp, Mus musculus
agtgctcacctcttatagctttcaa

SEQ ID NO: 215907 - DNA, 25 bp, Mus musculus
agtgctcacgcactcggtcaagaac

SEQ ID NO: 215908 - DNA, 25 bp, Mus musculus
agtgctcacgcagtcggtcaagaac

SEQ ID NO: 215909 - DNA, 25 bp, Mus musculus
agtgctcacttaactggtgctatgt

SEQ ID NO: 215910 - DNA, 25 bp, Mus musculus
agtgctcacttactgttgacaacaa

SEQ ID NO: 215911 - DNA, 25 bp, Mus musculus
agtgctcacttagtgttgacaacaa

SEQ ID NO: 215912 - DNA, 25 bp, Mus musculus
agtgctcacttatctggtgctatgt

SEQ ID NO: 215913 - DNA, 25 bp, Mus musculus
agtgctcagagtactgctacctcga

SEQ ID NO: 215914 - DNA, 25 bp, Mus musculus
agtgctcagagttctgctacctcga

SEQ ID NO: 215915 - DNA, 25 bp, Mus musculus
agtgctcagcacagccataaataaa

SEQ ID NO: 215916 - DNA, 25 bp, Mus musculus
agtgctcagcactgccataaataaa

SEQ ID NO: 215917 - DNA, 25 bp, Mus musculus
agtgctcaggccacgaacatgggaa

SEQ ID NO: 215918 - DNA, 25 bp, Mus musculus
agtgctcaggcctcgaacatgggaa

SEQ ID NO: 215919 - DNA, 25 bp, Mus musculus
agtgctcagggtagtgtgttgccca

SEQ ID NO: 215920 - DNA, 25 bp, Mus musculus
agtgctcagggttgtgtgttgccca

SEQ ID NO: 215921 - DNA, 25 bp, Mus musculus
agtgctcaggttacaggcaggctgc

SEQ ID NO: 215922 - DNA, 25 bp, Mus musculus
agtgctcaggttagagaggaaccat

SEQ ID NO: 215923 - DNA, 25 bp, Mus musculus
agtgctcaggtttcaggcaggctgc

SEQ ID NO: 215924 - DNA, 25 bp, Mus musculus
agtgctcaggtttgagaggaaccat

SEQ ID NO: 215925 - DNA, 25 bp, Mus musculus
agtgctcatctgactgatccaaaca

SEQ ID NO: 215926 - DNA, 25 bp, Mus musculus
agtgctcatctgtctgatccaaaca

SEQ ID NO: 215927 - DNA, 25 bp, Mus musculus
agtgctcatttccaagtgacagctg

SEQ ID NO: 215928 - DNA, 25 bp, Mus musculus
agtgctcatttcgaagtgacagctg

SEQ ID NO: 215929 - DNA, 25 bp, Mus musculus
agtgctccaaggctgaacaatagct

SEQ ID NO: 215930 - DNA, 25 bp, Mus musculus
agtgctccaagggtgaacaatagct

SEQ ID NO: 215931 - DNA, 25 bp, Mus musculus
agtgctccactaacggtcactcagg

SEQ ID NO: 215932 - DNA, 25 bp, Mus musculus
agtgctccactatcggtcactcagg

SEQ ID NO: 215933 - DNA, 25 bp, Mus musculus
agtgctccagcgaagagcccaggag

SEQ ID NO: 215934 - DNA, 25 bp, Mus musculus
agtgctccagcgtagagcccaggag

SEQ ID NO: 215935 - DNA, 25 bp, Mus musculus
agtgctccagttcctgggcttaaag

SEQ ID NO: 215936 - DNA, 25 bp, Mus musculus
agtgctccagttgctgggcttaaag

SEQ ID NO: 215937 - DNA, 25 bp, Mus musculus
agtgctcccagtcgatgttgccttg

SEQ ID NO: 215938 - DNA, 25 bp, Mus musculus
agtgctcccagtggatgttgccttg

SEQ ID NO: 215939 - DNA, 25 bp, Mus musculus
agtgctcccatgacactaaccatag

SEQ ID NO: 215940 - DNA, 25 bp, Mus musculus
agtgctcccatgtcactaaccatag

SEQ ID NO: 215941 - DNA, 25 bp, Mus musculus
agtgctccccagcagagtagaccgg

SEQ ID NO: 215942 - DNA, 25 bp, Mus musculus
agtgctccccaggagagtagaccgg

SEQ ID NO: 215943 - DNA, 25 bp, Mus musculus
agtgctccctaactcgaggttctgg

SEQ ID NO: 215944 - DNA, 25 bp, Mus musculus
agtgctccctaagtcgaggttctgg

SEQ ID NO: 215945 - DNA, 25 bp, Mus musculus
agtgctccctgtaattctgctgtaa

SEQ ID NO: 215946 - DNA, 25 bp, Mus musculus
agtgctccctgttattctgctgtaa

SEQ ID NO: 215947 - DNA, 25 bp, Mus musculus
agtgctccgtgcagtatgcgtgtgc

SEQ ID NO: 215948 - DNA, 25 bp, Mus musculus
agtgctccgtgctgtatgcgtgtgc

SEQ ID NO: 215949 - DNA, 25 bp, Mus musculus
agtgctccgttcctcagctcgagat

SEQ ID NO: 215950 - DNA, 25 bp, Mus musculus
agtgctccgttcgtcagctcgagat

SEQ ID NO: 215951 - DNA, 25 bp, Mus musculus
agtgctcctaacagttgagacaact

SEQ ID NO: 215952 - DNA, 25 bp, Mus musculus
agtgctcctaactgttgagacaact

SEQ ID NO: 215953 - DNA, 25 bp, Mus musculus
agtgctcctacaagaaccgccggaa

SEQ ID NO: 215954 - DNA, 25 bp, Mus musculus
agtgctcctacatgaaccgccggaa

SEQ ID NO: 215955 - DNA, 25 bp, Mus musculus
agtgctcctactcagggctatcaat

SEQ ID NO: 215956 - DNA, 25 bp, Mus musculus
agtgctcctactgagggctatcaat

SEQ ID NO: 215957 - DNA, 25 bp, Mus musculus
agtgctcctcatacctttgaagtag

SEQ ID NO: 215958 - DNA, 25 bp, Mus musculus
agtgctcctcattcctttgaagtag

SEQ ID NO: 215959 - DNA, 25 bp, Mus musculus
agtgctcctctgactatatagtgta

SEQ ID NO: 215960 - DNA, 25 bp, Mus musculus
agtgctcctctgagtggtcactgta

SEQ ID NO: 215961 - DNA, 25 bp, Mus musculus
agtgctcctctgcagttactcaagg

SEQ ID NO: 215962 - DNA, 25 bp, Mus musculus
agtgctcctctggagttactcaagg

SEQ ID NO: 215963 - DNA, 25 bp, Mus musculus
agtgctcctctgtctatatagtgta

SEQ ID NO: 215964 - DNA, 25 bp, Mus musculus
agtgctcctctgtgtggtcactgta

SEQ ID NO: 215965 - DNA, 25 bp, Mus musculus
agtgctcctgctagaactaactgtc

SEQ ID NO: 215966 - DNA, 25 bp, Mus musculus
agtgctcctgcttgaactaactgtc

SEQ ID NO: 215967 - DNA, 25 bp, Mus musculus
agtgctcctgttaccgcttaagttg

SEQ ID NO: 215968 - DNA, 25 bp, Mus musculus
agtgctcctgttacgggcagaagta

SEQ ID NO: 215969 - DNA, 25 bp, Mus musculus
agtgctcctgtttccgcttaagttg

SEQ ID NO: 215970 - DNA, 25 bp, Mus musculus
agtgctcctgtttcgggcagaagta

SEQ ID NO: 215971 - DNA, 25 bp, Mus musculus
agtgctcgagtgaatgtgcccattc

SEQ ID NO: 215972 - DNA, 25 bp, Mus musculus
agtgctcgagtgtatgtgcccattc

SEQ ID NO: 215973 - DNA, 25 bp, Mus musculus
agtgctcgcctcatggaagccatga

SEQ ID NO: 215974 - DNA, 25 bp, Mus musculus
agtgctcgcctcttggaagccatga

SEQ ID NO: 215975 - DNA, 25 bp, Mus musculus
agtgctcgctatcccagggatctcc

SEQ ID NO: 215976 - DNA, 25 bp, Mus musculus
agtgctcgctatgccagggatctcc

SEQ ID NO: 215977 - DNA, 25 bp, Mus musculus
agtgctcgctccaaggtcttaagtt

SEQ ID NO: 215978 - DNA, 25 bp, Mus musculus
agtgctcgctcctaggtcttaagtt

SEQ ID NO: 215979 - DNA, 25 bp, Mus musculus
agtgctcgctgcacagagactgtca

SEQ ID NO: 215980 - DNA, 25 bp, Mus musculus
agtgctcgctgctcagagactgtca

SEQ ID NO: 215981 - DNA, 25 bp, Mus musculus
agtgctcgctggagctctgagatgc

SEQ ID NO: 215982 - DNA, 25 bp, Mus musculus
agtgctcgctggtgctctgagatgc

SEQ ID NO: 215983 - DNA, 25 bp, Mus musculus
agtgctcggcaaccatttctaccaa

SEQ ID NO: 215984 - DNA, 25 bp, Mus musculus
agtgctcggcaagcatttctaccaa

SEQ ID NO: 215985 - DNA, 25 bp, Mus musculus
agtgctcggctccatttccaaatgt

SEQ ID NO: 215986 - DNA, 25 bp, Mus musculus
agtgctcggctcgatttccaaatgt

SEQ ID NO: 215987 - DNA, 25 bp, Mus musculus
agtgctcgggacaggcaaatgagaa

SEQ ID NO: 215988 - DNA, 25 bp, Mus musculus
agtgctcgggactggcaaatgagaa

SEQ ID NO: 215989 - DNA, 25 bp, Mus musculus
agtgctcgtcggatataaaccctca

SEQ ID NO: 215990 - DNA, 25 bp, Mus musculus
agtgctcgtcggttataaaccctca

SEQ ID NO: 215991 - DNA, 25 bp, Mus musculus
agtgctcgtgccaacatcacgctgt

SEQ ID NO: 215992 - DNA, 25 bp, Mus musculus
agtgctcgtgcctacatcacgctgt

SEQ ID NO: 215993 - DNA, 25 bp, Mus musculus
agtgctctaactattccttacaatc

SEQ ID NO: 215994 - DNA, 25 bp, Mus musculus
agtgctctaacttttccttacaatc

SEQ ID NO: 215995 - DNA, 25 bp, Mus musculus
agtgctctaccactgggtcacactc

SEQ ID NO: 215996 - DNA, 25 bp, Mus musculus
agtgctctaccagtgggtcacactc

SEQ ID NO: 215997 - DNA, 25 bp, Mus musculus
agtgctctactaagccacctgcaag

SEQ ID NO: 215998 - DNA, 25 bp, Mus musculus
agtgctctactatgccacctgcaag

SEQ ID NO: 215999 - DNA, 25 bp, Mus musculus
agtgctctactcacttgttataacc

SEQ ID NO: 216000 - DNA, 25 bp, Mus musculus
agtgctctactctcttgttataacc

SEQ ID NO: 216001 - DNA, 25 bp, Mus musculus
agtgctctagtgctgtaggaaccaa

SEQ ID NO: 216002 - DNA, 25 bp, Mus musculus
agtgctctagtggtgtaggaaccaa

SEQ ID NO: 216003 - DNA, 25 bp, Mus musculus
agtgctctcaatagctgagcccctg

SEQ ID NO: 216004 - DNA, 25 bp, Mus musculus
agtgctctcaattgctgagcccctg

SEQ ID NO: 216005 - DNA, 25 bp, Mus musculus
agtgctctccttactagcaaattgc

SEQ ID NO: 216006 - DNA, 25 bp, Mus musculus
agtgctctcctttctagcaaattgc

SEQ ID NO: 216007 - DNA, 25 bp, Mus musculus
agtgctctgagcagggtactaacca

SEQ ID NO: 216008 - DNA, 25 bp, Mus musculus
agtgctctgagctgggtactaacca

SEQ ID NO: 216009 - DNA, 25 bp, Mus musculus
agtgctctgatacaattcctctatg

SEQ ID NO: 216010 - DNA, 25 bp, Mus musculus
agtgctctgatagaattcctctatg

SEQ ID NO: 216011 - DNA, 25 bp, Mus musculus
agtgctctggagaactttgtttata

SEQ ID NO: 216012 - DNA, 25 bp, Mus musculus
agtgctctggagtactttgtttata

SEQ ID NO: 216013 - DNA, 25 bp, Mus musculus
agtgctctgggacatcatgcaggtt

SEQ ID NO: 216014 - DNA, 25 bp, Mus musculus
agtgctctgggagatcatgcaggtt

SEQ ID NO: 216015 - DNA, 25 bp, Mus musculus
agtgctctgtaaacgggtgatgacc

SEQ ID NO: 216016 - DNA, 25 bp, Mus musculus
agtgctctgtaatcgggtgatgacc

SEQ ID NO: 216017 - DNA, 25 bp, Mus musculus
agtgctctgtccctgtagcgtctga

SEQ ID NO: 216018 - DNA, 25 bp, Mus musculus
agtgctctgtccgtgtagcgtctga

SEQ ID NO: 216019 - DNA, 25 bp, Mus musculus
agtgctctgtgccagtgtttgacat

SEQ ID NO: 216020 - DNA, 25 bp, Mus musculus
agtgctctgtgcgagtgtttgacat

SEQ ID NO: 216021 - DNA, 25 bp, Mus musculus
agtgctctgtgtatacagctgctca

SEQ ID NO: 216022 - DNA, 25 bp, Mus musculus
agtgctctgtgtatgaagcttgccg

SEQ ID NO: 216023 - DNA, 25 bp, Mus musculus
agtgctctgtgtttacagctgctca

SEQ ID NO: 216024 - DNA, 25 bp, Mus musculus
agtgctctgtgtttgaagcttgccg

SEQ ID NO: 216025 - DNA, 25 bp, Mus musculus
agtgctcttaacagtcctaacaacc

SEQ ID NO: 216026 - DNA, 25 bp, Mus musculus
agtgctcttaactgtcctaacaacc

SEQ ID NO: 216027 - DNA, 25 bp, Mus musculus
agtgctcttccactttgactaggac

SEQ ID NO: 216028 - DNA, 25 bp, Mus musculus
agtgctcttccagtttgactaggac

SEQ ID NO: 216029 - DNA, 25 bp, Mus musculus
agtgctcttcttcgactcttaattc

SEQ ID NO: 216030 - DNA, 25 bp, Mus musculus
agtgctcttcttggactcttaattc

SEQ ID NO: 216031 - DNA, 25 bp, Mus musculus
agtgctcttttcagaccacttaaga

SEQ ID NO: 216032 - DNA, 25 bp, Mus musculus
agtgctcttttctgaccacttaaga

SEQ ID NO: 216033 - DNA, 25 bp, Mus musculus
agtgctgaacgtatctcaattcttc

SEQ ID NO: 216034 - DNA, 25 bp, Mus musculus
agtgctgaacgtttctcaattcttc

SEQ ID NO: 216035 - DNA, 25 bp, Mus musculus
agtgctgaatgtattaagacctcgc

SEQ ID NO: 216036 - DNA, 25 bp, Mus musculus
agtgctgaatgttttaagacctcgc

SEQ ID NO: 216037 - DNA, 25 bp, Mus musculus
agtgctgacagcaactggtgcagtt

SEQ ID NO: 216038 - DNA, 25 bp, Mus musculus
agtgctgacagcctttttaaccaac

SEQ ID NO: 216039 - DNA, 25 bp, Mus musculus
agtgctgacagcgtttttaaccaac

SEQ ID NO: 216040 - DNA, 25 bp, Mus musculus
agtgctgacagctactggtgcagtt

SEQ ID NO: 216041 - DNA, 25 bp, Mus musculus
agtgctgaccgcattaatttttgtg

SEQ ID NO: 216042 - DNA, 25 bp, Mus musculus
agtgctgaccgcctgaacaatatca

SEQ ID NO: 216043 - DNA, 25 bp, Mus musculus
agtgctgaccgcgtgaacaatatca

SEQ ID NO: 216044 - DNA, 25 bp, Mus musculus
agtgctgaccgctttaatttttgtg

SEQ ID NO: 216045 - DNA, 25 bp, Mus musculus
agtgctgactcaagggcatgcttct

SEQ ID NO: 216046 - DNA, 25 bp, Mus musculus
agtgctgactcatgggcatgcttct

SEQ ID NO: 216047 - DNA, 25 bp, Mus musculus
agtgctgactcgaaatgctattttg

SEQ ID NO: 216048 - DNA, 25 bp, Mus musculus
agtgctgactcgtaatgctattttg

SEQ ID NO: 216049 - DNA, 25 bp, Mus musculus
agtgctgactctcttgtatgaccca

SEQ ID NO: 216050 - DNA, 25 bp, Mus musculus
agtgctgactctgttgtatgaccca

SEQ ID NO: 216051 - DNA, 25 bp, Mus musculus
agtgctgactggacacttgaaggct

SEQ ID NO: 216052 - DNA, 25 bp, Mus musculus
agtgctgactggtcacttgaaggct

SEQ ID NO: 216053 - DNA, 25 bp, Mus musculus
agtgctgagaaaaggcgcgcccatt

SEQ ID NO: 216054 - DNA, 25 bp, Mus musculus
agtgctgagaaatggcgcgcccatt

SEQ ID NO: 216055 - DNA, 25 bp, Mus musculus
agtgctgagattaagagcttgcctc

SEQ ID NO: 216056 - DNA, 25 bp, Mus musculus
agtgctgagatttagagcttgcctc

SEQ ID NO: 216057 - DNA, 25 bp, Mus musculus
agtgctgagctgcatcatgtttgcc

SEQ ID NO: 216058 - DNA, 25 bp, Mus musculus
agtgctgagctggatcatgtttgcc

SEQ ID NO: 216059 - DNA, 25 bp, Mus musculus
agtgctgaggacattctcatggctc

SEQ ID NO: 216060 - DNA, 25 bp, Mus musculus
agtgctgaggactttctcatggctc

SEQ ID NO: 216061 - DNA, 25 bp, Mus musculus
agtgctgaggccctagccaaagatg

SEQ ID NO: 216062 - DNA, 25 bp, Mus musculus
agtgctgaggccgtagccaaagatg

SEQ ID NO: 216063 - DNA, 25 bp, Mus musculus
agtgctgagtagactaccttctcca

SEQ ID NO: 216064 - DNA, 25 bp, Mus musculus
agtgctgagtagtctaccttctcca

SEQ ID NO: 216065 - DNA, 25 bp, Mus musculus
agtgctgagttgatgtttggcctct

SEQ ID NO: 216066 - DNA, 25 bp, Mus musculus
agtgctgagttgttgtttggcctct

SEQ ID NO: 216067 - DNA, 25 bp, Mus musculus
agtgctgataaaactcatactgaat

SEQ ID NO: 216068 - DNA, 25 bp, Mus musculus
agtgctgataaatctcatactgaat

SEQ ID NO: 216069 - DNA, 25 bp, Mus musculus
agtgctgatcctcaattggccctgg

SEQ ID NO: 216070 - DNA, 25 bp, Mus musculus
agtgctgatcctgaattggccctgg

SEQ ID NO: 216071 - DNA, 25 bp, Mus musculus
agtgctgattcaccccagagggtta

SEQ ID NO: 216072 - DNA, 25 bp, Mus musculus
agtgctgattcagcccagagggtta

SEQ ID NO: 216073 - DNA, 25 bp, Mus musculus
agtgctgcaatcaaaataaaagtat

SEQ ID NO: 216074 - DNA, 25 bp, Mus musculus
agtgctgcaatctaaataaaagtat

SEQ ID NO: 216075 - DNA, 25 bp, Mus musculus
agtgctgcacagatcagttctttgt

SEQ ID NO: 216076 - DNA, 25 bp, Mus musculus
agtgctgcacagttcagttctttgt

SEQ ID NO: 216077 - DNA, 25 bp, Mus musculus
agtgctgcaccccaaaaggtaccag

SEQ ID NO: 216078 - DNA, 25 bp, Mus musculus
agtgctgcacccgaaaaggtaccag

SEQ ID NO: 216079 - DNA, 25 bp, Mus musculus
agtgctgcacctcaagtccatctaa

SEQ ID NO: 216080 - DNA, 25 bp, Mus musculus
agtgctgcacctgaagtccatctaa

SEQ ID NO: 216081 - DNA, 25 bp, Mus musculus
agtgctgcacgccaagagacttgga

SEQ ID NO: 216082 - DNA, 25 bp, Mus musculus
agtgctgcacgcgaagagacttgga

SEQ ID NO: 216083 - DNA, 25 bp, Mus musculus
agtgctgcactcatggctctgcgga

SEQ ID NO: 216084 - DNA, 25 bp, Mus musculus
agtgctgcactcttggctctgcgga

SEQ ID NO: 216085 - DNA, 25 bp, Mus musculus
agtgctgcagaccaccctgaaatag

SEQ ID NO: 216086 - DNA, 25 bp, Mus musculus
agtgctgcagacgaccctgaaatag

SEQ ID NO: 216087 - DNA, 25 bp, Mus musculus
agtgctgcagagatggtgtccattc

SEQ ID NO: 216088 - DNA, 25 bp, Mus musculus
agtgctgcagagttggtgtccattc

SEQ ID NO: 216089 - DNA, 25 bp, Mus musculus
agtgctgcagccagtgaagctttca

SEQ ID NO: 216090 - DNA, 25 bp, Mus musculus
agtgctgcagcctgtgaagctttca

SEQ ID NO: 216091 - DNA, 25 bp, Mus musculus
agtgctgcagctacaggttcacaca

SEQ ID NO: 216092 - DNA, 25 bp, Mus musculus
agtgctgcagcttcaggttcacaca

SEQ ID NO: 216093 - DNA, 25 bp, Mus musculus
agtgctgcagttaagatacctctgg

SEQ ID NO: 216094 - DNA, 25 bp, Mus musculus
agtgctgcagttaatcccaccttgg

SEQ ID NO: 216095 - DNA, 25 bp, Mus musculus
agtgctgcagtttagatacctctgg

SEQ ID NO: 216096 - DNA, 25 bp, Mus musculus
agtgctgcagtttatcccaccttgg

SEQ ID NO: 216097 - DNA, 25 bp, Mus musculus
agtgctgccactaagagatcatcct

SEQ ID NO: 216098 - DNA, 25 bp, Mus musculus
agtgctgccacttagagatcatcct

SEQ ID NO: 216099 - DNA, 25 bp, Mus musculus
agtgctgccatgatcctcaaagcat

SEQ ID NO: 216100 - DNA, 25 bp, Mus musculus
agtgctgccatgttcctcaaagcat

SEQ ID NO: 216101 - DNA, 25 bp, Mus musculus
agtgctgcccagcagtaccaacgac

SEQ ID NO: 216102 - DNA, 25 bp, Mus musculus
agtgctgcccaggagtaccaacgac

SEQ ID NO: 216103 - DNA, 25 bp, Mus musculus
agtgctgccccaaaatactgtttca

SEQ ID NO: 216104 - DNA, 25 bp, Mus musculus
agtgctgccccacatcgagaaactg

SEQ ID NO: 216105 - DNA, 25 bp, Mus musculus
agtgctgccccagatcgagaaactg

SEQ ID NO: 216106 - DNA, 25 bp, Mus musculus
agtgctgccccataatactgtttca

SEQ ID NO: 216107 - DNA, 25 bp, Mus musculus
agtgctgcctagcaacctgagctga

SEQ ID NO: 216108 - DNA, 25 bp, Mus musculus
agtgctgcctaggaacctgagctga

SEQ ID NO: 216109 - DNA, 25 bp, Mus musculus
agtgctgcctcactggccgctgcag

SEQ ID NO: 216110 - DNA, 25 bp, Mus musculus
agtgctgcctcagtggccgctgcag

SEQ ID NO: 216111 - DNA, 25 bp, Mus musculus
agtgctgcctgaagctgcgcctggc

SEQ ID NO: 216112 - DNA, 25 bp, Mus musculus
agtgctgcctgatgctgcgcctggc

SEQ ID NO: 216113 - DNA, 25 bp, Mus musculus
agtgctgcctgcatctgaccaagaa

SEQ ID NO: 216114 - DNA, 25 bp, Mus musculus
agtgctgcctgcttctgaccaagaa

SEQ ID NO: 216115 - DNA, 25 bp, Mus musculus
agtgctgccttcattctgcttgaga

SEQ ID NO: 216116 - DNA, 25 bp, Mus musculus
agtgctgccttctttctgcttgaga

SEQ ID NO: 216117 - DNA, 25 bp, Mus musculus
agtgctgcgcagaacctatctgtag

SEQ ID NO: 216118 - DNA, 25 bp, Mus musculus
agtgctgcgcagtacctatctgtag

SEQ ID NO: 216119 - DNA, 25 bp, Mus musculus
agtgctgctaatatggtaacaaacc

SEQ ID NO: 216120 - DNA, 25 bp, Mus musculus
agtgctgctaatttggtaacaaacc

SEQ ID NO: 216121 - DNA, 25 bp, Mus musculus
agtgctgctcatcggatccatcaag

SEQ ID NO: 216122 - DNA, 25 bp, Mus musculus
agtgctgctcatgggatccatcaag

SEQ ID NO: 216123 - DNA, 25 bp, Mus musculus
agtgctgctgaacctttttgtgctg

SEQ ID NO: 216124 - DNA, 25 bp, Mus musculus
agtgctgctgaagctttttgtgctg

SEQ ID NO: 216125 - DNA, 25 bp, Mus musculus
agtgctgctgaccaatctgattctc

SEQ ID NO: 216126 - DNA, 25 bp, Mus musculus
agtgctgctgacgaatctgattctc

SEQ ID NO: 216127 - DNA, 25 bp, Mus musculus
agtgctgctgcgacccaggcagaga

SEQ ID NO: 216128 - DNA, 25 bp, Mus musculus
agtgctgctgcgtcccaggcagaga

SEQ ID NO: 216129 - DNA, 25 bp, Mus musculus
agtgctgctgggatcaactgatcct

SEQ ID NO: 216130 - DNA, 25 bp, Mus musculus
agtgctgctgggttcaactgatcct

SEQ ID NO: 216131 - DNA, 25 bp, Mus musculus
agtgctgctgtgactaatctctctc

SEQ ID NO: 216132 - DNA, 25 bp, Mus musculus
agtgctgctgtgtctaatctctctc

SEQ ID NO: 216133 - DNA, 25 bp, Mus musculus
agtgctgcttgcaggtctgcttcgc

SEQ ID NO: 216134 - DNA, 25 bp, Mus musculus
agtgctgcttgctggtctgcttcgc

SEQ ID NO: 216135 - DNA, 25 bp, Mus musculus
agtgctgctttcactcgggctatta

SEQ ID NO: 216136 - DNA, 25 bp, Mus musculus
agtgctgctttctctcgggctatta

SEQ ID NO: 216137 - DNA, 25 bp, Mus musculus
agtgctggaccgagtctgcttccta

SEQ ID NO: 216138 - DNA, 25 bp, Mus musculus
agtgctggaccgtgtctgcttccta

SEQ ID NO: 216139 - DNA, 25 bp, Mus musculus
agtgctggagagagctatggccttt

SEQ ID NO: 216140 - DNA, 25 bp, Mus musculus
agtgctggagagtgctatggccttt

SEQ ID NO: 216141 - DNA, 25 bp, Mus musculus
agtgctggatcactctgttctctgc

SEQ ID NO: 216142 - DNA, 25 bp, Mus musculus
agtgctggatcagtctgttctctgc

SEQ ID NO: 216143 - DNA, 25 bp, Mus musculus
agtgctggcaaacttcttggactgc

SEQ ID NO: 216144 - DNA, 25 bp, Mus musculus
agtgctggcaaagttcttggactgc

SEQ ID NO: 216145 - DNA, 25 bp, Mus musculus
agtgctggcactccagatgtgtact

SEQ ID NO: 216146 - DNA, 25 bp, Mus musculus
agtgctggcactgcagatgtgtact

SEQ ID NO: 216147 - DNA, 25 bp, Mus musculus
agtgctggccccacaagcatgagga

SEQ ID NO: 216148 - DNA, 25 bp, Mus musculus
agtgctggcccctcaagcatgagga

SEQ ID NO: 216149 - DNA, 25 bp, Mus musculus
agtgctggccttcacatccgtgtac

SEQ ID NO: 216150 - DNA, 25 bp, Mus musculus
agtgctggccttgacatccgtgtac

SEQ ID NO: 216151 - DNA, 25 bp, Mus musculus
agtgctgggaacacaccatgtggaa

SEQ ID NO: 216152 - DNA, 25 bp, Mus musculus
agtgctgggaactcaccatgtggaa

SEQ ID NO: 216153 - DNA, 25 bp, Mus musculus
agtgctgggccaattgtacttgctt

SEQ ID NO: 216154 - DNA, 25 bp, Mus musculus
agtgctgggccatttgtacttgctt

SEQ ID NO: 216155 - DNA, 25 bp, Mus musculus
agtgctgggcgcagaatcctgcctc

SEQ ID NO: 216156 - DNA, 25 bp, Mus musculus
agtgctgggcgctgaatcctgcctc

SEQ ID NO: 216157 - DNA, 25 bp, Mus musculus
agtgctgggtataggactaaagtga

SEQ ID NO: 216158 - DNA, 25 bp, Mus musculus
agtgctgggtattggactaaagtga

SEQ ID NO: 216159 - DNA, 25 bp, Mus musculus
agtgctgggtgtcaatgcagaacct

SEQ ID NO: 216160 - DNA, 25 bp, Mus musculus
agtgctgggtgtgaatgcagaacct

SEQ ID NO: 216161 - DNA, 25 bp, Mus musculus
agtgctggtactctcagatactgac

SEQ ID NO: 216162 - DNA, 25 bp, Mus musculus
agtgctggtactgtcagatactgac

SEQ ID NO: 216163 - DNA, 25 bp, Mus musculus
agtgctggtatcagaacccatccgc

SEQ ID NO: 216164 - DNA, 25 bp, Mus musculus
agtgctggtatctgaacccatccgc

SEQ ID NO: 216165 - DNA, 25 bp, Mus musculus
agtgctggtccactaactctgttga

SEQ ID NO: 216166 - DNA, 25 bp, Mus musculus
agtgctggtccagtaactctgttga

SEQ ID NO: 216167 - DNA, 25 bp, Mus musculus
agtgctggtgctcaagtgcatcctc

SEQ ID NO: 216168 - DNA, 25 bp, Mus musculus
agtgctggtgctgaagtgcatcctc

SEQ ID NO: 216169 - DNA, 25 bp, Mus musculus
agtgctggttgcaagctactgtacc

SEQ ID NO: 216170 - DNA, 25 bp, Mus musculus
agtgctggttgcctcagtgtatccc

SEQ ID NO: 216171 - DNA, 25 bp, Mus musculus
agtgctggttgcgtcagtgtatccc

SEQ ID NO: 216172 - DNA, 25 bp, Mus musculus
agtgctggttgctagctactgtacc

SEQ ID NO: 216173 - DNA, 25 bp, Mus musculus
agtgctggtttgacggcaccctcac

SEQ ID NO: 216174 - DNA, 25 bp, Mus musculus
agtgctggtttgtcggcaccctcac

SEQ ID NO: 216175 - DNA, 25 bp, Mus musculus
agtgctgtaattagtttgctatgag

SEQ ID NO: 216176 - DNA, 25 bp, Mus musculus
agtgctgtaatttgtttgctatgag

SEQ ID NO: 216177 - DNA, 25 bp, Mus musculus
agtgctgtagagactgtttgtgttg

SEQ ID NO: 216178 - DNA, 25 bp, Mus musculus
agtgctgtagagtctgtttgtgttg

SEQ ID NO: 216179 - DNA, 25 bp, Mus musculus
agtgctgtagcaatcaccaccatca

SEQ ID NO: 216180 - DNA, 25 bp, Mus musculus
agtgctgtagcattcaccaccatca

SEQ ID NO: 216181 - DNA, 25 bp, Mus musculus
agtgctgtatccacacccatgtttg

SEQ ID NO: 216182 - DNA, 25 bp, Mus musculus
agtgctgtatcctcacccatgtttg

SEQ ID NO: 216183 - DNA, 25 bp, Mus musculus
agtgctgtatggacgtttctctctc

SEQ ID NO: 216184 - DNA, 25 bp, Mus musculus
agtgctgtatggtcgtttctctctc

SEQ ID NO: 216185 - DNA, 25 bp, Mus musculus
agtgctgtattcaccatttgcttaa

SEQ ID NO: 216186 - DNA, 25 bp, Mus musculus
agtgctgtattctccatttgcttaa

SEQ ID NO: 216187 - DNA, 25 bp, Mus musculus
agtgctgtatttcttggttgggcta

SEQ ID NO: 216188 - DNA, 25 bp, Mus musculus
agtgctgtatttgttggttgggcta

SEQ ID NO: 216189 - DNA, 25 bp, Mus musculus
agtgctgtcaacatttgcttggtgt

SEQ ID NO: 216190 - DNA, 25 bp, Mus musculus
agtgctgtcaacttttgcttggtgt

SEQ ID NO: 216191 - DNA, 25 bp, Mus musculus
agtgctgtcaatccagccttgtgga

SEQ ID NO: 216192 - DNA, 25 bp, Mus musculus
agtgctgtcaatgcagccttgtgga

SEQ ID NO: 216193 - DNA, 25 bp, Mus musculus
agtgctgtcactctaaagagccagg

SEQ ID NO: 216194 - DNA, 25 bp, Mus musculus
agtgctgtcactgtaaagagccagg

SEQ ID NO: 216195 - DNA, 25 bp, Mus musculus
agtgctgtcagccatcagtgcctca

SEQ ID NO: 216196 - DNA, 25 bp, Mus musculus
agtgctgtcagcgatcagtgcctca

SEQ ID NO: 216197 - DNA, 25 bp, Mus musculus
agtgctgtcataccaggctttccca

SEQ ID NO: 216198 - DNA, 25 bp, Mus musculus
agtgctgtcatagcaggctttccca

SEQ ID NO: 216199 - DNA, 25 bp, Mus musculus
agtgctgtccacaggcagggaaaat

SEQ ID NO: 216200 - DNA, 25 bp, Mus musculus
agtgctgtccactggcagggaaaat

SEQ ID NO: 216201 - DNA, 25 bp, Mus musculus
agtgctgtccagaactgaggcgcct

SEQ ID NO: 216202 - DNA, 25 bp, Mus musculus
agtgctgtccagtactgaggcgcct

SEQ ID NO: 216203 - DNA, 25 bp, Mus musculus
agtgctgtcctgattgatgtttgtc

SEQ ID NO: 216204 - DNA, 25 bp, Mus musculus
agtgctgtcctgtttgatgtttgtc

SEQ ID NO: 216205 - DNA, 25 bp, Mus musculus
agtgctgtcttacccatttgttgac

SEQ ID NO: 216206 - DNA, 25 bp, Mus musculus
agtgctgtcttagccatttgttgac

SEQ ID NO: 216207 - DNA, 25 bp, Mus musculus
agtgctgtctttactcatccagagt

SEQ ID NO: 216208 - DNA, 25 bp, Mus musculus
agtgctgtcttttctcatccagagt

SEQ ID NO: 216209 - DNA, 25 bp, Mus musculus
agtgctgtgataagcttcattctgg

SEQ ID NO: 216210 - DNA, 25 bp, Mus musculus
agtgctgtgatatgcttcattctgg

SEQ ID NO: 216211 - DNA, 25 bp, Mus musculus
agtgctgtgattctgctcaggacta

SEQ ID NO: 216212 - DNA, 25 bp, Mus musculus
agtgctgtgattgtgctcaggacta

SEQ ID NO: 216213 - DNA, 25 bp, Mus musculus
agtgctgtgcatctgtcccggttaa

SEQ ID NO: 216214 - DNA, 25 bp, Mus musculus
agtgctgtgcatgtgtcccggttaa

SEQ ID NO: 216215 - DNA, 25 bp, Mus musculus
agtgctgtggagacactcagtgctt

SEQ ID NO: 216216 - DNA, 25 bp, Mus musculus
agtgctgtggagtcactcagtgctt

SEQ ID NO: 216217 - DNA, 25 bp, Mus musculus
agtgctgtggatactattgcccttc

SEQ ID NO: 216218 - DNA, 25 bp, Mus musculus
agtgctgtggattctattgcccttc

SEQ ID NO: 216219 - DNA, 25 bp, Mus musculus
agtgctgtggcaactctccgggaag

SEQ ID NO: 216220 - DNA, 25 bp, Mus musculus
agtgctgtggcaagtcttgggccca

SEQ ID NO: 216221 - DNA, 25 bp, Mus musculus
agtgctgtggcatctctccgggaag

SEQ ID NO: 216222 - DNA, 25 bp, Mus musculus
agtgctgtggcatgtcttgggccca

SEQ ID NO: 216223 - DNA, 25 bp, Mus musculus
agtgctgtggccacttaggctggca

SEQ ID NO: 216224 - DNA, 25 bp, Mus musculus
agtgctgtggcctcttaggctggca

SEQ ID NO: 216225 - DNA, 25 bp, Mus musculus
agtgctgtgtctcacacctgagggc

SEQ ID NO: 216226 - DNA, 25 bp, Mus musculus
agtgctgtgtctgacacctgagggc

SEQ ID NO: 216227 - DNA, 25 bp, Mus musculus
agtgctgtgtgaaatcaagccagta

SEQ ID NO: 216228 - DNA, 25 bp, Mus musculus
agtgctgtgtgaagtgggttctttc

SEQ ID NO: 216229 - DNA, 25 bp, Mus musculus
agtgctgtgtgatatcaagccagta

SEQ ID NO: 216230 - DNA, 25 bp, Mus musculus
agtgctgtgtgatgtgggttctttc

SEQ ID NO: 216231 - DNA, 25 bp, Mus musculus
agtgctgtgttcacacttccgtaaa

SEQ ID NO: 216232 - DNA, 25 bp, Mus musculus
agtgctgtgttctcacttccgtaaa

SEQ ID NO: 216233 - DNA, 25 bp, Mus musculus
agtgctgttaacaggatgttgcgga

SEQ ID NO: 216234 - DNA, 25 bp, Mus musculus
agtgctgttaactggatgttgcgga

SEQ ID NO: 216235 - DNA, 25 bp, Mus musculus
agtgctgttaagacttcagtctgtt

SEQ ID NO: 216236 - DNA, 25 bp, Mus musculus
agtgctgttaagtcttcagtctgtt

SEQ ID NO: 216237 - DNA, 25 bp, Mus musculus
agtgctgttcaaacaccaacaggag

SEQ ID NO: 216238 - DNA, 25 bp, Mus musculus
agtgctgttcaacttgagttaccat

SEQ ID NO: 216239 - DNA, 25 bp, Mus musculus
agtgctgttcaagttgagttaccat

SEQ ID NO: 216240 - DNA, 25 bp, Mus musculus
agtgctgttcaatcaccaacaggag

SEQ ID NO: 216241 - DNA, 25 bp, Mus musculus
agtgctgttcagctattttctgttc

SEQ ID NO: 216242 - DNA, 25 bp, Mus musculus
agtgctgttcaggtattttctgttc

SEQ ID NO: 216243 - DNA, 25 bp, Mus musculus
agtgctgttgtaatcggctcagtgt

SEQ ID NO: 216244 - DNA, 25 bp, Mus musculus
agtgctgttgtattcggctcagtgt

SEQ ID NO: 216245 - DNA, 25 bp, Mus musculus
agtgctgtttagagaggaaccctaa

SEQ ID NO: 216246 - DNA, 25 bp, Mus musculus
agtgctgtttagtgaggaaccctaa

SEQ ID NO: 216247 - DNA, 25 bp, Mus musculus
agtgctgtttataaatcttagtgta

SEQ ID NO: 216248 - DNA, 25 bp, Mus musculus
agtgctgtttattaatcttagtgta

SEQ ID NO: 216249 - DNA, 25 bp, Mus musculus
agtgctgtttgtcccttttttgatc

SEQ ID NO: 216250 - DNA, 25 bp, Mus musculus
agtgctgtttgtgccttttttgatc

SEQ ID NO: 216251 - DNA, 25 bp, Mus musculus
agtgcttaatctattctgcctttgc

SEQ ID NO: 216252 - DNA, 25 bp, Mus musculus
agtgcttaatcttttctgcctttgc

SEQ ID NO: 216253 - DNA, 25 bp, Mus musculus
agtgcttacacacttaccatctcta

SEQ ID NO: 216254 - DNA, 25 bp, Mus musculus
agtgcttacacagttaccatctcta

SEQ ID NO: 216255 - DNA, 25 bp, Mus musculus
agtgcttacaccagtgacagcccca

SEQ ID NO: 216256 - DNA, 25 bp, Mus musculus
agtgcttacacctgtgacagcccca

SEQ ID NO: 216257 - DNA, 25 bp, Mus musculus
agtgcttaccttaagagggtcgcct

SEQ ID NO: 216258 - DNA, 25 bp, Mus musculus
agtgcttacctttagagggtcgcct

SEQ ID NO: 216259 - DNA, 25 bp, Mus musculus
agtgcttacggccattgttgttcgt

SEQ ID NO: 216260 - DNA, 25 bp, Mus musculus
agtgcttacggcgattgttgttcgt

SEQ ID NO: 216261 - DNA, 25 bp, Mus musculus
agtgcttagaatctgttctcatgag

SEQ ID NO: 216262 - DNA, 25 bp, Mus musculus
agtgcttagaatgtgttctcatgag

SEQ ID NO: 216263 - DNA, 25 bp, Mus musculus
agtgcttagccgaagagctcccgca

SEQ ID NO: 216264 - DNA, 25 bp, Mus musculus
agtgcttagccgtagagctcccgca

SEQ ID NO: 216265 - DNA, 25 bp, Mus musculus
agtgcttagtaactacccaggctta

SEQ ID NO: 216266 - DNA, 25 bp, Mus musculus
agtgcttagtaagtacccaggctta

SEQ ID NO: 216267 - DNA, 25 bp, Mus musculus
agtgcttagtatatgtgcccttcag

SEQ ID NO: 216268 - DNA, 25 bp, Mus musculus
agtgcttagtatttgtgcccttcag

SEQ ID NO: 216269 - DNA, 25 bp, Mus musculus
agtgcttatccacagagaccccagg

SEQ ID NO: 216270 - DNA, 25 bp, Mus musculus
agtgcttatccagagagaccccagg

SEQ ID NO: 216271 - DNA, 25 bp, Mus musculus
agtgcttatcccctgagcagcagct

SEQ ID NO: 216272 - DNA, 25 bp, Mus musculus
agtgcttatcccgtgagcagcagct

SEQ ID NO: 216273 - DNA, 25 bp, Mus musculus
agtgcttatcttcgcatttcctcaa

SEQ ID NO: 216274 - DNA, 25 bp, Mus musculus
agtgcttatcttggcatttcctcaa

SEQ ID NO: 216275 - DNA, 25 bp, Mus musculus
agtgcttatgtacgcatctcatgct

SEQ ID NO: 216276 - DNA, 25 bp, Mus musculus
agtgcttatgtaggcatctcatgct

SEQ ID NO: 216277 - DNA, 25 bp, Mus musculus
agtgcttatgttagaacagtttatg

SEQ ID NO: 216278 - DNA, 25 bp, Mus musculus
agtgcttatgtttgaacagtttatg

SEQ ID NO: 216279 - DNA, 25 bp, Mus musculus
agtgcttatttgagtggttgtgtgt

SEQ ID NO: 216280 - DNA, 25 bp, Mus musculus
agtgcttatttgtgtggttgtgtgt

SEQ ID NO: 216281 - DNA, 25 bp, Mus musculus
agtgcttcaagtacatctagggcct

SEQ ID NO: 216282 - DNA, 25 bp, Mus musculus
agtgcttcaagttcatctagggcct

SEQ ID NO: 216283 - DNA, 25 bp, Mus musculus
agtgcttcaatccttgggctctgaa

SEQ ID NO: 216284 - DNA, 25 bp, Mus musculus
agtgcttcaatcgttgggctctgaa

SEQ ID NO: 216285 - DNA, 25 bp, Mus musculus
agtgcttcacagatttcatgctcag

SEQ ID NO: 216286 - DNA, 25 bp, Mus musculus
agtgcttcacagttttcatgctcag

SEQ ID NO: 216287 - DNA, 25 bp, Mus musculus
agtgcttcacttcccttcatgttgc

SEQ ID NO: 216288 - DNA, 25 bp, Mus musculus
agtgcttcacttgccttcatgttgc

SEQ ID NO: 216289 - DNA, 25 bp, Mus musculus
agtgcttcagatctgcggagcgttc

SEQ ID NO: 216290 - DNA, 25 bp, Mus musculus
agtgcttcagatgtgcggagcgttc

SEQ ID NO: 216291 - DNA, 25 bp, Mus musculus
agtgcttcagtgactctgggaatgc

SEQ ID NO: 216292 - DNA, 25 bp, Mus musculus
agtgcttcagtgtctctgggaatgc

SEQ ID NO: 216293 - DNA, 25 bp, Mus musculus
agtgcttcagttcctcgtttccaaa

SEQ ID NO: 216294 - DNA, 25 bp, Mus musculus
agtgcttcagttgctcgtttccaaa

SEQ ID NO: 216295 - DNA, 25 bp, Mus musculus
agtgcttcatggatggctggtgact

SEQ ID NO: 216296 - DNA, 25 bp, Mus musculus
agtgcttcatggatgtctcacggaa

SEQ ID NO: 216297 - DNA, 25 bp, Mus musculus
agtgcttcatggttggctggtgact

SEQ ID NO: 216298 - DNA, 25 bp, Mus musculus
agtgcttcatggttgtctcacggaa

SEQ ID NO: 216299 - DNA, 25 bp, Mus musculus
agtgcttcatttcaacagctgaggc

SEQ ID NO: 216300 - DNA, 25 bp, Mus musculus
agtgcttcatttgaacagctgaggc

SEQ ID NO: 216301 - DNA, 25 bp, Mus musculus
agtgcttccatgactccaaaagcgc

SEQ ID NO: 216302 - DNA, 25 bp, Mus musculus
agtgcttccatgtctccaaaagcgc

SEQ ID NO: 216303 - DNA, 25 bp, Mus musculus
agtgcttcccgtaataggcctggtt

SEQ ID NO: 216304 - DNA, 25 bp, Mus musculus
agtgcttcccgttataggcctggtt

SEQ ID NO: 216305 - DNA, 25 bp, Mus musculus
agtgcttccctgatggataactgtc

SEQ ID NO: 216306 - DNA, 25 bp, Mus musculus
agtgcttccctgttggataactgtc

SEQ ID NO: 216307 - DNA, 25 bp, Mus musculus
agtgcttccggcagtacgcgaagga

SEQ ID NO: 216308 - DNA, 25 bp, Mus musculus
agtgcttccggctgtacgcgaagga

SEQ ID NO: 216309 - DNA, 25 bp, Mus musculus
agtgcttcctagatcaagattctgg

SEQ ID NO: 216310 - DNA, 25 bp, Mus musculus
agtgcttcctagttcaagattctgg

SEQ ID NO: 216311 - DNA, 25 bp, Mus musculus
agtgcttcctcaacagtcagttttg

SEQ ID NO: 216312 - DNA, 25 bp, Mus musculus
agtgcttcctcatcagtcagttttg

SEQ ID NO: 216313 - DNA, 25 bp, Mus musculus
agtgcttccttacctgaggtgacag

SEQ ID NO: 216314 - DNA, 25 bp, Mus musculus
agtgcttccttagctgaggtgacag

SEQ ID NO: 216315 - DNA, 25 bp, Mus musculus
agtgcttcgttgctgttttgtcaga

SEQ ID NO: 216316 - DNA, 25 bp, Mus musculus
agtgcttcgttggtgttttgtcaga

SEQ ID NO: 216317 - DNA, 25 bp, Mus musculus
agtgcttcgtttccactaaggcgga

SEQ ID NO: 216318 - DNA, 25 bp, Mus musculus
agtgcttcgtttgcactaaggcgga

SEQ ID NO: 216319 - DNA, 25 bp, Mus musculus
agtgcttctaagcatttccccgtct

SEQ ID NO: 216320 - DNA, 25 bp, Mus musculus
agtgcttctaaggatttccccgtct

SEQ ID NO: 216321 - DNA, 25 bp, Mus musculus
agtgcttctatcagagtattcctca

SEQ ID NO: 216322 - DNA, 25 bp, Mus musculus
agtgcttctatctgagtattcctca

SEQ ID NO: 216323 - DNA, 25 bp, Mus musculus
agtgcttctattacatcctcatgtt

SEQ ID NO: 216324 - DNA, 25 bp, Mus musculus
agtgcttctatttcatcctcatgtt

SEQ ID NO: 216325 - DNA, 25 bp, Mus musculus
agtgcttctcatcgttaaagtgctt

SEQ ID NO: 216326 - DNA, 25 bp, Mus musculus
agtgcttctcatggttaaagtgctt

SEQ ID NO: 216327 - DNA, 25 bp, Mus musculus
agtgcttctgaccttgtgaggccct

SEQ ID NO: 216328 - DNA, 25 bp, Mus musculus
agtgcttctgacgttgtgaggccct

SEQ ID NO: 216329 - DNA, 25 bp, Mus musculus
agtgcttcttttctttgtccttgag

SEQ ID NO: 216330 - DNA, 25 bp, Mus musculus
agtgcttcttttgtttgtccttgag

SEQ ID NO: 216331 - DNA, 25 bp, Mus musculus
agtgcttgaaatatatgtactccat

SEQ ID NO: 216332 - DNA, 25 bp, Mus musculus
agtgcttgaaatttatgtactccat

SEQ ID NO: 216333 - DNA, 25 bp, Mus musculus
agtgcttgatgtcgaaatttctggt

SEQ ID NO: 216334 - DNA, 25 bp, Mus musculus
agtgcttgatgtggaaatttctggt

SEQ ID NO: 216335 - DNA, 25 bp, Mus musculus
agtgcttgcaagaaagaatggtttc

SEQ ID NO: 216336 - DNA, 25 bp, Mus musculus
agtgcttgcaagtaagaatggtttc

SEQ ID NO: 216337 - DNA, 25 bp, Mus musculus
agtgcttgcagcaagggagctccaa

SEQ ID NO: 216338 - DNA, 25 bp, Mus musculus
agtgcttgcagctagggagctccaa

SEQ ID NO: 216339 - DNA, 25 bp, Mus musculus
agtgcttgccatacattaaactgaa

SEQ ID NO: 216340 - DNA, 25 bp, Mus musculus
agtgcttgccattcattaaactgaa

SEQ ID NO: 216341 - DNA, 25 bp, Mus musculus
agtgcttgcggcactttccagaaga

SEQ ID NO: 216342 - DNA, 25 bp, Mus musculus
agtgcttgcggctctttccagaaga

SEQ ID NO: 216343 - DNA, 25 bp, Mus musculus
agtgcttgcgtgaagagctgcgctc

SEQ ID NO: 216344 - DNA, 25 bp, Mus musculus
agtgcttgcgtgaccggactgacat

SEQ ID NO: 216345 - DNA, 25 bp, Mus musculus
agtgcttgcgtgtagagctgcgctc

SEQ ID NO: 216346 - DNA, 25 bp, Mus musculus
agtgcttgcgtgtccggactgacat

SEQ ID NO: 216347 - DNA, 25 bp, Mus musculus
agtgcttggaagagagactagtcaa

SEQ ID NO: 216348 - DNA, 25 bp, Mus musculus
agtgcttggaagtgagactagtcaa

SEQ ID NO: 216349 - DNA, 25 bp, Mus musculus
agtgcttggactcctggtatactag

SEQ ID NO: 216350 - DNA, 25 bp, Mus musculus
agtgcttggactgctggtatactag

SEQ ID NO: 216351 - DNA, 25 bp, Mus musculus
agtgcttggccactgaactgcatcc

SEQ ID NO: 216352 - DNA, 25 bp, Mus musculus
agtgcttggccagtgaactgcatcc

SEQ ID NO: 216353 - DNA, 25 bp, Mus musculus
agtgcttggcggacaggactcttga

SEQ ID NO: 216354 - DNA, 25 bp, Mus musculus
agtgcttggcggtcaggactcttga

SEQ ID NO: 216355 - DNA, 25 bp, Mus musculus
agtgcttggcttccatctttaagag

SEQ ID NO: 216356 - DNA, 25 bp, Mus musculus
agtgcttggcttgcatctttaagag

SEQ ID NO: 216357 - DNA, 25 bp, Mus musculus
agtgcttgggccctgctgaccagcc

SEQ ID NO: 216358 - DNA, 25 bp, Mus musculus
agtgcttgggccgtgctgaccagcc

SEQ ID NO: 216359 - DNA, 25 bp, Mus musculus
agtgcttgggtgactgtttctctca

SEQ ID NO: 216360 - DNA, 25 bp, Mus musculus
agtgcttgggtgtctgtttctctca

SEQ ID NO: 216361 - DNA, 25 bp, Mus musculus
agtgcttgtaataagttttcagaac

SEQ ID NO: 216362 - DNA, 25 bp, Mus musculus
agtgcttgtaattagttttcagaac

SEQ ID NO: 216363 - DNA, 25 bp, Mus musculus
agtgcttgtcctctgaactgctgga

SEQ ID NO: 216364 - DNA, 25 bp, Mus musculus
agtgcttgtcctgtgaactgctgga

SEQ ID NO: 216365 - DNA, 25 bp, Mus musculus
agtgcttgttacagtctcactgaca

SEQ ID NO: 216366 - DNA, 25 bp, Mus musculus
agtgcttgttactgtctcactgaca

SEQ ID NO: 216367 - DNA, 25 bp, Mus musculus
agtgctttactgacaatgctctgat

SEQ ID NO: 216368 - DNA, 25 bp, Mus musculus
agtgctttactgtcaatgctctgat

SEQ ID NO: 216369 - DNA, 25 bp, Mus musculus
agtgctttagctagatcatacggta

SEQ ID NO: 216370 - DNA, 25 bp, Mus musculus
agtgctttagcttgatcatacggta

SEQ ID NO: 216371 - DNA, 25 bp, Mus musculus
agtgctttcactatctttacagtta

SEQ ID NO: 216372 - DNA, 25 bp, Mus musculus
agtgctttcactttctttacagtta

SEQ ID NO: 216373 - DNA, 25 bp, Mus musculus
agtgctttcatcactactgaccctt

SEQ ID NO: 216374 - DNA, 25 bp, Mus musculus
agtgctttcatctctactgaccctt

SEQ ID NO: 216375 - DNA, 25 bp, Mus musculus
agtgctttccaaatcgtgttagtta

SEQ ID NO: 216376 - DNA, 25 bp, Mus musculus
agtgctttccaattcgtgttagtta

SEQ ID NO: 216377 - DNA, 25 bp, Mus musculus
agtgctttcgtccaaacctctttag

SEQ ID NO: 216378 - DNA, 25 bp, Mus musculus
agtgctttcgtcgaaacctctttag

SEQ ID NO: 216379 - DNA, 25 bp, Mus musculus
agtgctttctaccatctcagtcagg

SEQ ID NO: 216380 - DNA, 25 bp, Mus musculus
agtgctttctacgatctcagtcagg

SEQ ID NO: 216381 - DNA, 25 bp, Mus musculus
agtgctttctccacagagggttaca

SEQ ID NO: 216382 - DNA, 25 bp, Mus musculus
agtgctttctcctcagagggttaca

SEQ ID NO: 216383 - DNA, 25 bp, Mus musculus
agtgctttcttaacatgctggcttt

SEQ ID NO: 216384 - DNA, 25 bp, Mus musculus
agtgctttcttatcatgctggcttt

SEQ ID NO: 216385 - DNA, 25 bp, Mus musculus
agtgctttgatcatggatgctgctt

SEQ ID NO: 216386 - DNA, 25 bp, Mus musculus
agtgctttgatcttggatgctgctt

SEQ ID NO: 216387 - DNA, 25 bp, Mus musculus
agtgctttgattacacgccaaaagg

SEQ ID NO: 216388 - DNA, 25 bp, Mus musculus
agtgctttgattacagtagccatag

SEQ ID NO: 216389 - DNA, 25 bp, Mus musculus
agtgctttgatttcacgccaaaagg

SEQ ID NO: 216390 - DNA, 25 bp, Mus musculus
agtgctttgatttcagtagccatag

SEQ ID NO: 216391 - DNA, 25 bp, Mus musculus
agtgctttggaccatggactgttgt

SEQ ID NO: 216392 - DNA, 25 bp, Mus musculus
agtgctttggacgatggactgttgt

SEQ ID NO: 216393 - DNA, 25 bp, Mus musculus
agtgctttgggaagactggaagaaa

SEQ ID NO: 216394 - DNA, 25 bp, Mus musculus
agtgctttgggaatggccagtccca

SEQ ID NO: 216395 - DNA, 25 bp, Mus musculus
agtgctttgggatgactggaagaaa

SEQ ID NO: 216396 - DNA, 25 bp, Mus musculus
agtgctttgggattggccagtccca

SEQ ID NO: 216397 - DNA, 25 bp, Mus musculus
agtgctttggttcagggacaccgct

SEQ ID NO: 216398 - DNA, 25 bp, Mus musculus
agtgctttggttgagggacaccgct

SEQ ID NO: 216399 - DNA, 25 bp, Mus musculus
agtgctttgtggcatcattttctga

SEQ ID NO: 216400 - DNA, 25 bp, Mus musculus
agtgctttgtgggatcattttctga

SEQ ID NO: 216401 - DNA, 25 bp, Mus musculus
agtgcttttcaacgcctgtgtggga

SEQ ID NO: 216402 - DNA, 25 bp, Mus musculus
agtgcttttcaaggcctgtgtggga

SEQ ID NO: 216403 - DNA, 25 bp, Mus musculus
agtgcttttcttatatcttcatcag

SEQ ID NO: 216404 - DNA, 25 bp, Mus musculus
agtgcttttcttttatcttcatcag

SEQ ID NO: 216405 - DNA, 25 bp, Mus musculus
agtgcttttgcaatctgagtttcag

SEQ ID NO: 216406 - DNA, 25 bp, Mus musculus
agtgcttttgcattctgagtttcag

SEQ ID NO: 216407 - DNA, 25 bp, Mus musculus
agtgcttttgtgcaatgattcccaa

SEQ ID NO: 216408 - DNA, 25 bp, Mus musculus
agtgcttttgtggaatgattcccaa

SEQ ID NO: 216409 - DNA, 25 bp, Mus musculus
agtggaaaaactctgcccgcaagct

SEQ ID NO: 216410 - DNA, 25 bp, Mus musculus
agtggaaaaactgtgcccgcaagct

SEQ ID NO: 216411 - DNA, 25 bp, Mus musculus
agtggaaaacgtatctccttattgt

SEQ ID NO: 216412 - DNA, 25 bp, Mus musculus
agtggaaaacgtttctccttattgt

SEQ ID NO: 216413 - DNA, 25 bp, Mus musculus
agtggaaaatgacttcctgcccgtc

SEQ ID NO: 216414 - DNA, 25 bp, Mus musculus
agtggaaaatgagttcctgcccgtc

SEQ ID NO: 216415 - DNA, 25 bp, Mus musculus
agtggaaacactacctctagaggca

SEQ ID NO: 216416 - DNA, 25 bp, Mus musculus
agtggaaacacttcctctagaggca

SEQ ID NO: 216417 - DNA, 25 bp, Mus musculus
agtggaaaccaacgcagtagactgc

SEQ ID NO: 216418 - DNA, 25 bp, Mus musculus
agtggaaaccaaggcagtagactgc

SEQ ID NO: 216419 - DNA, 25 bp, Mus musculus
agtggaaacccgcagcgctgctcag

SEQ ID NO: 216420 - DNA, 25 bp, Mus musculus
agtggaaacccggagcgctgctcag

SEQ ID NO: 216421 - DNA, 25 bp, Mus musculus
agtggaaaccgactactgcctgctg

SEQ ID NO: 216422 - DNA, 25 bp, Mus musculus
agtggaaaccgagtactgcctgctg

SEQ ID NO: 216423 - DNA, 25 bp, Mus musculus
agtggaaacctcaagccagtcttag

SEQ ID NO: 216424 - DNA, 25 bp, Mus musculus
agtggaaacctctagccagtcttag

SEQ ID NO: 216425 - DNA, 25 bp, Mus musculus
agtggaaacctgacaacctcggtgg

SEQ ID NO: 216426 - DNA, 25 bp, Mus musculus
agtggaaacctgtcaacctcggtgg

SEQ ID NO: 216427 - DNA, 25 bp, Mus musculus
agtggaaacgttcgccacatgggct

SEQ ID NO: 216428 - DNA, 25 bp, Mus musculus
agtggaaacgttggccacatgggct

SEQ ID NO: 216429 - DNA, 25 bp, Mus musculus
agtggaaacttcacagccttccaag

SEQ ID NO: 216430 - DNA, 25 bp, Mus musculus
agtggaaacttctcagccttccaag

SEQ ID NO: 216431 - DNA, 25 bp, Mus musculus
agtggaaagacgaccaatcacgaaa

SEQ ID NO: 216432 - DNA, 25 bp, Mus musculus
agtggaaagacgtccaatcacgaaa

SEQ ID NO: 216433 - DNA, 25 bp, Mus musculus
agtggaaagcttcgtggcttcctcc

SEQ ID NO: 216434 - DNA, 25 bp, Mus musculus
agtggaaagcttggtggcttcctcc

SEQ ID NO: 216435 - DNA, 25 bp, Mus musculus
agtggaaagtgcatcccttttgtgt

SEQ ID NO: 216436 - DNA, 25 bp, Mus musculus
agtggaaagtgcttcccttttgtgt

SEQ ID NO: 216437 - DNA, 25 bp, Mus musculus
agtggaacagtaaggacagtctcta

SEQ ID NO: 216438 - DNA, 25 bp, Mus musculus
agtggaacagtatggacagtctcta

SEQ ID NO: 216439 - DNA, 25 bp, Mus musculus
agtggaacagtcactcgactcctct

SEQ ID NO: 216440 - DNA, 25 bp, Mus musculus
agtggaacagtctctcgactcctct

SEQ ID NO: 216441 - DNA, 25 bp, Mus musculus
agtggaaccctgatgcttaggcatc

SEQ ID NO: 216442 - DNA, 25 bp, Mus musculus
agtggaaccctgttgcttaggcatc

SEQ ID NO: 216443 - DNA, 25 bp, Mus musculus
agtggaacctctagccatgatcttt

SEQ ID NO: 216444 - DNA, 25 bp, Mus musculus
agtggaacctcttgccatgatcttt

SEQ ID NO: 216445 - DNA, 25 bp, Mus musculus
agtggaaccttcagtgctatctgca

SEQ ID NO: 216446 - DNA, 25 bp, Mus musculus
agtggaaccttctgtgctatctgca

SEQ ID NO: 216447 - DNA, 25 bp, Mus musculus
agtggaactcttcaaacctctgcct

SEQ ID NO: 216448 - DNA, 25 bp, Mus musculus
agtggaactcttgaaacctctgcct

SEQ ID NO: 216449 - DNA, 25 bp, Mus musculus
agtggaactgatcgctccctgacaa

SEQ ID NO: 216450 - DNA, 25 bp, Mus musculus
agtggaactgatggctccctgacaa

SEQ ID NO: 216451 - DNA, 25 bp, Mus musculus
agtggaactgttcacacctgggcag

SEQ ID NO: 216452 - DNA, 25 bp, Mus musculus
agtggaactgttgacacctgggcag

SEQ ID NO: 216453 - DNA, 25 bp, Mus musculus
agtggaacttggaaggcatcagcct

SEQ ID NO: 216454 - DNA, 25 bp, Mus musculus
agtggaacttggtaggcatcagcct

SEQ ID NO: 216455 - DNA, 25 bp, Mus musculus
agtggaagagatctgtccttactca

SEQ ID NO: 216456 - DNA, 25 bp, Mus musculus
agtggaagagatgtgtccttactca

SEQ ID NO: 216457 - DNA, 25 bp, Mus musculus
agtggaagagcaacccagcgtggtt

SEQ ID NO: 216458 - DNA, 25 bp, Mus musculus
agtggaagagcatcccagcgtggtt

SEQ ID NO: 216459 - DNA, 25 bp, Mus musculus
agtggaagccacaattgatctagac

SEQ ID NO: 216460 - DNA, 25 bp, Mus musculus
agtggaagccactattgatctagac

SEQ ID NO: 216461 - DNA, 25 bp, Mus musculus
agtggaagcccaagcaaggatctaa

SEQ ID NO: 216462 - DNA, 25 bp, Mus musculus
agtggaagcccatgcaaggatctaa

SEQ ID NO: 216463 - DNA, 25 bp, Mus musculus
agtggaagcttacagtcctaatgta

SEQ ID NO: 216464 - DNA, 25 bp, Mus musculus
agtggaagcttagagtcctaatgta

SEQ ID NO: 216465 - DNA, 25 bp, Mus musculus
agtggaaggacactactgtacacat

SEQ ID NO: 216466 - DNA, 25 bp, Mus musculus
agtggaaggacagtactgtacacat

SEQ ID NO: 216467 - DNA, 25 bp, Mus musculus
agtggaaggagcctgcttgtccatt

SEQ ID NO: 216468 - DNA, 25 bp, Mus musculus
agtggaaggagcgtgcttgtccatt

SEQ ID NO: 216469 - DNA, 25 bp, Mus musculus
agtggaaggcacatgatcagtctat

SEQ ID NO: 216470 - DNA, 25 bp, Mus musculus
agtggaaggcacttgatcagtctat

SEQ ID NO: 216471 - DNA, 25 bp, Mus musculus
agtggaaggttgcatccgaatgtac

SEQ ID NO: 216472 - DNA, 25 bp, Mus musculus
agtggaaggttggatccgaatgtac

SEQ ID NO: 216473 - DNA, 25 bp, Mus musculus
agtggaagtactcctgccagcttta

SEQ ID NO: 216474 - DNA, 25 bp, Mus musculus
agtggaagtactgctgccagcttta

SEQ ID NO: 216475 - DNA, 25 bp, Mus musculus
agtggaagtctcctttgggctcgct

SEQ ID NO: 216476 - DNA, 25 bp, Mus musculus
agtggaagtctcgtttgggctcgct

SEQ ID NO: 216477 - DNA, 25 bp, Mus musculus
agtggaagtggccaatatgacctca

SEQ ID NO: 216478 - DNA, 25 bp, Mus musculus
agtggaagtggcgaatatgacctca

SEQ ID NO: 216479 - DNA, 25 bp, Mus musculus
agtggaagtgtcagatgcccgagct

SEQ ID NO: 216480 - DNA, 25 bp, Mus musculus
agtggaagtgtctgatgcccgagct

SEQ ID NO: 216481 - DNA, 25 bp, Mus musculus
agtggaagttgcctatctgattcaa

SEQ ID NO: 216482 - DNA, 25 bp, Mus musculus
agtggaagttgcgtatctgattcaa

SEQ ID NO: 216483 - DNA, 25 bp, Mus musculus
agtggaataagtcccgcaccagcag

SEQ ID NO: 216484 - DNA, 25 bp, Mus musculus
agtggaataagtgccgcaccagcag

SEQ ID NO: 216485 - DNA, 25 bp, Mus musculus
agtggaatatacacaagccccctca

SEQ ID NO: 216486 - DNA, 25 bp, Mus musculus
agtggaatatactcaagccccctca

SEQ ID NO: 216487 - DNA, 25 bp, Mus musculus
agtggaatcatcatgtcaaggtcaa

SEQ ID NO: 216488 - DNA, 25 bp, Mus musculus
agtggaatcatcttgtcaaggtcaa

SEQ ID NO: 216489 - DNA, 25 bp, Mus musculus
agtggaatccatacctcacgtactc

SEQ ID NO: 216490 - DNA, 25 bp, Mus musculus
agtggaatccattcctcacgtactc

SEQ ID NO: 216491 - DNA, 25 bp, Mus musculus
agtggaatgctaaatctcagggaga

SEQ ID NO: 216492 - DNA, 25 bp, Mus musculus
agtggaatgctatatctcagggaga

SEQ ID NO: 216493 - DNA, 25 bp, Mus musculus
agtggaatggcaccttggagttcac

SEQ ID NO: 216494 - DNA, 25 bp, Mus musculus
agtggaatggcagcttggagttcac

SEQ ID NO: 216495 - DNA, 25 bp, Mus musculus
agtggaatgttgaccactccctacc

SEQ ID NO: 216496 - DNA, 25 bp, Mus musculus
agtggaatgttgtccactccctacc

SEQ ID NO: 216497 - DNA, 25 bp, Mus musculus
agtggaatgtttatgcccctcaaag

SEQ ID NO: 216498 - DNA, 25 bp, Mus musculus
agtggaatgtttttgcccctcaaag

SEQ ID NO: 216499 - DNA, 25 bp, Mus musculus
agtggacaaactcctctagtagata

SEQ ID NO: 216500 - DNA, 25 bp, Mus musculus
agtggacaaactgctctagtagata

SEQ ID NO: 216501 - DNA, 25 bp, Mus musculus
agtggacaacagctatcctgggttt

SEQ ID NO: 216502 - DNA, 25 bp, Mus musculus
agtggacaacaggtatcctgggttt

SEQ ID NO: 216503 - DNA, 25 bp, Mus musculus
agtggacaagatcgccccagaccga

SEQ ID NO: 216504 - DNA, 25 bp, Mus musculus
agtggacaagatggccccagaccga

SEQ ID NO: 216505 - DNA, 25 bp, Mus musculus
agtggacacaagaccagttcttctc

SEQ ID NO: 216506 - DNA, 25 bp, Mus musculus
agtggacacaagtccagttcttctc

SEQ ID NO: 216507 - DNA, 25 bp, Mus musculus
agtggacactcacagccctttcaaa

SEQ ID NO: 216508 - DNA, 25 bp, Mus musculus
agtggacactcagagccctttcaaa

SEQ ID NO: 216509 - DNA, 25 bp, Mus musculus
agtggacactctaaactgacttaat

SEQ ID NO: 216510 - DNA, 25 bp, Mus musculus
agtggacactcttaactgacttaat

SEQ ID NO: 216511 - DNA, 25 bp, Mus musculus
agtggacaggacatgttccctttcc

SEQ ID NO: 216512 - DNA, 25 bp, Mus musculus
agtggacaggacttgttccctttcc

SEQ ID NO: 216513 - DNA, 25 bp, Mus musculus
agtggacagtccaaaatgtgatcct

SEQ ID NO: 216514 - DNA, 25 bp, Mus musculus
agtggacagtccagcatcaggtgct

SEQ ID NO: 216515 - DNA, 25 bp, Mus musculus
agtggacagtcctaaatgtgatcct

SEQ ID NO: 216516 - DNA, 25 bp, Mus musculus
agtggacagtcctgcatcaggtgct

SEQ ID NO: 216517 - DNA, 25 bp, Mus musculus
agtggacatattccataccctggtg

SEQ ID NO: 216518 - DNA, 25 bp, Mus musculus
agtggacatattgcataccctggtg

SEQ ID NO: 216519 - DNA, 25 bp, Mus musculus
agtggacatgagaatgggtgcccaa

SEQ ID NO: 216520 - DNA, 25 bp, Mus musculus
agtggacatgagtatgggtgcccaa

SEQ ID NO: 216521 - DNA, 25 bp, Mus musculus
agtggacatgatcggctatctcctc

SEQ ID NO: 216522 - DNA, 25 bp, Mus musculus
agtggacatgatgggctatctcctc

SEQ ID NO: 216523 - DNA, 25 bp, Mus musculus
agtggacattctcgtactcttcctg

SEQ ID NO: 216524 - DNA, 25 bp, Mus musculus
agtggacattctggtactcttcctg

SEQ ID NO: 216525 - DNA, 25 bp, Mus musculus
agtggaccaagactgtctcgctact

SEQ ID NO: 216526 - DNA, 25 bp, Mus musculus
agtggaccaagagtgtctcgctact

SEQ ID NO: 216527 - DNA, 25 bp, Mus musculus
agtggaccaagtctgtcacctgcac

SEQ ID NO: 216528 - DNA, 25 bp, Mus musculus
agtggaccaagtgtgtcacctgcac

SEQ ID NO: 216529 - DNA, 25 bp, Mus musculus
agtggaccactgagctgtaccatgc

SEQ ID NO: 216530 - DNA, 25 bp, Mus musculus
agtggaccactgtgctgtaccatgc

SEQ ID NO: 216531 - DNA, 25 bp, Mus musculus
agtggaccatgccaggaaacctggt

SEQ ID NO: 216532 - DNA, 25 bp, Mus musculus
agtggaccatgcgaggaaacctggt

SEQ ID NO: 216533 - DNA, 25 bp, Mus musculus
agtggacccaagagtcttccagatc

SEQ ID NO: 216534 - DNA, 25 bp, Mus musculus
agtggacccaagcactgtcgcacat

SEQ ID NO: 216535 - DNA, 25 bp, Mus musculus
agtggacccaaggactgtcgcacat

SEQ ID NO: 216536 - DNA, 25 bp, Mus musculus
agtggacccaagtgtcttccagatc

SEQ ID NO: 216537 - DNA, 25 bp, Mus musculus
agtggaccccaacccatgagttagt

SEQ ID NO: 216538 - DNA, 25 bp, Mus musculus
agtggaccccaagccatgagttagt

SEQ ID NO: 216539 - DNA, 25 bp, Mus musculus
agtggaccctcaatagagacccaga

SEQ ID NO: 216540 - DNA, 25 bp, Mus musculus
agtggaccctcattagagacccaga

SEQ ID NO: 216541 - DNA, 25 bp, Mus musculus
agtggacctcctccaaacgcgattt

SEQ ID NO: 216542 - DNA, 25 bp, Mus musculus
agtggacctcctgcaaacgcgattt

SEQ ID NO: 216543 - DNA, 25 bp, Mus musculus
agtggacctgaaagtgtatttctca

SEQ ID NO: 216544 - DNA, 25 bp, Mus musculus
agtggacctgaatgtgtatttctca

SEQ ID NO: 216545 - DNA, 25 bp, Mus musculus
agtggacctggaagcctactggacc

SEQ ID NO: 216546 - DNA, 25 bp, Mus musculus
agtggacctggatgcctactggacc

SEQ ID NO: 216547 - DNA, 25 bp, Mus musculus
agtggacctggccagagtctatcat

SEQ ID NO: 216548 - DNA, 25 bp, Mus musculus
agtggacctggcgagagtctatcat

SEQ ID NO: 216549 - DNA, 25 bp, Mus musculus
agtggacctgttcccacagactccg

SEQ ID NO: 216550 - DNA, 25 bp, Mus musculus
agtggacctgttgccacagactccg

SEQ ID NO: 216551 - DNA, 25 bp, Mus musculus
agtggacgaatccatgaccgtcatg

SEQ ID NO: 216552 - DNA, 25 bp, Mus musculus
agtggacgaatcgatgaccgtcatg

SEQ ID NO: 216553 - DNA, 25 bp, Mus musculus
agtggacgcaggaaaagacagacat

SEQ ID NO: 216554 - DNA, 25 bp, Mus musculus
agtggacgcaggtaaagacagacat

SEQ ID NO: 216555 - DNA, 25 bp, Mus musculus
agtggacgcgctaccccaagtggaa

SEQ ID NO: 216556 - DNA, 25 bp, Mus musculus
agtggacgcgcttccccaagtggaa

SEQ ID NO: 216557 - DNA, 25 bp, Mus musculus
agtggacgtccaaacatcaattgtc

SEQ ID NO: 216558 - DNA, 25 bp, Mus musculus
agtggacgtccatacatcaattgtc

SEQ ID NO: 216559 - DNA, 25 bp, Mus musculus
agtggacgtggaacctctgctttca

SEQ ID NO: 216560 - DNA, 25 bp, Mus musculus
agtggacgtggatcctctgctttca

SEQ ID NO: 216561 - DNA, 25 bp, Mus musculus
agtggacgtgttccgaaagctgccc

SEQ ID NO: 216562 - DNA, 25 bp, Mus musculus
agtggacgtgttgcgaaagctgccc

SEQ ID NO: 216563 - DNA, 25 bp, Mus musculus
agtggactaataacagttctgttca

SEQ ID NO: 216564 - DNA, 25 bp, Mus musculus
agtggactaatatcagttctgttca

SEQ ID NO: 216565 - DNA, 25 bp, Mus musculus
agtggactatcacgagctggctaca

SEQ ID NO: 216566 - DNA, 25 bp, Mus musculus
agtggactatcaggagctggctaca

SEQ ID NO: 216567 - DNA, 25 bp, Mus musculus
agtggactatctcaagtgaaccagc

SEQ ID NO: 216568 - DNA, 25 bp, Mus musculus
agtggactatctgaagtgaaccagc

SEQ ID NO: 216569 - DNA, 25 bp, Mus musculus
agtggactcagtatcccatgctgtg

SEQ ID NO: 216570 - DNA, 25 bp, Mus musculus
agtggactcagtttcccatgctgtg

SEQ ID NO: 216571 - DNA, 25 bp, Mus musculus
agtggactccgtcaactctgggaac

SEQ ID NO: 216572 - DNA, 25 bp, Mus musculus
agtggactccgtgaactctgggaac

SEQ ID NO: 216573 - DNA, 25 bp, Mus musculus
agtggactccttccttggcttatat

SEQ ID NO: 216574 - DNA, 25 bp, Mus musculus
agtggactccttcgtgatccgcgaa

SEQ ID NO: 216575 - DNA, 25 bp, Mus musculus
agtggactccttgcttggcttatat

SEQ ID NO: 216576 - DNA, 25 bp, Mus musculus
agtggactccttggtgatccgcgaa

SEQ ID NO: 216577 - DNA, 25 bp, Mus musculus
agtggactctacctcggcatgaacg

SEQ ID NO: 216578 - DNA, 25 bp, Mus musculus
agtggactctacgtcggcatgaacg

SEQ ID NO: 216579 - DNA, 25 bp, Mus musculus
agtggactcttcatggtcaaattgt

SEQ ID NO: 216580 - DNA, 25 bp, Mus musculus
agtggactcttcttggtcaaattgt

SEQ ID NO: 216581 - DNA, 25 bp, Mus musculus
agtggactgccaactcacacagaac

SEQ ID NO: 216582 - DNA, 25 bp, Mus musculus
agtggactgccaatcttgtctggac

SEQ ID NO: 216583 - DNA, 25 bp, Mus musculus
agtggactgccatctcacacagaac

SEQ ID NO: 216584 - DNA, 25 bp, Mus musculus
agtggactgccattcttgtctggac

SEQ ID NO: 216585 - DNA, 25 bp, Mus musculus
agtggactggcaccaacaaagacaa

SEQ ID NO: 216586 - DNA, 25 bp, Mus musculus
agtggactggcagcaacaaagacaa

SEQ ID NO: 216587 - DNA, 25 bp, Mus musculus
agtggactgtctactaataccaaag

SEQ ID NO: 216588 - DNA, 25 bp, Mus musculus
agtggactgtcttctaataccaaag

SEQ ID NO: 216589 - DNA, 25 bp, Mus musculus
agtggacttaacaagccagcctcta

SEQ ID NO: 216590 - DNA, 25 bp, Mus musculus
agtggacttaactagccagcctcta

SEQ ID NO: 216591 - DNA, 25 bp, Mus musculus
agtggactttccagaagggctgccc

SEQ ID NO: 216592 - DNA, 25 bp, Mus musculus
agtggactttcctgaagggctgccc

SEQ ID NO: 216593 - DNA, 25 bp, Mus musculus
agtggagacagcactctgggcgcct

SEQ ID NO: 216594 - DNA, 25 bp, Mus musculus
agtggagacagctctctgggcgcct

SEQ ID NO: 216595 - DNA, 25 bp, Mus musculus
agtggagaccacatctgacctacag

SEQ ID NO: 216596 - DNA, 25 bp, Mus musculus
agtggagaccacttctgacctacag

SEQ ID NO: 216597 - DNA, 25 bp, Mus musculus
agtggagactcacagagccccgttt

SEQ ID NO: 216598 - DNA, 25 bp, Mus musculus
agtggagactcagagagccccgttt

SEQ ID NO: 216599 - DNA, 25 bp, Mus musculus
agtggagagctcaccctggatgaca

SEQ ID NO: 216600 - DNA, 25 bp, Mus musculus
agtggagagctctccctggatgaca

SEQ ID NO: 216601 - DNA, 25 bp, Mus musculus
agtggagagggcactgttaccattg

SEQ ID NO: 216602 - DNA, 25 bp, Mus musculus
agtggagagggctctgttaccattg

SEQ ID NO: 216603 - DNA, 25 bp, Mus musculus
agtggagagtgtactgttctatgca

SEQ ID NO: 216604 - DNA, 25 bp, Mus musculus
agtggagagtgttctgttctatgca

SEQ ID NO: 216605 - DNA, 25 bp, Mus musculus
agtggagagttgagacctgttctgc

SEQ ID NO: 216606 - DNA, 25 bp, Mus musculus
agtggagagttgtgacctgttctgc

SEQ ID NO: 216607 - DNA, 25 bp, Mus musculus
agtggagatactagcaactgcctgt

SEQ ID NO: 216608 - DNA, 25 bp, Mus musculus
agtggagatactcaccaaactgcca

SEQ ID NO: 216609 - DNA, 25 bp, Mus musculus
agtggagatactgaccaaactgcca

SEQ ID NO: 216610 - DNA, 25 bp, Mus musculus
agtggagatacttgcaactgcctgt

SEQ ID NO: 216611 - DNA, 25 bp, Mus musculus
agtggagatctacactcagagtatt

SEQ ID NO: 216612 - DNA, 25 bp, Mus musculus
agtggagatctagactcagagtatt

SEQ ID NO: 216613 - DNA, 25 bp, Mus musculus
agtggagatggtcctcagaccttgc

SEQ ID NO: 216614 - DNA, 25 bp, Mus musculus
agtggagatggtgctcagaccttgc

SEQ ID NO: 216615 - DNA, 25 bp, Mus musculus
agtggagatgtccatgaactctggt

SEQ ID NO: 216616 - DNA, 25 bp, Mus musculus
agtggagatgtcgatgaactctggt

SEQ ID NO: 216617 - DNA, 25 bp, Mus musculus
agtggagattcccaggccttttggc

SEQ ID NO: 216618 - DNA, 25 bp, Mus musculus
agtggagattccgaggccttttggc

SEQ ID NO: 216619 - DNA, 25 bp, Mus musculus
agtggagattctcagtcctcatgtc

SEQ ID NO: 216620 - DNA, 25 bp, Mus musculus
agtggagattctgagtcctcatgtc

SEQ ID NO: 216621 - DNA, 25 bp, Mus musculus
agtggagcacttactaagagacatc

SEQ ID NO: 216622 - DNA, 25 bp, Mus musculus
agtggagcactttctaagagacatc

SEQ ID NO: 216623 - DNA, 25 bp, Mus musculus
agtggagcagatactcatggctgta

SEQ ID NO: 216624 - DNA, 25 bp, Mus musculus
agtggagcagattctcatggctgta

SEQ ID NO: 216625 - DNA, 25 bp, Mus musculus
agtggagcagccacgtgctctagga

SEQ ID NO: 216626 - DNA, 25 bp, Mus musculus
agtggagcagcctcgtgctctagga

SEQ ID NO: 216627 - DNA, 25 bp, Mus musculus
agtggagcagcgattctcagcctgt

SEQ ID NO: 216628 - DNA, 25 bp, Mus musculus
agtggagcagcgtttctcagcctgt

SEQ ID NO: 216629 - DNA, 25 bp, Mus musculus
agtggagccagcaggatcccagaag

SEQ ID NO: 216630 - DNA, 25 bp, Mus musculus
agtggagccagctggatcccagaag

SEQ ID NO: 216631 - DNA, 25 bp, Mus musculus
agtggagccataatttcatttatct

SEQ ID NO: 216632 - DNA, 25 bp, Mus musculus
agtggagccatattttcatttatct

SEQ ID NO: 216633 - DNA, 25 bp, Mus musculus
agtggagcccagcagatcccagttt

SEQ ID NO: 216634 - DNA, 25 bp, Mus musculus
agtggagcccaggagatcccagttt

SEQ ID NO: 216635 - DNA, 25 bp, Mus musculus
agtggagcccttcagactgttagtg

SEQ ID NO: 216636 - DNA, 25 bp, Mus musculus
agtggagcccttgagactgttagtg

SEQ ID NO: 216637 - DNA, 25 bp, Mus musculus
agtggagccggacatgcaccttata

SEQ ID NO: 216638 - DNA, 25 bp, Mus musculus
agtggagccggagatgcaccttata

SEQ ID NO: 216639 - DNA, 25 bp, Mus musculus
agtggagcctctcaatgggaacctg

SEQ ID NO: 216640 - DNA, 25 bp, Mus musculus
agtggagcctctcttctgattgatc

SEQ ID NO: 216641 - DNA, 25 bp, Mus musculus
agtggagcctctgaatgggaacctg

SEQ ID NO: 216642 - DNA, 25 bp, Mus musculus
agtggagcctctgttctgattgatc

SEQ ID NO: 216643 - DNA, 25 bp, Mus musculus
agtggagcctgtagagctgatctct

SEQ ID NO: 216644 - DNA, 25 bp, Mus musculus
agtggagcctgttgagctgatctct

SEQ ID NO: 216645 - DNA, 25 bp, Mus musculus
agtggagccttcacatggtcctggt

SEQ ID NO: 216646 - DNA, 25 bp, Mus musculus
agtggagccttctcatggtcctggt

SEQ ID NO: 216647 - DNA, 25 bp, Mus musculus
agtggagcgaccaggatatctgtcc

SEQ ID NO: 216648 - DNA, 25 bp, Mus musculus
agtggagcgacctggatatctgtcc

SEQ ID NO: 216649 - DNA, 25 bp, Mus musculus
agtggagcgctacaatcctcaggaa

SEQ ID NO: 216650 - DNA, 25 bp, Mus musculus
agtggagcgctagaatcctcaggaa

SEQ ID NO: 216651 - DNA, 25 bp, Mus musculus
agtggagctagtctcccatggcaaa

SEQ ID NO: 216652 - DNA, 25 bp, Mus musculus
agtggagctagtgtcccatggcaaa

SEQ ID NO: 216653 - DNA, 25 bp, Mus musculus
agtggagctcaaccatgctatgtaa

SEQ ID NO: 216654 - DNA, 25 bp, Mus musculus
agtggagctcaagcatgctatgtaa

SEQ ID NO: 216655 - DNA, 25 bp, Mus musculus
agtggagctgaacagctggacacca

SEQ ID NO: 216656 - DNA, 25 bp, Mus musculus
agtggagctgaagagctggacacca

SEQ ID NO: 216657 - DNA, 25 bp, Mus musculus
agtggagcttacacatcatttccca

SEQ ID NO: 216658 - DNA, 25 bp, Mus musculus
agtggagcttactcatcatttccca

SEQ ID NO: 216659 - DNA, 25 bp, Mus musculus
agtggagcttagaaattgttcatta

SEQ ID NO: 216660 - DNA, 25 bp, Mus musculus
agtggagcttagtaattgttcatta

SEQ ID NO: 216661 - DNA, 25 bp, Mus musculus
agtggaggaaagctcctgccagcaa

SEQ ID NO: 216662 - DNA, 25 bp, Mus musculus
agtggaggaaaggtcctgccagcaa

SEQ ID NO: 216663 - DNA, 25 bp, Mus musculus
agtggaggacggacgatgccccact

SEQ ID NO: 216664 - DNA, 25 bp, Mus musculus
agtggaggacggtcgatgccccact

SEQ ID NO: 216665 - DNA, 25 bp, Mus musculus
agtggaggagacaaagaccccagga

SEQ ID NO: 216666 - DNA, 25 bp, Mus musculus
agtggaggagactaagaccccagga

SEQ ID NO: 216667 - DNA, 25 bp, Mus musculus
agtggaggaggcctgcatccttatc

SEQ ID NO: 216668 - DNA, 25 bp, Mus musculus
agtggaggaggcgtgcatccttatc

SEQ ID NO: 216669 - DNA, 25 bp, Mus musculus
agtggaggatacctccttggcttta

SEQ ID NO: 216670 - DNA, 25 bp, Mus musculus
agtggaggatacgtccttggcttta

SEQ ID NO: 216671 - DNA, 25 bp, Mus musculus
agtggaggcagaaccttcgagcatc

SEQ ID NO: 216672 - DNA, 25 bp, Mus musculus
agtggaggcagatccttcgagcatc

SEQ ID NO: 216673 - DNA, 25 bp, Mus musculus
agtggaggcaggaactaaagtctta

SEQ ID NO: 216674 - DNA, 25 bp, Mus musculus
agtggaggcaggtactaaagtctta

SEQ ID NO: 216675 - DNA, 25 bp, Mus musculus
agtggaggcctgcatctctgcctgc

SEQ ID NO: 216676 - DNA, 25 bp, Mus musculus
agtggaggcctggatctctgcctgc

SEQ ID NO: 216677 - DNA, 25 bp, Mus musculus
agtggaggctccaagacgttcagct

SEQ ID NO: 216678 - DNA, 25 bp, Mus musculus
agtggaggctcctagacgttcagct

SEQ ID NO: 216679 - DNA, 25 bp, Mus musculus
agtggaggctttctgagcaacctct

SEQ ID NO: 216680 - DNA, 25 bp, Mus musculus
agtggaggctttgtgagcaacctct

SEQ ID NO: 216681 - DNA, 25 bp, Mus musculus
agtggagggacgactgcctcatgaa

SEQ ID NO: 216682 - DNA, 25 bp, Mus musculus
agtggagggacgtctgcctcatgaa

SEQ ID NO: 216683 - DNA, 25 bp, Mus musculus
agtggagggatcatagggctctctc

SEQ ID NO: 216684 - DNA, 25 bp, Mus musculus
agtggagggatcttagggctctctc

SEQ ID NO: 216685 - DNA, 25 bp, Mus musculus
agtggagtatcacttcctgtcgccc

SEQ ID NO: 216686 - DNA, 25 bp, Mus musculus
agtggagtatcagttcctgtcgccc

SEQ ID NO: 216687 - DNA, 25 bp, Mus musculus
agtggagtcaccaaagcaccacttt

SEQ ID NO: 216688 - DNA, 25 bp, Mus musculus
agtggagtcacctaagcaccacttt

SEQ ID NO: 216689 - DNA, 25 bp, Mus musculus
agtggagtcagcacacagatggtct

SEQ ID NO: 216690 - DNA, 25 bp, Mus musculus
agtggagtcagctcacagatggtct

SEQ ID NO: 216691 - DNA, 25 bp, Mus musculus
agtggagtccagcatctgctcagta

SEQ ID NO: 216692 - DNA, 25 bp, Mus musculus
agtggagtccaggatctgctcagta

SEQ ID NO: 216693 - DNA, 25 bp, Mus musculus
agtggagtcctgagtcagcaccatc

SEQ ID NO: 216694 - DNA, 25 bp, Mus musculus
agtggagtcctgtgtcagcaccatc

SEQ ID NO: 216695 - DNA, 25 bp, Mus musculus
agtggagtggccagtaactaagcca

SEQ ID NO: 216696 - DNA, 25 bp, Mus musculus
agtggagtggcctgtaactaagcca

SEQ ID NO: 216697 - DNA, 25 bp, Mus musculus
agtggagttagcattccgtttccag

SEQ ID NO: 216698 - DNA, 25 bp, Mus musculus
agtggagttagctttccgtttccag

SEQ ID NO: 216699 - DNA, 25 bp, Mus musculus
agtggataactaaggccttcagaga

SEQ ID NO: 216700 - DNA, 25 bp, Mus musculus
agtggataactatggccttcagaga

SEQ ID NO: 216701 - DNA, 25 bp, Mus musculus
agtggataagtgatagcaactgctt

SEQ ID NO: 216702 - DNA, 25 bp, Mus musculus
agtggataagtgttagcaactgctt

SEQ ID NO: 216703 - DNA, 25 bp, Mus musculus
agtggatagactcctctgctgataa

SEQ ID NO: 216704 - DNA, 25 bp, Mus musculus
agtggatagactgctctgctgataa

SEQ ID NO: 216705 - DNA, 25 bp, Mus musculus
agtggatatgctcagcttttttcct

SEQ ID NO: 216706 - DNA, 25 bp, Mus musculus
agtggatatgctgagcttttttcct

SEQ ID NO: 216707 - DNA, 25 bp, Mus musculus
agtggatattataccctctgattgc

SEQ ID NO: 216708 - DNA, 25 bp, Mus musculus
agtggatattattccctctgattgc

SEQ ID NO: 216709 - DNA, 25 bp, Mus musculus
agtggatcacagagcttgccagcaa

SEQ ID NO: 216710 - DNA, 25 bp, Mus musculus
agtggatcacagtgcttgccagcaa

SEQ ID NO: 216711 - DNA, 25 bp, Mus musculus
agtggatcagctaacctgtgtgacc

SEQ ID NO: 216712 - DNA, 25 bp, Mus musculus
agtggatcagcttacctgtgtgacc

SEQ ID NO: 216713 - DNA, 25 bp, Mus musculus
agtggatccacgagcccaagggcta

SEQ ID NO: 216714 - DNA, 25 bp, Mus musculus
agtggatccacgtgcccaagggcta

SEQ ID NO: 216715 - DNA, 25 bp, Mus musculus
agtggatcccacagagtttgcctgc

SEQ ID NO: 216716 - DNA, 25 bp, Mus musculus
agtggatcccactgagtttgcctgc

SEQ ID NO: 216717 - DNA, 25 bp, Mus musculus
agtggatccgaaagagaactgctca

SEQ ID NO: 216718 - DNA, 25 bp, Mus musculus
agtggatccgaatgagaactgctca

SEQ ID NO: 216719 - DNA, 25 bp, Mus musculus
agtggatcctcaatagtttgagatc

SEQ ID NO: 216720 - DNA, 25 bp, Mus musculus
agtggatcctcattagtttgagatc

SEQ ID NO: 216721 - DNA, 25 bp, Mus musculus
agtggatcgtgtactggccctgcag

SEQ ID NO: 216722 - DNA, 25 bp, Mus musculus
agtggatcgtgttctggccctgcag

SEQ ID NO: 216723 - DNA, 25 bp, Mus musculus
agtggatctatgactactgcccgga

SEQ ID NO: 216724 - DNA, 25 bp, Mus musculus
agtggatctatgtctactgcccgga

SEQ ID NO: 216725 - DNA, 25 bp, Mus musculus
agtggatctcaacggctctgccatt

SEQ ID NO: 216726 - DNA, 25 bp, Mus musculus
agtggatctcaagggctctgccatt

SEQ ID NO: 216727 - DNA, 25 bp, Mus musculus
agtggatctggtcctagacagcgct

SEQ ID NO: 216728 - DNA, 25 bp, Mus musculus
agtggatctggtgctagacagcgct

SEQ ID NO: 216729 - DNA, 25 bp, Mus musculus
agtggatctgtcacttctagaactg

SEQ ID NO: 216730 - DNA, 25 bp, Mus musculus
agtggatctgtctcttctagaactg

SEQ ID NO: 216731 - DNA, 25 bp, Mus musculus
agtggatcttcaatgacccggaggc

SEQ ID NO: 216732 - DNA, 25 bp, Mus musculus
agtggatcttcattgacccggaggc

SEQ ID NO: 216733 - DNA, 25 bp, Mus musculus
agtggatgaatacatcaaacgctat

SEQ ID NO: 216734 - DNA, 25 bp, Mus musculus
agtggatgaatagatcaaacgctat

SEQ ID NO: 216735 - DNA, 25 bp, Mus musculus
agtggatgcctcacagtagatacag

SEQ ID NO: 216736 - DNA, 25 bp, Mus musculus
agtggatgcctctcagtagatacag

SEQ ID NO: 216737 - DNA, 25 bp, Mus musculus
agtggatgcctgatcttctcaaagt

SEQ ID NO: 216738 - DNA, 25 bp, Mus musculus
agtggatgcctgttcttctcaaagt

SEQ ID NO: 216739 - DNA, 25 bp, Mus musculus
agtggatgcttacagatatccattg

SEQ ID NO: 216740 - DNA, 25 bp, Mus musculus
agtggatgcttagagatatccattg

SEQ ID NO: 216741 - DNA, 25 bp, Mus musculus
agtggatggagcctccttgctaaaa

SEQ ID NO: 216742 - DNA, 25 bp, Mus musculus
agtggatggagcgtccttgctaaaa

SEQ ID NO: 216743 - DNA, 25 bp, Mus musculus
agtggatggtcgaccggaactgctc

SEQ ID NO: 216744 - DNA, 25 bp, Mus musculus
agtggatggtcgtccggaactgctc

SEQ ID NO: 216745 - DNA, 25 bp, Mus musculus
agtggatgtcccaactcggcagaac

SEQ ID NO: 216746 - DNA, 25 bp, Mus musculus
agtggatgtccctactcggcagaac

SEQ ID NO: 216747 - DNA, 25 bp, Mus musculus
agtggatgtgtcaccggtgtactgt

SEQ ID NO: 216748 - DNA, 25 bp, Mus musculus
agtggatgtgtctccggtgtactgt

SEQ ID NO: 216749 - DNA, 25 bp, Mus musculus
agtggatgtgttcgcaaccttaata

SEQ ID NO: 216750 - DNA, 25 bp, Mus musculus
agtggatgtgttggcaaccttaata

SEQ ID NO: 216751 - DNA, 25 bp, Mus musculus
agtggattagcacggatctttgaaa

SEQ ID NO: 216752 - DNA, 25 bp, Mus musculus
agtggattagcagggatctttgaaa

SEQ ID NO: 216753 - DNA, 25 bp, Mus musculus
agtggattatccactgttgctacat

SEQ ID NO: 216754 - DNA, 25 bp, Mus musculus
agtggattatcctctgttgctacat

SEQ ID NO: 216755 - DNA, 25 bp, Mus musculus
agtggattcagcacaggcccaggta

SEQ ID NO: 216756 - DNA, 25 bp, Mus musculus
agtggattcagctcaggcccaggta

SEQ ID NO: 216757 - DNA, 25 bp, Mus musculus
agtggattccacaaagatctgtata

SEQ ID NO: 216758 - DNA, 25 bp, Mus musculus
agtggattccactaagatctgtata

SEQ ID NO: 216759 - DNA, 25 bp, Mus musculus
agtggattccagctgtttatgcctc

SEQ ID NO: 216760 - DNA, 25 bp, Mus musculus
agtggattccaggtgtttatgcctc

SEQ ID NO: 216761 - DNA, 25 bp, Mus musculus
agtggattccatagtaaaaggcttt

SEQ ID NO: 216762 - DNA, 25 bp, Mus musculus
agtggattccattgtaaaaggcttt

SEQ ID NO: 216763 - DNA, 25 bp, Mus musculus
agtggatttagcagcttttgatcat

SEQ ID NO: 216764 - DNA, 25 bp, Mus musculus
agtggatttagctgcttttgatcat

SEQ ID NO: 216765 - DNA, 25 bp, Mus musculus
agtggattttctatggcgccaaact

SEQ ID NO: 216766 - DNA, 25 bp, Mus musculus
agtggattttctttggcgccaaact

SEQ ID NO: 216767 - DNA, 25 bp, Mus musculus
agtggattttgcaagttcagttgac

SEQ ID NO: 216768 - DNA, 25 bp, Mus musculus
agtggattttgcacccttgtgttag

SEQ ID NO: 216769 - DNA, 25 bp, Mus musculus
agtggattttgctagttcagttgac

SEQ ID NO: 216770 - DNA, 25 bp, Mus musculus
agtggattttgctcccttgtgttag

SEQ ID NO: 216771 - DNA, 25 bp, Mus musculus
agtggcaacaaaactggtacggcgc

SEQ ID NO: 216772 - DNA, 25 bp, Mus musculus
agtggcaacaaatctggtacggcgc

SEQ ID NO: 216773 - DNA, 25 bp, Mus musculus
agtggcaaccacacttaggcagcag

SEQ ID NO: 216774 - DNA, 25 bp, Mus musculus
agtggcaaccactcttaggcagcag

SEQ ID NO: 216775 - DNA, 25 bp, Mus musculus
agtggcaacgatctggaccctgctg

SEQ ID NO: 216776 - DNA, 25 bp, Mus musculus
agtggcaacgatgtggaccctgctg

SEQ ID NO: 216777 - DNA, 25 bp, Mus musculus
agtggcaactatataccagttgaaa

SEQ ID NO: 216778 - DNA, 25 bp, Mus musculus
agtggcaactatttaccagttgaaa

SEQ ID NO: 216779 - DNA, 25 bp, Mus musculus
agtggcaagcacctggtcttcattg

SEQ ID NO: 216780 - DNA, 25 bp, Mus musculus
agtggcaagcacgtggtcttcattg

SEQ ID NO: 216781 - DNA, 25 bp, Mus musculus
agtggcaagccccatagaccctctg

SEQ ID NO: 216782 - DNA, 25 bp, Mus musculus
agtggcaagcccgatagaccctctg

SEQ ID NO: 216783 - DNA, 25 bp, Mus musculus
agtggcaagtctccaagcccaagga

SEQ ID NO: 216784 - DNA, 25 bp, Mus musculus
agtggcaagtctgcaagcccaagga

SEQ ID NO: 216785 - DNA, 25 bp, Mus musculus
agtggcaatttcattgtctcctcct

SEQ ID NO: 216786 - DNA, 25 bp, Mus musculus
agtggcaatttctttgtctcctcct

SEQ ID NO: 216787 - DNA, 25 bp, Mus musculus
agtggcacaattagcctttcttcaa

SEQ ID NO: 216788 - DNA, 25 bp, Mus musculus
agtggcacaatttgcctttcttcaa

SEQ ID NO: 216789 - DNA, 25 bp, Mus musculus
agtggcacaggcctgaaatccagca

SEQ ID NO: 216790 - DNA, 25 bp, Mus musculus
agtggcacaggcgtgaaatccagca

SEQ ID NO: 216791 - DNA, 25 bp, Mus musculus
agtggcacatgcagataatgctagc

SEQ ID NO: 216792 - DNA, 25 bp, Mus musculus
agtggcacatgctgataatgctagc

SEQ ID NO: 216793 - DNA, 25 bp, Mus musculus
agtggcaccaatctgtaacctcggt

SEQ ID NO: 216794 - DNA, 25 bp, Mus musculus
agtggcaccaatgtgtaacctcggt

SEQ ID NO: 216795 - DNA, 25 bp, Mus musculus
agtggcaccagcagaaagcctgagt

SEQ ID NO: 216796 - DNA, 25 bp, Mus musculus
agtggcaccagctgaaagcctgagt

SEQ ID NO: 216797 - DNA, 25 bp, Mus musculus
agtggcaccctaaaacccatctctg

SEQ ID NO: 216798 - DNA, 25 bp, Mus musculus
agtggcaccctataacccatctctg

SEQ ID NO: 216799 - DNA, 25 bp, Mus musculus
agtggcacgagaagagcccagctct

SEQ ID NO: 216800 - DNA, 25 bp, Mus musculus
agtggcacgagatgagcccagctct

SEQ ID NO: 216801 - DNA, 25 bp, Mus musculus
agtggcacggctcttgtacaacatg

SEQ ID NO: 216802 - DNA, 25 bp, Mus musculus
agtggcacggctgttgtacaacatg

SEQ ID NO: 216803 - DNA, 25 bp, Mus musculus
agtggcactaagctattgttccaga

SEQ ID NO: 216804 - DNA, 25 bp, Mus musculus
agtggcactaaggtattgttccaga

SEQ ID NO: 216805 - DNA, 25 bp, Mus musculus
agtggcactctaatgtccccaggaa

SEQ ID NO: 216806 - DNA, 25 bp, Mus musculus
agtggcactctattgtccccaggaa

SEQ ID NO: 216807 - DNA, 25 bp, Mus musculus
agtggcactgccatgagtttgtctc

SEQ ID NO: 216808 - DNA, 25 bp, Mus musculus
agtggcactgccttgagtttgtctc

SEQ ID NO: 216809 - DNA, 25 bp, Mus musculus
agtggcacttgtccacgtacatgct

SEQ ID NO: 216810 - DNA, 25 bp, Mus musculus
agtggcacttgtccttcctctgcgg

SEQ ID NO: 216811 - DNA, 25 bp, Mus musculus
agtggcacttgtgcacgtacatgct

SEQ ID NO: 216812 - DNA, 25 bp, Mus musculus
agtggcacttgtgcttcctctgcgg

SEQ ID NO: 216813 - DNA, 25 bp, Mus musculus
agtggcactttaagcccagctttgc

SEQ ID NO: 216814 - DNA, 25 bp, Mus musculus
agtggcactttatgcccagctttgc

SEQ ID NO: 216815 - DNA, 25 bp, Mus musculus
agtggcagactgagcaggcatcgct

SEQ ID NO: 216816 - DNA, 25 bp, Mus musculus
agtggcagactgtgcaggcatcgct

SEQ ID NO: 216817 - DNA, 25 bp, Mus musculus
agtggcagcaacaaccatgacagct

SEQ ID NO: 216818 - DNA, 25 bp, Mus musculus
agtggcagcaactaccatgacagct

SEQ ID NO: 216819 - DNA, 25 bp, Mus musculus
agtggcagcaggacccacggtgttt

SEQ ID NO: 216820 - DNA, 25 bp, Mus musculus
agtggcagcaggtcccacggtgttt

SEQ ID NO: 216821 - DNA, 25 bp, Mus musculus
agtggcagcctgagcttacagacct

SEQ ID NO: 216822 - DNA, 25 bp, Mus musculus
agtggcagcctgtgcttacagacct

SEQ ID NO: 216823 - DNA, 25 bp, Mus musculus
agtggcagctccataggtcacggct

SEQ ID NO: 216824 - DNA, 25 bp, Mus musculus
agtggcagctccttaggtcacggct

SEQ ID NO: 216825 - DNA, 25 bp, Mus musculus
agtggcaggcacaatttaacagagg

SEQ ID NO: 216826 - DNA, 25 bp, Mus musculus
agtggcaggcactatttaacagagg

SEQ ID NO: 216827 - DNA, 25 bp, Mus musculus
agtggcaggccaacttcggacgcag

SEQ ID NO: 216828 - DNA, 25 bp, Mus musculus
agtggcaggccatcttcggacgcag

SEQ ID NO: 216829 - DNA, 25 bp, Mus musculus
agtggcaggcgtcccttctccgagt

SEQ ID NO: 216830 - DNA, 25 bp, Mus musculus
agtggcaggcgtgccttctccgagt

SEQ ID NO: 216831 - DNA, 25 bp, Mus musculus
agtggcaggtaacccacagactgcc

SEQ ID NO: 216832 - DNA, 25 bp, Mus musculus
agtggcaggtaagccacagactgcc

SEQ ID NO: 216833 - DNA, 25 bp, Mus musculus
agtggcaggtatccatacacacccc

SEQ ID NO: 216834 - DNA, 25 bp, Mus musculus
agtggcaggtatgcatacacacccc

SEQ ID NO: 216835 - DNA, 25 bp, Mus musculus
agtggcagtatgcaagacttgacag

SEQ ID NO: 216836 - DNA, 25 bp, Mus musculus
agtggcagtatggaagacttgacag

SEQ ID NO: 216837 - DNA, 25 bp, Mus musculus
agtggcagtcttctgttctttgggc

SEQ ID NO: 216838 - DNA, 25 bp, Mus musculus
agtggcagtcttgtgttctttgggc

SEQ ID NO: 216839 - DNA, 25 bp, Mus musculus
agtggcagtggcagtgcactcgcat

SEQ ID NO: 216840 - DNA, 25 bp, Mus musculus
agtggcagtggctgtgcactcgcat

SEQ ID NO: 216841 - DNA, 25 bp, Mus musculus
agtggcatagtaataatagtcgcaa

SEQ ID NO: 216842 - DNA, 25 bp, Mus musculus
agtggcatagtattaatagtcgcaa

SEQ ID NO: 216843 - DNA, 25 bp, Mus musculus
agtggcatagttcaccaagtcccag

SEQ ID NO: 216844 - DNA, 25 bp, Mus musculus
agtggcatagttgaccaagtcccag

SEQ ID NO: 216845 - DNA, 25 bp, Mus musculus
agtggcatatgcatggatccgtcct

SEQ ID NO: 216846 - DNA, 25 bp, Mus musculus
agtggcatatgcttggatccgtcct

SEQ ID NO: 216847 - DNA, 25 bp, Mus musculus
agtggcatatggctgtcacctatgt

SEQ ID NO: 216848 - DNA, 25 bp, Mus musculus
agtggcatatgggtgtcacctatgt

SEQ ID NO: 216849 - DNA, 25 bp, Mus musculus
agtggcatatttcacatctctgaat

SEQ ID NO: 216850 - DNA, 25 bp, Mus musculus
agtggcatatttgacatctctgaat

SEQ ID NO: 216851 - DNA, 25 bp, Mus musculus
agtggcatcaaaaccctgaagctgg

SEQ ID NO: 216852 - DNA, 25 bp, Mus musculus
agtggcatcaaatccctgaagctgg

SEQ ID NO: 216853 - DNA, 25 bp, Mus musculus
agtggcatccgaccagggcgtcact

SEQ ID NO: 216854 - DNA, 25 bp, Mus musculus
agtggcatccgagcagggcgtcact

SEQ ID NO: 216855 - DNA, 25 bp, Mus musculus
agtggcatccttcaatgggctggca

SEQ ID NO: 216856 - DNA, 25 bp, Mus musculus
agtggcatccttgaatgggctggca

SEQ ID NO: 216857 - DNA, 25 bp, Mus musculus
agtggcatcgttactatccagcgga

SEQ ID NO: 216858 - DNA, 25 bp, Mus musculus
agtggcatcgtttctatccagcgga

SEQ ID NO: 216859 - DNA, 25 bp, Mus musculus
agtggcatctgcctgcaccaattac

SEQ ID NO: 216860 - DNA, 25 bp, Mus musculus
agtggcatctgcgtgcaccaattac

SEQ ID NO: 216861 - DNA, 25 bp, Mus musculus
agtggcatcttacctcatacatggt

SEQ ID NO: 216862 - DNA, 25 bp, Mus musculus
agtggcatcttagctcatacatggt

SEQ ID NO: 216863 - DNA, 25 bp, Mus musculus
agtggcatcttcatacacatggtat

SEQ ID NO: 216864 - DNA, 25 bp, Mus musculus
agtggcatcttcttacacatggtat

SEQ ID NO: 216865 - DNA, 25 bp, Mus musculus
agtggcatctttcgagggttttctt

SEQ ID NO: 216866 - DNA, 25 bp, Mus musculus
agtggcatctttggagggttttctt

SEQ ID NO: 216867 - DNA, 25 bp, Mus musculus
agtggcatgaccagcaacactatgg

SEQ ID NO: 216868 - DNA, 25 bp, Mus musculus
agtggcatgacctgcaacactatgg

SEQ ID NO: 216869 - DNA, 25 bp, Mus musculus
agtggcatgatgaaatggcaagaat

SEQ ID NO: 216870 - DNA, 25 bp, Mus musculus
agtggcatgatgtaatggcaagaat

SEQ ID NO: 216871 - DNA, 25 bp, Mus musculus
agtggcatgcagactgtcctgttag

SEQ ID NO: 216872 - DNA, 25 bp, Mus musculus
agtggcatgcagtctgtcctgttag

SEQ ID NO: 216873 - DNA, 25 bp, Mus musculus
agtggcatgcctactaccctaaagg

SEQ ID NO: 216874 - DNA, 25 bp, Mus musculus
agtggcatgcctcccaagagacgaa

SEQ ID NO: 216875 - DNA, 25 bp, Mus musculus
agtggcatgcctgccaagagacgaa

SEQ ID NO: 216876 - DNA, 25 bp, Mus musculus
agtggcatgccttctaccctaaagg

SEQ ID NO: 216877 - DNA, 25 bp, Mus musculus
agtggcatggtcatcgtctggagac

SEQ ID NO: 216878 - DNA, 25 bp, Mus musculus
agtggcatggtcttcgtctggagac

SEQ ID NO: 216879 - DNA, 25 bp, Mus musculus
agtggcatgtttagtgcatttgtaa

SEQ ID NO: 216880 - DNA, 25 bp, Mus musculus
agtggcatgttttgtgcatttgtaa

SEQ ID NO: 216881 - DNA, 25 bp, Mus musculus
agtggcattccgactgtaaaactca

SEQ ID NO: 216882 - DNA, 25 bp, Mus musculus
agtggcattccgtctgtaaaactca

SEQ ID NO: 216883 - DNA, 25 bp, Mus musculus
agtggcatttgcatcaaagtcagat

SEQ ID NO: 216884 - DNA, 25 bp, Mus musculus
agtggcatttgcatggacattgttg

SEQ ID NO: 216885 - DNA, 25 bp, Mus musculus
agtggcatttgcttcaaagtcagat

SEQ ID NO: 216886 - DNA, 25 bp, Mus musculus
agtggcatttgcttggacattgttg

SEQ ID NO: 216887 - DNA, 25 bp, Mus musculus
agtggcatttttaataatgatctta

SEQ ID NO: 216888 - DNA, 25 bp, Mus musculus
agtggcattttttataatgatctta

SEQ ID NO: 216889 - DNA, 25 bp, Mus musculus
agtggccaaaaccttgaacctgaag

SEQ ID NO: 216890 - DNA, 25 bp, Mus musculus
agtggccaaaacgttgaacctgaag

SEQ ID NO: 216891 - DNA, 25 bp, Mus musculus
agtggccaagatatgtgtcaatcat

SEQ ID NO: 216892 - DNA, 25 bp, Mus musculus
agtggccaagatttgtgtcaatcat

SEQ ID NO: 216893 - DNA, 25 bp, Mus musculus
agtggccaagccactgtacatataa

SEQ ID NO: 216894 - DNA, 25 bp, Mus musculus
agtggccaagcctctgtacatataa

SEQ ID NO: 216895 - DNA, 25 bp, Mus musculus
agtggccacagaaacttcctggtta

SEQ ID NO: 216896 - DNA, 25 bp, Mus musculus
agtggccacagactcttgctcacaa

SEQ ID NO: 216897 - DNA, 25 bp, Mus musculus
agtggccacagagtcttgctcacaa

SEQ ID NO: 216898 - DNA, 25 bp, Mus musculus
agtggccacagatacttcctggtta

SEQ ID NO: 216899 - DNA, 25 bp, Mus musculus
agtggccacagccagctacagactg

SEQ ID NO: 216900 - DNA, 25 bp, Mus musculus
agtggccacagcgagctacagactg

SEQ ID NO: 216901 - DNA, 25 bp, Mus musculus
agtggccacagtcctactttacgag

SEQ ID NO: 216902 - DNA, 25 bp, Mus musculus
agtggccacagtgctactttacgag

SEQ ID NO: 216903 - DNA, 25 bp, Mus musculus
agtggccacattagcagcgtgccct

SEQ ID NO: 216904 - DNA, 25 bp, Mus musculus
agtggccacatttgcagcgtgccct

SEQ ID NO: 216905 - DNA, 25 bp, Mus musculus
agtggccagcgtcttctcaggctgc

SEQ ID NO: 216906 - DNA, 25 bp, Mus musculus
agtggccagcgtgttctcaggctgc

SEQ ID NO: 216907 - DNA, 25 bp, Mus musculus
agtggccagctgcactcgacagtga

SEQ ID NO: 216908 - DNA, 25 bp, Mus musculus
agtggccagctggactcgacagtga

SEQ ID NO: 216909 - DNA, 25 bp, Mus musculus
agtggccagcttcaatgtaaccttc

SEQ ID NO: 216910 - DNA, 25 bp, Mus musculus
agtggccagcttgaatgtaaccttc

SEQ ID NO: 216911 - DNA, 25 bp, Mus musculus
agtggccaggatagccttgatggta

SEQ ID NO: 216912 - DNA, 25 bp, Mus musculus
agtggccaggattgccttgatggta

SEQ ID NO: 216913 - DNA, 25 bp, Mus musculus
agtggccaggccagagatctgagct

SEQ ID NO: 216914 - DNA, 25 bp, Mus musculus
agtggccaggcctgagatctgagct

SEQ ID NO: 216915 - DNA, 25 bp, Mus musculus
agtggccaggctaaatcagttttta

SEQ ID NO: 216916 - DNA, 25 bp, Mus musculus
agtggccaggcttaatcagttttta

SEQ ID NO: 216917 - DNA, 25 bp, Mus musculus
agtggccagggcattggaacaaatc

SEQ ID NO: 216918 - DNA, 25 bp, Mus musculus
agtggccagggctttggaacaaatc

SEQ ID NO: 216919 - DNA, 25 bp, Mus musculus
agtggccagtgcactgagtcaggat

SEQ ID NO: 216920 - DNA, 25 bp, Mus musculus
agtggccagtgctctgagtcaggat

SEQ ID NO: 216921 - DNA, 25 bp, Mus musculus
agtggccatcacactggagcaggag

SEQ ID NO: 216922 - DNA, 25 bp, Mus musculus
agtggccatcactctggagcaggag

SEQ ID NO: 216923 - DNA, 25 bp, Mus musculus
agtggccatgaaattagtccctgaa

SEQ ID NO: 216924 - DNA, 25 bp, Mus musculus
agtggccatgaatttagtccctgaa

SEQ ID NO: 216925 - DNA, 25 bp, Mus musculus
agtggccatgtgcagccgctacgac

SEQ ID NO: 216926 - DNA, 25 bp, Mus musculus
agtggccatgtggagccgctacgac

SEQ ID NO: 216927 - DNA, 25 bp, Mus musculus
agtggccattgcaacggtcatcgtt

SEQ ID NO: 216928 - DNA, 25 bp, Mus musculus
agtggccattgctacggtcatcgtt

SEQ ID NO: 216929 - DNA, 25 bp, Mus musculus
agtggccatttaattttgcagtagt

SEQ ID NO: 216930 - DNA, 25 bp, Mus musculus
agtggccatttatttttgcagtagt

SEQ ID NO: 216931 - DNA, 25 bp, Mus musculus
agtggcccacgacgagaacgtccga

SEQ ID NO: 216932 - DNA, 25 bp, Mus musculus
agtggcccacgaggagaacgtccga

SEQ ID NO: 216933 - DNA, 25 bp, Mus musculus
agtggcccacggagagttctttatt

SEQ ID NO: 216934 - DNA, 25 bp, Mus musculus
agtggcccacggtgagttctttatt

SEQ ID NO: 216935 - DNA, 25 bp, Mus musculus
agtggcccagacaaagtcaccatcg

SEQ ID NO: 216936 - DNA, 25 bp, Mus musculus
agtggcccagactaagtcaccatcg

SEQ ID NO: 216937 - DNA, 25 bp, Mus musculus
agtggcccagtaagagacggtcagc

SEQ ID NO: 216938 - DNA, 25 bp, Mus musculus
agtggcccagtatgagacggtcagc

SEQ ID NO: 216939 - DNA, 25 bp, Mus musculus
agtggcccattcagtaaacattgtg

SEQ ID NO: 216940 - DNA, 25 bp, Mus musculus
agtggcccattctgtaaacattgtg

SEQ ID NO: 216941 - DNA, 25 bp, Mus musculus
agtggccccatgcagagctttctct

SEQ ID NO: 216942 - DNA, 25 bp, Mus musculus
agtggccccatggagagctttctct

SEQ ID NO: 216943 - DNA, 25 bp, Mus musculus
agtggccccattccttgaatttttg

SEQ ID NO: 216944 - DNA, 25 bp, Mus musculus
agtggccccattgcttgaatttttg

SEQ ID NO: 216945 - DNA, 25 bp, Mus musculus
agtggcccctgtccatggttttcat

SEQ ID NO: 216946 - DNA, 25 bp, Mus musculus
agtggcccctgtgcatggttttcat

SEQ ID NO: 216947 - DNA, 25 bp, Mus musculus
agtggcccggctagctagatctgag

SEQ ID NO: 216948 - DNA, 25 bp, Mus musculus
agtggcccggcttgctagatctgag

SEQ ID NO: 216949 - DNA, 25 bp, Mus musculus
agtggcccgggtactgagtttcagc

SEQ ID NO: 216950 - DNA, 25 bp, Mus musculus
agtggcccgggttctgagtttcagc

SEQ ID NO: 216951 - DNA, 25 bp, Mus musculus
agtggccctaaactacacctttcat

SEQ ID NO: 216952 - DNA, 25 bp, Mus musculus
agtggccctaaagtacacctttcat

SEQ ID NO: 216953 - DNA, 25 bp, Mus musculus
agtggccctgatccgagtgaactgc

SEQ ID NO: 216954 - DNA, 25 bp, Mus musculus
agtggccctgatgcgagtgaactgc

SEQ ID NO: 216955 - DNA, 25 bp, Mus musculus
agtggccctggcattgaacctagag

SEQ ID NO: 216956 - DNA, 25 bp, Mus musculus
agtggccctggctttgaacctagag

SEQ ID NO: 216957 - DNA, 25 bp, Mus musculus
agtggcccttctcttcaaggttagt

SEQ ID NO: 216958 - DNA, 25 bp, Mus musculus
agtggcccttctgttcaaggttagt

SEQ ID NO: 216959 - DNA, 25 bp, Mus musculus
agtggcccttttctgacctgcgatg

SEQ ID NO: 216960 - DNA, 25 bp, Mus musculus
agtggcccttttgtgacctgcgatg

SEQ ID NO: 216961 - DNA, 25 bp, Mus musculus
agtggccgagttcgaccagctgctt

SEQ ID NO: 216962 - DNA, 25 bp, Mus musculus
agtggccgagttggaccagctgctt

SEQ ID NO: 216963 - DNA, 25 bp, Mus musculus
agtggccggcaaacatcgtttctat

SEQ ID NO: 216964 - DNA, 25 bp, Mus musculus
agtggccggcaatcatcgtttctat

SEQ ID NO: 216965 - DNA, 25 bp, Mus musculus
agtggccggcacattggagcctacg

SEQ ID NO: 216966 - DNA, 25 bp, Mus musculus
agtggccggcactttggagcctacg

SEQ ID NO: 216967 - DNA, 25 bp, Mus musculus
agtggccgtcctctgaacctgatgg

SEQ ID NO: 216968 - DNA, 25 bp, Mus musculus
agtggccgtcctgtgaacctgatgg

SEQ ID NO: 216969 - DNA, 25 bp, Mus musculus
agtggcctaaggcacagctgtatct

SEQ ID NO: 216970 - DNA, 25 bp, Mus musculus
agtggcctaagggacagctgtatct

SEQ ID NO: 216971 - DNA, 25 bp, Mus musculus
agtggcctacagcttcagttttgag

SEQ ID NO: 216972 - DNA, 25 bp, Mus musculus
agtggcctacaggttcagttttgag

SEQ ID NO: 216973 - DNA, 25 bp, Mus musculus
agtggcctagacctggtggcacaca

SEQ ID NO: 216974 - DNA, 25 bp, Mus musculus
agtggcctagacgtggtggcacaca

SEQ ID NO: 216975 - DNA, 25 bp, Mus musculus
agtggcctcaaaagtctgcatcaca

SEQ ID NO: 216976 - DNA, 25 bp, Mus musculus
agtggcctcaaatgtctgcatcaca

SEQ ID NO: 216977 - DNA, 25 bp, Mus musculus
agtggcctcaggatgaagcctccca

SEQ ID NO: 216978 - DNA, 25 bp, Mus musculus
agtggcctcaggttgaagcctccca

SEQ ID NO: 216979 - DNA, 25 bp, Mus musculus
agtggcctcatcagtctgccaggga

SEQ ID NO: 216980 - DNA, 25 bp, Mus musculus
agtggcctcatctgtctgccaggga

SEQ ID NO: 216981 - DNA, 25 bp, Mus musculus
agtggcctccacacccggtacaaat

SEQ ID NO: 216982 - DNA, 25 bp, Mus musculus
agtggcctccactcccggtacaaat

SEQ ID NO: 216983 - DNA, 25 bp, Mus musculus
agtggcctccctcggccaagggtat

SEQ ID NO: 216984 - DNA, 25 bp, Mus musculus
agtggcctccctgggccaagggtat

SEQ ID NO: 216985 - DNA, 25 bp, Mus musculus
agtggcctcctcaggatgtaaatcc

SEQ ID NO: 216986 - DNA, 25 bp, Mus musculus
agtggcctcctctggatgtaaatcc

SEQ ID NO: 216987 - DNA, 25 bp, Mus musculus
agtggcctctacatcacaggatgaa

SEQ ID NO: 216988 - DNA, 25 bp, Mus musculus
agtggcctctacttcacaggatgaa

SEQ ID NO: 216989 - DNA, 25 bp, Mus musculus
agtggcctctgaagtggtacgcgcc

SEQ ID NO: 216990 - DNA, 25 bp, Mus musculus
agtggcctctgatgtggtacgcgcc

SEQ ID NO: 216991 - DNA, 25 bp, Mus musculus
agtggcctgaacactctgtcctctg

SEQ ID NO: 216992 - DNA, 25 bp, Mus musculus
agtggcctgaactctctgtcctctg

SEQ ID NO: 216993 - DNA, 25 bp, Mus musculus
agtggcctgagcattgagtacggta

SEQ ID NO: 216994 - DNA, 25 bp, Mus musculus
agtggcctgagctttgagtacggta

SEQ ID NO: 216995 - DNA, 25 bp, Mus musculus
agtggcctgatcagctcagtgactt

SEQ ID NO: 216996 - DNA, 25 bp, Mus musculus
agtggcctgatctgctcagtgactt

SEQ ID NO: 216997 - DNA, 25 bp, Mus musculus
agtggcctgcaactttaggatgttt

SEQ ID NO: 216998 - DNA, 25 bp, Mus musculus
agtggcctgcaagtttaggatgttt

SEQ ID NO: 216999 - DNA, 25 bp, Mus musculus
agtggcctgcgtcgcacgctgcatc

SEQ ID NO: 217000 - DNA, 25 bp, Mus musculus
agtggcctgcgtggcacgctgcatc

SEQ ID NO: 217001 - DNA, 25 bp, Mus musculus
agtggcctggcacgtggttcacaaa

SEQ ID NO: 217002 - DNA, 25 bp, Mus musculus
agtggcctggcaggtggttcacaaa

SEQ ID NO: 217003 - DNA, 25 bp, Mus musculus
agtggcctgggtcttagcattgctc

SEQ ID NO: 217004 - DNA, 25 bp, Mus musculus
agtggcctgggtgttagcattgctc

SEQ ID NO: 217005 - DNA, 25 bp, Mus musculus
agtggcctgtccagcagcaatggaa

SEQ ID NO: 217006 - DNA, 25 bp, Mus musculus
agtggcctgtcctgcagcaatggaa

SEQ ID NO: 217007 - DNA, 25 bp, Mus musculus
agtggcctgtgacttcctacctgct

SEQ ID NO: 217008 - DNA, 25 bp, Mus musculus
agtggcctgtgagttcctacctgct

SEQ ID NO: 217009 - DNA, 25 bp, Mus musculus
agtggcctgttcaggaaactgcttg

SEQ ID NO: 217010 - DNA, 25 bp, Mus musculus
agtggcctgttctggaaactgcttg

SEQ ID NO: 217011 - DNA, 25 bp, Mus musculus
agtggcctgttgacatagcaactgg

SEQ ID NO: 217012 - DNA, 25 bp, Mus musculus
agtggcctgttgtcatagcaactgg

SEQ ID NO: 217013 - DNA, 25 bp, Mus musculus
agtggccttaagcagtcaccgttta

SEQ ID NO: 217014 - DNA, 25 bp, Mus musculus
agtggccttaaggagtcaccgttta

SEQ ID NO: 217015 - DNA, 25 bp, Mus musculus
agtggccttactccattaaccttag

SEQ ID NO: 217016 - DNA, 25 bp, Mus musculus
agtggccttactgcattaaccttag

SEQ ID NO: 217017 - DNA, 25 bp, Mus musculus
agtggccttagcagtgctgcagaca

SEQ ID NO: 217018 - DNA, 25 bp, Mus musculus
agtggccttagctgtgctgcagaca

SEQ ID NO: 217019 - DNA, 25 bp, Mus musculus
agtggccttcagaccggtcacagaa

SEQ ID NO: 217020 - DNA, 25 bp, Mus musculus
agtggccttcagtccggtcacagaa

SEQ ID NO: 217021 - DNA, 25 bp, Mus musculus
agtggccttgacagtgtgtgctccc

SEQ ID NO: 217022 - DNA, 25 bp, Mus musculus
agtggccttgactgtgtgtgctccc

SEQ ID NO: 217023 - DNA, 25 bp, Mus musculus
agtggccttgctctgaacctgaatc

SEQ ID NO: 217024 - DNA, 25 bp, Mus musculus
agtggccttgctgtgaacctgaatc

SEQ ID NO: 217025 - DNA, 25 bp, Mus musculus
agtggccttggcacgttcacaggag

SEQ ID NO: 217026 - DNA, 25 bp, Mus musculus
agtggccttggcaggagtcttcatg

SEQ ID NO: 217027 - DNA, 25 bp, Mus musculus
agtggccttggctcgttcacaggag

SEQ ID NO: 217028 - DNA, 25 bp, Mus musculus
agtggccttggctggagtcttcatg

SEQ ID NO: 217029 - DNA, 25 bp, Mus musculus
agtggcctttgtcagtgcccagaac

SEQ ID NO: 217030 - DNA, 25 bp, Mus musculus
agtggcctttgtgagtgcccagaac

SEQ ID NO: 217031 - DNA, 25 bp, Mus musculus
agtggcgaagcaagatcctcctggg

SEQ ID NO: 217032 - DNA, 25 bp, Mus musculus
agtggcgaagcatgatcctcctggg

SEQ ID NO: 217033 - DNA, 25 bp, Mus musculus
agtggcgacaccaaaagcgtgcttc

SEQ ID NO: 217034 - DNA, 25 bp, Mus musculus
agtggcgacacctaaagcgtgcttc

SEQ ID NO: 217035 - DNA, 25 bp, Mus musculus
agtggcgaccacctgcctatctctt

SEQ ID NO: 217036 - DNA, 25 bp, Mus musculus
agtggcgaccacgtgcctatctctt

SEQ ID NO: 217037 - DNA, 25 bp, Mus musculus
agtggcgagatcaggtactcatgag

SEQ ID NO: 217038 - DNA, 25 bp, Mus musculus
agtggcgagatctggtactcatgag

SEQ ID NO: 217039 - DNA, 25 bp, Mus musculus
agtggcgagatgatccagtggttaa

SEQ ID NO: 217040 - DNA, 25 bp, Mus musculus
agtggcgagatgttccagtggttaa

SEQ ID NO: 217041 - DNA, 25 bp, Mus musculus
agtggcgatctacctcaaagcttct

SEQ ID NO: 217042 - DNA, 25 bp, Mus musculus
agtggcgatctagctcaaagcttct

SEQ ID NO: 217043 - DNA, 25 bp, Mus musculus
agtggcgcataaccgaagccctcca

SEQ ID NO: 217044 - DNA, 25 bp, Mus musculus
agtggcgcataagcgaagccctcca

SEQ ID NO: 217045 - DNA, 25 bp, Mus musculus
agtggcgccaccaaactcaaggaga

SEQ ID NO: 217046 - DNA, 25 bp, Mus musculus
agtggcgccaccaactgggacaatg

SEQ ID NO: 217047 - DNA, 25 bp, Mus musculus
agtggcgccacctaactcaaggaga

SEQ ID NO: 217048 - DNA, 25 bp, Mus musculus
agtggcgccacctactgggacaatg

SEQ ID NO: 217049 - DNA, 25 bp, Mus musculus
agtggcgcctatagaactaagtggc

SEQ ID NO: 217050 - DNA, 25 bp, Mus musculus
agtggcgcctattgaactaagtggc

SEQ ID NO: 217051 - DNA, 25 bp, Mus musculus
agtggcgcgatcaccagagtgctga

SEQ ID NO: 217052 - DNA, 25 bp, Mus musculus
agtggcgcgatctccagagtgctga

SEQ ID NO: 217053 - DNA, 25 bp, Mus musculus
agtggcgctcagatgtagctgcaca

SEQ ID NO: 217054 - DNA, 25 bp, Mus musculus
agtggcgctcagttgtagctgcaca

SEQ ID NO: 217055 - DNA, 25 bp, Mus musculus
agtggcgctggaaaagaactttcat

SEQ ID NO: 217056 - DNA, 25 bp, Mus musculus
agtggcgctggataagaactttcat

SEQ ID NO: 217057 - DNA, 25 bp, Mus musculus
agtggcggacaaatcctttgatgcc

SEQ ID NO: 217058 - DNA, 25 bp, Mus musculus
agtggcggacaattcctttgatgcc

SEQ ID NO: 217059 - DNA, 25 bp, Mus musculus
agtggcggacatatgccgatgtctc

SEQ ID NO: 217060 - DNA, 25 bp, Mus musculus
agtggcggacatttgccgatgtctc

SEQ ID NO: 217061 - DNA, 25 bp, Mus musculus
agtggcggagatcaagccccgtatt

SEQ ID NO: 217062 - DNA, 25 bp, Mus musculus
agtggcggagatgaagccccgtatt

SEQ ID NO: 217063 - DNA, 25 bp, Mus musculus
agtggcggattccaaatctccccta

SEQ ID NO: 217064 - DNA, 25 bp, Mus musculus
agtggcggattcgaaatctccccta

SEQ ID NO: 217065 - DNA, 25 bp, Mus musculus
agtggcggcccacgtgaagccaaca

SEQ ID NO: 217066 - DNA, 25 bp, Mus musculus
agtggcggcccaggtgaagccaaca

SEQ ID NO: 217067 - DNA, 25 bp, Mus musculus
agtggcggctccaattccatcaaaa

SEQ ID NO: 217068 - DNA, 25 bp, Mus musculus
agtggcggctcctattccatcaaaa

SEQ ID NO: 217069 - DNA, 25 bp, Mus musculus
agtggcgggtgaaatccagctgacc

SEQ ID NO: 217070 - DNA, 25 bp, Mus musculus
agtggcgggtgatatccagctgacc

SEQ ID NO: 217071 - DNA, 25 bp, Mus musculus
agtggcgtccagactcatctctggc

SEQ ID NO: 217072 - DNA, 25 bp, Mus musculus
agtggcgtccagtctcatctctggc

SEQ ID NO: 217073 - DNA, 25 bp, Mus musculus
agtggcgttcagccacccgagattg

SEQ ID NO: 217074 - DNA, 25 bp, Mus musculus
agtggcgttcaggcacccgagattg

SEQ ID NO: 217075 - DNA, 25 bp, Mus musculus
agtggcgttggaccttgttagtaat

SEQ ID NO: 217076 - DNA, 25 bp, Mus musculus
agtggcgttggagcttgttagtaat

SEQ ID NO: 217077 - DNA, 25 bp, Mus musculus
agtggctaacccaactcactgttct

SEQ ID NO: 217078 - DNA, 25 bp, Mus musculus
agtggctaaccctactcactgttct

SEQ ID NO: 217079 - DNA, 25 bp, Mus musculus
agtggctaccagctcggaggacata

SEQ ID NO: 217080 - DNA, 25 bp, Mus musculus
agtggctaccaggtcggaggacata

SEQ ID NO: 217081 - DNA, 25 bp, Mus musculus
agtggctaccggagctaagaacaag

SEQ ID NO: 217082 - DNA, 25 bp, Mus musculus
agtggctaccggtgctaagaacaag

SEQ ID NO: 217083 - DNA, 25 bp, Mus musculus
agtggctacctgaagtgtcatttat

SEQ ID NO: 217084 - DNA, 25 bp, Mus musculus
agtggctacctgtagtgtcatttat

SEQ ID NO: 217085 - DNA, 25 bp, Mus musculus
agtggctaccttacatgtcaaaatg

SEQ ID NO: 217086 - DNA, 25 bp, Mus musculus
agtggctacctttcatgtcaaaatg

SEQ ID NO: 217087 - DNA, 25 bp, Mus musculus
agtggctactctcaacctgatggac

SEQ ID NO: 217088 - DNA, 25 bp, Mus musculus
agtggctactctgaacctgatggac

SEQ ID NO: 217089 - DNA, 25 bp, Mus musculus
agtggctagactaggcctgtaggcc

SEQ ID NO: 217090 - DNA, 25 bp, Mus musculus
agtggctagacttggcctgtaggcc

SEQ ID NO: 217091 - DNA, 25 bp, Mus musculus
agtggctatttcctgacaatttccc

SEQ ID NO: 217092 - DNA, 25 bp, Mus musculus
agtggctatttcgtgacaatttccc

SEQ ID NO: 217093 - DNA, 25 bp, Mus musculus
agtggctcaatactttgccgatcca

SEQ ID NO: 217094 - DNA, 25 bp, Mus musculus
agtggctcaatagtttgccgatcca

SEQ ID NO: 217095 - DNA, 25 bp, Mus musculus
agtggctcacaccagcaacttggcc

SEQ ID NO: 217096 - DNA, 25 bp, Mus musculus
agtggctcacacgagcaacttggcc

SEQ ID NO: 217097 - DNA, 25 bp, Mus musculus
agtggctcacatctgctgttactaa

SEQ ID NO: 217098 - DNA, 25 bp, Mus musculus
agtggctcacatgtgctgttactaa

SEQ ID NO: 217099 - DNA, 25 bp, Mus musculus
agtggctcactcagaaatcctagca

SEQ ID NO: 217100 - DNA, 25 bp, Mus musculus
agtggctcactctgaaatcctagca

SEQ ID NO: 217101 - DNA, 25 bp, Mus musculus
agtggctcagaaaggctgcttgctc

SEQ ID NO: 217102 - DNA, 25 bp, Mus musculus
agtggctcagaatggctgcttgctc

SEQ ID NO: 217103 - DNA, 25 bp, Mus musculus
agtggctcagagacccgtggccaca

SEQ ID NO: 217104 - DNA, 25 bp, Mus musculus
agtggctcagagtcccgtggccaca

SEQ ID NO: 217105 - DNA, 25 bp, Mus musculus
agtggctcagctcaagtccctgagt

SEQ ID NO: 217106 - DNA, 25 bp, Mus musculus
agtggctcagctgaagtccctgagt

SEQ ID NO: 217107 - DNA, 25 bp, Mus musculus
agtggctcaggacccctgccatggt

SEQ ID NO: 217108 - DNA, 25 bp, Mus musculus
agtggctcaggagccctgccatggt

SEQ ID NO: 217109 - DNA, 25 bp, Mus musculus
agtggctcagggacttgcggccctt

SEQ ID NO: 217110 - DNA, 25 bp, Mus musculus
agtggctcagggtcttgcggccctt

SEQ ID NO: 217111 - DNA, 25 bp, Mus musculus
agtggctcaggtcttccatgctgga

SEQ ID NO: 217112 - DNA, 25 bp, Mus musculus
agtggctcaggtgttccatgctgga

SEQ ID NO: 217113 - DNA, 25 bp, Mus musculus
agtggctcagttcgacggttcttgc

SEQ ID NO: 217114 - DNA, 25 bp, Mus musculus
agtggctcagttggacggttcttgc

SEQ ID NO: 217115 - DNA, 25 bp, Mus musculus
agtggctcatggagctttcaataaa

SEQ ID NO: 217116 - DNA, 25 bp, Mus musculus
agtggctcatggtgctttcaataaa

SEQ ID NO: 217117 - DNA, 25 bp, Mus musculus
agtggctccagcatctacaactacc

SEQ ID NO: 217118 - DNA, 25 bp, Mus musculus
agtggctccagcttctacaactacc

SEQ ID NO: 217119 - DNA, 25 bp, Mus musculus
agtggctccaggctcgcctcagcat

SEQ ID NO: 217120 - DNA, 25 bp, Mus musculus
agtggctccagggtcgcctcagcat

SEQ ID NO: 217121 - DNA, 25 bp, Mus musculus
agtggctcccagatgcccaaagtac

SEQ ID NO: 217122 - DNA, 25 bp, Mus musculus
agtggctcccagttgcccaaagtac

SEQ ID NO: 217123 - DNA, 25 bp, Mus musculus
agtggctcccttccacaagtgactt

SEQ ID NO: 217124 - DNA, 25 bp, Mus musculus
agtggctcccttgcacaagtgactt

SEQ ID NO: 217125 - DNA, 25 bp, Mus musculus
agtggctccgtcatcaacttgatgt

SEQ ID NO: 217126 - DNA, 25 bp, Mus musculus
agtggctccgtcttcaacttgatgt

SEQ ID NO: 217127 - DNA, 25 bp, Mus musculus
agtggctcctaccttgttggaacct

SEQ ID NO: 217128 - DNA, 25 bp, Mus musculus
agtggctcctacgttgttggaacct

SEQ ID NO: 217129 - DNA, 25 bp, Mus musculus
agtggctcctccaacgacaacagag

SEQ ID NO: 217130 - DNA, 25 bp, Mus musculus
agtggctcctcctacgacaacagag

SEQ ID NO: 217131 - DNA, 25 bp, Mus musculus
agtggctcctttctcctttcagtaa

SEQ ID NO: 217132 - DNA, 25 bp, Mus musculus
agtggctcctttgtcctttcagtaa

SEQ ID NO: 217133 - DNA, 25 bp, Mus musculus
agtggctctcaacggcaaactcgcg

SEQ ID NO: 217134 - DNA, 25 bp, Mus musculus
agtggctctcaagggcaaactcgcg

SEQ ID NO: 217135 - DNA, 25 bp, Mus musculus
agtggctctgacagtgctctggaag

SEQ ID NO: 217136 - DNA, 25 bp, Mus musculus
agtggctctgactgtgctctggaag

SEQ ID NO: 217137 - DNA, 25 bp, Mus musculus
agtggctctgtcagtagggagctat

SEQ ID NO: 217138 - DNA, 25 bp, Mus musculus
agtggctctgtccacgttagggtcc

SEQ ID NO: 217139 - DNA, 25 bp, Mus musculus
agtggctctgtcgacgttagggtcc

SEQ ID NO: 217140 - DNA, 25 bp, Mus musculus
agtggctctgtctgtagggagctat

SEQ ID NO: 217141 - DNA, 25 bp, Mus musculus
agtggctcttcaccactgagcagaa

SEQ ID NO: 217142 - DNA, 25 bp, Mus musculus
agtggctcttcagcactgagcagaa

SEQ ID NO: 217143 - DNA, 25 bp, Mus musculus
agtggctcttcccacagtttcggac

SEQ ID NO: 217144 - DNA, 25 bp, Mus musculus
agtggctcttccgacagtttcggac

SEQ ID NO: 217145 - DNA, 25 bp, Mus musculus
agtggctcttctaagtgctttgtca

SEQ ID NO: 217146 - DNA, 25 bp, Mus musculus
agtggctcttcttagtgctttgtca

SEQ ID NO: 217147 - DNA, 25 bp, Mus musculus
agtggctgacacaaggcgccttaac

SEQ ID NO: 217148 - DNA, 25 bp, Mus musculus
agtggctgacacactaatctggagt

SEQ ID NO: 217149 - DNA, 25 bp, Mus musculus
agtggctgacacagcactccgggtg

SEQ ID NO: 217150 - DNA, 25 bp, Mus musculus
agtggctgacactaggcgccttaac

SEQ ID NO: 217151 - DNA, 25 bp, Mus musculus
agtggctgacactctaatctggagt

SEQ ID NO: 217152 - DNA, 25 bp, Mus musculus
agtggctgacactgcactccgggtg

SEQ ID NO: 217153 - DNA, 25 bp, Mus musculus
agtggctgacgtctttgattttcta

SEQ ID NO: 217154 - DNA, 25 bp, Mus musculus
agtggctgacgtgtttgattttcta

SEQ ID NO: 217155 - DNA, 25 bp, Mus musculus
agtggctgataacccagtacccagt

SEQ ID NO: 217156 - DNA, 25 bp, Mus musculus
agtggctgataagccagtacccagt

SEQ ID NO: 217157 - DNA, 25 bp, Mus musculus
agtggctgattcatgagctccttca

SEQ ID NO: 217158 - DNA, 25 bp, Mus musculus
agtggctgattcttgagctccttca

SEQ ID NO: 217159 - DNA, 25 bp, Mus musculus
agtggctgcagaagcggtcatgtca

SEQ ID NO: 217160 - DNA, 25 bp, Mus musculus
agtggctgcagacatgggacttcct

SEQ ID NO: 217161 - DNA, 25 bp, Mus musculus
agtggctgcagagatgggacttcct

SEQ ID NO: 217162 - DNA, 25 bp, Mus musculus
agtggctgcagatgcggtcatgtca

SEQ ID NO: 217163 - DNA, 25 bp, Mus musculus
agtggctgcagtaatacctctttcc

SEQ ID NO: 217164 - DNA, 25 bp, Mus musculus
agtggctgcagttatacctctttcc

SEQ ID NO: 217165 - DNA, 25 bp, Mus musculus
agtggctgccagcatcactgatggc

SEQ ID NO: 217166 - DNA, 25 bp, Mus musculus
agtggctgccaggatcactgatggc

SEQ ID NO: 217167 - DNA, 25 bp, Mus musculus
agtggctgccccagagtggagatct

SEQ ID NO: 217168 - DNA, 25 bp, Mus musculus
agtggctgcccctgagtggagatct

SEQ ID NO: 217169 - DNA, 25 bp, Mus musculus
agtggctgccgaagtattcttgaac

SEQ ID NO: 217170 - DNA, 25 bp, Mus musculus
agtggctgccgatgtattcttgaac

SEQ ID NO: 217171 - DNA, 25 bp, Mus musculus
agtggctgcggactgctctccagca

SEQ ID NO: 217172 - DNA, 25 bp, Mus musculus
agtggctgcggagtgctctccagca

SEQ ID NO: 217173 - DNA, 25 bp, Mus musculus
agtggctgcgggacattactgagac

SEQ ID NO: 217174 - DNA, 25 bp, Mus musculus
agtggctgcgggtcattactgagac

SEQ ID NO: 217175 - DNA, 25 bp, Mus musculus
agtggctgctggactccctagctga

SEQ ID NO: 217176 - DNA, 25 bp, Mus musculus
agtggctgctggtctccctagctga

SEQ ID NO: 217177 - DNA, 25 bp, Mus musculus
agtggctggaaaagtgtcccctaca

SEQ ID NO: 217178 - DNA, 25 bp, Mus musculus
agtggctggaaatgtgtcccctaca

SEQ ID NO: 217179 - DNA, 25 bp, Mus musculus
agtggctggactattttccaagtaa

SEQ ID NO: 217180 - DNA, 25 bp, Mus musculus
agtggctggactcaacggtgcttca

SEQ ID NO: 217181 - DNA, 25 bp, Mus musculus
agtggctggactgaacggtgcttca

SEQ ID NO: 217182 - DNA, 25 bp, Mus musculus
agtggctggacttttttccaagtaa

SEQ ID NO: 217183 - DNA, 25 bp, Mus musculus
agtggctggaggagaccgactcgtc

SEQ ID NO: 217184 - DNA, 25 bp, Mus musculus
agtggctggaggagtcggactcaga

SEQ ID NO: 217185 - DNA, 25 bp, Mus musculus
agtggctggaggtgaccgactcgtc

SEQ ID NO: 217186 - DNA, 25 bp, Mus musculus
agtggctggaggtgtcggactcaga

SEQ ID NO: 217187 - DNA, 25 bp, Mus musculus
agtggctggtatcctttcaaatatg

SEQ ID NO: 217188 - DNA, 25 bp, Mus musculus
agtggctggtatgctttcaaatatg

SEQ ID NO: 217189 - DNA, 25 bp, Mus musculus
agtggctggtgcaacagacgtcaca

SEQ ID NO: 217190 - DNA, 25 bp, Mus musculus
agtggctggtgctacagacgtcaca

SEQ ID NO: 217191 - DNA, 25 bp, Mus musculus
agtggctggttcatccgctaatcaa

SEQ ID NO: 217192 - DNA, 25 bp, Mus musculus
agtggctggttcttccgctaatcaa

SEQ ID NO: 217193 - DNA, 25 bp, Mus musculus
agtggctgtactcgcctgaagagca

SEQ ID NO: 217194 - DNA, 25 bp, Mus musculus
agtggctgtactggcctgaagagca

SEQ ID NO: 217195 - DNA, 25 bp, Mus musculus
agtggctgtggcaagtactcaccta

SEQ ID NO: 217196 - DNA, 25 bp, Mus musculus
agtggctgtggctagtactcaccta

SEQ ID NO: 217197 - DNA, 25 bp, Mus musculus
agtggctgttcaagctctgagttta

SEQ ID NO: 217198 - DNA, 25 bp, Mus musculus
agtggctgttcatgctctgagttta

SEQ ID NO: 217199 - DNA, 25 bp, Mus musculus
agtggctgttccacgactgatactc

SEQ ID NO: 217200 - DNA, 25 bp, Mus musculus
agtggctgttcctcgactgatactc

SEQ ID NO: 217201 - DNA, 25 bp, Mus musculus
agtggcttaaccctattggccagta

SEQ ID NO: 217202 - DNA, 25 bp, Mus musculus
agtggcttaaccgtattggccagta

SEQ ID NO: 217203 - DNA, 25 bp, Mus musculus
agtggcttagacagtctacccacag

SEQ ID NO: 217204 - DNA, 25 bp, Mus musculus
agtggcttagactgtctacccacag

SEQ ID NO: 217205 - DNA, 25 bp, Mus musculus
agtggcttcaagaatccctactgaa

SEQ ID NO: 217206 - DNA, 25 bp, Mus musculus
agtggcttcaagtatccctactgaa

SEQ ID NO: 217207 - DNA, 25 bp, Mus musculus
agtggcttccatatgatctgtgtag

SEQ ID NO: 217208 - DNA, 25 bp, Mus musculus
agtggcttccatttgatctgtgtag

SEQ ID NO: 217209 - DNA, 25 bp, Mus musculus
agtggcttcccaacttagaacccgg

SEQ ID NO: 217210 - DNA, 25 bp, Mus musculus
agtggcttcccatcttagaacccgg

SEQ ID NO: 217211 - DNA, 25 bp, Mus musculus
agtggcttcctgcacttgagagcat

SEQ ID NO: 217212 - DNA, 25 bp, Mus musculus
agtggcttcctggacttgagagcat

SEQ ID NO: 217213 - DNA, 25 bp, Mus musculus
agtggcttctcgctgcaggtcatgt

SEQ ID NO: 217214 - DNA, 25 bp, Mus musculus
agtggcttctcggtgcaggtcatgt

SEQ ID NO: 217215 - DNA, 25 bp, Mus musculus
agtggcttctggactggcatctgtc

SEQ ID NO: 217216 - DNA, 25 bp, Mus musculus
agtggcttctggtctggcatctgtc

SEQ ID NO: 217217 - DNA, 25 bp, Mus musculus
agtggcttgaagaagtggctccttt

SEQ ID NO: 217218 - DNA, 25 bp, Mus musculus
agtggcttgaagtagtggctccttt

SEQ ID NO: 217219 - DNA, 25 bp, Mus musculus
agtggcttgatcaactgccctaaaa

SEQ ID NO: 217220 - DNA, 25 bp, Mus musculus
agtggcttgatctactgccctaaaa

SEQ ID NO: 217221 - DNA, 25 bp, Mus musculus
agtggcttgattagaccagagacaa

SEQ ID NO: 217222 - DNA, 25 bp, Mus musculus
agtggcttgatttgaccagagacaa

SEQ ID NO: 217223 - DNA, 25 bp, Mus musculus
agtggcttgccaatttactatctgt

SEQ ID NO: 217224 - DNA, 25 bp, Mus musculus
agtggcttgccattttactatctgt

SEQ ID NO: 217225 - DNA, 25 bp, Mus musculus
agtggcttgctcactctccaaagca

SEQ ID NO: 217226 - DNA, 25 bp, Mus musculus
agtggcttgctctctctccaaagca

SEQ ID NO: 217227 - DNA, 25 bp, Mus musculus
agtggcttgcttctcatccatgcct

SEQ ID NO: 217228 - DNA, 25 bp, Mus musculus
agtggcttgcttgtcatccatgcct

SEQ ID NO: 217229 - DNA, 25 bp, Mus musculus
agtggcttggtcctcactaagagtc

SEQ ID NO: 217230 - DNA, 25 bp, Mus musculus
agtggcttggtcgtcactaagagtc

SEQ ID NO: 217231 - DNA, 25 bp, Mus musculus
agtggctttaggagccgctgtgccc

SEQ ID NO: 217232 - DNA, 25 bp, Mus musculus
agtggctttaggtgccgctgtgccc

SEQ ID NO: 217233 - DNA, 25 bp, Mus musculus
agtggctttcaacagcaggacagct

SEQ ID NO: 217234 - DNA, 25 bp, Mus musculus
agtggctttcaagagcaggacagct

SEQ ID NO: 217235 - DNA, 25 bp, Mus musculus
agtggctttctaacatccagctttg

SEQ ID NO: 217236 - DNA, 25 bp, Mus musculus
agtggctttctatcatccagctttg

SEQ ID NO: 217237 - DNA, 25 bp, Mus musculus
agtggctttgccatgatgtgtcagg

SEQ ID NO: 217238 - DNA, 25 bp, Mus musculus
agtggctttgccttgatgtgtcagg

SEQ ID NO: 217239 - DNA, 25 bp, Mus musculus
agtggctttggactcttgtcctgtc

SEQ ID NO: 217240 - DNA, 25 bp, Mus musculus
agtggctttggagtcttgtcctgtc

SEQ ID NO: 217241 - DNA, 25 bp, Mus musculus
agtggctttgtacttacccctgatg

SEQ ID NO: 217242 - DNA, 25 bp, Mus musculus
agtggctttgtagttacccctgatg

SEQ ID NO: 217243 - DNA, 25 bp, Mus musculus
agtgggaaacatcgtcaggacacga

SEQ ID NO: 217244 - DNA, 25 bp, Mus musculus
agtgggaaacatggtcaggacacga

SEQ ID NO: 217245 - DNA, 25 bp, Mus musculus
agtgggaaacccacggcataacgcg

SEQ ID NO: 217246 - DNA, 25 bp, Mus musculus
agtgggaaaccctcggcataacgcg

SEQ ID NO: 217247 - DNA, 25 bp, Mus musculus
agtgggaaagctctccggagctccc

SEQ ID NO: 217248 - DNA, 25 bp, Mus musculus
agtgggaaagctgtccggagctccc

SEQ ID NO: 217249 - DNA, 25 bp, Mus musculus
agtgggaaaggcactcacctccacg

SEQ ID NO: 217250 - DNA, 25 bp, Mus musculus
agtgggaaaggctctcacctccacg

SEQ ID NO: 217251 - DNA, 25 bp, Mus musculus
agtgggaaatgcatgcttcgaggaa

SEQ ID NO: 217252 - DNA, 25 bp, Mus musculus
agtgggaaatgcttgcttcgaggaa

SEQ ID NO: 217253 - DNA, 25 bp, Mus musculus
agtgggaacatcagcctgcttttgt

SEQ ID NO: 217254 - DNA, 25 bp, Mus musculus
agtgggaacatctgcctgcttttgt

SEQ ID NO: 217255 - DNA, 25 bp, Mus musculus
agtgggaacgccatagacctctgat

SEQ ID NO: 217256 - DNA, 25 bp, Mus musculus
agtgggaacgccttagacctctgat

SEQ ID NO: 217257 - DNA, 25 bp, Mus musculus
agtgggaactgtagcttgctcctcc

SEQ ID NO: 217258 - DNA, 25 bp, Mus musculus
agtgggaactgttgcttgctcctcc

SEQ ID NO: 217259 - DNA, 25 bp, Mus musculus
agtgggaagataagcctacctgagc

SEQ ID NO: 217260 - DNA, 25 bp, Mus musculus
agtgggaagatatgcctacctgagc

SEQ ID NO: 217261 - DNA, 25 bp, Mus musculus
agtgggaagctacgagcccacctct

SEQ ID NO: 217262 - DNA, 25 bp, Mus musculus
agtgggaagctaggagcccacctct

SEQ ID NO: 217263 - DNA, 25 bp, Mus musculus
agtgggaagcttacagcctaccgga

SEQ ID NO: 217264 - DNA, 25 bp, Mus musculus
agtgggaagcttcgtcgttctatgt

SEQ ID NO: 217265 - DNA, 25 bp, Mus musculus
agtgggaagcttggtcgttctatgt

SEQ ID NO: 217266 - DNA, 25 bp, Mus musculus
agtgggaagctttcagcctaccgga

SEQ ID NO: 217267 - DNA, 25 bp, Mus musculus
agtgggaatccacggcctaagtctc

SEQ ID NO: 217268 - DNA, 25 bp, Mus musculus
agtgggaatccagggcctaagtctc

SEQ ID NO: 217269 - DNA, 25 bp, Mus musculus
agtgggaatgagacccttcctgcgg

SEQ ID NO: 217270 - DNA, 25 bp, Mus musculus
agtgggaatgagtcccttcctgcgg

SEQ ID NO: 217271 - DNA, 25 bp, Mus musculus
agtgggaatgctacttaaaacaatt

SEQ ID NO: 217272 - DNA, 25 bp, Mus musculus
agtgggaatgcttcttaaaacaatt

SEQ ID NO: 217273 - DNA, 25 bp, Mus musculus
agtgggaatggactcaacctgtgaa

SEQ ID NO: 217274 - DNA, 25 bp, Mus musculus
agtgggaatggagtcaacctgtgaa

SEQ ID NO: 217275 - DNA, 25 bp, Mus musculus
agtgggacagtcagctaacttctgc

SEQ ID NO: 217276 - DNA, 25 bp, Mus musculus
agtgggacagtctgctaacttctgc

SEQ ID NO: 217277 - DNA, 25 bp, Mus musculus
agtgggacatccacatcaacacctg

SEQ ID NO: 217278 - DNA, 25 bp, Mus musculus
agtgggacatcctcatcaacacctg

SEQ ID NO: 217279 - DNA, 25 bp, Mus musculus
agtgggaccatcacggctgctcttg

SEQ ID NO: 217280 - DNA, 25 bp, Mus musculus
agtgggaccatctcggctgctcttg

SEQ ID NO: 217281 - DNA, 25 bp, Mus musculus
agtgggaccctgagagttcacatcc

SEQ ID NO: 217282 - DNA, 25 bp, Mus musculus
agtgggaccctgtgagttcacatcc

SEQ ID NO: 217283 - DNA, 25 bp, Mus musculus
agtgggacctaaatgaagctttcaa

SEQ ID NO: 217284 - DNA, 25 bp, Mus musculus
agtgggacctaattgaagctttcaa

SEQ ID NO: 217285 - DNA, 25 bp, Mus musculus
agtgggacctatcattgggcaatac

SEQ ID NO: 217286 - DNA, 25 bp, Mus musculus
agtgggacctatgattgggcaatac

SEQ ID NO: 217287 - DNA, 25 bp, Mus musculus
agtgggacgcgcaggcttcagcacc

SEQ ID NO: 217288 - DNA, 25 bp, Mus musculus
agtgggacgcgctggcttcagcacc

SEQ ID NO: 217289 - DNA, 25 bp, Mus musculus
agtgggactatgaggcagctcttac

SEQ ID NO: 217290 - DNA, 25 bp, Mus musculus
agtgggactatgtggcagctcttac

SEQ ID NO: 217291 - DNA, 25 bp, Mus musculus
agtgggactcggcacggctaataaa

SEQ ID NO: 217292 - DNA, 25 bp, Mus musculus
agtgggactcgggacggctaataaa

SEQ ID NO: 217293 - DNA, 25 bp, Mus musculus
agtgggacttgtcggcctgattcaa

SEQ ID NO: 217294 - DNA, 25 bp, Mus musculus
agtgggacttgtgggcctgattcaa

SEQ ID NO: 217295 - DNA, 25 bp, Mus musculus
agtgggagagagaccctttttctga

SEQ ID NO: 217296 - DNA, 25 bp, Mus musculus
agtgggagagagtccctttttctga

SEQ ID NO: 217297 - DNA, 25 bp, Mus musculus
agtgggagccaactcaccttagata

SEQ ID NO: 217298 - DNA, 25 bp, Mus musculus
agtgggagccaagtcaccttagata

SEQ ID NO: 217299 - DNA, 25 bp, Mus musculus
agtgggagcctcaatggtgtcccca

SEQ ID NO: 217300 - DNA, 25 bp, Mus musculus
agtgggagcctctatggtgtcccca

SEQ ID NO: 217301 - DNA, 25 bp, Mus musculus
agtgggagcgctatacggagcttcc

SEQ ID NO: 217302 - DNA, 25 bp, Mus musculus
agtgggagcgctttacggagcttcc

SEQ ID NO: 217303 - DNA, 25 bp, Mus musculus
agtgggagctatctcagccatactc

SEQ ID NO: 217304 - DNA, 25 bp, Mus musculus
agtgggagctatgtcagccatactc

SEQ ID NO: 217305 - DNA, 25 bp, Mus musculus
agtgggaggacaaccacgtcgtcac

SEQ ID NO: 217306 - DNA, 25 bp, Mus musculus
agtgggaggacatccacgtcgtcac

SEQ ID NO: 217307 - DNA, 25 bp, Mus musculus
agtgggaggagcagtcactcccacc

SEQ ID NO: 217308 - DNA, 25 bp, Mus musculus
agtgggaggagctgtcactcccacc

SEQ ID NO: 217309 - DNA, 25 bp, Mus musculus
agtgggaggatcatttcaatgttct

SEQ ID NO: 217310 - DNA, 25 bp, Mus musculus
agtgggaggatcttttcaatgttct

SEQ ID NO: 217311 - DNA, 25 bp, Mus musculus
agtgggagtactctggccagcccaa

SEQ ID NO: 217312 - DNA, 25 bp, Mus musculus
agtgggagtactgtggccagcccaa

SEQ ID NO: 217313 - DNA, 25 bp, Mus musculus
agtgggagtcaacccattagctaca

SEQ ID NO: 217314 - DNA, 25 bp, Mus musculus
agtgggagtcaagccattagctaca

SEQ ID NO: 217315 - DNA, 25 bp, Mus musculus
agtgggatacctcatgtttctcttc

SEQ ID NO: 217316 - DNA, 25 bp, Mus musculus
agtgggatacctgatgtttctcttc

SEQ ID NO: 217317 - DNA, 25 bp, Mus musculus
agtgggatagggaagtacctgcata

SEQ ID NO: 217318 - DNA, 25 bp, Mus musculus
agtgggatagggtagtacctgcata

SEQ ID NO: 217319 - DNA, 25 bp, Mus musculus
agtgggatccttctcatgggtccac

SEQ ID NO: 217320 - DNA, 25 bp, Mus musculus
agtgggatccttgtcatgggtccac

SEQ ID NO: 217321 - DNA, 25 bp, Mus musculus
agtgggatgccccacagagcgttat

SEQ ID NO: 217322 - DNA, 25 bp, Mus musculus
agtgggatgcccgacagagcgttat

SEQ ID NO: 217323 - DNA, 25 bp, Mus musculus
agtgggatgctcaagcccctgtaaa

SEQ ID NO: 217324 - DNA, 25 bp, Mus musculus
agtgggatgctctagcccctgtaaa

SEQ ID NO: 217325 - DNA, 25 bp, Mus musculus
agtgggatgcttaccaacctgggcc

SEQ ID NO: 217326 - DNA, 25 bp, Mus musculus
agtgggatgcttcctaccgtgccag

SEQ ID NO: 217327 - DNA, 25 bp, Mus musculus
agtgggatgcttgctaccgtgccag

SEQ ID NO: 217328 - DNA, 25 bp, Mus musculus
agtgggatgctttccaacctgggcc

SEQ ID NO: 217329 - DNA, 25 bp, Mus musculus
agtgggattataccctgagtcagta

SEQ ID NO: 217330 - DNA, 25 bp, Mus musculus
agtgggattatagcctgagtcagta

SEQ ID NO: 217331 - DNA, 25 bp, Mus musculus
agtgggattcatctgacctccagac

SEQ ID NO: 217332 - DNA, 25 bp, Mus musculus
agtgggattcatgtgacctccagac

SEQ ID NO: 217333 - DNA, 25 bp, Mus musculus
agtgggatttctccgtattttcaat

SEQ ID NO: 217334 - DNA, 25 bp, Mus musculus
agtgggatttctgcgtattttcaat

SEQ ID NO: 217335 - DNA, 25 bp, Mus musculus
agtgggatttgtcgactgtctctat

SEQ ID NO: 217336 - DNA, 25 bp, Mus musculus
agtgggatttgtggactgtctctat

SEQ ID NO: 217337 - DNA, 25 bp, Mus musculus
agtgggcaacccagagtatctcaac

SEQ ID NO: 217338 - DNA, 25 bp, Mus musculus
agtgggcaaccctgagtatctcaac

SEQ ID NO: 217339 - DNA, 25 bp, Mus musculus
agtgggcaactcagactgtgcctat

SEQ ID NO: 217340 - DNA, 25 bp, Mus musculus
agtgggcaactctgactgtgcctat

SEQ ID NO: 217341 - DNA, 25 bp, Mus musculus
agtgggcaagcaattatttacctgg

SEQ ID NO: 217342 - DNA, 25 bp, Mus musculus
agtgggcaagcatttatttacctgg

SEQ ID NO: 217343 - DNA, 25 bp, Mus musculus
agtgggcaaggtcttccctcttggt

SEQ ID NO: 217344 - DNA, 25 bp, Mus musculus
agtgggcaaggtgttccctcttggt

SEQ ID NO: 217345 - DNA, 25 bp, Mus musculus
agtgggcaccacaactttgtggtct

SEQ ID NO: 217346 - DNA, 25 bp, Mus musculus
agtgggcaccacctagagctgcagc

SEQ ID NO: 217347 - DNA, 25 bp, Mus musculus
agtgggcaccacgtagagctgcagc

SEQ ID NO: 217348 - DNA, 25 bp, Mus musculus
agtgggcaccactactttgtggtct

SEQ ID NO: 217349 - DNA, 25 bp, Mus musculus
agtgggcactggctctgtctattag

SEQ ID NO: 217350 - DNA, 25 bp, Mus musculus
agtgggcactgggtctgtctattag

SEQ ID NO: 217351 - DNA, 25 bp, Mus musculus
agtgggcacttgacgtacccgacgg

SEQ ID NO: 217352 - DNA, 25 bp, Mus musculus
agtgggcacttgtcgtacccgacgg

SEQ ID NO: 217353 - DNA, 25 bp, Mus musculus
agtgggcagacacctcatcaaagtg

SEQ ID NO: 217354 - DNA, 25 bp, Mus musculus
agtgggcagacagctcatcaaagtg

SEQ ID NO: 217355 - DNA, 25 bp, Mus musculus
agtgggcagctcacttgctgcagtg

SEQ ID NO: 217356 - DNA, 25 bp, Mus musculus
agtgggcagctctcttgctgcagtg

SEQ ID NO: 217357 - DNA, 25 bp, Mus musculus
agtgggcagctgagagatcaccaac

SEQ ID NO: 217358 - DNA, 25 bp, Mus musculus
agtgggcagctgtgagatcaccaac

SEQ ID NO: 217359 - DNA, 25 bp, Mus musculus
agtgggcagcttcctaaactacaca

SEQ ID NO: 217360 - DNA, 25 bp, Mus musculus
agtgggcagcttgctaaactacaca

SEQ ID NO: 217361 - DNA, 25 bp, Mus musculus
agtgggcagtgtaccgattggcaca

SEQ ID NO: 217362 - DNA, 25 bp, Mus musculus
agtgggcagtgttccgattggcaca

SEQ ID NO: 217363 - DNA, 25 bp, Mus musculus
agtgggcatacaccatggaccgtga

SEQ ID NO: 217364 - DNA, 25 bp, Mus musculus
agtgggcatacagcatggaccgtga

SEQ ID NO: 217365 - DNA, 25 bp, Mus musculus
agtgggccaagtagtgtgtctgaca

SEQ ID NO: 217366 - DNA, 25 bp, Mus musculus
agtgggccaagttgtgtgtctgaca

SEQ ID NO: 217367 - DNA, 25 bp, Mus musculus
agtgggccacacactggctttgtgg

SEQ ID NO: 217368 - DNA, 25 bp, Mus musculus
agtgggccacaccagcgaccagagc

SEQ ID NO: 217369 - DNA, 25 bp, Mus musculus
agtgggccacacgagcgaccagagc

SEQ ID NO: 217370 - DNA, 25 bp, Mus musculus
agtgggccacactctggctttgtgg

SEQ ID NO: 217371 - DNA, 25 bp, Mus musculus
agtgggccactgacttgacttggaa

SEQ ID NO: 217372 - DNA, 25 bp, Mus musculus
agtgggccactgtcttgacttggaa

SEQ ID NO: 217373 - DNA, 25 bp, Mus musculus
agtgggccacttataatcaatgtaa

SEQ ID NO: 217374 - DNA, 25 bp, Mus musculus
agtgggccacttttaatcaatgtaa

SEQ ID NO: 217375 - DNA, 25 bp, Mus musculus
agtgggccagaaactattcccatct

SEQ ID NO: 217376 - DNA, 25 bp, Mus musculus
agtgggccagaatctattcccatct

SEQ ID NO: 217377 - DNA, 25 bp, Mus musculus
agtgggccagttatgctctagagag

SEQ ID NO: 217378 - DNA, 25 bp, Mus musculus
agtgggccagttttgctctagagag

SEQ ID NO: 217379 - DNA, 25 bp, Mus musculus
agtgggccatccagagcatgtcacg

SEQ ID NO: 217380 - DNA, 25 bp, Mus musculus
agtgggccatcctgagcatgtcacg

SEQ ID NO: 217381 - DNA, 25 bp, Mus musculus
agtgggcccacaccttgactgggca

SEQ ID NO: 217382 - DNA, 25 bp, Mus musculus
agtgggcccacagcttgactgggca

SEQ ID NO: 217383 - DNA, 25 bp, Mus musculus
agtgggcccctaaggtgacctggca

SEQ ID NO: 217384 - DNA, 25 bp, Mus musculus
agtgggcccctatggtgacctggca

SEQ ID NO: 217385 - DNA, 25 bp, Mus musculus
agtgggcccgtcagaacctgggtct

SEQ ID NO: 217386 - DNA, 25 bp, Mus musculus
agtgggcccgtctgaacctgggtct

SEQ ID NO: 217387 - DNA, 25 bp, Mus musculus
agtgggcctatcatacactgggaga

SEQ ID NO: 217388 - DNA, 25 bp, Mus musculus
agtgggcctatcttacactgggaga

SEQ ID NO: 217389 - DNA, 25 bp, Mus musculus
agtgggcctcatctttgctgtgtgc

SEQ ID NO: 217390 - DNA, 25 bp, Mus musculus
agtgggcctcatgtttgctgtgtgc

SEQ ID NO: 217391 - DNA, 25 bp, Mus musculus
agtgggcctcgtacagactgaccag

SEQ ID NO: 217392 - DNA, 25 bp, Mus musculus
agtgggcctcgttcagactgaccag

SEQ ID NO: 217393 - DNA, 25 bp, Mus musculus
agtgggcctctcagtgttcactgtt

SEQ ID NO: 217394 - DNA, 25 bp, Mus musculus
agtgggcctctcctggaactttgga

SEQ ID NO: 217395 - DNA, 25 bp, Mus musculus
agtgggcctctcgtggaactttgga

SEQ ID NO: 217396 - DNA, 25 bp, Mus musculus
agtgggcctctctgtgttcactgtt

SEQ ID NO: 217397 - DNA, 25 bp, Mus musculus
agtgggcctcttacaaactactgaa

SEQ ID NO: 217398 - DNA, 25 bp, Mus musculus
agtgggcctctttcaaactactgaa

SEQ ID NO: 217399 - DNA, 25 bp, Mus musculus
agtgggcctgaaaaaccagtctcag

SEQ ID NO: 217400 - DNA, 25 bp, Mus musculus
agtgggcctgaataaccagtctcag

SEQ ID NO: 217401 - DNA, 25 bp, Mus musculus
agtgggcctgagatccgacttcata

SEQ ID NO: 217402 - DNA, 25 bp, Mus musculus
agtgggcctgagcaggtttcttacc

SEQ ID NO: 217403 - DNA, 25 bp, Mus musculus
agtgggcctgaggaggtttcttacc

SEQ ID NO: 217404 - DNA, 25 bp, Mus musculus
agtgggcctgagttccgacttcata

SEQ ID NO: 217405 - DNA, 25 bp, Mus musculus
agtgggcctgctatcaacagcgtct

SEQ ID NO: 217406 - DNA, 25 bp, Mus musculus
agtgggcctgctttcaacagcgtct

SEQ ID NO: 217407 - DNA, 25 bp, Mus musculus
agtgggccttccctaggtcaatctt

SEQ ID NO: 217408 - DNA, 25 bp, Mus musculus
agtgggccttccgtaggtcaatctt

SEQ ID NO: 217409 - DNA, 25 bp, Mus musculus
agtgggcctttccaatgacctcaaa

SEQ ID NO: 217410 - DNA, 25 bp, Mus musculus
agtgggcctttcgaatgacctcaaa

SEQ ID NO: 217411 - DNA, 25 bp, Mus musculus
agtgggcgaattcatccgctgtctg

SEQ ID NO: 217412 - DNA, 25 bp, Mus musculus
agtgggcgaattgatccgctgtctg

SEQ ID NO: 217413 - DNA, 25 bp, Mus musculus
agtgggcgagctcgcagaactcttc

SEQ ID NO: 217414 - DNA, 25 bp, Mus musculus
agtgggcgagctggcagaactcttc

SEQ ID NO: 217415 - DNA, 25 bp, Mus musculus
agtgggcgagtgacccagagcccct

SEQ ID NO: 217416 - DNA, 25 bp, Mus musculus
agtgggcgagtgtcccagagcccct

SEQ ID NO: 217417 - DNA, 25 bp, Mus musculus
agtgggcgtcgtaaggctttctcca

SEQ ID NO: 217418 - DNA, 25 bp, Mus musculus
agtgggcgtcgttaggctttctcca

SEQ ID NO: 217419 - DNA, 25 bp, Mus musculus
agtgggctactgaacttggcgtgcc

SEQ ID NO: 217420 - DNA, 25 bp, Mus musculus
agtgggctactgtacttggcgtgcc

SEQ ID NO: 217421 - DNA, 25 bp, Mus musculus
agtgggctagatcctctcatatcaa

SEQ ID NO: 217422 - DNA, 25 bp, Mus musculus
agtgggctagatgctctcatatcaa

SEQ ID NO: 217423 - DNA, 25 bp, Mus musculus
agtgggctatgtcacatcatcttga

SEQ ID NO: 217424 - DNA, 25 bp, Mus musculus
agtgggctatgtgacatcatcttga

SEQ ID NO: 217425 - DNA, 25 bp, Mus musculus
agtgggctcacactagcctgttgac

SEQ ID NO: 217426 - DNA, 25 bp, Mus musculus
agtgggctcacagtagcctgttgac

SEQ ID NO: 217427 - DNA, 25 bp, Mus musculus
agtgggctctgtatgacccctccct

SEQ ID NO: 217428 - DNA, 25 bp, Mus musculus
agtgggctctgtttgacccctccct

SEQ ID NO: 217429 - DNA, 25 bp, Mus musculus
agtgggctctttcgatccttcaggc

SEQ ID NO: 217430 - DNA, 25 bp, Mus musculus
agtgggctctttggatccttcaggc

SEQ ID NO: 217431 - DNA, 25 bp, Mus musculus
agtgggctgctaaggctactgctcg

SEQ ID NO: 217432 - DNA, 25 bp, Mus musculus
agtgggctgctatggctactgctcg

SEQ ID NO: 217433 - DNA, 25 bp, Mus musculus
agtgggcttcagagttaaggctgac

SEQ ID NO: 217434 - DNA, 25 bp, Mus musculus
agtgggcttcagctaaggacctaga

SEQ ID NO: 217435 - DNA, 25 bp, Mus musculus
agtgggcttcaggtaaggacctaga

SEQ ID NO: 217436 - DNA, 25 bp, Mus musculus
agtgggcttcagtgttaaggctgac

SEQ ID NO: 217437 - DNA, 25 bp, Mus musculus
agtgggcttgccagtccttgcatta

SEQ ID NO: 217438 - DNA, 25 bp, Mus musculus
agtgggcttgcctgtccttgcatta

SEQ ID NO: 217439 - DNA, 25 bp, Mus musculus
agtgggctttgaccacaccgcgcat

SEQ ID NO: 217440 - DNA, 25 bp, Mus musculus
agtgggctttgagcacaccgcgcat

SEQ ID NO: 217441 - DNA, 25 bp, Mus musculus
agtgggctttggatcctccctgtta

SEQ ID NO: 217442 - DNA, 25 bp, Mus musculus
agtgggctttggttcctccctgtta

SEQ ID NO: 217443 - DNA, 25 bp, Mus musculus
agtggggataagacaacccttcaag

SEQ ID NO: 217444 - DNA, 25 bp, Mus musculus
agtggggataagtcaacccttcaag

SEQ ID NO: 217445 - DNA, 25 bp, Mus musculus
agtggggcctgaaacagaactgcaa

SEQ ID NO: 217446 - DNA, 25 bp, Mus musculus
agtggggcctgatacagaactgcaa

SEQ ID NO: 217447 - DNA, 25 bp, Mus musculus
agtgggggcgtcctcaaaccatcac

SEQ ID NO: 217448 - DNA, 25 bp, Mus musculus
agtgggggcgtcgtcaaaccatcac

SEQ ID NO: 217449 - DNA, 25 bp, Mus musculus
agtgggtaaaagatgagctcattcc

SEQ ID NO: 217450 - DNA, 25 bp, Mus musculus
agtgggtaaaagttgagctcattcc

SEQ ID NO: 217451 - DNA, 25 bp, Mus musculus
agtgggtaacttccatggttattga

SEQ ID NO: 217452 - DNA, 25 bp, Mus musculus
agtgggtaacttgcatggttattga

SEQ ID NO: 217453 - DNA, 25 bp, Mus musculus
agtgggtacctactgagatcactat

SEQ ID NO: 217454 - DNA, 25 bp, Mus musculus
agtgggtacctagtgagatcactat

SEQ ID NO: 217455 - DNA, 25 bp, Mus musculus
agtgggtagaatcaactgtcaccaa

SEQ ID NO: 217456 - DNA, 25 bp, Mus musculus
agtgggtagaatgaactgtcaccaa

SEQ ID NO: 217457 - DNA, 25 bp, Mus musculus
agtgggtattctagactcctgttca

SEQ ID NO: 217458 - DNA, 25 bp, Mus musculus
agtgggtattcttgactcctgttca

SEQ ID NO: 217459 - DNA, 25 bp, Mus musculus
agtgggtcacataacttgctttaca

SEQ ID NO: 217460 - DNA, 25 bp, Mus musculus
agtgggtcacattacttgctttaca

SEQ ID NO: 217461 - DNA, 25 bp, Mus musculus
agtgggtcactcactagcccttgct

SEQ ID NO: 217462 - DNA, 25 bp, Mus musculus
agtgggtcactctctagcccttgct

SEQ ID NO: 217463 - DNA, 25 bp, Mus musculus
agtgggtccacaactcatgagctta

SEQ ID NO: 217464 - DNA, 25 bp, Mus musculus
agtgggtccacatctcatgagctta

SEQ ID NO: 217465 - DNA, 25 bp, Mus musculus
agtgggtcctggcactcacatagtg

SEQ ID NO: 217466 - DNA, 25 bp, Mus musculus
agtgggtcctgggactcacatagtg

SEQ ID NO: 217467 - DNA, 25 bp, Mus musculus
agtgggtctggcaacaccgtcacaa

SEQ ID NO: 217468 - DNA, 25 bp, Mus musculus
agtgggtctggctacaccgtcacaa

SEQ ID NO: 217469 - DNA, 25 bp, Mus musculus
agtgggtctttccacctgaatggcc

SEQ ID NO: 217470 - DNA, 25 bp, Mus musculus
agtgggtctttcgacctgaatggcc

SEQ ID NO: 217471 - DNA, 25 bp, Mus musculus
agtgggtgaactctatcatgtctga

SEQ ID NO: 217472 - DNA, 25 bp, Mus musculus
agtgggtgaactgtatcatgtctga

SEQ ID NO: 217473 - DNA, 25 bp, Mus musculus
agtgggtgacagatctttgttgttc

SEQ ID NO: 217474 - DNA, 25 bp, Mus musculus
agtgggtgacagttctttgttgttc

SEQ ID NO: 217475 - DNA, 25 bp, Mus musculus
agtgggtgatagctgaagcttttac

SEQ ID NO: 217476 - DNA, 25 bp, Mus musculus
agtgggtgataggtgaagcttttac

SEQ ID NO: 217477 - DNA, 25 bp, Mus musculus
agtgggtgcaatctgggccacattc

SEQ ID NO: 217478 - DNA, 25 bp, Mus musculus
agtgggtgcaatgtgggccacattc

SEQ ID NO: 217479 - DNA, 25 bp, Mus musculus
agtgggtggaatagcctatcagatt

SEQ ID NO: 217480 - DNA, 25 bp, Mus musculus
agtgggtggaattgcctatcagatt

SEQ ID NO: 217481 - DNA, 25 bp, Mus musculus
agtgggtggactacttattgccatc

SEQ ID NO: 217482 - DNA, 25 bp, Mus musculus
agtgggtggacttcttattgccatc

SEQ ID NO: 217483 - DNA, 25 bp, Mus musculus
agtgggtgggataccctgtatctct

SEQ ID NO: 217484 - DNA, 25 bp, Mus musculus
agtgggtgggattccctgtatctct

SEQ ID NO: 217485 - DNA, 25 bp, Mus musculus
agtgggtgttagacgccctggaact

SEQ ID NO: 217486 - DNA, 25 bp, Mus musculus
agtgggtgttagtcgccctggaact

SEQ ID NO: 217487 - DNA, 25 bp, Mus musculus
agtgggtgttcacattttccctcac

SEQ ID NO: 217488 - DNA, 25 bp, Mus musculus
agtgggtgttcagattttccctcac

SEQ ID NO: 217489 - DNA, 25 bp, Mus musculus
agtgggttacaaatgttgacacacc

SEQ ID NO: 217490 - DNA, 25 bp, Mus musculus
agtgggttacaattgttgacacacc

SEQ ID NO: 217491 - DNA, 25 bp, Mus musculus
agtgggttatacactgggtgagctt

SEQ ID NO: 217492 - DNA, 25 bp, Mus musculus
agtgggttatactctgggtgagctt

SEQ ID NO: 217493 - DNA, 25 bp, Mus musculus
agtgggttatttcttgagccacctc

SEQ ID NO: 217494 - DNA, 25 bp, Mus musculus
agtgggttatttgttgagccacctc

SEQ ID NO: 217495 - DNA, 25 bp, Mus musculus
agtgggttccacagaccaatagcca

SEQ ID NO: 217496 - DNA, 25 bp, Mus musculus
agtgggttccacatggactacggat

SEQ ID NO: 217497 - DNA, 25 bp, Mus musculus
agtgggttccactgaccaatagcca

SEQ ID NO: 217498 - DNA, 25 bp, Mus musculus
agtgggttccacttggactacggat

SEQ ID NO: 217499 - DNA, 25 bp, Mus musculus
agtgggttccagatcctggtgccac

SEQ ID NO: 217500 - DNA, 25 bp, Mus musculus
agtgggttccagctgtccttcaatc

SEQ ID NO: 217501 - DNA, 25 bp, Mus musculus
agtgggttccaggtgtccttcaatc

SEQ ID NO: 217502 - DNA, 25 bp, Mus musculus
agtgggttccagttcctggtgccac

SEQ ID NO: 217503 - DNA, 25 bp, Mus musculus
agtgggttcctcatgtaaattgcta

SEQ ID NO: 217504 - DNA, 25 bp, Mus musculus
agtgggttcctcttgtaaattgcta

SEQ ID NO: 217505 - DNA, 25 bp, Mus musculus
agtgggttctcaacacccgcatcct

SEQ ID NO: 217506 - DNA, 25 bp, Mus musculus
agtgggttctcatcacccgcatcct

SEQ ID NO: 217507 - DNA, 25 bp, Mus musculus
agtgggttctctacatgaatgtgaa

SEQ ID NO: 217508 - DNA, 25 bp, Mus musculus
agtgggttctcttcatgaatgtgaa

SEQ ID NO: 217509 - DNA, 25 bp, Mus musculus
agtgggttgtgcagttaatttggat

SEQ ID NO: 217510 - DNA, 25 bp, Mus musculus
agtgggttgtgctgttaatttggat

SEQ ID NO: 217511 - DNA, 25 bp, Mus musculus
agtgggtttacccttctgaacagat

SEQ ID NO: 217512 - DNA, 25 bp, Mus musculus
agtgggtttaccgttctgaacagat

SEQ ID NO: 217513 - DNA, 25 bp, Mus musculus
agtgggtttctcatagtgtccatgt

SEQ ID NO: 217514 - DNA, 25 bp, Mus musculus
agtgggtttctcttagtgtccatgt

SEQ ID NO: 217515 - DNA, 25 bp, Mus musculus
agtggtaacacacgtctttaatctc

SEQ ID NO: 217516 - DNA, 25 bp, Mus musculus
agtggtaacacaggtctttaatctc

SEQ ID NO: 217517 - DNA, 25 bp, Mus musculus
agtggtaacacgacattcttagaaa

SEQ ID NO: 217518 - DNA, 25 bp, Mus musculus
agtggtaacacgtcattcttagaaa

SEQ ID NO: 217519 - DNA, 25 bp, Mus musculus
agtggtaacatcagatgccctggaa

SEQ ID NO: 217520 - DNA, 25 bp, Mus musculus
agtggtaacatctgatgccctggaa

SEQ ID NO: 217521 - DNA, 25 bp, Mus musculus
agtggtaactaactctgcagccctc

SEQ ID NO: 217522 - DNA, 25 bp, Mus musculus
agtggtaactaagtctgcagccctc

SEQ ID NO: 217523 - DNA, 25 bp, Mus musculus
agtggtaactagaccagcaagcccc

SEQ ID NO: 217524 - DNA, 25 bp, Mus musculus
agtggtaactagtccagcaagcccc

SEQ ID NO: 217525 - DNA, 25 bp, Mus musculus
agtggtaagtcaagctcagttttgt

SEQ ID NO: 217526 - DNA, 25 bp, Mus musculus
agtggtaagtcatgctcagttttgt

SEQ ID NO: 217527 - DNA, 25 bp, Mus musculus
agtggtacaaccaggctcgatggag

SEQ ID NO: 217528 - DNA, 25 bp, Mus musculus
agtggtacaacctggctcgatggag

SEQ ID NO: 217529 - DNA, 25 bp, Mus musculus
agtggtacaattacattcagccccg

SEQ ID NO: 217530 - DNA, 25 bp, Mus musculus
agtggtacaatttcattcagccccg

SEQ ID NO: 217531 - DNA, 25 bp, Mus musculus
agtggtaccagtcaactccctgaag

SEQ ID NO: 217532 - DNA, 25 bp, Mus musculus
agtggtaccagtgaactccctgaag

SEQ ID NO: 217533 - DNA, 25 bp, Mus musculus
agtggtacccggcaattcaggatga

SEQ ID NO: 217534 - DNA, 25 bp, Mus musculus
agtggtacccgggaattcaggatga

SEQ ID NO: 217535 - DNA, 25 bp, Mus musculus
agtggtaccgtgaggccctgaagac

SEQ ID NO: 217536 - DNA, 25 bp, Mus musculus
agtggtaccgtgtggccctgaagac

SEQ ID NO: 217537 - DNA, 25 bp, Mus musculus
agtggtacctgcaggatccctaccc

SEQ ID NO: 217538 - DNA, 25 bp, Mus musculus
agtggtacctgcattgctgctgccg

SEQ ID NO: 217539 - DNA, 25 bp, Mus musculus
agtggtacctgctggatccctaccc

SEQ ID NO: 217540 - DNA, 25 bp, Mus musculus
agtggtacctgctttgctgctgccg

SEQ ID NO: 217541 - DNA, 25 bp, Mus musculus
agtggtacgcgccagagtgcatcaa

SEQ ID NO: 217542 - DNA, 25 bp, Mus musculus
agtggtacgcgcgagagtgcatcaa

SEQ ID NO: 217543 - DNA, 25 bp, Mus musculus
agtggtactgacatacccaatcctc

SEQ ID NO: 217544 - DNA, 25 bp, Mus musculus
agtggtactgacttacccaatcctc

SEQ ID NO: 217545 - DNA, 25 bp, Mus musculus
agtggtacttcactccagatgcctg

SEQ ID NO: 217546 - DNA, 25 bp, Mus musculus
agtggtacttcagtccagatgcctg

SEQ ID NO: 217547 - DNA, 25 bp, Mus musculus
agtggtactttgaggatggcatcct

SEQ ID NO: 217548 - DNA, 25 bp, Mus musculus
agtggtactttgtggatggcatcct

SEQ ID NO: 217549 - DNA, 25 bp, Mus musculus
agtggtagaagaagcctctccctgt

SEQ ID NO: 217550 - DNA, 25 bp, Mus musculus
agtggtagaagatgcctctccctgt

SEQ ID NO: 217551 - DNA, 25 bp, Mus musculus
agtggtagagcgcttgcctagcaag

SEQ ID NO: 217552 - DNA, 25 bp, Mus musculus
agtggtagagcggttgcctagcaag

SEQ ID NO: 217553 - DNA, 25 bp, Mus musculus
agtggtagcaccagcctagcgtgtg

SEQ ID NO: 217554 - DNA, 25 bp, Mus musculus
agtggtagcacctgcctagcgtgtg

SEQ ID NO: 217555 - DNA, 25 bp, Mus musculus
agtggtagccaccttgctcatgata

SEQ ID NO: 217556 - DNA, 25 bp, Mus musculus
agtggtagccacgttgctcatgata

SEQ ID NO: 217557 - DNA, 25 bp, Mus musculus
agtggtagccccacgagagcctgta

SEQ ID NO: 217558 - DNA, 25 bp, Mus musculus
agtggtagcccctcgagagcctgta

SEQ ID NO: 217559 - DNA, 25 bp, Mus musculus
agtggtagctaccatctgggctaag

SEQ ID NO: 217560 - DNA, 25 bp, Mus musculus
agtggtagctacgatctgggctaag

SEQ ID NO: 217561 - DNA, 25 bp, Mus musculus
agtggtagcttgctctgtgactccc

SEQ ID NO: 217562 - DNA, 25 bp, Mus musculus
agtggtagcttggtctgtgactccc

SEQ ID NO: 217563 - DNA, 25 bp, Mus musculus
agtggtaggtgaatgcctcgtgcct

SEQ ID NO: 217564 - DNA, 25 bp, Mus musculus
agtggtaggtgattgcctcgtgcct

SEQ ID NO: 217565 - DNA, 25 bp, Mus musculus
agtggtatcagtcgcccagcgtaga

SEQ ID NO: 217566 - DNA, 25 bp, Mus musculus
agtggtatcagtggcccagcgtaga

SEQ ID NO: 217567 - DNA, 25 bp, Mus musculus
agtggtatccacatagtggccatca

SEQ ID NO: 217568 - DNA, 25 bp, Mus musculus
agtggtatccacttagtggccatca

SEQ ID NO: 217569 - DNA, 25 bp, Mus musculus
agtggtatctgaacttatttttaag

SEQ ID NO: 217570 - DNA, 25 bp, Mus musculus
agtggtatctgatcttatttttaag

SEQ ID NO: 217571 - DNA, 25 bp, Mus musculus
agtggtatctgtacgtctgttagtt

SEQ ID NO: 217572 - DNA, 25 bp, Mus musculus
agtggtatctgttcgtctgttagtt

SEQ ID NO: 217573 - DNA, 25 bp, Mus musculus
agtggtattagcctttataagcctg

SEQ ID NO: 217574 - DNA, 25 bp, Mus musculus
agtggtattagcgtttataagcctg

SEQ ID NO: 217575 - DNA, 25 bp, Mus musculus
agtggtattcatcctttcaagaggg

SEQ ID NO: 217576 - DNA, 25 bp, Mus musculus
agtggtattcatgctttcaagaggg

SEQ ID NO: 217577 - DNA, 25 bp, Mus musculus
agtggtcaacctaggcattggcaga

SEQ ID NO: 217578 - DNA, 25 bp, Mus musculus
agtggtcaaccttggcattggcaga

SEQ ID NO: 217579 - DNA, 25 bp, Mus musculus
agtggtcaagatccacagtcatgtg

SEQ ID NO: 217580 - DNA, 25 bp, Mus musculus
agtggtcaagatgcacagtcatgtg

SEQ ID NO: 217581 - DNA, 25 bp, Mus musculus
agtggtcaaggacggttgctcaatc

SEQ ID NO: 217582 - DNA, 25 bp, Mus musculus
agtggtcaaggagggttgctcaatc

SEQ ID NO: 217583 - DNA, 25 bp, Mus musculus
agtggtcacaacagtaggatgctaa

SEQ ID NO: 217584 - DNA, 25 bp, Mus musculus
agtggtcacaactgtaggatgctaa

SEQ ID NO: 217585 - DNA, 25 bp, Mus musculus
agtggtcaccagctgttttgatgct

SEQ ID NO: 217586 - DNA, 25 bp, Mus musculus
agtggtcaccaggtgttttgatgct

SEQ ID NO: 217587 - DNA, 25 bp, Mus musculus
agtggtcaccgtaatctattcctgg

SEQ ID NO: 217588 - DNA, 25 bp, Mus musculus
agtggtcaccgttatctattcctgg

SEQ ID NO: 217589 - DNA, 25 bp, Mus musculus
agtggtcacgagcttactacccatc

SEQ ID NO: 217590 - DNA, 25 bp, Mus musculus
agtggtcacgaggttactacccatc

SEQ ID NO: 217591 - DNA, 25 bp, Mus musculus
agtggtcagcacaatgacttcccga

SEQ ID NO: 217592 - DNA, 25 bp, Mus musculus
agtggtcagcactatgacttcccga

SEQ ID NO: 217593 - DNA, 25 bp, Mus musculus
agtggtcattacagtcacactgccg

SEQ ID NO: 217594 - DNA, 25 bp, Mus musculus
agtggtcattactgtcacactgccg

SEQ ID NO: 217595 - DNA, 25 bp, Mus musculus
agtggtcattgtatcttatttcctg

SEQ ID NO: 217596 - DNA, 25 bp, Mus musculus
agtggtcattgtttcttatttcctg

SEQ ID NO: 217597 - DNA, 25 bp, Mus musculus
agtggtccaccaacaacttcaacat

SEQ ID NO: 217598 - DNA, 25 bp, Mus musculus
agtggtccaccatcaacttcaacat

SEQ ID NO: 217599 - DNA, 25 bp, Mus musculus
agtggtccacttagagattaggctc

SEQ ID NO: 217600 - DNA, 25 bp, Mus musculus
agtggtccactttgagattaggctc

SEQ ID NO: 217601 - DNA, 25 bp, Mus musculus
agtggtccagctatactgcctcaag

SEQ ID NO: 217602 - DNA, 25 bp, Mus musculus
agtggtccagctttactgcctcaag

SEQ ID NO: 217603 - DNA, 25 bp, Mus musculus
agtggtccagtgagctccatcacgg

SEQ ID NO: 217604 - DNA, 25 bp, Mus musculus
agtggtccagtgtgctccatcacgg

SEQ ID NO: 217605 - DNA, 25 bp, Mus musculus
agtggtccatagcactgacacctta

SEQ ID NO: 217606 - DNA, 25 bp, Mus musculus
agtggtccataggactgacacctta

SEQ ID NO: 217607 - DNA, 25 bp, Mus musculus
agtggtcccaatcgtcaagccttat

SEQ ID NO: 217608 - DNA, 25 bp, Mus musculus
agtggtcccaatggtcaagccttat

SEQ ID NO: 217609 - DNA, 25 bp, Mus musculus
agtggtcccactccagaccttagat

SEQ ID NO: 217610 - DNA, 25 bp, Mus musculus
agtggtcccactgcagaccttagat

SEQ ID NO: 217611 - DNA, 25 bp, Mus musculus
agtggtcccatcacttcactggaga

SEQ ID NO: 217612 - DNA, 25 bp, Mus musculus
agtggtcccatctcttcactggaga

SEQ ID NO: 217613 - DNA, 25 bp, Mus musculus
agtggtcccggtcccacagagaaga

SEQ ID NO: 217614 - DNA, 25 bp, Mus musculus
agtggtcccggtgccacagagaaga

SEQ ID NO: 217615 - DNA, 25 bp, Mus musculus
agtggtcccgtgcttgaaggttatc

SEQ ID NO: 217616 - DNA, 25 bp, Mus musculus
agtggtcccgtggttgaaggttatc

SEQ ID NO: 217617 - DNA, 25 bp, Mus musculus
agtggtccgcggaaacagacgaagt

SEQ ID NO: 217618 - DNA, 25 bp, Mus musculus
agtggtccgcggtaacagacgaagt

SEQ ID NO: 217619 - DNA, 25 bp, Mus musculus
agtggtcctaatcaacctgtggtca

SEQ ID NO: 217620 - DNA, 25 bp, Mus musculus
agtggtcctaatgaacctgtggtca

SEQ ID NO: 217621 - DNA, 25 bp, Mus musculus
agtggtcctagtatcagggatgaca

SEQ ID NO: 217622 - DNA, 25 bp, Mus musculus
agtggtcctagtttcagggatgaca

SEQ ID NO: 217623 - DNA, 25 bp, Mus musculus
agtggtcctctgctaatccttcagt

SEQ ID NO: 217624 - DNA, 25 bp, Mus musculus
agtggtcctctggtaatccttcagt

SEQ ID NO: 217625 - DNA, 25 bp, Mus musculus
agtggtcctgacatgcagaaggcct

SEQ ID NO: 217626 - DNA, 25 bp, Mus musculus
agtggtcctgacttgcagaaggcct

SEQ ID NO: 217627 - DNA, 25 bp, Mus musculus
agtggtcctgctaaactatgttttc

SEQ ID NO: 217628 - DNA, 25 bp, Mus musculus
agtggtcctgcttaactatgttttc

SEQ ID NO: 217629 - DNA, 25 bp, Mus musculus
agtggtcctggactatccgagaaag

SEQ ID NO: 217630 - DNA, 25 bp, Mus musculus
agtggtcctggagtatccgagaaag

SEQ ID NO: 217631 - DNA, 25 bp, Mus musculus
agtggtccttcacaattcaccaaga

SEQ ID NO: 217632 - DNA, 25 bp, Mus musculus
agtggtccttcagaattcaccaaga

SEQ ID NO: 217633 - DNA, 25 bp, Mus musculus
agtggtccttgacgccatgtgtaat

SEQ ID NO: 217634 - DNA, 25 bp, Mus musculus
agtggtccttgaggccatgtgtaat

SEQ ID NO: 217635 - DNA, 25 bp, Mus musculus
agtggtcggactatcactctgcagc

SEQ ID NO: 217636 - DNA, 25 bp, Mus musculus
agtggtcggactttcactctgcagc

SEQ ID NO: 217637 - DNA, 25 bp, Mus musculus
agtggtcgtccgatctggatggaaa

SEQ ID NO: 217638 - DNA, 25 bp, Mus musculus
agtggtcgtccgttctggatggaaa

SEQ ID NO: 217639 - DNA, 25 bp, Mus musculus
agtggtctaaccagtgctccacatg

SEQ ID NO: 217640 - DNA, 25 bp, Mus musculus
agtggtctaacctgtgctccacatg

SEQ ID NO: 217641 - DNA, 25 bp, Mus musculus
agtggtctaaggacctagagactac

SEQ ID NO: 217642 - DNA, 25 bp, Mus musculus
agtggtctaaggtcctagagactac

SEQ ID NO: 217643 - DNA, 25 bp, Mus musculus
agtggtctacagacattctggcttc

SEQ ID NO: 217644 - DNA, 25 bp, Mus musculus
agtggtctacagtcattctggcttc

SEQ ID NO: 217645 - DNA, 25 bp, Mus musculus
agtggtctaccaacccaaatagcaa

SEQ ID NO: 217646 - DNA, 25 bp, Mus musculus
agtggtctaccatcccaaatagcaa

SEQ ID NO: 217647 - DNA, 25 bp, Mus musculus
agtggtctacctacagcctatttag

SEQ ID NO: 217648 - DNA, 25 bp, Mus musculus
agtggtctaccttcagcctatttag

SEQ ID NO: 217649 - DNA, 25 bp, Mus musculus
agtggtctagtgcatgctctgtctt

SEQ ID NO: 217650 - DNA, 25 bp, Mus musculus
agtggtctagtggatgctctgtctt

SEQ ID NO: 217651 - DNA, 25 bp, Mus musculus
agtggtctatctaacatctgattac

SEQ ID NO: 217652 - DNA, 25 bp, Mus musculus
agtggtctatcttacatctgattac

SEQ ID NO: 217653 - DNA, 25 bp, Mus musculus
agtggtctcactctggaagctcaca

SEQ ID NO: 217654 - DNA, 25 bp, Mus musculus
agtggtctcactgtggaagctcaca

SEQ ID NO: 217655 - DNA, 25 bp, Mus musculus
agtggtctccatacaccaataaaat

SEQ ID NO: 217656 - DNA, 25 bp, Mus musculus
agtggtctccattcaccaataaaat

SEQ ID NO: 217657 - DNA, 25 bp, Mus musculus
agtggtctccctaaattctggagga

SEQ ID NO: 217658 - DNA, 25 bp, Mus musculus
agtggtctcccttaattctggagga

SEQ ID NO: 217659 - DNA, 25 bp, Mus musculus
agtggtctccttacatgtttccaaa

SEQ ID NO: 217660 - DNA, 25 bp, Mus musculus
agtggtctcctttcatgtttccaaa

SEQ ID NO: 217661 - DNA, 25 bp, Mus musculus
agtggtctgcacaatatgatgtcag

SEQ ID NO: 217662 - DNA, 25 bp, Mus musculus
agtggtctgcactatatgatgtcag

SEQ ID NO: 217663 - DNA, 25 bp, Mus musculus
agtggtctgggcacctgatgtagtt

SEQ ID NO: 217664 - DNA, 25 bp, Mus musculus
agtggtctgggctcctgatgtagtt

SEQ ID NO: 217665 - DNA, 25 bp, Mus musculus
agtggtctggtcctgtttctgcaga

SEQ ID NO: 217666 - DNA, 25 bp, Mus musculus
agtggtctggtcgtgtttctgcaga

SEQ ID NO: 217667 - DNA, 25 bp, Mus musculus
agtggtctgtagctgttccctgtgt

SEQ ID NO: 217668 - DNA, 25 bp, Mus musculus
agtggtctgtaggtgttccctgtgt

SEQ ID NO: 217669 - DNA, 25 bp, Mus musculus
agtggtcttaaaatccttgcttgtg

SEQ ID NO: 217670 - DNA, 25 bp, Mus musculus
agtggtcttaaacagtaatcgcttg

SEQ ID NO: 217671 - DNA, 25 bp, Mus musculus
agtggtcttaaagagtaatcgcttg

SEQ ID NO: 217672 - DNA, 25 bp, Mus musculus
agtggtcttaaattccttgcttgtg

SEQ ID NO: 217673 - DNA, 25 bp, Mus musculus
agtggtcttagaacagtcctgcctg

SEQ ID NO: 217674 - DNA, 25 bp, Mus musculus
agtggtcttagatcagtcctgcctg

SEQ ID NO: 217675 - DNA, 25 bp, Mus musculus
agtggtcttcagatccctgcaggtc

SEQ ID NO: 217676 - DNA, 25 bp, Mus musculus
agtggtcttcagttccctgcaggtc

SEQ ID NO: 217677 - DNA, 25 bp, Mus musculus
agtggtcttcggcaagcttgaccca

SEQ ID NO: 217678 - DNA, 25 bp, Mus musculus
agtggtcttcgggaagcttgaccca

SEQ ID NO: 217679 - DNA, 25 bp, Mus musculus
agtggtcttctcacgtgaagcactt

SEQ ID NO: 217680 - DNA, 25 bp, Mus musculus
agtggtcttctctcgtgaagcactt

SEQ ID NO: 217681 - DNA, 25 bp, Mus musculus
agtggtcttctgaaaagttgcttaa

SEQ ID NO: 217682 - DNA, 25 bp, Mus musculus
agtggtcttctgtaaagttgcttaa

SEQ ID NO: 217683 - DNA, 25 bp, Mus musculus
agtggtcttcttcgatgtcagcatt

SEQ ID NO: 217684 - DNA, 25 bp, Mus musculus
agtggtcttcttggatgtcagcatt

SEQ ID NO: 217685 - DNA, 25 bp, Mus musculus
agtggtcttgctcaggaacatggtt

SEQ ID NO: 217686 - DNA, 25 bp, Mus musculus
agtggtcttgctgaggaacatggtt

SEQ ID NO: 217687 - DNA, 25 bp, Mus musculus
agtggtcttgttatttagcagctta

SEQ ID NO: 217688 - DNA, 25 bp, Mus musculus
agtggtcttgttttttagcagctta

SEQ ID NO: 217689 - DNA, 25 bp, Mus musculus
agtggtctttctagccagttattcc

SEQ ID NO: 217690 - DNA, 25 bp, Mus musculus
agtggtctttcttgccagttattcc

SEQ ID NO: 217691 - DNA, 25 bp, Mus musculus
agtggtgaaccgaagaaaatgaagc

SEQ ID NO: 217692 - DNA, 25 bp, Mus musculus
agtggtgaaccgtagaaaatgaagc

SEQ ID NO: 217693 - DNA, 25 bp, Mus musculus
agtggtgaactgagtgcgagcatca

SEQ ID NO: 217694 - DNA, 25 bp, Mus musculus
agtggtgaactgtgtgcgagcatca

SEQ ID NO: 217695 - DNA, 25 bp, Mus musculus
agtggtgaaggcacatggtatttat

SEQ ID NO: 217696 - DNA, 25 bp, Mus musculus
agtggtgaaggctcatggtatttat

SEQ ID NO: 217697 - DNA, 25 bp, Mus musculus
agtggtgaatcacatcagttacccc

SEQ ID NO: 217698 - DNA, 25 bp, Mus musculus
agtggtgaatcagatcagttacccc

SEQ ID NO: 217699 - DNA, 25 bp, Mus musculus
agtggtgacaccagcccctaggagc

SEQ ID NO: 217700 - DNA, 25 bp, Mus musculus
agtggtgacacctgcccctaggagc

SEQ ID NO: 217701 - DNA, 25 bp, Mus musculus
agtggtgacatcaggcctcgctctg

SEQ ID NO: 217702 - DNA, 25 bp, Mus musculus
agtggtgacatctggcctcgctctg

SEQ ID NO: 217703 - DNA, 25 bp, Mus musculus
agtggtgacattcaggccagcctct

SEQ ID NO: 217704 - DNA, 25 bp, Mus musculus
agtggtgacattgaggccagcctct

SEQ ID NO: 217705 - DNA, 25 bp, Mus musculus
agtggtgaccacactactctattta

SEQ ID NO: 217706 - DNA, 25 bp, Mus musculus
agtggtgaccactctactctattta

SEQ ID NO: 217707 - DNA, 25 bp, Mus musculus
agtggtgacccgacttcaaagtcca

SEQ ID NO: 217708 - DNA, 25 bp, Mus musculus
agtggtgacccgtcttcaaagtcca

SEQ ID NO: 217709 - DNA, 25 bp, Mus musculus
agtggtgactaacatgtgccgccgt

SEQ ID NO: 217710 - DNA, 25 bp, Mus musculus
agtggtgactaagatgtgccgccgt

SEQ ID NO: 217711 - DNA, 25 bp, Mus musculus
agtggtgactgactatctggaccca

SEQ ID NO: 217712 - DNA, 25 bp, Mus musculus
agtggtgactgagtatctggaccca

SEQ ID NO: 217713 - DNA, 25 bp, Mus musculus
agtggtgagaggatccagtgacatt

SEQ ID NO: 217714 - DNA, 25 bp, Mus musculus
agtggtgagaggttccagtgacatt

SEQ ID NO: 217715 - DNA, 25 bp, Mus musculus
agtggtgagggacttctgccacctt

SEQ ID NO: 217716 - DNA, 25 bp, Mus musculus
agtggtgagggagttctgccacctt

SEQ ID NO: 217717 - DNA, 25 bp, Mus musculus
agtggtgatcacagcgtcctgaaca

SEQ ID NO: 217718 - DNA, 25 bp, Mus musculus
agtggtgatcactgcgtcctgaaca

SEQ ID NO: 217719 - DNA, 25 bp, Mus musculus
agtggtgatggcacaccccaacagg

SEQ ID NO: 217720 - DNA, 25 bp, Mus musculus
agtggtgatggctcaccccaacagg

SEQ ID NO: 217721 - DNA, 25 bp, Mus musculus
agtggtgatggtattctgcgcttcc

SEQ ID NO: 217722 - DNA, 25 bp, Mus musculus
agtggtgatggttttctgcgcttcc

SEQ ID NO: 217723 - DNA, 25 bp, Mus musculus
agtggtgcaactcagtaacttaatt

SEQ ID NO: 217724 - DNA, 25 bp, Mus musculus
agtggtgcaactgagtaacttaatt

SEQ ID NO: 217725 - DNA, 25 bp, Mus musculus
agtggtgcaatgactgtctggtaga

SEQ ID NO: 217726 - DNA, 25 bp, Mus musculus
agtggtgcaatgtctgtctggtaga

SEQ ID NO: 217727 - DNA, 25 bp, Mus musculus
agtggtgcagttacctaacaagtgg

SEQ ID NO: 217728 - DNA, 25 bp, Mus musculus
agtggtgcagtttcctaacaagtgg

SEQ ID NO: 217729 - DNA, 25 bp, Mus musculus
agtggtgcatgacccaagcctagtg

SEQ ID NO: 217730 - DNA, 25 bp, Mus musculus
agtggtgcatgagccaagcctagtg

SEQ ID NO: 217731 - DNA, 25 bp, Mus musculus
agtggtgccagtcttaagtggccta

SEQ ID NO: 217732 - DNA, 25 bp, Mus musculus
agtggtgccagtgttaagtggccta

SEQ ID NO: 217733 - DNA, 25 bp, Mus musculus
agtggtgccttcatattcctaacaa

SEQ ID NO: 217734 - DNA, 25 bp, Mus musculus
agtggtgccttcttattcctaacaa

SEQ ID NO: 217735 - DNA, 25 bp, Mus musculus
agtggtgctaggagggctcttccca

SEQ ID NO: 217736 - DNA, 25 bp, Mus musculus
agtggtgctaggtgggctcttccca

SEQ ID NO: 217737 - DNA, 25 bp, Mus musculus
agtggtgctagtacctggagagcct

SEQ ID NO: 217738 - DNA, 25 bp, Mus musculus
agtggtgctagttcctggagagcct

SEQ ID NO: 217739 - DNA, 25 bp, Mus musculus
agtggtgctcttcgccgcaagccag

SEQ ID NO: 217740 - DNA, 25 bp, Mus musculus
agtggtgctcttggccgcaagccag

SEQ ID NO: 217741 - DNA, 25 bp, Mus musculus
agtggtgctggaaataaactactct

SEQ ID NO: 217742 - DNA, 25 bp, Mus musculus
agtggtgctggatataaactactct

SEQ ID NO: 217743 - DNA, 25 bp, Mus musculus
agtggtgctgtaaggaagcaaattt

SEQ ID NO: 217744 - DNA, 25 bp, Mus musculus
agtggtgctgtatggaagcaaattt

SEQ ID NO: 217745 - DNA, 25 bp, Mus musculus
agtggtgcttcacttaaggtccatc

SEQ ID NO: 217746 - DNA, 25 bp, Mus musculus
agtggtgcttcagttaaggtccatc

SEQ ID NO: 217747 - DNA, 25 bp, Mus musculus
agtggtggacaaacttccagctgat

SEQ ID NO: 217748 - DNA, 25 bp, Mus musculus
agtggtggacaatcttccagctgat

SEQ ID NO: 217749 - DNA, 25 bp, Mus musculus
agtggtggacacatcatgggcatcc

SEQ ID NO: 217750 - DNA, 25 bp, Mus musculus
agtggtggacacttcatgggcatcc

SEQ ID NO: 217751 - DNA, 25 bp, Mus musculus
agtggtggaccacatattcctcagg

SEQ ID NO: 217752 - DNA, 25 bp, Mus musculus
agtggtggaccagatattcctcagg

SEQ ID NO: 217753 - DNA, 25 bp, Mus musculus
agtggtggagcccttgttctagatc

SEQ ID NO: 217754 - DNA, 25 bp, Mus musculus
agtggtggagccgttgttctagatc

SEQ ID NO: 217755 - DNA, 25 bp, Mus musculus
agtggtggcagccagtctgaccttg

SEQ ID NO: 217756 - DNA, 25 bp, Mus musculus
agtggtggcagcgagtctgaccttg

SEQ ID NO: 217757 - DNA, 25 bp, Mus musculus
agtggtggcatcactaacacgtcat

SEQ ID NO: 217758 - DNA, 25 bp, Mus musculus
agtggtggcatctctaacacgtcat

SEQ ID NO: 217759 - DNA, 25 bp, Mus musculus
agtggtgggaagatttctccctgcc

SEQ ID NO: 217760 - DNA, 25 bp, Mus musculus
agtggtgggaagttttctccctgcc

SEQ ID NO: 217761 - DNA, 25 bp, Mus musculus
agtggtgggagacgtgccaggcctt

SEQ ID NO: 217762 - DNA, 25 bp, Mus musculus
agtggtgggagaggtgccaggcctt

SEQ ID NO: 217763 - DNA, 25 bp, Mus musculus
agtggtgggcaaatacctgtgagct

SEQ ID NO: 217764 - DNA, 25 bp, Mus musculus
agtggtgggcaattacctgtgagct

SEQ ID NO: 217765 - DNA, 25 bp, Mus musculus
agtggtgggcctacaggatctttta

SEQ ID NO: 217766 - DNA, 25 bp, Mus musculus
agtggtgggccttcaggatctttta

SEQ ID NO: 217767 - DNA, 25 bp, Mus musculus
agtggtggtaacacacatggaacaa

SEQ ID NO: 217768 - DNA, 25 bp, Mus musculus
agtggtggtaactcacatggaacaa

SEQ ID NO: 217769 - DNA, 25 bp, Mus musculus
agtggtggtataacagctgcccact

SEQ ID NO: 217770 - DNA, 25 bp, Mus musculus
agtggtggtatatcagctgcccact

SEQ ID NO: 217771 - DNA, 25 bp, Mus musculus
agtggtggtatcaggacaactgacc

SEQ ID NO: 217772 - DNA, 25 bp, Mus musculus
agtggtggtatctggacaactgacc

SEQ ID NO: 217773 - DNA, 25 bp, Mus musculus
agtggtggtcccagtgttcataagg

SEQ ID NO: 217774 - DNA, 25 bp, Mus musculus
agtggtggtccctgtgttcataagg

SEQ ID NO: 217775 - DNA, 25 bp, Mus musculus
agtggtggtggcattatattgcaga

SEQ ID NO: 217776 - DNA, 25 bp, Mus musculus
agtggtggtggctttatattgcaga

SEQ ID NO: 217777 - DNA, 25 bp, Mus musculus
agtggtggttctctcacctggtgca

SEQ ID NO: 217778 - DNA, 25 bp, Mus musculus
agtggtggttctgtcacctggtgca

SEQ ID NO: 217779 - DNA, 25 bp, Mus musculus
agtggtggttggagttatttctgtt

SEQ ID NO: 217780 - DNA, 25 bp, Mus musculus
agtggtggttggtgttatttctgtt

SEQ ID NO: 217781 - DNA, 25 bp, Mus musculus
agtggtgtaacacggtccagacctt

SEQ ID NO: 217782 - DNA, 25 bp, Mus musculus
agtggtgtaacagggtccagacctt

SEQ ID NO: 217783 - DNA, 25 bp, Mus musculus
agtggtgtagggaccatctcttttt

SEQ ID NO: 217784 - DNA, 25 bp, Mus musculus
agtggtgtagggtccatctcttttt

SEQ ID NO: 217785 - DNA, 25 bp, Mus musculus
agtggtgtattcatctctctgactc

SEQ ID NO: 217786 - DNA, 25 bp, Mus musculus
agtggtgtattcttctctctgactc

SEQ ID NO: 217787 - DNA, 25 bp, Mus musculus
agtggtgtcacaagtggctcatcct

SEQ ID NO: 217788 - DNA, 25 bp, Mus musculus
agtggtgtcacatgtggctcatcct

SEQ ID NO: 217789 - DNA, 25 bp, Mus musculus
agtggtgtccaaaacattcacggcc

SEQ ID NO: 217790 - DNA, 25 bp, Mus musculus
agtggtgtccaatacattcacggcc

SEQ ID NO: 217791 - DNA, 25 bp, Mus musculus
agtggtgtcctgctcaaatatttga

SEQ ID NO: 217792 - DNA, 25 bp, Mus musculus
agtggtgtcctggtcaaatatttga

SEQ ID NO: 217793 - DNA, 25 bp, Mus musculus
agtggtgtgtccatcccaggtccat

SEQ ID NO: 217794 - DNA, 25 bp, Mus musculus
agtggtgtgtccttcccaggtccat

SEQ ID NO: 217795 - DNA, 25 bp, Mus musculus
agtggtgtgttcagctcagacttcc

SEQ ID NO: 217796 - DNA, 25 bp, Mus musculus
agtggtgtgttctgctcagacttcc

SEQ ID NO: 217797 - DNA, 25 bp, Mus musculus
agtggtgttcacactgagttccagc

SEQ ID NO: 217798 - DNA, 25 bp, Mus musculus
agtggtgttcactctgagttccagc

SEQ ID NO: 217799 - DNA, 25 bp, Mus musculus
agtggtgttgagactttcttgctgt

SEQ ID NO: 217800 - DNA, 25 bp, Mus musculus
agtggtgttgagtctttcttgctgt

SEQ ID NO: 217801 - DNA, 25 bp, Mus musculus
agtggtgtttggagccagcttattc

SEQ ID NO: 217802 - DNA, 25 bp, Mus musculus
agtggtgtttggtgccagcttattc

SEQ ID NO: 217803 - DNA, 25 bp, Mus musculus
agtggttaaggcagggcggattctg

SEQ ID NO: 217804 - DNA, 25 bp, Mus musculus
agtggttaaggctgggcggattctg

SEQ ID NO: 217805 - DNA, 25 bp, Mus musculus
agtggttacaagacgatctgctcaa

SEQ ID NO: 217806 - DNA, 25 bp, Mus musculus
agtggttacaagtcgatctgctcaa

SEQ ID NO: 217807 - DNA, 25 bp, Mus musculus
agtggttacataccctgcagcagct

SEQ ID NO: 217808 - DNA, 25 bp, Mus musculus
agtggttacatagcctgcagcagct

SEQ ID NO: 217809 - DNA, 25 bp, Mus musculus
agtggttacgcactgtgctgctaac

SEQ ID NO: 217810 - DNA, 25 bp, Mus musculus
agtggttacgcagtgtgctgctaac

SEQ ID NO: 217811 - DNA, 25 bp, Mus musculus
agtggttagaaaccgactcctgtca

SEQ ID NO: 217812 - DNA, 25 bp, Mus musculus
agtggttagaaagcgactcctgtca

SEQ ID NO: 217813 - DNA, 25 bp, Mus musculus
agtggttagcacactgtagtagaag

SEQ ID NO: 217814 - DNA, 25 bp, Mus musculus
agtggttagcacctgtgcccatgat

SEQ ID NO: 217815 - DNA, 25 bp, Mus musculus
agtggttagcacgtgtgcccatgat

SEQ ID NO: 217816 - DNA, 25 bp, Mus musculus
agtggttagcactctgtagtagaag

SEQ ID NO: 217817 - DNA, 25 bp, Mus musculus
agtggttagttaccactgggcacct

SEQ ID NO: 217818 - DNA, 25 bp, Mus musculus
agtggttagttagcactgggcacct

SEQ ID NO: 217819 - DNA, 25 bp, Mus musculus
agtggttatcctcagctacaaagaa

SEQ ID NO: 217820 - DNA, 25 bp, Mus musculus
agtggttatcctgagctacaaagaa

SEQ ID NO: 217821 - DNA, 25 bp, Mus musculus
agtggttcacttatctgatcttggc

SEQ ID NO: 217822 - DNA, 25 bp, Mus musculus
agtggttcacttttctgatcttggc

SEQ ID NO: 217823 - DNA, 25 bp, Mus musculus
agtggttcataacccgtctgaggag

SEQ ID NO: 217824 - DNA, 25 bp, Mus musculus
agtggttcataagccgtctgaggag

SEQ ID NO: 217825 - DNA, 25 bp, Mus musculus
agtggttcatggacctgattgtgac

SEQ ID NO: 217826 - DNA, 25 bp, Mus musculus
agtggttcatggtcctgattgtgac

SEQ ID NO: 217827 - DNA, 25 bp, Mus musculus
agtggttcccagacaagctcaggcc

SEQ ID NO: 217828 - DNA, 25 bp, Mus musculus
agtggttcccagtcaagctcaggcc

SEQ ID NO: 217829 - DNA, 25 bp, Mus musculus
agtggttcgcacagggtcactgagc

SEQ ID NO: 217830 - DNA, 25 bp, Mus musculus
agtggttcgcactgggtcactgagc

SEQ ID NO: 217831 - DNA, 25 bp, Mus musculus
agtggttctccacagttaggcgcgc

SEQ ID NO: 217832 - DNA, 25 bp, Mus musculus
agtggttctccagagttaggcgcgc

SEQ ID NO: 217833 - DNA, 25 bp, Mus musculus
agtggttctcggagtacgtctacga

SEQ ID NO: 217834 - DNA, 25 bp, Mus musculus
agtggttctcggtgtacgtctacga

SEQ ID NO: 217835 - DNA, 25 bp, Mus musculus
agtggttcttgcacccctgaatgag

SEQ ID NO: 217836 - DNA, 25 bp, Mus musculus
agtggttcttgctcccctgaatgag

SEQ ID NO: 217837 - DNA, 25 bp, Mus musculus
agtggttgagacaatcccatttcct

SEQ ID NO: 217838 - DNA, 25 bp, Mus musculus
agtggttgagactatcccatttcct

SEQ ID NO: 217839 - DNA, 25 bp, Mus musculus
agtggttgattgctttatctctcga

SEQ ID NO: 217840 - DNA, 25 bp, Mus musculus
agtggttgattggtttatctctcga

SEQ ID NO: 217841 - DNA, 25 bp, Mus musculus
agtggttgcatgagcgctcttcata

SEQ ID NO: 217842 - DNA, 25 bp, Mus musculus
agtggttgcatgtgcgctcttcata

SEQ ID NO: 217843 - DNA, 25 bp, Mus musculus
agtggttggtctctgtttctctgct

SEQ ID NO: 217844 - DNA, 25 bp, Mus musculus
agtggttggtctgtgtttctctgct

SEQ ID NO: 217845 - DNA, 25 bp, Mus musculus
agtggttgtatgaaacacagcccaa

SEQ ID NO: 217846 - DNA, 25 bp, Mus musculus
agtggttgtatgtaacacagcccaa

SEQ ID NO: 217847 - DNA, 25 bp, Mus musculus
agtggttgttcaacattggttccgt

SEQ ID NO: 217848 - DNA, 25 bp, Mus musculus
agtggttgttcatcattggttccgt

SEQ ID NO: 217849 - DNA, 25 bp, Mus musculus
agtggttgttttccttgtgagcatt

SEQ ID NO: 217850 - DNA, 25 bp, Mus musculus
agtggttgttttgcttgtgagcatt

SEQ ID NO: 217851 - DNA, 25 bp, Mus musculus
agtggtttacagatcagtgattttc

SEQ ID NO: 217852 - DNA, 25 bp, Mus musculus
agtggtttacagttcagtgattttc

SEQ ID NO: 217853 - DNA, 25 bp, Mus musculus
agtggtttcacacaaattcccttgt

SEQ ID NO: 217854 - DNA, 25 bp, Mus musculus
agtggtttcacagaaattcccttgt

SEQ ID NO: 217855 - DNA, 25 bp, Mus musculus
agtggtttcctacctatatctgaag

SEQ ID NO: 217856 - DNA, 25 bp, Mus musculus
agtggtttcctacgtgatccgtgtg

SEQ ID NO: 217857 - DNA, 25 bp, Mus musculus
agtggtttcctagctatatctgaag

SEQ ID NO: 217858 - DNA, 25 bp, Mus musculus
agtggtttcctaggtgatccgtgtg

SEQ ID NO: 217859 - DNA, 25 bp, Mus musculus
agtggtttcctgactgagcttccct

SEQ ID NO: 217860 - DNA, 25 bp, Mus musculus
agtggtttcctgtctgagcttccct

SEQ ID NO: 217861 - DNA, 25 bp, Mus musculus
agtggtttccttctaatcatgaagg

SEQ ID NO: 217862 - DNA, 25 bp, Mus musculus
agtggtttccttgtaatcatgaagg

SEQ ID NO: 217863 - DNA, 25 bp, Mus musculus
agtggtttctacagtattccttgct

SEQ ID NO: 217864 - DNA, 25 bp, Mus musculus
agtggtttctactgtattccttgct

SEQ ID NO: 217865 - DNA, 25 bp, Mus musculus
agtggtttgcacattcagcttagat

SEQ ID NO: 217866 - DNA, 25 bp, Mus musculus
agtggtttgcactttcagcttagat

SEQ ID NO: 217867 - DNA, 25 bp, Mus musculus
agtggtttgtccacggtctggcaga

SEQ ID NO: 217868 - DNA, 25 bp, Mus musculus
agtggtttgtccatactctggcaaa

SEQ ID NO: 217869 - DNA, 25 bp, Mus musculus
agtggtttgtcctcggtctggcaga

SEQ ID NO: 217870 - DNA, 25 bp, Mus musculus
agtggtttgtccttactctggcaaa

SEQ ID NO: 217871 - DNA, 25 bp, Mus musculus
agtggttttatgaactgtcatgtgt

SEQ ID NO: 217872 - DNA, 25 bp, Mus musculus
agtggttttatgtactgtcatgtgt

SEQ ID NO: 217873 - DNA, 25 bp, Mus musculus
agtggttttcacactgatgttttca

SEQ ID NO: 217874 - DNA, 25 bp, Mus musculus
agtggttttcactctgatgttttca

SEQ ID NO: 217875 - DNA, 25 bp, Mus musculus
agtggtttttgtcttgtaccctgag

SEQ ID NO: 217876 - DNA, 25 bp, Mus musculus
agtggtttttgtgttgtaccctgag

SEQ ID NO: 217877 - DNA, 25 bp, Mus musculus
agtgtaaacatccagcagtagcttg

SEQ ID NO: 217878 - DNA, 25 bp, Mus musculus
agtgtaaacatcgagcagtagcttg

SEQ ID NO: 217879 - DNA, 25 bp, Mus musculus
agtgtaaacattagtgggccctact

SEQ ID NO: 217880 - DNA, 25 bp, Mus musculus
agtgtaaacatttgtgggccctact

SEQ ID NO: 217881 - DNA, 25 bp, Mus musculus
agtgtaaagatgagtcccgcctgcg

SEQ ID NO: 217882 - DNA, 25 bp, Mus musculus
agtgtaaagatgtgtcccgcctgcg

SEQ ID NO: 217883 - DNA, 25 bp, Mus musculus
agtgtaaatctgctactgcctggtt

SEQ ID NO: 217884 - DNA, 25 bp, Mus musculus
agtgtaaatctggtactgcctggtt

SEQ ID NO: 217885 - DNA, 25 bp, Mus musculus
agtgtaacccatacctttcttactg

SEQ ID NO: 217886 - DNA, 25 bp, Mus musculus
agtgtaacccattcctttcttactg

SEQ ID NO: 217887 - DNA, 25 bp, Mus musculus
agtgtaaccggcaggccttccagaa

SEQ ID NO: 217888 - DNA, 25 bp, Mus musculus
agtgtaaccggctggccttccagaa

SEQ ID NO: 217889 - DNA, 25 bp, Mus musculus
agtgtaacctaacccaaatcactag

SEQ ID NO: 217890 - DNA, 25 bp, Mus musculus
agtgtaacctaagccaaatcactag

SEQ ID NO: 217891 - DNA, 25 bp, Mus musculus
agtgtaactaagactggctttgaac

SEQ ID NO: 217892 - DNA, 25 bp, Mus musculus
agtgtaactaagtctggctttgaac

SEQ ID NO: 217893 - DNA, 25 bp, Mus musculus
agtgtaactcacacaccagctcaat

SEQ ID NO: 217894 - DNA, 25 bp, Mus musculus
agtgtaactcactcaccagctcaat

SEQ ID NO: 217895 - DNA, 25 bp, Mus musculus
agtgtaactcctaatctgatgacgt

SEQ ID NO: 217896 - DNA, 25 bp, Mus musculus
agtgtaactccttatctgatgacgt

SEQ ID NO: 217897 - DNA, 25 bp, Mus musculus
agtgtaacttgtacctgatctgtcc

SEQ ID NO: 217898 - DNA, 25 bp, Mus musculus
agtgtaacttgttcctgatctgtcc

SEQ ID NO: 217899 - DNA, 25 bp, Mus musculus
agtgtaagccatctgcggactgtgc

SEQ ID NO: 217900 - DNA, 25 bp, Mus musculus
agtgtaagccatgtgcggactgtgc

SEQ ID NO: 217901 - DNA, 25 bp, Mus musculus
agtgtaaggccacccgcgttaggct

SEQ ID NO: 217902 - DNA, 25 bp, Mus musculus
agtgtaaggccagccgcgttaggct

SEQ ID NO: 217903 - DNA, 25 bp, Mus musculus
agtgtaagtgcaatcccaataaaat

SEQ ID NO: 217904 - DNA, 25 bp, Mus musculus
agtgtaagtgcattcccaataaaat

SEQ ID NO: 217905 - DNA, 25 bp, Mus musculus
agtgtaatcatcaatatagtcttga

SEQ ID NO: 217906 - DNA, 25 bp, Mus musculus
agtgtaatcatctatatagtcttga

SEQ ID NO: 217907 - DNA, 25 bp, Mus musculus
agtgtaatgcccagtgacagcgagt

SEQ ID NO: 217908 - DNA, 25 bp, Mus musculus
agtgtaatgccctgtgacagcgagt

SEQ ID NO: 217909 - DNA, 25 bp, Mus musculus
agtgtaatgccgacctttgtaaaag

SEQ ID NO: 217910 - DNA, 25 bp, Mus musculus
agtgtaatgccgtcctttgtaaaag

SEQ ID NO: 217911 - DNA, 25 bp, Mus musculus
agtgtaattacacctcaacctcctc

SEQ ID NO: 217912 - DNA, 25 bp, Mus musculus
agtgtaattacagctcaacctcctc

SEQ ID NO: 217913 - DNA, 25 bp, Mus musculus
agtgtaattattactgttggttcat

SEQ ID NO: 217914 - DNA, 25 bp, Mus musculus
agtgtaattatttctgttggttcat

SEQ ID NO: 217915 - DNA, 25 bp, Mus musculus
agtgtacaaaccattcatccatacc

SEQ ID NO: 217916 - DNA, 25 bp, Mus musculus
agtgtacaaacctttcatccatacc

SEQ ID NO: 217917 - DNA, 25 bp, Mus musculus
agtgtacaaatgatcccttagacca

SEQ ID NO: 217918 - DNA, 25 bp, Mus musculus
agtgtacaaatgttcccttagacca

SEQ ID NO: 217919 - DNA, 25 bp, Mus musculus
agtgtacaactcattttgcgccaat

SEQ ID NO: 217920 - DNA, 25 bp, Mus musculus
agtgtacaactctttttgcgccaat

SEQ ID NO: 217921 - DNA, 25 bp, Mus musculus
agtgtacaagtgacagcatgccagg

SEQ ID NO: 217922 - DNA, 25 bp, Mus musculus
agtgtacaagtgtcagcatgccagg

SEQ ID NO: 217923 - DNA, 25 bp, Mus musculus
agtgtacacaacacctggctactat

SEQ ID NO: 217924 - DNA, 25 bp, Mus musculus
agtgtacacaactcctggctactat

SEQ ID NO: 217925 - DNA, 25 bp, Mus musculus
agtgtacacactatgctgctaccgt

SEQ ID NO: 217926 - DNA, 25 bp, Mus musculus
agtgtacacactttgctgctaccgt

SEQ ID NO: 217927 - DNA, 25 bp, Mus musculus
agtgtacacctcattgatgttctcc

SEQ ID NO: 217928 - DNA, 25 bp, Mus musculus
agtgtacacctctttgatgttctcc

SEQ ID NO: 217929 - DNA, 25 bp, Mus musculus
agtgtacacgcaagagcccaccaga

SEQ ID NO: 217930 - DNA, 25 bp, Mus musculus
agtgtacacgcatgagcccaccaga

SEQ ID NO: 217931 - DNA, 25 bp, Mus musculus
agtgtacacgttatctcagaccaga

SEQ ID NO: 217932 - DNA, 25 bp, Mus musculus
agtgtacacgttttctcagaccaga

SEQ ID NO: 217933 - DNA, 25 bp, Mus musculus
agtgtacacttaagcacatgcctaa

SEQ ID NO: 217934 - DNA, 25 bp, Mus musculus
agtgtacacttatgcacatgcctaa

SEQ ID NO: 217935 - DNA, 25 bp, Mus musculus
agtgtacagcatctgccttcctttg

SEQ ID NO: 217936 - DNA, 25 bp, Mus musculus
agtgtacagcatgtgccttcctttg

SEQ ID NO: 217937 - DNA, 25 bp, Mus musculus
agtgtacagcgccaacacgtggcgt

SEQ ID NO: 217938 - DNA, 25 bp, Mus musculus
agtgtacagcgcgaacacgtggcgt

SEQ ID NO: 217939 - DNA, 25 bp, Mus musculus
agtgtacaggaacctcgttctcgag

SEQ ID NO: 217940 - DNA, 25 bp, Mus musculus
agtgtacaggaagctcgttctcgag

SEQ ID NO: 217941 - DNA, 25 bp, Mus musculus
agtgtaccagctcctgtgttcggga

SEQ ID NO: 217942 - DNA, 25 bp, Mus musculus
agtgtaccagctgctgtgttcggga

SEQ ID NO: 217943 - DNA, 25 bp, Mus musculus
agtgtaccatacatcatgttttcag

SEQ ID NO: 217944 - DNA, 25 bp, Mus musculus
agtgtaccatacttcatgttttcag

SEQ ID NO: 217945 - DNA, 25 bp, Mus musculus
agtgtacccatgcttgatctgtctc

SEQ ID NO: 217946 - DNA, 25 bp, Mus musculus
agtgtacccatggttgatctgtctc

SEQ ID NO: 217947 - DNA, 25 bp, Mus musculus
agtgtaccgcatctcgcgtaagctt

SEQ ID NO: 217948 - DNA, 25 bp, Mus musculus
agtgtaccgcatgtcgcgtaagctt

SEQ ID NO: 217949 - DNA, 25 bp, Mus musculus
agtgtacctcaccagagggtattcg

SEQ ID NO: 217950 - DNA, 25 bp, Mus musculus
agtgtacctcacgagagggtattcg

SEQ ID NO: 217951 - DNA, 25 bp, Mus musculus
agtgtaccttgtcccaccgaatttc

SEQ ID NO: 217952 - DNA, 25 bp, Mus musculus
agtgtaccttgtgccaccgaatttc

SEQ ID NO: 217953 - DNA, 25 bp, Mus musculus
agtgtacgatccagattatcacagc

SEQ ID NO: 217954 - DNA, 25 bp, Mus musculus
agtgtacgatcctgattatcacagc

SEQ ID NO: 217955 - DNA, 25 bp, Mus musculus
agtgtacgccgcagagtctagctca

SEQ ID NO: 217956 - DNA, 25 bp, Mus musculus
agtgtacgccgctgagtctagctca

SEQ ID NO: 217957 - DNA, 25 bp, Mus musculus
agtgtacgtcttctcacagctgaca

SEQ ID NO: 217958 - DNA, 25 bp, Mus musculus
agtgtacgtcttgtcacagctgaca

SEQ ID NO: 217959 - DNA, 25 bp, Mus musculus
agtgtactaaggctgtttccatatc

SEQ ID NO: 217960 - DNA, 25 bp, Mus musculus
agtgtactaagggtgtttccatatc

SEQ ID NO: 217961 - DNA, 25 bp, Mus musculus
agtgtactagtcagtgcattttttc

SEQ ID NO: 217962 - DNA, 25 bp, Mus musculus
agtgtactagtctgtgcattttttc

SEQ ID NO: 217963 - DNA, 25 bp, Mus musculus
agtgtactatacctcagccttattt

SEQ ID NO: 217964 - DNA, 25 bp, Mus musculus
agtgtactatacgtcagccttattt

SEQ ID NO: 217965 - DNA, 25 bp, Mus musculus
agtgtactcaccaaagaactacttt

SEQ ID NO: 217966 - DNA, 25 bp, Mus musculus
agtgtactcacctaagaactacttt

SEQ ID NO: 217967 - DNA, 25 bp, Mus musculus
agtgtactcctacttatggacccgc

SEQ ID NO: 217968 - DNA, 25 bp, Mus musculus
agtgtactcctagttatggacccgc

SEQ ID NO: 217969 - DNA, 25 bp, Mus musculus
agtgtactccttcaactccaataga

SEQ ID NO: 217970 - DNA, 25 bp, Mus musculus
agtgtactccttgaactccaataga

SEQ ID NO: 217971 - DNA, 25 bp, Mus musculus
agtgtactggccaacagggttctgc

SEQ ID NO: 217972 - DNA, 25 bp, Mus musculus
agtgtactggcctacagggttctgc

SEQ ID NO: 217973 - DNA, 25 bp, Mus musculus
agtgtactgggcaatcagagagacc

SEQ ID NO: 217974 - DNA, 25 bp, Mus musculus
agtgtactgggctatcagagagacc

SEQ ID NO: 217975 - DNA, 25 bp, Mus musculus
agtgtactgtccacagctcatggca

SEQ ID NO: 217976 - DNA, 25 bp, Mus musculus
agtgtactgtcctcagctcatggca

SEQ ID NO: 217977 - DNA, 25 bp, Mus musculus
agtgtactgtgactgatcactgttc

SEQ ID NO: 217978 - DNA, 25 bp, Mus musculus
agtgtactgtgagtgatcactgttc

SEQ ID NO: 217979 - DNA, 25 bp, Mus musculus
agtgtacttcatacatcagaggaaa

SEQ ID NO: 217980 - DNA, 25 bp, Mus musculus
agtgtacttcattcatcagaggaaa

SEQ ID NO: 217981 - DNA, 25 bp, Mus musculus
agtgtacttttcatgctgtcacatt

SEQ ID NO: 217982 - DNA, 25 bp, Mus musculus
agtgtacttttcttgctgtcacatt

SEQ ID NO: 217983 - DNA, 25 bp, Mus musculus
agtgtagaaagccataccgcagcct

SEQ ID NO: 217984 - DNA, 25 bp, Mus musculus
agtgtagaaagcgataccgcagcct

SEQ ID NO: 217985 - DNA, 25 bp, Mus musculus
agtgtagaactaagccccagtggtg

SEQ ID NO: 217986 - DNA, 25 bp, Mus musculus
agtgtagaactatgccccagtggtg

SEQ ID NO: 217987 - DNA, 25 bp, Mus musculus
agtgtagactctccgcgacctgttg

SEQ ID NO: 217988 - DNA, 25 bp, Mus musculus
agtgtagactctgcgcgacctgttg

SEQ ID NO: 217989 - DNA, 25 bp, Mus musculus
agtgtagcaatgagcttgcctagca

SEQ ID NO: 217990 - DNA, 25 bp, Mus musculus
agtgtagcaatgtgcttgcctagca

SEQ ID NO: 217991 - DNA, 25 bp, Mus musculus
agtgtagcacccagcagtgctgtga

SEQ ID NO: 217992 - DNA, 25 bp, Mus musculus
agtgtagcaccctgcagtgctgtga

SEQ ID NO: 217993 - DNA, 25 bp, Mus musculus
agtgtagcagacagatgcgcccatg

SEQ ID NO: 217994 - DNA, 25 bp, Mus musculus
agtgtagcagactgatgcgcccatg

SEQ ID NO: 217995 - DNA, 25 bp, Mus musculus
agtgtagcccggcttgaagctgttc

SEQ ID NO: 217996 - DNA, 25 bp, Mus musculus
agtgtagcccgggttgaagctgttc

SEQ ID NO: 217997 - DNA, 25 bp, Mus musculus
agtgtagccctccacgcattggcat

SEQ ID NO: 217998 - DNA, 25 bp, Mus musculus
agtgtagccctcgacgcattggcat

SEQ ID NO: 217999 - DNA, 25 bp, Mus musculus
agtgtagccgctctggtttgaagaa

SEQ ID NO: 218000 - DNA, 25 bp, Mus musculus
agtgtagccgctgtggtttgaagaa

SEQ ID NO: 218001 - DNA, 25 bp, Mus musculus
agtgtagccgttaccttctgtgaat

SEQ ID NO: 218002 - DNA, 25 bp, Mus musculus
agtgtagccgtttccttctgtgaat

SEQ ID NO: 218003 - DNA, 25 bp, Mus musculus
agtgtagctaaacccatgttgtaaa

SEQ ID NO: 218004 - DNA, 25 bp, Mus musculus
agtgtagctaaagccatgttgtaaa

SEQ ID NO: 218005 - DNA, 25 bp, Mus musculus
agtgtagctcacagtttgcaagtca

SEQ ID NO: 218006 - DNA, 25 bp, Mus musculus
agtgtagctcactgtttgcaagtca

SEQ ID NO: 218007 - DNA, 25 bp, Mus musculus
agtgtagctcagagtctctctgaca

SEQ ID NO: 218008 - DNA, 25 bp, Mus musculus
agtgtagctcagtgtctctctgaca

SEQ ID NO: 218009 - DNA, 25 bp, Mus musculus
agtgtagctctgaaggcgtccatgc

SEQ ID NO: 218010 - DNA, 25 bp, Mus musculus
agtgtagctctgtaggcgtccatgc

SEQ ID NO: 218011 - DNA, 25 bp, Mus musculus
agtgtagctgcccaaggcacgagct

SEQ ID NO: 218012 - DNA, 25 bp, Mus musculus
agtgtagctgccgaaggcacgagct

SEQ ID NO: 218013 - DNA, 25 bp, Mus musculus
agtgtagctgtcatgatagtattca

SEQ ID NO: 218014 - DNA, 25 bp, Mus musculus
agtgtagctgtcttgatagtattca

SEQ ID NO: 218015 - DNA, 25 bp, Mus musculus
agtgtaggcactaagcaccctttac

SEQ ID NO: 218016 - DNA, 25 bp, Mus musculus
agtgtaggcacttagcaccctttac

SEQ ID NO: 218017 - DNA, 25 bp, Mus musculus
agtgtaggcaggctctgtgactccc

SEQ ID NO: 218018 - DNA, 25 bp, Mus musculus
agtgtaggcagggtctgtgactccc

SEQ ID NO: 218019 - DNA, 25 bp, Mus musculus
agtgtaggcccaagaatgctgcaga

SEQ ID NO: 218020 - DNA, 25 bp, Mus musculus
agtgtaggcccatgaatgctgcaga

SEQ ID NO: 218021 - DNA, 25 bp, Mus musculus
agtgtaggccctaggatatctgtcc

SEQ ID NO: 218022 - DNA, 25 bp, Mus musculus
agtgtaggcccttggatatctgtcc

SEQ ID NO: 218023 - DNA, 25 bp, Mus musculus
agtgtaggcttgcagctttctctgc

SEQ ID NO: 218024 - DNA, 25 bp, Mus musculus
agtgtaggcttggagctttctctgc

SEQ ID NO: 218025 - DNA, 25 bp, Mus musculus
agtgtagtcacacagcaggctagca

SEQ ID NO: 218026 - DNA, 25 bp, Mus musculus
agtgtagtcacagagcaggctagca

SEQ ID NO: 218027 - DNA, 25 bp, Mus musculus
agtgtagtcactctgaagcctgcat

SEQ ID NO: 218028 - DNA, 25 bp, Mus musculus
agtgtagtcactgtgaagcctgcat

SEQ ID NO: 218029 - DNA, 25 bp, Mus musculus
agtgtagtcctgacttggcagcctt

SEQ ID NO: 218030 - DNA, 25 bp, Mus musculus
agtgtagtcctgtcttggcagcctt

SEQ ID NO: 218031 - DNA, 25 bp, Mus musculus
agtgtagtgaatccgggaagtcctt

SEQ ID NO: 218032 - DNA, 25 bp, Mus musculus
agtgtagtgaatgcgggaagtcctt

SEQ ID NO: 218033 - DNA, 25 bp, Mus musculus
agtgtagtgcagactcagtacctgt

SEQ ID NO: 218034 - DNA, 25 bp, Mus musculus
agtgtagtgcagtctcagtacctgt

SEQ ID NO: 218035 - DNA, 25 bp, Mus musculus
agtgtataggtcagagccctgtccc

SEQ ID NO: 218036 - DNA, 25 bp, Mus musculus
agtgtataggtctgagccctgtccc

SEQ ID NO: 218037 - DNA, 25 bp, Mus musculus
agtgtatatcttcgcgcaagcccga

SEQ ID NO: 218038 - DNA, 25 bp, Mus musculus
agtgtatatcttggcgcaagcccga

SEQ ID NO: 218039 - DNA, 25 bp, Mus musculus
agtgtatatggccactccttttcca

SEQ ID NO: 218040 - DNA, 25 bp, Mus musculus
agtgtatatggcgactccttttcca

SEQ ID NO: 218041 - DNA, 25 bp, Mus musculus
agtgtatcacttaccccatcgaatt

SEQ ID NO: 218042 - DNA, 25 bp, Mus musculus
agtgtatcactttccccatcgaatt

SEQ ID NO: 218043 - DNA, 25 bp, Mus musculus
agtgtatccacacagaaggaggccg

SEQ ID NO: 218044 - DNA, 25 bp, Mus musculus
agtgtatccacagagaaggaggccg

SEQ ID NO: 218045 - DNA, 25 bp, Mus musculus
agtgtatccacccagggtcattagc

SEQ ID NO: 218046 - DNA, 25 bp, Mus musculus
agtgtatccaccgagggtcattagc

SEQ ID NO: 218047 - DNA, 25 bp, Mus musculus
agtgtatccagacaggaccccgttg

SEQ ID NO: 218048 - DNA, 25 bp, Mus musculus
agtgtatccagagaggaccccgttg

SEQ ID NO: 218049 - DNA, 25 bp, Mus musculus
agtgtatccatgacaaaatccgaag

SEQ ID NO: 218050 - DNA, 25 bp, Mus musculus
agtgtatccatgtcaaaatccgaag

SEQ ID NO: 218051 - DNA, 25 bp, Mus musculus
agtgtatccccgcaagcctcaggct

SEQ ID NO: 218052 - DNA, 25 bp, Mus musculus
agtgtatccccggaagcctcaggct

SEQ ID NO: 218053 - DNA, 25 bp, Mus musculus
agtgtatcccgaacagatgacccca

SEQ ID NO: 218054 - DNA, 25 bp, Mus musculus
agtgtatcccgatcagatgacccca

SEQ ID NO: 218055 - DNA, 25 bp, Mus musculus
agtgtatcctggagtcattttctgg

SEQ ID NO: 218056 - DNA, 25 bp, Mus musculus
agtgtatcctggtgtcattttctgg

SEQ ID NO: 218057 - DNA, 25 bp, Mus musculus
agtgtatctactctggtttctgcca

SEQ ID NO: 218058 - DNA, 25 bp, Mus musculus
agtgtatctactgtggtttctgcca

SEQ ID NO: 218059 - DNA, 25 bp, Mus musculus
agtgtatctgccacgctgttggtca

SEQ ID NO: 218060 - DNA, 25 bp, Mus musculus
agtgtatctgcctcgctgttggtca

SEQ ID NO: 218061 - DNA, 25 bp, Mus musculus
agtgtatgaagactccggcatcccc

SEQ ID NO: 218062 - DNA, 25 bp, Mus musculus
agtgtatgaagagtccggcatcccc

SEQ ID NO: 218063 - DNA, 25 bp, Mus musculus
agtgtatgactacagcgctgccgac

SEQ ID NO: 218064 - DNA, 25 bp, Mus musculus
agtgtatgactagagcgctgccgac

SEQ ID NO: 218065 - DNA, 25 bp, Mus musculus
agtgtatgatccactctgagcttaa

SEQ ID NO: 218066 - DNA, 25 bp, Mus musculus
agtgtatgatcctctctgagcttaa

SEQ ID NO: 218067 - DNA, 25 bp, Mus musculus
agtgtatgatgaagggccccactgg

SEQ ID NO: 218068 - DNA, 25 bp, Mus musculus
agtgtatgatgatgggccccactgg

SEQ ID NO: 218069 - DNA, 25 bp, Mus musculus
agtgtatggactcggctgccactgt

SEQ ID NO: 218070 - DNA, 25 bp, Mus musculus
agtgtatggactgggctgccactgt

SEQ ID NO: 218071 - DNA, 25 bp, Mus musculus
agtgtatgggctctgagttcacctt

SEQ ID NO: 218072 - DNA, 25 bp, Mus musculus
agtgtatgggctgtgagttcacctt

SEQ ID NO: 218073 - DNA, 25 bp, Mus musculus
agtgtatgtcacaatgcctgccttt

SEQ ID NO: 218074 - DNA, 25 bp, Mus musculus
agtgtatgtcactatgcctgccttt

SEQ ID NO: 218075 - DNA, 25 bp, Mus musculus
agtgtatgtgtgatagaccgcttct

SEQ ID NO: 218076 - DNA, 25 bp, Mus musculus
agtgtatgtgtgttagaccgcttct

SEQ ID NO: 218077 - DNA, 25 bp, Mus musculus
agtgtatgttttagtccttccagaa

SEQ ID NO: 218078 - DNA, 25 bp, Mus musculus
agtgtatgtttttgtccttccagaa

SEQ ID NO: 218079 - DNA, 25 bp, Mus musculus
agtgtattacccagaacccctgaga

SEQ ID NO: 218080 - DNA, 25 bp, Mus musculus
agtgtattaccctgaacccctgaga

SEQ ID NO: 218081 - DNA, 25 bp, Mus musculus
agtgtattacctaccatgcgcatga

SEQ ID NO: 218082 - DNA, 25 bp, Mus musculus
agtgtattaccttccatgcgcatga

SEQ ID NO: 218083 - DNA, 25 bp, Mus musculus
agtgtattagtcctggctctccaag

SEQ ID NO: 218084 - DNA, 25 bp, Mus musculus
agtgtattagtcgtggctctccaag

SEQ ID NO: 218085 - DNA, 25 bp, Mus musculus
agtgtattcaacatttttccattgt

SEQ ID NO: 218086 - DNA, 25 bp, Mus musculus
agtgtattcaacttttttccattgt

SEQ ID NO: 218087 - DNA, 25 bp, Mus musculus
agtgtattcactagcttgtttgaga

SEQ ID NO: 218088 - DNA, 25 bp, Mus musculus
agtgtattcacttgcttgtttgaga

SEQ ID NO: 218089 - DNA, 25 bp, Mus musculus
agtgtattcctcctgtgtatgtgcc

SEQ ID NO: 218090 - DNA, 25 bp, Mus musculus
agtgtattcctcgtgtgtatgtgcc

SEQ ID NO: 218091 - DNA, 25 bp, Mus musculus
agtgtattctccaattacctcatgg

SEQ ID NO: 218092 - DNA, 25 bp, Mus musculus
agtgtattctcctattacctcatgg

SEQ ID NO: 218093 - DNA, 25 bp, Mus musculus
agtgtattctctaagatcctccctg

SEQ ID NO: 218094 - DNA, 25 bp, Mus musculus
agtgtattctcttagatcctccctg

SEQ ID NO: 218095 - DNA, 25 bp, Mus musculus
agtgtattcttaaccctagttcctg

SEQ ID NO: 218096 - DNA, 25 bp, Mus musculus
agtgtattcttatccctagttcctg

SEQ ID NO: 218097 - DNA, 25 bp, Mus musculus
agtgtattctttctactagtcccca

SEQ ID NO: 218098 - DNA, 25 bp, Mus musculus
agtgtattctttgtactagtcccca

SEQ ID NO: 218099 - DNA, 25 bp, Mus musculus
agtgtatttcatcaatgcattgtac

SEQ ID NO: 218100 - DNA, 25 bp, Mus musculus
agtgtatttcatgaatgcattgtac

SEQ ID NO: 218101 - DNA, 25 bp, Mus musculus
agtgtatttctacgttgcttatatc

SEQ ID NO: 218102 - DNA, 25 bp, Mus musculus
agtgtatttctaggttgcttatatc

SEQ ID NO: 218103 - DNA, 25 bp, Mus musculus
agtgtattttctagtccctgttata

SEQ ID NO: 218104 - DNA, 25 bp, Mus musculus
agtgtattttctcttactgctggca

SEQ ID NO: 218105 - DNA, 25 bp, Mus musculus
agtgtattttctgttactgctggca

SEQ ID NO: 218106 - DNA, 25 bp, Mus musculus
agtgtattttcttgtccctgttata

SEQ ID NO: 218107 - DNA, 25 bp, Mus musculus
agtgtatttttgatgctcccagtac

SEQ ID NO: 218108 - DNA, 25 bp, Mus musculus
agtgtatttttgttgctcccagtac

SEQ ID NO: 218109 - DNA, 25 bp, Mus musculus
agtgtcaaatcgactggaccccagg

SEQ ID NO: 218110 - DNA, 25 bp, Mus musculus
agtgtcaaatcgtctggaccccagg

SEQ ID NO: 218111 - DNA, 25 bp, Mus musculus
agtgtcaaatttctctccaccacct

SEQ ID NO: 218112 - DNA, 25 bp, Mus musculus
agtgtcaaatttgtctccaccacct

SEQ ID NO: 218113 - DNA, 25 bp, Mus musculus
agtgtcaacactactttccccttag

SEQ ID NO: 218114 - DNA, 25 bp, Mus musculus
agtgtcaacacttctttccccttag

SEQ ID NO: 218115 - DNA, 25 bp, Mus musculus
agtgtcaaccgcctttgctgccaag

SEQ ID NO: 218116 - DNA, 25 bp, Mus musculus
agtgtcaaccgcgtttgctgccaag

SEQ ID NO: 218117 - DNA, 25 bp, Mus musculus
agtgtcaactgcatgtctgcaccaa

SEQ ID NO: 218118 - DNA, 25 bp, Mus musculus
agtgtcaactgcttgtctgcaccaa

SEQ ID NO: 218119 - DNA, 25 bp, Mus musculus
agtgtcaacttcagcccttcatatg

SEQ ID NO: 218120 - DNA, 25 bp, Mus musculus
agtgtcaacttctgcccttcatatg

SEQ ID NO: 218121 - DNA, 25 bp, Mus musculus
agtgtcaatcggcaaagggcccttc

SEQ ID NO: 218122 - DNA, 25 bp, Mus musculus
agtgtcaatcgggaaagggcccttc

SEQ ID NO: 218123 - DNA, 25 bp, Mus musculus
agtgtcacaatgcacgtgctagtgg

SEQ ID NO: 218124 - DNA, 25 bp, Mus musculus
agtgtcacaatggacgtgctagtgg

SEQ ID NO: 218125 - DNA, 25 bp, Mus musculus
agtgtcacacacaaccagcatgggt

SEQ ID NO: 218126 - DNA, 25 bp, Mus musculus
agtgtcacacacatgtggccagtta

SEQ ID NO: 218127 - DNA, 25 bp, Mus musculus
agtgtcacacactaccagcatgggt

SEQ ID NO: 218128 - DNA, 25 bp, Mus musculus
agtgtcacacacttgtggccagtta

SEQ ID NO: 218129 - DNA, 25 bp, Mus musculus
agtgtcaccaaacccaaatgtcatt

SEQ ID NO: 218130 - DNA, 25 bp, Mus musculus
agtgtcaccaaagccaaatgtcatt

SEQ ID NO: 218131 - DNA, 25 bp, Mus musculus
agtgtcaccatcatacagcttaggg

SEQ ID NO: 218132 - DNA, 25 bp, Mus musculus
agtgtcaccatcttacagcttaggg

SEQ ID NO: 218133 - DNA, 25 bp, Mus musculus
agtgtcacccttcttagctgggcat

SEQ ID NO: 218134 - DNA, 25 bp, Mus musculus
agtgtcacccttgttagctgggcat

SEQ ID NO: 218135 - DNA, 25 bp, Mus musculus
agtgtcacctgaccagactgtatgc

SEQ ID NO: 218136 - DNA, 25 bp, Mus musculus
agtgtcacctgagcagactgtatgc

SEQ ID NO: 218137 - DNA, 25 bp, Mus musculus
agtgtcacgactcaggttgaaaacc

SEQ ID NO: 218138 - DNA, 25 bp, Mus musculus
agtgtcacgactgaggttgaaaacc

SEQ ID NO: 218139 - DNA, 25 bp, Mus musculus
agtgtcacgcacagctagtcttttt

SEQ ID NO: 218140 - DNA, 25 bp, Mus musculus
agtgtcacgcactgctagtcttttt

SEQ ID NO: 218141 - DNA, 25 bp, Mus musculus
agtgtcactaagcatgccatcatta

SEQ ID NO: 218142 - DNA, 25 bp, Mus musculus
agtgtcactaaggatgccatcatta

SEQ ID NO: 218143 - DNA, 25 bp, Mus musculus
agtgtcactcagcactttctgtctc

SEQ ID NO: 218144 - DNA, 25 bp, Mus musculus
agtgtcactcaggactttctgtctc

SEQ ID NO: 218145 - DNA, 25 bp, Mus musculus
agtgtcactgagcagacttcttggt

SEQ ID NO: 218146 - DNA, 25 bp, Mus musculus
agtgtcactgaggagacttcttggt

SEQ ID NO: 218147 - DNA, 25 bp, Mus musculus
agtgtcactgcacttacacgtgtct

SEQ ID NO: 218148 - DNA, 25 bp, Mus musculus
agtgtcactgcagttacacgtgtct

SEQ ID NO: 218149 - DNA, 25 bp, Mus musculus
agtgtcacttccatttggccatgag

SEQ ID NO: 218150 - DNA, 25 bp, Mus musculus
agtgtcacttccttttggccatgag

SEQ ID NO: 218151 - DNA, 25 bp, Mus musculus
agtgtcagaagcactgtaaacagca

SEQ ID NO: 218152 - DNA, 25 bp, Mus musculus
agtgtcagaagctctgtaaacagca

SEQ ID NO: 218153 - DNA, 25 bp, Mus musculus
agtgtcagacacatagggcccttga

SEQ ID NO: 218154 - DNA, 25 bp, Mus musculus
agtgtcagacacttagggcccttga

SEQ ID NO: 218155 - DNA, 25 bp, Mus musculus
agtgtcagagagcactagcctatca

SEQ ID NO: 218156 - DNA, 25 bp, Mus musculus
agtgtcagagaggactagcctatca

SEQ ID NO: 218157 - DNA, 25 bp, Mus musculus
agtgtcagagcacgccaaccgagca

SEQ ID NO: 218158 - DNA, 25 bp, Mus musculus
agtgtcagagcaggccaaccgagca

SEQ ID NO: 218159 - DNA, 25 bp, Mus musculus
agtgtcagagggagtcacaagtgtc

SEQ ID NO: 218160 - DNA, 25 bp, Mus musculus
agtgtcagagggtgtcacaagtgtc

SEQ ID NO: 218161 - DNA, 25 bp, Mus musculus
agtgtcagagtcaccgaggccgaga

SEQ ID NO: 218162 - DNA, 25 bp, Mus musculus
agtgtcagagtcaggcgccaccatc

SEQ ID NO: 218163 - DNA, 25 bp, Mus musculus
agtgtcagagtctccgaggccgaga

SEQ ID NO: 218164 - DNA, 25 bp, Mus musculus
agtgtcagagtctggcgccaccatc

SEQ ID NO: 218165 - DNA, 25 bp, Mus musculus
agtgtcagattcatgctggtggttt

SEQ ID NO: 218166 - DNA, 25 bp, Mus musculus
agtgtcagattcttgctggtggttt

SEQ ID NO: 218167 - DNA, 25 bp, Mus musculus
agtgtcagcaacagtggactctcct

SEQ ID NO: 218168 - DNA, 25 bp, Mus musculus
agtgtcagcaactgtggactctcct

SEQ ID NO: 218169 - DNA, 25 bp, Mus musculus
agtgtcagcaataccttcagtaagt

SEQ ID NO: 218170 - DNA, 25 bp, Mus musculus
agtgtcagcaattccttcagtaagt

SEQ ID NO: 218171 - DNA, 25 bp, Mus musculus
agtgtcagcagtacgtggtcttcga

SEQ ID NO: 218172 - DNA, 25 bp, Mus musculus
agtgtcagcagttcgtggtcttcga

SEQ ID NO: 218173 - DNA, 25 bp, Mus musculus
agtgtcagcttccttaagtgtggcc

SEQ ID NO: 218174 - DNA, 25 bp, Mus musculus
agtgtcagcttcgttaagtgtggcc

SEQ ID NO: 218175 - DNA, 25 bp, Mus musculus
agtgtcaggaaaccaacgtcatcaa

SEQ ID NO: 218176 - DNA, 25 bp, Mus musculus
agtgtcaggaaagcaacgtcatcaa

SEQ ID NO: 218177 - DNA, 25 bp, Mus musculus
agtgtcaggagtcccagaagacctt

SEQ ID NO: 218178 - DNA, 25 bp, Mus musculus
agtgtcaggagtgccagaagacctt

SEQ ID NO: 218179 - DNA, 25 bp, Mus musculus
agtgtcagggtcaaagccagctctc

SEQ ID NO: 218180 - DNA, 25 bp, Mus musculus
agtgtcagggtctaagccagctctc

SEQ ID NO: 218181 - DNA, 25 bp, Mus musculus
agtgtcaggttcagctgccgctgcg

SEQ ID NO: 218182 - DNA, 25 bp, Mus musculus
agtgtcaggttctgctgccgctgcg

SEQ ID NO: 218183 - DNA, 25 bp, Mus musculus
agtgtcagtcagaactactcttccc

SEQ ID NO: 218184 - DNA, 25 bp, Mus musculus
agtgtcagtcagtactactcttccc

SEQ ID NO: 218185 - DNA, 25 bp, Mus musculus
agtgtcagtcttatctctcagacct

SEQ ID NO: 218186 - DNA, 25 bp, Mus musculus
agtgtcagtcttttctctcagacct

SEQ ID NO: 218187 - DNA, 25 bp, Mus musculus
agtgtcagtgtcactctctggagac

SEQ ID NO: 218188 - DNA, 25 bp, Mus musculus
agtgtcagtgtctctctctggagac

SEQ ID NO: 218189 - DNA, 25 bp, Mus musculus
agtgtcagttaaatcgccccagcgc

SEQ ID NO: 218190 - DNA, 25 bp, Mus musculus
agtgtcagttaattcgccccagcgc

SEQ ID NO: 218191 - DNA, 25 bp, Mus musculus
agtgtcagttcacaagttcaatttg

SEQ ID NO: 218192 - DNA, 25 bp, Mus musculus
agtgtcagttcagaagttcaatttg

SEQ ID NO: 218193 - DNA, 25 bp, Mus musculus
agtgtcataacaaatagtttggact

SEQ ID NO: 218194 - DNA, 25 bp, Mus musculus
agtgtcataacatatagtttggact

SEQ ID NO: 218195 - DNA, 25 bp, Mus musculus
agtgtcatattaccccatgctggac

SEQ ID NO: 218196 - DNA, 25 bp, Mus musculus
agtgtcatattagcccatgctggac

SEQ ID NO: 218197 - DNA, 25 bp, Mus musculus
agtgtcatcagtaacctgtcaccag

SEQ ID NO: 218198 - DNA, 25 bp, Mus musculus
agtgtcatcagttacctgtcaccag

SEQ ID NO: 218199 - DNA, 25 bp, Mus musculus
agtgtcatccccattgcactgtaat

SEQ ID NO: 218200 - DNA, 25 bp, Mus musculus
agtgtcatcccctttgcactgtaat

SEQ ID NO: 218201 - DNA, 25 bp, Mus musculus
agtgtcatcgcaagacctacatcac

SEQ ID NO: 218202 - DNA, 25 bp, Mus musculus
agtgtcatcgcatgacctacatcac

SEQ ID NO: 218203 - DNA, 25 bp, Mus musculus
agtgtcatctcacctgaaggcctca

SEQ ID NO: 218204 - DNA, 25 bp, Mus musculus
agtgtcatctcagctgaaggcctca

SEQ ID NO: 218205 - DNA, 25 bp, Mus musculus
agtgtcatgacaccctagtacagtt

SEQ ID NO: 218206 - DNA, 25 bp, Mus musculus
agtgtcatgacagcctagtacagtt

SEQ ID NO: 218207 - DNA, 25 bp, Mus musculus
agtgtcatgccaaaccttgtagcta

SEQ ID NO: 218208 - DNA, 25 bp, Mus musculus
agtgtcatgccataccttgtagcta

SEQ ID NO: 218209 - DNA, 25 bp, Mus musculus
agtgtcatggatccaggctggcttc

SEQ ID NO: 218210 - DNA, 25 bp, Mus musculus
agtgtcatggatgcaggctggcttc

SEQ ID NO: 218211 - DNA, 25 bp, Mus musculus
agtgtcatggtcacaaccagccgga

SEQ ID NO: 218212 - DNA, 25 bp, Mus musculus
agtgtcatggtctcaaccagccgga

SEQ ID NO: 218213 - DNA, 25 bp, Mus musculus
agtgtcattctcaggatgtgcacct

SEQ ID NO: 218214 - DNA, 25 bp, Mus musculus
agtgtcattctctggatgtgcacct

SEQ ID NO: 218215 - DNA, 25 bp, Mus musculus
agtgtcattgtcactcagtggacca

SEQ ID NO: 218216 - DNA, 25 bp, Mus musculus
agtgtcattgtctctcagtggacca

SEQ ID NO: 218217 - DNA, 25 bp, Mus musculus
agtgtcattttgaattccctcatct

SEQ ID NO: 218218 - DNA, 25 bp, Mus musculus
agtgtcattttgtattccctcatct

SEQ ID NO: 218219 - DNA, 25 bp, Mus musculus
agtgtccaagacatttgcctctcaa

SEQ ID NO: 218220 - DNA, 25 bp, Mus musculus
agtgtccaagacttttgcctctcaa

SEQ ID NO: 218221 - DNA, 25 bp, Mus musculus
agtgtccacagtagcactggcctag

SEQ ID NO: 218222 - DNA, 25 bp, Mus musculus
agtgtccacagttgcactggcctag

SEQ ID NO: 218223 - DNA, 25 bp, Mus musculus
agtgtccacatcacttgttccaagt

SEQ ID NO: 218224 - DNA, 25 bp, Mus musculus
agtgtccacatctcttgttccaagt

SEQ ID NO: 218225 - DNA, 25 bp, Mus musculus
agtgtccacgcgctataccaggaag

SEQ ID NO: 218226 - DNA, 25 bp, Mus musculus
agtgtccacgcggtataccaggaag

SEQ ID NO: 218227 - DNA, 25 bp, Mus musculus
agtgtccaggccctagaacttcatt

SEQ ID NO: 218228 - DNA, 25 bp, Mus musculus
agtgtccaggccgtagaacttcatt

SEQ ID NO: 218229 - DNA, 25 bp, Mus musculus
agtgtccaggtgagtaaccgggctt

SEQ ID NO: 218230 - DNA, 25 bp, Mus musculus
agtgtccaggtgtgtaaccgggctt

SEQ ID NO: 218231 - DNA, 25 bp, Mus musculus
agtgtccattaaattcctgaagatc

SEQ ID NO: 218232 - DNA, 25 bp, Mus musculus
agtgtccattaatttcctgaagatc

SEQ ID NO: 218233 - DNA, 25 bp, Mus musculus
agtgtccatttgatgaccttctctg

SEQ ID NO: 218234 - DNA, 25 bp, Mus musculus
agtgtccatttgttgaccttctctg

SEQ ID NO: 218235 - DNA, 25 bp, Mus musculus
agtgtcccaaaaagtcctgatcaga

SEQ ID NO: 218236 - DNA, 25 bp, Mus musculus
agtgtcccaaaatgtcctgatcaga

SEQ ID NO: 218237 - DNA, 25 bp, Mus musculus
agtgtcccaaatctaaactcccaca

SEQ ID NO: 218238 - DNA, 25 bp, Mus musculus
agtgtcccaaatgtaaactcccaca

SEQ ID NO: 218239 - DNA, 25 bp, Mus musculus
agtgtcccaaccacacacatagtgt

SEQ ID NO: 218240 - DNA, 25 bp, Mus musculus
agtgtcccaacctcacacatagtgt

SEQ ID NO: 218241 - DNA, 25 bp, Mus musculus
agtgtcccaatgagcttggtggtta

SEQ ID NO: 218242 - DNA, 25 bp, Mus musculus
agtgtcccaatgtgcttggtggtta

SEQ ID NO: 218243 - DNA, 25 bp, Mus musculus
agtgtcccacatctctgcaggtaat

SEQ ID NO: 218244 - DNA, 25 bp, Mus musculus
agtgtcccacatgtctgcaggtaat

SEQ ID NO: 218245 - DNA, 25 bp, Mus musculus
agtgtcccagacagaaacaggttct

SEQ ID NO: 218246 - DNA, 25 bp, Mus musculus
agtgtcccagactgaaacaggttct

SEQ ID NO: 218247 - DNA, 25 bp, Mus musculus
agtgtcccagcgcaatcgtcaatga

SEQ ID NO: 218248 - DNA, 25 bp, Mus musculus
agtgtcccagcggaatcgtcaatga

SEQ ID NO: 218249 - DNA, 25 bp, Mus musculus
agtgtcccaggaatgtgaatcccaa

SEQ ID NO: 218250 - DNA, 25 bp, Mus musculus
agtgtcccaggaattaaggctgaga

SEQ ID NO: 218251 - DNA, 25 bp, Mus musculus
agtgtcccaggattgtgaatcccaa

SEQ ID NO: 218252 - DNA, 25 bp, Mus musculus
agtgtcccaggatttaaggctgaga

SEQ ID NO: 218253 - DNA, 25 bp, Mus musculus
agtgtccccaaaaagcacaaccaag

SEQ ID NO: 218254 - DNA, 25 bp, Mus musculus
agtgtccccaaaatgctgtgctata

SEQ ID NO: 218255 - DNA, 25 bp, Mus musculus
agtgtccccaaatagcacaaccaag

SEQ ID NO: 218256 - DNA, 25 bp, Mus musculus
agtgtccccaaattgctgtgctata

SEQ ID NO: 218257 - DNA, 25 bp, Mus musculus
agtgtccccaagacgtgaacgcagc

SEQ ID NO: 218258 - DNA, 25 bp, Mus musculus
agtgtccccaagtcgtgaacgcagc

SEQ ID NO: 218259 - DNA, 25 bp, Mus musculus
agtgtccccatgaaaacaccacttc

SEQ ID NO: 218260 - DNA, 25 bp, Mus musculus
agtgtccccatgcacgtggcagaga

SEQ ID NO: 218261 - DNA, 25 bp, Mus musculus
agtgtccccatggacgtggcagaga

SEQ ID NO: 218262 - DNA, 25 bp, Mus musculus
agtgtccccatgtaaacaccacttc

SEQ ID NO: 218263 - DNA, 25 bp, Mus musculus
agtgtccccgggaagctgtgatctt

SEQ ID NO: 218264 - DNA, 25 bp, Mus musculus
agtgtccccgggtagctgtgatctt

SEQ ID NO: 218265 - DNA, 25 bp, Mus musculus
agtgtcccctacagtggaggatgta

SEQ ID NO: 218266 - DNA, 25 bp, Mus musculus
agtgtcccctactgtggaggatgta

SEQ ID NO: 218267 - DNA, 25 bp, Mus musculus
agtgtccctatgcttgtgcccagag

SEQ ID NO: 218268 - DNA, 25 bp, Mus musculus
agtgtccctatggttgtgcccagag

SEQ ID NO: 218269 - DNA, 25 bp, Mus musculus
agtgtccctcaaatgtggcccaagg

SEQ ID NO: 218270 - DNA, 25 bp, Mus musculus
agtgtccctcaattgtggcccaagg

SEQ ID NO: 218271 - DNA, 25 bp, Mus musculus
agtgtccctccactctgagcaggaa

SEQ ID NO: 218272 - DNA, 25 bp, Mus musculus
agtgtccctccagtctgagcaggaa

SEQ ID NO: 218273 - DNA, 25 bp, Mus musculus
agtgtccctgatcagatccgaggtg

SEQ ID NO: 218274 - DNA, 25 bp, Mus musculus
agtgtccctgatgagatccgaggtg

SEQ ID NO: 218275 - DNA, 25 bp, Mus musculus
agtgtccctgccaaactgttagatt

SEQ ID NO: 218276 - DNA, 25 bp, Mus musculus
agtgtccctgcctaactgttagatt

SEQ ID NO: 218277 - DNA, 25 bp, Mus musculus
agtgtccctgctcagagtacagcca

SEQ ID NO: 218278 - DNA, 25 bp, Mus musculus
agtgtccctgctgagagtacagcca

SEQ ID NO: 218279 - DNA, 25 bp, Mus musculus
agtgtccctgtgatggtgactcaga

SEQ ID NO: 218280 - DNA, 25 bp, Mus musculus
agtgtccctgtgttggtgactcaga

SEQ ID NO: 218281 - DNA, 25 bp, Mus musculus
agtgtcccttggagatcctcactcc

SEQ ID NO: 218282 - DNA, 25 bp, Mus musculus
agtgtcccttggtgatcctcactcc

SEQ ID NO: 218283 - DNA, 25 bp, Mus musculus
agtgtcccttgtattggaactgtct

SEQ ID NO: 218284 - DNA, 25 bp, Mus musculus
agtgtcccttgttttggaactgtct

SEQ ID NO: 218285 - DNA, 25 bp, Mus musculus
agtgtccgccatattccctgtgtcg

SEQ ID NO: 218286 - DNA, 25 bp, Mus musculus
agtgtccgccattttccctgtgtcg

SEQ ID NO: 218287 - DNA, 25 bp, Mus musculus
agtgtccgcgccaagagcgtgctgc

SEQ ID NO: 218288 - DNA, 25 bp, Mus musculus
agtgtccgcgcctagagcgtgctgc

SEQ ID NO: 218289 - DNA, 25 bp, Mus musculus
agtgtccgctcaaacattagatgga

SEQ ID NO: 218290 - DNA, 25 bp, Mus musculus
agtgtccgctcatacattagatgga

SEQ ID NO: 218291 - DNA, 25 bp, Mus musculus
agtgtccggcttagcaggtgctgca

SEQ ID NO: 218292 - DNA, 25 bp, Mus musculus
agtgtccggctttgcaggtgctgca

SEQ ID NO: 218293 - DNA, 25 bp, Mus musculus
agtgtcctaggtcctcctgcaacag

SEQ ID NO: 218294 - DNA, 25 bp, Mus musculus
agtgtcctaggtgctcctgcaacag

SEQ ID NO: 218295 - DNA, 25 bp, Mus musculus
agtgtcctatcgagcaaagaagcaa

SEQ ID NO: 218296 - DNA, 25 bp, Mus musculus
agtgtcctatcgtgcaaagaagcaa

SEQ ID NO: 218297 - DNA, 25 bp, Mus musculus
agtgtcctcaacagcagcataaaac

SEQ ID NO: 218298 - DNA, 25 bp, Mus musculus
agtgtcctcaactgcagcataaaac

SEQ ID NO: 218299 - DNA, 25 bp, Mus musculus
agtgtcctcagacgttagaggcatc

SEQ ID NO: 218300 - DNA, 25 bp, Mus musculus
agtgtcctcagaggttagaggcatc

SEQ ID NO: 218301 - DNA, 25 bp, Mus musculus
agtgtcctctagagtcacagccaag

SEQ ID NO: 218302 - DNA, 25 bp, Mus musculus
agtgtcctctagtgtcacagccaag

SEQ ID NO: 218303 - DNA, 25 bp, Mus musculus
agtgtcctctcactgtctcttctta

SEQ ID NO: 218304 - DNA, 25 bp, Mus musculus
agtgtcctctcagtgtctcttctta

SEQ ID NO: 218305 - DNA, 25 bp, Mus musculus
agtgtcctctgaacagactttcagc

SEQ ID NO: 218306 - DNA, 25 bp, Mus musculus
agtgtcctctgaagtaactgcctgc

SEQ ID NO: 218307 - DNA, 25 bp, Mus musculus
agtgtcctctgatcagactttcagc

SEQ ID NO: 218308 - DNA, 25 bp, Mus musculus
agtgtcctctgatgtaactgcctgc

SEQ ID NO: 218309 - DNA, 25 bp, Mus musculus
agtgtcctctgtacggacaggagga

SEQ ID NO: 218310 - DNA, 25 bp, Mus musculus
agtgtcctctgttcggacaggagga

SEQ ID NO: 218311 - DNA, 25 bp, Mus musculus
agtgtcctcttcagtcaggtcggaa

SEQ ID NO: 218312 - DNA, 25 bp, Mus musculus
agtgtcctcttctgtcaggtcggaa

SEQ ID NO: 218313 - DNA, 25 bp, Mus musculus
agtgtcctgactcttttaagccaag

SEQ ID NO: 218314 - DNA, 25 bp, Mus musculus
agtgtcctgactgttttaagccaag

SEQ ID NO: 218315 - DNA, 25 bp, Mus musculus
agtgtcctgcatactaacctgtgca

SEQ ID NO: 218316 - DNA, 25 bp, Mus musculus
agtgtcctgcattctaacctgtgca

SEQ ID NO: 218317 - DNA, 25 bp, Mus musculus
agtgtcctgctgcaattctgaccta

SEQ ID NO: 218318 - DNA, 25 bp, Mus musculus
agtgtcctgctggaattctgaccta

SEQ ID NO: 218319 - DNA, 25 bp, Mus musculus
agtgtcctgtaacgtttcctgtggg

SEQ ID NO: 218320 - DNA, 25 bp, Mus musculus
agtgtcctgtaaggtttcctgtggg

SEQ ID NO: 218321 - DNA, 25 bp, Mus musculus
agtgtcctgtagcacaggctggact

SEQ ID NO: 218322 - DNA, 25 bp, Mus musculus
agtgtcctgtaggacaggctggact

SEQ ID NO: 218323 - DNA, 25 bp, Mus musculus
agtgtcctgtatatgatccctagaa

SEQ ID NO: 218324 - DNA, 25 bp, Mus musculus
agtgtcctgtatttgatccctagaa

SEQ ID NO: 218325 - DNA, 25 bp, Mus musculus
agtgtcctgtgtaggttgcttccga

SEQ ID NO: 218326 - DNA, 25 bp, Mus musculus
agtgtcctgtgtcagagactgacag

SEQ ID NO: 218327 - DNA, 25 bp, Mus musculus
agtgtcctgtgtgagagactgacag

SEQ ID NO: 218328 - DNA, 25 bp, Mus musculus
agtgtcctgtgttggttgcttccga

SEQ ID NO: 218329 - DNA, 25 bp, Mus musculus
agtgtccttatacaggcatcggcat

SEQ ID NO: 218330 - DNA, 25 bp, Mus musculus
agtgtccttatagaggcatcggcat

SEQ ID NO: 218331 - DNA, 25 bp, Mus musculus
agtgtccttcaaactcaccttgcag

SEQ ID NO: 218332 - DNA, 25 bp, Mus musculus
agtgtccttcaatctcaccttgcag

SEQ ID NO: 218333 - DNA, 25 bp, Mus musculus
agtgtccttctcaagatagttggca

SEQ ID NO: 218334 - DNA, 25 bp, Mus musculus
agtgtccttctctagatagttggca

SEQ ID NO: 218335 - DNA, 25 bp, Mus musculus
agtgtccttgtgaggaagtctccat

SEQ ID NO: 218336 - DNA, 25 bp, Mus musculus
agtgtccttgtgctgtggtagaaca

SEQ ID NO: 218337 - DNA, 25 bp, Mus musculus
agtgtccttgtggtgtggtagaaca

SEQ ID NO: 218338 - DNA, 25 bp, Mus musculus
agtgtccttgtgtggaagtctccat

SEQ ID NO: 218339 - DNA, 25 bp, Mus musculus
agtgtcctttaaatagcatctcaga

SEQ ID NO: 218340 - DNA, 25 bp, Mus musculus
agtgtcctttaattagcatctcaga

SEQ ID NO: 218341 - DNA, 25 bp, Mus musculus
agtgtcctttagctgcctttgtttt

SEQ ID NO: 218342 - DNA, 25 bp, Mus musculus
agtgtcctttagctgtggaccaaag

SEQ ID NO: 218343 - DNA, 25 bp, Mus musculus
agtgtcctttaggtgcctttgtttt

SEQ ID NO: 218344 - DNA, 25 bp, Mus musculus
agtgtcctttaggtgtggaccaaag

SEQ ID NO: 218345 - DNA, 25 bp, Mus musculus
agtgtcgactctcttctttgaaagc

SEQ ID NO: 218346 - DNA, 25 bp, Mus musculus
agtgtcgactctgttctttgaaagc

SEQ ID NO: 218347 - DNA, 25 bp, Mus musculus
agtgtcgatgatcacggccaacgtg

SEQ ID NO: 218348 - DNA, 25 bp, Mus musculus
agtgtcgatgatgacggccaacgtg

SEQ ID NO: 218349 - DNA, 25 bp, Mus musculus
agtgtcgatgtcagctttttcttac

SEQ ID NO: 218350 - DNA, 25 bp, Mus musculus
agtgtcgatgtctgctttttcttac

SEQ ID NO: 218351 - DNA, 25 bp, Mus musculus
agtgtcggcgagagggcttcagcca

SEQ ID NO: 218352 - DNA, 25 bp, Mus musculus
agtgtcggcgagtgggcttcagcca

SEQ ID NO: 218353 - DNA, 25 bp, Mus musculus
agtgtcgggcccagaaagctgaatc

SEQ ID NO: 218354 - DNA, 25 bp, Mus musculus
agtgtcgggccctgaaagctgaatc

SEQ ID NO: 218355 - DNA, 25 bp, Mus musculus
agtgtcggtgtccttgctgcctttt

SEQ ID NO: 218356 - DNA, 25 bp, Mus musculus
agtgtcggtgtcgttgctgcctttt

SEQ ID NO: 218357 - DNA, 25 bp, Mus musculus
agtgtcgtttgtagatttcttccca

SEQ ID NO: 218358 - DNA, 25 bp, Mus musculus
agtgtcgtttgttgatttcttccca

SEQ ID NO: 218359 - DNA, 25 bp, Mus musculus
agtgtctaacatattgcctcctctt

SEQ ID NO: 218360 - DNA, 25 bp, Mus musculus
agtgtctaacattttgcctcctctt

SEQ ID NO: 218361 - DNA, 25 bp, Mus musculus
agtgtctacaacactgtcccctgag

SEQ ID NO: 218362 - DNA, 25 bp, Mus musculus
agtgtctacaactctgtcccctgag

SEQ ID NO: 218363 - DNA, 25 bp, Mus musculus
agtgtctaccacaggatctcattac

SEQ ID NO: 218364 - DNA, 25 bp, Mus musculus
agtgtctaccactggatctcattac

SEQ ID NO: 218365 - DNA, 25 bp, Mus musculus
agtgtctactctatcgccgaagtca

SEQ ID NO: 218366 - DNA, 25 bp, Mus musculus
agtgtctactctttcgccgaagtca

SEQ ID NO: 218367 - DNA, 25 bp, Mus musculus
agtgtctagactactggtcagccat

SEQ ID NO: 218368 - DNA, 25 bp, Mus musculus
agtgtctagacttctggtcagccat

SEQ ID NO: 218369 - DNA, 25 bp, Mus musculus
agtgtctagcagattatcctggctg

SEQ ID NO: 218370 - DNA, 25 bp, Mus musculus
agtgtctagcagtttatcctggctg

SEQ ID NO: 218371 - DNA, 25 bp, Mus musculus
agtgtctaggcaaaagctttctttc

SEQ ID NO: 218372 - DNA, 25 bp, Mus musculus
agtgtctaggcataagctttctttc

SEQ ID NO: 218373 - DNA, 25 bp, Mus musculus
agtgtctagtctactgcctccctgg

SEQ ID NO: 218374 - DNA, 25 bp, Mus musculus
agtgtctagtcttctgcctccctgg

SEQ ID NO: 218375 - DNA, 25 bp, Mus musculus
agtgtctatgtccttgccaacgagc

SEQ ID NO: 218376 - DNA, 25 bp, Mus musculus
agtgtctatgtcgttgccaacgagc

SEQ ID NO: 218377 - DNA, 25 bp, Mus musculus
agtgtctatgtgaagtccccagtgt

SEQ ID NO: 218378 - DNA, 25 bp, Mus musculus
agtgtctatgtgtagtccccagtgt

SEQ ID NO: 218379 - DNA, 25 bp, Mus musculus
agtgtctcaaaaaggctatggtcca

SEQ ID NO: 218380 - DNA, 25 bp, Mus musculus
agtgtctcaaaatggctatggtcca

SEQ ID NO: 218381 - DNA, 25 bp, Mus musculus
agtgtctcacaacggcactggctaa

SEQ ID NO: 218382 - DNA, 25 bp, Mus musculus
agtgtctcacaagggcactggctaa

SEQ ID NO: 218383 - DNA, 25 bp, Mus musculus
agtgtctcacacaggagtagaagtt

SEQ ID NO: 218384 - DNA, 25 bp, Mus musculus
agtgtctcacactggagtagaagtt

SEQ ID NO: 218385 - DNA, 25 bp, Mus musculus
agtgtctcagacatgatagatgcac

SEQ ID NO: 218386 - DNA, 25 bp, Mus musculus
agtgtctcagacttgatagatgcac

SEQ ID NO: 218387 - DNA, 25 bp, Mus musculus
agtgtctcagccacggagtcaataa

SEQ ID NO: 218388 - DNA, 25 bp, Mus musculus
agtgtctcagcctcggagtcaataa

SEQ ID NO: 218389 - DNA, 25 bp, Mus musculus
agtgtctcaggtcatccctcacact

SEQ ID NO: 218390 - DNA, 25 bp, Mus musculus
agtgtctcaggtgatccctcacact

SEQ ID NO: 218391 - DNA, 25 bp, Mus musculus
agtgtctcattcctagcactgaaaa

SEQ ID NO: 218392 - DNA, 25 bp, Mus musculus
agtgtctcattcgtagcactgaaaa

SEQ ID NO: 218393 - DNA, 25 bp, Mus musculus
agtgtctccagtatcaatagcgcca

SEQ ID NO: 218394 - DNA, 25 bp, Mus musculus
agtgtctccagtttcaatagcgcca

SEQ ID NO: 218395 - DNA, 25 bp, Mus musculus
agtgtctccattatctaaagcacaa

SEQ ID NO: 218396 - DNA, 25 bp, Mus musculus
agtgtctccattttctaaagcacaa

SEQ ID NO: 218397 - DNA, 25 bp, Mus musculus
agtgtctcccacagtgccaggtgga

SEQ ID NO: 218398 - DNA, 25 bp, Mus musculus
agtgtctcccactgtgccaggtgga

SEQ ID NO: 218399 - DNA, 25 bp, Mus musculus
agtgtctcccagaagtgtctgtctt

SEQ ID NO: 218400 - DNA, 25 bp, Mus musculus
agtgtctcccagtagtgtctgtctt

SEQ ID NO: 218401 - DNA, 25 bp, Mus musculus
agtgtctccctgaaactttgctaac

SEQ ID NO: 218402 - DNA, 25 bp, Mus musculus
agtgtctccctgtaactttgctaac

SEQ ID NO: 218403 - DNA, 25 bp, Mus musculus
agtgtctcctaacattcctaacatg

SEQ ID NO: 218404 - DNA, 25 bp, Mus musculus
agtgtctcctaagattcctaacatg

SEQ ID NO: 218405 - DNA, 25 bp, Mus musculus
agtgtctcctgaaactgcctctgtg

SEQ ID NO: 218406 - DNA, 25 bp, Mus musculus
agtgtctcctgatactgcctctgtg

SEQ ID NO: 218407 - DNA, 25 bp, Mus musculus
agtgtctcctgccagtagtgctgag

SEQ ID NO: 218408 - DNA, 25 bp, Mus musculus
agtgtctcctgcgagtagtgctgag

SEQ ID NO: 218409 - DNA, 25 bp, Mus musculus
agtgtctcgaataccttgtacaacg

SEQ ID NO: 218410 - DNA, 25 bp, Mus musculus
agtgtctcgaattccttgtacaacg

SEQ ID NO: 218411 - DNA, 25 bp, Mus musculus
agtgtctcgccaacagctgggatca

SEQ ID NO: 218412 - DNA, 25 bp, Mus musculus
agtgtctcgccatcagctgggatca

SEQ ID NO: 218413 - DNA, 25 bp, Mus musculus
agtgtctcgggtagcttgtacttta

SEQ ID NO: 218414 - DNA, 25 bp, Mus musculus
agtgtctcgggttgcttgtacttta

SEQ ID NO: 218415 - DNA, 25 bp, Mus musculus
agtgtctctgttccctatactcact

SEQ ID NO: 218416 - DNA, 25 bp, Mus musculus
agtgtctctgttgcctatactcact

SEQ ID NO: 218417 - DNA, 25 bp, Mus musculus
agtgtctcttcacctcttaaaggaa

SEQ ID NO: 218418 - DNA, 25 bp, Mus musculus
agtgtctcttcagctcttaaaggaa

SEQ ID NO: 218419 - DNA, 25 bp, Mus musculus
agtgtctcttccaagcatgcggtac

SEQ ID NO: 218420 - DNA, 25 bp, Mus musculus
agtgtctcttcctagcatgcggtac

SEQ ID NO: 218421 - DNA, 25 bp, Mus musculus
agtgtctcttgcacctgtgaaagga

SEQ ID NO: 218422 - DNA, 25 bp, Mus musculus
agtgtctcttgctcctgtgaaagga

SEQ ID NO: 218423 - DNA, 25 bp, Mus musculus
agtgtctctttcattgtggccatcc

SEQ ID NO: 218424 - DNA, 25 bp, Mus musculus
agtgtctctttctttgtggccatcc

SEQ ID NO: 218425 - DNA, 25 bp, Mus musculus
agtgtctgaaatatctgggcccttt

SEQ ID NO: 218426 - DNA, 25 bp, Mus musculus
agtgtctgaaatttctgggcccttt

SEQ ID NO: 218427 - DNA, 25 bp, Mus musculus
agtgtctgaacaagatgcctcccgg

SEQ ID NO: 218428 - DNA, 25 bp, Mus musculus
agtgtctgaacatgatgcctcccgg

SEQ ID NO: 218429 - DNA, 25 bp, Mus musculus
agtgtctgatccagcagcacgagca

SEQ ID NO: 218430 - DNA, 25 bp, Mus musculus
agtgtctgatcctgcagcacgagca

SEQ ID NO: 218431 - DNA, 25 bp, Mus musculus
agtgtctgcactacactcccaaaga

SEQ ID NO: 218432 - DNA, 25 bp, Mus musculus
agtgtctgcactcgaatgttcgaaa

SEQ ID NO: 218433 - DNA, 25 bp, Mus musculus
agtgtctgcactggaatgttcgaaa

SEQ ID NO: 218434 - DNA, 25 bp, Mus musculus
agtgtctgcacttcactcccaaaga

SEQ ID NO: 218435 - DNA, 25 bp, Mus musculus
agtgtctgcattctggtatctgatg

SEQ ID NO: 218436 - DNA, 25 bp, Mus musculus
agtgtctgcattgtggtatctgatg

SEQ ID NO: 218437 - DNA, 25 bp, Mus musculus
agtgtctgccatagtttgtaccagg

SEQ ID NO: 218438 - DNA, 25 bp, Mus musculus
agtgtctgccattgtttgtaccagg

SEQ ID NO: 218439 - DNA, 25 bp, Mus musculus
agtgtctgccctctgcttaacccag

SEQ ID NO: 218440 - DNA, 25 bp, Mus musculus
agtgtctgccctgtgcttaacccag

SEQ ID NO: 218441 - DNA, 25 bp, Mus musculus
agtgtctggagaccctcctgaaagt

SEQ ID NO: 218442 - DNA, 25 bp, Mus musculus
agtgtctggagagcctcctgaaagt

SEQ ID NO: 218443 - DNA, 25 bp, Mus musculus
agtgtctggagcacctaccgaaaga

SEQ ID NO: 218444 - DNA, 25 bp, Mus musculus
agtgtctggagctcctaccgaaaga

SEQ ID NO: 218445 - DNA, 25 bp, Mus musculus
agtgtctggctcagtggacatggaa

SEQ ID NO: 218446 - DNA, 25 bp, Mus musculus
agtgtctggctctgtggacatggaa

SEQ ID NO: 218447 - DNA, 25 bp, Mus musculus
agtgtctggcttatgccacacagca

SEQ ID NO: 218448 - DNA, 25 bp, Mus musculus
agtgtctggcttttgccacacagca

SEQ ID NO: 218449 - DNA, 25 bp, Mus musculus
agtgtctgggttaggaatcttcagg

SEQ ID NO: 218450 - DNA, 25 bp, Mus musculus
agtgtctgggttatctgttgttcat

SEQ ID NO: 218451 - DNA, 25 bp, Mus musculus
agtgtctgggtttggaatcttcagg

SEQ ID NO: 218452 - DNA, 25 bp, Mus musculus
agtgtctgggttttctgttgttcat

SEQ ID NO: 218453 - DNA, 25 bp, Mus musculus
agtgtctgtaccacagctgggtcct

SEQ ID NO: 218454 - DNA, 25 bp, Mus musculus
agtgtctgtacctcagctgggtcct

SEQ ID NO: 218455 - DNA, 25 bp, Mus musculus
agtgtctgtcacatgctggtttctt

SEQ ID NO: 218456 - DNA, 25 bp, Mus musculus
agtgtctgtcacttgctggtttctt

SEQ ID NO: 218457 - DNA, 25 bp, Mus musculus
agtgtctgtcagaaaagccaagctc

SEQ ID NO: 218458 - DNA, 25 bp, Mus musculus
agtgtctgtcagtaaagccaagctc

SEQ ID NO: 218459 - DNA, 25 bp, Mus musculus
agtgtctgtccaagcatgcacacat

SEQ ID NO: 218460 - DNA, 25 bp, Mus musculus
agtgtctgtccatgcatgcacacat

SEQ ID NO: 218461 - DNA, 25 bp, Mus musculus
agtgtctgtcgaagaacctgcctga

SEQ ID NO: 218462 - DNA, 25 bp, Mus musculus
agtgtctgtcgatgaacctgcctga

SEQ ID NO: 218463 - DNA, 25 bp, Mus musculus
agtgtctgtctaacatacctctgtc

SEQ ID NO: 218464 - DNA, 25 bp, Mus musculus
agtgtctgtctatcatacctctgtc

SEQ ID NO: 218465 - DNA, 25 bp, Mus musculus
agtgtctgtctccacgctgctttac

SEQ ID NO: 218466 - DNA, 25 bp, Mus musculus
agtgtctgtctcgacgctgctttac

SEQ ID NO: 218467 - DNA, 25 bp, Mus musculus
agtgtctgtcttaagttgtcttgtc

SEQ ID NO: 218468 - DNA, 25 bp, Mus musculus
agtgtctgtctttagttgtcttgtc

SEQ ID NO: 218469 - DNA, 25 bp, Mus musculus
agtgtctgttcacgcccactgaaga

SEQ ID NO: 218470 - DNA, 25 bp, Mus musculus
agtgtctgttcaggcccactgaaga

SEQ ID NO: 218471 - DNA, 25 bp, Mus musculus
agtgtctgttgcataattgttaatt

SEQ ID NO: 218472 - DNA, 25 bp, Mus musculus
agtgtctgttgcttaattgttaatt

SEQ ID NO: 218473 - DNA, 25 bp, Mus musculus
agtgtcttacttacacaggccttgt

SEQ ID NO: 218474 - DNA, 25 bp, Mus musculus
agtgtcttactttcacaggccttgt

SEQ ID NO: 218475 - DNA, 25 bp, Mus musculus
agtgtcttaggcctttcccttccat

SEQ ID NO: 218476 - DNA, 25 bp, Mus musculus
agtgtcttaggcgtttcccttccat

SEQ ID NO: 218477 - DNA, 25 bp, Mus musculus
agtgtcttattcattgttcccatac

SEQ ID NO: 218478 - DNA, 25 bp, Mus musculus
agtgtcttattctttgttcccatac

SEQ ID NO: 218479 - DNA, 25 bp, Mus musculus
agtgtcttatttagctttctattgc

SEQ ID NO: 218480 - DNA, 25 bp, Mus musculus
agtgtcttattttgctttctattgc

SEQ ID NO: 218481 - DNA, 25 bp, Mus musculus
agtgtcttcacaagtagcccagggc

SEQ ID NO: 218482 - DNA, 25 bp, Mus musculus
agtgtcttcacatgtagcccagggc

SEQ ID NO: 218483 - DNA, 25 bp, Mus musculus
agtgtcttcactagagcccttaaaa

SEQ ID NO: 218484 - DNA, 25 bp, Mus musculus
agtgtcttcacttgagcccttaaaa

SEQ ID NO: 218485 - DNA, 25 bp, Mus musculus
agtgtcttcctgactatagtgcata

SEQ ID NO: 218486 - DNA, 25 bp, Mus musculus
agtgtcttcctgtctatagtgcata

SEQ ID NO: 218487 - DNA, 25 bp, Mus musculus
agtgtcttctacaaatgagtttata

SEQ ID NO: 218488 - DNA, 25 bp, Mus musculus
agtgtcttctactaatgagtttata

SEQ ID NO: 218489 - DNA, 25 bp, Mus musculus
agtgtcttctttaatgtattctgag

SEQ ID NO: 218490 - DNA, 25 bp, Mus musculus
agtgtcttcttttatgtattctgag

SEQ ID NO: 218491 - DNA, 25 bp, Mus musculus
agtgtcttgctgaggctaccctcat

SEQ ID NO: 218492 - DNA, 25 bp, Mus musculus
agtgtcttgctgtggctaccctcat

SEQ ID NO: 218493 - DNA, 25 bp, Mus musculus
agtgtctttaacatctcgtctttct

SEQ ID NO: 218494 - DNA, 25 bp, Mus musculus
agtgtctttaacttctcgtctttct

SEQ ID NO: 218495 - DNA, 25 bp, Mus musculus
agtgtctttcctcctcaagatcctg

SEQ ID NO: 218496 - DNA, 25 bp, Mus musculus
agtgtctttcctgctcaagatcctg

SEQ ID NO: 218497 - DNA, 25 bp, Mus musculus
agtgtctttctcagatggccgcata

SEQ ID NO: 218498 - DNA, 25 bp, Mus musculus
agtgtctttctctgatggccgcata

SEQ ID NO: 218499 - DNA, 25 bp, Mus musculus
agtgtctttgacaagcacagctggt

SEQ ID NO: 218500 - DNA, 25 bp, Mus musculus
agtgtctttgacaatccgtttgtga

SEQ ID NO: 218501 - DNA, 25 bp, Mus musculus
agtgtctttgactagcacagctggt

SEQ ID NO: 218502 - DNA, 25 bp, Mus musculus
agtgtctttgactatccgtttgtga

SEQ ID NO: 218503 - DNA, 25 bp, Mus musculus
agtgtctttgttcccttcagaaatc

SEQ ID NO: 218504 - DNA, 25 bp, Mus musculus
agtgtctttgttgccttcagaaatc

SEQ ID NO: 218505 - DNA, 25 bp, Mus musculus
agtgtcttttccctttgactgaaca

SEQ ID NO: 218506 - DNA, 25 bp, Mus musculus
agtgtcttttccgtttgactgaaca

SEQ ID NO: 218507 - DNA, 25 bp, Mus musculus
agtgtctttttcatgtgttctccct

SEQ ID NO: 218508 - DNA, 25 bp, Mus musculus
agtgtctttttcttgtgttctccct

SEQ ID NO: 218509 - DNA, 25 bp, Mus musculus
agtgtgaaaaatatacctccatgta

SEQ ID NO: 218510 - DNA, 25 bp, Mus musculus
agtgtgaaaaatttacctccatgta

SEQ ID NO: 218511 - DNA, 25 bp, Mus musculus
agtgtgaaactgcacgccacggtca

SEQ ID NO: 218512 - DNA, 25 bp, Mus musculus
agtgtgaaactggacgccacggtca

SEQ ID NO: 218513 - DNA, 25 bp, Mus musculus
agtgtgaaagccaccttcccttcag

SEQ ID NO: 218514 - DNA, 25 bp, Mus musculus
agtgtgaaagcctccttcccttcag

SEQ ID NO: 218515 - DNA, 25 bp, Mus musculus
agtgtgaaaggcctcggctccttgc

SEQ ID NO: 218516 - DNA, 25 bp, Mus musculus
agtgtgaaaggcgtcggctccttgc

SEQ ID NO: 218517 - DNA, 25 bp, Mus musculus
agtgtgaacgcactgggtagacccc

SEQ ID NO: 218518 - DNA, 25 bp, Mus musculus
agtgtgaacgcagtgggtagacccc

SEQ ID NO: 218519 - DNA, 25 bp, Mus musculus
agtgtgaactaccttcagcatgctg

SEQ ID NO: 218520 - DNA, 25 bp, Mus musculus
agtgtgaactacgttcagcatgctg

SEQ ID NO: 218521 - DNA, 25 bp, Mus musculus
agtgtgaacttactgaactctaggg

SEQ ID NO: 218522 - DNA, 25 bp, Mus musculus
agtgtgaacttagtgaactctaggg

SEQ ID NO: 218523 - DNA, 25 bp, Mus musculus
agtgtgaagaatagccctaccctgc

SEQ ID NO: 218524 - DNA, 25 bp, Mus musculus
agtgtgaagaattgccctaccctgc

SEQ ID NO: 218525 - DNA, 25 bp, Mus musculus
agtgtgaagaccagagcttggattc

SEQ ID NO: 218526 - DNA, 25 bp, Mus musculus
agtgtgaagacctgagcttggattc

SEQ ID NO: 218527 - DNA, 25 bp, Mus musculus
agtgtgaagtgccaggatcctttgc

SEQ ID NO: 218528 - DNA, 25 bp, Mus musculus
agtgtgaagtgcgaggatcctttgc

SEQ ID NO: 218529 - DNA, 25 bp, Mus musculus
agtgtgaatcataatacctaacctt

SEQ ID NO: 218530 - DNA, 25 bp, Mus musculus
agtgtgaatcattatacctaacctt

SEQ ID NO: 218531 - DNA, 25 bp, Mus musculus
agtgtgaatgccacggctacccctt

SEQ ID NO: 218532 - DNA, 25 bp, Mus musculus
agtgtgaatgccattcccctagtga

SEQ ID NO: 218533 - DNA, 25 bp, Mus musculus
agtgtgaatgcctcggctacccctt

SEQ ID NO: 218534 - DNA, 25 bp, Mus musculus
agtgtgaatgcctttcccctagtga

SEQ ID NO: 218535 - DNA, 25 bp, Mus musculus
agtgtgacaaagagagcagcccagg

SEQ ID NO: 218536 - DNA, 25 bp, Mus musculus
agtgtgacaaagtgagcagcccagg

SEQ ID NO: 218537 - DNA, 25 bp, Mus musculus
agtgtgacacacagtatacaattta

SEQ ID NO: 218538 - DNA, 25 bp, Mus musculus
agtgtgacacactgtatacaattta

SEQ ID NO: 218539 - DNA, 25 bp, Mus musculus
agtgtgacagccatgatgtttgggt

SEQ ID NO: 218540 - DNA, 25 bp, Mus musculus
agtgtgacagccttgatgtttgggt

SEQ ID NO: 218541 - DNA, 25 bp, Mus musculus
agtgtgacatccagcccagggtagg

SEQ ID NO: 218542 - DNA, 25 bp, Mus musculus
agtgtgacatcctgcccagggtagg

SEQ ID NO: 218543 - DNA, 25 bp, Mus musculus
agtgtgaccaccaagaccttgtacc

SEQ ID NO: 218544 - DNA, 25 bp, Mus musculus
agtgtgaccacctagaccttgtacc

SEQ ID NO: 218545 - DNA, 25 bp, Mus musculus
agtgtgaccagtaaccagccaaccc

SEQ ID NO: 218546 - DNA, 25 bp, Mus musculus
agtgtgaccagttaccagccaaccc

SEQ ID NO: 218547 - DNA, 25 bp, Mus musculus
agtgtgacccagaaaggctacccaa

SEQ ID NO: 218548 - DNA, 25 bp, Mus musculus
agtgtgacccagtaaggctacccaa

SEQ ID NO: 218549 - DNA, 25 bp, Mus musculus
agtgtgaccctcctaaccagaatta

SEQ ID NO: 218550 - DNA, 25 bp, Mus musculus
agtgtgaccctcgtaaccagaatta

SEQ ID NO: 218551 - DNA, 25 bp, Mus musculus
agtgtgaccctgatcagtggcagta

SEQ ID NO: 218552 - DNA, 25 bp, Mus musculus
agtgtgaccctgatgtgaactccat

SEQ ID NO: 218553 - DNA, 25 bp, Mus musculus
agtgtgaccctgttcagtggcagta

SEQ ID NO: 218554 - DNA, 25 bp, Mus musculus
agtgtgaccctgttgtgaactccat

SEQ ID NO: 218555 - DNA, 25 bp, Mus musculus
agtgtgacctgtactcctcagtgga

SEQ ID NO: 218556 - DNA, 25 bp, Mus musculus
agtgtgacctgtcgtgtcgtaccct

SEQ ID NO: 218557 - DNA, 25 bp, Mus musculus
agtgtgacctgtggtgtcgtaccct

SEQ ID NO: 218558 - DNA, 25 bp, Mus musculus
agtgtgacctgttctcctcagtgga

SEQ ID NO: 218559 - DNA, 25 bp, Mus musculus
agtgtgacctttagacctggtattc

SEQ ID NO: 218560 - DNA, 25 bp, Mus musculus
agtgtgaccttttgacctggtattc

SEQ ID NO: 218561 - DNA, 25 bp, Mus musculus
agtgtgacgggcatcctttgtccac

SEQ ID NO: 218562 - DNA, 25 bp, Mus musculus
agtgtgacgggcttcctttgtccac

SEQ ID NO: 218563 - DNA, 25 bp, Mus musculus
agtgtgacgtctcctttgtggaacc

SEQ ID NO: 218564 - DNA, 25 bp, Mus musculus
agtgtgacgtctgctttgtggaacc

SEQ ID NO: 218565 - DNA, 25 bp, Mus musculus
agtgtgactccaattctactccaac

SEQ ID NO: 218566 - DNA, 25 bp, Mus musculus
agtgtgactccatttctactccaac

SEQ ID NO: 218567 - DNA, 25 bp, Mus musculus
agtgtgactcctagaggctcttagc

SEQ ID NO: 218568 - DNA, 25 bp, Mus musculus
agtgtgactccttgaggctcttagc

SEQ ID NO: 218569 - DNA, 25 bp, Mus musculus
agtgtgactgaacgaccttgcccat

SEQ ID NO: 218570 - DNA, 25 bp, Mus musculus
agtgtgactgaaggaccttgcccat

SEQ ID NO: 218571 - DNA, 25 bp, Mus musculus
agtgtgactggcacaacagctacca

SEQ ID NO: 218572 - DNA, 25 bp, Mus musculus
agtgtgactggctcaacagctacca

SEQ ID NO: 218573 - DNA, 25 bp, Mus musculus
agtgtgacttacaacttaagcagct

SEQ ID NO: 218574 - DNA, 25 bp, Mus musculus
agtgtgacttactacttaagcagct

SEQ ID NO: 218575 - DNA, 25 bp, Mus musculus
agtgtgacttatctggcaaagcctt

SEQ ID NO: 218576 - DNA, 25 bp, Mus musculus
agtgtgacttatgtggcaaagcctt

SEQ ID NO: 218577 - DNA, 25 bp, Mus musculus
agtgtgacttcacccttcatgtccc

SEQ ID NO: 218578 - DNA, 25 bp, Mus musculus
agtgtgacttcagccttcatgtccc

SEQ ID NO: 218579 - DNA, 25 bp, Mus musculus
agtgtgactttgaaagcctcccttc

SEQ ID NO: 218580 - DNA, 25 bp, Mus musculus
agtgtgactttgtaagcctcccttc

SEQ ID NO: 218581 - DNA, 25 bp, Mus musculus
agtgtgagaatccaaactctttaca

SEQ ID NO: 218582 - DNA, 25 bp, Mus musculus
agtgtgagaatcgaaactctttaca

SEQ ID NO: 218583 - DNA, 25 bp, Mus musculus
agtgtgagagtgaagtacagcagct

SEQ ID NO: 218584 - DNA, 25 bp, Mus musculus
agtgtgagagtgtagtacagcagct

SEQ ID NO: 218585 - DNA, 25 bp, Mus musculus
agtgtgagcagtccttttgcttgga

SEQ ID NO: 218586 - DNA, 25 bp, Mus musculus
agtgtgagcagtgcttttgcttgga

SEQ ID NO: 218587 - DNA, 25 bp, Mus musculus
agtgtgagccacacaggcagatgtg

SEQ ID NO: 218588 - DNA, 25 bp, Mus musculus
agtgtgagccactcaggcagatgtg

SEQ ID NO: 218589 - DNA, 25 bp, Mus musculus
agtgtgagctatccggagcttgcct

SEQ ID NO: 218590 - DNA, 25 bp, Mus musculus
agtgtgagctatgcggagcttgcct

SEQ ID NO: 218591 - DNA, 25 bp, Mus musculus
agtgtgagctggattaaactctttc

SEQ ID NO: 218592 - DNA, 25 bp, Mus musculus
agtgtgagctggtttaaactctttc

SEQ ID NO: 218593 - DNA, 25 bp, Mus musculus
agtgtgagggagatctgtagatatc

SEQ ID NO: 218594 - DNA, 25 bp, Mus musculus
agtgtgagggagttctgtagatatc

SEQ ID NO: 218595 - DNA, 25 bp, Mus musculus
agtgtgaggtagaatctctcctgtg

SEQ ID NO: 218596 - DNA, 25 bp, Mus musculus
agtgtgaggtagtatctctcctgtg

SEQ ID NO: 218597 - DNA, 25 bp, Mus musculus
agtgtgagtactccaccaaccgggc

SEQ ID NO: 218598 - DNA, 25 bp, Mus musculus
agtgtgagtactgcaccaaccgggc

SEQ ID NO: 218599 - DNA, 25 bp, Mus musculus
agtgtgataacactggccacccttc

SEQ ID NO: 218600 - DNA, 25 bp, Mus musculus
agtgtgataacagtggccacccttc

SEQ ID NO: 218601 - DNA, 25 bp, Mus musculus
agtgtgatactcaatactcatgtga

SEQ ID NO: 218602 - DNA, 25 bp, Mus musculus
agtgtgatactctatactcatgtga

SEQ ID NO: 218603 - DNA, 25 bp, Mus musculus
agtgtgatatataactcccttccct

SEQ ID NO: 218604 - DNA, 25 bp, Mus musculus
agtgtgatatattactcccttccct

SEQ ID NO: 218605 - DNA, 25 bp, Mus musculus
agtgtgatcactatctaggttccta

SEQ ID NO: 218606 - DNA, 25 bp, Mus musculus
agtgtgatcactttctaggttccta

SEQ ID NO: 218607 - DNA, 25 bp, Mus musculus
agtgtgatccccaccaggcctttag

SEQ ID NO: 218608 - DNA, 25 bp, Mus musculus
agtgtgatcccctccaggcctttag

SEQ ID NO: 218609 - DNA, 25 bp, Mus musculus
agtgtgatccttctggcgcaatgtt

SEQ ID NO: 218610 - DNA, 25 bp, Mus musculus
agtgtgatccttgtggcgcaatgtt

SEQ ID NO: 218611 - DNA, 25 bp, Mus musculus
agtgtgatctacatggccatcatca

SEQ ID NO: 218612 - DNA, 25 bp, Mus musculus
agtgtgatctacttggccatcatca

SEQ ID NO: 218613 - DNA, 25 bp, Mus musculus
agtgtgatctatctgctggcagcca

SEQ ID NO: 218614 - DNA, 25 bp, Mus musculus
agtgtgatctatgtgctggcagcca

SEQ ID NO: 218615 - DNA, 25 bp, Mus musculus
agtgtgatgcagcttcactttacaa

SEQ ID NO: 218616 - DNA, 25 bp, Mus musculus
agtgtgatgcaggttcactttacaa

SEQ ID NO: 218617 - DNA, 25 bp, Mus musculus
agtgtgatgctccagatagcggcca

SEQ ID NO: 218618 - DNA, 25 bp, Mus musculus
agtgtgatgctcgagatagcggcca

SEQ ID NO: 218619 - DNA, 25 bp, Mus musculus
agtgtgatggtaccacagcccatta

SEQ ID NO: 218620 - DNA, 25 bp, Mus musculus
agtgtgatggtagcacagcccatta

SEQ ID NO: 218621 - DNA, 25 bp, Mus musculus
agtgtgatgtgtagcggttcgaaat

SEQ ID NO: 218622 - DNA, 25 bp, Mus musculus
agtgtgatgtgttgcggttcgaaat

SEQ ID NO: 218623 - DNA, 25 bp, Mus musculus
agtgtgattcatctaccaatggtag

SEQ ID NO: 218624 - DNA, 25 bp, Mus musculus
agtgtgattcatgtaccaatggtag

SEQ ID NO: 218625 - DNA, 25 bp, Mus musculus
agtgtgattcttcttttataaacag

SEQ ID NO: 218626 - DNA, 25 bp, Mus musculus
agtgtgattcttgttttataaacag

SEQ ID NO: 218627 - DNA, 25 bp, Mus musculus
agtgtgattgttcacgcgtctgtcc

SEQ ID NO: 218628 - DNA, 25 bp, Mus musculus
agtgtgattgttgacgcgtctgtcc

SEQ ID NO: 218629 - DNA, 25 bp, Mus musculus
agtgtgatttctccttttgtttccc

SEQ ID NO: 218630 - DNA, 25 bp, Mus musculus
agtgtgatttctgcttttgtttccc

SEQ ID NO: 218631 - DNA, 25 bp, Mus musculus
agtgtgcaaactcatgcacctccga

SEQ ID NO: 218632 - DNA, 25 bp, Mus musculus
agtgtgcaaactgatgcacctccga

SEQ ID NO: 218633 - DNA, 25 bp, Mus musculus
agtgtgcaacccctcagtagctgtg

SEQ ID NO: 218634 - DNA, 25 bp, Mus musculus
agtgtgcaacccgtcagtagctgtg

SEQ ID NO: 218635 - DNA, 25 bp, Mus musculus
agtgtgcaagaaaggctgccaacta

SEQ ID NO: 218636 - DNA, 25 bp, Mus musculus
agtgtgcaagaatggctgccaacta

SEQ ID NO: 218637 - DNA, 25 bp, Mus musculus
agtgtgcaatgcatatccacagaag

SEQ ID NO: 218638 - DNA, 25 bp, Mus musculus
agtgtgcaatgcttatccacagaag

SEQ ID NO: 218639 - DNA, 25 bp, Mus musculus
agtgtgcacaatctgtcctggagtt

SEQ ID NO: 218640 - DNA, 25 bp, Mus musculus
agtgtgcacaatgtgtcctggagtt

SEQ ID NO: 218641 - DNA, 25 bp, Mus musculus
agtgtgcacatacgaccagagtcgt

SEQ ID NO: 218642 - DNA, 25 bp, Mus musculus
agtgtgcacataggaccagagtcgt

SEQ ID NO: 218643 - DNA, 25 bp, Mus musculus
agtgtgcacatgaaccagcttggct

SEQ ID NO: 218644 - DNA, 25 bp, Mus musculus
agtgtgcacatgtaccagcttggct

SEQ ID NO: 218645 - DNA, 25 bp, Mus musculus
agtgtgcaccggacactacattcag

SEQ ID NO: 218646 - DNA, 25 bp, Mus musculus
agtgtgcaccggtcactacattcag

SEQ ID NO: 218647 - DNA, 25 bp, Mus musculus
agtgtgcacgcacgtagccattgct

SEQ ID NO: 218648 - DNA, 25 bp, Mus musculus
agtgtgcacgcaggtagccattgct

SEQ ID NO: 218649 - DNA, 25 bp, Mus musculus
agtgtgcactctatcatcatatgga

SEQ ID NO: 218650 - DNA, 25 bp, Mus musculus
agtgtgcactctttcatcatatgga

SEQ ID NO: 218651 - DNA, 25 bp, Mus musculus
agtgtgcagaacattgctttgagtt

SEQ ID NO: 218652 - DNA, 25 bp, Mus musculus
agtgtgcagaactttgctttgagtt

SEQ ID NO: 218653 - DNA, 25 bp, Mus musculus
agtgtgcagattcctcattccctca

SEQ ID NO: 218654 - DNA, 25 bp, Mus musculus
agtgtgcagattgctcattccctca

SEQ ID NO: 218655 - DNA, 25 bp, Mus musculus
agtgtgcagcagctaacttccatgt

SEQ ID NO: 218656 - DNA, 25 bp, Mus musculus
agtgtgcagcaggtaacttccatgt

SEQ ID NO: 218657 - DNA, 25 bp, Mus musculus
agtgtgcagcttaatcagctcaccc

SEQ ID NO: 218658 - DNA, 25 bp, Mus musculus
agtgtgcagctttatcagctcaccc

SEQ ID NO: 218659 - DNA, 25 bp, Mus musculus
agtgtgcagggactgaatcaattac

SEQ ID NO: 218660 - DNA, 25 bp, Mus musculus
agtgtgcagggagtgaatcaattac

SEQ ID NO: 218661 - DNA, 25 bp, Mus musculus
agtgtgcatctcatagtctcagtcc

SEQ ID NO: 218662 - DNA, 25 bp, Mus musculus
agtgtgcatctcttagtctcagtcc

SEQ ID NO: 218663 - DNA, 25 bp, Mus musculus
agtgtgcatgctcttgtcctaacca

SEQ ID NO: 218664 - DNA, 25 bp, Mus musculus
agtgtgcatgctgttgtcctaacca

SEQ ID NO: 218665 - DNA, 25 bp, Mus musculus
agtgtgcatgttacagtccaggcaa

SEQ ID NO: 218666 - DNA, 25 bp, Mus musculus
agtgtgcatgttcacatcatttttt

SEQ ID NO: 218667 - DNA, 25 bp, Mus musculus
agtgtgcatgttgacatcatttttt

SEQ ID NO: 218668 - DNA, 25 bp, Mus musculus
agtgtgcatgtttcagtccaggcaa

SEQ ID NO: 218669 - DNA, 25 bp, Mus musculus
agtgtgcattgcctatgtttgttta

SEQ ID NO: 218670 - DNA, 25 bp, Mus musculus
agtgtgcattgcgtatgtttgttta

SEQ ID NO: 218671 - DNA, 25 bp, Mus musculus
agtgtgccaccaaagaatcacccta

SEQ ID NO: 218672 - DNA, 25 bp, Mus musculus
agtgtgccaccatagaatcacccta

SEQ ID NO: 218673 - DNA, 25 bp, Mus musculus
agtgtgccagaactgccaagtgtgc

SEQ ID NO: 218674 - DNA, 25 bp, Mus musculus
agtgtgccagaagtgccaagtgtgc

SEQ ID NO: 218675 - DNA, 25 bp, Mus musculus
agtgtgccagagatactagtgccaa

SEQ ID NO: 218676 - DNA, 25 bp, Mus musculus
agtgtgccagagttactagtgccaa

SEQ ID NO: 218677 - DNA, 25 bp, Mus musculus
agtgtgccagcaacccgtacaatgg

SEQ ID NO: 218678 - DNA, 25 bp, Mus musculus
agtgtgccagcatcccgtacaatgg

SEQ ID NO: 218679 - DNA, 25 bp, Mus musculus
agtgtgccagtcacctttgcttggt

SEQ ID NO: 218680 - DNA, 25 bp, Mus musculus
agtgtgccagtctcctttgcttggt

SEQ ID NO: 218681 - DNA, 25 bp, Mus musculus
agtgtgccccgtctaggttgctgcc

SEQ ID NO: 218682 - DNA, 25 bp, Mus musculus
agtgtgccccgtgtaggttgctgcc

SEQ ID NO: 218683 - DNA, 25 bp, Mus musculus
agtgtgcccgagacatcctggttca

SEQ ID NO: 218684 - DNA, 25 bp, Mus musculus
agtgtgcccgagtcatcctggttca

SEQ ID NO: 218685 - DNA, 25 bp, Mus musculus
agtgtgccctagagtgttttccata

SEQ ID NO: 218686 - DNA, 25 bp, Mus musculus
agtgtgccctagtgtgttttccata

SEQ ID NO: 218687 - DNA, 25 bp, Mus musculus
agtgtgccggttaatttcttgcacc

SEQ ID NO: 218688 - DNA, 25 bp, Mus musculus
agtgtgccggtttatttcttgcacc

SEQ ID NO: 218689 - DNA, 25 bp, Mus musculus
agtgtgcctcacagaaggttgacta

SEQ ID NO: 218690 - DNA, 25 bp, Mus musculus
agtgtgcctcactgaaggttgacta

SEQ ID NO: 218691 - DNA, 25 bp, Mus musculus
agtgtgcctcccacaaggaacctta

SEQ ID NO: 218692 - DNA, 25 bp, Mus musculus
agtgtgcctccctcaaggaacctta

SEQ ID NO: 218693 - DNA, 25 bp, Mus musculus
agtgtgcctccgcagcaggtacagc

SEQ ID NO: 218694 - DNA, 25 bp, Mus musculus
agtgtgcctccggagcaggtacagc

SEQ ID NO: 218695 - DNA, 25 bp, Mus musculus
agtgtgcctgccctgatatagatac

SEQ ID NO: 218696 - DNA, 25 bp, Mus musculus
agtgtgcctgccgtgatatagatac

SEQ ID NO: 218697 - DNA, 25 bp, Mus musculus
agtgtgcctgctccggcaagcgttt

SEQ ID NO: 218698 - DNA, 25 bp, Mus musculus
agtgtgcctgctgcggcaagcgttt

SEQ ID NO: 218699 - DNA, 25 bp, Mus musculus
agtgtgcctggaatgtttgctttca

SEQ ID NO: 218700 - DNA, 25 bp, Mus musculus
agtgtgcctggattgtttgctttca

SEQ ID NO: 218701 - DNA, 25 bp, Mus musculus
agtgtgccttgcatgcataaaaagc

SEQ ID NO: 218702 - DNA, 25 bp, Mus musculus
agtgtgccttgcttgcataaaaagc

SEQ ID NO: 218703 - DNA, 25 bp, Mus musculus
agtgtgcgatgcatatccacaagaa

SEQ ID NO: 218704 - DNA, 25 bp, Mus musculus
agtgtgcgatgcttatccacaagaa

SEQ ID NO: 218705 - DNA, 25 bp, Mus musculus
agtgtgctactgatggttgaactat

SEQ ID NO: 218706 - DNA, 25 bp, Mus musculus
agtgtgctactgttggttgaactat

SEQ ID NO: 218707 - DNA, 25 bp, Mus musculus
agtgtgctagccctgaataatctca

SEQ ID NO: 218708 - DNA, 25 bp, Mus musculus
agtgtgctagccgtgaataatctca

SEQ ID NO: 218709 - DNA, 25 bp, Mus musculus
agtgtgctatagagtctggccaaca

SEQ ID NO: 218710 - DNA, 25 bp, Mus musculus
agtgtgctatagtgtctggccaaca

SEQ ID NO: 218711 - DNA, 25 bp, Mus musculus
agtgtgctatgaccaatgcccacct

SEQ ID NO: 218712 - DNA, 25 bp, Mus musculus
agtgtgctatgagcaatgcccacct

SEQ ID NO: 218713 - DNA, 25 bp, Mus musculus
agtgtgctcacaagacctagttgaa

SEQ ID NO: 218714 - DNA, 25 bp, Mus musculus
agtgtgctcacatgacctagttgaa

SEQ ID NO: 218715 - DNA, 25 bp, Mus musculus
agtgtgctcagaagtgtcctgcagc

SEQ ID NO: 218716 - DNA, 25 bp, Mus musculus
agtgtgctcagatgtgtcctgcagc

SEQ ID NO: 218717 - DNA, 25 bp, Mus musculus
agtgtgctcctcaaagcagcatgga

SEQ ID NO: 218718 - DNA, 25 bp, Mus musculus
agtgtgctcctctaagcagcatgga

SEQ ID NO: 218719 - DNA, 25 bp, Mus musculus
agtgtgctcttcagtgcctacaaac

SEQ ID NO: 218720 - DNA, 25 bp, Mus musculus
agtgtgctcttctgtgcctacaaac

SEQ ID NO: 218721 - DNA, 25 bp, Mus musculus
agtgtgctcttgaatcgtcggcggc

SEQ ID NO: 218722 - DNA, 25 bp, Mus musculus
agtgtgctcttgtatcgtcggcggc

SEQ ID NO: 218723 - DNA, 25 bp, Mus musculus
agtgtgctgcagagtcgcccaggca

SEQ ID NO: 218724 - DNA, 25 bp, Mus musculus
agtgtgctgcagtgtcgcccaggca

SEQ ID NO: 218725 - DNA, 25 bp, Mus musculus
agtgtgctgcctatgagagctgcta

SEQ ID NO: 218726 - DNA, 25 bp, Mus musculus
agtgtgctgcctttgagagctgcta

SEQ ID NO: 218727 - DNA, 25 bp, Mus musculus
agtgtgctgcttaattctgtctgac

SEQ ID NO: 218728 - DNA, 25 bp, Mus musculus
agtgtgctgctttattctgtctgac

SEQ ID NO: 218729 - DNA, 25 bp, Mus musculus
agtgtgctggacagctagagcaact

SEQ ID NO: 218730 - DNA, 25 bp, Mus musculus
agtgtgctggactgctagagcaact

SEQ ID NO: 218731 - DNA, 25 bp, Mus musculus
agtgtgctgggaaactgcttgctcc

SEQ ID NO: 218732 - DNA, 25 bp, Mus musculus
agtgtgctgggatactgcttgctcc

SEQ ID NO: 218733 - DNA, 25 bp, Mus musculus
agtgtgctgtatctgctcattgggc

SEQ ID NO: 218734 - DNA, 25 bp, Mus musculus
agtgtgctgtatgtgctcattgggc

SEQ ID NO: 218735 - DNA, 25 bp, Mus musculus
agtgtgctgtctctgaaaactccta

SEQ ID NO: 218736 - DNA, 25 bp, Mus musculus
agtgtgctgtctgtgaaaactccta

SEQ ID NO: 218737 - DNA, 25 bp, Mus musculus
agtgtgctgtgtatcctttaccctg

SEQ ID NO: 218738 - DNA, 25 bp, Mus musculus
agtgtgctgtgtttcctttaccctg

SEQ ID NO: 218739 - DNA, 25 bp, Mus musculus
agtgtgcttcacaccagtaacaagg

SEQ ID NO: 218740 - DNA, 25 bp, Mus musculus
agtgtgcttcactccagtaacaagg

SEQ ID NO: 218741 - DNA, 25 bp, Mus musculus
agtgtgcttcctccctgtcgattgg

SEQ ID NO: 218742 - DNA, 25 bp, Mus musculus
agtgtgcttcctgcctgtcgattgg

SEQ ID NO: 218743 - DNA, 25 bp, Mus musculus
agtgtgcttcttactcttcgagagc

SEQ ID NO: 218744 - DNA, 25 bp, Mus musculus
agtgtgcttctttctcttcgagagc

SEQ ID NO: 218745 - DNA, 25 bp, Mus musculus
agtgtgcttgctacaaatactgctg

SEQ ID NO: 218746 - DNA, 25 bp, Mus musculus
agtgtgcttgcttcaaatactgctg

SEQ ID NO: 218747 - DNA, 25 bp, Mus musculus
agtgtgcttggtattctttcttctt

SEQ ID NO: 218748 - DNA, 25 bp, Mus musculus
agtgtgcttggttttctttcttctt

SEQ ID NO: 218749 - DNA, 25 bp, Mus musculus
agtgtgctttacactgatcagctgc

SEQ ID NO: 218750 - DNA, 25 bp, Mus musculus
agtgtgctttactctgatcagctgc

SEQ ID NO: 218751 - DNA, 25 bp, Mus musculus
agtgtgctttcccatggcaccaggg

SEQ ID NO: 218752 - DNA, 25 bp, Mus musculus
agtgtgctttccgatggcaccaggg

SEQ ID NO: 218753 - DNA, 25 bp, Mus musculus
agtgtgctttggatcctcttcctgt

SEQ ID NO: 218754 - DNA, 25 bp, Mus musculus
agtgtgctttggttcctcttcctgt

SEQ ID NO: 218755 - DNA, 25 bp, Mus musculus
agtgtgcttttacagttttcgccgc

SEQ ID NO: 218756 - DNA, 25 bp, Mus musculus
agtgtgcttttagagttttcgccgc

SEQ ID NO: 218757 - DNA, 25 bp, Mus musculus
agtgtggaaagtctcttcctggcta

SEQ ID NO: 218758 - DNA, 25 bp, Mus musculus
agtgtggaaagtgtcttcctggcta

SEQ ID NO: 218759 - DNA, 25 bp, Mus musculus
agtgtggaacgtcctccatcctcgg

SEQ ID NO: 218760 - DNA, 25 bp, Mus musculus
agtgtggaacgtgctccatcctcgg

SEQ ID NO: 218761 - DNA, 25 bp, Mus musculus
agtgtggaccctaatatttctaaca

SEQ ID NO: 218762 - DNA, 25 bp, Mus musculus
agtgtggacccttatatttctaaca

SEQ ID NO: 218763 - DNA, 25 bp, Mus musculus
agtgtggacctcagtgatgggacat

SEQ ID NO: 218764 - DNA, 25 bp, Mus musculus
agtgtggacctctgtgatgggacat

SEQ ID NO: 218765 - DNA, 25 bp, Mus musculus
agtgtggactaaaaatggcttcaaa

SEQ ID NO: 218766 - DNA, 25 bp, Mus musculus
agtgtggactaataatggcttcaaa

SEQ ID NO: 218767 - DNA, 25 bp, Mus musculus
agtgtggactccacctgatgatttt

SEQ ID NO: 218768 - DNA, 25 bp, Mus musculus
agtgtggactcctcctgatgatttt

SEQ ID NO: 218769 - DNA, 25 bp, Mus musculus
agtgtggactcgatcatcagacttt

SEQ ID NO: 218770 - DNA, 25 bp, Mus musculus
agtgtggactcgttcatcagacttt

SEQ ID NO: 218771 - DNA, 25 bp, Mus musculus
agtgtggagcagattctcgcctgtc

SEQ ID NO: 218772 - DNA, 25 bp, Mus musculus
agtgtggagcagtttctcgcctgtc

SEQ ID NO: 218773 - DNA, 25 bp, Mus musculus
agtgtggagctcacatctttatgtg

SEQ ID NO: 218774 - DNA, 25 bp, Mus musculus
agtgtggagctctcatctttatgtg

SEQ ID NO: 218775 - DNA, 25 bp, Mus musculus
agtgtggaggtcagtgcccgtaatc

SEQ ID NO: 218776 - DNA, 25 bp, Mus musculus
agtgtggaggtctgtgcccgtaatc

SEQ ID NO: 218777 - DNA, 25 bp, Mus musculus
agtgtggatcacagtcaggacatga

SEQ ID NO: 218778 - DNA, 25 bp, Mus musculus
agtgtggatcactgtcaggacatga

SEQ ID NO: 218779 - DNA, 25 bp, Mus musculus
agtgtggatggcacagagacctaga

SEQ ID NO: 218780 - DNA, 25 bp, Mus musculus
agtgtggatggctcagagacctaga

SEQ ID NO: 218781 - DNA, 25 bp, Mus musculus
agtgtggattccaacgtgggtgtct

SEQ ID NO: 218782 - DNA, 25 bp, Mus musculus
agtgtggattcctacgtgggtgtct

SEQ ID NO: 218783 - DNA, 25 bp, Mus musculus
agtgtggattctcctcaccccatct

SEQ ID NO: 218784 - DNA, 25 bp, Mus musculus
agtgtggattctgctcaccccatct

SEQ ID NO: 218785 - DNA, 25 bp, Mus musculus
agtgtggcacacagatgatagatta

SEQ ID NO: 218786 - DNA, 25 bp, Mus musculus
agtgtggcacactgatgatagatta

SEQ ID NO: 218787 - DNA, 25 bp, Mus musculus
agtgtggcagtgaccatggcactac

SEQ ID NO: 218788 - DNA, 25 bp, Mus musculus
agtgtggcagtgtccatggcactac

SEQ ID NO: 218789 - DNA, 25 bp, Mus musculus
agtgtggcatcaccgcttggtagct

SEQ ID NO: 218790 - DNA, 25 bp, Mus musculus
agtgtggcatcagcgcttggtagct

SEQ ID NO: 218791 - DNA, 25 bp, Mus musculus
agtgtggcatctccctcttgcccag

SEQ ID NO: 218792 - DNA, 25 bp, Mus musculus
agtgtggcatctgcctcttgcccag

SEQ ID NO: 218793 - DNA, 25 bp, Mus musculus
agtgtggccagcaggatccacgcag

SEQ ID NO: 218794 - DNA, 25 bp, Mus musculus
agtgtggccagctggatccacgcag

SEQ ID NO: 218795 - DNA, 25 bp, Mus musculus
agtgtggccatcaatgtggcgtgct

SEQ ID NO: 218796 - DNA, 25 bp, Mus musculus
agtgtggccatctatgtggcgtgct

SEQ ID NO: 218797 - DNA, 25 bp, Mus musculus
agtgtggcccagcagtgatgtccat

SEQ ID NO: 218798 - DNA, 25 bp, Mus musculus
agtgtggcccagctctgtcgccatc

SEQ ID NO: 218799 - DNA, 25 bp, Mus musculus
agtgtggcccaggagtgatgtccat

SEQ ID NO: 218800 - DNA, 25 bp, Mus musculus
agtgtggcccaggtctgtcgccatc

SEQ ID NO: 218801 - DNA, 25 bp, Mus musculus
agtgtggcccttcgctcactctttg

SEQ ID NO: 218802 - DNA, 25 bp, Mus musculus
agtgtggcccttggctcactctttg

SEQ ID NO: 218803 - DNA, 25 bp, Mus musculus
agtgtggccgacacttaccaggact

SEQ ID NO: 218804 - DNA, 25 bp, Mus musculus
agtgtggccgactcttaccaggact

SEQ ID NO: 218805 - DNA, 25 bp, Mus musculus
agtgtggccgccatgtggacatctt

SEQ ID NO: 218806 - DNA, 25 bp, Mus musculus
agtgtggccgccttgtggacatctt

SEQ ID NO: 218807 - DNA, 25 bp, Mus musculus
agtgtggcctctctgcgcccagctg

SEQ ID NO: 218808 - DNA, 25 bp, Mus musculus
agtgtggcctctgtgcgcccagctg

SEQ ID NO: 218809 - DNA, 25 bp, Mus musculus
agtgtggcctgcagtgactcaatga

SEQ ID NO: 218810 - DNA, 25 bp, Mus musculus
agtgtggcctgctgtgactcaatga

SEQ ID NO: 218811 - DNA, 25 bp, Mus musculus
agtgtggcctttccagacacttctg

SEQ ID NO: 218812 - DNA, 25 bp, Mus musculus
agtgtggcctttgcagacacttctg

SEQ ID NO: 218813 - DNA, 25 bp, Mus musculus
agtgtggcgtttacactccagcata

SEQ ID NO: 218814 - DNA, 25 bp, Mus musculus
agtgtggcgttttcactccagcata

SEQ ID NO: 218815 - DNA, 25 bp, Mus musculus
agtgtggctctcatgcagacgacct

SEQ ID NO: 218816 - DNA, 25 bp, Mus musculus
agtgtggctctcttgcagacgacct

SEQ ID NO: 218817 - DNA, 25 bp, Mus musculus
agtgtggctctgagctacatgtcac

SEQ ID NO: 218818 - DNA, 25 bp, Mus musculus
agtgtggctctgtgctacatgtcac

SEQ ID NO: 218819 - DNA, 25 bp, Mus musculus
agtgtggctgtaagatggctttatc

SEQ ID NO: 218820 - DNA, 25 bp, Mus musculus
agtgtggctgtatgatggctttatc

SEQ ID NO: 218821 - DNA, 25 bp, Mus musculus
agtgtggctgttactgcccaaactt

SEQ ID NO: 218822 - DNA, 25 bp, Mus musculus
agtgtggctgtttctgcccaaactt

SEQ ID NO: 218823 - DNA, 25 bp, Mus musculus
agtgtggcttgcaaacagcgatgtt

SEQ ID NO: 218824 - DNA, 25 bp, Mus musculus
agtgtggcttgctaacagcgatgtt

SEQ ID NO: 218825 - DNA, 25 bp, Mus musculus
agtgtgggactgaaccttgactgta

SEQ ID NO: 218826 - DNA, 25 bp, Mus musculus
agtgtgggactgtaccttgactgta

SEQ ID NO: 218827 - DNA, 25 bp, Mus musculus
agtgtgggcaacagttactgcccct

SEQ ID NO: 218828 - DNA, 25 bp, Mus musculus
agtgtgggcaactgttactgcccct

SEQ ID NO: 218829 - DNA, 25 bp, Mus musculus
agtgtgggttgaagggaccttcacc

SEQ ID NO: 218830 - DNA, 25 bp, Mus musculus
agtgtgggttgatgggaccttcacc

SEQ ID NO: 218831 - DNA, 25 bp, Mus musculus
agtgtggtaactcgagtttaaccat

SEQ ID NO: 218832 - DNA, 25 bp, Mus musculus
agtgtggtaactggagtttaaccat

SEQ ID NO: 218833 - DNA, 25 bp, Mus musculus
agtgtggtactcatttcttcttaaa

SEQ ID NO: 218834 - DNA, 25 bp, Mus musculus
agtgtggtactcttttcttcttaaa

SEQ ID NO: 218835 - DNA, 25 bp, Mus musculus
agtgtggtagttccacgccttcaat

SEQ ID NO: 218836 - DNA, 25 bp, Mus musculus
agtgtggtagttgcacgccttcaat

SEQ ID NO: 218837 - DNA, 25 bp, Mus musculus
agtgtggtcacgacaagttcatgta

SEQ ID NO: 218838 - DNA, 25 bp, Mus musculus
agtgtggtcacgtcaagttcatgta

SEQ ID NO: 218839 - DNA, 25 bp, Mus musculus
agtgtggtcactagtcccaaacagc

SEQ ID NO: 218840 - DNA, 25 bp, Mus musculus
agtgtggtcacttgtcccaaacagc

SEQ ID NO: 218841 - DNA, 25 bp, Mus musculus
agtgtggtcagaaacgtatctctct

SEQ ID NO: 218842 - DNA, 25 bp, Mus musculus
agtgtggtcagatacgtatctctct

SEQ ID NO: 218843 - DNA, 25 bp, Mus musculus
agtgtggtgctcattgtatctgtgc

SEQ ID NO: 218844 - DNA, 25 bp, Mus musculus
agtgtggtgctctttgtatctgtgc

SEQ ID NO: 218845 - DNA, 25 bp, Mus musculus
agtgtggtgggcattgttcccaaca

SEQ ID NO: 218846 - DNA, 25 bp, Mus musculus
agtgtggtgggctttgttcccaaca

SEQ ID NO: 218847 - DNA, 25 bp, Mus musculus
agtgtggtgtccatgcccagaactc

SEQ ID NO: 218848 - DNA, 25 bp, Mus musculus
agtgtggtgtccttgcccagaactc

SEQ ID NO: 218849 - DNA, 25 bp, Mus musculus
agtgtggtgtgacttccttccgtga

SEQ ID NO: 218850 - DNA, 25 bp, Mus musculus
agtgtggtgtgagttccttccgtga

SEQ ID NO: 218851 - DNA, 25 bp, Mus musculus
agtgtggttaccctggatagcccct

SEQ ID NO: 218852 - DNA, 25 bp, Mus musculus
agtgtggttaccgtggatagcccct

SEQ ID NO: 218853 - DNA, 25 bp, Mus musculus
agtgtggttcgcaacagctttatga

SEQ ID NO: 218854 - DNA, 25 bp, Mus musculus
agtgtggttcgctacagctttatga

SEQ ID NO: 218855 - DNA, 25 bp, Mus musculus
agtgtggttgttcttgaccatcccc

SEQ ID NO: 218856 - DNA, 25 bp, Mus musculus
agtgtggttgttgttgaccatcccc

SEQ ID NO: 218857 - DNA, 25 bp, Mus musculus
agtgtggtttttccttgctcagaaa

SEQ ID NO: 218858 - DNA, 25 bp, Mus musculus
agtgtggtttttgcttgctcagaaa

SEQ ID NO: 218859 - DNA, 25 bp, Mus musculus
agtgtgtacaagactccagcctgcc

SEQ ID NO: 218860 - DNA, 25 bp, Mus musculus
agtgtgtacaagtctccagcctgcc

SEQ ID NO: 218861 - DNA, 25 bp, Mus musculus
agtgtgtacagacaggcccgtgcta

SEQ ID NO: 218862 - DNA, 25 bp, Mus musculus
agtgtgtacagagaggcccgtgcta

SEQ ID NO: 218863 - DNA, 25 bp, Mus musculus
agtgtgtacattagggtttctatta

SEQ ID NO: 218864 - DNA, 25 bp, Mus musculus
agtgtgtacattccccctttttgct

SEQ ID NO: 218865 - DNA, 25 bp, Mus musculus
agtgtgtacattgcccctttttgct

SEQ ID NO: 218866 - DNA, 25 bp, Mus musculus
agtgtgtacatttgggtttctatta

SEQ ID NO: 218867 - DNA, 25 bp, Mus musculus
agtgtgtacccaccttctgcaggga

SEQ ID NO: 218868 - DNA, 25 bp, Mus musculus
agtgtgtacccagcttctgcaggga

SEQ ID NO: 218869 - DNA, 25 bp, Mus musculus
agtgtgtacgcgctcagagagcaat

SEQ ID NO: 218870 - DNA, 25 bp, Mus musculus
agtgtgtacgcggtcagagagcaat

SEQ ID NO: 218871 - DNA, 25 bp, Mus musculus
agtgtgtacttgcaggaccctttgc

SEQ ID NO: 218872 - DNA, 25 bp, Mus musculus
agtgtgtacttggaggaccctttgc

SEQ ID NO: 218873 - DNA, 25 bp, Mus musculus
agtgtgtactttcccagaacagtct

SEQ ID NO: 218874 - DNA, 25 bp, Mus musculus
agtgtgtactttgccagaacagtct

SEQ ID NO: 218875 - DNA, 25 bp, Mus musculus
agtgtgtagtctatgctgcttcgtc

SEQ ID NO: 218876 - DNA, 25 bp, Mus musculus
agtgtgtagtctttgctgcttcgtc

SEQ ID NO: 218877 - DNA, 25 bp, Mus musculus
agtgtgtagtgtccttcctgtccac

SEQ ID NO: 218878 - DNA, 25 bp, Mus musculus
agtgtgtagtgtgcttcctgtccac

SEQ ID NO: 218879 - DNA, 25 bp, Mus musculus
agtgtgtatcacagccctgagtgct

SEQ ID NO: 218880 - DNA, 25 bp, Mus musculus
agtgtgtatcactgccctgagtgct

SEQ ID NO: 218881 - DNA, 25 bp, Mus musculus
agtgtgtatcagcacttgttctctg

SEQ ID NO: 218882 - DNA, 25 bp, Mus musculus
agtgtgtatcaggacttgttctctg

SEQ ID NO: 218883 - DNA, 25 bp, Mus musculus
agtgtgtatgcaccctacaccaaca

SEQ ID NO: 218884 - DNA, 25 bp, Mus musculus
agtgtgtatgcagcctacaccaaca

SEQ ID NO: 218885 - DNA, 25 bp, Mus musculus
agtgtgtcaaatcccttggaactca

SEQ ID NO: 218886 - DNA, 25 bp, Mus musculus
agtgtgtcaaatgccttggaactca

SEQ ID NO: 218887 - DNA, 25 bp, Mus musculus
agtgtgtcagctaccatgctatggg

SEQ ID NO: 218888 - DNA, 25 bp, Mus musculus
agtgtgtcagcttccatgctatggg

SEQ ID NO: 218889 - DNA, 25 bp, Mus musculus
agtgtgtcataaactctccttgctg

SEQ ID NO: 218890 - DNA, 25 bp, Mus musculus
agtgtgtcataatctctccttgctg

SEQ ID NO: 218891 - DNA, 25 bp, Mus musculus
agtgtgtcatagaccgaagcgtaaa

SEQ ID NO: 218892 - DNA, 25 bp, Mus musculus
agtgtgtcatagtccgaagcgtaaa

SEQ ID NO: 218893 - DNA, 25 bp, Mus musculus
agtgtgtcatatcccagtggtgtct

SEQ ID NO: 218894 - DNA, 25 bp, Mus musculus
agtgtgtcatatgccagtggtgtct

SEQ ID NO: 218895 - DNA, 25 bp, Mus musculus
agtgtgtcatgaccgtctaactcaa

SEQ ID NO: 218896 - DNA, 25 bp, Mus musculus
agtgtgtcatgagcgtctaactcaa

SEQ ID NO: 218897 - DNA, 25 bp, Mus musculus
agtgtgtccacaatgcctctggcat

SEQ ID NO: 218898 - DNA, 25 bp, Mus musculus
agtgtgtccacattgcctctggcat

SEQ ID NO: 218899 - DNA, 25 bp, Mus musculus
agtgtgtccgagattttgagacctt

SEQ ID NO: 218900 - DNA, 25 bp, Mus musculus
agtgtgtccgagtttttgagacctt

SEQ ID NO: 218901 - DNA, 25 bp, Mus musculus
agtgtgtccgttctggatatgatgt

SEQ ID NO: 218902 - DNA, 25 bp, Mus musculus
agtgtgtccgttgtggatatgatgt

SEQ ID NO: 218903 - DNA, 25 bp, Mus musculus
agtgtgtccttgagacccagggctg

SEQ ID NO: 218904 - DNA, 25 bp, Mus musculus
agtgtgtccttgtgacccagggctg

SEQ ID NO: 218905 - DNA, 25 bp, Mus musculus
agtgtgtctacaaccgtcctagatg

SEQ ID NO: 218906 - DNA, 25 bp, Mus musculus
agtgtgtctacatccgtcctagatg

SEQ ID NO: 218907 - DNA, 25 bp, Mus musculus
agtgtgtctatgagccctatttcca

SEQ ID NO: 218908 - DNA, 25 bp, Mus musculus
agtgtgtctatgtgccctatttcca

SEQ ID NO: 218909 - DNA, 25 bp, Mus musculus
agtgtgtctcccacatcaactagtt

SEQ ID NO: 218910 - DNA, 25 bp, Mus musculus
agtgtgtctccctcatcaactagtt

SEQ ID NO: 218911 - DNA, 25 bp, Mus musculus
agtgtgtctcctcctagcgccagca

SEQ ID NO: 218912 - DNA, 25 bp, Mus musculus
agtgtgtctcctctcttcagatcat

SEQ ID NO: 218913 - DNA, 25 bp, Mus musculus
agtgtgtctcctgctagcgccagca

SEQ ID NO: 218914 - DNA, 25 bp, Mus musculus
agtgtgtctcctgtcttcagatcat

SEQ ID NO: 218915 - DNA, 25 bp, Mus musculus
agtgtgtctgacattgaggcaccgg

SEQ ID NO: 218916 - DNA, 25 bp, Mus musculus
agtgtgtctgactttgaggcaccgg

SEQ ID NO: 218917 - DNA, 25 bp, Mus musculus
agtgtgtctgcaagcgggagggcct

SEQ ID NO: 218918 - DNA, 25 bp, Mus musculus
agtgtgtctgcactgtgtgctcacc

SEQ ID NO: 218919 - DNA, 25 bp, Mus musculus
agtgtgtctgcagtgtgtgctcacc

SEQ ID NO: 218920 - DNA, 25 bp, Mus musculus
agtgtgtctgcatgcgggagggcct

SEQ ID NO: 218921 - DNA, 25 bp, Mus musculus
agtgtgtctgtcagcctctggttta

SEQ ID NO: 218922 - DNA, 25 bp, Mus musculus
agtgtgtctgtctgcctctggttta

SEQ ID NO: 218923 - DNA, 25 bp, Mus musculus
agtgtgtcttttcgtttcccagttg

SEQ ID NO: 218924 - DNA, 25 bp, Mus musculus
agtgtgtcttttggtttcccagttg

SEQ ID NO: 218925 - DNA, 25 bp, Mus musculus
agtgtgtgaaggagcttgcagccaa

SEQ ID NO: 218926 - DNA, 25 bp, Mus musculus
agtgtgtgaaggtgcttgcagccaa

SEQ ID NO: 218927 - DNA, 25 bp, Mus musculus
agtgtgtgaatacagccccagatgc

SEQ ID NO: 218928 - DNA, 25 bp, Mus musculus
agtgtgtgaatagagccccagatgc

SEQ ID NO: 218929 - DNA, 25 bp, Mus musculus
agtgtgtgactgaggctgtactgta

SEQ ID NO: 218930 - DNA, 25 bp, Mus musculus
agtgtgtgactgtggctgtactgta

SEQ ID NO: 218931 - DNA, 25 bp, Mus musculus
agtgtgtgcacactcccaagagtgt

SEQ ID NO: 218932 - DNA, 25 bp, Mus musculus
agtgtgtgcacagtcccaagagtgt

SEQ ID NO: 218933 - DNA, 25 bp, Mus musculus
agtgtgtgcatgaagcctctgttca

SEQ ID NO: 218934 - DNA, 25 bp, Mus musculus
agtgtgtgcatgtagcctctgttca

SEQ ID NO: 218935 - DNA, 25 bp, Mus musculus
agtgtgtgccagacgtcggccgaaa

SEQ ID NO: 218936 - DNA, 25 bp, Mus musculus
agtgtgtgccagtcgtcggccgaaa

SEQ ID NO: 218937 - DNA, 25 bp, Mus musculus
agtgtgtgcctaaaacccaagtgct

SEQ ID NO: 218938 - DNA, 25 bp, Mus musculus
agtgtgtgcctataacccaagtgct

SEQ ID NO: 218939 - DNA, 25 bp, Mus musculus
agtgtgtgcctgactgacttggttc

SEQ ID NO: 218940 - DNA, 25 bp, Mus musculus
agtgtgtgcctgtctgacttggttc

SEQ ID NO: 218941 - DNA, 25 bp, Mus musculus
agtgtgtgcttacatgttccctcaa

SEQ ID NO: 218942 - DNA, 25 bp, Mus musculus
agtgtgtgcttagatgttccctcaa

SEQ ID NO: 218943 - DNA, 25 bp, Mus musculus
agtgtgtggagcactccggcatcat

SEQ ID NO: 218944 - DNA, 25 bp, Mus musculus
agtgtgtggagcatctgctgcatgc

SEQ ID NO: 218945 - DNA, 25 bp, Mus musculus
agtgtgtggagctctccggcatcat

SEQ ID NO: 218946 - DNA, 25 bp, Mus musculus
agtgtgtggagcttctgctgcatgc

SEQ ID NO: 218947 - DNA, 25 bp, Mus musculus
agtgtgtggcttcctgtcgtgtcct

SEQ ID NO: 218948 - DNA, 25 bp, Mus musculus
agtgtgtggcttgctgtcgtgtcct

SEQ ID NO: 218949 - DNA, 25 bp, Mus musculus
agtgtgtgtacactgtaatcgtgct

SEQ ID NO: 218950 - DNA, 25 bp, Mus musculus
agtgtgtgtacagtgtaatcgtgct

SEQ ID NO: 218951 - DNA, 25 bp, Mus musculus
agtgtgtgtaccaaacctcagatct

SEQ ID NO: 218952 - DNA, 25 bp, Mus musculus
agtgtgtgtacctaacctcagatct

SEQ ID NO: 218953 - DNA, 25 bp, Mus musculus
agtgtgtgtacgcttgcaggatcta

SEQ ID NO: 218954 - DNA, 25 bp, Mus musculus
agtgtgtgtacggttgcaggatcta

SEQ ID NO: 218955 - DNA, 25 bp, Mus musculus
agtgtgtgtatcagctcctcgggca

SEQ ID NO: 218956 - DNA, 25 bp, Mus musculus
agtgtgtgtatctgctcctcgggca

SEQ ID NO: 218957 - DNA, 25 bp, Mus musculus
agtgtgtgtatgctccatgcccagt

SEQ ID NO: 218958 - DNA, 25 bp, Mus musculus
agtgtgtgtatggtccatgcccagt

SEQ ID NO: 218959 - DNA, 25 bp, Mus musculus
agtgtgtgttaaacaactacaaaat

SEQ ID NO: 218960 - DNA, 25 bp, Mus musculus
agtgtgtgttaatcaactacaaaat

SEQ ID NO: 218961 - DNA, 25 bp, Mus musculus
agtgtgtgttgtacctcggcttagg

SEQ ID NO: 218962 - DNA, 25 bp, Mus musculus
agtgtgtgttgttcctcggcttagg

SEQ ID NO: 218963 - DNA, 25 bp, Mus musculus
agtgtgttacaactttcctgtcctt

SEQ ID NO: 218964 - DNA, 25 bp, Mus musculus
agtgtgttacaagtttcctgtcctt

SEQ ID NO: 218965 - DNA, 25 bp, Mus musculus
agtgtgttatcaccagcagacactg

SEQ ID NO: 218966 - DNA, 25 bp, Mus musculus
agtgtgttatcagcagcagacactg

SEQ ID NO: 218967 - DNA, 25 bp, Mus musculus
agtgtgttcacaatgctgctttact

SEQ ID NO: 218968 - DNA, 25 bp, Mus musculus
agtgtgttcacattgctgctttact

SEQ ID NO: 218969 - DNA, 25 bp, Mus musculus
agtgtgttcattagtggcagattca

SEQ ID NO: 218970 - DNA, 25 bp, Mus musculus
agtgtgttcatttgtggcagattca

SEQ ID NO: 218971 - DNA, 25 bp, Mus musculus
agtgtgttccagcaaacggttccca

SEQ ID NO: 218972 - DNA, 25 bp, Mus musculus
agtgtgttccaggaaacggttccca

SEQ ID NO: 218973 - DNA, 25 bp, Mus musculus
agtgtgttccccactgactcagaag

SEQ ID NO: 218974 - DNA, 25 bp, Mus musculus
agtgtgttcccctctgactcagaag

SEQ ID NO: 218975 - DNA, 25 bp, Mus musculus
agtgtgttcctgaattttcctccca

SEQ ID NO: 218976 - DNA, 25 bp, Mus musculus
agtgtgttcctgtattttcctccca

SEQ ID NO: 218977 - DNA, 25 bp, Mus musculus
agtgtgttctgcctgcaccaggtca

SEQ ID NO: 218978 - DNA, 25 bp, Mus musculus
agtgtgttctgcgtgcaccaggtca

SEQ ID NO: 218979 - DNA, 25 bp, Mus musculus
agtgtgttgatgactgcagtctctg

SEQ ID NO: 218980 - DNA, 25 bp, Mus musculus
agtgtgttgatgtctgcagtctctg

SEQ ID NO: 218981 - DNA, 25 bp, Mus musculus
agtgtgttgtctatccaatggtgcc

SEQ ID NO: 218982 - DNA, 25 bp, Mus musculus
agtgtgttgtctttccaatggtgcc

SEQ ID NO: 218983 - DNA, 25 bp, Mus musculus
agtgtgtttatgctatcgctgcctt

SEQ ID NO: 218984 - DNA, 25 bp, Mus musculus
agtgtgtttatgctcagtcttcctg

SEQ ID NO: 218985 - DNA, 25 bp, Mus musculus
agtgtgtttatggtatcgctgcctt

SEQ ID NO: 218986 - DNA, 25 bp, Mus musculus
agtgtgtttatggtcagtcttcctg

SEQ ID NO: 218987 - DNA, 25 bp, Mus musculus
agtgtgtttccccttatatagcttc

SEQ ID NO: 218988 - DNA, 25 bp, Mus musculus
agtgtgtttcccgttatatagcttc

SEQ ID NO: 218989 - DNA, 25 bp, Mus musculus
agtgtgtttcctcatatcttctttt

SEQ ID NO: 218990 - DNA, 25 bp, Mus musculus
agtgtgtttcctgatatcttctttt

SEQ ID NO: 218991 - DNA, 25 bp, Mus musculus
agtgtgtttgctacaagggcctgtt

SEQ ID NO: 218992 - DNA, 25 bp, Mus musculus
agtgtgtttgcttcaagggcctgtt

SEQ ID NO: 218993 - DNA, 25 bp, Mus musculus
agtgtgttttgacttctcagagaac

SEQ ID NO: 218994 - DNA, 25 bp, Mus musculus
agtgtgttttgagttctcagagaac

SEQ ID NO: 218995 - DNA, 25 bp, Mus musculus
agtgtgttttgcaggtgtgtccgtt

SEQ ID NO: 218996 - DNA, 25 bp, Mus musculus
agtgtgttttgctggtgtgtccgtt

SEQ ID NO: 218997 - DNA, 25 bp, Mus musculus
agtgtgtttttcattgctcctgaga

SEQ ID NO: 218998 - DNA, 25 bp, Mus musculus
agtgtgtttttctttgctcctgaga

SEQ ID NO: 218999 - DNA, 25 bp, Mus musculus
agtgttaaaggcatcccttgcctct

SEQ ID NO: 219000 - DNA, 25 bp, Mus musculus
agtgttaaaggcttcccttgcctct

SEQ ID NO: 219001 - DNA, 25 bp, Mus musculus
agtgttaatctcctatttcttccct

SEQ ID NO: 219002 - DNA, 25 bp, Mus musculus
agtgttaatctcgtatttcttccct

SEQ ID NO: 219003 - DNA, 25 bp, Mus musculus
agtgttaattccagaccaaaagtat

SEQ ID NO: 219004 - DNA, 25 bp, Mus musculus
agtgttaattcctgaccaaaagtat

SEQ ID NO: 219005 - DNA, 25 bp, Mus musculus
agtgttacaagtctgcgctccagaa

SEQ ID NO: 219006 - DNA, 25 bp, Mus musculus
agtgttacaagtgtgcgctccagaa

SEQ ID NO: 219007 - DNA, 25 bp, Mus musculus
agtgttacaggcatgtgcctctaag

SEQ ID NO: 219008 - DNA, 25 bp, Mus musculus
agtgttacaggcttgtgcctctaag

SEQ ID NO: 219009 - DNA, 25 bp, Mus musculus
agtgttacagtcatatgagttttat

SEQ ID NO: 219010 - DNA, 25 bp, Mus musculus
agtgttacagtcttatgagttttat

SEQ ID NO: 219011 - DNA, 25 bp, Mus musculus
agtgttaccacgctgtgtcatgctg

SEQ ID NO: 219012 - DNA, 25 bp, Mus musculus
agtgttaccacggtgtgtcatgctg

SEQ ID NO: 219013 - DNA, 25 bp, Mus musculus
agtgttacttccaaggccgagcaga

SEQ ID NO: 219014 - DNA, 25 bp, Mus musculus
agtgttacttcctaggccgagcaga

SEQ ID NO: 219015 - DNA, 25 bp, Mus musculus
agtgttactttaattctctgccaaa

SEQ ID NO: 219016 - DNA, 25 bp, Mus musculus
agtgttactttatttctctgccaaa

SEQ ID NO: 219017 - DNA, 25 bp, Mus musculus
agtgttagagatcgaccttttgaga

SEQ ID NO: 219018 - DNA, 25 bp, Mus musculus
agtgttagagatggaccttttgaga

SEQ ID NO: 219019 - DNA, 25 bp, Mus musculus
agtgttagcacaacctgagcagagt

SEQ ID NO: 219020 - DNA, 25 bp, Mus musculus
agtgttagcacatcctgagcagagt

SEQ ID NO: 219021 - DNA, 25 bp, Mus musculus
agtgttagccaaacagtggccctag

SEQ ID NO: 219022 - DNA, 25 bp, Mus musculus
agtgttagccaatcagtggccctag

SEQ ID NO: 219023 - DNA, 25 bp, Mus musculus
agtgttagtaaaagccatcctaggc

SEQ ID NO: 219024 - DNA, 25 bp, Mus musculus
agtgttagtaaatgccatcctaggc

SEQ ID NO: 219025 - DNA, 25 bp, Mus musculus
agtgttagtgagcatctccagccgt

SEQ ID NO: 219026 - DNA, 25 bp, Mus musculus
agtgttagtgaggatctccagccgt

SEQ ID NO: 219027 - DNA, 25 bp, Mus musculus
agtgttagttctctcagtggaccat

SEQ ID NO: 219028 - DNA, 25 bp, Mus musculus
agtgttagttctgtcagtggaccat

SEQ ID NO: 219029 - DNA, 25 bp, Mus musculus
agtgttatacagatccctccccttt

SEQ ID NO: 219030 - DNA, 25 bp, Mus musculus
agtgttatacagttccctccccttt

SEQ ID NO: 219031 - DNA, 25 bp, Mus musculus
agtgttatcactcattcctttggtc

SEQ ID NO: 219032 - DNA, 25 bp, Mus musculus
agtgttatcactgattcctttggtc

SEQ ID NO: 219033 - DNA, 25 bp, Mus musculus
agtgttatccaaatctctgttgagt

SEQ ID NO: 219034 - DNA, 25 bp, Mus musculus
agtgttatccaattctctgttgagt

SEQ ID NO: 219035 - DNA, 25 bp, Mus musculus
agtgttatctcactgatcaattgaa

SEQ ID NO: 219036 - DNA, 25 bp, Mus musculus
agtgttatctcagtgatcaattgaa

SEQ ID NO: 219037 - DNA, 25 bp, Mus musculus
agtgttatctgtccgtgatccccag

SEQ ID NO: 219038 - DNA, 25 bp, Mus musculus
agtgttatctgtgcgtgatccccag

SEQ ID NO: 219039 - DNA, 25 bp, Mus musculus
agtgttattagaaagggcctgggac

SEQ ID NO: 219040 - DNA, 25 bp, Mus musculus
agtgttattagatagggcctgggac

SEQ ID NO: 219041 - DNA, 25 bp, Mus musculus
agtgttattcataacaagtgtatat

SEQ ID NO: 219042 - DNA, 25 bp, Mus musculus
agtgttattcattacaagtgtatat

SEQ ID NO: 219043 - DNA, 25 bp, Mus musculus
agtgttattgtaaacagcccaggct

SEQ ID NO: 219044 - DNA, 25 bp, Mus musculus
agtgttattgtatacagcccaggct

SEQ ID NO: 219045 - DNA, 25 bp, Mus musculus
agtgttatttctagttatccatgag

SEQ ID NO: 219046 - DNA, 25 bp, Mus musculus
agtgttatttcttgttatccatgag

SEQ ID NO: 219047 - DNA, 25 bp, Mus musculus
agtgttatttgtatgtcttgtttag

SEQ ID NO: 219048 - DNA, 25 bp, Mus musculus
agtgttatttgtttgtcttgtttag

SEQ ID NO: 219049 - DNA, 25 bp, Mus musculus
agtgttcaaagcaggcccgagccgc

SEQ ID NO: 219050 - DNA, 25 bp, Mus musculus
agtgttcaaagctggcccgagccgc

SEQ ID NO: 219051 - DNA, 25 bp, Mus musculus
agtgttcaacatcataggctataga

SEQ ID NO: 219052 - DNA, 25 bp, Mus musculus
agtgttcaacatgataggctataga

SEQ ID NO: 219053 - DNA, 25 bp, Mus musculus
agtgttcaagagcagcccgtgctgt

SEQ ID NO: 219054 - DNA, 25 bp, Mus musculus
agtgttcaagaggagcccgtgctgt

SEQ ID NO: 219055 - DNA, 25 bp, Mus musculus
agtgttcacaagcagctcggtggtc

SEQ ID NO: 219056 - DNA, 25 bp, Mus musculus
agtgttcacaaggagctcggtggtc

SEQ ID NO: 219057 - DNA, 25 bp, Mus musculus
agtgttcacaatactcccatgcata

SEQ ID NO: 219058 - DNA, 25 bp, Mus musculus
agtgttcacaattctcccatgcata

SEQ ID NO: 219059 - DNA, 25 bp, Mus musculus
agtgttcaccaactgcaaggagtac

SEQ ID NO: 219060 - DNA, 25 bp, Mus musculus
agtgttcaccaagtgcaaggagtac

SEQ ID NO: 219061 - DNA, 25 bp, Mus musculus
agtgttcacgttcccactgtgaaaa

SEQ ID NO: 219062 - DNA, 25 bp, Mus musculus
agtgttcacgttgccactgtgaaaa

SEQ ID NO: 219063 - DNA, 25 bp, Mus musculus
agtgttcagctccagcggttatcaa

SEQ ID NO: 219064 - DNA, 25 bp, Mus musculus
agtgttcagctcgagcggttatcaa

SEQ ID NO: 219065 - DNA, 25 bp, Mus musculus
agtgttcaggctcctgtccttggtc

SEQ ID NO: 219066 - DNA, 25 bp, Mus musculus
agtgttcaggctgctgtccttggtc

SEQ ID NO: 219067 - DNA, 25 bp, Mus musculus
agtgttcagttcacactttagttgg

SEQ ID NO: 219068 - DNA, 25 bp, Mus musculus
agtgttcagttctcactttagttgg

SEQ ID NO: 219069 - DNA, 25 bp, Mus musculus
agtgttcatcacactatcctgactc

SEQ ID NO: 219070 - DNA, 25 bp, Mus musculus
agtgttcatcactctatcctgactc

SEQ ID NO: 219071 - DNA, 25 bp, Mus musculus
agtgttcatctgcttctagacctgg

SEQ ID NO: 219072 - DNA, 25 bp, Mus musculus
agtgttcatctggttctagacctgg

SEQ ID NO: 219073 - DNA, 25 bp, Mus musculus
agtgttcatgaaaggctgctgcctg

SEQ ID NO: 219074 - DNA, 25 bp, Mus musculus
agtgttcatgaatggctgctgcctg

SEQ ID NO: 219075 - DNA, 25 bp, Mus musculus
agtgttcattccagactaagtgtga

SEQ ID NO: 219076 - DNA, 25 bp, Mus musculus
agtgttcattcctgactaagtgtga

SEQ ID NO: 219077 - DNA, 25 bp, Mus musculus
agtgttcattggactccttccttct

SEQ ID NO: 219078 - DNA, 25 bp, Mus musculus
agtgttcattggtctccttccttct

SEQ ID NO: 219079 - DNA, 25 bp, Mus musculus
agtgttccacggcactactgtgcaa

SEQ ID NO: 219080 - DNA, 25 bp, Mus musculus
agtgttccacgggactactgtgcaa

SEQ ID NO: 219081 - DNA, 25 bp, Mus musculus
agtgttccagtaattgcatcagtga

SEQ ID NO: 219082 - DNA, 25 bp, Mus musculus
agtgttccagtatttgcatcagtga

SEQ ID NO: 219083 - DNA, 25 bp, Mus musculus
agtgttccatgcatcaggttcctga

SEQ ID NO: 219084 - DNA, 25 bp, Mus musculus
agtgttccatgcttcaggttcctga

SEQ ID NO: 219085 - DNA, 25 bp, Mus musculus
agtgttcccacaacacagactgttg

SEQ ID NO: 219086 - DNA, 25 bp, Mus musculus
agtgttcccacatcacagactgttg

SEQ ID NO: 219087 - DNA, 25 bp, Mus musculus
agtgttcccactcctgtttctcaca

SEQ ID NO: 219088 - DNA, 25 bp, Mus musculus
agtgttcccactgctgtttctcaca

SEQ ID NO: 219089 - DNA, 25 bp, Mus musculus
agtgttcccagaacactcctgaact

SEQ ID NO: 219090 - DNA, 25 bp, Mus musculus
agtgttcccagatcactcctgaact

SEQ ID NO: 219091 - DNA, 25 bp, Mus musculus
agtgttcccagtacactgacccagt

SEQ ID NO: 219092 - DNA, 25 bp, Mus musculus
agtgttcccagttcactgacccagt

SEQ ID NO: 219093 - DNA, 25 bp, Mus musculus
agtgttccgagtcagcaaacagtca

SEQ ID NO: 219094 - DNA, 25 bp, Mus musculus
agtgttccgagtgagcaaacagtca

SEQ ID NO: 219095 - DNA, 25 bp, Mus musculus
agtgttcctaatactcatggtagat

SEQ ID NO: 219096 - DNA, 25 bp, Mus musculus
agtgttcctaattctcatggtagat

SEQ ID NO: 219097 - DNA, 25 bp, Mus musculus
agtgttcctcttagtagttccttga

SEQ ID NO: 219098 - DNA, 25 bp, Mus musculus
agtgttcctctttgtagttccttga

SEQ ID NO: 219099 - DNA, 25 bp, Mus musculus
agtgttcctgctagggctgattgtc

SEQ ID NO: 219100 - DNA, 25 bp, Mus musculus
agtgttcctgctagtttccttactt

SEQ ID NO: 219101 - DNA, 25 bp, Mus musculus
agtgttcctgcttgggctgattgtc

SEQ ID NO: 219102 - DNA, 25 bp, Mus musculus
agtgttcctgcttgtttccttactt

SEQ ID NO: 219103 - DNA, 25 bp, Mus musculus
agtgttcctgtaatatcatggctaa

SEQ ID NO: 219104 - DNA, 25 bp, Mus musculus
agtgttcctgtattatcatggctaa

SEQ ID NO: 219105 - DNA, 25 bp, Mus musculus
agtgttcctgttatgcataaattgc

SEQ ID NO: 219106 - DNA, 25 bp, Mus musculus
agtgttcctgttttgcataaattgc

SEQ ID NO: 219107 - DNA, 25 bp, Mus musculus
agtgttccttttcagcttattatgg

SEQ ID NO: 219108 - DNA, 25 bp, Mus musculus
agtgttccttttgagcttattatgg

SEQ ID NO: 219109 - DNA, 25 bp, Mus musculus
agtgttcgccgcacgacctgcgggt

SEQ ID NO: 219110 - DNA, 25 bp, Mus musculus
agtgttcgccgctcgacctgcgggt

SEQ ID NO: 219111 - DNA, 25 bp, Mus musculus
agtgttcgctgtaagctggatgcca

SEQ ID NO: 219112 - DNA, 25 bp, Mus musculus
agtgttcgctgttagctggatgcca

SEQ ID NO: 219113 - DNA, 25 bp, Mus musculus
agtgttcggtcgacttctcaaggat

SEQ ID NO: 219114 - DNA, 25 bp, Mus musculus
agtgttcggtcgtcttctcaaggat

SEQ ID NO: 219115 - DNA, 25 bp, Mus musculus
agtgttcgtcatcccatacacacag

SEQ ID NO: 219116 - DNA, 25 bp, Mus musculus
agtgttcgtcatgccatacacacag

SEQ ID NO: 219117 - DNA, 25 bp, Mus musculus
agtgttcgttcaactgcatcagaga

SEQ ID NO: 219118 - DNA, 25 bp, Mus musculus
agtgttcgttcatctgcatcagaga

SEQ ID NO: 219119 - DNA, 25 bp, Mus musculus
agtgttctaattcctatgtggtcca

SEQ ID NO: 219120 - DNA, 25 bp, Mus musculus
agtgttctaattgctatgtggtcca

SEQ ID NO: 219121 - DNA, 25 bp, Mus musculus
agtgttctaggcaactgagtccctt

SEQ ID NO: 219122 - DNA, 25 bp, Mus musculus
agtgttctaggctactgagtccctt

SEQ ID NO: 219123 - DNA, 25 bp, Mus musculus
agtgttctaggtaggcccaccttgg

SEQ ID NO: 219124 - DNA, 25 bp, Mus musculus
agtgttctaggttggcccaccttgg

SEQ ID NO: 219125 - DNA, 25 bp, Mus musculus
agtgttctagtaaagtagccttagc

SEQ ID NO: 219126 - DNA, 25 bp, Mus musculus
agtgttctagtatagtagccttagc

SEQ ID NO: 219127 - DNA, 25 bp, Mus musculus
agtgttctatcacccacaattccag

SEQ ID NO: 219128 - DNA, 25 bp, Mus musculus
agtgttctatcagccacaattccag

SEQ ID NO: 219129 - DNA, 25 bp, Mus musculus
agtgttctcagaacagctgtcctca

SEQ ID NO: 219130 - DNA, 25 bp, Mus musculus
agtgttctcagatcagctgtcctca

SEQ ID NO: 219131 - DNA, 25 bp, Mus musculus
agtgttctcaggcaataccgtaagc

SEQ ID NO: 219132 - DNA, 25 bp, Mus musculus
agtgttctcagggaataccgtaagc

SEQ ID NO: 219133 - DNA, 25 bp, Mus musculus
agtgttctcagtctttttctcatca

SEQ ID NO: 219134 - DNA, 25 bp, Mus musculus
agtgttctcagtgtttttctcatca

SEQ ID NO: 219135 - DNA, 25 bp, Mus musculus
agtgttctcatgctgccgtgtctgc

SEQ ID NO: 219136 - DNA, 25 bp, Mus musculus
agtgttctcatggtgccgtgtctgc

SEQ ID NO: 219137 - DNA, 25 bp, Mus musculus
agtgttctccgtattctagtcctga

SEQ ID NO: 219138 - DNA, 25 bp, Mus musculus
agtgttctccgttttctagtcctga

SEQ ID NO: 219139 - DNA, 25 bp, Mus musculus
agtgttctcctactcagtggcagtt

SEQ ID NO: 219140 - DNA, 25 bp, Mus musculus
agtgttctcctagtcagtggcagtt

SEQ ID NO: 219141 - DNA, 25 bp, Mus musculus
agtgttctcctcagccacgcgaaag

SEQ ID NO: 219142 - DNA, 25 bp, Mus musculus
agtgttctcctctgccacgcgaaag

SEQ ID NO: 219143 - DNA, 25 bp, Mus musculus
agtgttctcctgctgctaggagctt

SEQ ID NO: 219144 - DNA, 25 bp, Mus musculus
agtgttctcctggtgctaggagctt

SEQ ID NO: 219145 - DNA, 25 bp, Mus musculus
agtgttctgaagctctgctcttaac

SEQ ID NO: 219146 - DNA, 25 bp, Mus musculus
agtgttctgaaggtctgctcttaac

SEQ ID NO: 219147 - DNA, 25 bp, Mus musculus
agtgttctgacaaccagatttcccc

SEQ ID NO: 219148 - DNA, 25 bp, Mus musculus
agtgttctgacatccagatttcccc

SEQ ID NO: 219149 - DNA, 25 bp, Mus musculus
agtgttctgactcctaattcctatg

SEQ ID NO: 219150 - DNA, 25 bp, Mus musculus
agtgttctgactgctaattcctatg

SEQ ID NO: 219151 - DNA, 25 bp, Mus musculus
agtgttctgcctctcggaagtctgt

SEQ ID NO: 219152 - DNA, 25 bp, Mus musculus
agtgttctgcctgtcggaagtctgt

SEQ ID NO: 219153 - DNA, 25 bp, Mus musculus
agtgttctgtgcctaccaggtaaca

SEQ ID NO: 219154 - DNA, 25 bp, Mus musculus
agtgttctgtgcgtaccaggtaaca

SEQ ID NO: 219155 - DNA, 25 bp, Mus musculus
agtgttcttaatctgatttcctaaa

SEQ ID NO: 219156 - DNA, 25 bp, Mus musculus
agtgttcttaatgtgatttcctaaa

SEQ ID NO: 219157 - DNA, 25 bp, Mus musculus
agtgttcttacaactggcttctaac

SEQ ID NO: 219158 - DNA, 25 bp, Mus musculus
agtgttcttacatctggcttctaac

SEQ ID NO: 219159 - DNA, 25 bp, Mus musculus
agtgttcttatgcatcatcgactgt

SEQ ID NO: 219160 - DNA, 25 bp, Mus musculus
agtgttcttatggatcatcgactgt

SEQ ID NO: 219161 - DNA, 25 bp, Mus musculus
agtgttcttcacatgaactaatcaa

SEQ ID NO: 219162 - DNA, 25 bp, Mus musculus
agtgttcttcacttgaactaatcaa

SEQ ID NO: 219163 - DNA, 25 bp, Mus musculus
agtgttcttcttctgttcacacacg

SEQ ID NO: 219164 - DNA, 25 bp, Mus musculus
agtgttcttcttgtgttcacacacg

SEQ ID NO: 219165 - DNA, 25 bp, Mus musculus
agtgttcttgctcacttgagggtat

SEQ ID NO: 219166 - DNA, 25 bp, Mus musculus
agtgttcttgctcttagcccagggt

SEQ ID NO: 219167 - DNA, 25 bp, Mus musculus
agtgttcttgctgacttgagggtat

SEQ ID NO: 219168 - DNA, 25 bp, Mus musculus
agtgttcttgctgttagcccagggt

SEQ ID NO: 219169 - DNA, 25 bp, Mus musculus
agtgttctttccattctggtttcat

SEQ ID NO: 219170 - DNA, 25 bp, Mus musculus
agtgttctttcctttctggtttcat

SEQ ID NO: 219171 - DNA, 25 bp, Mus musculus
agtgttgaacacatcagtccagaaa

SEQ ID NO: 219172 - DNA, 25 bp, Mus musculus
agtgttgaacacttcagtccagaaa

SEQ ID NO: 219173 - DNA, 25 bp, Mus musculus
agtgttgaataaccctcaagcccag

SEQ ID NO: 219174 - DNA, 25 bp, Mus musculus
agtgttgaataagcctcaagcccag

SEQ ID NO: 219175 - DNA, 25 bp, Mus musculus
agtgttgaatatctttccctcctaa

SEQ ID NO: 219176 - DNA, 25 bp, Mus musculus
agtgttgaatatgtttccctcctaa

SEQ ID NO: 219177 - DNA, 25 bp, Mus musculus
agtgttgacagcaagcccctgtgtg

SEQ ID NO: 219178 - DNA, 25 bp, Mus musculus
agtgttgacagctagcccctgtgtg

SEQ ID NO: 219179 - DNA, 25 bp, Mus musculus
agtgttgactgccaggttgcttata

SEQ ID NO: 219180 - DNA, 25 bp, Mus musculus
agtgttgactgcgaggttgcttata

SEQ ID NO: 219181 - DNA, 25 bp, Mus musculus
agtgttgagcaacgactgtcatttt

SEQ ID NO: 219182 - DNA, 25 bp, Mus musculus
agtgttgagcaaggactgtcatttt

SEQ ID NO: 219183 - DNA, 25 bp, Mus musculus
agtgttgaggttaaactgatcccag

SEQ ID NO: 219184 - DNA, 25 bp, Mus musculus
agtgttgaggtttaactgatcccag

SEQ ID NO: 219185 - DNA, 25 bp, Mus musculus
agtgttgagttcactgccagttagc

SEQ ID NO: 219186 - DNA, 25 bp, Mus musculus
agtgttgagttctctgccagttagc

SEQ ID NO: 219187 - DNA, 25 bp, Mus musculus
agtgttgataggctgccagctcctc

SEQ ID NO: 219188 - DNA, 25 bp, Mus musculus
agtgttgatagggtgccagctcctc

SEQ ID NO: 219189 - DNA, 25 bp, Mus musculus
agtgttgatttcctacctgtacttc

SEQ ID NO: 219190 - DNA, 25 bp, Mus musculus
agtgttgatttcgtacctgtacttc

SEQ ID NO: 219191 - DNA, 25 bp, Mus musculus
agtgttgcaacactttgctcatcat

SEQ ID NO: 219192 - DNA, 25 bp, Mus musculus
agtgttgcaacagtttgctcatcat

SEQ ID NO: 219193 - DNA, 25 bp, Mus musculus
agtgttgcacaaccttcaccatcat

SEQ ID NO: 219194 - DNA, 25 bp, Mus musculus
agtgttgcacaagcttcaccatcat

SEQ ID NO: 219195 - DNA, 25 bp, Mus musculus
agtgttgcacacagttgatcctagc

SEQ ID NO: 219196 - DNA, 25 bp, Mus musculus
agtgttgcacactgttgatcctagc

SEQ ID NO: 219197 - DNA, 25 bp, Mus musculus
agtgttgcactgaaatctatcatat

SEQ ID NO: 219198 - DNA, 25 bp, Mus musculus
agtgttgcactgtaatctatcatat

SEQ ID NO: 219199 - DNA, 25 bp, Mus musculus
agtgttgccactcttgctggtgctg

SEQ ID NO: 219200 - DNA, 25 bp, Mus musculus
agtgttgccactgttgctggtgctg

SEQ ID NO: 219201 - DNA, 25 bp, Mus musculus
agtgttgccatcatcacttactgct

SEQ ID NO: 219202 - DNA, 25 bp, Mus musculus
agtgttgccatcttcacttactgct

SEQ ID NO: 219203 - DNA, 25 bp, Mus musculus
agtgttgcccaaccacaagtgtttg

SEQ ID NO: 219204 - DNA, 25 bp, Mus musculus
agtgttgcccaagcacaagtgtttg

SEQ ID NO: 219205 - DNA, 25 bp, Mus musculus
agtgttgcccttcctgtgtgataaa

SEQ ID NO: 219206 - DNA, 25 bp, Mus musculus
agtgttgcccttgctgtgtgataaa

SEQ ID NO: 219207 - DNA, 25 bp, Mus musculus
agtgttgccgctacagacagtactg

SEQ ID NO: 219208 - DNA, 25 bp, Mus musculus
agtgttgccgcttcagacagtactg

SEQ ID NO: 219209 - DNA, 25 bp, Mus musculus
agtgttgcctttcacattcaggttc

SEQ ID NO: 219210 - DNA, 25 bp, Mus musculus
agtgttgcctttgacattcaggttc

SEQ ID NO: 219211 - DNA, 25 bp, Mus musculus
agtgttgctcataaattgcccataa

SEQ ID NO: 219212 - DNA, 25 bp, Mus musculus
agtgttgctcattaattgcccataa

SEQ ID NO: 219213 - DNA, 25 bp, Mus musculus
agtgttgctcgaattttgttcattt

SEQ ID NO: 219214 - DNA, 25 bp, Mus musculus
agtgttgctcgatttttgttcattt

SEQ ID NO: 219215 - DNA, 25 bp, Mus musculus
agtgttgctctgagtggcaagccca

SEQ ID NO: 219216 - DNA, 25 bp, Mus musculus
agtgttgctctgtgtggcaagccca

SEQ ID NO: 219217 - DNA, 25 bp, Mus musculus
agtgttgctgctagtcttcttggaa

SEQ ID NO: 219218 - DNA, 25 bp, Mus musculus
agtgttgctgcttgtcttcttggaa

SEQ ID NO: 219219 - DNA, 25 bp, Mus musculus
agtgttgctggcctagtaccttgga

SEQ ID NO: 219220 - DNA, 25 bp, Mus musculus
agtgttgctggcgtagtaccttgga

SEQ ID NO: 219221 - DNA, 25 bp, Mus musculus
agtgttgcttataggattctgtatc

SEQ ID NO: 219222 - DNA, 25 bp, Mus musculus
agtgttgcttattggattctgtatc

SEQ ID NO: 219223 - DNA, 25 bp, Mus musculus
agtgttgcttttctagttcccatct

SEQ ID NO: 219224 - DNA, 25 bp, Mus musculus
agtgttgcttttgtagttcccatct

SEQ ID NO: 219225 - DNA, 25 bp, Mus musculus
agtgttggaactagccaggcggtta

SEQ ID NO: 219226 - DNA, 25 bp, Mus musculus
agtgttggaacttgccaggcggtta

SEQ ID NO: 219227 - DNA, 25 bp, Mus musculus
agtgttggaagaagaccttttgctt

SEQ ID NO: 219228 - DNA, 25 bp, Mus musculus
agtgttggaagatgaccttttgctt

SEQ ID NO: 219229 - DNA, 25 bp, Mus musculus
agtgttggaagtcactgtcctgctc

SEQ ID NO: 219230 - DNA, 25 bp, Mus musculus
agtgttggaagtgactgtcctgctc

SEQ ID NO: 219231 - DNA, 25 bp, Mus musculus
agtgttggaattcagcactgtggac

SEQ ID NO: 219232 - DNA, 25 bp, Mus musculus
agtgttggaattgagcactgtggac

SEQ ID NO: 219233 - DNA, 25 bp, Mus musculus
agtgttggacatcatcgtttggaag

SEQ ID NO: 219234 - DNA, 25 bp, Mus musculus
agtgttggacatgatcgtttggaag

SEQ ID NO: 219235 - DNA, 25 bp, Mus musculus
agtgttggacctcctgttgtgagac

SEQ ID NO: 219236 - DNA, 25 bp, Mus musculus
agtgttggacctgctgttgtgagac

SEQ ID NO: 219237 - DNA, 25 bp, Mus musculus
agtgttggagctcaacctctactgc

SEQ ID NO: 219238 - DNA, 25 bp, Mus musculus
agtgttggagctgaacctctactgc

SEQ ID NO: 219239 - DNA, 25 bp, Mus musculus
agtgttggagttcttccatcttcct

SEQ ID NO: 219240 - DNA, 25 bp, Mus musculus
agtgttggagttgttccatcttcct

SEQ ID NO: 219241 - DNA, 25 bp, Mus musculus
agtgttggatctcctagtttcaatc

SEQ ID NO: 219242 - DNA, 25 bp, Mus musculus
agtgttggatctgctagtttcaatc

SEQ ID NO: 219243 - DNA, 25 bp, Mus musculus
agtgttggatgccttgaacgtcagc

SEQ ID NO: 219244 - DNA, 25 bp, Mus musculus
agtgttggatgcgttgaacgtcagc

SEQ ID NO: 219245 - DNA, 25 bp, Mus musculus
agtgttggcaccaaggtcatctgct

SEQ ID NO: 219246 - DNA, 25 bp, Mus musculus
agtgttggcacctaggtcatctgct

SEQ ID NO: 219247 - DNA, 25 bp, Mus musculus
agtgttggccctctcattcagaaaa

SEQ ID NO: 219248 - DNA, 25 bp, Mus musculus
agtgttggccctgtcattcagaaaa

SEQ ID NO: 219249 - DNA, 25 bp, Mus musculus
agtgttggcctcattgtcattcaca

SEQ ID NO: 219250 - DNA, 25 bp, Mus musculus
agtgttggcctctttgtcattcaca

SEQ ID NO: 219251 - DNA, 25 bp, Mus musculus
agtgttggctgcctctggacctgct

SEQ ID NO: 219252 - DNA, 25 bp, Mus musculus
agtgttggctgcgtctggacctgct

SEQ ID NO: 219253 - DNA, 25 bp, Mus musculus
agtgttggctgtatggctgtcatct

SEQ ID NO: 219254 - DNA, 25 bp, Mus musculus
agtgttggctgtttggctgtcatct

SEQ ID NO: 219255 - DNA, 25 bp, Mus musculus
agtgttggctttacccatgggccat

SEQ ID NO: 219256 - DNA, 25 bp, Mus musculus
agtgttggcttttcccatgggccat

SEQ ID NO: 219257 - DNA, 25 bp, Mus musculus
agtgttgggtttctgtagtcattac

SEQ ID NO: 219258 - DNA, 25 bp, Mus musculus
agtgttgggtttgtgtagtcattac

SEQ ID NO: 219259 - DNA, 25 bp, Mus musculus
agtgttggtgtcatctagaggtgac

SEQ ID NO: 219260 - DNA, 25 bp, Mus musculus
agtgttggtgtcttctagaggtgac

SEQ ID NO: 219261 - DNA, 25 bp, Mus musculus
agtgttgtaatgcttgctagtcttt

SEQ ID NO: 219262 - DNA, 25 bp, Mus musculus
agtgttgtaatggttgctagtcttt

SEQ ID NO: 219263 - DNA, 25 bp, Mus musculus
agtgttgtaattcatccctgtgttg

SEQ ID NO: 219264 - DNA, 25 bp, Mus musculus
agtgttgtaattgatccctgtgttg

SEQ ID NO: 219265 - DNA, 25 bp, Mus musculus
agtgttgtatctctttcctgttttc

SEQ ID NO: 219266 - DNA, 25 bp, Mus musculus
agtgttgtatctgtttcctgttttc

SEQ ID NO: 219267 - DNA, 25 bp, Mus musculus
agtgttgtccagagggccttgtcca

SEQ ID NO: 219268 - DNA, 25 bp, Mus musculus
agtgttgtccagtgggccttgtcca

SEQ ID NO: 219269 - DNA, 25 bp, Mus musculus
agtgttgtccatcatgtccacagtg

SEQ ID NO: 219270 - DNA, 25 bp, Mus musculus
agtgttgtccatgatgtccacagtg

SEQ ID NO: 219271 - DNA, 25 bp, Mus musculus
agtgttgtcctcagtcttacagtca

SEQ ID NO: 219272 - DNA, 25 bp, Mus musculus
agtgttgtcctctgtcttacagtca

SEQ ID NO: 219273 - DNA, 25 bp, Mus musculus
agtgttgtcctgagtaaggcgcgtt

SEQ ID NO: 219274 - DNA, 25 bp, Mus musculus
agtgttgtcctgtgtaaggcgcgtt

SEQ ID NO: 219275 - DNA, 25 bp, Mus musculus
agtgttgtctacattacatggtatg

SEQ ID NO: 219276 - DNA, 25 bp, Mus musculus
agtgttgtctactttacatggtatg

SEQ ID NO: 219277 - DNA, 25 bp, Mus musculus
agtgttgtggctatgtagcacgccc

SEQ ID NO: 219278 - DNA, 25 bp, Mus musculus
agtgttgtggctttgtagcacgccc

SEQ ID NO: 219279 - DNA, 25 bp, Mus musculus
agtgttgtggtcacttagctgttaa

SEQ ID NO: 219280 - DNA, 25 bp, Mus musculus
agtgttgtggtctcttagctgttaa

SEQ ID NO: 219281 - DNA, 25 bp, Mus musculus
agtgttgtgtatccgtaggttctaa

SEQ ID NO: 219282 - DNA, 25 bp, Mus musculus
agtgttgtgtatgcgtaggttctaa

SEQ ID NO: 219283 - DNA, 25 bp, Mus musculus
agtgttgtgttccattctgcacagc

SEQ ID NO: 219284 - DNA, 25 bp, Mus musculus
agtgttgtgttcgattctgcacagc

SEQ ID NO: 219285 - DNA, 25 bp, Mus musculus
agtgttgttactctgaatgctataa

SEQ ID NO: 219286 - DNA, 25 bp, Mus musculus
agtgttgttactgtgaatgctataa

SEQ ID NO: 219287 - DNA, 25 bp, Mus musculus
agtgttgttgatcttcgcttggtcc

SEQ ID NO: 219288 - DNA, 25 bp, Mus musculus
agtgttgttgatgttcgcttggtcc

SEQ ID NO: 219289 - DNA, 25 bp, Mus musculus
agtgttgtttctagcacctggcatt

SEQ ID NO: 219290 - DNA, 25 bp, Mus musculus
agtgttgtttcttgcacctggcatt

SEQ ID NO: 219291 - DNA, 25 bp, Mus musculus
agtgttgttttccacctgtgctaaa

SEQ ID NO: 219292 - DNA, 25 bp, Mus musculus
agtgttgttttcgacctgtgctaaa

SEQ ID NO: 219293 - DNA, 25 bp, Mus musculus
agtgtttaagggaggctggcttaca

SEQ ID NO: 219294 - DNA, 25 bp, Mus musculus
agtgtttaagggtggctggcttaca

SEQ ID NO: 219295 - DNA, 25 bp, Mus musculus
agtgtttaatgcatcctggctgtag

SEQ ID NO: 219296 - DNA, 25 bp, Mus musculus
agtgtttaatgcttcctggctgtag

SEQ ID NO: 219297 - DNA, 25 bp, Mus musculus
agtgtttacagcattgccatgtccc

SEQ ID NO: 219298 - DNA, 25 bp, Mus musculus
agtgtttacagctttgccatgtccc

SEQ ID NO: 219299 - DNA, 25 bp, Mus musculus
agtgtttactcactgtggctcccgc

SEQ ID NO: 219300 - DNA, 25 bp, Mus musculus
agtgtttactcagtgtggctcccgc

SEQ ID NO: 219301 - DNA, 25 bp, Mus musculus
agtgtttagtaaacgcttccctggt

SEQ ID NO: 219302 - DNA, 25 bp, Mus musculus
agtgtttagtaatcgcttccctggt

SEQ ID NO: 219303 - DNA, 25 bp, Mus musculus
agtgtttagtacagcatccatccca

SEQ ID NO: 219304 - DNA, 25 bp, Mus musculus
agtgtttagtactgcatccatccca

SEQ ID NO: 219305 - DNA, 25 bp, Mus musculus
agtgtttatccactcacaccctttc

SEQ ID NO: 219306 - DNA, 25 bp, Mus musculus
agtgtttatccagtcacaccctttc

SEQ ID NO: 219307 - DNA, 25 bp, Mus musculus
agtgtttatgaaatacttccctgac

SEQ ID NO: 219308 - DNA, 25 bp, Mus musculus
agtgtttatgaattacttccctgac

SEQ ID NO: 219309 - DNA, 25 bp, Mus musculus
agtgtttatgctacgctggcctgtt

SEQ ID NO: 219310 - DNA, 25 bp, Mus musculus
agtgtttatgcttcgctggcctgtt

SEQ ID NO: 219311 - DNA, 25 bp, Mus musculus
agtgtttattctaacctatggctga

SEQ ID NO: 219312 - DNA, 25 bp, Mus musculus
agtgtttattcttacctatggctga

SEQ ID NO: 219313 - DNA, 25 bp, Mus musculus
agtgtttcaaagagaccttctcaca

SEQ ID NO: 219314 - DNA, 25 bp, Mus musculus
agtgtttcaaagtgaccttctcaca

SEQ ID NO: 219315 - DNA, 25 bp, Mus musculus
agtgtttcaaccctttggtctatgg

SEQ ID NO: 219316 - DNA, 25 bp, Mus musculus
agtgtttcaaccgtttggtctatgg

SEQ ID NO: 219317 - DNA, 25 bp, Mus musculus
agtgtttcacgtcaagatgacccat

SEQ ID NO: 219318 - DNA, 25 bp, Mus musculus
agtgtttcacgtgaagatgacccat

SEQ ID NO: 219319 - DNA, 25 bp, Mus musculus
agtgtttcagagcagagattcatga

SEQ ID NO: 219320 - DNA, 25 bp, Mus musculus
agtgtttcagaggagagattcatga

SEQ ID NO: 219321 - DNA, 25 bp, Mus musculus
agtgtttcagccatttctgcgtcag

SEQ ID NO: 219322 - DNA, 25 bp, Mus musculus
agtgtttcagccttttctgcgtcag

SEQ ID NO: 219323 - DNA, 25 bp, Mus musculus
agtgtttcagtgcttaccatggtgt

SEQ ID NO: 219324 - DNA, 25 bp, Mus musculus
agtgtttcagtggttaccatggtgt

SEQ ID NO: 219325 - DNA, 25 bp, Mus musculus
agtgtttcatatcacccattttttc

SEQ ID NO: 219326 - DNA, 25 bp, Mus musculus
agtgtttcatatgacccattttttc

SEQ ID NO: 219327 - DNA, 25 bp, Mus musculus
agtgtttcatcaacttgctacaagc

SEQ ID NO: 219328 - DNA, 25 bp, Mus musculus
agtgtttcatcatcttgctacaagc

SEQ ID NO: 219329 - DNA, 25 bp, Mus musculus
agtgtttcattaatcatcccaaggt

SEQ ID NO: 219330 - DNA, 25 bp, Mus musculus
agtgtttcattattcatcccaaggt

SEQ ID NO: 219331 - DNA, 25 bp, Mus musculus
agtgtttccaaactcattgcccaag

SEQ ID NO: 219332 - DNA, 25 bp, Mus musculus
agtgtttccaaagtcattgcccaag

SEQ ID NO: 219333 - DNA, 25 bp, Mus musculus
agtgtttccacgcttttgctgcagt

SEQ ID NO: 219334 - DNA, 25 bp, Mus musculus
agtgtttccacggttttgctgcagt

SEQ ID NO: 219335 - DNA, 25 bp, Mus musculus
agtgtttccattagagtcccacttg

SEQ ID NO: 219336 - DNA, 25 bp, Mus musculus
agtgtttccatttgagtcccacttg

SEQ ID NO: 219337 - DNA, 25 bp, Mus musculus
agtgtttcccagatgtaatgctaag

SEQ ID NO: 219338 - DNA, 25 bp, Mus musculus
agtgtttcccagttgtaatgctaag

SEQ ID NO: 219339 - DNA, 25 bp, Mus musculus
agtgtttccctgattatctatccct

SEQ ID NO: 219340 - DNA, 25 bp, Mus musculus
agtgtttccctgtttatctatccct

SEQ ID NO: 219341 - DNA, 25 bp, Mus musculus
agtgtttcccttactcaacaggatt

SEQ ID NO: 219342 - DNA, 25 bp, Mus musculus
agtgtttcccttcggtacaggatag

SEQ ID NO: 219343 - DNA, 25 bp, Mus musculus
agtgtttcccttgggtacaggatag

SEQ ID NO: 219344 - DNA, 25 bp, Mus musculus
agtgtttccctttctcaacaggatt

SEQ ID NO: 219345 - DNA, 25 bp, Mus musculus
agtgtttcctgcactggtaacgggt

SEQ ID NO: 219346 - DNA, 25 bp, Mus musculus
agtgtttcctgctctggtaacgggt

SEQ ID NO: 219347 - DNA, 25 bp, Mus musculus
agtgtttcgaagcacctgcgtacag

SEQ ID NO: 219348 - DNA, 25 bp, Mus musculus
agtgtttcgaaggacctgcgtacag

SEQ ID NO: 219349 - DNA, 25 bp, Mus musculus
agtgtttcgaggctatgtctccata

SEQ ID NO: 219350 - DNA, 25 bp, Mus musculus
agtgtttcgagggtatgtctccata

SEQ ID NO: 219351 - DNA, 25 bp, Mus musculus
agtgtttcgcgccacatatgcgtgt

SEQ ID NO: 219352 - DNA, 25 bp, Mus musculus
agtgtttcgcgcgacatatgcgtgt

SEQ ID NO: 219353 - DNA, 25 bp, Mus musculus
agtgtttcggccaggagtcctactg

SEQ ID NO: 219354 - DNA, 25 bp, Mus musculus
agtgtttcggcctggagtcctactg

SEQ ID NO: 219355 - DNA, 25 bp, Mus musculus
agtgtttctagcaaagttgcccctt

SEQ ID NO: 219356 - DNA, 25 bp, Mus musculus
agtgtttctagctaagttgcccctt

SEQ ID NO: 219357 - DNA, 25 bp, Mus musculus
agtgtttctcatctatccttggctc

SEQ ID NO: 219358 - DNA, 25 bp, Mus musculus
agtgtttctcatgtatccttggctc

SEQ ID NO: 219359 - DNA, 25 bp, Mus musculus
agtgtttctcctcgagaccttccat

SEQ ID NO: 219360 - DNA, 25 bp, Mus musculus
agtgtttctcctggagaccttccat

SEQ ID NO: 219361 - DNA, 25 bp, Mus musculus
agtgtttctgggaacctgagtgctc

SEQ ID NO: 219362 - DNA, 25 bp, Mus musculus
agtgtttctgggtacctgagtgctc

SEQ ID NO: 219363 - DNA, 25 bp, Mus musculus
agtgtttctgtgactttatttgcaa

SEQ ID NO: 219364 - DNA, 25 bp, Mus musculus
agtgtttctgtgtctttatttgcaa

SEQ ID NO: 219365 - DNA, 25 bp, Mus musculus
agtgtttcttagagtgcacatttat

SEQ ID NO: 219366 - DNA, 25 bp, Mus musculus
agtgtttcttagtgtgcacatttat

SEQ ID NO: 219367 - DNA, 25 bp, Mus musculus
agtgtttcttcaacctacatgatga

SEQ ID NO: 219368 - DNA, 25 bp, Mus musculus
agtgtttcttcatcctacatgatga

SEQ ID NO: 219369 - DNA, 25 bp, Mus musculus
agtgtttcttgaactgtatgccaca

SEQ ID NO: 219370 - DNA, 25 bp, Mus musculus
agtgtttcttgatctgtatgccaca

SEQ ID NO: 219371 - DNA, 25 bp, Mus musculus
agtgtttcttttaaaggcgtgcatc

SEQ ID NO: 219372 - DNA, 25 bp, Mus musculus
agtgtttctttttaaggcgtgcatc

SEQ ID NO: 219373 - DNA, 25 bp, Mus musculus
agtgtttgacacaactcttgattaa

SEQ ID NO: 219374 - DNA, 25 bp, Mus musculus
agtgtttgacactactcttgattaa

SEQ ID NO: 219375 - DNA, 25 bp, Mus musculus
agtgtttgacctacgctacaagtta

SEQ ID NO: 219376 - DNA, 25 bp, Mus musculus
agtgtttgaccttcgctacaagtta

SEQ ID NO: 219377 - DNA, 25 bp, Mus musculus
agtgtttgaggccttccctgagacc

SEQ ID NO: 219378 - DNA, 25 bp, Mus musculus
agtgtttgaggcgttccctgagacc

SEQ ID NO: 219379 - DNA, 25 bp, Mus musculus
agtgtttgattaactacctttcaat

SEQ ID NO: 219380 - DNA, 25 bp, Mus musculus
agtgtttgattatctacctttcaat

SEQ ID NO: 219381 - DNA, 25 bp, Mus musculus
agtgtttgattgcattgggtctgtc

SEQ ID NO: 219382 - DNA, 25 bp, Mus musculus
agtgtttgattggattgggtctgtc

SEQ ID NO: 219383 - DNA, 25 bp, Mus musculus
agtgtttgcattaaagcctcccatg

SEQ ID NO: 219384 - DNA, 25 bp, Mus musculus
agtgtttgcatttaagcctcccatg

SEQ ID NO: 219385 - DNA, 25 bp, Mus musculus
agtgtttgccaaagccgagctctat

SEQ ID NO: 219386 - DNA, 25 bp, Mus musculus
agtgtttgccaatgccgagctctat

SEQ ID NO: 219387 - DNA, 25 bp, Mus musculus
agtgtttgccatacagtaaaatcct

SEQ ID NO: 219388 - DNA, 25 bp, Mus musculus
agtgtttgccattcagtaaaatcct

SEQ ID NO: 219389 - DNA, 25 bp, Mus musculus
agtgtttgccttctgtgtttgttcc

SEQ ID NO: 219390 - DNA, 25 bp, Mus musculus
agtgtttgccttgtgtgtttgttcc

SEQ ID NO: 219391 - DNA, 25 bp, Mus musculus
agtgtttgcttaattgctcattttg

SEQ ID NO: 219392 - DNA, 25 bp, Mus musculus
agtgtttgcttatttgctcattttg

SEQ ID NO: 219393 - DNA, 25 bp, Mus musculus
agtgtttgcttcacagatctcttct

SEQ ID NO: 219394 - DNA, 25 bp, Mus musculus
agtgtttgcttctcagatctcttct

SEQ ID NO: 219395 - DNA, 25 bp, Mus musculus
agtgtttggtgaaggtctctgatgt

SEQ ID NO: 219396 - DNA, 25 bp, Mus musculus
agtgtttggtgatggtctctgatgt

SEQ ID NO: 219397 - DNA, 25 bp, Mus musculus
agtgtttgtagtagacttgtttatt

SEQ ID NO: 219398 - DNA, 25 bp, Mus musculus
agtgtttgtagttgacttgtttatt

SEQ ID NO: 219399 - DNA, 25 bp, Mus musculus
agtgtttgtataaacccgggccata

SEQ ID NO: 219400 - DNA, 25 bp, Mus musculus
agtgtttgtatatacccgggccata

SEQ ID NO: 219401 - DNA, 25 bp, Mus musculus
agtgtttgtcatctgtcctcagtcc

SEQ ID NO: 219402 - DNA, 25 bp, Mus musculus
agtgtttgtcatgtgtcctcagtcc

SEQ ID NO: 219403 - DNA, 25 bp, Mus musculus
agtgtttgtctcaccgatttgaaaa

SEQ ID NO: 219404 - DNA, 25 bp, Mus musculus
agtgtttgtctctccgatttgaaaa

SEQ ID NO: 219405 - DNA, 25 bp, Mus musculus
agtgtttgttccctccaagtgtact

SEQ ID NO: 219406 - DNA, 25 bp, Mus musculus
agtgtttgttccgtccaagtgtact

SEQ ID NO: 219407 - DNA, 25 bp, Mus musculus
agtgtttgttttcatctcctgtcaa

SEQ ID NO: 219408 - DNA, 25 bp, Mus musculus
agtgtttgttttgatctcctgtcaa

SEQ ID NO: 219409 - DNA, 25 bp, Mus musculus
agtgttttaccaatggacatagact

SEQ ID NO: 219410 - DNA, 25 bp, Mus musculus
agtgttttaccattggacatagact

SEQ ID NO: 219411 - DNA, 25 bp, Mus musculus
agtgttttagttacccctgtgcagc

SEQ ID NO: 219412 - DNA, 25 bp, Mus musculus
agtgttttagtttcccctgtgcagc

SEQ ID NO: 219413 - DNA, 25 bp, Mus musculus
agtgttttattcaggacagggttct

SEQ ID NO: 219414 - DNA, 25 bp, Mus musculus
agtgttttattctggacagggttct

SEQ ID NO: 219415 - DNA, 25 bp, Mus musculus
agtgttttcaaaagggtggctcgca

SEQ ID NO: 219416 - DNA, 25 bp, Mus musculus
agtgttttcaaatgggtggctcgca

SEQ ID NO: 219417 - DNA, 25 bp, Mus musculus
agtgttttcaacagtgacgaagagc

SEQ ID NO: 219418 - DNA, 25 bp, Mus musculus
agtgttttcaactgtgacgaagagc

SEQ ID NO: 219419 - DNA, 25 bp, Mus musculus
agtgttttcactagactctgagtaa

SEQ ID NO: 219420 - DNA, 25 bp, Mus musculus
agtgttttcacttgactctgagtaa

SEQ ID NO: 219421 - DNA, 25 bp, Mus musculus
agtgttttcataaaactggtgatca

SEQ ID NO: 219422 - DNA, 25 bp, Mus musculus
agtgttttcatataactggtgatca

SEQ ID NO: 219423 - DNA, 25 bp, Mus musculus
agtgttttcattctggtccttagta

SEQ ID NO: 219424 - DNA, 25 bp, Mus musculus
agtgttttcattgtggtccttagta

SEQ ID NO: 219425 - DNA, 25 bp, Mus musculus
agtgttttccacactagggattcag

SEQ ID NO: 219426 - DNA, 25 bp, Mus musculus
agtgttttccactctagggattcag

SEQ ID NO: 219427 - DNA, 25 bp, Mus musculus
agtgttttcgcacactgcattcagc

SEQ ID NO: 219428 - DNA, 25 bp, Mus musculus
agtgttttcgcagactgcattcagc

SEQ ID NO: 219429 - DNA, 25 bp, Mus musculus
agtgttttctatattaggcgtgatt

SEQ ID NO: 219430 - DNA, 25 bp, Mus musculus
agtgttttctattttaggcgtgatt

SEQ ID NO: 219431 - DNA, 25 bp, Mus musculus
agtgttttctcgacagtgcttctaa

SEQ ID NO: 219432 - DNA, 25 bp, Mus musculus
agtgttttctcgtcagtgcttctaa

SEQ ID NO: 219433 - DNA, 25 bp, Mus musculus
agtgttttctgtcactaaacttcat

SEQ ID NO: 219434 - DNA, 25 bp, Mus musculus
agtgttttctgtgactaaacttcat

SEQ ID NO: 219435 - DNA, 25 bp, Mus musculus
agtgttttgaaacctgggcttctct

SEQ ID NO: 219436 - DNA, 25 bp, Mus musculus
agtgttttgaaagctgggcttctct

SEQ ID NO: 219437 - DNA, 25 bp, Mus musculus
agtgttttgtgaccctattgctgga

SEQ ID NO: 219438 - DNA, 25 bp, Mus musculus
agtgttttgtgagcctattgctgga

SEQ ID NO: 219439 - DNA, 25 bp, Mus musculus
agtgtttttattctcctgctccagc

SEQ ID NO: 219440 - DNA, 25 bp, Mus musculus
agtgtttttattgtcctgctccagc

SEQ ID NO: 219441 - DNA, 25 bp, Mus musculus
agtgtttttccaaagagcaaggtgc

SEQ ID NO: 219442 - DNA, 25 bp, Mus musculus
agtgtttttccatagagcaaggtgc

SEQ ID NO: 219443 - DNA, 25 bp, Mus musculus
agtgtttttcgacaggcgagaatga

SEQ ID NO: 219444 - DNA, 25 bp, Mus musculus
agtgtttttcgagaggcgagaatga

SEQ ID NO: 219445 - DNA, 25 bp, Mus musculus
agttaaaaaacgatgctgacctatg

SEQ ID NO: 219446 - DNA, 25 bp, Mus musculus
agttaaaaaacgttgctgacctatg

SEQ ID NO: 219447 - DNA, 25 bp, Mus musculus
agttaaaagtacatctggaggactt

SEQ ID NO: 219448 - DNA, 25 bp, Mus musculus
agttaaaagtacttctggaggactt

SEQ ID NO: 219449 - DNA, 25 bp, Mus musculus
agttaaacccagcattcgcggacgc

SEQ ID NO: 219450 - DNA, 25 bp, Mus musculus
agttaaacccaggattcgcggacgc

SEQ ID NO: 219451 - DNA, 25 bp, Mus musculus
agttaaagcctgctggaagattgat

SEQ ID NO: 219452 - DNA, 25 bp, Mus musculus
agttaaagcctggtggaagattgat

SEQ ID NO: 219453 - DNA, 25 bp, Mus musculus
agttaaagtatcaggcctttctccg

SEQ ID NO: 219454 - DNA, 25 bp, Mus musculus
agttaaagtatctggcctttctccg

SEQ ID NO: 219455 - DNA, 25 bp, Mus musculus
agttaaataacaacacattcagtgt

SEQ ID NO: 219456 - DNA, 25 bp, Mus musculus
agttaaataacatcacattcagtgt

SEQ ID NO: 219457 - DNA, 25 bp, Mus musculus
agttaaatgaccacactcagcactg

SEQ ID NO: 219458 - DNA, 25 bp, Mus musculus
agttaaatgacctcactcagcactg

SEQ ID NO: 219459 - DNA, 25 bp, Mus musculus
agttaaattctgaacctataaggca

SEQ ID NO: 219460 - DNA, 25 bp, Mus musculus
agttaaattctgtacctataaggca

SEQ ID NO: 219461 - DNA, 25 bp, Mus musculus
agttaaattcttctctccataaatt

SEQ ID NO: 219462 - DNA, 25 bp, Mus musculus
agttaaattcttgtctccataaatt

SEQ ID NO: 219463 - DNA, 25 bp, Mus musculus
agttaacagaaaccccaatccgcat

SEQ ID NO: 219464 - DNA, 25 bp, Mus musculus
agttaacagaaagcccaatccgcat

SEQ ID NO: 219465 - DNA, 25 bp, Mus musculus
agttaacaggtcacatcagggatgc

SEQ ID NO: 219466 - DNA, 25 bp, Mus musculus
agttaacaggtctcatcagggatgc

SEQ ID NO: 219467 - DNA, 25 bp, Mus musculus
agttaacatgatatggagccaccat

SEQ ID NO: 219468 - DNA, 25 bp, Mus musculus
agttaacatgatttggagccaccat

SEQ ID NO: 219469 - DNA, 25 bp, Mus musculus
agttaacccatcacagacacacaat

SEQ ID NO: 219470 - DNA, 25 bp, Mus musculus
agttaacccatctcagacacacaat

SEQ ID NO: 219471 - DNA, 25 bp, Mus musculus
agttaacctttaacttcatggctag

SEQ ID NO: 219472 - DNA, 25 bp, Mus musculus
agttaacctttatcttcatggctag

SEQ ID NO: 219473 - DNA, 25 bp, Mus musculus
agttaacggcagcactcttggatta

SEQ ID NO: 219474 - DNA, 25 bp, Mus musculus
agttaacggcaggactcttggatta

SEQ ID NO: 219475 - DNA, 25 bp, Mus musculus
agttaactaacaaccctgggctttg

SEQ ID NO: 219476 - DNA, 25 bp, Mus musculus
agttaactaacatccctgggctttg

SEQ ID NO: 219477 - DNA, 25 bp, Mus musculus
agttaactaactcggcactgtaatt

SEQ ID NO: 219478 - DNA, 25 bp, Mus musculus
agttaactaactgggcactgtaatt

SEQ ID NO: 219479 - DNA, 25 bp, Mus musculus
agttaactgtccctgtgaggcgctc

SEQ ID NO: 219480 - DNA, 25 bp, Mus musculus
agttaactgtccgtgtgaggcgctc

SEQ ID NO: 219481 - DNA, 25 bp, Mus musculus
agttaacttcagagagcctttcaaa

SEQ ID NO: 219482 - DNA, 25 bp, Mus musculus
agttaacttcagctctaccttggaa

SEQ ID NO: 219483 - DNA, 25 bp, Mus musculus
agttaacttcaggtctaccttggaa

SEQ ID NO: 219484 - DNA, 25 bp, Mus musculus
agttaacttcagtgagcctttcaaa

SEQ ID NO: 219485 - DNA, 25 bp, Mus musculus
agttaacttcttaaggtccatgtgt

SEQ ID NO: 219486 - DNA, 25 bp, Mus musculus
agttaacttctttaggtccatgtgt

SEQ ID NO: 219487 - DNA, 25 bp, Mus musculus
agttaacttggtactgctactagga

SEQ ID NO: 219488 - DNA, 25 bp, Mus musculus
agttaacttggttctgctactagga

SEQ ID NO: 219489 - DNA, 25 bp, Mus musculus
agttaagaaactcctgttgagatgc

SEQ ID NO: 219490 - DNA, 25 bp, Mus musculus
agttaagaaactgctgttgagatgc

SEQ ID NO: 219491 - DNA, 25 bp, Mus musculus
agttaagagctgactcactgggtca

SEQ ID NO: 219492 - DNA, 25 bp, Mus musculus
agttaagagctgtctcactgggtca

SEQ ID NO: 219493 - DNA, 25 bp, Mus musculus
agttaagaggtgatcgctgcgcctt

SEQ ID NO: 219494 - DNA, 25 bp, Mus musculus
agttaagaggtgttcgctgcgcctt

SEQ ID NO: 219495 - DNA, 25 bp, Mus musculus
agttaagattcccagacaccacagg

SEQ ID NO: 219496 - DNA, 25 bp, Mus musculus
agttaagattccgagacaccacagg

SEQ ID NO: 219497 - DNA, 25 bp, Mus musculus
agttaagcacatcgctgttcattcc

SEQ ID NO: 219498 - DNA, 25 bp, Mus musculus
agttaagcacatggctgttcattcc

SEQ ID NO: 219499 - DNA, 25 bp, Mus musculus
agttaagccagtagtgatgctgcca

SEQ ID NO: 219500 - DNA, 25 bp, Mus musculus
agttaagccagttgtgatgctgcca

SEQ ID NO: 219501 - DNA, 25 bp, Mus musculus
agttaagcccaccatattagcctca

SEQ ID NO: 219502 - DNA, 25 bp, Mus musculus
agttaagcccacgatattagcctca

SEQ ID NO: 219503 - DNA, 25 bp, Mus musculus
agttaagcccatcggcgcccacgga

SEQ ID NO: 219504 - DNA, 25 bp, Mus musculus
agttaagcccatgggcgcccacgga

SEQ ID NO: 219505 - DNA, 25 bp, Mus musculus
agttaagcctttagacacgtctgtt

SEQ ID NO: 219506 - DNA, 25 bp, Mus musculus
agttaagccttttgacacgtctgtt

SEQ ID NO: 219507 - DNA, 25 bp, Mus musculus
agttaagctctcatcatcatgatgt

SEQ ID NO: 219508 - DNA, 25 bp, Mus musculus
agttaagctctcttcatcatgatgt

SEQ ID NO: 219509 - DNA, 25 bp, Mus musculus
agttaagcttgtactgctctcttgg

SEQ ID NO: 219510 - DNA, 25 bp, Mus musculus
agttaagcttgttctgctctcttgg

SEQ ID NO: 219511 - DNA, 25 bp, Mus musculus
agttaaggatctctctggctcccac

SEQ ID NO: 219512 - DNA, 25 bp, Mus musculus
agttaaggatctgtctggctcccac

SEQ ID NO: 219513 - DNA, 25 bp, Mus musculus
agttaaggcacacactttccgagtc

SEQ ID NO: 219514 - DNA, 25 bp, Mus musculus
agttaaggcacagactttccgagtc

SEQ ID NO: 219515 - DNA, 25 bp, Mus musculus
agttaagtctacactttgccatctg

SEQ ID NO: 219516 - DNA, 25 bp, Mus musculus
agttaagtctactctttgccatctg

SEQ ID NO: 219517 - DNA, 25 bp, Mus musculus
agttaagtgcacaggatccaggttg

SEQ ID NO: 219518 - DNA, 25 bp, Mus musculus
agttaagtgcactggatccaggttg

SEQ ID NO: 219519 - DNA, 25 bp, Mus musculus
agttaagtgcatatacttgacaata

SEQ ID NO: 219520 - DNA, 25 bp, Mus musculus
agttaagtgcatttacttgacaata

SEQ ID NO: 219521 - DNA, 25 bp, Mus musculus
agttaagtgttgacagttctgctgc

SEQ ID NO: 219522 - DNA, 25 bp, Mus musculus
agttaagtgttgtcagttctgctgc

SEQ ID NO: 219523 - DNA, 25 bp, Mus musculus
agttaagttattccataaactcatt

SEQ ID NO: 219524 - DNA, 25 bp, Mus musculus
agttaagttattgcataaactcatt

SEQ ID NO: 219525 - DNA, 25 bp, Mus musculus
agttaagttcacagtcctcaactcc

SEQ ID NO: 219526 - DNA, 25 bp, Mus musculus
agttaagttcactgtcctcaactcc

SEQ ID NO: 219527 - DNA, 25 bp, Mus musculus
agttaagttgggatccttcatggaa

SEQ ID NO: 219528 - DNA, 25 bp, Mus musculus
agttaagttgggttccttcatggaa

SEQ ID NO: 219529 - DNA, 25 bp, Mus musculus
agttaatactccaataccaagtgta

SEQ ID NO: 219530 - DNA, 25 bp, Mus musculus
agttaatactcctataccaagtgta

SEQ ID NO: 219531 - DNA, 25 bp, Mus musculus
agttaatcccatcgtgctgttgctg

SEQ ID NO: 219532 - DNA, 25 bp, Mus musculus
agttaatcccatggtgctgttgctg

SEQ ID NO: 219533 - DNA, 25 bp, Mus musculus
agttaatccctacaaatacccagag

SEQ ID NO: 219534 - DNA, 25 bp, Mus musculus
agttaatccctagaaatacccagag

SEQ ID NO: 219535 - DNA, 25 bp, Mus musculus
agttaatccttcaccaaatctctta

SEQ ID NO: 219536 - DNA, 25 bp, Mus musculus
agttaatccttctccaaatctctta

SEQ ID NO: 219537 - DNA, 25 bp, Mus musculus
agttaatctcatagtctccttgctg

SEQ ID NO: 219538 - DNA, 25 bp, Mus musculus
agttaatctcattgtctccttgctg

SEQ ID NO: 219539 - DNA, 25 bp, Mus musculus
agttaatctgtaagtcctgtctgcc

SEQ ID NO: 219540 - DNA, 25 bp, Mus musculus
agttaatctgtatgtcctgtctgcc

SEQ ID NO: 219541 - DNA, 25 bp, Mus musculus
agttaatcttatatgccatcccttg

SEQ ID NO: 219542 - DNA, 25 bp, Mus musculus
agttaatcttatttgccatcccttg

SEQ ID NO: 219543 - DNA, 25 bp, Mus musculus
agttaatggaccatctccctgacag

SEQ ID NO: 219544 - DNA, 25 bp, Mus musculus
agttaatggaccttctccctgacag

SEQ ID NO: 219545 - DNA, 25 bp, Mus musculus
agttaatggatgagactggctttac

SEQ ID NO: 219546 - DNA, 25 bp, Mus musculus
agttaatggatgtgactggctttac

SEQ ID NO: 219547 - DNA, 25 bp, Mus musculus
agttaatgtcctctcgtttctttat

SEQ ID NO: 219548 - DNA, 25 bp, Mus musculus
agttaatgtcctgtcgtttctttat

SEQ ID NO: 219549 - DNA, 25 bp, Mus musculus
agttaatgtgagagagagccagcca

SEQ ID NO: 219550 - DNA, 25 bp, Mus musculus
agttaatgtgagtgagagccagcca

SEQ ID NO: 219551 - DNA, 25 bp, Mus musculus
agttaatgtgccagctttgattttc

SEQ ID NO: 219552 - DNA, 25 bp, Mus musculus
agttaatgtgcctgctttgattttc

SEQ ID NO: 219553 - DNA, 25 bp, Mus musculus
agttaattcatcatgttagctagat

SEQ ID NO: 219554 - DNA, 25 bp, Mus musculus
agttaattcatcttgttagctagat

SEQ ID NO: 219555 - DNA, 25 bp, Mus musculus
agttaattccaactgaacaccctgg

SEQ ID NO: 219556 - DNA, 25 bp, Mus musculus
agttaattccaagtgaacaccctgg

SEQ ID NO: 219557 - DNA, 25 bp, Mus musculus
agttaattctcaccaattggccctt

SEQ ID NO: 219558 - DNA, 25 bp, Mus musculus
agttaattctcagcaattggccctt

SEQ ID NO: 219559 - DNA, 25 bp, Mus musculus
agttaatttccaaacttccctcttg

SEQ ID NO: 219560 - DNA, 25 bp, Mus musculus
agttaatttccatacttccctcttg

SEQ ID NO: 219561 - DNA, 25 bp, Mus musculus
agttacaactctatactctcaccag

SEQ ID NO: 219562 - DNA, 25 bp, Mus musculus
agttacaactctttactctcaccag

SEQ ID NO: 219563 - DNA, 25 bp, Mus musculus
agttacaagcacagaggtggccagc

SEQ ID NO: 219564 - DNA, 25 bp, Mus musculus
agttacaagcactgaggtggccagc

SEQ ID NO: 219565 - DNA, 25 bp, Mus musculus
agttacaaggaacactgccctccac

SEQ ID NO: 219566 - DNA, 25 bp, Mus musculus
agttacaaggaagactgccctccac

SEQ ID NO: 219567 - DNA, 25 bp, Mus musculus
agttacaaggtcacatccagctggt

SEQ ID NO: 219568 - DNA, 25 bp, Mus musculus
agttacaaggtctcatccagctggt

SEQ ID NO: 219569 - DNA, 25 bp, Mus musculus
agttacacacttaaccattgacgag

SEQ ID NO: 219570 - DNA, 25 bp, Mus musculus
agttacacactttaccattgacgag

SEQ ID NO: 219571 - DNA, 25 bp, Mus musculus
agttacaccataaggattttccagt

SEQ ID NO: 219572 - DNA, 25 bp, Mus musculus
agttacaccatatggattttccagt

SEQ ID NO: 219573 - DNA, 25 bp, Mus musculus
agttacaccatgatgctcagcacag

SEQ ID NO: 219574 - DNA, 25 bp, Mus musculus
agttacaccatgttgctcagcacag

SEQ ID NO: 219575 - DNA, 25 bp, Mus musculus
agttacagaaagaggtgctcagttg

SEQ ID NO: 219576 - DNA, 25 bp, Mus musculus
agttacagaaagtggtgctcagttg

SEQ ID NO: 219577 - DNA, 25 bp, Mus musculus
agttacagcaggctccagttcatcc

SEQ ID NO: 219578 - DNA, 25 bp, Mus musculus
agttacagcagggtccagttcatcc

SEQ ID NO: 219579 - DNA, 25 bp, Mus musculus
agttacagctgtccagtgcctgtta

SEQ ID NO: 219580 - DNA, 25 bp, Mus musculus
agttacagctgtgcagtgcctgtta

SEQ ID NO: 219581 - DNA, 25 bp, Mus musculus
agttacagctttactcacagacaag

SEQ ID NO: 219582 - DNA, 25 bp, Mus musculus
agttacagcttttctcacagacaag

SEQ ID NO: 219583 - DNA, 25 bp, Mus musculus
agttacaggatccaccgatgagaag

SEQ ID NO: 219584 - DNA, 25 bp, Mus musculus
agttacaggatcgaccgatgagaag

SEQ ID NO: 219585 - DNA, 25 bp, Mus musculus
agttacagtcttacaaatggttcct

SEQ ID NO: 219586 - DNA, 25 bp, Mus musculus
agttacagtctttcaaatggttcct

SEQ ID NO: 219587 - DNA, 25 bp, Mus musculus
agttacagtggtcgcactttctaca

SEQ ID NO: 219588 - DNA, 25 bp, Mus musculus
agttacagtggtggcactttctaca

SEQ ID NO: 219589 - DNA, 25 bp, Mus musculus
agttacatccgaaccaagaagctgg

SEQ ID NO: 219590 - DNA, 25 bp, Mus musculus
agttacatccgatccaagaagctgg

SEQ ID NO: 219591 - DNA, 25 bp, Mus musculus
agttacatctgaccacatcagcgta

SEQ ID NO: 219592 - DNA, 25 bp, Mus musculus
agttacatctgagcacatcagcgta

SEQ ID NO: 219593 - DNA, 25 bp, Mus musculus
agttacatgacgctggtgggagatc

SEQ ID NO: 219594 - DNA, 25 bp, Mus musculus
agttacatgacggtggtgggagatc

SEQ ID NO: 219595 - DNA, 25 bp, Mus musculus
agttacatgccactaagggttacac

SEQ ID NO: 219596 - DNA, 25 bp, Mus musculus
agttacatgccagtaagggttacac

SEQ ID NO: 219597 - DNA, 25 bp, Mus musculus
agttacatggatcgctgttcccaca

SEQ ID NO: 219598 - DNA, 25 bp, Mus musculus
agttacatggatggctgttcccaca

SEQ ID NO: 219599 - DNA, 25 bp, Mus musculus
agttacatttacagcagactttctc

SEQ ID NO: 219600 - DNA, 25 bp, Mus musculus
agttacatttactgcagactttctc

SEQ ID NO: 219601 - DNA, 25 bp, Mus musculus
agttaccaagttctggacctcgtgg

SEQ ID NO: 219602 - DNA, 25 bp, Mus musculus
agttaccaagttgtggacctcgtgg

SEQ ID NO: 219603 - DNA, 25 bp, Mus musculus
agttaccacattatgtttcttgagt

SEQ ID NO: 219604 - DNA, 25 bp, Mus musculus
agttaccacattttgtttcttgagt

SEQ ID NO: 219605 - DNA, 25 bp, Mus musculus
agttaccactatctttgcctacaaa

SEQ ID NO: 219606 - DNA, 25 bp, Mus musculus
agttaccactatgtttgcctacaaa

SEQ ID NO: 219607 - DNA, 25 bp, Mus musculus
agttaccactggacaacactctggt

SEQ ID NO: 219608 - DNA, 25 bp, Mus musculus
agttaccactggtcaacactctggt

SEQ ID NO: 219609 - DNA, 25 bp, Mus musculus
agttaccacttacctagttccacct

SEQ ID NO: 219610 - DNA, 25 bp, Mus musculus
agttaccacttagctagttccacct

SEQ ID NO: 219611 - DNA, 25 bp, Mus musculus
agttaccagcttctcttgttgtttg

SEQ ID NO: 219612 - DNA, 25 bp, Mus musculus
agttaccagcttgtcttgttgtttg

SEQ ID NO: 219613 - DNA, 25 bp, Mus musculus
agttaccagtggctttgagtaggat

SEQ ID NO: 219614 - DNA, 25 bp, Mus musculus
agttaccagtgggtttgagtaggat

SEQ ID NO: 219615 - DNA, 25 bp, Mus musculus
agttaccagtttcttccgactctca

SEQ ID NO: 219616 - DNA, 25 bp, Mus musculus
agttaccagtttgttccgactctca

SEQ ID NO: 219617 - DNA, 25 bp, Mus musculus
agttaccataggactggtagtctac

SEQ ID NO: 219618 - DNA, 25 bp, Mus musculus
agttaccataggtctggtagtctac

SEQ ID NO: 219619 - DNA, 25 bp, Mus musculus
agttaccatcttcagtcttacttgg

SEQ ID NO: 219620 - DNA, 25 bp, Mus musculus
agttaccatcttgagtcttacttgg

SEQ ID NO: 219621 - DNA, 25 bp, Mus musculus
agttaccatggcatccatcagctgg

SEQ ID NO: 219622 - DNA, 25 bp, Mus musculus
agttaccatggcttccatcagctgg

SEQ ID NO: 219623 - DNA, 25 bp, Mus musculus
agttaccccgacacaaggagctctt

SEQ ID NO: 219624 - DNA, 25 bp, Mus musculus
agttaccccgactcaaggagctctt

SEQ ID NO: 219625 - DNA, 25 bp, Mus musculus
agttaccctgatacttaagtcacat

SEQ ID NO: 219626 - DNA, 25 bp, Mus musculus
agttaccctgattcttaagtcacat

SEQ ID NO: 219627 - DNA, 25 bp, Mus musculus
agttaccctggaacttactggatta

SEQ ID NO: 219628 - DNA, 25 bp, Mus musculus
agttaccctggatcttactggatta

SEQ ID NO: 219629 - DNA, 25 bp, Mus musculus
agttaccctgtcagatgtgatcctg

SEQ ID NO: 219630 - DNA, 25 bp, Mus musculus
agttaccctgtctgatgtgatcctg

SEQ ID NO: 219631 - DNA, 25 bp, Mus musculus
agttaccgcctcaggagcttgggtt

SEQ ID NO: 219632 - DNA, 25 bp, Mus musculus
agttaccgcctctggagcttgggtt

SEQ ID NO: 219633 - DNA, 25 bp, Mus musculus
agttaccgtaaactctgcatatctg

SEQ ID NO: 219634 - DNA, 25 bp, Mus musculus
agttaccgtaaagtctgcatatctg

SEQ ID NO: 219635 - DNA, 25 bp, Mus musculus
agttaccgtgagcaagctccagcaa

SEQ ID NO: 219636 - DNA, 25 bp, Mus musculus
agttaccgtgaggaagctccagcaa

SEQ ID NO: 219637 - DNA, 25 bp, Mus musculus
agttacctactgacttgaatccaac

SEQ ID NO: 219638 - DNA, 25 bp, Mus musculus
agttacctactgtcttgaatccaac

SEQ ID NO: 219639 - DNA, 25 bp, Mus musculus
agttacctagcaacggcttgcctct

SEQ ID NO: 219640 - DNA, 25 bp, Mus musculus
agttacctagcatcggcttgcctct

SEQ ID NO: 219641 - DNA, 25 bp, Mus musculus
agttacctagttagagactctcctc

SEQ ID NO: 219642 - DNA, 25 bp, Mus musculus
agttacctagtttgagactctcctc

SEQ ID NO: 219643 - DNA, 25 bp, Mus musculus
agttacctattgaagctagctcttt

SEQ ID NO: 219644 - DNA, 25 bp, Mus musculus
agttacctattgtagctagctcttt

SEQ ID NO: 219645 - DNA, 25 bp, Mus musculus
agttacctcgccagaggcagcagtg

SEQ ID NO: 219646 - DNA, 25 bp, Mus musculus
agttacctcgcctgaggcagcagtg

SEQ ID NO: 219647 - DNA, 25 bp, Mus musculus
agttacctgacgactgtgctacaga

SEQ ID NO: 219648 - DNA, 25 bp, Mus musculus
agttacctgacgtctgtgctacaga

SEQ ID NO: 219649 - DNA, 25 bp, Mus musculus
agttacctggccagtaagcttctta

SEQ ID NO: 219650 - DNA, 25 bp, Mus musculus
agttacctggcctgtaagcttctta

SEQ ID NO: 219651 - DNA, 25 bp, Mus musculus
agttacctggtgcacaatgatggag

SEQ ID NO: 219652 - DNA, 25 bp, Mus musculus
agttacctggtggacaatgatggag

SEQ ID NO: 219653 - DNA, 25 bp, Mus musculus
agttacctgtgccacctgattgaaa

SEQ ID NO: 219654 - DNA, 25 bp, Mus musculus
agttacctgtgcgacctgattgaaa

SEQ ID NO: 219655 - DNA, 25 bp, Mus musculus
agttaccttcctaggatgtctgagt

SEQ ID NO: 219656 - DNA, 25 bp, Mus musculus
agttaccttccttggatgtctgagt

SEQ ID NO: 219657 - DNA, 25 bp, Mus musculus
agttaccttctacgtgaaccctcag

SEQ ID NO: 219658 - DNA, 25 bp, Mus musculus
agttaccttctaggtgaaccctcag

SEQ ID NO: 219659 - DNA, 25 bp, Mus musculus
agttaccttgatcggactgtcttgg

SEQ ID NO: 219660 - DNA, 25 bp, Mus musculus
agttaccttgatgggactgtcttgg

SEQ ID NO: 219661 - DNA, 25 bp, Mus musculus
agttacctttctacttatggtggat

SEQ ID NO: 219662 - DNA, 25 bp, Mus musculus
agttacctttcttcttatggtggat

SEQ ID NO: 219663 - DNA, 25 bp, Mus musculus
agttaccttttgatgattgatttct

SEQ ID NO: 219664 - DNA, 25 bp, Mus musculus
agttaccttttgttgattgatttct

SEQ ID NO: 219665 - DNA, 25 bp, Mus musculus
agttacgaagcactcactcatctgc

SEQ ID NO: 219666 - DNA, 25 bp, Mus musculus
agttacgaagcagtcactcatctgc

SEQ ID NO: 219667 - DNA, 25 bp, Mus musculus
agttacgcctttctgtcttcagcaa

SEQ ID NO: 219668 - DNA, 25 bp, Mus musculus
agttacgcctttgtgtcttcagcaa

SEQ ID NO: 219669 - DNA, 25 bp, Mus musculus
agttacgctaacacaggtgtatgat

SEQ ID NO: 219670 - DNA, 25 bp, Mus musculus
agttacgctaactcaggtgtatgat

SEQ ID NO: 219671 - DNA, 25 bp, Mus musculus
agttacgctgggagtttatctccaa

SEQ ID NO: 219672 - DNA, 25 bp, Mus musculus
agttacgctgggtgtttatctccaa

SEQ ID NO: 219673 - DNA, 25 bp, Mus musculus
agttacgggcgcacatcctagacat

SEQ ID NO: 219674 - DNA, 25 bp, Mus musculus
agttacgggcgctcatcctagacat

SEQ ID NO: 219675 - DNA, 25 bp, Mus musculus
agttacgggtgcagccaaggcttac

SEQ ID NO: 219676 - DNA, 25 bp, Mus musculus
agttacgggtgctgccaaggcttac

SEQ ID NO: 219677 - DNA, 25 bp, Mus musculus
agttacgtcgaacgtgctgttgctc

SEQ ID NO: 219678 - DNA, 25 bp, Mus musculus
agttacgtcgaaggtgctgttgctc

SEQ ID NO: 219679 - DNA, 25 bp, Mus musculus
agttacgtggtaacatgggacatcc

SEQ ID NO: 219680 - DNA, 25 bp, Mus musculus
agttacgtggtatcatgggacatcc

SEQ ID NO: 219681 - DNA, 25 bp, Mus musculus
agttacgttaaaccttctcagcaag

SEQ ID NO: 219682 - DNA, 25 bp, Mus musculus
agttacgttaaagcttctcagcaag

SEQ ID NO: 219683 - DNA, 25 bp, Mus musculus
agttactaagtaaaatgtcctgctt

SEQ ID NO: 219684 - DNA, 25 bp, Mus musculus
agttactaagtataatgtcctgctt

SEQ ID NO: 219685 - DNA, 25 bp, Mus musculus
agttactaatatacctgagacgtga

SEQ ID NO: 219686 - DNA, 25 bp, Mus musculus
agttactaatattcctgagacgtga

SEQ ID NO: 219687 - DNA, 25 bp, Mus musculus
agttactactgaccactttatccag

SEQ ID NO: 219688 - DNA, 25 bp, Mus musculus
agttactactgagcactttatccag

SEQ ID NO: 219689 - DNA, 25 bp, Mus musculus
agttactactttcctgtacatatta

SEQ ID NO: 219690 - DNA, 25 bp, Mus musculus
agttactactttgctgtacatatta

SEQ ID NO: 219691 - DNA, 25 bp, Mus musculus
agttactagcttagagtgcactcct

SEQ ID NO: 219692 - DNA, 25 bp, Mus musculus
agttactagctttgagtgcactcct

SEQ ID NO: 219693 - DNA, 25 bp, Mus musculus
agttactatcccaagtaggaggaag

SEQ ID NO: 219694 - DNA, 25 bp, Mus musculus
agttactatccctagtaggaggaag

SEQ ID NO: 219695 - DNA, 25 bp, Mus musculus
agttactattgaaggctgtgagcta

SEQ ID NO: 219696 - DNA, 25 bp, Mus musculus
agttactattgatggctgtgagcta

SEQ ID NO: 219697 - DNA, 25 bp, Mus musculus
agttactcaagacagctttccagcc

SEQ ID NO: 219698 - DNA, 25 bp, Mus musculus
agttactcaagagagctttccagcc

SEQ ID NO: 219699 - DNA, 25 bp, Mus musculus
agttactcagaaaggtcaagtcccc

SEQ ID NO: 219700 - DNA, 25 bp, Mus musculus
agttactcagaatggtcaagtcccc

SEQ ID NO: 219701 - DNA, 25 bp, Mus musculus
agttactcagtaatgctgctccacg

SEQ ID NO: 219702 - DNA, 25 bp, Mus musculus
agttactcagtattgctgctccacg

SEQ ID NO: 219703 - DNA, 25 bp, Mus musculus
agttactcatggagtcagcagctct

SEQ ID NO: 219704 - DNA, 25 bp, Mus musculus
agttactcatggtgtcagcagctct

SEQ ID NO: 219705 - DNA, 25 bp, Mus musculus
agttactcattaatgtgagctgcca

SEQ ID NO: 219706 - DNA, 25 bp, Mus musculus
agttactcattattgtgagctgcca

SEQ ID NO: 219707 - DNA, 25 bp, Mus musculus
agttactccagacgaatggtttcct

SEQ ID NO: 219708 - DNA, 25 bp, Mus musculus
agttactccagaggaatggtttcct

SEQ ID NO: 219709 - DNA, 25 bp, Mus musculus
agttactccaggatatccacatcag

SEQ ID NO: 219710 - DNA, 25 bp, Mus musculus
agttactccaggttatccacatcag

SEQ ID NO: 219711 - DNA, 25 bp, Mus musculus
agttactcggttctctagtgtcaaa

SEQ ID NO: 219712 - DNA, 25 bp, Mus musculus
agttactcggttgtctagtgtcaaa

SEQ ID NO: 219713 - DNA, 25 bp, Mus musculus
agttactcttccagtcaaagacacc

SEQ ID NO: 219714 - DNA, 25 bp, Mus musculus
agttactcttcctgtcaaagacacc

SEQ ID NO: 219715 - DNA, 25 bp, Mus musculus
agttactcttctagtgtctgttgcc

SEQ ID NO: 219716 - DNA, 25 bp, Mus musculus
agttactcttctcggtgctacaatc

SEQ ID NO: 219717 - DNA, 25 bp, Mus musculus
agttactcttctgggtgctacaatc

SEQ ID NO: 219718 - DNA, 25 bp, Mus musculus
agttactcttcttgtgtctgttgcc

SEQ ID NO: 219719 - DNA, 25 bp, Mus musculus
agttactgaattattggtctggaaa

SEQ ID NO: 219720 - DNA, 25 bp, Mus musculus
agttactgaatttttggtctggaaa

SEQ ID NO: 219721 - DNA, 25 bp, Mus musculus
agttactgaccaccgtgctacattc

SEQ ID NO: 219722 - DNA, 25 bp, Mus musculus
agttactgaccagcgtgctacattc

SEQ ID NO: 219723 - DNA, 25 bp, Mus musculus
agttactgacttattgccctacagg

SEQ ID NO: 219724 - DNA, 25 bp, Mus musculus
agttactgactttttgccctacagg

SEQ ID NO: 219725 - DNA, 25 bp, Mus musculus
agttactgaggcagggctctcatct

SEQ ID NO: 219726 - DNA, 25 bp, Mus musculus
agttactgaggctgggctctcatct

SEQ ID NO: 219727 - DNA, 25 bp, Mus musculus
agttactgagtgctgcttacctaaa

SEQ ID NO: 219728 - DNA, 25 bp, Mus musculus
agttactgagtggtgcttacctaaa

SEQ ID NO: 219729 - DNA, 25 bp, Mus musculus
agttactgatacagtcctgtctaat

SEQ ID NO: 219730 - DNA, 25 bp, Mus musculus
agttactgatactgtcctgtctaat

SEQ ID NO: 219731 - DNA, 25 bp, Mus musculus
agttactgatagaggccaaaggccc

SEQ ID NO: 219732 - DNA, 25 bp, Mus musculus
agttactgatagtggccaaaggccc

SEQ ID NO: 219733 - DNA, 25 bp, Mus musculus
agttactgatgtctgccccaggcaa

SEQ ID NO: 219734 - DNA, 25 bp, Mus musculus
agttactgatgtgtgccccaggcaa

SEQ ID NO: 219735 - DNA, 25 bp, Mus musculus
agttactgatttcagcatttctaga

SEQ ID NO: 219736 - DNA, 25 bp, Mus musculus
agttactgatttgagcatttctaga

SEQ ID NO: 219737 - DNA, 25 bp, Mus musculus
agttactgcaacacccttacaagga

SEQ ID NO: 219738 - DNA, 25 bp, Mus musculus
agttactgcaactcccttacaagga

SEQ ID NO: 219739 - DNA, 25 bp, Mus musculus
agttactgcggaacttcaattttaa

SEQ ID NO: 219740 - DNA, 25 bp, Mus musculus
agttactgcggatcttcaattttaa

SEQ ID NO: 219741 - DNA, 25 bp, Mus musculus
agttactggagtattctgaatttca

SEQ ID NO: 219742 - DNA, 25 bp, Mus musculus
agttactggagttttctgaatttca

SEQ ID NO: 219743 - DNA, 25 bp, Mus musculus
agttactgtaggctggagtctgcaa

SEQ ID NO: 219744 - DNA, 25 bp, Mus musculus
agttactgtagggtggagtctgcaa

SEQ ID NO: 219745 - DNA, 25 bp, Mus musculus
agttactgtccgcagtgcctctatg

SEQ ID NO: 219746 - DNA, 25 bp, Mus musculus
agttactgtccggagtgcctctatg

SEQ ID NO: 219747 - DNA, 25 bp, Mus musculus
agttactgtgatacttagattgcaa

SEQ ID NO: 219748 - DNA, 25 bp, Mus musculus
agttactgtgattcttagattgcaa

SEQ ID NO: 219749 - DNA, 25 bp, Mus musculus
agttacttaaccatctcatccagat

SEQ ID NO: 219750 - DNA, 25 bp, Mus musculus
agttacttaaccttctcatccagat

SEQ ID NO: 219751 - DNA, 25 bp, Mus musculus
agttacttcctgatataatttgtga

SEQ ID NO: 219752 - DNA, 25 bp, Mus musculus
agttacttcctgttataatttgtga

SEQ ID NO: 219753 - DNA, 25 bp, Mus musculus
agttacttccttatcgtgatggtga

SEQ ID NO: 219754 - DNA, 25 bp, Mus musculus
agttacttccttttcgtgatggtga

SEQ ID NO: 219755 - DNA, 25 bp, Mus musculus
agttacttcgccctgtgttaggaat

SEQ ID NO: 219756 - DNA, 25 bp, Mus musculus
agttacttcgccgtgtgttaggaat

SEQ ID NO: 219757 - DNA, 25 bp, Mus musculus
agttacttctggattcagtcctgat

SEQ ID NO: 219758 - DNA, 25 bp, Mus musculus
agttacttctggtttcagtcctgat

SEQ ID NO: 219759 - DNA, 25 bp, Mus musculus
agttacttcttcatttctacttgag

SEQ ID NO: 219760 - DNA, 25 bp, Mus musculus
agttacttcttcttttctacttgag

SEQ ID NO: 219761 - DNA, 25 bp, Mus musculus
agttacttgctactgaaacttccaa

SEQ ID NO: 219762 - DNA, 25 bp, Mus musculus
agttacttgctagtgaaacttccaa

SEQ ID NO: 219763 - DNA, 25 bp, Mus musculus
agttacttggctaaacccatctagc

SEQ ID NO: 219764 - DNA, 25 bp, Mus musculus
agttacttggcttaacccatctagc

SEQ ID NO: 219765 - DNA, 25 bp, Mus musculus
agttactttaccaacatatcagttt

SEQ ID NO: 219766 - DNA, 25 bp, Mus musculus
agttactttacctacatatcagttt

SEQ ID NO: 219767 - DNA, 25 bp, Mus musculus
agttacttttgcattcttgagagac

SEQ ID NO: 219768 - DNA, 25 bp, Mus musculus
agttacttttgctttcttgagagac

SEQ ID NO: 219769 - DNA, 25 bp, Mus musculus
agttagaaacctcgcattgcgctga

SEQ ID NO: 219770 - DNA, 25 bp, Mus musculus
agttagaaacctggcattgcgctga

SEQ ID NO: 219771 - DNA, 25 bp, Mus musculus
agttagaaagtgaccatctctctgt

SEQ ID NO: 219772 - DNA, 25 bp, Mus musculus
agttagaaagtgtccatctctctgt

SEQ ID NO: 219773 - DNA, 25 bp, Mus musculus
agttagaagctcaccagaggttcaa

SEQ ID NO: 219774 - DNA, 25 bp, Mus musculus
agttagaagctctccagaggttcaa

SEQ ID NO: 219775 - DNA, 25 bp, Mus musculus
agttagacatgccatcctgggccac

SEQ ID NO: 219776 - DNA, 25 bp, Mus musculus
agttagacatgcgatcctgggccac

SEQ ID NO: 219777 - DNA, 25 bp, Mus musculus
agttagaccaaaagccaaagatcct

SEQ ID NO: 219778 - DNA, 25 bp, Mus musculus
agttagaccaaatgccaaagatcct

SEQ ID NO: 219779 - DNA, 25 bp, Mus musculus
agttagacgtcccaattgtgtcttt

SEQ ID NO: 219780 - DNA, 25 bp, Mus musculus
agttagacgtccgaattgtgtcttt

SEQ ID NO: 219781 - DNA, 25 bp, Mus musculus
agttagagaccgagaccagcggccc

SEQ ID NO: 219782 - DNA, 25 bp, Mus musculus
agttagagaccgtgaccagcggccc

SEQ ID NO: 219783 - DNA, 25 bp, Mus musculus
agttagagcaggctcagcctccaaa

SEQ ID NO: 219784 - DNA, 25 bp, Mus musculus
agttagagcagggtcagcctccaaa

SEQ ID NO: 219785 - DNA, 25 bp, Mus musculus
agttagaggccaaccaggtctgctt

SEQ ID NO: 219786 - DNA, 25 bp, Mus musculus
agttagaggccatccaggtctgctt

SEQ ID NO: 219787 - DNA, 25 bp, Mus musculus
agttagatccccattctggatacct

SEQ ID NO: 219788 - DNA, 25 bp, Mus musculus
agttagatcccctttctggatacct

SEQ ID NO: 219789 - DNA, 25 bp, Mus musculus
agttagatccgacgctgcttcagat

SEQ ID NO: 219790 - DNA, 25 bp, Mus musculus
agttagatccgaggctgcttcagat

SEQ ID NO: 219791 - DNA, 25 bp, Mus musculus
agttagatctgcctctgagtggcca

SEQ ID NO: 219792 - DNA, 25 bp, Mus musculus
agttagatctgcgtctgagtggcca

SEQ ID NO: 219793 - DNA, 25 bp, Mus musculus
agttagatcttacttctgctgctgt

SEQ ID NO: 219794 - DNA, 25 bp, Mus musculus
agttagatcttagttctgctgctgt

SEQ ID NO: 219795 - DNA, 25 bp, Mus musculus
agttagatgtcacccatgtggtatc

SEQ ID NO: 219796 - DNA, 25 bp, Mus musculus
agttagatgtcagccatgtggtatc

SEQ ID NO: 219797 - DNA, 25 bp, Mus musculus
agttagcacatcactctctcaatgg

SEQ ID NO: 219798 - DNA, 25 bp, Mus musculus
agttagcacatctctctctcaatgg

SEQ ID NO: 219799 - DNA, 25 bp, Mus musculus
agttagcaccaacatttccctgaaa

SEQ ID NO: 219800 - DNA, 25 bp, Mus musculus
agttagcaccaagatttccctgaaa

SEQ ID NO: 219801 - DNA, 25 bp, Mus musculus
agttagcactggaagatgacctctt

SEQ ID NO: 219802 - DNA, 25 bp, Mus musculus
agttagcactggtagatgacctctt

SEQ ID NO: 219803 - DNA, 25 bp, Mus musculus
agttagcactgtcctcctggaccat

SEQ ID NO: 219804 - DNA, 25 bp, Mus musculus
agttagcactgtgctcctggaccat

SEQ ID NO: 219805 - DNA, 25 bp, Mus musculus
agttagcagaacactgactggatta

SEQ ID NO: 219806 - DNA, 25 bp, Mus musculus
agttagcagaactctgactggatta

SEQ ID NO: 219807 - DNA, 25 bp, Mus musculus
agttagcatatgactgtgatttcag

SEQ ID NO: 219808 - DNA, 25 bp, Mus musculus
agttagcatatgtctgtgatttcag

SEQ ID NO: 219809 - DNA, 25 bp, Mus musculus
agttagccaaatacagactgtcctt

SEQ ID NO: 219810 - DNA, 25 bp, Mus musculus
agttagccaaattcagactgtcctt

SEQ ID NO: 219811 - DNA, 25 bp, Mus musculus
agttagccaggcaccggaaagaact

SEQ ID NO: 219812 - DNA, 25 bp, Mus musculus
agttagccaggctccggaaagaact

SEQ ID NO: 219813 - DNA, 25 bp, Mus musculus
agttagcctagaactttcttatcag

SEQ ID NO: 219814 - DNA, 25 bp, Mus musculus
agttagcctagatctttcttatcag

SEQ ID NO: 219815 - DNA, 25 bp, Mus musculus
agttagcctcacacagtgtactcag

SEQ ID NO: 219816 - DNA, 25 bp, Mus musculus
agttagcctcactcagtgtactcag

SEQ ID NO: 219817 - DNA, 25 bp, Mus musculus
agttagcgtatgaaggattaggttt

SEQ ID NO: 219818 - DNA, 25 bp, Mus musculus
agttagcgtatgtaggattaggttt

SEQ ID NO: 219819 - DNA, 25 bp, Mus musculus
agttagctaccccacactgatgagt

SEQ ID NO: 219820 - DNA, 25 bp, Mus musculus
agttagctacccgacactgatgagt

SEQ ID NO: 219821 - DNA, 25 bp, Mus musculus
agttagctagatcactctccccaga

SEQ ID NO: 219822 - DNA, 25 bp, Mus musculus
agttagctagatgactctccccaga

SEQ ID NO: 219823 - DNA, 25 bp, Mus musculus
agttagctagttattgtctacttga

SEQ ID NO: 219824 - DNA, 25 bp, Mus musculus
agttagctagtttttgtctacttga

SEQ ID NO: 219825 - DNA, 25 bp, Mus musculus
agttagctatgtctgtatgcccttc

SEQ ID NO: 219826 - DNA, 25 bp, Mus musculus
agttagctatgtgtgtatgcccttc

SEQ ID NO: 219827 - DNA, 25 bp, Mus musculus
agttagctccagagcacgaacagct

SEQ ID NO: 219828 - DNA, 25 bp, Mus musculus
agttagctccagtgcacgaacagct

SEQ ID NO: 219829 - DNA, 25 bp, Mus musculus
agttagctccttcctttgtagattg

SEQ ID NO: 219830 - DNA, 25 bp, Mus musculus
agttagctccttgctttgtagattg

SEQ ID NO: 219831 - DNA, 25 bp, Mus musculus
agttagctctcgcagtgacgtccat

SEQ ID NO: 219832 - DNA, 25 bp, Mus musculus
agttagctctcggagtgacgtccat

SEQ ID NO: 219833 - DNA, 25 bp, Mus musculus
agttagctctgcatgggtgctgcaa

SEQ ID NO: 219834 - DNA, 25 bp, Mus musculus
agttagctctgcttgggtgctgcaa

SEQ ID NO: 219835 - DNA, 25 bp, Mus musculus
agttagctgcagaacttgcctctct

SEQ ID NO: 219836 - DNA, 25 bp, Mus musculus
agttagctgcagtacttgcctctct

SEQ ID NO: 219837 - DNA, 25 bp, Mus musculus
agttagctgcatctgaagggtctga

SEQ ID NO: 219838 - DNA, 25 bp, Mus musculus
agttagctgcatgtgaagggtctga

SEQ ID NO: 219839 - DNA, 25 bp, Mus musculus
agttagctgccacactagctgggaa

SEQ ID NO: 219840 - DNA, 25 bp, Mus musculus
agttagctgccagactagctgggaa

SEQ ID NO: 219841 - DNA, 25 bp, Mus musculus
agttagctgggcactgtcttatcac

SEQ ID NO: 219842 - DNA, 25 bp, Mus musculus
agttagctgggctctgtcttatcac

SEQ ID NO: 219843 - DNA, 25 bp, Mus musculus
agttagctttacaagtgcaccccaa

SEQ ID NO: 219844 - DNA, 25 bp, Mus musculus
agttagctttactagtgcaccccaa

SEQ ID NO: 219845 - DNA, 25 bp, Mus musculus
agttagcttttcatggcctttgact

SEQ ID NO: 219846 - DNA, 25 bp, Mus musculus
agttagcttttcttggcctttgact

SEQ ID NO: 219847 - DNA, 25 bp, Mus musculus
agttaggaaactcgcgacaagtcac

SEQ ID NO: 219848 - DNA, 25 bp, Mus musculus
agttaggaaactggcgacaagtcac

SEQ ID NO: 219849 - DNA, 25 bp, Mus musculus
agttaggaagtcagtgccactggcc

SEQ ID NO: 219850 - DNA, 25 bp, Mus musculus
agttaggaagtctgtgccactggcc

SEQ ID NO: 219851 - DNA, 25 bp, Mus musculus
agttaggaatgacccagctcttttt

SEQ ID NO: 219852 - DNA, 25 bp, Mus musculus
agttaggaatgagccagctcttttt

SEQ ID NO: 219853 - DNA, 25 bp, Mus musculus
agttaggaatgcatcagaattggac

SEQ ID NO: 219854 - DNA, 25 bp, Mus musculus
agttaggaatgcttcagaattggac

SEQ ID NO: 219855 - DNA, 25 bp, Mus musculus
agttaggacagcatgggaccataag

SEQ ID NO: 219856 - DNA, 25 bp, Mus musculus
agttaggacagcttgggaccataag

SEQ ID NO: 219857 - DNA, 25 bp, Mus musculus
agttaggagagaatgctcaccagtt

SEQ ID NO: 219858 - DNA, 25 bp, Mus musculus
agttaggagagattgctcaccagtt

SEQ ID NO: 219859 - DNA, 25 bp, Mus musculus
agttaggagcaccataggatatgat

SEQ ID NO: 219860 - DNA, 25 bp, Mus musculus
agttaggagcacgataggatatgat

SEQ ID NO: 219861 - DNA, 25 bp, Mus musculus
agttaggatactactgtggcccatg

SEQ ID NO: 219862 - DNA, 25 bp, Mus musculus
agttaggatacttctgtggcccatg

SEQ ID NO: 219863 - DNA, 25 bp, Mus musculus
agttaggatagaaccccaggcccct

SEQ ID NO: 219864 - DNA, 25 bp, Mus musculus
agttaggatagatccccaggcccct

SEQ ID NO: 219865 - DNA, 25 bp, Mus musculus
agttaggcatttcactctcctgttg

SEQ ID NO: 219866 - DNA, 25 bp, Mus musculus
agttaggcatttgactctcctgttg

SEQ ID NO: 219867 - DNA, 25 bp, Mus musculus
agttaggccaccatcaatgcctgta

SEQ ID NO: 219868 - DNA, 25 bp, Mus musculus
agttaggccaccttcaatgcctgta

SEQ ID NO: 219869 - DNA, 25 bp, Mus musculus
agttaggcgtgcaggggcaccctcc

SEQ ID NO: 219870 - DNA, 25 bp, Mus musculus
agttaggcgtgctggggcaccctcc

SEQ ID NO: 219871 - DNA, 25 bp, Mus musculus
agttaggcttggaacatctgttatc

SEQ ID NO: 219872 - DNA, 25 bp, Mus musculus
agttaggcttggtacatctgttatc

SEQ ID NO: 219873 - DNA, 25 bp, Mus musculus
agttagggccccatgcagtctctga

SEQ ID NO: 219874 - DNA, 25 bp, Mus musculus
agttagggccccttgcagtctctga

SEQ ID NO: 219875 - DNA, 25 bp, Mus musculus
agttagggctcacttatgctcagtc

SEQ ID NO: 219876 - DNA, 25 bp, Mus musculus
agttagggctcagttatgctcagtc

SEQ ID NO: 219877 - DNA, 25 bp, Mus musculus
agttagggtcctagcacacatgtct

SEQ ID NO: 219878 - DNA, 25 bp, Mus musculus
agttagggtccttgcacacatgtct

SEQ ID NO: 219879 - DNA, 25 bp, Mus musculus
agttagggttagatcagttcacagc

SEQ ID NO: 219880 - DNA, 25 bp, Mus musculus
agttagggttagttcagttcacagc

SEQ ID NO: 219881 - DNA, 25 bp, Mus musculus
agttaggtactgagaatggtgcccc

SEQ ID NO: 219882 - DNA, 25 bp, Mus musculus
agttaggtactgtgaatggtgcccc

SEQ ID NO: 219883 - DNA, 25 bp, Mus musculus
agttaggtgcttatctgtggagcat

SEQ ID NO: 219884 - DNA, 25 bp, Mus musculus
agttaggtgcttttctgtggagcat

SEQ ID NO: 219885 - DNA, 25 bp, Mus musculus
agttaggtggtcattgagcttgtct

SEQ ID NO: 219886 - DNA, 25 bp, Mus musculus
agttaggtggtctttgagcttgtct

SEQ ID NO: 219887 - DNA, 25 bp, Mus musculus
agttaggtgtcaaagcagctcagga

SEQ ID NO: 219888 - DNA, 25 bp, Mus musculus
agttaggtgtcaagactccagagga

SEQ ID NO: 219889 - DNA, 25 bp, Mus musculus
agttaggtgtcatagcagctcagga

SEQ ID NO: 219890 - DNA, 25 bp, Mus musculus
agttaggtgtcatgactccagagga

SEQ ID NO: 219891 - DNA, 25 bp, Mus musculus
agttagtaacgacaccttgggcagt

SEQ ID NO: 219892 - DNA, 25 bp, Mus musculus
agttagtaacgagaccttgggcagt

SEQ ID NO: 219893 - DNA, 25 bp, Mus musculus
agttagtaactgcagctcacctact

SEQ ID NO: 219894 - DNA, 25 bp, Mus musculus
agttagtaactggagctcacctact

SEQ ID NO: 219895 - DNA, 25 bp, Mus musculus
agttagtatgccagtacactgcctt

SEQ ID NO: 219896 - DNA, 25 bp, Mus musculus
agttagtatgcctgtacactgcctt

SEQ ID NO: 219897 - DNA, 25 bp, Mus musculus
agttagtcaggaaagccactacttt

SEQ ID NO: 219898 - DNA, 25 bp, Mus musculus
agttagtcaggatagccactacttt

SEQ ID NO: 219899 - DNA, 25 bp, Mus musculus
agttagtctggtattgctgctttag

SEQ ID NO: 219900 - DNA, 25 bp, Mus musculus
agttagtctggttttgctgctttag

SEQ ID NO: 219901 - DNA, 25 bp, Mus musculus
agttagtgaactcgcctgcaagcat

SEQ ID NO: 219902 - DNA, 25 bp, Mus musculus
agttagtgaactggcctgcaagcat

SEQ ID NO: 219903 - DNA, 25 bp, Mus musculus
agttagtgaccaagagccaacccta

SEQ ID NO: 219904 - DNA, 25 bp, Mus musculus
agttagtgaccatgagccaacccta

SEQ ID NO: 219905 - DNA, 25 bp, Mus musculus
agttagtggtctagccagggcagcc

SEQ ID NO: 219906 - DNA, 25 bp, Mus musculus
agttagtggtcttgccagggcagcc

SEQ ID NO: 219907 - DNA, 25 bp, Mus musculus
agttagtgtgacagcctattcctca

SEQ ID NO: 219908 - DNA, 25 bp, Mus musculus
agttagtgtgactgcctattcctca

SEQ ID NO: 219909 - DNA, 25 bp, Mus musculus
agttagtgtgcgagcggtgcttttc

SEQ ID NO: 219910 - DNA, 25 bp, Mus musculus
agttagtgtgcgtgcggtgcttttc

SEQ ID NO: 219911 - DNA, 25 bp, Mus musculus
agttagtgtgtgagactactcattt

SEQ ID NO: 219912 - DNA, 25 bp, Mus musculus
agttagtgtgtgtgactactcattt

SEQ ID NO: 219913 - DNA, 25 bp, Mus musculus
agttagttaggacctattctgggct

SEQ ID NO: 219914 - DNA, 25 bp, Mus musculus
agttagttaggagctattctgggct

SEQ ID NO: 219915 - DNA, 25 bp, Mus musculus
agttagttcaacatgtttctgtgat

SEQ ID NO: 219916 - DNA, 25 bp, Mus musculus
agttagttcaacttgtttctgtgat

SEQ ID NO: 219917 - DNA, 25 bp, Mus musculus
agttagttccacactactatcagcc

SEQ ID NO: 219918 - DNA, 25 bp, Mus musculus
agttagttccactctactatcagcc

SEQ ID NO: 219919 - DNA, 25 bp, Mus musculus
agttagttgccacatcccaaaggtt

SEQ ID NO: 219920 - DNA, 25 bp, Mus musculus
agttagttgccagatcccaaaggtt

SEQ ID NO: 219921 - DNA, 25 bp, Mus musculus
agttagttggtaatgtaatcattta

SEQ ID NO: 219922 - DNA, 25 bp, Mus musculus
agttagttggtattgtaatcattta

SEQ ID NO: 219923 - DNA, 25 bp, Mus musculus
agttagttttccactgacagatact

SEQ ID NO: 219924 - DNA, 25 bp, Mus musculus
agttagttttcctctgacagatact

SEQ ID NO: 219925 - DNA, 25 bp, Mus musculus
agttataaatgtctgcgcatgcgca

SEQ ID NO: 219926 - DNA, 25 bp, Mus musculus
agttataaatgtgtgcgcatgcgca

SEQ ID NO: 219927 - DNA, 25 bp, Mus musculus
agttataaccgaccagcttctgtgt

SEQ ID NO: 219928 - DNA, 25 bp, Mus musculus
agttataaccgagcagcttctgtgt

SEQ ID NO: 219929 - DNA, 25 bp, Mus musculus
agttatacagacaccaagcctgtcc

SEQ ID NO: 219930 - DNA, 25 bp, Mus musculus
agttatacagactccaagcctgtcc

SEQ ID NO: 219931 - DNA, 25 bp, Mus musculus
agttataccagaatttccactgatg

SEQ ID NO: 219932 - DNA, 25 bp, Mus musculus
agttataccagattttccactgatg

SEQ ID NO: 219933 - DNA, 25 bp, Mus musculus
agttatacgtaaccatgcccacata

SEQ ID NO: 219934 - DNA, 25 bp, Mus musculus
agttatacgtaagcatgcccacata

SEQ ID NO: 219935 - DNA, 25 bp, Mus musculus
agttatactcagactgccagcagga

SEQ ID NO: 219936 - DNA, 25 bp, Mus musculus
agttatactcagtctgccagcagga

SEQ ID NO: 219937 - DNA, 25 bp, Mus musculus
agttatactcctccataaggcccag

SEQ ID NO: 219938 - DNA, 25 bp, Mus musculus
agttatactcctgcataaggcccag

SEQ ID NO: 219939 - DNA, 25 bp, Mus musculus
agttatagacagaataccgatatta

SEQ ID NO: 219940 - DNA, 25 bp, Mus musculus
agttatagacagtataccgatatta

SEQ ID NO: 219941 - DNA, 25 bp, Mus musculus
agttatagatcaacatcctttttaa

SEQ ID NO: 219942 - DNA, 25 bp, Mus musculus
agttatagatcatcatcctttttaa

SEQ ID NO: 219943 - DNA, 25 bp, Mus musculus
agttatagatgcaatcttccccact

SEQ ID NO: 219944 - DNA, 25 bp, Mus musculus
agttatagatgctatcttccccact

SEQ ID NO: 219945 - DNA, 25 bp, Mus musculus
agttatagcctcctcacagggattt

SEQ ID NO: 219946 - DNA, 25 bp, Mus musculus
agttatagcctcgtcacagggattt

SEQ ID NO: 219947 - DNA, 25 bp, Mus musculus
agttatatacatacactggtgagtt

SEQ ID NO: 219948 - DNA, 25 bp, Mus musculus
agttatatacattcactggtgagtt

SEQ ID NO: 219949 - DNA, 25 bp, Mus musculus
agttatatactcactgtccccagtg

SEQ ID NO: 219950 - DNA, 25 bp, Mus musculus
agttatatactctctgtccccagtg

SEQ ID NO: 219951 - DNA, 25 bp, Mus musculus
agttatatgatgactatggttccca

SEQ ID NO: 219952 - DNA, 25 bp, Mus musculus
agttatatgatgtctatggttccca

SEQ ID NO: 219953 - DNA, 25 bp, Mus musculus
agttatatttctacaagggcaggtt

SEQ ID NO: 219954 - DNA, 25 bp, Mus musculus
agttatatttcttcaagggcaggtt

SEQ ID NO: 219955 - DNA, 25 bp, Mus musculus
agttatcaacacctgctgagagagc

SEQ ID NO: 219956 - DNA, 25 bp, Mus musculus
agttatcaacacgtgctgagagagc

SEQ ID NO: 219957 - DNA, 25 bp, Mus musculus
agttatcacaggctgcttttggcag

SEQ ID NO: 219958 - DNA, 25 bp, Mus musculus
agttatcacagggtgcttttggcag

SEQ ID NO: 219959 - DNA, 25 bp, Mus musculus
agttatcaggtccacttgtctggaa

SEQ ID NO: 219960 - DNA, 25 bp, Mus musculus
agttatcaggtcgacttgtctggaa

SEQ ID NO: 219961 - DNA, 25 bp, Mus musculus
agttatcatgttattcctgctaaaa

SEQ ID NO: 219962 - DNA, 25 bp, Mus musculus
agttatcatgtttttcctgctaaaa

SEQ ID NO: 219963 - DNA, 25 bp, Mus musculus
agttatccagaaatcagctgaatgc

SEQ ID NO: 219964 - DNA, 25 bp, Mus musculus
agttatccagaattcagctgaatgc

SEQ ID NO: 219965 - DNA, 25 bp, Mus musculus
agttatcccaaaattctcagcctaa

SEQ ID NO: 219966 - DNA, 25 bp, Mus musculus
agttatcccaaatttctcagcctaa

SEQ ID NO: 219967 - DNA, 25 bp, Mus musculus
agttatcccatcatcccgacaataa

SEQ ID NO: 219968 - DNA, 25 bp, Mus musculus
agttatcccatcttcccgacaataa

SEQ ID NO: 219969 - DNA, 25 bp, Mus musculus
agttatcccattatgcatgctggaa

SEQ ID NO: 219970 - DNA, 25 bp, Mus musculus
agttatcccattttgcatgctggaa

SEQ ID NO: 219971 - DNA, 25 bp, Mus musculus
agttatcccgcaaatgtcccttcat

SEQ ID NO: 219972 - DNA, 25 bp, Mus musculus
agttatcccgcatatgtcccttcat

SEQ ID NO: 219973 - DNA, 25 bp, Mus musculus
agttatccctcaaagtctgttgcca

SEQ ID NO: 219974 - DNA, 25 bp, Mus musculus
agttatccctcatagtctgttgcca

SEQ ID NO: 219975 - DNA, 25 bp, Mus musculus
agttatcctcacactcatgctcaat

SEQ ID NO: 219976 - DNA, 25 bp, Mus musculus
agttatcctcactctcatgctcaat

SEQ ID NO: 219977 - DNA, 25 bp, Mus musculus
agttatcctctgcacaaagtaggcc

SEQ ID NO: 219978 - DNA, 25 bp, Mus musculus
agttatcctctggacaaagtaggcc

SEQ ID NO: 219979 - DNA, 25 bp, Mus musculus
agttatcggaacaggacggccagca

SEQ ID NO: 219980 - DNA, 25 bp, Mus musculus
agttatcggaactggacggccagca

SEQ ID NO: 219981 - DNA, 25 bp, Mus musculus
agttatctacatctgtgccagctca

SEQ ID NO: 219982 - DNA, 25 bp, Mus musculus
agttatctacatgtgtgccagctca

SEQ ID NO: 219983 - DNA, 25 bp, Mus musculus
agttatctacttcctgctgttgagt

SEQ ID NO: 219984 - DNA, 25 bp, Mus musculus
agttatctacttgctgctgttgagt

SEQ ID NO: 219985 - DNA, 25 bp, Mus musculus
agttatctatttactgccacagtgg

SEQ ID NO: 219986 - DNA, 25 bp, Mus musculus
agttatctattttctgccacagtgg

SEQ ID NO: 219987 - DNA, 25 bp, Mus musculus
agttatctccttcacaacttactca

SEQ ID NO: 219988 - DNA, 25 bp, Mus musculus
agttatctccttgacaacttactca

SEQ ID NO: 219989 - DNA, 25 bp, Mus musculus
agttatctgaacaaatacttttgaa

SEQ ID NO: 219990 - DNA, 25 bp, Mus musculus
agttatctgaactaatacttttgaa

SEQ ID NO: 219991 - DNA, 25 bp, Mus musculus
agttatctgtgtccctgttgccagt

SEQ ID NO: 219992 - DNA, 25 bp, Mus musculus
agttatctgtgtgcctgttgccagt

SEQ ID NO: 219993 - DNA, 25 bp, Mus musculus
agttatcttcagactctttttacag

SEQ ID NO: 219994 - DNA, 25 bp, Mus musculus
agttatcttcagtctctttttacag

SEQ ID NO: 219995 - DNA, 25 bp, Mus musculus
agttatcttcttactaccacttgaa

SEQ ID NO: 219996 - DNA, 25 bp, Mus musculus
agttatcttctttctaccacttgaa

SEQ ID NO: 219997 - DNA, 25 bp, Mus musculus
agttatcttggccatggtttctctt

SEQ ID NO: 219998 - DNA, 25 bp, Mus musculus
agttatcttggcgatggtttctctt

SEQ ID NO: 219999 - DNA, 25 bp, Mus musculus
agttatgaaatgagccacttgtcct

SEQ ID NO: 220000 - DNA, 25 bp, Mus musculus
agttatgaaatgtgccacttgtcct

SEQ ID NO: 220001 - DNA, 25 bp, Mus musculus
agttatgaatttcctgtccgttaga

SEQ ID NO: 220002 - DNA, 25 bp, Mus musculus
agttatgaatttgctgtccgttaga

SEQ ID NO: 220003 - DNA, 25 bp, Mus musculus
agttatgacatcacaatgtgtcaag

SEQ ID NO: 220004 - DNA, 25 bp, Mus musculus
agttatgacatctcaatgtgtcaag

SEQ ID NO: 220005 - DNA, 25 bp, Mus musculus
agttatgagcacaagtacctcttga

SEQ ID NO: 220006 - DNA, 25 bp, Mus musculus
agttatgagcactagtacctcttga

SEQ ID NO: 220007 - DNA, 25 bp, Mus musculus
agttatgcacttagtattcctgatc

SEQ ID NO: 220008 - DNA, 25 bp, Mus musculus
agttatgcactttgtattcctgatc

SEQ ID NO: 220009 - DNA, 25 bp, Mus musculus
agttatgccaccaccatcattgaca

SEQ ID NO: 220010 - DNA, 25 bp, Mus musculus
agttatgccacctccatcattgaca

SEQ ID NO: 220011 - DNA, 25 bp, Mus musculus
agttatgccagaagccactgtgctg

SEQ ID NO: 220012 - DNA, 25 bp, Mus musculus
agttatgccagatgccactgtgctg

SEQ ID NO: 220013 - DNA, 25 bp, Mus musculus
agttatgcctatattaccttgtaag

SEQ ID NO: 220014 - DNA, 25 bp, Mus musculus
agttatgcctattttaccttgtaag

SEQ ID NO: 220015 - DNA, 25 bp, Mus musculus
agttatgcgggtatgccaatccatt

SEQ ID NO: 220016 - DNA, 25 bp, Mus musculus
agttatgcgggtttgccaatccatt

SEQ ID NO: 220017 - DNA, 25 bp, Mus musculus
agttatgctctgaaattaaccagga

SEQ ID NO: 220018 - DNA, 25 bp, Mus musculus
agttatgctctgtaattaaccagga

SEQ ID NO: 220019 - DNA, 25 bp, Mus musculus
agttatggaccaacatttccggaag

SEQ ID NO: 220020 - DNA, 25 bp, Mus musculus
agttatggaccacactatttctccc

SEQ ID NO: 220021 - DNA, 25 bp, Mus musculus
agttatggaccagactatttctccc

SEQ ID NO: 220022 - DNA, 25 bp, Mus musculus
agttatggaccatcatttccggaag

SEQ ID NO: 220023 - DNA, 25 bp, Mus musculus
agttatggccagctgcggatcccga

SEQ ID NO: 220024 - DNA, 25 bp, Mus musculus
agttatggccaggtgcggatcccga

SEQ ID NO: 220025 - DNA, 25 bp, Mus musculus
agttatggccggatttgctttctcc

SEQ ID NO: 220026 - DNA, 25 bp, Mus musculus
agttatggccggttttgctttctcc

SEQ ID NO: 220027 - DNA, 25 bp, Mus musculus
agttatgggaccagctcagctcctc

SEQ ID NO: 220028 - DNA, 25 bp, Mus musculus
agttatgggacctgctcagctcctc

SEQ ID NO: 220029 - DNA, 25 bp, Mus musculus
agttatgggactccgaatcctcctg

SEQ ID NO: 220030 - DNA, 25 bp, Mus musculus
agttatgggactgcgaatcctcctg

SEQ ID NO: 220031 - DNA, 25 bp, Mus musculus
agttatggtcagacctttgtcttga

SEQ ID NO: 220032 - DNA, 25 bp, Mus musculus
agttatggtcagatataagctgcca

SEQ ID NO: 220033 - DNA, 25 bp, Mus musculus
agttatggtcagtcctttgtcttga

SEQ ID NO: 220034 - DNA, 25 bp, Mus musculus
agttatggtcagttataagctgcca

SEQ ID NO: 220035 - DNA, 25 bp, Mus musculus
agttatggttctctgcctcaggagc

SEQ ID NO: 220036 - DNA, 25 bp, Mus musculus
agttatggttctgtgcctcaggagc

SEQ ID NO: 220037 - DNA, 25 bp, Mus musculus
agttatggttggagttagctctcta

SEQ ID NO: 220038 - DNA, 25 bp, Mus musculus
agttatggttggtgttagctctcta

SEQ ID NO: 220039 - DNA, 25 bp, Mus musculus
agttatgtactcaagagcctatggt

SEQ ID NO: 220040 - DNA, 25 bp, Mus musculus
agttatgtactctagagcctatggt

SEQ ID NO: 220041 - DNA, 25 bp, Mus musculus
agttatgtcaatcgtctccctccaa

SEQ ID NO: 220042 - DNA, 25 bp, Mus musculus
agttatgtcaatggtctccctccaa

SEQ ID NO: 220043 - DNA, 25 bp, Mus musculus
agttatgtcaggacacggtgtggca

SEQ ID NO: 220044 - DNA, 25 bp, Mus musculus
agttatgtcaggtcacggtgtggca

SEQ ID NO: 220045 - DNA, 25 bp, Mus musculus
agttattaagacagcccaacctggg

SEQ ID NO: 220046 - DNA, 25 bp, Mus musculus
agttattaagactgcccaacctggg

SEQ ID NO: 220047 - DNA, 25 bp, Mus musculus
agttattacaaacctgtcctgccct

SEQ ID NO: 220048 - DNA, 25 bp, Mus musculus
agttattacaaagctgtcctgccct

SEQ ID NO: 220049 - DNA, 25 bp, Mus musculus
agttattacaagacatccagacggg

SEQ ID NO: 220050 - DNA, 25 bp, Mus musculus
agttattacaagtcatccagacggg

SEQ ID NO: 220051 - DNA, 25 bp, Mus musculus
agttattaccatcctgaggggagtg

SEQ ID NO: 220052 - DNA, 25 bp, Mus musculus
agttattaccatgctgaggggagtg

SEQ ID NO: 220053 - DNA, 25 bp, Mus musculus
agttattatctgacatccttatgga

SEQ ID NO: 220054 - DNA, 25 bp, Mus musculus
agttattatctgactgtgtctcctg

SEQ ID NO: 220055 - DNA, 25 bp, Mus musculus
agttattatctgtcatccttatgga

SEQ ID NO: 220056 - DNA, 25 bp, Mus musculus
agttattatctgtctgtgtctcctg

SEQ ID NO: 220057 - DNA, 25 bp, Mus musculus
agttattcaccgaggacgagcttaa

SEQ ID NO: 220058 - DNA, 25 bp, Mus musculus
agttattcaccgtggacgagcttaa

SEQ ID NO: 220059 - DNA, 25 bp, Mus musculus
agttattcagtgaagtgtgtgccaa

SEQ ID NO: 220060 - DNA, 25 bp, Mus musculus
agttattcagtgtagtgtgtgccaa

SEQ ID NO: 220061 - DNA, 25 bp, Mus musculus
agttattcatagctcgccaatagca

SEQ ID NO: 220062 - DNA, 25 bp, Mus musculus
agttattcataggtcgccaatagca

SEQ ID NO: 220063 - DNA, 25 bp, Mus musculus
agttattcccaacaatggtccagtt

SEQ ID NO: 220064 - DNA, 25 bp, Mus musculus
agttattcccaagaatggtccagtt

SEQ ID NO: 220065 - DNA, 25 bp, Mus musculus
agttattcctgtccactgtgtagca

SEQ ID NO: 220066 - DNA, 25 bp, Mus musculus
agttattcctgtgcactgtgtagca

SEQ ID NO: 220067 - DNA, 25 bp, Mus musculus
agttattctcacacaagtgcaggat

SEQ ID NO: 220068 - DNA, 25 bp, Mus musculus
agttattctcactcaagtgcaggat

SEQ ID NO: 220069 - DNA, 25 bp, Mus musculus
agttattgagtaaaaattcaccttt

SEQ ID NO: 220070 - DNA, 25 bp, Mus musculus
agttattgagtataaattcaccttt

SEQ ID NO: 220071 - DNA, 25 bp, Mus musculus
agttattgccataaaagcctggaaa

SEQ ID NO: 220072 - DNA, 25 bp, Mus musculus
agttattgccattaaagcctggaaa

SEQ ID NO: 220073 - DNA, 25 bp, Mus musculus
agttattgcgttcccttagcacttc

SEQ ID NO: 220074 - DNA, 25 bp, Mus musculus
agttattgcgttgccttagcacttc

SEQ ID NO: 220075 - DNA, 25 bp, Mus musculus
agttattgctgtcccctgctgtgtg

SEQ ID NO: 220076 - DNA, 25 bp, Mus musculus
agttattgctgtgccctgctgtgtg

SEQ ID NO: 220077 - DNA, 25 bp, Mus musculus
agttattgcttgctgaccttttcct

SEQ ID NO: 220078 - DNA, 25 bp, Mus musculus
agttattgcttggtgaccttttcct

SEQ ID NO: 220079 - DNA, 25 bp, Mus musculus
agttattgctttaccatctgcccta

SEQ ID NO: 220080 - DNA, 25 bp, Mus musculus
agttattgcttttccatctgcccta

SEQ ID NO: 220081 - DNA, 25 bp, Mus musculus
agttattgggcaattactgtatacc

SEQ ID NO: 220082 - DNA, 25 bp, Mus musculus
agttattgggcatttactgtatacc

SEQ ID NO: 220083 - DNA, 25 bp, Mus musculus
agttattgtaatcttctggcctgga

SEQ ID NO: 220084 - DNA, 25 bp, Mus musculus
agttattgtaatgttctggcctgga

SEQ ID NO: 220085 - DNA, 25 bp, Mus musculus
agttattgtagcagtttcattgtag

SEQ ID NO: 220086 - DNA, 25 bp, Mus musculus
agttattgtagctgtttcattgtag

SEQ ID NO: 220087 - DNA, 25 bp, Mus musculus
agttattgtgagaagagacctcctc

SEQ ID NO: 220088 - DNA, 25 bp, Mus musculus
agttattgtgagtagagacctcctc

SEQ ID NO: 220089 - DNA, 25 bp, Mus musculus
agttattgtgctcttttctgttata

SEQ ID NO: 220090 - DNA, 25 bp, Mus musculus
agttattgtgctgttttctgttata

SEQ ID NO: 220091 - DNA, 25 bp, Mus musculus
agttatttaaccactctggagcctc

SEQ ID NO: 220092 - DNA, 25 bp, Mus musculus
agttatttaacctctctggagcctc

SEQ ID NO: 220093 - DNA, 25 bp, Mus musculus
agttatttaattctgtttctctgtg

SEQ ID NO: 220094 - DNA, 25 bp, Mus musculus
agttatttaattgtgtttctctgtg

SEQ ID NO: 220095 - DNA, 25 bp, Mus musculus
agttatttctatatgccttgtattg

SEQ ID NO: 220096 - DNA, 25 bp, Mus musculus
agttatttctatttgccttgtattg

SEQ ID NO: 220097 - DNA, 25 bp, Mus musculus
agttatttctgtctctcctttaagg

SEQ ID NO: 220098 - DNA, 25 bp, Mus musculus
agttatttctgtgtctcctttaagg

SEQ ID NO: 220099 - DNA, 25 bp, Mus musculus
agttatttcttcactgtacattgag

SEQ ID NO: 220100 - DNA, 25 bp, Mus musculus
agttatttcttctctgtacattgag

SEQ ID NO: 220101 - DNA, 25 bp, Mus musculus
agttatttcttgctacttctggaga

SEQ ID NO: 220102 - DNA, 25 bp, Mus musculus
agttatttcttggtacttctggaga

SEQ ID NO: 220103 - DNA, 25 bp, Mus musculus
agttatttgcccatcggagctggtc

SEQ ID NO: 220104 - DNA, 25 bp, Mus musculus
agttatttgcccttcggagctggtc

SEQ ID NO: 220105 - DNA, 25 bp, Mus musculus
agttatttgcttcgattcctgacat

SEQ ID NO: 220106 - DNA, 25 bp, Mus musculus
agttatttgcttggattcctgacat

SEQ ID NO: 220107 - DNA, 25 bp, Mus musculus
agttatttgggaatgtgtacctaat

SEQ ID NO: 220108 - DNA, 25 bp, Mus musculus
agttatttgggattgtgtacctaat

SEQ ID NO: 220109 - DNA, 25 bp, Mus musculus
agttattttatacccatagaacgag

SEQ ID NO: 220110 - DNA, 25 bp, Mus musculus
agttattttatagccatagaacgag

SEQ ID NO: 220111 - DNA, 25 bp, Mus musculus
agttcaaaatccacatctaaataaa

SEQ ID NO: 220112 - DNA, 25 bp, Mus musculus
agttcaaaatcctcatctaaataaa

SEQ ID NO: 220113 - DNA, 25 bp, Mus musculus
agttcaaacaatcgtggcttctctg

SEQ ID NO: 220114 - DNA, 25 bp, Mus musculus
agttcaaacaatggtggcttctctg

SEQ ID NO: 220115 - DNA, 25 bp, Mus musculus
agttcaaaccgcctgagtcaaatca

SEQ ID NO: 220116 - DNA, 25 bp, Mus musculus
agttcaaaccgcgtgagtcaaatca

SEQ ID NO: 220117 - DNA, 25 bp, Mus musculus
agttcaaacctccagcttgtgaaat

SEQ ID NO: 220118 - DNA, 25 bp, Mus musculus
agttcaaacctcgagcttgtgaaat

SEQ ID NO: 220119 - DNA, 25 bp, Mus musculus
agttcaaactccaaatatatcgatt

SEQ ID NO: 220120 - DNA, 25 bp, Mus musculus
agttcaaactcctaatatatcgatt

SEQ ID NO: 220121 - DNA, 25 bp, Mus musculus
agttcaaacttcaaattctggatca

SEQ ID NO: 220122 - DNA, 25 bp, Mus musculus
agttcaaacttctaattctggatca

SEQ ID NO: 220123 - DNA, 25 bp, Mus musculus
agttcaaagctgagcacatgtggac

SEQ ID NO: 220124 - DNA, 25 bp, Mus musculus
agttcaaagctgtgcacatgtggac

SEQ ID NO: 220125 - DNA, 25 bp, Mus musculus
agttcaaagcttcggactcagtacc

SEQ ID NO: 220126 - DNA, 25 bp, Mus musculus
agttcaaagcttgggactcagtacc

SEQ ID NO: 220127 - DNA, 25 bp, Mus musculus
agttcaaagggcaccagtcggccag

SEQ ID NO: 220128 - DNA, 25 bp, Mus musculus
agttcaaagggctccagtcggccag

SEQ ID NO: 220129 - DNA, 25 bp, Mus musculus
agttcaaatcatctggtggcagcag

SEQ ID NO: 220130 - DNA, 25 bp, Mus musculus
agttcaaatcatgtggtggcagcag

SEQ ID NO: 220131 - DNA, 25 bp, Mus musculus
agttcaaatcccagcaaccacatgg

SEQ ID NO: 220132 - DNA, 25 bp, Mus musculus
agttcaaatccctgcaaccacatgg

SEQ ID NO: 220133 - DNA, 25 bp, Mus musculus
agttcaaatgctagtgccatggcca

SEQ ID NO: 220134 - DNA, 25 bp, Mus musculus
agttcaaatgcttgtgccatggcca

SEQ ID NO: 220135 - DNA, 25 bp, Mus musculus
agttcaacaaccacactcaaaatcc

SEQ ID NO: 220136 - DNA, 25 bp, Mus musculus
agttcaacaacctcactcaaaatcc

SEQ ID NO: 220137 - DNA, 25 bp, Mus musculus
agttcaacacttcaacacagctctt

SEQ ID NO: 220138 - DNA, 25 bp, Mus musculus
agttcaacacttgaacacagctctt

SEQ ID NO: 220139 - DNA, 25 bp, Mus musculus
agttcaacatatcggaccgcgtcct

SEQ ID NO: 220140 - DNA, 25 bp, Mus musculus
agttcaacatatgggaccgcgtcct

SEQ ID NO: 220141 - DNA, 25 bp, Mus musculus
agttcaacatctctgggcgttgcca

SEQ ID NO: 220142 - DNA, 25 bp, Mus musculus
agttcaacatctgtgggcgttgcca

SEQ ID NO: 220143 - DNA, 25 bp, Mus musculus
agttcaaccagaacctaacagccct

SEQ ID NO: 220144 - DNA, 25 bp, Mus musculus
agttcaaccagatcctaacagccct

SEQ ID NO: 220145 - DNA, 25 bp, Mus musculus
agttcaacctgactaccatcttcgt

SEQ ID NO: 220146 - DNA, 25 bp, Mus musculus
agttcaacctgagtaccatcttcgt

SEQ ID NO: 220147 - DNA, 25 bp, Mus musculus
agttcaacctgcacacacatgtgga

SEQ ID NO: 220148 - DNA, 25 bp, Mus musculus
agttcaacctgctcacacatgtgga

SEQ ID NO: 220149 - DNA, 25 bp, Mus musculus
agttcaacgataaatgtctcccctg

SEQ ID NO: 220150 - DNA, 25 bp, Mus musculus
agttcaacgatatatgtctcccctg

SEQ ID NO: 220151 - DNA, 25 bp, Mus musculus
agttcaacgctaacctgtgctacag

SEQ ID NO: 220152 - DNA, 25 bp, Mus musculus
agttcaacgctatcctgtgctacag

SEQ ID NO: 220153 - DNA, 25 bp, Mus musculus
agttcaactcatctggatttctttt

SEQ ID NO: 220154 - DNA, 25 bp, Mus musculus
agttcaactcatgtggatttctttt

SEQ ID NO: 220155 - DNA, 25 bp, Mus musculus
agttcaactctaaagcatgctgaca

SEQ ID NO: 220156 - DNA, 25 bp, Mus musculus
agttcaactctatagcatgctgaca

SEQ ID NO: 220157 - DNA, 25 bp, Mus musculus
agttcaacttatcacccaggcgact

SEQ ID NO: 220158 - DNA, 25 bp, Mus musculus
agttcaacttatgacccaggcgact

SEQ ID NO: 220159 - DNA, 25 bp, Mus musculus
agttcaacttgtattgcacctctgc

SEQ ID NO: 220160 - DNA, 25 bp, Mus musculus
agttcaacttgttttgcacctctgc

SEQ ID NO: 220161 - DNA, 25 bp, Mus musculus
agttcaagaaacaccatcacccaag

SEQ ID NO: 220162 - DNA, 25 bp, Mus musculus
agttcaagaaactccatcacccaag

SEQ ID NO: 220163 - DNA, 25 bp, Mus musculus
agttcaagaacaccctgtagatgtc

SEQ ID NO: 220164 - DNA, 25 bp, Mus musculus
agttcaagaacagcctgtagatgtc

SEQ ID NO: 220165 - DNA, 25 bp, Mus musculus
agttcaagaatacccagggtgacac

SEQ ID NO: 220166 - DNA, 25 bp, Mus musculus
agttcaagaatagccagggtgacac

SEQ ID NO: 220167 - DNA, 25 bp, Mus musculus
agttcaagacccagtggaacggaca

SEQ ID NO: 220168 - DNA, 25 bp, Mus musculus
agttcaagacccataactcattcca

SEQ ID NO: 220169 - DNA, 25 bp, Mus musculus
agttcaagaccctgtggaacggaca

SEQ ID NO: 220170 - DNA, 25 bp, Mus musculus
agttcaagacccttaactcattcca

SEQ ID NO: 220171 - DNA, 25 bp, Mus musculus
agttcaagccctcattggtctatat

SEQ ID NO: 220172 - DNA, 25 bp, Mus musculus
agttcaagccctgattggtctatat

SEQ ID NO: 220173 - DNA, 25 bp, Mus musculus
agttcaagcgcaaatcttctcataa

SEQ ID NO: 220174 - DNA, 25 bp, Mus musculus
agttcaagcgcatatcttctcataa

SEQ ID NO: 220175 - DNA, 25 bp, Mus musculus
agttcaagctggacatcggccaggt

SEQ ID NO: 220176 - DNA, 25 bp, Mus musculus
agttcaagctggtcatcggccaggt

SEQ ID NO: 220177 - DNA, 25 bp, Mus musculus
agttcaagcttgcacccattcatta

SEQ ID NO: 220178 - DNA, 25 bp, Mus musculus
agttcaagcttggacccattcatta

SEQ ID NO: 220179 - DNA, 25 bp, Mus musculus
agttcaaggactctcacgcaggtgt

SEQ ID NO: 220180 - DNA, 25 bp, Mus musculus
agttcaaggactgtcacgcaggtgt

SEQ ID NO: 220181 - DNA, 25 bp, Mus musculus
agttcaaggcatagctggtctatat

SEQ ID NO: 220182 - DNA, 25 bp, Mus musculus
agttcaaggcattgctggtctatat

SEQ ID NO: 220183 - DNA, 25 bp, Mus musculus
agttcaaggccgatcatattctgct

SEQ ID NO: 220184 - DNA, 25 bp, Mus musculus
agttcaaggccgttcatattctgct

SEQ ID NO: 220185 - DNA, 25 bp, Mus musculus
agttcaagggccagcttctcctgtt

SEQ ID NO: 220186 - DNA, 25 bp, Mus musculus
agttcaagggcctgcttctcctgtt

SEQ ID NO: 220187 - DNA, 25 bp, Mus musculus
agttcaagggcgacaggtttccttg

SEQ ID NO: 220188 - DNA, 25 bp, Mus musculus
agttcaagggcgtcaggtttccttg

SEQ ID NO: 220189 - DNA, 25 bp, Mus musculus
agttcaaggtcacccgagtatggta

SEQ ID NO: 220190 - DNA, 25 bp, Mus musculus
agttcaaggtcagccgagtatggta

SEQ ID NO: 220191 - DNA, 25 bp, Mus musculus
agttcaagtgagattcaccctgccc

SEQ ID NO: 220192 - DNA, 25 bp, Mus musculus
agttcaagtgagtttcaccctgccc

SEQ ID NO: 220193 - DNA, 25 bp, Mus musculus
agttcaagtgctccattcgttttcc

SEQ ID NO: 220194 - DNA, 25 bp, Mus musculus
agttcaagtgctgcattcgttttcc

SEQ ID NO: 220195 - DNA, 25 bp, Mus musculus
agttcaagtggtcgcccctgagaca

SEQ ID NO: 220196 - DNA, 25 bp, Mus musculus
agttcaagtggtggcccctgagaca

SEQ ID NO: 220197 - DNA, 25 bp, Mus musculus
agttcaagtgtgctgttcgctctcg

SEQ ID NO: 220198 - DNA, 25 bp, Mus musculus
agttcaagtgtggtgttcgctctcg

SEQ ID NO: 220199 - DNA, 25 bp, Mus musculus
agttcaatacttacaatgcatccag

SEQ ID NO: 220200 - DNA, 25 bp, Mus musculus
agttcaatactttcaatgcatccag

SEQ ID NO: 220201 - DNA, 25 bp, Mus musculus
agttcaatcccaactccatgggagg

SEQ ID NO: 220202 - DNA, 25 bp, Mus musculus
agttcaatcccatctccatgggagg

SEQ ID NO: 220203 - DNA, 25 bp, Mus musculus
agttcaatctgtagctgtctctaca

SEQ ID NO: 220204 - DNA, 25 bp, Mus musculus
agttcaatctgttgctgtctctaca

SEQ ID NO: 220205 - DNA, 25 bp, Mus musculus
agttcaatgacaactctcagagcat

SEQ ID NO: 220206 - DNA, 25 bp, Mus musculus
agttcaatgacatctctcagagcat

SEQ ID NO: 220207 - DNA, 25 bp, Mus musculus
agttcaattttgcttttctgtggtt

SEQ ID NO: 220208 - DNA, 25 bp, Mus musculus
agttcaattttggttttctgtggtt

SEQ ID NO: 220209 - DNA, 25 bp, Mus musculus
agttcacaaaagaaccgccttgctg

SEQ ID NO: 220210 - DNA, 25 bp, Mus musculus
agttcacaaaagtaccgccttgctg

SEQ ID NO: 220211 - DNA, 25 bp, Mus musculus
agttcacaaagcatcacagctgcct

SEQ ID NO: 220212 - DNA, 25 bp, Mus musculus
agttcacaaagcttcacagctgcct

SEQ ID NO: 220213 - DNA, 25 bp, Mus musculus
agttcacaacccctgtacaagtaca

SEQ ID NO: 220214 - DNA, 25 bp, Mus musculus
agttcacaacccgtgtacaagtaca

SEQ ID NO: 220215 - DNA, 25 bp, Mus musculus
agttcacaactcatcagtcatcaca

SEQ ID NO: 220216 - DNA, 25 bp, Mus musculus
agttcacaactcttcagtcatcaca

SEQ ID NO: 220217 - DNA, 25 bp, Mus musculus
agttcacaatgaaacgctctcctat

SEQ ID NO: 220218 - DNA, 25 bp, Mus musculus
agttcacaatgatacgctctcctat

SEQ ID NO: 220219 - DNA, 25 bp, Mus musculus
agttcacaccacctggacgagcagt

SEQ ID NO: 220220 - DNA, 25 bp, Mus musculus
agttcacaccacgtggacgagcagt

SEQ ID NO: 220221 - DNA, 25 bp, Mus musculus
agttcacactctcactcttatgttc

SEQ ID NO: 220222 - DNA, 25 bp, Mus musculus
agttcacactctgactcttatgttc

SEQ ID NO: 220223 - DNA, 25 bp, Mus musculus
agttcacactgtagcatctttggac

SEQ ID NO: 220224 - DNA, 25 bp, Mus musculus
agttcacactgttgcatctttggac

SEQ ID NO: 220225 - DNA, 25 bp, Mus musculus
agttcacacttcctctaatttctga

SEQ ID NO: 220226 - DNA, 25 bp, Mus musculus
agttcacacttcgtctaatttctga

SEQ ID NO: 220227 - DNA, 25 bp, Mus musculus
agttcacagactctagccgctgctc

SEQ ID NO: 220228 - DNA, 25 bp, Mus musculus
agttcacagactgtagccgctgctc

SEQ ID NO: 220229 - DNA, 25 bp, Mus musculus
agttcacagaggacctcaagaccaa

SEQ ID NO: 220230 - DNA, 25 bp, Mus musculus
agttcacagaggtcctcaagaccaa

SEQ ID NO: 220231 - DNA, 25 bp, Mus musculus
agttcacagcataaacaaatggatg

SEQ ID NO: 220232 - DNA, 25 bp, Mus musculus
agttcacagcattaacaaatggatg

SEQ ID NO: 220233 - DNA, 25 bp, Mus musculus
agttcacagcgcactttcatattta

SEQ ID NO: 220234 - DNA, 25 bp, Mus musculus
agttcacagcgctctttcatattta

SEQ ID NO: 220235 - DNA, 25 bp, Mus musculus
agttcacagcttctctgcggtagtc

SEQ ID NO: 220236 - DNA, 25 bp, Mus musculus
agttcacagcttgtctgcggtagtc

SEQ ID NO: 220237 - DNA, 25 bp, Mus musculus
agttcacaggacagccccagatcac

SEQ ID NO: 220238 - DNA, 25 bp, Mus musculus
agttcacaggactgccccagatcac

SEQ ID NO: 220239 - DNA, 25 bp, Mus musculus
agttcacagggccaatgttcgctca

SEQ ID NO: 220240 - DNA, 25 bp, Mus musculus
agttcacagggcgaatgttcgctca

SEQ ID NO: 220241 - DNA, 25 bp, Mus musculus
agttcacagtgacaccagggtttaa

SEQ ID NO: 220242 - DNA, 25 bp, Mus musculus
agttcacagtgagaccagggtttaa

SEQ ID NO: 220243 - DNA, 25 bp, Mus musculus
agttcacagtgcagagcaccaccgg

SEQ ID NO: 220244 - DNA, 25 bp, Mus musculus
agttcacagtgctgagcaccaccgg

SEQ ID NO: 220245 - DNA, 25 bp, Mus musculus
agttcacagtggatcgtgtgggcca

SEQ ID NO: 220246 - DNA, 25 bp, Mus musculus
agttcacagtggttcgtgtgggcca

SEQ ID NO: 220247 - DNA, 25 bp, Mus musculus
agttcacatattccttggacactta

SEQ ID NO: 220248 - DNA, 25 bp, Mus musculus
agttcacatattgcttggacactta

SEQ ID NO: 220249 - DNA, 25 bp, Mus musculus
agttcacatccgcagccacacaggt

SEQ ID NO: 220250 - DNA, 25 bp, Mus musculus
agttcacatccggagccacacaggt

SEQ ID NO: 220251 - DNA, 25 bp, Mus musculus
agttcacatctcagtcagctttcct

SEQ ID NO: 220252 - DNA, 25 bp, Mus musculus
agttcacatctctgtcagctttcct

SEQ ID NO: 220253 - DNA, 25 bp, Mus musculus
agttcacatgtaaagcctgctggcc

SEQ ID NO: 220254 - DNA, 25 bp, Mus musculus
agttcacatgtatagcctgctggcc

SEQ ID NO: 220255 - DNA, 25 bp, Mus musculus
agttcaccaagacatagtccttgta

SEQ ID NO: 220256 - DNA, 25 bp, Mus musculus
agttcaccaagagatagtccttgta

SEQ ID NO: 220257 - DNA, 25 bp, Mus musculus
agttcaccacagagcattttagatg

SEQ ID NO: 220258 - DNA, 25 bp, Mus musculus
agttcaccacagtgcattttagatg

SEQ ID NO: 220259 - DNA, 25 bp, Mus musculus
agttcaccagaaaccacttatatgt

SEQ ID NO: 220260 - DNA, 25 bp, Mus musculus
agttcaccagaatccacttatatgt

SEQ ID NO: 220261 - DNA, 25 bp, Mus musculus
agttcaccagatatcattgcacatt

SEQ ID NO: 220262 - DNA, 25 bp, Mus musculus
agttcaccagatttcattgcacatt

SEQ ID NO: 220263 - DNA, 25 bp, Mus musculus
agttcacccagacctttcttgtaga

SEQ ID NO: 220264 - DNA, 25 bp, Mus musculus
agttcacccagagctttcttgtaga

SEQ ID NO: 220265 - DNA, 25 bp, Mus musculus
agttcacccatcaagaccagagtct

SEQ ID NO: 220266 - DNA, 25 bp, Mus musculus
agttcacccatctagaccagagtct

SEQ ID NO: 220267 - DNA, 25 bp, Mus musculus
agttcaccggctactgggattctaa

SEQ ID NO: 220268 - DNA, 25 bp, Mus musculus
agttcaccggcttctgggattctaa

SEQ ID NO: 220269 - DNA, 25 bp, Mus musculus
agttcaccgttaccataggcgcgat

SEQ ID NO: 220270 - DNA, 25 bp, Mus musculus
agttcaccgttagcataggcgcgat

SEQ ID NO: 220271 - DNA, 25 bp, Mus musculus
agttcacctactcctaagaccagtt

SEQ ID NO: 220272 - DNA, 25 bp, Mus musculus
agttcacctactcctggcatgatga

SEQ ID NO: 220273 - DNA, 25 bp, Mus musculus
agttcacctactgctaagaccagtt

SEQ ID NO: 220274 - DNA, 25 bp, Mus musculus
agttcacctactgctggcatgatga

SEQ ID NO: 220275 - DNA, 25 bp, Mus musculus
agttcacctatactacacctgctaa

SEQ ID NO: 220276 - DNA, 25 bp, Mus musculus
agttcacctatagtacacctgctaa

SEQ ID NO: 220277 - DNA, 25 bp, Mus musculus
agttcacctgtgaagtgccgggcct

SEQ ID NO: 220278 - DNA, 25 bp, Mus musculus
agttcacctgtgtagtgccgggcct

SEQ ID NO: 220279 - DNA, 25 bp, Mus musculus
agttcaccttcaatgcggctctgga

SEQ ID NO: 220280 - DNA, 25 bp, Mus musculus
agttcaccttcattgcggctctgga

SEQ ID NO: 220281 - DNA, 25 bp, Mus musculus
agttcacgcacacactcttggacag

SEQ ID NO: 220282 - DNA, 25 bp, Mus musculus
agttcacgcacagactcttggacag

SEQ ID NO: 220283 - DNA, 25 bp, Mus musculus
agttcacggatacggtggtctccat

SEQ ID NO: 220284 - DNA, 25 bp, Mus musculus
agttcacggatagggtggtctccat

SEQ ID NO: 220285 - DNA, 25 bp, Mus musculus
agttcacggccacactatagccaaa

SEQ ID NO: 220286 - DNA, 25 bp, Mus musculus
agttcacggccagactatagccaaa

SEQ ID NO: 220287 - DNA, 25 bp, Mus musculus
agttcactaaggctgcacactgtat

SEQ ID NO: 220288 - DNA, 25 bp, Mus musculus
agttcactaagggtgcacactgtat

SEQ ID NO: 220289 - DNA, 25 bp, Mus musculus
agttcactatggcagccccagtgta

SEQ ID NO: 220290 - DNA, 25 bp, Mus musculus
agttcactatgggagccccagtgta

SEQ ID NO: 220291 - DNA, 25 bp, Mus musculus
agttcactcacccttgattgtactg

SEQ ID NO: 220292 - DNA, 25 bp, Mus musculus
agttcactcaccgttgattgtactg

SEQ ID NO: 220293 - DNA, 25 bp, Mus musculus
agttcactcattatggaccttgcca

SEQ ID NO: 220294 - DNA, 25 bp, Mus musculus
agttcactcattttggaccttgcca

SEQ ID NO: 220295 - DNA, 25 bp, Mus musculus
agttcactgaacactgatttttgcc

SEQ ID NO: 220296 - DNA, 25 bp, Mus musculus
agttcactgaactctgatttttgcc

SEQ ID NO: 220297 - DNA, 25 bp, Mus musculus
agttcactgaatcacaggctgctta

SEQ ID NO: 220298 - DNA, 25 bp, Mus musculus
agttcactgaatgacaggctgctta

SEQ ID NO: 220299 - DNA, 25 bp, Mus musculus
agttcactgcctctctctaattgtg

SEQ ID NO: 220300 - DNA, 25 bp, Mus musculus
agttcactgcctgtctctaattgtg

SEQ ID NO: 220301 - DNA, 25 bp, Mus musculus
agttcactggagacaggcgaagcca

SEQ ID NO: 220302 - DNA, 25 bp, Mus musculus
agttcactggagtcaggcgaagcca

SEQ ID NO: 220303 - DNA, 25 bp, Mus musculus
agttcactggctacaagtggatcct

SEQ ID NO: 220304 - DNA, 25 bp, Mus musculus
agttcactggcttcaagtggatcct

SEQ ID NO: 220305 - DNA, 25 bp, Mus musculus
agttcacttattcgtctttgtatgt

SEQ ID NO: 220306 - DNA, 25 bp, Mus musculus
agttcacttattggtctttgtatgt

SEQ ID NO: 220307 - DNA, 25 bp, Mus musculus
agttcacttgtgcaacggctgtggc

SEQ ID NO: 220308 - DNA, 25 bp, Mus musculus
agttcacttgtggaacggctgtggc

SEQ ID NO: 220309 - DNA, 25 bp, Mus musculus
agttcagaacatccaacctcagtga

SEQ ID NO: 220310 - DNA, 25 bp, Mus musculus
agttcagaacatgcaacctcagtga

SEQ ID NO: 220311 - DNA, 25 bp, Mus musculus
agttcagaaccacgcgtgttcctac

SEQ ID NO: 220312 - DNA, 25 bp, Mus musculus
agttcagaaccaggcgtgttcctac

SEQ ID NO: 220313 - DNA, 25 bp, Mus musculus
agttcagaactaccactgtggatca

SEQ ID NO: 220314 - DNA, 25 bp, Mus musculus
agttcagaactagcactgtggatca

SEQ ID NO: 220315 - DNA, 25 bp, Mus musculus
agttcagaagtaccaggttcctggg

SEQ ID NO: 220316 - DNA, 25 bp, Mus musculus
agttcagaagtagcaggttcctggg

SEQ ID NO: 220317 - DNA, 25 bp, Mus musculus
agttcagaatacagcccttcccaca

SEQ ID NO: 220318 - DNA, 25 bp, Mus musculus
agttcagaatactgcccttcccaca

SEQ ID NO: 220319 - DNA, 25 bp, Mus musculus
agttcagaatctcagccacatgtca

SEQ ID NO: 220320 - DNA, 25 bp, Mus musculus
agttcagaatctgagccacatgtca

SEQ ID NO: 220321 - DNA, 25 bp, Mus musculus
agttcagacattactttggagtttg

SEQ ID NO: 220322 - DNA, 25 bp, Mus musculus
agttcagacattcctccttgaccta

SEQ ID NO: 220323 - DNA, 25 bp, Mus musculus
agttcagacattgctccttgaccta

SEQ ID NO: 220324 - DNA, 25 bp, Mus musculus
agttcagacatttctttggagtttg

SEQ ID NO: 220325 - DNA, 25 bp, Mus musculus
agttcagaccccaggctggaagatc

SEQ ID NO: 220326 - DNA, 25 bp, Mus musculus
agttcagacccctggctggaagatc

SEQ ID NO: 220327 - DNA, 25 bp, Mus musculus
agttcagacggacttcattggccac

SEQ ID NO: 220328 - DNA, 25 bp, Mus musculus
agttcagacggagttcattggccac

SEQ ID NO: 220329 - DNA, 25 bp, Mus musculus
agttcagactctaagcaggcttagc

SEQ ID NO: 220330 - DNA, 25 bp, Mus musculus
agttcagactcttagcaggcttagc

SEQ ID NO: 220331 - DNA, 25 bp, Mus musculus
agttcagactgcaacaccccattgt

SEQ ID NO: 220332 - DNA, 25 bp, Mus musculus
agttcagactgctacaccccattgt

SEQ ID NO: 220333 - DNA, 25 bp, Mus musculus
agttcagactggacaccacttgtag

SEQ ID NO: 220334 - DNA, 25 bp, Mus musculus
agttcagactggtcaccacttgtag

SEQ ID NO: 220335 - DNA, 25 bp, Mus musculus
agttcagagcaacagttcaagtcaa

SEQ ID NO: 220336 - DNA, 25 bp, Mus musculus
agttcagagcaagagttcaagtcaa

SEQ ID NO: 220337 - DNA, 25 bp, Mus musculus
agttcagagcatccgaactcatttc

SEQ ID NO: 220338 - DNA, 25 bp, Mus musculus
agttcagagcatgcgaactcatttc

SEQ ID NO: 220339 - DNA, 25 bp, Mus musculus
agttcagagctaacctcagcttcat

SEQ ID NO: 220340 - DNA, 25 bp, Mus musculus
agttcagagctatcctcagcttcat

SEQ ID NO: 220341 - DNA, 25 bp, Mus musculus
agttcagagctcaagaatccatgga

SEQ ID NO: 220342 - DNA, 25 bp, Mus musculus
agttcagagctctagaatccatgga

SEQ ID NO: 220343 - DNA, 25 bp, Mus musculus
agttcagatatgcagttgtcccttt

SEQ ID NO: 220344 - DNA, 25 bp, Mus musculus
agttcagatatggagttgtcccttt

SEQ ID NO: 220345 - DNA, 25 bp, Mus musculus
agttcagatctcattgtgctcattc

SEQ ID NO: 220346 - DNA, 25 bp, Mus musculus
agttcagatctctttgtgctcattc

SEQ ID NO: 220347 - DNA, 25 bp, Mus musculus
agttcagatgacacttctagatcac

SEQ ID NO: 220348 - DNA, 25 bp, Mus musculus
agttcagatgactcttctagatcac

SEQ ID NO: 220349 - DNA, 25 bp, Mus musculus
agttcagattgcctctctctgagaa

SEQ ID NO: 220350 - DNA, 25 bp, Mus musculus
agttcagattgcgtctctctgagaa

SEQ ID NO: 220351 - DNA, 25 bp, Mus musculus
agttcagcaatacagaggcttgcaa

SEQ ID NO: 220352 - DNA, 25 bp, Mus musculus
agttcagcaatagagaggcttgcaa

SEQ ID NO: 220353 - DNA, 25 bp, Mus musculus
agttcagcactcacactattcagat

SEQ ID NO: 220354 - DNA, 25 bp, Mus musculus
agttcagcactctcactattcagat

SEQ ID NO: 220355 - DNA, 25 bp, Mus musculus
agttcagcagctcatgtgatcccca

SEQ ID NO: 220356 - DNA, 25 bp, Mus musculus
agttcagcagctgatgtgatcccca

SEQ ID NO: 220357 - DNA, 25 bp, Mus musculus
agttcagcagtgaagccctagtggc

SEQ ID NO: 220358 - DNA, 25 bp, Mus musculus
agttcagcagtgtagccctagtggc

SEQ ID NO: 220359 - DNA, 25 bp, Mus musculus
agttcagcatgtactctggaagcca

SEQ ID NO: 220360 - DNA, 25 bp, Mus musculus
agttcagcatgttctctggaagcca

SEQ ID NO: 220361 - DNA, 25 bp, Mus musculus
agttcagccaagctcagtgtgttta

SEQ ID NO: 220362 - DNA, 25 bp, Mus musculus
agttcagccaaggtcagtgtgttta

SEQ ID NO: 220363 - DNA, 25 bp, Mus musculus
agttcagccctacatctgcagatgc

SEQ ID NO: 220364 - DNA, 25 bp, Mus musculus
agttcagccctagatctgcagatgc

SEQ ID NO: 220365 - DNA, 25 bp, Mus musculus
agttcagccgccagcacaagctaag

SEQ ID NO: 220366 - DNA, 25 bp, Mus musculus
agttcagccgcctgcacaagctaag

SEQ ID NO: 220367 - DNA, 25 bp, Mus musculus
agttcagccggccttacctgcagca

SEQ ID NO: 220368 - DNA, 25 bp, Mus musculus
agttcagccggcgttacctgcagca

SEQ ID NO: 220369 - DNA, 25 bp, Mus musculus
agttcagccgtgacctgaaacgcaa

SEQ ID NO: 220370 - DNA, 25 bp, Mus musculus
agttcagccgtgtcctgaaacgcaa

SEQ ID NO: 220371 - DNA, 25 bp, Mus musculus
agttcagcctcaagcaccagttgga

SEQ ID NO: 220372 - DNA, 25 bp, Mus musculus
agttcagcctcatgcaccagttgga

SEQ ID NO: 220373 - DNA, 25 bp, Mus musculus
agttcagcgggcaaagcagatcgaa

SEQ ID NO: 220374 - DNA, 25 bp, Mus musculus
agttcagcgggctaagcagatcgaa

SEQ ID NO: 220375 - DNA, 25 bp, Mus musculus
agttcagctatcatggagcctatga

SEQ ID NO: 220376 - DNA, 25 bp, Mus musculus
agttcagctatcttggagcctatga

SEQ ID NO: 220377 - DNA, 25 bp, Mus musculus
agttcagctattatttcctccaaga

SEQ ID NO: 220378 - DNA, 25 bp, Mus musculus
agttcagctattttttcctccaaga

SEQ ID NO: 220379 - DNA, 25 bp, Mus musculus
agttcagctccaagcaactcaatct

SEQ ID NO: 220380 - DNA, 25 bp, Mus musculus
agttcagctccatgcaactcaatct

SEQ ID NO: 220381 - DNA, 25 bp, Mus musculus
agttcagctccgaggaaacccagac

SEQ ID NO: 220382 - DNA, 25 bp, Mus musculus
agttcagctccgtggaaacccagac

SEQ ID NO: 220383 - DNA, 25 bp, Mus musculus
agttcagctctgatactgtgtctac

SEQ ID NO: 220384 - DNA, 25 bp, Mus musculus
agttcagctctgttactgtgtctac

SEQ ID NO: 220385 - DNA, 25 bp, Mus musculus
agttcagctcttcaaagcactgcag

SEQ ID NO: 220386 - DNA, 25 bp, Mus musculus
agttcagctcttgaaagcactgcag

SEQ ID NO: 220387 - DNA, 25 bp, Mus musculus
agttcagctgctagtacgagcacat

SEQ ID NO: 220388 - DNA, 25 bp, Mus musculus
agttcagctgcttgtacgagcacat

SEQ ID NO: 220389 - DNA, 25 bp, Mus musculus
agttcagcttcaccacctgtgtcaa

SEQ ID NO: 220390 - DNA, 25 bp, Mus musculus
agttcagcttcagcacctgtgtcaa

SEQ ID NO: 220391 - DNA, 25 bp, Mus musculus
agttcagcttctagcatgtacctct

SEQ ID NO: 220392 - DNA, 25 bp, Mus musculus
agttcagcttcttgcatgtacctct

SEQ ID NO: 220393 - DNA, 25 bp, Mus musculus
agttcagctttgactgtcaacctgt

SEQ ID NO: 220394 - DNA, 25 bp, Mus musculus
agttcagctttgtctgtcaacctgt

SEQ ID NO: 220395 - DNA, 25 bp, Mus musculus
agttcagcttttaacacagacccac

SEQ ID NO: 220396 - DNA, 25 bp, Mus musculus
agttcagctttttacacagacccac

SEQ ID NO: 220397 - DNA, 25 bp, Mus musculus
agttcaggaaacaaagtgaccagtc

SEQ ID NO: 220398 - DNA, 25 bp, Mus musculus
agttcaggaaactaagtgaccagtc

SEQ ID NO: 220399 - DNA, 25 bp, Mus musculus
agttcaggacctcgcgctggagtca

SEQ ID NO: 220400 - DNA, 25 bp, Mus musculus
agttcaggacctggcgctggagtca

SEQ ID NO: 220401 - DNA, 25 bp, Mus musculus
agttcaggatcaagctcagaagcgc

SEQ ID NO: 220402 - DNA, 25 bp, Mus musculus
agttcaggatcatgctcagaagcgc

SEQ ID NO: 220403 - DNA, 25 bp, Mus musculus
agttcaggctctagccttgtggcca

SEQ ID NO: 220404 - DNA, 25 bp, Mus musculus
agttcaggctcttgccttgtggcca

SEQ ID NO: 220405 - DNA, 25 bp, Mus musculus
agttcaggctgcagctccggtggct

SEQ ID NO: 220406 - DNA, 25 bp, Mus musculus
agttcaggctgctgctccggtggct

SEQ ID NO: 220407 - DNA, 25 bp, Mus musculus
agttcaggctgtcctacttggtttg

SEQ ID NO: 220408 - DNA, 25 bp, Mus musculus
agttcaggctgtgctacttggtttg

SEQ ID NO: 220409 - DNA, 25 bp, Mus musculus
agttcaggcttcctgcaagtaaagg

SEQ ID NO: 220410 - DNA, 25 bp, Mus musculus
agttcaggcttcgtgcaagtaaagg

SEQ ID NO: 220411 - DNA, 25 bp, Mus musculus
agttcagggcagactctttctgtca

SEQ ID NO: 220412 - DNA, 25 bp, Mus musculus
agttcagggcagtctctttctgtca

SEQ ID NO: 220413 - DNA, 25 bp, Mus musculus
agttcagggccaacatggtagtcat

SEQ ID NO: 220414 - DNA, 25 bp, Mus musculus
agttcagggccacgttggactacaa

SEQ ID NO: 220415 - DNA, 25 bp, Mus musculus
agttcagggccaggttggactacaa

SEQ ID NO: 220416 - DNA, 25 bp, Mus musculus
agttcagggccatcatggtagtcat

SEQ ID NO: 220417 - DNA, 25 bp, Mus musculus
agttcagggctgatccaagcactgc

SEQ ID NO: 220418 - DNA, 25 bp, Mus musculus
agttcagggctgttccaagcactgc

SEQ ID NO: 220419 - DNA, 25 bp, Mus musculus
agttcagggtgtattactcaggcct

SEQ ID NO: 220420 - DNA, 25 bp, Mus musculus
agttcagggtgttttactcaggcct

SEQ ID NO: 220421 - DNA, 25 bp, Mus musculus
agttcaggtatgctgggaccttcca

SEQ ID NO: 220422 - DNA, 25 bp, Mus musculus
agttcaggtatggtgggaccttcca

SEQ ID NO: 220423 - DNA, 25 bp, Mus musculus
agttcaggtcacagttcacggtggc

SEQ ID NO: 220424 - DNA, 25 bp, Mus musculus
agttcaggtcactgttcacggtggc

SEQ ID NO: 220425 - DNA, 25 bp, Mus musculus
agttcaggtcttactttattattga

SEQ ID NO: 220426 - DNA, 25 bp, Mus musculus
agttcaggtctttctttattattga

SEQ ID NO: 220427 - DNA, 25 bp, Mus musculus
agttcaggtgagcagcttgatgctt

SEQ ID NO: 220428 - DNA, 25 bp, Mus musculus
agttcaggtgaggagcttgatgctt

SEQ ID NO: 220429 - DNA, 25 bp, Mus musculus
agttcaggtgggactgttctctgtc

SEQ ID NO: 220430 - DNA, 25 bp, Mus musculus
agttcaggtgggtctgttctctgtc

SEQ ID NO: 220431 - DNA, 25 bp, Mus musculus
agttcagtcaggatagtcgccagcc

SEQ ID NO: 220432 - DNA, 25 bp, Mus musculus
agttcagtcaggttagtcgccagcc

SEQ ID NO: 220433 - DNA, 25 bp, Mus musculus
agttcagtccatctgaatctcacgg

SEQ ID NO: 220434 - DNA, 25 bp, Mus musculus
agttcagtccatgtgaatctcacgg

SEQ ID NO: 220435 - DNA, 25 bp, Mus musculus
agttcagtcctgagaagctcggcta

SEQ ID NO: 220436 - DNA, 25 bp, Mus musculus
agttcagtcctgtgaagctcggcta

SEQ ID NO: 220437 - DNA, 25 bp, Mus musculus
agttcagtctctcgaactcacagtg

SEQ ID NO: 220438 - DNA, 25 bp, Mus musculus
agttcagtctctggaactcacagtg

SEQ ID NO: 220439 - DNA, 25 bp, Mus musculus
agttcagtgattccagctctgccaa

SEQ ID NO: 220440 - DNA, 25 bp, Mus musculus
agttcagtgattgcagctctgccaa

SEQ ID NO: 220441 - DNA, 25 bp, Mus musculus
agttcagtgccaagttgtagataga

SEQ ID NO: 220442 - DNA, 25 bp, Mus musculus
agttcagtgccatgttgtagataga

SEQ ID NO: 220443 - DNA, 25 bp, Mus musculus
agttcagtgctcatttacactccac

SEQ ID NO: 220444 - DNA, 25 bp, Mus musculus
agttcagtgctcttttacactccac

SEQ ID NO: 220445 - DNA, 25 bp, Mus musculus
agttcagtgctgattggctagttcc

SEQ ID NO: 220446 - DNA, 25 bp, Mus musculus
agttcagtgctgtttggctagttcc

SEQ ID NO: 220447 - DNA, 25 bp, Mus musculus
agttcagtggtaaagtgttgagcaa

SEQ ID NO: 220448 - DNA, 25 bp, Mus musculus
agttcagtggtatagtgttgagcaa

SEQ ID NO: 220449 - DNA, 25 bp, Mus musculus
agttcagtgtccagtcattcagtaa

SEQ ID NO: 220450 - DNA, 25 bp, Mus musculus
agttcagtgtcctgtcattcagtaa

SEQ ID NO: 220451 - DNA, 25 bp, Mus musculus
agttcagtgtgcctctggtcgttcc

SEQ ID NO: 220452 - DNA, 25 bp, Mus musculus
agttcagtgtgcgtctggtcgttcc

SEQ ID NO: 220453 - DNA, 25 bp, Mus musculus
agttcagttcacagccaattgtcct

SEQ ID NO: 220454 - DNA, 25 bp, Mus musculus
agttcagttcactgccaattgtcct

SEQ ID NO: 220455 - DNA, 25 bp, Mus musculus
agttcagttcccaggcctagttagc

SEQ ID NO: 220456 - DNA, 25 bp, Mus musculus
agttcagttccctggcctagttagc

SEQ ID NO: 220457 - DNA, 25 bp, Mus musculus
agttcagttcggaccagtggtggcc

SEQ ID NO: 220458 - DNA, 25 bp, Mus musculus
agttcagttcggtccagtggtggcc

SEQ ID NO: 220459 - DNA, 25 bp, Mus musculus
agttcagttgagattgtgcagttct

SEQ ID NO: 220460 - DNA, 25 bp, Mus musculus
agttcagttgagctgttttctttga

SEQ ID NO: 220461 - DNA, 25 bp, Mus musculus
agttcagttgaggtgttttctttga

SEQ ID NO: 220462 - DNA, 25 bp, Mus musculus
agttcagttgagtttgtgcagttct

SEQ ID NO: 220463 - DNA, 25 bp, Mus musculus
agttcagttgtaacagtttaattgg

SEQ ID NO: 220464 - DNA, 25 bp, Mus musculus
agttcagttgtatcagtttaattgg

SEQ ID NO: 220465 - DNA, 25 bp, Mus musculus
agttcagtttggagcccaggcacca

SEQ ID NO: 220466 - DNA, 25 bp, Mus musculus
agttcagtttggtgcccaggcacca

SEQ ID NO: 220467 - DNA, 25 bp, Mus musculus
agttcagttttactctggtctgggc

SEQ ID NO: 220468 - DNA, 25 bp, Mus musculus
agttcagttttagtctggtctgggc

SEQ ID NO: 220469 - DNA, 25 bp, Mus musculus
agttcatacacaattctgtttgtct

SEQ ID NO: 220470 - DNA, 25 bp, Mus musculus
agttcatacacatttctgtttgtct

SEQ ID NO: 220471 - DNA, 25 bp, Mus musculus
agttcataccatactgtcagttttt

SEQ ID NO: 220472 - DNA, 25 bp, Mus musculus
agttcataccattctgtcagttttt

SEQ ID NO: 220473 - DNA, 25 bp, Mus musculus
agttcatatgtgcaacttccctgct

SEQ ID NO: 220474 - DNA, 25 bp, Mus musculus
agttcatatgtggaacttccctgct

SEQ ID NO: 220475 - DNA, 25 bp, Mus musculus
agttcatcagtgactacctctggag

SEQ ID NO: 220476 - DNA, 25 bp, Mus musculus
agttcatcagtgtctacctctggag

SEQ ID NO: 220477 - DNA, 25 bp, Mus musculus
agttcatcatccatgcatgcgatgg

SEQ ID NO: 220478 - DNA, 25 bp, Mus musculus
agttcatcatccttgcatgcgatgg

SEQ ID NO: 220479 - DNA, 25 bp, Mus musculus
agttcatccaggcactgtcggtgac

SEQ ID NO: 220480 - DNA, 25 bp, Mus musculus
agttcatccagggactgtcggtgac

SEQ ID NO: 220481 - DNA, 25 bp, Mus musculus
agttcatccatcaaataagcttgtt

SEQ ID NO: 220482 - DNA, 25 bp, Mus musculus
agttcatccatctaataagcttgtt

SEQ ID NO: 220483 - DNA, 25 bp, Mus musculus
agttcatccccgctaaaggcctatt

SEQ ID NO: 220484 - DNA, 25 bp, Mus musculus
agttcatccccggtaaaggcctatt

SEQ ID NO: 220485 - DNA, 25 bp, Mus musculus
agttcatcccttagcaccagaccga

SEQ ID NO: 220486 - DNA, 25 bp, Mus musculus
agttcatccctttgcaccagaccga

SEQ ID NO: 220487 - DNA, 25 bp, Mus musculus
agttcatccgacagaagcgccgtgg

SEQ ID NO: 220488 - DNA, 25 bp, Mus musculus
agttcatccgactgaagcgccgtgg

SEQ ID NO: 220489 - DNA, 25 bp, Mus musculus
agttcatccgagagagctacccaga

SEQ ID NO: 220490 - DNA, 25 bp, Mus musculus
agttcatccgagagtctgagcctga

SEQ ID NO: 220491 - DNA, 25 bp, Mus musculus
agttcatccgagtgagctacccaga

SEQ ID NO: 220492 - DNA, 25 bp, Mus musculus
agttcatccgagtgtctgagcctga

SEQ ID NO: 220493 - DNA, 25 bp, Mus musculus
agttcatccggccttatggaggcat

SEQ ID NO: 220494 - DNA, 25 bp, Mus musculus
agttcatccggcgttatggaggcat

SEQ ID NO: 220495 - DNA, 25 bp, Mus musculus
agttcatcctggagcatgtctgata

SEQ ID NO: 220496 - DNA, 25 bp, Mus musculus
agttcatcctggtgcatgtctgata

SEQ ID NO: 220497 - DNA, 25 bp, Mus musculus
agttcatcgccgagaccaccgagga

SEQ ID NO: 220498 - DNA, 25 bp, Mus musculus
agttcatcgccgtgaccaccgagga

SEQ ID NO: 220499 - DNA, 25 bp, Mus musculus
agttcatctgcacccatcagagttt

SEQ ID NO: 220500 - DNA, 25 bp, Mus musculus
agttcatctgcagccatcagagttt

SEQ ID NO: 220501 - DNA, 25 bp, Mus musculus
agttcatctgtgactaattatctga

SEQ ID NO: 220502 - DNA, 25 bp, Mus musculus
agttcatctgtgtctaattatctga

SEQ ID NO: 220503 - DNA, 25 bp, Mus musculus
agttcatgaagtaatacacctacaa

SEQ ID NO: 220504 - DNA, 25 bp, Mus musculus
agttcatgaagttatacacctacaa

SEQ ID NO: 220505 - DNA, 25 bp, Mus musculus
agttcatgagacctgccttggtaaa

SEQ ID NO: 220506 - DNA, 25 bp, Mus musculus
agttcatgagacgtgccttggtaaa

SEQ ID NO: 220507 - DNA, 25 bp, Mus musculus
agttcatgagctcagcctacgggat

SEQ ID NO: 220508 - DNA, 25 bp, Mus musculus
agttcatgagctgagcctacgggat

SEQ ID NO: 220509 - DNA, 25 bp, Mus musculus
agttcatgcaatactctctctagag

SEQ ID NO: 220510 - DNA, 25 bp, Mus musculus
agttcatgcaattctctctctagag

SEQ ID NO: 220511 - DNA, 25 bp, Mus musculus
agttcatgcaggagccagccatcca

SEQ ID NO: 220512 - DNA, 25 bp, Mus musculus
agttcatgcaggtgccagccatcca

SEQ ID NO: 220513 - DNA, 25 bp, Mus musculus
agttcatgccttcacgttcctcagc

SEQ ID NO: 220514 - DNA, 25 bp, Mus musculus
agttcatgccttgacgttcctcagc

SEQ ID NO: 220515 - DNA, 25 bp, Mus musculus
agttcatgctctacagcaacttggc

SEQ ID NO: 220516 - DNA, 25 bp, Mus musculus
agttcatgctcttcagcaacttggc

SEQ ID NO: 220517 - DNA, 25 bp, Mus musculus
agttcatggacgatctttgtaggat

SEQ ID NO: 220518 - DNA, 25 bp, Mus musculus
agttcatggacgttctttgtaggat

SEQ ID NO: 220519 - DNA, 25 bp, Mus musculus
agttcatggcacactaatttttggt

SEQ ID NO: 220520 - DNA, 25 bp, Mus musculus
agttcatggcactctaatttttggt

SEQ ID NO: 220521 - DNA, 25 bp, Mus musculus
agttcatggcatcgctttacctttg

SEQ ID NO: 220522 - DNA, 25 bp, Mus musculus
agttcatggcatggctttacctttg

SEQ ID NO: 220523 - DNA, 25 bp, Mus musculus
agttcatggtcaccctggcttacat

SEQ ID NO: 220524 - DNA, 25 bp, Mus musculus
agttcatggtcagcctggcttacat

SEQ ID NO: 220525 - DNA, 25 bp, Mus musculus
agttcatggtggctctgtcagaaag

SEQ ID NO: 220526 - DNA, 25 bp, Mus musculus
agttcatggtgggtctgtcagaaag

SEQ ID NO: 220527 - DNA, 25 bp, Mus musculus
agttcatgttctacccagatcgtat

SEQ ID NO: 220528 - DNA, 25 bp, Mus musculus
agttcatgttcttcccagatcgtat

SEQ ID NO: 220529 - DNA, 25 bp, Mus musculus
agttcatgtttactctgccagggtg

SEQ ID NO: 220530 - DNA, 25 bp, Mus musculus
agttcatgtttagtctgccagggtg

SEQ ID NO: 220531 - DNA, 25 bp, Mus musculus
agttcattaatgaccctgcgcagat

SEQ ID NO: 220532 - DNA, 25 bp, Mus musculus
agttcattaatgtccctgcgcagat

SEQ ID NO: 220533 - DNA, 25 bp, Mus musculus
agttcattactgacttcttacctac

SEQ ID NO: 220534 - DNA, 25 bp, Mus musculus
agttcattactgtcttcttacctac

SEQ ID NO: 220535 - DNA, 25 bp, Mus musculus
agttcattagtgagctttgctctcc

SEQ ID NO: 220536 - DNA, 25 bp, Mus musculus
agttcattagtgtgctttgctctcc

SEQ ID NO: 220537 - DNA, 25 bp, Mus musculus
agttcattatgtcctcaaccctggg

SEQ ID NO: 220538 - DNA, 25 bp, Mus musculus
agttcattatgtgctcaaccctggg

SEQ ID NO: 220539 - DNA, 25 bp, Mus musculus
agttcattctaccaagctgtcacag

SEQ ID NO: 220540 - DNA, 25 bp, Mus musculus
agttcattctacgaagctgtcacag

SEQ ID NO: 220541 - DNA, 25 bp, Mus musculus
agttcattctctcctttgagcttgt

SEQ ID NO: 220542 - DNA, 25 bp, Mus musculus
agttcattctctgctttgagcttgt

SEQ ID NO: 220543 - DNA, 25 bp, Mus musculus
agttcattgaacatgggtctacaaa

SEQ ID NO: 220544 - DNA, 25 bp, Mus musculus
agttcattgaacttgggtctacaaa

SEQ ID NO: 220545 - DNA, 25 bp, Mus musculus
agttcattgcatactgaagtttggg

SEQ ID NO: 220546 - DNA, 25 bp, Mus musculus
agttcattgcatcctgacgcgacat

SEQ ID NO: 220547 - DNA, 25 bp, Mus musculus
agttcattgcatgctgacgcgacat

SEQ ID NO: 220548 - DNA, 25 bp, Mus musculus
agttcattgcattctgaagtttggg

SEQ ID NO: 220549 - DNA, 25 bp, Mus musculus
agttcattgccacccttcagtacat

SEQ ID NO: 220550 - DNA, 25 bp, Mus musculus
agttcattgccagccttcagtacat

SEQ ID NO: 220551 - DNA, 25 bp, Mus musculus
agttcattggctcttgtttctagaa

SEQ ID NO: 220552 - DNA, 25 bp, Mus musculus
agttcattggctgttgtttctagaa

SEQ ID NO: 220553 - DNA, 25 bp, Mus musculus
agttcattggttcggcattctctca

SEQ ID NO: 220554 - DNA, 25 bp, Mus musculus
agttcattggttgggcattctctca

SEQ ID NO: 220555 - DNA, 25 bp, Mus musculus
agttcattgtttcgttggctccacc

SEQ ID NO: 220556 - DNA, 25 bp, Mus musculus
agttcattgtttggttggctccacc

SEQ ID NO: 220557 - DNA, 25 bp, Mus musculus
agttcatttaacatacaggcagtct

SEQ ID NO: 220558 - DNA, 25 bp, Mus musculus
agttcatttaacttacaggcagtct

SEQ ID NO: 220559 - DNA, 25 bp, Mus musculus
agttcatttttgatgctgcagccca

SEQ ID NO: 220560 - DNA, 25 bp, Mus musculus
agttcatttttgttgctgcagccca

SEQ ID NO: 220561 - DNA, 25 bp, Mus musculus
agttccaaaagcatcctgggcatga

SEQ ID NO: 220562 - DNA, 25 bp, Mus musculus
agttccaaaagcttcctgggcatga

SEQ ID NO: 220563 - DNA, 25 bp, Mus musculus
agttccaaaccacgtcagctgttag

SEQ ID NO: 220564 - DNA, 25 bp, Mus musculus
agttccaaaccaggtcagctgttag

SEQ ID NO: 220565 - DNA, 25 bp, Mus musculus
agttccaaagcaaaattttgccttt

SEQ ID NO: 220566 - DNA, 25 bp, Mus musculus
agttccaaagcaccgctctagacag

SEQ ID NO: 220567 - DNA, 25 bp, Mus musculus
agttccaaagcagcgctctagacag

SEQ ID NO: 220568 - DNA, 25 bp, Mus musculus
agttccaaagcataattttgccttt

SEQ ID NO: 220569 - DNA, 25 bp, Mus musculus
agttccaaatgcattgtgggtttca

SEQ ID NO: 220570 - DNA, 25 bp, Mus musculus
agttccaaatgctttgtgggtttca

SEQ ID NO: 220571 - DNA, 25 bp, Mus musculus
agttccaaccataaagatccacacc

SEQ ID NO: 220572 - DNA, 25 bp, Mus musculus
agttccaaccatatcacatacatac

SEQ ID NO: 220573 - DNA, 25 bp, Mus musculus
agttccaaccattaagatccacacc

SEQ ID NO: 220574 - DNA, 25 bp, Mus musculus
agttccaaccatttcacatacatac

SEQ ID NO: 220575 - DNA, 25 bp, Mus musculus
agttccaacctacctaagggtcatg

SEQ ID NO: 220576 - DNA, 25 bp, Mus musculus
agttccaacctagctaagggtcatg

SEQ ID NO: 220577 - DNA, 25 bp, Mus musculus
agttccaactaaaacctcagcatct

SEQ ID NO: 220578 - DNA, 25 bp, Mus musculus
agttccaactaatacctcagcatct

SEQ ID NO: 220579 - DNA, 25 bp, Mus musculus
agttccaagaccagccagagcctga

SEQ ID NO: 220580 - DNA, 25 bp, Mus musculus
agttccaagacctgccagagcctga

SEQ ID NO: 220581 - DNA, 25 bp, Mus musculus
agttccaagatactgaaggttacag

SEQ ID NO: 220582 - DNA, 25 bp, Mus musculus
agttccaagatagtgaaggttacag

SEQ ID NO: 220583 - DNA, 25 bp, Mus musculus
agttccaagcacaggagtctgccag

SEQ ID NO: 220584 - DNA, 25 bp, Mus musculus
agttccaagcactggagtctgccag

SEQ ID NO: 220585 - DNA, 25 bp, Mus musculus
agttccaataacactttagccattt

SEQ ID NO: 220586 - DNA, 25 bp, Mus musculus
agttccaataactctttagccattt

SEQ ID NO: 220587 - DNA, 25 bp, Mus musculus
agttccaatgtacggactcttgcta

SEQ ID NO: 220588 - DNA, 25 bp, Mus musculus
agttccaatgtagggactcttgcta

SEQ ID NO: 220589 - DNA, 25 bp, Mus musculus
agttccacaaatcccctcagtagag

SEQ ID NO: 220590 - DNA, 25 bp, Mus musculus
agttccacaaatgccctcagtagag

SEQ ID NO: 220591 - DNA, 25 bp, Mus musculus
agttccacaccaaggatgcttttcc

SEQ ID NO: 220592 - DNA, 25 bp, Mus musculus
agttccacaccatggatgcttttcc

SEQ ID NO: 220593 - DNA, 25 bp, Mus musculus
agttccacagtgactcggttctgaa

SEQ ID NO: 220594 - DNA, 25 bp, Mus musculus
agttccacagtgtctcggttctgaa

SEQ ID NO: 220595 - DNA, 25 bp, Mus musculus
agttccaccaatacacagcagtgcc

SEQ ID NO: 220596 - DNA, 25 bp, Mus musculus
agttccaccaattcacagcagtgcc

SEQ ID NO: 220597 - DNA, 25 bp, Mus musculus
agttccaccaggcagcatctgagga

SEQ ID NO: 220598 - DNA, 25 bp, Mus musculus
agttccaccagggagcatctgagga

SEQ ID NO: 220599 - DNA, 25 bp, Mus musculus
agttccacctacagagctccaagga

SEQ ID NO: 220600 - DNA, 25 bp, Mus musculus
agttccacctactgagctccaagga

SEQ ID NO: 220601 - DNA, 25 bp, Mus musculus
agttccacctatcaggaggccttaa

SEQ ID NO: 220602 - DNA, 25 bp, Mus musculus
agttccacctatgaggaggccttaa

SEQ ID NO: 220603 - DNA, 25 bp, Mus musculus
agttccacctcccacttgagaagaa

SEQ ID NO: 220604 - DNA, 25 bp, Mus musculus
agttccacctccgacttgagaagaa

SEQ ID NO: 220605 - DNA, 25 bp, Mus musculus
agttccacctcgaggtcctcttcgg

SEQ ID NO: 220606 - DNA, 25 bp, Mus musculus
agttccacctcgtggtcctcttcgg

SEQ ID NO: 220607 - DNA, 25 bp, Mus musculus
agttccacgaccagcagcttaccta

SEQ ID NO: 220608 - DNA, 25 bp, Mus musculus
agttccacgacctgcagcttaccta

SEQ ID NO: 220609 - DNA, 25 bp, Mus musculus
agttccactaccacggtcggcaggg

SEQ ID NO: 220610 - DNA, 25 bp, Mus musculus
agttccactacctcggtcggcaggg

SEQ ID NO: 220611 - DNA, 25 bp, Mus musculus
agttccactcaaagccgatcagtaa

SEQ ID NO: 220612 - DNA, 25 bp, Mus musculus
agttccactcaatgccgatcagtaa

SEQ ID NO: 220613 - DNA, 25 bp, Mus musculus
agttccactctactatcagccatac

SEQ ID NO: 220614 - DNA, 25 bp, Mus musculus
agttccactctagtatcagccatac

SEQ ID NO: 220615 - DNA, 25 bp, Mus musculus
agttccactgtgaggctattctgtg

SEQ ID NO: 220616 - DNA, 25 bp, Mus musculus
agttccactgtgtggctattctgtg

SEQ ID NO: 220617 - DNA, 25 bp, Mus musculus
agttccactttacccacagtttata

SEQ ID NO: 220618 - DNA, 25 bp, Mus musculus
agttccactttagccacagtttata

SEQ ID NO: 220619 - DNA, 25 bp, Mus musculus
agttccagaactcagtcttcctttg

SEQ ID NO: 220620 - DNA, 25 bp, Mus musculus
agttccagaactgagtcttcctttg

SEQ ID NO: 220621 - DNA, 25 bp, Mus musculus
agttccagaatacctcagcagcctc

SEQ ID NO: 220622 - DNA, 25 bp, Mus musculus
agttccagaatagctcagcagcctc

SEQ ID NO: 220623 - DNA, 25 bp, Mus musculus
agttccagaccaaacacagccttgt

SEQ ID NO: 220624 - DNA, 25 bp, Mus musculus
agttccagaccatacacagccttgt

SEQ ID NO: 220625 - DNA, 25 bp, Mus musculus
agttccagagcaagacacccccttt

SEQ ID NO: 220626 - DNA, 25 bp, Mus musculus
agttccagagcatgacacccccttt

SEQ ID NO: 220627 - DNA, 25 bp, Mus musculus
agttccagcaccacagagcaaagcc

SEQ ID NO: 220628 - DNA, 25 bp, Mus musculus
agttccagcacctcagagcaaagcc

SEQ ID NO: 220629 - DNA, 25 bp, Mus musculus
agttccagcatcatactctttgata

SEQ ID NO: 220630 - DNA, 25 bp, Mus musculus
agttccagcatcttactctttgata

SEQ ID NO: 220631 - DNA, 25 bp, Mus musculus
agttccagccctcagggaaccaagc

SEQ ID NO: 220632 - DNA, 25 bp, Mus musculus
agttccagccctgagggaaccaagc

SEQ ID NO: 220633 - DNA, 25 bp, Mus musculus
agttccagctaacggcactaatgca

SEQ ID NO: 220634 - DNA, 25 bp, Mus musculus
agttccagctaagggcactaatgca

SEQ ID NO: 220635 - DNA, 25 bp, Mus musculus
agttccagctcaactacgttgtaat

SEQ ID NO: 220636 - DNA, 25 bp, Mus musculus
agttccagctcatctacgttgtaat

SEQ ID NO: 220637 - DNA, 25 bp, Mus musculus
agttccagcttacccgtcgggctat

SEQ ID NO: 220638 - DNA, 25 bp, Mus musculus
agttccagcttagccgtcgggctat

SEQ ID NO: 220639 - DNA, 25 bp, Mus musculus
agttccagcttcagtgagagactgt

SEQ ID NO: 220640 - DNA, 25 bp, Mus musculus
agttccagcttctgtgagagactgt

SEQ ID NO: 220641 - DNA, 25 bp, Mus musculus
agttccaggaacagagcccacatct

SEQ ID NO: 220642 - DNA, 25 bp, Mus musculus
agttccaggaactgagcccacatct

SEQ ID NO: 220643 - DNA, 25 bp, Mus musculus
agttccaggacgatcttcttggcca

SEQ ID NO: 220644 - DNA, 25 bp, Mus musculus
agttccaggacgttcttcttggcca

SEQ ID NO: 220645 - DNA, 25 bp, Mus musculus
agttccaggagcctcctcatgtttg

SEQ ID NO: 220646 - DNA, 25 bp, Mus musculus
agttccaggagcgtcctcatgtttg

SEQ ID NO: 220647 - DNA, 25 bp, Mus musculus
agttccaggccaatgcaaatacttg

SEQ ID NO: 220648 - DNA, 25 bp, Mus musculus
agttccaggccattgcaaatacttg

SEQ ID NO: 220649 - DNA, 25 bp, Mus musculus
agttccaggctaagctatggtaccg

SEQ ID NO: 220650 - DNA, 25 bp, Mus musculus
agttccaggctatgctatggtaccg

SEQ ID NO: 220651 - DNA, 25 bp, Mus musculus
agttccaggctgctctaatgccttt

SEQ ID NO: 220652 - DNA, 25 bp, Mus musculus
agttccaggctggtctaatgccttt

SEQ ID NO: 220653 - DNA, 25 bp, Mus musculus
agttccagggcccttctatatgttc

SEQ ID NO: 220654 - DNA, 25 bp, Mus musculus
agttccagggccgttctatatgttc

SEQ ID NO: 220655 - DNA, 25 bp, Mus musculus
agttccagggtaccctgattttaca

SEQ ID NO: 220656 - DNA, 25 bp, Mus musculus
agttccagggtagcctgattttaca

SEQ ID NO: 220657 - DNA, 25 bp, Mus musculus
agttccagtcacaattaccttgctc

SEQ ID NO: 220658 - DNA, 25 bp, Mus musculus
agttccagtcactattaccttgctc

SEQ ID NO: 220659 - DNA, 25 bp, Mus musculus
agttccagtcccatgggatctgaca

SEQ ID NO: 220660 - DNA, 25 bp, Mus musculus
agttccagtcccttgggatctgaca

SEQ ID NO: 220661 - DNA, 25 bp, Mus musculus
agttccagttctcagcaaccaccgt

SEQ ID NO: 220662 - DNA, 25 bp, Mus musculus
agttccagttctgagcaaccaccgt

SEQ ID NO: 220663 - DNA, 25 bp, Mus musculus
agttccataccacccagaattacat

SEQ ID NO: 220664 - DNA, 25 bp, Mus musculus
agttccataccagccagaattacat

SEQ ID NO: 220665 - DNA, 25 bp, Mus musculus
agttccatatcaacgttctctgact

SEQ ID NO: 220666 - DNA, 25 bp, Mus musculus
agttccatatcatcgttctctgact

SEQ ID NO: 220667 - DNA, 25 bp, Mus musculus
agttccatccgacggcctggagctg

SEQ ID NO: 220668 - DNA, 25 bp, Mus musculus
agttccatccgagggcctggagctg

SEQ ID NO: 220669 - DNA, 25 bp, Mus musculus
agttccatctacatatcccatttag

SEQ ID NO: 220670 - DNA, 25 bp, Mus musculus
agttccatctacttatcccatttag

SEQ ID NO: 220671 - DNA, 25 bp, Mus musculus
agttccatctcaattttaactcagc

SEQ ID NO: 220672 - DNA, 25 bp, Mus musculus
agttccatctcatttttaactcagc

SEQ ID NO: 220673 - DNA, 25 bp, Mus musculus
agttccatctccagatatccaggct

SEQ ID NO: 220674 - DNA, 25 bp, Mus musculus
agttccatctcctgatatccaggct

SEQ ID NO: 220675 - DNA, 25 bp, Mus musculus
agttccatgaaacctcattgttcag

SEQ ID NO: 220676 - DNA, 25 bp, Mus musculus
agttccatgaaagctcattgttcag

SEQ ID NO: 220677 - DNA, 25 bp, Mus musculus
agttccatgaacagagctcccaagg

SEQ ID NO: 220678 - DNA, 25 bp, Mus musculus
agttccatgaactgagctcccaagg

SEQ ID NO: 220679 - DNA, 25 bp, Mus musculus
agttccatgcagagcttcattttgc

SEQ ID NO: 220680 - DNA, 25 bp, Mus musculus
agttccatgcagtgcttcattttgc

SEQ ID NO: 220681 - DNA, 25 bp, Mus musculus
agttccatggcaactgacacctctt

SEQ ID NO: 220682 - DNA, 25 bp, Mus musculus
agttccatggcactggccatagcca

SEQ ID NO: 220683 - DNA, 25 bp, Mus musculus
agttccatggcagtggccatagcca

SEQ ID NO: 220684 - DNA, 25 bp, Mus musculus
agttccatggcatctgacacctctt

SEQ ID NO: 220685 - DNA, 25 bp, Mus musculus
agttccatgtgaccggctgaagtaa

SEQ ID NO: 220686 - DNA, 25 bp, Mus musculus
agttccatgtgagcggctgaagtaa

SEQ ID NO: 220687 - DNA, 25 bp, Mus musculus
agttccattccacgcatccagtagg

SEQ ID NO: 220688 - DNA, 25 bp, Mus musculus
agttccattccaggcatccagtagg

SEQ ID NO: 220689 - DNA, 25 bp, Mus musculus
agttccattccgacctggcccatta

SEQ ID NO: 220690 - DNA, 25 bp, Mus musculus
agttccattccgtcctggcccatta

SEQ ID NO: 220691 - DNA, 25 bp, Mus musculus
agttccattgctcataagtcctggt

SEQ ID NO: 220692 - DNA, 25 bp, Mus musculus
agttccattgctgataagtcctggt

SEQ ID NO: 220693 - DNA, 25 bp, Mus musculus
agttccatttataccactactagtt

SEQ ID NO: 220694 - DNA, 25 bp, Mus musculus
agttccatttattccactactagtt

SEQ ID NO: 220695 - DNA, 25 bp, Mus musculus
agttccatttgtcgtttgggctcta

SEQ ID NO: 220696 - DNA, 25 bp, Mus musculus
agttccatttgtggtttgggctcta

SEQ ID NO: 220697 - DNA, 25 bp, Mus musculus
agttcccaaagcatggtggcaggtc

SEQ ID NO: 220698 - DNA, 25 bp, Mus musculus
agttcccaaagcttggtggcaggtc

SEQ ID NO: 220699 - DNA, 25 bp, Mus musculus
agttcccaccacagacagggcagct

SEQ ID NO: 220700 - DNA, 25 bp, Mus musculus
agttcccaccactgacagggcagct

SEQ ID NO: 220701 - DNA, 25 bp, Mus musculus
agttcccagaacacctcaaacagaa

SEQ ID NO: 220702 - DNA, 25 bp, Mus musculus
agttcccagaactcctcaaacagaa

SEQ ID NO: 220703 - DNA, 25 bp, Mus musculus
agttcccagattatctcattgggcc

SEQ ID NO: 220704 - DNA, 25 bp, Mus musculus
agttcccagattttctcattgggcc

SEQ ID NO: 220705 - DNA, 25 bp, Mus musculus
agttcccagcctcagtaatgttcca

SEQ ID NO: 220706 - DNA, 25 bp, Mus musculus
agttcccagcctgagtaatgttcca

SEQ ID NO: 220707 - DNA, 25 bp, Mus musculus
agttcccagctacctatcagtgcag

SEQ ID NO: 220708 - DNA, 25 bp, Mus musculus
agttcccagctagctatcagtgcag

SEQ ID NO: 220709 - DNA, 25 bp, Mus musculus
agttcccaggtgaccaatggcaaca

SEQ ID NO: 220710 - DNA, 25 bp, Mus musculus
agttcccaggtgtccaatggcaaca

SEQ ID NO: 220711 - DNA, 25 bp, Mus musculus
agttcccagtacaaccagggttgcg

SEQ ID NO: 220712 - DNA, 25 bp, Mus musculus
agttcccagtacagtctgcacagag

SEQ ID NO: 220713 - DNA, 25 bp, Mus musculus
agttcccagtactaccagggttgcg

SEQ ID NO: 220714 - DNA, 25 bp, Mus musculus
agttcccagtactgtctgcacagag

SEQ ID NO: 220715 - DNA, 25 bp, Mus musculus
agttcccataggagcagaaggcccc

SEQ ID NO: 220716 - DNA, 25 bp, Mus musculus
agttcccataggtgcagaaggcccc

SEQ ID NO: 220717 - DNA, 25 bp, Mus musculus
agttcccatgctagaatccaggtta

SEQ ID NO: 220718 - DNA, 25 bp, Mus musculus
agttcccatgcttgaatccaggtta

SEQ ID NO: 220719 - DNA, 25 bp, Mus musculus
agttcccatggacagcagactagga

SEQ ID NO: 220720 - DNA, 25 bp, Mus musculus
agttcccatggagagcagactagga

SEQ ID NO: 220721 - DNA, 25 bp, Mus musculus
agttcccatgttcttgctggttgtt

SEQ ID NO: 220722 - DNA, 25 bp, Mus musculus
agttcccatgttgttgctggttgtt

SEQ ID NO: 220723 - DNA, 25 bp, Mus musculus
agttcccatttgctccaggtattta

SEQ ID NO: 220724 - DNA, 25 bp, Mus musculus
agttcccatttggtccaggtattta

SEQ ID NO: 220725 - DNA, 25 bp, Mus musculus
agttccccagagacatgaaggctat

SEQ ID NO: 220726 - DNA, 25 bp, Mus musculus
agttccccagagatccactgtggag

SEQ ID NO: 220727 - DNA, 25 bp, Mus musculus
agttccccagagatgctgtatcagt

SEQ ID NO: 220728 - DNA, 25 bp, Mus musculus
agttccccagagtcatgaaggctat

SEQ ID NO: 220729 - DNA, 25 bp, Mus musculus
agttccccagagttccactgtggag

SEQ ID NO: 220730 - DNA, 25 bp, Mus musculus
agttccccagagttgctgtatcagt

SEQ ID NO: 220731 - DNA, 25 bp, Mus musculus
agttccccaggtccagtgaagtagc

SEQ ID NO: 220732 - DNA, 25 bp, Mus musculus
agttccccaggtgcagtgaagtagc

SEQ ID NO: 220733 - DNA, 25 bp, Mus musculus
agttccccgtaactttgcacacaag

SEQ ID NO: 220734 - DNA, 25 bp, Mus musculus
agttccccgtaagtttgcacacaag

SEQ ID NO: 220735 - DNA, 25 bp, Mus musculus
agttcccctaccaggaccatatcat

SEQ ID NO: 220736 - DNA, 25 bp, Mus musculus
agttcccctacctggaccatatcat

SEQ ID NO: 220737 - DNA, 25 bp, Mus musculus
agttcccctgagatggtttgtcact

SEQ ID NO: 220738 - DNA, 25 bp, Mus musculus
agttcccctgagttggtttgtcact

SEQ ID NO: 220739 - DNA, 25 bp, Mus musculus
agttcccctggacatctagctggga

SEQ ID NO: 220740 - DNA, 25 bp, Mus musculus
agttcccctggagatctagctggga

SEQ ID NO: 220741 - DNA, 25 bp, Mus musculus
agttcccctgtcaatggcaatgggc

SEQ ID NO: 220742 - DNA, 25 bp, Mus musculus
agttcccctgtctatggcaatgggc

SEQ ID NO: 220743 - DNA, 25 bp, Mus musculus
agttcccgctttatagtagctcaca

SEQ ID NO: 220744 - DNA, 25 bp, Mus musculus
agttcccgctttttagtagctcaca

SEQ ID NO: 220745 - DNA, 25 bp, Mus musculus
agttcccgggacagatgctgcagct

SEQ ID NO: 220746 - DNA, 25 bp, Mus musculus
agttcccgggactgatgctgcagct

SEQ ID NO: 220747 - DNA, 25 bp, Mus musculus
agttcccgtgctatacagtatcttc

SEQ ID NO: 220748 - DNA, 25 bp, Mus musculus
agttcccgtgctttacagtatcttc

SEQ ID NO: 220749 - DNA, 25 bp, Mus musculus
agttccctaccaccttagtaatgag

SEQ ID NO: 220750 - DNA, 25 bp, Mus musculus
agttccctaccagcttagtaatgag

SEQ ID NO: 220751 - DNA, 25 bp, Mus musculus
agttccctagtccagctaaacatgc

SEQ ID NO: 220752 - DNA, 25 bp, Mus musculus
agttccctagtcgagctaaacatgc

SEQ ID NO: 220753 - DNA, 25 bp, Mus musculus
agttccctatataaaatgtctcatt

SEQ ID NO: 220754 - DNA, 25 bp, Mus musculus
agttccctatattaaatgtctcatt

SEQ ID NO: 220755 - DNA, 25 bp, Mus musculus
agttccctattgatctggtgggctt

SEQ ID NO: 220756 - DNA, 25 bp, Mus musculus
agttccctattgttctggtgggctt

SEQ ID NO: 220757 - DNA, 25 bp, Mus musculus
agttccctcacgcttggcgagttct

SEQ ID NO: 220758 - DNA, 25 bp, Mus musculus
agttccctcacggttggcgagttct

SEQ ID NO: 220759 - DNA, 25 bp, Mus musculus
agttccctcatgaaggcccagaata

SEQ ID NO: 220760 - DNA, 25 bp, Mus musculus
agttccctcatgtaggcccagaata

SEQ ID NO: 220761 - DNA, 25 bp, Mus musculus
agttccctcctcagacatggttatt

SEQ ID NO: 220762 - DNA, 25 bp, Mus musculus
agttccctcctcagtttaatcagtg

SEQ ID NO: 220763 - DNA, 25 bp, Mus musculus
agttccctcctctgacatggttatt

SEQ ID NO: 220764 - DNA, 25 bp, Mus musculus
agttccctcctctgtttaatcagtg

SEQ ID NO: 220765 - DNA, 25 bp, Mus musculus
agttccctcctgaaagccaactagg

SEQ ID NO: 220766 - DNA, 25 bp, Mus musculus
agttccctcctgtaagccaactagg

SEQ ID NO: 220767 - DNA, 25 bp, Mus musculus
agttccctcgtgctgctaggcagct

SEQ ID NO: 220768 - DNA, 25 bp, Mus musculus
agttccctcgtggtgctaggcagct

SEQ ID NO: 220769 - DNA, 25 bp, Mus musculus
agttccctctagaagagacagcccc

SEQ ID NO: 220770 - DNA, 25 bp, Mus musculus
agttccctctagtagagacagcccc

SEQ ID NO: 220771 - DNA, 25 bp, Mus musculus
agttccctgatcactctgacacttg

SEQ ID NO: 220772 - DNA, 25 bp, Mus musculus
agttccctgatctctctgacacttg

SEQ ID NO: 220773 - DNA, 25 bp, Mus musculus
agttccctgccaatgtccataggag

SEQ ID NO: 220774 - DNA, 25 bp, Mus musculus
agttccctgccattgtccataggag

SEQ ID NO: 220775 - DNA, 25 bp, Mus musculus
agttccctgctcactaaatgactat

SEQ ID NO: 220776 - DNA, 25 bp, Mus musculus
agttccctgctctctaaatgactat

SEQ ID NO: 220777 - DNA, 25 bp, Mus musculus
agttccctggaacaggattcccaga

SEQ ID NO: 220778 - DNA, 25 bp, Mus musculus
agttccctggaagaggattcccaga

SEQ ID NO: 220779 - DNA, 25 bp, Mus musculus
agttccctggctacaaggaggtgcg

SEQ ID NO: 220780 - DNA, 25 bp, Mus musculus
agttccctggcttcaaggaggtgcg

SEQ ID NO: 220781 - DNA, 25 bp, Mus musculus
agttccctggttctgtgccatgctg

SEQ ID NO: 220782 - DNA, 25 bp, Mus musculus
agttccctggttgtgtgccatgctg

SEQ ID NO: 220783 - DNA, 25 bp, Mus musculus
agttcccttactagactggcttttg

SEQ ID NO: 220784 - DNA, 25 bp, Mus musculus
agttcccttacttgactggcttttg

SEQ ID NO: 220785 - DNA, 25 bp, Mus musculus
agttcccttagaccacccagaaagg

SEQ ID NO: 220786 - DNA, 25 bp, Mus musculus
agttcccttagagcacccagaaagg

SEQ ID NO: 220787 - DNA, 25 bp, Mus musculus
agttcccttgaaccagatttcctgc

SEQ ID NO: 220788 - DNA, 25 bp, Mus musculus
agttcccttgaagcagatttcctgc

SEQ ID NO: 220789 - DNA, 25 bp, Mus musculus
agttcccttggtaccttcagtctct

SEQ ID NO: 220790 - DNA, 25 bp, Mus musculus
agttcccttggttccttcagtctct

SEQ ID NO: 220791 - DNA, 25 bp, Mus musculus
agttccgagccacatctgagatcta

SEQ ID NO: 220792 - DNA, 25 bp, Mus musculus
agttccgagccagatctgagatcta

SEQ ID NO: 220793 - DNA, 25 bp, Mus musculus
agttccgagtagaaatgctgaccat

SEQ ID NO: 220794 - DNA, 25 bp, Mus musculus
agttccgagtagtaatgctgaccat

SEQ ID NO: 220795 - DNA, 25 bp, Mus musculus
agttccgatcccatgctaaatttgc

SEQ ID NO: 220796 - DNA, 25 bp, Mus musculus
agttccgatcccttgctaaatttgc

SEQ ID NO: 220797 - DNA, 25 bp, Mus musculus
agttccgcggccactgtgagcagaa

SEQ ID NO: 220798 - DNA, 25 bp, Mus musculus
agttccgcggcctctgtgagcagaa

SEQ ID NO: 220799 - DNA, 25 bp, Mus musculus
agttccgctcgcagtccatggtttc

SEQ ID NO: 220800 - DNA, 25 bp, Mus musculus
agttccgctcgctgtccatggtttc

SEQ ID NO: 220801 - DNA, 25 bp, Mus musculus
agttccgctgtccaattgtcttcag

SEQ ID NO: 220802 - DNA, 25 bp, Mus musculus
agttccgctgtcgaattgtcttcag

SEQ ID NO: 220803 - DNA, 25 bp, Mus musculus
agttccggaaacaggtgaccgccat

SEQ ID NO: 220804 - DNA, 25 bp, Mus musculus
agttccggaaactggtgaccgccat

SEQ ID NO: 220805 - DNA, 25 bp, Mus musculus
agttccggaactcagtgcacccaag

SEQ ID NO: 220806 - DNA, 25 bp, Mus musculus
agttccggaactctatgctcaccac

SEQ ID NO: 220807 - DNA, 25 bp, Mus musculus
agttccggaactgagtgcacccaag

SEQ ID NO: 220808 - DNA, 25 bp, Mus musculus
agttccggaactgtatgctcaccac

SEQ ID NO: 220809 - DNA, 25 bp, Mus musculus
agttccggcatgcacaatggactgg

SEQ ID NO: 220810 - DNA, 25 bp, Mus musculus
agttccggcatggacaatggactgg

SEQ ID NO: 220811 - DNA, 25 bp, Mus musculus
agttccggccagctgtatatgcagg

SEQ ID NO: 220812 - DNA, 25 bp, Mus musculus
agttccggccaggtgtatatgcagg

SEQ ID NO: 220813 - DNA, 25 bp, Mus musculus
agttccggctcccacagttgcctat

SEQ ID NO: 220814 - DNA, 25 bp, Mus musculus
agttccggctccgacagttgcctat

SEQ ID NO: 220815 - DNA, 25 bp, Mus musculus
agttccgggctcagcagttctcgct

SEQ ID NO: 220816 - DNA, 25 bp, Mus musculus
agttccgggctctgcagttctcgct

SEQ ID NO: 220817 - DNA, 25 bp, Mus musculus
agttccgggtgcactttgccaacat

SEQ ID NO: 220818 - DNA, 25 bp, Mus musculus
agttccgggtgctctttgccaacat

SEQ ID NO: 220819 - DNA, 25 bp, Mus musculus
agttccgtctataaggaggagaaga

SEQ ID NO: 220820 - DNA, 25 bp, Mus musculus
agttccgtctattaggaggagaaga

SEQ ID NO: 220821 - DNA, 25 bp, Mus musculus
agttccgtctctcattggttgtcaa

SEQ ID NO: 220822 - DNA, 25 bp, Mus musculus
agttccgtctctgattggttgtcaa

SEQ ID NO: 220823 - DNA, 25 bp, Mus musculus
agttccgtgacgctctggccaagct

SEQ ID NO: 220824 - DNA, 25 bp, Mus musculus
agttccgtgacggtctggccaagct

SEQ ID NO: 220825 - DNA, 25 bp, Mus musculus
agttccgtgaggacgacttccgtag

SEQ ID NO: 220826 - DNA, 25 bp, Mus musculus
agttccgtgaggtcgacttccgtag

SEQ ID NO: 220827 - DNA, 25 bp, Mus musculus
agttccgtgctccttgtagacttaa

SEQ ID NO: 220828 - DNA, 25 bp, Mus musculus
agttccgtgctcgttgtagacttaa

SEQ ID NO: 220829 - DNA, 25 bp, Mus musculus
agttccgtggccaggatcgttgtga

SEQ ID NO: 220830 - DNA, 25 bp, Mus musculus
agttccgtggcctggatcgttgtga

SEQ ID NO: 220831 - DNA, 25 bp, Mus musculus
agttccgtgtcaataacctcatccc

SEQ ID NO: 220832 - DNA, 25 bp, Mus musculus
agttccgtgtcattaacctcatccc

SEQ ID NO: 220833 - DNA, 25 bp, Mus musculus
agttccgttgtgctttctgaggtcc

SEQ ID NO: 220834 - DNA, 25 bp, Mus musculus
agttccgttgtggtttctgaggtcc

SEQ ID NO: 220835 - DNA, 25 bp, Mus musculus
agttcctaaaatagctcctgatgtt

SEQ ID NO: 220836 - DNA, 25 bp, Mus musculus
agttcctaaaattgctcctgatgtt

SEQ ID NO: 220837 - DNA, 25 bp, Mus musculus
agttcctaaattcgcacataaacac

SEQ ID NO: 220838 - DNA, 25 bp, Mus musculus
agttcctaaattggcacataaacac

SEQ ID NO: 220839 - DNA, 25 bp, Mus musculus
agttcctaataaacagctgcctcac

SEQ ID NO: 220840 - DNA, 25 bp, Mus musculus
agttcctaataatcagctgcctcac

SEQ ID NO: 220841 - DNA, 25 bp, Mus musculus
agttcctaatagaagcaatcattta

SEQ ID NO: 220842 - DNA, 25 bp, Mus musculus
agttcctaatagcttcctgtctgaa

SEQ ID NO: 220843 - DNA, 25 bp, Mus musculus
agttcctaataggttcctgtctgaa

SEQ ID NO: 220844 - DNA, 25 bp, Mus musculus
agttcctaatagtagcaatcattta

SEQ ID NO: 220845 - DNA, 25 bp, Mus musculus
agttcctacagtcgctatcacagaa

SEQ ID NO: 220846 - DNA, 25 bp, Mus musculus
agttcctacagtggctatcacagaa

SEQ ID NO: 220847 - DNA, 25 bp, Mus musculus
agttcctacattcattgatttccca

SEQ ID NO: 220848 - DNA, 25 bp, Mus musculus
agttcctacattgattgatttccca

SEQ ID NO: 220849 - DNA, 25 bp, Mus musculus
agttcctactgacttgtcactagcc

SEQ ID NO: 220850 - DNA, 25 bp, Mus musculus
agttcctactgagttgtcactagcc

SEQ ID NO: 220851 - DNA, 25 bp, Mus musculus
agttcctagcatacacagtgtgatg

SEQ ID NO: 220852 - DNA, 25 bp, Mus musculus
agttcctagcattcacagtgtgatg

SEQ ID NO: 220853 - DNA, 25 bp, Mus musculus
agttcctaggaccatcacaattatt

SEQ ID NO: 220854 - DNA, 25 bp, Mus musculus
agttcctaggacgatcacaattatt

SEQ ID NO: 220855 - DNA, 25 bp, Mus musculus
agttcctataacatcttctttctaa

SEQ ID NO: 220856 - DNA, 25 bp, Mus musculus
agttcctataacttcttctttctaa

SEQ ID NO: 220857 - DNA, 25 bp, Mus musculus
agttcctatggactattgtgagagc

SEQ ID NO: 220858 - DNA, 25 bp, Mus musculus
agttcctatggagtattgtgagagc

SEQ ID NO: 220859 - DNA, 25 bp, Mus musculus
agttcctattccaggtgcatgtgga

SEQ ID NO: 220860 - DNA, 25 bp, Mus musculus
agttcctattcctggtgcatgtgga

SEQ ID NO: 220861 - DNA, 25 bp, Mus musculus
agttcctcaaaacttccctgtatga

SEQ ID NO: 220862 - DNA, 25 bp, Mus musculus
agttcctcaaaagttccctgtatga

SEQ ID NO: 220863 - DNA, 25 bp, Mus musculus
agttcctcaagccttctgattcatt

SEQ ID NO: 220864 - DNA, 25 bp, Mus musculus
agttcctcaagcgttctgattcatt

SEQ ID NO: 220865 - DNA, 25 bp, Mus musculus
agttcctcacctagaagttgcataa

SEQ ID NO: 220866 - DNA, 25 bp, Mus musculus
agttcctcaccttgaagttgcataa

SEQ ID NO: 220867 - DNA, 25 bp, Mus musculus
agttcctcacttcgcaggtatctga

SEQ ID NO: 220868 - DNA, 25 bp, Mus musculus
agttcctcacttggcaggtatctga

SEQ ID NO: 220869 - DNA, 25 bp, Mus musculus
agttcctcatgcaggtttcaattgt

SEQ ID NO: 220870 - DNA, 25 bp, Mus musculus
agttcctcatgctggtttcaattgt

SEQ ID NO: 220871 - DNA, 25 bp, Mus musculus
agttcctccaggaggaaggttacag

SEQ ID NO: 220872 - DNA, 25 bp, Mus musculus
agttcctccaggtggaaggttacag

SEQ ID NO: 220873 - DNA, 25 bp, Mus musculus
agttcctcccgaaggcgctcaaggt

SEQ ID NO: 220874 - DNA, 25 bp, Mus musculus
agttcctcccgatggcgctcaaggt

SEQ ID NO: 220875 - DNA, 25 bp, Mus musculus
agttcctccctgcatttatactgga

SEQ ID NO: 220876 - DNA, 25 bp, Mus musculus
agttcctccctggatttatactgga

SEQ ID NO: 220877 - DNA, 25 bp, Mus musculus
agttcctccgggagaatcagatcca

SEQ ID NO: 220878 - DNA, 25 bp, Mus musculus
agttcctccgggtgaatcagatcca

SEQ ID NO: 220879 - DNA, 25 bp, Mus musculus
agttcctcctcacataatgctgatt

SEQ ID NO: 220880 - DNA, 25 bp, Mus musculus
agttcctcctcagataatgctgatt

SEQ ID NO: 220881 - DNA, 25 bp, Mus musculus
agttcctcctccaggcaatattttt

SEQ ID NO: 220882 - DNA, 25 bp, Mus musculus
agttcctcctcctggcaatattttt

SEQ ID NO: 220883 - DNA, 25 bp, Mus musculus
agttcctcctggactaccatgactg

SEQ ID NO: 220884 - DNA, 25 bp, Mus musculus
agttcctcctggtctaccatgactg

SEQ ID NO: 220885 - DNA, 25 bp, Mus musculus
agttcctcgctcagggatgcaggca

SEQ ID NO: 220886 - DNA, 25 bp, Mus musculus
agttcctcgctctgggatgcaggca

SEQ ID NO: 220887 - DNA, 25 bp, Mus musculus
agttcctcgggcatttctcctgtga

SEQ ID NO: 220888 - DNA, 25 bp, Mus musculus
agttcctcgggcttttctcctgtga

SEQ ID NO: 220889 - DNA, 25 bp, Mus musculus
agttcctcgtgtagtggtggctccc

SEQ ID NO: 220890 - DNA, 25 bp, Mus musculus
agttcctcgtgttgtggtggctccc

SEQ ID NO: 220891 - DNA, 25 bp, Mus musculus
agttcctctaatcctcaagactttt

SEQ ID NO: 220892 - DNA, 25 bp, Mus musculus
agttcctctaatgctcaagactttt

SEQ ID NO: 220893 - DNA, 25 bp, Mus musculus
agttcctctaggacccgtagccgat

SEQ ID NO: 220894 - DNA, 25 bp, Mus musculus
agttcctctaggtcccgtagccgat

SEQ ID NO: 220895 - DNA, 25 bp, Mus musculus
agttcctctgaaccagccactctgt

SEQ ID NO: 220896 - DNA, 25 bp, Mus musculus
agttcctctgaagcagccactctgt

SEQ ID NO: 220897 - DNA, 25 bp, Mus musculus
agttcctctgcaatgacaaccaggt

SEQ ID NO: 220898 - DNA, 25 bp, Mus musculus
agttcctctgcattgacaaccaggt

SEQ ID NO: 220899 - DNA, 25 bp, Mus musculus
agttcctctggcatctacactgtag

SEQ ID NO: 220900 - DNA, 25 bp, Mus musculus
agttcctctggcttctacactgtag

SEQ ID NO: 220901 - DNA, 25 bp, Mus musculus
agttcctctgtaccctgttcggtgt

SEQ ID NO: 220902 - DNA, 25 bp, Mus musculus
agttcctctgtagcctgttcggtgt

SEQ ID NO: 220903 - DNA, 25 bp, Mus musculus
agttcctgaaacaggtccacattca

SEQ ID NO: 220904 - DNA, 25 bp, Mus musculus
agttcctgaaactggtccacattca

SEQ ID NO: 220905 - DNA, 25 bp, Mus musculus
agttcctgaagtagaagccctgctg

SEQ ID NO: 220906 - DNA, 25 bp, Mus musculus
agttcctgaagttgaagccctgctg

SEQ ID NO: 220907 - DNA, 25 bp, Mus musculus
agttcctgactcagcagttgctagt

SEQ ID NO: 220908 - DNA, 25 bp, Mus musculus
agttcctgactctgcagttgctagt

SEQ ID NO: 220909 - DNA, 25 bp, Mus musculus
agttcctgaggaacttcgtactaga

SEQ ID NO: 220910 - DNA, 25 bp, Mus musculus
agttcctgaggatcttcgtactaga

SEQ ID NO: 220911 - DNA, 25 bp, Mus musculus
agttcctgccacaatatgcatcctt

SEQ ID NO: 220912 - DNA, 25 bp, Mus musculus
agttcctgccactatatgcatcctt

SEQ ID NO: 220913 - DNA, 25 bp, Mus musculus
agttcctgcccaaaatgcactgcaa

SEQ ID NO: 220914 - DNA, 25 bp, Mus musculus
agttcctgcccataatgcactgcaa

SEQ ID NO: 220915 - DNA, 25 bp, Mus musculus
agttcctgccgacatgtcctgccag

SEQ ID NO: 220916 - DNA, 25 bp, Mus musculus
agttcctgccgagatgtcctgccag

SEQ ID NO: 220917 - DNA, 25 bp, Mus musculus
agttcctgcggacatcccttggagg

SEQ ID NO: 220918 - DNA, 25 bp, Mus musculus
agttcctgcggagatcccttggagg

SEQ ID NO: 220919 - DNA, 25 bp, Mus musculus
agttcctgcgttcagtgcctgtctg

SEQ ID NO: 220920 - DNA, 25 bp, Mus musculus
agttcctgcgttgagtgcctgtctg

SEQ ID NO: 220921 - DNA, 25 bp, Mus musculus
agttcctgctctatcataattgacg

SEQ ID NO: 220922 - DNA, 25 bp, Mus musculus
agttcctgctctttcataattgacg

SEQ ID NO: 220923 - DNA, 25 bp, Mus musculus
agttcctgctgcctgttgtgagcgt

SEQ ID NO: 220924 - DNA, 25 bp, Mus musculus
agttcctgctgcgtgttgtgagcgt

SEQ ID NO: 220925 - DNA, 25 bp, Mus musculus
agttcctgctggaccataggcatga

SEQ ID NO: 220926 - DNA, 25 bp, Mus musculus
agttcctgctggtccataggcatga

SEQ ID NO: 220927 - DNA, 25 bp, Mus musculus
agttcctgctgtccagttatcaaca

SEQ ID NO: 220928 - DNA, 25 bp, Mus musculus
agttcctgctgtctaatggttcctc

SEQ ID NO: 220929 - DNA, 25 bp, Mus musculus
agttcctgctgtgcagttatcaaca

SEQ ID NO: 220930 - DNA, 25 bp, Mus musculus
agttcctgctgtgtaatggttcctc

SEQ ID NO: 220931 - DNA, 25 bp, Mus musculus
agttcctgcttcatgaaaacgaaat

SEQ ID NO: 220932 - DNA, 25 bp, Mus musculus
agttcctgcttcttgaaaacgaaat

SEQ ID NO: 220933 - DNA, 25 bp, Mus musculus
agttcctggccaccttaacataaag

SEQ ID NO: 220934 - DNA, 25 bp, Mus musculus
agttcctggccagcttaacataaag

SEQ ID NO: 220935 - DNA, 25 bp, Mus musculus
agttcctgggtaaatgttagctgta

SEQ ID NO: 220936 - DNA, 25 bp, Mus musculus
agttcctgggtatatgttagctgta

SEQ ID NO: 220937 - DNA, 25 bp, Mus musculus
agttcctggtgcagcagttgaacac

SEQ ID NO: 220938 - DNA, 25 bp, Mus musculus
agttcctggtgctgcagttgaacac

SEQ ID NO: 220939 - DNA, 25 bp, Mus musculus
agttcctggtttacacatcagcact

SEQ ID NO: 220940 - DNA, 25 bp, Mus musculus
agttcctggttttcacatcagcact

SEQ ID NO: 220941 - DNA, 25 bp, Mus musculus
agttcctgtacaaccagaagccaca

SEQ ID NO: 220942 - DNA, 25 bp, Mus musculus
agttcctgtacatccagaagccaca

SEQ ID NO: 220943 - DNA, 25 bp, Mus musculus
agttcctgtcaccttgggagcagtg

SEQ ID NO: 220944 - DNA, 25 bp, Mus musculus
agttcctgtcacgttgggagcagtg

SEQ ID NO: 220945 - DNA, 25 bp, Mus musculus
agttcctgtctaactaaatgcagtt

SEQ ID NO: 220946 - DNA, 25 bp, Mus musculus
agttcctgtctatctaaatgcagtt

SEQ ID NO: 220947 - DNA, 25 bp, Mus musculus
agttcctgtctcagaacaacaagag

SEQ ID NO: 220948 - DNA, 25 bp, Mus musculus
agttcctgtctctgaacaacaagag

SEQ ID NO: 220949 - DNA, 25 bp, Mus musculus
agttcctgtgacacctaccccttca

SEQ ID NO: 220950 - DNA, 25 bp, Mus musculus
agttcctgtgactcctaccccttca

SEQ ID NO: 220951 - DNA, 25 bp, Mus musculus
agttcctgtgctacagtcttacgta

SEQ ID NO: 220952 - DNA, 25 bp, Mus musculus
agttcctgtgctaggtccttcttta

SEQ ID NO: 220953 - DNA, 25 bp, Mus musculus
agttcctgtgcttcagtcttacgta

SEQ ID NO: 220954 - DNA, 25 bp, Mus musculus
agttcctgtgcttggtccttcttta

SEQ ID NO: 220955 - DNA, 25 bp, Mus musculus
agttcctgttccatagcgggtcagt

SEQ ID NO: 220956 - DNA, 25 bp, Mus musculus
agttcctgttccttagcgggtcagt

SEQ ID NO: 220957 - DNA, 25 bp, Mus musculus
agttcctgttctatttgctgcatac

SEQ ID NO: 220958 - DNA, 25 bp, Mus musculus
agttcctgttctcacagctctcagc

SEQ ID NO: 220959 - DNA, 25 bp, Mus musculus
agttcctgttctgacagctctcagc

SEQ ID NO: 220960 - DNA, 25 bp, Mus musculus
agttcctgttctttttgctgcatac

SEQ ID NO: 220961 - DNA, 25 bp, Mus musculus
agttcctgttgtatagtctgttgta

SEQ ID NO: 220962 - DNA, 25 bp, Mus musculus
agttcctgttgtttagtctgttgta

SEQ ID NO: 220963 - DNA, 25 bp, Mus musculus
agttccttaagtatccagctatgtg

SEQ ID NO: 220964 - DNA, 25 bp, Mus musculus
agttccttaagtttccagctatgtg

SEQ ID NO: 220965 - DNA, 25 bp, Mus musculus
agttccttatatagttgtgacccac

SEQ ID NO: 220966 - DNA, 25 bp, Mus musculus
agttccttatattgttgtgacccac

SEQ ID NO: 220967 - DNA, 25 bp, Mus musculus
agttccttatgcatatgggcttcga

SEQ ID NO: 220968 - DNA, 25 bp, Mus musculus
agttccttatgcttatgggcttcga

SEQ ID NO: 220969 - DNA, 25 bp, Mus musculus
agttccttattgagacatccttccc

SEQ ID NO: 220970 - DNA, 25 bp, Mus musculus
agttccttattgtgacatccttccc

SEQ ID NO: 220971 - DNA, 25 bp, Mus musculus
agttccttatttaattgcagaacat

SEQ ID NO: 220972 - DNA, 25 bp, Mus musculus
agttccttattttattgcagaacat

SEQ ID NO: 220973 - DNA, 25 bp, Mus musculus
agttccttcagcactaggaccacag

SEQ ID NO: 220974 - DNA, 25 bp, Mus musculus
agttccttcagctctaggaccacag

SEQ ID NO: 220975 - DNA, 25 bp, Mus musculus
agttccttcctcagtaggttgtgac

SEQ ID NO: 220976 - DNA, 25 bp, Mus musculus
agttccttcctctgtaggttgtgac

SEQ ID NO: 220977 - DNA, 25 bp, Mus musculus
agttccttccttactacataatgac

SEQ ID NO: 220978 - DNA, 25 bp, Mus musculus
agttccttcctttctacataatgac

SEQ ID NO: 220979 - DNA, 25 bp, Mus musculus
agttccttctctaagctccgggaat

SEQ ID NO: 220980 - DNA, 25 bp, Mus musculus
agttccttctctactcccaggaaat

SEQ ID NO: 220981 - DNA, 25 bp, Mus musculus
agttccttctcttagctccgggaat

SEQ ID NO: 220982 - DNA, 25 bp, Mus musculus
agttccttctcttctcccaggaaat

SEQ ID NO: 220983 - DNA, 25 bp, Mus musculus
agttccttctgaaatggctcctcca

SEQ ID NO: 220984 - DNA, 25 bp, Mus musculus
agttccttctgatatggctcctcca

SEQ ID NO: 220985 - DNA, 25 bp, Mus musculus
agttccttgaataaacactacgcat

SEQ ID NO: 220986 - DNA, 25 bp, Mus musculus
agttccttgaattaacactacgcat

SEQ ID NO: 220987 - DNA, 25 bp, Mus musculus
agttccttgaccatgctttatgcaa

SEQ ID NO: 220988 - DNA, 25 bp, Mus musculus
agttccttgaccttgctttatgcaa

SEQ ID NO: 220989 - DNA, 25 bp, Mus musculus
agttccttgagactggtgccatccc

SEQ ID NO: 220990 - DNA, 25 bp, Mus musculus
agttccttgagagtggtgccatccc

SEQ ID NO: 220991 - DNA, 25 bp, Mus musculus
agttccttgcttctgatattattga

SEQ ID NO: 220992 - DNA, 25 bp, Mus musculus
agttccttgcttgtgatattattga

SEQ ID NO: 220993 - DNA, 25 bp, Mus musculus
agttccttggaaccgtcagcatctg

SEQ ID NO: 220994 - DNA, 25 bp, Mus musculus
agttccttggaagcgtcagcatctg

SEQ ID NO: 220995 - DNA, 25 bp, Mus musculus
agttccttggccatagtgtttgctc

SEQ ID NO: 220996 - DNA, 25 bp, Mus musculus
agttccttggccttagtgtttgctc

SEQ ID NO: 220997 - DNA, 25 bp, Mus musculus
agttccttgggccagaagtgccagc

SEQ ID NO: 220998 - DNA, 25 bp, Mus musculus
agttccttgggcgagaagtgccagc

SEQ ID NO: 220999 - DNA, 25 bp, Mus musculus
agttccttggtgagtgtcctataca

SEQ ID NO: 221000 - DNA, 25 bp, Mus musculus
agttccttggtgtgtgtcctataca

SEQ ID NO: 221001 - DNA, 25 bp, Mus musculus
agttccttgtaaatcttgagcgttg

SEQ ID NO: 221002 - DNA, 25 bp, Mus musculus
agttccttgtaattcttgagcgttg

SEQ ID NO: 221003 - DNA, 25 bp, Mus musculus
agttccttgttacctgtgcttgtat

SEQ ID NO: 221004 - DNA, 25 bp, Mus musculus
agttccttgttagctgtgcttgtat

SEQ ID NO: 221005 - DNA, 25 bp, Mus musculus
agttccttgtttcgtttgcattgtt

SEQ ID NO: 221006 - DNA, 25 bp, Mus musculus
agttccttgtttggtttgcattgtt

SEQ ID NO: 221007 - DNA, 25 bp, Mus musculus
agttcctttatgctcctgtaatcgg

SEQ ID NO: 221008 - DNA, 25 bp, Mus musculus
agttcctttatggtcctgtaatcgg

SEQ ID NO: 221009 - DNA, 25 bp, Mus musculus
agttcctttctcacagatggtcttc

SEQ ID NO: 221010 - DNA, 25 bp, Mus musculus
agttcctttctctcagatggtcttc

SEQ ID NO: 221011 - DNA, 25 bp, Mus musculus
agttcctttctgatgggacaccata

SEQ ID NO: 221012 - DNA, 25 bp, Mus musculus
agttcctttctgttgggacaccata

SEQ ID NO: 221013 - DNA, 25 bp, Mus musculus
agttccttttacacagcttcatgac

SEQ ID NO: 221014 - DNA, 25 bp, Mus musculus
agttccttttactcagcttcatgac

SEQ ID NO: 221015 - DNA, 25 bp, Mus musculus
agttcctttttgagctgccttcgcg

SEQ ID NO: 221016 - DNA, 25 bp, Mus musculus
agttcctttttgtgctgccttcgcg

SEQ ID NO: 221017 - DNA, 25 bp, Mus musculus
agttcgaagaatactggccacggaa

SEQ ID NO: 221018 - DNA, 25 bp, Mus musculus
agttcgaagaattctggccacggaa

SEQ ID NO: 221019 - DNA, 25 bp, Mus musculus
agttcgaagatccagctcagtggcc

SEQ ID NO: 221020 - DNA, 25 bp, Mus musculus
agttcgaagatcgagctcagtggcc

SEQ ID NO: 221021 - DNA, 25 bp, Mus musculus
agttcgaccccaataagctggcacc

SEQ ID NO: 221022 - DNA, 25 bp, Mus musculus
agttcgaccccattaagctggcacc

SEQ ID NO: 221023 - DNA, 25 bp, Mus musculus
agttcgagacttataagcatcctta

SEQ ID NO: 221024 - DNA, 25 bp, Mus musculus
agttcgagacttttaagcatcctta

SEQ ID NO: 221025 - DNA, 25 bp, Mus musculus
agttcgagaggaaccttcgggctca

SEQ ID NO: 221026 - DNA, 25 bp, Mus musculus
agttcgagaggatccttcgggctca

SEQ ID NO: 221027 - DNA, 25 bp, Mus musculus
agttcgagggaaagccactgctcca

SEQ ID NO: 221028 - DNA, 25 bp, Mus musculus
agttcgagggaatgccactgctcca

SEQ ID NO: 221029 - DNA, 25 bp, Mus musculus
agttcgagggacaccaacaggcaca

SEQ ID NO: 221030 - DNA, 25 bp, Mus musculus
agttcgagggactccaacaggcaca

SEQ ID NO: 221031 - DNA, 25 bp, Mus musculus
agttcgcacacacggtgaatgccac

SEQ ID NO: 221032 - DNA, 25 bp, Mus musculus
agttcgcacacagggtgaatgccac

SEQ ID NO: 221033 - DNA, 25 bp, Mus musculus
agttcgcacagaagctctgcaggtg

SEQ ID NO: 221034 - DNA, 25 bp, Mus musculus
agttcgcacagatgctctgcaggtg

SEQ ID NO: 221035 - DNA, 25 bp, Mus musculus
agttcgcatcttctggatcattctt

SEQ ID NO: 221036 - DNA, 25 bp, Mus musculus
agttcgcatcttgtggatcattctt

SEQ ID NO: 221037 - DNA, 25 bp, Mus musculus
agttcgcatgtaccagaatgtgtca

SEQ ID NO: 221038 - DNA, 25 bp, Mus musculus
agttcgcatgtagcagaatgtgtca

SEQ ID NO: 221039 - DNA, 25 bp, Mus musculus
agttcgcatgttccttttgttactc

SEQ ID NO: 221040 - DNA, 25 bp, Mus musculus
agttcgcatgttgcttttgttactc

SEQ ID NO: 221041 - DNA, 25 bp, Mus musculus
agttcgctaagcaatgatgggatat

SEQ ID NO: 221042 - DNA, 25 bp, Mus musculus
agttcgctaagctatgatgggatat

SEQ ID NO: 221043 - DNA, 25 bp, Mus musculus
agttcgctacgtcgtgatctcacac

SEQ ID NO: 221044 - DNA, 25 bp, Mus musculus
agttcgctacgtggtgatctcacac

SEQ ID NO: 221045 - DNA, 25 bp, Mus musculus
agttcgctgtacatggcctggctgg

SEQ ID NO: 221046 - DNA, 25 bp, Mus musculus
agttcgctgtacttggcctggctgg

SEQ ID NO: 221047 - DNA, 25 bp, Mus musculus
agttcggaaaacaggaacacaccat

SEQ ID NO: 221048 - DNA, 25 bp, Mus musculus
agttcggaaaactggaacacaccat

SEQ ID NO: 221049 - DNA, 25 bp, Mus musculus
agttcggacgacatggcgccatctc

SEQ ID NO: 221050 - DNA, 25 bp, Mus musculus
agttcggacgacttggcgccatctc

SEQ ID NO: 221051 - DNA, 25 bp, Mus musculus
agttcggagccaagttccctgtagt

SEQ ID NO: 221052 - DNA, 25 bp, Mus musculus
agttcggagccatgttccctgtagt

SEQ ID NO: 221053 - DNA, 25 bp, Mus musculus
agttcggatcacaggccggcatcag

SEQ ID NO: 221054 - DNA, 25 bp, Mus musculus
agttcggatcactggccggcatcag

SEQ ID NO: 221055 - DNA, 25 bp, Mus musculus
agttcggatctcctagtttctatgc

SEQ ID NO: 221056 - DNA, 25 bp, Mus musculus
agttcggatctcgtagtttctatgc

SEQ ID NO: 221057 - DNA, 25 bp, Mus musculus
agttcggattcacgttagcgaccca

SEQ ID NO: 221058 - DNA, 25 bp, Mus musculus
agttcggattcaggttagcgaccca

SEQ ID NO: 221059 - DNA, 25 bp, Mus musculus
agttcggccaggcttcccgctcttg

SEQ ID NO: 221060 - DNA, 25 bp, Mus musculus
agttcggccagggttcccgctcttg

SEQ ID NO: 221061 - DNA, 25 bp, Mus musculus
agttcggctactaggagtatgccca

SEQ ID NO: 221062 - DNA, 25 bp, Mus musculus
agttcggctacttggagtatgccca

SEQ ID NO: 221063 - DNA, 25 bp, Mus musculus
agttcgggtctgacctcgaggttag

SEQ ID NO: 221064 - DNA, 25 bp, Mus musculus
agttcgggtctgtcctcgaggttag

SEQ ID NO: 221065 - DNA, 25 bp, Mus musculus
agttcgggtgatatatacacagctc

SEQ ID NO: 221066 - DNA, 25 bp, Mus musculus
agttcgggtgatttatacacagctc

SEQ ID NO: 221067 - DNA, 25 bp, Mus musculus
agttcggtgtacatcatgtctgaca

SEQ ID NO: 221068 - DNA, 25 bp, Mus musculus
agttcggtgtacttcatgtctgaca

SEQ ID NO: 221069 - DNA, 25 bp, Mus musculus
agttcgtaacgacgcacacttatct

SEQ ID NO: 221070 - DNA, 25 bp, Mus musculus
agttcgtaacgaggcacacttatct

SEQ ID NO: 221071 - DNA, 25 bp, Mus musculus
agttcgtaacttctgctctaaaaca

SEQ ID NO: 221072 - DNA, 25 bp, Mus musculus
agttcgtaacttgtgctctaaaaca

SEQ ID NO: 221073 - DNA, 25 bp, Mus musculus
agttcgtaggcaatcccggctgtgg

SEQ ID NO: 221074 - DNA, 25 bp, Mus musculus
agttcgtaggcattcccggctgtgg

SEQ ID NO: 221075 - DNA, 25 bp, Mus musculus
agttcgtatgggacatttgctctct

SEQ ID NO: 221076 - DNA, 25 bp, Mus musculus
agttcgtatgggtcatttgctctct

SEQ ID NO: 221077 - DNA, 25 bp, Mus musculus
agttcgtgactcatctctacattag

SEQ ID NO: 221078 - DNA, 25 bp, Mus musculus
agttcgtgactcttctctacattag

SEQ ID NO: 221079 - DNA, 25 bp, Mus musculus
agttcgtgacttcggtttgcagatc

SEQ ID NO: 221080 - DNA, 25 bp, Mus musculus
agttcgtgacttgggtttgcagatc

SEQ ID NO: 221081 - DNA, 25 bp, Mus musculus
agttcgtgcgggacatgatccggga

SEQ ID NO: 221082 - DNA, 25 bp, Mus musculus
agttcgtgcgggtcatgatccggga

SEQ ID NO: 221083 - DNA, 25 bp, Mus musculus
agttcgtgctgaaaccagtgctgat

SEQ ID NO: 221084 - DNA, 25 bp, Mus musculus
agttcgtgctgataccagtgctgat

SEQ ID NO: 221085 - DNA, 25 bp, Mus musculus
agttcgtggcgtatgaggagcttcc

SEQ ID NO: 221086 - DNA, 25 bp, Mus musculus
agttcgtggcgtttgaggagcttcc

SEQ ID NO: 221087 - DNA, 25 bp, Mus musculus
agttcgtgttctcccttgacagaat

SEQ ID NO: 221088 - DNA, 25 bp, Mus musculus
agttcgtgttctgccttgacagaat

SEQ ID NO: 221089 - DNA, 25 bp, Mus musculus
agttctaaaagaccacgagtcattt

SEQ ID NO: 221090 - DNA, 25 bp, Mus musculus
agttctaaaagagcacgagtcattt

SEQ ID NO: 221091 - DNA, 25 bp, Mus musculus
agttctaaaatcacctgggctcagg

SEQ ID NO: 221092 - DNA, 25 bp, Mus musculus
agttctaaaatctcctgggctcagg

SEQ ID NO: 221093 - DNA, 25 bp, Mus musculus
agttctaaccagataatgggccttg

SEQ ID NO: 221094 - DNA, 25 bp, Mus musculus
agttctaaccagttaatgggccttg

SEQ ID NO: 221095 - DNA, 25 bp, Mus musculus
agttctaactccaaaacacaccatg

SEQ ID NO: 221096 - DNA, 25 bp, Mus musculus
agttctaactcctaaacacaccatg

SEQ ID NO: 221097 - DNA, 25 bp, Mus musculus
agttctaagatcaagtcagctgtta

SEQ ID NO: 221098 - DNA, 25 bp, Mus musculus
agttctaagatctagtcagctgtta

SEQ ID NO: 221099 - DNA, 25 bp, Mus musculus
agttctaaggcactgtttctcaaaa

SEQ ID NO: 221100 - DNA, 25 bp, Mus musculus
agttctaaggcagtgtttctcaaaa

SEQ ID NO: 221101 - DNA, 25 bp, Mus musculus
agttctaagggaaggtccacctctt

SEQ ID NO: 221102 - DNA, 25 bp, Mus musculus
agttctaagggatggtccacctctt

SEQ ID NO: 221103 - DNA, 25 bp, Mus musculus
agttctaatctcatgtgtctgcatt

SEQ ID NO: 221104 - DNA, 25 bp, Mus musculus
agttctaatctcttgtgtctgcatt

SEQ ID NO: 221105 - DNA, 25 bp, Mus musculus
agttctaattcgacttccttcctct

SEQ ID NO: 221106 - DNA, 25 bp, Mus musculus
agttctaattcgtcttccttcctct

SEQ ID NO: 221107 - DNA, 25 bp, Mus musculus
agttctacacgacgcttaccaacag

SEQ ID NO: 221108 - DNA, 25 bp, Mus musculus
agttctacacgaggcttaccaacag

SEQ ID NO: 221109 - DNA, 25 bp, Mus musculus
agttctacagacaggtgagccaagt

SEQ ID NO: 221110 - DNA, 25 bp, Mus musculus
agttctacagactggtgagccaagt

SEQ ID NO: 221111 - DNA, 25 bp, Mus musculus
agttctaccgtacggcgatgcagct

SEQ ID NO: 221112 - DNA, 25 bp, Mus musculus
agttctaccgtagggcgatgcagct

SEQ ID NO: 221113 - DNA, 25 bp, Mus musculus
agttctacctgcacacttcaagaca

SEQ ID NO: 221114 - DNA, 25 bp, Mus musculus
agttctacctgctcacttcaagaca

SEQ ID NO: 221115 - DNA, 25 bp, Mus musculus
agttctacctttagctactagtgat

SEQ ID NO: 221116 - DNA, 25 bp, Mus musculus
agttctaccttttgctactagtgat

SEQ ID NO: 221117 - DNA, 25 bp, Mus musculus
agttctacgaatctccacctaggca

SEQ ID NO: 221118 - DNA, 25 bp, Mus musculus
agttctacgaatgtccacctaggca

SEQ ID NO: 221119 - DNA, 25 bp, Mus musculus
agttctacgatgccaagtcgtgcct

SEQ ID NO: 221120 - DNA, 25 bp, Mus musculus
agttctacgatggcaagtcgtgcct

SEQ ID NO: 221121 - DNA, 25 bp, Mus musculus
agttctactctaaagctggatggcc

SEQ ID NO: 221122 - DNA, 25 bp, Mus musculus
agttctactctatagctggatggcc

SEQ ID NO: 221123 - DNA, 25 bp, Mus musculus
agttctactgcaaagggtgtgtcct

SEQ ID NO: 221124 - DNA, 25 bp, Mus musculus
agttctactgcatagggtgtgtcct

SEQ ID NO: 221125 - DNA, 25 bp, Mus musculus
agttctactggacgcccagattcac

SEQ ID NO: 221126 - DNA, 25 bp, Mus musculus
agttctactggaggcccagattcac

SEQ ID NO: 221127 - DNA, 25 bp, Mus musculus
agttctactgtgagggaaacccgct

SEQ ID NO: 221128 - DNA, 25 bp, Mus musculus
agttctactgtgtgggaaacccgct

SEQ ID NO: 221129 - DNA, 25 bp, Mus musculus
agttctagacatctgggccagatta

SEQ ID NO: 221130 - DNA, 25 bp, Mus musculus
agttctagacatgtgggccagatta

SEQ ID NO: 221131 - DNA, 25 bp, Mus musculus
agttctagagcacgtgctgtcctga

SEQ ID NO: 221132 - DNA, 25 bp, Mus musculus
agttctagagcaggtgctgtcctga

SEQ ID NO: 221133 - DNA, 25 bp, Mus musculus
agttctagaggaaccagcaccctca

SEQ ID NO: 221134 - DNA, 25 bp, Mus musculus
agttctagaggatccagcaccctca

SEQ ID NO: 221135 - DNA, 25 bp, Mus musculus
agttctagaggccagacctgggata

SEQ ID NO: 221136 - DNA, 25 bp, Mus musculus
agttctagaggcgagacctgggata

SEQ ID NO: 221137 - DNA, 25 bp, Mus musculus
agttctagccaacagctattaatta

SEQ ID NO: 221138 - DNA, 25 bp, Mus musculus
agttctagccaagagctattaatta

SEQ ID NO: 221139 - DNA, 25 bp, Mus musculus
agttctagccatagctgttacaggc

SEQ ID NO: 221140 - DNA, 25 bp, Mus musculus
agttctagccattgctgttacaggc

SEQ ID NO: 221141 - DNA, 25 bp, Mus musculus
agttctaggattccaggtgcatgtt

SEQ ID NO: 221142 - DNA, 25 bp, Mus musculus
agttctaggattgcaggtgcatgtt

SEQ ID NO: 221143 - DNA, 25 bp, Mus musculus
agttctagggcaacccagctacaca

SEQ ID NO: 221144 - DNA, 25 bp, Mus musculus
agttctagggcatcccagctacaca

SEQ ID NO: 221145 - DNA, 25 bp, Mus musculus
agttctaggtacatctgaatgttag

SEQ ID NO: 221146 - DNA, 25 bp, Mus musculus
agttctaggtacttctgaatgttag

SEQ ID NO: 221147 - DNA, 25 bp, Mus musculus
agttctagtctgattatcctcctgg

SEQ ID NO: 221148 - DNA, 25 bp, Mus musculus
agttctagtctgtttatcctcctgg

SEQ ID NO: 221149 - DNA, 25 bp, Mus musculus
agttctagtgacatgtaacaaatag

SEQ ID NO: 221150 - DNA, 25 bp, Mus musculus
agttctagtgacctcggctcgggat

SEQ ID NO: 221151 - DNA, 25 bp, Mus musculus
agttctagtgacgtcggctcgggat

SEQ ID NO: 221152 - DNA, 25 bp, Mus musculus
agttctagtgacttgtaacaaatag

SEQ ID NO: 221153 - DNA, 25 bp, Mus musculus
agttctagtgccatacactccagga

SEQ ID NO: 221154 - DNA, 25 bp, Mus musculus
agttctagtgccttacactccagga

SEQ ID NO: 221155 - DNA, 25 bp, Mus musculus
agttctagttagagagttaccacgg

SEQ ID NO: 221156 - DNA, 25 bp, Mus musculus
agttctagttagtgagttaccacgg

SEQ ID NO: 221157 - DNA, 25 bp, Mus musculus
agttctatacaacacagcccataca

SEQ ID NO: 221158 - DNA, 25 bp, Mus musculus
agttctatacaagacagcccataca

SEQ ID NO: 221159 - DNA, 25 bp, Mus musculus
agttctatacccactccagtatttt

SEQ ID NO: 221160 - DNA, 25 bp, Mus musculus
agttctataccctctccagtatttt

SEQ ID NO: 221161 - DNA, 25 bp, Mus musculus
agttctatactgatatgcctctcaa

SEQ ID NO: 221162 - DNA, 25 bp, Mus musculus
agttctatactgttatgcctctcaa

SEQ ID NO: 221163 - DNA, 25 bp, Mus musculus
agttctatatctccatccacaggag

SEQ ID NO: 221164 - DNA, 25 bp, Mus musculus
agttctatatctgcatccacaggag

SEQ ID NO: 221165 - DNA, 25 bp, Mus musculus
agttctatcgccacgggattgctca

SEQ ID NO: 221166 - DNA, 25 bp, Mus musculus
agttctatcgcctcgggattgctca

SEQ ID NO: 221167 - DNA, 25 bp, Mus musculus
agttctatctcacatctcagcttcc

SEQ ID NO: 221168 - DNA, 25 bp, Mus musculus
agttctatctcagatctcagcttcc

SEQ ID NO: 221169 - DNA, 25 bp, Mus musculus
agttctatctccaaccctaaacagt

SEQ ID NO: 221170 - DNA, 25 bp, Mus musculus
agttctatctcctaccctaaacagt

SEQ ID NO: 221171 - DNA, 25 bp, Mus musculus
agttctatgcttaggctgccagatc

SEQ ID NO: 221172 - DNA, 25 bp, Mus musculus
agttctatgctttggctgccagatc

SEQ ID NO: 221173 - DNA, 25 bp, Mus musculus
agttctattgacatccctccttaat

SEQ ID NO: 221174 - DNA, 25 bp, Mus musculus
agttctattgacttccctccttaat

SEQ ID NO: 221175 - DNA, 25 bp, Mus musculus
agttctcaacagagtcagcacgctc

SEQ ID NO: 221176 - DNA, 25 bp, Mus musculus
agttctcaacagtgtcagcacgctc

SEQ ID NO: 221177 - DNA, 25 bp, Mus musculus
agttctcaactcatgctttacacat

SEQ ID NO: 221178 - DNA, 25 bp, Mus musculus
agttctcaactcttgctttacacat

SEQ ID NO: 221179 - DNA, 25 bp, Mus musculus
agttctcaatgcagcttcctgtagc

SEQ ID NO: 221180 - DNA, 25 bp, Mus musculus
agttctcaatgctgcttcctgtagc

SEQ ID NO: 221181 - DNA, 25 bp, Mus musculus
agttctcacagaacttctgtctttt

SEQ ID NO: 221182 - DNA, 25 bp, Mus musculus
agttctcacagatcttctgtctttt

SEQ ID NO: 221183 - DNA, 25 bp, Mus musculus
agttctcaccgacgcacatttgcat

SEQ ID NO: 221184 - DNA, 25 bp, Mus musculus
agttctcaccgaggcacatttgcat

SEQ ID NO: 221185 - DNA, 25 bp, Mus musculus
agttctcactggatgctagacttta

SEQ ID NO: 221186 - DNA, 25 bp, Mus musculus
agttctcactggttgctagacttta

SEQ ID NO: 221187 - DNA, 25 bp, Mus musculus
agttctcagacgcagcactgctgta

SEQ ID NO: 221188 - DNA, 25 bp, Mus musculus
agttctcagacggagcactgctgta

SEQ ID NO: 221189 - DNA, 25 bp, Mus musculus
agttctcagactagtgcagtccttg

SEQ ID NO: 221190 - DNA, 25 bp, Mus musculus
agttctcagacttgtgcagtccttg

SEQ ID NO: 221191 - DNA, 25 bp, Mus musculus
agttctcagaggatgcttgcagcct

SEQ ID NO: 221192 - DNA, 25 bp, Mus musculus
agttctcagaggttgcttgcagcct

SEQ ID NO: 221193 - DNA, 25 bp, Mus musculus
agttctcagcacacatctaaggtga

SEQ ID NO: 221194 - DNA, 25 bp, Mus musculus
agttctcagcactcatctaaggtga

SEQ ID NO: 221195 - DNA, 25 bp, Mus musculus
agttctcagcatatctaatgctgtg

SEQ ID NO: 221196 - DNA, 25 bp, Mus musculus
agttctcagcatttctaatgctgtg

SEQ ID NO: 221197 - DNA, 25 bp, Mus musculus
agttctcagccccatttggaggatt

SEQ ID NO: 221198 - DNA, 25 bp, Mus musculus
agttctcagcccgatttggaggatt

SEQ ID NO: 221199 - DNA, 25 bp, Mus musculus
agttctcagcttcaatagagtcctc

SEQ ID NO: 221200 - DNA, 25 bp, Mus musculus
agttctcagcttgaatagagtcctc

SEQ ID NO: 221201 - DNA, 25 bp, Mus musculus
agttctcagggtccacgtgttagat

SEQ ID NO: 221202 - DNA, 25 bp, Mus musculus
agttctcagggtgcacgtgttagat

SEQ ID NO: 221203 - DNA, 25 bp, Mus musculus
agttctcaggtcagaactcctgcaa

SEQ ID NO: 221204 - DNA, 25 bp, Mus musculus
agttctcaggtctgaactcctgcaa

SEQ ID NO: 221205 - DNA, 25 bp, Mus musculus
agttctcaggttctgggttgctatc

SEQ ID NO: 221206 - DNA, 25 bp, Mus musculus
agttctcaggttgtgggttgctatc

SEQ ID NO: 221207 - DNA, 25 bp, Mus musculus
agttctcagtgtcctcgccagctac

SEQ ID NO: 221208 - DNA, 25 bp, Mus musculus
agttctcagtgtgctcgccagctac

SEQ ID NO: 221209 - DNA, 25 bp, Mus musculus
agttctcatcctaattacctgctaa

SEQ ID NO: 221210 - DNA, 25 bp, Mus musculus
agttctcatccttattacctgctaa

SEQ ID NO: 221211 - DNA, 25 bp, Mus musculus
agttctcatgctaggaagttctcat

SEQ ID NO: 221212 - DNA, 25 bp, Mus musculus
agttctcatgcttggaagttctcat

SEQ ID NO: 221213 - DNA, 25 bp, Mus musculus
agttctcattttcaccatcaacaca

SEQ ID NO: 221214 - DNA, 25 bp, Mus musculus
agttctcattttgaccatcaacaca

SEQ ID NO: 221215 - DNA, 25 bp, Mus musculus
agttctccaaaaaacggtcctgatt

SEQ ID NO: 221216 - DNA, 25 bp, Mus musculus
agttctccaaaatacggtcctgatt

SEQ ID NO: 221217 - DNA, 25 bp, Mus musculus
agttctccacataccttgaaagaca

SEQ ID NO: 221218 - DNA, 25 bp, Mus musculus
agttctccacattccttgaaagaca

SEQ ID NO: 221219 - DNA, 25 bp, Mus musculus
agttctccaggaagccttacccttg

SEQ ID NO: 221220 - DNA, 25 bp, Mus musculus
agttctccaggaatttctcatgaag

SEQ ID NO: 221221 - DNA, 25 bp, Mus musculus
agttctccaggacatgaccgacgga

SEQ ID NO: 221222 - DNA, 25 bp, Mus musculus
agttctccaggagatgaccgacgga

SEQ ID NO: 221223 - DNA, 25 bp, Mus musculus
agttctccaggatgccttacccttg

SEQ ID NO: 221224 - DNA, 25 bp, Mus musculus
agttctccaggattttctcatgaag

SEQ ID NO: 221225 - DNA, 25 bp, Mus musculus
agttctccatccagtagaggtccag

SEQ ID NO: 221226 - DNA, 25 bp, Mus musculus
agttctccatcctgtagaggtccag

SEQ ID NO: 221227 - DNA, 25 bp, Mus musculus
agttctcccactacagcaagccttg

SEQ ID NO: 221228 - DNA, 25 bp, Mus musculus
agttctcccacttcagcaagccttg

SEQ ID NO: 221229 - DNA, 25 bp, Mus musculus
agttctcccaggacaggacctttgg

SEQ ID NO: 221230 - DNA, 25 bp, Mus musculus
agttctcccaggtcaggacctttgg

SEQ ID NO: 221231 - DNA, 25 bp, Mus musculus
agttctcccgtgacactcagggtga

SEQ ID NO: 221232 - DNA, 25 bp, Mus musculus
agttctcccgtgtcactcagggtga

SEQ ID NO: 221233 - DNA, 25 bp, Mus musculus
agttctccctctaagactttatcca

SEQ ID NO: 221234 - DNA, 25 bp, Mus musculus
agttctccctcttagactttatcca

SEQ ID NO: 221235 - DNA, 25 bp, Mus musculus
agttctccgggaagcatagattcat

SEQ ID NO: 221236 - DNA, 25 bp, Mus musculus
agttctccgggatgcatagattcat

SEQ ID NO: 221237 - DNA, 25 bp, Mus musculus
agttctccgtgaccaggcacgagaa

SEQ ID NO: 221238 - DNA, 25 bp, Mus musculus
agttctccgtgagcaggcacgagaa

SEQ ID NO: 221239 - DNA, 25 bp, Mus musculus
agttctccgtggacatgacctgtga

SEQ ID NO: 221240 - DNA, 25 bp, Mus musculus
agttctccgtggtcatgacctgtga

SEQ ID NO: 221241 - DNA, 25 bp, Mus musculus
agttctccgtgtactcaagggctca

SEQ ID NO: 221242 - DNA, 25 bp, Mus musculus
agttctccgtgttctcaagggctca

SEQ ID NO: 221243 - DNA, 25 bp, Mus musculus
agttctcctcctatcaatgtatgtt

SEQ ID NO: 221244 - DNA, 25 bp, Mus musculus
agttctcctcctttcaatgtatgtt

SEQ ID NO: 221245 - DNA, 25 bp, Mus musculus
agttctcctcttagttttatcttgt

SEQ ID NO: 221246 - DNA, 25 bp, Mus musculus
agttctcctcttatacttacaagcc

SEQ ID NO: 221247 - DNA, 25 bp, Mus musculus
agttctcctctttgttttatcttgt

SEQ ID NO: 221248 - DNA, 25 bp, Mus musculus
agttctcctcttttacttacaagcc

SEQ ID NO: 221249 - DNA, 25 bp, Mus musculus
agttctcctgacaccttccgtgcat

SEQ ID NO: 221250 - DNA, 25 bp, Mus musculus
agttctcctgacactatccagatga

SEQ ID NO: 221251 - DNA, 25 bp, Mus musculus
agttctcctgactccttccgtgcat

SEQ ID NO: 221252 - DNA, 25 bp, Mus musculus
agttctcctgactctatccagatga

SEQ ID NO: 221253 - DNA, 25 bp, Mus musculus
agttctcctttgcaggtgacctcat

SEQ ID NO: 221254 - DNA, 25 bp, Mus musculus
agttctcctttggaggtgacctcat

SEQ ID NO: 221255 - DNA, 25 bp, Mus musculus
agttctcggctgattaatccttgta

SEQ ID NO: 221256 - DNA, 25 bp, Mus musculus
agttctcggctgtttaatccttgta

SEQ ID NO: 221257 - DNA, 25 bp, Mus musculus
agttctcgggtgagctcagactcaa

SEQ ID NO: 221258 - DNA, 25 bp, Mus musculus
agttctcgggtgtgctcagactcaa

SEQ ID NO: 221259 - DNA, 25 bp, Mus musculus
agttctcgtgagcagtggtattccc

SEQ ID NO: 221260 - DNA, 25 bp, Mus musculus
agttctcgtgaggagtggtattccc

SEQ ID NO: 221261 - DNA, 25 bp, Mus musculus
agttctctaaacagctctcacacac

SEQ ID NO: 221262 - DNA, 25 bp, Mus musculus
agttctctaaactgctctcacacac

SEQ ID NO: 221263 - DNA, 25 bp, Mus musculus
agttctctaaggagctcagtgggtc

SEQ ID NO: 221264 - DNA, 25 bp, Mus musculus
agttctctaaggtgctcagtgggtc

SEQ ID NO: 221265 - DNA, 25 bp, Mus musculus
agttctctacccactgaagtgctag

SEQ ID NO: 221266 - DNA, 25 bp, Mus musculus
agttctctaccctctgaagtgctag

SEQ ID NO: 221267 - DNA, 25 bp, Mus musculus
agttctctactaagcatgtaacaga

SEQ ID NO: 221268 - DNA, 25 bp, Mus musculus
agttctctactaatctatgctgctt

SEQ ID NO: 221269 - DNA, 25 bp, Mus musculus
agttctctactatgcatgtaacaga

SEQ ID NO: 221270 - DNA, 25 bp, Mus musculus
agttctctactattctatgctgctt

SEQ ID NO: 221271 - DNA, 25 bp, Mus musculus
agttctctacttcgtgtatctaagg

SEQ ID NO: 221272 - DNA, 25 bp, Mus musculus
agttctctacttggtgtatctaagg

SEQ ID NO: 221273 - DNA, 25 bp, Mus musculus
agttctctagctccgctgagtcatt

SEQ ID NO: 221274 - DNA, 25 bp, Mus musculus
agttctctagctgcgctgagtcatt

SEQ ID NO: 221275 - DNA, 25 bp, Mus musculus
agttctctcaacatgtttgcaacat

SEQ ID NO: 221276 - DNA, 25 bp, Mus musculus
agttctctcaacttgtttgcaacat

SEQ ID NO: 221277 - DNA, 25 bp, Mus musculus
agttctctcaatcaagtgctgggac

SEQ ID NO: 221278 - DNA, 25 bp, Mus musculus
agttctctcaatgaagtgctgggac

SEQ ID NO: 221279 - DNA, 25 bp, Mus musculus
agttctctcagaaccgggccgagag

SEQ ID NO: 221280 - DNA, 25 bp, Mus musculus
agttctctcagaatggtggtactag

SEQ ID NO: 221281 - DNA, 25 bp, Mus musculus
agttctctcagacccgtcaggaggc

SEQ ID NO: 221282 - DNA, 25 bp, Mus musculus
agttctctcagagccgtcaggaggc

SEQ ID NO: 221283 - DNA, 25 bp, Mus musculus
agttctctcagatccgggccgagag

SEQ ID NO: 221284 - DNA, 25 bp, Mus musculus
agttctctcagattggtggtactag

SEQ ID NO: 221285 - DNA, 25 bp, Mus musculus
agttctctcctacaggctggtccta

SEQ ID NO: 221286 - DNA, 25 bp, Mus musculus
agttctctcctagaggctggtccta

SEQ ID NO: 221287 - DNA, 25 bp, Mus musculus
agttctctcctgacagctgtgagct

SEQ ID NO: 221288 - DNA, 25 bp, Mus musculus
agttctctcctgtcagctgtgagct

SEQ ID NO: 221289 - DNA, 25 bp, Mus musculus
agttctctccttcacattccttatg

SEQ ID NO: 221290 - DNA, 25 bp, Mus musculus
agttctctccttgacattccttatg

SEQ ID NO: 221291 - DNA, 25 bp, Mus musculus
agttctctctaacaacgttttcaga

SEQ ID NO: 221292 - DNA, 25 bp, Mus musculus
agttctctctaagaacgttttcaga

SEQ ID NO: 221293 - DNA, 25 bp, Mus musculus
agttctctctcacgcatggatttca

SEQ ID NO: 221294 - DNA, 25 bp, Mus musculus
agttctctctcaggcatggatttca

SEQ ID NO: 221295 - DNA, 25 bp, Mus musculus
agttctctctctagtgaacacttaa

SEQ ID NO: 221296 - DNA, 25 bp, Mus musculus
agttctctctcttgtgaacacttaa

SEQ ID NO: 221297 - DNA, 25 bp, Mus musculus
agttctctctgtcgcctagctgggc

SEQ ID NO: 221298 - DNA, 25 bp, Mus musculus
agttctctctgtggcctagctgggc

SEQ ID NO: 221299 - DNA, 25 bp, Mus musculus
agttctctcttcatagcttccaaat

SEQ ID NO: 221300 - DNA, 25 bp, Mus musculus
agttctctcttcttagcttccaaat

SEQ ID NO: 221301 - DNA, 25 bp, Mus musculus
agttctctgaccctctaagcctgag

SEQ ID NO: 221302 - DNA, 25 bp, Mus musculus
agttctctgaccgtctaagcctgag

SEQ ID NO: 221303 - DNA, 25 bp, Mus musculus
agttctctgactccatgggcttact

SEQ ID NO: 221304 - DNA, 25 bp, Mus musculus
agttctctgactgcatgggcttact

SEQ ID NO: 221305 - DNA, 25 bp, Mus musculus
agttctctggctaaatttctcatgt

SEQ ID NO: 221306 - DNA, 25 bp, Mus musculus
agttctctggcttaatttctcatgt

SEQ ID NO: 221307 - DNA, 25 bp, Mus musculus
agttctctggtcaaggacagctctt

SEQ ID NO: 221308 - DNA, 25 bp, Mus musculus
agttctctggtctaggacagctctt

SEQ ID NO: 221309 - DNA, 25 bp, Mus musculus
agttctctggtgatgctgggaataa

SEQ ID NO: 221310 - DNA, 25 bp, Mus musculus
agttctctggtgttgctgggaataa

SEQ ID NO: 221311 - DNA, 25 bp, Mus musculus
agttctctgtgccaaggtagagtgt

SEQ ID NO: 221312 - DNA, 25 bp, Mus musculus
agttctctgtgcgaaggtagagtgt

SEQ ID NO: 221313 - DNA, 25 bp, Mus musculus
agttctctgtgtcgtcagctctgta

SEQ ID NO: 221314 - DNA, 25 bp, Mus musculus
agttctctgtgtggtcagctctgta

SEQ ID NO: 221315 - DNA, 25 bp, Mus musculus
agttctctgtttattcccttgagca

SEQ ID NO: 221316 - DNA, 25 bp, Mus musculus
agttctctgttttttcccttgagca

SEQ ID NO: 221317 - DNA, 25 bp, Mus musculus
agttctcttctcagcactcaaatga

SEQ ID NO: 221318 - DNA, 25 bp, Mus musculus
agttctcttctctgcactcaaatga

SEQ ID NO: 221319 - DNA, 25 bp, Mus musculus
agttctcttctgaggaatgctggac

SEQ ID NO: 221320 - DNA, 25 bp, Mus musculus
agttctcttctgtggaatgctggac

SEQ ID NO: 221321 - DNA, 25 bp, Mus musculus
agttctcttcttactatccgtcttt

SEQ ID NO: 221322 - DNA, 25 bp, Mus musculus
agttctcttctttctatccgtcttt

SEQ ID NO: 221323 - DNA, 25 bp, Mus musculus
agttctcttgacagtctaccagctg

SEQ ID NO: 221324 - DNA, 25 bp, Mus musculus
agttctcttgactgtctaccagctg

SEQ ID NO: 221325 - DNA, 25 bp, Mus musculus
agttctcttgtcagtctttgacaca

SEQ ID NO: 221326 - DNA, 25 bp, Mus musculus
agttctcttgtctgtctttgacaca

SEQ ID NO: 221327 - DNA, 25 bp, Mus musculus
agttctctttacacaacgttgtctg

SEQ ID NO: 221328 - DNA, 25 bp, Mus musculus
agttctctttactcaacgttgtctg

SEQ ID NO: 221329 - DNA, 25 bp, Mus musculus
agttctctttcaatgatctgtgcat

SEQ ID NO: 221330 - DNA, 25 bp, Mus musculus
agttctctttcattgatctgtgcat

SEQ ID NO: 221331 - DNA, 25 bp, Mus musculus
agttctgaacttcagcctgggtcgc

SEQ ID NO: 221332 - DNA, 25 bp, Mus musculus
agttctgaacttgagcctgggtcgc

SEQ ID NO: 221333 - DNA, 25 bp, Mus musculus
agttctgaagatcattctgacctct

SEQ ID NO: 221334 - DNA, 25 bp, Mus musculus
agttctgaagatgattctgacctct

SEQ ID NO: 221335 - DNA, 25 bp, Mus musculus
agttctgaatggctgcctctgtgac

SEQ ID NO: 221336 - DNA, 25 bp, Mus musculus
agttctgaatgggtgcctctgtgac

SEQ ID NO: 221337 - DNA, 25 bp, Mus musculus
agttctgacactccctgatggtggg

SEQ ID NO: 221338 - DNA, 25 bp, Mus musculus
agttctgacactgcctgatggtggg

SEQ ID NO: 221339 - DNA, 25 bp, Mus musculus
agttctgacatcaggatctgaaggc

SEQ ID NO: 221340 - DNA, 25 bp, Mus musculus
agttctgacatctggatctgaaggc

SEQ ID NO: 221341 - DNA, 25 bp, Mus musculus
agttctgaccttcgtcaccagttga

SEQ ID NO: 221342 - DNA, 25 bp, Mus musculus
agttctgaccttggtcaccagttga

SEQ ID NO: 221343 - DNA, 25 bp, Mus musculus
agttctgacggcactagggggctta

SEQ ID NO: 221344 - DNA, 25 bp, Mus musculus
agttctgacggctctagggggctta

SEQ ID NO: 221345 - DNA, 25 bp, Mus musculus
agttctgactatcggcgtttcatcc

SEQ ID NO: 221346 - DNA, 25 bp, Mus musculus
agttctgactatgggcgtttcatcc

SEQ ID NO: 221347 - DNA, 25 bp, Mus musculus
agttctgactccactgatgcattca

SEQ ID NO: 221348 - DNA, 25 bp, Mus musculus
agttctgactcctctgatgcattca

SEQ ID NO: 221349 - DNA, 25 bp, Mus musculus
agttctgactggaccaaagctgtgt

SEQ ID NO: 221350 - DNA, 25 bp, Mus musculus
agttctgactggtccaaagctgtgt

SEQ ID NO: 221351 - DNA, 25 bp, Mus musculus
agttctgagactctacatttgttta

SEQ ID NO: 221352 - DNA, 25 bp, Mus musculus
agttctgagactgtacatttgttta

SEQ ID NO: 221353 - DNA, 25 bp, Mus musculus
agttctgagctgaaatttcgcctta

SEQ ID NO: 221354 - DNA, 25 bp, Mus musculus
agttctgagctgtaatttcgcctta

SEQ ID NO: 221355 - DNA, 25 bp, Mus musculus
agttctgagtaacctgtttgtaagt

SEQ ID NO: 221356 - DNA, 25 bp, Mus musculus
agttctgagtaagctgtttgtaagt

SEQ ID NO: 221357 - DNA, 25 bp, Mus musculus
agttctgagtacctagtgcctaagc

SEQ ID NO: 221358 - DNA, 25 bp, Mus musculus
agttctgagtacgtagtgcctaagc

SEQ ID NO: 221359 - DNA, 25 bp, Mus musculus
agttctgataccatgctggagaaga

SEQ ID NO: 221360 - DNA, 25 bp, Mus musculus
agttctgataccttgctggagaaga

SEQ ID NO: 221361 - DNA, 25 bp, Mus musculus
agttctgatatcacatctggctgag

SEQ ID NO: 221362 - DNA, 25 bp, Mus musculus
agttctgatatctcatctggctgag

SEQ ID NO: 221363 - DNA, 25 bp, Mus musculus
agttctgatcataatttgagaaggg

SEQ ID NO: 221364 - DNA, 25 bp, Mus musculus
agttctgatcattatttgagaaggg

SEQ ID NO: 221365 - DNA, 25 bp, Mus musculus
agttctgatctcacactgacaacat

SEQ ID NO: 221366 - DNA, 25 bp, Mus musculus
agttctgatctctcactgacaacat

SEQ ID NO: 221367 - DNA, 25 bp, Mus musculus
agttctgatcttactctgcaacaag

SEQ ID NO: 221368 - DNA, 25 bp, Mus musculus
agttctgatctttctctgcaacaag

SEQ ID NO: 221369 - DNA, 25 bp, Mus musculus
agttctgatgagaaccctccttata

SEQ ID NO: 221370 - DNA, 25 bp, Mus musculus
agttctgatgagtaccctccttata

SEQ ID NO: 221371 - DNA, 25 bp, Mus musculus
agttctgatggccagtttttcctgt

SEQ ID NO: 221372 - DNA, 25 bp, Mus musculus
agttctgatggcgagtttttcctgt

SEQ ID NO: 221373 - DNA, 25 bp, Mus musculus
agttctgatttgcttgtgtgctatg

SEQ ID NO: 221374 - DNA, 25 bp, Mus musculus
agttctgatttggttgtgtgctatg

SEQ ID NO: 221375 - DNA, 25 bp, Mus musculus
agttctgcaagtaccattagaagaa

SEQ ID NO: 221376 - DNA, 25 bp, Mus musculus
agttctgcaagttccattagaagaa

SEQ ID NO: 221377 - DNA, 25 bp, Mus musculus
agttctgcacctcgtttcagcaagg

SEQ ID NO: 221378 - DNA, 25 bp, Mus musculus
agttctgcacctggtttcagcaagg

SEQ ID NO: 221379 - DNA, 25 bp, Mus musculus
agttctgcagttcttgtttataagc

SEQ ID NO: 221380 - DNA, 25 bp, Mus musculus
agttctgcagttgttgtttataagc

SEQ ID NO: 221381 - DNA, 25 bp, Mus musculus
agttctgcatttaagggcctgctcc

SEQ ID NO: 221382 - DNA, 25 bp, Mus musculus
agttctgcattttagggcctgctcc

SEQ ID NO: 221383 - DNA, 25 bp, Mus musculus
agttctgcctctagtgtctgtccta

SEQ ID NO: 221384 - DNA, 25 bp, Mus musculus
agttctgcctcttgtgtctgtccta

SEQ ID NO: 221385 - DNA, 25 bp, Mus musculus
agttctgccttcaggattcacatgg

SEQ ID NO: 221386 - DNA, 25 bp, Mus musculus
agttctgccttctggattcacatgg

SEQ ID NO: 221387 - DNA, 25 bp, Mus musculus
agttctgcgaaaatggtgtctgttt

SEQ ID NO: 221388 - DNA, 25 bp, Mus musculus
agttctgcgaaattggtgtctgttt

SEQ ID NO: 221389 - DNA, 25 bp, Mus musculus
agttctgcgaatccctcattggcat

SEQ ID NO: 221390 - DNA, 25 bp, Mus musculus
agttctgcgaatgcctcattggcat

SEQ ID NO: 221391 - DNA, 25 bp, Mus musculus
agttctgctaaaaggcctcttggaa

SEQ ID NO: 221392 - DNA, 25 bp, Mus musculus
agttctgctaaatggcctcttggaa

SEQ ID NO: 221393 - DNA, 25 bp, Mus musculus
agttctgctatgctattttcggctg

SEQ ID NO: 221394 - DNA, 25 bp, Mus musculus
agttctgctatgcttctgcgaattc

SEQ ID NO: 221395 - DNA, 25 bp, Mus musculus
agttctgctatggtattttcggctg

SEQ ID NO: 221396 - DNA, 25 bp, Mus musculus
agttctgctatggttctgcgaattc

SEQ ID NO: 221397 - DNA, 25 bp, Mus musculus
agttctgctcaaatgccttctatga

SEQ ID NO: 221398 - DNA, 25 bp, Mus musculus
agttctgctcaattgccttctatga

SEQ ID NO: 221399 - DNA, 25 bp, Mus musculus
agttctgctgggaccgtagccagaa

SEQ ID NO: 221400 - DNA, 25 bp, Mus musculus
agttctgctgggtccgtagccagaa

SEQ ID NO: 221401 - DNA, 25 bp, Mus musculus
agttctgctgtgaatgtggcattcg

SEQ ID NO: 221402 - DNA, 25 bp, Mus musculus
agttctgctgtgtatgtggcattcg

SEQ ID NO: 221403 - DNA, 25 bp, Mus musculus
agttctgctgttaaactggtgggag

SEQ ID NO: 221404 - DNA, 25 bp, Mus musculus
agttctgctgtttaactggtgggag

SEQ ID NO: 221405 - DNA, 25 bp, Mus musculus
agttctgctttacatcatgctgtta

SEQ ID NO: 221406 - DNA, 25 bp, Mus musculus
agttctgctttagatcatgctgtta

SEQ ID NO: 221407 - DNA, 25 bp, Mus musculus
agttctggaatgcactcgggccgcc

SEQ ID NO: 221408 - DNA, 25 bp, Mus musculus
agttctggaatggactcgggccgcc

SEQ ID NO: 221409 - DNA, 25 bp, Mus musculus
agttctggacagaggagcctttgcc

SEQ ID NO: 221410 - DNA, 25 bp, Mus musculus
agttctggacagtggagcctttgcc

SEQ ID NO: 221411 - DNA, 25 bp, Mus musculus
agttctggaccaagcctgagattgc

SEQ ID NO: 221412 - DNA, 25 bp, Mus musculus
agttctggaccatgcctgagattgc

SEQ ID NO: 221413 - DNA, 25 bp, Mus musculus
agttctggagtcacacatgcgtccc

SEQ ID NO: 221414 - DNA, 25 bp, Mus musculus
agttctggagtctcacatgcgtccc

SEQ ID NO: 221415 - DNA, 25 bp, Mus musculus
agttctggctatccctgtaacttac

SEQ ID NO: 221416 - DNA, 25 bp, Mus musculus
agttctggctatgcctgtaacttac

SEQ ID NO: 221417 - DNA, 25 bp, Mus musculus
agttctggctgcagtcagtgccaag

SEQ ID NO: 221418 - DNA, 25 bp, Mus musculus
agttctggctgcattatgctccatc

SEQ ID NO: 221419 - DNA, 25 bp, Mus musculus
agttctggctgctgtcagtgccaag

SEQ ID NO: 221420 - DNA, 25 bp, Mus musculus
agttctggctgctttatgctccatc

SEQ ID NO: 221421 - DNA, 25 bp, Mus musculus
agttctggctggagttaagggacac

SEQ ID NO: 221422 - DNA, 25 bp, Mus musculus
agttctggctggtgttaagggacac

SEQ ID NO: 221423 - DNA, 25 bp, Mus musculus
agttctgggactatgttcacacaca

SEQ ID NO: 221424 - DNA, 25 bp, Mus musculus
agttctgggactttgttcacacaca

SEQ ID NO: 221425 - DNA, 25 bp, Mus musculus
agttctgggcaaatgatccttttca

SEQ ID NO: 221426 - DNA, 25 bp, Mus musculus
agttctgggcaattgatccttttca

SEQ ID NO: 221427 - DNA, 25 bp, Mus musculus
agttctgggtctccatccacaacag

SEQ ID NO: 221428 - DNA, 25 bp, Mus musculus
agttctgggtctgcatccacaacag

SEQ ID NO: 221429 - DNA, 25 bp, Mus musculus
agttctgggtgtccgggaaattcca

SEQ ID NO: 221430 - DNA, 25 bp, Mus musculus
agttctgggtgtgcgggaaattcca

SEQ ID NO: 221431 - DNA, 25 bp, Mus musculus
agttctggtaggcttgctcacatgg

SEQ ID NO: 221432 - DNA, 25 bp, Mus musculus
agttctggtagggttgctcacatgg

SEQ ID NO: 221433 - DNA, 25 bp, Mus musculus
agttctggtagtagtggactgcctt

SEQ ID NO: 221434 - DNA, 25 bp, Mus musculus
agttctggtagttgtggactgcctt

SEQ ID NO: 221435 - DNA, 25 bp, Mus musculus
agttctggtctcagaaacctccatg

SEQ ID NO: 221436 - DNA, 25 bp, Mus musculus
agttctggtctctgaaacctccatg

SEQ ID NO: 221437 - DNA, 25 bp, Mus musculus
agttctggtggtaaacccagcactt

SEQ ID NO: 221438 - DNA, 25 bp, Mus musculus
agttctggtggttaacccagcactt

SEQ ID NO: 221439 - DNA, 25 bp, Mus musculus
agttctgtaccccacataggcaggg

SEQ ID NO: 221440 - DNA, 25 bp, Mus musculus
agttctgtacccgacataggcaggg

SEQ ID NO: 221441 - DNA, 25 bp, Mus musculus
agttctgtagacctgaatggtattc

SEQ ID NO: 221442 - DNA, 25 bp, Mus musculus
agttctgtagacgtgaatggtattc

SEQ ID NO: 221443 - DNA, 25 bp, Mus musculus
agttctgtagcacccgatcagcgtc

SEQ ID NO: 221444 - DNA, 25 bp, Mus musculus
agttctgtagcagccgatcagcgtc

SEQ ID NO: 221445 - DNA, 25 bp, Mus musculus
agttctgtatatcccatgtggtctg

SEQ ID NO: 221446 - DNA, 25 bp, Mus musculus
agttctgtatatgccatgtggtctg

SEQ ID NO: 221447 - DNA, 25 bp, Mus musculus
agttctgtatgaagtgaggccattt

SEQ ID NO: 221448 - DNA, 25 bp, Mus musculus
agttctgtatgatgtgaggccattt

SEQ ID NO: 221449 - DNA, 25 bp, Mus musculus
agttctgtctatagcccagcaggct

SEQ ID NO: 221450 - DNA, 25 bp, Mus musculus
agttctgtctattgcccagcaggct

SEQ ID NO: 221451 - DNA, 25 bp, Mus musculus
agttctgtctcaccccgttgtacat

SEQ ID NO: 221452 - DNA, 25 bp, Mus musculus
agttctgtctcagcccgttgtacat

SEQ ID NO: 221453 - DNA, 25 bp, Mus musculus
agttctgtctgcaaggctgaagtga

SEQ ID NO: 221454 - DNA, 25 bp, Mus musculus
agttctgtctgctaggctgaagtga

SEQ ID NO: 221455 - DNA, 25 bp, Mus musculus
agttctgtgaccatcagatggccca

SEQ ID NO: 221456 - DNA, 25 bp, Mus musculus
agttctgtgaccttcagatggccca

SEQ ID NO: 221457 - DNA, 25 bp, Mus musculus
agttctgtgatccacttcaacatgt

SEQ ID NO: 221458 - DNA, 25 bp, Mus musculus
agttctgtgatcgacttcaacatgt

SEQ ID NO: 221459 - DNA, 25 bp, Mus musculus
agttctgtgatgatctggccctcga

SEQ ID NO: 221460 - DNA, 25 bp, Mus musculus
agttctgtgatgttctggccctcga

SEQ ID NO: 221461 - DNA, 25 bp, Mus musculus
agttctgtgattcctcaggtcatag

SEQ ID NO: 221462 - DNA, 25 bp, Mus musculus
agttctgtgattgctcaggtcatag

SEQ ID NO: 221463 - DNA, 25 bp, Mus musculus
agttctgtgcacagacactgtttgc

SEQ ID NO: 221464 - DNA, 25 bp, Mus musculus
agttctgtgcactgacactgtttgc

SEQ ID NO: 221465 - DNA, 25 bp, Mus musculus
agttctgtggaaacagactctgcat

SEQ ID NO: 221466 - DNA, 25 bp, Mus musculus
agttctgtggaatcagactctgcat

SEQ ID NO: 221467 - DNA, 25 bp, Mus musculus
agttctgtggtacccattgttttac

SEQ ID NO: 221468 - DNA, 25 bp, Mus musculus
agttctgtggtagccattgttttac

SEQ ID NO: 221469 - DNA, 25 bp, Mus musculus
agttctgtgtacagttcttgtaaca

SEQ ID NO: 221470 - DNA, 25 bp, Mus musculus
agttctgtgtactgttcttgtaaca

SEQ ID NO: 221471 - DNA, 25 bp, Mus musculus
agttctgtgtttactgtgagcccat

SEQ ID NO: 221472 - DNA, 25 bp, Mus musculus
agttctgtgttttctgtgagcccat

SEQ ID NO: 221473 - DNA, 25 bp, Mus musculus
agttctgttagactggagctgcctg

SEQ ID NO: 221474 - DNA, 25 bp, Mus musculus
agttctgttagagtggagctgcctg

SEQ ID NO: 221475 - DNA, 25 bp, Mus musculus
agttctgttcccagcatgcaagtgg

SEQ ID NO: 221476 - DNA, 25 bp, Mus musculus
agttctgttccctgcatgcaagtgg

SEQ ID NO: 221477 - DNA, 25 bp, Mus musculus
agttctgttctacagaatcccaagt

SEQ ID NO: 221478 - DNA, 25 bp, Mus musculus
agttctgttctagagaatcccaagt

SEQ ID NO: 221479 - DNA, 25 bp, Mus musculus
agttctgttctgcactctacgtcag

SEQ ID NO: 221480 - DNA, 25 bp, Mus musculus
agttctgttctggactctacgtcag

SEQ ID NO: 221481 - DNA, 25 bp, Mus musculus
agttctgttttcagtaaccaagatt

SEQ ID NO: 221482 - DNA, 25 bp, Mus musculus
agttctgttttctgtaaccaagatt

SEQ ID NO: 221483 - DNA, 25 bp, Mus musculus
agttctgtttttcaggctcgcccag

SEQ ID NO: 221484 - DNA, 25 bp, Mus musculus
agttctgtttttccatcgtgacaaa

SEQ ID NO: 221485 - DNA, 25 bp, Mus musculus
agttctgtttttgaggctcgcccag

SEQ ID NO: 221486 - DNA, 25 bp, Mus musculus
agttctgtttttgcatcgtgacaaa

SEQ ID NO: 221487 - DNA, 25 bp, Mus musculus
agttcttaatagaccccaaatctag

SEQ ID NO: 221488 - DNA, 25 bp, Mus musculus
agttcttaatagtccccaaatctag

SEQ ID NO: 221489 - DNA, 25 bp, Mus musculus
agttcttacaagatggccgacattg

SEQ ID NO: 221490 - DNA, 25 bp, Mus musculus
agttcttacaagttggccgacattg

SEQ ID NO: 221491 - DNA, 25 bp, Mus musculus
agttcttacagaaagctcttgggtt

SEQ ID NO: 221492 - DNA, 25 bp, Mus musculus
agttcttacagatagctcttgggtt

SEQ ID NO: 221493 - DNA, 25 bp, Mus musculus
agttcttacagcctcctctgataga

SEQ ID NO: 221494 - DNA, 25 bp, Mus musculus
agttcttacagcgtcctctgataga

SEQ ID NO: 221495 - DNA, 25 bp, Mus musculus
agttcttacattaccttcagcttta

SEQ ID NO: 221496 - DNA, 25 bp, Mus musculus
agttcttacatttccttcagcttta

SEQ ID NO: 221497 - DNA, 25 bp, Mus musculus
agttcttacctgctgacctatcttt

SEQ ID NO: 221498 - DNA, 25 bp, Mus musculus
agttcttacctggtgacctatcttt

SEQ ID NO: 221499 - DNA, 25 bp, Mus musculus
agttcttactccagtgttttagcaa

SEQ ID NO: 221500 - DNA, 25 bp, Mus musculus
agttcttactcctgtgttttagcaa

SEQ ID NO: 221501 - DNA, 25 bp, Mus musculus
agttcttagcacaccccagatctga

SEQ ID NO: 221502 - DNA, 25 bp, Mus musculus
agttcttagcactccccagatctga

SEQ ID NO: 221503 - DNA, 25 bp, Mus musculus
agttcttagcatctgtggtctacaa

SEQ ID NO: 221504 - DNA, 25 bp, Mus musculus
agttcttagcatgtgtggtctacaa

SEQ ID NO: 221505 - DNA, 25 bp, Mus musculus
agttcttagcttagccctttgatgc

SEQ ID NO: 221506 - DNA, 25 bp, Mus musculus
agttcttagctttgccctttgatgc

SEQ ID NO: 221507 - DNA, 25 bp, Mus musculus
agttcttaggcaactccaaagctct

SEQ ID NO: 221508 - DNA, 25 bp, Mus musculus
agttcttaggcatctccaaagctct

SEQ ID NO: 221509 - DNA, 25 bp, Mus musculus
agttcttatggtatggtctgggatc

SEQ ID NO: 221510 - DNA, 25 bp, Mus musculus
agttcttatggtttggtctgggatc

SEQ ID NO: 221511 - DNA, 25 bp, Mus musculus
agttcttattgccatgccgtcacgg

SEQ ID NO: 221512 - DNA, 25 bp, Mus musculus
agttcttattgcgatgccgtcacgg

SEQ ID NO: 221513 - DNA, 25 bp, Mus musculus
agttcttcacctcatagcttctcct

SEQ ID NO: 221514 - DNA, 25 bp, Mus musculus
agttcttcacctgatagcttctcct

SEQ ID NO: 221515 - DNA, 25 bp, Mus musculus
agttcttcagccaaatcaggcgtgg

SEQ ID NO: 221516 - DNA, 25 bp, Mus musculus
agttcttcagcctaatcaggcgtgg

SEQ ID NO: 221517 - DNA, 25 bp, Mus musculus
agttcttcaggaaacacctccttca

SEQ ID NO: 221518 - DNA, 25 bp, Mus musculus
agttcttcaggatacacctccttca

SEQ ID NO: 221519 - DNA, 25 bp, Mus musculus
agttcttcagggaccagggccggca

SEQ ID NO: 221520 - DNA, 25 bp, Mus musculus
agttcttcagggtccagggccggca

SEQ ID NO: 221521 - DNA, 25 bp, Mus musculus
agttcttcatcacattccgatcctg

SEQ ID NO: 221522 - DNA, 25 bp, Mus musculus
agttcttcatcagattccgatcctg

SEQ ID NO: 221523 - DNA, 25 bp, Mus musculus
agttcttcattcactcaagggctat

SEQ ID NO: 221524 - DNA, 25 bp, Mus musculus
agttcttcattctctcaagggctat

SEQ ID NO: 221525 - DNA, 25 bp, Mus musculus
agttcttccaagaattcgcctctgg

SEQ ID NO: 221526 - DNA, 25 bp, Mus musculus
agttcttccaagtattcgcctctgg

SEQ ID NO: 221527 - DNA, 25 bp, Mus musculus
agttcttccacgacgaagtctgcag

SEQ ID NO: 221528 - DNA, 25 bp, Mus musculus
agttcttccacgtcgaagtctgcag

SEQ ID NO: 221529 - DNA, 25 bp, Mus musculus
agttcttccagccagctgctagaga

SEQ ID NO: 221530 - DNA, 25 bp, Mus musculus
agttcttccagcgagctgctagaga

SEQ ID NO: 221531 - DNA, 25 bp, Mus musculus
agttcttccccaaaggctgttgagt

SEQ ID NO: 221532 - DNA, 25 bp, Mus musculus
agttcttccccataggctgttgagt

SEQ ID NO: 221533 - DNA, 25 bp, Mus musculus
agttcttcccgcaatagcacatgaa

SEQ ID NO: 221534 - DNA, 25 bp, Mus musculus
agttcttcccgctatagcacatgaa

SEQ ID NO: 221535 - DNA, 25 bp, Mus musculus
agttcttccctgatcgcattcctct

SEQ ID NO: 221536 - DNA, 25 bp, Mus musculus
agttcttccctgttcgcattcctct

SEQ ID NO: 221537 - DNA, 25 bp, Mus musculus
agttcttcccttcatctcttaagta

SEQ ID NO: 221538 - DNA, 25 bp, Mus musculus
agttcttcccttgatctcttaagta

SEQ ID NO: 221539 - DNA, 25 bp, Mus musculus
agttcttccgtcagtagcccagaga

SEQ ID NO: 221540 - DNA, 25 bp, Mus musculus
agttcttccgtctgtagcccagaga

SEQ ID NO: 221541 - DNA, 25 bp, Mus musculus
agttcttcctcaaagttagctctcc

SEQ ID NO: 221542 - DNA, 25 bp, Mus musculus
agttcttcctcatagttagctctcc

SEQ ID NO: 221543 - DNA, 25 bp, Mus musculus
agttcttcctggatgtgacgcctcg

SEQ ID NO: 221544 - DNA, 25 bp, Mus musculus
agttcttcctggttgtgacgcctcg

SEQ ID NO: 221545 - DNA, 25 bp, Mus musculus
agttcttcgatgcacatgagaacct

SEQ ID NO: 221546 - DNA, 25 bp, Mus musculus
agttcttcgatggacatgagaacct

SEQ ID NO: 221547 - DNA, 25 bp, Mus musculus
agttcttcggaccagggacacgact

SEQ ID NO: 221548 - DNA, 25 bp, Mus musculus
agttcttcggacgagggacacgact

SEQ ID NO: 221549 - DNA, 25 bp, Mus musculus
agttcttcggagagcacctgttgga

SEQ ID NO: 221550 - DNA, 25 bp, Mus musculus
agttcttcggagtgcacctgttgga

SEQ ID NO: 221551 - DNA, 25 bp, Mus musculus
agttcttctcctagagccagagatg

SEQ ID NO: 221552 - DNA, 25 bp, Mus musculus
agttcttctccttgagccagagatg

SEQ ID NO: 221553 - DNA, 25 bp, Mus musculus
agttcttctcggctgataatggacc

SEQ ID NO: 221554 - DNA, 25 bp, Mus musculus
agttcttctcgggtgataatggacc

SEQ ID NO: 221555 - DNA, 25 bp, Mus musculus
agttcttcttagatcagacaactgt

SEQ ID NO: 221556 - DNA, 25 bp, Mus musculus
agttcttcttagttcagacaactgt

SEQ ID NO: 221557 - DNA, 25 bp, Mus musculus
agttcttcttctcttgagttcttta

SEQ ID NO: 221558 - DNA, 25 bp, Mus musculus
agttcttcttctgttgagttcttta

SEQ ID NO: 221559 - DNA, 25 bp, Mus musculus
agttcttgaaaaatcgtgcctcctc

SEQ ID NO: 221560 - DNA, 25 bp, Mus musculus
agttcttgaaaattcgtgcctcctc

SEQ ID NO: 221561 - DNA, 25 bp, Mus musculus
agttcttgaaaccaatcatccccaa

SEQ ID NO: 221562 - DNA, 25 bp, Mus musculus
agttcttgaaacgaatcatccccaa

SEQ ID NO: 221563 - DNA, 25 bp, Mus musculus
agttcttgagtcacctttcagttct

SEQ ID NO: 221564 - DNA, 25 bp, Mus musculus
agttcttgagtctcctttcagttct

SEQ ID NO: 221565 - DNA, 25 bp, Mus musculus
agttcttgagttctcagagggcctc

SEQ ID NO: 221566 - DNA, 25 bp, Mus musculus
agttcttgagttctccacagtaaaa

SEQ ID NO: 221567 - DNA, 25 bp, Mus musculus
agttcttgagttgtcagagggcctc

SEQ ID NO: 221568 - DNA, 25 bp, Mus musculus
agttcttgagttgtccacagtaaaa

SEQ ID NO: 221569 - DNA, 25 bp, Mus musculus
agttcttgatacactaaggcattag

SEQ ID NO: 221570 - DNA, 25 bp, Mus musculus
agttcttgatactctaaggcattag

SEQ ID NO: 221571 - DNA, 25 bp, Mus musculus
agttcttgatagaggttactggtaa

SEQ ID NO: 221572 - DNA, 25 bp, Mus musculus
agttcttgatagtggttactggtaa

SEQ ID NO: 221573 - DNA, 25 bp, Mus musculus
agttcttgatgcatctttaatggga

SEQ ID NO: 221574 - DNA, 25 bp, Mus musculus
agttcttgatgcttctttaatggga

SEQ ID NO: 221575 - DNA, 25 bp, Mus musculus
agttcttgatgtaatccccagtgga

SEQ ID NO: 221576 - DNA, 25 bp, Mus musculus
agttcttgatgttatccccagtgga

SEQ ID NO: 221577 - DNA, 25 bp, Mus musculus
agttcttgctataccatggactgta

SEQ ID NO: 221578 - DNA, 25 bp, Mus musculus
agttcttgctattccatggactgta

SEQ ID NO: 221579 - DNA, 25 bp, Mus musculus
agttcttgctggactcaggctactt

SEQ ID NO: 221580 - DNA, 25 bp, Mus musculus
agttcttgctggtctcaggctactt

SEQ ID NO: 221581 - DNA, 25 bp, Mus musculus
agttcttggcagagcagggccagct

SEQ ID NO: 221582 - DNA, 25 bp, Mus musculus
agttcttggcagtgcagggccagct

SEQ ID NO: 221583 - DNA, 25 bp, Mus musculus
agttcttggccactctcatgtcaca

SEQ ID NO: 221584 - DNA, 25 bp, Mus musculus
agttcttggccagtctcatgtcaca

SEQ ID NO: 221585 - DNA, 25 bp, Mus musculus
agttcttggcttacatattgtttca

SEQ ID NO: 221586 - DNA, 25 bp, Mus musculus
agttcttggctttcatattgtttca

SEQ ID NO: 221587 - DNA, 25 bp, Mus musculus
agttcttggtgtatctcagtctggg

SEQ ID NO: 221588 - DNA, 25 bp, Mus musculus
agttcttggtgtttctcagtctggg

SEQ ID NO: 221589 - DNA, 25 bp, Mus musculus
agttcttgtccaaggctagatagca

SEQ ID NO: 221590 - DNA, 25 bp, Mus musculus
agttcttgtccaagtaatttctgtg

SEQ ID NO: 221591 - DNA, 25 bp, Mus musculus
agttcttgtccatggctagatagca

SEQ ID NO: 221592 - DNA, 25 bp, Mus musculus
agttcttgtccatgtaatttctgtg

SEQ ID NO: 221593 - DNA, 25 bp, Mus musculus
agttcttgtgcacatgttctagaca

SEQ ID NO: 221594 - DNA, 25 bp, Mus musculus
agttcttgtgcagatgttctagaca

SEQ ID NO: 221595 - DNA, 25 bp, Mus musculus
agttcttgtgctctactttgtgcgt

SEQ ID NO: 221596 - DNA, 25 bp, Mus musculus
agttcttgtgctgtactttgtgcgt

SEQ ID NO: 221597 - DNA, 25 bp, Mus musculus
agttcttgttttaagccagtcgctc

SEQ ID NO: 221598 - DNA, 25 bp, Mus musculus
agttcttgtttttagccagtcgctc

SEQ ID NO: 221599 - DNA, 25 bp, Mus musculus
agttctttaatgacattgtcacaag

SEQ ID NO: 221600 - DNA, 25 bp, Mus musculus
agttctttaatgactgtgtattcat

SEQ ID NO: 221601 - DNA, 25 bp, Mus musculus
agttctttaatgtcattgtcacaag

SEQ ID NO: 221602 - DNA, 25 bp, Mus musculus
agttctttaatgtctgtgtattcat

SEQ ID NO: 221603 - DNA, 25 bp, Mus musculus
agttctttacttcagtctggttatc

SEQ ID NO: 221604 - DNA, 25 bp, Mus musculus
agttctttacttgagtctggttatc

SEQ ID NO: 221605 - DNA, 25 bp, Mus musculus
agttctttatctaatttcctctagt

SEQ ID NO: 221606 - DNA, 25 bp, Mus musculus
agttctttatcttatttcctctagt

SEQ ID NO: 221607 - DNA, 25 bp, Mus musculus
agttctttatgccttcctggatgaa

SEQ ID NO: 221608 - DNA, 25 bp, Mus musculus
agttctttatgcgttcctggatgaa

SEQ ID NO: 221609 - DNA, 25 bp, Mus musculus
agttctttattcagatttgcctgca

SEQ ID NO: 221610 - DNA, 25 bp, Mus musculus
agttctttattctgatttgcctgca

SEQ ID NO: 221611 - DNA, 25 bp, Mus musculus
agttctttcattacctgttctatcc

SEQ ID NO: 221612 - DNA, 25 bp, Mus musculus
agttctttcatttcctgttctatcc

SEQ ID NO: 221613 - DNA, 25 bp, Mus musculus
agttctttccatagtagtgccaccg

SEQ ID NO: 221614 - DNA, 25 bp, Mus musculus
agttctttccattgtagtgccaccg

SEQ ID NO: 221615 - DNA, 25 bp, Mus musculus
agttctttcccaagacctagagtga

SEQ ID NO: 221616 - DNA, 25 bp, Mus musculus
agttctttcccatgacctagagtga

SEQ ID NO: 221617 - DNA, 25 bp, Mus musculus
agttctttcctcaattgacttctgc

SEQ ID NO: 221618 - DNA, 25 bp, Mus musculus
agttctttcctctattgacttctgc

SEQ ID NO: 221619 - DNA, 25 bp, Mus musculus
agttctttcggaactccttggacac

SEQ ID NO: 221620 - DNA, 25 bp, Mus musculus
agttctttcggatctccttggacac

SEQ ID NO: 221621 - DNA, 25 bp, Mus musculus
agttctttctcaaatcctctttagc

SEQ ID NO: 221622 - DNA, 25 bp, Mus musculus
agttctttctcaagttcagctctag

SEQ ID NO: 221623 - DNA, 25 bp, Mus musculus
agttctttctcatatcctctttagc

SEQ ID NO: 221624 - DNA, 25 bp, Mus musculus
agttctttctcatgttcagctctag

SEQ ID NO: 221625 - DNA, 25 bp, Mus musculus
agttctttctttaccgtgctctcgt

SEQ ID NO: 221626 - DNA, 25 bp, Mus musculus
agttctttcttttccgtgctctcgt

SEQ ID NO: 221627 - DNA, 25 bp, Mus musculus
agttctttgaacacagcatctgaca

SEQ ID NO: 221628 - DNA, 25 bp, Mus musculus
agttctttgaactcagcatctgaca

SEQ ID NO: 221629 - DNA, 25 bp, Mus musculus
agttctttgacacctcctccagatt

SEQ ID NO: 221630 - DNA, 25 bp, Mus musculus
agttctttgacagctcctccagatt

SEQ ID NO: 221631 - DNA, 25 bp, Mus musculus
agttctttgctactaaccagtcacg

SEQ ID NO: 221632 - DNA, 25 bp, Mus musculus
agttctttgctagtaaccagtcacg

SEQ ID NO: 221633 - DNA, 25 bp, Mus musculus
agttctttgggacgcaaagctgttg

SEQ ID NO: 221634 - DNA, 25 bp, Mus musculus
agttctttgggaggcaaagctgttg

SEQ ID NO: 221635 - DNA, 25 bp, Mus musculus
agttctttggtactgcacaggagca

SEQ ID NO: 221636 - DNA, 25 bp, Mus musculus
agttctttggtagtgcacaggagca

SEQ ID NO: 221637 - DNA, 25 bp, Mus musculus
agttctttggtcatcacaggtagtt

SEQ ID NO: 221638 - DNA, 25 bp, Mus musculus
agttctttggtcttcacaggtagtt

SEQ ID NO: 221639 - DNA, 25 bp, Mus musculus
agttctttgtctaccttcagggaga

SEQ ID NO: 221640 - DNA, 25 bp, Mus musculus
agttctttgtcttccttcagggaga

SEQ ID NO: 221641 - DNA, 25 bp, Mus musculus
agttcttttcataacgtgtaattgc

SEQ ID NO: 221642 - DNA, 25 bp, Mus musculus
agttcttttcattacgtgtaattgc

SEQ ID NO: 221643 - DNA, 25 bp, Mus musculus
agttcttttccacccttttagtctg

SEQ ID NO: 221644 - DNA, 25 bp, Mus musculus
agttcttttccagccttttagtctg

SEQ ID NO: 221645 - DNA, 25 bp, Mus musculus
agttcttttgtacagagtttctcaa

SEQ ID NO: 221646 - DNA, 25 bp, Mus musculus
agttcttttgtagagagtttctcaa

SEQ ID NO: 221647 - DNA, 25 bp, Mus musculus
agttgaaacctcaactcgactttgt

SEQ ID NO: 221648 - DNA, 25 bp, Mus musculus
agttgaaacctctactcgactttgt

SEQ ID NO: 221649 - DNA, 25 bp, Mus musculus
agttgaaatgctcgaggggtacttt

SEQ ID NO: 221650 - DNA, 25 bp, Mus musculus
agttgaaatgctggaggggtacttt

SEQ ID NO: 221651 - DNA, 25 bp, Mus musculus
agttgaacagtgcttctcatggtta

SEQ ID NO: 221652 - DNA, 25 bp, Mus musculus
agttgaacagtggttctcatggtta

SEQ ID NO: 221653 - DNA, 25 bp, Mus musculus
agttgaacatgactccctgcttagc

SEQ ID NO: 221654 - DNA, 25 bp, Mus musculus
agttgaacatgagtccctgcttagc

SEQ ID NO: 221655 - DNA, 25 bp, Mus musculus
agttgaaccgacatccttaactctg

SEQ ID NO: 221656 - DNA, 25 bp, Mus musculus
agttgaaccgacttccttaactctg

SEQ ID NO: 221657 - DNA, 25 bp, Mus musculus
agttgaacctgaaaccttcagctcc

SEQ ID NO: 221658 - DNA, 25 bp, Mus musculus
agttgaacctgataccttcagctcc

SEQ ID NO: 221659 - DNA, 25 bp, Mus musculus
agttgaaccttcctattggtccaca

SEQ ID NO: 221660 - DNA, 25 bp, Mus musculus
agttgaaccttcgtattggtccaca

SEQ ID NO: 221661 - DNA, 25 bp, Mus musculus
agttgaacgtggctctgtggaccta

SEQ ID NO: 221662 - DNA, 25 bp, Mus musculus
agttgaacgtgggtctgtggaccta

SEQ ID NO: 221663 - DNA, 25 bp, Mus musculus
agttgaactctccttattagcccaa

SEQ ID NO: 221664 - DNA, 25 bp, Mus musculus
agttgaactctcgttattagcccaa

SEQ ID NO: 221665 - DNA, 25 bp, Mus musculus
agttgaactgatcttggcacctcac

SEQ ID NO: 221666 - DNA, 25 bp, Mus musculus
agttgaactgatgttggcacctcac

SEQ ID NO: 221667 - DNA, 25 bp, Mus musculus
agttgaagatcactggcctagacct

SEQ ID NO: 221668 - DNA, 25 bp, Mus musculus
agttgaagatcagtggcctagacct

SEQ ID NO: 221669 - DNA, 25 bp, Mus musculus
agttgaagccccaagaactgcagtt

SEQ ID NO: 221670 - DNA, 25 bp, Mus musculus
agttgaagcccctagaactgcagtt

SEQ ID NO: 221671 - DNA, 25 bp, Mus musculus
agttgaagcgtccatacacaataat

SEQ ID NO: 221672 - DNA, 25 bp, Mus musculus
agttgaagcgtcgatacacaataat

SEQ ID NO: 221673 - DNA, 25 bp, Mus musculus
agttgaaggcaacattgccctccgg

SEQ ID NO: 221674 - DNA, 25 bp, Mus musculus
agttgaaggcaagattgccctccgg

SEQ ID NO: 221675 - DNA, 25 bp, Mus musculus
agttgaaggtgccttatcttcccgc

SEQ ID NO: 221676 - DNA, 25 bp, Mus musculus
agttgaaggtgcgttatcttcccgc

SEQ ID NO: 221677 - DNA, 25 bp, Mus musculus
agttgaagtaccagttggtgccaca

SEQ ID NO: 221678 - DNA, 25 bp, Mus musculus
agttgaagtacctgttggtgccaca

SEQ ID NO: 221679 - DNA, 25 bp, Mus musculus
agttgaatagtcaggacgctgccct

SEQ ID NO: 221680 - DNA, 25 bp, Mus musculus
agttgaatagtctggacgctgccct

SEQ ID NO: 221681 - DNA, 25 bp, Mus musculus
agttgaatgcatctccaaatcggga

SEQ ID NO: 221682 - DNA, 25 bp, Mus musculus
agttgaatgcatgtccaaatcggga

SEQ ID NO: 221683 - DNA, 25 bp, Mus musculus
agttgaatggaaagcccaccaggcc

SEQ ID NO: 221684 - DNA, 25 bp, Mus musculus
agttgaatggaatgcccaccaggcc

SEQ ID NO: 221685 - DNA, 25 bp, Mus musculus
agttgaatgttcctagtctaaagat

SEQ ID NO: 221686 - DNA, 25 bp, Mus musculus
agttgaatgttcgtagtctaaagat

SEQ ID NO: 221687 - DNA, 25 bp, Mus musculus
agttgaattgttagcacccctcatc

SEQ ID NO: 221688 - DNA, 25 bp, Mus musculus
agttgaattgtttgcacccctcatc

SEQ ID NO: 221689 - DNA, 25 bp, Mus musculus
agttgacaacagaactcatccctgt

SEQ ID NO: 221690 - DNA, 25 bp, Mus musculus
agttgacaacagtactcatccctgt

SEQ ID NO: 221691 - DNA, 25 bp, Mus musculus
agttgacaacccagatatacctttt

SEQ ID NO: 221692 - DNA, 25 bp, Mus musculus
agttgacaaccctgatatacctttt

SEQ ID NO: 221693 - DNA, 25 bp, Mus musculus
agttgacaatacatcctacctctaa

SEQ ID NO: 221694 - DNA, 25 bp, Mus musculus
agttgacaatacttcctacctctaa

SEQ ID NO: 221695 - DNA, 25 bp, Mus musculus
agttgacaatcaaggctaacaaggg

SEQ ID NO: 221696 - DNA, 25 bp, Mus musculus
agttgacaatcatggctaacaaggg

SEQ ID NO: 221697 - DNA, 25 bp, Mus musculus
agttgacaatgtatccagccctgaa

SEQ ID NO: 221698 - DNA, 25 bp, Mus musculus
agttgacaatgtttccagccctgaa

SEQ ID NO: 221699 - DNA, 25 bp, Mus musculus
agttgacacaggctccagctgacag

SEQ ID NO: 221700 - DNA, 25 bp, Mus musculus
agttgacacagggtccagctgacag

SEQ ID NO: 221701 - DNA, 25 bp, Mus musculus
agttgacactcacttactgtaatga

SEQ ID NO: 221702 - DNA, 25 bp, Mus musculus
agttgacactcagttactgtaatga

SEQ ID NO: 221703 - DNA, 25 bp, Mus musculus
agttgacacttaactttgactcagt

SEQ ID NO: 221704 - DNA, 25 bp, Mus musculus
agttgacacttatctttgactcagt

SEQ ID NO: 221705 - DNA, 25 bp, Mus musculus
agttgacacttgactgtggttccag

SEQ ID NO: 221706 - DNA, 25 bp, Mus musculus
agttgacacttgtctgtggttccag

SEQ ID NO: 221707 - DNA, 25 bp, Mus musculus
agttgacagaacactatcatgcaag

SEQ ID NO: 221708 - DNA, 25 bp, Mus musculus
agttgacagaactctatcatgcaag

SEQ ID NO: 221709 - DNA, 25 bp, Mus musculus
agttgacagatactggtggcacaca

SEQ ID NO: 221710 - DNA, 25 bp, Mus musculus
agttgacagatagtggtggcacaca

SEQ ID NO: 221711 - DNA, 25 bp, Mus musculus
agttgacagctacatgcgacttctc

SEQ ID NO: 221712 - DNA, 25 bp, Mus musculus
agttgacagctagatgcgacttctc

SEQ ID NO: 221713 - DNA, 25 bp, Mus musculus
agttgacagtataacgtagccctac

SEQ ID NO: 221714 - DNA, 25 bp, Mus musculus
agttgacagtattacgtagccctac

SEQ ID NO: 221715 - DNA, 25 bp, Mus musculus
agttgacatactcacacattcctgt

SEQ ID NO: 221716 - DNA, 25 bp, Mus musculus
agttgacatactgacacattcctgt

SEQ ID NO: 221717 - DNA, 25 bp, Mus musculus
agttgacatagacctgcttctgtgt

SEQ ID NO: 221718 - DNA, 25 bp, Mus musculus
agttgacatagagctgcttctgtgt

SEQ ID NO: 221719 - DNA, 25 bp, Mus musculus
agttgacatgacatacgtgcattta

SEQ ID NO: 221720 - DNA, 25 bp, Mus musculus
agttgacatgacttacgtgcattta

SEQ ID NO: 221721 - DNA, 25 bp, Mus musculus
agttgacatggaaccgctcagagcc

SEQ ID NO: 221722 - DNA, 25 bp, Mus musculus
agttgacatggatccgctcagagcc

SEQ ID NO: 221723 - DNA, 25 bp, Mus musculus
agttgacatttcatctttcgagtag

SEQ ID NO: 221724 - DNA, 25 bp, Mus musculus
agttgacatttcttctttcgagtag

SEQ ID NO: 221725 - DNA, 25 bp, Mus musculus
agttgacatttgatcctggtacagt

SEQ ID NO: 221726 - DNA, 25 bp, Mus musculus
agttgacatttgttcctggtacagt

SEQ ID NO: 221727 - DNA, 25 bp, Mus musculus
agttgaccaataagtctgcttcctt

SEQ ID NO: 221728 - DNA, 25 bp, Mus musculus
agttgaccaatatgtctgcttcctt

SEQ ID NO: 221729 - DNA, 25 bp, Mus musculus
agttgaccacgactaccggacacag

SEQ ID NO: 221730 - DNA, 25 bp, Mus musculus
agttgaccacgagtaccggacacag

SEQ ID NO: 221731 - DNA, 25 bp, Mus musculus
agttgacccattcctcctgctatgc

SEQ ID NO: 221732 - DNA, 25 bp, Mus musculus
agttgacccattgctcctgctatgc

SEQ ID NO: 221733 - DNA, 25 bp, Mus musculus
agttgaccccttctatcgagacatg

SEQ ID NO: 221734 - DNA, 25 bp, Mus musculus
agttgaccccttgtatcgagacatg

SEQ ID NO: 221735 - DNA, 25 bp, Mus musculus
agttgacccgatagtgagccccaga

SEQ ID NO: 221736 - DNA, 25 bp, Mus musculus
agttgacccgattgtgagccccaga

SEQ ID NO: 221737 - DNA, 25 bp, Mus musculus
agttgaccctgaatactcaggctcc

SEQ ID NO: 221738 - DNA, 25 bp, Mus musculus
agttgaccctgattactcaggctcc

SEQ ID NO: 221739 - DNA, 25 bp, Mus musculus
agttgaccctttcctctgttaatta

SEQ ID NO: 221740 - DNA, 25 bp, Mus musculus
agttgaccctttgctctgttaatta

SEQ ID NO: 221741 - DNA, 25 bp, Mus musculus
agttgaccgtccaggagtgacaaat

SEQ ID NO: 221742 - DNA, 25 bp, Mus musculus
agttgaccgtcctggagtgacaaat

SEQ ID NO: 221743 - DNA, 25 bp, Mus musculus
agttgaccgtgaatctggccagaac

SEQ ID NO: 221744 - DNA, 25 bp, Mus musculus
agttgaccgtgattctggccagaac

SEQ ID NO: 221745 - DNA, 25 bp, Mus musculus
agttgacctcggcactgtacgcagt

SEQ ID NO: 221746 - DNA, 25 bp, Mus musculus
agttgacctcgggactgtacgcagt

SEQ ID NO: 221747 - DNA, 25 bp, Mus musculus
agttgacctggcagagtcctgcaca

SEQ ID NO: 221748 - DNA, 25 bp, Mus musculus
agttgacctggctgagtcctgcaca

SEQ ID NO: 221749 - DNA, 25 bp, Mus musculus
agttgacctgttctggcagctggaa

SEQ ID NO: 221750 - DNA, 25 bp, Mus musculus
agttgacctgttgtggcagctggaa

SEQ ID NO: 221751 - DNA, 25 bp, Mus musculus
agttgacctttgaggaagccccatc

SEQ ID NO: 221752 - DNA, 25 bp, Mus musculus
agttgacctttgtggaagccccatc

SEQ ID NO: 221753 - DNA, 25 bp, Mus musculus
agttgacgacctaggctgctgtaaa

SEQ ID NO: 221754 - DNA, 25 bp, Mus musculus
agttgacgaccttggctgctgtaaa

SEQ ID NO: 221755 - DNA, 25 bp, Mus musculus
agttgacgatttatcacctacccca

SEQ ID NO: 221756 - DNA, 25 bp, Mus musculus
agttgacgatttttcacctacccca

SEQ ID NO: 221757 - DNA, 25 bp, Mus musculus
agttgacgtgatagctggttcttcc

SEQ ID NO: 221758 - DNA, 25 bp, Mus musculus
agttgacgtgattgctggttcttcc

SEQ ID NO: 221759 - DNA, 25 bp, Mus musculus
agttgactactgaaaaatgtccata

SEQ ID NO: 221760 - DNA, 25 bp, Mus musculus
agttgactactgtaaaatgtccata

SEQ ID NO: 221761 - DNA, 25 bp, Mus musculus
agttgactaggccattgctttgctc

SEQ ID NO: 221762 - DNA, 25 bp, Mus musculus
agttgactaggcgattgctttgctc

SEQ ID NO: 221763 - DNA, 25 bp, Mus musculus
agttgactcaggacgatgcttgcga

SEQ ID NO: 221764 - DNA, 25 bp, Mus musculus
agttgactcaggtcgatgcttgcga

SEQ ID NO: 221765 - DNA, 25 bp, Mus musculus
agttgactgagtatgggctggaata

SEQ ID NO: 221766 - DNA, 25 bp, Mus musculus
agttgactgagtcagtccctatgtt

SEQ ID NO: 221767 - DNA, 25 bp, Mus musculus
agttgactgagtgagtccctatgtt

SEQ ID NO: 221768 - DNA, 25 bp, Mus musculus
agttgactgagtttgggctggaata

SEQ ID NO: 221769 - DNA, 25 bp, Mus musculus
agttgactggtcaggctctgtattc

SEQ ID NO: 221770 - DNA, 25 bp, Mus musculus
agttgactggtctggctctgtattc

SEQ ID NO: 221771 - DNA, 25 bp, Mus musculus
agttgacttggaactgtgcttgcag

SEQ ID NO: 221772 - DNA, 25 bp, Mus musculus
agttgacttggatctgtgcttgcag

SEQ ID NO: 221773 - DNA, 25 bp, Mus musculus
agttgactttctctctttactcagt

SEQ ID NO: 221774 - DNA, 25 bp, Mus musculus
agttgactttctgtctttactcagt

SEQ ID NO: 221775 - DNA, 25 bp, Mus musculus
agttgactttgaaagattctcaaga

SEQ ID NO: 221776 - DNA, 25 bp, Mus musculus
agttgactttgatagattctcaaga

SEQ ID NO: 221777 - DNA, 25 bp, Mus musculus
agttgactttggctccatgggtagc

SEQ ID NO: 221778 - DNA, 25 bp, Mus musculus
agttgactttgggtccatgggtagc

SEQ ID NO: 221779 - DNA, 25 bp, Mus musculus
agttgagaatgtcctgcctggacag

SEQ ID NO: 221780 - DNA, 25 bp, Mus musculus
agttgagaatgtgctgcctggacag

SEQ ID NO: 221781 - DNA, 25 bp, Mus musculus
agttgagacatgactcctctgtgtc

SEQ ID NO: 221782 - DNA, 25 bp, Mus musculus
agttgagacatgtctcctctgtgtc

SEQ ID NO: 221783 - DNA, 25 bp, Mus musculus
agttgagacggactatgcccgctat

SEQ ID NO: 221784 - DNA, 25 bp, Mus musculus
agttgagacggagtatgcccgctat

SEQ ID NO: 221785 - DNA, 25 bp, Mus musculus
agttgagacggtctgcagccctttc

SEQ ID NO: 221786 - DNA, 25 bp, Mus musculus
agttgagacggtgtgcagccctttc

SEQ ID NO: 221787 - DNA, 25 bp, Mus musculus
agttgagactccctgctagggtgta

SEQ ID NO: 221788 - DNA, 25 bp, Mus musculus
agttgagactccgtgctagggtgta

SEQ ID NO: 221789 - DNA, 25 bp, Mus musculus
agttgagatgacagcccacttcaaa

SEQ ID NO: 221790 - DNA, 25 bp, Mus musculus
agttgagatgactgcccacttcaaa

SEQ ID NO: 221791 - DNA, 25 bp, Mus musculus
agttgagcacgcatcccagaggcat

SEQ ID NO: 221792 - DNA, 25 bp, Mus musculus
agttgagcacgcttcccagaggcat

SEQ ID NO: 221793 - DNA, 25 bp, Mus musculus
agttgagcagctagtccgacaggaa

SEQ ID NO: 221794 - DNA, 25 bp, Mus musculus
agttgagcagcttgtccgacaggaa

SEQ ID NO: 221795 - DNA, 25 bp, Mus musculus
agttgagcatccctgacctacaaat

SEQ ID NO: 221796 - DNA, 25 bp, Mus musculus
agttgagcatccgtgacctacaaat

SEQ ID NO: 221797 - DNA, 25 bp, Mus musculus
agttgagcccataaccacggtagtg

SEQ ID NO: 221798 - DNA, 25 bp, Mus musculus
agttgagcccattaccacggtagtg

SEQ ID NO: 221799 - DNA, 25 bp, Mus musculus
agttgagccctcatatattctccca

SEQ ID NO: 221800 - DNA, 25 bp, Mus musculus
agttgagccctcttatattctccca

SEQ ID NO: 221801 - DNA, 25 bp, Mus musculus
agttgaggaacaccagaccctgcct

SEQ ID NO: 221802 - DNA, 25 bp, Mus musculus
agttgaggaacagcagaccctgcct

SEQ ID NO: 221803 - DNA, 25 bp, Mus musculus
agttgaggacacactttggagcttt

SEQ ID NO: 221804 - DNA, 25 bp, Mus musculus
agttgaggacactctttggagcttt

SEQ ID NO: 221805 - DNA, 25 bp, Mus musculus
agttgaggacttcttgctggtctag

SEQ ID NO: 221806 - DNA, 25 bp, Mus musculus
agttgaggacttgttgctggtctag

SEQ ID NO: 221807 - DNA, 25 bp, Mus musculus
agttgaggtcaaatgcacccgatta

SEQ ID NO: 221808 - DNA, 25 bp, Mus musculus
agttgaggtcaattgcacccgatta

SEQ ID NO: 221809 - DNA, 25 bp, Mus musculus
agttgaggttcaagagccctgttaa

SEQ ID NO: 221810 - DNA, 25 bp, Mus musculus
agttgaggttcatgagccctgttaa

SEQ ID NO: 221811 - DNA, 25 bp, Mus musculus
agttgagtactcagcagctatccca

SEQ ID NO: 221812 - DNA, 25 bp, Mus musculus
agttgagtactctgcagctatccca

SEQ ID NO: 221813 - DNA, 25 bp, Mus musculus
agttgagtagctcccctgctttttt

SEQ ID NO: 221814 - DNA, 25 bp, Mus musculus
agttgagtagctgccctgctttttt

SEQ ID NO: 221815 - DNA, 25 bp, Mus musculus
agttgagtcagcactgtgggctcct

SEQ ID NO: 221816 - DNA, 25 bp, Mus musculus
agttgagtcagctctgtgggctcct

SEQ ID NO: 221817 - DNA, 25 bp, Mus musculus
agttgagtgtcccacactcaggcac

SEQ ID NO: 221818 - DNA, 25 bp, Mus musculus
agttgagtgtccgacactcaggcac

SEQ ID NO: 221819 - DNA, 25 bp, Mus musculus
agttgagtgttcaggctgctgtcct

SEQ ID NO: 221820 - DNA, 25 bp, Mus musculus
agttgagtgttctggctgctgtcct

SEQ ID NO: 221821 - DNA, 25 bp, Mus musculus
agttgagttagtcgccagctcccaa

SEQ ID NO: 221822 - DNA, 25 bp, Mus musculus
agttgagttagtggccagctcccaa

SEQ ID NO: 221823 - DNA, 25 bp, Mus musculus
agttgagttccaccatgctggccca

SEQ ID NO: 221824 - DNA, 25 bp, Mus musculus
agttgagttccagcatgctggccca

SEQ ID NO: 221825 - DNA, 25 bp, Mus musculus
agttgagttgatcagttcccttttc

SEQ ID NO: 221826 - DNA, 25 bp, Mus musculus
agttgagttgatgagttcccttttc

SEQ ID NO: 221827 - DNA, 25 bp, Mus musculus
agttgagtttgtcactgggctctgc

SEQ ID NO: 221828 - DNA, 25 bp, Mus musculus
agttgagtttgtgactgggctctgc

SEQ ID NO: 221829 - DNA, 25 bp, Mus musculus
agttgataacccagctccttgggca

SEQ ID NO: 221830 - DNA, 25 bp, Mus musculus
agttgataaccctgctccttgggca

SEQ ID NO: 221831 - DNA, 25 bp, Mus musculus
agttgataactcagaacatgatgtc

SEQ ID NO: 221832 - DNA, 25 bp, Mus musculus
agttgataactctgaacatgatgtc

SEQ ID NO: 221833 - DNA, 25 bp, Mus musculus
agttgatacattacatctgttacct

SEQ ID NO: 221834 - DNA, 25 bp, Mus musculus
agttgatacatttcatctgttacct

SEQ ID NO: 221835 - DNA, 25 bp, Mus musculus
agttgataccatagccagtcccatg

SEQ ID NO: 221836 - DNA, 25 bp, Mus musculus
agttgataccattgccagtcccatg

SEQ ID NO: 221837 - DNA, 25 bp, Mus musculus
agttgatattctactgctcacgtct

SEQ ID NO: 221838 - DNA, 25 bp, Mus musculus
agttgatattcttctgctcacgtct

SEQ ID NO: 221839 - DNA, 25 bp, Mus musculus
agttgatcccagcagccgagtgaag

SEQ ID NO: 221840 - DNA, 25 bp, Mus musculus
agttgatcccaggagccgagtgaag

SEQ ID NO: 221841 - DNA, 25 bp, Mus musculus
agttgatcctgtagtttgctgccat

SEQ ID NO: 221842 - DNA, 25 bp, Mus musculus
agttgatcctgttgtttgctgccat

SEQ ID NO: 221843 - DNA, 25 bp, Mus musculus
agttgatctgccagggagacccgag

SEQ ID NO: 221844 - DNA, 25 bp, Mus musculus
agttgatctgcctgggagacccgag

SEQ ID NO: 221845 - DNA, 25 bp, Mus musculus
agttgatcttgtctaggttgcacaa

SEQ ID NO: 221846 - DNA, 25 bp, Mus musculus
agttgatcttgtgtaggttgcacaa

SEQ ID NO: 221847 - DNA, 25 bp, Mus musculus
agttgatgatttcttcctgagaagt

SEQ ID NO: 221848 - DNA, 25 bp, Mus musculus
agttgatgatttgttcctgagaagt

SEQ ID NO: 221849 - DNA, 25 bp, Mus musculus
agttgatgctgtaaaactctatggc

SEQ ID NO: 221850 - DNA, 25 bp, Mus musculus
agttgatgctgttaaactctatggc

SEQ ID NO: 221851 - DNA, 25 bp, Mus musculus
agttgatgggcaccgtttaagttac

SEQ ID NO: 221852 - DNA, 25 bp, Mus musculus
agttgatgggcagcgtttaagttac

SEQ ID NO: 221853 - DNA, 25 bp, Mus musculus
agttgatgtactcctctactctgcc

SEQ ID NO: 221854 - DNA, 25 bp, Mus musculus
agttgatgtactgctctactctgcc

SEQ ID NO: 221855 - DNA, 25 bp, Mus musculus
agttgatgtgttcccatggtggatt

SEQ ID NO: 221856 - DNA, 25 bp, Mus musculus
agttgatgtgttgccatggtggatt

SEQ ID NO: 221857 - DNA, 25 bp, Mus musculus
agttgatgtttccactcactatctg

SEQ ID NO: 221858 - DNA, 25 bp, Mus musculus
agttgatgtttcgactcactatctg

SEQ ID NO: 221859 - DNA, 25 bp, Mus musculus
agttgattagacacttgttgactca

SEQ ID NO: 221860 - DNA, 25 bp, Mus musculus
agttgattagactcttgttgactca

SEQ ID NO: 221861 - DNA, 25 bp, Mus musculus
agttgattatatctcgatgtctgtg

SEQ ID NO: 221862 - DNA, 25 bp, Mus musculus
agttgattatatgtcgatgtctgtg

SEQ ID NO: 221863 - DNA, 25 bp, Mus musculus
agttgattatctcagctatgctgtg

SEQ ID NO: 221864 - DNA, 25 bp, Mus musculus
agttgattatctcggcgtacaggaa

SEQ ID NO: 221865 - DNA, 25 bp, Mus musculus
agttgattatctgagctatgctgtg

SEQ ID NO: 221866 - DNA, 25 bp, Mus musculus
agttgattatctgggcgtacaggaa

SEQ ID NO: 221867 - DNA, 25 bp, Mus musculus
agttgattccagacgtaactgcatg

SEQ ID NO: 221868 - DNA, 25 bp, Mus musculus
agttgattccagtcgtaactgcatg

SEQ ID NO: 221869 - DNA, 25 bp, Mus musculus
agttgattctctcccctactgtttt

SEQ ID NO: 221870 - DNA, 25 bp, Mus musculus
agttgattctctgccctactgtttt

SEQ ID NO: 221871 - DNA, 25 bp, Mus musculus
agttgattggtcactgttcttgctg

SEQ ID NO: 221872 - DNA, 25 bp, Mus musculus
agttgattggtctctgttcttgctg

SEQ ID NO: 221873 - DNA, 25 bp, Mus musculus
agttgattttccaccgtgaagcaca

SEQ ID NO: 221874 - DNA, 25 bp, Mus musculus
agttgattttcctccgtgaagcaca

SEQ ID NO: 221875 - DNA, 25 bp, Mus musculus
agttgcaaatttcactacactggct

SEQ ID NO: 221876 - DNA, 25 bp, Mus musculus
agttgcaaatttgactacactggct

SEQ ID NO: 221877 - DNA, 25 bp, Mus musculus
agttgcaaccacagatgcctgtgat

SEQ ID NO: 221878 - DNA, 25 bp, Mus musculus
agttgcaaccactgatgcctgtgat

SEQ ID NO: 221879 - DNA, 25 bp, Mus musculus
agttgcaaccctacagctctaagca

SEQ ID NO: 221880 - DNA, 25 bp, Mus musculus
agttgcaacccttcagctctaagca

SEQ ID NO: 221881 - DNA, 25 bp, Mus musculus
agttgcaagcaaaaatcccacccat

SEQ ID NO: 221882 - DNA, 25 bp, Mus musculus
agttgcaagcaataatcccacccat

SEQ ID NO: 221883 - DNA, 25 bp, Mus musculus
agttgcaagctacccagagctactt

SEQ ID NO: 221884 - DNA, 25 bp, Mus musculus
agttgcaagctagccagagctactt

SEQ ID NO: 221885 - DNA, 25 bp, Mus musculus
agttgcaatcgcagctggccggaaa

SEQ ID NO: 221886 - DNA, 25 bp, Mus musculus
agttgcaatcgctgctggccggaaa

SEQ ID NO: 221887 - DNA, 25 bp, Mus musculus
agttgcacaaaacgctaactgcatg

SEQ ID NO: 221888 - DNA, 25 bp, Mus musculus
agttgcacaaaaggctaactgcatg

SEQ ID NO: 221889 - DNA, 25 bp, Mus musculus
agttgcacctcacccctaaaaaatg

SEQ ID NO: 221890 - DNA, 25 bp, Mus musculus
agttgcacctcagccctaaaaaatg

SEQ ID NO: 221891 - DNA, 25 bp, Mus musculus
agttgcacctttcagacacctgctt

SEQ ID NO: 221892 - DNA, 25 bp, Mus musculus
agttgcacctttgagacacctgctt

SEQ ID NO: 221893 - DNA, 25 bp, Mus musculus
agttgcactcccagtcattgaattg

SEQ ID NO: 221894 - DNA, 25 bp, Mus musculus
agttgcactccctgtcattgaattg

SEQ ID NO: 221895 - DNA, 25 bp, Mus musculus
agttgcactttgacaagctctgaga

SEQ ID NO: 221896 - DNA, 25 bp, Mus musculus
agttgcactttgtcaagctctgaga

SEQ ID NO: 221897 - DNA, 25 bp, Mus musculus
agttgcagacacagacgggactgta

SEQ ID NO: 221898 - DNA, 25 bp, Mus musculus
agttgcagacactgacgggactgta

SEQ ID NO: 221899 - DNA, 25 bp, Mus musculus
agttgcagaccgatgtcagtgctgt

SEQ ID NO: 221900 - DNA, 25 bp, Mus musculus
agttgcagaccgttgtcagtgctgt

SEQ ID NO: 221901 - DNA, 25 bp, Mus musculus
agttgcagaggaacagctgctggaa

SEQ ID NO: 221902 - DNA, 25 bp, Mus musculus
agttgcagaggatcagctgctggaa

SEQ ID NO: 221903 - DNA, 25 bp, Mus musculus
agttgcagcaatcacctggaagtgt

SEQ ID NO: 221904 - DNA, 25 bp, Mus musculus
agttgcagcaatgacctggaagtgt

SEQ ID NO: 221905 - DNA, 25 bp, Mus musculus
agttgcagcgatagcaactggcctg

SEQ ID NO: 221906 - DNA, 25 bp, Mus musculus
agttgcagcgattgcaactggcctg

SEQ ID NO: 221907 - DNA, 25 bp, Mus musculus
agttgcaggcacagatgcttctgtg

SEQ ID NO: 221908 - DNA, 25 bp, Mus musculus
agttgcaggcactgatgcttctgtg

SEQ ID NO: 221909 - DNA, 25 bp, Mus musculus
agttgcaggcttccaccaaagaatt

SEQ ID NO: 221910 - DNA, 25 bp, Mus musculus
agttgcaggcttgcaccaaagaatt

SEQ ID NO: 221911 - DNA, 25 bp, Mus musculus
agttgcagggaaactaatcccctct

SEQ ID NO: 221912 - DNA, 25 bp, Mus musculus
agttgcagggaatctaatcccctct

SEQ ID NO: 221913 - DNA, 25 bp, Mus musculus
agttgcagggcaactcataccattt

SEQ ID NO: 221914 - DNA, 25 bp, Mus musculus
agttgcagggcatctcataccattt

SEQ ID NO: 221915 - DNA, 25 bp, Mus musculus
agttgcagggtaaccaacgtcttct

SEQ ID NO: 221916 - DNA, 25 bp, Mus musculus
agttgcagggtatccaacgtcttct

SEQ ID NO: 221917 - DNA, 25 bp, Mus musculus
agttgcagtaggacggttccactcg

SEQ ID NO: 221918 - DNA, 25 bp, Mus musculus
agttgcagtaggtcggttccactcg

SEQ ID NO: 221919 - DNA, 25 bp, Mus musculus
agttgcagttcaatttccacatgga

SEQ ID NO: 221920 - DNA, 25 bp, Mus musculus
agttgcagttcattttccacatgga

SEQ ID NO: 221921 - DNA, 25 bp, Mus musculus
agttgcagtttaacaccccgcagaa

SEQ ID NO: 221922 - DNA, 25 bp, Mus musculus
agttgcagtttatcaccccgcagaa

SEQ ID NO: 221923 - DNA, 25 bp, Mus musculus
agttgcataacgacgggcacatccc

SEQ ID NO: 221924 - DNA, 25 bp, Mus musculus
agttgcataacgtcgggcacatccc

SEQ ID NO: 221925 - DNA, 25 bp, Mus musculus
agttgcataaggacccgtgtttcct

SEQ ID NO: 221926 - DNA, 25 bp, Mus musculus
agttgcataaggtcccgtgtttcct

SEQ ID NO: 221927 - DNA, 25 bp, Mus musculus
agttgcatcaatcaattcacctagc

SEQ ID NO: 221928 - DNA, 25 bp, Mus musculus
agttgcatcaatgaattcacctagc

SEQ ID NO: 221929 - DNA, 25 bp, Mus musculus
agttgcatcagaacagctcctgtgt

SEQ ID NO: 221930 - DNA, 25 bp, Mus musculus
agttgcatcagatcagctcctgtgt

SEQ ID NO: 221931 - DNA, 25 bp, Mus musculus
agttgcatcagtaccttatatgtga

SEQ ID NO: 221932 - DNA, 25 bp, Mus musculus
agttgcatcagttccttatatgtga

SEQ ID NO: 221933 - DNA, 25 bp, Mus musculus
agttgcatccgaagacagctgtttt

SEQ ID NO: 221934 - DNA, 25 bp, Mus musculus
agttgcatccgatgacagctgtttt

SEQ ID NO: 221935 - DNA, 25 bp, Mus musculus
agttgcatggacactgtcaaggact

SEQ ID NO: 221936 - DNA, 25 bp, Mus musculus
agttgcatggactctgtcaaggact

SEQ ID NO: 221937 - DNA, 25 bp, Mus musculus
agttgcattagaaaccaccatccct

SEQ ID NO: 221938 - DNA, 25 bp, Mus musculus
agttgcattagataccaccatccct

SEQ ID NO: 221939 - DNA, 25 bp, Mus musculus
agttgcatttgaccccgcatagatc

SEQ ID NO: 221940 - DNA, 25 bp, Mus musculus
agttgcatttgagcccgcatagatc

SEQ ID NO: 221941 - DNA, 25 bp, Mus musculus
agttgcatttgtcccatgtctctag

SEQ ID NO: 221942 - DNA, 25 bp, Mus musculus
agttgcatttgtgccatgtctctag

SEQ ID NO: 221943 - DNA, 25 bp, Mus musculus
agttgccaaaagacactctcacatg

SEQ ID NO: 221944 - DNA, 25 bp, Mus musculus
agttgccaaaagtcactctcacatg

SEQ ID NO: 221945 - DNA, 25 bp, Mus musculus
agttgccaaacaagcttacccatgc

SEQ ID NO: 221946 - DNA, 25 bp, Mus musculus
agttgccaaacatgcttacccatgc

SEQ ID NO: 221947 - DNA, 25 bp, Mus musculus
agttgccaaactaatccatacatag

SEQ ID NO: 221948 - DNA, 25 bp, Mus musculus
agttgccaaacttatccatacatag

SEQ ID NO: 221949 - DNA, 25 bp, Mus musculus
agttgccaaagaccgaaccccagaa

SEQ ID NO: 221950 - DNA, 25 bp, Mus musculus
agttgccaaagagcgaaccccagaa

SEQ ID NO: 221951 - DNA, 25 bp, Mus musculus
agttgccaaagtcggaggagtcaca

SEQ ID NO: 221952 - DNA, 25 bp, Mus musculus
agttgccaaagtgggaggagtcaca

SEQ ID NO: 221953 - DNA, 25 bp, Mus musculus
agttgccaatctcccttctaaatat

SEQ ID NO: 221954 - DNA, 25 bp, Mus musculus
agttgccaatctgccttctaaatat

SEQ ID NO: 221955 - DNA, 25 bp, Mus musculus
agttgccacctaccaagttcttgtc

SEQ ID NO: 221956 - DNA, 25 bp, Mus musculus
agttgccacctagcaagttcttgtc

SEQ ID NO: 221957 - DNA, 25 bp, Mus musculus
agttgccactagaactatttgctgt

SEQ ID NO: 221958 - DNA, 25 bp, Mus musculus
agttgccactagtactatttgctgt

SEQ ID NO: 221959 - DNA, 25 bp, Mus musculus
agttgccacttaacttgaagctctc

SEQ ID NO: 221960 - DNA, 25 bp, Mus musculus
agttgccacttatcttgaagctctc

SEQ ID NO: 221961 - DNA, 25 bp, Mus musculus
agttgccagaatcccatttctctct

SEQ ID NO: 221962 - DNA, 25 bp, Mus musculus
agttgccagaatgccatttctctct

SEQ ID NO: 221963 - DNA, 25 bp, Mus musculus
agttgccagcatatttttactgagc

SEQ ID NO: 221964 - DNA, 25 bp, Mus musculus
agttgccagcatttttttactgagc

SEQ ID NO: 221965 - DNA, 25 bp, Mus musculus
agttgccagtacctaccgctctgtg

SEQ ID NO: 221966 - DNA, 25 bp, Mus musculus
agttgccagtacgtaccgctctgtg

SEQ ID NO: 221967 - DNA, 25 bp, Mus musculus
agttgccagttgaaccctcagagct

SEQ ID NO: 221968 - DNA, 25 bp, Mus musculus
agttgccagttgtaccctcagagct

SEQ ID NO: 221969 - DNA, 25 bp, Mus musculus
agttgccataccatcgtctgaggag

SEQ ID NO: 221970 - DNA, 25 bp, Mus musculus
agttgccataccttcgtctgaggag

SEQ ID NO: 221971 - DNA, 25 bp, Mus musculus
agttgccatgttccacttggatcca

SEQ ID NO: 221972 - DNA, 25 bp, Mus musculus
agttgccatgttgcacttggatcca

SEQ ID NO: 221973 - DNA, 25 bp, Mus musculus
agttgccattgcacattgctgtcag

SEQ ID NO: 221974 - DNA, 25 bp, Mus musculus
agttgccattgctcattgctgtcag

SEQ ID NO: 221975 - DNA, 25 bp, Mus musculus
agttgcccaacgaactgacctgtac

SEQ ID NO: 221976 - DNA, 25 bp, Mus musculus
agttgcccaacgtactgacctgtac

SEQ ID NO: 221977 - DNA, 25 bp, Mus musculus
agttgcccacacatgtccagactat

SEQ ID NO: 221978 - DNA, 25 bp, Mus musculus
agttgcccacacttgtccagactat

SEQ ID NO: 221979 - DNA, 25 bp, Mus musculus
agttgcccacgtcctccaggtagat

SEQ ID NO: 221980 - DNA, 25 bp, Mus musculus
agttgcccacgtgctccaggtagat

SEQ ID NO: 221981 - DNA, 25 bp, Mus musculus
agttgcccatcaatacattctaaga

SEQ ID NO: 221982 - DNA, 25 bp, Mus musculus
agttgcccatcattacattctaaga

SEQ ID NO: 221983 - DNA, 25 bp, Mus musculus
agttgcccatctcttaaggcacctt

SEQ ID NO: 221984 - DNA, 25 bp, Mus musculus
agttgcccatctgttaaggcacctt

SEQ ID NO: 221985 - DNA, 25 bp, Mus musculus
agttgccccaaacctgtcatcagga

SEQ ID NO: 221986 - DNA, 25 bp, Mus musculus
agttgccccaaagctgtcatcagga

SEQ ID NO: 221987 - DNA, 25 bp, Mus musculus
agttgccccacgatgcaggaccgaa

SEQ ID NO: 221988 - DNA, 25 bp, Mus musculus
agttgccccacgttgcaggaccgaa

SEQ ID NO: 221989 - DNA, 25 bp, Mus musculus
agttgccccattaggccttcgcatg

SEQ ID NO: 221990 - DNA, 25 bp, Mus musculus
agttgccccatttggccttcgcatg

SEQ ID NO: 221991 - DNA, 25 bp, Mus musculus
agttgccccgtcagcctggagggaa

SEQ ID NO: 221992 - DNA, 25 bp, Mus musculus
agttgccccgtctgcctggagggaa

SEQ ID NO: 221993 - DNA, 25 bp, Mus musculus
agttgcccctgtattcattttctgc

SEQ ID NO: 221994 - DNA, 25 bp, Mus musculus
agttgcccctgttttcattttctgc

SEQ ID NO: 221995 - DNA, 25 bp, Mus musculus
agttgcccgtacacgcgagtgcatc

SEQ ID NO: 221996 - DNA, 25 bp, Mus musculus
agttgcccgtactcgcgagtgcatc

SEQ ID NO: 221997 - DNA, 25 bp, Mus musculus
agttgcccgtagatgtttttcctca

SEQ ID NO: 221998 - DNA, 25 bp, Mus musculus
agttgcccgtagatgtttttcttca

SEQ ID NO: 221999 - DNA, 25 bp, Mus musculus
agttgcccgtagttgtttttcctca

SEQ ID NO: 222000 - DNA, 25 bp, Mus musculus
agttgcccgtagttgtttttcttca

SEQ ID NO: 222001 - DNA, 25 bp, Mus musculus
agttgccctcagctttcactagtgg

SEQ ID NO: 222002 - DNA, 25 bp, Mus musculus
agttgccctcaggtttcactagtgg

SEQ ID NO: 222003 - DNA, 25 bp, Mus musculus
agttgccctcggatcgattttctgc

SEQ ID NO: 222004 - DNA, 25 bp, Mus musculus
agttgccctcggttcgattttctgc

SEQ ID NO: 222005 - DNA, 25 bp, Mus musculus
agttgccctctcagtaagatccttc

SEQ ID NO: 222006 - DNA, 25 bp, Mus musculus
agttgccctctctgtaagatccttc

SEQ ID NO: 222007 - DNA, 25 bp, Mus musculus
agttgccctggaatgatggtgccca

SEQ ID NO: 222008 - DNA, 25 bp, Mus musculus
agttgccctggattgatggtgccca

SEQ ID NO: 222009 - DNA, 25 bp, Mus musculus
agttgccctgggatccagaaacaca

SEQ ID NO: 222010 - DNA, 25 bp, Mus musculus
agttgccctgggttccagaaacaca

SEQ ID NO: 222011 - DNA, 25 bp, Mus musculus
agttgccctgttatgttgcatctaa

SEQ ID NO: 222012 - DNA, 25 bp, Mus musculus
agttgccctgttttgttgcatctaa

SEQ ID NO: 222013 - DNA, 25 bp, Mus musculus
agttgcccttgtcccaaaatgtcag

SEQ ID NO: 222014 - DNA, 25 bp, Mus musculus
agttgcccttgtgccaaaatgtcag

SEQ ID NO: 222015 - DNA, 25 bp, Mus musculus
agttgcccttttcagtcccagggtg

SEQ ID NO: 222016 - DNA, 25 bp, Mus musculus
agttgcccttttgagtcccagggtg

SEQ ID NO: 222017 - DNA, 25 bp, Mus musculus
agttgccgaaaaccctatgaagact

SEQ ID NO: 222018 - DNA, 25 bp, Mus musculus
agttgccgaaaagcctatgaagact

SEQ ID NO: 222019 - DNA, 25 bp, Mus musculus
agttgccgagtgatatctgagtcca

SEQ ID NO: 222020 - DNA, 25 bp, Mus musculus
agttgccgagtgttatctgagtcca

SEQ ID NO: 222021 - DNA, 25 bp, Mus musculus
agttgccgcggactgcagctgcaat

SEQ ID NO: 222022 - DNA, 25 bp, Mus musculus
agttgccgcggagtgcagctgcaat

SEQ ID NO: 222023 - DNA, 25 bp, Mus musculus
agttgcctacttcatggctgaatcc

SEQ ID NO: 222024 - DNA, 25 bp, Mus musculus
agttgcctacttgatggctgaatcc

SEQ ID NO: 222025 - DNA, 25 bp, Mus musculus
agttgcctaggcaggtattgagctc

SEQ ID NO: 222026 - DNA, 25 bp, Mus musculus
agttgcctaggctggtattgagctc

SEQ ID NO: 222027 - DNA, 25 bp, Mus musculus
agttgcctatagatcgttctctagg

SEQ ID NO: 222028 - DNA, 25 bp, Mus musculus
agttgcctatagttcgttctctagg

SEQ ID NO: 222029 - DNA, 25 bp, Mus musculus
agttgcctatgtctacaggcaagag

SEQ ID NO: 222030 - DNA, 25 bp, Mus musculus
agttgcctatgtgtacaggcaagag

SEQ ID NO: 222031 - DNA, 25 bp, Mus musculus
agttgcctccagactgacacagaag

SEQ ID NO: 222032 - DNA, 25 bp, Mus musculus
agttgcctccagtctgacacagaag

SEQ ID NO: 222033 - DNA, 25 bp, Mus musculus
agttgcctcgtgcttttagccgctt

SEQ ID NO: 222034 - DNA, 25 bp, Mus musculus
agttgcctcgtggttttagccgctt

SEQ ID NO: 222035 - DNA, 25 bp, Mus musculus
agttgcctctagattcttgtctgga

SEQ ID NO: 222036 - DNA, 25 bp, Mus musculus
agttgcctctagtttcttgtctgga

SEQ ID NO: 222037 - DNA, 25 bp, Mus musculus
agttgcctcttgagcataatttttt

SEQ ID NO: 222038 - DNA, 25 bp, Mus musculus
agttgcctcttgtgcataatttttt

SEQ ID NO: 222039 - DNA, 25 bp, Mus musculus
agttgcctctttagctgttttcctt

SEQ ID NO: 222040 - DNA, 25 bp, Mus musculus
agttgcctcttttgctgttttcctt

SEQ ID NO: 222041 - DNA, 25 bp, Mus musculus
agttgcctgaataccgtggtatgct

SEQ ID NO: 222042 - DNA, 25 bp, Mus musculus
agttgcctgaattccgtggtatgct

SEQ ID NO: 222043 - DNA, 25 bp, Mus musculus
agttgcctgagtaactgacttgtat

SEQ ID NO: 222044 - DNA, 25 bp, Mus musculus
agttgcctgagttactgacttgtat

SEQ ID NO: 222045 - DNA, 25 bp, Mus musculus
agttgcctgcagcatccttggcgga

SEQ ID NO: 222046 - DNA, 25 bp, Mus musculus
agttgcctgcaggatccttggcgga

SEQ ID NO: 222047 - DNA, 25 bp, Mus musculus
agttgcctgcataggagccggtcct

SEQ ID NO: 222048 - DNA, 25 bp, Mus musculus
agttgcctgcattggagccggtcct

SEQ ID NO: 222049 - DNA, 25 bp, Mus musculus
agttgcctgctacagtctgatgttc

SEQ ID NO: 222050 - DNA, 25 bp, Mus musculus
agttgcctgctagagtctgatgttc

SEQ ID NO: 222051 - DNA, 25 bp, Mus musculus
agttgcctggaaacccatagtagca

SEQ ID NO: 222052 - DNA, 25 bp, Mus musculus
agttgcctggaaagtcatttgttag

SEQ ID NO: 222053 - DNA, 25 bp, Mus musculus
agttgcctggaatcccatagtagca

SEQ ID NO: 222054 - DNA, 25 bp, Mus musculus
agttgcctggaatgtcatttgttag

SEQ ID NO: 222055 - DNA, 25 bp, Mus musculus
agttgcctggccatgggacggctcc

SEQ ID NO: 222056 - DNA, 25 bp, Mus musculus
agttgcctggccttgggacggctcc

SEQ ID NO: 222057 - DNA, 25 bp, Mus musculus
agttgcctgggcatagctcagacac

SEQ ID NO: 222058 - DNA, 25 bp, Mus musculus
agttgcctgggcttagctcagacac

SEQ ID NO: 222059 - DNA, 25 bp, Mus musculus
agttgcctgtgtacacagagctcct

SEQ ID NO: 222060 - DNA, 25 bp, Mus musculus
agttgcctgtgttcacagagctcct

SEQ ID NO: 222061 - DNA, 25 bp, Mus musculus
agttgcctgttacctcatcctctaa

SEQ ID NO: 222062 - DNA, 25 bp, Mus musculus
agttgcctgttagctcatcctctaa

SEQ ID NO: 222063 - DNA, 25 bp, Mus musculus
agttgccttagaatattctctctgc

SEQ ID NO: 222064 - DNA, 25 bp, Mus musculus
agttgccttagattattctctctgc

SEQ ID NO: 222065 - DNA, 25 bp, Mus musculus
agttgccttatgatgtgaccctctg

SEQ ID NO: 222066 - DNA, 25 bp, Mus musculus
agttgccttatgttgtgaccctctg

SEQ ID NO: 222067 - DNA, 25 bp, Mus musculus
agttgccttccactaatgcctgtga

SEQ ID NO: 222068 - DNA, 25 bp, Mus musculus
agttgccttccagtaatgcctgtga

SEQ ID NO: 222069 - DNA, 25 bp, Mus musculus
agttgcctttctacacacgtagcaa

SEQ ID NO: 222070 - DNA, 25 bp, Mus musculus
agttgcctttcttcacacgtagcaa

SEQ ID NO: 222071 - DNA, 25 bp, Mus musculus
agttgcgaacttacatccttgctaa

SEQ ID NO: 222072 - DNA, 25 bp, Mus musculus
agttgcgaactttcatccttgctaa

SEQ ID NO: 222073 - DNA, 25 bp, Mus musculus
agttgcgacgtgctcttgccgctgt

SEQ ID NO: 222074 - DNA, 25 bp, Mus musculus
agttgcgacgtggtcttgccgctgt

SEQ ID NO: 222075 - DNA, 25 bp, Mus musculus
agttgcgactgcatcagggcccaac

SEQ ID NO: 222076 - DNA, 25 bp, Mus musculus
agttgcgactgcttcagggcccaac

SEQ ID NO: 222077 - DNA, 25 bp, Mus musculus
agttgcgatggaagcaggcccctgc

SEQ ID NO: 222078 - DNA, 25 bp, Mus musculus
agttgcgatggatgcaggcccctgc

SEQ ID NO: 222079 - DNA, 25 bp, Mus musculus
agttgcgccagccaggaagccttga

SEQ ID NO: 222080 - DNA, 25 bp, Mus musculus
agttgcgccagcgaggaagccttga

SEQ ID NO: 222081 - DNA, 25 bp, Mus musculus
agttgcgcttcaaaccagcctacaa

SEQ ID NO: 222082 - DNA, 25 bp, Mus musculus
agttgcgcttcataccagcctacaa

SEQ ID NO: 222083 - DNA, 25 bp, Mus musculus
agttgcggcatcacagtcctgtaac

SEQ ID NO: 222084 - DNA, 25 bp, Mus musculus
agttgcggcatctcagtcctgtaac

SEQ ID NO: 222085 - DNA, 25 bp, Mus musculus
agttgcggtgccatgcatgtaccag

SEQ ID NO: 222086 - DNA, 25 bp, Mus musculus
agttgcggtgccttgcatgtaccag

SEQ ID NO: 222087 - DNA, 25 bp, Mus musculus
agttgcgtatttattctctgctctg

SEQ ID NO: 222088 - DNA, 25 bp, Mus musculus
agttgcgtattttttctctgctctg

SEQ ID NO: 222089 - DNA, 25 bp, Mus musculus
agttgcgtctgtattgccctgttac

SEQ ID NO: 222090 - DNA, 25 bp, Mus musculus
agttgcgtctgttttgccctgttac

SEQ ID NO: 222091 - DNA, 25 bp, Mus musculus
agttgctaaaacaggtaatggttga

SEQ ID NO: 222092 - DNA, 25 bp, Mus musculus
agttgctaaaactggtaatggttga

SEQ ID NO: 222093 - DNA, 25 bp, Mus musculus
agttgctactctcagtcttcatgaa

SEQ ID NO: 222094 - DNA, 25 bp, Mus musculus
agttgctactctgagtcttcatgaa

SEQ ID NO: 222095 - DNA, 25 bp, Mus musculus
agttgctacttcctttgctgtgttt

SEQ ID NO: 222096 - DNA, 25 bp, Mus musculus
agttgctacttcgtttgctgtgttt

SEQ ID NO: 222097 - DNA, 25 bp, Mus musculus
agttgctactttccactgggtggtc

SEQ ID NO: 222098 - DNA, 25 bp, Mus musculus
agttgctactttgcactgggtggtc

SEQ ID NO: 222099 - DNA, 25 bp, Mus musculus
agttgctaggtactaacatcccatt

SEQ ID NO: 222100 - DNA, 25 bp, Mus musculus
agttgctaggtagtaacatcccatt

SEQ ID NO: 222101 - DNA, 25 bp, Mus musculus
agttgctatgtgcagattatgcaga

SEQ ID NO: 222102 - DNA, 25 bp, Mus musculus
agttgctatgtggagattatgcaga

SEQ ID NO: 222103 - DNA, 25 bp, Mus musculus
agttgctcacatattcatctcttgc

SEQ ID NO: 222104 - DNA, 25 bp, Mus musculus
agttgctcacatctcttggggtcag

SEQ ID NO: 222105 - DNA, 25 bp, Mus musculus
agttgctcacatgtcttggggtcag

SEQ ID NO: 222106 - DNA, 25 bp, Mus musculus
agttgctcacattttcatctcttgc

SEQ ID NO: 222107 - DNA, 25 bp, Mus musculus
agttgctcagtgcacaaggctggat

SEQ ID NO: 222108 - DNA, 25 bp, Mus musculus
agttgctcagtggacaaggctggat

SEQ ID NO: 222109 - DNA, 25 bp, Mus musculus
agttgctcataaaccatgtaccggg

SEQ ID NO: 222110 - DNA, 25 bp, Mus musculus
agttgctcataatccatgtaccggg

SEQ ID NO: 222111 - DNA, 25 bp, Mus musculus
agttgctctaccactcaaagagaag

SEQ ID NO: 222112 - DNA, 25 bp, Mus musculus
agttgctctacctctcaaagagaag

SEQ ID NO: 222113 - DNA, 25 bp, Mus musculus
agttgctctattctatgcctgttag

SEQ ID NO: 222114 - DNA, 25 bp, Mus musculus
agttgctctattgtatgcctgttag

SEQ ID NO: 222115 - DNA, 25 bp, Mus musculus
agttgctctcctccatatttagata

SEQ ID NO: 222116 - DNA, 25 bp, Mus musculus
agttgctctcctgcatatttagata

SEQ ID NO: 222117 - DNA, 25 bp, Mus musculus
agttgctctgtgacaccaacctggg

SEQ ID NO: 222118 - DNA, 25 bp, Mus musculus
agttgctctgtgtcaccaacctggg

SEQ ID NO: 222119 - DNA, 25 bp, Mus musculus
agttgctcttacagcctgtctctaa

SEQ ID NO: 222120 - DNA, 25 bp, Mus musculus
agttgctcttactgcctgtctctaa

SEQ ID NO: 222121 - DNA, 25 bp, Mus musculus
agttgctcttatactcttctaatgg

SEQ ID NO: 222122 - DNA, 25 bp, Mus musculus
agttgctcttattctcttctaatgg

SEQ ID NO: 222123 - DNA, 25 bp, Mus musculus
agttgctcttctccatgagagtcag

SEQ ID NO: 222124 - DNA, 25 bp, Mus musculus
agttgctcttctgcatgagagtcag

SEQ ID NO: 222125 - DNA, 25 bp, Mus musculus
agttgctcttggctggtgtatgatc

SEQ ID NO: 222126 - DNA, 25 bp, Mus musculus
agttgctcttgggtggtgtatgatc

SEQ ID NO: 222127 - DNA, 25 bp, Mus musculus
agttgctgacacaattaaacctcct

SEQ ID NO: 222128 - DNA, 25 bp, Mus musculus
agttgctgacactattaaacctcct

SEQ ID NO: 222129 - DNA, 25 bp, Mus musculus
agttgctgacagagcctctcagagg

SEQ ID NO: 222130 - DNA, 25 bp, Mus musculus
agttgctgacagtgcctctcagagg

SEQ ID NO: 222131 - DNA, 25 bp, Mus musculus
agttgctgccaaagcaccaggacac

SEQ ID NO: 222132 - DNA, 25 bp, Mus musculus
agttgctgccaatgcaccaggacac

SEQ ID NO: 222133 - DNA, 25 bp, Mus musculus
agttgctgccgcatgtcaaatgtct

SEQ ID NO: 222134 - DNA, 25 bp, Mus musculus
agttgctgccgcttgtcaaatgtct

SEQ ID NO: 222135 - DNA, 25 bp, Mus musculus
agttgctggattatagtatggaata

SEQ ID NO: 222136 - DNA, 25 bp, Mus musculus
agttgctggattttagtatggaata

SEQ ID NO: 222137 - DNA, 25 bp, Mus musculus
agttgctggctgctcccaaggaaaa

SEQ ID NO: 222138 - DNA, 25 bp, Mus musculus
agttgctggctggtcccaaggaaaa

SEQ ID NO: 222139 - DNA, 25 bp, Mus musculus
agttgctggcttccacttcgggctt

SEQ ID NO: 222140 - DNA, 25 bp, Mus musculus
agttgctggcttgcacttcgggctt

SEQ ID NO: 222141 - DNA, 25 bp, Mus musculus
agttgctgggatatgtgtcacctca

SEQ ID NO: 222142 - DNA, 25 bp, Mus musculus
agttgctgggatttgtgtcacctca

SEQ ID NO: 222143 - DNA, 25 bp, Mus musculus
agttgctgggcccttctaaaggagc

SEQ ID NO: 222144 - DNA, 25 bp, Mus musculus
agttgctgggccgttctaaaggagc

SEQ ID NO: 222145 - DNA, 25 bp, Mus musculus
agttgctggtgcaaacagcgtctct

SEQ ID NO: 222146 - DNA, 25 bp, Mus musculus
agttgctggtgctaacagcgtctct

SEQ ID NO: 222147 - DNA, 25 bp, Mus musculus
agttgctgtgagaaccaagcctaca

SEQ ID NO: 222148 - DNA, 25 bp, Mus musculus
agttgctgtgagtaccaagcctaca

SEQ ID NO: 222149 - DNA, 25 bp, Mus musculus
agttgctgtgatacttcatttttaa

SEQ ID NO: 222150 - DNA, 25 bp, Mus musculus
agttgctgtgattcttcatttttaa

SEQ ID NO: 222151 - DNA, 25 bp, Mus musculus
agttgctgtgctatttaagtatcca

SEQ ID NO: 222152 - DNA, 25 bp, Mus musculus
agttgctgtgctttttaagtatcca

SEQ ID NO: 222153 - DNA, 25 bp, Mus musculus
agttgctgtttgaaccaacctcgaa

SEQ ID NO: 222154 - DNA, 25 bp, Mus musculus
agttgctgtttgtaccaacctcgaa

SEQ ID NO: 222155 - DNA, 25 bp, Mus musculus
agttgcttcattctaatgtttgcag

SEQ ID NO: 222156 - DNA, 25 bp, Mus musculus
agttgcttcattgtaatgtttgcag

SEQ ID NO: 222157 - DNA, 25 bp, Mus musculus
agttgcttccaaagttctgtgatta

SEQ ID NO: 222158 - DNA, 25 bp, Mus musculus
agttgcttccaatgttctgtgatta

SEQ ID NO: 222159 - DNA, 25 bp, Mus musculus
agttgcttccccaagttgtagtgaa

SEQ ID NO: 222160 - DNA, 25 bp, Mus musculus
agttgcttcccctagttgtagtgaa

SEQ ID NO: 222161 - DNA, 25 bp, Mus musculus
agttgcttcttactctccaggcggt

SEQ ID NO: 222162 - DNA, 25 bp, Mus musculus
agttgcttcttagtctccaggcggt

SEQ ID NO: 222163 - DNA, 25 bp, Mus musculus
agttgcttctttctcatggtgccaa

SEQ ID NO: 222164 - DNA, 25 bp, Mus musculus
agttgcttctttgtcatggtgccaa

SEQ ID NO: 222165 - DNA, 25 bp, Mus musculus
agttgcttgaagcttggatgtccaa

SEQ ID NO: 222166 - DNA, 25 bp, Mus musculus
agttgcttgaaggttggatgtccaa

SEQ ID NO: 222167 - DNA, 25 bp, Mus musculus
agttgcttgggtcctgactacactg

SEQ ID NO: 222168 - DNA, 25 bp, Mus musculus
agttgcttgggtgctgactacactg

SEQ ID NO: 222169 - DNA, 25 bp, Mus musculus
agttgcttgtacagcttctcagtta

SEQ ID NO: 222170 - DNA, 25 bp, Mus musculus
agttgcttgtactgcttctcagtta

SEQ ID NO: 222171 - DNA, 25 bp, Mus musculus
agttgctttcatcactaaatctaat

SEQ ID NO: 222172 - DNA, 25 bp, Mus musculus
agttgctttcatgactaaatctaat

SEQ ID NO: 222173 - DNA, 25 bp, Mus musculus
agttgctttctaacctaggagccac

SEQ ID NO: 222174 - DNA, 25 bp, Mus musculus
agttgctttctatcctaggagccac

SEQ ID NO: 222175 - DNA, 25 bp, Mus musculus
agttgctttctgacttgtacctaca

SEQ ID NO: 222176 - DNA, 25 bp, Mus musculus
agttgctttctgtcttgtacctaca

SEQ ID NO: 222177 - DNA, 25 bp, Mus musculus
agttgctttcttaataatggctcac

SEQ ID NO: 222178 - DNA, 25 bp, Mus musculus
agttgctttctttataatggctcac

SEQ ID NO: 222179 - DNA, 25 bp, Mus musculus
agttgctttgaaccattgctctctc

SEQ ID NO: 222180 - DNA, 25 bp, Mus musculus
agttgctttgaacgacctgtactca

SEQ ID NO: 222181 - DNA, 25 bp, Mus musculus
agttgctttgaagcattgctctctc

SEQ ID NO: 222182 - DNA, 25 bp, Mus musculus
agttgctttgaaggacctgtactca

SEQ ID NO: 222183 - DNA, 25 bp, Mus musculus
agttgctttgccaaggattagaacc

SEQ ID NO: 222184 - DNA, 25 bp, Mus musculus
agttgctttgcctaggattagaacc

SEQ ID NO: 222185 - DNA, 25 bp, Mus musculus
agttgctttgctcagatcctattta

SEQ ID NO: 222186 - DNA, 25 bp, Mus musculus
agttgctttgctgagatcctattta

SEQ ID NO: 222187 - DNA, 25 bp, Mus musculus
agttgctttggtacactgtcatcca

SEQ ID NO: 222188 - DNA, 25 bp, Mus musculus
agttgctttggttcactgtcatcca

SEQ ID NO: 222189 - DNA, 25 bp, Mus musculus
agttgcttttttcccttctttcctg

SEQ ID NO: 222190 - DNA, 25 bp, Mus musculus
agttgcttttttgccttctttcctg

SEQ ID NO: 222191 - DNA, 25 bp, Mus musculus
agttggaaaacaacttagagacgtg

SEQ ID NO: 222192 - DNA, 25 bp, Mus musculus
agttggaaaacatcttagagacgtg

SEQ ID NO: 222193 - DNA, 25 bp, Mus musculus
agttggaaagctctcattaccctct

SEQ ID NO: 222194 - DNA, 25 bp, Mus musculus
agttggaaagctgtcattaccctct

SEQ ID NO: 222195 - DNA, 25 bp, Mus musculus
agttggaaattcactgggcctcagg

SEQ ID NO: 222196 - DNA, 25 bp, Mus musculus
agttggaaattctctgggcctcagg

SEQ ID NO: 222197 - DNA, 25 bp, Mus musculus
agttggaactctatgggcagcctgg

SEQ ID NO: 222198 - DNA, 25 bp, Mus musculus
agttggaactctttgggcagcctgg

SEQ ID NO: 222199 - DNA, 25 bp, Mus musculus
agttggaactgtcgttttccagcct

SEQ ID NO: 222200 - DNA, 25 bp, Mus musculus
agttggaactgtggttttccagcct

SEQ ID NO: 222201 - DNA, 25 bp, Mus musculus
agttggaatcccaggcgtcgtcagg

SEQ ID NO: 222202 - DNA, 25 bp, Mus musculus
agttggaatccctggcgtcgtcagg

SEQ ID NO: 222203 - DNA, 25 bp, Mus musculus
agttggaattggaagctgtgtgatt

SEQ ID NO: 222204 - DNA, 25 bp, Mus musculus
agttggaattggtagctgtgtgatt

SEQ ID NO: 222205 - DNA, 25 bp, Mus musculus
agttggaattttcgcgatactttca

SEQ ID NO: 222206 - DNA, 25 bp, Mus musculus
agttggaattttggcgatactttca

SEQ ID NO: 222207 - DNA, 25 bp, Mus musculus
agttggacacttaaccatctgaccc

SEQ ID NO: 222208 - DNA, 25 bp, Mus musculus
agttggacactttaccatctgaccc

SEQ ID NO: 222209 - DNA, 25 bp, Mus musculus
agttggacagtgcaccatcacgtct

SEQ ID NO: 222210 - DNA, 25 bp, Mus musculus
agttggacagtggaccatcacgtct

SEQ ID NO: 222211 - DNA, 25 bp, Mus musculus
agttggacatccagcggcagcagat

SEQ ID NO: 222212 - DNA, 25 bp, Mus musculus
agttggacatcctgcggcagcagat

SEQ ID NO: 222213 - DNA, 25 bp, Mus musculus
agttggaccctgcattctttgaatc

SEQ ID NO: 222214 - DNA, 25 bp, Mus musculus
agttggaccctggattctttgaatc

SEQ ID NO: 222215 - DNA, 25 bp, Mus musculus
agttggacctgtcccattgctaggt

SEQ ID NO: 222216 - DNA, 25 bp, Mus musculus
agttggacctgtgccattgctaggt

SEQ ID NO: 222217 - DNA, 25 bp, Mus musculus
agttggacgcacagctggatgctta

SEQ ID NO: 222218 - DNA, 25 bp, Mus musculus
agttggacgcactgctggatgctta

SEQ ID NO: 222219 - DNA, 25 bp, Mus musculus
agttggacggctatttattgctttg

SEQ ID NO: 222220 - DNA, 25 bp, Mus musculus
agttggacggctttttattgctttg

SEQ ID NO: 222221 - DNA, 25 bp, Mus musculus
agttggacggtccactgagctcaag

SEQ ID NO: 222222 - DNA, 25 bp, Mus musculus
agttggacggtcgactgagctcaag

SEQ ID NO: 222223 - DNA, 25 bp, Mus musculus
agttggactattcgtcctctctttt

SEQ ID NO: 222224 - DNA, 25 bp, Mus musculus
agttggactattggtcctctctttt

SEQ ID NO: 222225 - DNA, 25 bp, Mus musculus
agttggactcatacagggagctgct

SEQ ID NO: 222226 - DNA, 25 bp, Mus musculus
agttggactcattcagggagctgct

SEQ ID NO: 222227 - DNA, 25 bp, Mus musculus
agttggactgacaatacctgacgaa

SEQ ID NO: 222228 - DNA, 25 bp, Mus musculus
agttggactgactatacctgacgaa

SEQ ID NO: 222229 - DNA, 25 bp, Mus musculus
agttggacttctctttttcatccct

SEQ ID NO: 222230 - DNA, 25 bp, Mus musculus
agttggacttctgtttttcatccct

SEQ ID NO: 222231 - DNA, 25 bp, Mus musculus
agttggagaacccatatcttccaca

SEQ ID NO: 222232 - DNA, 25 bp, Mus musculus
agttggagaaccgatatcttccaca

SEQ ID NO: 222233 - DNA, 25 bp, Mus musculus
agttggagagccatccacagtgacc

SEQ ID NO: 222234 - DNA, 25 bp, Mus musculus
agttggagagccttccacagtgacc

SEQ ID NO: 222235 - DNA, 25 bp, Mus musculus
agttggagatgcaaatgccctcccc

SEQ ID NO: 222236 - DNA, 25 bp, Mus musculus
agttggagatgctaatgccctcccc

SEQ ID NO: 222237 - DNA, 25 bp, Mus musculus
agttggagcactccaaggccctgga

SEQ ID NO: 222238 - DNA, 25 bp, Mus musculus
agttggagcactgcaaggccctgga

SEQ ID NO: 222239 - DNA, 25 bp, Mus musculus
agttggagcagccttcagaccagct

SEQ ID NO: 222240 - DNA, 25 bp, Mus musculus
agttggagcagcgttcagaccagct

SEQ ID NO: 222241 - DNA, 25 bp, Mus musculus
agttggagcctactaactgggcagc

SEQ ID NO: 222242 - DNA, 25 bp, Mus musculus
agttggagcctagtaactgggcagc

SEQ ID NO: 222243 - DNA, 25 bp, Mus musculus
agttggagcgtcaggctttggaccc

SEQ ID NO: 222244 - DNA, 25 bp, Mus musculus
agttggagcgtctggctttggaccc

SEQ ID NO: 222245 - DNA, 25 bp, Mus musculus
agttggagctacaatctgggtgcta

SEQ ID NO: 222246 - DNA, 25 bp, Mus musculus
agttggagctactatctgggtgcta

SEQ ID NO: 222247 - DNA, 25 bp, Mus musculus
agttggaggcccatcccagcaggtc

SEQ ID NO: 222248 - DNA, 25 bp, Mus musculus
agttggaggcccttcccagcaggtc

SEQ ID NO: 222249 - DNA, 25 bp, Mus musculus
agttggagggaaccgctgccacctc

SEQ ID NO: 222250 - DNA, 25 bp, Mus musculus
agttggagggaagcgctgccacctc

SEQ ID NO: 222251 - DNA, 25 bp, Mus musculus
agttggaggttacctctggctacat

SEQ ID NO: 222252 - DNA, 25 bp, Mus musculus
agttggaggttagctctggctacat

SEQ ID NO: 222253 - DNA, 25 bp, Mus musculus
agttggagtcttagagccgctggtt

SEQ ID NO: 222254 - DNA, 25 bp, Mus musculus
agttggagtctttgagccgctggtt

SEQ ID NO: 222255 - DNA, 25 bp, Mus musculus
agttggagtgcccaagccaaagaac

SEQ ID NO: 222256 - DNA, 25 bp, Mus musculus
agttggagtgccgaagccaaagaac

SEQ ID NO: 222257 - DNA, 25 bp, Mus musculus
agttggatctcaaagcttattttgt

SEQ ID NO: 222258 - DNA, 25 bp, Mus musculus
agttggatctcatagcttattttgt

SEQ ID NO: 222259 - DNA, 25 bp, Mus musculus
agttggatgaccattttgtgaccgg

SEQ ID NO: 222260 - DNA, 25 bp, Mus musculus
agttggatgacctttttgtgaccgg

SEQ ID NO: 222261 - DNA, 25 bp, Mus musculus
agttggatgagaacctgcgtgccgt

SEQ ID NO: 222262 - DNA, 25 bp, Mus musculus
agttggatgagatcctgcgtgccgt

SEQ ID NO: 222263 - DNA, 25 bp, Mus musculus
agttggatgatccagaccagagttc

SEQ ID NO: 222264 - DNA, 25 bp, Mus musculus
agttggatgatcgagaccagagttc

SEQ ID NO: 222265 - DNA, 25 bp, Mus musculus
agttggatgcaaacttggaccctcc

SEQ ID NO: 222266 - DNA, 25 bp, Mus musculus
agttggatgcaatcttggaccctcc

SEQ ID NO: 222267 - DNA, 25 bp, Mus musculus
agttggatgcagctgcacactgcat

SEQ ID NO: 222268 - DNA, 25 bp, Mus musculus
agttggatgcaggtgcacactgcat

SEQ ID NO: 222269 - DNA, 25 bp, Mus musculus
agttggatggttacagctggtggca

SEQ ID NO: 222270 - DNA, 25 bp, Mus musculus
agttggatggtttcagctggtggca

SEQ ID NO: 222271 - DNA, 25 bp, Mus musculus
agttggattcttacatttggatggt

SEQ ID NO: 222272 - DNA, 25 bp, Mus musculus
agttggattctttcatttggatggt

SEQ ID NO: 222273 - DNA, 25 bp, Mus musculus
agttggatttctacacaatattaaa

SEQ ID NO: 222274 - DNA, 25 bp, Mus musculus
agttggatttcttcacaatattaaa

SEQ ID NO: 222275 - DNA, 25 bp, Mus musculus
agttggatttgtcgctcatttcctc

SEQ ID NO: 222276 - DNA, 25 bp, Mus musculus
agttggatttgtggctcatttcctc

SEQ ID NO: 222277 - DNA, 25 bp, Mus musculus
agttggcaaatcaggtggttgtcca

SEQ ID NO: 222278 - DNA, 25 bp, Mus musculus
agttggcaaatctggtggttgtcca

SEQ ID NO: 222279 - DNA, 25 bp, Mus musculus
agttggcaactgctggctcttgaga

SEQ ID NO: 222280 - DNA, 25 bp, Mus musculus
agttggcaactggtggctcttgaga

SEQ ID NO: 222281 - DNA, 25 bp, Mus musculus
agttggcacccaagcagactggagt

SEQ ID NO: 222282 - DNA, 25 bp, Mus musculus
agttggcacccatgcagactggagt

SEQ ID NO: 222283 - DNA, 25 bp, Mus musculus
agttggcactacatgggtcccctag

SEQ ID NO: 222284 - DNA, 25 bp, Mus musculus
agttggcactacttgggtcccctag

SEQ ID NO: 222285 - DNA, 25 bp, Mus musculus
agttggcactcaacagctctgagga

SEQ ID NO: 222286 - DNA, 25 bp, Mus musculus
agttggcactcatcagctctgagga

SEQ ID NO: 222287 - DNA, 25 bp, Mus musculus
agttggcagggtacttagcatggtt

SEQ ID NO: 222288 - DNA, 25 bp, Mus musculus
agttggcagggttcttagcatggtt

SEQ ID NO: 222289 - DNA, 25 bp, Mus musculus
agttggcattggatgacctctgtta

SEQ ID NO: 222290 - DNA, 25 bp, Mus musculus
agttggcattggttgacctctgtta

SEQ ID NO: 222291 - DNA, 25 bp, Mus musculus
agttggcatttgattgaaattgtat

SEQ ID NO: 222292 - DNA, 25 bp, Mus musculus
agttggcatttgtttgaaattgtat

SEQ ID NO: 222293 - DNA, 25 bp, Mus musculus
agttggccactgaggagtttcttcc

SEQ ID NO: 222294 - DNA, 25 bp, Mus musculus
agttggccactgtggagtttcttcc

SEQ ID NO: 222295 - DNA, 25 bp, Mus musculus
agttggccagatacatcttttctat

SEQ ID NO: 222296 - DNA, 25 bp, Mus musculus
agttggccagattcatcttttctat

SEQ ID NO: 222297 - DNA, 25 bp, Mus musculus
agttggccagcaaggcctaagttcc

SEQ ID NO: 222298 - DNA, 25 bp, Mus musculus
agttggccagcatggcctaagttcc

SEQ ID NO: 222299 - DNA, 25 bp, Mus musculus
agttggccatatatacctcagcctg

SEQ ID NO: 222300 - DNA, 25 bp, Mus musculus
agttggccatatcgtttgcagccct

SEQ ID NO: 222301 - DNA, 25 bp, Mus musculus
agttggccatatggtttgcagccct

SEQ ID NO: 222302 - DNA, 25 bp, Mus musculus
agttggccatatttacctcagcctg

SEQ ID NO: 222303 - DNA, 25 bp, Mus musculus
agttggccatctatagctaccctgt

SEQ ID NO: 222304 - DNA, 25 bp, Mus musculus
agttggccatctttagctaccctgt

SEQ ID NO: 222305 - DNA, 25 bp, Mus musculus
agttggccccagcactctaccttag

SEQ ID NO: 222306 - DNA, 25 bp, Mus musculus
agttggccccaggactctaccttag

SEQ ID NO: 222307 - DNA, 25 bp, Mus musculus
agttggccctttcagtgtgaggctc

SEQ ID NO: 222308 - DNA, 25 bp, Mus musculus
agttggccctttcgctttattagct

SEQ ID NO: 222309 - DNA, 25 bp, Mus musculus
agttggccctttgagtgtgaggctc

SEQ ID NO: 222310 - DNA, 25 bp, Mus musculus
agttggccctttggctttattagct

SEQ ID NO: 222311 - DNA, 25 bp, Mus musculus
agttggccgggaaagacactcctgt

SEQ ID NO: 222312 - DNA, 25 bp, Mus musculus
agttggccgggatagacactcctgt

SEQ ID NO: 222313 - DNA, 25 bp, Mus musculus
agttggcctctgctgtgtagtgaaa

SEQ ID NO: 222314 - DNA, 25 bp, Mus musculus
agttggcctctggtgtgtagtgaaa

SEQ ID NO: 222315 - DNA, 25 bp, Mus musculus
agttggcctgccacaaacactggtc

SEQ ID NO: 222316 - DNA, 25 bp, Mus musculus
agttggcctgcctcaaacactggtc

SEQ ID NO: 222317 - DNA, 25 bp, Mus musculus
agttggcctgtgaagcatttgctgc

SEQ ID NO: 222318 - DNA, 25 bp, Mus musculus
agttggcctgtgtagcatttgctgc

SEQ ID NO: 222319 - DNA, 25 bp, Mus musculus
agttggccttacagggtttgactgc

SEQ ID NO: 222320 - DNA, 25 bp, Mus musculus
agttggccttactgggtttgactgc

SEQ ID NO: 222321 - DNA, 25 bp, Mus musculus
agttggcgacttagactgtcagcgg

SEQ ID NO: 222322 - DNA, 25 bp, Mus musculus
agttggcgactttgactgtcagcgg

SEQ ID NO: 222323 - DNA, 25 bp, Mus musculus
agttggcggatgactcagagtccct

SEQ ID NO: 222324 - DNA, 25 bp, Mus musculus
agttggcggatgtctcagagtccct

SEQ ID NO: 222325 - DNA, 25 bp, Mus musculus
agttggctaaagacgccctgtggca

SEQ ID NO: 222326 - DNA, 25 bp, Mus musculus
agttggctaaagtcgccctgtggca

SEQ ID NO: 222327 - DNA, 25 bp, Mus musculus
agttggctcactagacaatgctcac

SEQ ID NO: 222328 - DNA, 25 bp, Mus musculus
agttggctcacttgacaatgctcac

SEQ ID NO: 222329 - DNA, 25 bp, Mus musculus
agttggctcctgaatggttgttttc

SEQ ID NO: 222330 - DNA, 25 bp, Mus musculus
agttggctcctgtatggttgttttc

SEQ ID NO: 222331 - DNA, 25 bp, Mus musculus
agttggctctatatgttgctgactc

SEQ ID NO: 222332 - DNA, 25 bp, Mus musculus
agttggctctatttgttgctgactc

SEQ ID NO: 222333 - DNA, 25 bp, Mus musculus
agttggctctctccatcactaacct

SEQ ID NO: 222334 - DNA, 25 bp, Mus musculus
agttggctctctgcatcactaacct

SEQ ID NO: 222335 - DNA, 25 bp, Mus musculus
agttggctgactcagggcacctgct

SEQ ID NO: 222336 - DNA, 25 bp, Mus musculus
agttggctgactgagggcacctgct

SEQ ID NO: 222337 - DNA, 25 bp, Mus musculus
agttggctgatgatcttcagtccgg

SEQ ID NO: 222338 - DNA, 25 bp, Mus musculus
agttggctgatgttcttcagtccgg

SEQ ID NO: 222339 - DNA, 25 bp, Mus musculus
agttggctgcaaccctaatcagttg

SEQ ID NO: 222340 - DNA, 25 bp, Mus musculus
agttggctgcaagcctaatcagttg

SEQ ID NO: 222341 - DNA, 25 bp, Mus musculus
agttggctgtctcgctctgatgagc

SEQ ID NO: 222342 - DNA, 25 bp, Mus musculus
agttggctgtctggctctgatgagc

SEQ ID NO: 222343 - DNA, 25 bp, Mus musculus
agttggcttagacccacatgttgaa

SEQ ID NO: 222344 - DNA, 25 bp, Mus musculus
agttggcttagagccacatgttgaa

SEQ ID NO: 222345 - DNA, 25 bp, Mus musculus
agttggcttatcataatgcggttat

SEQ ID NO: 222346 - DNA, 25 bp, Mus musculus
agttggcttatcttaatgcggttat

SEQ ID NO: 222347 - DNA, 25 bp, Mus musculus
agttggcttgccaagcaggctccag

SEQ ID NO: 222348 - DNA, 25 bp, Mus musculus
agttggcttgcctagcaggctccag

SEQ ID NO: 222349 - DNA, 25 bp, Mus musculus
agttggcttttcctaactatgacca

SEQ ID NO: 222350 - DNA, 25 bp, Mus musculus
agttggcttttcgtaactatgacca

SEQ ID NO: 222351 - DNA, 25 bp, Mus musculus
agttgggaaaccagagccttataga

SEQ ID NO: 222352 - DNA, 25 bp, Mus musculus
agttgggaaacctgagccttataga

SEQ ID NO: 222353 - DNA, 25 bp, Mus musculus
agttgggaacccatgtcctgaagct

SEQ ID NO: 222354 - DNA, 25 bp, Mus musculus
agttgggaacccttgtcctgaagct

SEQ ID NO: 222355 - DNA, 25 bp, Mus musculus
agttgggaagaaccgagtcctctgt

SEQ ID NO: 222356 - DNA, 25 bp, Mus musculus
agttgggaagaagcgagtcctctgt

SEQ ID NO: 222357 - DNA, 25 bp, Mus musculus
agttgggacaccatgggtggcggct

SEQ ID NO: 222358 - DNA, 25 bp, Mus musculus
agttgggacaccttgggtggcggct

SEQ ID NO: 222359 - DNA, 25 bp, Mus musculus
agttgggaccctagtgggcatccgc

SEQ ID NO: 222360 - DNA, 25 bp, Mus musculus
agttgggacccttgtgggcatccgc

SEQ ID NO: 222361 - DNA, 25 bp, Mus musculus
agttgggactctcggcatttgccac

SEQ ID NO: 222362 - DNA, 25 bp, Mus musculus
agttgggactctgggcatttgccac

SEQ ID NO: 222363 - DNA, 25 bp, Mus musculus
agttgggactgcacactgagaccct

SEQ ID NO: 222364 - DNA, 25 bp, Mus musculus
agttgggactgctcactgagaccct

SEQ ID NO: 222365 - DNA, 25 bp, Mus musculus
agttgggacttcaacagactggttg

SEQ ID NO: 222366 - DNA, 25 bp, Mus musculus
agttgggacttctacagactggttg

SEQ ID NO: 222367 - DNA, 25 bp, Mus musculus
agttgggagatgagcacatgaggat

SEQ ID NO: 222368 - DNA, 25 bp, Mus musculus
agttgggagatgtgcacatgaggat

SEQ ID NO: 222369 - DNA, 25 bp, Mus musculus
agttgggagcccctagccctccagt

SEQ ID NO: 222370 - DNA, 25 bp, Mus musculus
agttgggagcccgtagccctccagt

SEQ ID NO: 222371 - DNA, 25 bp, Mus musculus
agttgggagccgcactctacacttt

SEQ ID NO: 222372 - DNA, 25 bp, Mus musculus
agttgggagccggactctacacttt

SEQ ID NO: 222373 - DNA, 25 bp, Mus musculus
agttgggagcgccatgcttttgata

SEQ ID NO: 222374 - DNA, 25 bp, Mus musculus
agttgggagcgcgatgcttttgata

SEQ ID NO: 222375 - DNA, 25 bp, Mus musculus
agttgggatagcaggattcctcatc

SEQ ID NO: 222376 - DNA, 25 bp, Mus musculus
agttgggatagctggattcctcatc

SEQ ID NO: 222377 - DNA, 25 bp, Mus musculus
agttgggatcagaatctagccggcc

SEQ ID NO: 222378 - DNA, 25 bp, Mus musculus
agttgggatcagtatctagccggcc

SEQ ID NO: 222379 - DNA, 25 bp, Mus musculus
agttgggatctgactcctcaggtca

SEQ ID NO: 222380 - DNA, 25 bp, Mus musculus
agttgggatctgtctcctcaggtca

SEQ ID NO: 222381 - DNA, 25 bp, Mus musculus
agttgggcaataaaaccgatgtttt

SEQ ID NO: 222382 - DNA, 25 bp, Mus musculus
agttgggcaatataaccgatgtttt

SEQ ID NO: 222383 - DNA, 25 bp, Mus musculus
agttgggcacccatggtccagggct

SEQ ID NO: 222384 - DNA, 25 bp, Mus musculus
agttgggcacccttggtccagggct

SEQ ID NO: 222385 - DNA, 25 bp, Mus musculus
agttgggcagacatccagctcctag

SEQ ID NO: 222386 - DNA, 25 bp, Mus musculus
agttgggcagacttccagctcctag

SEQ ID NO: 222387 - DNA, 25 bp, Mus musculus
agttgggcagcaccctctcacagag

SEQ ID NO: 222388 - DNA, 25 bp, Mus musculus
agttgggcagcagcctctcacagag

SEQ ID NO: 222389 - DNA, 25 bp, Mus musculus
agttgggcagtactagtgcatgcct

SEQ ID NO: 222390 - DNA, 25 bp, Mus musculus
agttgggcagtagtagtgcatgcct

SEQ ID NO: 222391 - DNA, 25 bp, Mus musculus
agttgggcagtgacgtctttctgtc

SEQ ID NO: 222392 - DNA, 25 bp, Mus musculus
agttgggcagtgtcgtctttctgtc

SEQ ID NO: 222393 - DNA, 25 bp, Mus musculus
agttgggcatcactgccctgcacat

SEQ ID NO: 222394 - DNA, 25 bp, Mus musculus
agttgggcatcagtgccctgcacat

SEQ ID NO: 222395 - DNA, 25 bp, Mus musculus
agttgggccaggatagctctatcaa

SEQ ID NO: 222396 - DNA, 25 bp, Mus musculus
agttgggccaggttagctctatcaa

SEQ ID NO: 222397 - DNA, 25 bp, Mus musculus
agttgggcctggaaaatcatgccgt

SEQ ID NO: 222398 - DNA, 25 bp, Mus musculus
agttgggcctggtaaatcatgccgt

SEQ ID NO: 222399 - DNA, 25 bp, Mus musculus
agttgggcctttagcgagccgagac

SEQ ID NO: 222400 - DNA, 25 bp, Mus musculus
agttgggccttttgcgagccgagac

SEQ ID NO: 222401 - DNA, 25 bp, Mus musculus
agttgggctcctcttaattctcgca

SEQ ID NO: 222402 - DNA, 25 bp, Mus musculus
agttgggctcctgttaattctcgca

SEQ ID NO: 222403 - DNA, 25 bp, Mus musculus
agttgggtatgtctagttcttgcta

SEQ ID NO: 222404 - DNA, 25 bp, Mus musculus
agttgggtatgtgtagttcttgcta

SEQ ID NO: 222405 - DNA, 25 bp, Mus musculus
agttgggtcaaacccttatccccag

SEQ ID NO: 222406 - DNA, 25 bp, Mus musculus
agttgggtcaaagccttatccccag

SEQ ID NO: 222407 - DNA, 25 bp, Mus musculus
agttgggtcaacaaacctgccttga

SEQ ID NO: 222408 - DNA, 25 bp, Mus musculus
agttgggtcaactaacctgccttga

SEQ ID NO: 222409 - DNA, 25 bp, Mus musculus
agttgggtcaccagaactggagttt

SEQ ID NO: 222410 - DNA, 25 bp, Mus musculus
agttgggtcacctgaactggagttt

SEQ ID NO: 222411 - DNA, 25 bp, Mus musculus
agttgggtccaacttgcatcctttg

SEQ ID NO: 222412 - DNA, 25 bp, Mus musculus
agttgggtccaagttgcatcctttg

SEQ ID NO: 222413 - DNA, 25 bp, Mus musculus
agttgggtgtacatctggctatgtc

SEQ ID NO: 222414 - DNA, 25 bp, Mus musculus
agttgggtgtacttctggctatgtc

SEQ ID NO: 222415 - DNA, 25 bp, Mus musculus
agttgggttcccagcagaggccagc

SEQ ID NO: 222416 - DNA, 25 bp, Mus musculus
agttgggttccctgcagaggccagc

SEQ ID NO: 222417 - DNA, 25 bp, Mus musculus
agttggtacactcggcgcccacgag

SEQ ID NO: 222418 - DNA, 25 bp, Mus musculus
agttggtacactgggcgcccacgag

SEQ ID NO: 222419 - DNA, 25 bp, Mus musculus
agttggtacagtccctgcctagaat

SEQ ID NO: 222420 - DNA, 25 bp, Mus musculus
agttggtacagtgcctgcctagaat

SEQ ID NO: 222421 - DNA, 25 bp, Mus musculus
agttggtaccagctgatggctcaca

SEQ ID NO: 222422 - DNA, 25 bp, Mus musculus
agttggtaccaggtgatggctcaca

SEQ ID NO: 222423 - DNA, 25 bp, Mus musculus
agttggtagcggagtctgagggaga

SEQ ID NO: 222424 - DNA, 25 bp, Mus musculus
agttggtagcggtgtctgagggaga

SEQ ID NO: 222425 - DNA, 25 bp, Mus musculus
agttggtagtaccactagccccagg

SEQ ID NO: 222426 - DNA, 25 bp, Mus musculus
agttggtagtacgactagccccagg

SEQ ID NO: 222427 - DNA, 25 bp, Mus musculus
agttggtagtccaggccagtgctaa

SEQ ID NO: 222428 - DNA, 25 bp, Mus musculus
agttggtagtcctggccagtgctaa

SEQ ID NO: 222429 - DNA, 25 bp, Mus musculus
agttggtataagctctgctctctcc

SEQ ID NO: 222430 - DNA, 25 bp, Mus musculus
agttggtataaggtctgctctctcc

SEQ ID NO: 222431 - DNA, 25 bp, Mus musculus
agttggtataccactggatctcctt

SEQ ID NO: 222432 - DNA, 25 bp, Mus musculus
agttggtatacctctggatctcctt

SEQ ID NO: 222433 - DNA, 25 bp, Mus musculus
agttggtatgtcacatttgcctgga

SEQ ID NO: 222434 - DNA, 25 bp, Mus musculus
agttggtatgtctcatttgcctgga

SEQ ID NO: 222435 - DNA, 25 bp, Mus musculus
agttggtatgttatgttagtgctca

SEQ ID NO: 222436 - DNA, 25 bp, Mus musculus
agttggtatgttttgttagtgctca

SEQ ID NO: 222437 - DNA, 25 bp, Mus musculus
agttggtcaagcaccagagacgccg

SEQ ID NO: 222438 - DNA, 25 bp, Mus musculus
agttggtcaagctccagagacgccg

SEQ ID NO: 222439 - DNA, 25 bp, Mus musculus
agttggtcagggatacactgccttt

SEQ ID NO: 222440 - DNA, 25 bp, Mus musculus
agttggtcagggttacactgccttt

SEQ ID NO: 222441 - DNA, 25 bp, Mus musculus
agttggtcccagaatgtcactttaa

SEQ ID NO: 222442 - DNA, 25 bp, Mus musculus
agttggtcccagtatgtcactttaa

SEQ ID NO: 222443 - DNA, 25 bp, Mus musculus
agttggtcctcaagattgtagtcag

SEQ ID NO: 222444 - DNA, 25 bp, Mus musculus
agttggtcctcatgattgtagtcag

SEQ ID NO: 222445 - DNA, 25 bp, Mus musculus
agttggtccttcatggcctgctgct

SEQ ID NO: 222446 - DNA, 25 bp, Mus musculus
agttggtccttcttggcctgctgct

SEQ ID NO: 222447 - DNA, 25 bp, Mus musculus
agttggtctacgcatccatcgaagt

SEQ ID NO: 222448 - DNA, 25 bp, Mus musculus
agttggtctacggatccatcgaagt

SEQ ID NO: 222449 - DNA, 25 bp, Mus musculus
agttggtctcacaggtcttgtgtgc

SEQ ID NO: 222450 - DNA, 25 bp, Mus musculus
agttggtctcactggtcttgtgtgc

SEQ ID NO: 222451 - DNA, 25 bp, Mus musculus
agttggtgacagctaaccccagcat

SEQ ID NO: 222452 - DNA, 25 bp, Mus musculus
agttggtgacaggtaaccccagcat

SEQ ID NO: 222453 - DNA, 25 bp, Mus musculus
agttggtgcagactaacgcgctcac

SEQ ID NO: 222454 - DNA, 25 bp, Mus musculus
agttggtgcagagtaacgcgctcac

SEQ ID NO: 222455 - DNA, 25 bp, Mus musculus
agttggtggatcacgattgctctca

SEQ ID NO: 222456 - DNA, 25 bp, Mus musculus
agttggtggatctcgattgctctca

SEQ ID NO: 222457 - DNA, 25 bp, Mus musculus
agttggtggtatagctttggattat

SEQ ID NO: 222458 - DNA, 25 bp, Mus musculus
agttggtggtattgctttggattat

SEQ ID NO: 222459 - DNA, 25 bp, Mus musculus
agttggtgtcagctctgtactacct

SEQ ID NO: 222460 - DNA, 25 bp, Mus musculus
agttggtgtcagcttgctcaggacc

SEQ ID NO: 222461 - DNA, 25 bp, Mus musculus
agttggtgtcaggtctgtactacct

SEQ ID NO: 222462 - DNA, 25 bp, Mus musculus
agttggtgtcaggttgctcaggacc

SEQ ID NO: 222463 - DNA, 25 bp, Mus musculus
agttggtgtccaagttgtctttctc

SEQ ID NO: 222464 - DNA, 25 bp, Mus musculus
agttggtgtccatgttgtctttctc

SEQ ID NO: 222465 - DNA, 25 bp, Mus musculus
agttggtgtcccagggtcacttcta

SEQ ID NO: 222466 - DNA, 25 bp, Mus musculus
agttggtgtccctgggtcacttcta

SEQ ID NO: 222467 - DNA, 25 bp, Mus musculus
agttggtgtcttatgaggacgtcac

SEQ ID NO: 222468 - DNA, 25 bp, Mus musculus
agttggtgtcttttgaggacgtcac

SEQ ID NO: 222469 - DNA, 25 bp, Mus musculus
agttggtgtgatatgcagcctggta

SEQ ID NO: 222470 - DNA, 25 bp, Mus musculus
agttggtgtgatttgcagcctggta

SEQ ID NO: 222471 - DNA, 25 bp, Mus musculus
agttggtgtgcgatactacgagaca

SEQ ID NO: 222472 - DNA, 25 bp, Mus musculus
agttggtgtgcgttactacgagaca

SEQ ID NO: 222473 - DNA, 25 bp, Mus musculus
agttggtgtggacactagccctcgt

SEQ ID NO: 222474 - DNA, 25 bp, Mus musculus
agttggtgtggagactagccctcgt

SEQ ID NO: 222475 - DNA, 25 bp, Mus musculus
agttggttagtcaagccttatgctc

SEQ ID NO: 222476 - DNA, 25 bp, Mus musculus
agttggttagtctagccttatgctc

SEQ ID NO: 222477 - DNA, 25 bp, Mus musculus
agttggttcaggcaccatgcagagt

SEQ ID NO: 222478 - DNA, 25 bp, Mus musculus
agttggttcagggaccatgcagagt

SEQ ID NO: 222479 - DNA, 25 bp, Mus musculus
agttggttcataagggcagccccag

SEQ ID NO: 222480 - DNA, 25 bp, Mus musculus
agttggttcatatgggcagccccag

SEQ ID NO: 222481 - DNA, 25 bp, Mus musculus
agttggttcatgctgttggtcctcc

SEQ ID NO: 222482 - DNA, 25 bp, Mus musculus
agttggttcatggtgttggtcctcc

SEQ ID NO: 222483 - DNA, 25 bp, Mus musculus
agttggttccttatcccatcattgc

SEQ ID NO: 222484 - DNA, 25 bp, Mus musculus
agttggttccttttcccatcattgc

SEQ ID NO: 222485 - DNA, 25 bp, Mus musculus
agttggttctctctatttcatttca

SEQ ID NO: 222486 - DNA, 25 bp, Mus musculus
agttggttctctgtatttcatttca

SEQ ID NO: 222487 - DNA, 25 bp, Mus musculus
agttggttgaccatgacgcttgttc

SEQ ID NO: 222488 - DNA, 25 bp, Mus musculus
agttggttgaccatgctccagtgga

SEQ ID NO: 222489 - DNA, 25 bp, Mus musculus
agttggttgaccttgacgcttgttc

SEQ ID NO: 222490 - DNA, 25 bp, Mus musculus
agttggttgaccttgctccagtgga

SEQ ID NO: 222491 - DNA, 25 bp, Mus musculus
agttggtttgccatctgcctcatgt

SEQ ID NO: 222492 - DNA, 25 bp, Mus musculus
agttggtttgccttctgcctcatgt

SEQ ID NO: 222493 - DNA, 25 bp, Mus musculus
agttggtttgctccagttgtgccta

SEQ ID NO: 222494 - DNA, 25 bp, Mus musculus
agttggtttgctgcagttgtgccta

SEQ ID NO: 222495 - DNA, 25 bp, Mus musculus
agttggttttaaacgtcatgaagtg

SEQ ID NO: 222496 - DNA, 25 bp, Mus musculus
agttggttttaatcgtcatgaagtg

SEQ ID NO: 222497 - DNA, 25 bp, Mus musculus
agttggttttccacttgctagttag

SEQ ID NO: 222498 - DNA, 25 bp, Mus musculus
agttggttttcctcttgctagttag

SEQ ID NO: 222499 - DNA, 25 bp, Mus musculus
agttggttttcgatcttgtgtgtca

SEQ ID NO: 222500 - DNA, 25 bp, Mus musculus
agttggttttcgttcttgtgtgtca

SEQ ID NO: 222501 - DNA, 25 bp, Mus musculus
agttgtaaaacaacagaccttctga

SEQ ID NO: 222502 - DNA, 25 bp, Mus musculus
agttgtaaaacatcagaccttctga

SEQ ID NO: 222503 - DNA, 25 bp, Mus musculus
agttgtaaactcattgggctacaga

SEQ ID NO: 222504 - DNA, 25 bp, Mus musculus
agttgtaaactctttgggctacaga

SEQ ID NO: 222505 - DNA, 25 bp, Mus musculus
agttgtaagatccaaatacccagga

SEQ ID NO: 222506 - DNA, 25 bp, Mus musculus
agttgtaagatcgaaatacccagga

SEQ ID NO: 222507 - DNA, 25 bp, Mus musculus
agttgtaagtccacaaaggtcactt

SEQ ID NO: 222508 - DNA, 25 bp, Mus musculus
agttgtaagtcctcaaaggtcactt

SEQ ID NO: 222509 - DNA, 25 bp, Mus musculus
agttgtaatacgctagctaggcctt

SEQ ID NO: 222510 - DNA, 25 bp, Mus musculus
agttgtaatacggtagctaggcctt

SEQ ID NO: 222511 - DNA, 25 bp, Mus musculus
agttgtaatagccacactctctcta

SEQ ID NO: 222512 - DNA, 25 bp, Mus musculus
agttgtaatagcgacactctctcta

SEQ ID NO: 222513 - DNA, 25 bp, Mus musculus
agttgtaatattagtttctttatgc

SEQ ID NO: 222514 - DNA, 25 bp, Mus musculus
agttgtaatatttgtttctttatgc

SEQ ID NO: 222515 - DNA, 25 bp, Mus musculus
agttgtaatcaaaagctcccggtgc

SEQ ID NO: 222516 - DNA, 25 bp, Mus musculus
agttgtaatcaatagctcccggtgc

SEQ ID NO: 222517 - DNA, 25 bp, Mus musculus
agttgtaatttgagaacgccttaat

SEQ ID NO: 222518 - DNA, 25 bp, Mus musculus
agttgtaatttgtgaacgccttaat

SEQ ID NO: 222519 - DNA, 25 bp, Mus musculus
agttgtacacaacagattatcctaa

SEQ ID NO: 222520 - DNA, 25 bp, Mus musculus
agttgtacacaagagattatcctaa

SEQ ID NO: 222521 - DNA, 25 bp, Mus musculus
agttgtacagacacgggtgtcacct

SEQ ID NO: 222522 - DNA, 25 bp, Mus musculus
agttgtacagactcgggtgtcacct

SEQ ID NO: 222523 - DNA, 25 bp, Mus musculus
agttgtacagctctttctgctccac

SEQ ID NO: 222524 - DNA, 25 bp, Mus musculus
agttgtacagctgtttctgctccac

SEQ ID NO: 222525 - DNA, 25 bp, Mus musculus
agttgtacagtacctgaccaggtta

SEQ ID NO: 222526 - DNA, 25 bp, Mus musculus
agttgtacagtagctgaccaggtta

SEQ ID NO: 222527 - DNA, 25 bp, Mus musculus
agttgtaccctactgtgctcagaca

SEQ ID NO: 222528 - DNA, 25 bp, Mus musculus
agttgtaccctagtgtgctcagaca

SEQ ID NO: 222529 - DNA, 25 bp, Mus musculus
agttgtactgcacaaggcgtcccgt

SEQ ID NO: 222530 - DNA, 25 bp, Mus musculus
agttgtactgcagaaggcgtcccgt

SEQ ID NO: 222531 - DNA, 25 bp, Mus musculus
agttgtactgtacgatgatctctga

SEQ ID NO: 222532 - DNA, 25 bp, Mus musculus
agttgtactgtaggatgatctctga

SEQ ID NO: 222533 - DNA, 25 bp, Mus musculus
agttgtagactaccttttctcacag

SEQ ID NO: 222534 - DNA, 25 bp, Mus musculus
agttgtagactagcttttctcacag

SEQ ID NO: 222535 - DNA, 25 bp, Mus musculus
agttgtagagcaaaaacctcttcta

SEQ ID NO: 222536 - DNA, 25 bp, Mus musculus
agttgtagagcataaacctcttcta

SEQ ID NO: 222537 - DNA, 25 bp, Mus musculus
agttgtagcaagacattatctcgag

SEQ ID NO: 222538 - DNA, 25 bp, Mus musculus
agttgtagcaagtcattatctcgag

SEQ ID NO: 222539 - DNA, 25 bp, Mus musculus
agttgtagctaaactgtccagggag

SEQ ID NO: 222540 - DNA, 25 bp, Mus musculus
agttgtagctaatctgtccagggag

SEQ ID NO: 222541 - DNA, 25 bp, Mus musculus
agttgtaggctgctaacaccttcca

SEQ ID NO: 222542 - DNA, 25 bp, Mus musculus
agttgtaggctggtaacaccttcca

SEQ ID NO: 222543 - DNA, 25 bp, Mus musculus
agttgtagtttccatccttagcttg

SEQ ID NO: 222544 - DNA, 25 bp, Mus musculus
agttgtagtttcgatccttagcttg

SEQ ID NO: 222545 - DNA, 25 bp, Mus musculus
agttgtataaagacagcctccctgg

SEQ ID NO: 222546 - DNA, 25 bp, Mus musculus
agttgtataaagtcagcctccctgg

SEQ ID NO: 222547 - DNA, 25 bp, Mus musculus
agttgtataaccatcctggcagtgt

SEQ ID NO: 222548 - DNA, 25 bp, Mus musculus
agttgtataaccttcctggcagtgt

SEQ ID NO: 222549 - DNA, 25 bp, Mus musculus
agttgtatcatgctccaggttggac

SEQ ID NO: 222550 - DNA, 25 bp, Mus musculus
agttgtatcatggtccaggttggac

SEQ ID NO: 222551 - DNA, 25 bp, Mus musculus
agttgtatctctcgatgtgctcggg

SEQ ID NO: 222552 - DNA, 25 bp, Mus musculus
agttgtatctctggatgtgctcggg

SEQ ID NO: 222553 - DNA, 25 bp, Mus musculus
agttgtatgcataggcaggcctgac

SEQ ID NO: 222554 - DNA, 25 bp, Mus musculus
agttgtatgcattggcaggcctgac

SEQ ID NO: 222555 - DNA, 25 bp, Mus musculus
agttgtatgcctcctacgtctatct

SEQ ID NO: 222556 - DNA, 25 bp, Mus musculus
agttgtatgcctcggagctgtcaga

SEQ ID NO: 222557 - DNA, 25 bp, Mus musculus
agttgtatgcctgctacgtctatct

SEQ ID NO: 222558 - DNA, 25 bp, Mus musculus
agttgtatgcctgggagctgtcaga

SEQ ID NO: 222559 - DNA, 25 bp, Mus musculus
agttgtatgctaatgggcctcattt

SEQ ID NO: 222560 - DNA, 25 bp, Mus musculus
agttgtatgctattgggcctcattt

SEQ ID NO: 222561 - DNA, 25 bp, Mus musculus
agttgtattatgagccactcccaga

SEQ ID NO: 222562 - DNA, 25 bp, Mus musculus
agttgtattatgtgccactcccaga

SEQ ID NO: 222563 - DNA, 25 bp, Mus musculus
agttgtattattaccccaacagatc

SEQ ID NO: 222564 - DNA, 25 bp, Mus musculus
agttgtattatttccccaacagatc

SEQ ID NO: 222565 - DNA, 25 bp, Mus musculus
agttgtattgtcattggtgcctctg

SEQ ID NO: 222566 - DNA, 25 bp, Mus musculus
agttgtattgtctttggtgcctctg

SEQ ID NO: 222567 - DNA, 25 bp, Mus musculus
agttgtatttgtacacgtatgtgct

SEQ ID NO: 222568 - DNA, 25 bp, Mus musculus
agttgtatttgtacataggctgtca

SEQ ID NO: 222569 - DNA, 25 bp, Mus musculus
agttgtatttgttcacgtatgtgct

SEQ ID NO: 222570 - DNA, 25 bp, Mus musculus
agttgtatttgttcataggctgtca

SEQ ID NO: 222571 - DNA, 25 bp, Mus musculus
agttgtcaaagcctggtcacgcagc

SEQ ID NO: 222572 - DNA, 25 bp, Mus musculus
agttgtcaaagcgtggtcacgcagc

SEQ ID NO: 222573 - DNA, 25 bp, Mus musculus
agttgtcacaacctacaaaagaaag

SEQ ID NO: 222574 - DNA, 25 bp, Mus musculus
agttgtcacaacgtacaaaagaaag

SEQ ID NO: 222575 - DNA, 25 bp, Mus musculus
agttgtcacacacagacactctcag

SEQ ID NO: 222576 - DNA, 25 bp, Mus musculus
agttgtcacacagagacactctcag

SEQ ID NO: 222577 - DNA, 25 bp, Mus musculus
agttgtcagagtcattaaccccgga

SEQ ID NO: 222578 - DNA, 25 bp, Mus musculus
agttgtcagagtgattaaccccgga

SEQ ID NO: 222579 - DNA, 25 bp, Mus musculus
agttgtcataacagcaggtccctga

SEQ ID NO: 222580 - DNA, 25 bp, Mus musculus
agttgtcataactgcaggtccctga

SEQ ID NO: 222581 - DNA, 25 bp, Mus musculus
agttgtcattggcaccattctttgg

SEQ ID NO: 222582 - DNA, 25 bp, Mus musculus
agttgtcattgggaccattctttgg

SEQ ID NO: 222583 - DNA, 25 bp, Mus musculus
agttgtcatttcacatgtttttcag

SEQ ID NO: 222584 - DNA, 25 bp, Mus musculus
agttgtcatttctcatgtttttcag

SEQ ID NO: 222585 - DNA, 25 bp, Mus musculus
agttgtccaagtactttaactccat

SEQ ID NO: 222586 - DNA, 25 bp, Mus musculus
agttgtccaagttctttaactccat

SEQ ID NO: 222587 - DNA, 25 bp, Mus musculus
agttgtccacatactcctggtcata

SEQ ID NO: 222588 - DNA, 25 bp, Mus musculus
agttgtccacatagatcagaggttg

SEQ ID NO: 222589 - DNA, 25 bp, Mus musculus
agttgtccacattctcctggtcata

SEQ ID NO: 222590 - DNA, 25 bp, Mus musculus
agttgtccacattgatcagaggttg

SEQ ID NO: 222591 - DNA, 25 bp, Mus musculus
agttgtccagacagacttcttagct

SEQ ID NO: 222592 - DNA, 25 bp, Mus musculus
agttgtccagactgacttcttagct

SEQ ID NO: 222593 - DNA, 25 bp, Mus musculus
agttgtccatcacacctcaggccaa

SEQ ID NO: 222594 - DNA, 25 bp, Mus musculus
agttgtccatcagacctcaggccaa

SEQ ID NO: 222595 - DNA, 25 bp, Mus musculus
agttgtcccaatcgtccagcatgaa

SEQ ID NO: 222596 - DNA, 25 bp, Mus musculus
agttgtcccaatggtccagcatgaa

SEQ ID NO: 222597 - DNA, 25 bp, Mus musculus
agttgtcccacaccaaggtcagtga

SEQ ID NO: 222598 - DNA, 25 bp, Mus musculus
agttgtcccacagcaaggtcagtga

SEQ ID NO: 222599 - DNA, 25 bp, Mus musculus
agttgtccccataactttgtggtgg

SEQ ID NO: 222600 - DNA, 25 bp, Mus musculus
agttgtccccattactttgtggtgg

SEQ ID NO: 222601 - DNA, 25 bp, Mus musculus
agttgtccccgcactcagagttgga

SEQ ID NO: 222602 - DNA, 25 bp, Mus musculus
agttgtccccgctctcagagttgga

SEQ ID NO: 222603 - DNA, 25 bp, Mus musculus
agttgtcccctcacttgtaagtact

SEQ ID NO: 222604 - DNA, 25 bp, Mus musculus
agttgtcccctctcttgtaagtact

SEQ ID NO: 222605 - DNA, 25 bp, Mus musculus
agttgtccctttactgtacacatgg

SEQ ID NO: 222606 - DNA, 25 bp, Mus musculus
agttgtccctttcatggctgtagcc

SEQ ID NO: 222607 - DNA, 25 bp, Mus musculus
agttgtccctttgatggctgtagcc

SEQ ID NO: 222608 - DNA, 25 bp, Mus musculus
agttgtcccttttctgtacacatgg

SEQ ID NO: 222609 - DNA, 25 bp, Mus musculus
agttgtcctcccctatacagaagat

SEQ ID NO: 222610 - DNA, 25 bp, Mus musculus
agttgtcctcccgtatacagaagat

SEQ ID NO: 222611 - DNA, 25 bp, Mus musculus
agttgtcgagttccctggccagctg

SEQ ID NO: 222612 - DNA, 25 bp, Mus musculus
agttgtcgagttgcctggccagctg

SEQ ID NO: 222613 - DNA, 25 bp, Mus musculus
agttgtcgtttgcatagtctctgtt

SEQ ID NO: 222614 - DNA, 25 bp, Mus musculus
agttgtcgtttggatagtctctgtt

SEQ ID NO: 222615 - DNA, 25 bp, Mus musculus
agttgtctaactcatctagctaaga

SEQ ID NO: 222616 - DNA, 25 bp, Mus musculus
agttgtctaactgatctagctaaga

SEQ ID NO: 222617 - DNA, 25 bp, Mus musculus
agttgtctacatcaggttggcatga

SEQ ID NO: 222618 - DNA, 25 bp, Mus musculus
agttgtctacatgaggttggcatga

SEQ ID NO: 222619 - DNA, 25 bp, Mus musculus
agttgtctcaaaccacaggtctccc

SEQ ID NO: 222620 - DNA, 25 bp, Mus musculus
agttgtctcaaagcacaggtctccc

SEQ ID NO: 222621 - DNA, 25 bp, Mus musculus
agttgtctcctgaccctaatgttaa

SEQ ID NO: 222622 - DNA, 25 bp, Mus musculus
agttgtctcctgtccctaatgttaa

SEQ ID NO: 222623 - DNA, 25 bp, Mus musculus
agttgtctctagaatgccctcgata

SEQ ID NO: 222624 - DNA, 25 bp, Mus musculus
agttgtctctagtatgccctcgata

SEQ ID NO: 222625 - DNA, 25 bp, Mus musculus
agttgtctctttaggaagtccgtgc

SEQ ID NO: 222626 - DNA, 25 bp, Mus musculus
agttgtctcttttggaagtccgtgc

SEQ ID NO: 222627 - DNA, 25 bp, Mus musculus
agttgtctgaagactcggttccttc

SEQ ID NO: 222628 - DNA, 25 bp, Mus musculus
agttgtctgaagtctcggttccttc

SEQ ID NO: 222629 - DNA, 25 bp, Mus musculus
agttgtctgatgactgtctgggatc

SEQ ID NO: 222630 - DNA, 25 bp, Mus musculus
agttgtctgatgtctgtctgggatc

SEQ ID NO: 222631 - DNA, 25 bp, Mus musculus
agttgtctgcccagcatggacagca

SEQ ID NO: 222632 - DNA, 25 bp, Mus musculus
agttgtctgccctgcatggacagca

SEQ ID NO: 222633 - DNA, 25 bp, Mus musculus
agttgtctgtcacgtggccaggaac

SEQ ID NO: 222634 - DNA, 25 bp, Mus musculus
agttgtctgtcaggtggccaggaac

SEQ ID NO: 222635 - DNA, 25 bp, Mus musculus
agttgtctgtgcactggagtggcca

SEQ ID NO: 222636 - DNA, 25 bp, Mus musculus
agttgtctgtgctctggagtggcca

SEQ ID NO: 222637 - DNA, 25 bp, Mus musculus
agttgtctgtgtactgtcaccttac

SEQ ID NO: 222638 - DNA, 25 bp, Mus musculus
agttgtctgtgttctgtcaccttac

SEQ ID NO: 222639 - DNA, 25 bp, Mus musculus
agttgtctgttccatgttgttcctg

SEQ ID NO: 222640 - DNA, 25 bp, Mus musculus
agttgtctgttcgatgttgttcctg

SEQ ID NO: 222641 - DNA, 25 bp, Mus musculus
agttgtctgttgctgctcactgcaa

SEQ ID NO: 222642 - DNA, 25 bp, Mus musculus
agttgtctgttggtgctcactgcaa

SEQ ID NO: 222643 - DNA, 25 bp, Mus musculus
agttgtcttactccacttgtgtgaa

SEQ ID NO: 222644 - DNA, 25 bp, Mus musculus
agttgtcttactgcacttgtgtgaa

SEQ ID NO: 222645 - DNA, 25 bp, Mus musculus
agttgtcttcacatattggtggaga

SEQ ID NO: 222646 - DNA, 25 bp, Mus musculus
agttgtcttcacttattggtggaga

SEQ ID NO: 222647 - DNA, 25 bp, Mus musculus
agttgtcttgacattcttctgtata

SEQ ID NO: 222648 - DNA, 25 bp, Mus musculus
agttgtcttgactttcttctgtata

SEQ ID NO: 222649 - DNA, 25 bp, Mus musculus
agttgtcttggactggccacaggca

SEQ ID NO: 222650 - DNA, 25 bp, Mus musculus
agttgtcttggagtggccacaggca

SEQ ID NO: 222651 - DNA, 25 bp, Mus musculus
agttgtctttgtcgtggtcttttat

SEQ ID NO: 222652 - DNA, 25 bp, Mus musculus
agttgtctttgtggtggtcttttat

SEQ ID NO: 222653 - DNA, 25 bp, Mus musculus
agttgtgaaccactgtgcttagtac

SEQ ID NO: 222654 - DNA, 25 bp, Mus musculus
agttgtgaaccagtgtgcttagtac

SEQ ID NO: 222655 - DNA, 25 bp, Mus musculus
agttgtgaactcattccacatccca

SEQ ID NO: 222656 - DNA, 25 bp, Mus musculus
agttgtgaactctttccacatccca

SEQ ID NO: 222657 - DNA, 25 bp, Mus musculus
agttgtgaccatcaaacccggaggc

SEQ ID NO: 222658 - DNA, 25 bp, Mus musculus
agttgtgaccatgaaacccggaggc

SEQ ID NO: 222659 - DNA, 25 bp, Mus musculus
agttgtgactgacgctgagcaccat

SEQ ID NO: 222660 - DNA, 25 bp, Mus musculus
agttgtgactgaggctgagcaccat

SEQ ID NO: 222661 - DNA, 25 bp, Mus musculus
agttgtgacttaagctctgtccctc

SEQ ID NO: 222662 - DNA, 25 bp, Mus musculus
agttgtgacttatgctctgtccctc

SEQ ID NO: 222663 - DNA, 25 bp, Mus musculus
agttgtgagacaaccttactttatg

SEQ ID NO: 222664 - DNA, 25 bp, Mus musculus
agttgtgagacatccttactttatg

SEQ ID NO: 222665 - DNA, 25 bp, Mus musculus
agttgtgagcacagaagccttgcta

SEQ ID NO: 222666 - DNA, 25 bp, Mus musculus
agttgtgagcactgaagccttgcta

SEQ ID NO: 222667 - DNA, 25 bp, Mus musculus
agttgtgagcccattaagcctggaa

SEQ ID NO: 222668 - DNA, 25 bp, Mus musculus
agttgtgagccctttaagcctggaa

SEQ ID NO: 222669 - DNA, 25 bp, Mus musculus
agttgtgagcctcatacgtgttcta

SEQ ID NO: 222670 - DNA, 25 bp, Mus musculus
agttgtgagcctgatacgtgttcta

SEQ ID NO: 222671 - DNA, 25 bp, Mus musculus
agttgtgatgcacctctttaatccc

SEQ ID NO: 222672 - DNA, 25 bp, Mus musculus
agttgtgatgcagctctttaatccc

SEQ ID NO: 222673 - DNA, 25 bp, Mus musculus
agttgtgattacaactttcttacag

SEQ ID NO: 222674 - DNA, 25 bp, Mus musculus
agttgtgattactactttcttacag

SEQ ID NO: 222675 - DNA, 25 bp, Mus musculus
agttgtgattccatcatcccagctc

SEQ ID NO: 222676 - DNA, 25 bp, Mus musculus
agttgtgattccttcatcccagctc

SEQ ID NO: 222677 - DNA, 25 bp, Mus musculus
agttgtgcaagaatccatgctttaa

SEQ ID NO: 222678 - DNA, 25 bp, Mus musculus
agttgtgcaagattccatgctttaa

SEQ ID NO: 222679 - DNA, 25 bp, Mus musculus
agttgtgcaagtcctgagctcaggc

SEQ ID NO: 222680 - DNA, 25 bp, Mus musculus
agttgtgcaagtgctgagctcaggc

SEQ ID NO: 222681 - DNA, 25 bp, Mus musculus
agttgtgcagatactcacagaaaca

SEQ ID NO: 222682 - DNA, 25 bp, Mus musculus
agttgtgcagatccaaagacctcaa

SEQ ID NO: 222683 - DNA, 25 bp, Mus musculus
agttgtgcagatgcaaagacctcaa

SEQ ID NO: 222684 - DNA, 25 bp, Mus musculus
agttgtgcagattctcacagaaaca

SEQ ID NO: 222685 - DNA, 25 bp, Mus musculus
agttgtgcatatatggccggaaacc

SEQ ID NO: 222686 - DNA, 25 bp, Mus musculus
agttgtgcatatttggccggaaacc

SEQ ID NO: 222687 - DNA, 25 bp, Mus musculus
agttgtgcatttccatacgtattga

SEQ ID NO: 222688 - DNA, 25 bp, Mus musculus
agttgtgcatttgcatacgtattga

SEQ ID NO: 222689 - DNA, 25 bp, Mus musculus
agttgtgcccaaaacctagaggcta

SEQ ID NO: 222690 - DNA, 25 bp, Mus musculus
agttgtgcccaatacctagaggcta

SEQ ID NO: 222691 - DNA, 25 bp, Mus musculus
agttgtgcccacataccagactcag

SEQ ID NO: 222692 - DNA, 25 bp, Mus musculus
agttgtgcccaccaaggcctgccaa

SEQ ID NO: 222693 - DNA, 25 bp, Mus musculus
agttgtgcccacgaaggcctgccaa

SEQ ID NO: 222694 - DNA, 25 bp, Mus musculus
agttgtgcccacttaccagactcag

SEQ ID NO: 222695 - DNA, 25 bp, Mus musculus
agttgtgccccaattcagactcact

SEQ ID NO: 222696 - DNA, 25 bp, Mus musculus
agttgtgccccaccgctgttaacta

SEQ ID NO: 222697 - DNA, 25 bp, Mus musculus
agttgtgccccagcgctgttaacta

SEQ ID NO: 222698 - DNA, 25 bp, Mus musculus
agttgtgccccatttcagactcact

SEQ ID NO: 222699 - DNA, 25 bp, Mus musculus
agttgtgcctatcggatgctttgta

SEQ ID NO: 222700 - DNA, 25 bp, Mus musculus
agttgtgcctatgggatgctttgta

SEQ ID NO: 222701 - DNA, 25 bp, Mus musculus
agttgtgcctgtaccttgtacttcg

SEQ ID NO: 222702 - DNA, 25 bp, Mus musculus
agttgtgcctgttccttgtacttcg

SEQ ID NO: 222703 - DNA, 25 bp, Mus musculus
agttgtgcgcaacccaagtatcaaa

SEQ ID NO: 222704 - DNA, 25 bp, Mus musculus
agttgtgcgcaagccaagtatcaaa

SEQ ID NO: 222705 - DNA, 25 bp, Mus musculus
agttgtgcgccccagccgccaggaa

SEQ ID NO: 222706 - DNA, 25 bp, Mus musculus
agttgtgcgcccgagccgccaggaa

SEQ ID NO: 222707 - DNA, 25 bp, Mus musculus
agttgtgctaggaacatacctgtaa

SEQ ID NO: 222708 - DNA, 25 bp, Mus musculus
agttgtgctaggtacatacctgtaa

SEQ ID NO: 222709 - DNA, 25 bp, Mus musculus
agttgtgctataattgccacagaaa

SEQ ID NO: 222710 - DNA, 25 bp, Mus musculus
agttgtgctatatttgccacagaaa

SEQ ID NO: 222711 - DNA, 25 bp, Mus musculus
agttgtgctcttcatgttggttcaa

SEQ ID NO: 222712 - DNA, 25 bp, Mus musculus
agttgtgctcttgatgttggttcaa

SEQ ID NO: 222713 - DNA, 25 bp, Mus musculus
agttgtgcttgcattctctgaggtc

SEQ ID NO: 222714 - DNA, 25 bp, Mus musculus
agttgtgcttgctttctctgaggtc

SEQ ID NO: 222715 - DNA, 25 bp, Mus musculus
agttgtgcttttagttgtctgttcc

SEQ ID NO: 222716 - DNA, 25 bp, Mus musculus
agttgtgctttttgttgtctgttcc

SEQ ID NO: 222717 - DNA, 25 bp, Mus musculus
agttgtggacacagtgggctcactt

SEQ ID NO: 222718 - DNA, 25 bp, Mus musculus
agttgtggacactgtgggctcactt

SEQ ID NO: 222719 - DNA, 25 bp, Mus musculus
agttgtggagccaagttatccgcgg

SEQ ID NO: 222720 - DNA, 25 bp, Mus musculus
agttgtggagcctagttatccgcgg

SEQ ID NO: 222721 - DNA, 25 bp, Mus musculus
agttgtggaggtaccttatgcccgc

SEQ ID NO: 222722 - DNA, 25 bp, Mus musculus
agttgtggaggttccttatgcccgc

SEQ ID NO: 222723 - DNA, 25 bp, Mus musculus
agttgtggccaacttttcctgactc

SEQ ID NO: 222724 - DNA, 25 bp, Mus musculus
agttgtggccaagttttcctgactc

SEQ ID NO: 222725 - DNA, 25 bp, Mus musculus
agttgtggccatctttccatttgga

SEQ ID NO: 222726 - DNA, 25 bp, Mus musculus
agttgtggccatgtttccatttgga

SEQ ID NO: 222727 - DNA, 25 bp, Mus musculus
agttgtggccgtcttttccttcatt

SEQ ID NO: 222728 - DNA, 25 bp, Mus musculus
agttgtggccgtgttttccttcatt

SEQ ID NO: 222729 - DNA, 25 bp, Mus musculus
agttgtgggcagacctgttggactc

SEQ ID NO: 222730 - DNA, 25 bp, Mus musculus
agttgtgggcagtcctgttggactc

SEQ ID NO: 222731 - DNA, 25 bp, Mus musculus
agttgtgtactcataattccttcct

SEQ ID NO: 222732 - DNA, 25 bp, Mus musculus
agttgtgtactcttaattccttcct

SEQ ID NO: 222733 - DNA, 25 bp, Mus musculus
agttgtgtactgactccatacgtgc

SEQ ID NO: 222734 - DNA, 25 bp, Mus musculus
agttgtgtactgtctccatacgtgc

SEQ ID NO: 222735 - DNA, 25 bp, Mus musculus
agttgtgtagtgacacgcatgcaca

SEQ ID NO: 222736 - DNA, 25 bp, Mus musculus
agttgtgtagtgtcacgcatgcaca

SEQ ID NO: 222737 - DNA, 25 bp, Mus musculus
agttgtgtctttccggacatctggg

SEQ ID NO: 222738 - DNA, 25 bp, Mus musculus
agttgtgtctttgcggacatctggg

SEQ ID NO: 222739 - DNA, 25 bp, Mus musculus
agttgtgtgtatagtgttcctctca

SEQ ID NO: 222740 - DNA, 25 bp, Mus musculus
agttgtgtgtattgtgttcctctca

SEQ ID NO: 222741 - DNA, 25 bp, Mus musculus
agttgtgttccacactctgtgtcta

SEQ ID NO: 222742 - DNA, 25 bp, Mus musculus
agttgtgttccagactctgtgtcta

SEQ ID NO: 222743 - DNA, 25 bp, Mus musculus
agttgtgttctaactctctgtgagc

SEQ ID NO: 222744 - DNA, 25 bp, Mus musculus
agttgtgttctatctctctgtgagc

SEQ ID NO: 222745 - DNA, 25 bp, Mus musculus
agttgtgttgatatctacctgtagc

SEQ ID NO: 222746 - DNA, 25 bp, Mus musculus
agttgtgttgatttctacctgtagc

SEQ ID NO: 222747 - DNA, 25 bp, Mus musculus
agttgttacaaaatcctggcatctc

SEQ ID NO: 222748 - DNA, 25 bp, Mus musculus
agttgttacaaattcctggcatctc

SEQ ID NO: 222749 - DNA, 25 bp, Mus musculus
agttgttactccaggctgatcacgt

SEQ ID NO: 222750 - DNA, 25 bp, Mus musculus
agttgttactcctggctgatcacgt

SEQ ID NO: 222751 - DNA, 25 bp, Mus musculus
agttgttaggctccctgctcataca

SEQ ID NO: 222752 - DNA, 25 bp, Mus musculus
agttgttaggctgcctgctcataca

SEQ ID NO: 222753 - DNA, 25 bp, Mus musculus
agttgttaggtcacaaagacgctca

SEQ ID NO: 222754 - DNA, 25 bp, Mus musculus
agttgttaggtctcaaagacgctca

SEQ ID NO: 222755 - DNA, 25 bp, Mus musculus
agttgttatatgagacagccttggc

SEQ ID NO: 222756 - DNA, 25 bp, Mus musculus
agttgttatatgtgacagccttggc

SEQ ID NO: 222757 - DNA, 25 bp, Mus musculus
agttgttattacacctaggtcctgt

SEQ ID NO: 222758 - DNA, 25 bp, Mus musculus
agttgttattactcctaggtcctgt

SEQ ID NO: 222759 - DNA, 25 bp, Mus musculus
agttgttatttcattgcacctagta

SEQ ID NO: 222760 - DNA, 25 bp, Mus musculus
agttgttatttctttgcacctagta

SEQ ID NO: 222761 - DNA, 25 bp, Mus musculus
agttgttcaaacctgtagttgctgc

SEQ ID NO: 222762 - DNA, 25 bp, Mus musculus
agttgttcaaacgtgtagttgctgc

SEQ ID NO: 222763 - DNA, 25 bp, Mus musculus
agttgttcaaccctcggtacctctg

SEQ ID NO: 222764 - DNA, 25 bp, Mus musculus
agttgttcaaccgtcggtacctctg

SEQ ID NO: 222765 - DNA, 25 bp, Mus musculus
agttgttcaatcacagtgcttcctc

SEQ ID NO: 222766 - DNA, 25 bp, Mus musculus
agttgttcaatctcagtgcttcctc

SEQ ID NO: 222767 - DNA, 25 bp, Mus musculus
agttgttcatggactgtgttcgcag

SEQ ID NO: 222768 - DNA, 25 bp, Mus musculus
agttgttcatggctacttcttaatg

SEQ ID NO: 222769 - DNA, 25 bp, Mus musculus
agttgttcatgggtacttcttaatg

SEQ ID NO: 222770 - DNA, 25 bp, Mus musculus
agttgttcatggtctgtgttcgcag

SEQ ID NO: 222771 - DNA, 25 bp, Mus musculus
agttgttctacaagcttgtcttgaa

SEQ ID NO: 222772 - DNA, 25 bp, Mus musculus
agttgttctacatgcttgtcttgaa

SEQ ID NO: 222773 - DNA, 25 bp, Mus musculus
agttgttgaagaaaggttggcccca

SEQ ID NO: 222774 - DNA, 25 bp, Mus musculus
agttgttgaagataggttggcccca

SEQ ID NO: 222775 - DNA, 25 bp, Mus musculus
agttgttgacgtcttttgcatcctc

SEQ ID NO: 222776 - DNA, 25 bp, Mus musculus
agttgttgacgtgttttgcatcctc

SEQ ID NO: 222777 - DNA, 25 bp, Mus musculus
agttgttgcctacgcctgagcccaa

SEQ ID NO: 222778 - DNA, 25 bp, Mus musculus
agttgttgcctaggcctgagcccaa

SEQ ID NO: 222779 - DNA, 25 bp, Mus musculus
agttgttggctaaatgatagacatt

SEQ ID NO: 222780 - DNA, 25 bp, Mus musculus
agttgttggctatatgatagacatt

SEQ ID NO: 222781 - DNA, 25 bp, Mus musculus
agttgttgggaaccattccaaagcc

SEQ ID NO: 222782 - DNA, 25 bp, Mus musculus
agttgttgggaagcattccaaagcc

SEQ ID NO: 222783 - DNA, 25 bp, Mus musculus
agttgttggtgcaggcgtccagacc

SEQ ID NO: 222784 - DNA, 25 bp, Mus musculus
agttgttggtgctggcgtccagacc

SEQ ID NO: 222785 - DNA, 25 bp, Mus musculus
agttgttggtgtacgaagactccgt

SEQ ID NO: 222786 - DNA, 25 bp, Mus musculus
agttgttggtgttcgaagactccgt

SEQ ID NO: 222787 - DNA, 25 bp, Mus musculus
agttgttgtcttccgaacatcatgt

SEQ ID NO: 222788 - DNA, 25 bp, Mus musculus
agttgttgtcttgcgaacatcatgt

SEQ ID NO: 222789 - DNA, 25 bp, Mus musculus
agttgtttaatgataatgttgcccc

SEQ ID NO: 222790 - DNA, 25 bp, Mus musculus
agttgtttaatgttaatgttgcccc

SEQ ID NO: 222791 - DNA, 25 bp, Mus musculus
agttgtttactcacagaatttgtct

SEQ ID NO: 222792 - DNA, 25 bp, Mus musculus
agttgtttactctcagaatttgtct

SEQ ID NO: 222793 - DNA, 25 bp, Mus musculus
agttgtttattcatcaggcctcacg

SEQ ID NO: 222794 - DNA, 25 bp, Mus musculus
agttgtttattcttcaggcctcacg

SEQ ID NO: 222795 - DNA, 25 bp, Mus musculus
agttgtttcataatcccaggatgct

SEQ ID NO: 222796 - DNA, 25 bp, Mus musculus
agttgtttcatattcccaggatgct

SEQ ID NO: 222797 - DNA, 25 bp, Mus musculus
agttgtttcctgaggatcacgtcag

SEQ ID NO: 222798 - DNA, 25 bp, Mus musculus
agttgtttcctgtggatcacgtcag

SEQ ID NO: 222799 - DNA, 25 bp, Mus musculus
agttgtttctatcccacaaccctgt

SEQ ID NO: 222800 - DNA, 25 bp, Mus musculus
agttgtttctatgccacaaccctgt

SEQ ID NO: 222801 - DNA, 25 bp, Mus musculus
agttgtttctctccccttgtattga

SEQ ID NO: 222802 - DNA, 25 bp, Mus musculus
agttgtttctctcctttccaaatta

SEQ ID NO: 222803 - DNA, 25 bp, Mus musculus
agttgtttctctgcccttgtattga

SEQ ID NO: 222804 - DNA, 25 bp, Mus musculus
agttgtttctctgctttccaaatta

SEQ ID NO: 222805 - DNA, 25 bp, Mus musculus
agttgtttctgtctgaataaaccga

SEQ ID NO: 222806 - DNA, 25 bp, Mus musculus
agttgtttctgtgtgaataaaccga

SEQ ID NO: 222807 - DNA, 25 bp, Mus musculus
agttgtttcttgaagccatctggtg

SEQ ID NO: 222808 - DNA, 25 bp, Mus musculus
agttgtttcttgtagccatctggtg

SEQ ID NO: 222809 - DNA, 25 bp, Mus musculus
agttgtttgaagagcgccttctcag

SEQ ID NO: 222810 - DNA, 25 bp, Mus musculus
agttgtttgaagtgcgccttctcag

SEQ ID NO: 222811 - DNA, 25 bp, Mus musculus
agttgtttgagacgctgacatggac

SEQ ID NO: 222812 - DNA, 25 bp, Mus musculus
agttgtttgagaggctgacatggac

SEQ ID NO: 222813 - DNA, 25 bp, Mus musculus
agttgtttgatgacccatgtccgat

SEQ ID NO: 222814 - DNA, 25 bp, Mus musculus
agttgtttgatgtcccatgtccgat

SEQ ID NO: 222815 - DNA, 25 bp, Mus musculus
agttgtttgcaaagagtttttcctt

SEQ ID NO: 222816 - DNA, 25 bp, Mus musculus
agttgtttgcaatgagtttttcctt

SEQ ID NO: 222817 - DNA, 25 bp, Mus musculus
agttgttttctaatctcactctaag

SEQ ID NO: 222818 - DNA, 25 bp, Mus musculus
agttgttttctattctcactctaag

SEQ ID NO: 222819 - DNA, 25 bp, Mus musculus
agttgtttttccatacacggtgtct

SEQ ID NO: 222820 - DNA, 25 bp, Mus musculus
agttgtttttccttacacggtgtct

SEQ ID NO: 222821 - DNA, 25 bp, Mus musculus
agttgttttttgcttcagtaattca

SEQ ID NO: 222822 - DNA, 25 bp, Mus musculus
agttgttttttggttcagtaattca

SEQ ID NO: 222823 - DNA, 25 bp, Mus musculus
agtttaaaaaccacacagcttgtat

SEQ ID NO: 222824 - DNA, 25 bp, Mus musculus
agtttaaaaacctcacagcttgtat

SEQ ID NO: 222825 - DNA, 25 bp, Mus musculus
agtttaaagcacaccaccagcacta

SEQ ID NO: 222826 - DNA, 25 bp, Mus musculus
agtttaaagcacctttcttgcacgc

SEQ ID NO: 222827 - DNA, 25 bp, Mus musculus
agtttaaagcacgtttcttgcacgc

SEQ ID NO: 222828 - DNA, 25 bp, Mus musculus
agtttaaagcactccaccagcacta

SEQ ID NO: 222829 - DNA, 25 bp, Mus musculus
agtttaaagctgagaccttcacctt

SEQ ID NO: 222830 - DNA, 25 bp, Mus musculus
agtttaaagctgtgaccttcacctt

SEQ ID NO: 222831 - DNA, 25 bp, Mus musculus
agtttaacagtaacactcagggatt

SEQ ID NO: 222832 - DNA, 25 bp, Mus musculus
agtttaacagtatcactcagggatt

SEQ ID NO: 222833 - DNA, 25 bp, Mus musculus
agtttaagatcaaccttgcctgctt

SEQ ID NO: 222834 - DNA, 25 bp, Mus musculus
agtttaagatcatccttgcctgctt

SEQ ID NO: 222835 - DNA, 25 bp, Mus musculus
agtttaagattaatgctcacttcaa

SEQ ID NO: 222836 - DNA, 25 bp, Mus musculus
agtttaagattattgctcacttcaa

SEQ ID NO: 222837 - DNA, 25 bp, Mus musculus
agtttaagtagaacagcaacccaca

SEQ ID NO: 222838 - DNA, 25 bp, Mus musculus
agtttaagtagatcagcaacccaca

SEQ ID NO: 222839 - DNA, 25 bp, Mus musculus
agtttaatcttcaatctcctttcag

SEQ ID NO: 222840 - DNA, 25 bp, Mus musculus
agtttaatcttctatctcctttcag

SEQ ID NO: 222841 - DNA, 25 bp, Mus musculus
agtttaatgctgattactgaaaata

SEQ ID NO: 222842 - DNA, 25 bp, Mus musculus
agtttaatgctgtttactgaaaata

SEQ ID NO: 222843 - DNA, 25 bp, Mus musculus
agtttaatgtctcggacgctcttcc

SEQ ID NO: 222844 - DNA, 25 bp, Mus musculus
agtttaatgtctgggacgctcttcc

SEQ ID NO: 222845 - DNA, 25 bp, Mus musculus
agtttaattctcagtggctcataac

SEQ ID NO: 222846 - DNA, 25 bp, Mus musculus
agtttaattctctgtggctcataac

SEQ ID NO: 222847 - DNA, 25 bp, Mus musculus
agtttacaacgtccacatcttttcg

SEQ ID NO: 222848 - DNA, 25 bp, Mus musculus
agtttacaacgtgcacatcttttcg

SEQ ID NO: 222849 - DNA, 25 bp, Mus musculus
agtttacaagcccagtatcatgtct

SEQ ID NO: 222850 - DNA, 25 bp, Mus musculus
agtttacaagccgagtatcatgtct

SEQ ID NO: 222851 - DNA, 25 bp, Mus musculus
agtttacacatgcagtcagatctct

SEQ ID NO: 222852 - DNA, 25 bp, Mus musculus
agtttacacatggagtcagatctct

SEQ ID NO: 222853 - DNA, 25 bp, Mus musculus
agtttacaccacagaggtccttgac

SEQ ID NO: 222854 - DNA, 25 bp, Mus musculus
agtttacaccactgaggtccttgac

SEQ ID NO: 222855 - DNA, 25 bp, Mus musculus
agtttacactgcagatgctcttcct

SEQ ID NO: 222856 - DNA, 25 bp, Mus musculus
agtttacactgctgatgctcttcct

SEQ ID NO: 222857 - DNA, 25 bp, Mus musculus
agtttacagaggcactgcacagctt

SEQ ID NO: 222858 - DNA, 25 bp, Mus musculus
agtttacagagggactgcacagctt

SEQ ID NO: 222859 - DNA, 25 bp, Mus musculus
agtttacatgtgaccttcttatagg

SEQ ID NO: 222860 - DNA, 25 bp, Mus musculus
agtttacatgtgtccttcttatagg

SEQ ID NO: 222861 - DNA, 25 bp, Mus musculus
agtttacattgcagtagcattgtgg

SEQ ID NO: 222862 - DNA, 25 bp, Mus musculus
agtttacattgctgtagcattgtgg

SEQ ID NO: 222863 - DNA, 25 bp, Mus musculus
agtttacatttcaaccgcagctttt

SEQ ID NO: 222864 - DNA, 25 bp, Mus musculus
agtttacatttctaccgcagctttt

SEQ ID NO: 222865 - DNA, 25 bp, Mus musculus
agtttaccatacagaagcctgccac

SEQ ID NO: 222866 - DNA, 25 bp, Mus musculus
agtttaccatactgaagcctgccac

SEQ ID NO: 222867 - DNA, 25 bp, Mus musculus
agtttaccattaaggcacaggccag

SEQ ID NO: 222868 - DNA, 25 bp, Mus musculus
agtttaccattatggcacaggccag

SEQ ID NO: 222869 - DNA, 25 bp, Mus musculus
agtttacccgtccaagcagtttgat

SEQ ID NO: 222870 - DNA, 25 bp, Mus musculus
agtttacccgtcgaagcagtttgat

SEQ ID NO: 222871 - DNA, 25 bp, Mus musculus
agtttacctgagctcttttatttca

SEQ ID NO: 222872 - DNA, 25 bp, Mus musculus
agtttacctgaggtcttttatttca

SEQ ID NO: 222873 - DNA, 25 bp, Mus musculus
agtttacgaagaaatcttgtgctag

SEQ ID NO: 222874 - DNA, 25 bp, Mus musculus
agtttacgaagatatcttgtgctag

SEQ ID NO: 222875 - DNA, 25 bp, Mus musculus
agtttacggaagcagctgattgcac

SEQ ID NO: 222876 - DNA, 25 bp, Mus musculus
agtttacggaaggagctgattgcac

SEQ ID NO: 222877 - DNA, 25 bp, Mus musculus
agtttactatacagtcttggctaaa

SEQ ID NO: 222878 - DNA, 25 bp, Mus musculus
agtttactatactgtcttggctaaa

SEQ ID NO: 222879 - DNA, 25 bp, Mus musculus
agtttactcgttactatcctggaag

SEQ ID NO: 222880 - DNA, 25 bp, Mus musculus
agtttactcgtttctatcctggaag

SEQ ID NO: 222881 - DNA, 25 bp, Mus musculus
agtttactctctagttttcctcata

SEQ ID NO: 222882 - DNA, 25 bp, Mus musculus
agtttactctcttgttttcctcata

SEQ ID NO: 222883 - DNA, 25 bp, Mus musculus
agtttactcttcagattataagctg

SEQ ID NO: 222884 - DNA, 25 bp, Mus musculus
agtttactcttctgattataagctg

SEQ ID NO: 222885 - DNA, 25 bp, Mus musculus
agtttactctttctagtgacgctgg

SEQ ID NO: 222886 - DNA, 25 bp, Mus musculus
agtttactctttgtagtgacgctgg

SEQ ID NO: 222887 - DNA, 25 bp, Mus musculus
agtttactgacaagttcaccggctt

SEQ ID NO: 222888 - DNA, 25 bp, Mus musculus
agtttactgacatgttcaccggctt

SEQ ID NO: 222889 - DNA, 25 bp, Mus musculus
agtttactgctaaggctgaggccaa

SEQ ID NO: 222890 - DNA, 25 bp, Mus musculus
agtttactgctatggctgaggccaa

SEQ ID NO: 222891 - DNA, 25 bp, Mus musculus
agtttactgctgaagcttctttcaa

SEQ ID NO: 222892 - DNA, 25 bp, Mus musculus
agtttactgctgtagcttctttcaa

SEQ ID NO: 222893 - DNA, 25 bp, Mus musculus
agtttacttcatactgtacatgtga

SEQ ID NO: 222894 - DNA, 25 bp, Mus musculus
agtttacttcattctgtacatgtga

SEQ ID NO: 222895 - DNA, 25 bp, Mus musculus
agtttacttgttactctgggccagc

SEQ ID NO: 222896 - DNA, 25 bp, Mus musculus
agtttacttgtttctctgggccagc

SEQ ID NO: 222897 - DNA, 25 bp, Mus musculus
agtttactttagcactcatgctgtc

SEQ ID NO: 222898 - DNA, 25 bp, Mus musculus
agtttactttaggactcatgctgtc

SEQ ID NO: 222899 - DNA, 25 bp, Mus musculus
agtttacttttgaagactctaagca

SEQ ID NO: 222900 - DNA, 25 bp, Mus musculus
agtttacttttgtagactctaagca

SEQ ID NO: 222901 - DNA, 25 bp, Mus musculus
agtttagaaatgaggtgttcttcct

SEQ ID NO: 222902 - DNA, 25 bp, Mus musculus
agtttagaaatgtggtgttcttcct

SEQ ID NO: 222903 - DNA, 25 bp, Mus musculus
agtttagaagtcatcaacacctagg

SEQ ID NO: 222904 - DNA, 25 bp, Mus musculus
agtttagaagtcttcaacacctagg

SEQ ID NO: 222905 - DNA, 25 bp, Mus musculus
agtttagagacaatcctggacgcag

SEQ ID NO: 222906 - DNA, 25 bp, Mus musculus
agtttagagacattcctggacgcag

SEQ ID NO: 222907 - DNA, 25 bp, Mus musculus
agtttagagagaatggcacaatcct

SEQ ID NO: 222908 - DNA, 25 bp, Mus musculus
agtttagagagattggcacaatcct

SEQ ID NO: 222909 - DNA, 25 bp, Mus musculus
agtttagagcacatgacgctcttaa

SEQ ID NO: 222910 - DNA, 25 bp, Mus musculus
agtttagagcacttgacgctcttaa

SEQ ID NO: 222911 - DNA, 25 bp, Mus musculus
agtttagcagctctgactgcccctg

SEQ ID NO: 222912 - DNA, 25 bp, Mus musculus
agtttagcagctgtgactgcccctg

SEQ ID NO: 222913 - DNA, 25 bp, Mus musculus
agtttagcaggtacaacacccggca

SEQ ID NO: 222914 - DNA, 25 bp, Mus musculus
agtttagcaggttcaacacccggca

SEQ ID NO: 222915 - DNA, 25 bp, Mus musculus
agtttagcagtgaggtcatctgaca

SEQ ID NO: 222916 - DNA, 25 bp, Mus musculus
agtttagcagtgtggtcatctgaca

SEQ ID NO: 222917 - DNA, 25 bp, Mus musculus
agtttagcagttagccacacgggta

SEQ ID NO: 222918 - DNA, 25 bp, Mus musculus
agtttagcagtttgccacacgggta

SEQ ID NO: 222919 - DNA, 25 bp, Mus musculus
agtttagcatatatcccattgtagg

SEQ ID NO: 222920 - DNA, 25 bp, Mus musculus
agtttagcatatttcccattgtagg

SEQ ID NO: 222921 - DNA, 25 bp, Mus musculus
agtttagcatgccagtgtttcctgt

SEQ ID NO: 222922 - DNA, 25 bp, Mus musculus
agtttagcatgcgagtgtttcctgt

SEQ ID NO: 222923 - DNA, 25 bp, Mus musculus
agtttagccctgcttgtccactggg

SEQ ID NO: 222924 - DNA, 25 bp, Mus musculus
agtttagccctggttgtccactggg

SEQ ID NO: 222925 - DNA, 25 bp, Mus musculus
agtttagcgtccatccatctgagaa

SEQ ID NO: 222926 - DNA, 25 bp, Mus musculus
agtttagcgtccttccatctgagaa

SEQ ID NO: 222927 - DNA, 25 bp, Mus musculus
agtttagctggtccttctgaagcca

SEQ ID NO: 222928 - DNA, 25 bp, Mus musculus
agtttagctggtgcttctgaagcca

SEQ ID NO: 222929 - DNA, 25 bp, Mus musculus
agtttagctttcagcccgcctctga

SEQ ID NO: 222930 - DNA, 25 bp, Mus musculus
agtttagctttctgcccgcctctga

SEQ ID NO: 222931 - DNA, 25 bp, Mus musculus
agtttaggactacccggatgtatat

SEQ ID NO: 222932 - DNA, 25 bp, Mus musculus
agtttaggactagccggatgtatat

SEQ ID NO: 222933 - DNA, 25 bp, Mus musculus
agtttaggctgtacgttgacgcgta

SEQ ID NO: 222934 - DNA, 25 bp, Mus musculus
agtttaggctgttcgttgacgcgta

SEQ ID NO: 222935 - DNA, 25 bp, Mus musculus
agtttagggttgatctctgttggat

SEQ ID NO: 222936 - DNA, 25 bp, Mus musculus
agtttagggttgttctctgttggat

SEQ ID NO: 222937 - DNA, 25 bp, Mus musculus
agtttaggtgccattgcggatgacc

SEQ ID NO: 222938 - DNA, 25 bp, Mus musculus
agtttaggtgcctttgcggatgacc

SEQ ID NO: 222939 - DNA, 25 bp, Mus musculus
agtttagtacacatcgccagctggg

SEQ ID NO: 222940 - DNA, 25 bp, Mus musculus
agtttagtacacttcgccagctggg

SEQ ID NO: 222941 - DNA, 25 bp, Mus musculus
agtttagtaccacccactgttacaa

SEQ ID NO: 222942 - DNA, 25 bp, Mus musculus
agtttagtaccagccactgttacaa

SEQ ID NO: 222943 - DNA, 25 bp, Mus musculus
agtttagtatctagtgccaacctcc

SEQ ID NO: 222944 - DNA, 25 bp, Mus musculus
agtttagtatcttgtgccaacctcc

SEQ ID NO: 222945 - DNA, 25 bp, Mus musculus
agtttagtctcccgccctttgatag

SEQ ID NO: 222946 - DNA, 25 bp, Mus musculus
agtttagtctccggccctttgatag

SEQ ID NO: 222947 - DNA, 25 bp, Mus musculus
agtttagtctggactctacccgatg

SEQ ID NO: 222948 - DNA, 25 bp, Mus musculus
agtttagtctggtctctacccgatg

SEQ ID NO: 222949 - DNA, 25 bp, Mus musculus
agtttagttgggatctcagagtctc

SEQ ID NO: 222950 - DNA, 25 bp, Mus musculus
agtttagttgggttctcagagtctc

SEQ ID NO: 222951 - DNA, 25 bp, Mus musculus
agtttagtttgtctgggtgacgtgt

SEQ ID NO: 222952 - DNA, 25 bp, Mus musculus
agtttagtttgtgtgggtgacgtgt

SEQ ID NO: 222953 - DNA, 25 bp, Mus musculus
agtttataccaaagactccccacaa

SEQ ID NO: 222954 - DNA, 25 bp, Mus musculus
agtttataccaatgactccccacaa

SEQ ID NO: 222955 - DNA, 25 bp, Mus musculus
agtttatagtctaaatctgtcccca

SEQ ID NO: 222956 - DNA, 25 bp, Mus musculus
agtttatagtcttaatctgtcccca

SEQ ID NO: 222957 - DNA, 25 bp, Mus musculus
agtttatatacgcttggctcaggga

SEQ ID NO: 222958 - DNA, 25 bp, Mus musculus
agtttatatacggttggctcaggga

SEQ ID NO: 222959 - DNA, 25 bp, Mus musculus
agtttatatagcacatgcccctttg

SEQ ID NO: 222960 - DNA, 25 bp, Mus musculus
agtttatatagccttgttcttgaga

SEQ ID NO: 222961 - DNA, 25 bp, Mus musculus
agtttatatagcgttgttcttgaga

SEQ ID NO: 222962 - DNA, 25 bp, Mus musculus
agtttatatagctcatgcccctttg

SEQ ID NO: 222963 - DNA, 25 bp, Mus musculus
agtttatatgttcttatctctccct

SEQ ID NO: 222964 - DNA, 25 bp, Mus musculus
agtttatatgttgttatctctccct

SEQ ID NO: 222965 - DNA, 25 bp, Mus musculus
agtttatcactgactttacccctga

SEQ ID NO: 222966 - DNA, 25 bp, Mus musculus
agtttatcactgtctttacccctga

SEQ ID NO: 222967 - DNA, 25 bp, Mus musculus
agtttatcagtcatcctgtggaagt

SEQ ID NO: 222968 - DNA, 25 bp, Mus musculus
agtttatcagtcttcctgtggaagt

SEQ ID NO: 222969 - DNA, 25 bp, Mus musculus
agtttatcatccatccgaataggcc

SEQ ID NO: 222970 - DNA, 25 bp, Mus musculus
agtttatcatccttccgaataggcc

SEQ ID NO: 222971 - DNA, 25 bp, Mus musculus
agtttatcatttctctacattttaa

SEQ ID NO: 222972 - DNA, 25 bp, Mus musculus
agtttatcatttgtctacattttaa

SEQ ID NO: 222973 - DNA, 25 bp, Mus musculus
agtttatccctactcaccttcctgg

SEQ ID NO: 222974 - DNA, 25 bp, Mus musculus
agtttatccctagtcaccttcctgg

SEQ ID NO: 222975 - DNA, 25 bp, Mus musculus
agtttatcctccacaggcaggcgta

SEQ ID NO: 222976 - DNA, 25 bp, Mus musculus
agtttatcctcctcaggcaggcgta

SEQ ID NO: 222977 - DNA, 25 bp, Mus musculus
agtttatctcaaactacctcacaaa

SEQ ID NO: 222978 - DNA, 25 bp, Mus musculus
agtttatctcaatctacctcacaaa

SEQ ID NO: 222979 - DNA, 25 bp, Mus musculus
agtttatctgatatctgcccatgct

SEQ ID NO: 222980 - DNA, 25 bp, Mus musculus
agtttatctgatttctgcccatgct

SEQ ID NO: 222981 - DNA, 25 bp, Mus musculus
agtttatcttctctgagctgctggc

SEQ ID NO: 222982 - DNA, 25 bp, Mus musculus
agtttatcttctgtgagctgctggc

SEQ ID NO: 222983 - DNA, 25 bp, Mus musculus
agtttatctttgaccatgtgttcat

SEQ ID NO: 222984 - DNA, 25 bp, Mus musculus
agtttatctttgtccatgtgttcat

SEQ ID NO: 222985 - DNA, 25 bp, Mus musculus
agtttatgaacacctcttgagtggg

SEQ ID NO: 222986 - DNA, 25 bp, Mus musculus
agtttatgaacagctcttgagtggg

SEQ ID NO: 222987 - DNA, 25 bp, Mus musculus
agtttatgcatcactgtgtctccat

SEQ ID NO: 222988 - DNA, 25 bp, Mus musculus
agtttatgcatctctgtgtctccat

SEQ ID NO: 222989 - DNA, 25 bp, Mus musculus
agtttatgcggcaggtgcaacttgc

SEQ ID NO: 222990 - DNA, 25 bp, Mus musculus
agtttatgcggctggtgcaacttgc

SEQ ID NO: 222991 - DNA, 25 bp, Mus musculus
agtttatgctgtcccgctgggaaga

SEQ ID NO: 222992 - DNA, 25 bp, Mus musculus
agtttatgctgtgccgctgggaaga

SEQ ID NO: 222993 - DNA, 25 bp, Mus musculus
agtttatgtctacagtttccctcca

SEQ ID NO: 222994 - DNA, 25 bp, Mus musculus
agtttatgtctagagtttccctcca

SEQ ID NO: 222995 - DNA, 25 bp, Mus musculus
agtttatgtgacatgctgctgcagt

SEQ ID NO: 222996 - DNA, 25 bp, Mus musculus
agtttatgtgacttgctgctgcagt

SEQ ID NO: 222997 - DNA, 25 bp, Mus musculus
agtttatgtgctacggtaggaatgc

SEQ ID NO: 222998 - DNA, 25 bp, Mus musculus
agtttatgtgcttcggtaggaatgc

SEQ ID NO: 222999 - DNA, 25 bp, Mus musculus
agtttattaaatcgctgaatgttca

SEQ ID NO: 223000 - DNA, 25 bp, Mus musculus
agtttattaaatggctgaatgttca

SEQ ID NO: 223001 - DNA, 25 bp, Mus musculus
agtttattatatacctcctatgtgt

SEQ ID NO: 223002 - DNA, 25 bp, Mus musculus
agtttattatattcctcctatgtgt

SEQ ID NO: 223003 - DNA, 25 bp, Mus musculus
agtttattctctcctagaactccag

SEQ ID NO: 223004 - DNA, 25 bp, Mus musculus
agtttattctctgctagaactccag

SEQ ID NO: 223005 - DNA, 25 bp, Mus musculus
agtttattgaaaatgctgcccgtaa

SEQ ID NO: 223006 - DNA, 25 bp, Mus musculus
agtttattgaaattgctgcccgtaa

SEQ ID NO: 223007 - DNA, 25 bp, Mus musculus
agtttattgcttcccaaagatgcca

SEQ ID NO: 223008 - DNA, 25 bp, Mus musculus
agtttattgcttgccaaagatgcca

SEQ ID NO: 223009 - DNA, 25 bp, Mus musculus
agtttatttacgaggccattgccca

SEQ ID NO: 223010 - DNA, 25 bp, Mus musculus
agtttatttacgtggccattgccca

SEQ ID NO: 223011 - DNA, 25 bp, Mus musculus
agtttatttccgagtctgcctgtac

SEQ ID NO: 223012 - DNA, 25 bp, Mus musculus
agtttatttccgtgtctgcctgtac

SEQ ID NO: 223013 - DNA, 25 bp, Mus musculus
agtttatttgcaactgcccttcttt

SEQ ID NO: 223014 - DNA, 25 bp, Mus musculus
agtttatttgcatctgcccttcttt

SEQ ID NO: 223015 - DNA, 25 bp, Mus musculus
agtttatttgttccaatgactgtaa

SEQ ID NO: 223016 - DNA, 25 bp, Mus musculus
agtttatttgttgcaatgactgtaa

SEQ ID NO: 223017 - DNA, 25 bp, Mus musculus
agtttattttgcaccattggctgct

SEQ ID NO: 223018 - DNA, 25 bp, Mus musculus
agtttattttgctccattggctgct

SEQ ID NO: 223019 - DNA, 25 bp, Mus musculus
agtttcaaaatgcttctcccagttg

SEQ ID NO: 223020 - DNA, 25 bp, Mus musculus
agtttcaaaatggttctcccagttg

SEQ ID NO: 223021 - DNA, 25 bp, Mus musculus
agtttcaaacgcatgcggccagcgg

SEQ ID NO: 223022 - DNA, 25 bp, Mus musculus
agtttcaaacgcttgcggccagcgg

SEQ ID NO: 223023 - DNA, 25 bp, Mus musculus
agtttcaaactacaacccacacgtg

SEQ ID NO: 223024 - DNA, 25 bp, Mus musculus
agtttcaaactagaacccacacgtg

SEQ ID NO: 223025 - DNA, 25 bp, Mus musculus
agtttcaaatacaccttcttcgacg

SEQ ID NO: 223026 - DNA, 25 bp, Mus musculus
agtttcaaatactccttcttcgacg

SEQ ID NO: 223027 - DNA, 25 bp, Mus musculus
agtttcaaatgaagtactgtgcccc

SEQ ID NO: 223028 - DNA, 25 bp, Mus musculus
agtttcaaatgatgtactgtgcccc

SEQ ID NO: 223029 - DNA, 25 bp, Mus musculus
agtttcaaatgcctgactctacctt

SEQ ID NO: 223030 - DNA, 25 bp, Mus musculus
agtttcaaatgcgtgactctacctt

SEQ ID NO: 223031 - DNA, 25 bp, Mus musculus
agtttcaaccctattgacaacctga

SEQ ID NO: 223032 - DNA, 25 bp, Mus musculus
agtttcaacccttttgacaacctga

SEQ ID NO: 223033 - DNA, 25 bp, Mus musculus
agtttcaagaatccagtcctgtgtg

SEQ ID NO: 223034 - DNA, 25 bp, Mus musculus
agtttcaagaatgcagtcctgtgtg

SEQ ID NO: 223035 - DNA, 25 bp, Mus musculus
agtttcaagctaagcagccctgtca

SEQ ID NO: 223036 - DNA, 25 bp, Mus musculus
agtttcaagctatgcagccctgtca

SEQ ID NO: 223037 - DNA, 25 bp, Mus musculus
agtttcaatagacttcacctctccc

SEQ ID NO: 223038 - DNA, 25 bp, Mus musculus
agtttcaatagagttcacctctccc

SEQ ID NO: 223039 - DNA, 25 bp, Mus musculus
agtttcaattaaactggacgcctga

SEQ ID NO: 223040 - DNA, 25 bp, Mus musculus
agtttcaattaatctggacgcctga

SEQ ID NO: 223041 - DNA, 25 bp, Mus musculus
agtttcacaccaacatactaccaac

SEQ ID NO: 223042 - DNA, 25 bp, Mus musculus
agtttcacaccatcatactaccaac

SEQ ID NO: 223043 - DNA, 25 bp, Mus musculus
agtttcacatccctctttggagcct

SEQ ID NO: 223044 - DNA, 25 bp, Mus musculus
agtttcacatccgtctttggagcct

SEQ ID NO: 223045 - DNA, 25 bp, Mus musculus
agtttcaccctacgcacaaatgctg

SEQ ID NO: 223046 - DNA, 25 bp, Mus musculus
agtttcaccctaggcacaaatgctg

SEQ ID NO: 223047 - DNA, 25 bp, Mus musculus
agtttcaccgacatgcgcaggctgg

SEQ ID NO: 223048 - DNA, 25 bp, Mus musculus
agtttcaccgacttgcgcaggctgg

SEQ ID NO: 223049 - DNA, 25 bp, Mus musculus
agtttcacgtaaagggcactgctcc

SEQ ID NO: 223050 - DNA, 25 bp, Mus musculus
agtttcacgtaatgggcactgctcc

SEQ ID NO: 223051 - DNA, 25 bp, Mus musculus
agtttcactagtagaagccacccct

SEQ ID NO: 223052 - DNA, 25 bp, Mus musculus
agtttcactagttgaagccacccct

SEQ ID NO: 223053 - DNA, 25 bp, Mus musculus
agtttcactcaaccccgacttggtg

SEQ ID NO: 223054 - DNA, 25 bp, Mus musculus
agtttcactcaagcccgacttggtg

SEQ ID NO: 223055 - DNA, 25 bp, Mus musculus
agtttcactgtcagggccaccatgc

SEQ ID NO: 223056 - DNA, 25 bp, Mus musculus
agtttcactgtctgggccaccatgc

SEQ ID NO: 223057 - DNA, 25 bp, Mus musculus
agtttcactttgacgtagttaacag

SEQ ID NO: 223058 - DNA, 25 bp, Mus musculus
agtttcactttgtcgtagttaacag

SEQ ID NO: 223059 - DNA, 25 bp, Mus musculus
agtttcagaagcagtagagcctcgt

SEQ ID NO: 223060 - DNA, 25 bp, Mus musculus
agtttcagaagctgtagagcctcgt

SEQ ID NO: 223061 - DNA, 25 bp, Mus musculus
agtttcagacacactgtcctgttga

SEQ ID NO: 223062 - DNA, 25 bp, Mus musculus
agtttcagacactctgtcctgttga

SEQ ID NO: 223063 - DNA, 25 bp, Mus musculus
agtttcagaggaccacaccactaac

SEQ ID NO: 223064 - DNA, 25 bp, Mus musculus
agtttcagaggagcacaccactaac

SEQ ID NO: 223065 - DNA, 25 bp, Mus musculus
agtttcagcctcatagcaagtaccc

SEQ ID NO: 223066 - DNA, 25 bp, Mus musculus
agtttcagcctcttagcaagtaccc

SEQ ID NO: 223067 - DNA, 25 bp, Mus musculus
agtttcagctgcactatcgaatgca

SEQ ID NO: 223068 - DNA, 25 bp, Mus musculus
agtttcagctgctctatcgaatgca

SEQ ID NO: 223069 - DNA, 25 bp, Mus musculus
agtttcagctttccaaccatactcc

SEQ ID NO: 223070 - DNA, 25 bp, Mus musculus
agtttcagctttgcaaccatactcc

SEQ ID NO: 223071 - DNA, 25 bp, Mus musculus
agtttcaggacacctcatgatgccc

SEQ ID NO: 223072 - DNA, 25 bp, Mus musculus
agtttcaggacagctcatgatgccc

SEQ ID NO: 223073 - DNA, 25 bp, Mus musculus
agtttcagggaaacggacagtgctt

SEQ ID NO: 223074 - DNA, 25 bp, Mus musculus
agtttcagggaatcggacagtgctt

SEQ ID NO: 223075 - DNA, 25 bp, Mus musculus
agtttcaggtgcctaggcttctgaa

SEQ ID NO: 223076 - DNA, 25 bp, Mus musculus
agtttcaggtgcgtaggcttctgaa

SEQ ID NO: 223077 - DNA, 25 bp, Mus musculus
agtttcagtcctcgtatctgcttga

SEQ ID NO: 223078 - DNA, 25 bp, Mus musculus
agtttcagtcctggtatctgcttga

SEQ ID NO: 223079 - DNA, 25 bp, Mus musculus
agtttcagtcgacgatagccggcct

SEQ ID NO: 223080 - DNA, 25 bp, Mus musculus
agtttcagtcgaggatagccggcct

SEQ ID NO: 223081 - DNA, 25 bp, Mus musculus
agtttcagtgatctttggagcccga

SEQ ID NO: 223082 - DNA, 25 bp, Mus musculus
agtttcagtgatgtttggagcccga

SEQ ID NO: 223083 - DNA, 25 bp, Mus musculus
agtttcagtgtgatggttattcctt

SEQ ID NO: 223084 - DNA, 25 bp, Mus musculus
agtttcagtgtgttggttattcctt

SEQ ID NO: 223085 - DNA, 25 bp, Mus musculus
agtttcagttaacctttacagatct

SEQ ID NO: 223086 - DNA, 25 bp, Mus musculus
agtttcagttaagctttacagatct

SEQ ID NO: 223087 - DNA, 25 bp, Mus musculus
agtttcataatcacgtggtctccaa

SEQ ID NO: 223088 - DNA, 25 bp, Mus musculus
agtttcataatctcgtggtctccaa

SEQ ID NO: 223089 - DNA, 25 bp, Mus musculus
agtttcatacctcgactggatgtct

SEQ ID NO: 223090 - DNA, 25 bp, Mus musculus
agtttcatacctggactggatgtct

SEQ ID NO: 223091 - DNA, 25 bp, Mus musculus
agtttcatagttcggcctttcttca

SEQ ID NO: 223092 - DNA, 25 bp, Mus musculus
agtttcatagttgggcctttcttca

SEQ ID NO: 223093 - DNA, 25 bp, Mus musculus
agtttcatatgtagccattcctcct

SEQ ID NO: 223094 - DNA, 25 bp, Mus musculus
agtttcatatgttgccattcctcct

SEQ ID NO: 223095 - DNA, 25 bp, Mus musculus
agtttcatccacagtccattgtgtg

SEQ ID NO: 223096 - DNA, 25 bp, Mus musculus
agtttcatccactgtccattgtgtg

SEQ ID NO: 223097 - DNA, 25 bp, Mus musculus
agtttcatccagctcttatgctcta

SEQ ID NO: 223098 - DNA, 25 bp, Mus musculus
agtttcatccaggtcttatgctcta

SEQ ID NO: 223099 - DNA, 25 bp, Mus musculus
agtttcatccatccactatttacac

SEQ ID NO: 223100 - DNA, 25 bp, Mus musculus
agtttcatccatgcactatttacac

SEQ ID NO: 223101 - DNA, 25 bp, Mus musculus
agtttcatccctagtacctcaagaa

SEQ ID NO: 223102 - DNA, 25 bp, Mus musculus
agtttcatcccttgtacctcaagaa

SEQ ID NO: 223103 - DNA, 25 bp, Mus musculus
agtttcatctctattgcatcctcaa

SEQ ID NO: 223104 - DNA, 25 bp, Mus musculus
agtttcatctcttttgcatcctcaa

SEQ ID NO: 223105 - DNA, 25 bp, Mus musculus
agtttcatcttccactactgccatg

SEQ ID NO: 223106 - DNA, 25 bp, Mus musculus
agtttcatcttcgactactgccatg

SEQ ID NO: 223107 - DNA, 25 bp, Mus musculus
agtttcatgccaagagggactccct

SEQ ID NO: 223108 - DNA, 25 bp, Mus musculus
agtttcatgccatgagggactccct

SEQ ID NO: 223109 - DNA, 25 bp, Mus musculus
agtttcatgctaccactcttatgag

SEQ ID NO: 223110 - DNA, 25 bp, Mus musculus
agtttcatgctagcactcttatgag

SEQ ID NO: 223111 - DNA, 25 bp, Mus musculus
agtttcattaagaaggagctgtcca

SEQ ID NO: 223112 - DNA, 25 bp, Mus musculus
agtttcattaagtaggagctgtcca

SEQ ID NO: 223113 - DNA, 25 bp, Mus musculus
agtttcattcctatctgtggaccaa

SEQ ID NO: 223114 - DNA, 25 bp, Mus musculus
agtttcattcctttctgtggaccaa

SEQ ID NO: 223115 - DNA, 25 bp, Mus musculus
agtttcattctgagcttccgatctg

SEQ ID NO: 223116 - DNA, 25 bp, Mus musculus
agtttcattctgtgcttccgatctg

SEQ ID NO: 223117 - DNA, 25 bp, Mus musculus
agtttcatttaaaagctctgtgtaa

SEQ ID NO: 223118 - DNA, 25 bp, Mus musculus
agtttcatttaatagctctgtgtaa

SEQ ID NO: 223119 - DNA, 25 bp, Mus musculus
agtttcattttgaggttcaaattat

SEQ ID NO: 223120 - DNA, 25 bp, Mus musculus
agtttcattttgtggttcaaattat

SEQ ID NO: 223121 - DNA, 25 bp, Mus musculus
agtttccaaaccagcgccatttcaa

SEQ ID NO: 223122 - DNA, 25 bp, Mus musculus
agtttccaaacctgcgccatttcaa

SEQ ID NO: 223123 - DNA, 25 bp, Mus musculus
agtttccaagctcattcctgaggcc

SEQ ID NO: 223124 - DNA, 25 bp, Mus musculus
agtttccaagctgattcctgaggcc

SEQ ID NO: 223125 - DNA, 25 bp, Mus musculus
agtttccacactacagccaaacttt

SEQ ID NO: 223126 - DNA, 25 bp, Mus musculus
agtttccacacttcagccaaacttt

SEQ ID NO: 223127 - DNA, 25 bp, Mus musculus
agtttccacctcaggtaagcactgg

SEQ ID NO: 223128 - DNA, 25 bp, Mus musculus
agtttccacctctggtaagcactgg

SEQ ID NO: 223129 - DNA, 25 bp, Mus musculus
agtttccagacaaatctgttgcaat

SEQ ID NO: 223130 - DNA, 25 bp, Mus musculus
agtttccagacatatctgttgcaat

SEQ ID NO: 223131 - DNA, 25 bp, Mus musculus
agtttccagcagacactaatgatag

SEQ ID NO: 223132 - DNA, 25 bp, Mus musculus
agtttccagcagtcactaatgatag

SEQ ID NO: 223133 - DNA, 25 bp, Mus musculus
agtttccagctgctctgctatcttt

SEQ ID NO: 223134 - DNA, 25 bp, Mus musculus
agtttccagctggtctgctatcttt

SEQ ID NO: 223135 - DNA, 25 bp, Mus musculus
agtttccagggaacactcccgaatg

SEQ ID NO: 223136 - DNA, 25 bp, Mus musculus
agtttccagggatcactcccgaatg

SEQ ID NO: 223137 - DNA, 25 bp, Mus musculus
agtttccagtgcagcatcccaggca

SEQ ID NO: 223138 - DNA, 25 bp, Mus musculus
agtttccagtgctgcatcccaggca

SEQ ID NO: 223139 - DNA, 25 bp, Mus musculus
agtttccatattaatccgcatgtaa

SEQ ID NO: 223140 - DNA, 25 bp, Mus musculus
agtttccatatttatccgcatgtaa

SEQ ID NO: 223141 - DNA, 25 bp, Mus musculus
agtttccattgtaggtttattgcag

SEQ ID NO: 223142 - DNA, 25 bp, Mus musculus
agtttccattgttggtttattgcag

SEQ ID NO: 223143 - DNA, 25 bp, Mus musculus
agtttccatttcaatctgtattcac

SEQ ID NO: 223144 - DNA, 25 bp, Mus musculus
agtttccatttctatctgtattcac

SEQ ID NO: 223145 - DNA, 25 bp, Mus musculus
agtttcccaatgaccaatcacttga

SEQ ID NO: 223146 - DNA, 25 bp, Mus musculus
agtttcccaatgtccaatcacttga

SEQ ID NO: 223147 - DNA, 25 bp, Mus musculus
agtttcccagcaccacaacagacag

SEQ ID NO: 223148 - DNA, 25 bp, Mus musculus
agtttcccagcagcacaacagacag

SEQ ID NO: 223149 - DNA, 25 bp, Mus musculus
agtttcccagtcacgtcactgattt

SEQ ID NO: 223150 - DNA, 25 bp, Mus musculus
agtttcccagtctcgtcactgattt

SEQ ID NO: 223151 - DNA, 25 bp, Mus musculus
agtttcccatcactgattgaaaatc

SEQ ID NO: 223152 - DNA, 25 bp, Mus musculus
agtttcccatcagtgattgaaaatc

SEQ ID NO: 223153 - DNA, 25 bp, Mus musculus
agtttcccatgcagtgctaacccag

SEQ ID NO: 223154 - DNA, 25 bp, Mus musculus
agtttcccatgctgtgctaacccag

SEQ ID NO: 223155 - DNA, 25 bp, Mus musculus
agtttccccattcctcagaatttga

SEQ ID NO: 223156 - DNA, 25 bp, Mus musculus
agtttccccattgctcagaatttga

SEQ ID NO: 223157 - DNA, 25 bp, Mus musculus
agtttcccctcaagcgacaagtagt

SEQ ID NO: 223158 - DNA, 25 bp, Mus musculus
agtttcccctcatgcgacaagtagt

SEQ ID NO: 223159 - DNA, 25 bp, Mus musculus
agtttcccctgaactgcagagagga

SEQ ID NO: 223160 - DNA, 25 bp, Mus musculus
agtttcccctgacctggtgagagca

SEQ ID NO: 223161 - DNA, 25 bp, Mus musculus
agtttcccctgagctggtgagagca

SEQ ID NO: 223162 - DNA, 25 bp, Mus musculus
agtttcccctgatctgcagagagga

SEQ ID NO: 223163 - DNA, 25 bp, Mus musculus
agtttccccttcagtgattagagag

SEQ ID NO: 223164 - DNA, 25 bp, Mus musculus
agtttccccttctgtgattagagag

SEQ ID NO: 223165 - DNA, 25 bp, Mus musculus
agtttccctctgaactcaacagtca

SEQ ID NO: 223166 - DNA, 25 bp, Mus musculus
agtttccctctgtactcaacagtca

SEQ ID NO: 223167 - DNA, 25 bp, Mus musculus
agtttccctgcacgcacaaggacat

SEQ ID NO: 223168 - DNA, 25 bp, Mus musculus
agtttccctgcaggcacaaggacat

SEQ ID NO: 223169 - DNA, 25 bp, Mus musculus
agtttcctagggatgtccatgcgga

SEQ ID NO: 223170 - DNA, 25 bp, Mus musculus
agtttcctagggttgtccatgcgga

SEQ ID NO: 223171 - DNA, 25 bp, Mus musculus
agtttcctaggtaaactcctcattg

SEQ ID NO: 223172 - DNA, 25 bp, Mus musculus
agtttcctaggtctatgtgtgctta

SEQ ID NO: 223173 - DNA, 25 bp, Mus musculus
agtttcctaggtgtatgtgtgctta

SEQ ID NO: 223174 - DNA, 25 bp, Mus musculus
agtttcctaggttaactcctcattg

SEQ ID NO: 223175 - DNA, 25 bp, Mus musculus
agtttcctcccaacaaacctgaaat

SEQ ID NO: 223176 - DNA, 25 bp, Mus musculus
agtttcctcccatcaaacctgaaat

SEQ ID NO: 223177 - DNA, 25 bp, Mus musculus
agtttcctccttaaatgcatctctg

SEQ ID NO: 223178 - DNA, 25 bp, Mus musculus
agtttcctccttatgtctctatgtc

SEQ ID NO: 223179 - DNA, 25 bp, Mus musculus
agtttcctcctttaatgcatctctg

SEQ ID NO: 223180 - DNA, 25 bp, Mus musculus
agtttcctccttttgtctctatgtc

SEQ ID NO: 223181 - DNA, 25 bp, Mus musculus
agtttcctctccagcgcttggaagc

SEQ ID NO: 223182 - DNA, 25 bp, Mus musculus
agtttcctctcctgcgcttggaagc

SEQ ID NO: 223183 - DNA, 25 bp, Mus musculus
agtttcctctgactaggtctggtga

SEQ ID NO: 223184 - DNA, 25 bp, Mus musculus
agtttcctctgagtaggtctggtga

SEQ ID NO: 223185 - DNA, 25 bp, Mus musculus
agtttcctgaccaaacatactttgg

SEQ ID NO: 223186 - DNA, 25 bp, Mus musculus
agtttcctgacctaacatactttgg

SEQ ID NO: 223187 - DNA, 25 bp, Mus musculus
agtttcctgatcagtaccagaccag

SEQ ID NO: 223188 - DNA, 25 bp, Mus musculus
agtttcctgatctgtaccagaccag

SEQ ID NO: 223189 - DNA, 25 bp, Mus musculus
agtttcctggttacagatctggaca

SEQ ID NO: 223190 - DNA, 25 bp, Mus musculus
agtttcctggtttcagatctggaca

SEQ ID NO: 223191 - DNA, 25 bp, Mus musculus
agtttcctgtatcgtctgggtgccc

SEQ ID NO: 223192 - DNA, 25 bp, Mus musculus
agtttcctgtatggtctgggtgccc

SEQ ID NO: 223193 - DNA, 25 bp, Mus musculus
agtttcctgtcaacattccacatgc

SEQ ID NO: 223194 - DNA, 25 bp, Mus musculus
agtttcctgtcatcattccacatgc

SEQ ID NO: 223195 - DNA, 25 bp, Mus musculus
agtttcctgtggatttgtccatgac

SEQ ID NO: 223196 - DNA, 25 bp, Mus musculus
agtttcctgtggttttgtccatgac

SEQ ID NO: 223197 - DNA, 25 bp, Mus musculus
agtttcctgtgtactgggtctcctc

SEQ ID NO: 223198 - DNA, 25 bp, Mus musculus
agtttcctgtgttctgggtctcctc

SEQ ID NO: 223199 - DNA, 25 bp, Mus musculus
agtttccttactcctggtattacag

SEQ ID NO: 223200 - DNA, 25 bp, Mus musculus
agtttccttactgctggtattacag

SEQ ID NO: 223201 - DNA, 25 bp, Mus musculus
agtttccttctgctgtgccaaggat

SEQ ID NO: 223202 - DNA, 25 bp, Mus musculus
agtttccttctggtgtgccaaggat

SEQ ID NO: 223203 - DNA, 25 bp, Mus musculus
agtttccttggacagtacacagcga

SEQ ID NO: 223204 - DNA, 25 bp, Mus musculus
agtttccttggagagtacacagcga

SEQ ID NO: 223205 - DNA, 25 bp, Mus musculus
agtttccttgtcacttctgaaggat

SEQ ID NO: 223206 - DNA, 25 bp, Mus musculus
agtttccttgtctcttctgaaggat

SEQ ID NO: 223207 - DNA, 25 bp, Mus musculus
agtttccttttgaacacagtccttg

SEQ ID NO: 223208 - DNA, 25 bp, Mus musculus
agtttccttttgtacacagtccttg

SEQ ID NO: 223209 - DNA, 25 bp, Mus musculus
agtttcgaacctccaatccttatgc

SEQ ID NO: 223210 - DNA, 25 bp, Mus musculus
agtttcgaacctgcaatccttatgc

SEQ ID NO: 223211 - DNA, 25 bp, Mus musculus
agtttcgaagtcactgattagccag

SEQ ID NO: 223212 - DNA, 25 bp, Mus musculus
agtttcgaagtctctgattagccag

SEQ ID NO: 223213 - DNA, 25 bp, Mus musculus
agtttcgaagtgacggcattaagcc

SEQ ID NO: 223214 - DNA, 25 bp, Mus musculus
agtttcgaagtgtcggcattaagcc

SEQ ID NO: 223215 - DNA, 25 bp, Mus musculus
agtttcgaggcacagtccgggtaca

SEQ ID NO: 223216 - DNA, 25 bp, Mus musculus
agtttcgaggcagagtccgggtaca

SEQ ID NO: 223217 - DNA, 25 bp, Mus musculus
agtttcgataccagctctatgctac

SEQ ID NO: 223218 - DNA, 25 bp, Mus musculus
agtttcgatacctgctctatgctac

SEQ ID NO: 223219 - DNA, 25 bp, Mus musculus
agtttcgatcataaagctctctttt

SEQ ID NO: 223220 - DNA, 25 bp, Mus musculus
agtttcgatcattaagctctctttt

SEQ ID NO: 223221 - DNA, 25 bp, Mus musculus
agtttcgccggaatgaacgtgccat

SEQ ID NO: 223222 - DNA, 25 bp, Mus musculus
agtttcgccggattgaacgtgccat

SEQ ID NO: 223223 - DNA, 25 bp, Mus musculus
agtttcgctaccaggacgcggccgg

SEQ ID NO: 223224 - DNA, 25 bp, Mus musculus
agtttcgctacctggacgcggccgg

SEQ ID NO: 223225 - DNA, 25 bp, Mus musculus
agtttcgctgatcttggttattaaa

SEQ ID NO: 223226 - DNA, 25 bp, Mus musculus
agtttcgctgatgttggttattaaa

SEQ ID NO: 223227 - DNA, 25 bp, Mus musculus
agtttcgctgccacgagactcttct

SEQ ID NO: 223228 - DNA, 25 bp, Mus musculus
agtttcgctgcctcgagactcttct

SEQ ID NO: 223229 - DNA, 25 bp, Mus musculus
agtttcggacagatatgacttttgt

SEQ ID NO: 223230 - DNA, 25 bp, Mus musculus
agtttcggacagttatgacttttgt

SEQ ID NO: 223231 - DNA, 25 bp, Mus musculus
agtttcggctacagccatgtataaa

SEQ ID NO: 223232 - DNA, 25 bp, Mus musculus
agtttcggctactgccatgtataaa

SEQ ID NO: 223233 - DNA, 25 bp, Mus musculus
agtttcgtaactcagtccctcagaa

SEQ ID NO: 223234 - DNA, 25 bp, Mus musculus
agtttcgtaactgagtccctcagaa

SEQ ID NO: 223235 - DNA, 25 bp, Mus musculus
agtttcgttgttaccagcatctcat

SEQ ID NO: 223236 - DNA, 25 bp, Mus musculus
agtttcgttgtttccagcatctcat

SEQ ID NO: 223237 - DNA, 25 bp, Mus musculus
agtttctaagtccaattgcctctaa

SEQ ID NO: 223238 - DNA, 25 bp, Mus musculus
agtttctaagtcgaattgcctctaa

SEQ ID NO: 223239 - DNA, 25 bp, Mus musculus
agtttctacactagtatcttgcagt

SEQ ID NO: 223240 - DNA, 25 bp, Mus musculus
agtttctacacttgtatcttgcagt

SEQ ID NO: 223241 - DNA, 25 bp, Mus musculus
agtttctactgccattttgagcttg

SEQ ID NO: 223242 - DNA, 25 bp, Mus musculus
agtttctactgcgattttgagcttg

SEQ ID NO: 223243 - DNA, 25 bp, Mus musculus
agtttctacttcagcttgccgctag

SEQ ID NO: 223244 - DNA, 25 bp, Mus musculus
agtttctacttctgcttgccgctag

SEQ ID NO: 223245 - DNA, 25 bp, Mus musculus
agtttctagactcccttccttggct

SEQ ID NO: 223246 - DNA, 25 bp, Mus musculus
agtttctagactgccttccttggct

SEQ ID NO: 223247 - DNA, 25 bp, Mus musculus
agtttctagtctcagctcccagtat

SEQ ID NO: 223248 - DNA, 25 bp, Mus musculus
agtttctagtctgagctcccagtat

SEQ ID NO: 223249 - DNA, 25 bp, Mus musculus
agtttctatatcatgtgctacctaa

SEQ ID NO: 223250 - DNA, 25 bp, Mus musculus
agtttctatatcttgtgctacctaa

SEQ ID NO: 223251 - DNA, 25 bp, Mus musculus
agtttctattctaactccaaccact

SEQ ID NO: 223252 - DNA, 25 bp, Mus musculus
agtttctattcttactccaaccact

SEQ ID NO: 223253 - DNA, 25 bp, Mus musculus
agtttctcacacagcagtaacccct

SEQ ID NO: 223254 - DNA, 25 bp, Mus musculus
agtttctcacactgcagtaacccct

SEQ ID NO: 223255 - DNA, 25 bp, Mus musculus
agtttctcagaactttaagtgcaag

SEQ ID NO: 223256 - DNA, 25 bp, Mus musculus
agtttctcagaagtttaagtgcaag

SEQ ID NO: 223257 - DNA, 25 bp, Mus musculus
agtttctcagatcaaggtcctcagc

SEQ ID NO: 223258 - DNA, 25 bp, Mus musculus
agtttctcagatgaaggtcctcagc

SEQ ID NO: 223259 - DNA, 25 bp, Mus musculus
agtttctcagtcaaccacttctgat

SEQ ID NO: 223260 - DNA, 25 bp, Mus musculus
agtttctcagtctaccacttctgat

SEQ ID NO: 223261 - DNA, 25 bp, Mus musculus
agtttctcatgaaggccagctggct

SEQ ID NO: 223262 - DNA, 25 bp, Mus musculus
agtttctcatgatggccagctggct

SEQ ID NO: 223263 - DNA, 25 bp, Mus musculus
agtttctcctataacactgtctcac

SEQ ID NO: 223264 - DNA, 25 bp, Mus musculus
agtttctcctattacactgtctcac

SEQ ID NO: 223265 - DNA, 25 bp, Mus musculus
agtttctcgtttagtctctctccag

SEQ ID NO: 223266 - DNA, 25 bp, Mus musculus
agtttctcgttttgtctctctccag

SEQ ID NO: 223267 - DNA, 25 bp, Mus musculus
agtttctctcctcacttgtaaacat

SEQ ID NO: 223268 - DNA, 25 bp, Mus musculus
agtttctctcctgacttgtaaacat

SEQ ID NO: 223269 - DNA, 25 bp, Mus musculus
agtttctctgcgaacatagggttgt

SEQ ID NO: 223270 - DNA, 25 bp, Mus musculus
agtttctctgcgtacatagggttgt

SEQ ID NO: 223271 - DNA, 25 bp, Mus musculus
agtttctcttgaatgttcttgctaa

SEQ ID NO: 223272 - DNA, 25 bp, Mus musculus
agtttctcttgattgttcttgctaa

SEQ ID NO: 223273 - DNA, 25 bp, Mus musculus
agtttctgaatcctgcaagcacata

SEQ ID NO: 223274 - DNA, 25 bp, Mus musculus
agtttctgaatcgtgcaagcacata

SEQ ID NO: 223275 - DNA, 25 bp, Mus musculus
agtttctgactcctcatagtgtgaa

SEQ ID NO: 223276 - DNA, 25 bp, Mus musculus
agtttctgactcgtcatagtgtgaa

SEQ ID NO: 223277 - DNA, 25 bp, Mus musculus
agtttctgagtaacagcgatttgca

SEQ ID NO: 223278 - DNA, 25 bp, Mus musculus
agtttctgagtatcagcgatttgca

SEQ ID NO: 223279 - DNA, 25 bp, Mus musculus
agtttctgatatccagtctcagctg

SEQ ID NO: 223280 - DNA, 25 bp, Mus musculus
agtttctgatatgcagtctcagctg

SEQ ID NO: 223281 - DNA, 25 bp, Mus musculus
agtttctgatgcacagtcccctgga

SEQ ID NO: 223282 - DNA, 25 bp, Mus musculus
agtttctgatgctcagtcccctgga

SEQ ID NO: 223283 - DNA, 25 bp, Mus musculus
agtttctgcacgcttggagtctgta

SEQ ID NO: 223284 - DNA, 25 bp, Mus musculus
agtttctgcacggttggagtctgta

SEQ ID NO: 223285 - DNA, 25 bp, Mus musculus
agtttctgcagaacccaccgaaagt

SEQ ID NO: 223286 - DNA, 25 bp, Mus musculus
agtttctgcagatcccaccgaaagt

SEQ ID NO: 223287 - DNA, 25 bp, Mus musculus
agtttctgccctctttcttagtctg

SEQ ID NO: 223288 - DNA, 25 bp, Mus musculus
agtttctgccctgtttcttagtctg

SEQ ID NO: 223289 - DNA, 25 bp, Mus musculus
agtttctgcctcaacgagctcagta

SEQ ID NO: 223290 - DNA, 25 bp, Mus musculus
agtttctgcctctacgagctcagta

SEQ ID NO: 223291 - DNA, 25 bp, Mus musculus
agtttctgcgtgagccctgcctatt

SEQ ID NO: 223292 - DNA, 25 bp, Mus musculus
agtttctgcgtgtgccctgcctatt

SEQ ID NO: 223293 - DNA, 25 bp, Mus musculus
agtttctgctcaatggctggtttca

SEQ ID NO: 223294 - DNA, 25 bp, Mus musculus
agtttctgctcattggctggtttca

SEQ ID NO: 223295 - DNA, 25 bp, Mus musculus
agtttctgctctccacacatgtaga

SEQ ID NO: 223296 - DNA, 25 bp, Mus musculus
agtttctgctctgcacacatgtaga

SEQ ID NO: 223297 - DNA, 25 bp, Mus musculus
agtttctgcttcaactggatgtgga

SEQ ID NO: 223298 - DNA, 25 bp, Mus musculus
agtttctgcttctactggatgtgga

SEQ ID NO: 223299 - DNA, 25 bp, Mus musculus
agtttctggcctcagaggatcacaa

SEQ ID NO: 223300 - DNA, 25 bp, Mus musculus
agtttctggcctgagaggatcacaa

SEQ ID NO: 223301 - DNA, 25 bp, Mus musculus
agtttctggctcaccatgtctccta

SEQ ID NO: 223302 - DNA, 25 bp, Mus musculus
agtttctggctctccatgtctccta

SEQ ID NO: 223303 - DNA, 25 bp, Mus musculus
agtttctggttcaagggccttgtgg

SEQ ID NO: 223304 - DNA, 25 bp, Mus musculus
agtttctggttctagggccttgtgg

SEQ ID NO: 223305 - DNA, 25 bp, Mus musculus
agtttctgtcacagcatgttacaga

SEQ ID NO: 223306 - DNA, 25 bp, Mus musculus
agtttctgtcactgcatgttacaga

SEQ ID NO: 223307 - DNA, 25 bp, Mus musculus
agtttctgtcccaggaatattgtct

SEQ ID NO: 223308 - DNA, 25 bp, Mus musculus
agtttctgtccctggaatattgtct

SEQ ID NO: 223309 - DNA, 25 bp, Mus musculus
agtttctgtccgagtgggtcaggca

SEQ ID NO: 223310 - DNA, 25 bp, Mus musculus
agtttctgtccgtgtgggtcaggca

SEQ ID NO: 223311 - DNA, 25 bp, Mus musculus
agtttctgttacactactgtctaaa

SEQ ID NO: 223312 - DNA, 25 bp, Mus musculus
agtttctgttactctactgtctaaa

SEQ ID NO: 223313 - DNA, 25 bp, Mus musculus
agtttcttaccaacaggtgcttcct

SEQ ID NO: 223314 - DNA, 25 bp, Mus musculus
agtttcttaccatcaggtgcttcct

SEQ ID NO: 223315 - DNA, 25 bp, Mus musculus
agtttcttcaaaactgcccaatatt

SEQ ID NO: 223316 - DNA, 25 bp, Mus musculus
agtttcttcaaatctgcccaatatt

SEQ ID NO: 223317 - DNA, 25 bp, Mus musculus
agtttcttcactagaccccaggagt

SEQ ID NO: 223318 - DNA, 25 bp, Mus musculus
agtttcttcacttgaccccaggagt

SEQ ID NO: 223319 - DNA, 25 bp, Mus musculus
agtttcttccacaattttagcctgc

SEQ ID NO: 223320 - DNA, 25 bp, Mus musculus
agtttcttccactattttagcctgc

SEQ ID NO: 223321 - DNA, 25 bp, Mus musculus
agtttcttccccattgagagactag

SEQ ID NO: 223322 - DNA, 25 bp, Mus musculus
agtttcttcccctttgagagactag

SEQ ID NO: 223323 - DNA, 25 bp, Mus musculus
agtttcttccggaactggcttagct

SEQ ID NO: 223324 - DNA, 25 bp, Mus musculus
agtttcttccggtactggcttagct

SEQ ID NO: 223325 - DNA, 25 bp, Mus musculus
agtttcttctccagcccttgcagct

SEQ ID NO: 223326 - DNA, 25 bp, Mus musculus
agtttcttctcctgcccttgcagct

SEQ ID NO: 223327 - DNA, 25 bp, Mus musculus
agtttcttgagaacagagtgttttt

SEQ ID NO: 223328 - DNA, 25 bp, Mus musculus
agtttcttgagatcagagtgttttt

SEQ ID NO: 223329 - DNA, 25 bp, Mus musculus
agtttcttgccgcagctaaatcaaa

SEQ ID NO: 223330 - DNA, 25 bp, Mus musculus
agtttcttgccggagctaaatcaaa

SEQ ID NO: 223331 - DNA, 25 bp, Mus musculus
agtttcttgggccagcaactagcta

SEQ ID NO: 223332 - DNA, 25 bp, Mus musculus
agtttcttgggcgagcaactagcta

SEQ ID NO: 223333 - DNA, 25 bp, Mus musculus
agtttcttgtagctactgcagtctg

SEQ ID NO: 223334 - DNA, 25 bp, Mus musculus
agtttcttgtaggtactgcagtctg

SEQ ID NO: 223335 - DNA, 25 bp, Mus musculus
agtttcttgtctatgctctgagtgt

SEQ ID NO: 223336 - DNA, 25 bp, Mus musculus
agtttcttgtctttgctctgagtgt

SEQ ID NO: 223337 - DNA, 25 bp, Mus musculus
agtttcttgtggcaggcagttgaca

SEQ ID NO: 223338 - DNA, 25 bp, Mus musculus
agtttcttgtgggaggcagttgaca

SEQ ID NO: 223339 - DNA, 25 bp, Mus musculus
agtttctttcaactttgccttcctg

SEQ ID NO: 223340 - DNA, 25 bp, Mus musculus
agtttctttcaagtttgccttcctg

SEQ ID NO: 223341 - DNA, 25 bp, Mus musculus
agtttctttcctcctattctgtatt

SEQ ID NO: 223342 - DNA, 25 bp, Mus musculus
agtttctttcctgctattctgtatt

SEQ ID NO: 223343 - DNA, 25 bp, Mus musculus
agtttctttgcaacatcaccaatgg

SEQ ID NO: 223344 - DNA, 25 bp, Mus musculus
agtttctttgcatcatcaccaatgg

SEQ ID NO: 223345 - DNA, 25 bp, Mus musculus
agtttctttggcatgcaggcctatt

SEQ ID NO: 223346 - DNA, 25 bp, Mus musculus
agtttctttggcttgcaggcctatt

SEQ ID NO: 223347 - DNA, 25 bp, Mus musculus
agtttctttttcatgatgtggtaac

SEQ ID NO: 223348 - DNA, 25 bp, Mus musculus
agtttctttttcttgatgtggtaac

SEQ ID NO: 223349 - DNA, 25 bp, Mus musculus
agtttgaacagaagacctaccacaa

SEQ ID NO: 223350 - DNA, 25 bp, Mus musculus
agtttgaacagatgacctaccacaa

SEQ ID NO: 223351 - DNA, 25 bp, Mus musculus
agtttgaaccctcggcctacaggtg

SEQ ID NO: 223352 - DNA, 25 bp, Mus musculus
agtttgaaccctgggcctacaggtg

SEQ ID NO: 223353 - DNA, 25 bp, Mus musculus
agtttgaacgtgactttgcctctcg

SEQ ID NO: 223354 - DNA, 25 bp, Mus musculus
agtttgaacgtgtctttgcctctcg

SEQ ID NO: 223355 - DNA, 25 bp, Mus musculus
agtttgaactatccacggtgtgcca

SEQ ID NO: 223356 - DNA, 25 bp, Mus musculus
agtttgaactatgcacggtgtgcca

SEQ ID NO: 223357 - DNA, 25 bp, Mus musculus
agtttgaagctgaggctgctccacc

SEQ ID NO: 223358 - DNA, 25 bp, Mus musculus
agtttgaagctgtggctgctccacc

SEQ ID NO: 223359 - DNA, 25 bp, Mus musculus
agtttgaatagtaccttccatccca

SEQ ID NO: 223360 - DNA, 25 bp, Mus musculus
agtttgaatagttccttccatccca

SEQ ID NO: 223361 - DNA, 25 bp, Mus musculus
agtttgaatcatccgcagctcagtt

SEQ ID NO: 223362 - DNA, 25 bp, Mus musculus
agtttgaatcatgcgcagctcagtt

SEQ ID NO: 223363 - DNA, 25 bp, Mus musculus
agtttgaattatcctgaatccatga

SEQ ID NO: 223364 - DNA, 25 bp, Mus musculus
agtttgaattatgctgaatccatga

SEQ ID NO: 223365 - DNA, 25 bp, Mus musculus
agtttgacaaagacctcactgcctt

SEQ ID NO: 223366 - DNA, 25 bp, Mus musculus
agtttgacaaagtcctcactgcctt

SEQ ID NO: 223367 - DNA, 25 bp, Mus musculus
agtttgacaggccatttcctaggaa

SEQ ID NO: 223368 - DNA, 25 bp, Mus musculus
agtttgacaggcgatttcctaggaa

SEQ ID NO: 223369 - DNA, 25 bp, Mus musculus
agtttgacctcaacattgccttcct

SEQ ID NO: 223370 - DNA, 25 bp, Mus musculus
agtttgacctcatcattgccttcct

SEQ ID NO: 223371 - DNA, 25 bp, Mus musculus
agtttgacctgaacagcccctggga

SEQ ID NO: 223372 - DNA, 25 bp, Mus musculus
agtttgacctgatcagcccctggga

SEQ ID NO: 223373 - DNA, 25 bp, Mus musculus
agtttgacgagcagcaccagctgaa

SEQ ID NO: 223374 - DNA, 25 bp, Mus musculus
agtttgacgagctgcaccagctgaa

SEQ ID NO: 223375 - DNA, 25 bp, Mus musculus
agtttgagaccaccacgggatacat

SEQ ID NO: 223376 - DNA, 25 bp, Mus musculus
agtttgagaccagcacgggatacat

SEQ ID NO: 223377 - DNA, 25 bp, Mus musculus
agtttgagactacccaggactacat

SEQ ID NO: 223378 - DNA, 25 bp, Mus musculus
agtttgagactagccaggactacat

SEQ ID NO: 223379 - DNA, 25 bp, Mus musculus
agtttgaggaagcttctaggctgga

SEQ ID NO: 223380 - DNA, 25 bp, Mus musculus
agtttgaggaaggttctaggctgga

SEQ ID NO: 223381 - DNA, 25 bp, Mus musculus
agtttgaggcggcatccacggcacc

SEQ ID NO: 223382 - DNA, 25 bp, Mus musculus
agtttgaggcgggatccacggcacc

SEQ ID NO: 223383 - DNA, 25 bp, Mus musculus
agtttgaggctgagatccttgtcct

SEQ ID NO: 223384 - DNA, 25 bp, Mus musculus
agtttgaggctgtgatccttgtcct

SEQ ID NO: 223385 - DNA, 25 bp, Mus musculus
agtttgaggcttccatcttctgaag

SEQ ID NO: 223386 - DNA, 25 bp, Mus musculus
agtttgaggcttgcatcttctgaag

SEQ ID NO: 223387 - DNA, 25 bp, Mus musculus
agtttgagtatcactatccctttcc

SEQ ID NO: 223388 - DNA, 25 bp, Mus musculus
agtttgagtatctctatccctttcc

SEQ ID NO: 223389 - DNA, 25 bp, Mus musculus
agtttgagtcccagatgcacccaga

SEQ ID NO: 223390 - DNA, 25 bp, Mus musculus
agtttgagtccctgatgcacccaga

SEQ ID NO: 223391 - DNA, 25 bp, Mus musculus
agtttgatatacatctgagtgctta

SEQ ID NO: 223392 - DNA, 25 bp, Mus musculus
agtttgatatacttctgagtgctta

SEQ ID NO: 223393 - DNA, 25 bp, Mus musculus
agtttgatattcattgctctgctgt

SEQ ID NO: 223394 - DNA, 25 bp, Mus musculus
agtttgatattctttgctctgctgt

SEQ ID NO: 223395 - DNA, 25 bp, Mus musculus
agtttgatcagtacagcagcatgca

SEQ ID NO: 223396 - DNA, 25 bp, Mus musculus
agtttgatcagtcccttttgaggtc

SEQ ID NO: 223397 - DNA, 25 bp, Mus musculus
agtttgatcagtcctggcacaagag

SEQ ID NO: 223398 - DNA, 25 bp, Mus musculus
agtttgatcagtgccttttgaggtc

SEQ ID NO: 223399 - DNA, 25 bp, Mus musculus
agtttgatcagtgctggcacaagag

SEQ ID NO: 223400 - DNA, 25 bp, Mus musculus
agtttgatcagttcagcagcatgca

SEQ ID NO: 223401 - DNA, 25 bp, Mus musculus
agtttgatcatcaggtctttttctt

SEQ ID NO: 223402 - DNA, 25 bp, Mus musculus
agtttgatcatctggtctttttctt

SEQ ID NO: 223403 - DNA, 25 bp, Mus musculus
agtttgatccatcctctgatgagcg

SEQ ID NO: 223404 - DNA, 25 bp, Mus musculus
agtttgatccatgctctgatgagcg

SEQ ID NO: 223405 - DNA, 25 bp, Mus musculus
agtttgatctccatggctcaagacc

SEQ ID NO: 223406 - DNA, 25 bp, Mus musculus
agtttgatctccttggctcaagacc

SEQ ID NO: 223407 - DNA, 25 bp, Mus musculus
agtttgatctctcggtcccataggg

SEQ ID NO: 223408 - DNA, 25 bp, Mus musculus
agtttgatctctgggtcccataggg

SEQ ID NO: 223409 - DNA, 25 bp, Mus musculus
agtttgatgcatcccattatgacag

SEQ ID NO: 223410 - DNA, 25 bp, Mus musculus
agtttgatgcatgccattatgacag

SEQ ID NO: 223411 - DNA, 25 bp, Mus musculus
agtttgatgctaactttgcctgtct

SEQ ID NO: 223412 - DNA, 25 bp, Mus musculus
agtttgatgctatctttgcctgtct

SEQ ID NO: 223413 - DNA, 25 bp, Mus musculus
agtttgatgtggaaggttctttctc

SEQ ID NO: 223414 - DNA, 25 bp, Mus musculus
agtttgatgtggtaggttctttctc

SEQ ID NO: 223415 - DNA, 25 bp, Mus musculus
agtttgattatccaccttgctttct

SEQ ID NO: 223416 - DNA, 25 bp, Mus musculus
agtttgattatcgaccttgctttct

SEQ ID NO: 223417 - DNA, 25 bp, Mus musculus
agtttgattcccaggcgagaccagc

SEQ ID NO: 223418 - DNA, 25 bp, Mus musculus
agtttgattccctggcgagaccagc

SEQ ID NO: 223419 - DNA, 25 bp, Mus musculus
agtttgattgcaccatcatgtcttt

SEQ ID NO: 223420 - DNA, 25 bp, Mus musculus
agtttgattgcagcatcatgtcttt

SEQ ID NO: 223421 - DNA, 25 bp, Mus musculus
agtttgattggcaaccttctggtct

SEQ ID NO: 223422 - DNA, 25 bp, Mus musculus
agtttgattggctaccttctggtct

SEQ ID NO: 223423 - DNA, 25 bp, Mus musculus
agtttgattttcatggccctgcata

SEQ ID NO: 223424 - DNA, 25 bp, Mus musculus
agtttgattttcttggccctgcata

SEQ ID NO: 223425 - DNA, 25 bp, Mus musculus
agtttgcaatgtctaagccctgtaa

SEQ ID NO: 223426 - DNA, 25 bp, Mus musculus
agtttgcaatgtgtaagccctgtaa

SEQ ID NO: 223427 - DNA, 25 bp, Mus musculus
agtttgcagagcaattaccgaggtg

SEQ ID NO: 223428 - DNA, 25 bp, Mus musculus
agtttgcagagctattaccgaggtg

SEQ ID NO: 223429 - DNA, 25 bp, Mus musculus
agtttgcagagtatccttctgggac

SEQ ID NO: 223430 - DNA, 25 bp, Mus musculus
agtttgcagagtttccttctgggac

SEQ ID NO: 223431 - DNA, 25 bp, Mus musculus
agtttgcagtacatgacatgtattt

SEQ ID NO: 223432 - DNA, 25 bp, Mus musculus
agtttgcagtacttgacatgtattt

SEQ ID NO: 223433 - DNA, 25 bp, Mus musculus
agtttgcagtgtatggtttctataa

SEQ ID NO: 223434 - DNA, 25 bp, Mus musculus
agtttgcagtgtttggtttctataa

SEQ ID NO: 223435 - DNA, 25 bp, Mus musculus
agtttgcatcatattccttttaaga

SEQ ID NO: 223436 - DNA, 25 bp, Mus musculus
agtttgcatcatcaccttgactgtg

SEQ ID NO: 223437 - DNA, 25 bp, Mus musculus
agtttgcatcatgaccttgactgtg

SEQ ID NO: 223438 - DNA, 25 bp, Mus musculus
agtttgcatcattttccttttaaga

SEQ ID NO: 223439 - DNA, 25 bp, Mus musculus
agtttgcattacaacccagcagttc

SEQ ID NO: 223440 - DNA, 25 bp, Mus musculus
agtttgcattactacccagcagttc

SEQ ID NO: 223441 - DNA, 25 bp, Mus musculus
agtttgcatttgattcttctctgaa

SEQ ID NO: 223442 - DNA, 25 bp, Mus musculus
agtttgcatttgtttcttctctgaa

SEQ ID NO: 223443 - DNA, 25 bp, Mus musculus
agtttgccaaacaaagcgtgaaatg

SEQ ID NO: 223444 - DNA, 25 bp, Mus musculus
agtttgccaaactaagcgtgaaatg

SEQ ID NO: 223445 - DNA, 25 bp, Mus musculus
agtttgccagtaacactgccatcag

SEQ ID NO: 223446 - DNA, 25 bp, Mus musculus
agtttgccagtatcactgccatcag

SEQ ID NO: 223447 - DNA, 25 bp, Mus musculus
agtttgccatgcctatagtctgtat

SEQ ID NO: 223448 - DNA, 25 bp, Mus musculus
agtttgccatgcgtatagtctgtat

SEQ ID NO: 223449 - DNA, 25 bp, Mus musculus
agtttgcccaccagacctatatcag

SEQ ID NO: 223450 - DNA, 25 bp, Mus musculus
agtttgcccacctgacctatatcag

SEQ ID NO: 223451 - DNA, 25 bp, Mus musculus
agtttgcccaggacgtatttctgta

SEQ ID NO: 223452 - DNA, 25 bp, Mus musculus
agtttgcccaggtcgtatttctgta

SEQ ID NO: 223453 - DNA, 25 bp, Mus musculus
agtttgccctgtcgcatgtattctc

SEQ ID NO: 223454 - DNA, 25 bp, Mus musculus
agtttgccctgtggcatgtattctc

SEQ ID NO: 223455 - DNA, 25 bp, Mus musculus
agtttgccgagcacgtcttccgcac

SEQ ID NO: 223456 - DNA, 25 bp, Mus musculus
agtttgccgagctcgtcttccgcac

SEQ ID NO: 223457 - DNA, 25 bp, Mus musculus
agtttgcctctgcagactgtttctt

SEQ ID NO: 223458 - DNA, 25 bp, Mus musculus
agtttgcctctggagactgtttctt

SEQ ID NO: 223459 - DNA, 25 bp, Mus musculus
agtttgcctggtattagtcacctat

SEQ ID NO: 223460 - DNA, 25 bp, Mus musculus
agtttgcctggttttagtcacctat

SEQ ID NO: 223461 - DNA, 25 bp, Mus musculus
agtttgcctgtcaaatccccaaaga

SEQ ID NO: 223462 - DNA, 25 bp, Mus musculus
agtttgcctgtcagagcctcacaaa

SEQ ID NO: 223463 - DNA, 25 bp, Mus musculus
agtttgcctgtctaatccccaaaga

SEQ ID NO: 223464 - DNA, 25 bp, Mus musculus
agtttgcctgtctgagcctcacaaa

SEQ ID NO: 223465 - DNA, 25 bp, Mus musculus
agtttgccttcaattggcggcagga

SEQ ID NO: 223466 - DNA, 25 bp, Mus musculus
agtttgccttcatttggcggcagga

SEQ ID NO: 223467 - DNA, 25 bp, Mus musculus
agtttgcgacggatctttactgttg

SEQ ID NO: 223468 - DNA, 25 bp, Mus musculus
agtttgcgacggcaccagtgtgtct

SEQ ID NO: 223469 - DNA, 25 bp, Mus musculus
agtttgcgacgggaccagtgtgtct

SEQ ID NO: 223470 - DNA, 25 bp, Mus musculus
agtttgcgacggttctttactgttg

SEQ ID NO: 223471 - DNA, 25 bp, Mus musculus
agtttgcgcccaccaggcctgagga

SEQ ID NO: 223472 - DNA, 25 bp, Mus musculus
agtttgcgcccagcaggcctgagga

SEQ ID NO: 223473 - DNA, 25 bp, Mus musculus
agtttgcggataagacaccccgttt

SEQ ID NO: 223474 - DNA, 25 bp, Mus musculus
agtttgcggatatgacaccccgttt

SEQ ID NO: 223475 - DNA, 25 bp, Mus musculus
agtttgcgttgaaggagggtgttga

SEQ ID NO: 223476 - DNA, 25 bp, Mus musculus
agtttgcgttgatggagggtgttga

SEQ ID NO: 223477 - DNA, 25 bp, Mus musculus
agtttgctacctaccagttgtctta

SEQ ID NO: 223478 - DNA, 25 bp, Mus musculus
agtttgctaccttccagttgtctta

SEQ ID NO: 223479 - DNA, 25 bp, Mus musculus
agtttgctagctaaggccattggaa

SEQ ID NO: 223480 - DNA, 25 bp, Mus musculus
agtttgctagcttaggccattggaa

SEQ ID NO: 223481 - DNA, 25 bp, Mus musculus
agtttgctcaagatgtgggccgcat

SEQ ID NO: 223482 - DNA, 25 bp, Mus musculus
agtttgctcaagttgtgggccgcat

SEQ ID NO: 223483 - DNA, 25 bp, Mus musculus
agtttgctcacaataacgatcctga

SEQ ID NO: 223484 - DNA, 25 bp, Mus musculus
agtttgctcacattaacgatcctga

SEQ ID NO: 223485 - DNA, 25 bp, Mus musculus
agtttgctcagacgcctttgctgtc

SEQ ID NO: 223486 - DNA, 25 bp, Mus musculus
agtttgctcagaggcctttgctgtc

SEQ ID NO: 223487 - DNA, 25 bp, Mus musculus
agtttgctccggctttcttcaaagt

SEQ ID NO: 223488 - DNA, 25 bp, Mus musculus
agtttgctccgggtttcttcaaagt

SEQ ID NO: 223489 - DNA, 25 bp, Mus musculus
agtttgctcctcaccagtatatgga

SEQ ID NO: 223490 - DNA, 25 bp, Mus musculus
agtttgctcctctccagtatatgga

SEQ ID NO: 223491 - DNA, 25 bp, Mus musculus
agtttgctccttcggctgtaagaaa

SEQ ID NO: 223492 - DNA, 25 bp, Mus musculus
agtttgctccttgggctgtaagaaa

SEQ ID NO: 223493 - DNA, 25 bp, Mus musculus
agtttgctctaacactcaacttcgc

SEQ ID NO: 223494 - DNA, 25 bp, Mus musculus
agtttgctctaagactcaacttcgc

SEQ ID NO: 223495 - DNA, 25 bp, Mus musculus
agtttgctctgcacattgccatcag

SEQ ID NO: 223496 - DNA, 25 bp, Mus musculus
agtttgctctgctcattgccatcag

SEQ ID NO: 223497 - DNA, 25 bp, Mus musculus
agtttgctcttcattatgtgctctt

SEQ ID NO: 223498 - DNA, 25 bp, Mus musculus
agtttgctcttctttatgtgctctt

SEQ ID NO: 223499 - DNA, 25 bp, Mus musculus
agtttgctctttaccattgctggac

SEQ ID NO: 223500 - DNA, 25 bp, Mus musculus
agtttgctcttttccattgctggac

SEQ ID NO: 223501 - DNA, 25 bp, Mus musculus
agtttgctgatcaggttgcttttca

SEQ ID NO: 223502 - DNA, 25 bp, Mus musculus
agtttgctgatctggttgcttttca

SEQ ID NO: 223503 - DNA, 25 bp, Mus musculus
agtttgctgcaaagttcccactgtc

SEQ ID NO: 223504 - DNA, 25 bp, Mus musculus
agtttgctgcaatgttcccactgtc

SEQ ID NO: 223505 - DNA, 25 bp, Mus musculus
agtttgctgcccagctaactaagct

SEQ ID NO: 223506 - DNA, 25 bp, Mus musculus
agtttgctgccctgctaactaagct

SEQ ID NO: 223507 - DNA, 25 bp, Mus musculus
agtttgctgctactcagcatgctct

SEQ ID NO: 223508 - DNA, 25 bp, Mus musculus
agtttgctgctagtcagcatgctct

SEQ ID NO: 223509 - DNA, 25 bp, Mus musculus
agtttgctgctcaacctctagtgtc

SEQ ID NO: 223510 - DNA, 25 bp, Mus musculus
agtttgctgctctacctctagtgtc

SEQ ID NO: 223511 - DNA, 25 bp, Mus musculus
agtttgctggctatgccatgtgtct

SEQ ID NO: 223512 - DNA, 25 bp, Mus musculus
agtttgctggctttgccatgtgtct

SEQ ID NO: 223513 - DNA, 25 bp, Mus musculus
agtttgctgggcctttgattgcttg

SEQ ID NO: 223514 - DNA, 25 bp, Mus musculus
agtttgctgggcgtttgattgcttg

SEQ ID NO: 223515 - DNA, 25 bp, Mus musculus
agtttgctttagaaggtctctctgg

SEQ ID NO: 223516 - DNA, 25 bp, Mus musculus
agtttgctttagtaggtctctctgg

SEQ ID NO: 223517 - DNA, 25 bp, Mus musculus
agtttgctttctctgcttcatactt

SEQ ID NO: 223518 - DNA, 25 bp, Mus musculus
agtttgctttctgtgcttcatactt

SEQ ID NO: 223519 - DNA, 25 bp, Mus musculus
agtttgctttgtactgcgcgtttca

SEQ ID NO: 223520 - DNA, 25 bp, Mus musculus
agtttgctttgttctgcgcgtttca

SEQ ID NO: 223521 - DNA, 25 bp, Mus musculus
agtttggaattcaaacagccacctt

SEQ ID NO: 223522 - DNA, 25 bp, Mus musculus
agtttggaattctaacagccacctt

SEQ ID NO: 223523 - DNA, 25 bp, Mus musculus
agtttggactaccatgttctccatg

SEQ ID NO: 223524 - DNA, 25 bp, Mus musculus
agtttggactacgatgttctccatg

SEQ ID NO: 223525 - DNA, 25 bp, Mus musculus
agtttggactctcagtccccgtgta

SEQ ID NO: 223526 - DNA, 25 bp, Mus musculus
agtttggactctgagtccccgtgta

SEQ ID NO: 223527 - DNA, 25 bp, Mus musculus
agtttggatttccaggtgcgtgcct

SEQ ID NO: 223528 - DNA, 25 bp, Mus musculus
agtttggatttcgaggtgcgtgcct

SEQ ID NO: 223529 - DNA, 25 bp, Mus musculus
agtttggcagagaatttcctataga

SEQ ID NO: 223530 - DNA, 25 bp, Mus musculus
agtttggcagagtatttcctataga

SEQ ID NO: 223531 - DNA, 25 bp, Mus musculus
agtttggcagcaccagaactgcatc

SEQ ID NO: 223532 - DNA, 25 bp, Mus musculus
agtttggcagcagcagaactgcatc

SEQ ID NO: 223533 - DNA, 25 bp, Mus musculus
agtttggcccacagatctagtacac

SEQ ID NO: 223534 - DNA, 25 bp, Mus musculus
agtttggcccactgatctagtacac

SEQ ID NO: 223535 - DNA, 25 bp, Mus musculus
agtttggccgtcctgggcttccaga

SEQ ID NO: 223536 - DNA, 25 bp, Mus musculus
agtttggccgtcgtgggcttccaga

SEQ ID NO: 223537 - DNA, 25 bp, Mus musculus
agtttggcctgaccaccaacattag

SEQ ID NO: 223538 - DNA, 25 bp, Mus musculus
agtttggcctgagcaccaacattag

SEQ ID NO: 223539 - DNA, 25 bp, Mus musculus
agtttggcgcttcttatctgtaatt

SEQ ID NO: 223540 - DNA, 25 bp, Mus musculus
agtttggcgcttgttatctgtaatt

SEQ ID NO: 223541 - DNA, 25 bp, Mus musculus
agtttggctactacgtttgagcacc

SEQ ID NO: 223542 - DNA, 25 bp, Mus musculus
agtttggctacttcgtttgagcacc

SEQ ID NO: 223543 - DNA, 25 bp, Mus musculus
agtttggctagtaagcatccccttg

SEQ ID NO: 223544 - DNA, 25 bp, Mus musculus
agtttggctagttagcatccccttg

SEQ ID NO: 223545 - DNA, 25 bp, Mus musculus
agtttggctgaaagcaggcccctcg

SEQ ID NO: 223546 - DNA, 25 bp, Mus musculus
agtttggctgaatgcaggcccctcg

SEQ ID NO: 223547 - DNA, 25 bp, Mus musculus
agtttggcttcaagggtgtaaacac

SEQ ID NO: 223548 - DNA, 25 bp, Mus musculus
agtttggcttcatgggtgtaaacac

SEQ ID NO: 223549 - DNA, 25 bp, Mus musculus
agtttgggatttcgcaattttgtca

SEQ ID NO: 223550 - DNA, 25 bp, Mus musculus
agtttgggatttggcaattttgtca

SEQ ID NO: 223551 - DNA, 25 bp, Mus musculus
agtttgggcgagacaaagatgcact

SEQ ID NO: 223552 - DNA, 25 bp, Mus musculus
agtttgggcgagtcaaagatgcact

SEQ ID NO: 223553 - DNA, 25 bp, Mus musculus
agtttgggctccctcgtactccagc

SEQ ID NO: 223554 - DNA, 25 bp, Mus musculus
agtttgggctccgtcgtactccagc

SEQ ID NO: 223555 - DNA, 25 bp, Mus musculus
agtttgggtctcatcaaccctgcta

SEQ ID NO: 223556 - DNA, 25 bp, Mus musculus
agtttgggtctcttcaaccctgcta

SEQ ID NO: 223557 - DNA, 25 bp, Mus musculus
agtttgggtttccagctcctgcgtg

SEQ ID NO: 223558 - DNA, 25 bp, Mus musculus
agtttgggtttcgagctcctgcgtg

SEQ ID NO: 223559 - DNA, 25 bp, Mus musculus
agtttggtccaaagctcttgaacaa

SEQ ID NO: 223560 - DNA, 25 bp, Mus musculus
agtttggtccaatgctcttgaacaa

SEQ ID NO: 223561 - DNA, 25 bp, Mus musculus
agtttggtccagaaacagccatccc

SEQ ID NO: 223562 - DNA, 25 bp, Mus musculus
agtttggtccagtaacagccatccc

SEQ ID NO: 223563 - DNA, 25 bp, Mus musculus
agtttggtcctcacagtgactgctt

SEQ ID NO: 223564 - DNA, 25 bp, Mus musculus
agtttggtcctctcagtgactgctt

SEQ ID NO: 223565 - DNA, 25 bp, Mus musculus
agtttggtgcagacctcgagtgacc

SEQ ID NO: 223566 - DNA, 25 bp, Mus musculus
agtttggtgcagtcctcgagtgacc

SEQ ID NO: 223567 - DNA, 25 bp, Mus musculus
agtttggtggacagagagactcttt

SEQ ID NO: 223568 - DNA, 25 bp, Mus musculus
agtttggtggactgagagactcttt

SEQ ID NO: 223569 - DNA, 25 bp, Mus musculus
agtttggtgggcaaattactttctg

SEQ ID NO: 223570 - DNA, 25 bp, Mus musculus
agtttggtgggctaattactttctg

SEQ ID NO: 223571 - DNA, 25 bp, Mus musculus
agtttggtggtaactgccatcccag

SEQ ID NO: 223572 - DNA, 25 bp, Mus musculus
agtttggtggtatctgccatcccag

SEQ ID NO: 223573 - DNA, 25 bp, Mus musculus
agtttggttctgaaggtccctgtca

SEQ ID NO: 223574 - DNA, 25 bp, Mus musculus
agtttggttctgtaggtccctgtca

SEQ ID NO: 223575 - DNA, 25 bp, Mus musculus
agtttggttgacatccctgatactt

SEQ ID NO: 223576 - DNA, 25 bp, Mus musculus
agtttggttgacttccctgatactt

SEQ ID NO: 223577 - DNA, 25 bp, Mus musculus
agtttggtttcgatcttcataacgg

SEQ ID NO: 223578 - DNA, 25 bp, Mus musculus
agtttggtttcgttcttcataacgg

SEQ ID NO: 223579 - DNA, 25 bp, Mus musculus
agtttgtaacttcgcttctctggct

SEQ ID NO: 223580 - DNA, 25 bp, Mus musculus
agtttgtaacttggcttctctggct

SEQ ID NO: 223581 - DNA, 25 bp, Mus musculus
agtttgtaatttcagctccagagac

SEQ ID NO: 223582 - DNA, 25 bp, Mus musculus
agtttgtaatttgagctccagagac

SEQ ID NO: 223583 - DNA, 25 bp, Mus musculus
agtttgtactttatcaccctgagct

SEQ ID NO: 223584 - DNA, 25 bp, Mus musculus
agtttgtactttttcaccctgagct

SEQ ID NO: 223585 - DNA, 25 bp, Mus musculus
agtttgtagacccatgctgtagaat

SEQ ID NO: 223586 - DNA, 25 bp, Mus musculus
agtttgtagaccgatgctgtagaat

SEQ ID NO: 223587 - DNA, 25 bp, Mus musculus
agtttgtaggcacatcgttccttga

SEQ ID NO: 223588 - DNA, 25 bp, Mus musculus
agtttgtaggcagatcgttccttga

SEQ ID NO: 223589 - DNA, 25 bp, Mus musculus
agtttgtagtccacatgtatgtaag

SEQ ID NO: 223590 - DNA, 25 bp, Mus musculus
agtttgtagtcctcatgtatgtaag

SEQ ID NO: 223591 - DNA, 25 bp, Mus musculus
agtttgtattcgatagcatcttggc

SEQ ID NO: 223592 - DNA, 25 bp, Mus musculus
agtttgtattcgttagcatcttggc

SEQ ID NO: 223593 - DNA, 25 bp, Mus musculus
agtttgtcaaaaccgcaggtctgga

SEQ ID NO: 223594 - DNA, 25 bp, Mus musculus
agtttgtcaaaagcgcaggtctgga

SEQ ID NO: 223595 - DNA, 25 bp, Mus musculus
agtttgtcaactaggatgcggtcca

SEQ ID NO: 223596 - DNA, 25 bp, Mus musculus
agtttgtcaacttggatgcggtcca

SEQ ID NO: 223597 - DNA, 25 bp, Mus musculus
agtttgtcaccaccattgcatacag

SEQ ID NO: 223598 - DNA, 25 bp, Mus musculus
agtttgtcaccagcattgcatacag

SEQ ID NO: 223599 - DNA, 25 bp, Mus musculus
agtttgtcacctatcagtgtccagc

SEQ ID NO: 223600 - DNA, 25 bp, Mus musculus
agtttgtcacctttcagtgtccagc

SEQ ID NO: 223601 - DNA, 25 bp, Mus musculus
agtttgtcagtcaagctaacatcct

SEQ ID NO: 223602 - DNA, 25 bp, Mus musculus
agtttgtcagtctagctaacatcct

SEQ ID NO: 223603 - DNA, 25 bp, Mus musculus
agtttgtcatctacttggacgtgaa

SEQ ID NO: 223604 - DNA, 25 bp, Mus musculus
agtttgtcatcttcttggacgtgaa

SEQ ID NO: 223605 - DNA, 25 bp, Mus musculus
agtttgtccctcagtatttcatgcc

SEQ ID NO: 223606 - DNA, 25 bp, Mus musculus
agtttgtccctctgtatttcatgcc

SEQ ID NO: 223607 - DNA, 25 bp, Mus musculus
agtttgtcctggactcactgcacat

SEQ ID NO: 223608 - DNA, 25 bp, Mus musculus
agtttgtcctggtctcactgcacat

SEQ ID NO: 223609 - DNA, 25 bp, Mus musculus
agtttgtcgacacttttcaggatga

SEQ ID NO: 223610 - DNA, 25 bp, Mus musculus
agtttgtcgacagttttcaggatga

SEQ ID NO: 223611 - DNA, 25 bp, Mus musculus
agtttgtctactctatccctgtggg

SEQ ID NO: 223612 - DNA, 25 bp, Mus musculus
agtttgtctactgtatccctgtggg

SEQ ID NO: 223613 - DNA, 25 bp, Mus musculus
agtttgtctcctacagctcatttac

SEQ ID NO: 223614 - DNA, 25 bp, Mus musculus
agtttgtctccttcagctcatttac

SEQ ID NO: 223615 - DNA, 25 bp, Mus musculus
agtttgtctctcatgaatggctgca

SEQ ID NO: 223616 - DNA, 25 bp, Mus musculus
agtttgtctctcttgaatggctgca

SEQ ID NO: 223617 - DNA, 25 bp, Mus musculus
agtttgtctctgattttgatccctg

SEQ ID NO: 223618 - DNA, 25 bp, Mus musculus
agtttgtctctgtttttgatccctg

SEQ ID NO: 223619 - DNA, 25 bp, Mus musculus
agtttgtctcttagaagctgcatgt

SEQ ID NO: 223620 - DNA, 25 bp, Mus musculus
agtttgtctctttgaagctgcatgt

SEQ ID NO: 223621 - DNA, 25 bp, Mus musculus
agtttgtgactgcaacctgtcgctt

SEQ ID NO: 223622 - DNA, 25 bp, Mus musculus
agtttgtgactggaacctgtcgctt

SEQ ID NO: 223623 - DNA, 25 bp, Mus musculus
agtttgtgatgtctgcctatcccac

SEQ ID NO: 223624 - DNA, 25 bp, Mus musculus
agtttgtgatgtgtgcctatcccac

SEQ ID NO: 223625 - DNA, 25 bp, Mus musculus
agtttgtgctccctagatactcatg

SEQ ID NO: 223626 - DNA, 25 bp, Mus musculus
agtttgtgctccgtagatactcatg

SEQ ID NO: 223627 - DNA, 25 bp, Mus musculus
agtttgtggagcaagcaccgcagcc

SEQ ID NO: 223628 - DNA, 25 bp, Mus musculus
agtttgtggagctagcaccgcagcc

SEQ ID NO: 223629 - DNA, 25 bp, Mus musculus
agtttgtggatgctctgatgattca

SEQ ID NO: 223630 - DNA, 25 bp, Mus musculus
agtttgtggatggtctgatgattca

SEQ ID NO: 223631 - DNA, 25 bp, Mus musculus
agtttgtggctgaaaggtttagata

SEQ ID NO: 223632 - DNA, 25 bp, Mus musculus
agtttgtggctgtaaggtttagata

SEQ ID NO: 223633 - DNA, 25 bp, Mus musculus
agtttgtgggacagcagtaagaact

SEQ ID NO: 223634 - DNA, 25 bp, Mus musculus
agtttgtgggactgcagtaagaact

SEQ ID NO: 223635 - DNA, 25 bp, Mus musculus
agtttgtggtgcagctccgtggaac

SEQ ID NO: 223636 - DNA, 25 bp, Mus musculus
agtttgtggtgcctggcaacccgac

SEQ ID NO: 223637 - DNA, 25 bp, Mus musculus
agtttgtggtgcgtggcaacccgac

SEQ ID NO: 223638 - DNA, 25 bp, Mus musculus
agtttgtggtgctgctccgtggaac

SEQ ID NO: 223639 - DNA, 25 bp, Mus musculus
agtttgtgtatcatgttgctgtggc

SEQ ID NO: 223640 - DNA, 25 bp, Mus musculus
agtttgtgtatcttgttgctgtggc

SEQ ID NO: 223641 - DNA, 25 bp, Mus musculus
agtttgtgtgcaatgtcctttccca

SEQ ID NO: 223642 - DNA, 25 bp, Mus musculus
agtttgtgtgcattgtcctttccca

SEQ ID NO: 223643 - DNA, 25 bp, Mus musculus
agtttgtgttcaaattagtgtgtgt

SEQ ID NO: 223644 - DNA, 25 bp, Mus musculus
agtttgtgttcacacctcctgcagg

SEQ ID NO: 223645 - DNA, 25 bp, Mus musculus
agtttgtgttcactggcctctttca

SEQ ID NO: 223646 - DNA, 25 bp, Mus musculus
agtttgtgttcagacctcctgcagg

SEQ ID NO: 223647 - DNA, 25 bp, Mus musculus
agtttgtgttcagtggcctctttca

SEQ ID NO: 223648 - DNA, 25 bp, Mus musculus
agtttgtgttcatattagtgtgtgt

SEQ ID NO: 223649 - DNA, 25 bp, Mus musculus
agtttgtgttcccattggattctcc

SEQ ID NO: 223650 - DNA, 25 bp, Mus musculus
agtttgtgttccgattggattctcc

SEQ ID NO: 223651 - DNA, 25 bp, Mus musculus
agtttgtgttcgatgccgtcactga

SEQ ID NO: 223652 - DNA, 25 bp, Mus musculus
agtttgtgttcgttgccgtcactga

SEQ ID NO: 223653 - DNA, 25 bp, Mus musculus
agtttgttaacgctccatggaggag

SEQ ID NO: 223654 - DNA, 25 bp, Mus musculus
agtttgttaacggtccatggaggag

SEQ ID NO: 223655 - DNA, 25 bp, Mus musculus
agtttgttaattcattaagctgtat

SEQ ID NO: 223656 - DNA, 25 bp, Mus musculus
agtttgttaattgattaagctgtat

SEQ ID NO: 223657 - DNA, 25 bp, Mus musculus
agtttgttatccagttgtctcacga

SEQ ID NO: 223658 - DNA, 25 bp, Mus musculus
agtttgttatcctgttgtctcacga

SEQ ID NO: 223659 - DNA, 25 bp, Mus musculus
agtttgttcaacatggtgccctcca

SEQ ID NO: 223660 - DNA, 25 bp, Mus musculus
agtttgttcaacttggtgccctcca

SEQ ID NO: 223661 - DNA, 25 bp, Mus musculus
agtttgttcaccatcatcctcaagt

SEQ ID NO: 223662 - DNA, 25 bp, Mus musculus
agtttgttcaccttcatcctcaagt

SEQ ID NO: 223663 - DNA, 25 bp, Mus musculus
agtttgttctccatcttcaaagttc

SEQ ID NO: 223664 - DNA, 25 bp, Mus musculus
agtttgttctccttcttcaaagttc

SEQ ID NO: 223665 - DNA, 25 bp, Mus musculus
agtttgttcttcacaaagcccgaca

SEQ ID NO: 223666 - DNA, 25 bp, Mus musculus
agtttgttcttctcaaagcccgaca

SEQ ID NO: 223667 - DNA, 25 bp, Mus musculus
agtttgttgtgcaacctttcagcag

SEQ ID NO: 223668 - DNA, 25 bp, Mus musculus
agtttgttgtgctacctttcagcag

SEQ ID NO: 223669 - DNA, 25 bp, Mus musculus
agtttgtttgttagatctcctgtag

SEQ ID NO: 223670 - DNA, 25 bp, Mus musculus
agtttgtttgtttgatctcctgtag

SEQ ID NO: 223671 - DNA, 25 bp, Mus musculus
agtttgttttcaccaatccatccta

SEQ ID NO: 223672 - DNA, 25 bp, Mus musculus
agtttgttttcagcaatccatccta

SEQ ID NO: 223673 - DNA, 25 bp, Mus musculus
agttttaaactcacaggccttctga

SEQ ID NO: 223674 - DNA, 25 bp, Mus musculus
agttttaaactctcaggccttctga

SEQ ID NO: 223675 - DNA, 25 bp, Mus musculus
agttttaaactgagagccatggaag

SEQ ID NO: 223676 - DNA, 25 bp, Mus musculus
agttttaaactgtgagccatggaag

SEQ ID NO: 223677 - DNA, 25 bp, Mus musculus
agttttaaagagagaccaggcttgt

SEQ ID NO: 223678 - DNA, 25 bp, Mus musculus
agttttaaagagtgaccaggcttgt

SEQ ID NO: 223679 - DNA, 25 bp, Mus musculus
agttttaacgtacctgactccatct

SEQ ID NO: 223680 - DNA, 25 bp, Mus musculus
agttttaacgtagctgactccatct

SEQ ID NO: 223681 - DNA, 25 bp, Mus musculus
agttttaagggcacctgcatctaac

SEQ ID NO: 223682 - DNA, 25 bp, Mus musculus
agttttaagggctcctgcatctaac

SEQ ID NO: 223683 - DNA, 25 bp, Mus musculus
agttttaagtctacatttgaggagg

SEQ ID NO: 223684 - DNA, 25 bp, Mus musculus
agttttaagtcttcatttgaggagg

SEQ ID NO: 223685 - DNA, 25 bp, Mus musculus
agttttaagtttcatgctccagcaa

SEQ ID NO: 223686 - DNA, 25 bp, Mus musculus
agttttaagtttgatgctccagcaa

SEQ ID NO: 223687 - DNA, 25 bp, Mus musculus
agttttacaatcaccctttgcactt

SEQ ID NO: 223688 - DNA, 25 bp, Mus musculus
agttttacaatctccctttgcactt

SEQ ID NO: 223689 - DNA, 25 bp, Mus musculus
agttttacagccacagtctggtctt

SEQ ID NO: 223690 - DNA, 25 bp, Mus musculus
agttttacagcctcagtctggtctt

SEQ ID NO: 223691 - DNA, 25 bp, Mus musculus
agttttaccatgactccttagcaaa

SEQ ID NO: 223692 - DNA, 25 bp, Mus musculus
agttttaccatgtctccttagcaaa

SEQ ID NO: 223693 - DNA, 25 bp, Mus musculus
agttttacccctccgaggaatgtgc

SEQ ID NO: 223694 - DNA, 25 bp, Mus musculus
agttttacccctgcgaggaatgtgc

SEQ ID NO: 223695 - DNA, 25 bp, Mus musculus
agttttacggaactggctcgcgcct

SEQ ID NO: 223696 - DNA, 25 bp, Mus musculus
agttttacggaagtggctcgcgcct

SEQ ID NO: 223697 - DNA, 25 bp, Mus musculus
agttttactaccaaggcatctcacc

SEQ ID NO: 223698 - DNA, 25 bp, Mus musculus
agttttactacctaggcatctcacc

SEQ ID NO: 223699 - DNA, 25 bp, Mus musculus
agttttagaattcatctgtcagtta

SEQ ID NO: 223700 - DNA, 25 bp, Mus musculus
agttttagaattgatctgtcagtta

SEQ ID NO: 223701 - DNA, 25 bp, Mus musculus
agttttagatggctacttcagccga

SEQ ID NO: 223702 - DNA, 25 bp, Mus musculus
agttttagatgggtacttcagccga

SEQ ID NO: 223703 - DNA, 25 bp, Mus musculus
agttttagccttaatgttatcatgt

SEQ ID NO: 223704 - DNA, 25 bp, Mus musculus
agttttagcctttatgttatcatgt

SEQ ID NO: 223705 - DNA, 25 bp, Mus musculus
agttttagtacgaatctggcttgta

SEQ ID NO: 223706 - DNA, 25 bp, Mus musculus
agttttagtacgtatctggcttgta

SEQ ID NO: 223707 - DNA, 25 bp, Mus musculus
agttttagtatgaggctcctttgag

SEQ ID NO: 223708 - DNA, 25 bp, Mus musculus
agttttagtatgtggctcctttgag

SEQ ID NO: 223709 - DNA, 25 bp, Mus musculus
agttttagtcaaagtcctccagcct

SEQ ID NO: 223710 - DNA, 25 bp, Mus musculus
agttttagtcaatgtcctccagcct

SEQ ID NO: 223711 - DNA, 25 bp, Mus musculus
agttttagtggaacctacaccctct

SEQ ID NO: 223712 - DNA, 25 bp, Mus musculus
agttttagtggatcctacaccctct

SEQ ID NO: 223713 - DNA, 25 bp, Mus musculus
agttttagtggtccccaagcatgct

SEQ ID NO: 223714 - DNA, 25 bp, Mus musculus
agttttagtggtgcccaagcatgct

SEQ ID NO: 223715 - DNA, 25 bp, Mus musculus
agttttagttgaagttatttgcttg

SEQ ID NO: 223716 - DNA, 25 bp, Mus musculus
agttttagttgatgttatttgcttg

SEQ ID NO: 223717 - DNA, 25 bp, Mus musculus
agttttataactcagatgtacctaa

SEQ ID NO: 223718 - DNA, 25 bp, Mus musculus
agttttataactgagatgtacctaa

SEQ ID NO: 223719 - DNA, 25 bp, Mus musculus
agttttatatgcattttcagagcaa

SEQ ID NO: 223720 - DNA, 25 bp, Mus musculus
agttttatatgctttttcagagcaa

SEQ ID NO: 223721 - DNA, 25 bp, Mus musculus
agttttatcaacatggctctgcctt

SEQ ID NO: 223722 - DNA, 25 bp, Mus musculus
agttttatcaacttggctctgcctt

SEQ ID NO: 223723 - DNA, 25 bp, Mus musculus
agttttatgaacaggttccaacaga

SEQ ID NO: 223724 - DNA, 25 bp, Mus musculus
agttttatgaactggttccaacaga

SEQ ID NO: 223725 - DNA, 25 bp, Mus musculus
agttttatgcctcttctctgccgag

SEQ ID NO: 223726 - DNA, 25 bp, Mus musculus
agttttatgcctgttctctgccgag

SEQ ID NO: 223727 - DNA, 25 bp, Mus musculus
agttttatgctactgcacagaaatt

SEQ ID NO: 223728 - DNA, 25 bp, Mus musculus
agttttatgctagtgcacagaaatt

SEQ ID NO: 223729 - DNA, 25 bp, Mus musculus
agttttatgtcaccctaagccagag

SEQ ID NO: 223730 - DNA, 25 bp, Mus musculus
agttttatgtcagcctaagccagag

SEQ ID NO: 223731 - DNA, 25 bp, Mus musculus
agttttatgtctcggtcatgtgtac

SEQ ID NO: 223732 - DNA, 25 bp, Mus musculus
agttttatgtctgggtcatgtgtac

SEQ ID NO: 223733 - DNA, 25 bp, Mus musculus
agttttattaccatgccatgggcat

SEQ ID NO: 223734 - DNA, 25 bp, Mus musculus
agttttattaccttgccatgggcat

SEQ ID NO: 223735 - DNA, 25 bp, Mus musculus
agttttattttaagagtcgcacaca

SEQ ID NO: 223736 - DNA, 25 bp, Mus musculus
agttttattttatgagtcgcacaca

SEQ ID NO: 223737 - DNA, 25 bp, Mus musculus
agttttcaagttatggctactcaga

SEQ ID NO: 223738 - DNA, 25 bp, Mus musculus
agttttcaagttttggctactcaga

SEQ ID NO: 223739 - DNA, 25 bp, Mus musculus
agttttcaatgaaggacgggtgtgc

SEQ ID NO: 223740 - DNA, 25 bp, Mus musculus
agttttcaatgatggacgggtgtgc

SEQ ID NO: 223741 - DNA, 25 bp, Mus musculus
agttttcacctgcagtccacactgg

SEQ ID NO: 223742 - DNA, 25 bp, Mus musculus
agttttcacctggagtccacactgg

SEQ ID NO: 223743 - DNA, 25 bp, Mus musculus
agttttcactagaaatgctcatcag

SEQ ID NO: 223744 - DNA, 25 bp, Mus musculus
agttttcactagtaatgctcatcag

SEQ ID NO: 223745 - DNA, 25 bp, Mus musculus
agttttcagatcagacacagtccaa

SEQ ID NO: 223746 - DNA, 25 bp, Mus musculus
agttttcagatctgacacagtccaa

SEQ ID NO: 223747 - DNA, 25 bp, Mus musculus
agttttcagcacacttcccaaagat

SEQ ID NO: 223748 - DNA, 25 bp, Mus musculus
agttttcagcacatagtacacatga

SEQ ID NO: 223749 - DNA, 25 bp, Mus musculus
agttttcagcactcttcccaaagat

SEQ ID NO: 223750 - DNA, 25 bp, Mus musculus
agttttcagcacttagtacacatga

SEQ ID NO: 223751 - DNA, 25 bp, Mus musculus
agttttcagcctactcaggagagtg

SEQ ID NO: 223752 - DNA, 25 bp, Mus musculus
agttttcagccttctcaggagagtg

SEQ ID NO: 223753 - DNA, 25 bp, Mus musculus
agttttcagtgaagaacccccccat

SEQ ID NO: 223754 - DNA, 25 bp, Mus musculus
agttttcagtgatgaacccccccat

SEQ ID NO: 223755 - DNA, 25 bp, Mus musculus
agttttcagttgcaaacttgacttt

SEQ ID NO: 223756 - DNA, 25 bp, Mus musculus
agttttcagttggaaacttgacttt

SEQ ID NO: 223757 - DNA, 25 bp, Mus musculus
agttttcatactaccagcttggaaa

SEQ ID NO: 223758 - DNA, 25 bp, Mus musculus
agttttcatactacctgtctggagg

SEQ ID NO: 223759 - DNA, 25 bp, Mus musculus
agttttcatacttccagcttggaaa

SEQ ID NO: 223760 - DNA, 25 bp, Mus musculus
agttttcatacttcctgtctggagg

SEQ ID NO: 223761 - DNA, 25 bp, Mus musculus
agttttcatcatctgtgagatatta

SEQ ID NO: 223762 - DNA, 25 bp, Mus musculus
agttttcatcatgtgtgagatatta

SEQ ID NO: 223763 - DNA, 25 bp, Mus musculus
agttttcatccaacatgaagttgga

SEQ ID NO: 223764 - DNA, 25 bp, Mus musculus
agttttcatccatcatgaagttgga

SEQ ID NO: 223765 - DNA, 25 bp, Mus musculus
agttttcatctgagaacacgggctt

SEQ ID NO: 223766 - DNA, 25 bp, Mus musculus
agttttcatctgtgaacacgggctt

SEQ ID NO: 223767 - DNA, 25 bp, Mus musculus
agttttcatcttaggatcatatgta

SEQ ID NO: 223768 - DNA, 25 bp, Mus musculus
agttttcatctttggatcatatgta

SEQ ID NO: 223769 - DNA, 25 bp, Mus musculus
agttttcatgtgagtttatctgctc

SEQ ID NO: 223770 - DNA, 25 bp, Mus musculus
agttttcatgtgtgtttatctgctc

SEQ ID NO: 223771 - DNA, 25 bp, Mus musculus
agttttcattcccagaggtcaaaat

SEQ ID NO: 223772 - DNA, 25 bp, Mus musculus
agttttcattccgagaggtcaaaat

SEQ ID NO: 223773 - DNA, 25 bp, Mus musculus
agttttccaaatctgtcgtctctct

SEQ ID NO: 223774 - DNA, 25 bp, Mus musculus
agttttccaaatgtgtcgtctctct

SEQ ID NO: 223775 - DNA, 25 bp, Mus musculus
agttttccaagcatctgattcttgt

SEQ ID NO: 223776 - DNA, 25 bp, Mus musculus
agttttccaagcttctgattcttgt

SEQ ID NO: 223777 - DNA, 25 bp, Mus musculus
agttttccacatattctgggtcaga

SEQ ID NO: 223778 - DNA, 25 bp, Mus musculus
agttttccacattttctgggtcaga

SEQ ID NO: 223779 - DNA, 25 bp, Mus musculus
agttttccactccactgcatttcct

SEQ ID NO: 223780 - DNA, 25 bp, Mus musculus
agttttccactcgactgcatttcct

SEQ ID NO: 223781 - DNA, 25 bp, Mus musculus
agttttccagacaacacgcagcttt

SEQ ID NO: 223782 - DNA, 25 bp, Mus musculus
agttttccagactacacgcagcttt

SEQ ID NO: 223783 - DNA, 25 bp, Mus musculus
agttttccatagctccctgtaaata

SEQ ID NO: 223784 - DNA, 25 bp, Mus musculus
agttttccataggtccctgtaaata

SEQ ID NO: 223785 - DNA, 25 bp, Mus musculus
agttttccatatactagcccataag

SEQ ID NO: 223786 - DNA, 25 bp, Mus musculus
agttttccatattctagcccataag

SEQ ID NO: 223787 - DNA, 25 bp, Mus musculus
agttttccatccatagtgcatctta

SEQ ID NO: 223788 - DNA, 25 bp, Mus musculus
agttttccatccttagtgcatctta

SEQ ID NO: 223789 - DNA, 25 bp, Mus musculus
agttttcctcttcagatgccctgta

SEQ ID NO: 223790 - DNA, 25 bp, Mus musculus
agttttcctcttgagatgccctgta

SEQ ID NO: 223791 - DNA, 25 bp, Mus musculus
agttttcctgtacgcgaagctccca

SEQ ID NO: 223792 - DNA, 25 bp, Mus musculus
agttttcctgtaggcgaagctccca

SEQ ID NO: 223793 - DNA, 25 bp, Mus musculus
agttttcctgtcctaagtttctcag

SEQ ID NO: 223794 - DNA, 25 bp, Mus musculus
agttttcctgtcgtaagtttctcag

SEQ ID NO: 223795 - DNA, 25 bp, Mus musculus
agttttccttctcatatgttttgtt

SEQ ID NO: 223796 - DNA, 25 bp, Mus musculus
agttttccttctgatatgttttgtt

SEQ ID NO: 223797 - DNA, 25 bp, Mus musculus
agttttcctttaatttgcagttcat

SEQ ID NO: 223798 - DNA, 25 bp, Mus musculus
agttttcctttattttgcagttcat

SEQ ID NO: 223799 - DNA, 25 bp, Mus musculus
agttttcctttcctcagcgtcccag

SEQ ID NO: 223800 - DNA, 25 bp, Mus musculus
agttttcctttcgtcagcgtcccag

SEQ ID NO: 223801 - DNA, 25 bp, Mus musculus
agttttcgacacaattcccagctgt

SEQ ID NO: 223802 - DNA, 25 bp, Mus musculus
agttttcgacactattcccagctgt

SEQ ID NO: 223803 - DNA, 25 bp, Mus musculus
agttttcgccgcagactacatttct

SEQ ID NO: 223804 - DNA, 25 bp, Mus musculus
agttttcgccgctgactacatttct

SEQ ID NO: 223805 - DNA, 25 bp, Mus musculus
agttttcgtatcctgtgttccgagc

SEQ ID NO: 223806 - DNA, 25 bp, Mus musculus
agttttcgtatcgtgtgttccgagc

SEQ ID NO: 223807 - DNA, 25 bp, Mus musculus
agttttctaagcctgttccacatat

SEQ ID NO: 223808 - DNA, 25 bp, Mus musculus
agttttctaagcgtgttccacatat

SEQ ID NO: 223809 - DNA, 25 bp, Mus musculus
agttttctaatcattctttgttctg

SEQ ID NO: 223810 - DNA, 25 bp, Mus musculus
agttttctaatctttctttgttctg

SEQ ID NO: 223811 - DNA, 25 bp, Mus musculus
agttttctacagctgattttatcaa

SEQ ID NO: 223812 - DNA, 25 bp, Mus musculus
agttttctacaggtgattttatcaa

SEQ ID NO: 223813 - DNA, 25 bp, Mus musculus
agttttctactgcactccaggtgga

SEQ ID NO: 223814 - DNA, 25 bp, Mus musculus
agttttctactggactccaggtgga

SEQ ID NO: 223815 - DNA, 25 bp, Mus musculus
agttttctaggacaatggcagcggt

SEQ ID NO: 223816 - DNA, 25 bp, Mus musculus
agttttctaggagaatggcagcggt

SEQ ID NO: 223817 - DNA, 25 bp, Mus musculus
agttttctatttcccctcttgagta

SEQ ID NO: 223818 - DNA, 25 bp, Mus musculus
agttttctatttgccctcttgagta

SEQ ID NO: 223819 - DNA, 25 bp, Mus musculus
agttttctcacgctcggagcatcag

SEQ ID NO: 223820 - DNA, 25 bp, Mus musculus
agttttctcacggtcggagcatcag

SEQ ID NO: 223821 - DNA, 25 bp, Mus musculus
agttttctcctgcttgagtagaatc

SEQ ID NO: 223822 - DNA, 25 bp, Mus musculus
agttttctcctggttgagtagaatc

SEQ ID NO: 223823 - DNA, 25 bp, Mus musculus
agttttctctagatccacggcttct

SEQ ID NO: 223824 - DNA, 25 bp, Mus musculus
agttttctctagttccacggcttct

SEQ ID NO: 223825 - DNA, 25 bp, Mus musculus
agttttctctttaccaagtcatggg

SEQ ID NO: 223826 - DNA, 25 bp, Mus musculus
agttttctctttatcagatctcctc

SEQ ID NO: 223827 - DNA, 25 bp, Mus musculus
agttttctcttttccaagtcatggg

SEQ ID NO: 223828 - DNA, 25 bp, Mus musculus
agttttctctttttcagatctcctc

SEQ ID NO: 223829 - DNA, 25 bp, Mus musculus
agttttctgaagatgctttagcttt

SEQ ID NO: 223830 - DNA, 25 bp, Mus musculus
agttttctgaagttgctttagcttt

SEQ ID NO: 223831 - DNA, 25 bp, Mus musculus
agttttctgattccttgtgctttat

SEQ ID NO: 223832 - DNA, 25 bp, Mus musculus
agttttctgattgcttgtgctttat

SEQ ID NO: 223833 - DNA, 25 bp, Mus musculus
agttttctgcaaaacctaccttgtt

SEQ ID NO: 223834 - DNA, 25 bp, Mus musculus
agttttctgcaaatgtgcctcgttc

SEQ ID NO: 223835 - DNA, 25 bp, Mus musculus
agttttctgcaatacctaccttgtt

SEQ ID NO: 223836 - DNA, 25 bp, Mus musculus
agttttctgcaattgtgcctcgttc

SEQ ID NO: 223837 - DNA, 25 bp, Mus musculus
agttttctgcggatgacctggtgcc

SEQ ID NO: 223838 - DNA, 25 bp, Mus musculus
agttttctgcggttgacctggtgcc

SEQ ID NO: 223839 - DNA, 25 bp, Mus musculus
agttttctggataggtacctgaata

SEQ ID NO: 223840 - DNA, 25 bp, Mus musculus
agttttctggattggtacctgaata

SEQ ID NO: 223841 - DNA, 25 bp, Mus musculus
agttttctggttctgagtaatgggc

SEQ ID NO: 223842 - DNA, 25 bp, Mus musculus
agttttctggttgtgagtaatgggc

SEQ ID NO: 223843 - DNA, 25 bp, Mus musculus
agttttctgtgcaccatgtgcaata

SEQ ID NO: 223844 - DNA, 25 bp, Mus musculus
agttttctgtgctccatgtgcaata

SEQ ID NO: 223845 - DNA, 25 bp, Mus musculus
agttttctgtggcttaagtcttatt

SEQ ID NO: 223846 - DNA, 25 bp, Mus musculus
agttttctgtgggttaagtcttatt

SEQ ID NO: 223847 - DNA, 25 bp, Mus musculus
agttttctgtgtaaagctgtcttga

SEQ ID NO: 223848 - DNA, 25 bp, Mus musculus
agttttctgtgttaagctgtcttga

SEQ ID NO: 223849 - DNA, 25 bp, Mus musculus
agttttctgttactcttgtttctat

SEQ ID NO: 223850 - DNA, 25 bp, Mus musculus
agttttctgttagtcttgtttctat

SEQ ID NO: 223851 - DNA, 25 bp, Mus musculus
agttttcttatgataccctccattc

SEQ ID NO: 223852 - DNA, 25 bp, Mus musculus
agttttcttatgttaccctccattc

SEQ ID NO: 223853 - DNA, 25 bp, Mus musculus
agttttcttcgacagcagtggttcc

SEQ ID NO: 223854 - DNA, 25 bp, Mus musculus
agttttcttcgagagcagtggttcc

SEQ ID NO: 223855 - DNA, 25 bp, Mus musculus
agttttcttctactatttctggatt

SEQ ID NO: 223856 - DNA, 25 bp, Mus musculus
agttttcttctagtatttctggatt

SEQ ID NO: 223857 - DNA, 25 bp, Mus musculus
agttttcttgagacattatctgtga

SEQ ID NO: 223858 - DNA, 25 bp, Mus musculus
agttttcttgagtcattatctgtga

SEQ ID NO: 223859 - DNA, 25 bp, Mus musculus
agttttcttggcactgtatctcagg

SEQ ID NO: 223860 - DNA, 25 bp, Mus musculus
agttttcttggctctgtatctcagg

SEQ ID NO: 223861 - DNA, 25 bp, Mus musculus
agttttctttcaccacttcttgaga

SEQ ID NO: 223862 - DNA, 25 bp, Mus musculus
agttttctttcagcacttcttgaga

SEQ ID NO: 223863 - DNA, 25 bp, Mus musculus
agttttctttctctgctttagtgag

SEQ ID NO: 223864 - DNA, 25 bp, Mus musculus
agttttctttctgtgctttagtgag

SEQ ID NO: 223865 - DNA, 25 bp, Mus musculus
agttttgaaagcatggtgtccaggc

SEQ ID NO: 223866 - DNA, 25 bp, Mus musculus
agttttgaaagcttggtgtccaggc

SEQ ID NO: 223867 - DNA, 25 bp, Mus musculus
agttttgaaatgctgcacttacatt

SEQ ID NO: 223868 - DNA, 25 bp, Mus musculus
agttttgaaatggtgcacttacatt

SEQ ID NO: 223869 - DNA, 25 bp, Mus musculus
agttttgaacagctcaggtgttgct

SEQ ID NO: 223870 - DNA, 25 bp, Mus musculus
agttttgaacaggtcaggtgttgct

SEQ ID NO: 223871 - DNA, 25 bp, Mus musculus
agttttgacaatccaaccagtgccc

SEQ ID NO: 223872 - DNA, 25 bp, Mus musculus
agttttgacaatgcaaccagtgccc

SEQ ID NO: 223873 - DNA, 25 bp, Mus musculus
agttttgagaatccagtcctgcagc

SEQ ID NO: 223874 - DNA, 25 bp, Mus musculus
agttttgagaatgcagtcctgcagc

SEQ ID NO: 223875 - DNA, 25 bp, Mus musculus
agttttgatcacatagctgcctgtc

SEQ ID NO: 223876 - DNA, 25 bp, Mus musculus
agttttgatcacttagctgcctgtc

SEQ ID NO: 223877 - DNA, 25 bp, Mus musculus
agttttgatcgaactccatccttgc

SEQ ID NO: 223878 - DNA, 25 bp, Mus musculus
agttttgatcgatctccatccttgc

SEQ ID NO: 223879 - DNA, 25 bp, Mus musculus
agttttgattatatctcctgttcta

SEQ ID NO: 223880 - DNA, 25 bp, Mus musculus
agttttgattatttctcctgttcta

SEQ ID NO: 223881 - DNA, 25 bp, Mus musculus
agttttgattctctttcctgtgacc

SEQ ID NO: 223882 - DNA, 25 bp, Mus musculus
agttttgattctgtttcctgtgacc

SEQ ID NO: 223883 - DNA, 25 bp, Mus musculus
agttttgattgtatagcccagtgta

SEQ ID NO: 223884 - DNA, 25 bp, Mus musculus
agttttgattgtctttccccagtgc

SEQ ID NO: 223885 - DNA, 25 bp, Mus musculus
agttttgattgtgtttccccagtgc

SEQ ID NO: 223886 - DNA, 25 bp, Mus musculus
agttttgattgtttagcccagtgta

SEQ ID NO: 223887 - DNA, 25 bp, Mus musculus
agttttgattttagcagccttctgc

SEQ ID NO: 223888 - DNA, 25 bp, Mus musculus
agttttgatttttgcagccttctgc

SEQ ID NO: 223889 - DNA, 25 bp, Mus musculus
agttttgcaaaaactttctgtagga

SEQ ID NO: 223890 - DNA, 25 bp, Mus musculus
agttttgcaaaatctttctgtagga

SEQ ID NO: 223891 - DNA, 25 bp, Mus musculus
agttttgcacttatgtttagtcttg

SEQ ID NO: 223892 - DNA, 25 bp, Mus musculus
agttttgcacttcataatttgttaa

SEQ ID NO: 223893 - DNA, 25 bp, Mus musculus
agttttgcacttgataatttgttaa

SEQ ID NO: 223894 - DNA, 25 bp, Mus musculus
agttttgcacttttgtttagtcttg

SEQ ID NO: 223895 - DNA, 25 bp, Mus musculus
agttttgccctgagaatgttagaga

SEQ ID NO: 223896 - DNA, 25 bp, Mus musculus
agttttgccctgtgaatgttagaga

SEQ ID NO: 223897 - DNA, 25 bp, Mus musculus
agttttgccgcaccagtttatgtga

SEQ ID NO: 223898 - DNA, 25 bp, Mus musculus
agttttgccgcagcagtttatgtga

SEQ ID NO: 223899 - DNA, 25 bp, Mus musculus
agttttgcggcacacactttaccaa

SEQ ID NO: 223900 - DNA, 25 bp, Mus musculus
agttttgcggcagacactttaccaa

SEQ ID NO: 223901 - DNA, 25 bp, Mus musculus
agttttgctcctctgttgggcttta

SEQ ID NO: 223902 - DNA, 25 bp, Mus musculus
agttttgctcctgtgttgggcttta

SEQ ID NO: 223903 - DNA, 25 bp, Mus musculus
agttttgctgaaacttcacttcgcc

SEQ ID NO: 223904 - DNA, 25 bp, Mus musculus
agttttgctgaatcttcacttcgcc

SEQ ID NO: 223905 - DNA, 25 bp, Mus musculus
agttttgctgtaactatttcttagg

SEQ ID NO: 223906 - DNA, 25 bp, Mus musculus
agttttgctgtatctatttcttagg

SEQ ID NO: 223907 - DNA, 25 bp, Mus musculus
agttttgctgtcaggcttgctgtcc

SEQ ID NO: 223908 - DNA, 25 bp, Mus musculus
agttttgctgtctggcttgctgtcc

SEQ ID NO: 223909 - DNA, 25 bp, Mus musculus
agttttgcttcacatatttctcaga

SEQ ID NO: 223910 - DNA, 25 bp, Mus musculus
agttttgcttcagatatttctcaga

SEQ ID NO: 223911 - DNA, 25 bp, Mus musculus
agttttggaggacttcgtgcttgct

SEQ ID NO: 223912 - DNA, 25 bp, Mus musculus
agttttggaggagttcgtgcttgct

SEQ ID NO: 223913 - DNA, 25 bp, Mus musculus
agttttggaggtagactctggtcat

SEQ ID NO: 223914 - DNA, 25 bp, Mus musculus
agttttggaggttgactctggtcat

SEQ ID NO: 223915 - DNA, 25 bp, Mus musculus
agttttggagtcatgagggccctgc

SEQ ID NO: 223916 - DNA, 25 bp, Mus musculus
agttttggagtcttgagggccctgc

SEQ ID NO: 223917 - DNA, 25 bp, Mus musculus
agttttggcagtcgcttttgttagc

SEQ ID NO: 223918 - DNA, 25 bp, Mus musculus
agttttggcagtggcttttgttagc

SEQ ID NO: 223919 - DNA, 25 bp, Mus musculus
agttttggccggagctcattagaca

SEQ ID NO: 223920 - DNA, 25 bp, Mus musculus
agttttggccggtgctcattagaca

SEQ ID NO: 223921 - DNA, 25 bp, Mus musculus
agttttggcgttctcattcttatac

SEQ ID NO: 223922 - DNA, 25 bp, Mus musculus
agttttggcgttgtcattcttatac

SEQ ID NO: 223923 - DNA, 25 bp, Mus musculus
agttttggtcgtctgttaagctatt

SEQ ID NO: 223924 - DNA, 25 bp, Mus musculus
agttttggtcgtgtgttaagctatt

SEQ ID NO: 223925 - DNA, 25 bp, Mus musculus
agttttggtgaaagtccagacacat

SEQ ID NO: 223926 - DNA, 25 bp, Mus musculus
agttttggtgaatgtccagacacat

SEQ ID NO: 223927 - DNA, 25 bp, Mus musculus
agttttggtggtagtggcacattct

SEQ ID NO: 223928 - DNA, 25 bp, Mus musculus
agttttggtggttgtggcacattct

SEQ ID NO: 223929 - DNA, 25 bp, Mus musculus
agttttggttgtctgctgaggcccc

SEQ ID NO: 223930 - DNA, 25 bp, Mus musculus
agttttggttgtgtgctgaggcccc

SEQ ID NO: 223931 - DNA, 25 bp, Mus musculus
agttttggtttcagatattgggaca

SEQ ID NO: 223932 - DNA, 25 bp, Mus musculus
agttttggtttctgatattgggaca

SEQ ID NO: 223933 - DNA, 25 bp, Mus musculus
agttttgtaagccagtcggcctggt

SEQ ID NO: 223934 - DNA, 25 bp, Mus musculus
agttttgtaagcgagtcggcctggt

SEQ ID NO: 223935 - DNA, 25 bp, Mus musculus
agttttgtaatcacagaagccctgc

SEQ ID NO: 223936 - DNA, 25 bp, Mus musculus
agttttgtaatctcagaagccctgc

SEQ ID NO: 223937 - DNA, 25 bp, Mus musculus
agttttgtatccagctgcacctaga

SEQ ID NO: 223938 - DNA, 25 bp, Mus musculus
agttttgtatcctgctgcacctaga

SEQ ID NO: 223939 - DNA, 25 bp, Mus musculus
agttttgtatgtatgtgatgcacac

SEQ ID NO: 223940 - DNA, 25 bp, Mus musculus
agttttgtatgtttgtgatgcacac

SEQ ID NO: 223941 - DNA, 25 bp, Mus musculus
agttttgtattcatgtgaaccagca

SEQ ID NO: 223942 - DNA, 25 bp, Mus musculus
agttttgtattcttgtgaaccagca

SEQ ID NO: 223943 - DNA, 25 bp, Mus musculus
agttttgtattgcttcccatctgca

SEQ ID NO: 223944 - DNA, 25 bp, Mus musculus
agttttgtattggttcccatctgca

SEQ ID NO: 223945 - DNA, 25 bp, Mus musculus
agttttgtccttagttgctactcct

SEQ ID NO: 223946 - DNA, 25 bp, Mus musculus
agttttgtcctttgttgctactcct

SEQ ID NO: 223947 - DNA, 25 bp, Mus musculus
agttttgtcggtacctctagtgctt

SEQ ID NO: 223948 - DNA, 25 bp, Mus musculus
agttttgtcggttcctctagtgctt

SEQ ID NO: 223949 - DNA, 25 bp, Mus musculus
agttttgtctttcttgtttacatgt

SEQ ID NO: 223950 - DNA, 25 bp, Mus musculus
agttttgtctttgttgtttacatgt

SEQ ID NO: 223951 - DNA, 25 bp, Mus musculus
agttttgtgtgcatattctatgaaa

SEQ ID NO: 223952 - DNA, 25 bp, Mus musculus
agttttgtgtgcttattctatgaaa

SEQ ID NO: 223953 - DNA, 25 bp, Mus musculus
agttttgtgtggcaaggctcttagc

SEQ ID NO: 223954 - DNA, 25 bp, Mus musculus
agttttgtgtgggaaggctcttagc

SEQ ID NO: 223955 - DNA, 25 bp, Mus musculus
agttttgtgttaacagtttaatgct

SEQ ID NO: 223956 - DNA, 25 bp, Mus musculus
agttttgtgttatcagtttaatgct

SEQ ID NO: 223957 - DNA, 25 bp, Mus musculus
agttttgttaatcttcctgaacaca

SEQ ID NO: 223958 - DNA, 25 bp, Mus musculus
agttttgttaatgttcctgaacaca

SEQ ID NO: 223959 - DNA, 25 bp, Mus musculus
agttttgttattattcttgtatcat

SEQ ID NO: 223960 - DNA, 25 bp, Mus musculus
agttttgttatttttcttgtatcat

SEQ ID NO: 223961 - DNA, 25 bp, Mus musculus
agttttgttcccctggcagagtgag

SEQ ID NO: 223962 - DNA, 25 bp, Mus musculus
agttttgttcccgtggcagagtgag

SEQ ID NO: 223963 - DNA, 25 bp, Mus musculus
agttttgttctcctgcttagagcag

SEQ ID NO: 223964 - DNA, 25 bp, Mus musculus
agttttgttctcgtgcttagagcag

SEQ ID NO: 223965 - DNA, 25 bp, Mus musculus
agttttgttgtaacacctgtcacag

SEQ ID NO: 223966 - DNA, 25 bp, Mus musculus
agttttgttgtatcacctgtcacag

SEQ ID NO: 223967 - DNA, 25 bp, Mus musculus
agttttgtttgtatgatgaggctaa

SEQ ID NO: 223968 - DNA, 25 bp, Mus musculus
agttttgtttgtttgatgaggctaa

SEQ ID NO: 223969 - DNA, 25 bp, Mus musculus
agtttttaagcactccgccttcatg

SEQ ID NO: 223970 - DNA, 25 bp, Mus musculus
agtttttaagcagtccgccttcatg

SEQ ID NO: 223971 - DNA, 25 bp, Mus musculus
agtttttaagttcatcagccctcac

SEQ ID NO: 223972 - DNA, 25 bp, Mus musculus
agtttttaagttgatcagccctcac

SEQ ID NO: 223973 - DNA, 25 bp, Mus musculus
agtttttacatcatcaattttctgg

SEQ ID NO: 223974 - DNA, 25 bp, Mus musculus
agtttttacatcttcaattttctgg

SEQ ID NO: 223975 - DNA, 25 bp, Mus musculus
agtttttaccatccagcaacagttg

SEQ ID NO: 223976 - DNA, 25 bp, Mus musculus
agtttttaccatgcagcaacagttg

SEQ ID NO: 223977 - DNA, 25 bp, Mus musculus
agtttttacttaagcaactgccaag

SEQ ID NO: 223978 - DNA, 25 bp, Mus musculus
agtttttacttatgcaactgccaag

SEQ ID NO: 223979 - DNA, 25 bp, Mus musculus
agtttttagcgcacggatgcagctc

SEQ ID NO: 223980 - DNA, 25 bp, Mus musculus
agtttttagcgctcggatgcagctc

SEQ ID NO: 223981 - DNA, 25 bp, Mus musculus
agtttttaggccactggttatcaag

SEQ ID NO: 223982 - DNA, 25 bp, Mus musculus
agtttttaggcctctggttatcaag

SEQ ID NO: 223983 - DNA, 25 bp, Mus musculus
agtttttatgtcctgagtctccatc

SEQ ID NO: 223984 - DNA, 25 bp, Mus musculus
agtttttatgtcgtgagtctccatc

SEQ ID NO: 223985 - DNA, 25 bp, Mus musculus
agtttttatttactggccagacaat

SEQ ID NO: 223986 - DNA, 25 bp, Mus musculus
agtttttatttagtggccagacaat

SEQ ID NO: 223987 - DNA, 25 bp, Mus musculus
agtttttatttgactctcatagcac

SEQ ID NO: 223988 - DNA, 25 bp, Mus musculus
agtttttatttgtctctcatagcac

SEQ ID NO: 223989 - DNA, 25 bp, Mus musculus
agtttttcaattctgctctctatgg

SEQ ID NO: 223990 - DNA, 25 bp, Mus musculus
agtttttcaattgtgctctctatgg

SEQ ID NO: 223991 - DNA, 25 bp, Mus musculus
agtttttcactgacttcatgctggg

SEQ ID NO: 223992 - DNA, 25 bp, Mus musculus
agtttttcactgtcttcatgctggg

SEQ ID NO: 223993 - DNA, 25 bp, Mus musculus
agtttttcagaaatggcttggtatg

SEQ ID NO: 223994 - DNA, 25 bp, Mus musculus
agtttttcagaattggcttggtatg

SEQ ID NO: 223995 - DNA, 25 bp, Mus musculus
agtttttcagcacttagccatcctc

SEQ ID NO: 223996 - DNA, 25 bp, Mus musculus
agtttttcagcagttagccatcctc

SEQ ID NO: 223997 - DNA, 25 bp, Mus musculus
agtttttcaggaccgcaagatagat

SEQ ID NO: 223998 - DNA, 25 bp, Mus musculus
agtttttcaggagcgcaagatagat

SEQ ID NO: 223999 - DNA, 25 bp, Mus musculus
agtttttccaccatacatctttagg

SEQ ID NO: 224000 - DNA, 25 bp, Mus musculus
agtttttccaccttacatctttagg

SEQ ID NO: 224001 - DNA, 25 bp, Mus musculus
agtttttccctcacggagatgccag

SEQ ID NO: 224002 - DNA, 25 bp, Mus musculus
agtttttccctctcggagatgccag

SEQ ID NO: 224003 - DNA, 25 bp, Mus musculus
agtttttctcagattgtcacagact

SEQ ID NO: 224004 - DNA, 25 bp, Mus musculus
agtttttctcagtttgtcacagact

SEQ ID NO: 224005 - DNA, 25 bp, Mus musculus
agtttttctgtcagtcacccattta

SEQ ID NO: 224006 - DNA, 25 bp, Mus musculus
agtttttctgtctgtcacccattta

SEQ ID NO: 224007 - DNA, 25 bp, Mus musculus
agtttttgacctcaatgctggctgc

SEQ ID NO: 224008 - DNA, 25 bp, Mus musculus
agtttttgacctgaatgctggctgc

SEQ ID NO: 224009 - DNA, 25 bp, Mus musculus
agtttttgactgaatcacgacccca

SEQ ID NO: 224010 - DNA, 25 bp, Mus musculus
agtttttgactgtatcacgacccca

SEQ ID NO: 224011 - DNA, 25 bp, Mus musculus
agtttttgaggccacagcttctgca

SEQ ID NO: 224012 - DNA, 25 bp, Mus musculus
agtttttgaggcgacagcttctgca

SEQ ID NO: 224013 - DNA, 25 bp, Mus musculus
agtttttgatgcctttctatctctc

SEQ ID NO: 224014 - DNA, 25 bp, Mus musculus
agtttttgatgcgtttctatctctc

SEQ ID NO: 224015 - DNA, 25 bp, Mus musculus
agtttttgattactcatgtctgaaa

SEQ ID NO: 224016 - DNA, 25 bp, Mus musculus
agtttttgattagtcatgtctgaaa

SEQ ID NO: 224017 - DNA, 25 bp, Mus musculus
agtttttgccttagagctggcagga

SEQ ID NO: 224018 - DNA, 25 bp, Mus musculus
agtttttgccttcccaagtctaaca

SEQ ID NO: 224019 - DNA, 25 bp, Mus musculus
agtttttgccttgccaagtctaaca

SEQ ID NO: 224020 - DNA, 25 bp, Mus musculus
agtttttgcctttgagctggcagga

SEQ ID NO: 224021 - DNA, 25 bp, Mus musculus
agtttttgctatcttgtttactaca

SEQ ID NO: 224022 - DNA, 25 bp, Mus musculus
agtttttgctatgttgtttactaca

SEQ ID NO: 224023 - DNA, 25 bp, Mus musculus
agtttttggagacggtgcacaccct

SEQ ID NO: 224024 - DNA, 25 bp, Mus musculus
agtttttggagagggtgcacaccct

SEQ ID NO: 224025 - DNA, 25 bp, Mus musculus
agtttttggcgaagtcaacacctgc

SEQ ID NO: 224026 - DNA, 25 bp, Mus musculus
agtttttggcgatgtcaacacctgc

SEQ ID NO: 224027 - DNA, 25 bp, Mus musculus
agttttttagcacgacctctcctgc

SEQ ID NO: 224028 - DNA, 25 bp, Mus musculus
agttttttagcaggacctctcctgc

SEQ ID NO: 224029 - DNA, 25 bp, Mus musculus
agttttttagttctgacgcatgctt

SEQ ID NO: 224030 - DNA, 25 bp, Mus musculus
agttttttagttgtgacgcatgctt

SEQ ID NO: 224031 - DNA, 25 bp, Mus musculus
agttttttcctgaactgtatgttat

SEQ ID NO: 224032 - DNA, 25 bp, Mus musculus
agttttttcctgtactgtatgttat

SEQ ID NO: 224033 - DNA, 25 bp, Mus musculus
agttttttctccctgaagagcctgc

SEQ ID NO: 224034 - DNA, 25 bp, Mus musculus
agttttttctccgtgaagagcctgc

SEQ ID NO: 224035 - DNA, 25 bp, Mus musculus
ataaaaaatcctaagagtcctctgt

SEQ ID NO: 224036 - DNA, 25 bp, Mus musculus
ataaaaaatccttagagtcctctgt

SEQ ID NO: 224037 - DNA, 25 bp, Mus musculus
ataaaaacagttatgggctggagac

SEQ ID NO: 224038 - DNA, 25 bp, Mus musculus
ataaaaacagttttgggctggagac

SEQ ID NO: 224039 - DNA, 25 bp, Mus musculus
ataaaaaccacgacacgccagttct

SEQ ID NO: 224040 - DNA, 25 bp, Mus musculus
ataaaaaccacgtcacgccagttct

SEQ ID NO: 224041 - DNA, 25 bp, Mus musculus
ataaaaaccagcctatggcccagct

SEQ ID NO: 224042 - DNA, 25 bp, Mus musculus
ataaaaaccagcctgtccttgcgcc

SEQ ID NO: 224043 - DNA, 25 bp, Mus musculus
ataaaaaccagcgtatggcccagct

SEQ ID NO: 224044 - DNA, 25 bp, Mus musculus
ataaaaaccagcgtgtccttgcgcc

SEQ ID NO: 224045 - DNA, 25 bp, Mus musculus
ataaaaacgtccaagtactgccagt

SEQ ID NO: 224046 - DNA, 25 bp, Mus musculus
ataaaaacgtcctagtactgccagt

SEQ ID NO: 224047 - DNA, 25 bp, Mus musculus
ataaaaactgctatgtctgcaccaa

SEQ ID NO: 224048 - DNA, 25 bp, Mus musculus
ataaaaactgctttgtctgcaccaa

SEQ ID NO: 224049 - DNA, 25 bp, Mus musculus
ataaaaagagcacaccctccacact

SEQ ID NO: 224050 - DNA, 25 bp, Mus musculus
ataaaaagagcagaccctccacact

SEQ ID NO: 224051 - DNA, 25 bp, Mus musculus
ataaaaatagccagcttagcaccgt

SEQ ID NO: 224052 - DNA, 25 bp, Mus musculus
ataaaaatagcctgcttagcaccgt

SEQ ID NO: 224053 - DNA, 25 bp, Mus musculus
ataaaaatatctcccataggctcat

SEQ ID NO: 224054 - DNA, 25 bp, Mus musculus
ataaaaatatctgccataggctcat

SEQ ID NO: 224055 - DNA, 25 bp, Mus musculus
ataaaaatccttactgttccagcag

SEQ ID NO: 224056 - DNA, 25 bp, Mus musculus
ataaaaatccttcgactggcgcatg

SEQ ID NO: 224057 - DNA, 25 bp, Mus musculus
ataaaaatccttggactggcgcatg

SEQ ID NO: 224058 - DNA, 25 bp, Mus musculus
ataaaaatcctttctgttccagcag

SEQ ID NO: 224059 - DNA, 25 bp, Mus musculus
ataaaaatctacatcccagcagcca

SEQ ID NO: 224060 - DNA, 25 bp, Mus musculus
ataaaaatctacttcccagcagcca

SEQ ID NO: 224061 - DNA, 25 bp, Mus musculus
ataaaaatctgacggtctctccagc

SEQ ID NO: 224062 - DNA, 25 bp, Mus musculus
ataaaaatctgagggtctctccagc

SEQ ID NO: 224063 - DNA, 25 bp, Mus musculus
ataaaaatcttgacgaccattcctt

SEQ ID NO: 224064 - DNA, 25 bp, Mus musculus
ataaaaatcttgtcgaccattcctt

SEQ ID NO: 224065 - DNA, 25 bp, Mus musculus
ataaaaatgatgctgccctttggct

SEQ ID NO: 224066 - DNA, 25 bp, Mus musculus
ataaaaatgatggtgccctttggct

SEQ ID NO: 224067 - DNA, 25 bp, Mus musculus
ataaaaatgccaccctctctaacag

SEQ ID NO: 224068 - DNA, 25 bp, Mus musculus
ataaaaatgccagcctctctaacag

SEQ ID NO: 224069 - DNA, 25 bp, Mus musculus
ataaaacacgtcaaggctagcctgg

SEQ ID NO: 224070 - DNA, 25 bp, Mus musculus
ataaaacacgtctaggctagcctgg

SEQ ID NO: 224071 - DNA, 25 bp, Mus musculus
ataaaacacgttctccactcaagtc

SEQ ID NO: 224072 - DNA, 25 bp, Mus musculus
ataaaacacgttgtccactcaagtc

SEQ ID NO: 224073 - DNA, 25 bp, Mus musculus
ataaaacacttaacaggcaaagctg

SEQ ID NO: 224074 - DNA, 25 bp, Mus musculus
ataaaacacttatcaggcaaagctg

SEQ ID NO: 224075 - DNA, 25 bp, Mus musculus
ataaaacagctcagcagaactggag

SEQ ID NO: 224076 - DNA, 25 bp, Mus musculus
ataaaacagctctgcagaactggag

SEQ ID NO: 224077 - DNA, 25 bp, Mus musculus
ataaaacaggacaggtagtgagtaa

SEQ ID NO: 224078 - DNA, 25 bp, Mus musculus
ataaaacaggactggtagtgagtaa

SEQ ID NO: 224079 - DNA, 25 bp, Mus musculus
ataaaacatgcaaaggtctctctcc

SEQ ID NO: 224080 - DNA, 25 bp, Mus musculus
ataaaacatgcataggtctctctcc

SEQ ID NO: 224081 - DNA, 25 bp, Mus musculus
ataaaaccctcgatcctgagcttat

SEQ ID NO: 224082 - DNA, 25 bp, Mus musculus
ataaaaccctcgttcctgagcttat

SEQ ID NO: 224083 - DNA, 25 bp, Mus musculus
ataaaaccgctgactgctaagcctg

SEQ ID NO: 224084 - DNA, 25 bp, Mus musculus
ataaaaccgctgtctgctaagcctg

SEQ ID NO: 224085 - DNA, 25 bp, Mus musculus
ataaaacctcatcctagggctggtg

SEQ ID NO: 224086 - DNA, 25 bp, Mus musculus
ataaaacctcatgctagggctggtg

SEQ ID NO: 224087 - DNA, 25 bp, Mus musculus
ataaaacctcccaagaagcctactg

SEQ ID NO: 224088 - DNA, 25 bp, Mus musculus
ataaaacctccctagaagcctactg

SEQ ID NO: 224089 - DNA, 25 bp, Mus musculus
ataaaacctttcctagctgcagagt

SEQ ID NO: 224090 - DNA, 25 bp, Mus musculus
ataaaacctttcgtagctgcagagt

SEQ ID NO: 224091 - DNA, 25 bp, Mus musculus
ataaaacgaaatcctactcctcctg

SEQ ID NO: 224092 - DNA, 25 bp, Mus musculus
ataaaacgaaatgctactcctcctg

SEQ ID NO: 224093 - DNA, 25 bp, Mus musculus
ataaaacgcggtcgtgtgggcctat

SEQ ID NO: 224094 - DNA, 25 bp, Mus musculus
ataaaacgcggtggtgtgggcctat

SEQ ID NO: 224095 - DNA, 25 bp, Mus musculus
ataaaactccaaccacagtgaatga

SEQ ID NO: 224096 - DNA, 25 bp, Mus musculus
ataaaactccaagcacagtgaatga

SEQ ID NO: 224097 - DNA, 25 bp, Mus musculus
ataaaactcctcatccttttgtcat

SEQ ID NO: 224098 - DNA, 25 bp, Mus musculus
ataaaactcctcttccttttgtcat

SEQ ID NO: 224099 - DNA, 25 bp, Mus musculus
ataaaactcttaaccttattcacag

SEQ ID NO: 224100 - DNA, 25 bp, Mus musculus
ataaaactcttatccttattcacag

SEQ ID NO: 224101 - DNA, 25 bp, Mus musculus
ataaaactgcggcagacgcgtcaaa

SEQ ID NO: 224102 - DNA, 25 bp, Mus musculus
ataaaactgcgggagacgcgtcaaa

SEQ ID NO: 224103 - DNA, 25 bp, Mus musculus
ataaaactgcttaagatttacattt

SEQ ID NO: 224104 - DNA, 25 bp, Mus musculus
ataaaactgctttagatttacattt

SEQ ID NO: 224105 - DNA, 25 bp, Mus musculus
ataaaactggagctcaagtgtggta

SEQ ID NO: 224106 - DNA, 25 bp, Mus musculus
ataaaactggaggtcaagtgtggta

SEQ ID NO: 224107 - DNA, 25 bp, Mus musculus
ataaaacttgctatgcctgggcagc

SEQ ID NO: 224108 - DNA, 25 bp, Mus musculus
ataaaacttgctcaccaggagcttc

SEQ ID NO: 224109 - DNA, 25 bp, Mus musculus
ataaaacttgctgaccaggagcttc

SEQ ID NO: 224110 - DNA, 25 bp, Mus musculus
ataaaacttgctttgcctgggcagc

SEQ ID NO: 224111 - DNA, 25 bp, Mus musculus
ataaaagaactcagcctggcacggt

SEQ ID NO: 224112 - DNA, 25 bp, Mus musculus
ataaaagaactctgcctggcacggt

SEQ ID NO: 224113 - DNA, 25 bp, Mus musculus
ataaaagacctcacagttctgtttg

SEQ ID NO: 224114 - DNA, 25 bp, Mus musculus
ataaaagacctctcagttctgtttg

SEQ ID NO: 224115 - DNA, 25 bp, Mus musculus
ataaaagaccttcccagtgcagtct

SEQ ID NO: 224116 - DNA, 25 bp, Mus musculus
ataaaagaccttgccagtgcagtct

SEQ ID NO: 224117 - DNA, 25 bp, Mus musculus
ataaaagactccagcaacctacctt

SEQ ID NO: 224118 - DNA, 25 bp, Mus musculus
ataaaagactcctgcaacctacctt

SEQ ID NO: 224119 - DNA, 25 bp, Mus musculus
ataaaagaggccctgcccaggagga

SEQ ID NO: 224120 - DNA, 25 bp, Mus musculus
ataaaagaggccgtgcccaggagga

SEQ ID NO: 224121 - DNA, 25 bp, Mus musculus
ataaaagagggcctagctgcgccag

SEQ ID NO: 224122 - DNA, 25 bp, Mus musculus
ataaaagagggcgtagctgcgccag

SEQ ID NO: 224123 - DNA, 25 bp, Mus musculus
ataaaagattgtatcaccacgcttc

SEQ ID NO: 224124 - DNA, 25 bp, Mus musculus
ataaaagattgtttcaccacgcttc

SEQ ID NO: 224125 - DNA, 25 bp, Mus musculus
ataaaagcaagcctctttctccctc

SEQ ID NO: 224126 - DNA, 25 bp, Mus musculus
ataaaagcaagcgtctttctccctc

SEQ ID NO: 224127 - DNA, 25 bp, Mus musculus
ataaaagcacctaggagccgccctt

SEQ ID NO: 224128 - DNA, 25 bp, Mus musculus
ataaaagcaccttggagccgccctt

SEQ ID NO: 224129 - DNA, 25 bp, Mus musculus
ataaaagctaggagtgccagtgcac

SEQ ID NO: 224130 - DNA, 25 bp, Mus musculus
ataaaagctaggtgtgccagtgcac

SEQ ID NO: 224131 - DNA, 25 bp, Mus musculus
ataaaagctatcaagaagttgccct

SEQ ID NO: 224132 - DNA, 25 bp, Mus musculus
ataaaagctatctagaagttgccct

SEQ ID NO: 224133 - DNA, 25 bp, Mus musculus
ataaaagctctcctgtgcctgttgg

SEQ ID NO: 224134 - DNA, 25 bp, Mus musculus
ataaaagctctcgtgtgcctgttgg

SEQ ID NO: 224135 - DNA, 25 bp, Mus musculus
ataaaagctcttagcttcctcaggg

SEQ ID NO: 224136 - DNA, 25 bp, Mus musculus
ataaaagctctttgcttcctcaggg

SEQ ID NO: 224137 - DNA, 25 bp, Mus musculus
ataaaaggatcaagccccgtccaga

SEQ ID NO: 224138 - DNA, 25 bp, Mus musculus
ataaaaggatcatgccccgtccaga

SEQ ID NO: 224139 - DNA, 25 bp, Mus musculus
ataaaaggatctctgctgggctcat

SEQ ID NO: 224140 - DNA, 25 bp, Mus musculus
ataaaaggatctgtgctgggctcat

SEQ ID NO: 224141 - DNA, 25 bp, Mus musculus
ataaaaggccatcaccatcttgggc

SEQ ID NO: 224142 - DNA, 25 bp, Mus musculus
ataaaaggccatgaccatcttgggc

SEQ ID NO: 224143 - DNA, 25 bp, Mus musculus
ataaaagggtgacgcgtcggcgccg

SEQ ID NO: 224144 - DNA, 25 bp, Mus musculus
ataaaagggtgaggcgtcggcgccg

SEQ ID NO: 224145 - DNA, 25 bp, Mus musculus
ataaaagtaatgagttcagcctaac

SEQ ID NO: 224146 - DNA, 25 bp, Mus musculus
ataaaagtaatgtgttcagcctaac

SEQ ID NO: 224147 - DNA, 25 bp, Mus musculus
ataaaagtatcactcaccaagccga

SEQ ID NO: 224148 - DNA, 25 bp, Mus musculus
ataaaagtatcagtcaccaagccga

SEQ ID NO: 224149 - DNA, 25 bp, Mus musculus
ataaaagtctgtagctctgtcccag

SEQ ID NO: 224150 - DNA, 25 bp, Mus musculus
ataaaagtctgttgctctgtcccag

SEQ ID NO: 224151 - DNA, 25 bp, Mus musculus
ataaaagtgtgcagcactggctgac

SEQ ID NO: 224152 - DNA, 25 bp, Mus musculus
ataaaagtgtgctgcactggctgac

SEQ ID NO: 224153 - DNA, 25 bp, Mus musculus
ataaaagttgcaccatcccaccatc

SEQ ID NO: 224154 - DNA, 25 bp, Mus musculus
ataaaagttgcagcatcccaccatc

SEQ ID NO: 224155 - DNA, 25 bp, Mus musculus
ataaaataaagccactgttttgcat

SEQ ID NO: 224156 - DNA, 25 bp, Mus musculus
ataaaataaagcgactgttttgcat

SEQ ID NO: 224157 - DNA, 25 bp, Mus musculus
ataaaataccttaagttgtgctagg

SEQ ID NO: 224158 - DNA, 25 bp, Mus musculus
ataaaatacctttagttgtgctagg

SEQ ID NO: 224159 - DNA, 25 bp, Mus musculus
ataaaatacttcaacttctgggctg

SEQ ID NO: 224160 - DNA, 25 bp, Mus musculus
ataaaatacttctacttctgggctg

SEQ ID NO: 224161 - DNA, 25 bp, Mus musculus
ataaaatagctcatcctttgttcag

SEQ ID NO: 224162 - DNA, 25 bp, Mus musculus
ataaaatagctcttcctttgttcag

SEQ ID NO: 224163 - DNA, 25 bp, Mus musculus
ataaaatagcttcagcccagcccca

SEQ ID NO: 224164 - DNA, 25 bp, Mus musculus
ataaaatagcttgagcccagcccca

SEQ ID NO: 224165 - DNA, 25 bp, Mus musculus
ataaaatatgacaaaccgccggatt

SEQ ID NO: 224166 - DNA, 25 bp, Mus musculus
ataaaatatgactaaccgccggatt

SEQ ID NO: 224167 - DNA, 25 bp, Mus musculus
ataaaatcaaacctctcctcgcaca

SEQ ID NO: 224168 - DNA, 25 bp, Mus musculus
ataaaatcaaacgtctcctcgcaca

SEQ ID NO: 224169 - DNA, 25 bp, Mus musculus
ataaaatcctgtatccggcgagcca

SEQ ID NO: 224170 - DNA, 25 bp, Mus musculus
ataaaatcctgtttccggcgagcca

SEQ ID NO: 224171 - DNA, 25 bp, Mus musculus
ataaaatcgcaacccttctgggaat

SEQ ID NO: 224172 - DNA, 25 bp, Mus musculus
ataaaatcgcaagccttctgggaat

SEQ ID NO: 224173 - DNA, 25 bp, Mus musculus
ataaaatctccccatccctgtacat

SEQ ID NO: 224174 - DNA, 25 bp, Mus musculus
ataaaatctcccgatccctgtacat

SEQ ID NO: 224175 - DNA, 25 bp, Mus musculus
ataaaatgagggacagtgccccggg

SEQ ID NO: 224176 - DNA, 25 bp, Mus musculus
ataaaatgagggtcagtgccccggg

SEQ ID NO: 224177 - DNA, 25 bp, Mus musculus
ataaaatgccctctaggcttatata

SEQ ID NO: 224178 - DNA, 25 bp, Mus musculus
ataaaatgccctgtaggcttatata

SEQ ID NO: 224179 - DNA, 25 bp, Mus musculus
ataaaatgctatagatgcttttggg

SEQ ID NO: 224180 - DNA, 25 bp, Mus musculus
ataaaatgctattgatgcttttggg

SEQ ID NO: 224181 - DNA, 25 bp, Mus musculus
ataaaatgtcagaaagggccaggtg

SEQ ID NO: 224182 - DNA, 25 bp, Mus musculus
ataaaatgtcagtaagggccaggtg

SEQ ID NO: 224183 - DNA, 25 bp, Mus musculus
ataaaattcttacctactcctctgc

SEQ ID NO: 224184 - DNA, 25 bp, Mus musculus
ataaaattcttagctactcctctgc

SEQ ID NO: 224185 - DNA, 25 bp, Mus musculus
ataaaattctttctgcacggtgtca

SEQ ID NO: 224186 - DNA, 25 bp, Mus musculus
ataaaattctttgtgcacggtgtca

SEQ ID NO: 224187 - DNA, 25 bp, Mus musculus
ataaaattgacccatctaccctgca

SEQ ID NO: 224188 - DNA, 25 bp, Mus musculus
ataaaattgaccgatctaccctgca

SEQ ID NO: 224189 - DNA, 25 bp, Mus musculus
ataaaattgactaacgccgggcgtg

SEQ ID NO: 224190 - DNA, 25 bp, Mus musculus
ataaaattgacttacgccgggcgtg

SEQ ID NO: 224191 - DNA, 25 bp, Mus musculus
ataaaattgaggctgtctgctttcc

SEQ ID NO: 224192 - DNA, 25 bp, Mus musculus
ataaaattgagggtgtctgctttcc

SEQ ID NO: 224193 - DNA, 25 bp, Mus musculus
ataaaattgcctacctggtatgaca

SEQ ID NO: 224194 - DNA, 25 bp, Mus musculus
ataaaattgccttcctggtatgaca

SEQ ID NO: 224195 - DNA, 25 bp, Mus musculus
ataaaatttacaaggaatccctatt

SEQ ID NO: 224196 - DNA, 25 bp, Mus musculus
ataaaatttacatggaatccctatt

SEQ ID NO: 224197 - DNA, 25 bp, Mus musculus
ataaaattttggagtgctgagcact

SEQ ID NO: 224198 - DNA, 25 bp, Mus musculus
ataaaattttggtgtgctgagcact

SEQ ID NO: 224199 - DNA, 25 bp, Mus musculus
ataaacaaatccctgtgcccaccat

SEQ ID NO: 224200 - DNA, 25 bp, Mus musculus
ataaacaaatccgtgtgcccaccat

SEQ ID NO: 224201 - DNA, 25 bp, Mus musculus
ataaacaactccatacagctccagg

SEQ ID NO: 224202 - DNA, 25 bp, Mus musculus
ataaacaactccttacagctccagg

SEQ ID NO: 224203 - DNA, 25 bp, Mus musculus
ataaacaatgctcaggatctcctcc

SEQ ID NO: 224204 - DNA, 25 bp, Mus musculus
ataaacaatgctgaggatctcctcc

SEQ ID NO: 224205 - DNA, 25 bp, Mus musculus
ataaacacagcactttcagcataca

SEQ ID NO: 224206 - DNA, 25 bp, Mus musculus
ataaacacagcagtttcagcataca

SEQ ID NO: 224207 - DNA, 25 bp, Mus musculus
ataaacacatgaattgattagcccc

SEQ ID NO: 224208 - DNA, 25 bp, Mus musculus
ataaacacatgatttgattagcccc

SEQ ID NO: 224209 - DNA, 25 bp, Mus musculus
ataaacacatgccacttttgacagt

SEQ ID NO: 224210 - DNA, 25 bp, Mus musculus
ataaacacatgcgacttttgacagt

SEQ ID NO: 224211 - DNA, 25 bp, Mus musculus
ataaacaccaggaagctccacggac

SEQ ID NO: 224212 - DNA, 25 bp, Mus musculus
ataaacaccaggtagctccacggac

SEQ ID NO: 224213 - DNA, 25 bp, Mus musculus
ataaacaccctgactgcagcagtag

SEQ ID NO: 224214 - DNA, 25 bp, Mus musculus
ataaacaccctgtctgcagcagtag

SEQ ID NO: 224215 - DNA, 25 bp, Mus musculus
ataaacacgtatagaccccacagta

SEQ ID NO: 224216 - DNA, 25 bp, Mus musculus
ataaacacgtattgaccccacagta

SEQ ID NO: 224217 - DNA, 25 bp, Mus musculus
ataaacacgtggaggcccaagtcct

SEQ ID NO: 224218 - DNA, 25 bp, Mus musculus
ataaacacgtggtggcccaagtcct

SEQ ID NO: 224219 - DNA, 25 bp, Mus musculus
ataaacactctaccattgtctccac

SEQ ID NO: 224220 - DNA, 25 bp, Mus musculus
ataaacactctagcattgtctccac

SEQ ID NO: 224221 - DNA, 25 bp, Mus musculus
ataaacacttctatgggccgccgcg

SEQ ID NO: 224222 - DNA, 25 bp, Mus musculus
ataaacacttctttgggccgccgcg

SEQ ID NO: 224223 - DNA, 25 bp, Mus musculus
ataaacagaatacccactcttccta

SEQ ID NO: 224224 - DNA, 25 bp, Mus musculus
ataaacagaatagccactcttccta

SEQ ID NO: 224225 - DNA, 25 bp, Mus musculus
ataaacagacccactatagccctgg

SEQ ID NO: 224226 - DNA, 25 bp, Mus musculus
ataaacagaccctctatagccctgg

SEQ ID NO: 224227 - DNA, 25 bp, Mus musculus
ataaacagccccaatatgtcctttc

SEQ ID NO: 224228 - DNA, 25 bp, Mus musculus
ataaacagcccctatatgtcctttc

SEQ ID NO: 224229 - DNA, 25 bp, Mus musculus
ataaacagcgttcctattcctttga

SEQ ID NO: 224230 - DNA, 25 bp, Mus musculus
ataaacagcgttgctattcctttga

SEQ ID NO: 224231 - DNA, 25 bp, Mus musculus
ataaacagctagaaacccttcaaga

SEQ ID NO: 224232 - DNA, 25 bp, Mus musculus
ataaacagctagtaacccttcaaga

SEQ ID NO: 224233 - DNA, 25 bp, Mus musculus
ataaacagctatatctcatatccta

SEQ ID NO: 224234 - DNA, 25 bp, Mus musculus
ataaacagctatttctcatatccta

SEQ ID NO: 224235 - DNA, 25 bp, Mus musculus
ataaacagctgtccatggatacatg

SEQ ID NO: 224236 - DNA, 25 bp, Mus musculus
ataaacagctgtgcatggatacatg

SEQ ID NO: 224237 - DNA, 25 bp, Mus musculus
ataaacagttgacatggcccataat

SEQ ID NO: 224238 - DNA, 25 bp, Mus musculus
ataaacagttgagatggcccataat

SEQ ID NO: 224239 - DNA, 25 bp, Mus musculus
ataaacagtttcaacatggagcaat

SEQ ID NO: 224240 - DNA, 25 bp, Mus musculus
ataaacagtttctacatggagcaat

SEQ ID NO: 224241 - DNA, 25 bp, Mus musculus
ataaacagttttactagctcatctt

SEQ ID NO: 224242 - DNA, 25 bp, Mus musculus
ataaacagttttccacctcgtcaat

SEQ ID NO: 224243 - DNA, 25 bp, Mus musculus
ataaacagttttgcacctcgtcaat

SEQ ID NO: 224244 - DNA, 25 bp, Mus musculus
ataaacagtttttctagctcatctt

SEQ ID NO: 224245 - DNA, 25 bp, Mus musculus
ataaacatatcacacctagcttccc

SEQ ID NO: 224246 - DNA, 25 bp, Mus musculus
ataaacatatcagacctagcttccc

SEQ ID NO: 224247 - DNA, 25 bp, Mus musculus
ataaacatcacacagatgagtctgt

SEQ ID NO: 224248 - DNA, 25 bp, Mus musculus
ataaacatcacactcgagggcggaa

SEQ ID NO: 224249 - DNA, 25 bp, Mus musculus
ataaacatcacagagatgagtctgt

SEQ ID NO: 224250 - DNA, 25 bp, Mus musculus
ataaacatcacagtcgagggcggaa

SEQ ID NO: 224251 - DNA, 25 bp, Mus musculus
ataaacatccctattttgcagtggt

SEQ ID NO: 224252 - DNA, 25 bp, Mus musculus
ataaacatcccttttttgcagtggt

SEQ ID NO: 224253 - DNA, 25 bp, Mus musculus
ataaacatcgaaaaggcgttcctca

SEQ ID NO: 224254 - DNA, 25 bp, Mus musculus
ataaacatcgaataggcgttcctca

SEQ ID NO: 224255 - DNA, 25 bp, Mus musculus
ataaacatcttcaaatccctctgtc

SEQ ID NO: 224256 - DNA, 25 bp, Mus musculus
ataaacatcttctaatccctctgtc

SEQ ID NO: 224257 - DNA, 25 bp, Mus musculus
ataaacatgcatagccccaaagggc

SEQ ID NO: 224258 - DNA, 25 bp, Mus musculus
ataaacatgcattgccccaaagggc

SEQ ID NO: 224259 - DNA, 25 bp, Mus musculus
ataaacatgccaccagtttgctttt

SEQ ID NO: 224260 - DNA, 25 bp, Mus musculus
ataaacatgccagcagtttgctttt

SEQ ID NO: 224261 - DNA, 25 bp, Mus musculus
ataaacatggaaacacgggtcgcag

SEQ ID NO: 224262 - DNA, 25 bp, Mus musculus
ataaacatggaatcacgggtcgcag

SEQ ID NO: 224263 - DNA, 25 bp, Mus musculus
ataaacatgttaccctggcactgct

SEQ ID NO: 224264 - DNA, 25 bp, Mus musculus
ataaacatgttagcctggcactgct

SEQ ID NO: 224265 - DNA, 25 bp, Mus musculus
ataaacatgtttcttgggctccatg

SEQ ID NO: 224266 - DNA, 25 bp, Mus musculus
ataaacatgtttgttgggctccatg

SEQ ID NO: 224267 - DNA, 25 bp, Mus musculus
ataaacattcagagctcgcctttaa

SEQ ID NO: 224268 - DNA, 25 bp, Mus musculus
ataaacattcagtgctcgcctttaa

SEQ ID NO: 224269 - DNA, 25 bp, Mus musculus
ataaacattgacatccctttgcctt

SEQ ID NO: 224270 - DNA, 25 bp, Mus musculus
ataaacattgacttccctttgcctt

SEQ ID NO: 224271 - DNA, 25 bp, Mus musculus
ataaaccacagtacattagagacac

SEQ ID NO: 224272 - DNA, 25 bp, Mus musculus
ataaaccacagttcattagagacac

SEQ ID NO: 224273 - DNA, 25 bp, Mus musculus
ataaaccactctactcgttgtctgt

SEQ ID NO: 224274 - DNA, 25 bp, Mus musculus
ataaaccactcttctcgttgtctgt

SEQ ID NO: 224275 - DNA, 25 bp, Mus musculus
ataaaccagcccagcacatactcta

SEQ ID NO: 224276 - DNA, 25 bp, Mus musculus
ataaaccagccctgcacatactcta

SEQ ID NO: 224277 - DNA, 25 bp, Mus musculus
ataaaccagggaagacctaggcata

SEQ ID NO: 224278 - DNA, 25 bp, Mus musculus
ataaaccagggatgacctaggcata

SEQ ID NO: 224279 - DNA, 25 bp, Mus musculus
ataaaccatgtgctattcccaccct

SEQ ID NO: 224280 - DNA, 25 bp, Mus musculus
ataaaccatgtggtattcccaccct

SEQ ID NO: 224281 - DNA, 25 bp, Mus musculus
ataaaccatttccagtgatccttct

SEQ ID NO: 224282 - DNA, 25 bp, Mus musculus
ataaaccatttcgagtgatccttct

SEQ ID NO: 224283 - DNA, 25 bp, Mus musculus
ataaaccccagtatcttgtatcctg

SEQ ID NO: 224284 - DNA, 25 bp, Mus musculus
ataaaccccagtttcttgtatcctg

SEQ ID NO: 224285 - DNA, 25 bp, Mus musculus
ataaacccgtttactgtgtgtgtgt

SEQ ID NO: 224286 - DNA, 25 bp, Mus musculus
ataaacccgttttctgtgtgtgtgt

SEQ ID NO: 224287 - DNA, 25 bp, Mus musculus
ataaaccctcacctgttaattgatt

SEQ ID NO: 224288 - DNA, 25 bp, Mus musculus
ataaaccctcacgtgttaattgatt

SEQ ID NO: 224289 - DNA, 25 bp, Mus musculus
ataaaccgaagtatgcattgctgga

SEQ ID NO: 224290 - DNA, 25 bp, Mus musculus
ataaaccgaagtttgcattgctgga

SEQ ID NO: 224291 - DNA, 25 bp, Mus musculus
ataaaccggagcctacgtgtggccg

SEQ ID NO: 224292 - DNA, 25 bp, Mus musculus
ataaaccggagcgtacgtgtggccg

SEQ ID NO: 224293 - DNA, 25 bp, Mus musculus
ataaaccgtgttagcagctcaggaa

SEQ ID NO: 224294 - DNA, 25 bp, Mus musculus
ataaaccgtgtttgcagctcaggaa

SEQ ID NO: 224295 - DNA, 25 bp, Mus musculus
ataaacctaggcaatatggcatata

SEQ ID NO: 224296 - DNA, 25 bp, Mus musculus
ataaacctaggctatatggcatata

SEQ ID NO: 224297 - DNA, 25 bp, Mus musculus
ataaacctcgagcagccagttggct

SEQ ID NO: 224298 - DNA, 25 bp, Mus musculus
ataaacctcgaggagccagttggct

SEQ ID NO: 224299 - DNA, 25 bp, Mus musculus
ataaacctgagacgttcctttgtgt

SEQ ID NO: 224300 - DNA, 25 bp, Mus musculus
ataaacctgagaggttcctttgtgt

SEQ ID NO: 224301 - DNA, 25 bp, Mus musculus
ataaacctgctcagataggacaatt

SEQ ID NO: 224302 - DNA, 25 bp, Mus musculus
ataaacctgctctgataggacaatt

SEQ ID NO: 224303 - DNA, 25 bp, Mus musculus
ataaacctgtaaatcctgtatgtga

SEQ ID NO: 224304 - DNA, 25 bp, Mus musculus
ataaacctgtaattcctgtatgtga

SEQ ID NO: 224305 - DNA, 25 bp, Mus musculus
ataaacctgtttccacgataggaca

SEQ ID NO: 224306 - DNA, 25 bp, Mus musculus
ataaacctgtttgcacgataggaca

SEQ ID NO: 224307 - DNA, 25 bp, Mus musculus
ataaaccttcctctcagtacttgtg

SEQ ID NO: 224308 - DNA, 25 bp, Mus musculus
ataaaccttcctgtcagtacttgtg

SEQ ID NO: 224309 - DNA, 25 bp, Mus musculus
ataaacgagagtccatgggtcccca

SEQ ID NO: 224310 - DNA, 25 bp, Mus musculus
ataaacgagagtgcatgggtcccca

SEQ ID NO: 224311 - DNA, 25 bp, Mus musculus
ataaacgagcagatcctactgtggt

SEQ ID NO: 224312 - DNA, 25 bp, Mus musculus
ataaacgagcagttcctactgtggt

SEQ ID NO: 224313 - DNA, 25 bp, Mus musculus
ataaacgagccaattggttctccct

SEQ ID NO: 224314 - DNA, 25 bp, Mus musculus
ataaacgagccatttggttctccct

SEQ ID NO: 224315 - DNA, 25 bp, Mus musculus
ataaacgagttcatcagcctgacca

SEQ ID NO: 224316 - DNA, 25 bp, Mus musculus
ataaacgagttcttcagcctgacca

SEQ ID NO: 224317 - DNA, 25 bp, Mus musculus
ataaacgtcacaatgtgccctgagc

SEQ ID NO: 224318 - DNA, 25 bp, Mus musculus
ataaacgtcacattgtgccctgagc

SEQ ID NO: 224319 - DNA, 25 bp, Mus musculus
ataaacgtcctgatgtcaggcttgg

SEQ ID NO: 224320 - DNA, 25 bp, Mus musculus
ataaacgtcctgttgtcaggcttgg

SEQ ID NO: 224321 - DNA, 25 bp, Mus musculus
ataaacgtgcgcatctggagactga

SEQ ID NO: 224322 - DNA, 25 bp, Mus musculus
ataaacgtgcgcttctggagactga

SEQ ID NO: 224323 - DNA, 25 bp, Mus musculus
ataaactaccccacttattcagaag

SEQ ID NO: 224324 - DNA, 25 bp, Mus musculus
ataaactacccctcttattcagaag

SEQ ID NO: 224325 - DNA, 25 bp, Mus musculus
ataaactacgccacagggactcctg

SEQ ID NO: 224326 - DNA, 25 bp, Mus musculus
ataaactacgcctcagggactcctg

SEQ ID NO: 224327 - DNA, 25 bp, Mus musculus
ataaactaggctccgactgtgcaca

SEQ ID NO: 224328 - DNA, 25 bp, Mus musculus
ataaactaggctgcgactgtgcaca

SEQ ID NO: 224329 - DNA, 25 bp, Mus musculus
ataaactagggaatgctgttaggaa

SEQ ID NO: 224330 - DNA, 25 bp, Mus musculus
ataaactagggattgctgttaggaa

SEQ ID NO: 224331 - DNA, 25 bp, Mus musculus
ataaactatatccttcactccatgc

SEQ ID NO: 224332 - DNA, 25 bp, Mus musculus
ataaactatatcgttcactccatgc

SEQ ID NO: 224333 - DNA, 25 bp, Mus musculus
ataaactatttacgcggttgacgct

SEQ ID NO: 224334 - DNA, 25 bp, Mus musculus
ataaactatttaggcggttgacgct

SEQ ID NO: 224335 - DNA, 25 bp, Mus musculus
ataaactcaactctgtactatcaag

SEQ ID NO: 224336 - DNA, 25 bp, Mus musculus
ataaactcaactgtgtactatcaag

SEQ ID NO: 224337 - DNA, 25 bp, Mus musculus
ataaactcccacatctagctgtaat

SEQ ID NO: 224338 - DNA, 25 bp, Mus musculus
ataaactcccacttctagctgtaat

SEQ ID NO: 224339 - DNA, 25 bp, Mus musculus
ataaactccccacattccatggatc

SEQ ID NO: 224340 - DNA, 25 bp, Mus musculus
ataaactccccagattccatggatc

SEQ ID NO: 224341 - DNA, 25 bp, Mus musculus
ataaactcctacacatccctcaaag

SEQ ID NO: 224342 - DNA, 25 bp, Mus musculus
ataaactcctactcatccctcaaag

SEQ ID NO: 224343 - DNA, 25 bp, Mus musculus
ataaactctcagaacgttgtcactt

SEQ ID NO: 224344 - DNA, 25 bp, Mus musculus
ataaactctcagtacgttgtcactt

SEQ ID NO: 224345 - DNA, 25 bp, Mus musculus
ataaactctctcaatacccttggaa

SEQ ID NO: 224346 - DNA, 25 bp, Mus musculus
ataaactctctctatacccttggaa

SEQ ID NO: 224347 - DNA, 25 bp, Mus musculus
ataaactctgatacctcagggagaa

SEQ ID NO: 224348 - DNA, 25 bp, Mus musculus
ataaactctgattcctcagggagaa

SEQ ID NO: 224349 - DNA, 25 bp, Mus musculus
ataaactctttcagttagcagcaag

SEQ ID NO: 224350 - DNA, 25 bp, Mus musculus
ataaactctttctgttagcagcaag

SEQ ID NO: 224351 - DNA, 25 bp, Mus musculus
ataaactctttgcatcttgccacat

SEQ ID NO: 224352 - DNA, 25 bp, Mus musculus
ataaactctttgctcactgtgccat

SEQ ID NO: 224353 - DNA, 25 bp, Mus musculus
ataaactctttggatcttgccacat

SEQ ID NO: 224354 - DNA, 25 bp, Mus musculus
ataaactctttggtcactgtgccat

SEQ ID NO: 224355 - DNA, 25 bp, Mus musculus
ataaactgaaagagccctgggtgac

SEQ ID NO: 224356 - DNA, 25 bp, Mus musculus
ataaactgaaagtgccctgggtgac

SEQ ID NO: 224357 - DNA, 25 bp, Mus musculus
ataaactgagaacaccttaactgga

SEQ ID NO: 224358 - DNA, 25 bp, Mus musculus
ataaactgagaagaccttaactgga

SEQ ID NO: 224359 - DNA, 25 bp, Mus musculus
ataaactgagctaaatgccattgca

SEQ ID NO: 224360 - DNA, 25 bp, Mus musculus
ataaactgagcttaatgccattgca

SEQ ID NO: 224361 - DNA, 25 bp, Mus musculus
ataaactgagggactgtgacatgac

SEQ ID NO: 224362 - DNA, 25 bp, Mus musculus
ataaactgagggtctgtgacatgac

SEQ ID NO: 224363 - DNA, 25 bp, Mus musculus
ataaactgccagattgtacaacttt

SEQ ID NO: 224364 - DNA, 25 bp, Mus musculus
ataaactgccagtttgtacaacttt

SEQ ID NO: 224365 - DNA, 25 bp, Mus musculus
ataaactgccttaaattggaagtgg

SEQ ID NO: 224366 - DNA, 25 bp, Mus musculus
ataaactgcctttaattggaagtgg

SEQ ID NO: 224367 - DNA, 25 bp, Mus musculus
ataaactgtagacggcttgcagcac

SEQ ID NO: 224368 - DNA, 25 bp, Mus musculus
ataaactgtagagggcttgcagcac

SEQ ID NO: 224369 - DNA, 25 bp, Mus musculus
ataaactgtttcaaggttgctaaag

SEQ ID NO: 224370 - DNA, 25 bp, Mus musculus
ataaactgtttctaggttgctaaag

SEQ ID NO: 224371 - DNA, 25 bp, Mus musculus
ataaactgtttgcaaccccattcac

SEQ ID NO: 224372 - DNA, 25 bp, Mus musculus
ataaactgtttggaaccccattcac

SEQ ID NO: 224373 - DNA, 25 bp, Mus musculus
ataaacttagctctgggtactgtaa

SEQ ID NO: 224374 - DNA, 25 bp, Mus musculus
ataaacttagctgtgggtactgtaa

SEQ ID NO: 224375 - DNA, 25 bp, Mus musculus
ataaacttcccccacagtgctgtgg

SEQ ID NO: 224376 - DNA, 25 bp, Mus musculus
ataaacttccccgacagtgctgtgg

SEQ ID NO: 224377 - DNA, 25 bp, Mus musculus
ataaacttcctaatgatcagcgcta

SEQ ID NO: 224378 - DNA, 25 bp, Mus musculus
ataaacttcctattgatcagcgcta

SEQ ID NO: 224379 - DNA, 25 bp, Mus musculus
ataaacttggctcttctatctgaaa

SEQ ID NO: 224380 - DNA, 25 bp, Mus musculus
ataaacttggctgttctatctgaaa

SEQ ID NO: 224381 - DNA, 25 bp, Mus musculus
ataaacttgtttagtgagggtctca

SEQ ID NO: 224382 - DNA, 25 bp, Mus musculus
ataaacttgttttgtgagggtctca

SEQ ID NO: 224383 - DNA, 25 bp, Mus musculus
ataaacttttgaagttctcagcaac

SEQ ID NO: 224384 - DNA, 25 bp, Mus musculus
ataaacttttgatgttctcagcaac

SEQ ID NO: 224385 - DNA, 25 bp, Mus musculus
ataaagaatcggcttgagatcaacg

SEQ ID NO: 224386 - DNA, 25 bp, Mus musculus
ataaagaatcgggttgagatcaacg

SEQ ID NO: 224387 - DNA, 25 bp, Mus musculus
ataaagacaccacacgaagcgccct

SEQ ID NO: 224388 - DNA, 25 bp, Mus musculus
ataaagacaccagacgaagcgccct

SEQ ID NO: 224389 - DNA, 25 bp, Mus musculus
ataaagacagcaaccgcagtggcgg

SEQ ID NO: 224390 - DNA, 25 bp, Mus musculus
ataaagacagcatccgcagtggcgg

SEQ ID NO: 224391 - DNA, 25 bp, Mus musculus
ataaagacctagcaaacacatctgg

SEQ ID NO: 224392 - DNA, 25 bp, Mus musculus
ataaagacctaggaaacacatctgg

SEQ ID NO: 224393 - DNA, 25 bp, Mus musculus
ataaagactcggaaccccatgttgg

SEQ ID NO: 224394 - DNA, 25 bp, Mus musculus
ataaagactcggtaccccatgttgg

SEQ ID NO: 224395 - DNA, 25 bp, Mus musculus
ataaagactgcaccgcaggcggcct

SEQ ID NO: 224396 - DNA, 25 bp, Mus musculus
ataaagactgcagcgcaggcggcct

SEQ ID NO: 224397 - DNA, 25 bp, Mus musculus
ataaagacttgaccaccaccagtgg

SEQ ID NO: 224398 - DNA, 25 bp, Mus musculus
ataaagacttgagcaccaccagtgg

SEQ ID NO: 224399 - DNA, 25 bp, Mus musculus
ataaagagaattcccatcaccctgg

SEQ ID NO: 224400 - DNA, 25 bp, Mus musculus
ataaagagaattgccatcaccctgg

SEQ ID NO: 224401 - DNA, 25 bp, Mus musculus
ataaagagacccatcctagccttat

SEQ ID NO: 224402 - DNA, 25 bp, Mus musculus
ataaagagacccttcctagccttat

SEQ ID NO: 224403 - DNA, 25 bp, Mus musculus
ataaagagactcagcccaggagaaa

SEQ ID NO: 224404 - DNA, 25 bp, Mus musculus
ataaagagactctgcccaggagaaa

SEQ ID NO: 224405 - DNA, 25 bp, Mus musculus
ataaagagcacacttggtcttccaa

SEQ ID NO: 224406 - DNA, 25 bp, Mus musculus
ataaagagcacagttggtcttccaa

SEQ ID NO: 224407 - DNA, 25 bp, Mus musculus
ataaagaggatacccctgcgcacgt

SEQ ID NO: 224408 - DNA, 25 bp, Mus musculus
ataaagaggatagccctgcgcacgt

SEQ ID NO: 224409 - DNA, 25 bp, Mus musculus
ataaagatacatccttcgtgttcat

SEQ ID NO: 224410 - DNA, 25 bp, Mus musculus
ataaagatacatgcttcgtgttcat

SEQ ID NO: 224411 - DNA, 25 bp, Mus musculus
ataaagatacttcctgagaccagcc

SEQ ID NO: 224412 - DNA, 25 bp, Mus musculus
ataaagatacttgctgagaccagcc

SEQ ID NO: 224413 - DNA, 25 bp, Mus musculus
ataaagatcactctctgaccttcac

SEQ ID NO: 224414 - DNA, 25 bp, Mus musculus
ataaagatcactgtctgaccttcac

SEQ ID NO: 224415 - DNA, 25 bp, Mus musculus
ataaagatcagacgctccttctcta

SEQ ID NO: 224416 - DNA, 25 bp, Mus musculus
ataaagatcagaggctccttctcta

SEQ ID NO: 224417 - DNA, 25 bp, Mus musculus
ataaagatccccagaaaccaagctc

SEQ ID NO: 224418 - DNA, 25 bp, Mus musculus
ataaagatcccctgaaaccaagctc

SEQ ID NO: 224419 - DNA, 25 bp, Mus musculus
ataaagatctgtatgtcccacaccc

SEQ ID NO: 224420 - DNA, 25 bp, Mus musculus
ataaagatctgtttgtcccacaccc

SEQ ID NO: 224421 - DNA, 25 bp, Mus musculus
ataaagatctttctcccatgggatg

SEQ ID NO: 224422 - DNA, 25 bp, Mus musculus
ataaagatctttgtcccatgggatg

SEQ ID NO: 224423 - DNA, 25 bp, Mus musculus
ataaagatgcctcttggttcctctg

SEQ ID NO: 224424 - DNA, 25 bp, Mus musculus
ataaagatgcctgttggttcctctg

SEQ ID NO: 224425 - DNA, 25 bp, Mus musculus
ataaagattcctctcaattcactga

SEQ ID NO: 224426 - DNA, 25 bp, Mus musculus
ataaagattcctgtcaattcactga

SEQ ID NO: 224427 - DNA, 25 bp, Mus musculus
ataaagcagaagaccctgggtatga

SEQ ID NO: 224428 - DNA, 25 bp, Mus musculus
ataaagcagaagtccctgggtatga

SEQ ID NO: 224429 - DNA, 25 bp, Mus musculus
ataaagcagcccatactagcagatt

SEQ ID NO: 224430 - DNA, 25 bp, Mus musculus
ataaagcagcccttactagcagatt

SEQ ID NO: 224431 - DNA, 25 bp, Mus musculus
ataaagcagctgacaacttgggtgg

SEQ ID NO: 224432 - DNA, 25 bp, Mus musculus
ataaagcagctgtcaacttgggtgg

SEQ ID NO: 224433 - DNA, 25 bp, Mus musculus
ataaagcataccatccagtgcgtca

SEQ ID NO: 224434 - DNA, 25 bp, Mus musculus
ataaagcataccttccagtgcgtca

SEQ ID NO: 224435 - DNA, 25 bp, Mus musculus
ataaagcattccaccgtttttcatc

SEQ ID NO: 224436 - DNA, 25 bp, Mus musculus
ataaagcattcctccgtttttcatc

SEQ ID NO: 224437 - DNA, 25 bp, Mus musculus
ataaagccaatcaaggtcccgtatc

SEQ ID NO: 224438 - DNA, 25 bp, Mus musculus
ataaagccaatctaggtcccgtatc

SEQ ID NO: 224439 - DNA, 25 bp, Mus musculus
ataaagccacagaaagccacacttt

SEQ ID NO: 224440 - DNA, 25 bp, Mus musculus
ataaagccacagtaagccacacttt

SEQ ID NO: 224441 - DNA, 25 bp, Mus musculus
ataaagccactgatttgcatgcttg

SEQ ID NO: 224442 - DNA, 25 bp, Mus musculus
ataaagccactgttttgcatgcttg

SEQ ID NO: 224443 - DNA, 25 bp, Mus musculus
ataaagcccaacatcagtcagcctt

SEQ ID NO: 224444 - DNA, 25 bp, Mus musculus
ataaagcccaacttcagtcagcctt

SEQ ID NO: 224445 - DNA, 25 bp, Mus musculus
ataaagcccaagactctggaacctc

SEQ ID NO: 224446 - DNA, 25 bp, Mus musculus
ataaagcccaagtctctggaacctc

SEQ ID NO: 224447 - DNA, 25 bp, Mus musculus
ataaagcccagcagggtcgttgcca

SEQ ID NO: 224448 - DNA, 25 bp, Mus musculus
ataaagcccagctgggtcgttgcca

SEQ ID NO: 224449 - DNA, 25 bp, Mus musculus
ataaagccccgcacagtgcacgtga

SEQ ID NO: 224450 - DNA, 25 bp, Mus musculus
ataaagccccgctcagtgcacgtga

SEQ ID NO: 224451 - DNA, 25 bp, Mus musculus
ataaagccctagagtggacgcctta

SEQ ID NO: 224452 - DNA, 25 bp, Mus musculus
ataaagccctagtgtggacgcctta

SEQ ID NO: 224453 - DNA, 25 bp, Mus musculus
ataaagccgccgctgaatgtttcgc

SEQ ID NO: 224454 - DNA, 25 bp, Mus musculus
ataaagccgccggtgaatgtttcgc

SEQ ID NO: 224455 - DNA, 25 bp, Mus musculus
ataaagccgtctcggccaagggaat

SEQ ID NO: 224456 - DNA, 25 bp, Mus musculus
ataaagccgtctgggccaagggaat

SEQ ID NO: 224457 - DNA, 25 bp, Mus musculus
ataaagcctatgatagactaccaat

SEQ ID NO: 224458 - DNA, 25 bp, Mus musculus
ataaagcctatgttagactaccaat

SEQ ID NO: 224459 - DNA, 25 bp, Mus musculus
ataaagcctgtacaccacctcaaat

SEQ ID NO: 224460 - DNA, 25 bp, Mus musculus
ataaagcctgtagaccacctcaaat

SEQ ID NO: 224461 - DNA, 25 bp, Mus musculus
ataaagccttggctcttacccaagc

SEQ ID NO: 224462 - DNA, 25 bp, Mus musculus
ataaagccttgggtcttacccaagc

SEQ ID NO: 224463 - DNA, 25 bp, Mus musculus
ataaagcgcacacccaggttcttga

SEQ ID NO: 224464 - DNA, 25 bp, Mus musculus
ataaagcgcacagccaggttcttga

SEQ ID NO: 224465 - DNA, 25 bp, Mus musculus
ataaagcgcctcacttgattggact

SEQ ID NO: 224466 - DNA, 25 bp, Mus musculus
ataaagcgcctctcttgattggact

SEQ ID NO: 224467 - DNA, 25 bp, Mus musculus
ataaagctcaagaattggtgcgact

SEQ ID NO: 224468 - DNA, 25 bp, Mus musculus
ataaagctcaagtattggtgcgact

SEQ ID NO: 224469 - DNA, 25 bp, Mus musculus
ataaagctggctactgcactcgtgt

SEQ ID NO: 224470 - DNA, 25 bp, Mus musculus
ataaagctggcttctgcactcgtgt

SEQ ID NO: 224471 - DNA, 25 bp, Mus musculus
ataaagctgtatatctgtcacattg

SEQ ID NO: 224472 - DNA, 25 bp, Mus musculus
ataaagctgtatttctgtcacattg

SEQ ID NO: 224473 - DNA, 25 bp, Mus musculus
ataaagctgtccattcaattccaaa

SEQ ID NO: 224474 - DNA, 25 bp, Mus musculus
ataaagctgtcctttcaattccaaa

SEQ ID NO: 224475 - DNA, 25 bp, Mus musculus
ataaagctgtggacatacctggcat

SEQ ID NO: 224476 - DNA, 25 bp, Mus musculus
ataaagctgtggtcatacctggcat

SEQ ID NO: 224477 - DNA, 25 bp, Mus musculus
ataaagcttaggaatgctgggcaga

SEQ ID NO: 224478 - DNA, 25 bp, Mus musculus
ataaagcttaggtatgctgggcaga

SEQ ID NO: 224479 - DNA, 25 bp, Mus musculus
ataaagcttttaatctgtccagttt

SEQ ID NO: 224480 - DNA, 25 bp, Mus musculus
ataaagcttttattctgtccagttt

SEQ ID NO: 224481 - DNA, 25 bp, Mus musculus
ataaaggagatcatgtccccaactc

SEQ ID NO: 224482 - DNA, 25 bp, Mus musculus
ataaaggagatcttgtccccaactc

SEQ ID NO: 224483 - DNA, 25 bp, Mus musculus
ataaaggcagacaggtcacgtttta

SEQ ID NO: 224484 - DNA, 25 bp, Mus musculus
ataaaggcagactggtcacgtttta

SEQ ID NO: 224485 - DNA, 25 bp, Mus musculus
ataaaggccaagatccaggagaagt

SEQ ID NO: 224486 - DNA, 25 bp, Mus musculus
ataaaggccaagttccaggagaagt

SEQ ID NO: 224487 - DNA, 25 bp, Mus musculus
ataaaggccccacggagttagtcat

SEQ ID NO: 224488 - DNA, 25 bp, Mus musculus
ataaaggccccagggagttagtcat

SEQ ID NO: 224489 - DNA, 25 bp, Mus musculus
ataaaggcccgtccacattcctctg

SEQ ID NO: 224490 - DNA, 25 bp, Mus musculus
ataaaggcccgtgcacattcctctg

SEQ ID NO: 224491 - DNA, 25 bp, Mus musculus
ataaaggcctcccagtcttgaggtc

SEQ ID NO: 224492 - DNA, 25 bp, Mus musculus
ataaaggcctccgagtcttgaggtc

SEQ ID NO: 224493 - DNA, 25 bp, Mus musculus
ataaaggcgactcggcctggtgcca

SEQ ID NO: 224494 - DNA, 25 bp, Mus musculus
ataaaggcgactgggcctggtgcca

SEQ ID NO: 224495 - DNA, 25 bp, Mus musculus
ataaaggctttaccggctgttgtag

SEQ ID NO: 224496 - DNA, 25 bp, Mus musculus
ataaaggctttagcggctgttgtag

SEQ ID NO: 224497 - DNA, 25 bp, Mus musculus
ataaagggctatctctttcccagga

SEQ ID NO: 224498 - DNA, 25 bp, Mus musculus
ataaagggctatgtctttcccagga

SEQ ID NO: 224499 - DNA, 25 bp, Mus musculus
ataaaggtcacccagagtctttcct

SEQ ID NO: 224500 - DNA, 25 bp, Mus musculus
ataaaggtcaccgagagtctttcct

SEQ ID NO: 224501 - DNA, 25 bp, Mus musculus
ataaaggtccaacccttgacctgag

SEQ ID NO: 224502 - DNA, 25 bp, Mus musculus
ataaaggtccaagccttgacctgag

SEQ ID NO: 224503 - DNA, 25 bp, Mus musculus
ataaaggtccctctatagctaacac

SEQ ID NO: 224504 - DNA, 25 bp, Mus musculus
ataaaggtccctgtatagctaacac

SEQ ID NO: 224505 - DNA, 25 bp, Mus musculus
ataaaggtgccacttgccaacccga

SEQ ID NO: 224506 - DNA, 25 bp, Mus musculus
ataaaggtgccagttgccaacccga

SEQ ID NO: 224507 - DNA, 25 bp, Mus musculus
ataaaggtgccgcataccacccagc

SEQ ID NO: 224508 - DNA, 25 bp, Mus musculus
ataaaggtgccggataccacccagc

SEQ ID NO: 224509 - DNA, 25 bp, Mus musculus
ataaaggttgttctgtttcctgtca

SEQ ID NO: 224510 - DNA, 25 bp, Mus musculus
ataaaggttgttgtgtttcctgtca

SEQ ID NO: 224511 - DNA, 25 bp, Mus musculus
ataaaggtttcgactctatcaggag

SEQ ID NO: 224512 - DNA, 25 bp, Mus musculus
ataaaggtttcgtctctatcaggag

SEQ ID NO: 224513 - DNA, 25 bp, Mus musculus
ataaaggtttggagcttatcagcaa

SEQ ID NO: 224514 - DNA, 25 bp, Mus musculus
ataaaggtttggtgcttatcagcaa

SEQ ID NO: 224515 - DNA, 25 bp, Mus musculus
ataaagtataccacctcagtcaagt

SEQ ID NO: 224516 - DNA, 25 bp, Mus musculus
ataaagtatacctcctcagtcaagt

SEQ ID NO: 224517 - DNA, 25 bp, Mus musculus
ataaagtatctcacaccactgttgc

SEQ ID NO: 224518 - DNA, 25 bp, Mus musculus
ataaagtatctctcaccactgttgc

SEQ ID NO: 224519 - DNA, 25 bp, Mus musculus
ataaagtcatacctgattccgtttc

SEQ ID NO: 224520 - DNA, 25 bp, Mus musculus
ataaagtcatacgtgattccgtttc

SEQ ID NO: 224521 - DNA, 25 bp, Mus musculus
ataaagtcatccagttctccatagt

SEQ ID NO: 224522 - DNA, 25 bp, Mus musculus
ataaagtcatcctgttctccatagt

SEQ ID NO: 224523 - DNA, 25 bp, Mus musculus
ataaagtccagtcctttcttgcctt

SEQ ID NO: 224524 - DNA, 25 bp, Mus musculus
ataaagtccagtgctttcttgcctt

SEQ ID NO: 224525 - DNA, 25 bp, Mus musculus
ataaagtccctaaactttcctctgt

SEQ ID NO: 224526 - DNA, 25 bp, Mus musculus
ataaagtccctatactttcctctgt

SEQ ID NO: 224527 - DNA, 25 bp, Mus musculus
ataaagtccctgaatgccttgcacc

SEQ ID NO: 224528 - DNA, 25 bp, Mus musculus
ataaagtccctgtatgccttgcacc

SEQ ID NO: 224529 - DNA, 25 bp, Mus musculus
ataaagtcgcttagaggagtgctct

SEQ ID NO: 224530 - DNA, 25 bp, Mus musculus
ataaagtcgctttgaggagtgctct

SEQ ID NO: 224531 - DNA, 25 bp, Mus musculus
ataaagtcgttcaggagggagcaaa

SEQ ID NO: 224532 - DNA, 25 bp, Mus musculus
ataaagtcgttctggagggagcaaa

SEQ ID NO: 224533 - DNA, 25 bp, Mus musculus
ataaagtcttcacccaaagcagaac

SEQ ID NO: 224534 - DNA, 25 bp, Mus musculus
ataaagtcttcagccaaagcagaac

SEQ ID NO: 224535 - DNA, 25 bp, Mus musculus
ataaagtcttccactggttcacggg

SEQ ID NO: 224536 - DNA, 25 bp, Mus musculus
ataaagtcttcctctggttcacggg

SEQ ID NO: 224537 - DNA, 25 bp, Mus musculus
ataaagtgccaaaacctgccttgtt

SEQ ID NO: 224538 - DNA, 25 bp, Mus musculus
ataaagtgccaatacctgccttgtt

SEQ ID NO: 224539 - DNA, 25 bp, Mus musculus
ataaagttaactcctccgatgccca

SEQ ID NO: 224540 - DNA, 25 bp, Mus musculus
ataaagttaactgctccgatgccca

SEQ ID NO: 224541 - DNA, 25 bp, Mus musculus
ataaagttcacgcattgctactgcc

SEQ ID NO: 224542 - DNA, 25 bp, Mus musculus
ataaagttcacggattgctactgcc

SEQ ID NO: 224543 - DNA, 25 bp, Mus musculus
ataaagttccttagccggcatgttg

SEQ ID NO: 224544 - DNA, 25 bp, Mus musculus
ataaagttcctttgccggcatgttg

SEQ ID NO: 224545 - DNA, 25 bp, Mus musculus
ataaagtttattctgattgtctgta

SEQ ID NO: 224546 - DNA, 25 bp, Mus musculus
ataaagtttattgtgattgtctgta

SEQ ID NO: 224547 - DNA, 25 bp, Mus musculus
ataaagtttcaactcctgctgtaaa

SEQ ID NO: 224548 - DNA, 25 bp, Mus musculus
ataaagtttcaagtcctgctgtaaa

SEQ ID NO: 224549 - DNA, 25 bp, Mus musculus
ataaataactcccagtcggctcagt

SEQ ID NO: 224550 - DNA, 25 bp, Mus musculus
ataaataactccgagtcggctcagt

SEQ ID NO: 224551 - DNA, 25 bp, Mus musculus
ataaataatagcacttcccctactc

SEQ ID NO: 224552 - DNA, 25 bp, Mus musculus
ataaataatagctcttcccctactc

SEQ ID NO: 224553 - DNA, 25 bp, Mus musculus
ataaataccctaccgattcacaact

SEQ ID NO: 224554 - DNA, 25 bp, Mus musculus
ataaataccctagcgattcacaact

SEQ ID NO: 224555 - DNA, 25 bp, Mus musculus
ataaataccctgatgattactactg

SEQ ID NO: 224556 - DNA, 25 bp, Mus musculus
ataaataccctgttgattactactg

SEQ ID NO: 224557 - DNA, 25 bp, Mus musculus
ataaatacctggactggcagcaccg

SEQ ID NO: 224558 - DNA, 25 bp, Mus musculus
ataaatacctggtctggcagcaccg

SEQ ID NO: 224559 - DNA, 25 bp, Mus musculus
ataaatacctgtagtcttcaaatgc

SEQ ID NO: 224560 - DNA, 25 bp, Mus musculus
ataaatacctgttgtcttcaaatgc

SEQ ID NO: 224561 - DNA, 25 bp, Mus musculus
ataaatactgataggccgactccct

SEQ ID NO: 224562 - DNA, 25 bp, Mus musculus
ataaatactgattggccgactccct

SEQ ID NO: 224563 - DNA, 25 bp, Mus musculus
ataaatagagtgacctctcccagac

SEQ ID NO: 224564 - DNA, 25 bp, Mus musculus
ataaatagagtgtcctctcccagac

SEQ ID NO: 224565 - DNA, 25 bp, Mus musculus
ataaatagatccactgctgcagaac

SEQ ID NO: 224566 - DNA, 25 bp, Mus musculus
ataaatagatcctctgctgcagaac

SEQ ID NO: 224567 - DNA, 25 bp, Mus musculus
ataaatagctagagcctgtatgtgc

SEQ ID NO: 224568 - DNA, 25 bp, Mus musculus
ataaatagctagtgcctgtatgtgc

SEQ ID NO: 224569 - DNA, 25 bp, Mus musculus
ataaatatattcatggcttctgtta

SEQ ID NO: 224570 - DNA, 25 bp, Mus musculus
ataaatatattcttggcttctgtta

SEQ ID NO: 224571 - DNA, 25 bp, Mus musculus
ataaatatccgtctacatcctcatt

SEQ ID NO: 224572 - DNA, 25 bp, Mus musculus
ataaatatccgtgtacatcctcatt

SEQ ID NO: 224573 - DNA, 25 bp, Mus musculus
ataaatatcctaaaatccgtgcatg

SEQ ID NO: 224574 - DNA, 25 bp, Mus musculus
ataaatatcctataatccgtgcatg

SEQ ID NO: 224575 - DNA, 25 bp, Mus musculus
ataaatatgtgccttctgtgccgcg

SEQ ID NO: 224576 - DNA, 25 bp, Mus musculus
ataaatatgtgcgttctgtgccgcg

SEQ ID NO: 224577 - DNA, 25 bp, Mus musculus
ataaatattgccatgctccattcct

SEQ ID NO: 224578 - DNA, 25 bp, Mus musculus
ataaatattgccttgctccattcct

SEQ ID NO: 224579 - DNA, 25 bp, Mus musculus
ataaatcagcaactccaacccttat

SEQ ID NO: 224580 - DNA, 25 bp, Mus musculus
ataaatcagcaagtccaacccttat

SEQ ID NO: 224581 - DNA, 25 bp, Mus musculus
ataaatcatgatccctactgcacca

SEQ ID NO: 224582 - DNA, 25 bp, Mus musculus
ataaatcatgatgcctactgcacca

SEQ ID NO: 224583 - DNA, 25 bp, Mus musculus
ataaatcatgctatagagagcctgt

SEQ ID NO: 224584 - DNA, 25 bp, Mus musculus
ataaatcatgctttagagagcctgt

SEQ ID NO: 224585 - DNA, 25 bp, Mus musculus
ataaatccaagcaccgattgtgaaa

SEQ ID NO: 224586 - DNA, 25 bp, Mus musculus
ataaatccaagctccgattgtgaaa

SEQ ID NO: 224587 - DNA, 25 bp, Mus musculus
ataaatccagtcatccgttcttgta

SEQ ID NO: 224588 - DNA, 25 bp, Mus musculus
ataaatccagtcttccgttcttgta

SEQ ID NO: 224589 - DNA, 25 bp, Mus musculus
ataaatccagtgaatcttcagagtc

SEQ ID NO: 224590 - DNA, 25 bp, Mus musculus
ataaatccagtgtatcttcagagtc

SEQ ID NO: 224591 - DNA, 25 bp, Mus musculus
ataaatccatgcactttgcaacaat

SEQ ID NO: 224592 - DNA, 25 bp, Mus musculus
ataaatccatgctctttgcaacaat

SEQ ID NO: 224593 - DNA, 25 bp, Mus musculus
ataaatccattcactgcatgtgcat

SEQ ID NO: 224594 - DNA, 25 bp, Mus musculus
ataaatccattctctgcatgtgcat

SEQ ID NO: 224595 - DNA, 25 bp, Mus musculus
ataaatccctgtagtggccaagaca

SEQ ID NO: 224596 - DNA, 25 bp, Mus musculus
ataaatccctgttgtggccaagaca

SEQ ID NO: 224597 - DNA, 25 bp, Mus musculus
ataaatcctactcgctacgtgctca

SEQ ID NO: 224598 - DNA, 25 bp, Mus musculus
ataaatcctactggctacgtgctca

SEQ ID NO: 224599 - DNA, 25 bp, Mus musculus
ataaatcctgaaccgaactcaagtg

SEQ ID NO: 224600 - DNA, 25 bp, Mus musculus
ataaatcctgaagcgaactcaagtg

SEQ ID NO: 224601 - DNA, 25 bp, Mus musculus
ataaatcctgctcttatacgtgaca

SEQ ID NO: 224602 - DNA, 25 bp, Mus musculus
ataaatcctgctgttatacgtgaca

SEQ ID NO: 224603 - DNA, 25 bp, Mus musculus
ataaatcgatcaaatttttggcgaa

SEQ ID NO: 224604 - DNA, 25 bp, Mus musculus
ataaatcgatcatatttttggcgaa

SEQ ID NO: 224605 - DNA, 25 bp, Mus musculus
ataaatcgtggtatcttcccacact

SEQ ID NO: 224606 - DNA, 25 bp, Mus musculus
ataaatcgtggtttcttcccacact

SEQ ID NO: 224607 - DNA, 25 bp, Mus musculus
ataaatctaaacaacctctcatggt

SEQ ID NO: 224608 - DNA, 25 bp, Mus musculus
ataaatctaaactacctctcatggt

SEQ ID NO: 224609 - DNA, 25 bp, Mus musculus
ataaatctaaagactgaggccgtaa

SEQ ID NO: 224610 - DNA, 25 bp, Mus musculus
ataaatctaaagtctgaggccgtaa

SEQ ID NO: 224611 - DNA, 25 bp, Mus musculus
ataaatctaacaatcccatggctga

SEQ ID NO: 224612 - DNA, 25 bp, Mus musculus
ataaatctaacattcccatggctga

SEQ ID NO: 224613 - DNA, 25 bp, Mus musculus
ataaatctaattcttgacaacagga

SEQ ID NO: 224614 - DNA, 25 bp, Mus musculus
ataaatctaattgttgacaacagga

SEQ ID NO: 224615 - DNA, 25 bp, Mus musculus
ataaatctactcatctcaattctgg

SEQ ID NO: 224616 - DNA, 25 bp, Mus musculus
ataaatctactcttctcaattctgg

SEQ ID NO: 224617 - DNA, 25 bp, Mus musculus
ataaatctaggccatttcactcctc

SEQ ID NO: 224618 - DNA, 25 bp, Mus musculus
ataaatctaggcgatttcactcctc

SEQ ID NO: 224619 - DNA, 25 bp, Mus musculus
ataaatctcaaacccttcgtcagtc

SEQ ID NO: 224620 - DNA, 25 bp, Mus musculus
ataaatctcaaagccttcgtcagtc

SEQ ID NO: 224621 - DNA, 25 bp, Mus musculus
ataaatctcattcttctacccacct

SEQ ID NO: 224622 - DNA, 25 bp, Mus musculus
ataaatctcattgttctacccacct

SEQ ID NO: 224623 - DNA, 25 bp, Mus musculus
ataaatctctccaacacatctcctg

SEQ ID NO: 224624 - DNA, 25 bp, Mus musculus
ataaatctctcctacacatctcctg

SEQ ID NO: 224625 - DNA, 25 bp, Mus musculus
ataaatctgttcagtctgtctgtca

SEQ ID NO: 224626 - DNA, 25 bp, Mus musculus
ataaatctgttctgtctgtctgtca

SEQ ID NO: 224627 - DNA, 25 bp, Mus musculus
ataaatgaaaagaattgcacctttg

SEQ ID NO: 224628 - DNA, 25 bp, Mus musculus
ataaatgaaaagtattgcacctttg

SEQ ID NO: 224629 - DNA, 25 bp, Mus musculus
ataaatgacgagcttcccagagtgt

SEQ ID NO: 224630 - DNA, 25 bp, Mus musculus
ataaatgacgaggttcccagagtgt

SEQ ID NO: 224631 - DNA, 25 bp, Mus musculus
ataaatgactgaaaggccctggaag

SEQ ID NO: 224632 - DNA, 25 bp, Mus musculus
ataaatgactgataggccctggaag

SEQ ID NO: 224633 - DNA, 25 bp, Mus musculus
ataaatgatactagtccccttactc

SEQ ID NO: 224634 - DNA, 25 bp, Mus musculus
ataaatgatacttgtccccttactc

SEQ ID NO: 224635 - DNA, 25 bp, Mus musculus
ataaatgatgcacgtgctcaccatt

SEQ ID NO: 224636 - DNA, 25 bp, Mus musculus
ataaatgatgcaggtgctcaccatt

SEQ ID NO: 224637 - DNA, 25 bp, Mus musculus
ataaatgatgtcaatttttcatcag

SEQ ID NO: 224638 - DNA, 25 bp, Mus musculus
ataaatgatgtctatttttcatcag

SEQ ID NO: 224639 - DNA, 25 bp, Mus musculus
ataaatgcaatcatctggtctcggg

SEQ ID NO: 224640 - DNA, 25 bp, Mus musculus
ataaatgcaatcttctggtctcggg

SEQ ID NO: 224641 - DNA, 25 bp, Mus musculus
ataaatgcactccacacactatagg

SEQ ID NO: 224642 - DNA, 25 bp, Mus musculus
ataaatgcactcgacacactatagg

SEQ ID NO: 224643 - DNA, 25 bp, Mus musculus
ataaatgcagcccatttctccagat

SEQ ID NO: 224644 - DNA, 25 bp, Mus musculus
ataaatgcagccgatttctccagat

SEQ ID NO: 224645 - DNA, 25 bp, Mus musculus
ataaatgcatcacgctcttttcagg

SEQ ID NO: 224646 - DNA, 25 bp, Mus musculus
ataaatgcatcaggctcttttcagg

SEQ ID NO: 224647 - DNA, 25 bp, Mus musculus
ataaatgcgcacacctggtattagg

SEQ ID NO: 224648 - DNA, 25 bp, Mus musculus
ataaatgcgcactcctggtattagg

SEQ ID NO: 224649 - DNA, 25 bp, Mus musculus
ataaatgctgcccacgcgaagctcg

SEQ ID NO: 224650 - DNA, 25 bp, Mus musculus
ataaatgctgccgacgcgaagctcg

SEQ ID NO: 224651 - DNA, 25 bp, Mus musculus
ataaatgcttcaatcctcgggtccc

SEQ ID NO: 224652 - DNA, 25 bp, Mus musculus
ataaatgcttcattcctcgggtccc

SEQ ID NO: 224653 - DNA, 25 bp, Mus musculus
ataaatgcttgcagctcttagccct

SEQ ID NO: 224654 - DNA, 25 bp, Mus musculus
ataaatgcttgctgctcttagccct

SEQ ID NO: 224655 - DNA, 25 bp, Mus musculus
ataaatggaggccaccgccaagctg

SEQ ID NO: 224656 - DNA, 25 bp, Mus musculus
ataaatggaggcgaccgccaagctg

SEQ ID NO: 224657 - DNA, 25 bp, Mus musculus
ataaatgggacactttgccctctac

SEQ ID NO: 224658 - DNA, 25 bp, Mus musculus
ataaatgggacagtttgccctctac

SEQ ID NO: 224659 - DNA, 25 bp, Mus musculus
ataaatgggcctcggatcatagcac

SEQ ID NO: 224660 - DNA, 25 bp, Mus musculus
ataaatgggcctgggatcatagcac

SEQ ID NO: 224661 - DNA, 25 bp, Mus musculus
ataaatggtccaactagcgcttctg

SEQ ID NO: 224662 - DNA, 25 bp, Mus musculus
ataaatggtccatctagcgcttctg

SEQ ID NO: 224663 - DNA, 25 bp, Mus musculus
ataaatggtgtcagctccccaagtt

SEQ ID NO: 224664 - DNA, 25 bp, Mus musculus
ataaatggtgtctgctccccaagtt

SEQ ID NO: 224665 - DNA, 25 bp, Mus musculus
ataaatgtaaatcctcccttatgct

SEQ ID NO: 224666 - DNA, 25 bp, Mus musculus
ataaatgtaaatgctcccttatgct

SEQ ID NO: 224667 - DNA, 25 bp, Mus musculus
ataaatgtaaggatggtagtggcca

SEQ ID NO: 224668 - DNA, 25 bp, Mus musculus
ataaatgtaaggttggtagtggcca

SEQ ID NO: 224669 - DNA, 25 bp, Mus musculus
ataaatgtattccttcccaccagca

SEQ ID NO: 224670 - DNA, 25 bp, Mus musculus
ataaatgtattcgttcccaccagca

SEQ ID NO: 224671 - DNA, 25 bp, Mus musculus
ataaatgtcaccaagtccagtatta

SEQ ID NO: 224672 - DNA, 25 bp, Mus musculus
ataaatgtcacctagtccagtatta

SEQ ID NO: 224673 - DNA, 25 bp, Mus musculus
ataaatgtcacgctcagctctgttc

SEQ ID NO: 224674 - DNA, 25 bp, Mus musculus
ataaatgtcacggtcagctctgttc

SEQ ID NO: 224675 - DNA, 25 bp, Mus musculus
ataaatgtggccacacttaaccctg

SEQ ID NO: 224676 - DNA, 25 bp, Mus musculus
ataaatgtggcctcacttaaccctg

SEQ ID NO: 224677 - DNA, 25 bp, Mus musculus
ataaatgtgtgaattgttccaaacc

SEQ ID NO: 224678 - DNA, 25 bp, Mus musculus
ataaatgtgtgactgagaagatgca

SEQ ID NO: 224679 - DNA, 25 bp, Mus musculus
ataaatgtgtgagtgagaagatgca

SEQ ID NO: 224680 - DNA, 25 bp, Mus musculus
ataaatgtgtgatttgttccaaacc

SEQ ID NO: 224681 - DNA, 25 bp, Mus musculus
ataaatgttctcaaacggtgctagc

SEQ ID NO: 224682 - DNA, 25 bp, Mus musculus
ataaatgttctctaacggtgctagc

SEQ ID NO: 224683 - DNA, 25 bp, Mus musculus
ataaattaaccaccccaactctcag

SEQ ID NO: 224684 - DNA, 25 bp, Mus musculus
ataaattaaccagcccaactctcag

SEQ ID NO: 224685 - DNA, 25 bp, Mus musculus
ataaattaatgcacacagtgctggg

SEQ ID NO: 224686 - DNA, 25 bp, Mus musculus
ataaattaatgctcacagtgctggg

SEQ ID NO: 224687 - DNA, 25 bp, Mus musculus
ataaattacatgattcgccgaatgc

SEQ ID NO: 224688 - DNA, 25 bp, Mus musculus
ataaattacatgtttcgccgaatgc

SEQ ID NO: 224689 - DNA, 25 bp, Mus musculus
ataaattaggctccaccatgtatat

SEQ ID NO: 224690 - DNA, 25 bp, Mus musculus
ataaattaggctgcaccatgtatat

SEQ ID NO: 224691 - DNA, 25 bp, Mus musculus
ataaattcaggaatggacaccatgt

SEQ ID NO: 224692 - DNA, 25 bp, Mus musculus
ataaattcaggattggacaccatgt

SEQ ID NO: 224693 - DNA, 25 bp, Mus musculus
ataaattcatatatgtctcagatct

SEQ ID NO: 224694 - DNA, 25 bp, Mus musculus
ataaattcatatttgtctcagatct

SEQ ID NO: 224695 - DNA, 25 bp, Mus musculus
ataaattcatgacgcccccacttcg

SEQ ID NO: 224696 - DNA, 25 bp, Mus musculus
ataaattcatgaggcccccacttcg

SEQ ID NO: 224697 - DNA, 25 bp, Mus musculus
ataaattcccctaccctagcagttg

SEQ ID NO: 224698 - DNA, 25 bp, Mus musculus
ataaattccccttccctagcagttg

SEQ ID NO: 224699 - DNA, 25 bp, Mus musculus
ataaattccggaccccatctgagct

SEQ ID NO: 224700 - DNA, 25 bp, Mus musculus
ataaattccggagcccatctgagct

SEQ ID NO: 224701 - DNA, 25 bp, Mus musculus
ataaattccttcatcgaaagctggg

SEQ ID NO: 224702 - DNA, 25 bp, Mus musculus
ataaattccttcttcgaaagctggg

SEQ ID NO: 224703 - DNA, 25 bp, Mus musculus
ataaattctaaaagccttacctggc

SEQ ID NO: 224704 - DNA, 25 bp, Mus musculus
ataaattctaaatgccttacctggc

SEQ ID NO: 224705 - DNA, 25 bp, Mus musculus
ataaattctgagatcctacctgtgg

SEQ ID NO: 224706 - DNA, 25 bp, Mus musculus
ataaattctgagttcctacctgtgg

SEQ ID NO: 224707 - DNA, 25 bp, Mus musculus
ataaattctgatccagtagtgctgg

SEQ ID NO: 224708 - DNA, 25 bp, Mus musculus
ataaattctgatgcagtagtgctgg

SEQ ID NO: 224709 - DNA, 25 bp, Mus musculus
ataaattctgtcacactccagctgg

SEQ ID NO: 224710 - DNA, 25 bp, Mus musculus
ataaattctgtctcactccagctgg

SEQ ID NO: 224711 - DNA, 25 bp, Mus musculus
ataaattgtgtcagtctgcatcgca

SEQ ID NO: 224712 - DNA, 25 bp, Mus musculus
ataaattgtgtctgtctgcatcgca

SEQ ID NO: 224713 - DNA, 25 bp, Mus musculus
ataaatttaactcatggcctcttgc

SEQ ID NO: 224714 - DNA, 25 bp, Mus musculus
ataaatttaactgatggcctcttgc

SEQ ID NO: 224715 - DNA, 25 bp, Mus musculus
ataaatttatttcggcgtgactgtt

SEQ ID NO: 224716 - DNA, 25 bp, Mus musculus
ataaatttatttgggcgtgactgtt

SEQ ID NO: 224717 - DNA, 25 bp, Mus musculus
ataaatttcgcccagcttcagataa

SEQ ID NO: 224718 - DNA, 25 bp, Mus musculus
ataaatttcgccgagcttcagataa

SEQ ID NO: 224719 - DNA, 25 bp, Mus musculus
ataaattttatgaaccccaggcata

SEQ ID NO: 224720 - DNA, 25 bp, Mus musculus
ataaattttatgtaccccaggcata

SEQ ID NO: 224721 - DNA, 25 bp, Mus musculus
ataaattttcatcatatagactgga

SEQ ID NO: 224722 - DNA, 25 bp, Mus musculus
ataaattttcatgatatagactgga

SEQ ID NO: 224723 - DNA, 25 bp, Mus musculus
ataaattttgaaactgcagttgact

SEQ ID NO: 224724 - DNA, 25 bp, Mus musculus
ataaattttgaatctgcagttgact

SEQ ID NO: 224725 - DNA, 25 bp, Mus musculus
ataaatttttgcctatctcctttca

SEQ ID NO: 224726 - DNA, 25 bp, Mus musculus
ataaatttttgcgtatctcctttca

SEQ ID NO: 224727 - DNA, 25 bp, Mus musculus
ataacaaaatttcatacagctacat

SEQ ID NO: 224728 - DNA, 25 bp, Mus musculus
ataacaaaatttgatacagctacat

SEQ ID NO: 224729 - DNA, 25 bp, Mus musculus
ataacaaagagcacagactcgcctc

SEQ ID NO: 224730 - DNA, 25 bp, Mus musculus
ataacaaagagctcagactcgcctc

SEQ ID NO: 224731 - DNA, 25 bp, Mus musculus
ataacaaagtgtactgggatcacag

SEQ ID NO: 224732 - DNA, 25 bp, Mus musculus
ataacaaagtgttctgggatcacag

SEQ ID NO: 224733 - DNA, 25 bp, Mus musculus
ataacaaatggtatgcaggagcaca

SEQ ID NO: 224734 - DNA, 25 bp, Mus musculus
ataacaaatggtttgcaggagcaca

SEQ ID NO: 224735 - DNA, 25 bp, Mus musculus
ataacaacaaaaccgcctttgccct

SEQ ID NO: 224736 - DNA, 25 bp, Mus musculus
ataacaacaaaagcgcctttgccct

SEQ ID NO: 224737 - DNA, 25 bp, Mus musculus
ataacaacaccaaataaccttatct

SEQ ID NO: 224738 - DNA, 25 bp, Mus musculus
ataacaacaccatataaccttatct

SEQ ID NO: 224739 - DNA, 25 bp, Mus musculus
ataacaaccctaattagtgccgtag

SEQ ID NO: 224740 - DNA, 25 bp, Mus musculus
ataacaaccctatttagtgccgtag

SEQ ID NO: 224741 - DNA, 25 bp, Mus musculus
ataacaacgactcgtacagccaccg

SEQ ID NO: 224742 - DNA, 25 bp, Mus musculus
ataacaacgactggtacagccaccg

SEQ ID NO: 224743 - DNA, 25 bp, Mus musculus
ataacaacggatcggagcagcagat

SEQ ID NO: 224744 - DNA, 25 bp, Mus musculus
ataacaacggatgggagcagcagat

SEQ ID NO: 224745 - DNA, 25 bp, Mus musculus
ataacaactaatacgttctgccttg

SEQ ID NO: 224746 - DNA, 25 bp, Mus musculus
ataacaactaattcgttctgccttg

SEQ ID NO: 224747 - DNA, 25 bp, Mus musculus
ataacaagagccagtcctcatcctt

SEQ ID NO: 224748 - DNA, 25 bp, Mus musculus
ataacaagagcctgtcctcatcctt

SEQ ID NO: 224749 - DNA, 25 bp, Mus musculus
ataacaaggcttacatcaccgggca

SEQ ID NO: 224750 - DNA, 25 bp, Mus musculus
ataacaaggctttcatcaccgggca

SEQ ID NO: 224751 - DNA, 25 bp, Mus musculus
ataacaagggccagacgaccccaga

SEQ ID NO: 224752 - DNA, 25 bp, Mus musculus
ataacaagggcctgacgaccccaga

SEQ ID NO: 224753 - DNA, 25 bp, Mus musculus
ataacaagtcctagaccatctgagg

SEQ ID NO: 224754 - DNA, 25 bp, Mus musculus
ataacaagtccttgaccatctgagg

SEQ ID NO: 224755 - DNA, 25 bp, Mus musculus
ataacaagtcttcctgccgggccta

SEQ ID NO: 224756 - DNA, 25 bp, Mus musculus
ataacaagtcttgctgccgggccta

SEQ ID NO: 224757 - DNA, 25 bp, Mus musculus
ataacaataacaccgtcttgggagc

SEQ ID NO: 224758 - DNA, 25 bp, Mus musculus
ataacaataacagcgtcttgggagc

SEQ ID NO: 224759 - DNA, 25 bp, Mus musculus
ataacaatatgcaagacctctggga

SEQ ID NO: 224760 - DNA, 25 bp, Mus musculus
ataacaatatgctagacctctggga

SEQ ID NO: 224761 - DNA, 25 bp, Mus musculus
ataacaatcataatctctcactccc

SEQ ID NO: 224762 - DNA, 25 bp, Mus musculus
ataacaatcatattctctcactccc

SEQ ID NO: 224763 - DNA, 25 bp, Mus musculus
ataacaatctgtattctcccacgtc

SEQ ID NO: 224764 - DNA, 25 bp, Mus musculus
ataacaatctgttttctcccacgtc

SEQ ID NO: 224765 - DNA, 25 bp, Mus musculus
ataacaatgcctaggtagtccctcc

SEQ ID NO: 224766 - DNA, 25 bp, Mus musculus
ataacaatgccttggtagtccctcc

SEQ ID NO: 224767 - DNA, 25 bp, Mus musculus
ataacaatggcaacagtgggatctt

SEQ ID NO: 224768 - DNA, 25 bp, Mus musculus
ataacaatggcatcagtgggatctt

SEQ ID NO: 224769 - DNA, 25 bp, Mus musculus
ataacaatgtccctttgcatatttg

SEQ ID NO: 224770 - DNA, 25 bp, Mus musculus
ataacaatgtccgtttgcatatttg

SEQ ID NO: 224771 - DNA, 25 bp, Mus musculus
ataacaattcctctagtttcccttg

SEQ ID NO: 224772 - DNA, 25 bp, Mus musculus
ataacaattcctgtagtttcccttg

SEQ ID NO: 224773 - DNA, 25 bp, Mus musculus
ataacaattgctctgcccattatgc

SEQ ID NO: 224774 - DNA, 25 bp, Mus musculus
ataacaattgctgtgcccattatgc

SEQ ID NO: 224775 - DNA, 25 bp, Mus musculus
ataacaattggtaaagctcactgtg

SEQ ID NO: 224776 - DNA, 25 bp, Mus musculus
ataacaattggttaagctcactgtg

SEQ ID NO: 224777 - DNA, 25 bp, Mus musculus
ataacacaaccaaggcaaccttgcc

SEQ ID NO: 224778 - DNA, 25 bp, Mus musculus
ataacacaaccatggcaaccttgcc

SEQ ID NO: 224779 - DNA, 25 bp, Mus musculus
ataacacaagtcatcaggtcctctt

SEQ ID NO: 224780 - DNA, 25 bp, Mus musculus
ataacacaagtcttcaggtcctctt

SEQ ID NO: 224781 - DNA, 25 bp, Mus musculus
ataacacaattgctggtggaagctt

SEQ ID NO: 224782 - DNA, 25 bp, Mus musculus
ataacacaattggtggtggaagctt

SEQ ID NO: 224783 - DNA, 25 bp, Mus musculus
ataacacagccccacatcaaagact

SEQ ID NO: 224784 - DNA, 25 bp, Mus musculus
ataacacagcccgacatcaaagact

SEQ ID NO: 224785 - DNA, 25 bp, Mus musculus
ataacacaggcgaccggtttcagat

SEQ ID NO: 224786 - DNA, 25 bp, Mus musculus
ataacacaggcgtccggtttcagat

SEQ ID NO: 224787 - DNA, 25 bp, Mus musculus
ataacacaggtaacttagcccaggc

SEQ ID NO: 224788 - DNA, 25 bp, Mus musculus
ataacacaggtatcttagcccaggc

SEQ ID NO: 224789 - DNA, 25 bp, Mus musculus
ataacacatacacacttaccctatt

SEQ ID NO: 224790 - DNA, 25 bp, Mus musculus
ataacacatacagacttaccctatt

SEQ ID NO: 224791 - DNA, 25 bp, Mus musculus
ataacacattgtctagcccctttcc

SEQ ID NO: 224792 - DNA, 25 bp, Mus musculus
ataacacattgtgtagcccctttcc

SEQ ID NO: 224793 - DNA, 25 bp, Mus musculus
ataacaccaaacatctgttcctctg

SEQ ID NO: 224794 - DNA, 25 bp, Mus musculus
ataacaccaaacttctgttcctctg

SEQ ID NO: 224795 - DNA, 25 bp, Mus musculus
ataacaccagagacgaccctcaagc

SEQ ID NO: 224796 - DNA, 25 bp, Mus musculus
ataacaccagagtcgaccctcaagc

SEQ ID NO: 224797 - DNA, 25 bp, Mus musculus
ataacaccagatatcagttcagaga

SEQ ID NO: 224798 - DNA, 25 bp, Mus musculus
ataacaccagatttcagttcagaga

SEQ ID NO: 224799 - DNA, 25 bp, Mus musculus
ataacaccagcacgaccagtatagt

SEQ ID NO: 224800 - DNA, 25 bp, Mus musculus
ataacaccagcaggaccagtatagt

SEQ ID NO: 224801 - DNA, 25 bp, Mus musculus
ataacaccagctaatttcagtactt

SEQ ID NO: 224802 - DNA, 25 bp, Mus musculus
ataacaccagcttatttcagtactt

SEQ ID NO: 224803 - DNA, 25 bp, Mus musculus
ataacaccagtgcatgcgcagacag

SEQ ID NO: 224804 - DNA, 25 bp, Mus musculus
ataacaccagtggatgcgcagacag

SEQ ID NO: 224805 - DNA, 25 bp, Mus musculus
ataacacccatccagttttgtgagg

SEQ ID NO: 224806 - DNA, 25 bp, Mus musculus
ataacacccatcgagttttgtgagg

SEQ ID NO: 224807 - DNA, 25 bp, Mus musculus
ataacaccgctgctccagtgcagga

SEQ ID NO: 224808 - DNA, 25 bp, Mus musculus
ataacaccgctggtccagtgcagga

SEQ ID NO: 224809 - DNA, 25 bp, Mus musculus
ataacacctaccatgcagggttgtt

SEQ ID NO: 224810 - DNA, 25 bp, Mus musculus
ataacacctaccttgcagggttgtt

SEQ ID NO: 224811 - DNA, 25 bp, Mus musculus
ataacacctgagctactcaaaggct

SEQ ID NO: 224812 - DNA, 25 bp, Mus musculus
ataacacctgaggtactcaaaggct

SEQ ID NO: 224813 - DNA, 25 bp, Mus musculus
ataacacctttgagatccacgacga

SEQ ID NO: 224814 - DNA, 25 bp, Mus musculus
ataacacctttgtgatccacgacga

SEQ ID NO: 224815 - DNA, 25 bp, Mus musculus
ataacacgagctcattatagcccat

SEQ ID NO: 224816 - DNA, 25 bp, Mus musculus
ataacacgagctgattatagcccat

SEQ ID NO: 224817 - DNA, 25 bp, Mus musculus
ataacacgagggatctgcggcttta

SEQ ID NO: 224818 - DNA, 25 bp, Mus musculus
ataacacgagggttctgcggcttta

SEQ ID NO: 224819 - DNA, 25 bp, Mus musculus
ataacactcacgagcctatacttac

SEQ ID NO: 224820 - DNA, 25 bp, Mus musculus
ataacactcacgtgcctatacttac

SEQ ID NO: 224821 - DNA, 25 bp, Mus musculus
ataacactgactatggcaaggacaa

SEQ ID NO: 224822 - DNA, 25 bp, Mus musculus
ataacactgactttggcaaggacaa

SEQ ID NO: 224823 - DNA, 25 bp, Mus musculus
ataacacttctgatccaggatcgtc

SEQ ID NO: 224824 - DNA, 25 bp, Mus musculus
ataacacttctgttccaggatcgtc

SEQ ID NO: 224825 - DNA, 25 bp, Mus musculus
ataacacttgttagtttatggccca

SEQ ID NO: 224826 - DNA, 25 bp, Mus musculus
ataacacttgttatgtgagcaggtg

SEQ ID NO: 224827 - DNA, 25 bp, Mus musculus
ataacacttgtttgtttatggccca

SEQ ID NO: 224828 - DNA, 25 bp, Mus musculus
ataacacttgttttgtgagcaggtg

SEQ ID NO: 224829 - DNA, 25 bp, Mus musculus
ataacagaaatgctgccctggaagt

SEQ ID NO: 224830 - DNA, 25 bp, Mus musculus
ataacagaaatggtgccctggaagt

SEQ ID NO: 224831 - DNA, 25 bp, Mus musculus
ataacagaacccatggttagagaca

SEQ ID NO: 224832 - DNA, 25 bp, Mus musculus
ataacagaacccttggttagagaca

SEQ ID NO: 224833 - DNA, 25 bp, Mus musculus
ataacagaagctatggccctggcca

SEQ ID NO: 224834 - DNA, 25 bp, Mus musculus
ataacagaagctttggccctggcca

SEQ ID NO: 224835 - DNA, 25 bp, Mus musculus
ataacagaagtcacccttccatggt

SEQ ID NO: 224836 - DNA, 25 bp, Mus musculus
ataacagaagtctcccttccatggt

SEQ ID NO: 224837 - DNA, 25 bp, Mus musculus
ataacagaccagattcggctgtggg

SEQ ID NO: 224838 - DNA, 25 bp, Mus musculus
ataacagaccagtttcggctgtggg

SEQ ID NO: 224839 - DNA, 25 bp, Mus musculus
ataacagaccgaaagctcagctcaa

SEQ ID NO: 224840 - DNA, 25 bp, Mus musculus
ataacagaccgatagctcagctcaa

SEQ ID NO: 224841 - DNA, 25 bp, Mus musculus
ataacagaggccagatacgctacag

SEQ ID NO: 224842 - DNA, 25 bp, Mus musculus
ataacagaggcctgatacgctacag

SEQ ID NO: 224843 - DNA, 25 bp, Mus musculus
ataacagattccacccatgagtatc

SEQ ID NO: 224844 - DNA, 25 bp, Mus musculus
ataacagattcctcccatgagtatc

SEQ ID NO: 224845 - DNA, 25 bp, Mus musculus
ataacagcaaagactcagcatgggt

SEQ ID NO: 224846 - DNA, 25 bp, Mus musculus
ataacagcaaagtctcagcatgggt

SEQ ID NO: 224847 - DNA, 25 bp, Mus musculus
ataacagcaacccagagagagcttt

SEQ ID NO: 224848 - DNA, 25 bp, Mus musculus
ataacagcaaccgagagagagcttt

SEQ ID NO: 224849 - DNA, 25 bp, Mus musculus
ataacagcaagcaggcgcctgcgct

SEQ ID NO: 224850 - DNA, 25 bp, Mus musculus
ataacagcaagctggcgcctgcgct

SEQ ID NO: 224851 - DNA, 25 bp, Mus musculus
ataacagcatgtcttaaacccaaag

SEQ ID NO: 224852 - DNA, 25 bp, Mus musculus
ataacagcatgtgttaaacccaaag

SEQ ID NO: 224853 - DNA, 25 bp, Mus musculus
ataacagccctgatgtagtgaccag

SEQ ID NO: 224854 - DNA, 25 bp, Mus musculus
ataacagccctgttgtagtgaccag

SEQ ID NO: 224855 - DNA, 25 bp, Mus musculus
ataacagcccttagtgatccagtac

SEQ ID NO: 224856 - DNA, 25 bp, Mus musculus
ataacagccctttgtgatccagtac

SEQ ID NO: 224857 - DNA, 25 bp, Mus musculus
ataacagccttccatgtgtatccat

SEQ ID NO: 224858 - DNA, 25 bp, Mus musculus
ataacagccttcgatgtgtatccat

SEQ ID NO: 224859 - DNA, 25 bp, Mus musculus
ataacagctataccctgggagggca

SEQ ID NO: 224860 - DNA, 25 bp, Mus musculus
ataacagctatagcctgggagggca

SEQ ID NO: 224861 - DNA, 25 bp, Mus musculus
ataacagctcacagtatcccatctg

SEQ ID NO: 224862 - DNA, 25 bp, Mus musculus
ataacagctcacattgattgcatgt

SEQ ID NO: 224863 - DNA, 25 bp, Mus musculus
ataacagctcactgtatcccatctg

SEQ ID NO: 224864 - DNA, 25 bp, Mus musculus
ataacagctcactttgattgcatgt

SEQ ID NO: 224865 - DNA, 25 bp, Mus musculus
ataacagctttgaccttgccaacgc

SEQ ID NO: 224866 - DNA, 25 bp, Mus musculus
ataacagctttgtccttgccaacgc

SEQ ID NO: 224867 - DNA, 25 bp, Mus musculus
ataacagcttttacttgcatgggaa

SEQ ID NO: 224868 - DNA, 25 bp, Mus musculus
ataacagctttttcttgcatgggaa

SEQ ID NO: 224869 - DNA, 25 bp, Mus musculus
ataacaggatctcaacttagagaag

SEQ ID NO: 224870 - DNA, 25 bp, Mus musculus
ataacaggatctgaacttagagaag

SEQ ID NO: 224871 - DNA, 25 bp, Mus musculus
ataacaggcagaattgaatggcgca

SEQ ID NO: 224872 - DNA, 25 bp, Mus musculus
ataacaggcagatttgaatggcgca

SEQ ID NO: 224873 - DNA, 25 bp, Mus musculus
ataacagggcatacttgtctttttt

SEQ ID NO: 224874 - DNA, 25 bp, Mus musculus
ataacagggcattcttgtctttttt

SEQ ID NO: 224875 - DNA, 25 bp, Mus musculus
ataacagggcttaaactgacatctc

SEQ ID NO: 224876 - DNA, 25 bp, Mus musculus
ataacagggcttcctggcctaacac

SEQ ID NO: 224877 - DNA, 25 bp, Mus musculus
ataacagggcttgctggcctaacac

SEQ ID NO: 224878 - DNA, 25 bp, Mus musculus
ataacagggctttaactgacatctc

SEQ ID NO: 224879 - DNA, 25 bp, Mus musculus
ataacaggtctgagatgcccttaga

SEQ ID NO: 224880 - DNA, 25 bp, Mus musculus
ataacaggtctgtgatgcccttaga

SEQ ID NO: 224881 - DNA, 25 bp, Mus musculus
ataacaggtgctagccaggaatcac

SEQ ID NO: 224882 - DNA, 25 bp, Mus musculus
ataacaggtgcttgccaggaatcac

SEQ ID NO: 224883 - DNA, 25 bp, Mus musculus
ataacagtaaatcagcacaatgctt

SEQ ID NO: 224884 - DNA, 25 bp, Mus musculus
ataacagtaaatgagcacaatgctt

SEQ ID NO: 224885 - DNA, 25 bp, Mus musculus
ataacagtcagcagcgctgtcctcg

SEQ ID NO: 224886 - DNA, 25 bp, Mus musculus
ataacagtcagctgcgctgtcctcg

SEQ ID NO: 224887 - DNA, 25 bp, Mus musculus
ataacagtctttcaccgctccctga

SEQ ID NO: 224888 - DNA, 25 bp, Mus musculus
ataacagtctttgaccgctccctga

SEQ ID NO: 224889 - DNA, 25 bp, Mus musculus
ataacagtggcaaacagattaaggg

SEQ ID NO: 224890 - DNA, 25 bp, Mus musculus
ataacagtggcatacagattaaggg

SEQ ID NO: 224891 - DNA, 25 bp, Mus musculus
ataacagtgtatcccaagtagatca

SEQ ID NO: 224892 - DNA, 25 bp, Mus musculus
ataacagtgtatgccaagtagatca

SEQ ID NO: 224893 - DNA, 25 bp, Mus musculus
ataacagttactagttcctcacctt

SEQ ID NO: 224894 - DNA, 25 bp, Mus musculus
ataacagttacttgttcctcacctt

SEQ ID NO: 224895 - DNA, 25 bp, Mus musculus
ataacagttatcatctggagaggaa

SEQ ID NO: 224896 - DNA, 25 bp, Mus musculus
ataacagttatcttctggagaggaa

SEQ ID NO: 224897 - DNA, 25 bp, Mus musculus
ataacagttgtgatctttgctctcg

SEQ ID NO: 224898 - DNA, 25 bp, Mus musculus
ataacagttgtgttctttgctctcg

SEQ ID NO: 224899 - DNA, 25 bp, Mus musculus
ataacagtttatatgctctcagaca

SEQ ID NO: 224900 - DNA, 25 bp, Mus musculus
ataacagtttatttgctctcagaca

SEQ ID NO: 224901 - DNA, 25 bp, Mus musculus
ataacagtttccaagcagcattctc

SEQ ID NO: 224902 - DNA, 25 bp, Mus musculus
ataacagtttcctagcagcattctc

SEQ ID NO: 224903 - DNA, 25 bp, Mus musculus
ataacagtttgcatcgaccacgcag

SEQ ID NO: 224904 - DNA, 25 bp, Mus musculus
ataacagtttgcttcgaccacgcag

SEQ ID NO: 224905 - DNA, 25 bp, Mus musculus
ataacataaatgcactcagtggctt

SEQ ID NO: 224906 - DNA, 25 bp, Mus musculus
ataacataaatggactcagtggctt

SEQ ID NO: 224907 - DNA, 25 bp, Mus musculus
ataacatacagtcctgccaccagtc

SEQ ID NO: 224908 - DNA, 25 bp, Mus musculus
ataacatacagtgctgccaccagtc

SEQ ID NO: 224909 - DNA, 25 bp, Mus musculus
ataacataggtcacagcctgactag

SEQ ID NO: 224910 - DNA, 25 bp, Mus musculus
ataacataggtctcagcctgactag

SEQ ID NO: 224911 - DNA, 25 bp, Mus musculus
ataacatatctaatggcattctaat

SEQ ID NO: 224912 - DNA, 25 bp, Mus musculus
ataacatatctattggcattctaat

SEQ ID NO: 224913 - DNA, 25 bp, Mus musculus
ataacatcaatccttgcacactcta

SEQ ID NO: 224914 - DNA, 25 bp, Mus musculus
ataacatcaatcgttgcacactcta

SEQ ID NO: 224915 - DNA, 25 bp, Mus musculus
ataacatcacttacagttgaccggg

SEQ ID NO: 224916 - DNA, 25 bp, Mus musculus
ataacatcactttcagttgaccggg

SEQ ID NO: 224917 - DNA, 25 bp, Mus musculus
ataacatccattacggtccaaactt

SEQ ID NO: 224918 - DNA, 25 bp, Mus musculus
ataacatccattcatgtcacatgcg

SEQ ID NO: 224919 - DNA, 25 bp, Mus musculus
ataacatccattgatgtcacatgcg

SEQ ID NO: 224920 - DNA, 25 bp, Mus musculus
ataacatccatttcggtccaaactt

SEQ ID NO: 224921 - DNA, 25 bp, Mus musculus
ataacatccttccacctttgggtgt

SEQ ID NO: 224922 - DNA, 25 bp, Mus musculus
ataacatccttcgacctttgggtgt

SEQ ID NO: 224923 - DNA, 25 bp, Mus musculus
ataacatcgtggatccccagtctcc

SEQ ID NO: 224924 - DNA, 25 bp, Mus musculus
ataacatcgtggttccccagtctcc

SEQ ID NO: 224925 - DNA, 25 bp, Mus musculus
ataacatctctcagctgtctgtgac

SEQ ID NO: 224926 - DNA, 25 bp, Mus musculus
ataacatctctcatttaacccacag

SEQ ID NO: 224927 - DNA, 25 bp, Mus musculus
ataacatctctctgctgtctgtgac

SEQ ID NO: 224928 - DNA, 25 bp, Mus musculus
ataacatctctcttttaacccacag

SEQ ID NO: 224929 - DNA, 25 bp, Mus musculus
ataacatctttaacactagtggcaa

SEQ ID NO: 224930 - DNA, 25 bp, Mus musculus
ataacatctttatcactagtggcaa

SEQ ID NO: 224931 - DNA, 25 bp, Mus musculus
ataacatgaaatactatcccctccc

SEQ ID NO: 224932 - DNA, 25 bp, Mus musculus
ataacatgaaattctatcccctccc

SEQ ID NO: 224933 - DNA, 25 bp, Mus musculus
ataacatgatcccagtctaccgaga

SEQ ID NO: 224934 - DNA, 25 bp, Mus musculus
ataacatgatccgagtctaccgaga

SEQ ID NO: 224935 - DNA, 25 bp, Mus musculus
ataacatgctaacacagctctggtc

SEQ ID NO: 224936 - DNA, 25 bp, Mus musculus
ataacatgctaagacagctctggtc

SEQ ID NO: 224937 - DNA, 25 bp, Mus musculus
ataacatggagtcagctgcggtcat

SEQ ID NO: 224938 - DNA, 25 bp, Mus musculus
ataacatggagtgagctgcggtcat

SEQ ID NO: 224939 - DNA, 25 bp, Mus musculus
ataacatggcaccttctttgttcca

SEQ ID NO: 224940 - DNA, 25 bp, Mus musculus
ataacatggcacgttctttgttcca

SEQ ID NO: 224941 - DNA, 25 bp, Mus musculus
ataacatgtcgcctgattctgcttc

SEQ ID NO: 224942 - DNA, 25 bp, Mus musculus
ataacatgtcgcgtgattctgcttc

SEQ ID NO: 224943 - DNA, 25 bp, Mus musculus
ataacattaagacatcgcccacaag

SEQ ID NO: 224944 - DNA, 25 bp, Mus musculus
ataacattaagagatcgcccacaag

SEQ ID NO: 224945 - DNA, 25 bp, Mus musculus
ataacattatggaagatcactggat

SEQ ID NO: 224946 - DNA, 25 bp, Mus musculus
ataacattatggtagatcactggat

SEQ ID NO: 224947 - DNA, 25 bp, Mus musculus
ataacattcaataggaagccctcga

SEQ ID NO: 224948 - DNA, 25 bp, Mus musculus
ataacattcaattggaagccctcga

SEQ ID NO: 224949 - DNA, 25 bp, Mus musculus
ataacattccaaactgtcagaagca

SEQ ID NO: 224950 - DNA, 25 bp, Mus musculus
ataacattccaatctgtcagaagca

SEQ ID NO: 224951 - DNA, 25 bp, Mus musculus
ataacattccatactctctacaacc

SEQ ID NO: 224952 - DNA, 25 bp, Mus musculus
ataacattccattctctctacaacc

SEQ ID NO: 224953 - DNA, 25 bp, Mus musculus
ataacattctcaccgcacttctaag

SEQ ID NO: 224954 - DNA, 25 bp, Mus musculus
ataacattctcagcgcacttctaag

SEQ ID NO: 224955 - DNA, 25 bp, Mus musculus
ataacattctgaatgtggcccacgc

SEQ ID NO: 224956 - DNA, 25 bp, Mus musculus
ataacattctgattgtggcccacgc

SEQ ID NO: 224957 - DNA, 25 bp, Mus musculus
ataacattctgcattgcacacgctt

SEQ ID NO: 224958 - DNA, 25 bp, Mus musculus
ataacattctgctttgcacacgctt

SEQ ID NO: 224959 - DNA, 25 bp, Mus musculus
ataacattggttctccacctgcaag

SEQ ID NO: 224960 - DNA, 25 bp, Mus musculus
ataacattggttgtccacctgcaag

SEQ ID NO: 224961 - DNA, 25 bp, Mus musculus
ataacatttcacattcaacaccatt

SEQ ID NO: 224962 - DNA, 25 bp, Mus musculus
ataacatttcactttcaacaccatt

SEQ ID NO: 224963 - DNA, 25 bp, Mus musculus
ataacatttgggatcctaatcttaa

SEQ ID NO: 224964 - DNA, 25 bp, Mus musculus
ataacatttgggttcctaatcttaa

SEQ ID NO: 224965 - DNA, 25 bp, Mus musculus
ataacattttatctgcagctaagca

SEQ ID NO: 224966 - DNA, 25 bp, Mus musculus
ataacattttatgtgcagctaagca

SEQ ID NO: 224967 - DNA, 25 bp, Mus musculus
ataacatttttcattctctctggaa

SEQ ID NO: 224968 - DNA, 25 bp, Mus musculus
ataacatttttctttctctctggaa

SEQ ID NO: 224969 - DNA, 25 bp, Mus musculus
ataaccaacaagatgctgctctccg

SEQ ID NO: 224970 - DNA, 25 bp, Mus musculus
ataaccaacaagttgctgctctccg

SEQ ID NO: 224971 - DNA, 25 bp, Mus musculus
ataaccaaccagatcttaccagcac

SEQ ID NO: 224972 - DNA, 25 bp, Mus musculus
ataaccaaccagttcttaccagcac

SEQ ID NO: 224973 - DNA, 25 bp, Mus musculus
ataaccaagttcagtcattcaaagg

SEQ ID NO: 224974 - DNA, 25 bp, Mus musculus
ataaccaagttctgtcattcaaagg

SEQ ID NO: 224975 - DNA, 25 bp, Mus musculus
ataaccaatggtactgatctatcca

SEQ ID NO: 224976 - DNA, 25 bp, Mus musculus
ataaccaatggttctgatctatcca

SEQ ID NO: 224977 - DNA, 25 bp, Mus musculus
ataaccaatgtcagcttagccgtct

SEQ ID NO: 224978 - DNA, 25 bp, Mus musculus
ataaccaatgtctgcttagccgtct

SEQ ID NO: 224979 - DNA, 25 bp, Mus musculus
ataaccacaaccaccaccgaagagg

SEQ ID NO: 224980 - DNA, 25 bp, Mus musculus
ataaccacaacctccaccgaagagg

SEQ ID NO: 224981 - DNA, 25 bp, Mus musculus
ataaccacaccccatctgagtgcta

SEQ ID NO: 224982 - DNA, 25 bp, Mus musculus
ataaccacacccgatctgagtgcta

SEQ ID NO: 224983 - DNA, 25 bp, Mus musculus
ataaccacagaaaatgcttaccttt

SEQ ID NO: 224984 - DNA, 25 bp, Mus musculus
ataaccacagaatatgcttaccttt

SEQ ID NO: 224985 - DNA, 25 bp, Mus musculus
ataaccacagaccatgagcaagcca

SEQ ID NO: 224986 - DNA, 25 bp, Mus musculus
ataaccacagacgatgagcaagcca

SEQ ID NO: 224987 - DNA, 25 bp, Mus musculus
ataaccacagttagcttgcacatgt

SEQ ID NO: 224988 - DNA, 25 bp, Mus musculus
ataaccacagtttgcttgcacatgt

SEQ ID NO: 224989 - DNA, 25 bp, Mus musculus
ataaccacgcatctgctgatcattg

SEQ ID NO: 224990 - DNA, 25 bp, Mus musculus
ataaccacgcatgtgctgatcattg

SEQ ID NO: 224991 - DNA, 25 bp, Mus musculus
ataaccactccacaaccatgaatag

SEQ ID NO: 224992 - DNA, 25 bp, Mus musculus
ataaccactccagaaccatgaatag

SEQ ID NO: 224993 - DNA, 25 bp, Mus musculus
ataaccactctcatccctcttattt

SEQ ID NO: 224994 - DNA, 25 bp, Mus musculus
ataaccactctcttccctcttattt

SEQ ID NO: 224995 - DNA, 25 bp, Mus musculus
ataaccactttacactaggcctcat

SEQ ID NO: 224996 - DNA, 25 bp, Mus musculus
ataaccactttagactaggcctcat

SEQ ID NO: 224997 - DNA, 25 bp, Mus musculus
ataaccagcacacgacttgatgaca

SEQ ID NO: 224998 - DNA, 25 bp, Mus musculus
ataaccagcacaggacttgatgaca

SEQ ID NO: 224999 - DNA, 25 bp, Mus musculus
ataaccagcagcagattggctcctg

SEQ ID NO: 225000 - DNA, 25 bp, Mus musculus
ataaccagcagctgattggctcctg

SEQ ID NO: 225001 - DNA, 25 bp, Mus musculus
ataaccaggtttacagcagtcagtg

SEQ ID NO: 225002 - DNA, 25 bp, Mus musculus
ataaccaggttttcagcagtcagtg

SEQ ID NO: 225003 - DNA, 25 bp, Mus musculus
ataaccagtcttactacagcaatag

SEQ ID NO: 225004 - DNA, 25 bp, Mus musculus
ataaccagtctttctacagcaatag

SEQ ID NO: 225005 - DNA, 25 bp, Mus musculus
ataaccagtggtccctttgagcctg

SEQ ID NO: 225006 - DNA, 25 bp, Mus musculus
ataaccagtggtgcctttgagcctg

SEQ ID NO: 225007 - DNA, 25 bp, Mus musculus
ataaccagtgtgattgattgcaagt

SEQ ID NO: 225008 - DNA, 25 bp, Mus musculus
ataaccagtgtgtttgattgcaagt

SEQ ID NO: 225009 - DNA, 25 bp, Mus musculus
ataaccatatacatctgatcccacc

SEQ ID NO: 225010 - DNA, 25 bp, Mus musculus
ataaccatatacttctgatcccacc

SEQ ID NO: 225011 - DNA, 25 bp, Mus musculus
ataaccatcaggatacctcgattag

SEQ ID NO: 225012 - DNA, 25 bp, Mus musculus
ataaccatcaggttacctcgattag

SEQ ID NO: 225013 - DNA, 25 bp, Mus musculus
ataaccatcgacacaggaagggagg

SEQ ID NO: 225014 - DNA, 25 bp, Mus musculus
ataaccatcgactcaggaagggagg

SEQ ID NO: 225015 - DNA, 25 bp, Mus musculus
ataaccatctaaaagccttgcggct

SEQ ID NO: 225016 - DNA, 25 bp, Mus musculus
ataaccatctaatagccttgcggct

SEQ ID NO: 225017 - DNA, 25 bp, Mus musculus
ataaccatctctatactccagtttc

SEQ ID NO: 225018 - DNA, 25 bp, Mus musculus
ataaccatctctttactccagtttc

SEQ ID NO: 225019 - DNA, 25 bp, Mus musculus
ataaccatcttaaacattccagtct

SEQ ID NO: 225020 - DNA, 25 bp, Mus musculus
ataaccatcttatacattccagtct

SEQ ID NO: 225021 - DNA, 25 bp, Mus musculus
ataaccatgccgagcttatgaaggc

SEQ ID NO: 225022 - DNA, 25 bp, Mus musculus
ataaccatgccgtgcttatgaaggc

SEQ ID NO: 225023 - DNA, 25 bp, Mus musculus
ataaccatggttagttgtacgtaag

SEQ ID NO: 225024 - DNA, 25 bp, Mus musculus
ataaccatggtttgttgtacgtaag

SEQ ID NO: 225025 - DNA, 25 bp, Mus musculus
ataaccatgtgcatgcctatttcca

SEQ ID NO: 225026 - DNA, 25 bp, Mus musculus
ataaccatgtgcttgcctatttcca

SEQ ID NO: 225027 - DNA, 25 bp, Mus musculus
ataaccattaggactgggctccatc

SEQ ID NO: 225028 - DNA, 25 bp, Mus musculus
ataaccattaggtctgggctccatc

SEQ ID NO: 225029 - DNA, 25 bp, Mus musculus
ataaccattccaactttacatgtgt

SEQ ID NO: 225030 - DNA, 25 bp, Mus musculus
ataaccattccatctttacatgtgt

SEQ ID NO: 225031 - DNA, 25 bp, Mus musculus
ataaccattgttaacagagctgagc

SEQ ID NO: 225032 - DNA, 25 bp, Mus musculus
ataaccattgtttacagagctgagc

SEQ ID NO: 225033 - DNA, 25 bp, Mus musculus
ataaccatttatacactcaactcct

SEQ ID NO: 225034 - DNA, 25 bp, Mus musculus
ataaccatttattcactcaactcct

SEQ ID NO: 225035 - DNA, 25 bp, Mus musculus
ataaccattttcatcagatcagggc

SEQ ID NO: 225036 - DNA, 25 bp, Mus musculus
ataaccattttcttcagatcagggc

SEQ ID NO: 225037 - DNA, 25 bp, Mus musculus
ataacccaaaacacctggccagact

SEQ ID NO: 225038 - DNA, 25 bp, Mus musculus
ataacccaaaactcctggccagact

SEQ ID NO: 225039 - DNA, 25 bp, Mus musculus
ataacccaaaggctacttactgaag

SEQ ID NO: 225040 - DNA, 25 bp, Mus musculus
ataacccaaagggtacttactgaag

SEQ ID NO: 225041 - DNA, 25 bp, Mus musculus
ataacccaaagtccacatactgcac

SEQ ID NO: 225042 - DNA, 25 bp, Mus musculus
ataacccaaagtgcacatactgcac

SEQ ID NO: 225043 - DNA, 25 bp, Mus musculus
ataacccaacatagcacagtgtgtt

SEQ ID NO: 225044 - DNA, 25 bp, Mus musculus
ataacccaacattgcacagtgtgtt

SEQ ID NO: 225045 - DNA, 25 bp, Mus musculus
ataacccaacctctcacagtaggaa

SEQ ID NO: 225046 - DNA, 25 bp, Mus musculus
ataacccaacctgtcacagtaggaa

SEQ ID NO: 225047 - DNA, 25 bp, Mus musculus
ataacccaactgatagtcactggac

SEQ ID NO: 225048 - DNA, 25 bp, Mus musculus
ataacccaactgttagtcactggac

SEQ ID NO: 225049 - DNA, 25 bp, Mus musculus
ataacccaagctaggttcttcctgc

SEQ ID NO: 225050 - DNA, 25 bp, Mus musculus
ataacccaagcttggttcttcctgc

SEQ ID NO: 225051 - DNA, 25 bp, Mus musculus
ataacccaatggactcatgcctgga

SEQ ID NO: 225052 - DNA, 25 bp, Mus musculus
ataacccaatggtctcatgcctgga

SEQ ID NO: 225053 - DNA, 25 bp, Mus musculus
ataacccagggcagtagatctcctt

SEQ ID NO: 225054 - DNA, 25 bp, Mus musculus
ataacccagggctgtagatctcctt

SEQ ID NO: 225055 - DNA, 25 bp, Mus musculus
ataaccccaactcctgtgtcaacat

SEQ ID NO: 225056 - DNA, 25 bp, Mus musculus
ataaccccaactgctgtgtcaacat

SEQ ID NO: 225057 - DNA, 25 bp, Mus musculus
ataaccccagatatttgagtggctg

SEQ ID NO: 225058 - DNA, 25 bp, Mus musculus
ataaccccagatttttgagtggctg

SEQ ID NO: 225059 - DNA, 25 bp, Mus musculus
ataaccccagggaccgcgtatcaga

SEQ ID NO: 225060 - DNA, 25 bp, Mus musculus
ataaccccagggtccgcgtatcaga

SEQ ID NO: 225061 - DNA, 25 bp, Mus musculus
ataaccccagtgctcacgaggcaga

SEQ ID NO: 225062 - DNA, 25 bp, Mus musculus
ataaccccagtggtcacgaggcaga

SEQ ID NO: 225063 - DNA, 25 bp, Mus musculus
ataaccccgggtctggaccagtgct

SEQ ID NO: 225064 - DNA, 25 bp, Mus musculus
ataaccccgggtgtggaccagtgct

SEQ ID NO: 225065 - DNA, 25 bp, Mus musculus
ataacccctgatattccactatgaa

SEQ ID NO: 225066 - DNA, 25 bp, Mus musculus
ataacccctgattttccactatgaa

SEQ ID NO: 225067 - DNA, 25 bp, Mus musculus
ataacccgagctccactgagaaact

SEQ ID NO: 225068 - DNA, 25 bp, Mus musculus
ataacccgagctgcactgagaaact

SEQ ID NO: 225069 - DNA, 25 bp, Mus musculus
ataacccgttctctggaagacactg

SEQ ID NO: 225070 - DNA, 25 bp, Mus musculus
ataacccgttctgtggaagacactg

SEQ ID NO: 225071 - DNA, 25 bp, Mus musculus
ataaccctaactctagtgcaacctg

SEQ ID NO: 225072 - DNA, 25 bp, Mus musculus
ataaccctaactgtagtgcaacctg

SEQ ID NO: 225073 - DNA, 25 bp, Mus musculus
ataaccctagggatcatcactgctg

SEQ ID NO: 225074 - DNA, 25 bp, Mus musculus
ataaccctagggttcatcactgctg

SEQ ID NO: 225075 - DNA, 25 bp, Mus musculus
ataaccctagtacagctatgctgta

SEQ ID NO: 225076 - DNA, 25 bp, Mus musculus
ataaccctagtagagctatgctgta

SEQ ID NO: 225077 - DNA, 25 bp, Mus musculus
ataaccctcagcacttcgtgattga

SEQ ID NO: 225078 - DNA, 25 bp, Mus musculus
ataaccctcagctcttcgtgattga

SEQ ID NO: 225079 - DNA, 25 bp, Mus musculus
ataaccctcgttcgataagtcaaat

SEQ ID NO: 225080 - DNA, 25 bp, Mus musculus
ataaccctcgttggataagtcaaat

SEQ ID NO: 225081 - DNA, 25 bp, Mus musculus
ataaccctctatcaggctatgggat

SEQ ID NO: 225082 - DNA, 25 bp, Mus musculus
ataaccctctatgaggctatgggat

SEQ ID NO: 225083 - DNA, 25 bp, Mus musculus
ataaccctgctgaagtgaccgagtc

SEQ ID NO: 225084 - DNA, 25 bp, Mus musculus
ataaccctgctgagagcgctaacag

SEQ ID NO: 225085 - DNA, 25 bp, Mus musculus
ataaccctgctgtagtgaccgagtc

SEQ ID NO: 225086 - DNA, 25 bp, Mus musculus
ataaccctgctgtgagcgctaacag

SEQ ID NO: 225087 - DNA, 25 bp, Mus musculus
ataacccttctcaagggcagccatg

SEQ ID NO: 225088 - DNA, 25 bp, Mus musculus
ataacccttctctagggcagccatg

SEQ ID NO: 225089 - DNA, 25 bp, Mus musculus
ataacccttgccacaatgctatctc

SEQ ID NO: 225090 - DNA, 25 bp, Mus musculus
ataacccttgcctcaatgctatctc

SEQ ID NO: 225091 - DNA, 25 bp, Mus musculus
ataacccttgttcaatactctgtgg

SEQ ID NO: 225092 - DNA, 25 bp, Mus musculus
ataacccttgttgaatactctgtgg

SEQ ID NO: 225093 - DNA, 25 bp, Mus musculus
ataacccttttgaattcctagatgg

SEQ ID NO: 225094 - DNA, 25 bp, Mus musculus
ataacccttttgtattcctagatgg

SEQ ID NO: 225095 - DNA, 25 bp, Mus musculus
ataaccgagctaacacggctaactc

SEQ ID NO: 225096 - DNA, 25 bp, Mus musculus
ataaccgagctatcacggctaactc

SEQ ID NO: 225097 - DNA, 25 bp, Mus musculus
ataaccgagcttacacggctaattt

SEQ ID NO: 225098 - DNA, 25 bp, Mus musculus
ataaccgagctttcacggctaattt

SEQ ID NO: 225099 - DNA, 25 bp, Mus musculus
ataaccgatactctgacaactcaag

SEQ ID NO: 225100 - DNA, 25 bp, Mus musculus
ataaccgatactgtgacaactcaag

SEQ ID NO: 225101 - DNA, 25 bp, Mus musculus
ataaccgatgttatttgggtgtcca

SEQ ID NO: 225102 - DNA, 25 bp, Mus musculus
ataaccgatgttttttgggtgtcca

SEQ ID NO: 225103 - DNA, 25 bp, Mus musculus
ataaccgcgcccatggtgaagcttg

SEQ ID NO: 225104 - DNA, 25 bp, Mus musculus
ataaccgcgcccttggtgaagcttg

SEQ ID NO: 225105 - DNA, 25 bp, Mus musculus
ataaccgctggtacaacgggcaggc

SEQ ID NO: 225106 - DNA, 25 bp, Mus musculus
ataaccgctggttcaacgggcaggc

SEQ ID NO: 225107 - DNA, 25 bp, Mus musculus
ataaccggaagtccagcctggtgct

SEQ ID NO: 225108 - DNA, 25 bp, Mus musculus
ataaccggaagtgcagcctggtgct

SEQ ID NO: 225109 - DNA, 25 bp, Mus musculus
ataaccgtacaaacctatggcccat

SEQ ID NO: 225110 - DNA, 25 bp, Mus musculus
ataaccgtacaatcctatggcccat

SEQ ID NO: 225111 - DNA, 25 bp, Mus musculus
ataaccgtcctgctgtaactctaga

SEQ ID NO: 225112 - DNA, 25 bp, Mus musculus
ataaccgtcctggtgtaactctaga

SEQ ID NO: 225113 - DNA, 25 bp, Mus musculus
ataaccgtgttgaataggctcagag

SEQ ID NO: 225114 - DNA, 25 bp, Mus musculus
ataaccgtgttgtataggctcagag

SEQ ID NO: 225115 - DNA, 25 bp, Mus musculus
ataacctaagccctggtcaccagag

SEQ ID NO: 225116 - DNA, 25 bp, Mus musculus
ataacctaagccgtggtcaccagag

SEQ ID NO: 225117 - DNA, 25 bp, Mus musculus
ataacctactacatacttgatactc

SEQ ID NO: 225118 - DNA, 25 bp, Mus musculus
ataacctactacttacttgatactc

SEQ ID NO: 225119 - DNA, 25 bp, Mus musculus
ataacctactttcgcgtctgtttga

SEQ ID NO: 225120 - DNA, 25 bp, Mus musculus
ataacctactttggcgtctgtttga

SEQ ID NO: 225121 - DNA, 25 bp, Mus musculus
ataacctatatcaggctgcaaatgt

SEQ ID NO: 225122 - DNA, 25 bp, Mus musculus
ataacctatatctggctgcaaatgt

SEQ ID NO: 225123 - DNA, 25 bp, Mus musculus
ataacctcacatctatttttcatag

SEQ ID NO: 225124 - DNA, 25 bp, Mus musculus
ataacctcacatgtatttttcatag

SEQ ID NO: 225125 - DNA, 25 bp, Mus musculus
ataacctcagaaccagtgacagctc

SEQ ID NO: 225126 - DNA, 25 bp, Mus musculus
ataacctcagaagcagtgacagctc

SEQ ID NO: 225127 - DNA, 25 bp, Mus musculus
ataacctcaggcaacagatttgtgg

SEQ ID NO: 225128 - DNA, 25 bp, Mus musculus
ataacctcaggctacagatttgtgg

SEQ ID NO: 225129 - DNA, 25 bp, Mus musculus
ataacctcatcccataattccagtt

SEQ ID NO: 225130 - DNA, 25 bp, Mus musculus
ataacctcatccgataattccagtt

SEQ ID NO: 225131 - DNA, 25 bp, Mus musculus
ataacctcatgtacagacatccctg

SEQ ID NO: 225132 - DNA, 25 bp, Mus musculus
ataacctcatgttcagacatccctg

SEQ ID NO: 225133 - DNA, 25 bp, Mus musculus
ataacctccactcacaaggagccat

SEQ ID NO: 225134 - DNA, 25 bp, Mus musculus
ataacctccactgacaaggagccat

SEQ ID NO: 225135 - DNA, 25 bp, Mus musculus
ataacctccagtatgttgccatcag

SEQ ID NO: 225136 - DNA, 25 bp, Mus musculus
ataacctccagtttgttgccatcag

SEQ ID NO: 225137 - DNA, 25 bp, Mus musculus
ataacctcttctacatgctgcacca

SEQ ID NO: 225138 - DNA, 25 bp, Mus musculus
ataacctcttcttcatgctgcacca

SEQ ID NO: 225139 - DNA, 25 bp, Mus musculus
ataacctgagatataagttgtgcag

SEQ ID NO: 225140 - DNA, 25 bp, Mus musculus
ataacctgagatttaagttgtgcag

SEQ ID NO: 225141 - DNA, 25 bp, Mus musculus
ataacctgctttctccttcagagtt

SEQ ID NO: 225142 - DNA, 25 bp, Mus musculus
ataacctgctttgtccttcagagtt

SEQ ID NO: 225143 - DNA, 25 bp, Mus musculus
ataacctgggcccttgtgaacatag

SEQ ID NO: 225144 - DNA, 25 bp, Mus musculus
ataacctgggccgttgtgaacatag

SEQ ID NO: 225145 - DNA, 25 bp, Mus musculus
ataacctgggtgcttctggaagctt

SEQ ID NO: 225146 - DNA, 25 bp, Mus musculus
ataacctgggtggttctggaagctt

SEQ ID NO: 225147 - DNA, 25 bp, Mus musculus
ataacctggtaaaagactgggctga

SEQ ID NO: 225148 - DNA, 25 bp, Mus musculus
ataacctggtaatagactgggctga

SEQ ID NO: 225149 - DNA, 25 bp, Mus musculus
ataacctgtcccacctgaataaata

SEQ ID NO: 225150 - DNA, 25 bp, Mus musculus
ataacctgtccctcctgaataaata

SEQ ID NO: 225151 - DNA, 25 bp, Mus musculus
ataaccttacgcaccgtgacctatt

SEQ ID NO: 225152 - DNA, 25 bp, Mus musculus
ataaccttacgctccgtgacctatt

SEQ ID NO: 225153 - DNA, 25 bp, Mus musculus
ataaccttcagacctccaggaggat

SEQ ID NO: 225154 - DNA, 25 bp, Mus musculus
ataaccttcagagctccaggaggat

SEQ ID NO: 225155 - DNA, 25 bp, Mus musculus
ataaccttcattatggtggtctaag

SEQ ID NO: 225156 - DNA, 25 bp, Mus musculus
ataaccttcattttggtggtctaag

SEQ ID NO: 225157 - DNA, 25 bp, Mus musculus
ataaccttcctcatgggcaccatgg

SEQ ID NO: 225158 - DNA, 25 bp, Mus musculus
ataaccttcctcttgggcaccatgg

SEQ ID NO: 225159 - DNA, 25 bp, Mus musculus
ataaccttctggcaagggctttgtt

SEQ ID NO: 225160 - DNA, 25 bp, Mus musculus
ataaccttctgggaagggctttgtt

SEQ ID NO: 225161 - DNA, 25 bp, Mus musculus
ataaccttgagtccttccaaagagt

SEQ ID NO: 225162 - DNA, 25 bp, Mus musculus
ataaccttgagtcgtgtgaccttga

SEQ ID NO: 225163 - DNA, 25 bp, Mus musculus
ataaccttgagtgcttccaaagagt

SEQ ID NO: 225164 - DNA, 25 bp, Mus musculus
ataaccttgagtggtgtgaccttga

SEQ ID NO: 225165 - DNA, 25 bp, Mus musculus
ataaccttgtacatgtctagaattt

SEQ ID NO: 225166 - DNA, 25 bp, Mus musculus
ataaccttgtacattgaatacgttg

SEQ ID NO: 225167 - DNA, 25 bp, Mus musculus
ataaccttgtacttgtctagaattt

SEQ ID NO: 225168 - DNA, 25 bp, Mus musculus
ataaccttgtactttgaatacgttg

SEQ ID NO: 225169 - DNA, 25 bp, Mus musculus
ataaccttgtctcgatgcggtgcct

SEQ ID NO: 225170 - DNA, 25 bp, Mus musculus
ataaccttgtctctcatggctactc

SEQ ID NO: 225171 - DNA, 25 bp, Mus musculus
ataaccttgtctggatgcggtgcct

SEQ ID NO: 225172 - DNA, 25 bp, Mus musculus
ataaccttgtctgtcatggctactc

SEQ ID NO: 225173 - DNA, 25 bp, Mus musculus
ataacctttatcaccactctgaaga

SEQ ID NO: 225174 - DNA, 25 bp, Mus musculus
ataacctttatctccactctgaaga

SEQ ID NO: 225175 - DNA, 25 bp, Mus musculus
ataacgactaatcactcctcgtggg

SEQ ID NO: 225176 - DNA, 25 bp, Mus musculus
ataacgactaatgactcctcgtggg

SEQ ID NO: 225177 - DNA, 25 bp, Mus musculus
ataacgagatagcttgacaataatt

SEQ ID NO: 225178 - DNA, 25 bp, Mus musculus
ataacgagataggttgacaataatt

SEQ ID NO: 225179 - DNA, 25 bp, Mus musculus
ataacgagtgggactacaccaaagc

SEQ ID NO: 225180 - DNA, 25 bp, Mus musculus
ataacgagtgggtctacaccaaagc

SEQ ID NO: 225181 - DNA, 25 bp, Mus musculus
ataacgagtgtcctgtgggagcctc

SEQ ID NO: 225182 - DNA, 25 bp, Mus musculus
ataacgagtgtcgtgtgggagcctc

SEQ ID NO: 225183 - DNA, 25 bp, Mus musculus
ataacgatggctctggttgccacaa

SEQ ID NO: 225184 - DNA, 25 bp, Mus musculus
ataacgatggctgtggttgccacaa

SEQ ID NO: 225185 - DNA, 25 bp, Mus musculus
ataacgccttttcagctatgtaact

SEQ ID NO: 225186 - DNA, 25 bp, Mus musculus
ataacgccttttgagctatgtaact

SEQ ID NO: 225187 - DNA, 25 bp, Mus musculus
ataacgcgacaaaaactccggctgc

SEQ ID NO: 225188 - DNA, 25 bp, Mus musculus
ataacgcgacaataactccggctgc

SEQ ID NO: 225189 - DNA, 25 bp, Mus musculus
ataacgctacatattcccaactgtc

SEQ ID NO: 225190 - DNA, 25 bp, Mus musculus
ataacgctacattttcccaactgtc

SEQ ID NO: 225191 - DNA, 25 bp, Mus musculus
ataacgctcccgcagtgctgatgag

SEQ ID NO: 225192 - DNA, 25 bp, Mus musculus
ataacgctcccggagtgctgatgag

SEQ ID NO: 225193 - DNA, 25 bp, Mus musculus
ataacgcttcttaccgctgggatga

SEQ ID NO: 225194 - DNA, 25 bp, Mus musculus
ataacgcttctttccgctgggatga

SEQ ID NO: 225195 - DNA, 25 bp, Mus musculus
ataacggactctcatccttctggaa

SEQ ID NO: 225196 - DNA, 25 bp, Mus musculus
ataacggactctgatccttctggaa

SEQ ID NO: 225197 - DNA, 25 bp, Mus musculus
ataacggagcgtctgcgaagtttca

SEQ ID NO: 225198 - DNA, 25 bp, Mus musculus
ataacggagcgtgtgcgaagtttca

SEQ ID NO: 225199 - DNA, 25 bp, Mus musculus
ataacggcggcgattctcttgcctg

SEQ ID NO: 225200 - DNA, 25 bp, Mus musculus
ataacggcggcgtttctcttgcctg

SEQ ID NO: 225201 - DNA, 25 bp, Mus musculus
ataacggcttccaccgtgtcaggtt

SEQ ID NO: 225202 - DNA, 25 bp, Mus musculus
ataacggcttcctccgtgtcaggtt

SEQ ID NO: 225203 - DNA, 25 bp, Mus musculus
ataacgggactcaatcttcaactca

SEQ ID NO: 225204 - DNA, 25 bp, Mus musculus
ataacgggactctatcttcaactca

SEQ ID NO: 225205 - DNA, 25 bp, Mus musculus
ataacggtagtccttccagtcagag

SEQ ID NO: 225206 - DNA, 25 bp, Mus musculus
ataacggtagtcgttccagtcagag

SEQ ID NO: 225207 - DNA, 25 bp, Mus musculus
ataacggtgagtatggcatgtttac

SEQ ID NO: 225208 - DNA, 25 bp, Mus musculus
ataacggtgagtttggcatgtttac

SEQ ID NO: 225209 - DNA, 25 bp, Mus musculus
ataacgtacatgacacctgctaaga

SEQ ID NO: 225210 - DNA, 25 bp, Mus musculus
ataacgtacatgtcacctgctaaga

SEQ ID NO: 225211 - DNA, 25 bp, Mus musculus
ataacgtacgccagacctcaatgtt

SEQ ID NO: 225212 - DNA, 25 bp, Mus musculus
ataacgtacgcctgacctcaatgtt

SEQ ID NO: 225213 - DNA, 25 bp, Mus musculus
ataacgtcagtaatgagcgcatcaa

SEQ ID NO: 225214 - DNA, 25 bp, Mus musculus
ataacgtcagtattgagcgcatcaa

SEQ ID NO: 225215 - DNA, 25 bp, Mus musculus
ataacgtgccagagttgcatcttcc

SEQ ID NO: 225216 - DNA, 25 bp, Mus musculus
ataacgtgccagtgttgcatcttcc

SEQ ID NO: 225217 - DNA, 25 bp, Mus musculus
ataacgtggtgaagcccacaggcct

SEQ ID NO: 225218 - DNA, 25 bp, Mus musculus
ataacgtggtgatgcccacaggcct

SEQ ID NO: 225219 - DNA, 25 bp, Mus musculus
ataacgtgtaatagcttgttttggg

SEQ ID NO: 225220 - DNA, 25 bp, Mus musculus
ataacgtgtaattgcttgttttggg

SEQ ID NO: 225221 - DNA, 25 bp, Mus musculus
ataacgtgtacaccttttatgtccc

SEQ ID NO: 225222 - DNA, 25 bp, Mus musculus
ataacgtgtacagcttttatgtccc

SEQ ID NO: 225223 - DNA, 25 bp, Mus musculus
ataacgtgttgcctgtaagccaaaa

SEQ ID NO: 225224 - DNA, 25 bp, Mus musculus
ataacgtgttgcgtgtaagccaaaa

SEQ ID NO: 225225 - DNA, 25 bp, Mus musculus
ataacgttatcaacactgcttggca

SEQ ID NO: 225226 - DNA, 25 bp, Mus musculus
ataacgttatcatcactgcttggca

SEQ ID NO: 225227 - DNA, 25 bp, Mus musculus
ataacgttccatatgcttatgtagc

SEQ ID NO: 225228 - DNA, 25 bp, Mus musculus
ataacgttccatttgcttatgtagc

SEQ ID NO: 225229 - DNA, 25 bp, Mus musculus
ataacgttctcactctctcatgaag

SEQ ID NO: 225230 - DNA, 25 bp, Mus musculus
ataacgttctcagtctctcatgaag

SEQ ID NO: 225231 - DNA, 25 bp, Mus musculus
ataactaacagtcgcctgggctttc

SEQ ID NO: 225232 - DNA, 25 bp, Mus musculus
ataactaacagtggcctgggctttc

SEQ ID NO: 225233 - DNA, 25 bp, Mus musculus
ataactaaccccaccaaattgctgt

SEQ ID NO: 225234 - DNA, 25 bp, Mus musculus
ataactaacccctccaaattgctgt

SEQ ID NO: 225235 - DNA, 25 bp, Mus musculus
ataactaagatcagtcacctcccag

SEQ ID NO: 225236 - DNA, 25 bp, Mus musculus
ataactaagatctgtcacctcccag

SEQ ID NO: 225237 - DNA, 25 bp, Mus musculus
ataactaagcacacaagataaacct

SEQ ID NO: 225238 - DNA, 25 bp, Mus musculus
ataactaagcactcaagataaacct

SEQ ID NO: 225239 - DNA, 25 bp, Mus musculus
ataactaatctcaaactaacataat

SEQ ID NO: 225240 - DNA, 25 bp, Mus musculus
ataactaatctctaactaacataat

SEQ ID NO: 225241 - DNA, 25 bp, Mus musculus
ataactacctacaacatgctctcaa

SEQ ID NO: 225242 - DNA, 25 bp, Mus musculus
ataactacctactacatgctctcaa

SEQ ID NO: 225243 - DNA, 25 bp, Mus musculus
ataactacctgtattgccgggtcag

SEQ ID NO: 225244 - DNA, 25 bp, Mus musculus
ataactacctgttttgccgggtcag

SEQ ID NO: 225245 - DNA, 25 bp, Mus musculus
ataactacgggactttactgcgact

SEQ ID NO: 225246 - DNA, 25 bp, Mus musculus
ataactacgggagtttactgcgact

SEQ ID NO: 225247 - DNA, 25 bp, Mus musculus
ataactactctcaatgctgtaccca

SEQ ID NO: 225248 - DNA, 25 bp, Mus musculus
ataactactctctatgctgtaccca

SEQ ID NO: 225249 - DNA, 25 bp, Mus musculus
ataactacttccatttcatcctttg

SEQ ID NO: 225250 - DNA, 25 bp, Mus musculus
ataactacttccttttcatcctttg

SEQ ID NO: 225251 - DNA, 25 bp, Mus musculus
ataactagctggcagtggacttacc

SEQ ID NO: 225252 - DNA, 25 bp, Mus musculus
ataactagctgggagtggacttacc

SEQ ID NO: 225253 - DNA, 25 bp, Mus musculus
ataactaggtggatcttgatgctca

SEQ ID NO: 225254 - DNA, 25 bp, Mus musculus
ataactaggtggttcttgatgctca

SEQ ID NO: 225255 - DNA, 25 bp, Mus musculus
ataactagtgtccagtccagtgcct

SEQ ID NO: 225256 - DNA, 25 bp, Mus musculus
ataactagtgtcgagtccagtgcct

SEQ ID NO: 225257 - DNA, 25 bp, Mus musculus
ataactagttcaagtcaggagcagg

SEQ ID NO: 225258 - DNA, 25 bp, Mus musculus
ataactagttcatgtcaggagcagg

SEQ ID NO: 225259 - DNA, 25 bp, Mus musculus
ataactatcaatcacgtatgctaac

SEQ ID NO: 225260 - DNA, 25 bp, Mus musculus
ataactatcaatgacgtatgctaac

SEQ ID NO: 225261 - DNA, 25 bp, Mus musculus
ataactatcaggcagaagaatcttt

SEQ ID NO: 225262 - DNA, 25 bp, Mus musculus
ataactatcagggagaagaatcttt

SEQ ID NO: 225263 - DNA, 25 bp, Mus musculus
ataactatcagtccaagtgaactgt

SEQ ID NO: 225264 - DNA, 25 bp, Mus musculus
ataactatcagtgcaagtgaactgt

SEQ ID NO: 225265 - DNA, 25 bp, Mus musculus
ataactatggccagtctcaaataca

SEQ ID NO: 225266 - DNA, 25 bp, Mus musculus
ataactatggcctgtctcaaataca

SEQ ID NO: 225267 - DNA, 25 bp, Mus musculus
ataactattatccttttttgctcct

SEQ ID NO: 225268 - DNA, 25 bp, Mus musculus
ataactattatcgttttttgctcct

SEQ ID NO: 225269 - DNA, 25 bp, Mus musculus
ataactattcaaactttccttacag

SEQ ID NO: 225270 - DNA, 25 bp, Mus musculus
ataactattcaatctttccttacag

SEQ ID NO: 225271 - DNA, 25 bp, Mus musculus
ataactattgctctgtgtctgtcct

SEQ ID NO: 225272 - DNA, 25 bp, Mus musculus
ataactattgctgtgtgtctgtcct

SEQ ID NO: 225273 - DNA, 25 bp, Mus musculus
ataactatttatcgcagggcagtgg

SEQ ID NO: 225274 - DNA, 25 bp, Mus musculus
ataactatttatggcagggcagtgg

SEQ ID NO: 225275 - DNA, 25 bp, Mus musculus
ataactcaaaaactcctctgaccca

SEQ ID NO: 225276 - DNA, 25 bp, Mus musculus
ataactcaaaaagtcctctgaccca

SEQ ID NO: 225277 - DNA, 25 bp, Mus musculus
ataactcaatctagcgggtgccagg

SEQ ID NO: 225278 - DNA, 25 bp, Mus musculus
ataactcaatcttgcgggtgccagg

SEQ ID NO: 225279 - DNA, 25 bp, Mus musculus
ataactcacacactgaaataaaagt

SEQ ID NO: 225280 - DNA, 25 bp, Mus musculus
ataactcacacagtgaaataaaagt

SEQ ID NO: 225281 - DNA, 25 bp, Mus musculus
ataactcaccttaatgaactgctcg

SEQ ID NO: 225282 - DNA, 25 bp, Mus musculus
ataactcacctttatgaactgctcg

SEQ ID NO: 225283 - DNA, 25 bp, Mus musculus
ataactcacggaatcagtgttcaag

SEQ ID NO: 225284 - DNA, 25 bp, Mus musculus
ataactcacggattcagtgttcaag

SEQ ID NO: 225285 - DNA, 25 bp, Mus musculus
ataactcagcctctgaaacctgttc

SEQ ID NO: 225286 - DNA, 25 bp, Mus musculus
ataactcagcctgtgaaacctgttc

SEQ ID NO: 225287 - DNA, 25 bp, Mus musculus
ataactcagggaaagagccgtcatt

SEQ ID NO: 225288 - DNA, 25 bp, Mus musculus
ataactcagggatagagccgtcatt

SEQ ID NO: 225289 - DNA, 25 bp, Mus musculus
ataactcatacacttcaggactgac

SEQ ID NO: 225290 - DNA, 25 bp, Mus musculus
ataactcatacagttcaggactgac

SEQ ID NO: 225291 - DNA, 25 bp, Mus musculus
ataactcatcagcacctgcttgctg

SEQ ID NO: 225292 - DNA, 25 bp, Mus musculus
ataactcatcaggacctgcttgctg

SEQ ID NO: 225293 - DNA, 25 bp, Mus musculus
ataactcatcttcccatttcttgaa

SEQ ID NO: 225294 - DNA, 25 bp, Mus musculus
ataactcatcttgccatttcttgaa

SEQ ID NO: 225295 - DNA, 25 bp, Mus musculus
ataactcattttatacagccagcta

SEQ ID NO: 225296 - DNA, 25 bp, Mus musculus
ataactcattttttacagccagcta

SEQ ID NO: 225297 - DNA, 25 bp, Mus musculus
ataactccaactattgtagggtcat

SEQ ID NO: 225298 - DNA, 25 bp, Mus musculus
ataactccaacttttgtagggtcat

SEQ ID NO: 225299 - DNA, 25 bp, Mus musculus
ataactccactaatgacttaagcaa

SEQ ID NO: 225300 - DNA, 25 bp, Mus musculus
ataactccactattgacttaagcaa

SEQ ID NO: 225301 - DNA, 25 bp, Mus musculus
ataactccatagagaaggctcctgt

SEQ ID NO: 225302 - DNA, 25 bp, Mus musculus
ataactccatagtgaaggctcctgt

SEQ ID NO: 225303 - DNA, 25 bp, Mus musculus
ataactcccaagattcactgaactg

SEQ ID NO: 225304 - DNA, 25 bp, Mus musculus
ataactcccaagtttcactgaactg

SEQ ID NO: 225305 - DNA, 25 bp, Mus musculus
ataactcccaccctgaagatctgac

SEQ ID NO: 225306 - DNA, 25 bp, Mus musculus
ataactcccaccgtgaagatctgac

SEQ ID NO: 225307 - DNA, 25 bp, Mus musculus
ataactccctggaaattactgagca

SEQ ID NO: 225308 - DNA, 25 bp, Mus musculus
ataactccctggtaattactgagca

SEQ ID NO: 225309 - DNA, 25 bp, Mus musculus
ataactccctgtacagtgctttgga

SEQ ID NO: 225310 - DNA, 25 bp, Mus musculus
ataactccctgttcagtgctttgga

SEQ ID NO: 225311 - DNA, 25 bp, Mus musculus
ataactccgaaacctgcgaggcgtt

SEQ ID NO: 225312 - DNA, 25 bp, Mus musculus
ataactccgaaagctgcgaggcgtt

SEQ ID NO: 225313 - DNA, 25 bp, Mus musculus
ataactcctggaagcatcacctttt

SEQ ID NO: 225314 - DNA, 25 bp, Mus musculus
ataactcctggatgcatcacctttt

SEQ ID NO: 225315 - DNA, 25 bp, Mus musculus
ataactcctgttcccacaacaacat

SEQ ID NO: 225316 - DNA, 25 bp, Mus musculus
ataactcctgttgccacaacaacat

SEQ ID NO: 225317 - DNA, 25 bp, Mus musculus
ataactcggcatctgacctgaagca

SEQ ID NO: 225318 - DNA, 25 bp, Mus musculus
ataactcggcatgtgacctgaagca

SEQ ID NO: 225319 - DNA, 25 bp, Mus musculus
ataactcggtgtatgcttacctagt

SEQ ID NO: 225320 - DNA, 25 bp, Mus musculus
ataactcggtgtttgcttacctagt

SEQ ID NO: 225321 - DNA, 25 bp, Mus musculus
ataactctagtcacgggatcctctg

SEQ ID NO: 225322 - DNA, 25 bp, Mus musculus
ataactctagtctcgggatcctctg

SEQ ID NO: 225323 - DNA, 25 bp, Mus musculus
ataactctatacatctcctgtttct

SEQ ID NO: 225324 - DNA, 25 bp, Mus musculus
ataactctatacttctcctgtttct

SEQ ID NO: 225325 - DNA, 25 bp, Mus musculus
ataactctcagacgctcttgaggga

SEQ ID NO: 225326 - DNA, 25 bp, Mus musculus
ataactctcagaggctcttgaggga

SEQ ID NO: 225327 - DNA, 25 bp, Mus musculus
ataactctccagctgtgactccagt

SEQ ID NO: 225328 - DNA, 25 bp, Mus musculus
ataactctccaggtgtgactccagt

SEQ ID NO: 225329 - DNA, 25 bp, Mus musculus
ataactctcctcagctttcaagaat

SEQ ID NO: 225330 - DNA, 25 bp, Mus musculus
ataactctcctctgctttcaagaat

SEQ ID NO: 225331 - DNA, 25 bp, Mus musculus
ataactctctgcagggccataggta

SEQ ID NO: 225332 - DNA, 25 bp, Mus musculus
ataactctctgctgggccataggta

SEQ ID NO: 225333 - DNA, 25 bp, Mus musculus
ataactctctggacgtggcatacat

SEQ ID NO: 225334 - DNA, 25 bp, Mus musculus
ataactctctggtcgtggcatacat

SEQ ID NO: 225335 - DNA, 25 bp, Mus musculus
ataactctgaagacccatgatagta

SEQ ID NO: 225336 - DNA, 25 bp, Mus musculus
ataactctgaagacgtggacacgga

SEQ ID NO: 225337 - DNA, 25 bp, Mus musculus
ataactctgaagtcccatgatagta

SEQ ID NO: 225338 - DNA, 25 bp, Mus musculus
ataactctgaagtcgtggacacgga

SEQ ID NO: 225339 - DNA, 25 bp, Mus musculus
ataactctgtcaatagcgacgctag

SEQ ID NO: 225340 - DNA, 25 bp, Mus musculus
ataactctgtcattagcgacgctag

SEQ ID NO: 225341 - DNA, 25 bp, Mus musculus
ataactctgtggaaatgcaggcgca

SEQ ID NO: 225342 - DNA, 25 bp, Mus musculus
ataactctgtggtaatgcaggcgca

SEQ ID NO: 225343 - DNA, 25 bp, Mus musculus
ataactcttccaagcattgtttatg

SEQ ID NO: 225344 - DNA, 25 bp, Mus musculus
ataactcttccatgcattgtttatg

SEQ ID NO: 225345 - DNA, 25 bp, Mus musculus
ataactgaatctccacatctgaggt

SEQ ID NO: 225346 - DNA, 25 bp, Mus musculus
ataactgaatctgcacatctgaggt

SEQ ID NO: 225347 - DNA, 25 bp, Mus musculus
ataactgaccagatggtctggtttg

SEQ ID NO: 225348 - DNA, 25 bp, Mus musculus
ataactgaccagttggtctggtttg

SEQ ID NO: 225349 - DNA, 25 bp, Mus musculus
ataactgacctgagtgtcttctaga

SEQ ID NO: 225350 - DNA, 25 bp, Mus musculus
ataactgacctgtgtgtcttctaga

SEQ ID NO: 225351 - DNA, 25 bp, Mus musculus
ataactgagaagaccctggcagctg

SEQ ID NO: 225352 - DNA, 25 bp, Mus musculus
ataactgagaagtccctggcagctg

SEQ ID NO: 225353 - DNA, 25 bp, Mus musculus
ataactgagctgcattaaaactggt

SEQ ID NO: 225354 - DNA, 25 bp, Mus musculus
ataactgagctggattaaaactggt

SEQ ID NO: 225355 - DNA, 25 bp, Mus musculus
ataactgatagaccaaatcctggaa

SEQ ID NO: 225356 - DNA, 25 bp, Mus musculus
ataactgatagagcaaatcctggaa

SEQ ID NO: 225357 - DNA, 25 bp, Mus musculus
ataactgatgttacttggcgcttgg

SEQ ID NO: 225358 - DNA, 25 bp, Mus musculus
ataactgatgtttcttggcgcttgg

SEQ ID NO: 225359 - DNA, 25 bp, Mus musculus
ataactgatttcacaccttctcttt

SEQ ID NO: 225360 - DNA, 25 bp, Mus musculus
ataactgatttctcaccttctcttt

SEQ ID NO: 225361 - DNA, 25 bp, Mus musculus
ataactgcacgaatcaagctactga

SEQ ID NO: 225362 - DNA, 25 bp, Mus musculus
ataactgcacgattcaagctactga

SEQ ID NO: 225363 - DNA, 25 bp, Mus musculus
ataactgcatgtagctccagcttgt

SEQ ID NO: 225364 - DNA, 25 bp, Mus musculus
ataactgcatgttgctccagcttgt

SEQ ID NO: 225365 - DNA, 25 bp, Mus musculus
ataactgcattcagtgtaatggtaa

SEQ ID NO: 225366 - DNA, 25 bp, Mus musculus
ataactgcattctgtgtaatggtaa

SEQ ID NO: 225367 - DNA, 25 bp, Mus musculus
ataactgccagcagaggctagaccc

SEQ ID NO: 225368 - DNA, 25 bp, Mus musculus
ataactgccagctgaggctagaccc

SEQ ID NO: 225369 - DNA, 25 bp, Mus musculus
ataactgccatcaggaaggcttcac

SEQ ID NO: 225370 - DNA, 25 bp, Mus musculus
ataactgccatctggaaggcttcac

SEQ ID NO: 225371 - DNA, 25 bp, Mus musculus
ataactgccccgaagtgctctgaag

SEQ ID NO: 225372 - DNA, 25 bp, Mus musculus
ataactgccccgtagtgctctgaag

SEQ ID NO: 225373 - DNA, 25 bp, Mus musculus
ataactgctcgtccagaaaccacag

SEQ ID NO: 225374 - DNA, 25 bp, Mus musculus
ataactgctcgtgcagaaaccacag

SEQ ID NO: 225375 - DNA, 25 bp, Mus musculus
ataactgctcttaccctagaactgt

SEQ ID NO: 225376 - DNA, 25 bp, Mus musculus
ataactgctctttccctagaactgt

SEQ ID NO: 225377 - DNA, 25 bp, Mus musculus
ataactgctgctacctagctatagg

SEQ ID NO: 225378 - DNA, 25 bp, Mus musculus
ataactgctgcttcctagctatagg

SEQ ID NO: 225379 - DNA, 25 bp, Mus musculus
ataactgctgttaacttaccctctc

SEQ ID NO: 225380 - DNA, 25 bp, Mus musculus
ataactgctgtttacttaccctctc

SEQ ID NO: 225381 - DNA, 25 bp, Mus musculus
ataactgcttatacccatcttgtct

SEQ ID NO: 225382 - DNA, 25 bp, Mus musculus
ataactgcttattcccatcttgtct

SEQ ID NO: 225383 - DNA, 25 bp, Mus musculus
ataactgctttcagctcccaaattt

SEQ ID NO: 225384 - DNA, 25 bp, Mus musculus
ataactgctttcatcaggtcctcag

SEQ ID NO: 225385 - DNA, 25 bp, Mus musculus
ataactgctttctgctcccaaattt

SEQ ID NO: 225386 - DNA, 25 bp, Mus musculus
ataactgctttcttcaggtcctcag

SEQ ID NO: 225387 - DNA, 25 bp, Mus musculus
ataactggaccaccctgggacttga

SEQ ID NO: 225388 - DNA, 25 bp, Mus musculus
ataactggaccagcctgggacttga

SEQ ID NO: 225389 - DNA, 25 bp, Mus musculus
ataactggagatcgcctgtctgtct

SEQ ID NO: 225390 - DNA, 25 bp, Mus musculus
ataactggagatggcctgtctgtct

SEQ ID NO: 225391 - DNA, 25 bp, Mus musculus
ataactggagccctaggttgtcact

SEQ ID NO: 225392 - DNA, 25 bp, Mus musculus
ataactggagccgtaggttgtcact

SEQ ID NO: 225393 - DNA, 25 bp, Mus musculus
ataactggatcgactgttccactaa

SEQ ID NO: 225394 - DNA, 25 bp, Mus musculus
ataactggatcgtctgttccactaa

SEQ ID NO: 225395 - DNA, 25 bp, Mus musculus
ataactggccagactccgcgaagaa

SEQ ID NO: 225396 - DNA, 25 bp, Mus musculus
ataactggccagtctccgcgaagaa

SEQ ID NO: 225397 - DNA, 25 bp, Mus musculus
ataactggcttgaatgatatttctt

SEQ ID NO: 225398 - DNA, 25 bp, Mus musculus
ataactggcttgtatgatatttctt

SEQ ID NO: 225399 - DNA, 25 bp, Mus musculus
ataactgggactccatctttgctgg

SEQ ID NO: 225400 - DNA, 25 bp, Mus musculus
ataactgggactgcatctttgctgg

SEQ ID NO: 225401 - DNA, 25 bp, Mus musculus
ataactggtcatctccacataggca

SEQ ID NO: 225402 - DNA, 25 bp, Mus musculus
ataactggtcatgtccacataggca

SEQ ID NO: 225403 - DNA, 25 bp, Mus musculus
ataactggtgggagcatttctaaca

SEQ ID NO: 225404 - DNA, 25 bp, Mus musculus
ataactggtgggtgcatttctaaca

SEQ ID NO: 225405 - DNA, 25 bp, Mus musculus
ataactggtgttctagctgatcaca

SEQ ID NO: 225406 - DNA, 25 bp, Mus musculus
ataactggtgttgtagctgatcaca

SEQ ID NO: 225407 - DNA, 25 bp, Mus musculus
ataactgtaagaaagcaggcacaca

SEQ ID NO: 225408 - DNA, 25 bp, Mus musculus
ataactgtaagatagcaggcacaca

SEQ ID NO: 225409 - DNA, 25 bp, Mus musculus
ataactgtagccaggcagcggtcca

SEQ ID NO: 225410 - DNA, 25 bp, Mus musculus
ataactgtagcctggcagcggtcca

SEQ ID NO: 225411 - DNA, 25 bp, Mus musculus
ataactgtcaacacccctttgagct

SEQ ID NO: 225412 - DNA, 25 bp, Mus musculus
ataactgtcaactcccctttgagct

SEQ ID NO: 225413 - DNA, 25 bp, Mus musculus
ataactgtccatccgcgggtagggc

SEQ ID NO: 225414 - DNA, 25 bp, Mus musculus
ataactgtccatgcgcgggtagggc

SEQ ID NO: 225415 - DNA, 25 bp, Mus musculus
ataactgtctccctcttgtaataca

SEQ ID NO: 225416 - DNA, 25 bp, Mus musculus
ataactgtctccgtcttgtaataca

SEQ ID NO: 225417 - DNA, 25 bp, Mus musculus
ataactgtctttccaccttcttgtt

SEQ ID NO: 225418 - DNA, 25 bp, Mus musculus
ataactgtctttgcaccttcttgtt

SEQ ID NO: 225419 - DNA, 25 bp, Mus musculus
ataactgtgaccatgtcacctatgg

SEQ ID NO: 225420 - DNA, 25 bp, Mus musculus
ataactgtgaccttgtcacctatgg

SEQ ID NO: 225421 - DNA, 25 bp, Mus musculus
ataactgtgggtcaagggctccgta

SEQ ID NO: 225422 - DNA, 25 bp, Mus musculus
ataactgtgggtgaagggctccgta

SEQ ID NO: 225423 - DNA, 25 bp, Mus musculus
ataactgttacaagcaactgtacat

SEQ ID NO: 225424 - DNA, 25 bp, Mus musculus
ataactgttacatgcaactgtacat

SEQ ID NO: 225425 - DNA, 25 bp, Mus musculus
ataactgttatgaagttcggatagc

SEQ ID NO: 225426 - DNA, 25 bp, Mus musculus
ataactgttatgtagttcggatagc

SEQ ID NO: 225427 - DNA, 25 bp, Mus musculus
ataactgttcaaattgcaattttta

SEQ ID NO: 225428 - DNA, 25 bp, Mus musculus
ataactgttcaatttgcaattttta

SEQ ID NO: 225429 - DNA, 25 bp, Mus musculus
ataactgttccgaccaccttgtgct

SEQ ID NO: 225430 - DNA, 25 bp, Mus musculus
ataactgttccgtccaccttgtgct

SEQ ID NO: 225431 - DNA, 25 bp, Mus musculus
ataactgttcctaagcttgttcaat

SEQ ID NO: 225432 - DNA, 25 bp, Mus musculus
ataactgttccttagcttgttcaat

SEQ ID NO: 225433 - DNA, 25 bp, Mus musculus
ataactgttctgagtcttagcttag

SEQ ID NO: 225434 - DNA, 25 bp, Mus musculus
ataactgttctgtgtcttagcttag

SEQ ID NO: 225435 - DNA, 25 bp, Mus musculus
ataacttacgatacattcttcccca

SEQ ID NO: 225436 - DNA, 25 bp, Mus musculus
ataacttacgattcattcttcccca

SEQ ID NO: 225437 - DNA, 25 bp, Mus musculus
ataacttagtgtaccttttgcttca

SEQ ID NO: 225438 - DNA, 25 bp, Mus musculus
ataacttagtgttccttttgcttca

SEQ ID NO: 225439 - DNA, 25 bp, Mus musculus
ataacttatttgcacacctttcttg

SEQ ID NO: 225440 - DNA, 25 bp, Mus musculus
ataacttatttgcttcgagaacttt

SEQ ID NO: 225441 - DNA, 25 bp, Mus musculus
ataacttatttggacacctttcttg

SEQ ID NO: 225442 - DNA, 25 bp, Mus musculus
ataacttatttggttcgagaacttt

SEQ ID NO: 225443 - DNA, 25 bp, Mus musculus
ataacttattttccctgaatcctgg

SEQ ID NO: 225444 - DNA, 25 bp, Mus musculus
ataacttattttgcctgaatcctgg

SEQ ID NO: 225445 - DNA, 25 bp, Mus musculus
ataacttcaaggcaggcactatggt

SEQ ID NO: 225446 - DNA, 25 bp, Mus musculus
ataacttcaagggaggcactatggt

SEQ ID NO: 225447 - DNA, 25 bp, Mus musculus
ataacttcacatagctggttttgct

SEQ ID NO: 225448 - DNA, 25 bp, Mus musculus
ataacttcacattgctggttttgct

SEQ ID NO: 225449 - DNA, 25 bp, Mus musculus
ataacttcagcaagacttcagacat

SEQ ID NO: 225450 - DNA, 25 bp, Mus musculus
ataacttcagcatgacttcagacat

SEQ ID NO: 225451 - DNA, 25 bp, Mus musculus
ataacttcagtccaagattgcccaa

SEQ ID NO: 225452 - DNA, 25 bp, Mus musculus
ataacttcagtcgaagattgcccaa

SEQ ID NO: 225453 - DNA, 25 bp, Mus musculus
ataacttcagtgatttccattgaaa

SEQ ID NO: 225454 - DNA, 25 bp, Mus musculus
ataacttcagtgttttccattgaaa

SEQ ID NO: 225455 - DNA, 25 bp, Mus musculus
ataacttcatttcctgccagctgag

SEQ ID NO: 225456 - DNA, 25 bp, Mus musculus
ataacttcatttgctgccagctgag

SEQ ID NO: 225457 - DNA, 25 bp, Mus musculus
ataacttccagaaggcgttgctcaa

SEQ ID NO: 225458 - DNA, 25 bp, Mus musculus
ataacttccagatggcgttgctcaa

SEQ ID NO: 225459 - DNA, 25 bp, Mus musculus
ataacttcccaacctttccttgatg

SEQ ID NO: 225460 - DNA, 25 bp, Mus musculus
ataacttcccaagctttccttgatg

SEQ ID NO: 225461 - DNA, 25 bp, Mus musculus
ataacttcctgtattcatgtcctgg

SEQ ID NO: 225462 - DNA, 25 bp, Mus musculus
ataacttcctgttttcatgtcctgg

SEQ ID NO: 225463 - DNA, 25 bp, Mus musculus
ataacttcgttaatttgtgctgcag

SEQ ID NO: 225464 - DNA, 25 bp, Mus musculus
ataacttcgttattttgtgctgcag

SEQ ID NO: 225465 - DNA, 25 bp, Mus musculus
ataacttctagacattgctgggcat

SEQ ID NO: 225466 - DNA, 25 bp, Mus musculus
ataacttctagagattgctgggcat

SEQ ID NO: 225467 - DNA, 25 bp, Mus musculus
ataacttctagcaagcttagagaga

SEQ ID NO: 225468 - DNA, 25 bp, Mus musculus
ataacttctagctagcttagagaga

SEQ ID NO: 225469 - DNA, 25 bp, Mus musculus
ataacttcttgtctttccctccata

SEQ ID NO: 225470 - DNA, 25 bp, Mus musculus
ataacttcttgtgtttccctccata

SEQ ID NO: 225471 - DNA, 25 bp, Mus musculus
ataacttgacttccgttgatctttt

SEQ ID NO: 225472 - DNA, 25 bp, Mus musculus
ataacttgacttgcgttgatctttt

SEQ ID NO: 225473 - DNA, 25 bp, Mus musculus
ataacttggcggctcaatgggctat

SEQ ID NO: 225474 - DNA, 25 bp, Mus musculus
ataacttggcgggtcaatgggctat

SEQ ID NO: 225475 - DNA, 25 bp, Mus musculus
ataacttgggctatgtagcttttat

SEQ ID NO: 225476 - DNA, 25 bp, Mus musculus
ataacttgggctttgtagcttttat

SEQ ID NO: 225477 - DNA, 25 bp, Mus musculus
ataacttggtatctcttagcactca

SEQ ID NO: 225478 - DNA, 25 bp, Mus musculus
ataacttggtatgtcttagcactca

SEQ ID NO: 225479 - DNA, 25 bp, Mus musculus
ataacttgtctcagcaatagccagc

SEQ ID NO: 225480 - DNA, 25 bp, Mus musculus
ataacttgtctctgcaatagccagc

SEQ ID NO: 225481 - DNA, 25 bp, Mus musculus
ataacttgtgcacctcttaacgcta

SEQ ID NO: 225482 - DNA, 25 bp, Mus musculus
ataacttgtgcagctcttaacgcta

SEQ ID NO: 225483 - DNA, 25 bp, Mus musculus
ataacttgtgctaattttgtgcatt

SEQ ID NO: 225484 - DNA, 25 bp, Mus musculus
ataacttgtgcttattttgtgcatt

SEQ ID NO: 225485 - DNA, 25 bp, Mus musculus
ataacttgttccagttcgttctctc

SEQ ID NO: 225486 - DNA, 25 bp, Mus musculus
ataacttgttcctgttcgttctctc

SEQ ID NO: 225487 - DNA, 25 bp, Mus musculus
ataactttaatactgatgtcacttt

SEQ ID NO: 225488 - DNA, 25 bp, Mus musculus
ataactttaatagtgatgtcacttt

SEQ ID NO: 225489 - DNA, 25 bp, Mus musculus
ataactttacccctggtagatgctc

SEQ ID NO: 225490 - DNA, 25 bp, Mus musculus
ataactttacccgtggtagatgctc

SEQ ID NO: 225491 - DNA, 25 bp, Mus musculus
ataactttgcaactataatcctgta

SEQ ID NO: 225492 - DNA, 25 bp, Mus musculus
ataactttgcaagtataatcctgta

SEQ ID NO: 225493 - DNA, 25 bp, Mus musculus
ataactttgctgagatccagatggg

SEQ ID NO: 225494 - DNA, 25 bp, Mus musculus
ataactttgctgtgatccagatggg

SEQ ID NO: 225495 - DNA, 25 bp, Mus musculus
ataacttttataacttgccactaat

SEQ ID NO: 225496 - DNA, 25 bp, Mus musculus
ataacttttatatcttgccactaat

SEQ ID NO: 225497 - DNA, 25 bp, Mus musculus
ataactttttcacgtgaccttgcca

SEQ ID NO: 225498 - DNA, 25 bp, Mus musculus
ataactttttcaggtgaccttgcca

SEQ ID NO: 225499 - DNA, 25 bp, Mus musculus
ataagaaagtttagcccacacaaat

SEQ ID NO: 225500 - DNA, 25 bp, Mus musculus
ataagaaagttttgcccacacaaat

SEQ ID NO: 225501 - DNA, 25 bp, Mus musculus
ataagaaatcatccctgccctagag

SEQ ID NO: 225502 - DNA, 25 bp, Mus musculus
ataagaaatcatgcctgccctagag

SEQ ID NO: 225503 - DNA, 25 bp, Mus musculus
ataagaacaacacctcaccagtcga

SEQ ID NO: 225504 - DNA, 25 bp, Mus musculus
ataagaacaacagctcaccagtcga

SEQ ID NO: 225505 - DNA, 25 bp, Mus musculus
ataagaaccgctagaactacctcac

SEQ ID NO: 225506 - DNA, 25 bp, Mus musculus
ataagaaccgcttgaactacctcac

SEQ ID NO: 225507 - DNA, 25 bp, Mus musculus
ataagaacctctatgtgttttgctt

SEQ ID NO: 225508 - DNA, 25 bp, Mus musculus
ataagaacctctttgtgttttgctt

SEQ ID NO: 225509 - DNA, 25 bp, Mus musculus
ataagaacctggagtcttccagctc

SEQ ID NO: 225510 - DNA, 25 bp, Mus musculus
ataagaacctggtgtcttccagctc

SEQ ID NO: 225511 - DNA, 25 bp, Mus musculus
ataagaactaccaaccatttgataa

SEQ ID NO: 225512 - DNA, 25 bp, Mus musculus
ataagaactacctaccatttgataa

SEQ ID NO: 225513 - DNA, 25 bp, Mus musculus
ataagaactgagagcctacctaggc

SEQ ID NO: 225514 - DNA, 25 bp, Mus musculus
ataagaactgagtgcctacctaggc

SEQ ID NO: 225515 - DNA, 25 bp, Mus musculus
ataagaagaggcctgactatcaagc

SEQ ID NO: 225516 - DNA, 25 bp, Mus musculus
ataagaagaggcgtgactatcaagc

SEQ ID NO: 225517 - DNA, 25 bp, Mus musculus
ataagaagcctccagtaccacaagg

SEQ ID NO: 225518 - DNA, 25 bp, Mus musculus
ataagaagcctcgagtaccacaagg

SEQ ID NO: 225519 - DNA, 25 bp, Mus musculus
ataagaaggcccaagaggaggagac

SEQ ID NO: 225520 - DNA, 25 bp, Mus musculus
ataagaaggccctagaggaggagac

SEQ ID NO: 225521 - DNA, 25 bp, Mus musculus
ataagaagggctcgccggtgcccac

SEQ ID NO: 225522 - DNA, 25 bp, Mus musculus
ataagaagggctggccggtgcccac

SEQ ID NO: 225523 - DNA, 25 bp, Mus musculus
ataagaagggtcaccacgtggtgga

SEQ ID NO: 225524 - DNA, 25 bp, Mus musculus
ataagaagggtctccacgtggtgga

SEQ ID NO: 225525 - DNA, 25 bp, Mus musculus
ataagaagtaccctgccctgagatt

SEQ ID NO: 225526 - DNA, 25 bp, Mus musculus
ataagaagtaccgtgccctgagatt

SEQ ID NO: 225527 - DNA, 25 bp, Mus musculus
ataagaagtatgattgtcagtcaaa

SEQ ID NO: 225528 - DNA, 25 bp, Mus musculus
ataagaagtatgcactgacccctca

SEQ ID NO: 225529 - DNA, 25 bp, Mus musculus
ataagaagtatggactgacccctca

SEQ ID NO: 225530 - DNA, 25 bp, Mus musculus
ataagaagtatgtttgtcagtcaaa

SEQ ID NO: 225531 - DNA, 25 bp, Mus musculus
ataagaagtcagactgagccgggcg

SEQ ID NO: 225532 - DNA, 25 bp, Mus musculus
ataagaagtcagtctgagccgggcg

SEQ ID NO: 225533 - DNA, 25 bp, Mus musculus
ataagaagtctcaggtcaacctctg

SEQ ID NO: 225534 - DNA, 25 bp, Mus musculus
ataagaagtctctggtcaacctctg

SEQ ID NO: 225535 - DNA, 25 bp, Mus musculus
ataagaagtgtgacagtaagtcaat

SEQ ID NO: 225536 - DNA, 25 bp, Mus musculus
ataagaagtgtgtcagtaagtcaat

SEQ ID NO: 225537 - DNA, 25 bp, Mus musculus
ataagaatcagcctgtcactgccac

SEQ ID NO: 225538 - DNA, 25 bp, Mus musculus
ataagaatcagcgtgtcactgccac

SEQ ID NO: 225539 - DNA, 25 bp, Mus musculus
ataagaatctccactatcggtgtgg

SEQ ID NO: 225540 - DNA, 25 bp, Mus musculus
ataagaatctcctctatcggtgtgg

SEQ ID NO: 225541 - DNA, 25 bp, Mus musculus
ataagaatgcctatagaccacccgc

SEQ ID NO: 225542 - DNA, 25 bp, Mus musculus
ataagaatgcctttagaccacccgc

SEQ ID NO: 225543 - DNA, 25 bp, Mus musculus
ataagaatgctgattgctgcagttc

SEQ ID NO: 225544 - DNA, 25 bp, Mus musculus
ataagaatgctgtttgctgcagttc

SEQ ID NO: 225545 - DNA, 25 bp, Mus musculus
ataagaatgtggactgtgaccatcc

SEQ ID NO: 225546 - DNA, 25 bp, Mus musculus
ataagaatgtggtctgtgaccatcc

SEQ ID NO: 225547 - DNA, 25 bp, Mus musculus
ataagaattcctcggatgcctctcc

SEQ ID NO: 225548 - DNA, 25 bp, Mus musculus
ataagaattcctgggatgcctctcc

SEQ ID NO: 225549 - DNA, 25 bp, Mus musculus
ataagacaaatgatcccagactggg

SEQ ID NO: 225550 - DNA, 25 bp, Mus musculus
ataagacaaatgttcccagactggg

SEQ ID NO: 225551 - DNA, 25 bp, Mus musculus
ataagacaactgaagtccctcagga

SEQ ID NO: 225552 - DNA, 25 bp, Mus musculus
ataagacaactgtagtccctcagga

SEQ ID NO: 225553 - DNA, 25 bp, Mus musculus
ataagacacaagaagactgggctag

SEQ ID NO: 225554 - DNA, 25 bp, Mus musculus
ataagacacaagtagactgggctag

SEQ ID NO: 225555 - DNA, 25 bp, Mus musculus
ataagacacctaacactcgatatgt

SEQ ID NO: 225556 - DNA, 25 bp, Mus musculus
ataagacacctatcactcgatatgt

SEQ ID NO: 225557 - DNA, 25 bp, Mus musculus
ataagacagattcgctggacggcaa

SEQ ID NO: 225558 - DNA, 25 bp, Mus musculus
ataagacagattggctggacggcaa

SEQ ID NO: 225559 - DNA, 25 bp, Mus musculus
ataagacagctgagcccgcctggga

SEQ ID NO: 225560 - DNA, 25 bp, Mus musculus
ataagacagctgagttctgcagagc

SEQ ID NO: 225561 - DNA, 25 bp, Mus musculus
ataagacagctgtgcccgcctggga

SEQ ID NO: 225562 - DNA, 25 bp, Mus musculus
ataagacagctgtgttctgcagagc

SEQ ID NO: 225563 - DNA, 25 bp, Mus musculus
ataagacagcttccatctcctgtta

SEQ ID NO: 225564 - DNA, 25 bp, Mus musculus
ataagacagcttgcatctcctgtta

SEQ ID NO: 225565 - DNA, 25 bp, Mus musculus
ataagaccaaacagctccacgtggg

SEQ ID NO: 225566 - DNA, 25 bp, Mus musculus
ataagaccaaactgctccacgtggg

SEQ ID NO: 225567 - DNA, 25 bp, Mus musculus
ataagacccagaaccagggcagaat

SEQ ID NO: 225568 - DNA, 25 bp, Mus musculus
ataagacccagatccagggcagaat

SEQ ID NO: 225569 - DNA, 25 bp, Mus musculus
ataagacccatactcctctggttaa

SEQ ID NO: 225570 - DNA, 25 bp, Mus musculus
ataagacccatagtcctctggttaa

SEQ ID NO: 225571 - DNA, 25 bp, Mus musculus
ataagactgatgcagagccctgaat

SEQ ID NO: 225572 - DNA, 25 bp, Mus musculus
ataagactgatggagagccctgaat

SEQ ID NO: 225573 - DNA, 25 bp, Mus musculus
ataagactgccaccgaccaagcaac

SEQ ID NO: 225574 - DNA, 25 bp, Mus musculus
ataagactgccagcgaccaagcaac

SEQ ID NO: 225575 - DNA, 25 bp, Mus musculus
ataagactgcctcgtctagcatcag

SEQ ID NO: 225576 - DNA, 25 bp, Mus musculus
ataagactgcctggtctagcatcag

SEQ ID NO: 225577 - DNA, 25 bp, Mus musculus
ataagactgctaatacctaccttgt

SEQ ID NO: 225578 - DNA, 25 bp, Mus musculus
ataagactgctattacctaccttgt

SEQ ID NO: 225579 - DNA, 25 bp, Mus musculus
ataagactggatccctcatcagcac

SEQ ID NO: 225580 - DNA, 25 bp, Mus musculus
ataagactggatgcctcatcagcac

SEQ ID NO: 225581 - DNA, 25 bp, Mus musculus
ataagacttagtcacagtcccaggc

SEQ ID NO: 225582 - DNA, 25 bp, Mus musculus
ataagacttagtgacagtcccaggc

SEQ ID NO: 225583 - DNA, 25 bp, Mus musculus
ataagacttcccaagtagccatatt

SEQ ID NO: 225584 - DNA, 25 bp, Mus musculus
ataagacttccctagtagccatatt

SEQ ID NO: 225585 - DNA, 25 bp, Mus musculus
ataagacttttgacaccagctgcac

SEQ ID NO: 225586 - DNA, 25 bp, Mus musculus
ataagacttttgtcaccagctgcac

SEQ ID NO: 225587 - DNA, 25 bp, Mus musculus
ataagagaacacaagcctggctggt

SEQ ID NO: 225588 - DNA, 25 bp, Mus musculus
ataagagaacactagcctggctggt

SEQ ID NO: 225589 - DNA, 25 bp, Mus musculus
ataagagagctcaacctaaccctat

SEQ ID NO: 225590 - DNA, 25 bp, Mus musculus
ataagagagctctacctaaccctat

SEQ ID NO: 225591 - DNA, 25 bp, Mus musculus
ataagagatttcagcacgatggtgc

SEQ ID NO: 225592 - DNA, 25 bp, Mus musculus
ataagagatttctgcacgatggtgc

SEQ ID NO: 225593 - DNA, 25 bp, Mus musculus
ataagagcaagcagagccttcccca

SEQ ID NO: 225594 - DNA, 25 bp, Mus musculus
ataagagcaagctgagccttcccca

SEQ ID NO: 225595 - DNA, 25 bp, Mus musculus
ataagagcagttccctaccctgtgt

SEQ ID NO: 225596 - DNA, 25 bp, Mus musculus
ataagagcagttgcctaccctgtgt

SEQ ID NO: 225597 - DNA, 25 bp, Mus musculus
ataagagccatcaccaggtgaggac

SEQ ID NO: 225598 - DNA, 25 bp, Mus musculus
ataagagccatctccaggtgaggac

SEQ ID NO: 225599 - DNA, 25 bp, Mus musculus
ataagagccctccagctgcggagac

SEQ ID NO: 225600 - DNA, 25 bp, Mus musculus
ataagagccctcgagctgcggagac

SEQ ID NO: 225601 - DNA, 25 bp, Mus musculus
ataagagctgtcagagaaaagaaca

SEQ ID NO: 225602 - DNA, 25 bp, Mus musculus
ataagagctgtctgagaaaagaaca

SEQ ID NO: 225603 - DNA, 25 bp, Mus musculus
ataagagggcgcctgattcttgcat

SEQ ID NO: 225604 - DNA, 25 bp, Mus musculus
ataagagggcgcgtgattcttgcat

SEQ ID NO: 225605 - DNA, 25 bp, Mus musculus
ataagagggtacacactgccaccgg

SEQ ID NO: 225606 - DNA, 25 bp, Mus musculus
ataagagggtactcactgccaccgg

SEQ ID NO: 225607 - DNA, 25 bp, Mus musculus
ataagaggtacccagcatctgtgcc

SEQ ID NO: 225608 - DNA, 25 bp, Mus musculus
ataagaggtaccgagcatctgtgcc

SEQ ID NO: 225609 - DNA, 25 bp, Mus musculus
ataagaggtattccaggtgttaaag

SEQ ID NO: 225610 - DNA, 25 bp, Mus musculus
ataagaggtattgcaggtgttaaag

SEQ ID NO: 225611 - DNA, 25 bp, Mus musculus
ataagaggtcagactgtacaaaaat

SEQ ID NO: 225612 - DNA, 25 bp, Mus musculus
ataagaggtcagtctgtacaaaaat

SEQ ID NO: 225613 - DNA, 25 bp, Mus musculus
ataagaggtctacggctaccattgg

SEQ ID NO: 225614 - DNA, 25 bp, Mus musculus
ataagaggtctagggctaccattgg

SEQ ID NO: 225615 - DNA, 25 bp, Mus musculus
ataagagtacttatcccagggtcat

SEQ ID NO: 225616 - DNA, 25 bp, Mus musculus
ataagagtacttttcccagggtcat

SEQ ID NO: 225617 - DNA, 25 bp, Mus musculus
ataagagtcaccataatctcaaaag

SEQ ID NO: 225618 - DNA, 25 bp, Mus musculus
ataagagtcaccttaatctcaaaag

SEQ ID NO: 225619 - DNA, 25 bp, Mus musculus
ataagagttagtctatgcttcctga

SEQ ID NO: 225620 - DNA, 25 bp, Mus musculus
ataagagttagtgtatgcttcctga

SEQ ID NO: 225621 - DNA, 25 bp, Mus musculus
ataagagttgccattcttcctggct

SEQ ID NO: 225622 - DNA, 25 bp, Mus musculus
ataagagttgcctttcttcctggct

SEQ ID NO: 225623 - DNA, 25 bp, Mus musculus
ataagagttgtgatcctgtgtttgt

SEQ ID NO: 225624 - DNA, 25 bp, Mus musculus
ataagagttgtgttcctgtgtttgt

SEQ ID NO: 225625 - DNA, 25 bp, Mus musculus
ataagatacctcaagcctagcttct

SEQ ID NO: 225626 - DNA, 25 bp, Mus musculus
ataagatacctctagcctagcttct

SEQ ID NO: 225627 - DNA, 25 bp, Mus musculus
ataagatatcccaacagagtcacct

SEQ ID NO: 225628 - DNA, 25 bp, Mus musculus
ataagatatccctacagagtcacct

SEQ ID NO: 225629 - DNA, 25 bp, Mus musculus
ataagatccaccaactttttcagct

SEQ ID NO: 225630 - DNA, 25 bp, Mus musculus
ataagatccacctactttttcagct

SEQ ID NO: 225631 - DNA, 25 bp, Mus musculus
ataagatccccacgagctagctctg

SEQ ID NO: 225632 - DNA, 25 bp, Mus musculus
ataagatccccaggagctagctctg

SEQ ID NO: 225633 - DNA, 25 bp, Mus musculus
ataagatctcttcgcgtgaaattgg

SEQ ID NO: 225634 - DNA, 25 bp, Mus musculus
ataagatctcttggcgtgaaattgg

SEQ ID NO: 225635 - DNA, 25 bp, Mus musculus
ataagatctgaaagactttgccctt

SEQ ID NO: 225636 - DNA, 25 bp, Mus musculus
ataagatctgaatgactttgccctt

SEQ ID NO: 225637 - DNA, 25 bp, Mus musculus
ataagatctgtactgaccccaagct

SEQ ID NO: 225638 - DNA, 25 bp, Mus musculus
ataagatctgtagtgaccccaagct

SEQ ID NO: 225639 - DNA, 25 bp, Mus musculus
ataagatgcagcaaaccccagacat

SEQ ID NO: 225640 - DNA, 25 bp, Mus musculus
ataagatgcagctaaccccagacat

SEQ ID NO: 225641 - DNA, 25 bp, Mus musculus
ataagatgcccacgtggccctctgt

SEQ ID NO: 225642 - DNA, 25 bp, Mus musculus
ataagatgcccaggtggccctctgt

SEQ ID NO: 225643 - DNA, 25 bp, Mus musculus
ataagatggacacatctttccacag

SEQ ID NO: 225644 - DNA, 25 bp, Mus musculus
ataagatggacagatctttccacag

SEQ ID NO: 225645 - DNA, 25 bp, Mus musculus
ataagatggagccacacccgtatct

SEQ ID NO: 225646 - DNA, 25 bp, Mus musculus
ataagatggagcgacacccgtatct

SEQ ID NO: 225647 - DNA, 25 bp, Mus musculus
ataagatgttccagctcaaggattg

SEQ ID NO: 225648 - DNA, 25 bp, Mus musculus
ataagatgttcctgctcaaggattg

SEQ ID NO: 225649 - DNA, 25 bp, Mus musculus
ataagattaactcgacgcgtcaccc

SEQ ID NO: 225650 - DNA, 25 bp, Mus musculus
ataagattaactggacgcgtcaccc

SEQ ID NO: 225651 - DNA, 25 bp, Mus musculus
ataagattatgcatcaaccaaaagc

SEQ ID NO: 225652 - DNA, 25 bp, Mus musculus
ataagattatgcttcaaccaaaagc

SEQ ID NO: 225653 - DNA, 25 bp, Mus musculus
ataagattgcacagttagtcctata

SEQ ID NO: 225654 - DNA, 25 bp, Mus musculus
ataagattgcactgttagtcctata

SEQ ID NO: 225655 - DNA, 25 bp, Mus musculus
ataagatttcctatagtcagagtgc

SEQ ID NO: 225656 - DNA, 25 bp, Mus musculus
ataagatttcctttagtcagagtgc

SEQ ID NO: 225657 - DNA, 25 bp, Mus musculus
ataagcaaaaatacccagagtcata

SEQ ID NO: 225658 - DNA, 25 bp, Mus musculus
ataagcaaaaattcccagagtcata

SEQ ID NO: 225659 - DNA, 25 bp, Mus musculus
ataagcaaagctcagatgttccctc

SEQ ID NO: 225660 - DNA, 25 bp, Mus musculus
ataagcaaagctgagatgttccctc

SEQ ID NO: 225661 - DNA, 25 bp, Mus musculus
ataagcaacctgagatggatcaaag

SEQ ID NO: 225662 - DNA, 25 bp, Mus musculus
ataagcaacctgtgatggatcaaag

SEQ ID NO: 225663 - DNA, 25 bp, Mus musculus
ataagcaagatactttagcttgggc

SEQ ID NO: 225664 - DNA, 25 bp, Mus musculus
ataagcaagatagtttagcttgggc

SEQ ID NO: 225665 - DNA, 25 bp, Mus musculus
ataagcaagatcctacacttccacg

SEQ ID NO: 225666 - DNA, 25 bp, Mus musculus
ataagcaagatcgtacacttccacg

SEQ ID NO: 225667 - DNA, 25 bp, Mus musculus
ataagcaaggccaatgtgcctcagt

SEQ ID NO: 225668 - DNA, 25 bp, Mus musculus
ataagcaaggcctatgtgcctcagt

SEQ ID NO: 225669 - DNA, 25 bp, Mus musculus
ataagcaagttcatttgggcccata

SEQ ID NO: 225670 - DNA, 25 bp, Mus musculus
ataagcaagttcttttgggcccata

SEQ ID NO: 225671 - DNA, 25 bp, Mus musculus
ataagcaataatactacacctacat

SEQ ID NO: 225672 - DNA, 25 bp, Mus musculus
ataagcaataattctacacctacat

SEQ ID NO: 225673 - DNA, 25 bp, Mus musculus
ataagcaatatcctgcctctttggc

SEQ ID NO: 225674 - DNA, 25 bp, Mus musculus
ataagcaatatcgtgcctctttggc

SEQ ID NO: 225675 - DNA, 25 bp, Mus musculus
ataagcaatattcgcacattacttg

SEQ ID NO: 225676 - DNA, 25 bp, Mus musculus
ataagcaatattggcacattacttg

SEQ ID NO: 225677 - DNA, 25 bp, Mus musculus
ataagcacaccaagcccagcatggt

SEQ ID NO: 225678 - DNA, 25 bp, Mus musculus
ataagcacaccatgcccagcatggt

SEQ ID NO: 225679 - DNA, 25 bp, Mus musculus
ataagcacacctacgcgtttgagag

SEQ ID NO: 225680 - DNA, 25 bp, Mus musculus
ataagcacaccttcgcgtttgagag

SEQ ID NO: 225681 - DNA, 25 bp, Mus musculus
ataagcacactaaaccctcaagact

SEQ ID NO: 225682 - DNA, 25 bp, Mus musculus
ataagcacactataccctcaagact

SEQ ID NO: 225683 - DNA, 25 bp, Mus musculus
ataagcacagatcctcacgactaga

SEQ ID NO: 225684 - DNA, 25 bp, Mus musculus
ataagcacagatgctcacgactaga

SEQ ID NO: 225685 - DNA, 25 bp, Mus musculus
ataagcaccattattgtttactgag

SEQ ID NO: 225686 - DNA, 25 bp, Mus musculus
ataagcaccatttttgtttactgag

SEQ ID NO: 225687 - DNA, 25 bp, Mus musculus
ataagcaccccgcaagcgttagaag

SEQ ID NO: 225688 - DNA, 25 bp, Mus musculus
ataagcaccccggaagcgttagaag

SEQ ID NO: 225689 - DNA, 25 bp, Mus musculus
ataagcacctagacaggcgctctta

SEQ ID NO: 225690 - DNA, 25 bp, Mus musculus
ataagcacctagtcaggcgctctta

SEQ ID NO: 225691 - DNA, 25 bp, Mus musculus
ataagcacgattaaccaacacctgt

SEQ ID NO: 225692 - DNA, 25 bp, Mus musculus
ataagcacgatttaccaacacctgt

SEQ ID NO: 225693 - DNA, 25 bp, Mus musculus
ataagcactatgactccaactttac

SEQ ID NO: 225694 - DNA, 25 bp, Mus musculus
ataagcactatgtctccaactttac

SEQ ID NO: 225695 - DNA, 25 bp, Mus musculus
ataagcactgacataggtcctgagt

SEQ ID NO: 225696 - DNA, 25 bp, Mus musculus
ataagcactgacttaggtcctgagt

SEQ ID NO: 225697 - DNA, 25 bp, Mus musculus
ataagcactgcacaggacacctcag

SEQ ID NO: 225698 - DNA, 25 bp, Mus musculus
ataagcactgcagaggacacctcag

SEQ ID NO: 225699 - DNA, 25 bp, Mus musculus
ataagcactggaaaaccgatcttct

SEQ ID NO: 225700 - DNA, 25 bp, Mus musculus
ataagcactggataaccgatcttct

SEQ ID NO: 225701 - DNA, 25 bp, Mus musculus
ataagcacttggatcacataaatat

SEQ ID NO: 225702 - DNA, 25 bp, Mus musculus
ataagcacttggttcacataaatat

SEQ ID NO: 225703 - DNA, 25 bp, Mus musculus
ataagcagaaggcacctctgcgtcc

SEQ ID NO: 225704 - DNA, 25 bp, Mus musculus
ataagcagaagggacctctgcgtcc

SEQ ID NO: 225705 - DNA, 25 bp, Mus musculus
ataagcagatgcacctgtgactgac

SEQ ID NO: 225706 - DNA, 25 bp, Mus musculus
ataagcagatgctcctgtgactgac

SEQ ID NO: 225707 - DNA, 25 bp, Mus musculus
ataagcagcagcactgatccctaat

SEQ ID NO: 225708 - DNA, 25 bp, Mus musculus
ataagcagcagctctgatccctaat

SEQ ID NO: 225709 - DNA, 25 bp, Mus musculus
ataagcagcggtctcttgtctaaag

SEQ ID NO: 225710 - DNA, 25 bp, Mus musculus
ataagcagcggtgtcttgtctaaag

SEQ ID NO: 225711 - DNA, 25 bp, Mus musculus
ataagcagctgcagaacttagagaa

SEQ ID NO: 225712 - DNA, 25 bp, Mus musculus
ataagcagctgctgaacttagagaa

SEQ ID NO: 225713 - DNA, 25 bp, Mus musculus
ataagcagcttacttcggttgtcaa

SEQ ID NO: 225714 - DNA, 25 bp, Mus musculus
ataagcagcttagttcggttgtcaa

SEQ ID NO: 225715 - DNA, 25 bp, Mus musculus
ataagcaggacaccaccggcatgaa

SEQ ID NO: 225716 - DNA, 25 bp, Mus musculus
ataagcaggacagcaccggcatgaa

SEQ ID NO: 225717 - DNA, 25 bp, Mus musculus
ataagcaggttgctcagctgcatcc

SEQ ID NO: 225718 - DNA, 25 bp, Mus musculus
ataagcaggttggtcagctgcatcc

SEQ ID NO: 225719 - DNA, 25 bp, Mus musculus
ataagcagtataactcctttgtatc

SEQ ID NO: 225720 - DNA, 25 bp, Mus musculus
ataagcagtatatctcctttgtatc

SEQ ID NO: 225721 - DNA, 25 bp, Mus musculus
ataagcagtcttaggtggttagtag

SEQ ID NO: 225722 - DNA, 25 bp, Mus musculus
ataagcagtctttggtggttagtag

SEQ ID NO: 225723 - DNA, 25 bp, Mus musculus
ataagcagttgcctgggcttcccgt

SEQ ID NO: 225724 - DNA, 25 bp, Mus musculus
ataagcagttgcgtgggcttcccgt

SEQ ID NO: 225725 - DNA, 25 bp, Mus musculus
ataagcataagaccaaggaccagta

SEQ ID NO: 225726 - DNA, 25 bp, Mus musculus
ataagcataagagcaaggaccagta

SEQ ID NO: 225727 - DNA, 25 bp, Mus musculus
ataagcatcaaacgcctgaccctgt

SEQ ID NO: 225728 - DNA, 25 bp, Mus musculus
ataagcatcaaaggcctgaccctgt

SEQ ID NO: 225729 - DNA, 25 bp, Mus musculus
ataagcatgaacctagctgccaaga

SEQ ID NO: 225730 - DNA, 25 bp, Mus musculus
ataagcatgaacgtagctgccaaga

SEQ ID NO: 225731 - DNA, 25 bp, Mus musculus
ataagcatgactcccgagttctacc

SEQ ID NO: 225732 - DNA, 25 bp, Mus musculus
ataagcatgactgccgagttctacc

SEQ ID NO: 225733 - DNA, 25 bp, Mus musculus
ataagcatgatgattaggtcctatt

SEQ ID NO: 225734 - DNA, 25 bp, Mus musculus
ataagcatgatgtttaggtcctatt

SEQ ID NO: 225735 - DNA, 25 bp, Mus musculus
ataagcatgtgcctcattcggaagc

SEQ ID NO: 225736 - DNA, 25 bp, Mus musculus
ataagcatgtgcgtcattcggaagc

SEQ ID NO: 225737 - DNA, 25 bp, Mus musculus
ataagcattagacattttttcccca

SEQ ID NO: 225738 - DNA, 25 bp, Mus musculus
ataagcattagagattttttcccca

SEQ ID NO: 225739 - DNA, 25 bp, Mus musculus
ataagcattctaacacctcagtaat

SEQ ID NO: 225740 - DNA, 25 bp, Mus musculus
ataagcattctatcacctcagtaat

SEQ ID NO: 225741 - DNA, 25 bp, Mus musculus
ataagcatttttcgcctgtgagact

SEQ ID NO: 225742 - DNA, 25 bp, Mus musculus
ataagcatttttggcctgtgagact

SEQ ID NO: 225743 - DNA, 25 bp, Mus musculus
ataagccaacgtactatgaccaagc

SEQ ID NO: 225744 - DNA, 25 bp, Mus musculus
ataagccaacgttctatgaccaagc

SEQ ID NO: 225745 - DNA, 25 bp, Mus musculus
ataagccaagagaagtagtttcagt

SEQ ID NO: 225746 - DNA, 25 bp, Mus musculus
ataagccaagagtagtagtttcagt

SEQ ID NO: 225747 - DNA, 25 bp, Mus musculus
ataagccaagtgagttgagtcatgc

SEQ ID NO: 225748 - DNA, 25 bp, Mus musculus
ataagccaagtgtgttgagtcatgc

SEQ ID NO: 225749 - DNA, 25 bp, Mus musculus
ataagccaatacactataaccaaga

SEQ ID NO: 225750 - DNA, 25 bp, Mus musculus
ataagccaatactctataaccaaga

SEQ ID NO: 225751 - DNA, 25 bp, Mus musculus
ataagccacagaacctcctggtggt

SEQ ID NO: 225752 - DNA, 25 bp, Mus musculus
ataagccacagatcctcctggtggt

SEQ ID NO: 225753 - DNA, 25 bp, Mus musculus
ataagccaccgtcggcaggagctgc

SEQ ID NO: 225754 - DNA, 25 bp, Mus musculus
ataagccaccgtgggcaggagctgc

SEQ ID NO: 225755 - DNA, 25 bp, Mus musculus
ataagccactatcttctgaccttgg

SEQ ID NO: 225756 - DNA, 25 bp, Mus musculus
ataagccactatgttctgaccttgg

SEQ ID NO: 225757 - DNA, 25 bp, Mus musculus
ataagccagagtacacatatcccac

SEQ ID NO: 225758 - DNA, 25 bp, Mus musculus
ataagccagagttcacatatcccac

SEQ ID NO: 225759 - DNA, 25 bp, Mus musculus
ataagccagatccttgactctcaag

SEQ ID NO: 225760 - DNA, 25 bp, Mus musculus
ataagccagatcgttgactctcaag

SEQ ID NO: 225761 - DNA, 25 bp, Mus musculus
ataagccagcatcaggttttctctc

SEQ ID NO: 225762 - DNA, 25 bp, Mus musculus
ataagccagcatgaggttttctctc

SEQ ID NO: 225763 - DNA, 25 bp, Mus musculus
ataagccagcctagttgagcacacc

SEQ ID NO: 225764 - DNA, 25 bp, Mus musculus
ataagccagccttgttgagcacacc

SEQ ID NO: 225765 - DNA, 25 bp, Mus musculus
ataagccaggcaagacccctgagga

SEQ ID NO: 225766 - DNA, 25 bp, Mus musculus
ataagccaggcatgacccctgagga

SEQ ID NO: 225767 - DNA, 25 bp, Mus musculus
ataagccaggccaaagccattttat

SEQ ID NO: 225768 - DNA, 25 bp, Mus musculus
ataagccaggcctaagccattttat

SEQ ID NO: 225769 - DNA, 25 bp, Mus musculus
ataagccatgtcactattctctttg

SEQ ID NO: 225770 - DNA, 25 bp, Mus musculus
ataagccatgtctctattctctttg

SEQ ID NO: 225771 - DNA, 25 bp, Mus musculus
ataagccatgtgcagcatgccagta

SEQ ID NO: 225772 - DNA, 25 bp, Mus musculus
ataagccatgtggagcatgccagta

SEQ ID NO: 225773 - DNA, 25 bp, Mus musculus
ataagccatttgatgcagcatttgt

SEQ ID NO: 225774 - DNA, 25 bp, Mus musculus
ataagccatttgttgcagcatttgt

SEQ ID NO: 225775 - DNA, 25 bp, Mus musculus
ataagcccaaacagccagtggtgat

SEQ ID NO: 225776 - DNA, 25 bp, Mus musculus
ataagcccaaactgccagtggtgat

SEQ ID NO: 225777 - DNA, 25 bp, Mus musculus
ataagcccctcacgatggtggacgc

SEQ ID NO: 225778 - DNA, 25 bp, Mus musculus
ataagcccctcaggatggtggacgc

SEQ ID NO: 225779 - DNA, 25 bp, Mus musculus
ataagccccttgaaggcctgcagaa

SEQ ID NO: 225780 - DNA, 25 bp, Mus musculus
ataagccccttgtaggcctgcagaa

SEQ ID NO: 225781 - DNA, 25 bp, Mus musculus
ataagcccgagaagggtcttcccta

SEQ ID NO: 225782 - DNA, 25 bp, Mus musculus
ataagcccgagatgggtcttcccta

SEQ ID NO: 225783 - DNA, 25 bp, Mus musculus
ataagccctattagtctccattgaa

SEQ ID NO: 225784 - DNA, 25 bp, Mus musculus
ataagccctatttgtctccattgaa

SEQ ID NO: 225785 - DNA, 25 bp, Mus musculus
ataagccgtttgctaaccgtcctca

SEQ ID NO: 225786 - DNA, 25 bp, Mus musculus
ataagccgtttggtaaccgtcctca

SEQ ID NO: 225787 - DNA, 25 bp, Mus musculus
ataagcctattgctgccacttcaaa

SEQ ID NO: 225788 - DNA, 25 bp, Mus musculus
ataagcctattggtgccacttcaaa

SEQ ID NO: 225789 - DNA, 25 bp, Mus musculus
ataagcctgagccttctcgtgccca

SEQ ID NO: 225790 - DNA, 25 bp, Mus musculus
ataagcctgagcgttctcgtgccca

SEQ ID NO: 225791 - DNA, 25 bp, Mus musculus
ataagcctgattaactgtgggtggt

SEQ ID NO: 225792 - DNA, 25 bp, Mus musculus
ataagcctgatttactgtgggtggt

SEQ ID NO: 225793 - DNA, 25 bp, Mus musculus
ataagcctgcctcgaagtgctctct

SEQ ID NO: 225794 - DNA, 25 bp, Mus musculus
ataagcctgcctggaagtgctctct

SEQ ID NO: 225795 - DNA, 25 bp, Mus musculus
ataagcctggttaatttctgtaaca

SEQ ID NO: 225796 - DNA, 25 bp, Mus musculus
ataagcctggtttatttctgtaaca

SEQ ID NO: 225797 - DNA, 25 bp, Mus musculus
ataagcctgtagacccaggattggg

SEQ ID NO: 225798 - DNA, 25 bp, Mus musculus
ataagcctgtagtcccaggattggg

SEQ ID NO: 225799 - DNA, 25 bp, Mus musculus
ataagccttcatatcttgatcctgt

SEQ ID NO: 225800 - DNA, 25 bp, Mus musculus
ataagccttcatttcttgatcctgt

SEQ ID NO: 225801 - DNA, 25 bp, Mus musculus
ataagccttccacgtgactgctttg

SEQ ID NO: 225802 - DNA, 25 bp, Mus musculus
ataagccttccaggtgactgctttg

SEQ ID NO: 225803 - DNA, 25 bp, Mus musculus
ataagcgccagcagagccgcggccg

SEQ ID NO: 225804 - DNA, 25 bp, Mus musculus
ataagcgccagctgagccgcggccg

SEQ ID NO: 225805 - DNA, 25 bp, Mus musculus
ataagcggagttacacccagagcca

SEQ ID NO: 225806 - DNA, 25 bp, Mus musculus
ataagcggagtttcacccagagcca

SEQ ID NO: 225807 - DNA, 25 bp, Mus musculus
ataagcgtagacacttgaaaagcag

SEQ ID NO: 225808 - DNA, 25 bp, Mus musculus
ataagcgtagactcttgaaaagcag

SEQ ID NO: 225809 - DNA, 25 bp, Mus musculus
ataagcgtccgtccaaagaattaca

SEQ ID NO: 225810 - DNA, 25 bp, Mus musculus
ataagcgtccgtgcaaagaattaca

SEQ ID NO: 225811 - DNA, 25 bp, Mus musculus
ataagcgtcttgaacctggaggtgg

SEQ ID NO: 225812 - DNA, 25 bp, Mus musculus
ataagcgtcttgtacctggaggtgg

SEQ ID NO: 225813 - DNA, 25 bp, Mus musculus
ataagcgtgactcggcattttcaaa

SEQ ID NO: 225814 - DNA, 25 bp, Mus musculus
ataagcgtgactgggcattttcaaa

SEQ ID NO: 225815 - DNA, 25 bp, Mus musculus
ataagcgtgcagaaccctcagaggc

SEQ ID NO: 225816 - DNA, 25 bp, Mus musculus
ataagcgtgcagtaccctcagaggc

SEQ ID NO: 225817 - DNA, 25 bp, Mus musculus
ataagctaagcaagagttccagact

SEQ ID NO: 225818 - DNA, 25 bp, Mus musculus
ataagctaagcatgagttccagact

SEQ ID NO: 225819 - DNA, 25 bp, Mus musculus
ataagctacaatacccttgtccata

SEQ ID NO: 225820 - DNA, 25 bp, Mus musculus
ataagctacaattcccttgtccata

SEQ ID NO: 225821 - DNA, 25 bp, Mus musculus
ataagctacaggcttggcttgcacc

SEQ ID NO: 225822 - DNA, 25 bp, Mus musculus
ataagctacagggttggcttgcacc

SEQ ID NO: 225823 - DNA, 25 bp, Mus musculus
ataagctacatgcagcatcctcatg

SEQ ID NO: 225824 - DNA, 25 bp, Mus musculus
ataagctacatggagcatcctcatg

SEQ ID NO: 225825 - DNA, 25 bp, Mus musculus
ataagctactaactctaacccaaag

SEQ ID NO: 225826 - DNA, 25 bp, Mus musculus
ataagctactaagtctaacccaaag

SEQ ID NO: 225827 - DNA, 25 bp, Mus musculus
ataagctagacacctgtggtctcct

SEQ ID NO: 225828 - DNA, 25 bp, Mus musculus
ataagctagacagctgtggtctcct

SEQ ID NO: 225829 - DNA, 25 bp, Mus musculus
ataagctagagaatcaccccagtgc

SEQ ID NO: 225830 - DNA, 25 bp, Mus musculus
ataagctagagattcaccccagtgc

SEQ ID NO: 225831 - DNA, 25 bp, Mus musculus
ataagctcaacaatgctgccaccat

SEQ ID NO: 225832 - DNA, 25 bp, Mus musculus
ataagctcaacattgctgccaccat

SEQ ID NO: 225833 - DNA, 25 bp, Mus musculus
ataagctcagctaattcaggacact

SEQ ID NO: 225834 - DNA, 25 bp, Mus musculus
ataagctcagcttattcaggacact

SEQ ID NO: 225835 - DNA, 25 bp, Mus musculus
ataagctccagacagtcccctgagt

SEQ ID NO: 225836 - DNA, 25 bp, Mus musculus
ataagctccagagagtcccctgagt

SEQ ID NO: 225837 - DNA, 25 bp, Mus musculus
ataagctccaggcatatgtttcttg

SEQ ID NO: 225838 - DNA, 25 bp, Mus musculus
ataagctccagggatatgtttcttg

SEQ ID NO: 225839 - DNA, 25 bp, Mus musculus
ataagctccttcaggtcctctgtgg

SEQ ID NO: 225840 - DNA, 25 bp, Mus musculus
ataagctccttctggtcctctgtgg

SEQ ID NO: 225841 - DNA, 25 bp, Mus musculus
ataagctcgatcatgggcctataca

SEQ ID NO: 225842 - DNA, 25 bp, Mus musculus
ataagctcgatcttgggcctataca

SEQ ID NO: 225843 - DNA, 25 bp, Mus musculus
ataagctctaccattattgctcaga

SEQ ID NO: 225844 - DNA, 25 bp, Mus musculus
ataagctctacctttattgctcaga

SEQ ID NO: 225845 - DNA, 25 bp, Mus musculus
ataagctctaggagcggttcgttga

SEQ ID NO: 225846 - DNA, 25 bp, Mus musculus
ataagctctaggtgcggttcgttga

SEQ ID NO: 225847 - DNA, 25 bp, Mus musculus
ataagctctcccatactgaataccg

SEQ ID NO: 225848 - DNA, 25 bp, Mus musculus
ataagctctcccattttctgtagag

SEQ ID NO: 225849 - DNA, 25 bp, Mus musculus
ataagctctcccttactgaataccg

SEQ ID NO: 225850 - DNA, 25 bp, Mus musculus
ataagctctccctttttctgtagag

SEQ ID NO: 225851 - DNA, 25 bp, Mus musculus
ataagctctcctacagacggtgagg

SEQ ID NO: 225852 - DNA, 25 bp, Mus musculus
ataagctctccttcagacggtgagg

SEQ ID NO: 225853 - DNA, 25 bp, Mus musculus
ataagctctgagctccagtgcttct

SEQ ID NO: 225854 - DNA, 25 bp, Mus musculus
ataagctctgaggtccagtgcttct

SEQ ID NO: 225855 - DNA, 25 bp, Mus musculus
ataagctctgttccatctgaatcct

SEQ ID NO: 225856 - DNA, 25 bp, Mus musculus
ataagctctgttgcatctgaatcct

SEQ ID NO: 225857 - DNA, 25 bp, Mus musculus
ataagctcttttactcccagctaag

SEQ ID NO: 225858 - DNA, 25 bp, Mus musculus
ataagctctttttctcccagctaag

SEQ ID NO: 225859 - DNA, 25 bp, Mus musculus
ataagctgaaagctgcctgcgttcc

SEQ ID NO: 225860 - DNA, 25 bp, Mus musculus
ataagctgaaaggtgcctgcgttcc

SEQ ID NO: 225861 - DNA, 25 bp, Mus musculus
ataagctgaatacgcctgtcttgtt

SEQ ID NO: 225862 - DNA, 25 bp, Mus musculus
ataagctgaataggcctgtcttgtt

SEQ ID NO: 225863 - DNA, 25 bp, Mus musculus
ataagctgaatgaccctgtgcgcca

SEQ ID NO: 225864 - DNA, 25 bp, Mus musculus
ataagctgaatgtccctgtgcgcca

SEQ ID NO: 225865 - DNA, 25 bp, Mus musculus
ataagctgagtgactgtcttcccgg

SEQ ID NO: 225866 - DNA, 25 bp, Mus musculus
ataagctgagtgtctgtcttcccgg

SEQ ID NO: 225867 - DNA, 25 bp, Mus musculus
ataagctgatgcacggttcaatgat

SEQ ID NO: 225868 - DNA, 25 bp, Mus musculus
ataagctgatgctcggttcaatgat

SEQ ID NO: 225869 - DNA, 25 bp, Mus musculus
ataagctgattgacccagacctacc

SEQ ID NO: 225870 - DNA, 25 bp, Mus musculus
ataagctgattgtcccagacctacc

SEQ ID NO: 225871 - DNA, 25 bp, Mus musculus
ataagctgcagaatatataggagag

SEQ ID NO: 225872 - DNA, 25 bp, Mus musculus
ataagctgcagattatataggagag

SEQ ID NO: 225873 - DNA, 25 bp, Mus musculus
ataagctgcccgagaactatgagga

SEQ ID NO: 225874 - DNA, 25 bp, Mus musculus
ataagctgcccgtgaactatgagga

SEQ ID NO: 225875 - DNA, 25 bp, Mus musculus
ataagctgccgcagcaggttttata

SEQ ID NO: 225876 - DNA, 25 bp, Mus musculus
ataagctgccgctgcaggttttata

SEQ ID NO: 225877 - DNA, 25 bp, Mus musculus
ataagctgctcccagatggtccaag

SEQ ID NO: 225878 - DNA, 25 bp, Mus musculus
ataagctgctccgagatggtccaag

SEQ ID NO: 225879 - DNA, 25 bp, Mus musculus
ataagctgctgaactgttctttctc

SEQ ID NO: 225880 - DNA, 25 bp, Mus musculus
ataagctgctgatctgttctttctc

SEQ ID NO: 225881 - DNA, 25 bp, Mus musculus
ataagctgtacaatcgtttcatcat

SEQ ID NO: 225882 - DNA, 25 bp, Mus musculus
ataagctgtacattcgtttcatcat

SEQ ID NO: 225883 - DNA, 25 bp, Mus musculus
ataagctgtgccattcccactgtgc

SEQ ID NO: 225884 - DNA, 25 bp, Mus musculus
ataagctgtgcctttcccactgtgc

SEQ ID NO: 225885 - DNA, 25 bp, Mus musculus
ataagctgtgtaaatagttcctagg

SEQ ID NO: 225886 - DNA, 25 bp, Mus musculus
ataagctgtgtatatagttcctagg

SEQ ID NO: 225887 - DNA, 25 bp, Mus musculus
ataagctgttatcacctgtgtggtt

SEQ ID NO: 225888 - DNA, 25 bp, Mus musculus
ataagctgttatgacctgtgtggtt

SEQ ID NO: 225889 - DNA, 25 bp, Mus musculus
ataagcttaccactgaccttgttca

SEQ ID NO: 225890 - DNA, 25 bp, Mus musculus
ataagcttaccagtgaccttgttca

SEQ ID NO: 225891 - DNA, 25 bp, Mus musculus
ataagcttagcccttgcagcagcag

SEQ ID NO: 225892 - DNA, 25 bp, Mus musculus
ataagcttagccgttgcagcagcag

SEQ ID NO: 225893 - DNA, 25 bp, Mus musculus
ataagcttaggtcgaaactcgcagg

SEQ ID NO: 225894 - DNA, 25 bp, Mus musculus
ataagcttaggtggaaactcgcagg

SEQ ID NO: 225895 - DNA, 25 bp, Mus musculus
ataagcttctttagatactggcaat

SEQ ID NO: 225896 - DNA, 25 bp, Mus musculus
ataagcttcttttgatactggcaat

SEQ ID NO: 225897 - DNA, 25 bp, Mus musculus
ataagcttgaccattttactcctct

SEQ ID NO: 225898 - DNA, 25 bp, Mus musculus
ataagcttgacctttttactcctct

SEQ ID NO: 225899 - DNA, 25 bp, Mus musculus
ataagcttgtttatctggtcgtccc

SEQ ID NO: 225900 - DNA, 25 bp, Mus musculus
ataagcttgtttttctggtcgtccc

SEQ ID NO: 225901 - DNA, 25 bp, Mus musculus
ataagctttacgagcgacgcggcgg

SEQ ID NO: 225902 - DNA, 25 bp, Mus musculus
ataagctttacgtgcgacgcggcgg

SEQ ID NO: 225903 - DNA, 25 bp, Mus musculus
ataagctttcagatgggaggcacaa

SEQ ID NO: 225904 - DNA, 25 bp, Mus musculus
ataagctttcagttgggaggcacaa

SEQ ID NO: 225905 - DNA, 25 bp, Mus musculus
ataagctttgtaagtgggcacattt

SEQ ID NO: 225906 - DNA, 25 bp, Mus musculus
ataagctttgtatgtgggcacattt

SEQ ID NO: 225907 - DNA, 25 bp, Mus musculus
ataagctttgttcgcacgatccttt

SEQ ID NO: 225908 - DNA, 25 bp, Mus musculus
ataagctttgttggcacgatccttt

SEQ ID NO: 225909 - DNA, 25 bp, Mus musculus
ataagcttttccctcttgtatttct

SEQ ID NO: 225910 - DNA, 25 bp, Mus musculus
ataagcttttccgtcttgtatttct

SEQ ID NO: 225911 - DNA, 25 bp, Mus musculus
ataagcttttgaaccggcgaatctg

SEQ ID NO: 225912 - DNA, 25 bp, Mus musculus
ataagcttttgatccggcgaatctg

SEQ ID NO: 225913 - DNA, 25 bp, Mus musculus
ataagcttttgtcccctgtttttct

SEQ ID NO: 225914 - DNA, 25 bp, Mus musculus
ataagcttttgtgccctgtttttct

SEQ ID NO: 225915 - DNA, 25 bp, Mus musculus
ataaggaacacaccaggctaatcag

SEQ ID NO: 225916 - DNA, 25 bp, Mus musculus
ataaggaacacagcaggctaatcag

SEQ ID NO: 225917 - DNA, 25 bp, Mus musculus
ataaggaatcctatggcttctgtcc

SEQ ID NO: 225918 - DNA, 25 bp, Mus musculus
ataaggaatcctttggcttctgtcc

SEQ ID NO: 225919 - DNA, 25 bp, Mus musculus
ataaggaatggtacagcccacagtt

SEQ ID NO: 225920 - DNA, 25 bp, Mus musculus
ataaggaatggttcagcccacagtt

SEQ ID NO: 225921 - DNA, 25 bp, Mus musculus
ataaggaattccaggccaacccgat

SEQ ID NO: 225922 - DNA, 25 bp, Mus musculus
ataaggaattcctggccaacccgat

SEQ ID NO: 225923 - DNA, 25 bp, Mus musculus
ataaggacagtgctcgaaaccgacc

SEQ ID NO: 225924 - DNA, 25 bp, Mus musculus
ataaggacagtggtcgaaaccgacc

SEQ ID NO: 225925 - DNA, 25 bp, Mus musculus
ataaggacccgcagttagaccctca

SEQ ID NO: 225926 - DNA, 25 bp, Mus musculus
ataaggacccgctgttagaccctca

SEQ ID NO: 225927 - DNA, 25 bp, Mus musculus
ataaggaccctgcatcccgaatgag

SEQ ID NO: 225928 - DNA, 25 bp, Mus musculus
ataaggaccctggatcccgaatgag

SEQ ID NO: 225929 - DNA, 25 bp, Mus musculus
ataaggacgcggacttgtacacttc

SEQ ID NO: 225930 - DNA, 25 bp, Mus musculus
ataaggacgcggtcttgtacacttc

SEQ ID NO: 225931 - DNA, 25 bp, Mus musculus
ataaggacggccaggttcgcatggt

SEQ ID NO: 225932 - DNA, 25 bp, Mus musculus
ataaggacggcctggttcgcatggt

SEQ ID NO: 225933 - DNA, 25 bp, Mus musculus
ataaggactgtgcactcgactcatt

SEQ ID NO: 225934 - DNA, 25 bp, Mus musculus
ataaggactgtggactcgactcatt

SEQ ID NO: 225935 - DNA, 25 bp, Mus musculus
ataaggagagaaacctgcatccact

SEQ ID NO: 225936 - DNA, 25 bp, Mus musculus
ataaggagagaatcctgcatccact

SEQ ID NO: 225937 - DNA, 25 bp, Mus musculus
ataaggagctaactcgaagcttcac

SEQ ID NO: 225938 - DNA, 25 bp, Mus musculus
ataaggagctaagtcgaagcttcac

SEQ ID NO: 225939 - DNA, 25 bp, Mus musculus
ataaggagcttcctaagcggttggt

SEQ ID NO: 225940 - DNA, 25 bp, Mus musculus
ataaggagcttcgtaagcggttggt

SEQ ID NO: 225941 - DNA, 25 bp, Mus musculus
ataaggaggctccttttgcccactt

SEQ ID NO: 225942 - DNA, 25 bp, Mus musculus
ataaggaggctcgttttgcccactt

SEQ ID NO: 225943 - DNA, 25 bp, Mus musculus
ataaggagggccagcactcgaggct

SEQ ID NO: 225944 - DNA, 25 bp, Mus musculus
ataaggagggcctgcactcgaggct

SEQ ID NO: 225945 - DNA, 25 bp, Mus musculus
ataaggaggtgtccactggcatcct

SEQ ID NO: 225946 - DNA, 25 bp, Mus musculus
ataaggaggtgtgcactggcatcct

SEQ ID NO: 225947 - DNA, 25 bp, Mus musculus
ataaggagttgtctggccctcggcc

SEQ ID NO: 225948 - DNA, 25 bp, Mus musculus
ataaggagttgtgtggccctcggcc

SEQ ID NO: 225949 - DNA, 25 bp, Mus musculus
ataaggatcctgagggcactgctgg

SEQ ID NO: 225950 - DNA, 25 bp, Mus musculus
ataaggatcctgtgggcactgctgg

SEQ ID NO: 225951 - DNA, 25 bp, Mus musculus
ataaggatctgcacacctatgggcc

SEQ ID NO: 225952 - DNA, 25 bp, Mus musculus
ataaggatctgctcacctatgggcc

SEQ ID NO: 225953 - DNA, 25 bp, Mus musculus
ataaggatgataccccagttgtgaa

SEQ ID NO: 225954 - DNA, 25 bp, Mus musculus
ataaggatgatagcccagttgtgaa

SEQ ID NO: 225955 - DNA, 25 bp, Mus musculus
ataaggatggagacgctgtttaaga

SEQ ID NO: 225956 - DNA, 25 bp, Mus musculus
ataaggatggagtcgctgtttaaga

SEQ ID NO: 225957 - DNA, 25 bp, Mus musculus
ataaggatgtgaccactgccttggg

SEQ ID NO: 225958 - DNA, 25 bp, Mus musculus
ataaggatgtgagcactgccttggg

SEQ ID NO: 225959 - DNA, 25 bp, Mus musculus
ataaggattccacttctttctgacc

SEQ ID NO: 225960 - DNA, 25 bp, Mus musculus
ataaggattccagttctttctgacc

SEQ ID NO: 225961 - DNA, 25 bp, Mus musculus
ataaggattctgaagtcctctgcaa

SEQ ID NO: 225962 - DNA, 25 bp, Mus musculus
ataaggattctgtagtcctctgcaa

SEQ ID NO: 225963 - DNA, 25 bp, Mus musculus
ataaggcaatccacctaagactctc

SEQ ID NO: 225964 - DNA, 25 bp, Mus musculus
ataaggcaatcctcctaagactctc

SEQ ID NO: 225965 - DNA, 25 bp, Mus musculus
ataaggcaatgcatgagccacttaa

SEQ ID NO: 225966 - DNA, 25 bp, Mus musculus
ataaggcaatgcttgagccacttaa

SEQ ID NO: 225967 - DNA, 25 bp, Mus musculus
ataaggcacccaaagggagatgtca

SEQ ID NO: 225968 - DNA, 25 bp, Mus musculus
ataaggcacccatagggagatgtca

SEQ ID NO: 225969 - DNA, 25 bp, Mus musculus
ataaggcagcacagctctgacagct

SEQ ID NO: 225970 - DNA, 25 bp, Mus musculus
ataaggcagcactgctctgacagct

SEQ ID NO: 225971 - DNA, 25 bp, Mus musculus
ataaggcagcctatggtcatcggca

SEQ ID NO: 225972 - DNA, 25 bp, Mus musculus
ataaggcagcctttggtcatcggca

SEQ ID NO: 225973 - DNA, 25 bp, Mus musculus
ataaggcatctcagattctttgctg

SEQ ID NO: 225974 - DNA, 25 bp, Mus musculus
ataaggcatctctgattctttgctg

SEQ ID NO: 225975 - DNA, 25 bp, Mus musculus
ataaggccactcctgtaaccatgac

SEQ ID NO: 225976 - DNA, 25 bp, Mus musculus
ataaggccactcgtgtaaccatgac

SEQ ID NO: 225977 - DNA, 25 bp, Mus musculus
ataaggccagaccttctccaataag

SEQ ID NO: 225978 - DNA, 25 bp, Mus musculus
ataaggccagacgttctccaataag

SEQ ID NO: 225979 - DNA, 25 bp, Mus musculus
ataaggccatctaggaacctgaaga

SEQ ID NO: 225980 - DNA, 25 bp, Mus musculus
ataaggccatcttggaacctgaaga

SEQ ID NO: 225981 - DNA, 25 bp, Mus musculus
ataaggcccatgaacaatggtgttc

SEQ ID NO: 225982 - DNA, 25 bp, Mus musculus
ataaggcccatgtacaatggtgttc

SEQ ID NO: 225983 - DNA, 25 bp, Mus musculus
ataaggcccgccagacagaggcaga

SEQ ID NO: 225984 - DNA, 25 bp, Mus musculus
ataaggcccgcctgacagaggcaga

SEQ ID NO: 225985 - DNA, 25 bp, Mus musculus
ataaggcccttaaatttgtcacact

SEQ ID NO: 225986 - DNA, 25 bp, Mus musculus
ataaggcccttatatttgtcacact

SEQ ID NO: 225987 - DNA, 25 bp, Mus musculus
ataaggcctgccaatgtgtatagct

SEQ ID NO: 225988 - DNA, 25 bp, Mus musculus
ataaggcctgcctatgtgtatagct

SEQ ID NO: 225989 - DNA, 25 bp, Mus musculus
ataaggcctgcgaatcccagctcaa

SEQ ID NO: 225990 - DNA, 25 bp, Mus musculus
ataaggcctgcgtatcccagctcaa

SEQ ID NO: 225991 - DNA, 25 bp, Mus musculus
ataaggcgccagaattcttcacaag

SEQ ID NO: 225992 - DNA, 25 bp, Mus musculus
ataaggcgccagtattcttcacaag

SEQ ID NO: 225993 - DNA, 25 bp, Mus musculus
ataaggcgcctactttgagggccct

SEQ ID NO: 225994 - DNA, 25 bp, Mus musculus
ataaggcgcctagtttgagggccct

SEQ ID NO: 225995 - DNA, 25 bp, Mus musculus
ataaggcgcgatcacaccctgggct

SEQ ID NO: 225996 - DNA, 25 bp, Mus musculus
ataaggcgcgatgacaccctgggct

SEQ ID NO: 225997 - DNA, 25 bp, Mus musculus
ataaggcggtgacatggcgcactct

SEQ ID NO: 225998 - DNA, 25 bp, Mus musculus
ataaggcggtgagatggcgcactct

SEQ ID NO: 225999 - DNA, 25 bp, Mus musculus
ataaggcgtatcaccggaggatcaa

SEQ ID NO: 226000 - DNA, 25 bp, Mus musculus
ataaggcgtatctccggaggatcaa

SEQ ID NO: 226001 - DNA, 25 bp, Mus musculus
ataaggcgtcttccacagtgcctgg

SEQ ID NO: 226002 - DNA, 25 bp, Mus musculus
ataaggcgtcttgcacagtgcctgg

SEQ ID NO: 226003 - DNA, 25 bp, Mus musculus
ataaggctacatctggactctatca

SEQ ID NO: 226004 - DNA, 25 bp, Mus musculus
ataaggctacatgtggactctatca

SEQ ID NO: 226005 - DNA, 25 bp, Mus musculus
ataaggctcaggagggtcggcaaaa

SEQ ID NO: 226006 - DNA, 25 bp, Mus musculus
ataaggctcaggtgggtcggcaaaa

SEQ ID NO: 226007 - DNA, 25 bp, Mus musculus
ataaggctccagctttgtagcggtc

SEQ ID NO: 226008 - DNA, 25 bp, Mus musculus
ataaggctccaggtttgtagcggtc

SEQ ID NO: 226009 - DNA, 25 bp, Mus musculus
ataaggctcttaaactcctccgacc

SEQ ID NO: 226010 - DNA, 25 bp, Mus musculus
ataaggctcttatactcctccgacc

SEQ ID NO: 226011 - DNA, 25 bp, Mus musculus
ataaggctcttcacattaaacattt

SEQ ID NO: 226012 - DNA, 25 bp, Mus musculus
ataaggctcttctcattaaacattt

SEQ ID NO: 226013 - DNA, 25 bp, Mus musculus
ataaggcttctactaccacaccaaa

SEQ ID NO: 226014 - DNA, 25 bp, Mus musculus
ataaggcttctagtaccacaccaaa

SEQ ID NO: 226015 - DNA, 25 bp, Mus musculus
ataaggcttgaccaagacaggctgc

SEQ ID NO: 226016 - DNA, 25 bp, Mus musculus
ataaggcttgacgaagacaggctgc

SEQ ID NO: 226017 - DNA, 25 bp, Mus musculus
ataaggcttgcacctagggtctctt

SEQ ID NO: 226018 - DNA, 25 bp, Mus musculus
ataaggcttgcagctagggtctctt

SEQ ID NO: 226019 - DNA, 25 bp, Mus musculus
ataaggctttctaccattgattaaa

SEQ ID NO: 226020 - DNA, 25 bp, Mus musculus
ataaggctttcttccattgattaaa

SEQ ID NO: 226021 - DNA, 25 bp, Mus musculus
ataagggaacagacccgcttctgga

SEQ ID NO: 226022 - DNA, 25 bp, Mus musculus
ataagggaacagtcccgcttctgga

SEQ ID NO: 226023 - DNA, 25 bp, Mus musculus
ataagggaatccaccgtgacttctc

SEQ ID NO: 226024 - DNA, 25 bp, Mus musculus
ataagggaatcctccgtgacttctc

SEQ ID NO: 226025 - DNA, 25 bp, Mus musculus
ataagggacctacctcttctggatg

SEQ ID NO: 226026 - DNA, 25 bp, Mus musculus
ataagggacctagctcttctggatg

SEQ ID NO: 226027 - DNA, 25 bp, Mus musculus
ataagggacgccaccaagtcagatt

SEQ ID NO: 226028 - DNA, 25 bp, Mus musculus
ataagggacgcctccaagtcagatt

SEQ ID NO: 226029 - DNA, 25 bp, Mus musculus
ataagggatacgctccacactatcc

SEQ ID NO: 226030 - DNA, 25 bp, Mus musculus
ataagggatacggtccacactatcc

SEQ ID NO: 226031 - DNA, 25 bp, Mus musculus
ataagggcacaaagctgactagcag

SEQ ID NO: 226032 - DNA, 25 bp, Mus musculus
ataagggcacaatgctgactagcag

SEQ ID NO: 226033 - DNA, 25 bp, Mus musculus
ataagggcagccaggtacccttctt

SEQ ID NO: 226034 - DNA, 25 bp, Mus musculus
ataagggcagcctggtacccttctt

SEQ ID NO: 226035 - DNA, 25 bp, Mus musculus
ataagggcagctcctagttgatata

SEQ ID NO: 226036 - DNA, 25 bp, Mus musculus
ataagggcagctgctagttgatata

SEQ ID NO: 226037 - DNA, 25 bp, Mus musculus
ataagggcctgacagcctgaagcca

SEQ ID NO: 226038 - DNA, 25 bp, Mus musculus
ataagggcctgagagcctgaagcca

SEQ ID NO: 226039 - DNA, 25 bp, Mus musculus
ataagggccttcaagtgtgagcact

SEQ ID NO: 226040 - DNA, 25 bp, Mus musculus
ataagggccttctagtgtgagcact

SEQ ID NO: 226041 - DNA, 25 bp, Mus musculus
ataagggctcctcagagatctttct

SEQ ID NO: 226042 - DNA, 25 bp, Mus musculus
ataagggctcctgagagatctttct

SEQ ID NO: 226043 - DNA, 25 bp, Mus musculus
ataagggctgccagcagtaccggct

SEQ ID NO: 226044 - DNA, 25 bp, Mus musculus
ataagggctgcctgcagtaccggct

SEQ ID NO: 226045 - DNA, 25 bp, Mus musculus
ataaggggacctatgagtatgcact

SEQ ID NO: 226046 - DNA, 25 bp, Mus musculus
ataaggggacctttgagtatgcact

SEQ ID NO: 226047 - DNA, 25 bp, Mus musculus
ataagggtacacagatggcatctat

SEQ ID NO: 226048 - DNA, 25 bp, Mus musculus
ataagggtacactgatggcatctat

SEQ ID NO: 226049 - DNA, 25 bp, Mus musculus
ataagggtagcgagttctctctgcc

SEQ ID NO: 226050 - DNA, 25 bp, Mus musculus
ataagggtagcgtgttctctctgcc

SEQ ID NO: 226051 - DNA, 25 bp, Mus musculus
ataagggtctctaagtgctccgtgc

SEQ ID NO: 226052 - DNA, 25 bp, Mus musculus
ataagggtctcttagtgctccgtgc

SEQ ID NO: 226053 - DNA, 25 bp, Mus musculus
ataaggtaactgcactcgcttccaa

SEQ ID NO: 226054 - DNA, 25 bp, Mus musculus
ataaggtaactggactcgcttccaa

SEQ ID NO: 226055 - DNA, 25 bp, Mus musculus
ataaggtacacaacttgcccttcag

SEQ ID NO: 226056 - DNA, 25 bp, Mus musculus
ataaggtacacatcttgcccttcag

SEQ ID NO: 226057 - DNA, 25 bp, Mus musculus
ataaggtagaggagcttccctccca

SEQ ID NO: 226058 - DNA, 25 bp, Mus musculus
ataaggtagaggtgcttccctccca

SEQ ID NO: 226059 - DNA, 25 bp, Mus musculus
ataaggtattgcagccttgccgtta

SEQ ID NO: 226060 - DNA, 25 bp, Mus musculus
ataaggtattgctgccttgccgtta

SEQ ID NO: 226061 - DNA, 25 bp, Mus musculus
ataaggtcacacagccaaggcagcc

SEQ ID NO: 226062 - DNA, 25 bp, Mus musculus
ataaggtcacactgccaaggcagcc

SEQ ID NO: 226063 - DNA, 25 bp, Mus musculus
ataaggtcactgatgggagcatcga

SEQ ID NO: 226064 - DNA, 25 bp, Mus musculus
ataaggtcactgttgggagcatcga

SEQ ID NO: 226065 - DNA, 25 bp, Mus musculus
ataaggtcacttcggccacaggcaa

SEQ ID NO: 226066 - DNA, 25 bp, Mus musculus
ataaggtcacttgggccacaggcaa

SEQ ID NO: 226067 - DNA, 25 bp, Mus musculus
ataaggtccaggctggtccttactc

SEQ ID NO: 226068 - DNA, 25 bp, Mus musculus
ataaggtccagggtggtccttactc

SEQ ID NO: 226069 - DNA, 25 bp, Mus musculus
ataaggtccattaaaggctgcagtt

SEQ ID NO: 226070 - DNA, 25 bp, Mus musculus
ataaggtccattaatagagctctct

SEQ ID NO: 226071 - DNA, 25 bp, Mus musculus
ataaggtccatttaaggctgcagtt

SEQ ID NO: 226072 - DNA, 25 bp, Mus musculus
ataaggtccatttatagagctctct

SEQ ID NO: 226073 - DNA, 25 bp, Mus musculus
ataaggtcctttagtgattctctgc

SEQ ID NO: 226074 - DNA, 25 bp, Mus musculus
ataaggtccttttgtgattctctgc

SEQ ID NO: 226075 - DNA, 25 bp, Mus musculus
ataaggtcgagcagggcttggattt

SEQ ID NO: 226076 - DNA, 25 bp, Mus musculus
ataaggtcgagctgggcttggattt

SEQ ID NO: 226077 - DNA, 25 bp, Mus musculus
ataaggtcgattactcaattagcaa

SEQ ID NO: 226078 - DNA, 25 bp, Mus musculus
ataaggtcgatttctcaattagcaa

SEQ ID NO: 226079 - DNA, 25 bp, Mus musculus
ataaggtctacaactttccctagga

SEQ ID NO: 226080 - DNA, 25 bp, Mus musculus
ataaggtctacatctttccctagga

SEQ ID NO: 226081 - DNA, 25 bp, Mus musculus
ataaggtctgaaagccaggctagat

SEQ ID NO: 226082 - DNA, 25 bp, Mus musculus
ataaggtctgaatgccaggctagat

SEQ ID NO: 226083 - DNA, 25 bp, Mus musculus
ataaggtgactaagcccctcagagg

SEQ ID NO: 226084 - DNA, 25 bp, Mus musculus
ataaggtgactatgcccctcagagg

SEQ ID NO: 226085 - DNA, 25 bp, Mus musculus
ataaggtgcatgacctgttcaccct

SEQ ID NO: 226086 - DNA, 25 bp, Mus musculus
ataaggtgcatgtcctgttcaccct

SEQ ID NO: 226087 - DNA, 25 bp, Mus musculus
ataaggtgccacagctcctacaagc

SEQ ID NO: 226088 - DNA, 25 bp, Mus musculus
ataaggtgccactgctcctacaagc

SEQ ID NO: 226089 - DNA, 25 bp, Mus musculus
ataaggtgccatcctggtcatagcc

SEQ ID NO: 226090 - DNA, 25 bp, Mus musculus
ataaggtgccatgctggtcatagcc

SEQ ID NO: 226091 - DNA, 25 bp, Mus musculus
ataaggtgtgtgactgcggctgctc

SEQ ID NO: 226092 - DNA, 25 bp, Mus musculus
ataaggtgtgtgtctgcggctgctc

SEQ ID NO: 226093 - DNA, 25 bp, Mus musculus
ataaggttactcagatttctttctt

SEQ ID NO: 226094 - DNA, 25 bp, Mus musculus
ataaggttactctgatttctttctt

SEQ ID NO: 226095 - DNA, 25 bp, Mus musculus
ataaggttccacctggctgatccat

SEQ ID NO: 226096 - DNA, 25 bp, Mus musculus
ataaggttccacgtggctgatccat

SEQ ID NO: 226097 - DNA, 25 bp, Mus musculus
ataaggttccatatacctcacactc

SEQ ID NO: 226098 - DNA, 25 bp, Mus musculus
ataaggttccatttacctcacactc

SEQ ID NO: 226099 - DNA, 25 bp, Mus musculus
ataaggttcctcagttaaggcgcct

SEQ ID NO: 226100 - DNA, 25 bp, Mus musculus
ataaggttcctctgttaaggcgcct

SEQ ID NO: 226101 - DNA, 25 bp, Mus musculus
ataaggttggtcagagcctccatgt

SEQ ID NO: 226102 - DNA, 25 bp, Mus musculus
ataaggttggtctgagcctccatgt

SEQ ID NO: 226103 - DNA, 25 bp, Mus musculus
ataagtaagcacactgtccatctct

SEQ ID NO: 226104 - DNA, 25 bp, Mus musculus
ataagtaagcactctgtccatctct

SEQ ID NO: 226105 - DNA, 25 bp, Mus musculus
ataagtaattttcgagggactacat

SEQ ID NO: 226106 - DNA, 25 bp, Mus musculus
ataagtaattttggagggactacat

SEQ ID NO: 226107 - DNA, 25 bp, Mus musculus
ataagtacgcagcttgccgtggccc

SEQ ID NO: 226108 - DNA, 25 bp, Mus musculus
ataagtacgcaggttgccgtggccc

SEQ ID NO: 226109 - DNA, 25 bp, Mus musculus
ataagtacggctcttccaaggtgag

SEQ ID NO: 226110 - DNA, 25 bp, Mus musculus
ataagtacggctgttccaaggtgag

SEQ ID NO: 226111 - DNA, 25 bp, Mus musculus
ataagtagggtcacccaggtcacac

SEQ ID NO: 226112 - DNA, 25 bp, Mus musculus
ataagtagggtctcccaggtcacac

SEQ ID NO: 226113 - DNA, 25 bp, Mus musculus
ataagtaggtttccaattggctatt

SEQ ID NO: 226114 - DNA, 25 bp, Mus musculus
ataagtaggtttgcaattggctatt

SEQ ID NO: 226115 - DNA, 25 bp, Mus musculus
ataagtagtttaagtcctcctttgt

SEQ ID NO: 226116 - DNA, 25 bp, Mus musculus
ataagtagtttatgtcctcctttgt

SEQ ID NO: 226117 - DNA, 25 bp, Mus musculus
ataagtatatacctggtgctggacc

SEQ ID NO: 226118 - DNA, 25 bp, Mus musculus
ataagtatatacgtggtgctggacc

SEQ ID NO: 226119 - DNA, 25 bp, Mus musculus
ataagtatcaccaccaagcaccggg

SEQ ID NO: 226120 - DNA, 25 bp, Mus musculus
ataagtatcacctccaagcaccggg

SEQ ID NO: 226121 - DNA, 25 bp, Mus musculus
ataagtatcgctccgtggtgaagcc

SEQ ID NO: 226122 - DNA, 25 bp, Mus musculus
ataagtatcgctgcgtggtgaagcc

SEQ ID NO: 226123 - DNA, 25 bp, Mus musculus
ataagtatctcactggtaaggctgt

SEQ ID NO: 226124 - DNA, 25 bp, Mus musculus
ataagtatctcagtggtaaggctgt

SEQ ID NO: 226125 - DNA, 25 bp, Mus musculus
ataagtatcttactctgttcctcct

SEQ ID NO: 226126 - DNA, 25 bp, Mus musculus
ataagtatcttagtctgttcctcct

SEQ ID NO: 226127 - DNA, 25 bp, Mus musculus
ataagtatgtgcacccatacccaac

SEQ ID NO: 226128 - DNA, 25 bp, Mus musculus
ataagtatgtgctcccatacccaac

SEQ ID NO: 226129 - DNA, 25 bp, Mus musculus
ataagtcaaaagaaaatggctcctt

SEQ ID NO: 226130 - DNA, 25 bp, Mus musculus
ataagtcaaaagtaaatggctcctt

SEQ ID NO: 226131 - DNA, 25 bp, Mus musculus
ataagtcaatttcctcctggtgaga

SEQ ID NO: 226132 - DNA, 25 bp, Mus musculus
ataagtcaatttgctcctggtgaga

SEQ ID NO: 226133 - DNA, 25 bp, Mus musculus
ataagtcagcatccaagttttgaaa

SEQ ID NO: 226134 - DNA, 25 bp, Mus musculus
ataagtcagcatgcaagttttgaaa

SEQ ID NO: 226135 - DNA, 25 bp, Mus musculus
ataagtcagcgcagtttccgtggca

SEQ ID NO: 226136 - DNA, 25 bp, Mus musculus
ataagtcagcgctgtttccgtggca

SEQ ID NO: 226137 - DNA, 25 bp, Mus musculus
ataagtccatggacagctggtccgc

SEQ ID NO: 226138 - DNA, 25 bp, Mus musculus
ataagtccatggtcagctggtccgc

SEQ ID NO: 226139 - DNA, 25 bp, Mus musculus
ataagtccctacacgcggatgaaga

SEQ ID NO: 226140 - DNA, 25 bp, Mus musculus
ataagtccctactcgcggatgaaga

SEQ ID NO: 226141 - DNA, 25 bp, Mus musculus
ataagtcctcatcttgtgtagcctg

SEQ ID NO: 226142 - DNA, 25 bp, Mus musculus
ataagtcctcatgttgtgtagcctg

SEQ ID NO: 226143 - DNA, 25 bp, Mus musculus
ataagtctcagtaattccagaggct

SEQ ID NO: 226144 - DNA, 25 bp, Mus musculus
ataagtctcagttattccagaggct

SEQ ID NO: 226145 - DNA, 25 bp, Mus musculus
ataagtctcccaactactgcgtgga

SEQ ID NO: 226146 - DNA, 25 bp, Mus musculus
ataagtctcccatctactgcgtgga

SEQ ID NO: 226147 - DNA, 25 bp, Mus musculus
ataagtctcttcacattttgtcctc

SEQ ID NO: 226148 - DNA, 25 bp, Mus musculus
ataagtctcttctcattttgtcctc

SEQ ID NO: 226149 - DNA, 25 bp, Mus musculus
ataagtctcttgcacttcaggagca

SEQ ID NO: 226150 - DNA, 25 bp, Mus musculus
ataagtctcttggacttcaggagca

SEQ ID NO: 226151 - DNA, 25 bp, Mus musculus
ataagtctgctacatacaagtcctg

SEQ ID NO: 226152 - DNA, 25 bp, Mus musculus
ataagtctgctagatacaagtcctg

SEQ ID NO: 226153 - DNA, 25 bp, Mus musculus
ataagtctggtaagatccctcttcc

SEQ ID NO: 226154 - DNA, 25 bp, Mus musculus
ataagtctggtatgatccctcttcc

SEQ ID NO: 226155 - DNA, 25 bp, Mus musculus
ataagtctggtcacagcgctgagtt

SEQ ID NO: 226156 - DNA, 25 bp, Mus musculus
ataagtctggtctcagcgctgagtt

SEQ ID NO: 226157 - DNA, 25 bp, Mus musculus
ataagtcttgacaagctagctcatg

SEQ ID NO: 226158 - DNA, 25 bp, Mus musculus
ataagtcttgactagctagctcatg

SEQ ID NO: 226159 - DNA, 25 bp, Mus musculus
ataagtcttgggactcctatttcct

SEQ ID NO: 226160 - DNA, 25 bp, Mus musculus
ataagtcttgggtctcctatttcct

SEQ ID NO: 226161 - DNA, 25 bp, Mus musculus
ataagtctttcacacgtgccttcct

SEQ ID NO: 226162 - DNA, 25 bp, Mus musculus
ataagtctttcagacgtgccttcct

SEQ ID NO: 226163 - DNA, 25 bp, Mus musculus
ataagtcttttgagtcctagtggcc

SEQ ID NO: 226164 - DNA, 25 bp, Mus musculus
ataagtcttttgtgtcctagtggcc

SEQ ID NO: 226165 - DNA, 25 bp, Mus musculus
ataagtgaaagacacagtagccatt

SEQ ID NO: 226166 - DNA, 25 bp, Mus musculus
ataagtgaaagagacagtagccatt

SEQ ID NO: 226167 - DNA, 25 bp, Mus musculus
ataagtgacttaccgtcctcctgga

SEQ ID NO: 226168 - DNA, 25 bp, Mus musculus
ataagtgacttagcgtcctcctgga

SEQ ID NO: 226169 - DNA, 25 bp, Mus musculus
ataagtgagtgacatttcataccct

SEQ ID NO: 226170 - DNA, 25 bp, Mus musculus
ataagtgagtgagatttcataccct

SEQ ID NO: 226171 - DNA, 25 bp, Mus musculus
ataagtgatcctcagccctgattgc

SEQ ID NO: 226172 - DNA, 25 bp, Mus musculus
ataagtgatcctgagccctgattgc

SEQ ID NO: 226173 - DNA, 25 bp, Mus musculus
ataagtgcaactcttatatcagatt

SEQ ID NO: 226174 - DNA, 25 bp, Mus musculus
ataagtgcaactgttatatcagatt

SEQ ID NO: 226175 - DNA, 25 bp, Mus musculus
ataagtgcacctcacacaccagcgt

SEQ ID NO: 226176 - DNA, 25 bp, Mus musculus
ataagtgcacctgacacaccagcgt

SEQ ID NO: 226177 - DNA, 25 bp, Mus musculus
ataagtgcactgaacagaacttttg

SEQ ID NO: 226178 - DNA, 25 bp, Mus musculus
ataagtgcactgtacagaacttttg

SEQ ID NO: 226179 - DNA, 25 bp, Mus musculus
ataagtgccataccgacccagctgg

SEQ ID NO: 226180 - DNA, 25 bp, Mus musculus
ataagtgccatagcgacccagctgg

SEQ ID NO: 226181 - DNA, 25 bp, Mus musculus
ataagtgctaccacggcaaaaccgg

SEQ ID NO: 226182 - DNA, 25 bp, Mus musculus
ataagtgctacccagctactcaaaa

SEQ ID NO: 226183 - DNA, 25 bp, Mus musculus
ataagtgctaccgagctactcaaaa

SEQ ID NO: 226184 - DNA, 25 bp, Mus musculus
ataagtgctacctcggcaaaaccgg

SEQ ID NO: 226185 - DNA, 25 bp, Mus musculus
ataagtgctacgattcggctataaa

SEQ ID NO: 226186 - DNA, 25 bp, Mus musculus
ataagtgctacgtttcggctataaa

SEQ ID NO: 226187 - DNA, 25 bp, Mus musculus
ataagtgctcccatctataatgctg

SEQ ID NO: 226188 - DNA, 25 bp, Mus musculus
ataagtgctcccttctataatgctg

SEQ ID NO: 226189 - DNA, 25 bp, Mus musculus
ataagtgctctgaggtggtggcaaa

SEQ ID NO: 226190 - DNA, 25 bp, Mus musculus
ataagtgctctgtggtggtggcaaa

SEQ ID NO: 226191 - DNA, 25 bp, Mus musculus
ataagtgctgctaacatcactcaac

SEQ ID NO: 226192 - DNA, 25 bp, Mus musculus
ataagtgctgcttacatcactcaac

SEQ ID NO: 226193 - DNA, 25 bp, Mus musculus
ataagtgcttgtactgctcgtggct

SEQ ID NO: 226194 - DNA, 25 bp, Mus musculus
ataagtgcttgttctgctcgtggct

SEQ ID NO: 226195 - DNA, 25 bp, Mus musculus
ataagtggacagctttccccatagg

SEQ ID NO: 226196 - DNA, 25 bp, Mus musculus
ataagtggacaggtttccccatagg

SEQ ID NO: 226197 - DNA, 25 bp, Mus musculus
ataagtgggtgacggttcagcctat

SEQ ID NO: 226198 - DNA, 25 bp, Mus musculus
ataagtgggtgagggttcagcctat

SEQ ID NO: 226199 - DNA, 25 bp, Mus musculus
ataagtggtcatactttgatttctt

SEQ ID NO: 226200 - DNA, 25 bp, Mus musculus
ataagtggtcattctttgatttctt

SEQ ID NO: 226201 - DNA, 25 bp, Mus musculus
ataagtggttcacatacccaaccct

SEQ ID NO: 226202 - DNA, 25 bp, Mus musculus
ataagtggttcagatacccaaccct

SEQ ID NO: 226203 - DNA, 25 bp, Mus musculus
ataagtgtaaccacggcaaaacaga

SEQ ID NO: 226204 - DNA, 25 bp, Mus musculus
ataagtgtaacctcggcaaaacaga

SEQ ID NO: 226205 - DNA, 25 bp, Mus musculus
ataagtgtataaacaagtgtgttct

SEQ ID NO: 226206 - DNA, 25 bp, Mus musculus
ataagtgtataatcaagtgtgttct

SEQ ID NO: 226207 - DNA, 25 bp, Mus musculus
ataagtgtattcagttggtaacaac

SEQ ID NO: 226208 - DNA, 25 bp, Mus musculus
ataagtgtattctgttggtaacaac

SEQ ID NO: 226209 - DNA, 25 bp, Mus musculus
ataagtgtccccacttagatgctat

SEQ ID NO: 226210 - DNA, 25 bp, Mus musculus
ataagtgtcccctcttagatgctat

SEQ ID NO: 226211 - DNA, 25 bp, Mus musculus
ataagtgtgcatccagaccagagac

SEQ ID NO: 226212 - DNA, 25 bp, Mus musculus
ataagtgtgcatgcagaccagagac

SEQ ID NO: 226213 - DNA, 25 bp, Mus musculus
ataagtgtgcctcgccccatctctt

SEQ ID NO: 226214 - DNA, 25 bp, Mus musculus
ataagtgtgcctggccccatctctt

SEQ ID NO: 226215 - DNA, 25 bp, Mus musculus
ataagtgtggtcaggctgtcattgt

SEQ ID NO: 226216 - DNA, 25 bp, Mus musculus
ataagtgtggtctggctgtcattgt

SEQ ID NO: 226217 - DNA, 25 bp, Mus musculus
ataagtgtgtacaccggtgctggcc

SEQ ID NO: 226218 - DNA, 25 bp, Mus musculus
ataagtgtgtactccggtgctggcc

SEQ ID NO: 226219 - DNA, 25 bp, Mus musculus
ataagtgttggtatacagcttttag

SEQ ID NO: 226220 - DNA, 25 bp, Mus musculus
ataagtgttggtttacagcttttag

SEQ ID NO: 226221 - DNA, 25 bp, Mus musculus
ataagtgttgtcctatgccactcga

SEQ ID NO: 226222 - DNA, 25 bp, Mus musculus
ataagtgttgtcgtatgccactcga

SEQ ID NO: 226223 - DNA, 25 bp, Mus musculus
ataagttaacctagttctcagagag

SEQ ID NO: 226224 - DNA, 25 bp, Mus musculus
ataagttaaccttgttctcagagag

SEQ ID NO: 226225 - DNA, 25 bp, Mus musculus
ataagttaccagcaaattactgcaa

SEQ ID NO: 226226 - DNA, 25 bp, Mus musculus
ataagttaccaggaaattactgcaa

SEQ ID NO: 226227 - DNA, 25 bp, Mus musculus
ataagttagataatctcctgcggtg

SEQ ID NO: 226228 - DNA, 25 bp, Mus musculus
ataagttagatattctcctgcggtg

SEQ ID NO: 226229 - DNA, 25 bp, Mus musculus
ataagttattctatcatgtatacag

SEQ ID NO: 226230 - DNA, 25 bp, Mus musculus
ataagttattctttcatgtatacag

SEQ ID NO: 226231 - DNA, 25 bp, Mus musculus
ataagttcacaacccaagtccctgg

SEQ ID NO: 226232 - DNA, 25 bp, Mus musculus
ataagttcacaagccaagtccctgg

SEQ ID NO: 226233 - DNA, 25 bp, Mus musculus
ataagttcatctccagccttagttt

SEQ ID NO: 226234 - DNA, 25 bp, Mus musculus
ataagttcatctgcagccttagttt

SEQ ID NO: 226235 - DNA, 25 bp, Mus musculus
ataagttccaggagtatgagctccg

SEQ ID NO: 226236 - DNA, 25 bp, Mus musculus
ataagttccaggtgtatgagctccg

SEQ ID NO: 226237 - DNA, 25 bp, Mus musculus
ataagttccgcgagctcgtgagttt

SEQ ID NO: 226238 - DNA, 25 bp, Mus musculus
ataagttccgcgtgctcgtgagttt

SEQ ID NO: 226239 - DNA, 25 bp, Mus musculus
ataagttcgtcaagcggctgcagtc

SEQ ID NO: 226240 - DNA, 25 bp, Mus musculus
ataagttcgtcatgcggctgcagtc

SEQ ID NO: 226241 - DNA, 25 bp, Mus musculus
ataagttcttcacctgccttactag

SEQ ID NO: 226242 - DNA, 25 bp, Mus musculus
ataagttcttcagctgccttactag

SEQ ID NO: 226243 - DNA, 25 bp, Mus musculus
ataagttctttcatagatctgcata

SEQ ID NO: 226244 - DNA, 25 bp, Mus musculus
ataagttctttcttagatctgcata

SEQ ID NO: 226245 - DNA, 25 bp, Mus musculus
ataagttgagtgagatggcgcatgt

SEQ ID NO: 226246 - DNA, 25 bp, Mus musculus
ataagttgagtgtgatggcgcatgt

SEQ ID NO: 226247 - DNA, 25 bp, Mus musculus
ataagttggctgagggcttgtttgt

SEQ ID NO: 226248 - DNA, 25 bp, Mus musculus
ataagttggctgtgggcttgtttgt

SEQ ID NO: 226249 - DNA, 25 bp, Mus musculus
ataagtttaagaaagcactcagaaa

SEQ ID NO: 226250 - DNA, 25 bp, Mus musculus
ataagtttaagatagcactcagaaa

SEQ ID NO: 226251 - DNA, 25 bp, Mus musculus
ataagtttaagtacctgattgagat

SEQ ID NO: 226252 - DNA, 25 bp, Mus musculus
ataagtttaagttcctgattgagat

SEQ ID NO: 226253 - DNA, 25 bp, Mus musculus
ataagtttaatcaactggttctgct

SEQ ID NO: 226254 - DNA, 25 bp, Mus musculus
ataagtttaatctactggttctgct

SEQ ID NO: 226255 - DNA, 25 bp, Mus musculus
ataagtttaggccagatatggagga

SEQ ID NO: 226256 - DNA, 25 bp, Mus musculus
ataagtttaggcgagatatggagga

SEQ ID NO: 226257 - DNA, 25 bp, Mus musculus
ataagtttccctatgttgcttcaga

SEQ ID NO: 226258 - DNA, 25 bp, Mus musculus
ataagtttccctttgttgcttcaga

SEQ ID NO: 226259 - DNA, 25 bp, Mus musculus
ataagtttctgtagacggcatgtgg

SEQ ID NO: 226260 - DNA, 25 bp, Mus musculus
ataagtttctgttgacggcatgtgg

SEQ ID NO: 226261 - DNA, 25 bp, Mus musculus
ataagtttgatcagcaccttgcttc

SEQ ID NO: 226262 - DNA, 25 bp, Mus musculus
ataagtttgatctgcaccttgcttc

SEQ ID NO: 226263 - DNA, 25 bp, Mus musculus
ataagtttggatataggtggcgaat

SEQ ID NO: 226264 - DNA, 25 bp, Mus musculus
ataagtttggatttaggtggcgaat

SEQ ID NO: 226265 - DNA, 25 bp, Mus musculus
ataagtttgtatccttctatgtgta

SEQ ID NO: 226266 - DNA, 25 bp, Mus musculus
ataagtttgtatgcttctatgtgta

SEQ ID NO: 226267 - DNA, 25 bp, Mus musculus
ataagtttgtgtatccccagttcca

SEQ ID NO: 226268 - DNA, 25 bp, Mus musculus
ataagtttgtgtttccccagttcca

SEQ ID NO: 226269 - DNA, 25 bp, Mus musculus
ataagtttgttacgacctgatgcaa

SEQ ID NO: 226270 - DNA, 25 bp, Mus musculus
ataagtttgttaggacctgatgcaa

SEQ ID NO: 226271 - DNA, 25 bp, Mus musculus
ataagttttcacatttgggtcgcaa

SEQ ID NO: 226272 - DNA, 25 bp, Mus musculus
ataagttttcacttttgggtcgcaa

SEQ ID NO: 226273 - DNA, 25 bp, Mus musculus
ataagttttctacctatgccagtaa

SEQ ID NO: 226274 - DNA, 25 bp, Mus musculus
ataagttttctagctatgccagtaa

SEQ ID NO: 226275 - DNA, 25 bp, Mus musculus
ataagttttctcctctgtcaggtgg

SEQ ID NO: 226276 - DNA, 25 bp, Mus musculus
ataagttttctcgtctgtcaggtgg

SEQ ID NO: 226277 - DNA, 25 bp, Mus musculus
ataagttttcttcataacccatttg

SEQ ID NO: 226278 - DNA, 25 bp, Mus musculus
ataagttttcttgataacccatttg

SEQ ID NO: 226279 - DNA, 25 bp, Mus musculus
ataataaactcaactctctatccct

SEQ ID NO: 226280 - DNA, 25 bp, Mus musculus
ataataaactcatctctctatccct

SEQ ID NO: 226281 - DNA, 25 bp, Mus musculus
ataataaagcagagctgtgacatca

SEQ ID NO: 226282 - DNA, 25 bp, Mus musculus
ataataaagcagtgctgtgacatca

SEQ ID NO: 226283 - DNA, 25 bp, Mus musculus
ataataaagcccactgccgtggtgt

SEQ ID NO: 226284 - DNA, 25 bp, Mus musculus
ataataaagccctctgccgtggtgt

SEQ ID NO: 226285 - DNA, 25 bp, Mus musculus
ataataaattggctgtcccttcccg

SEQ ID NO: 226286 - DNA, 25 bp, Mus musculus
ataataaattgggtgtcccttcccg

SEQ ID NO: 226287 - DNA, 25 bp, Mus musculus
ataataaatttccaactgtgcattg

SEQ ID NO: 226288 - DNA, 25 bp, Mus musculus
ataataaatttcgaactgtgcattg

SEQ ID NO: 226289 - DNA, 25 bp, Mus musculus
ataataacttacaagcctctgaaac

SEQ ID NO: 226290 - DNA, 25 bp, Mus musculus
ataataacttactagcctctgaaac

SEQ ID NO: 226291 - DNA, 25 bp, Mus musculus
ataataatggcaactccccacttta

SEQ ID NO: 226292 - DNA, 25 bp, Mus musculus
ataataatggcatctccccacttta

SEQ ID NO: 226293 - DNA, 25 bp, Mus musculus
ataataattcctattccctggcctc

SEQ ID NO: 226294 - DNA, 25 bp, Mus musculus
ataataattccttttccctggcctc

SEQ ID NO: 226295 - DNA, 25 bp, Mus musculus
ataataattgctctttcactggctg

SEQ ID NO: 226296 - DNA, 25 bp, Mus musculus
ataataattgctgtttcactggctg

SEQ ID NO: 226297 - DNA, 25 bp, Mus musculus
ataatacaacacaggttcctttgtg

SEQ ID NO: 226298 - DNA, 25 bp, Mus musculus
ataatacaacactggttcctttgtg

SEQ ID NO: 226299 - DNA, 25 bp, Mus musculus
ataatacaactccttggacctcatc

SEQ ID NO: 226300 - DNA, 25 bp, Mus musculus
ataatacaactcgttggacctcatc

SEQ ID NO: 226301 - DNA, 25 bp, Mus musculus
ataatacaacttctgctctttcttt

SEQ ID NO: 226302 - DNA, 25 bp, Mus musculus
ataatacaacttgtgctctttcttt

SEQ ID NO: 226303 - DNA, 25 bp, Mus musculus
ataatacacttcatgcctaaatcca

SEQ ID NO: 226304 - DNA, 25 bp, Mus musculus
ataatacacttcttgcctaaatcca

SEQ ID NO: 226305 - DNA, 25 bp, Mus musculus
ataatacagaacactttttcatcaa

SEQ ID NO: 226306 - DNA, 25 bp, Mus musculus
ataatacagaactctttttcatcaa

SEQ ID NO: 226307 - DNA, 25 bp, Mus musculus
ataatacatcccaggcattggcaca

SEQ ID NO: 226308 - DNA, 25 bp, Mus musculus
ataatacatccctggcattggcaca

SEQ ID NO: 226309 - DNA, 25 bp, Mus musculus
ataatacatctcatgattctttttc

SEQ ID NO: 226310 - DNA, 25 bp, Mus musculus
ataatacatctcttgattctttttc

SEQ ID NO: 226311 - DNA, 25 bp, Mus musculus
ataatacattcccaaagttgccccg

SEQ ID NO: 226312 - DNA, 25 bp, Mus musculus
ataatacattccgaaagttgccccg

SEQ ID NO: 226313 - DNA, 25 bp, Mus musculus
ataatacattgcatcagcgctgcct

SEQ ID NO: 226314 - DNA, 25 bp, Mus musculus
ataatacattgcttcagcgctgcct

SEQ ID NO: 226315 - DNA, 25 bp, Mus musculus
ataatacatttccagctgcaccacc

SEQ ID NO: 226316 - DNA, 25 bp, Mus musculus
ataatacatttcgagctgcaccacc

SEQ ID NO: 226317 - DNA, 25 bp, Mus musculus
ataatacccattacatcctctggag

SEQ ID NO: 226318 - DNA, 25 bp, Mus musculus
ataatacccatttcatcctctggag

SEQ ID NO: 226319 - DNA, 25 bp, Mus musculus
ataataccctgcagtcctttacagg

SEQ ID NO: 226320 - DNA, 25 bp, Mus musculus
ataataccctgctgtcctttacagg

SEQ ID NO: 226321 - DNA, 25 bp, Mus musculus
ataatacctcttaatttcctctatt

SEQ ID NO: 226322 - DNA, 25 bp, Mus musculus
ataatacctctttatttcctctatt

SEQ ID NO: 226323 - DNA, 25 bp, Mus musculus
ataatacgaagaactcccagccaca

SEQ ID NO: 226324 - DNA, 25 bp, Mus musculus
ataatacgaagatctcccagccaca

SEQ ID NO: 226325 - DNA, 25 bp, Mus musculus
ataatacgtgcaagcaaccactgcc

SEQ ID NO: 226326 - DNA, 25 bp, Mus musculus
ataatacgtgcatgcaaccactgcc

SEQ ID NO: 226327 - DNA, 25 bp, Mus musculus
ataatactacctcagggtctctgcc

SEQ ID NO: 226328 - DNA, 25 bp, Mus musculus
ataatactacctgagggtctctgcc

SEQ ID NO: 226329 - DNA, 25 bp, Mus musculus
ataatactatgtaacagccaactgt

SEQ ID NO: 226330 - DNA, 25 bp, Mus musculus
ataatactatgttacagccaactgt

SEQ ID NO: 226331 - DNA, 25 bp, Mus musculus
ataatactgcctaaacccgtgactt

SEQ ID NO: 226332 - DNA, 25 bp, Mus musculus
ataatactgccttaacccgtgactt

SEQ ID NO: 226333 - DNA, 25 bp, Mus musculus
ataatactgggtctcatcatgatct

SEQ ID NO: 226334 - DNA, 25 bp, Mus musculus
ataatactgggtgtcatcatgatct

SEQ ID NO: 226335 - DNA, 25 bp, Mus musculus
ataatagacccacccttcggctgga

SEQ ID NO: 226336 - DNA, 25 bp, Mus musculus
ataatagacccagccttcggctgga

SEQ ID NO: 226337 - DNA, 25 bp, Mus musculus
ataatagacccgacagacagacccc

SEQ ID NO: 226338 - DNA, 25 bp, Mus musculus
ataatagacccgtcagacagacccc

SEQ ID NO: 226339 - DNA, 25 bp, Mus musculus
ataatagacttcattctccttaaaa

SEQ ID NO: 226340 - DNA, 25 bp, Mus musculus
ataatagacttctttctccttaaaa

SEQ ID NO: 226341 - DNA, 25 bp, Mus musculus
ataatagatctcattcaggtttcag

SEQ ID NO: 226342 - DNA, 25 bp, Mus musculus
ataatagatctctttcaggtttcag

SEQ ID NO: 226343 - DNA, 25 bp, Mus musculus
ataatagcactgacggttccttttt

SEQ ID NO: 226344 - DNA, 25 bp, Mus musculus
ataatagcactgtcggttccttttt

SEQ ID NO: 226345 - DNA, 25 bp, Mus musculus
ataatagcagcacatcattacccct

SEQ ID NO: 226346 - DNA, 25 bp, Mus musculus
ataatagcagcagatcattacccct

SEQ ID NO: 226347 - DNA, 25 bp, Mus musculus
ataatagcagctcaaggttcagtga

SEQ ID NO: 226348 - DNA, 25 bp, Mus musculus
ataatagcagctgaaggttcagtga

SEQ ID NO: 226349 - DNA, 25 bp, Mus musculus
ataatagcagtcaagtccccagcag

SEQ ID NO: 226350 - DNA, 25 bp, Mus musculus
ataatagcagtctagtccccagcag

SEQ ID NO: 226351 - DNA, 25 bp, Mus musculus
ataataggacctaggaccccatctc

SEQ ID NO: 226352 - DNA, 25 bp, Mus musculus
ataataggaccttggaccccatctc

SEQ ID NO: 226353 - DNA, 25 bp, Mus musculus
ataataggttgaaagctaggtagct

SEQ ID NO: 226354 - DNA, 25 bp, Mus musculus
ataataggttgatagctaggtagct

SEQ ID NO: 226355 - DNA, 25 bp, Mus musculus
ataatagtatttaagccagacatgc

SEQ ID NO: 226356 - DNA, 25 bp, Mus musculus
ataatagtattttagccagacatgc

SEQ ID NO: 226357 - DNA, 25 bp, Mus musculus
ataatagtcattccttcaacccttg

SEQ ID NO: 226358 - DNA, 25 bp, Mus musculus
ataatagtcattgcttcaacccttg

SEQ ID NO: 226359 - DNA, 25 bp, Mus musculus
ataatagtcttgatccctctctcac

SEQ ID NO: 226360 - DNA, 25 bp, Mus musculus
ataatagtcttgttccctctctcac

SEQ ID NO: 226361 - DNA, 25 bp, Mus musculus
ataatagtgaacactccttgtattc

SEQ ID NO: 226362 - DNA, 25 bp, Mus musculus
ataatagtgaactctccttgtattc

SEQ ID NO: 226363 - DNA, 25 bp, Mus musculus
ataatagtgaagctgtgacttgcca

SEQ ID NO: 226364 - DNA, 25 bp, Mus musculus
ataatagtgaaggtgtgacttgcca

SEQ ID NO: 226365 - DNA, 25 bp, Mus musculus
ataatatacagaatttccttgcaaa

SEQ ID NO: 226366 - DNA, 25 bp, Mus musculus
ataatatacagattttccttgcaaa

SEQ ID NO: 226367 - DNA, 25 bp, Mus musculus
ataatatactttaccttcccataat

SEQ ID NO: 226368 - DNA, 25 bp, Mus musculus
ataatatacttttccttcccataat

SEQ ID NO: 226369 - DNA, 25 bp, Mus musculus
ataatatagtccaaacccagaattg

SEQ ID NO: 226370 - DNA, 25 bp, Mus musculus
ataatatagtcctaacccagaattg

SEQ ID NO: 226371 - DNA, 25 bp, Mus musculus
ataatatcccaacagctcggctgag

SEQ ID NO: 226372 - DNA, 25 bp, Mus musculus
ataatatcccaagagctcggctgag

SEQ ID NO: 226373 - DNA, 25 bp, Mus musculus
ataatatccctaatgattctttgga

SEQ ID NO: 226374 - DNA, 25 bp, Mus musculus
ataatatccctattgattctttgga

SEQ ID NO: 226375 - DNA, 25 bp, Mus musculus
ataatatgcaaccacttcttcaccc

SEQ ID NO: 226376 - DNA, 25 bp, Mus musculus
ataatatgcaacgacttcttcaccc

SEQ ID NO: 226377 - DNA, 25 bp, Mus musculus
ataatatgggccagagtccctgctt

SEQ ID NO: 226378 - DNA, 25 bp, Mus musculus
ataatatgggcctgagtccctgctt

SEQ ID NO: 226379 - DNA, 25 bp, Mus musculus
ataatatggtgtcctctgtgccagt

SEQ ID NO: 226380 - DNA, 25 bp, Mus musculus
ataatatggtgtgctctgtgccagt

SEQ ID NO: 226381 - DNA, 25 bp, Mus musculus
ataatatgtccaactgcctggtctc

SEQ ID NO: 226382 - DNA, 25 bp, Mus musculus
ataatatgtccatctgcctggtctc

SEQ ID NO: 226383 - DNA, 25 bp, Mus musculus
ataatatgttttccctggttgaatc

SEQ ID NO: 226384 - DNA, 25 bp, Mus musculus
ataatatgttttgcctggttgaatc

SEQ ID NO: 226385 - DNA, 25 bp, Mus musculus
ataatattaccacatgctgggtttc

SEQ ID NO: 226386 - DNA, 25 bp, Mus musculus
ataatattaccagatgctgggtttc

SEQ ID NO: 226387 - DNA, 25 bp, Mus musculus
ataatattattgcacctgctcccag

SEQ ID NO: 226388 - DNA, 25 bp, Mus musculus
ataatattattggacctgctcccag

SEQ ID NO: 226389 - DNA, 25 bp, Mus musculus
ataatattatttctcttactaatac

SEQ ID NO: 226390 - DNA, 25 bp, Mus musculus
ataatattatttgtcttactaatac

SEQ ID NO: 226391 - DNA, 25 bp, Mus musculus
ataatattccaccaaccaacattcc

SEQ ID NO: 226392 - DNA, 25 bp, Mus musculus
ataatattccacgaaccaacattcc

SEQ ID NO: 226393 - DNA, 25 bp, Mus musculus
ataatattcttgctgtttgtttata

SEQ ID NO: 226394 - DNA, 25 bp, Mus musculus
ataatattcttggtgtttgtttata

SEQ ID NO: 226395 - DNA, 25 bp, Mus musculus
ataatattggaaccctattatcaga

SEQ ID NO: 226396 - DNA, 25 bp, Mus musculus
ataatattggaagcctattatcaga

SEQ ID NO: 226397 - DNA, 25 bp, Mus musculus
ataatattgtatatcatctcaccac

SEQ ID NO: 226398 - DNA, 25 bp, Mus musculus
ataatattgtatttcatctcaccac

SEQ ID NO: 226399 - DNA, 25 bp, Mus musculus
ataatatttgctcccgaggacgctc

SEQ ID NO: 226400 - DNA, 25 bp, Mus musculus
ataatatttgctgccgaggacgctc

SEQ ID NO: 226401 - DNA, 25 bp, Mus musculus
ataatatttgttatctgctagacac

SEQ ID NO: 226402 - DNA, 25 bp, Mus musculus
ataatatttgttttctgctagacac

SEQ ID NO: 226403 - DNA, 25 bp, Mus musculus
ataatatttttgacacgcacctgct

SEQ ID NO: 226404 - DNA, 25 bp, Mus musculus
ataatatttttgtcacgcacctgct

SEQ ID NO: 226405 - DNA, 25 bp, Mus musculus
ataatcaaattgattctcccatttt

SEQ ID NO: 226406 - DNA, 25 bp, Mus musculus
ataatcaaattgtttctcccatttt

SEQ ID NO: 226407 - DNA, 25 bp, Mus musculus
ataatcaacaagagccagggcccta

SEQ ID NO: 226408 - DNA, 25 bp, Mus musculus
ataatcaacaagtgccagggcccta

SEQ ID NO: 226409 - DNA, 25 bp, Mus musculus
ataatcaactcaattgatgctcccc

SEQ ID NO: 226410 - DNA, 25 bp, Mus musculus
ataatcaactcatttgatgctcccc

SEQ ID NO: 226411 - DNA, 25 bp, Mus musculus
ataatcaagcctcaacaagactgtt

SEQ ID NO: 226412 - DNA, 25 bp, Mus musculus
ataatcaagcctgaacaagactgtt

SEQ ID NO: 226413 - DNA, 25 bp, Mus musculus
ataatcacagccattttttttcaag

SEQ ID NO: 226414 - DNA, 25 bp, Mus musculus
ataatcacagcctttttttttcaag

SEQ ID NO: 226415 - DNA, 25 bp, Mus musculus
ataatcacagctactgctctctaag

SEQ ID NO: 226416 - DNA, 25 bp, Mus musculus
ataatcacagctagctttataacta

SEQ ID NO: 226417 - DNA, 25 bp, Mus musculus
ataatcacagcttctgctctctaag

SEQ ID NO: 226418 - DNA, 25 bp, Mus musculus
ataatcacagcttgctttataacta

SEQ ID NO: 226419 - DNA, 25 bp, Mus musculus
ataatcaccactccctttttgtgtt

SEQ ID NO: 226420 - DNA, 25 bp, Mus musculus
ataatcaccactgcctttttgtgtt

SEQ ID NO: 226421 - DNA, 25 bp, Mus musculus
ataatcaccagcacacaaatacttg

SEQ ID NO: 226422 - DNA, 25 bp, Mus musculus
ataatcaccagctcacaaatacttg

SEQ ID NO: 226423 - DNA, 25 bp, Mus musculus
ataatcacttcacgccaatttgcaa

SEQ ID NO: 226424 - DNA, 25 bp, Mus musculus
ataatcacttcaggccaatttgcaa

SEQ ID NO: 226425 - DNA, 25 bp, Mus musculus
ataatcagactaattgccagccaag

SEQ ID NO: 226426 - DNA, 25 bp, Mus musculus
ataatcagactatttgccagccaag

SEQ ID NO: 226427 - DNA, 25 bp, Mus musculus
ataatcagagctcgctgttcagcca

SEQ ID NO: 226428 - DNA, 25 bp, Mus musculus
ataatcagagctggctgttcagcca

SEQ ID NO: 226429 - DNA, 25 bp, Mus musculus
ataatcagcctcaggacctgttaac

SEQ ID NO: 226430 - DNA, 25 bp, Mus musculus
ataatcagcctctggacctgttaac

SEQ ID NO: 226431 - DNA, 25 bp, Mus musculus
ataatcaggacacctagaatctttt

SEQ ID NO: 226432 - DNA, 25 bp, Mus musculus
ataatcaggacagctagaatctttt

SEQ ID NO: 226433 - DNA, 25 bp, Mus musculus
ataatcatagcacttggcaggctga

SEQ ID NO: 226434 - DNA, 25 bp, Mus musculus
ataatcatagcagttggcaggctga

SEQ ID NO: 226435 - DNA, 25 bp, Mus musculus
ataatcatctcacagtccagtttgc

SEQ ID NO: 226436 - DNA, 25 bp, Mus musculus
ataatcatctcagagtccagtttgc

SEQ ID NO: 226437 - DNA, 25 bp, Mus musculus
ataatcatggtaattccccttccag

SEQ ID NO: 226438 - DNA, 25 bp, Mus musculus
ataatcatggtatttccccttccag

SEQ ID NO: 226439 - DNA, 25 bp, Mus musculus
ataatcatggttctcctcaccttaa

SEQ ID NO: 226440 - DNA, 25 bp, Mus musculus
ataatcatggttgtcctcaccttaa

SEQ ID NO: 226441 - DNA, 25 bp, Mus musculus
ataatcattcgcctgcattggtttc

SEQ ID NO: 226442 - DNA, 25 bp, Mus musculus
ataatcattcgcgtgcattggtttc

SEQ ID NO: 226443 - DNA, 25 bp, Mus musculus
ataatcattctgatcatagatctgt

SEQ ID NO: 226444 - DNA, 25 bp, Mus musculus
ataatcattctgttcatagatctgt

SEQ ID NO: 226445 - DNA, 25 bp, Mus musculus
ataatccacaagagtcacctgcgac

SEQ ID NO: 226446 - DNA, 25 bp, Mus musculus
ataatccacaagtgtcacctgcgac

SEQ ID NO: 226447 - DNA, 25 bp, Mus musculus
ataatccagcgtcccttagaaataa

SEQ ID NO: 226448 - DNA, 25 bp, Mus musculus
ataatccagcgtgccttagaaataa

SEQ ID NO: 226449 - DNA, 25 bp, Mus musculus
ataatccaggacatggcaagccaga

SEQ ID NO: 226450 - DNA, 25 bp, Mus musculus
ataatccaggacttggcaagccaga

SEQ ID NO: 226451 - DNA, 25 bp, Mus musculus
ataatccatggcacctaaccagtgg

SEQ ID NO: 226452 - DNA, 25 bp, Mus musculus
ataatccatggctcctaaccagtgg

SEQ ID NO: 226453 - DNA, 25 bp, Mus musculus
ataatcccaagaacagtgctgtact

SEQ ID NO: 226454 - DNA, 25 bp, Mus musculus
ataatcccaagatcagtgctgtact

SEQ ID NO: 226455 - DNA, 25 bp, Mus musculus
ataatcccaagcagtatctccagtc

SEQ ID NO: 226456 - DNA, 25 bp, Mus musculus
ataatcccaagctgtatctccagtc

SEQ ID NO: 226457 - DNA, 25 bp, Mus musculus
ataatcccaataaacctaccttcat

SEQ ID NO: 226458 - DNA, 25 bp, Mus musculus
ataatcccaataaattgtgtacaaa

SEQ ID NO: 226459 - DNA, 25 bp, Mus musculus
ataatcccaatatacctaccttcat

SEQ ID NO: 226460 - DNA, 25 bp, Mus musculus
ataatcccaatatattgtgtacaaa

SEQ ID NO: 226461 - DNA, 25 bp, Mus musculus
ataatcccacagctctttccttgtt

SEQ ID NO: 226462 - DNA, 25 bp, Mus musculus
ataatcccacaggtctttccttgtt

SEQ ID NO: 226463 - DNA, 25 bp, Mus musculus
ataatcccagttatcggcagagggc

SEQ ID NO: 226464 - DNA, 25 bp, Mus musculus
ataatcccagttttcggcagagggc

SEQ ID NO: 226465 - DNA, 25 bp, Mus musculus
ataatccctcaaatactcaggacat

SEQ ID NO: 226466 - DNA, 25 bp, Mus musculus
ataatccctcaattactcaggacat

SEQ ID NO: 226467 - DNA, 25 bp, Mus musculus
ataatcccttgaactgaggctacaa

SEQ ID NO: 226468 - DNA, 25 bp, Mus musculus
ataatcccttgatctgaggctacaa

SEQ ID NO: 226469 - DNA, 25 bp, Mus musculus
ataatcccttttacacattgtgcca

SEQ ID NO: 226470 - DNA, 25 bp, Mus musculus
ataatccctttttcacattgtgcca

SEQ ID NO: 226471 - DNA, 25 bp, Mus musculus
ataatccgaatcaaccagtctctgg

SEQ ID NO: 226472 - DNA, 25 bp, Mus musculus
ataatccgaatctaccagtctctgg

SEQ ID NO: 226473 - DNA, 25 bp, Mus musculus
ataatccgctgtctgtaggttgctg

SEQ ID NO: 226474 - DNA, 25 bp, Mus musculus
ataatccgctgtgtgtaggttgctg

SEQ ID NO: 226475 - DNA, 25 bp, Mus musculus
ataatcctaacaagtactcaaccat

SEQ ID NO: 226476 - DNA, 25 bp, Mus musculus
ataatcctaacatgtactcaaccat

SEQ ID NO: 226477 - DNA, 25 bp, Mus musculus
ataatcctatacaacatgctacatg

SEQ ID NO: 226478 - DNA, 25 bp, Mus musculus
ataatcctatactacatgctacatg

SEQ ID NO: 226479 - DNA, 25 bp, Mus musculus
ataatcctcgaaaccaggagatcca

SEQ ID NO: 226480 - DNA, 25 bp, Mus musculus
ataatcctcgaatccaggagatcca

SEQ ID NO: 226481 - DNA, 25 bp, Mus musculus
ataatcctctctcagttctttggtc

SEQ ID NO: 226482 - DNA, 25 bp, Mus musculus
ataatcctctctgagttctttggtc

SEQ ID NO: 226483 - DNA, 25 bp, Mus musculus
ataatcctgcaaacacatctgacca

SEQ ID NO: 226484 - DNA, 25 bp, Mus musculus
ataatcctgcaatcacatctgacca

SEQ ID NO: 226485 - DNA, 25 bp, Mus musculus
ataatccttattcccatgagctatg

SEQ ID NO: 226486 - DNA, 25 bp, Mus musculus
ataatccttattgccatgagctatg

SEQ ID NO: 226487 - DNA, 25 bp, Mus musculus
ataatccttcctaggtgctctttaa

SEQ ID NO: 226488 - DNA, 25 bp, Mus musculus
ataatccttccttggtgctctttaa

SEQ ID NO: 226489 - DNA, 25 bp, Mus musculus
ataatcgaactccagccttgattgc

SEQ ID NO: 226490 - DNA, 25 bp, Mus musculus
ataatcgaactcgagccttgattgc

SEQ ID NO: 226491 - DNA, 25 bp, Mus musculus
ataatcgaccagcttagtccacttg

SEQ ID NO: 226492 - DNA, 25 bp, Mus musculus
ataatcgaccaggttagtccacttg

SEQ ID NO: 226493 - DNA, 25 bp, Mus musculus
ataatcgagcagcagatttcatgtt

SEQ ID NO: 226494 - DNA, 25 bp, Mus musculus
ataatcgagcaggagatttcatgtt

SEQ ID NO: 226495 - DNA, 25 bp, Mus musculus
ataatcgaggtaccagagctgcgtc

SEQ ID NO: 226496 - DNA, 25 bp, Mus musculus
ataatcgaggtagcagagctgcgtc

SEQ ID NO: 226497 - DNA, 25 bp, Mus musculus
ataatcgcatctagagggttcctca

SEQ ID NO: 226498 - DNA, 25 bp, Mus musculus
ataatcgcatcttgagggttcctca

SEQ ID NO: 226499 - DNA, 25 bp, Mus musculus
ataatcgctaggactcaacacaggg

SEQ ID NO: 226500 - DNA, 25 bp, Mus musculus
ataatcgctaggtctcaacacaggg

SEQ ID NO: 226501 - DNA, 25 bp, Mus musculus
ataatcgctgccagactcaaaatct

SEQ ID NO: 226502 - DNA, 25 bp, Mus musculus
ataatcgctgcctgactcaaaatct

SEQ ID NO: 226503 - DNA, 25 bp, Mus musculus
ataatcggcgtgctacaagcctaat

SEQ ID NO: 226504 - DNA, 25 bp, Mus musculus
ataatcggcgtggtacaagcctaat

SEQ ID NO: 226505 - DNA, 25 bp, Mus musculus
ataatcggtgtaacagaaatggaac

SEQ ID NO: 226506 - DNA, 25 bp, Mus musculus
ataatcggtgtatcagaaatggaac

SEQ ID NO: 226507 - DNA, 25 bp, Mus musculus
ataatcgtagcccttcatgttgcac

SEQ ID NO: 226508 - DNA, 25 bp, Mus musculus
ataatcgtagccgttcatgttgcac

SEQ ID NO: 226509 - DNA, 25 bp, Mus musculus
ataatcgttacaacaccaaaggaaa

SEQ ID NO: 226510 - DNA, 25 bp, Mus musculus
ataatcgttacatcaccaaaggaaa

SEQ ID NO: 226511 - DNA, 25 bp, Mus musculus
ataatcgtttgcagtactcttccta

SEQ ID NO: 226512 - DNA, 25 bp, Mus musculus
ataatcgtttgctgtactcttccta

SEQ ID NO: 226513 - DNA, 25 bp, Mus musculus
ataatctatgtcaatggctctgtgc

SEQ ID NO: 226514 - DNA, 25 bp, Mus musculus
ataatctatgtctatggctctgtgc

SEQ ID NO: 226515 - DNA, 25 bp, Mus musculus
ataatctattctccgaccttgaagc

SEQ ID NO: 226516 - DNA, 25 bp, Mus musculus
ataatctattctgcgaccttgaagc

SEQ ID NO: 226517 - DNA, 25 bp, Mus musculus
ataatctcaacactacgggaacaga

SEQ ID NO: 226518 - DNA, 25 bp, Mus musculus
ataatctcaacagtacgggaacaga

SEQ ID NO: 226519 - DNA, 25 bp, Mus musculus
ataatctcaatacttgctatttcaa

SEQ ID NO: 226520 - DNA, 25 bp, Mus musculus
ataatctcaatagttgctatttcaa

SEQ ID NO: 226521 - DNA, 25 bp, Mus musculus
ataatctcacgactacaagtagctc

SEQ ID NO: 226522 - DNA, 25 bp, Mus musculus
ataatctcacgagtacaagtagctc

SEQ ID NO: 226523 - DNA, 25 bp, Mus musculus
ataatctcatttcataccacacaca

SEQ ID NO: 226524 - DNA, 25 bp, Mus musculus
ataatctcatttgataccacacaca

SEQ ID NO: 226525 - DNA, 25 bp, Mus musculus
ataatctccaggagttagaagccga

SEQ ID NO: 226526 - DNA, 25 bp, Mus musculus
ataatctccaggtgttagaagccga

SEQ ID NO: 226527 - DNA, 25 bp, Mus musculus
ataatctccgctagtctatagttaa

SEQ ID NO: 226528 - DNA, 25 bp, Mus musculus
ataatctccgcttgtctatagttaa

SEQ ID NO: 226529 - DNA, 25 bp, Mus musculus
ataatctgagaacaagtgccctgaa

SEQ ID NO: 226530 - DNA, 25 bp, Mus musculus
ataatctgagaagaagtgccctgaa

SEQ ID NO: 226531 - DNA, 25 bp, Mus musculus
ataatctgcagtcccctgacaacaa

SEQ ID NO: 226532 - DNA, 25 bp, Mus musculus
ataatctgcagtgccctgacaacaa

SEQ ID NO: 226533 - DNA, 25 bp, Mus musculus
ataatctgctttaggatagtatgcc

SEQ ID NO: 226534 - DNA, 25 bp, Mus musculus
ataatctgcttttggatagtatgcc

SEQ ID NO: 226535 - DNA, 25 bp, Mus musculus
ataatctggaccataagggcacaag

SEQ ID NO: 226536 - DNA, 25 bp, Mus musculus
ataatctggaccttaagggcacaag

SEQ ID NO: 226537 - DNA, 25 bp, Mus musculus
ataatctggattatctatagcatgg

SEQ ID NO: 226538 - DNA, 25 bp, Mus musculus
ataatctggattccactacacctca

SEQ ID NO: 226539 - DNA, 25 bp, Mus musculus
ataatctggattgcactacacctca

SEQ ID NO: 226540 - DNA, 25 bp, Mus musculus
ataatctggattttctatagcatgg

SEQ ID NO: 226541 - DNA, 25 bp, Mus musculus
ataatctgtataatcctctttccta

SEQ ID NO: 226542 - DNA, 25 bp, Mus musculus
ataatctgtatattcctctttccta

SEQ ID NO: 226543 - DNA, 25 bp, Mus musculus
ataatctgtcacagtggactcaggc

SEQ ID NO: 226544 - DNA, 25 bp, Mus musculus
ataatctgtcactgtggactcaggc

SEQ ID NO: 226545 - DNA, 25 bp, Mus musculus
ataatctgtggactcatcctgaccc

SEQ ID NO: 226546 - DNA, 25 bp, Mus musculus
ataatctgtggagtcatcctgaccc

SEQ ID NO: 226547 - DNA, 25 bp, Mus musculus
ataatcttaaatacctcttcaaggt

SEQ ID NO: 226548 - DNA, 25 bp, Mus musculus
ataatcttaaattcctcttcaaggt

SEQ ID NO: 226549 - DNA, 25 bp, Mus musculus
ataatcttaggtatcaattgagtag

SEQ ID NO: 226550 - DNA, 25 bp, Mus musculus
ataatcttaggtttcaattgagtag

SEQ ID NO: 226551 - DNA, 25 bp, Mus musculus
ataatcttattcatgggacgagtca

SEQ ID NO: 226552 - DNA, 25 bp, Mus musculus
ataatcttattcttgggacgagtca

SEQ ID NO: 226553 - DNA, 25 bp, Mus musculus
ataatcttcagcaactaaaccctaa

SEQ ID NO: 226554 - DNA, 25 bp, Mus musculus
ataatcttcagctactaaaccctaa

SEQ ID NO: 226555 - DNA, 25 bp, Mus musculus
ataatcttcattagtaccacccaag

SEQ ID NO: 226556 - DNA, 25 bp, Mus musculus
ataatcttcatttgtaccacccaag

SEQ ID NO: 226557 - DNA, 25 bp, Mus musculus
ataatcttggccctagagcacttac

SEQ ID NO: 226558 - DNA, 25 bp, Mus musculus
ataatcttggccgtagagcacttac

SEQ ID NO: 226559 - DNA, 25 bp, Mus musculus
ataatcttgtttacttcctcccctg

SEQ ID NO: 226560 - DNA, 25 bp, Mus musculus
ataatcttgttttcttcctcccctg

SEQ ID NO: 226561 - DNA, 25 bp, Mus musculus
ataatctttactccctgtgcagaaa

SEQ ID NO: 226562 - DNA, 25 bp, Mus musculus
ataatctttactgcctgtgcagaaa

SEQ ID NO: 226563 - DNA, 25 bp, Mus musculus
ataatctttcttcatctgctgaggg

SEQ ID NO: 226564 - DNA, 25 bp, Mus musculus
ataatctttcttgatctgctgaggg

SEQ ID NO: 226565 - DNA, 25 bp, Mus musculus
ataatctttgagctcctcaggtggg

SEQ ID NO: 226566 - DNA, 25 bp, Mus musculus
ataatctttgaggtcctcaggtggg

SEQ ID NO: 226567 - DNA, 25 bp, Mus musculus
ataatctttgggacaggactctggc

SEQ ID NO: 226568 - DNA, 25 bp, Mus musculus
ataatctttgggtcaggactctggc

SEQ ID NO: 226569 - DNA, 25 bp, Mus musculus
ataatctttgttctaatgcccggtc

SEQ ID NO: 226570 - DNA, 25 bp, Mus musculus
ataatctttgttctttggtgtccct

SEQ ID NO: 226571 - DNA, 25 bp, Mus musculus
ataatctttgttgtaatgcccggtc

SEQ ID NO: 226572 - DNA, 25 bp, Mus musculus
ataatctttgttgtttggtgtccct

SEQ ID NO: 226573 - DNA, 25 bp, Mus musculus
ataatgaactaaccccacattttct

SEQ ID NO: 226574 - DNA, 25 bp, Mus musculus
ataatgaactaagcccacattttct

SEQ ID NO: 226575 - DNA, 25 bp, Mus musculus
ataatgaacttgaggactttcactt

SEQ ID NO: 226576 - DNA, 25 bp, Mus musculus
ataatgaacttgtggactttcactt

SEQ ID NO: 226577 - DNA, 25 bp, Mus musculus
ataatgaatgctactatttaaaggg

SEQ ID NO: 226578 - DNA, 25 bp, Mus musculus
ataatgaatgcttctatttaaaggg

SEQ ID NO: 226579 - DNA, 25 bp, Mus musculus
ataatgacacctcggctcttcctga

SEQ ID NO: 226580 - DNA, 25 bp, Mus musculus
ataatgacacctgggctcttcctga

SEQ ID NO: 226581 - DNA, 25 bp, Mus musculus
ataatgacatctcgcttacttccgc

SEQ ID NO: 226582 - DNA, 25 bp, Mus musculus
ataatgacatctggcttacttccgc

SEQ ID NO: 226583 - DNA, 25 bp, Mus musculus
ataatgacatttctgctctctgcgt

SEQ ID NO: 226584 - DNA, 25 bp, Mus musculus
ataatgacatttgtgctctctgcgt

SEQ ID NO: 226585 - DNA, 25 bp, Mus musculus
ataatgaccctcagtctccctagat

SEQ ID NO: 226586 - DNA, 25 bp, Mus musculus
ataatgaccctctgtctccctagat

SEQ ID NO: 226587 - DNA, 25 bp, Mus musculus
ataatgaccctgatgaaaattctac

SEQ ID NO: 226588 - DNA, 25 bp, Mus musculus
ataatgaccctgttgaaaattctac

SEQ ID NO: 226589 - DNA, 25 bp, Mus musculus
ataatgacctctatctgctgcaaag

SEQ ID NO: 226590 - DNA, 25 bp, Mus musculus
ataatgacctctttctgctgcaaag

SEQ ID NO: 226591 - DNA, 25 bp, Mus musculus
ataatgactattaagcttcctgagg

SEQ ID NO: 226592 - DNA, 25 bp, Mus musculus
ataatgactatttagcttcctgagg

SEQ ID NO: 226593 - DNA, 25 bp, Mus musculus
ataatgagatctcttcccgactcgt

SEQ ID NO: 226594 - DNA, 25 bp, Mus musculus
ataatgagatctgttcccgactcgt

SEQ ID NO: 226595 - DNA, 25 bp, Mus musculus
ataatgagcgttcctgacacccttg

SEQ ID NO: 226596 - DNA, 25 bp, Mus musculus
ataatgagcgttgctgacacccttg

SEQ ID NO: 226597 - DNA, 25 bp, Mus musculus
ataatgagggatcgctgctggccta

SEQ ID NO: 226598 - DNA, 25 bp, Mus musculus
ataatgagggatggctgctggccta

SEQ ID NO: 226599 - DNA, 25 bp, Mus musculus
ataatgagtcttatctgaggttttt

SEQ ID NO: 226600 - DNA, 25 bp, Mus musculus
ataatgagtcttttctgaggttttt

SEQ ID NO: 226601 - DNA, 25 bp, Mus musculus
ataatgagttaacccttgcagcaaa

SEQ ID NO: 226602 - DNA, 25 bp, Mus musculus
ataatgagttaagccttgcagcaaa

SEQ ID NO: 226603 - DNA, 25 bp, Mus musculus
ataatgataaacacctcacgcctca

SEQ ID NO: 226604 - DNA, 25 bp, Mus musculus
ataatgataaactcctcacgcctca

SEQ ID NO: 226605 - DNA, 25 bp, Mus musculus
ataatgatgcccattatctgcacag

SEQ ID NO: 226606 - DNA, 25 bp, Mus musculus
ataatgatgccctttatctgcacag

SEQ ID NO: 226607 - DNA, 25 bp, Mus musculus
ataatgatgtttacttctcttacca

SEQ ID NO: 226608 - DNA, 25 bp, Mus musculus
ataatgatgttttcttctcttacca

SEQ ID NO: 226609 - DNA, 25 bp, Mus musculus
ataatgcacaccatgataccactcc

SEQ ID NO: 226610 - DNA, 25 bp, Mus musculus
ataatgcacaccttgataccactcc

SEQ ID NO: 226611 - DNA, 25 bp, Mus musculus
ataatgcacccacgccaaaacagtg

SEQ ID NO: 226612 - DNA, 25 bp, Mus musculus
ataatgcacccaggccaaaacagtg

SEQ ID NO: 226613 - DNA, 25 bp, Mus musculus
ataatgcactgcaactgtcaccctg

SEQ ID NO: 226614 - DNA, 25 bp, Mus musculus
ataatgcactgctactgtcaccctg

SEQ ID NO: 226615 - DNA, 25 bp, Mus musculus
ataatgcagacgatgacttctcccc

SEQ ID NO: 226616 - DNA, 25 bp, Mus musculus
ataatgcagacgttgacttctcccc

SEQ ID NO: 226617 - DNA, 25 bp, Mus musculus
ataatgcatctcaaaagccctaccc

SEQ ID NO: 226618 - DNA, 25 bp, Mus musculus
ataatgcatctctaaagccctaccc

SEQ ID NO: 226619 - DNA, 25 bp, Mus musculus
ataatgcatcttatcctttgtcacc

SEQ ID NO: 226620 - DNA, 25 bp, Mus musculus
ataatgcatcttttcctttgtcacc

SEQ ID NO: 226621 - DNA, 25 bp, Mus musculus
ataatgcatgttacctttgactctc

SEQ ID NO: 226622 - DNA, 25 bp, Mus musculus
ataatgcatgtttcctttgactctc

SEQ ID NO: 226623 - DNA, 25 bp, Mus musculus
ataatgccaaatagcccctaggtaa

SEQ ID NO: 226624 - DNA, 25 bp, Mus musculus
ataatgccaaattgcccctaggtaa

SEQ ID NO: 226625 - DNA, 25 bp, Mus musculus
ataatgccaaccagcaagcgctcat

SEQ ID NO: 226626 - DNA, 25 bp, Mus musculus
ataatgccaacctgcaagcgctcat

SEQ ID NO: 226627 - DNA, 25 bp, Mus musculus
ataatgccaggcagggcagcgagag

SEQ ID NO: 226628 - DNA, 25 bp, Mus musculus
ataatgccaggctgggcagcgagag

SEQ ID NO: 226629 - DNA, 25 bp, Mus musculus
ataatgccagggactcatcgttaga

SEQ ID NO: 226630 - DNA, 25 bp, Mus musculus
ataatgccagggtctcatcgttaga

SEQ ID NO: 226631 - DNA, 25 bp, Mus musculus
ataatgccaggtcacatgtggccat

SEQ ID NO: 226632 - DNA, 25 bp, Mus musculus
ataatgccaggtgacatgtggccat

SEQ ID NO: 226633 - DNA, 25 bp, Mus musculus
ataatgccctgaagattcctgtgcc

SEQ ID NO: 226634 - DNA, 25 bp, Mus musculus
ataatgccctgatgattcctgtgcc

SEQ ID NO: 226635 - DNA, 25 bp, Mus musculus
ataatgcctgcgatctttttgccgt

SEQ ID NO: 226636 - DNA, 25 bp, Mus musculus
ataatgcctgcgttctttttgccgt

SEQ ID NO: 226637 - DNA, 25 bp, Mus musculus
ataatgcgaggcactccgctaaagt

SEQ ID NO: 226638 - DNA, 25 bp, Mus musculus
ataatgcgaggctctccgctaaagt

SEQ ID NO: 226639 - DNA, 25 bp, Mus musculus
ataatgctaatgcttccgctgctgt

SEQ ID NO: 226640 - DNA, 25 bp, Mus musculus
ataatgctaatggttccgctgctgt

SEQ ID NO: 226641 - DNA, 25 bp, Mus musculus
ataatgctcattattgagacgttta

SEQ ID NO: 226642 - DNA, 25 bp, Mus musculus
ataatgctcatttttgagacgttta

SEQ ID NO: 226643 - DNA, 25 bp, Mus musculus
ataatgctctagctaaatccaagga

SEQ ID NO: 226644 - DNA, 25 bp, Mus musculus
ataatgctctaggtaaatccaagga

SEQ ID NO: 226645 - DNA, 25 bp, Mus musculus
ataatgctctctctttggcttgtta

SEQ ID NO: 226646 - DNA, 25 bp, Mus musculus
ataatgctctctgtttggcttgtta

SEQ ID NO: 226647 - DNA, 25 bp, Mus musculus
ataatgctgctgattaccttctctt

SEQ ID NO: 226648 - DNA, 25 bp, Mus musculus
ataatgctgctgtttaccttctctt

SEQ ID NO: 226649 - DNA, 25 bp, Mus musculus
ataatgctggtgatgtgactcagat

SEQ ID NO: 226650 - DNA, 25 bp, Mus musculus
ataatgctggtgttgtgactcagat

SEQ ID NO: 226651 - DNA, 25 bp, Mus musculus
ataatgcttatcacctaacaccacc

SEQ ID NO: 226652 - DNA, 25 bp, Mus musculus
ataatgcttatctcctaacaccacc

SEQ ID NO: 226653 - DNA, 25 bp, Mus musculus
ataatgcttcaacgcttttaaaaca

SEQ ID NO: 226654 - DNA, 25 bp, Mus musculus
ataatgcttcaaggcttttaaaaca

SEQ ID NO: 226655 - DNA, 25 bp, Mus musculus
ataatggactctaagccctttggaa

SEQ ID NO: 226656 - DNA, 25 bp, Mus musculus
ataatggactcttagccctttggaa

SEQ ID NO: 226657 - DNA, 25 bp, Mus musculus
ataatggactgaatgccagccccac

SEQ ID NO: 226658 - DNA, 25 bp, Mus musculus
ataatggactgattgccagccccac

SEQ ID NO: 226659 - DNA, 25 bp, Mus musculus
ataatggagattatgattcccagac

SEQ ID NO: 226660 - DNA, 25 bp, Mus musculus
ataatggagattttgattcccagac

SEQ ID NO: 226661 - DNA, 25 bp, Mus musculus
ataatggatcatccgggtaccttct

SEQ ID NO: 226662 - DNA, 25 bp, Mus musculus
ataatggatcatgcgggtaccttct

SEQ ID NO: 226663 - DNA, 25 bp, Mus musculus
ataatggatcccctaccaatacgca

SEQ ID NO: 226664 - DNA, 25 bp, Mus musculus
ataatggatcccgtaccaatacgca

SEQ ID NO: 226665 - DNA, 25 bp, Mus musculus
ataatggatcgtatggcttcctgaa

SEQ ID NO: 226666 - DNA, 25 bp, Mus musculus
ataatggatcgtttggcttcctgaa

SEQ ID NO: 226667 - DNA, 25 bp, Mus musculus
ataatggcagacaggcggcagaaat

SEQ ID NO: 226668 - DNA, 25 bp, Mus musculus
ataatggcagactggcggcagaaat

SEQ ID NO: 226669 - DNA, 25 bp, Mus musculus
ataatggcagtgaccggtctggcag

SEQ ID NO: 226670 - DNA, 25 bp, Mus musculus
ataatggcagtgtccggtctggcag

SEQ ID NO: 226671 - DNA, 25 bp, Mus musculus
ataatggcatctcacttcgtgagtg

SEQ ID NO: 226672 - DNA, 25 bp, Mus musculus
ataatggcatctgacttcgtgagtg

SEQ ID NO: 226673 - DNA, 25 bp, Mus musculus
ataatggcatgcctgcgtgtcccga

SEQ ID NO: 226674 - DNA, 25 bp, Mus musculus
ataatggcatgcgtgcgtgtcccga

SEQ ID NO: 226675 - DNA, 25 bp, Mus musculus
ataatggccgatccattcaaatgct

SEQ ID NO: 226676 - DNA, 25 bp, Mus musculus
ataatggccgatgcattcaaatgct

SEQ ID NO: 226677 - DNA, 25 bp, Mus musculus
ataatggctagaacactcccttgtg

SEQ ID NO: 226678 - DNA, 25 bp, Mus musculus
ataatggctagatcactcccttgtg

SEQ ID NO: 226679 - DNA, 25 bp, Mus musculus
ataatggctcttagtttgtgttgtt

SEQ ID NO: 226680 - DNA, 25 bp, Mus musculus
ataatggctctttgtttgtgttgtt

SEQ ID NO: 226681 - DNA, 25 bp, Mus musculus
ataatggctgcccaaactctacagt

SEQ ID NO: 226682 - DNA, 25 bp, Mus musculus
ataatggctgccgaaactctacagt

SEQ ID NO: 226683 - DNA, 25 bp, Mus musculus
ataatggctttcctgttataatgtc

SEQ ID NO: 226684 - DNA, 25 bp, Mus musculus
ataatggctttcgtgttataatgtc

SEQ ID NO: 226685 - DNA, 25 bp, Mus musculus
ataatgggagggagtcatcatcccc

SEQ ID NO: 226686 - DNA, 25 bp, Mus musculus
ataatgggagggtgtcatcatcccc

SEQ ID NO: 226687 - DNA, 25 bp, Mus musculus
ataatgggccatagcagaggaaaca

SEQ ID NO: 226688 - DNA, 25 bp, Mus musculus
ataatgggccattgcagaggaaaca

SEQ ID NO: 226689 - DNA, 25 bp, Mus musculus
ataatgggcctcagttaaagtacag

SEQ ID NO: 226690 - DNA, 25 bp, Mus musculus
ataatgggcctctgttaaagtacag

SEQ ID NO: 226691 - DNA, 25 bp, Mus musculus
ataatgggctctaggccagcctaaa

SEQ ID NO: 226692 - DNA, 25 bp, Mus musculus
ataatgggctcttggccagcctaaa

SEQ ID NO: 226693 - DNA, 25 bp, Mus musculus
ataatggtaggactagattgcgtgt

SEQ ID NO: 226694 - DNA, 25 bp, Mus musculus
ataatggtaggagtagattgcgtgt

SEQ ID NO: 226695 - DNA, 25 bp, Mus musculus
ataatggtagtacttatttccccag

SEQ ID NO: 226696 - DNA, 25 bp, Mus musculus
ataatggtagtagttatttccccag

SEQ ID NO: 226697 - DNA, 25 bp, Mus musculus
ataatggtgcctaatgcaactggcc

SEQ ID NO: 226698 - DNA, 25 bp, Mus musculus
ataatggtgccttatgcaactggcc

SEQ ID NO: 226699 - DNA, 25 bp, Mus musculus
ataatggtgctgctttatgcccaca

SEQ ID NO: 226700 - DNA, 25 bp, Mus musculus
ataatggtgctggtttatgcccaca

SEQ ID NO: 226701 - DNA, 25 bp, Mus musculus
ataatgtacagacagacagagtccc

SEQ ID NO: 226702 - DNA, 25 bp, Mus musculus
ataatgtacagagagacagagtccc

SEQ ID NO: 226703 - DNA, 25 bp, Mus musculus
ataatgtagatgagtcttcagccac

SEQ ID NO: 226704 - DNA, 25 bp, Mus musculus
ataatgtagatgtgtcttcagccac

SEQ ID NO: 226705 - DNA, 25 bp, Mus musculus
ataatgtatcttctacacctcggct

SEQ ID NO: 226706 - DNA, 25 bp, Mus musculus
ataatgtatcttgtacacctcggct

SEQ ID NO: 226707 - DNA, 25 bp, Mus musculus
ataatgtcaccaacggaggccagaa

SEQ ID NO: 226708 - DNA, 25 bp, Mus musculus
ataatgtcaccatcggaggccagaa

SEQ ID NO: 226709 - DNA, 25 bp, Mus musculus
ataatgtcatgtctctccacccagg

SEQ ID NO: 226710 - DNA, 25 bp, Mus musculus
ataatgtcatgtgtctccacccagg

SEQ ID NO: 226711 - DNA, 25 bp, Mus musculus
ataatgtcatttactgcaactgttg

SEQ ID NO: 226712 - DNA, 25 bp, Mus musculus
ataatgtcattttctgcaactgttg

SEQ ID NO: 226713 - DNA, 25 bp, Mus musculus
ataatgtccatccacacctccttat

SEQ ID NO: 226714 - DNA, 25 bp, Mus musculus
ataatgtccatcgacacctccttat

SEQ ID NO: 226715 - DNA, 25 bp, Mus musculus
ataatgtcccggagcagatgctgat

SEQ ID NO: 226716 - DNA, 25 bp, Mus musculus
ataatgtcccggtgcagatgctgat

SEQ ID NO: 226717 - DNA, 25 bp, Mus musculus
ataatgtcgtgtctggtatagccct

SEQ ID NO: 226718 - DNA, 25 bp, Mus musculus
ataatgtcgtgtgtggtatagccct

SEQ ID NO: 226719 - DNA, 25 bp, Mus musculus
ataatgtctgtaccctgaaggctcc

SEQ ID NO: 226720 - DNA, 25 bp, Mus musculus
ataatgtctgtagcctgaaggctcc

SEQ ID NO: 226721 - DNA, 25 bp, Mus musculus
ataatgtcttctcatgaatcccaca

SEQ ID NO: 226722 - DNA, 25 bp, Mus musculus
ataatgtcttctgatgaatcccaca

SEQ ID NO: 226723 - DNA, 25 bp, Mus musculus
ataatgtgattgaatcaactaccac

SEQ ID NO: 226724 - DNA, 25 bp, Mus musculus
ataatgtgattgtatcaactaccac

SEQ ID NO: 226725 - DNA, 25 bp, Mus musculus
ataatgtggaccaatgaactgtgtg

SEQ ID NO: 226726 - DNA, 25 bp, Mus musculus
ataatgtggacctatgaactgtgtg

SEQ ID NO: 226727 - DNA, 25 bp, Mus musculus
ataatgtggatgagtagacccttga

SEQ ID NO: 226728 - DNA, 25 bp, Mus musculus
ataatgtggatgtgtagacccttga

SEQ ID NO: 226729 - DNA, 25 bp, Mus musculus
ataatgtggcccagttctcgggaac

SEQ ID NO: 226730 - DNA, 25 bp, Mus musculus
ataatgtggccctgttctcgggaac

SEQ ID NO: 226731 - DNA, 25 bp, Mus musculus
ataatgtggctcacatgtgcttcct

SEQ ID NO: 226732 - DNA, 25 bp, Mus musculus
ataatgtggctcctgtctttcttcc

SEQ ID NO: 226733 - DNA, 25 bp, Mus musculus
ataatgtggctcgtgtctttcttcc

SEQ ID NO: 226734 - DNA, 25 bp, Mus musculus
ataatgtggctctcatgtgcttcct

SEQ ID NO: 226735 - DNA, 25 bp, Mus musculus
ataatgtgggacaccgtctgggaag

SEQ ID NO: 226736 - DNA, 25 bp, Mus musculus
ataatgtgggactccgtctgggaag

SEQ ID NO: 226737 - DNA, 25 bp, Mus musculus
ataatgtgtggtaccagggctgttt

SEQ ID NO: 226738 - DNA, 25 bp, Mus musculus
ataatgtgtggttccagggctgttt

SEQ ID NO: 226739 - DNA, 25 bp, Mus musculus
ataatgttcaacagagtcctgtaga

SEQ ID NO: 226740 - DNA, 25 bp, Mus musculus
ataatgttcaactgagtcctgtaga

SEQ ID NO: 226741 - DNA, 25 bp, Mus musculus
ataatgttcatcacagttgcaggaa

SEQ ID NO: 226742 - DNA, 25 bp, Mus musculus
ataatgttcatctcagttgcaggaa

SEQ ID NO: 226743 - DNA, 25 bp, Mus musculus
ataatgttctttcttgtttctgtac

SEQ ID NO: 226744 - DNA, 25 bp, Mus musculus
ataatgttctttgttgtttctgtac

SEQ ID NO: 226745 - DNA, 25 bp, Mus musculus
ataatgttggccaagtcctcttttg

SEQ ID NO: 226746 - DNA, 25 bp, Mus musculus
ataatgttggcctagtcctcttttg

SEQ ID NO: 226747 - DNA, 25 bp, Mus musculus
ataatgtttttaaggccctgtggca

SEQ ID NO: 226748 - DNA, 25 bp, Mus musculus
ataatgtttttatggccctgtggca

SEQ ID NO: 226749 - DNA, 25 bp, Mus musculus
ataattaaaatgaagccgggcagtg

SEQ ID NO: 226750 - DNA, 25 bp, Mus musculus
ataattaaaatgtagccgggcagtg

SEQ ID NO: 226751 - DNA, 25 bp, Mus musculus
ataattaacgcccaagcttctccca

SEQ ID NO: 226752 - DNA, 25 bp, Mus musculus
ataattaacgccgaagcttctccca

SEQ ID NO: 226753 - DNA, 25 bp, Mus musculus
ataattaatcccctctctggtttgc

SEQ ID NO: 226754 - DNA, 25 bp, Mus musculus
ataattaatcccgtctctggtttgc

SEQ ID NO: 226755 - DNA, 25 bp, Mus musculus
ataattacctgcactgtctatctct

SEQ ID NO: 226756 - DNA, 25 bp, Mus musculus
ataattacctgctctgtctatctct

SEQ ID NO: 226757 - DNA, 25 bp, Mus musculus
ataattactatactttcctttgtct

SEQ ID NO: 226758 - DNA, 25 bp, Mus musculus
ataattactatagtttcctttgtct

SEQ ID NO: 226759 - DNA, 25 bp, Mus musculus
ataattacttaaccctcagtgcatg

SEQ ID NO: 226760 - DNA, 25 bp, Mus musculus
ataattacttaagcctcagtgcatg

SEQ ID NO: 226761 - DNA, 25 bp, Mus musculus
ataattaggcaaatccagcccgaag

SEQ ID NO: 226762 - DNA, 25 bp, Mus musculus
ataattaggcaattccagcccgaag

SEQ ID NO: 226763 - DNA, 25 bp, Mus musculus
ataattatacgtactctgactattg

SEQ ID NO: 226764 - DNA, 25 bp, Mus musculus
ataattatacgttctctgactattg

SEQ ID NO: 226765 - DNA, 25 bp, Mus musculus
ataattatctcaccgaagaggacac

SEQ ID NO: 226766 - DNA, 25 bp, Mus musculus
ataattatctcagcgaagaggacac

SEQ ID NO: 226767 - DNA, 25 bp, Mus musculus
ataattatctctacttttgcagtga

SEQ ID NO: 226768 - DNA, 25 bp, Mus musculus
ataattatctcttcttttgcagtga

SEQ ID NO: 226769 - DNA, 25 bp, Mus musculus
ataattatgagaccgattccagcaa

SEQ ID NO: 226770 - DNA, 25 bp, Mus musculus
ataattatgagagcgattccagcaa

SEQ ID NO: 226771 - DNA, 25 bp, Mus musculus
ataattatgcccatgattagcccct

SEQ ID NO: 226772 - DNA, 25 bp, Mus musculus
ataattatgcccttgattagcccct

SEQ ID NO: 226773 - DNA, 25 bp, Mus musculus
ataattatgtcacctatgtacctag

SEQ ID NO: 226774 - DNA, 25 bp, Mus musculus
ataattatgtcagctatgtacctag

SEQ ID NO: 226775 - DNA, 25 bp, Mus musculus
ataattattctcatgccattttaca

SEQ ID NO: 226776 - DNA, 25 bp, Mus musculus
ataattattctcttgccattttaca

SEQ ID NO: 226777 - DNA, 25 bp, Mus musculus
ataattcaaaccacgggaaccagtg

SEQ ID NO: 226778 - DNA, 25 bp, Mus musculus
ataattcaaacctcgggaaccagtg

SEQ ID NO: 226779 - DNA, 25 bp, Mus musculus
ataattcaacagctgcttgcttcca

SEQ ID NO: 226780 - DNA, 25 bp, Mus musculus
ataattcaacaggtgcttgcttcca

SEQ ID NO: 226781 - DNA, 25 bp, Mus musculus
ataattcaatgtctctgtgataagc

SEQ ID NO: 226782 - DNA, 25 bp, Mus musculus
ataattcaatgtgtctgtgataagc

SEQ ID NO: 226783 - DNA, 25 bp, Mus musculus
ataattcacacaacttgtccgcaac

SEQ ID NO: 226784 - DNA, 25 bp, Mus musculus
ataattcacacatcttgtccgcaac

SEQ ID NO: 226785 - DNA, 25 bp, Mus musculus
ataattcacataacccacagttcaa

SEQ ID NO: 226786 - DNA, 25 bp, Mus musculus
ataattcacatatcccacagttcaa

SEQ ID NO: 226787 - DNA, 25 bp, Mus musculus
ataattcactctctgaatgaggtga

SEQ ID NO: 226788 - DNA, 25 bp, Mus musculus
ataattcactctgtgaatgaggtga

SEQ ID NO: 226789 - DNA, 25 bp, Mus musculus
ataattcactggacctgcatcagga

SEQ ID NO: 226790 - DNA, 25 bp, Mus musculus
ataattcactggtcctgcatcagga

SEQ ID NO: 226791 - DNA, 25 bp, Mus musculus
ataattcagaagagcagcggatttt

SEQ ID NO: 226792 - DNA, 25 bp, Mus musculus
ataattcagaagtgcagcggatttt

SEQ ID NO: 226793 - DNA, 25 bp, Mus musculus
ataattcagtacatagcaactctag

SEQ ID NO: 226794 - DNA, 25 bp, Mus musculus
ataattcagtacttagcaactctag

SEQ ID NO: 226795 - DNA, 25 bp, Mus musculus
ataattcagtttcgtcactatattt

SEQ ID NO: 226796 - DNA, 25 bp, Mus musculus
ataattcagtttggtcactatattt

SEQ ID NO: 226797 - DNA, 25 bp, Mus musculus
ataattcattcccaatttatgtgtg

SEQ ID NO: 226798 - DNA, 25 bp, Mus musculus
ataattcattccgaatttatgtgtg

SEQ ID NO: 226799 - DNA, 25 bp, Mus musculus
ataattcatttcaccaggctaaagc

SEQ ID NO: 226800 - DNA, 25 bp, Mus musculus
ataattcatttctccaggctaaagc

SEQ ID NO: 226801 - DNA, 25 bp, Mus musculus
ataattccagatccctccgaaaaat

SEQ ID NO: 226802 - DNA, 25 bp, Mus musculus
ataattccagatgcctccgaaaaat

SEQ ID NO: 226803 - DNA, 25 bp, Mus musculus
ataattccagtgcttgggagtctga

SEQ ID NO: 226804 - DNA, 25 bp, Mus musculus
ataattccagtggttgggagtctga

SEQ ID NO: 226805 - DNA, 25 bp, Mus musculus
ataattcccacaaggcccaaatcat

SEQ ID NO: 226806 - DNA, 25 bp, Mus musculus
ataattcccacatggcccaaatcat

SEQ ID NO: 226807 - DNA, 25 bp, Mus musculus
ataattccccatataaatgccttgg

SEQ ID NO: 226808 - DNA, 25 bp, Mus musculus
ataattccccatttaaatgccttgg

SEQ ID NO: 226809 - DNA, 25 bp, Mus musculus
ataattccggtcaagatcatgtaca

SEQ ID NO: 226810 - DNA, 25 bp, Mus musculus
ataattccggtctagatcatgtaca

SEQ ID NO: 226811 - DNA, 25 bp, Mus musculus
ataattcctgacctatagtgtaaca

SEQ ID NO: 226812 - DNA, 25 bp, Mus musculus
ataattcctgacgtatagtgtaaca

SEQ ID NO: 226813 - DNA, 25 bp, Mus musculus
ataattcctggaagccaacccttga

SEQ ID NO: 226814 - DNA, 25 bp, Mus musculus
ataattcctggacctaacctaagag

SEQ ID NO: 226815 - DNA, 25 bp, Mus musculus
ataattcctggagctaacctaagag

SEQ ID NO: 226816 - DNA, 25 bp, Mus musculus
ataattcctggatgccaacccttga

SEQ ID NO: 226817 - DNA, 25 bp, Mus musculus
ataattcctggcataaagaaactga

SEQ ID NO: 226818 - DNA, 25 bp, Mus musculus
ataattcctggcttaaagaaactga

SEQ ID NO: 226819 - DNA, 25 bp, Mus musculus
ataattcctgtaagtccagttgcag

SEQ ID NO: 226820 - DNA, 25 bp, Mus musculus
ataattcctgtatgtccagttgcag

SEQ ID NO: 226821 - DNA, 25 bp, Mus musculus
ataattccttgaatcttatctgacc

SEQ ID NO: 226822 - DNA, 25 bp, Mus musculus
ataattccttgattcttatctgacc

SEQ ID NO: 226823 - DNA, 25 bp, Mus musculus
ataattcctttcacgcacccaagag

SEQ ID NO: 226824 - DNA, 25 bp, Mus musculus
ataattcctttctcgcacccaagag

SEQ ID NO: 226825 - DNA, 25 bp, Mus musculus
ataattccttttctataccgtccag

SEQ ID NO: 226826 - DNA, 25 bp, Mus musculus
ataattccttttgtataccgtccag

SEQ ID NO: 226827 - DNA, 25 bp, Mus musculus
ataattcgtggcaatgctcccatgg

SEQ ID NO: 226828 - DNA, 25 bp, Mus musculus
ataattcgtggctatgctcccatgg

SEQ ID NO: 226829 - DNA, 25 bp, Mus musculus
ataattctaagaagtgttactccaa

SEQ ID NO: 226830 - DNA, 25 bp, Mus musculus
ataattctaagatgtgttactccaa

SEQ ID NO: 226831 - DNA, 25 bp, Mus musculus
ataattctccataaaactcccagag

SEQ ID NO: 226832 - DNA, 25 bp, Mus musculus
ataattctccattaaactcccagag

SEQ ID NO: 226833 - DNA, 25 bp, Mus musculus
ataattctcttcaatgtcatggcgt

SEQ ID NO: 226834 - DNA, 25 bp, Mus musculus
ataattctcttctatgtcatggcgt

SEQ ID NO: 226835 - DNA, 25 bp, Mus musculus
ataattctgcgcactattcaataaa

SEQ ID NO: 226836 - DNA, 25 bp, Mus musculus
ataattctgcgctctattcaataaa

SEQ ID NO: 226837 - DNA, 25 bp, Mus musculus
ataattctggtgatgaagctaggtc

SEQ ID NO: 226838 - DNA, 25 bp, Mus musculus
ataattctggtgttgaagctaggtc

SEQ ID NO: 226839 - DNA, 25 bp, Mus musculus
ataattctgtggctcgtgcagtcat

SEQ ID NO: 226840 - DNA, 25 bp, Mus musculus
ataattctgtgggtcgtgcagtcat

SEQ ID NO: 226841 - DNA, 25 bp, Mus musculus
ataattctgtgtaggagagctgcaa

SEQ ID NO: 226842 - DNA, 25 bp, Mus musculus
ataattctgtgttggagagctgcaa

SEQ ID NO: 226843 - DNA, 25 bp, Mus musculus
ataattcttattattctggtgctat

SEQ ID NO: 226844 - DNA, 25 bp, Mus musculus
ataattcttatttttctggtgctat

SEQ ID NO: 226845 - DNA, 25 bp, Mus musculus
ataattcttgcaactcacaatccca

SEQ ID NO: 226846 - DNA, 25 bp, Mus musculus
ataattcttgcatctcacaatccca

SEQ ID NO: 226847 - DNA, 25 bp, Mus musculus
ataattcttgttagcttcgggatgt

SEQ ID NO: 226848 - DNA, 25 bp, Mus musculus
ataattcttgtttgcttcgggatgt

SEQ ID NO: 226849 - DNA, 25 bp, Mus musculus
ataattctttgcctgacgatctcct

SEQ ID NO: 226850 - DNA, 25 bp, Mus musculus
ataattctttgcgtgacgatctcct

SEQ ID NO: 226851 - DNA, 25 bp, Mus musculus
ataattctttttcatgtccatctct

SEQ ID NO: 226852 - DNA, 25 bp, Mus musculus
ataattctttttgatgtccatctct

SEQ ID NO: 226853 - DNA, 25 bp, Mus musculus
ataattgactcgcattcacttccct

SEQ ID NO: 226854 - DNA, 25 bp, Mus musculus
ataattgactcggattcacttccct

SEQ ID NO: 226855 - DNA, 25 bp, Mus musculus
ataattgagccaatgctccagcctc

SEQ ID NO: 226856 - DNA, 25 bp, Mus musculus
ataattgagccattgctccagcctc

SEQ ID NO: 226857 - DNA, 25 bp, Mus musculus
ataattgagtggattagcacggatc

SEQ ID NO: 226858 - DNA, 25 bp, Mus musculus
ataattgagtggtttagcacggatc

SEQ ID NO: 226859 - DNA, 25 bp, Mus musculus
ataattgatcttccatggtgtgaaa

SEQ ID NO: 226860 - DNA, 25 bp, Mus musculus
ataattgatcttgcatggtgtgaaa

SEQ ID NO: 226861 - DNA, 25 bp, Mus musculus
ataattgatgagcaggccgggcccc

SEQ ID NO: 226862 - DNA, 25 bp, Mus musculus
ataattgatgaggaggccgggcccc

SEQ ID NO: 226863 - DNA, 25 bp, Mus musculus
ataattgcattgaatcacccacctc

SEQ ID NO: 226864 - DNA, 25 bp, Mus musculus
ataattgcattgtatcacccacctc

SEQ ID NO: 226865 - DNA, 25 bp, Mus musculus
ataattgcctatcaagctgtgaaca

SEQ ID NO: 226866 - DNA, 25 bp, Mus musculus
ataattgcctatgaagctgtgaaca

SEQ ID NO: 226867 - DNA, 25 bp, Mus musculus
ataattgctcctagagtttccacct

SEQ ID NO: 226868 - DNA, 25 bp, Mus musculus
ataattgctccttgagtttccacct

SEQ ID NO: 226869 - DNA, 25 bp, Mus musculus
ataattggcagtctttcctcaagaa

SEQ ID NO: 226870 - DNA, 25 bp, Mus musculus
ataattggcagtgtttcctcaagaa

SEQ ID NO: 226871 - DNA, 25 bp, Mus musculus
ataattggttagagtttgcatagaa

SEQ ID NO: 226872 - DNA, 25 bp, Mus musculus
ataattggttagtgtttgcatagaa

SEQ ID NO: 226873 - DNA, 25 bp, Mus musculus
ataattgtcgccactgcagagacca

SEQ ID NO: 226874 - DNA, 25 bp, Mus musculus
ataattgtcgcctctgcagagacca

SEQ ID NO: 226875 - DNA, 25 bp, Mus musculus
ataattgtctgtacacccgctcttg

SEQ ID NO: 226876 - DNA, 25 bp, Mus musculus
ataattgtctgttcacccgctcttg

SEQ ID NO: 226877 - DNA, 25 bp, Mus musculus
ataattgtgccaatgactccttgtg

SEQ ID NO: 226878 - DNA, 25 bp, Mus musculus
ataattgtgccattgactccttgtg

SEQ ID NO: 226879 - DNA, 25 bp, Mus musculus
ataattgtggcaactctgtgaatac

SEQ ID NO: 226880 - DNA, 25 bp, Mus musculus
ataattgtggcatctctgtgaatac

SEQ ID NO: 226881 - DNA, 25 bp, Mus musculus
ataattgtggtgagtggttgcagct

SEQ ID NO: 226882 - DNA, 25 bp, Mus musculus
ataattgtggtgtgtggttgcagct

SEQ ID NO: 226883 - DNA, 25 bp, Mus musculus
ataattgttctcaagttgttggaat

SEQ ID NO: 226884 - DNA, 25 bp, Mus musculus
ataattgttctctagttgttggaat

SEQ ID NO: 226885 - DNA, 25 bp, Mus musculus
ataattgtttcactcctatggcatg

SEQ ID NO: 226886 - DNA, 25 bp, Mus musculus
ataattgtttcagtcctatggcatg

SEQ ID NO: 226887 - DNA, 25 bp, Mus musculus
ataattgttttcagatttggagttt

SEQ ID NO: 226888 - DNA, 25 bp, Mus musculus
ataattgttttctgatttggagttt

SEQ ID NO: 226889 - DNA, 25 bp, Mus musculus
ataatttaatgcctaccaccaccac

SEQ ID NO: 226890 - DNA, 25 bp, Mus musculus
ataatttaatgcgtaccaccaccac

SEQ ID NO: 226891 - DNA, 25 bp, Mus musculus
ataatttacgtccattccaagttgt

SEQ ID NO: 226892 - DNA, 25 bp, Mus musculus
ataatttacgtcgattccaagttgt

SEQ ID NO: 226893 - DNA, 25 bp, Mus musculus
ataatttcaggaactggttatcagc

SEQ ID NO: 226894 - DNA, 25 bp, Mus musculus
ataatttcaggatctggttatcagc

SEQ ID NO: 226895 - DNA, 25 bp, Mus musculus
ataatttcatccattatttccctga

SEQ ID NO: 226896 - DNA, 25 bp, Mus musculus
ataatttcatcctttatttccctga

SEQ ID NO: 226897 - DNA, 25 bp, Mus musculus
ataatttcccggagcacagatctgc

SEQ ID NO: 226898 - DNA, 25 bp, Mus musculus
ataatttcccggtgcacagatctgc

SEQ ID NO: 226899 - DNA, 25 bp, Mus musculus
ataatttcgtgcacaccaaccgtgg

SEQ ID NO: 226900 - DNA, 25 bp, Mus musculus
ataatttcgtgctcaccaaccgtgg

SEQ ID NO: 226901 - DNA, 25 bp, Mus musculus
ataatttcgttcatgagtcagctgt

SEQ ID NO: 226902 - DNA, 25 bp, Mus musculus
ataatttcgttcttgagtcagctgt

SEQ ID NO: 226903 - DNA, 25 bp, Mus musculus
ataatttctctaatgtgcttatgaa

SEQ ID NO: 226904 - DNA, 25 bp, Mus musculus
ataatttctctattgtgcttatgaa

SEQ ID NO: 226905 - DNA, 25 bp, Mus musculus
ataatttctgctagtgttcaccaac

SEQ ID NO: 226906 - DNA, 25 bp, Mus musculus
ataatttctgcttgtgttcaccaac

SEQ ID NO: 226907 - DNA, 25 bp, Mus musculus
ataatttgaataagcaacttgcagc

SEQ ID NO: 226908 - DNA, 25 bp, Mus musculus
ataatttgaatatgcaacttgcagc

SEQ ID NO: 226909 - DNA, 25 bp, Mus musculus
ataatttgcactataatcgcccgac

SEQ ID NO: 226910 - DNA, 25 bp, Mus musculus
ataatttgcactttaatcgcccgac

SEQ ID NO: 226911 - DNA, 25 bp, Mus musculus
ataatttgcccactgaccgtagtca

SEQ ID NO: 226912 - DNA, 25 bp, Mus musculus
ataatttgcccagtgaccgtagtca

SEQ ID NO: 226913 - DNA, 25 bp, Mus musculus
ataatttgcggtctgctgtatgtta

SEQ ID NO: 226914 - DNA, 25 bp, Mus musculus
ataatttgcggtgtgctgtatgtta

SEQ ID NO: 226915 - DNA, 25 bp, Mus musculus
ataattttaaccaagatgttcaggg

SEQ ID NO: 226916 - DNA, 25 bp, Mus musculus
ataattttaacctagatgttcaggg

SEQ ID NO: 226917 - DNA, 25 bp, Mus musculus
ataattttacatagccgccaccaat

SEQ ID NO: 226918 - DNA, 25 bp, Mus musculus
ataattttacattgccgccaccaat

SEQ ID NO: 226919 - DNA, 25 bp, Mus musculus
ataattttagtgaagctggtgacca

SEQ ID NO: 226920 - DNA, 25 bp, Mus musculus
ataattttagtgtagctggtgacca

SEQ ID NO: 226921 - DNA, 25 bp, Mus musculus
ataattttataaagttgcactgcat

SEQ ID NO: 226922 - DNA, 25 bp, Mus musculus
ataattttataatgttgcactgcat

SEQ ID NO: 226923 - DNA, 25 bp, Mus musculus
ataattttcaatcctcagtacccag

SEQ ID NO: 226924 - DNA, 25 bp, Mus musculus
ataattttcaatgctcagtacccag

SEQ ID NO: 226925 - DNA, 25 bp, Mus musculus
ataattttcactatccacctgggat

SEQ ID NO: 226926 - DNA, 25 bp, Mus musculus
ataattttcactttccacctgggat

SEQ ID NO: 226927 - DNA, 25 bp, Mus musculus
ataattttccccaaagtgcattcaa

SEQ ID NO: 226928 - DNA, 25 bp, Mus musculus
ataattttcccctaagtgcattcaa

SEQ ID NO: 226929 - DNA, 25 bp, Mus musculus
ataattttctaccaatcataacaaa

SEQ ID NO: 226930 - DNA, 25 bp, Mus musculus
ataattttctacgaatcataacaaa

SEQ ID NO: 226931 - DNA, 25 bp, Mus musculus
ataattttgacaaattttgtagcag

SEQ ID NO: 226932 - DNA, 25 bp, Mus musculus
ataattttgacatattttgtagcag

SEQ ID NO: 226933 - DNA, 25 bp, Mus musculus
ataattttgcccatagttacacaca

SEQ ID NO: 226934 - DNA, 25 bp, Mus musculus
ataattttgcccttagttacacaca

SEQ ID NO: 226935 - DNA, 25 bp, Mus musculus
ataatttttacaccctagacagcaa

SEQ ID NO: 226936 - DNA, 25 bp, Mus musculus
ataatttttacagcctagacagcaa

SEQ ID NO: 226937 - DNA, 25 bp, Mus musculus
ataatttttatgacttccatgccat

SEQ ID NO: 226938 - DNA, 25 bp, Mus musculus
ataatttttatgtcttccatgccat

SEQ ID NO: 226939 - DNA, 25 bp, Mus musculus
atacaaaaacatccaccattgcatg

SEQ ID NO: 226940 - DNA, 25 bp, Mus musculus
atacaaaaacatgcaccattgcatg

SEQ ID NO: 226941 - DNA, 25 bp, Mus musculus
atacaaaaatctcagcagcgccagg

SEQ ID NO: 226942 - DNA, 25 bp, Mus musculus
atacaaaaatctgagcagcgccagg

SEQ ID NO: 226943 - DNA, 25 bp, Mus musculus
atacaaaaatgaatggtcacctcag

SEQ ID NO: 226944 - DNA, 25 bp, Mus musculus
atacaaaaatgattggtcacctcag

SEQ ID NO: 226945 - DNA, 25 bp, Mus musculus
atacaaaaccatactgtcgtccaaa

SEQ ID NO: 226946 - DNA, 25 bp, Mus musculus
atacaaaaccattctgtcgtccaaa

SEQ ID NO: 226947 - DNA, 25 bp, Mus musculus
atacaaaacctcatgtgctcttggt

SEQ ID NO: 226948 - DNA, 25 bp, Mus musculus
atacaaaacctcttgtgctcttggt

SEQ ID NO: 226949 - DNA, 25 bp, Mus musculus
atacaaaatggcaccctgctcagtc

SEQ ID NO: 226950 - DNA, 25 bp, Mus musculus
atacaaaatggctccctgctcagtc

SEQ ID NO: 226951 - DNA, 25 bp, Mus musculus
atacaaaatggtctcctgagtgatt

SEQ ID NO: 226952 - DNA, 25 bp, Mus musculus
atacaaaatggtgtcctgagtgatt

SEQ ID NO: 226953 - DNA, 25 bp, Mus musculus
atacaaaattctcctggctcatctc

SEQ ID NO: 226954 - DNA, 25 bp, Mus musculus
atacaaaattctgctggctcatctc

SEQ ID NO: 226955 - DNA, 25 bp, Mus musculus
atacaaaccaatcaagccccgggcg

SEQ ID NO: 226956 - DNA, 25 bp, Mus musculus
atacaaaccaatgaagccccgggcg

SEQ ID NO: 226957 - DNA, 25 bp, Mus musculus
atacaaaccagtctacctctgacct

SEQ ID NO: 226958 - DNA, 25 bp, Mus musculus
atacaaaccagtgtacctctgacct

SEQ ID NO: 226959 - DNA, 25 bp, Mus musculus
atacaaaccgtgcataaagccctca

SEQ ID NO: 226960 - DNA, 25 bp, Mus musculus
atacaaaccgtggataaagccctca

SEQ ID NO: 226961 - DNA, 25 bp, Mus musculus
atacaaacgcaaataaatggacaga

SEQ ID NO: 226962 - DNA, 25 bp, Mus musculus
atacaaacgcaattaaatggacaga

SEQ ID NO: 226963 - DNA, 25 bp, Mus musculus
atacaaactagtcgcccaagagcta

SEQ ID NO: 226964 - DNA, 25 bp, Mus musculus
atacaaactagtggcccaagagcta

SEQ ID NO: 226965 - DNA, 25 bp, Mus musculus
atacaaactttcactggatctgcct

SEQ ID NO: 226966 - DNA, 25 bp, Mus musculus
atacaaactttctctggatctgcct

SEQ ID NO: 226967 - DNA, 25 bp, Mus musculus
atacaaagacgacatccggcggcac

SEQ ID NO: 226968 - DNA, 25 bp, Mus musculus
atacaaagacgagatccggcggcac

SEQ ID NO: 226969 - DNA, 25 bp, Mus musculus
atacaaagatgacctcctggcattg

SEQ ID NO: 226970 - DNA, 25 bp, Mus musculus
atacaaagatgagctcctggcattg

SEQ ID NO: 226971 - DNA, 25 bp, Mus musculus
atacaaagctccaaggtcttctcaa

SEQ ID NO: 226972 - DNA, 25 bp, Mus musculus
atacaaagctcctaggtcttctcaa

SEQ ID NO: 226973 - DNA, 25 bp, Mus musculus
atacaaagctctcgtggcgggccat

SEQ ID NO: 226974 - DNA, 25 bp, Mus musculus
atacaaagctctggtggcgggccat

SEQ ID NO: 226975 - DNA, 25 bp, Mus musculus
atacaaagtgcacatgtcttcattc

SEQ ID NO: 226976 - DNA, 25 bp, Mus musculus
atacaaagtgcagatgtcttcattc

SEQ ID NO: 226977 - DNA, 25 bp, Mus musculus
atacaaatacttactgtgagctaca

SEQ ID NO: 226978 - DNA, 25 bp, Mus musculus
atacaaatactttctgtgagctaca

SEQ ID NO: 226979 - DNA, 25 bp, Mus musculus
atacaaatgaacactgcttcgatcc

SEQ ID NO: 226980 - DNA, 25 bp, Mus musculus
atacaaatgaactctgcttcgatcc

SEQ ID NO: 226981 - DNA, 25 bp, Mus musculus
atacaaatgagcagtccctttccaa

SEQ ID NO: 226982 - DNA, 25 bp, Mus musculus
atacaaatgagctgtccctttccaa

SEQ ID NO: 226983 - DNA, 25 bp, Mus musculus
atacaaatgtatacgtgtcaggtct

SEQ ID NO: 226984 - DNA, 25 bp, Mus musculus
atacaaatgtattcgtgtcaggtct

SEQ ID NO: 226985 - DNA, 25 bp, Mus musculus
atacaacaactgagatacgcaggta

SEQ ID NO: 226986 - DNA, 25 bp, Mus musculus
atacaacaactgtgatacgcaggta

SEQ ID NO: 226987 - DNA, 25 bp, Mus musculus
atacaacacagcctcgactggcaaa

SEQ ID NO: 226988 - DNA, 25 bp, Mus musculus
atacaacacagcgtcgactggcaaa

SEQ ID NO: 226989 - DNA, 25 bp, Mus musculus
atacaacacgtacatgcgcaacacc

SEQ ID NO: 226990 - DNA, 25 bp, Mus musculus
atacaacacgtagatgcgcaacacc

SEQ ID NO: 226991 - DNA, 25 bp, Mus musculus
atacaacactggatcctttgtggac

SEQ ID NO: 226992 - DNA, 25 bp, Mus musculus
atacaacactggttcctttgtggac

SEQ ID NO: 226993 - DNA, 25 bp, Mus musculus
atacaacaggagctttccagtggaa

SEQ ID NO: 226994 - DNA, 25 bp, Mus musculus
atacaacaggaggtttccagtggaa

SEQ ID NO: 226995 - DNA, 25 bp, Mus musculus
atacaacagggacatgtgtcccagt

SEQ ID NO: 226996 - DNA, 25 bp, Mus musculus
atacaacagggagatgtgtcccagt

SEQ ID NO: 226997 - DNA, 25 bp, Mus musculus
atacaacaggtcaccatacttctca

SEQ ID NO: 226998 - DNA, 25 bp, Mus musculus
atacaacaggtctccatacttctca

SEQ ID NO: 226999 - DNA, 25 bp, Mus musculus
atacaacaggtgcaccgcgctgtgg

SEQ ID NO: 227000 - DNA, 25 bp, Mus musculus
atacaacaggtggaccgcgctgtgg

SEQ ID NO: 227001 - DNA, 25 bp, Mus musculus
atacaacagtggaggtctctggtga

SEQ ID NO: 227002 - DNA, 25 bp, Mus musculus
atacaacagtggtggtctctggtga

SEQ ID NO: 227003 - DNA, 25 bp, Mus musculus
atacaacatccacctcttagttgtg

SEQ ID NO: 227004 - DNA, 25 bp, Mus musculus
atacaacatccagctcttagttgtg

SEQ ID NO: 227005 - DNA, 25 bp, Mus musculus
atacaaccagcacctatagtccagt

SEQ ID NO: 227006 - DNA, 25 bp, Mus musculus
atacaaccagcagctatagtccagt

SEQ ID NO: 227007 - DNA, 25 bp, Mus musculus
atacaaccagctattctcatcagaa

SEQ ID NO: 227008 - DNA, 25 bp, Mus musculus
atacaaccagcttttctcatcagaa

SEQ ID NO: 227009 - DNA, 25 bp, Mus musculus
atacaaccctgaaacacttcctcct

SEQ ID NO: 227010 - DNA, 25 bp, Mus musculus
atacaaccctgatacacttcctcct

SEQ ID NO: 227011 - DNA, 25 bp, Mus musculus
atacaaccctttcttcatggctctc

SEQ ID NO: 227012 - DNA, 25 bp, Mus musculus
atacaaccctttgttcatggctctc

SEQ ID NO: 227013 - DNA, 25 bp, Mus musculus
atacaacctaaaagcttttctatga

SEQ ID NO: 227014 - DNA, 25 bp, Mus musculus
atacaacctaaatgcttttctatga

SEQ ID NO: 227015 - DNA, 25 bp, Mus musculus
atacaacctaatcacgtaaccacag

SEQ ID NO: 227016 - DNA, 25 bp, Mus musculus
atacaacctaatgacgtaaccacag

SEQ ID NO: 227017 - DNA, 25 bp, Mus musculus
atacaacctcacctggtaccagtac

SEQ ID NO: 227018 - DNA, 25 bp, Mus musculus
atacaacctcacgtggtaccagtac

SEQ ID NO: 227019 - DNA, 25 bp, Mus musculus
atacaacctgctacgactgtgatgt

SEQ ID NO: 227020 - DNA, 25 bp, Mus musculus
atacaacctgcttcgactgtgatgt

SEQ ID NO: 227021 - DNA, 25 bp, Mus musculus
atacaaccttaacagcacacactag

SEQ ID NO: 227022 - DNA, 25 bp, Mus musculus
atacaaccttaagagcacacactag

SEQ ID NO: 227023 - DNA, 25 bp, Mus musculus
atacaacgctcgcaagatccaggtt

SEQ ID NO: 227024 - DNA, 25 bp, Mus musculus
atacaacgctcggaagatccaggtt

SEQ ID NO: 227025 - DNA, 25 bp, Mus musculus
atacaacgtgtacacggttccctgt

SEQ ID NO: 227026 - DNA, 25 bp, Mus musculus
atacaacgtgtagacggttccctgt

SEQ ID NO: 227027 - DNA, 25 bp, Mus musculus
atacaacgttacaacttgagcggta

SEQ ID NO: 227028 - DNA, 25 bp, Mus musculus
atacaacgttactacttgagcggta

SEQ ID NO: 227029 - DNA, 25 bp, Mus musculus
atacaactagttaataatcttaggg

SEQ ID NO: 227030 - DNA, 25 bp, Mus musculus
atacaactagtttataatcttaggg

SEQ ID NO: 227031 - DNA, 25 bp, Mus musculus
atacaactctgacctcagtctgggt

SEQ ID NO: 227032 - DNA, 25 bp, Mus musculus
atacaactctgagctcagtctgggt

SEQ ID NO: 227033 - DNA, 25 bp, Mus musculus
atacaactgcttactggactgtacg

SEQ ID NO: 227034 - DNA, 25 bp, Mus musculus
atacaactgctttctggactgtacg

SEQ ID NO: 227035 - DNA, 25 bp, Mus musculus
atacaactgtagacttgctgcctcc

SEQ ID NO: 227036 - DNA, 25 bp, Mus musculus
atacaactgtagtcttgctgcctcc

SEQ ID NO: 227037 - DNA, 25 bp, Mus musculus
atacaacttactattctagattctt

SEQ ID NO: 227038 - DNA, 25 bp, Mus musculus
atacaacttacttttctagattctt

SEQ ID NO: 227039 - DNA, 25 bp, Mus musculus
atacaacttgttcccactaccttat

SEQ ID NO: 227040 - DNA, 25 bp, Mus musculus
atacaacttgttgccactaccttat

SEQ ID NO: 227041 - DNA, 25 bp, Mus musculus
atacaagaacccctggtactcacgg

SEQ ID NO: 227042 - DNA, 25 bp, Mus musculus
atacaagaacccgtggtactcacgg

SEQ ID NO: 227043 - DNA, 25 bp, Mus musculus
atacaagaagtacctctgagaacat

SEQ ID NO: 227044 - DNA, 25 bp, Mus musculus
atacaagaagtagctctgagaacat

SEQ ID NO: 227045 - DNA, 25 bp, Mus musculus
atacaagaagttaccaccatgcagg

SEQ ID NO: 227046 - DNA, 25 bp, Mus musculus
atacaagaagtttccaccatgcagg

SEQ ID NO: 227047 - DNA, 25 bp, Mus musculus
atacaagacataccattcagctcca

SEQ ID NO: 227048 - DNA, 25 bp, Mus musculus
atacaagacatagcattcagctcca

SEQ ID NO: 227049 - DNA, 25 bp, Mus musculus
atacaagaccaaaggcagcgccgtc

SEQ ID NO: 227050 - DNA, 25 bp, Mus musculus
atacaagaccaatggcagcgccgtc

SEQ ID NO: 227051 - DNA, 25 bp, Mus musculus
atacaagaccgtcatcaagaaagat

SEQ ID NO: 227052 - DNA, 25 bp, Mus musculus
atacaagaccgtgatcaagaaagat

SEQ ID NO: 227053 - DNA, 25 bp, Mus musculus
atacaagagagcatatttactgtga

SEQ ID NO: 227054 - DNA, 25 bp, Mus musculus
atacaagagagcttatttactgtga

SEQ ID NO: 227055 - DNA, 25 bp, Mus musculus
atacaagattaactctgtttccagc

SEQ ID NO: 227056 - DNA, 25 bp, Mus musculus
atacaagattaagtctgtttccagc

SEQ ID NO: 227057 - DNA, 25 bp, Mus musculus
atacaagattatccccagtgccctc

SEQ ID NO: 227058 - DNA, 25 bp, Mus musculus
atacaagattatgcccagtgccctc

SEQ ID NO: 227059 - DNA, 25 bp, Mus musculus
atacaagcatacaggctgctaccct

SEQ ID NO: 227060 - DNA, 25 bp, Mus musculus
atacaagcatactggctgctaccct

SEQ ID NO: 227061 - DNA, 25 bp, Mus musculus
atacaagccatactccatagtttag

SEQ ID NO: 227062 - DNA, 25 bp, Mus musculus
atacaagccatagtccatagtttag

SEQ ID NO: 227063 - DNA, 25 bp, Mus musculus
atacaagcccaaatgcgtggtttgt

SEQ ID NO: 227064 - DNA, 25 bp, Mus musculus
atacaagcccaattgcgtggtttgt

SEQ ID NO: 227065 - DNA, 25 bp, Mus musculus
atacaagctagacccataataaaac

SEQ ID NO: 227066 - DNA, 25 bp, Mus musculus
atacaagctagagccataataaaac

SEQ ID NO: 227067 - DNA, 25 bp, Mus musculus
atacaagcttgaactctgtccactg

SEQ ID NO: 227068 - DNA, 25 bp, Mus musculus
atacaagcttgatctctgtccactg

SEQ ID NO: 227069 - DNA, 25 bp, Mus musculus
atacaaggcctccactagtgactac

SEQ ID NO: 227070 - DNA, 25 bp, Mus musculus
atacaaggcctcgactagtgactac

SEQ ID NO: 227071 - DNA, 25 bp, Mus musculus
atacaaggctgtcttgcctgtcact

SEQ ID NO: 227072 - DNA, 25 bp, Mus musculus
atacaaggctgtgttgcctgtcact

SEQ ID NO: 227073 - DNA, 25 bp, Mus musculus
atacaaggcttacctacggtggctg

SEQ ID NO: 227074 - DNA, 25 bp, Mus musculus
atacaaggcttagctacggtggctg

SEQ ID NO: 227075 - DNA, 25 bp, Mus musculus
atacaagggtatcagcttttcctta

SEQ ID NO: 227076 - DNA, 25 bp, Mus musculus
atacaagggtatgagcttttcctta

SEQ ID NO: 227077 - DNA, 25 bp, Mus musculus
atacaaggtcacagggtggacttca

SEQ ID NO: 227078 - DNA, 25 bp, Mus musculus
atacaaggtcactgggtggacttca

SEQ ID NO: 227079 - DNA, 25 bp, Mus musculus
atacaaggtgcgattccccgggact

SEQ ID NO: 227080 - DNA, 25 bp, Mus musculus
atacaaggtgcgtttccccgggact

SEQ ID NO: 227081 - DNA, 25 bp, Mus musculus
atacaaggttctcaggacagtccaa

SEQ ID NO: 227082 - DNA, 25 bp, Mus musculus
atacaaggttctgaggacagtccaa

SEQ ID NO: 227083 - DNA, 25 bp, Mus musculus
atacaagtggccatgggtcctcatg

SEQ ID NO: 227084 - DNA, 25 bp, Mus musculus
atacaagtggccttgggtcctcatg

SEQ ID NO: 227085 - DNA, 25 bp, Mus musculus
atacaagttctgagaggcatgtcaa

SEQ ID NO: 227086 - DNA, 25 bp, Mus musculus
atacaagttctgtgaggcatgtcaa

SEQ ID NO: 227087 - DNA, 25 bp, Mus musculus
atacaagttgatcccctatccacag

SEQ ID NO: 227088 - DNA, 25 bp, Mus musculus
atacaagttgatgccctatccacag

SEQ ID NO: 227089 - DNA, 25 bp, Mus musculus
atacaatactcgatcctcaagtgtg

SEQ ID NO: 227090 - DNA, 25 bp, Mus musculus
atacaatactcgttcctcaagtgtg

SEQ ID NO: 227091 - DNA, 25 bp, Mus musculus
atacaatagaatctgttgaggcaca

SEQ ID NO: 227092 - DNA, 25 bp, Mus musculus
atacaatagaatgtgttgaggcaca

SEQ ID NO: 227093 - DNA, 25 bp, Mus musculus
atacaatatgctacctccaaaggca

SEQ ID NO: 227094 - DNA, 25 bp, Mus musculus
atacaatatgcttcctccaaaggca

SEQ ID NO: 227095 - DNA, 25 bp, Mus musculus
atacaatcaagaatcctgcctccag

SEQ ID NO: 227096 - DNA, 25 bp, Mus musculus
atacaatcaagattcctgcctccag

SEQ ID NO: 227097 - DNA, 25 bp, Mus musculus
atacaatcagtgagcttagctttaa

SEQ ID NO: 227098 - DNA, 25 bp, Mus musculus
atacaatcagtgtgcttagctttaa

SEQ ID NO: 227099 - DNA, 25 bp, Mus musculus
atacaatcctcaaaatatctaataa

SEQ ID NO: 227100 - DNA, 25 bp, Mus musculus
atacaatcctcataatatctaataa

SEQ ID NO: 227101 - DNA, 25 bp, Mus musculus
atacaatctctgaggatcggccagt

SEQ ID NO: 227102 - DNA, 25 bp, Mus musculus
atacaatctctgtggatcggccagt

SEQ ID NO: 227103 - DNA, 25 bp, Mus musculus
atacaatgaagcaggtctcacctct

SEQ ID NO: 227104 - DNA, 25 bp, Mus musculus
atacaatgaagctggtctcacctct

SEQ ID NO: 227105 - DNA, 25 bp, Mus musculus
atacaatgcatcacttttcttgggc

SEQ ID NO: 227106 - DNA, 25 bp, Mus musculus
atacaatgcatctcttttcttgggc

SEQ ID NO: 227107 - DNA, 25 bp, Mus musculus
atacaatgccagatactccagagcc

SEQ ID NO: 227108 - DNA, 25 bp, Mus musculus
atacaatgccagttactccagagcc

SEQ ID NO: 227109 - DNA, 25 bp, Mus musculus
atacaatggctaacctttcagagtg

SEQ ID NO: 227110 - DNA, 25 bp, Mus musculus
atacaatggctatcctttcagagtg

SEQ ID NO: 227111 - DNA, 25 bp, Mus musculus
atacaatgtattctgtttagcccaa

SEQ ID NO: 227112 - DNA, 25 bp, Mus musculus
atacaatgtattgtgtttagcccaa

SEQ ID NO: 227113 - DNA, 25 bp, Mus musculus
atacaatgtggcacatatggcacta

SEQ ID NO: 227114 - DNA, 25 bp, Mus musculus
atacaatgtggctcatatggcacta

SEQ ID NO: 227115 - DNA, 25 bp, Mus musculus
atacaatgtgtaatttcctttctaa

SEQ ID NO: 227116 - DNA, 25 bp, Mus musculus
atacaatgtgtattttcctttctaa

SEQ ID NO: 227117 - DNA, 25 bp, Mus musculus
atacaatgtttcacactaccacggt

SEQ ID NO: 227118 - DNA, 25 bp, Mus musculus
atacaatgtttctcactaccacggt

SEQ ID NO: 227119 - DNA, 25 bp, Mus musculus
atacaattattgatcccctaggcaa

SEQ ID NO: 227120 - DNA, 25 bp, Mus musculus
atacaattattgttcccctaggcaa

SEQ ID NO: 227121 - DNA, 25 bp, Mus musculus
atacaattcataactacacacaagt

SEQ ID NO: 227122 - DNA, 25 bp, Mus musculus
atacaattcatatctacacacaagt

SEQ ID NO: 227123 - DNA, 25 bp, Mus musculus
atacaattcccaagcttgctttatt

SEQ ID NO: 227124 - DNA, 25 bp, Mus musculus
atacaattcccatgcttgctttatt

SEQ ID NO: 227125 - DNA, 25 bp, Mus musculus
atacaattccgcatcccttgggaga

SEQ ID NO: 227126 - DNA, 25 bp, Mus musculus
atacaattccgcttcccttgggaga

SEQ ID NO: 227127 - DNA, 25 bp, Mus musculus
atacaattcttgattccccacaatt

SEQ ID NO: 227128 - DNA, 25 bp, Mus musculus
atacaattcttgtttccccacaatt

SEQ ID NO: 227129 - DNA, 25 bp, Mus musculus
atacaattgggaccctgcccatcct

SEQ ID NO: 227130 - DNA, 25 bp, Mus musculus
atacaattgggagcctgcccatcct

SEQ ID NO: 227131 - DNA, 25 bp, Mus musculus
atacaattgttgattctggctattg

SEQ ID NO: 227132 - DNA, 25 bp, Mus musculus
atacaattgttgtttctggctattg

SEQ ID NO: 227133 - DNA, 25 bp, Mus musculus
atacacaaccataacccaacatttt

SEQ ID NO: 227134 - DNA, 25 bp, Mus musculus
atacacaaccattacccaacatttt

SEQ ID NO: 227135 - DNA, 25 bp, Mus musculus
atacacaagactcttgttctttcag

SEQ ID NO: 227136 - DNA, 25 bp, Mus musculus
atacacaagactgttgttctttcag

SEQ ID NO: 227137 - DNA, 25 bp, Mus musculus
atacacacacagctgatccactcat

SEQ ID NO: 227138 - DNA, 25 bp, Mus musculus
atacacacacaggtgatccactcat

SEQ ID NO: 227139 - DNA, 25 bp, Mus musculus
atacacacacatagcatcctcagga

SEQ ID NO: 227140 - DNA, 25 bp, Mus musculus
atacacacacattgcatcctcagga

SEQ ID NO: 227141 - DNA, 25 bp, Mus musculus
atacacacaccaaaaattttcccgc

SEQ ID NO: 227142 - DNA, 25 bp, Mus musculus
atacacacaccaaccctgtggcagt

SEQ ID NO: 227143 - DNA, 25 bp, Mus musculus
atacacacaccaattatgccttgaa

SEQ ID NO: 227144 - DNA, 25 bp, Mus musculus
atacacacaccataaattttcccgc

SEQ ID NO: 227145 - DNA, 25 bp, Mus musculus
atacacacaccatccctgtggcagt

SEQ ID NO: 227146 - DNA, 25 bp, Mus musculus
atacacacaccatttatgccttgaa

SEQ ID NO: 227147 - DNA, 25 bp, Mus musculus
atacacacacccctgtggctgggag

SEQ ID NO: 227148 - DNA, 25 bp, Mus musculus
atacacacacccgtgtggctgggag

SEQ ID NO: 227149 - DNA, 25 bp, Mus musculus
atacacacacgcacggacggatgga

SEQ ID NO: 227150 - DNA, 25 bp, Mus musculus
atacacacacgctcggacggatgga

SEQ ID NO: 227151 - DNA, 25 bp, Mus musculus
atacacacattgatgcatgtgggta

SEQ ID NO: 227152 - DNA, 25 bp, Mus musculus
atacacacattgttgcatgtgggta

SEQ ID NO: 227153 - DNA, 25 bp, Mus musculus
atacacaccaaacagcttttcactt

SEQ ID NO: 227154 - DNA, 25 bp, Mus musculus
atacacaccaaagagcttttcactt

SEQ ID NO: 227155 - DNA, 25 bp, Mus musculus
atacacacccatctttacttggatt

SEQ ID NO: 227156 - DNA, 25 bp, Mus musculus
atacacacccatgtttacttggatt

SEQ ID NO: 227157 - DNA, 25 bp, Mus musculus
atacacaccgaaattctgactgaga

SEQ ID NO: 227158 - DNA, 25 bp, Mus musculus
atacacaccgaatttctgactgaga

SEQ ID NO: 227159 - DNA, 25 bp, Mus musculus
atacacaccttcacagattgccctg

SEQ ID NO: 227160 - DNA, 25 bp, Mus musculus
atacacaccttctcagattgccctg

SEQ ID NO: 227161 - DNA, 25 bp, Mus musculus
atacacacgactcccaggattcagg

SEQ ID NO: 227162 - DNA, 25 bp, Mus musculus
atacacacgactgccaggattcagg

SEQ ID NO: 227163 - DNA, 25 bp, Mus musculus
atacacacgcttatacatattacaa

SEQ ID NO: 227164 - DNA, 25 bp, Mus musculus
atacacacgcttttacatattacaa

SEQ ID NO: 227165 - DNA, 25 bp, Mus musculus
atacacacgtatcgaattctcaaaa

SEQ ID NO: 227166 - DNA, 25 bp, Mus musculus
atacacacgtatggaattctcaaaa

SEQ ID NO: 227167 - DNA, 25 bp, Mus musculus
atacacactatactggagggatatc

SEQ ID NO: 227168 - DNA, 25 bp, Mus musculus
atacacactatagtggagggatatc

SEQ ID NO: 227169 - DNA, 25 bp, Mus musculus
atacacactcggagtgcttgcacac

SEQ ID NO: 227170 - DNA, 25 bp, Mus musculus
atacacactcggtgtgcttgcacac

SEQ ID NO: 227171 - DNA, 25 bp, Mus musculus
atacacactgaacaactggttggct

SEQ ID NO: 227172 - DNA, 25 bp, Mus musculus
atacacactgaagaactggttggct

SEQ ID NO: 227173 - DNA, 25 bp, Mus musculus
atacacacttgtactattcatttga

SEQ ID NO: 227174 - DNA, 25 bp, Mus musculus
atacacacttgttctattcatttga

SEQ ID NO: 227175 - DNA, 25 bp, Mus musculus
atacacagagctactatattggtgg

SEQ ID NO: 227176 - DNA, 25 bp, Mus musculus
atacacagagcttctatattggtgg

SEQ ID NO: 227177 - DNA, 25 bp, Mus musculus
atacacagatagaggccatccgggc

SEQ ID NO: 227178 - DNA, 25 bp, Mus musculus
atacacagatagtggccatccgggc

SEQ ID NO: 227179 - DNA, 25 bp, Mus musculus
atacacagccagatttcaaaatgaa

SEQ ID NO: 227180 - DNA, 25 bp, Mus musculus
atacacagccagttttcaaaatgaa

SEQ ID NO: 227181 - DNA, 25 bp, Mus musculus
atacacagctgcaattttgaccatg

SEQ ID NO: 227182 - DNA, 25 bp, Mus musculus
atacacagctgctattttgaccatg

SEQ ID NO: 227183 - DNA, 25 bp, Mus musculus
atacacaggagtactgtccacccag

SEQ ID NO: 227184 - DNA, 25 bp, Mus musculus
atacacaggagttctgtccacccag

SEQ ID NO: 227185 - DNA, 25 bp, Mus musculus
atacacaggcctatctcgtagatgg

SEQ ID NO: 227186 - DNA, 25 bp, Mus musculus
atacacaggcctttctcgtagatgg

SEQ ID NO: 227187 - DNA, 25 bp, Mus musculus
atacacaggctcacagtgatacccc

SEQ ID NO: 227188 - DNA, 25 bp, Mus musculus
atacacaggctctcagtgatacccc

SEQ ID NO: 227189 - DNA, 25 bp, Mus musculus
atacacagtacaactgttaattctg

SEQ ID NO: 227190 - DNA, 25 bp, Mus musculus
atacacagtacatctgttaattctg

SEQ ID NO: 227191 - DNA, 25 bp, Mus musculus
atacacagtgccacaaaggcctgtt

SEQ ID NO: 227192 - DNA, 25 bp, Mus musculus
atacacagtgcctcaaaggcctgtt

SEQ ID NO: 227193 - DNA, 25 bp, Mus musculus
atacacagtgctctaggcaggcatt

SEQ ID NO: 227194 - DNA, 25 bp, Mus musculus
atacacagtgctgtaggcaggcatt

SEQ ID NO: 227195 - DNA, 25 bp, Mus musculus
atacacagtgtgctactcgtctctc

SEQ ID NO: 227196 - DNA, 25 bp, Mus musculus
atacacagtgtggtactcgtctctc

SEQ ID NO: 227197 - DNA, 25 bp, Mus musculus
atacacagtgttacggtttgagggt

SEQ ID NO: 227198 - DNA, 25 bp, Mus musculus
atacacagtgtttcggtttgagggt

SEQ ID NO: 227199 - DNA, 25 bp, Mus musculus
atacacagttctagatccacttgga

SEQ ID NO: 227200 - DNA, 25 bp, Mus musculus
atacacagttcttgatccacttgga

SEQ ID NO: 227201 - DNA, 25 bp, Mus musculus
atacacatatatatcccgagccagc

SEQ ID NO: 227202 - DNA, 25 bp, Mus musculus
atacacatatatttcccgagccagc

SEQ ID NO: 227203 - DNA, 25 bp, Mus musculus
atacacatcctcattaatgaaggta

SEQ ID NO: 227204 - DNA, 25 bp, Mus musculus
atacacatcctctttaatgaaggta

SEQ ID NO: 227205 - DNA, 25 bp, Mus musculus
atacacatgattacttactctgatt

SEQ ID NO: 227206 - DNA, 25 bp, Mus musculus
atacacatgatttcttactctgatt

SEQ ID NO: 227207 - DNA, 25 bp, Mus musculus
atacacatgccacctgtctaaaagg

SEQ ID NO: 227208 - DNA, 25 bp, Mus musculus
atacacatgccagctgtctaaaagg

SEQ ID NO: 227209 - DNA, 25 bp, Mus musculus
atacacatgctaaaagttcgcctta

SEQ ID NO: 227210 - DNA, 25 bp, Mus musculus
atacacatgctacatgggcgtacat

SEQ ID NO: 227211 - DNA, 25 bp, Mus musculus
atacacatgctagatgggcgtacat

SEQ ID NO: 227212 - DNA, 25 bp, Mus musculus
atacacatgctataagttcgcctta

SEQ ID NO: 227213 - DNA, 25 bp, Mus musculus
atacacattacaattccataccagt

SEQ ID NO: 227214 - DNA, 25 bp, Mus musculus
atacacattacatttccataccagt

SEQ ID NO: 227215 - DNA, 25 bp, Mus musculus
atacacattggtaggcttgcctatt

SEQ ID NO: 227216 - DNA, 25 bp, Mus musculus
atacacattggttggcttgcctatt

SEQ ID NO: 227217 - DNA, 25 bp, Mus musculus
atacacatttatccagtctgccagg

SEQ ID NO: 227218 - DNA, 25 bp, Mus musculus
atacacatttatgcagtctgccagg

SEQ ID NO: 227219 - DNA, 25 bp, Mus musculus
atacacatttgcaggcttcttgggc

SEQ ID NO: 227220 - DNA, 25 bp, Mus musculus
atacacatttgctggcttcttgggc

SEQ ID NO: 227221 - DNA, 25 bp, Mus musculus
atacaccaacaaactcctgtaactt

SEQ ID NO: 227222 - DNA, 25 bp, Mus musculus
atacaccaacaatctcctgtaactt

SEQ ID NO: 227223 - DNA, 25 bp, Mus musculus
atacaccaactacgagtggccccaa

SEQ ID NO: 227224 - DNA, 25 bp, Mus musculus
atacaccaactaggagtggccccaa

SEQ ID NO: 227225 - DNA, 25 bp, Mus musculus
atacaccaggcaaattctctgccac

SEQ ID NO: 227226 - DNA, 25 bp, Mus musculus
atacaccaggcatattctctgccac

SEQ ID NO: 227227 - DNA, 25 bp, Mus musculus
atacaccataccaggagcacctcag

SEQ ID NO: 227228 - DNA, 25 bp, Mus musculus
atacaccatacctggagcacctcag

SEQ ID NO: 227229 - DNA, 25 bp, Mus musculus
atacaccatactatcatgaatcaga

SEQ ID NO: 227230 - DNA, 25 bp, Mus musculus
atacaccatactttcatgaatcaga

SEQ ID NO: 227231 - DNA, 25 bp, Mus musculus
atacaccatcatccaaagtttaaca

SEQ ID NO: 227232 - DNA, 25 bp, Mus musculus
atacaccatcatgcaaagtttaaca

SEQ ID NO: 227233 - DNA, 25 bp, Mus musculus
atacaccatcccaattgacttacta

SEQ ID NO: 227234 - DNA, 25 bp, Mus musculus
atacaccatccctattgacttacta

SEQ ID NO: 227235 - DNA, 25 bp, Mus musculus
atacaccatggaatagaccttccag

SEQ ID NO: 227236 - DNA, 25 bp, Mus musculus
atacaccatggattagaccttccag

SEQ ID NO: 227237 - DNA, 25 bp, Mus musculus
atacaccatgtaattgctttgtcaa

SEQ ID NO: 227238 - DNA, 25 bp, Mus musculus
atacaccatgtatttgctttgtcaa

SEQ ID NO: 227239 - DNA, 25 bp, Mus musculus
atacacccaccacccctaattacag

SEQ ID NO: 227240 - DNA, 25 bp, Mus musculus
atacacccaccagccctaattacag

SEQ ID NO: 227241 - DNA, 25 bp, Mus musculus
atacacccatgcatgttacacttgt

SEQ ID NO: 227242 - DNA, 25 bp, Mus musculus
atacacccatgcttgttacacttgt

SEQ ID NO: 227243 - DNA, 25 bp, Mus musculus
atacaccccttgctgtgagctcatt

SEQ ID NO: 227244 - DNA, 25 bp, Mus musculus
atacaccccttggtgtgagctcatt

SEQ ID NO: 227245 - DNA, 25 bp, Mus musculus
atacacccggtgagaaaggatggga

SEQ ID NO: 227246 - DNA, 25 bp, Mus musculus
atacacccggtgtgaaaggatggga

SEQ ID NO: 227247 - DNA, 25 bp, Mus musculus
atacaccctaatacaattattgatt

SEQ ID NO: 227248 - DNA, 25 bp, Mus musculus
atacaccctaattcaattattgatt

SEQ ID NO: 227249 - DNA, 25 bp, Mus musculus
atacaccctgataaagtcacgtcca

SEQ ID NO: 227250 - DNA, 25 bp, Mus musculus
atacaccctgattaagtcacgtcca

SEQ ID NO: 227251 - DNA, 25 bp, Mus musculus
atacaccgctcacagtgtttcagag

SEQ ID NO: 227252 - DNA, 25 bp, Mus musculus
atacaccgctcagagtgtttcagag

SEQ ID NO: 227253 - DNA, 25 bp, Mus musculus
atacaccgtaatattagccactcgc

SEQ ID NO: 227254 - DNA, 25 bp, Mus musculus
atacaccgtaattttagccactcgc

SEQ ID NO: 227255 - DNA, 25 bp, Mus musculus
atacaccgtcacagtctttagacag

SEQ ID NO: 227256 - DNA, 25 bp, Mus musculus
atacaccgtcactgtctttagacag

SEQ ID NO: 227257 - DNA, 25 bp, Mus musculus
atacacctagaacagctcgacttat

SEQ ID NO: 227258 - DNA, 25 bp, Mus musculus
atacacctagaagagctcgacttat

SEQ ID NO: 227259 - DNA, 25 bp, Mus musculus
atacacctaggaacagaatgagctg

SEQ ID NO: 227260 - DNA, 25 bp, Mus musculus
atacacctaggatcagaatgagctg

SEQ ID NO: 227261 - DNA, 25 bp, Mus musculus
atacacctcggacctccgggagcag

SEQ ID NO: 227262 - DNA, 25 bp, Mus musculus
atacacctcggagctccgggagcag

SEQ ID NO: 227263 - DNA, 25 bp, Mus musculus
atacacctcgttacattgtctcaga

SEQ ID NO: 227264 - DNA, 25 bp, Mus musculus
atacacctcgtttcattgtctcaga

SEQ ID NO: 227265 - DNA, 25 bp, Mus musculus
atacacctctatcctgttgagtcca

SEQ ID NO: 227266 - DNA, 25 bp, Mus musculus
atacacctctatgctgttgagtcca

SEQ ID NO: 227267 - DNA, 25 bp, Mus musculus
atacacctgaatagcgagtctgatt

SEQ ID NO: 227268 - DNA, 25 bp, Mus musculus
atacacctgaattgcgagtctgatt

SEQ ID NO: 227269 - DNA, 25 bp, Mus musculus
atacacctgataccactcctacaag

SEQ ID NO: 227270 - DNA, 25 bp, Mus musculus
atacacctgatagcactcctacaag

SEQ ID NO: 227271 - DNA, 25 bp, Mus musculus
atacacctgcgacggccgaaaatga

SEQ ID NO: 227272 - DNA, 25 bp, Mus musculus
atacacctgcgagggccgaaaatga

SEQ ID NO: 227273 - DNA, 25 bp, Mus musculus
atacacctggcacacagtgactcag

SEQ ID NO: 227274 - DNA, 25 bp, Mus musculus
atacacctggcagacagtgactcag

SEQ ID NO: 227275 - DNA, 25 bp, Mus musculus
atacacctggccacctaattgagtt

SEQ ID NO: 227276 - DNA, 25 bp, Mus musculus
atacacctggcctcctaattgagtt

SEQ ID NO: 227277 - DNA, 25 bp, Mus musculus
atacacctgtttagtgctgagttat

SEQ ID NO: 227278 - DNA, 25 bp, Mus musculus
atacacctgttttgtgctgagttat

SEQ ID NO: 227279 - DNA, 25 bp, Mus musculus
atacaccttccaatgttgctggacc

SEQ ID NO: 227280 - DNA, 25 bp, Mus musculus
atacaccttccattgttgctggacc

SEQ ID NO: 227281 - DNA, 25 bp, Mus musculus
atacaccttgcacgtggtagacatg

SEQ ID NO: 227282 - DNA, 25 bp, Mus musculus
atacaccttgcaggtggtagacatg

SEQ ID NO: 227283 - DNA, 25 bp, Mus musculus
atacaccttggtctcccaagaaggt

SEQ ID NO: 227284 - DNA, 25 bp, Mus musculus
atacaccttggtgtcccaagaaggt

SEQ ID NO: 227285 - DNA, 25 bp, Mus musculus
atacacctttagcaggtcaccggcc

SEQ ID NO: 227286 - DNA, 25 bp, Mus musculus
atacacctttaggaggtcaccggcc

SEQ ID NO: 227287 - DNA, 25 bp, Mus musculus
atacacgaacacacatgaaccttat

SEQ ID NO: 227288 - DNA, 25 bp, Mus musculus
atacacgaacactcatgaaccttat

SEQ ID NO: 227289 - DNA, 25 bp, Mus musculus
atacacgaaggcaccactgtgcgtg

SEQ ID NO: 227290 - DNA, 25 bp, Mus musculus
atacacgaaggctccactgtgcgtg

SEQ ID NO: 227291 - DNA, 25 bp, Mus musculus
atacacgagctaacatttatccctg

SEQ ID NO: 227292 - DNA, 25 bp, Mus musculus
atacacgagctatcatttatccctg

SEQ ID NO: 227293 - DNA, 25 bp, Mus musculus
atacacgaggtccaacctcaaaagt

SEQ ID NO: 227294 - DNA, 25 bp, Mus musculus
atacacgaggtcgaacctcaaaagt

SEQ ID NO: 227295 - DNA, 25 bp, Mus musculus
atacacgcaaccatacgatgatgtt

SEQ ID NO: 227296 - DNA, 25 bp, Mus musculus
atacacgcaaccttacgatgatgtt

SEQ ID NO: 227297 - DNA, 25 bp, Mus musculus
atacacgcacagagatacacatata

SEQ ID NO: 227298 - DNA, 25 bp, Mus musculus
atacacgcacagtgatacacatata

SEQ ID NO: 227299 - DNA, 25 bp, Mus musculus
atacacggatgtcttccagcagcaa

SEQ ID NO: 227300 - DNA, 25 bp, Mus musculus
atacacggatgtgttccagcagcaa

SEQ ID NO: 227301 - DNA, 25 bp, Mus musculus
atacacggcccgaggtggaggccca

SEQ ID NO: 227302 - DNA, 25 bp, Mus musculus
atacacggcccgtggtggaggccca

SEQ ID NO: 227303 - DNA, 25 bp, Mus musculus
atacacgtctgtaaggcctgtgctt

SEQ ID NO: 227304 - DNA, 25 bp, Mus musculus
atacacgtctgttaggcctgtgctt

SEQ ID NO: 227305 - DNA, 25 bp, Mus musculus
atacacgtgtggacttgacaagata

SEQ ID NO: 227306 - DNA, 25 bp, Mus musculus
atacacgtgtggtcttgacaagata

SEQ ID NO: 227307 - DNA, 25 bp, Mus musculus
atacacgttaccctggattccgata

SEQ ID NO: 227308 - DNA, 25 bp, Mus musculus
atacacgttaccgtggattccgata

SEQ ID NO: 227309 - DNA, 25 bp, Mus musculus
atacactacaacaaggcagtttcct

SEQ ID NO: 227310 - DNA, 25 bp, Mus musculus
atacactacaactaggcagtttcct

SEQ ID NO: 227311 - DNA, 25 bp, Mus musculus
atacactactcacacagatggagat

SEQ ID NO: 227312 - DNA, 25 bp, Mus musculus
atacactactcagacagatggagat

SEQ ID NO: 227313 - DNA, 25 bp, Mus musculus
atacactagggtcgctcaggacaca

SEQ ID NO: 227314 - DNA, 25 bp, Mus musculus
atacactagggtggctcaggacaca

SEQ ID NO: 227315 - DNA, 25 bp, Mus musculus
atacactatagcacagattgctggg

SEQ ID NO: 227316 - DNA, 25 bp, Mus musculus
atacactatagctcagattgctggg

SEQ ID NO: 227317 - DNA, 25 bp, Mus musculus
atacactatcaaagctttcttctat

SEQ ID NO: 227318 - DNA, 25 bp, Mus musculus
atacactatcaatgctttcttctat

SEQ ID NO: 227319 - DNA, 25 bp, Mus musculus
atacactatgtaatctcgtctggcc

SEQ ID NO: 227320 - DNA, 25 bp, Mus musculus
atacactatgtattctcgtctggcc

SEQ ID NO: 227321 - DNA, 25 bp, Mus musculus
atacactcaggaccataaacaaatg

SEQ ID NO: 227322 - DNA, 25 bp, Mus musculus
atacactcaggagcataaacaaatg

SEQ ID NO: 227323 - DNA, 25 bp, Mus musculus
atacactcagttctctcgttacggt

SEQ ID NO: 227324 - DNA, 25 bp, Mus musculus
atacactcagttgtctcgttacggt

SEQ ID NO: 227325 - DNA, 25 bp, Mus musculus
atacactcatatattctcctcagct

SEQ ID NO: 227326 - DNA, 25 bp, Mus musculus
atacactcatattttctcctcagct

SEQ ID NO: 227327 - DNA, 25 bp, Mus musculus
atacactccaaccattactttgctt

SEQ ID NO: 227328 - DNA, 25 bp, Mus musculus
atacactccaacgattactttgctt

SEQ ID NO: 227329 - DNA, 25 bp, Mus musculus
atacactcctgactacccattttct

SEQ ID NO: 227330 - DNA, 25 bp, Mus musculus
atacactcctgagtacccattttct

SEQ ID NO: 227331 - DNA, 25 bp, Mus musculus
atacactctacaaattcaggaccag

SEQ ID NO: 227332 - DNA, 25 bp, Mus musculus
atacactctacatattcaggaccag

SEQ ID NO: 227333 - DNA, 25 bp, Mus musculus
atacactctagtatctactgctgaa

SEQ ID NO: 227334 - DNA, 25 bp, Mus musculus
atacactctagtttctactgctgaa

SEQ ID NO: 227335 - DNA, 25 bp, Mus musculus
atacactctccgcatggggcttctg

SEQ ID NO: 227336 - DNA, 25 bp, Mus musculus
atacactctccggatggggcttctg

SEQ ID NO: 227337 - DNA, 25 bp, Mus musculus
atacactctgacaatctccacgtta

SEQ ID NO: 227338 - DNA, 25 bp, Mus musculus
atacactctgactatctccacgtta

SEQ ID NO: 227339 - DNA, 25 bp, Mus musculus
atacactcttttcacgtacttctag

SEQ ID NO: 227340 - DNA, 25 bp, Mus musculus
atacactcttttgacgtacttctag

SEQ ID NO: 227341 - DNA, 25 bp, Mus musculus
atacactgagctacctgggtgatgc

SEQ ID NO: 227342 - DNA, 25 bp, Mus musculus
atacactgagcttcctgggtgatgc

SEQ ID NO: 227343 - DNA, 25 bp, Mus musculus
atacactgatccatacgctcacata

SEQ ID NO: 227344 - DNA, 25 bp, Mus musculus
atacactgatccttacgctcacata

SEQ ID NO: 227345 - DNA, 25 bp, Mus musculus
atacactgcatacacatacttcctt

SEQ ID NO: 227346 - DNA, 25 bp, Mus musculus
atacactgcatagacatacttcctt

SEQ ID NO: 227347 - DNA, 25 bp, Mus musculus
atacactgctcacgatgctctctgt

SEQ ID NO: 227348 - DNA, 25 bp, Mus musculus
atacactgctcaggatgctctctgt

SEQ ID NO: 227349 - DNA, 25 bp, Mus musculus
atacactgctccagtagaggaccca

SEQ ID NO: 227350 - DNA, 25 bp, Mus musculus
atacactgctccagtgttagagcct

SEQ ID NO: 227351 - DNA, 25 bp, Mus musculus
atacactgctcctgtagaggaccca

SEQ ID NO: 227352 - DNA, 25 bp, Mus musculus
atacactgctcctgtgttagagcct

SEQ ID NO: 227353 - DNA, 25 bp, Mus musculus
atacactggcgtatgggcgagcttc

SEQ ID NO: 227354 - DNA, 25 bp, Mus musculus
atacactggcgtttgggcgagcttc

SEQ ID NO: 227355 - DNA, 25 bp, Mus musculus
atacactggctccaggaggcaccta

SEQ ID NO: 227356 - DNA, 25 bp, Mus musculus
atacactggctcgaggaggcaccta

SEQ ID NO: 227357 - DNA, 25 bp, Mus musculus
atacactggctgaagcatacaataa

SEQ ID NO: 227358 - DNA, 25 bp, Mus musculus
atacactggctgtagcatacaataa

SEQ ID NO: 227359 - DNA, 25 bp, Mus musculus
atacactggtagacatgctgtagag

SEQ ID NO: 227360 - DNA, 25 bp, Mus musculus
atacactggtagtcatgctgtagag

SEQ ID NO: 227361 - DNA, 25 bp, Mus musculus
atacactggtatccagttcctgcct

SEQ ID NO: 227362 - DNA, 25 bp, Mus musculus
atacactggtatgcagttcctgcct

SEQ ID NO: 227363 - DNA, 25 bp, Mus musculus
atacactgtacaaattgactgccca

SEQ ID NO: 227364 - DNA, 25 bp, Mus musculus
atacactgtacatattgactgccca

SEQ ID NO: 227365 - DNA, 25 bp, Mus musculus
atacactgtcgcataggagtagaag

SEQ ID NO: 227366 - DNA, 25 bp, Mus musculus
atacactgtcgcttaggagtagaag

SEQ ID NO: 227367 - DNA, 25 bp, Mus musculus
atacactgttatcagatgggctgca

SEQ ID NO: 227368 - DNA, 25 bp, Mus musculus
atacactgttatgagatgggctgca

SEQ ID NO: 227369 - DNA, 25 bp, Mus musculus
atacactgttgtctttccaagctgg

SEQ ID NO: 227370 - DNA, 25 bp, Mus musculus
atacactgttgtgtttccaagctgg

SEQ ID NO: 227371 - DNA, 25 bp, Mus musculus
atacacttaacaagacccagcaata

SEQ ID NO: 227372 - DNA, 25 bp, Mus musculus
atacacttaacactgatcaggtggg

SEQ ID NO: 227373 - DNA, 25 bp, Mus musculus
atacacttaacagtgatcaggtggg

SEQ ID NO: 227374 - DNA, 25 bp, Mus musculus
atacacttaacatgacccagcaata

SEQ ID NO: 227375 - DNA, 25 bp, Mus musculus
atacacttacagcaactggtctcct

SEQ ID NO: 227376 - DNA, 25 bp, Mus musculus
atacacttacaggaactggtctcct

SEQ ID NO: 227377 - DNA, 25 bp, Mus musculus
atacacttatatcgctccatcaatt

SEQ ID NO: 227378 - DNA, 25 bp, Mus musculus
atacacttatatggctccatcaatt

SEQ ID NO: 227379 - DNA, 25 bp, Mus musculus
atacacttccgactttcctacacgt

SEQ ID NO: 227380 - DNA, 25 bp, Mus musculus
atacacttccgagtttcctacacgt

SEQ ID NO: 227381 - DNA, 25 bp, Mus musculus
atacacttccttctagtgagtttaa

SEQ ID NO: 227382 - DNA, 25 bp, Mus musculus
atacacttccttgtagtgagtttaa

SEQ ID NO: 227383 - DNA, 25 bp, Mus musculus
atacacttggcaagatacttgcttt

SEQ ID NO: 227384 - DNA, 25 bp, Mus musculus
atacacttggcacggtaagacatcc

SEQ ID NO: 227385 - DNA, 25 bp, Mus musculus
atacacttggcagggtaagacatcc

SEQ ID NO: 227386 - DNA, 25 bp, Mus musculus
atacacttggcatgatacttgcttt

SEQ ID NO: 227387 - DNA, 25 bp, Mus musculus
atacacttgtttataggtagtacag

SEQ ID NO: 227388 - DNA, 25 bp, Mus musculus
atacacttgtttttaggtagtacag

SEQ ID NO: 227389 - DNA, 25 bp, Mus musculus
atacactttctgacgtttcaaactg

SEQ ID NO: 227390 - DNA, 25 bp, Mus musculus
atacactttctgtcgtttcaaactg

SEQ ID NO: 227391 - DNA, 25 bp, Mus musculus
atacactttgctaactcctcagcag

SEQ ID NO: 227392 - DNA, 25 bp, Mus musculus
atacactttgcttactcctcagcag

SEQ ID NO: 227393 - DNA, 25 bp, Mus musculus
atacactttgtgagctttaatgttg

SEQ ID NO: 227394 - DNA, 25 bp, Mus musculus
atacactttgtgtgctttaatgttg

SEQ ID NO: 227395 - DNA, 25 bp, Mus musculus
atacacttttcactgagtcacttct

SEQ ID NO: 227396 - DNA, 25 bp, Mus musculus
atacacttttcagtgagtcacttct

SEQ ID NO: 227397 - DNA, 25 bp, Mus musculus
atacagaacgcacgcttcctaaaat

SEQ ID NO: 227398 - DNA, 25 bp, Mus musculus
atacagaacgcaggcttcctaaaat

SEQ ID NO: 227399 - DNA, 25 bp, Mus musculus
atacagaactctcaactcactaaga

SEQ ID NO: 227400 - DNA, 25 bp, Mus musculus
atacagaactctgaactcactaaga

SEQ ID NO: 227401 - DNA, 25 bp, Mus musculus
atacagaacttaaggaccctcagaa

SEQ ID NO: 227402 - DNA, 25 bp, Mus musculus
atacagaacttatggaccctcagaa

SEQ ID NO: 227403 - DNA, 25 bp, Mus musculus
atacagaatgaacagcacagcactt

SEQ ID NO: 227404 - DNA, 25 bp, Mus musculus
atacagaatgaagagcacagcactt

SEQ ID NO: 227405 - DNA, 25 bp, Mus musculus
atacagaattacactccacaaccat

SEQ ID NO: 227406 - DNA, 25 bp, Mus musculus
atacagaattactctccacaaccat

SEQ ID NO: 227407 - DNA, 25 bp, Mus musculus
atacagacaagccatctctatccta

SEQ ID NO: 227408 - DNA, 25 bp, Mus musculus
atacagacaagcgatctctatccta

SEQ ID NO: 227409 - DNA, 25 bp, Mus musculus
atacagacaagtcctatgccgtgaa

SEQ ID NO: 227410 - DNA, 25 bp, Mus musculus
atacagacaagtgctatgccgtgaa

SEQ ID NO: 227411 - DNA, 25 bp, Mus musculus
atacagacccctagttactgtttca

SEQ ID NO: 227412 - DNA, 25 bp, Mus musculus
atacagaccccttgttactgtttca

SEQ ID NO: 227413 - DNA, 25 bp, Mus musculus
atacagacctcaagtttcccaaaag

SEQ ID NO: 227414 - DNA, 25 bp, Mus musculus
atacagacctcatgtttcccaaaag

SEQ ID NO: 227415 - DNA, 25 bp, Mus musculus
atacagacctctcacatcatgctgc

SEQ ID NO: 227416 - DNA, 25 bp, Mus musculus
atacagacctctgacatcatgctgc

SEQ ID NO: 227417 - DNA, 25 bp, Mus musculus
atacagacggatctagcttccaaaa

SEQ ID NO: 227418 - DNA, 25 bp, Mus musculus
atacagacggatgtagcttccaaaa

SEQ ID NO: 227419 - DNA, 25 bp, Mus musculus
atacagactcagcttgtgttctctc

SEQ ID NO: 227420 - DNA, 25 bp, Mus musculus
atacagactcaggttgtgttctctc

SEQ ID NO: 227421 - DNA, 25 bp, Mus musculus
atacagacttgaacacccctgggtg

SEQ ID NO: 227422 - DNA, 25 bp, Mus musculus
atacagacttgatcacccctgggtg

SEQ ID NO: 227423 - DNA, 25 bp, Mus musculus
atacagacttgtcgtgccatccttg

SEQ ID NO: 227424 - DNA, 25 bp, Mus musculus
atacagacttgtggtgccatccttg

SEQ ID NO: 227425 - DNA, 25 bp, Mus musculus
atacagagagtaattccgatccaca

SEQ ID NO: 227426 - DNA, 25 bp, Mus musculus
atacagagagtatttccgatccaca

SEQ ID NO: 227427 - DNA, 25 bp, Mus musculus
atacagagatagagcatcacattcc

SEQ ID NO: 227428 - DNA, 25 bp, Mus musculus
atacagagatagtgcatcacattcc

SEQ ID NO: 227429 - DNA, 25 bp, Mus musculus
atacagagcctcatgactgactgct

SEQ ID NO: 227430 - DNA, 25 bp, Mus musculus
atacagagcctcttgactgactgct

SEQ ID NO: 227431 - DNA, 25 bp, Mus musculus
atacagagctccattaacctgtctg

SEQ ID NO: 227432 - DNA, 25 bp, Mus musculus
atacagagctcctttaacctgtctg

SEQ ID NO: 227433 - DNA, 25 bp, Mus musculus
atacagagctgaccggtaccgtcta

SEQ ID NO: 227434 - DNA, 25 bp, Mus musculus
atacagagctgagcggtaccgtcta

SEQ ID NO: 227435 - DNA, 25 bp, Mus musculus
atacagaggcggctcctactccttg

SEQ ID NO: 227436 - DNA, 25 bp, Mus musculus
atacagaggcgggtcctactccttg

SEQ ID NO: 227437 - DNA, 25 bp, Mus musculus
atacagaggtatagggccccttcaa

SEQ ID NO: 227438 - DNA, 25 bp, Mus musculus
atacagaggtattgggccccttcaa

SEQ ID NO: 227439 - DNA, 25 bp, Mus musculus
atacagagtcacagggacgcaatgg

SEQ ID NO: 227440 - DNA, 25 bp, Mus musculus
atacagagtcactgggacgcaatgg

SEQ ID NO: 227441 - DNA, 25 bp, Mus musculus
atacagagtcctattaagctaccag

SEQ ID NO: 227442 - DNA, 25 bp, Mus musculus
atacagagtccttttaagctaccag

SEQ ID NO: 227443 - DNA, 25 bp, Mus musculus
atacagagttgaattgactttactg

SEQ ID NO: 227444 - DNA, 25 bp, Mus musculus
atacagagttgatttgactttactg

SEQ ID NO: 227445 - DNA, 25 bp, Mus musculus
atacagataccaattacagcttttg

SEQ ID NO: 227446 - DNA, 25 bp, Mus musculus
atacagataccatttacagcttttg

SEQ ID NO: 227447 - DNA, 25 bp, Mus musculus
atacagatccctcccctttcgtgaa

SEQ ID NO: 227448 - DNA, 25 bp, Mus musculus
atacagatccctgccctttcgtgaa

SEQ ID NO: 227449 - DNA, 25 bp, Mus musculus
atacagatcctgaaccttaattgaa

SEQ ID NO: 227450 - DNA, 25 bp, Mus musculus
atacagatcctgtaccttaattgaa

SEQ ID NO: 227451 - DNA, 25 bp, Mus musculus
atacagatgtgtagctccagagctc

SEQ ID NO: 227452 - DNA, 25 bp, Mus musculus
atacagatgtgttgctccagagctc

SEQ ID NO: 227453 - DNA, 25 bp, Mus musculus
atacagcaactcaagatatcttgaa

SEQ ID NO: 227454 - DNA, 25 bp, Mus musculus
atacagcaactctagatatcttgaa

SEQ ID NO: 227455 - DNA, 25 bp, Mus musculus
atacagcaagacagtccctgtcttt

SEQ ID NO: 227456 - DNA, 25 bp, Mus musculus
atacagcaagactgtccctgtcttt

SEQ ID NO: 227457 - DNA, 25 bp, Mus musculus
atacagcactgtaatctctctaggt

SEQ ID NO: 227458 - DNA, 25 bp, Mus musculus
atacagcactgttatctctctaggt

SEQ ID NO: 227459 - DNA, 25 bp, Mus musculus
atacagcactttctcccagtagaag

SEQ ID NO: 227460 - DNA, 25 bp, Mus musculus
atacagcactttctctggcttcatc

SEQ ID NO: 227461 - DNA, 25 bp, Mus musculus
atacagcactttgtcccagtagaag

SEQ ID NO: 227462 - DNA, 25 bp, Mus musculus
atacagcactttgtctggcttcatc

SEQ ID NO: 227463 - DNA, 25 bp, Mus musculus
atacagcagcggctccgcaggtgaa

SEQ ID NO: 227464 - DNA, 25 bp, Mus musculus
atacagcagcgggtccgcaggtgaa

SEQ ID NO: 227465 - DNA, 25 bp, Mus musculus
atacagcatccccagtataaattct

SEQ ID NO: 227466 - DNA, 25 bp, Mus musculus
atacagcatcccgagtataaattct

SEQ ID NO: 227467 - DNA, 25 bp, Mus musculus
atacagcatgtcacagttactatgt

SEQ ID NO: 227468 - DNA, 25 bp, Mus musculus
atacagcatgtctcagttactatgt

SEQ ID NO: 227469 - DNA, 25 bp, Mus musculus
atacagccaggcagtcagcaacaag

SEQ ID NO: 227470 - DNA, 25 bp, Mus musculus
atacagccaggctgtcagcaacaag

SEQ ID NO: 227471 - DNA, 25 bp, Mus musculus
atacagccatggagctgcctgtgga

SEQ ID NO: 227472 - DNA, 25 bp, Mus musculus
atacagccatggtgctgcctgtgga

SEQ ID NO: 227473 - DNA, 25 bp, Mus musculus
atacagccatgtaggatgactcctg

SEQ ID NO: 227474 - DNA, 25 bp, Mus musculus
atacagccatgttggatgactcctg

SEQ ID NO: 227475 - DNA, 25 bp, Mus musculus
atacagcccatcagccacaagagct

SEQ ID NO: 227476 - DNA, 25 bp, Mus musculus
atacagcccatctgccacaagagct

SEQ ID NO: 227477 - DNA, 25 bp, Mus musculus
atacagccgagtcagcaaatgcact

SEQ ID NO: 227478 - DNA, 25 bp, Mus musculus
atacagccgagtgagcaaatgcact

SEQ ID NO: 227479 - DNA, 25 bp, Mus musculus
atacagccgttcattaacctccaaa

SEQ ID NO: 227480 - DNA, 25 bp, Mus musculus
atacagccgttctttaacctccaaa

SEQ ID NO: 227481 - DNA, 25 bp, Mus musculus
atacagcctcctagctatgtccaca

SEQ ID NO: 227482 - DNA, 25 bp, Mus musculus
atacagcctccttgctatgtccaca

SEQ ID NO: 227483 - DNA, 25 bp, Mus musculus
atacagcctggcatcccaaggaaaa

SEQ ID NO: 227484 - DNA, 25 bp, Mus musculus
atacagcctggcttcccaaggaaaa

SEQ ID NO: 227485 - DNA, 25 bp, Mus musculus
atacagcctttgctgatatggccct

SEQ ID NO: 227486 - DNA, 25 bp, Mus musculus
atacagcctttggtgatatggccct

SEQ ID NO: 227487 - DNA, 25 bp, Mus musculus
atacagcgagtacatgaacaacaag

SEQ ID NO: 227488 - DNA, 25 bp, Mus musculus
atacagcgagtacttttattccaac

SEQ ID NO: 227489 - DNA, 25 bp, Mus musculus
atacagcgagtagatgaacaacaag

SEQ ID NO: 227490 - DNA, 25 bp, Mus musculus
atacagcgagtagttttattccaac

SEQ ID NO: 227491 - DNA, 25 bp, Mus musculus
atacagcggaaccacaagagagact

SEQ ID NO: 227492 - DNA, 25 bp, Mus musculus
atacagcggaacgacaagagagact

SEQ ID NO: 227493 - DNA, 25 bp, Mus musculus
atacagcgtaagagagaactcttgg

SEQ ID NO: 227494 - DNA, 25 bp, Mus musculus
atacagcgtaagtgagaactcttgg

SEQ ID NO: 227495 - DNA, 25 bp, Mus musculus
atacagcgtgtacgttcctcgttga

SEQ ID NO: 227496 - DNA, 25 bp, Mus musculus
atacagcgtgtaggttcctcgttga

SEQ ID NO: 227497 - DNA, 25 bp, Mus musculus
atacagcgtttacagttttgtttgt

SEQ ID NO: 227498 - DNA, 25 bp, Mus musculus
atacagcgtttagagttttgtttgt

SEQ ID NO: 227499 - DNA, 25 bp, Mus musculus
atacagctactaacattcccacaat

SEQ ID NO: 227500 - DNA, 25 bp, Mus musculus
atacagctactatcattcccacaat

SEQ ID NO: 227501 - DNA, 25 bp, Mus musculus
atacagctcataacttcataaaggc

SEQ ID NO: 227502 - DNA, 25 bp, Mus musculus
atacagctcatatcttcataaaggc

SEQ ID NO: 227503 - DNA, 25 bp, Mus musculus
atacagctccacaaacaggccagtg

SEQ ID NO: 227504 - DNA, 25 bp, Mus musculus
atacagctccactaacaggccagtg

SEQ ID NO: 227505 - DNA, 25 bp, Mus musculus
atacagctctggacatgcgttcttc

SEQ ID NO: 227506 - DNA, 25 bp, Mus musculus
atacagctctggtcatgcgttcttc

SEQ ID NO: 227507 - DNA, 25 bp, Mus musculus
atacagctggacagtttcacaccaa

SEQ ID NO: 227508 - DNA, 25 bp, Mus musculus
atacagctggactgtttcacaccaa

SEQ ID NO: 227509 - DNA, 25 bp, Mus musculus
atacagctggccagcaccatcatag

SEQ ID NO: 227510 - DNA, 25 bp, Mus musculus
atacagctggcctgcaccatcatag

SEQ ID NO: 227511 - DNA, 25 bp, Mus musculus
atacagctgtgacagtcggatccgg

SEQ ID NO: 227512 - DNA, 25 bp, Mus musculus
atacagctgtgagagtcggatccgg

SEQ ID NO: 227513 - DNA, 25 bp, Mus musculus
atacagcttataccgcaacacactt

SEQ ID NO: 227514 - DNA, 25 bp, Mus musculus
atacagcttatactggtaaccacaa

SEQ ID NO: 227515 - DNA, 25 bp, Mus musculus
atacagcttatagcgcaacacactt

SEQ ID NO: 227516 - DNA, 25 bp, Mus musculus
atacagcttatagtggtaaccacaa

SEQ ID NO: 227517 - DNA, 25 bp, Mus musculus
atacagcttttgatcatactattga

SEQ ID NO: 227518 - DNA, 25 bp, Mus musculus
atacagcttttgttcatactattga

SEQ ID NO: 227519 - DNA, 25 bp, Mus musculus
atacaggaactgctcattaaccatg

SEQ ID NO: 227520 - DNA, 25 bp, Mus musculus
atacaggaactggtcattaaccatg

SEQ ID NO: 227521 - DNA, 25 bp, Mus musculus
atacaggaagtaccccgtagggtca

SEQ ID NO: 227522 - DNA, 25 bp, Mus musculus
atacaggaagtagcccgtagggtca

SEQ ID NO: 227523 - DNA, 25 bp, Mus musculus
atacaggacacaccctcaagaacag

SEQ ID NO: 227524 - DNA, 25 bp, Mus musculus
atacaggacacagcctcaagaacag

SEQ ID NO: 227525 - DNA, 25 bp, Mus musculus
atacaggacggacatggtgacacat

SEQ ID NO: 227526 - DNA, 25 bp, Mus musculus
atacaggacggagatggtgacacat

SEQ ID NO: 227527 - DNA, 25 bp, Mus musculus
atacaggagagtatgggacaagact

SEQ ID NO: 227528 - DNA, 25 bp, Mus musculus
atacaggagagtttgggacaagact

SEQ ID NO: 227529 - DNA, 25 bp, Mus musculus
atacaggagccccttttatcccaga

SEQ ID NO: 227530 - DNA, 25 bp, Mus musculus
atacaggagcccgttttatcccaga

SEQ ID NO: 227531 - DNA, 25 bp, Mus musculus
atacaggaggatctacaagcgaggc

SEQ ID NO: 227532 - DNA, 25 bp, Mus musculus
atacaggaggatgtacaagcgaggc

SEQ ID NO: 227533 - DNA, 25 bp, Mus musculus
atacaggatcttcaccagtggttct

SEQ ID NO: 227534 - DNA, 25 bp, Mus musculus
atacaggatcttgaccagtggttct

SEQ ID NO: 227535 - DNA, 25 bp, Mus musculus
atacaggatttaccggctgaaggct

SEQ ID NO: 227536 - DNA, 25 bp, Mus musculus
atacaggatttagcggctgaaggct

SEQ ID NO: 227537 - DNA, 25 bp, Mus musculus
atacaggcacataagctcatatatt

SEQ ID NO: 227538 - DNA, 25 bp, Mus musculus
atacaggcacattagctcatatatt

SEQ ID NO: 227539 - DNA, 25 bp, Mus musculus
atacaggcactgatcaaagcaaacc

SEQ ID NO: 227540 - DNA, 25 bp, Mus musculus
atacaggcactgttcaaagcaaacc

SEQ ID NO: 227541 - DNA, 25 bp, Mus musculus
atacaggcagatacggattcttgct

SEQ ID NO: 227542 - DNA, 25 bp, Mus musculus
atacaggcagattcggattcttgct

SEQ ID NO: 227543 - DNA, 25 bp, Mus musculus
atacaggcagtacacatttattggt

SEQ ID NO: 227544 - DNA, 25 bp, Mus musculus
atacaggcagtagacatttattggt

SEQ ID NO: 227545 - DNA, 25 bp, Mus musculus
atacaggcatggaagctcaggcagc

SEQ ID NO: 227546 - DNA, 25 bp, Mus musculus
atacaggcatggtagctcaggcagc

SEQ ID NO: 227547 - DNA, 25 bp, Mus musculus
atacaggcatttagtggacataagc

SEQ ID NO: 227548 - DNA, 25 bp, Mus musculus
atacaggcattttgtggacataagc

SEQ ID NO: 227549 - DNA, 25 bp, Mus musculus
atacaggccattaccacagtcgatc

SEQ ID NO: 227550 - DNA, 25 bp, Mus musculus
atacaggccatttccacagtcgatc

SEQ ID NO: 227551 - DNA, 25 bp, Mus musculus
atacaggcccagaactttcttcctt

SEQ ID NO: 227552 - DNA, 25 bp, Mus musculus
atacaggcccagtactttcttcctt

SEQ ID NO: 227553 - DNA, 25 bp, Mus musculus
atacaggccctacgtcattcgaggt

SEQ ID NO: 227554 - DNA, 25 bp, Mus musculus
atacaggccctaggtcattcgaggt

SEQ ID NO: 227555 - DNA, 25 bp, Mus musculus
atacaggcctggaccatgacgcaga

SEQ ID NO: 227556 - DNA, 25 bp, Mus musculus
atacaggcctggtccatgacgcaga

SEQ ID NO: 227557 - DNA, 25 bp, Mus musculus
atacaggccttcaggtcagtgtcca

SEQ ID NO: 227558 - DNA, 25 bp, Mus musculus
atacaggccttctggtcagtgtcca

SEQ ID NO: 227559 - DNA, 25 bp, Mus musculus
atacaggcgcggaatgtcttacata

SEQ ID NO: 227560 - DNA, 25 bp, Mus musculus
atacaggcgcggtatgtcttacata

SEQ ID NO: 227561 - DNA, 25 bp, Mus musculus
atacaggctagtcatgcctcactta

SEQ ID NO: 227562 - DNA, 25 bp, Mus musculus
atacaggctagtgatgcctcactta

SEQ ID NO: 227563 - DNA, 25 bp, Mus musculus
atacaggctctgcgaattaactcaa

SEQ ID NO: 227564 - DNA, 25 bp, Mus musculus
atacaggctctgggaattaactcaa

SEQ ID NO: 227565 - DNA, 25 bp, Mus musculus
atacaggctgaaaatcctttttctg

SEQ ID NO: 227566 - DNA, 25 bp, Mus musculus
atacaggctgaatatcctttttctg

SEQ ID NO: 227567 - DNA, 25 bp, Mus musculus
atacaggctgagagcatcaaaggac

SEQ ID NO: 227568 - DNA, 25 bp, Mus musculus
atacaggctgagtgcatcaaaggac

SEQ ID NO: 227569 - DNA, 25 bp, Mus musculus
atacagggactgatagtttgtgcct

SEQ ID NO: 227570 - DNA, 25 bp, Mus musculus
atacagggactgttagtttgtgcct

SEQ ID NO: 227571 - DNA, 25 bp, Mus musculus
atacagggctcaactttaggtcttc

SEQ ID NO: 227572 - DNA, 25 bp, Mus musculus
atacagggctcatctttaggtcttc

SEQ ID NO: 227573 - DNA, 25 bp, Mus musculus
atacagggcttgctctcagctctgc

SEQ ID NO: 227574 - DNA, 25 bp, Mus musculus
atacagggcttggtctcagctctgc

SEQ ID NO: 227575 - DNA, 25 bp, Mus musculus
atacagggtctcatccttcggtctt

SEQ ID NO: 227576 - DNA, 25 bp, Mus musculus
atacagggtctcttccttcggtctt

SEQ ID NO: 227577 - DNA, 25 bp, Mus musculus
atacagggtgttctccagtgtctga

SEQ ID NO: 227578 - DNA, 25 bp, Mus musculus
atacagggtgttgtccagtgtctga

SEQ ID NO: 227579 - DNA, 25 bp, Mus musculus
atacagggttcaccatccaatggca

SEQ ID NO: 227580 - DNA, 25 bp, Mus musculus
atacagggttcagcatccaatggca

SEQ ID NO: 227581 - DNA, 25 bp, Mus musculus
atacaggtacaacgttgcagttggc

SEQ ID NO: 227582 - DNA, 25 bp, Mus musculus
atacaggtacaaggttgcagttggc

SEQ ID NO: 227583 - DNA, 25 bp, Mus musculus
atacaggtacagatacaacagcccc

SEQ ID NO: 227584 - DNA, 25 bp, Mus musculus
atacaggtacagttacaacagcccc

SEQ ID NO: 227585 - DNA, 25 bp, Mus musculus
atacaggtaccgaagaaggccagaa

SEQ ID NO: 227586 - DNA, 25 bp, Mus musculus
atacaggtaccgtagaaggccagaa

SEQ ID NO: 227587 - DNA, 25 bp, Mus musculus
atacaggtcacgatctcgatcacga

SEQ ID NO: 227588 - DNA, 25 bp, Mus musculus
atacaggtcacgttctcgatcacga

SEQ ID NO: 227589 - DNA, 25 bp, Mus musculus
atacaggtcattatggcaggcagct

SEQ ID NO: 227590 - DNA, 25 bp, Mus musculus
atacaggtcattttggcaggcagct

SEQ ID NO: 227591 - DNA, 25 bp, Mus musculus
atacaggtgacactgtggacatctg

SEQ ID NO: 227592 - DNA, 25 bp, Mus musculus
atacaggtgacagtgtggacatctg

SEQ ID NO: 227593 - DNA, 25 bp, Mus musculus
atacaggtgattcacatctctatga

SEQ ID NO: 227594 - DNA, 25 bp, Mus musculus
atacaggtgattgacatctctatga

SEQ ID NO: 227595 - DNA, 25 bp, Mus musculus
atacaggttacacctggagccagga

SEQ ID NO: 227596 - DNA, 25 bp, Mus musculus
atacaggttacagctggagccagga

SEQ ID NO: 227597 - DNA, 25 bp, Mus musculus
atacagtaagtaccctctctctcat

SEQ ID NO: 227598 - DNA, 25 bp, Mus musculus
atacagtaagtagcctctctctcat

SEQ ID NO: 227599 - DNA, 25 bp, Mus musculus
atacagtacaccctggacacagttt

SEQ ID NO: 227600 - DNA, 25 bp, Mus musculus
atacagtacaccgtggacacagttt

SEQ ID NO: 227601 - DNA, 25 bp, Mus musculus
atacagtatatactcaggtcattta

SEQ ID NO: 227602 - DNA, 25 bp, Mus musculus
atacagtatatagtcaggtcattta

SEQ ID NO: 227603 - DNA, 25 bp, Mus musculus
atacagtatgccagctgggtgggta

SEQ ID NO: 227604 - DNA, 25 bp, Mus musculus
atacagtatgcctgctgggtgggta

SEQ ID NO: 227605 - DNA, 25 bp, Mus musculus
atacagtcacttccctgatttttct

SEQ ID NO: 227606 - DNA, 25 bp, Mus musculus
atacagtcacttgcctgatttttct

SEQ ID NO: 227607 - DNA, 25 bp, Mus musculus
atacagtccctcaggggccagaaga

SEQ ID NO: 227608 - DNA, 25 bp, Mus musculus
atacagtccctctggggccagaaga

SEQ ID NO: 227609 - DNA, 25 bp, Mus musculus
atacagtccttacctcatctgaaag

SEQ ID NO: 227610 - DNA, 25 bp, Mus musculus
atacagtccttagctcatctgaaag

SEQ ID NO: 227611 - DNA, 25 bp, Mus musculus
atacagtcggagacattctaaaaat

SEQ ID NO: 227612 - DNA, 25 bp, Mus musculus
atacagtcggagtcattctaaaaat

SEQ ID NO: 227613 - DNA, 25 bp, Mus musculus
atacagtcggctcagtctcagcgta

SEQ ID NO: 227614 - DNA, 25 bp, Mus musculus
atacagtcggctgagtctcagcgta

SEQ ID NO: 227615 - DNA, 25 bp, Mus musculus
atacagtctctgaataccatggaac

SEQ ID NO: 227616 - DNA, 25 bp, Mus musculus
atacagtctctgtataccatggaac

SEQ ID NO: 227617 - DNA, 25 bp, Mus musculus
atacagtctgctaacgctacaacaa

SEQ ID NO: 227618 - DNA, 25 bp, Mus musculus
atacagtctgcttacgctacaacaa

SEQ ID NO: 227619 - DNA, 25 bp, Mus musculus
atacagtctgtgagtttatcactag

SEQ ID NO: 227620 - DNA, 25 bp, Mus musculus
atacagtctgtgtgtttatcactag

SEQ ID NO: 227621 - DNA, 25 bp, Mus musculus
atacagtgacctagctaacccaacc

SEQ ID NO: 227622 - DNA, 25 bp, Mus musculus
atacagtgaccttgctaacccaacc

SEQ ID NO: 227623 - DNA, 25 bp, Mus musculus
atacagtgactgatccaccatgact

SEQ ID NO: 227624 - DNA, 25 bp, Mus musculus
atacagtgactgttccaccatgact

SEQ ID NO: 227625 - DNA, 25 bp, Mus musculus
atacagtgcattatctattggtctt

SEQ ID NO: 227626 - DNA, 25 bp, Mus musculus
atacagtgcattttctattggtctt

SEQ ID NO: 227627 - DNA, 25 bp, Mus musculus
atacagtgctgtacctaggagctct

SEQ ID NO: 227628 - DNA, 25 bp, Mus musculus
atacagtgctgttcctaggagctct

SEQ ID NO: 227629 - DNA, 25 bp, Mus musculus
atacagtgtagtcccaagcacataa

SEQ ID NO: 227630 - DNA, 25 bp, Mus musculus
atacagtgtagtgccaagcacataa

SEQ ID NO: 227631 - DNA, 25 bp, Mus musculus
atacagtgtgccaccttttctagag

SEQ ID NO: 227632 - DNA, 25 bp, Mus musculus
atacagtgtgcctccttttctagag

SEQ ID NO: 227633 - DNA, 25 bp, Mus musculus
atacagtgtggcacgcttttttaat

SEQ ID NO: 227634 - DNA, 25 bp, Mus musculus
atacagtgtggctcgcttttttaat

SEQ ID NO: 227635 - DNA, 25 bp, Mus musculus
atacagtgttagacacggcctcggg

SEQ ID NO: 227636 - DNA, 25 bp, Mus musculus
atacagtgttagtcacggcctcggg

SEQ ID NO: 227637 - DNA, 25 bp, Mus musculus
atacagttacccatagtcgcttgtc

SEQ ID NO: 227638 - DNA, 25 bp, Mus musculus
atacagttacccttagtcgcttgtc

SEQ ID NO: 227639 - DNA, 25 bp, Mus musculus
atacagttacgtcgcatgacacctt

SEQ ID NO: 227640 - DNA, 25 bp, Mus musculus
atacagttacgtggcatgacacctt

SEQ ID NO: 227641 - DNA, 25 bp, Mus musculus
atacagttactaagatgcacggaca

SEQ ID NO: 227642 - DNA, 25 bp, Mus musculus
atacagttactatgatgcacggaca

SEQ ID NO: 227643 - DNA, 25 bp, Mus musculus
atacagttagctacctttgtctcca

SEQ ID NO: 227644 - DNA, 25 bp, Mus musculus
atacagttagcttcctttgtctcca

SEQ ID NO: 227645 - DNA, 25 bp, Mus musculus
atacagttcagtcgtagaggcgcct

SEQ ID NO: 227646 - DNA, 25 bp, Mus musculus
atacagttcagtggtagaggcgcct

SEQ ID NO: 227647 - DNA, 25 bp, Mus musculus
atacagttccaccttcgtttgcagt

SEQ ID NO: 227648 - DNA, 25 bp, Mus musculus
atacagttccacgttcgtttgcagt

SEQ ID NO: 227649 - DNA, 25 bp, Mus musculus
atacagttcgttcgcgcctgaatgg

SEQ ID NO: 227650 - DNA, 25 bp, Mus musculus
atacagttcgttggcgcctgaatgg

SEQ ID NO: 227651 - DNA, 25 bp, Mus musculus
atacagtttaagctggcttcccatg

SEQ ID NO: 227652 - DNA, 25 bp, Mus musculus
atacagtttaaggtggcttcccatg

SEQ ID NO: 227653 - DNA, 25 bp, Mus musculus
atacagtttctcacactgcagtaac

SEQ ID NO: 227654 - DNA, 25 bp, Mus musculus
atacagtttctctcactgcagtaac

SEQ ID NO: 227655 - DNA, 25 bp, Mus musculus
atacagtttgctacctgttttcgct

SEQ ID NO: 227656 - DNA, 25 bp, Mus musculus
atacagtttgcttcctgttttcgct

SEQ ID NO: 227657 - DNA, 25 bp, Mus musculus
atacataaacacaacctgaccggtc

SEQ ID NO: 227658 - DNA, 25 bp, Mus musculus
atacataaacactacctgaccggtc

SEQ ID NO: 227659 - DNA, 25 bp, Mus musculus
atacataacagacaaagcgcctcgt

SEQ ID NO: 227660 - DNA, 25 bp, Mus musculus
atacataacagagaaagcgcctcgt

SEQ ID NO: 227661 - DNA, 25 bp, Mus musculus
atacataactatagaaattccagag

SEQ ID NO: 227662 - DNA, 25 bp, Mus musculus
atacataactattgaaattccagag

SEQ ID NO: 227663 - DNA, 25 bp, Mus musculus
atacataaggctctaggctcagtta

SEQ ID NO: 227664 - DNA, 25 bp, Mus musculus
atacataaggctgtaggctcagtta

SEQ ID NO: 227665 - DNA, 25 bp, Mus musculus
atacataagtgcatcctgggacagg

SEQ ID NO: 227666 - DNA, 25 bp, Mus musculus
atacataagtgcttcctgggacagg

SEQ ID NO: 227667 - DNA, 25 bp, Mus musculus
atacatacatatacctacaccacaa

SEQ ID NO: 227668 - DNA, 25 bp, Mus musculus
atacatacatattcctacaccacaa

SEQ ID NO: 227669 - DNA, 25 bp, Mus musculus
atacatacatgtagatttgttttct

SEQ ID NO: 227670 - DNA, 25 bp, Mus musculus
atacatacatgttgatttgttttct

SEQ ID NO: 227671 - DNA, 25 bp, Mus musculus
atacatacctcaaacctgtctttga

SEQ ID NO: 227672 - DNA, 25 bp, Mus musculus
atacatacctcatacctgtctttga

SEQ ID NO: 227673 - DNA, 25 bp, Mus musculus
atacatacgcgaccaatgacacctc

SEQ ID NO: 227674 - DNA, 25 bp, Mus musculus
atacatacgcgagcaatgacacctc

SEQ ID NO: 227675 - DNA, 25 bp, Mus musculus
atacatacgtgtatcctgtgctaag

SEQ ID NO: 227676 - DNA, 25 bp, Mus musculus
atacatacgtgtttcctgtgctaag

SEQ ID NO: 227677 - DNA, 25 bp, Mus musculus
atacatactctaactgtagcccagt

SEQ ID NO: 227678 - DNA, 25 bp, Mus musculus
atacatactctatctgtagcccagt

SEQ ID NO: 227679 - DNA, 25 bp, Mus musculus
atacatactgagaccttactgtctg

SEQ ID NO: 227680 - DNA, 25 bp, Mus musculus
atacatactgagtccttactgtctg

SEQ ID NO: 227681 - DNA, 25 bp, Mus musculus
atacatacttgtaacgttcaaacac

SEQ ID NO: 227682 - DNA, 25 bp, Mus musculus
atacatacttgttacgttcaaacac

SEQ ID NO: 227683 - DNA, 25 bp, Mus musculus
atacatagatccaaaacctttttag

SEQ ID NO: 227684 - DNA, 25 bp, Mus musculus
atacatagatcctaaacctttttag

SEQ ID NO: 227685 - DNA, 25 bp, Mus musculus
atacataggacacttcttgcctgcc

SEQ ID NO: 227686 - DNA, 25 bp, Mus musculus
atacataggacagttcttgcctgcc

SEQ ID NO: 227687 - DNA, 25 bp, Mus musculus
atacatagggctacactcattactg

SEQ ID NO: 227688 - DNA, 25 bp, Mus musculus
atacatagggcttcactcattactg

SEQ ID NO: 227689 - DNA, 25 bp, Mus musculus
atacataggtaaatgtcagcacttg

SEQ ID NO: 227690 - DNA, 25 bp, Mus musculus
atacataggtaattgtcagcacttg

SEQ ID NO: 227691 - DNA, 25 bp, Mus musculus
atacataggtagatctatttctgag

SEQ ID NO: 227692 - DNA, 25 bp, Mus musculus
atacataggtagttctatttctgag

SEQ ID NO: 227693 - DNA, 25 bp, Mus musculus
atacatatacacagagcatctctgt

SEQ ID NO: 227694 - DNA, 25 bp, Mus musculus
atacatatacacctaacaacacaca

SEQ ID NO: 227695 - DNA, 25 bp, Mus musculus
atacatatacacgtaacaacacaca

SEQ ID NO: 227696 - DNA, 25 bp, Mus musculus
atacatatacactgagcatctctgt

SEQ ID NO: 227697 - DNA, 25 bp, Mus musculus
atacatatcaagacccactcggtgt

SEQ ID NO: 227698 - DNA, 25 bp, Mus musculus
atacatatcaagtcccactcggtgt

SEQ ID NO: 227699 - DNA, 25 bp, Mus musculus
atacatatcgtaagccttgccgtct

SEQ ID NO: 227700 - DNA, 25 bp, Mus musculus
atacatatcgtatgccttgccgtct

SEQ ID NO: 227701 - DNA, 25 bp, Mus musculus
atacatatctaccttctttctcatc

SEQ ID NO: 227702 - DNA, 25 bp, Mus musculus
atacatatctacgttctttctcatc

SEQ ID NO: 227703 - DNA, 25 bp, Mus musculus
atacatatctatacctcatcaccat

SEQ ID NO: 227704 - DNA, 25 bp, Mus musculus
atacatatctattcctcatcaccat

SEQ ID NO: 227705 - DNA, 25 bp, Mus musculus
atacatatctttctgtcttattgga

SEQ ID NO: 227706 - DNA, 25 bp, Mus musculus
atacatatctttgtgtcttattgga

SEQ ID NO: 227707 - DNA, 25 bp, Mus musculus
atacatatgcatcccaccaggtgtt

SEQ ID NO: 227708 - DNA, 25 bp, Mus musculus
atacatatgcatgccaccaggtgtt

SEQ ID NO: 227709 - DNA, 25 bp, Mus musculus
atacatatgccacagcttgtgtccc

SEQ ID NO: 227710 - DNA, 25 bp, Mus musculus
atacatatgccagagcttgtgtccc

SEQ ID NO: 227711 - DNA, 25 bp, Mus musculus
atacatatgctcatcctgcgtttct

SEQ ID NO: 227712 - DNA, 25 bp, Mus musculus
atacatatgctcttcctgcgtttct

SEQ ID NO: 227713 - DNA, 25 bp, Mus musculus
atacatatttctcacttgctggtac

SEQ ID NO: 227714 - DNA, 25 bp, Mus musculus
atacatatttctgacttgctggtac

SEQ ID NO: 227715 - DNA, 25 bp, Mus musculus
atacatcaccaaagaaatctgcccc

SEQ ID NO: 227716 - DNA, 25 bp, Mus musculus
atacatcaccaatgaaatctgcccc

SEQ ID NO: 227717 - DNA, 25 bp, Mus musculus
atacatcaccccatattcttttatt

SEQ ID NO: 227718 - DNA, 25 bp, Mus musculus
atacatcaccccttattcttttatt

SEQ ID NO: 227719 - DNA, 25 bp, Mus musculus
atacatcaccgcctagttgttttac

SEQ ID NO: 227720 - DNA, 25 bp, Mus musculus
atacatcaccgcgtagttgttttac

SEQ ID NO: 227721 - DNA, 25 bp, Mus musculus
atacatcactctactggttgactct

SEQ ID NO: 227722 - DNA, 25 bp, Mus musculus
atacatcactcttctggttgactct

SEQ ID NO: 227723 - DNA, 25 bp, Mus musculus
atacatcactgtatccccatggact

SEQ ID NO: 227724 - DNA, 25 bp, Mus musculus
atacatcactgtttccccatggact

SEQ ID NO: 227725 - DNA, 25 bp, Mus musculus
atacatcagacccttagttccaaaa

SEQ ID NO: 227726 - DNA, 25 bp, Mus musculus
atacatcagaccgttagttccaaaa

SEQ ID NO: 227727 - DNA, 25 bp, Mus musculus
atacatcagtccagaccctaagtct

SEQ ID NO: 227728 - DNA, 25 bp, Mus musculus
atacatcagtcctgaccctaagtct

SEQ ID NO: 227729 - DNA, 25 bp, Mus musculus
atacatcataacctcttaaccatgg

SEQ ID NO: 227730 - DNA, 25 bp, Mus musculus
atacatcataacgtcttaaccatgg

SEQ ID NO: 227731 - DNA, 25 bp, Mus musculus
atacatcatatcatgtcataactag

SEQ ID NO: 227732 - DNA, 25 bp, Mus musculus
atacatcatatcttgtcataactag

SEQ ID NO: 227733 - DNA, 25 bp, Mus musculus
atacatcatgctagcttcttgaggc

SEQ ID NO: 227734 - DNA, 25 bp, Mus musculus
atacatcatgcttgcttcttgaggc

SEQ ID NO: 227735 - DNA, 25 bp, Mus musculus
atacatccaactctctttccatttc

SEQ ID NO: 227736 - DNA, 25 bp, Mus musculus
atacatccaactgtctttccatttc

SEQ ID NO: 227737 - DNA, 25 bp, Mus musculus
atacatccatataaaactgcacggg

SEQ ID NO: 227738 - DNA, 25 bp, Mus musculus
atacatccatattaaactgcacggg

SEQ ID NO: 227739 - DNA, 25 bp, Mus musculus
atacatccatcaactgtctttttaa

SEQ ID NO: 227740 - DNA, 25 bp, Mus musculus
atacatccatcaattccagtcatta

SEQ ID NO: 227741 - DNA, 25 bp, Mus musculus
atacatccatcatctgtctttttaa

SEQ ID NO: 227742 - DNA, 25 bp, Mus musculus
atacatccatcatttccagtcatta

SEQ ID NO: 227743 - DNA, 25 bp, Mus musculus
atacatccatctatcttcacacttc

SEQ ID NO: 227744 - DNA, 25 bp, Mus musculus
atacatccatctttcttcacacttc

SEQ ID NO: 227745 - DNA, 25 bp, Mus musculus
atacatccattcaagcatgcaattt

SEQ ID NO: 227746 - DNA, 25 bp, Mus musculus
atacatccattctagcatgcaattt

SEQ ID NO: 227747 - DNA, 25 bp, Mus musculus
atacatcccgagcttataacaataa

SEQ ID NO: 227748 - DNA, 25 bp, Mus musculus
atacatcccgaggttataacaataa

SEQ ID NO: 227749 - DNA, 25 bp, Mus musculus
atacatccgtgcagcaggaaagaaa

SEQ ID NO: 227750 - DNA, 25 bp, Mus musculus
atacatccgtgctgcaggaaagaaa

SEQ ID NO: 227751 - DNA, 25 bp, Mus musculus
atacatcctatcaagagccaaagag

SEQ ID NO: 227752 - DNA, 25 bp, Mus musculus
atacatcctatctagagccaaagag

SEQ ID NO: 227753 - DNA, 25 bp, Mus musculus
atacatcctcagctttaaggcctca

SEQ ID NO: 227754 - DNA, 25 bp, Mus musculus
atacatcctcaggtttaaggcctca

SEQ ID NO: 227755 - DNA, 25 bp, Mus musculus
atacatcctgacacatacctgaaca

SEQ ID NO: 227756 - DNA, 25 bp, Mus musculus
atacatcctgactcatacctgaaca

SEQ ID NO: 227757 - DNA, 25 bp, Mus musculus
atacatcctgccagtggtcgagtat

SEQ ID NO: 227758 - DNA, 25 bp, Mus musculus
atacatcctgcctgtggtcgagtat

SEQ ID NO: 227759 - DNA, 25 bp, Mus musculus
atacatcctgtcattcaagctctga

SEQ ID NO: 227760 - DNA, 25 bp, Mus musculus
atacatcctgtctttcaagctctga

SEQ ID NO: 227761 - DNA, 25 bp, Mus musculus
atacatcctttgctgatttcagttt

SEQ ID NO: 227762 - DNA, 25 bp, Mus musculus
atacatcctttggtgatttcagttt

SEQ ID NO: 227763 - DNA, 25 bp, Mus musculus
atacatccttttctgatccctacac

SEQ ID NO: 227764 - DNA, 25 bp, Mus musculus
atacatccttttgtgatccctacac

SEQ ID NO: 227765 - DNA, 25 bp, Mus musculus
atacatcgcacgcaagcacaacatg

SEQ ID NO: 227766 - DNA, 25 bp, Mus musculus
atacatcgcacggaagcacaacatg

SEQ ID NO: 227767 - DNA, 25 bp, Mus musculus
atacatctatcccatacacaagcta

SEQ ID NO: 227768 - DNA, 25 bp, Mus musculus
atacatctatccgatacacaagcta

SEQ ID NO: 227769 - DNA, 25 bp, Mus musculus
atacatctatggagcacagggaatc

SEQ ID NO: 227770 - DNA, 25 bp, Mus musculus
atacatctatggtgcacagggaatc

SEQ ID NO: 227771 - DNA, 25 bp, Mus musculus
atacatctatgtattgcatgtcaaa

SEQ ID NO: 227772 - DNA, 25 bp, Mus musculus
atacatctatgttttgcatgtcaaa

SEQ ID NO: 227773 - DNA, 25 bp, Mus musculus
atacatctcacgaaaccatttccct

SEQ ID NO: 227774 - DNA, 25 bp, Mus musculus
atacatctcacgtaaccatttccct

SEQ ID NO: 227775 - DNA, 25 bp, Mus musculus
atacatctccacacagttacttttc

SEQ ID NO: 227776 - DNA, 25 bp, Mus musculus
atacatctccactcagttacttttc

SEQ ID NO: 227777 - DNA, 25 bp, Mus musculus
atacatcttactcagttatgcttag

SEQ ID NO: 227778 - DNA, 25 bp, Mus musculus
atacatcttactgagttatgcttag

SEQ ID NO: 227779 - DNA, 25 bp, Mus musculus
atacatgacatacctgacactggaa

SEQ ID NO: 227780 - DNA, 25 bp, Mus musculus
atacatgacatagctgacactggaa

SEQ ID NO: 227781 - DNA, 25 bp, Mus musculus
atacatgatgctatcttccattaag

SEQ ID NO: 227782 - DNA, 25 bp, Mus musculus
atacatgatgctttcttccattaag

SEQ ID NO: 227783 - DNA, 25 bp, Mus musculus
atacatgcaataaatttgccttcta

SEQ ID NO: 227784 - DNA, 25 bp, Mus musculus
atacatgcaatatatttgccttcta

SEQ ID NO: 227785 - DNA, 25 bp, Mus musculus
atacatgcacatcgaggccctagta

SEQ ID NO: 227786 - DNA, 25 bp, Mus musculus
atacatgcacatggaggccctagta

SEQ ID NO: 227787 - DNA, 25 bp, Mus musculus
atacatgcacctcactgccaggcca

SEQ ID NO: 227788 - DNA, 25 bp, Mus musculus
atacatgcacctgactgccaggcca

SEQ ID NO: 227789 - DNA, 25 bp, Mus musculus
atacatgcagtgattgttattccca

SEQ ID NO: 227790 - DNA, 25 bp, Mus musculus
atacatgcagtgtttgttattccca

SEQ ID NO: 227791 - DNA, 25 bp, Mus musculus
atacatgcatacacaaagcaagcca

SEQ ID NO: 227792 - DNA, 25 bp, Mus musculus
atacatgcatactcaaagcaagcca

SEQ ID NO: 227793 - DNA, 25 bp, Mus musculus
atacatgcatgcatgagtcagtctc

SEQ ID NO: 227794 - DNA, 25 bp, Mus musculus
atacatgcatgcttgagtcagtctc

SEQ ID NO: 227795 - DNA, 25 bp, Mus musculus
atacatgccgaccggcgctgacccc

SEQ ID NO: 227796 - DNA, 25 bp, Mus musculus
atacatgccgacgggcgctgacccc

SEQ ID NO: 227797 - DNA, 25 bp, Mus musculus
atacatgcctcaaaatagctaatga

SEQ ID NO: 227798 - DNA, 25 bp, Mus musculus
atacatgcctcataatagctaatga

SEQ ID NO: 227799 - DNA, 25 bp, Mus musculus
atacatgctaatatattctcacctg

SEQ ID NO: 227800 - DNA, 25 bp, Mus musculus
atacatgctaatttattctcacctg

SEQ ID NO: 227801 - DNA, 25 bp, Mus musculus
atacatgctcaaaccctaaattctt

SEQ ID NO: 227802 - DNA, 25 bp, Mus musculus
atacatgctcaatccctaaattctt

SEQ ID NO: 227803 - DNA, 25 bp, Mus musculus
atacatgctcacaaaaaaccacaag

SEQ ID NO: 227804 - DNA, 25 bp, Mus musculus
atacatgctcactaaaaaccacaag

SEQ ID NO: 227805 - DNA, 25 bp, Mus musculus
atacatgcttgccaggagtcaccat

SEQ ID NO: 227806 - DNA, 25 bp, Mus musculus
atacatgcttgcgaggagtcaccat

SEQ ID NO: 227807 - DNA, 25 bp, Mus musculus
atacatggacccaggctgcttgctg

SEQ ID NO: 227808 - DNA, 25 bp, Mus musculus
atacatggaccctggctgcttgctg

SEQ ID NO: 227809 - DNA, 25 bp, Mus musculus
atacatggagacactgcggacagaa

SEQ ID NO: 227810 - DNA, 25 bp, Mus musculus
atacatggagactctgcggacagaa

SEQ ID NO: 227811 - DNA, 25 bp, Mus musculus
atacatggattgcaagtgcccttca

SEQ ID NO: 227812 - DNA, 25 bp, Mus musculus
atacatggattggaagtgcccttca

SEQ ID NO: 227813 - DNA, 25 bp, Mus musculus
atacatggcctcatttctcattaac

SEQ ID NO: 227814 - DNA, 25 bp, Mus musculus
atacatggcctcttttctcattaac

SEQ ID NO: 227815 - DNA, 25 bp, Mus musculus
atacatggctcaattcttgtctgtc

SEQ ID NO: 227816 - DNA, 25 bp, Mus musculus
atacatggctcatttcttgtctgtc

SEQ ID NO: 227817 - DNA, 25 bp, Mus musculus
atacatggctgtagtaacattgtca

SEQ ID NO: 227818 - DNA, 25 bp, Mus musculus
atacatggctgttgtaacattgtca

SEQ ID NO: 227819 - DNA, 25 bp, Mus musculus
atacatgggcggctttgcaggcaac

SEQ ID NO: 227820 - DNA, 25 bp, Mus musculus
atacatgggcgggtttgcaggcaac

SEQ ID NO: 227821 - DNA, 25 bp, Mus musculus
atacatgggctgcaccatattgaga

SEQ ID NO: 227822 - DNA, 25 bp, Mus musculus
atacatgggctggaccatattgaga

SEQ ID NO: 227823 - DNA, 25 bp, Mus musculus
atacatgggtcactggctcaccagg

SEQ ID NO: 227824 - DNA, 25 bp, Mus musculus
atacatgggtcagtggctcaccagg

SEQ ID NO: 227825 - DNA, 25 bp, Mus musculus
atacatggtaccagtggttgtccac

SEQ ID NO: 227826 - DNA, 25 bp, Mus musculus
atacatggtacctgtggttgtccac

SEQ ID NO: 227827 - DNA, 25 bp, Mus musculus
atacatggtcatagttatcagagat

SEQ ID NO: 227828 - DNA, 25 bp, Mus musculus
atacatggtcattgttatcagagat

SEQ ID NO: 227829 - DNA, 25 bp, Mus musculus
atacatggtgtcaccctgagtatca

SEQ ID NO: 227830 - DNA, 25 bp, Mus musculus
atacatggtgtctccctgagtatca

SEQ ID NO: 227831 - DNA, 25 bp, Mus musculus
atacatggttaaatgcctgtctcaa

SEQ ID NO: 227832 - DNA, 25 bp, Mus musculus
atacatggttaattgcctgtctcaa

SEQ ID NO: 227833 - DNA, 25 bp, Mus musculus
atacatggttccacgatccagtcgg

SEQ ID NO: 227834 - DNA, 25 bp, Mus musculus
atacatggttcctcgatccagtcgg

SEQ ID NO: 227835 - DNA, 25 bp, Mus musculus
atacatgtacttctgtcttccaaga

SEQ ID NO: 227836 - DNA, 25 bp, Mus musculus
atacatgtacttgtgtcttccaaga

SEQ ID NO: 227837 - DNA, 25 bp, Mus musculus
atacatgtcacaacttctctgagct

SEQ ID NO: 227838 - DNA, 25 bp, Mus musculus
atacatgtcacatcttctctgagct

SEQ ID NO: 227839 - DNA, 25 bp, Mus musculus
atacatgtcggtctgtatgcacctg

SEQ ID NO: 227840 - DNA, 25 bp, Mus musculus
atacatgtcggtgtgtatgcacctg

SEQ ID NO: 227841 - DNA, 25 bp, Mus musculus
atacatgtctagattcaagacccca

SEQ ID NO: 227842 - DNA, 25 bp, Mus musculus
atacatgtctagtttcaagacccca

SEQ ID NO: 227843 - DNA, 25 bp, Mus musculus
atacatgtctatccactaaaaattt

SEQ ID NO: 227844 - DNA, 25 bp, Mus musculus
atacatgtctatgcactaaaaattt

SEQ ID NO: 227845 - DNA, 25 bp, Mus musculus
atacatgtgggtacattttgaaacc

SEQ ID NO: 227846 - DNA, 25 bp, Mus musculus
atacatgtgggttcattttgaaacc

SEQ ID NO: 227847 - DNA, 25 bp, Mus musculus
atacatgtgtatattccttttgaag

SEQ ID NO: 227848 - DNA, 25 bp, Mus musculus
atacatgtgtattttccttttgaag

SEQ ID NO: 227849 - DNA, 25 bp, Mus musculus
atacatgttaacacatctgcaggga

SEQ ID NO: 227850 - DNA, 25 bp, Mus musculus
atacatgttaactcatctgcaggga

SEQ ID NO: 227851 - DNA, 25 bp, Mus musculus
atacatgtttaaacctaaggcttct

SEQ ID NO: 227852 - DNA, 25 bp, Mus musculus
atacatgtttaatcctaaggcttct

SEQ ID NO: 227853 - DNA, 25 bp, Mus musculus
atacattaagtaccgcgtggagcag

SEQ ID NO: 227854 - DNA, 25 bp, Mus musculus
atacattaagtagcgcgtggagcag

SEQ ID NO: 227855 - DNA, 25 bp, Mus musculus
atacattagactcatatccaaatca

SEQ ID NO: 227856 - DNA, 25 bp, Mus musculus
atacattagactgatatccaaatca

SEQ ID NO: 227857 - DNA, 25 bp, Mus musculus
atacattagcacaccttacacacac

SEQ ID NO: 227858 - DNA, 25 bp, Mus musculus
atacattagcactccttacacacac

SEQ ID NO: 227859 - DNA, 25 bp, Mus musculus
atacattatgcacccttcccaaaat

SEQ ID NO: 227860 - DNA, 25 bp, Mus musculus
atacattatgcagccttcccaaaat

SEQ ID NO: 227861 - DNA, 25 bp, Mus musculus
atacattcacatcctagctggattg

SEQ ID NO: 227862 - DNA, 25 bp, Mus musculus
atacattcacatgctagctggattg

SEQ ID NO: 227863 - DNA, 25 bp, Mus musculus
atacattcacgtacacacgtgtaca

SEQ ID NO: 227864 - DNA, 25 bp, Mus musculus
atacattcacgttcacacgtgtaca

SEQ ID NO: 227865 - DNA, 25 bp, Mus musculus
atacattcatatattccaaagtaag

SEQ ID NO: 227866 - DNA, 25 bp, Mus musculus
atacattcatattttccaaagtaag

SEQ ID NO: 227867 - DNA, 25 bp, Mus musculus
atacattcgctgaggcgtgcttaca

SEQ ID NO: 227868 - DNA, 25 bp, Mus musculus
atacattcgctgtggcgtgcttaca

SEQ ID NO: 227869 - DNA, 25 bp, Mus musculus
atacattcggcaccagagtccgcat

SEQ ID NO: 227870 - DNA, 25 bp, Mus musculus
atacattcggcagcagagtccgcat

SEQ ID NO: 227871 - DNA, 25 bp, Mus musculus
atacattcggtgactattaatgcaa

SEQ ID NO: 227872 - DNA, 25 bp, Mus musculus
atacattcggtgtctattaatgcaa

SEQ ID NO: 227873 - DNA, 25 bp, Mus musculus
atacattctattacctttgattcac

SEQ ID NO: 227874 - DNA, 25 bp, Mus musculus
atacattctatttcctttgattcac

SEQ ID NO: 227875 - DNA, 25 bp, Mus musculus
atacattctgcacaggcctttgacc

SEQ ID NO: 227876 - DNA, 25 bp, Mus musculus
atacattctgcagaggcctttgacc

SEQ ID NO: 227877 - DNA, 25 bp, Mus musculus
atacattgaatactgctctggctgg

SEQ ID NO: 227878 - DNA, 25 bp, Mus musculus
atacattgaatagtgctctggctgg

SEQ ID NO: 227879 - DNA, 25 bp, Mus musculus
atacattgactcaattcgccctgtc

SEQ ID NO: 227880 - DNA, 25 bp, Mus musculus
atacattgactctattcgccctgtc

SEQ ID NO: 227881 - DNA, 25 bp, Mus musculus
atacattgagttactgtggaccaca

SEQ ID NO: 227882 - DNA, 25 bp, Mus musculus
atacattgagtttctgtggaccaca

SEQ ID NO: 227883 - DNA, 25 bp, Mus musculus
atacattgatgtaactgaccagagt

SEQ ID NO: 227884 - DNA, 25 bp, Mus musculus
atacattgatgttactgaccagagt

SEQ ID NO: 227885 - DNA, 25 bp, Mus musculus
atacattgctatatattgagggaaa

SEQ ID NO: 227886 - DNA, 25 bp, Mus musculus
atacattgctatttattgagggaaa

SEQ ID NO: 227887 - DNA, 25 bp, Mus musculus
atacattgcttcagtgggtttgact

SEQ ID NO: 227888 - DNA, 25 bp, Mus musculus
atacattgcttctgtgggtttgact

SEQ ID NO: 227889 - DNA, 25 bp, Mus musculus
atacattggaacattcaggttttgg

SEQ ID NO: 227890 - DNA, 25 bp, Mus musculus
atacattggaactttcaggttttgg

SEQ ID NO: 227891 - DNA, 25 bp, Mus musculus
atacattggacaaagccattcccca

SEQ ID NO: 227892 - DNA, 25 bp, Mus musculus
atacattggacatagccattcccca

SEQ ID NO: 227893 - DNA, 25 bp, Mus musculus
atacattggccgcagtggcatttat

SEQ ID NO: 227894 - DNA, 25 bp, Mus musculus
atacattggccggagtggcatttat

SEQ ID NO: 227895 - DNA, 25 bp, Mus musculus
atacattggtatactcgaggagtct

SEQ ID NO: 227896 - DNA, 25 bp, Mus musculus
atacattggtattctcgaggagtct

SEQ ID NO: 227897 - DNA, 25 bp, Mus musculus
atacattgtattcattttttcccta

SEQ ID NO: 227898 - DNA, 25 bp, Mus musculus
atacattgtattgattttttcccta

SEQ ID NO: 227899 - DNA, 25 bp, Mus musculus
atacattgtcacatccttgagggag

SEQ ID NO: 227900 - DNA, 25 bp, Mus musculus
atacattgtcacttccttgagggag

SEQ ID NO: 227901 - DNA, 25 bp, Mus musculus
atacattgtgctaactgttgtagta

SEQ ID NO: 227902 - DNA, 25 bp, Mus musculus
atacattgtgcttactgttgtagta

SEQ ID NO: 227903 - DNA, 25 bp, Mus musculus
atacattgtttaaagcgctacgcaa

SEQ ID NO: 227904 - DNA, 25 bp, Mus musculus
atacattgtttatagcgctacgcaa

SEQ ID NO: 227905 - DNA, 25 bp, Mus musculus
atacatttaaagaacttggctctta

SEQ ID NO: 227906 - DNA, 25 bp, Mus musculus
atacatttaaagtacttggctctta

SEQ ID NO: 227907 - DNA, 25 bp, Mus musculus
atacatttaaatacgggcttgccaa

SEQ ID NO: 227908 - DNA, 25 bp, Mus musculus
atacatttaaattcgggcttgccaa

SEQ ID NO: 227909 - DNA, 25 bp, Mus musculus
atacatttcatcatcccacgtgtgg

SEQ ID NO: 227910 - DNA, 25 bp, Mus musculus
atacatttcatcttcccacgtgtgg

SEQ ID NO: 227911 - DNA, 25 bp, Mus musculus
atacatttcccaagctatatctagc

SEQ ID NO: 227912 - DNA, 25 bp, Mus musculus
atacatttcccatgctatatctagc

SEQ ID NO: 227913 - DNA, 25 bp, Mus musculus
atacatttcctacttaaattctggg

SEQ ID NO: 227914 - DNA, 25 bp, Mus musculus
atacatttcctagttaaattctggg

SEQ ID NO: 227915 - DNA, 25 bp, Mus musculus
atacatttctgtatcgtccccactg

SEQ ID NO: 227916 - DNA, 25 bp, Mus musculus
atacatttctgtttcgtccccactg

SEQ ID NO: 227917 - DNA, 25 bp, Mus musculus
atacatttgaatccattgaggtctg

SEQ ID NO: 227918 - DNA, 25 bp, Mus musculus
atacatttgaatgcattgaggtctg

SEQ ID NO: 227919 - DNA, 25 bp, Mus musculus
atacatttgcacaccacctccatta

SEQ ID NO: 227920 - DNA, 25 bp, Mus musculus
atacatttgcactccacctccatta

SEQ ID NO: 227921 - DNA, 25 bp, Mus musculus
atacatttgccccttttatctctaa

SEQ ID NO: 227922 - DNA, 25 bp, Mus musculus
atacatttgcccgttttatctctaa

SEQ ID NO: 227923 - DNA, 25 bp, Mus musculus
atacatttgcttatattagatcact

SEQ ID NO: 227924 - DNA, 25 bp, Mus musculus
atacatttgcttcgctgggctggaa

SEQ ID NO: 227925 - DNA, 25 bp, Mus musculus
atacatttgcttggctgggctggaa

SEQ ID NO: 227926 - DNA, 25 bp, Mus musculus
atacatttgcttttattagatcact

SEQ ID NO: 227927 - DNA, 25 bp, Mus musculus
atacatttgtatcctggaattactt

SEQ ID NO: 227928 - DNA, 25 bp, Mus musculus
atacatttgtatgctggaattactt

SEQ ID NO: 227929 - DNA, 25 bp, Mus musculus
atacatttgtgtagggcaggtggac

SEQ ID NO: 227930 - DNA, 25 bp, Mus musculus
atacatttgtgttgggcaggtggac

SEQ ID NO: 227931 - DNA, 25 bp, Mus musculus
atacatttgttgaagtggattcctt

SEQ ID NO: 227932 - DNA, 25 bp, Mus musculus
atacatttgttgtagtggattcctt

SEQ ID NO: 227933 - DNA, 25 bp, Mus musculus
atacatttgtttactcccacagtgg

SEQ ID NO: 227934 - DNA, 25 bp, Mus musculus
atacatttgttttctcccacagtgg

SEQ ID NO: 227935 - DNA, 25 bp, Mus musculus
atacattttatcaagccaccatgag

SEQ ID NO: 227936 - DNA, 25 bp, Mus musculus
atacattttatctagccaccatgag

SEQ ID NO: 227937 - DNA, 25 bp, Mus musculus
atacattttctcatagcaaaccatg

SEQ ID NO: 227938 - DNA, 25 bp, Mus musculus
atacattttctcttagcaaaccatg

SEQ ID NO: 227939 - DNA, 25 bp, Mus musculus
atacattttgcaaaggccctacagg

SEQ ID NO: 227940 - DNA, 25 bp, Mus musculus
atacattttgcataggccctacagg

SEQ ID NO: 227941 - DNA, 25 bp, Mus musculus
atacattttgtaaacctgttgtggg

SEQ ID NO: 227942 - DNA, 25 bp, Mus musculus
atacattttgtacgcgggaggagct

SEQ ID NO: 227943 - DNA, 25 bp, Mus musculus
atacattttgtaggcgggaggagct

SEQ ID NO: 227944 - DNA, 25 bp, Mus musculus
atacattttgtatacctgttgtggg

SEQ ID NO: 227945 - DNA, 25 bp, Mus musculus
ataccaaaagatctgcgtgagccta

SEQ ID NO: 227946 - DNA, 25 bp, Mus musculus
ataccaaaagatgtgcgtgagccta

SEQ ID NO: 227947 - DNA, 25 bp, Mus musculus
ataccaaaccttctgactttgccaa

SEQ ID NO: 227948 - DNA, 25 bp, Mus musculus
ataccaaaccttgtgactttgccaa

SEQ ID NO: 227949 - DNA, 25 bp, Mus musculus
ataccaaacgctactgattcccatg

SEQ ID NO: 227950 - DNA, 25 bp, Mus musculus
ataccaaacgcttctgattcccatg

SEQ ID NO: 227951 - DNA, 25 bp, Mus musculus
ataccaaaggacacctgggccactg

SEQ ID NO: 227952 - DNA, 25 bp, Mus musculus
ataccaaaggactcctgggccactg

SEQ ID NO: 227953 - DNA, 25 bp, Mus musculus
ataccaaaggttacactgcaggcgt

SEQ ID NO: 227954 - DNA, 25 bp, Mus musculus
ataccaaaggtttcactgcaggcgt

SEQ ID NO: 227955 - DNA, 25 bp, Mus musculus
ataccaaatacgcttgaggatgcaa

SEQ ID NO: 227956 - DNA, 25 bp, Mus musculus
ataccaaatacggttgaggatgcaa

SEQ ID NO: 227957 - DNA, 25 bp, Mus musculus
ataccaaatgaaacaacttggattt

SEQ ID NO: 227958 - DNA, 25 bp, Mus musculus
ataccaaatgaatcaacttggattt

SEQ ID NO: 227959 - DNA, 25 bp, Mus musculus
ataccaacaaagatgccacctcagc

SEQ ID NO: 227960 - DNA, 25 bp, Mus musculus
ataccaacaaagttgccacctcagc

SEQ ID NO: 227961 - DNA, 25 bp, Mus musculus
ataccaacagcaccaggcgcagagt

SEQ ID NO: 227962 - DNA, 25 bp, Mus musculus
ataccaacagcagcaggcgcagagt

SEQ ID NO: 227963 - DNA, 25 bp, Mus musculus
ataccaaccacaacagaatgctgtt

SEQ ID NO: 227964 - DNA, 25 bp, Mus musculus
ataccaaccacatcagaatgctgtt

SEQ ID NO: 227965 - DNA, 25 bp, Mus musculus
ataccaaccctcaatggcgattttg

SEQ ID NO: 227966 - DNA, 25 bp, Mus musculus
ataccaaccctctatggcgattttg

SEQ ID NO: 227967 - DNA, 25 bp, Mus musculus
ataccaacgcatacattttcaacaa

SEQ ID NO: 227968 - DNA, 25 bp, Mus musculus
ataccaacgcattcattttcaacaa

SEQ ID NO: 227969 - DNA, 25 bp, Mus musculus
ataccaactactcttgagagccgag

SEQ ID NO: 227970 - DNA, 25 bp, Mus musculus
ataccaactactgttgagagccgag

SEQ ID NO: 227971 - DNA, 25 bp, Mus musculus
ataccaactgacattgcgtgctgct

SEQ ID NO: 227972 - DNA, 25 bp, Mus musculus
ataccaactgactttgcgtgctgct

SEQ ID NO: 227973 - DNA, 25 bp, Mus musculus
ataccaacttcaacaacttttccat

SEQ ID NO: 227974 - DNA, 25 bp, Mus musculus
ataccaacttcatcaacttttccat

SEQ ID NO: 227975 - DNA, 25 bp, Mus musculus
ataccaacttcgagcactaggcagg

SEQ ID NO: 227976 - DNA, 25 bp, Mus musculus
ataccaacttcgtgcactaggcagg

SEQ ID NO: 227977 - DNA, 25 bp, Mus musculus
ataccaagaagtctgcgctgctttc

SEQ ID NO: 227978 - DNA, 25 bp, Mus musculus
ataccaagaagtgtgcgctgctttc

SEQ ID NO: 227979 - DNA, 25 bp, Mus musculus
ataccaagatgccttcactgattaa

SEQ ID NO: 227980 - DNA, 25 bp, Mus musculus
ataccaagatgcgttcactgattaa

SEQ ID NO: 227981 - DNA, 25 bp, Mus musculus
ataccaagctggactggcaggacgt

SEQ ID NO: 227982 - DNA, 25 bp, Mus musculus
ataccaagctggtctggcaggacgt

SEQ ID NO: 227983 - DNA, 25 bp, Mus musculus
ataccaaggcgtcacataacatgac

SEQ ID NO: 227984 - DNA, 25 bp, Mus musculus
ataccaaggcgtgacataacatgac

SEQ ID NO: 227985 - DNA, 25 bp, Mus musculus
ataccaagggtgatcgccctccctt

SEQ ID NO: 227986 - DNA, 25 bp, Mus musculus
ataccaagggtgttcgccctccctt

SEQ ID NO: 227987 - DNA, 25 bp, Mus musculus
ataccaagtctgaggtttgtcccat

SEQ ID NO: 227988 - DNA, 25 bp, Mus musculus
ataccaagtctgtggtttgtcccat

SEQ ID NO: 227989 - DNA, 25 bp, Mus musculus
ataccaagtggacatggttctgagc

SEQ ID NO: 227990 - DNA, 25 bp, Mus musculus
ataccaagtggagatggttctgagc

SEQ ID NO: 227991 - DNA, 25 bp, Mus musculus
ataccaatcctaacagctgtttcca

SEQ ID NO: 227992 - DNA, 25 bp, Mus musculus
ataccaatcctatcagctgtttcca

SEQ ID NO: 227993 - DNA, 25 bp, Mus musculus
ataccaatgaccagctatccacttt

SEQ ID NO: 227994 - DNA, 25 bp, Mus musculus
ataccaatgacctgctatccacttt

SEQ ID NO: 227995 - DNA, 25 bp, Mus musculus
ataccaatgatgaatcttttgtgaa

SEQ ID NO: 227996 - DNA, 25 bp, Mus musculus
ataccaatgatgtatcttttgtgaa

SEQ ID NO: 227997 - DNA, 25 bp, Mus musculus
ataccaatgtagacagtgttcgtgt

SEQ ID NO: 227998 - DNA, 25 bp, Mus musculus
ataccaatgtagtcagtgttcgtgt

SEQ ID NO: 227999 - DNA, 25 bp, Mus musculus
ataccaattcccaaactatgtagtt

SEQ ID NO: 228000 - DNA, 25 bp, Mus musculus
ataccaattccctaactatgtagtt

SEQ ID NO: 228001 - DNA, 25 bp, Mus musculus
ataccacaagcgattttccttcttc

SEQ ID NO: 228002 - DNA, 25 bp, Mus musculus
ataccacaagcgtttttccttcttc

SEQ ID NO: 228003 - DNA, 25 bp, Mus musculus
ataccacaagtcatacctcattctg

SEQ ID NO: 228004 - DNA, 25 bp, Mus musculus
ataccacaagtcttacctcattctg

SEQ ID NO: 228005 - DNA, 25 bp, Mus musculus
ataccacaattccatggcttatgat

SEQ ID NO: 228006 - DNA, 25 bp, Mus musculus
ataccacaattcgatggcttatgat

SEQ ID NO: 228007 - DNA, 25 bp, Mus musculus
ataccacaccttactatgactgttc

SEQ ID NO: 228008 - DNA, 25 bp, Mus musculus
ataccacacctttctatgactgttc

SEQ ID NO: 228009 - DNA, 25 bp, Mus musculus
ataccacacgagatcccgctttact

SEQ ID NO: 228010 - DNA, 25 bp, Mus musculus
ataccacacgagttcccgctttact

SEQ ID NO: 228011 - DNA, 25 bp, Mus musculus
ataccacactggctactagcagtat

SEQ ID NO: 228012 - DNA, 25 bp, Mus musculus
ataccacactgggtactagcagtat

SEQ ID NO: 228013 - DNA, 25 bp, Mus musculus
ataccacagacgattatacctagaa

SEQ ID NO: 228014 - DNA, 25 bp, Mus musculus
ataccacagacgtttatacctagaa

SEQ ID NO: 228015 - DNA, 25 bp, Mus musculus
ataccacagagcacctgattgccag

SEQ ID NO: 228016 - DNA, 25 bp, Mus musculus
ataccacagagctcctgattgccag

SEQ ID NO: 228017 - DNA, 25 bp, Mus musculus
ataccacagcttccctttcaggaga

SEQ ID NO: 228018 - DNA, 25 bp, Mus musculus
ataccacagcttgcctttcaggaga

SEQ ID NO: 228019 - DNA, 25 bp, Mus musculus
ataccacaggccatcggttagctca

SEQ ID NO: 228020 - DNA, 25 bp, Mus musculus
ataccacaggccttcggttagctca

SEQ ID NO: 228021 - DNA, 25 bp, Mus musculus
ataccacagttaccaggacccagag

SEQ ID NO: 228022 - DNA, 25 bp, Mus musculus
ataccacagttagcaggacccagag

SEQ ID NO: 228023 - DNA, 25 bp, Mus musculus
ataccacagttcattgtagtcagta

SEQ ID NO: 228024 - DNA, 25 bp, Mus musculus
ataccacagttctttgtagtcagta

SEQ ID NO: 228025 - DNA, 25 bp, Mus musculus
ataccacatgtgagctagatgcaaa

SEQ ID NO: 228026 - DNA, 25 bp, Mus musculus
ataccacatgtgtgctagatgcaaa

SEQ ID NO: 228027 - DNA, 25 bp, Mus musculus
ataccacattcacccggccaggaga

SEQ ID NO: 228028 - DNA, 25 bp, Mus musculus
ataccacattcagccggccaggaga

SEQ ID NO: 228029 - DNA, 25 bp, Mus musculus
ataccacattgcattcaaccagctg

SEQ ID NO: 228030 - DNA, 25 bp, Mus musculus
ataccacattgctttcaaccagctg

SEQ ID NO: 228031 - DNA, 25 bp, Mus musculus
ataccacattgtcttaggattctga

SEQ ID NO: 228032 - DNA, 25 bp, Mus musculus
ataccacattgtgttaggattctga

SEQ ID NO: 228033 - DNA, 25 bp, Mus musculus
ataccaccacgacagcaggcggata

SEQ ID NO: 228034 - DNA, 25 bp, Mus musculus
ataccaccacgagagcaggcggata

SEQ ID NO: 228035 - DNA, 25 bp, Mus musculus
ataccaccactactcaactattatt

SEQ ID NO: 228036 - DNA, 25 bp, Mus musculus
ataccaccactagtcaactattatt

SEQ ID NO: 228037 - DNA, 25 bp, Mus musculus
ataccaccagccagttatctggagg

SEQ ID NO: 228038 - DNA, 25 bp, Mus musculus
ataccaccagcctgttatctggagg

SEQ ID NO: 228039 - DNA, 25 bp, Mus musculus
ataccaccagcgattttataggttg

SEQ ID NO: 228040 - DNA, 25 bp, Mus musculus
ataccaccagcgtttttataggttg

SEQ ID NO: 228041 - DNA, 25 bp, Mus musculus
ataccaccatatctgccttggttgt

SEQ ID NO: 228042 - DNA, 25 bp, Mus musculus
ataccaccatatgtgccttggttgt

SEQ ID NO: 228043 - DNA, 25 bp, Mus musculus
ataccacccatcctttatcctgaaa

SEQ ID NO: 228044 - DNA, 25 bp, Mus musculus
ataccacccatcgtttatcctgaaa

SEQ ID NO: 228045 - DNA, 25 bp, Mus musculus
ataccacgaactagtgctgaccaca

SEQ ID NO: 228046 - DNA, 25 bp, Mus musculus
ataccacgaacttgtgctgaccaca

SEQ ID NO: 228047 - DNA, 25 bp, Mus musculus
ataccacgacttatgcagcccaaga

SEQ ID NO: 228048 - DNA, 25 bp, Mus musculus
ataccacgacttttgcagcccaaga

SEQ ID NO: 228049 - DNA, 25 bp, Mus musculus
ataccacgagtccaagctggcagcg

SEQ ID NO: 228050 - DNA, 25 bp, Mus musculus
ataccacgagtcgaagctggcagcg

SEQ ID NO: 228051 - DNA, 25 bp, Mus musculus
ataccacggttgaaaagagttcgag

SEQ ID NO: 228052 - DNA, 25 bp, Mus musculus
ataccacggttgtaaagagttcgag

SEQ ID NO: 228053 - DNA, 25 bp, Mus musculus
ataccacgtgaccatcaggctaaag

SEQ ID NO: 228054 - DNA, 25 bp, Mus musculus
ataccacgtgacgatcaggctaaag

SEQ ID NO: 228055 - DNA, 25 bp, Mus musculus
ataccactaaccacctacttgtctt

SEQ ID NO: 228056 - DNA, 25 bp, Mus musculus
ataccactaacctcctacttgtctt

SEQ ID NO: 228057 - DNA, 25 bp, Mus musculus
ataccactaagcacctttaagactc

SEQ ID NO: 228058 - DNA, 25 bp, Mus musculus
ataccactaagctcctttaagactc

SEQ ID NO: 228059 - DNA, 25 bp, Mus musculus
ataccactccatctcagactctcat

SEQ ID NO: 228060 - DNA, 25 bp, Mus musculus
ataccactccatgtcagactctcat

SEQ ID NO: 228061 - DNA, 25 bp, Mus musculus
ataccactgccacatctttgggagg

SEQ ID NO: 228062 - DNA, 25 bp, Mus musculus
ataccactgccagatctttgggagg

SEQ ID NO: 228063 - DNA, 25 bp, Mus musculus
ataccactgcctacgggacatgggc

SEQ ID NO: 228064 - DNA, 25 bp, Mus musculus
ataccactgccttcgggacatgggc

SEQ ID NO: 228065 - DNA, 25 bp, Mus musculus
ataccactgcttatctggctttgac

SEQ ID NO: 228066 - DNA, 25 bp, Mus musculus
ataccactgcttttctggctttgac

SEQ ID NO: 228067 - DNA, 25 bp, Mus musculus
ataccactgtacatgttttacacca

SEQ ID NO: 228068 - DNA, 25 bp, Mus musculus
ataccactgtacttgttttacacca

SEQ ID NO: 228069 - DNA, 25 bp, Mus musculus
ataccactgtcaagatgcgcagcat

SEQ ID NO: 228070 - DNA, 25 bp, Mus musculus
ataccactgtcatgatgcgcagcat

SEQ ID NO: 228071 - DNA, 25 bp, Mus musculus
ataccacttgataatcatgggcccc

SEQ ID NO: 228072 - DNA, 25 bp, Mus musculus
ataccacttgattatcatgggcccc

SEQ ID NO: 228073 - DNA, 25 bp, Mus musculus
ataccacttgccaagtatgcttcaa

SEQ ID NO: 228074 - DNA, 25 bp, Mus musculus
ataccacttgcctagtatgcttcaa

SEQ ID NO: 228075 - DNA, 25 bp, Mus musculus
ataccagaaaacctgtgaggatctt

SEQ ID NO: 228076 - DNA, 25 bp, Mus musculus
ataccagaaaacgtgtgaggatctt

SEQ ID NO: 228077 - DNA, 25 bp, Mus musculus
ataccagaaacccttctacattctt

SEQ ID NO: 228078 - DNA, 25 bp, Mus musculus
ataccagaaaccgttctacattctt

SEQ ID NO: 228079 - DNA, 25 bp, Mus musculus
ataccagaaatcctaccgataagcc

SEQ ID NO: 228080 - DNA, 25 bp, Mus musculus
ataccagaaatcgtaccgataagcc

SEQ ID NO: 228081 - DNA, 25 bp, Mus musculus
ataccagaagccagatttccacatt

SEQ ID NO: 228082 - DNA, 25 bp, Mus musculus
ataccagaagcctgatttccacatt

SEQ ID NO: 228083 - DNA, 25 bp, Mus musculus
ataccagaccaacacatttctaaag

SEQ ID NO: 228084 - DNA, 25 bp, Mus musculus
ataccagaccaagacatttctaaag

SEQ ID NO: 228085 - DNA, 25 bp, Mus musculus
ataccagactatacagttcacaagc

SEQ ID NO: 228086 - DNA, 25 bp, Mus musculus
ataccagactattcagttcacaagc

SEQ ID NO: 228087 - DNA, 25 bp, Mus musculus
ataccagaggacaaacttatttttg

SEQ ID NO: 228088 - DNA, 25 bp, Mus musculus
ataccagaggacactcttggcctgt

SEQ ID NO: 228089 - DNA, 25 bp, Mus musculus
ataccagaggactaacttatttttg

SEQ ID NO: 228090 - DNA, 25 bp, Mus musculus
ataccagaggactctcttggcctgt

SEQ ID NO: 228091 - DNA, 25 bp, Mus musculus
ataccagagtttagcagttcccttc

SEQ ID NO: 228092 - DNA, 25 bp, Mus musculus
ataccagagttttgcagttcccttc

SEQ ID NO: 228093 - DNA, 25 bp, Mus musculus
ataccagatctcctgagtttgccag

SEQ ID NO: 228094 - DNA, 25 bp, Mus musculus
ataccagatctcgtgagtttgccag

SEQ ID NO: 228095 - DNA, 25 bp, Mus musculus
ataccagatgccatacattgccttt

SEQ ID NO: 228096 - DNA, 25 bp, Mus musculus
ataccagatgccttacattgccttt

SEQ ID NO: 228097 - DNA, 25 bp, Mus musculus
ataccagcaaaacctgcagctgtgt

SEQ ID NO: 228098 - DNA, 25 bp, Mus musculus
ataccagcaaaagctgcagctgtgt

SEQ ID NO: 228099 - DNA, 25 bp, Mus musculus
ataccagcacatatggaggcttccc

SEQ ID NO: 228100 - DNA, 25 bp, Mus musculus
ataccagcacatttggaggcttccc

SEQ ID NO: 228101 - DNA, 25 bp, Mus musculus
ataccagcacttagtggcaggcaga

SEQ ID NO: 228102 - DNA, 25 bp, Mus musculus
ataccagcactttgtggcaggcaga

SEQ ID NO: 228103 - DNA, 25 bp, Mus musculus
ataccagcagagaccacagcggcta

SEQ ID NO: 228104 - DNA, 25 bp, Mus musculus
ataccagcagagtccacagcggcta

SEQ ID NO: 228105 - DNA, 25 bp, Mus musculus
ataccagcagcacatccacatgaac

SEQ ID NO: 228106 - DNA, 25 bp, Mus musculus
ataccagcagcacccgatgagcttc

SEQ ID NO: 228107 - DNA, 25 bp, Mus musculus
ataccagcagcagatccacatgaac

SEQ ID NO: 228108 - DNA, 25 bp, Mus musculus
ataccagcagcagccgatgagcttc

SEQ ID NO: 228109 - DNA, 25 bp, Mus musculus
ataccagccactatgcacacaacaa

SEQ ID NO: 228110 - DNA, 25 bp, Mus musculus
ataccagccactttgcacacaacaa

SEQ ID NO: 228111 - DNA, 25 bp, Mus musculus
ataccagcccatcttaaggtttcag

SEQ ID NO: 228112 - DNA, 25 bp, Mus musculus
ataccagcccatgttaaggtttcag

SEQ ID NO: 228113 - DNA, 25 bp, Mus musculus
ataccagcccctataaacttgcatt

SEQ ID NO: 228114 - DNA, 25 bp, Mus musculus
ataccagcccctttaaacttgcatt

SEQ ID NO: 228115 - DNA, 25 bp, Mus musculus
ataccagcctcccagtagtgcgtat

SEQ ID NO: 228116 - DNA, 25 bp, Mus musculus
ataccagcctccgagtagtgcgtat

SEQ ID NO: 228117 - DNA, 25 bp, Mus musculus
ataccagcgccgcagcggtggcata

SEQ ID NO: 228118 - DNA, 25 bp, Mus musculus
ataccagcgccggagcggtggcata

SEQ ID NO: 228119 - DNA, 25 bp, Mus musculus
ataccagcgttgcatgggccttaat

SEQ ID NO: 228120 - DNA, 25 bp, Mus musculus
ataccagcgttggatgggccttaat

SEQ ID NO: 228121 - DNA, 25 bp, Mus musculus
ataccagctaacagtgaagaccaca

SEQ ID NO: 228122 - DNA, 25 bp, Mus musculus
ataccagctaactgtgaagaccaca

SEQ ID NO: 228123 - DNA, 25 bp, Mus musculus
ataccagctcacaatgacaggccct

SEQ ID NO: 228124 - DNA, 25 bp, Mus musculus
ataccagctcactatgacaggccct

SEQ ID NO: 228125 - DNA, 25 bp, Mus musculus
ataccagctcagaatattgcagtgt

SEQ ID NO: 228126 - DNA, 25 bp, Mus musculus
ataccagctcagtatattgcagtgt

SEQ ID NO: 228127 - DNA, 25 bp, Mus musculus
ataccagctcccaagacacatctgt

SEQ ID NO: 228128 - DNA, 25 bp, Mus musculus
ataccagctccctagacacatctgt

SEQ ID NO: 228129 - DNA, 25 bp, Mus musculus
ataccagctgaacaaatcccggaga

SEQ ID NO: 228130 - DNA, 25 bp, Mus musculus
ataccagctgaagaaatcccggaga

SEQ ID NO: 228131 - DNA, 25 bp, Mus musculus
ataccagctgccagcctaaaatctg

SEQ ID NO: 228132 - DNA, 25 bp, Mus musculus
ataccagctgcctgcctaaaatctg

SEQ ID NO: 228133 - DNA, 25 bp, Mus musculus
ataccaggacgcagaaggacactat

SEQ ID NO: 228134 - DNA, 25 bp, Mus musculus
ataccaggacgctgaaggacactat

SEQ ID NO: 228135 - DNA, 25 bp, Mus musculus
ataccaggagatcatggcggctgca

SEQ ID NO: 228136 - DNA, 25 bp, Mus musculus
ataccaggagatgatggcggctgca

SEQ ID NO: 228137 - DNA, 25 bp, Mus musculus
ataccaggagctattcttgagcgcg

SEQ ID NO: 228138 - DNA, 25 bp, Mus musculus
ataccaggagctccctgtgagctgt

SEQ ID NO: 228139 - DNA, 25 bp, Mus musculus
ataccaggagctgcctgtgagctgt

SEQ ID NO: 228140 - DNA, 25 bp, Mus musculus
ataccaggagcttttcttgagcgcg

SEQ ID NO: 228141 - DNA, 25 bp, Mus musculus
ataccaggagtgagcagccacacat

SEQ ID NO: 228142 - DNA, 25 bp, Mus musculus
ataccaggagtgtgcagccacacat

SEQ ID NO: 228143 - DNA, 25 bp, Mus musculus
ataccagggacacgaaacgagagtg

SEQ ID NO: 228144 - DNA, 25 bp, Mus musculus
ataccagggacaggaaacgagagtg

SEQ ID NO: 228145 - DNA, 25 bp, Mus musculus
ataccagggcccaactctataataa

SEQ ID NO: 228146 - DNA, 25 bp, Mus musculus
ataccagggccctactctataataa

SEQ ID NO: 228147 - DNA, 25 bp, Mus musculus
ataccaggtcttcttttagctactc

SEQ ID NO: 228148 - DNA, 25 bp, Mus musculus
ataccaggtcttgttttagctactc

SEQ ID NO: 228149 - DNA, 25 bp, Mus musculus
ataccaggttgcaaacatgagagac

SEQ ID NO: 228150 - DNA, 25 bp, Mus musculus
ataccaggttgctaacatgagagac

SEQ ID NO: 228151 - DNA, 25 bp, Mus musculus
ataccagtactgaatgcgcgaacat

SEQ ID NO: 228152 - DNA, 25 bp, Mus musculus
ataccagtactgtatgcgcgaacat

SEQ ID NO: 228153 - DNA, 25 bp, Mus musculus
ataccagtagcgcttggctgcatat

SEQ ID NO: 228154 - DNA, 25 bp, Mus musculus
ataccagtagcggttggctgcatat

SEQ ID NO: 228155 - DNA, 25 bp, Mus musculus
ataccagtatgtcatccaggtgcta

SEQ ID NO: 228156 - DNA, 25 bp, Mus musculus
ataccagtatgtgatccaggtgcta

SEQ ID NO: 228157 - DNA, 25 bp, Mus musculus
ataccagtcaagactcacactctga

SEQ ID NO: 228158 - DNA, 25 bp, Mus musculus
ataccagtcaagtctcacactctga

SEQ ID NO: 228159 - DNA, 25 bp, Mus musculus
ataccagtctggacaggctgtggac

SEQ ID NO: 228160 - DNA, 25 bp, Mus musculus
ataccagtctggtcaggctgtggac

SEQ ID NO: 228161 - DNA, 25 bp, Mus musculus
ataccagtcttccatatcctgcagg

SEQ ID NO: 228162 - DNA, 25 bp, Mus musculus
ataccagtcttcgatatcctgcagg

SEQ ID NO: 228163 - DNA, 25 bp, Mus musculus
ataccagtgagcactgttgtaccaa

SEQ ID NO: 228164 - DNA, 25 bp, Mus musculus
ataccagtgagctctgttgtaccaa

SEQ ID NO: 228165 - DNA, 25 bp, Mus musculus
ataccagtggccctttctgcttttg

SEQ ID NO: 228166 - DNA, 25 bp, Mus musculus
ataccagtggccgtttctgcttttg

SEQ ID NO: 228167 - DNA, 25 bp, Mus musculus
ataccagtgtaccatctgcacggaa

SEQ ID NO: 228168 - DNA, 25 bp, Mus musculus
ataccagtgtacgatctgcacggaa

SEQ ID NO: 228169 - DNA, 25 bp, Mus musculus
ataccagttaccatcatttgatcag

SEQ ID NO: 228170 - DNA, 25 bp, Mus musculus
ataccagttaccttcatttgatcag

SEQ ID NO: 228171 - DNA, 25 bp, Mus musculus
ataccagttactatgacagttccca

SEQ ID NO: 228172 - DNA, 25 bp, Mus musculus
ataccagttactttgacagttccca

SEQ ID NO: 228173 - DNA, 25 bp, Mus musculus
ataccagttcttagtaatgggttca

SEQ ID NO: 228174 - DNA, 25 bp, Mus musculus
ataccagttctttgtaatgggttca

SEQ ID NO: 228175 - DNA, 25 bp, Mus musculus
ataccagttggaacctactgcttct

SEQ ID NO: 228176 - DNA, 25 bp, Mus musculus
ataccagttggatcctactgcttct

SEQ ID NO: 228177 - DNA, 25 bp, Mus musculus
ataccatactatctccagagttaac

SEQ ID NO: 228178 - DNA, 25 bp, Mus musculus
ataccatactatgtccagagttaac

SEQ ID NO: 228179 - DNA, 25 bp, Mus musculus
ataccatactggaggtcttcactag

SEQ ID NO: 228180 - DNA, 25 bp, Mus musculus
ataccatactggtggtcttcactag

SEQ ID NO: 228181 - DNA, 25 bp, Mus musculus
ataccatactgtctgctccctgtag

SEQ ID NO: 228182 - DNA, 25 bp, Mus musculus
ataccatactgtgtgctccctgtag

SEQ ID NO: 228183 - DNA, 25 bp, Mus musculus
ataccatactttctagttcctgtaa

SEQ ID NO: 228184 - DNA, 25 bp, Mus musculus
ataccatactttgtagttcctgtaa

SEQ ID NO: 228185 - DNA, 25 bp, Mus musculus
ataccatagcagatccacacaattt

SEQ ID NO: 228186 - DNA, 25 bp, Mus musculus
ataccatagcagttccacacaattt

SEQ ID NO: 228187 - DNA, 25 bp, Mus musculus
ataccatcaaggaagcctctgctat

SEQ ID NO: 228188 - DNA, 25 bp, Mus musculus
ataccatcaaggtagcctctgctat

SEQ ID NO: 228189 - DNA, 25 bp, Mus musculus
ataccatcaccacctctttaaaaat

SEQ ID NO: 228190 - DNA, 25 bp, Mus musculus
ataccatcaccagctctttaaaaat

SEQ ID NO: 228191 - DNA, 25 bp, Mus musculus
ataccatccattaagctagccaaaa

SEQ ID NO: 228192 - DNA, 25 bp, Mus musculus
ataccatccatttagctagccaaaa

SEQ ID NO: 228193 - DNA, 25 bp, Mus musculus
ataccatctgaacactgccttgctt

SEQ ID NO: 228194 - DNA, 25 bp, Mus musculus
ataccatctgaagactgccttgctt

SEQ ID NO: 228195 - DNA, 25 bp, Mus musculus
ataccatctggccttgtgaactcca

SEQ ID NO: 228196 - DNA, 25 bp, Mus musculus
ataccatctggcgttgtgaactcca

SEQ ID NO: 228197 - DNA, 25 bp, Mus musculus
ataccatctgtaatcagctatttat

SEQ ID NO: 228198 - DNA, 25 bp, Mus musculus
ataccatctgtattcagctatttat

SEQ ID NO: 228199 - DNA, 25 bp, Mus musculus
ataccatgaaaccagcatccgcctt

SEQ ID NO: 228200 - DNA, 25 bp, Mus musculus
ataccatgaaacgagcatccgcctt

SEQ ID NO: 228201 - DNA, 25 bp, Mus musculus
ataccatgacatagggcgacattgt

SEQ ID NO: 228202 - DNA, 25 bp, Mus musculus
ataccatgacattgggcgacattgt

SEQ ID NO: 228203 - DNA, 25 bp, Mus musculus
ataccatgcagcatccggtggcggt

SEQ ID NO: 228204 - DNA, 25 bp, Mus musculus
ataccatgcagcttccggtggcggt

SEQ ID NO: 228205 - DNA, 25 bp, Mus musculus
ataccatgccatattagcgagtgaa

SEQ ID NO: 228206 - DNA, 25 bp, Mus musculus
ataccatgccattttagcgagtgaa

SEQ ID NO: 228207 - DNA, 25 bp, Mus musculus
ataccatgcgagctggagttccttc

SEQ ID NO: 228208 - DNA, 25 bp, Mus musculus
ataccatgcgaggtggagttccttc

SEQ ID NO: 228209 - DNA, 25 bp, Mus musculus
ataccatgggaaaaaagctgtgata

SEQ ID NO: 228210 - DNA, 25 bp, Mus musculus
ataccatgggaataaagctgtgata

SEQ ID NO: 228211 - DNA, 25 bp, Mus musculus
ataccatgggacactggaccttgag

SEQ ID NO: 228212 - DNA, 25 bp, Mus musculus
ataccatgggactctggaccttgag

SEQ ID NO: 228213 - DNA, 25 bp, Mus musculus
ataccatgttggatgaccttaataa

SEQ ID NO: 228214 - DNA, 25 bp, Mus musculus
ataccatgttggttgaccttaataa

SEQ ID NO: 228215 - DNA, 25 bp, Mus musculus
ataccattcagcagattctccaaaa

SEQ ID NO: 228216 - DNA, 25 bp, Mus musculus
ataccattcagctgattctccaaaa

SEQ ID NO: 228217 - DNA, 25 bp, Mus musculus
ataccattcagtatgccttaaccgg

SEQ ID NO: 228218 - DNA, 25 bp, Mus musculus
ataccattcagtttgccttaaccgg

SEQ ID NO: 228219 - DNA, 25 bp, Mus musculus
ataccattccatactgctgacattg

SEQ ID NO: 228220 - DNA, 25 bp, Mus musculus
ataccattccattctgctgacattg

SEQ ID NO: 228221 - DNA, 25 bp, Mus musculus
ataccattccttccctggtgaagac

SEQ ID NO: 228222 - DNA, 25 bp, Mus musculus
ataccattccttgcctggtgaagac

SEQ ID NO: 228223 - DNA, 25 bp, Mus musculus
ataccattcggtcttttgcagagaa

SEQ ID NO: 228224 - DNA, 25 bp, Mus musculus
ataccattcggtgttttgcagagaa

SEQ ID NO: 228225 - DNA, 25 bp, Mus musculus
ataccatttaataagctcttgtgca

SEQ ID NO: 228226 - DNA, 25 bp, Mus musculus
ataccatttaattagctcttgtgca

SEQ ID NO: 228227 - DNA, 25 bp, Mus musculus
ataccatttgagatgtaacttacgt

SEQ ID NO: 228228 - DNA, 25 bp, Mus musculus
ataccatttgagttgtaacttacgt

SEQ ID NO: 228229 - DNA, 25 bp, Mus musculus
ataccatttttaaactccacacgag

SEQ ID NO: 228230 - DNA, 25 bp, Mus musculus
ataccatttttatactccacacgag

SEQ ID NO: 228231 - DNA, 25 bp, Mus musculus
atacccaaagatatccaatgctcag

SEQ ID NO: 228232 - DNA, 25 bp, Mus musculus
atacccaaagatttccaatgctcag

SEQ ID NO: 228233 - DNA, 25 bp, Mus musculus
atacccaaattgattgaccctggag

SEQ ID NO: 228234 - DNA, 25 bp, Mus musculus
atacccaaattgtttgaccctggag

SEQ ID NO: 228235 - DNA, 25 bp, Mus musculus
atacccaaccggatgttgactgttg

SEQ ID NO: 228236 - DNA, 25 bp, Mus musculus
atacccaaccggttgttgactgttg

SEQ ID NO: 228237 - DNA, 25 bp, Mus musculus
atacccaagcagaggcagacgctgt

SEQ ID NO: 228238 - DNA, 25 bp, Mus musculus
atacccaagcagtggcagacgctgt

SEQ ID NO: 228239 - DNA, 25 bp, Mus musculus
atacccaagcgcacatacaataggt

SEQ ID NO: 228240 - DNA, 25 bp, Mus musculus
atacccaagcgctcatacaataggt

SEQ ID NO: 228241 - DNA, 25 bp, Mus musculus
atacccaaggagagaaccggctgtt

SEQ ID NO: 228242 - DNA, 25 bp, Mus musculus
atacccaaggagtgaaccggctgtt

SEQ ID NO: 228243 - DNA, 25 bp, Mus musculus
atacccaagggtcctgcattacagc

SEQ ID NO: 228244 - DNA, 25 bp, Mus musculus
atacccaagggtgctgcattacagc

SEQ ID NO: 228245 - DNA, 25 bp, Mus musculus
atacccaatgctagtgtgtgcttat

SEQ ID NO: 228246 - DNA, 25 bp, Mus musculus
atacccaatgcttgtgtgtgcttat

SEQ ID NO: 228247 - DNA, 25 bp, Mus musculus
atacccaatgggattccagcttgaa

SEQ ID NO: 228248 - DNA, 25 bp, Mus musculus
atacccaatgggtttccagcttgaa

SEQ ID NO: 228249 - DNA, 25 bp, Mus musculus
atacccacaccaccactagtagtaa

SEQ ID NO: 228250 - DNA, 25 bp, Mus musculus
atacccacaccagcactagtagtaa

SEQ ID NO: 228251 - DNA, 25 bp, Mus musculus
atacccacatccagagctgtgtgaa

SEQ ID NO: 228252 - DNA, 25 bp, Mus musculus
atacccacatcctgagctgtgtgaa

SEQ ID NO: 228253 - DNA, 25 bp, Mus musculus
atacccacgaagatagtctctggcc

SEQ ID NO: 228254 - DNA, 25 bp, Mus musculus
atacccacgaagttagtctctggcc

SEQ ID NO: 228255 - DNA, 25 bp, Mus musculus
atacccactcacagtgatgccagca

SEQ ID NO: 228256 - DNA, 25 bp, Mus musculus
atacccactcactgtgatgccagca

SEQ ID NO: 228257 - DNA, 25 bp, Mus musculus
atacccactcatcaagattttgctg

SEQ ID NO: 228258 - DNA, 25 bp, Mus musculus
atacccactcatgaagattttgctg

SEQ ID NO: 228259 - DNA, 25 bp, Mus musculus
atacccactggaatggaacttccca

SEQ ID NO: 228260 - DNA, 25 bp, Mus musculus
atacccactggattggaacttccca

SEQ ID NO: 228261 - DNA, 25 bp, Mus musculus
atacccactgtactaacgtgccaag

SEQ ID NO: 228262 - DNA, 25 bp, Mus musculus
atacccactgtagtaacgtgccaag

SEQ ID NO: 228263 - DNA, 25 bp, Mus musculus
atacccactttaatcatgacatcgc

SEQ ID NO: 228264 - DNA, 25 bp, Mus musculus
atacccactttattcatgacatcgc

SEQ ID NO: 228265 - DNA, 25 bp, Mus musculus
atacccagaagtcttctcagatcag

SEQ ID NO: 228266 - DNA, 25 bp, Mus musculus
atacccagaagtgttctcagatcag

SEQ ID NO: 228267 - DNA, 25 bp, Mus musculus
atacccagagtacgctttgacagtt

SEQ ID NO: 228268 - DNA, 25 bp, Mus musculus
atacccagagtaggctttgacagtt

SEQ ID NO: 228269 - DNA, 25 bp, Mus musculus
atacccagcataagtttgtaccctc

SEQ ID NO: 228270 - DNA, 25 bp, Mus musculus
atacccagcatatgtttgtaccctc

SEQ ID NO: 228271 - DNA, 25 bp, Mus musculus
atacccagccggcatcgctgatttc

SEQ ID NO: 228272 - DNA, 25 bp, Mus musculus
atacccagccgggatcgctgatttc

SEQ ID NO: 228273 - DNA, 25 bp, Mus musculus
atacccagcctgactggcaggaggg

SEQ ID NO: 228274 - DNA, 25 bp, Mus musculus
atacccagcctgtctggcaggaggg

SEQ ID NO: 228275 - DNA, 25 bp, Mus musculus
atacccaggaaaacggcactgcaca

SEQ ID NO: 228276 - DNA, 25 bp, Mus musculus
atacccaggaaatcggcactgcaca

SEQ ID NO: 228277 - DNA, 25 bp, Mus musculus
atacccaggactcaaatcttaaaag

SEQ ID NO: 228278 - DNA, 25 bp, Mus musculus
atacccaggactgaaatcttaaaag

SEQ ID NO: 228279 - DNA, 25 bp, Mus musculus
atacccaggagaaattttacaccaa

SEQ ID NO: 228280 - DNA, 25 bp, Mus musculus
atacccaggagatattttacaccaa

SEQ ID NO: 228281 - DNA, 25 bp, Mus musculus
atacccaggaggctgcagccatagg

SEQ ID NO: 228282 - DNA, 25 bp, Mus musculus
atacccaggagggtgcagccatagg

SEQ ID NO: 228283 - DNA, 25 bp, Mus musculus
atacccagggcaaactgccgggaca

SEQ ID NO: 228284 - DNA, 25 bp, Mus musculus
atacccagggcatactgccgggaca

SEQ ID NO: 228285 - DNA, 25 bp, Mus musculus
atacccagggcgctgaccttccagg

SEQ ID NO: 228286 - DNA, 25 bp, Mus musculus
atacccagggcggtgaccttccagg

SEQ ID NO: 228287 - DNA, 25 bp, Mus musculus
atacccatagctctgggcttgatcc

SEQ ID NO: 228288 - DNA, 25 bp, Mus musculus
atacccatagctgtgggcttgatcc

SEQ ID NO: 228289 - DNA, 25 bp, Mus musculus
atacccatctacactacaaagttcc

SEQ ID NO: 228290 - DNA, 25 bp, Mus musculus
atacccatctactctacaaagttcc

SEQ ID NO: 228291 - DNA, 25 bp, Mus musculus
atacccatctcaacaacaagtgcac

SEQ ID NO: 228292 - DNA, 25 bp, Mus musculus
atacccatctcatcaacaagtgcac

SEQ ID NO: 228293 - DNA, 25 bp, Mus musculus
atacccatctgtaccagcactgtga

SEQ ID NO: 228294 - DNA, 25 bp, Mus musculus
atacccatctgttccagcactgtga

SEQ ID NO: 228295 - DNA, 25 bp, Mus musculus
atacccatgcccattgtgagcatta

SEQ ID NO: 228296 - DNA, 25 bp, Mus musculus
atacccatgccctttgtgagcatta

SEQ ID NO: 228297 - DNA, 25 bp, Mus musculus
atacccatggacaggttggcaccag

SEQ ID NO: 228298 - DNA, 25 bp, Mus musculus
atacccatggactggttggcaccag

SEQ ID NO: 228299 - DNA, 25 bp, Mus musculus
atacccatgttcagataccagtgtg

SEQ ID NO: 228300 - DNA, 25 bp, Mus musculus
atacccatgttctgataccagtgtg

SEQ ID NO: 228301 - DNA, 25 bp, Mus musculus
atacccattacaccttcaggcaaag

SEQ ID NO: 228302 - DNA, 25 bp, Mus musculus
atacccattacagcttcaggcaaag

SEQ ID NO: 228303 - DNA, 25 bp, Mus musculus
atacccattgttatagatctctgcc

SEQ ID NO: 228304 - DNA, 25 bp, Mus musculus
atacccattgttttagatctctgcc

SEQ ID NO: 228305 - DNA, 25 bp, Mus musculus
ataccccaagatctcgctaaaggag

SEQ ID NO: 228306 - DNA, 25 bp, Mus musculus
ataccccaagatgtcgctaaaggag

SEQ ID NO: 228307 - DNA, 25 bp, Mus musculus
ataccccaatccagtctagacaacg

SEQ ID NO: 228308 - DNA, 25 bp, Mus musculus
ataccccaatcctgtctagacaacg

SEQ ID NO: 228309 - DNA, 25 bp, Mus musculus
ataccccacatacaatagaaagaat

SEQ ID NO: 228310 - DNA, 25 bp, Mus musculus
ataccccacatagaatagaaagaat

SEQ ID NO: 228311 - DNA, 25 bp, Mus musculus
ataccccatgcaatgttagcccttt

SEQ ID NO: 228312 - DNA, 25 bp, Mus musculus
ataccccatgcattgttagcccttt

SEQ ID NO: 228313 - DNA, 25 bp, Mus musculus
ataccccatgcgctgaacctgatat

SEQ ID NO: 228314 - DNA, 25 bp, Mus musculus
ataccccatgcggtgaacctgatat

SEQ ID NO: 228315 - DNA, 25 bp, Mus musculus
ataccccggtgtccctgtggaggaa

SEQ ID NO: 228316 - DNA, 25 bp, Mus musculus
ataccccggtgtgcctgtggaggaa

SEQ ID NO: 228317 - DNA, 25 bp, Mus musculus
ataccccgtgcaccttgtggtgtgc

SEQ ID NO: 228318 - DNA, 25 bp, Mus musculus
ataccccgtgcagcttgtggtgtgc

SEQ ID NO: 228319 - DNA, 25 bp, Mus musculus
atacccctactgctaccaaggaggt

SEQ ID NO: 228320 - DNA, 25 bp, Mus musculus
atacccctactggtaccaaggaggt

SEQ ID NO: 228321 - DNA, 25 bp, Mus musculus
atacccctcagactctgtatgtgct

SEQ ID NO: 228322 - DNA, 25 bp, Mus musculus
atacccctcagagtctgtatgtgct

SEQ ID NO: 228323 - DNA, 25 bp, Mus musculus
atacccctctgtccattgtttataa

SEQ ID NO: 228324 - DNA, 25 bp, Mus musculus
atacccctctgtgcattgtttataa

SEQ ID NO: 228325 - DNA, 25 bp, Mus musculus
atacccctgacaattatcctggaaa

SEQ ID NO: 228326 - DNA, 25 bp, Mus musculus
atacccctgacatttatcctggaaa

SEQ ID NO: 228327 - DNA, 25 bp, Mus musculus
atacccctgaccattctaaaactgg

SEQ ID NO: 228328 - DNA, 25 bp, Mus musculus
atacccctgacctttctaaaactgg

SEQ ID NO: 228329 - DNA, 25 bp, Mus musculus
atacccctggaaaacacctgtgcat

SEQ ID NO: 228330 - DNA, 25 bp, Mus musculus
atacccctggaatacacctgtgcat

SEQ ID NO: 228331 - DNA, 25 bp, Mus musculus
atacccctgggcagtgtgcatccgg

SEQ ID NO: 228332 - DNA, 25 bp, Mus musculus
atacccctgggctgtgtgcatccgg

SEQ ID NO: 228333 - DNA, 25 bp, Mus musculus
ataccccttaccaggagtcagattc

SEQ ID NO: 228334 - DNA, 25 bp, Mus musculus
ataccccttacctggagtcagattc

SEQ ID NO: 228335 - DNA, 25 bp, Mus musculus
ataccccttgttatcatcagcattt

SEQ ID NO: 228336 - DNA, 25 bp, Mus musculus
ataccccttgttttcatcagcattt

SEQ ID NO: 228337 - DNA, 25 bp, Mus musculus
atacccgatgtcaacgcgagttaga

SEQ ID NO: 228338 - DNA, 25 bp, Mus musculus
atacccgatgtctacgcgagttaga

SEQ ID NO: 228339 - DNA, 25 bp, Mus musculus
atacccgatttgcttctttgaagaa

SEQ ID NO: 228340 - DNA, 25 bp, Mus musculus
atacccgatttggttctttgaagaa

SEQ ID NO: 228341 - DNA, 25 bp, Mus musculus
atacccgcctagacaggagatctcg

SEQ ID NO: 228342 - DNA, 25 bp, Mus musculus
atacccgcctagtcaggagatctcg

SEQ ID NO: 228343 - DNA, 25 bp, Mus musculus
atacccgctactatgctcttagtaa

SEQ ID NO: 228344 - DNA, 25 bp, Mus musculus
atacccgctactttgctcttagtaa

SEQ ID NO: 228345 - DNA, 25 bp, Mus musculus
atacccggaaatcattcctgccgaa

SEQ ID NO: 228346 - DNA, 25 bp, Mus musculus
atacccggaaatgattcctgccgaa

SEQ ID NO: 228347 - DNA, 25 bp, Mus musculus
atacccggcaagctctagaattatt

SEQ ID NO: 228348 - DNA, 25 bp, Mus musculus
atacccggcaaggtctagaattatt

SEQ ID NO: 228349 - DNA, 25 bp, Mus musculus
atacccggttttataatctggcagt

SEQ ID NO: 228350 - DNA, 25 bp, Mus musculus
atacccggttttttaatctggcagt

SEQ ID NO: 228351 - DNA, 25 bp, Mus musculus
atacccgtagggaatgtagctgcat

SEQ ID NO: 228352 - DNA, 25 bp, Mus musculus
atacccgtagggtatgtagctgcat

SEQ ID NO: 228353 - DNA, 25 bp, Mus musculus
atacccgtattgatgagtgactagg

SEQ ID NO: 228354 - DNA, 25 bp, Mus musculus
atacccgtattgttgagtgactagg

SEQ ID NO: 228355 - DNA, 25 bp, Mus musculus
atacccgtgtcaccatggtcatgtt

SEQ ID NO: 228356 - DNA, 25 bp, Mus musculus
atacccgtgtcagcatggtcatgtt

SEQ ID NO: 228357 - DNA, 25 bp, Mus musculus
atacccgtgtgtacctgtatgaggt

SEQ ID NO: 228358 - DNA, 25 bp, Mus musculus
atacccgtgtgttcctgtatgaggt

SEQ ID NO: 228359 - DNA, 25 bp, Mus musculus
atacccgttagtcatgcccattaat

SEQ ID NO: 228360 - DNA, 25 bp, Mus musculus
atacccgttagtgatgcccattaat

SEQ ID NO: 228361 - DNA, 25 bp, Mus musculus
ataccctaaaggagcttctgaccgc

SEQ ID NO: 228362 - DNA, 25 bp, Mus musculus
ataccctaaaggtgcttctgaccgc

SEQ ID NO: 228363 - DNA, 25 bp, Mus musculus
ataccctaagccctgaagaggaggc

SEQ ID NO: 228364 - DNA, 25 bp, Mus musculus
ataccctaagccgtgaagaggaggc

SEQ ID NO: 228365 - DNA, 25 bp, Mus musculus
ataccctacatcattatggcactgg

SEQ ID NO: 228366 - DNA, 25 bp, Mus musculus
ataccctacatctttatggcactgg

SEQ ID NO: 228367 - DNA, 25 bp, Mus musculus
ataccctactaccaaagctggaaag

SEQ ID NO: 228368 - DNA, 25 bp, Mus musculus
ataccctactacgaaagctggaaag

SEQ ID NO: 228369 - DNA, 25 bp, Mus musculus
ataccctagggccagagactaactt

SEQ ID NO: 228370 - DNA, 25 bp, Mus musculus
ataccctagggcgagagactaactt

SEQ ID NO: 228371 - DNA, 25 bp, Mus musculus
ataccctcacatcttatcagtcaag

SEQ ID NO: 228372 - DNA, 25 bp, Mus musculus
ataccctcacatgttatcagtcaag

SEQ ID NO: 228373 - DNA, 25 bp, Mus musculus
ataccctcagaacgcaaatgctttt

SEQ ID NO: 228374 - DNA, 25 bp, Mus musculus
ataccctcagaaggcaaatgctttt

SEQ ID NO: 228375 - DNA, 25 bp, Mus musculus
ataccctcatctctgctgtcagtgt

SEQ ID NO: 228376 - DNA, 25 bp, Mus musculus
ataccctcatctgtgctgtcagtgt

SEQ ID NO: 228377 - DNA, 25 bp, Mus musculus
ataccctccacccagactcagtttt

SEQ ID NO: 228378 - DNA, 25 bp, Mus musculus
ataccctccaccgagactcagtttt

SEQ ID NO: 228379 - DNA, 25 bp, Mus musculus
ataccctcccacaagagaccaggat

SEQ ID NO: 228380 - DNA, 25 bp, Mus musculus
ataccctcccactagagaccaggat

SEQ ID NO: 228381 - DNA, 25 bp, Mus musculus
ataccctccctgcaacagtcagtca

SEQ ID NO: 228382 - DNA, 25 bp, Mus musculus
ataccctccctggaacagtcagtca

SEQ ID NO: 228383 - DNA, 25 bp, Mus musculus
ataccctcctgacagtctggaagtg

SEQ ID NO: 228384 - DNA, 25 bp, Mus musculus
ataccctcctgagagtctggaagtg

SEQ ID NO: 228385 - DNA, 25 bp, Mus musculus
ataccctcgctgacaggtcttctat

SEQ ID NO: 228386 - DNA, 25 bp, Mus musculus
ataccctcgctgtcaggtcttctat

SEQ ID NO: 228387 - DNA, 25 bp, Mus musculus
ataccctcgttcaaggtcaccagct

SEQ ID NO: 228388 - DNA, 25 bp, Mus musculus
ataccctcgttctaggtcaccagct

SEQ ID NO: 228389 - DNA, 25 bp, Mus musculus
ataccctctgtgatgtaagtaacta

SEQ ID NO: 228390 - DNA, 25 bp, Mus musculus
ataccctctgtgttgtaagtaacta

SEQ ID NO: 228391 - DNA, 25 bp, Mus musculus
ataccctgaggaacaggctgctctt

SEQ ID NO: 228392 - DNA, 25 bp, Mus musculus
ataccctgaggatcaggctgctctt

SEQ ID NO: 228393 - DNA, 25 bp, Mus musculus
ataccctgataacgcccgacggaga

SEQ ID NO: 228394 - DNA, 25 bp, Mus musculus
ataccctgataaggcccgacggaga

SEQ ID NO: 228395 - DNA, 25 bp, Mus musculus
ataccctgatgtaacagatgactgt

SEQ ID NO: 228396 - DNA, 25 bp, Mus musculus
ataccctgatgttacagatgactgt

SEQ ID NO: 228397 - DNA, 25 bp, Mus musculus
ataccctgctttagtatccttccat

SEQ ID NO: 228398 - DNA, 25 bp, Mus musculus
ataccctgcttttgtatccttccat

SEQ ID NO: 228399 - DNA, 25 bp, Mus musculus
ataccctggaccatcggtgtgttta

SEQ ID NO: 228400 - DNA, 25 bp, Mus musculus
ataccctggaccttcggtgtgttta

SEQ ID NO: 228401 - DNA, 25 bp, Mus musculus
ataccctgggaactgaggcctggct

SEQ ID NO: 228402 - DNA, 25 bp, Mus musculus
ataccctgggaagtgaggcctggct

SEQ ID NO: 228403 - DNA, 25 bp, Mus musculus
ataccctgtactacatgagtgacgc

SEQ ID NO: 228404 - DNA, 25 bp, Mus musculus
ataccctgtacttcatgagtgacgc

SEQ ID NO: 228405 - DNA, 25 bp, Mus musculus
ataccctgtataagaaggctcctaa

SEQ ID NO: 228406 - DNA, 25 bp, Mus musculus
ataccctgtatatgaaggctcctaa

SEQ ID NO: 228407 - DNA, 25 bp, Mus musculus
ataccctgtcctcgagacgtgtgct

SEQ ID NO: 228408 - DNA, 25 bp, Mus musculus
ataccctgtcctggagacgtgtgct

SEQ ID NO: 228409 - DNA, 25 bp, Mus musculus
ataccctgtgcactggagcttccta

SEQ ID NO: 228410 - DNA, 25 bp, Mus musculus
ataccctgtgcagtggagcttccta

SEQ ID NO: 228411 - DNA, 25 bp, Mus musculus
ataccctgtttcctgtgttcattga

SEQ ID NO: 228412 - DNA, 25 bp, Mus musculus
ataccctgtttcgtgtgttcattga

SEQ ID NO: 228413 - DNA, 25 bp, Mus musculus
ataccctgttttcgctctctcacga

SEQ ID NO: 228414 - DNA, 25 bp, Mus musculus
ataccctgttttggctctctcacga

SEQ ID NO: 228415 - DNA, 25 bp, Mus musculus
atacccttagtacacagcttcctag

SEQ ID NO: 228416 - DNA, 25 bp, Mus musculus
atacccttagtagacagcttcctag

SEQ ID NO: 228417 - DNA, 25 bp, Mus musculus
atacccttattacccttattacatg

SEQ ID NO: 228418 - DNA, 25 bp, Mus musculus
atacccttattagccttattacatg

SEQ ID NO: 228419 - DNA, 25 bp, Mus musculus
atacccttccatacaccttgagtaa

SEQ ID NO: 228420 - DNA, 25 bp, Mus musculus
atacccttccatatagacacacttt

SEQ ID NO: 228421 - DNA, 25 bp, Mus musculus
atacccttccattcaccttgagtaa

SEQ ID NO: 228422 - DNA, 25 bp, Mus musculus
atacccttccatttagacacacttt

SEQ ID NO: 228423 - DNA, 25 bp, Mus musculus
atacccttcttcatgagagttttgt

SEQ ID NO: 228424 - DNA, 25 bp, Mus musculus
atacccttcttcttgagagttttgt

SEQ ID NO: 228425 - DNA, 25 bp, Mus musculus
atacccttcttgaaatacatagcta

SEQ ID NO: 228426 - DNA, 25 bp, Mus musculus
atacccttcttgtaatacatagcta

SEQ ID NO: 228427 - DNA, 25 bp, Mus musculus
ataccctttcctatcaggtaagcat

SEQ ID NO: 228428 - DNA, 25 bp, Mus musculus
ataccctttcctttcaggtaagcat

SEQ ID NO: 228429 - DNA, 25 bp, Mus musculus
ataccctttcttctgtgttagcctg

SEQ ID NO: 228430 - DNA, 25 bp, Mus musculus
ataccctttcttgtgtgttagcctg

SEQ ID NO: 228431 - DNA, 25 bp, Mus musculus
ataccctttgtcaaaatatgcttgt

SEQ ID NO: 228432 - DNA, 25 bp, Mus musculus
ataccctttgtctaaatatgcttgt

SEQ ID NO: 228433 - DNA, 25 bp, Mus musculus
atacccttttgtccatctcatgtcc

SEQ ID NO: 228434 - DNA, 25 bp, Mus musculus
atacccttttgtgcatctcatgtcc

SEQ ID NO: 228435 - DNA, 25 bp, Mus musculus
ataccgaaaatgctactaacatggg

SEQ ID NO: 228436 - DNA, 25 bp, Mus musculus
ataccgaaaatggtactaacatggg

SEQ ID NO: 228437 - DNA, 25 bp, Mus musculus
ataccgacagcgatgggatgaagcc

SEQ ID NO: 228438 - DNA, 25 bp, Mus musculus
ataccgacagcgttgggatgaagcc

SEQ ID NO: 228439 - DNA, 25 bp, Mus musculus
ataccgacgtaaacaagtgcttatt

SEQ ID NO: 228440 - DNA, 25 bp, Mus musculus
ataccgacgtaatcaagtgcttatt

SEQ ID NO: 228441 - DNA, 25 bp, Mus musculus
ataccgactataatgttcccagctt

SEQ ID NO: 228442 - DNA, 25 bp, Mus musculus
ataccgactatattgttcccagctt

SEQ ID NO: 228443 - DNA, 25 bp, Mus musculus
ataccgactttgacacacagctgag

SEQ ID NO: 228444 - DNA, 25 bp, Mus musculus
ataccgactttgtcacacagctgag

SEQ ID NO: 228445 - DNA, 25 bp, Mus musculus
ataccgagcttgacgccatgagata

SEQ ID NO: 228446 - DNA, 25 bp, Mus musculus
ataccgagcttgtcgccatgagata

SEQ ID NO: 228447 - DNA, 25 bp, Mus musculus
ataccgaggcccactgtggagtggc

SEQ ID NO: 228448 - DNA, 25 bp, Mus musculus
ataccgaggcccatagacttttatg

SEQ ID NO: 228449 - DNA, 25 bp, Mus musculus
ataccgaggccctctgtggagtggc

SEQ ID NO: 228450 - DNA, 25 bp, Mus musculus
ataccgaggcccttagacttttatg

SEQ ID NO: 228451 - DNA, 25 bp, Mus musculus
ataccgagggaacctcattgaagca

SEQ ID NO: 228452 - DNA, 25 bp, Mus musculus
ataccgagggaagctcattgaagca

SEQ ID NO: 228453 - DNA, 25 bp, Mus musculus
ataccgcaagaacatctggatcaag

SEQ ID NO: 228454 - DNA, 25 bp, Mus musculus
ataccgcaagaagatctggatcaag

SEQ ID NO: 228455 - DNA, 25 bp, Mus musculus
ataccgcagattccagcagtgtgct

SEQ ID NO: 228456 - DNA, 25 bp, Mus musculus
ataccgcagattgcagcagtgtgct

SEQ ID NO: 228457 - DNA, 25 bp, Mus musculus
ataccgcagcttcctgaggatctgt

SEQ ID NO: 228458 - DNA, 25 bp, Mus musculus
ataccgcagcttgctgaggatctgt

SEQ ID NO: 228459 - DNA, 25 bp, Mus musculus
ataccgccagtcattaaactagctt

SEQ ID NO: 228460 - DNA, 25 bp, Mus musculus
ataccgccagtctttaaactagctt

SEQ ID NO: 228461 - DNA, 25 bp, Mus musculus
ataccgcccactctttattcagtgc

SEQ ID NO: 228462 - DNA, 25 bp, Mus musculus
ataccgcccactgtttattcagtgc

SEQ ID NO: 228463 - DNA, 25 bp, Mus musculus
ataccgctctgtcctggctgtgaaa

SEQ ID NO: 228464 - DNA, 25 bp, Mus musculus
ataccgctctgtgctggctgtgaaa

SEQ ID NO: 228465 - DNA, 25 bp, Mus musculus
ataccgcttagaaccggcgcctggg

SEQ ID NO: 228466 - DNA, 25 bp, Mus musculus
ataccgcttagatccggcgcctggg

SEQ ID NO: 228467 - DNA, 25 bp, Mus musculus
ataccgggagccacgacgcatgctg

SEQ ID NO: 228468 - DNA, 25 bp, Mus musculus
ataccgggagcctcgacgcatgctg

SEQ ID NO: 228469 - DNA, 25 bp, Mus musculus
ataccgggtactcagaaggcttcct

SEQ ID NO: 228470 - DNA, 25 bp, Mus musculus
ataccgggtactgagaaggcttcct

SEQ ID NO: 228471 - DNA, 25 bp, Mus musculus
ataccgggtatcaacttcttcacct

SEQ ID NO: 228472 - DNA, 25 bp, Mus musculus
ataccgggtatctacttcttcacct

SEQ ID NO: 228473 - DNA, 25 bp, Mus musculus
ataccgggtctacggaatccacagt

SEQ ID NO: 228474 - DNA, 25 bp, Mus musculus
ataccgggtctagggaatccacagt

SEQ ID NO: 228475 - DNA, 25 bp, Mus musculus
ataccgggtggtctacacagaccat

SEQ ID NO: 228476 - DNA, 25 bp, Mus musculus
ataccgggtggtgtacacagaccat

SEQ ID NO: 228477 - DNA, 25 bp, Mus musculus
ataccggtgctcactggacagttag

SEQ ID NO: 228478 - DNA, 25 bp, Mus musculus
ataccggtgctctctggacagttag

SEQ ID NO: 228479 - DNA, 25 bp, Mus musculus
ataccggtgggtaaagatcctctgt

SEQ ID NO: 228480 - DNA, 25 bp, Mus musculus
ataccggtgggttaagatcctctgt

SEQ ID NO: 228481 - DNA, 25 bp, Mus musculus
ataccggtttgtaaatgaattctgt

SEQ ID NO: 228482 - DNA, 25 bp, Mus musculus
ataccggtttgttaatgaattctgt

SEQ ID NO: 228483 - DNA, 25 bp, Mus musculus
ataccgtaacaaatgcttgatctta

SEQ ID NO: 228484 - DNA, 25 bp, Mus musculus
ataccgtaacaattgcttgatctta

SEQ ID NO: 228485 - DNA, 25 bp, Mus musculus
ataccgtcacataaggtctggctgt

SEQ ID NO: 228486 - DNA, 25 bp, Mus musculus
ataccgtcacattaggtctggctgt

SEQ ID NO: 228487 - DNA, 25 bp, Mus musculus
ataccgtcagcgctaggtgagatat

SEQ ID NO: 228488 - DNA, 25 bp, Mus musculus
ataccgtcagcggtaggtgagatat

SEQ ID NO: 228489 - DNA, 25 bp, Mus musculus
ataccgtccagcagggtggcgatgc

SEQ ID NO: 228490 - DNA, 25 bp, Mus musculus
ataccgtccagctgggtggcgatgc

SEQ ID NO: 228491 - DNA, 25 bp, Mus musculus
ataccgtccccaatgagaagactgt

SEQ ID NO: 228492 - DNA, 25 bp, Mus musculus
ataccgtccccattgagaagactgt

SEQ ID NO: 228493 - DNA, 25 bp, Mus musculus
ataccgtcgtccaatgaagcgcaac

SEQ ID NO: 228494 - DNA, 25 bp, Mus musculus
ataccgtcgtcctatgaagcgcaac

SEQ ID NO: 228495 - DNA, 25 bp, Mus musculus
ataccgtctcagaatgtgtgttcga

SEQ ID NO: 228496 - DNA, 25 bp, Mus musculus
ataccgtctcagtatgtgtgttcga

SEQ ID NO: 228497 - DNA, 25 bp, Mus musculus
ataccgtgcactaaggttgccatgt

SEQ ID NO: 228498 - DNA, 25 bp, Mus musculus
ataccgtgcacttaggttgccatgt

SEQ ID NO: 228499 - DNA, 25 bp, Mus musculus
ataccgtggttcctgccaggccaga

SEQ ID NO: 228500 - DNA, 25 bp, Mus musculus
ataccgtggttcgtgccaggccaga

SEQ ID NO: 228501 - DNA, 25 bp, Mus musculus
ataccgtgtcatcttatgtaaggga

SEQ ID NO: 228502 - DNA, 25 bp, Mus musculus
ataccgtgtcatgttatgtaaggga

SEQ ID NO: 228503 - DNA, 25 bp, Mus musculus
ataccgttcacgatttagatcagac

SEQ ID NO: 228504 - DNA, 25 bp, Mus musculus
ataccgttcacgttttagatcagac

SEQ ID NO: 228505 - DNA, 25 bp, Mus musculus
atacctaaaaggacactcaccagat

SEQ ID NO: 228506 - DNA, 25 bp, Mus musculus
atacctaaaaggtcactcaccagat

SEQ ID NO: 228507 - DNA, 25 bp, Mus musculus
atacctaactagaatgtggactggg

SEQ ID NO: 228508 - DNA, 25 bp, Mus musculus
atacctaactagtatgtggactggg

SEQ ID NO: 228509 - DNA, 25 bp, Mus musculus
atacctaagaggagagctcatccag

SEQ ID NO: 228510 - DNA, 25 bp, Mus musculus
atacctaagaggtgagctcatccag

SEQ ID NO: 228511 - DNA, 25 bp, Mus musculus
atacctaagtctacccgtggctaga

SEQ ID NO: 228512 - DNA, 25 bp, Mus musculus
atacctaagtcttcccgtggctaga

SEQ ID NO: 228513 - DNA, 25 bp, Mus musculus
atacctaatgatcactcccttatgt

SEQ ID NO: 228514 - DNA, 25 bp, Mus musculus
atacctaatgatgactcccttatgt

SEQ ID NO: 228515 - DNA, 25 bp, Mus musculus
atacctacaagtcatagaccttagt

SEQ ID NO: 228516 - DNA, 25 bp, Mus musculus
atacctacaagtgatagaccttagt

SEQ ID NO: 228517 - DNA, 25 bp, Mus musculus
atacctacacacacatcgagagctg

SEQ ID NO: 228518 - DNA, 25 bp, Mus musculus
atacctacacactcatcgagagctg

SEQ ID NO: 228519 - DNA, 25 bp, Mus musculus
atacctacagaccactgtgcttgtg

SEQ ID NO: 228520 - DNA, 25 bp, Mus musculus
atacctacagacgactgtgcttgtg

SEQ ID NO: 228521 - DNA, 25 bp, Mus musculus
atacctaccatgcagaacggcccag

SEQ ID NO: 228522 - DNA, 25 bp, Mus musculus
atacctaccatggagaacggcccag

SEQ ID NO: 228523 - DNA, 25 bp, Mus musculus
atacctaccttgacaagcggctaga

SEQ ID NO: 228524 - DNA, 25 bp, Mus musculus
atacctaccttgtcaagcggctaga

SEQ ID NO: 228525 - DNA, 25 bp, Mus musculus
atacctactactaactacttccagt

SEQ ID NO: 228526 - DNA, 25 bp, Mus musculus
atacctactacttactacttccagt

SEQ ID NO: 228527 - DNA, 25 bp, Mus musculus
atacctactcaacagatggcatggg

SEQ ID NO: 228528 - DNA, 25 bp, Mus musculus
atacctactcaagagatggcatggg

SEQ ID NO: 228529 - DNA, 25 bp, Mus musculus
atacctactgtaattgttaccttct

SEQ ID NO: 228530 - DNA, 25 bp, Mus musculus
atacctactgtatttgttaccttct

SEQ ID NO: 228531 - DNA, 25 bp, Mus musculus
atacctactgtccaatagcacttga

SEQ ID NO: 228532 - DNA, 25 bp, Mus musculus
atacctactgtcgaatagcacttga

SEQ ID NO: 228533 - DNA, 25 bp, Mus musculus
atacctactttaatctctatctcac

SEQ ID NO: 228534 - DNA, 25 bp, Mus musculus
atacctactttattctctatctcac

SEQ ID NO: 228535 - DNA, 25 bp, Mus musculus
atacctagaggcaaaattttccagt

SEQ ID NO: 228536 - DNA, 25 bp, Mus musculus
atacctagaggctaaattttccagt

SEQ ID NO: 228537 - DNA, 25 bp, Mus musculus
atacctagcaccatatatagccaat

SEQ ID NO: 228538 - DNA, 25 bp, Mus musculus
atacctagcaccttatatagccaat

SEQ ID NO: 228539 - DNA, 25 bp, Mus musculus
atacctaggcttcattctcagctct

SEQ ID NO: 228540 - DNA, 25 bp, Mus musculus
atacctaggcttgattctcagctct

SEQ ID NO: 228541 - DNA, 25 bp, Mus musculus
atacctaggtagctctgttggaaga

SEQ ID NO: 228542 - DNA, 25 bp, Mus musculus
atacctaggtaggtctgttggaaga

SEQ ID NO: 228543 - DNA, 25 bp, Mus musculus
atacctagtatgaccaaggttttgg

SEQ ID NO: 228544 - DNA, 25 bp, Mus musculus
atacctagtatgtccaaggttttgg

SEQ ID NO: 228545 - DNA, 25 bp, Mus musculus
atacctagtgccctacatggaacag

SEQ ID NO: 228546 - DNA, 25 bp, Mus musculus
atacctagtgccgtacatggaacag

SEQ ID NO: 228547 - DNA, 25 bp, Mus musculus
atacctagttttcaagctacaagtt

SEQ ID NO: 228548 - DNA, 25 bp, Mus musculus
atacctagttttgaagctacaagtt

SEQ ID NO: 228549 - DNA, 25 bp, Mus musculus
atacctatagccctgatgaacattt

SEQ ID NO: 228550 - DNA, 25 bp, Mus musculus
atacctatagccgtgatgaacattt

SEQ ID NO: 228551 - DNA, 25 bp, Mus musculus
atacctatctgcaacatgtactggg

SEQ ID NO: 228552 - DNA, 25 bp, Mus musculus
atacctatctgctacatgtactggg

SEQ ID NO: 228553 - DNA, 25 bp, Mus musculus
atacctatgactaatgctcaccctg

SEQ ID NO: 228554 - DNA, 25 bp, Mus musculus
atacctatgacttatgctcaccctg

SEQ ID NO: 228555 - DNA, 25 bp, Mus musculus
atacctatgagtatggattgtgtga

SEQ ID NO: 228556 - DNA, 25 bp, Mus musculus
atacctatgagtttggattgtgtga

SEQ ID NO: 228557 - DNA, 25 bp, Mus musculus
atacctattgccataatgttgtggg

SEQ ID NO: 228558 - DNA, 25 bp, Mus musculus
atacctattgccttaatgttgtggg

SEQ ID NO: 228559 - DNA, 25 bp, Mus musculus
atacctcaaacgactaccgttacag

SEQ ID NO: 228560 - DNA, 25 bp, Mus musculus
atacctcaaacgtctaccgttacag

SEQ ID NO: 228561 - DNA, 25 bp, Mus musculus
atacctcaaatactgcgttttgtca

SEQ ID NO: 228562 - DNA, 25 bp, Mus musculus
atacctcaaatagtgcgttttgtca

SEQ ID NO: 228563 - DNA, 25 bp, Mus musculus
atacctcaaattagctgtggatttt

SEQ ID NO: 228564 - DNA, 25 bp, Mus musculus
atacctcaaatttgctgtggatttt

SEQ ID NO: 228565 - DNA, 25 bp, Mus musculus
atacctcaagctagtgaccatcttt

SEQ ID NO: 228566 - DNA, 25 bp, Mus musculus
atacctcaagcttgtgaccatcttt

SEQ ID NO: 228567 - DNA, 25 bp, Mus musculus
atacctcaaggactagactttggct

SEQ ID NO: 228568 - DNA, 25 bp, Mus musculus
atacctcaaggagtagactttggct

SEQ ID NO: 228569 - DNA, 25 bp, Mus musculus
atacctcaatacctcagacaaggcc

SEQ ID NO: 228570 - DNA, 25 bp, Mus musculus
atacctcaatacgtcagacaaggcc

SEQ ID NO: 228571 - DNA, 25 bp, Mus musculus
atacctcaatgtatatgcacactgg

SEQ ID NO: 228572 - DNA, 25 bp, Mus musculus
atacctcaatgtttatgcacactgg

SEQ ID NO: 228573 - DNA, 25 bp, Mus musculus
atacctcacacaagtcttctgttag

SEQ ID NO: 228574 - DNA, 25 bp, Mus musculus
atacctcacacatgtcttctgttag

SEQ ID NO: 228575 - DNA, 25 bp, Mus musculus
atacctcacgagagctttgacaatg

SEQ ID NO: 228576 - DNA, 25 bp, Mus musculus
atacctcacgagtgctttgacaatg

SEQ ID NO: 228577 - DNA, 25 bp, Mus musculus
atacctcactccagttagggacgaa

SEQ ID NO: 228578 - DNA, 25 bp, Mus musculus
atacctcactcctgttagggacgaa

SEQ ID NO: 228579 - DNA, 25 bp, Mus musculus
atacctcagatgagctcatgaatgt

SEQ ID NO: 228580 - DNA, 25 bp, Mus musculus
atacctcagatgaggacctcacggg

SEQ ID NO: 228581 - DNA, 25 bp, Mus musculus
atacctcagatgtgctcatgaatgt

SEQ ID NO: 228582 - DNA, 25 bp, Mus musculus
atacctcagatgtggacctcacggg

SEQ ID NO: 228583 - DNA, 25 bp, Mus musculus
atacctcagggcagacacttccaat

SEQ ID NO: 228584 - DNA, 25 bp, Mus musculus
atacctcagggctgacacttccaat

SEQ ID NO: 228585 - DNA, 25 bp, Mus musculus
atacctcaggtcattgtgattccca

SEQ ID NO: 228586 - DNA, 25 bp, Mus musculus
atacctcaggtctttgtgattccca

SEQ ID NO: 228587 - DNA, 25 bp, Mus musculus
atacctcatagcattctggaagcaa

SEQ ID NO: 228588 - DNA, 25 bp, Mus musculus
atacctcatagctttctggaagcaa

SEQ ID NO: 228589 - DNA, 25 bp, Mus musculus
atacctcatattcgcctcaaattta

SEQ ID NO: 228590 - DNA, 25 bp, Mus musculus
atacctcatattggcctcaaattta

SEQ ID NO: 228591 - DNA, 25 bp, Mus musculus
atacctcatcatccagactgaagct

SEQ ID NO: 228592 - DNA, 25 bp, Mus musculus
atacctcatcatgcagactgaagct

SEQ ID NO: 228593 - DNA, 25 bp, Mus musculus
atacctcatctgaggattgtgattt

SEQ ID NO: 228594 - DNA, 25 bp, Mus musculus
atacctcatctgtggattgtgattt

SEQ ID NO: 228595 - DNA, 25 bp, Mus musculus
atacctcatgccatccacagacatt

SEQ ID NO: 228596 - DNA, 25 bp, Mus musculus
atacctcatgccttccacagacatt

SEQ ID NO: 228597 - DNA, 25 bp, Mus musculus
atacctcatgtgatatcagaagctt

SEQ ID NO: 228598 - DNA, 25 bp, Mus musculus
atacctcatgtgttatcagaagctt

SEQ ID NO: 228599 - DNA, 25 bp, Mus musculus
atacctccaaatcatactcctcttg

SEQ ID NO: 228600 - DNA, 25 bp, Mus musculus
atacctccaaatgatactcctcttg

SEQ ID NO: 228601 - DNA, 25 bp, Mus musculus
atacctccaggacttctattactgt

SEQ ID NO: 228602 - DNA, 25 bp, Mus musculus
atacctccaggagttctattactgt

SEQ ID NO: 228603 - DNA, 25 bp, Mus musculus
atacctccatagatgggttgaattt

SEQ ID NO: 228604 - DNA, 25 bp, Mus musculus
atacctccatagttgggttgaattt

SEQ ID NO: 228605 - DNA, 25 bp, Mus musculus
atacctcccctgctgggttatggtg

SEQ ID NO: 228606 - DNA, 25 bp, Mus musculus
atacctcccctggtgggttatggtg

SEQ ID NO: 228607 - DNA, 25 bp, Mus musculus
atacctccctatattccaagtgcat

SEQ ID NO: 228608 - DNA, 25 bp, Mus musculus
atacctccctattttccaagtgcat

SEQ ID NO: 228609 - DNA, 25 bp, Mus musculus
atacctcccttacgtagtcactgtc

SEQ ID NO: 228610 - DNA, 25 bp, Mus musculus
atacctcccttaggtagtcactgtc

SEQ ID NO: 228611 - DNA, 25 bp, Mus musculus
atacctccgcctcggtgtctaagat

SEQ ID NO: 228612 - DNA, 25 bp, Mus musculus
atacctccgcctgggtgtctaagat

SEQ ID NO: 228613 - DNA, 25 bp, Mus musculus
atacctcctagtcctactcaaatag

SEQ ID NO: 228614 - DNA, 25 bp, Mus musculus
atacctcctagtgctactcaaatag

SEQ ID NO: 228615 - DNA, 25 bp, Mus musculus
atacctcctcctctgttgtattaca

SEQ ID NO: 228616 - DNA, 25 bp, Mus musculus
atacctcctcctgtgttgtattaca

SEQ ID NO: 228617 - DNA, 25 bp, Mus musculus
atacctcctgacaccaggttcttta

SEQ ID NO: 228618 - DNA, 25 bp, Mus musculus
atacctcctgactccaggttcttta

SEQ ID NO: 228619 - DNA, 25 bp, Mus musculus
atacctcctgagacaaagaagcaat

SEQ ID NO: 228620 - DNA, 25 bp, Mus musculus
atacctcctgagtcaaagaagcaat

SEQ ID NO: 228621 - DNA, 25 bp, Mus musculus
atacctccttgtccctctgtctata

SEQ ID NO: 228622 - DNA, 25 bp, Mus musculus
atacctccttgtcctatttgaatgc

SEQ ID NO: 228623 - DNA, 25 bp, Mus musculus
atacctccttgtgcctctgtctata

SEQ ID NO: 228624 - DNA, 25 bp, Mus musculus
atacctccttgtgctatttgaatgc

SEQ ID NO: 228625 - DNA, 25 bp, Mus musculus
atacctcgacaaagccttaaccgca

SEQ ID NO: 228626 - DNA, 25 bp, Mus musculus
atacctcgacaatgccttaaccgca

SEQ ID NO: 228627 - DNA, 25 bp, Mus musculus
atacctcgcagaagttagggacacg

SEQ ID NO: 228628 - DNA, 25 bp, Mus musculus
atacctcgcagatgttagggacacg

SEQ ID NO: 228629 - DNA, 25 bp, Mus musculus
atacctcgccaaccttgggtcttta

SEQ ID NO: 228630 - DNA, 25 bp, Mus musculus
atacctcgccaagcttgggtcttta

SEQ ID NO: 228631 - DNA, 25 bp, Mus musculus
atacctctcactatattggagcccc

SEQ ID NO: 228632 - DNA, 25 bp, Mus musculus
atacctctcactttattggagcccc

SEQ ID NO: 228633 - DNA, 25 bp, Mus musculus
atacctctcagaatacagcattggg

SEQ ID NO: 228634 - DNA, 25 bp, Mus musculus
atacctctcagattacagcattggg

SEQ ID NO: 228635 - DNA, 25 bp, Mus musculus
atacctctcattccaggctgttggg

SEQ ID NO: 228636 - DNA, 25 bp, Mus musculus
atacctctcattgcaggctgttggg

SEQ ID NO: 228637 - DNA, 25 bp, Mus musculus
atacctctccgcagaaccaagaatt

SEQ ID NO: 228638 - DNA, 25 bp, Mus musculus
atacctctccgctgaaccaagaatt

SEQ ID NO: 228639 - DNA, 25 bp, Mus musculus
atacctctcttcatcttcggcgctg

SEQ ID NO: 228640 - DNA, 25 bp, Mus musculus
atacctctcttcttcttcggcgctg

SEQ ID NO: 228641 - DNA, 25 bp, Mus musculus
atacctctgcggatcagctaagtga

SEQ ID NO: 228642 - DNA, 25 bp, Mus musculus
atacctctgcggttcagctaagtga

SEQ ID NO: 228643 - DNA, 25 bp, Mus musculus
atacctctgtaacccttatccttta

SEQ ID NO: 228644 - DNA, 25 bp, Mus musculus
atacctctgtaagccttatccttta

SEQ ID NO: 228645 - DNA, 25 bp, Mus musculus
atacctcttactagtgtgttcctat

SEQ ID NO: 228646 - DNA, 25 bp, Mus musculus
atacctcttacttgtgtgttcctat

SEQ ID NO: 228647 - DNA, 25 bp, Mus musculus
atacctcttcatagcagcgctgttg

SEQ ID NO: 228648 - DNA, 25 bp, Mus musculus
atacctcttcattgcagcgctgttg

SEQ ID NO: 228649 - DNA, 25 bp, Mus musculus
atacctcttctccaatatagtctca

SEQ ID NO: 228650 - DNA, 25 bp, Mus musculus
atacctcttctcgaatatagtctca

SEQ ID NO: 228651 - DNA, 25 bp, Mus musculus
atacctcttcttcttcgatgaggcc

SEQ ID NO: 228652 - DNA, 25 bp, Mus musculus
atacctcttcttgttcgatgaggcc

SEQ ID NO: 228653 - DNA, 25 bp, Mus musculus
atacctctttccctgctagaatgga

SEQ ID NO: 228654 - DNA, 25 bp, Mus musculus
atacctctttccgtgctagaatgga

SEQ ID NO: 228655 - DNA, 25 bp, Mus musculus
atacctcttttaagaggcaagcggg

SEQ ID NO: 228656 - DNA, 25 bp, Mus musculus
atacctcttttatgaggcaagcggg

SEQ ID NO: 228657 - DNA, 25 bp, Mus musculus
atacctgaaggccagcctgtgcaac

SEQ ID NO: 228658 - DNA, 25 bp, Mus musculus
atacctgaaggcgagcctgtgcaac

SEQ ID NO: 228659 - DNA, 25 bp, Mus musculus
atacctgaagtaaaatgaccccgtg

SEQ ID NO: 228660 - DNA, 25 bp, Mus musculus
atacctgaagtataatgaccccgtg

SEQ ID NO: 228661 - DNA, 25 bp, Mus musculus
atacctgaatcaactgcattttgtg

SEQ ID NO: 228662 - DNA, 25 bp, Mus musculus
atacctgaatcatctgcattttgtg

SEQ ID NO: 228663 - DNA, 25 bp, Mus musculus
atacctgacatgctggtcgaggcct

SEQ ID NO: 228664 - DNA, 25 bp, Mus musculus
atacctgacatggtggtcgaggcct

SEQ ID NO: 228665 - DNA, 25 bp, Mus musculus
atacctgaccaactcgtgattctag

SEQ ID NO: 228666 - DNA, 25 bp, Mus musculus
atacctgaccaagtcgtgattctag

SEQ ID NO: 228667 - DNA, 25 bp, Mus musculus
atacctgagaacaacaccagtgaga

SEQ ID NO: 228668 - DNA, 25 bp, Mus musculus
atacctgagaactacaccagtgaga

SEQ ID NO: 228669 - DNA, 25 bp, Mus musculus
atacctgagccactaccctgtgatg

SEQ ID NO: 228670 - DNA, 25 bp, Mus musculus
atacctgagccagtaccctgtgatg

SEQ ID NO: 228671 - DNA, 25 bp, Mus musculus
atacctgagctgactgcacccttgt

SEQ ID NO: 228672 - DNA, 25 bp, Mus musculus
atacctgagctgtctgcacccttgt

SEQ ID NO: 228673 - DNA, 25 bp, Mus musculus
atacctgaggcacttcccatgggaa

SEQ ID NO: 228674 - DNA, 25 bp, Mus musculus
atacctgaggcagttcccatgggaa

SEQ ID NO: 228675 - DNA, 25 bp, Mus musculus
atacctgaggctatgtgtggcttgt

SEQ ID NO: 228676 - DNA, 25 bp, Mus musculus
atacctgaggctttgtgtggcttgt

SEQ ID NO: 228677 - DNA, 25 bp, Mus musculus
atacctgagggcatggattctacct

SEQ ID NO: 228678 - DNA, 25 bp, Mus musculus
atacctgagggcttggattctacct

SEQ ID NO: 228679 - DNA, 25 bp, Mus musculus
atacctgagggtagtcccagccaac

SEQ ID NO: 228680 - DNA, 25 bp, Mus musculus
atacctgagggttgtcccagccaac

SEQ ID NO: 228681 - DNA, 25 bp, Mus musculus
atacctgagtgtatccatttccacg

SEQ ID NO: 228682 - DNA, 25 bp, Mus musculus
atacctgagtgtttccatttccacg

SEQ ID NO: 228683 - DNA, 25 bp, Mus musculus
atacctgataccatgttttcagtct

SEQ ID NO: 228684 - DNA, 25 bp, Mus musculus
atacctgataccttgttttcagtct

SEQ ID NO: 228685 - DNA, 25 bp, Mus musculus
atacctgatggtcttccttatgttt

SEQ ID NO: 228686 - DNA, 25 bp, Mus musculus
atacctgatggtgttccttatgttt

SEQ ID NO: 228687 - DNA, 25 bp, Mus musculus
atacctgatgtgctcatactttaga

SEQ ID NO: 228688 - DNA, 25 bp, Mus musculus
atacctgatgtggtcatactttaga

SEQ ID NO: 228689 - DNA, 25 bp, Mus musculus
atacctgattatatcctatgcatat

SEQ ID NO: 228690 - DNA, 25 bp, Mus musculus
atacctgattatccctcttttttct

SEQ ID NO: 228691 - DNA, 25 bp, Mus musculus
atacctgattatgcctcttttttct

SEQ ID NO: 228692 - DNA, 25 bp, Mus musculus
atacctgattatttcctatgcatat

SEQ ID NO: 228693 - DNA, 25 bp, Mus musculus
atacctgattgtaaaagcttctctg

SEQ ID NO: 228694 - DNA, 25 bp, Mus musculus
atacctgattgttaaagcttctctg

SEQ ID NO: 228695 - DNA, 25 bp, Mus musculus
atacctgcaaagcacacattctact

SEQ ID NO: 228696 - DNA, 25 bp, Mus musculus
atacctgcaaaggacacattctact

SEQ ID NO: 228697 - DNA, 25 bp, Mus musculus
atacctgcaccaagtcatgtctgtg

SEQ ID NO: 228698 - DNA, 25 bp, Mus musculus
atacctgcaccatgtcatgtctgtg

SEQ ID NO: 228699 - DNA, 25 bp, Mus musculus
atacctgcacttagccatccagaat

SEQ ID NO: 228700 - DNA, 25 bp, Mus musculus
atacctgcactttgccatccagaat

SEQ ID NO: 228701 - DNA, 25 bp, Mus musculus
atacctgcagctaaaatttccatca

SEQ ID NO: 228702 - DNA, 25 bp, Mus musculus
atacctgcagcttaaatttccatca

SEQ ID NO: 228703 - DNA, 25 bp, Mus musculus
atacctgcaggtattttgatgaata

SEQ ID NO: 228704 - DNA, 25 bp, Mus musculus
atacctgcaggttttttgatgaata

SEQ ID NO: 228705 - DNA, 25 bp, Mus musculus
atacctgcatttaacttgtggacta

SEQ ID NO: 228706 - DNA, 25 bp, Mus musculus
atacctgcattttacttgtggacta

SEQ ID NO: 228707 - DNA, 25 bp, Mus musculus
atacctgccaccaacattattagtc

SEQ ID NO: 228708 - DNA, 25 bp, Mus musculus
atacctgccacctacattattagtc

SEQ ID NO: 228709 - DNA, 25 bp, Mus musculus
atacctgccagtagttgatgcacag

SEQ ID NO: 228710 - DNA, 25 bp, Mus musculus
atacctgccagttgttgatgcacag

SEQ ID NO: 228711 - DNA, 25 bp, Mus musculus
atacctgcccgacatttacatgaat

SEQ ID NO: 228712 - DNA, 25 bp, Mus musculus
atacctgcccgagatttacatgaat

SEQ ID NO: 228713 - DNA, 25 bp, Mus musculus
atacctgcctggatgatgctatttt

SEQ ID NO: 228714 - DNA, 25 bp, Mus musculus
atacctgcctggttgatgctatttt

SEQ ID NO: 228715 - DNA, 25 bp, Mus musculus
atacctgccttaccataggaaccat

SEQ ID NO: 228716 - DNA, 25 bp, Mus musculus
atacctgccttagcataggaaccat

SEQ ID NO: 228717 - DNA, 25 bp, Mus musculus
atacctgccttgctactaccattac

SEQ ID NO: 228718 - DNA, 25 bp, Mus musculus
atacctgccttggtactaccattac

SEQ ID NO: 228719 - DNA, 25 bp, Mus musculus
atacctgcgactataggaagctgaa

SEQ ID NO: 228720 - DNA, 25 bp, Mus musculus
atacctgcgactttaggaagctgaa

SEQ ID NO: 228721 - DNA, 25 bp, Mus musculus
atacctgctctaacaaacatggctc

SEQ ID NO: 228722 - DNA, 25 bp, Mus musculus
atacctgctctatcaaacatggctc

SEQ ID NO: 228723 - DNA, 25 bp, Mus musculus
atacctgctcttagaaggagctgac

SEQ ID NO: 228724 - DNA, 25 bp, Mus musculus
atacctgctctttgaaggagctgac

SEQ ID NO: 228725 - DNA, 25 bp, Mus musculus
atacctgctgaaactcaagttcaat

SEQ ID NO: 228726 - DNA, 25 bp, Mus musculus
atacctgctgaatctcaagttcaat

SEQ ID NO: 228727 - DNA, 25 bp, Mus musculus
atacctgctgggatctttaatatca

SEQ ID NO: 228728 - DNA, 25 bp, Mus musculus
atacctgctgggttctttaatatca

SEQ ID NO: 228729 - DNA, 25 bp, Mus musculus
atacctgctgtacacgttttatttg

SEQ ID NO: 228730 - DNA, 25 bp, Mus musculus
atacctgctgtagacgttttatttg

SEQ ID NO: 228731 - DNA, 25 bp, Mus musculus
atacctgctgtgcaggacatctgct

SEQ ID NO: 228732 - DNA, 25 bp, Mus musculus
atacctgctgtggaggacatctgct

SEQ ID NO: 228733 - DNA, 25 bp, Mus musculus
atacctggaaagacttcctgtgcag

SEQ ID NO: 228734 - DNA, 25 bp, Mus musculus
atacctggaaagtcttcctgtgcag

SEQ ID NO: 228735 - DNA, 25 bp, Mus musculus
atacctggaagccagctgcacagtg

SEQ ID NO: 228736 - DNA, 25 bp, Mus musculus
atacctggaagcgagctgcacagtg

SEQ ID NO: 228737 - DNA, 25 bp, Mus musculus
atacctggacttacatgttgccaag

SEQ ID NO: 228738 - DNA, 25 bp, Mus musculus
atacctggacttctggtatttctcc

SEQ ID NO: 228739 - DNA, 25 bp, Mus musculus
atacctggacttgtggtatttctcc

SEQ ID NO: 228740 - DNA, 25 bp, Mus musculus
atacctggactttcatgttgccaag

SEQ ID NO: 228741 - DNA, 25 bp, Mus musculus
atacctggagacagttcatcttgac

SEQ ID NO: 228742 - DNA, 25 bp, Mus musculus
atacctggagactgttcatcttgac

SEQ ID NO: 228743 - DNA, 25 bp, Mus musculus
atacctggagtaacagcggagcctt

SEQ ID NO: 228744 - DNA, 25 bp, Mus musculus
atacctggagtatcagcggagcctt

SEQ ID NO: 228745 - DNA, 25 bp, Mus musculus
atacctggagtgcatttgtgagctg

SEQ ID NO: 228746 - DNA, 25 bp, Mus musculus
atacctggagtggatttgtgagctg

SEQ ID NO: 228747 - DNA, 25 bp, Mus musculus
atacctggcagacagcgcagatcag

SEQ ID NO: 228748 - DNA, 25 bp, Mus musculus
atacctggcagagagcgcagatcag

SEQ ID NO: 228749 - DNA, 25 bp, Mus musculus
atacctggcatgagaccccgggacc

SEQ ID NO: 228750 - DNA, 25 bp, Mus musculus
atacctggcatgtgaccccgggacc

SEQ ID NO: 228751 - DNA, 25 bp, Mus musculus
atacctggcccactactattttaag

SEQ ID NO: 228752 - DNA, 25 bp, Mus musculus
atacctggcccagtactattttaag

SEQ ID NO: 228753 - DNA, 25 bp, Mus musculus
atacctggccccagttctcaagagg

SEQ ID NO: 228754 - DNA, 25 bp, Mus musculus
atacctggcccctgttctcaagagg

SEQ ID NO: 228755 - DNA, 25 bp, Mus musculus
atacctggcgtaaaagtcttctaag

SEQ ID NO: 228756 - DNA, 25 bp, Mus musculus
atacctggcgtataagtcttctaag

SEQ ID NO: 228757 - DNA, 25 bp, Mus musculus
atacctggctctacataggcatact

SEQ ID NO: 228758 - DNA, 25 bp, Mus musculus
atacctggctcttcataggcatact

SEQ ID NO: 228759 - DNA, 25 bp, Mus musculus
atacctggctgacctgtgtagtgag

SEQ ID NO: 228760 - DNA, 25 bp, Mus musculus
atacctggctgagctgtgtagtgag

SEQ ID NO: 228761 - DNA, 25 bp, Mus musculus
atacctggcttaacttttatcaaca

SEQ ID NO: 228762 - DNA, 25 bp, Mus musculus
atacctggcttatcttttatcaaca

SEQ ID NO: 228763 - DNA, 25 bp, Mus musculus
atacctgggtatctgctggtagcaa

SEQ ID NO: 228764 - DNA, 25 bp, Mus musculus
atacctgggtatgtgctggtagcaa

SEQ ID NO: 228765 - DNA, 25 bp, Mus musculus
atacctgggtcgaggaacgcagcca

SEQ ID NO: 228766 - DNA, 25 bp, Mus musculus
atacctgggtcgtggaacgcagcca

SEQ ID NO: 228767 - DNA, 25 bp, Mus musculus
atacctgggttcaaagtcatgacta

SEQ ID NO: 228768 - DNA, 25 bp, Mus musculus
atacctgggttctaagtcatgacta

SEQ ID NO: 228769 - DNA, 25 bp, Mus musculus
atacctggtatcagctacccatggt

SEQ ID NO: 228770 - DNA, 25 bp, Mus musculus
atacctggtatctgctacccatggt

SEQ ID NO: 228771 - DNA, 25 bp, Mus musculus
atacctggtcagagtatgtcagtac

SEQ ID NO: 228772 - DNA, 25 bp, Mus musculus
atacctggtcagtgtatgtcagtac

SEQ ID NO: 228773 - DNA, 25 bp, Mus musculus
atacctggtctgatgcatggcatga

SEQ ID NO: 228774 - DNA, 25 bp, Mus musculus
atacctggtctgttgcatggcatga

SEQ ID NO: 228775 - DNA, 25 bp, Mus musculus
atacctggtgagaaggtttctttct

SEQ ID NO: 228776 - DNA, 25 bp, Mus musculus
atacctggtgagtaggtttctttct

SEQ ID NO: 228777 - DNA, 25 bp, Mus musculus
atacctggtgatcgacgtgcaaatg

SEQ ID NO: 228778 - DNA, 25 bp, Mus musculus
atacctggtgatggacgtgcaaatg

SEQ ID NO: 228779 - DNA, 25 bp, Mus musculus
atacctggtgctctccctgggctct

SEQ ID NO: 228780 - DNA, 25 bp, Mus musculus
atacctggtgctgtccctgggctct

SEQ ID NO: 228781 - DNA, 25 bp, Mus musculus
atacctggtgtcacacaagcatctg

SEQ ID NO: 228782 - DNA, 25 bp, Mus musculus
atacctggtgtctcacaagcatctg

SEQ ID NO: 228783 - DNA, 25 bp, Mus musculus
atacctggttcaagtgcccgtggtt

SEQ ID NO: 228784 - DNA, 25 bp, Mus musculus
atacctggttcatgtgcccgtggtt

SEQ ID NO: 228785 - DNA, 25 bp, Mus musculus
atacctgtaaccacagcattgggaa

SEQ ID NO: 228786 - DNA, 25 bp, Mus musculus
atacctgtaacctcagcattgggaa

SEQ ID NO: 228787 - DNA, 25 bp, Mus musculus
atacctgtaaggagccgctgtcagc

SEQ ID NO: 228788 - DNA, 25 bp, Mus musculus
atacctgtaaggtgccgctgtcagc

SEQ ID NO: 228789 - DNA, 25 bp, Mus musculus
atacctgtactgcaatcctctaaca

SEQ ID NO: 228790 - DNA, 25 bp, Mus musculus
atacctgtactggaatcctctaaca

SEQ ID NO: 228791 - DNA, 25 bp, Mus musculus
atacctgtcaagatccaatatgcaa

SEQ ID NO: 228792 - DNA, 25 bp, Mus musculus
atacctgtcaagttccaatatgcaa

SEQ ID NO: 228793 - DNA, 25 bp, Mus musculus
atacctgtcactcgtcagcccttgt

SEQ ID NO: 228794 - DNA, 25 bp, Mus musculus
atacctgtcactggtcagcccttgt

SEQ ID NO: 228795 - DNA, 25 bp, Mus musculus
atacctgtccagagtaaagtaccat

SEQ ID NO: 228796 - DNA, 25 bp, Mus musculus
atacctgtccagtgtaaagtaccat

SEQ ID NO: 228797 - DNA, 25 bp, Mus musculus
atacctgtcttcacatcatccagtt

SEQ ID NO: 228798 - DNA, 25 bp, Mus musculus
atacctgtcttctcatcatccagtt

SEQ ID NO: 228799 - DNA, 25 bp, Mus musculus
atacctgtgacaattgctctgctac

SEQ ID NO: 228800 - DNA, 25 bp, Mus musculus
atacctgtgacatttgctctgctac

SEQ ID NO: 228801 - DNA, 25 bp, Mus musculus
atacctgtgagcaactggtacccca

SEQ ID NO: 228802 - DNA, 25 bp, Mus musculus
atacctgtgagctactggtacccca

SEQ ID NO: 228803 - DNA, 25 bp, Mus musculus
atacctgtgcatccgctgtattctt

SEQ ID NO: 228804 - DNA, 25 bp, Mus musculus
atacctgtgcatgcgctgtattctt

SEQ ID NO: 228805 - DNA, 25 bp, Mus musculus
atacctgtgggtactcatagttgaa

SEQ ID NO: 228806 - DNA, 25 bp, Mus musculus
atacctgtgggttctcatagttgaa

SEQ ID NO: 228807 - DNA, 25 bp, Mus musculus
atacctgtggttaattgacgctaat

SEQ ID NO: 228808 - DNA, 25 bp, Mus musculus
atacctgtggtttattgacgctaat

SEQ ID NO: 228809 - DNA, 25 bp, Mus musculus
atacctgtgtgacgccaatcctttg

SEQ ID NO: 228810 - DNA, 25 bp, Mus musculus
atacctgtgtgaggccaatcctttg

SEQ ID NO: 228811 - DNA, 25 bp, Mus musculus
atacctgtgttgaaggccacgaggc

SEQ ID NO: 228812 - DNA, 25 bp, Mus musculus
atacctgtgttgtaggccacgaggc

SEQ ID NO: 228813 - DNA, 25 bp, Mus musculus
atacctgttatgaccaactgggaaa

SEQ ID NO: 228814 - DNA, 25 bp, Mus musculus
atacctgttatgtccaactgggaaa

SEQ ID NO: 228815 - DNA, 25 bp, Mus musculus
atacctgttggtcgcatgtgatgcc

SEQ ID NO: 228816 - DNA, 25 bp, Mus musculus
atacctgttggtggcatgtgatgcc

SEQ ID NO: 228817 - DNA, 25 bp, Mus musculus
atacctgttttaagtgtgtctcctt

SEQ ID NO: 228818 - DNA, 25 bp, Mus musculus
atacctgttttatgtgtgtctcctt

SEQ ID NO: 228819 - DNA, 25 bp, Mus musculus
ataccttaaaataaccgctgtcatg

SEQ ID NO: 228820 - DNA, 25 bp, Mus musculus
ataccttaaaattaccgctgtcatg

SEQ ID NO: 228821 - DNA, 25 bp, Mus musculus
ataccttaccaactgctgggagggt

SEQ ID NO: 228822 - DNA, 25 bp, Mus musculus
ataccttaccaagtgctgggagggt

SEQ ID NO: 228823 - DNA, 25 bp, Mus musculus
ataccttacctcagcagatttcagt

SEQ ID NO: 228824 - DNA, 25 bp, Mus musculus
ataccttacctctgcagatttcagt

SEQ ID NO: 228825 - DNA, 25 bp, Mus musculus
ataccttaggaacccactgcaggcc

SEQ ID NO: 228826 - DNA, 25 bp, Mus musculus
ataccttaggaagccactgcaggcc

SEQ ID NO: 228827 - DNA, 25 bp, Mus musculus
ataccttatggtagattgctgttgg

SEQ ID NO: 228828 - DNA, 25 bp, Mus musculus
ataccttatggttgattgctgttgg

SEQ ID NO: 228829 - DNA, 25 bp, Mus musculus
ataccttcaccgactattggatgca

SEQ ID NO: 228830 - DNA, 25 bp, Mus musculus
ataccttcaccgtctattggatgca

SEQ ID NO: 228831 - DNA, 25 bp, Mus musculus
ataccttcagacctatatgcagtta

SEQ ID NO: 228832 - DNA, 25 bp, Mus musculus
ataccttcagacgtatatgcagtta

SEQ ID NO: 228833 - DNA, 25 bp, Mus musculus
ataccttcagcacggaaatcttccg

SEQ ID NO: 228834 - DNA, 25 bp, Mus musculus
ataccttcagcagggaaatcttccg

SEQ ID NO: 228835 - DNA, 25 bp, Mus musculus
ataccttcaggaatgggccagggaa

SEQ ID NO: 228836 - DNA, 25 bp, Mus musculus
ataccttcaggattgggccagggaa

SEQ ID NO: 228837 - DNA, 25 bp, Mus musculus
ataccttcagttaaaaagctgctgt

SEQ ID NO: 228838 - DNA, 25 bp, Mus musculus
ataccttcagtttaaaagctgctgt

SEQ ID NO: 228839 - DNA, 25 bp, Mus musculus
ataccttcatttaagggaccacttg

SEQ ID NO: 228840 - DNA, 25 bp, Mus musculus
ataccttcattttagggaccacttg

SEQ ID NO: 228841 - DNA, 25 bp, Mus musculus
ataccttccaagatcatcaacacct

SEQ ID NO: 228842 - DNA, 25 bp, Mus musculus
ataccttccaagttcatcaacacct

SEQ ID NO: 228843 - DNA, 25 bp, Mus musculus
ataccttccactatgctgtggacgg

SEQ ID NO: 228844 - DNA, 25 bp, Mus musculus
ataccttccactttgctgtggacgg

SEQ ID NO: 228845 - DNA, 25 bp, Mus musculus
ataccttccagaccctcaagagggc

SEQ ID NO: 228846 - DNA, 25 bp, Mus musculus
ataccttccagagcctcaagagggc

SEQ ID NO: 228847 - DNA, 25 bp, Mus musculus
ataccttcccatattctattctact

SEQ ID NO: 228848 - DNA, 25 bp, Mus musculus
ataccttcccattttctattctact

SEQ ID NO: 228849 - DNA, 25 bp, Mus musculus
ataccttccgaactgctctgtagat

SEQ ID NO: 228850 - DNA, 25 bp, Mus musculus
ataccttccgaagtgctctgtagat

SEQ ID NO: 228851 - DNA, 25 bp, Mus musculus
ataccttctcttaagccagattcta

SEQ ID NO: 228852 - DNA, 25 bp, Mus musculus
ataccttctctttagccagattcta

SEQ ID NO: 228853 - DNA, 25 bp, Mus musculus
ataccttctgccatgagtgacacaa

SEQ ID NO: 228854 - DNA, 25 bp, Mus musculus
ataccttctgccttgagtgacacaa

SEQ ID NO: 228855 - DNA, 25 bp, Mus musculus
ataccttcttacctcatgttacctt

SEQ ID NO: 228856 - DNA, 25 bp, Mus musculus
ataccttcttacgtcatgttacctt

SEQ ID NO: 228857 - DNA, 25 bp, Mus musculus
ataccttcttcaacagacttagccc

SEQ ID NO: 228858 - DNA, 25 bp, Mus musculus
ataccttcttcatcagacttagccc

SEQ ID NO: 228859 - DNA, 25 bp, Mus musculus
ataccttgaacaccaacacctggga

SEQ ID NO: 228860 - DNA, 25 bp, Mus musculus
ataccttgaacagcaacacctggga

SEQ ID NO: 228861 - DNA, 25 bp, Mus musculus
ataccttgcaatactttcctgtttg

SEQ ID NO: 228862 - DNA, 25 bp, Mus musculus
ataccttgcaattctttcctgtttg

SEQ ID NO: 228863 - DNA, 25 bp, Mus musculus
ataccttgcagccaagcccagttag

SEQ ID NO: 228864 - DNA, 25 bp, Mus musculus
ataccttgcagcgaagcccagttag

SEQ ID NO: 228865 - DNA, 25 bp, Mus musculus
ataccttggatgcatgcttgtgaaa

SEQ ID NO: 228866 - DNA, 25 bp, Mus musculus
ataccttggatggatgcttgtgaaa

SEQ ID NO: 228867 - DNA, 25 bp, Mus musculus
ataccttggctaattatggatctat

SEQ ID NO: 228868 - DNA, 25 bp, Mus musculus
ataccttggctatttatggatctat

SEQ ID NO: 228869 - DNA, 25 bp, Mus musculus
ataccttgggagatcatccttgcgt

SEQ ID NO: 228870 - DNA, 25 bp, Mus musculus
ataccttgggagttcatccttgcgt

SEQ ID NO: 228871 - DNA, 25 bp, Mus musculus
ataccttgtctccttaggtggcaag

SEQ ID NO: 228872 - DNA, 25 bp, Mus musculus
ataccttgtctcgttaggtggcaag

SEQ ID NO: 228873 - DNA, 25 bp, Mus musculus
ataccttgtgtgaaagcagtcccgt

SEQ ID NO: 228874 - DNA, 25 bp, Mus musculus
ataccttgtgtgtaagcagtcccgt

SEQ ID NO: 228875 - DNA, 25 bp, Mus musculus
ataccttgttctagttgatggcagc

SEQ ID NO: 228876 - DNA, 25 bp, Mus musculus
ataccttgttcttgttgatggcagc

SEQ ID NO: 228877 - DNA, 25 bp, Mus musculus
atacctttacaactctttagcagag

SEQ ID NO: 228878 - DNA, 25 bp, Mus musculus
atacctttacaagtctttagcagag

SEQ ID NO: 228879 - DNA, 25 bp, Mus musculus
atacctttatgtcagacttcagtag

SEQ ID NO: 228880 - DNA, 25 bp, Mus musculus
atacctttatgtgagacttcagtag

SEQ ID NO: 228881 - DNA, 25 bp, Mus musculus
atacctttatttcacctgagttatc

SEQ ID NO: 228882 - DNA, 25 bp, Mus musculus
atacctttatttgacctgagttatc

SEQ ID NO: 228883 - DNA, 25 bp, Mus musculus
atacctttcaacactgagactgcta

SEQ ID NO: 228884 - DNA, 25 bp, Mus musculus
atacctttcaactctgagactgcta

SEQ ID NO: 228885 - DNA, 25 bp, Mus musculus
atacctttcactattccagaacaat

SEQ ID NO: 228886 - DNA, 25 bp, Mus musculus
atacctttcacttttccagaacaat

SEQ ID NO: 228887 - DNA, 25 bp, Mus musculus
atacctttccttcggacattgctta

SEQ ID NO: 228888 - DNA, 25 bp, Mus musculus
atacctttccttgggacattgctta

SEQ ID NO: 228889 - DNA, 25 bp, Mus musculus
atacctttgagaaacttgctgggcc

SEQ ID NO: 228890 - DNA, 25 bp, Mus musculus
atacctttgagatacttgctgggcc

SEQ ID NO: 228891 - DNA, 25 bp, Mus musculus
atacctttgaggaaacaatggctgt

SEQ ID NO: 228892 - DNA, 25 bp, Mus musculus
atacctttgaggtaacaatggctgt

SEQ ID NO: 228893 - DNA, 25 bp, Mus musculus
atacctttgcaaccaaacttggttt

SEQ ID NO: 228894 - DNA, 25 bp, Mus musculus
atacctttgcaagcaaacttggttt

SEQ ID NO: 228895 - DNA, 25 bp, Mus musculus
atacctttggatactaccttctatg

SEQ ID NO: 228896 - DNA, 25 bp, Mus musculus
atacctttggattctaccttctatg

SEQ ID NO: 228897 - DNA, 25 bp, Mus musculus
atacctttgggtcttctggcatttc

SEQ ID NO: 228898 - DNA, 25 bp, Mus musculus
atacctttgggtgttctggcatttc

SEQ ID NO: 228899 - DNA, 25 bp, Mus musculus
atacctttgtaccttgacatatgaa

SEQ ID NO: 228900 - DNA, 25 bp, Mus musculus
atacctttgtacgttgacatatgaa

SEQ ID NO: 228901 - DNA, 25 bp, Mus musculus
ataccttttagacatgatccctccc

SEQ ID NO: 228902 - DNA, 25 bp, Mus musculus
ataccttttagagatgatccctccc

SEQ ID NO: 228903 - DNA, 25 bp, Mus musculus
ataccttttatcacagcatttggga

SEQ ID NO: 228904 - DNA, 25 bp, Mus musculus
ataccttttatctcagcatttggga

SEQ ID NO: 228905 - DNA, 25 bp, Mus musculus
ataccttttggtaataagccctgtg

SEQ ID NO: 228906 - DNA, 25 bp, Mus musculus
ataccttttggttataagccctgtg

SEQ ID NO: 228907 - DNA, 25 bp, Mus musculus
atacctttttggactacagactaat

SEQ ID NO: 228908 - DNA, 25 bp, Mus musculus
atacctttttggtctacagactaat

SEQ ID NO: 228909 - DNA, 25 bp, Mus musculus
atacgaaccattccttgcaatctgt

SEQ ID NO: 228910 - DNA, 25 bp, Mus musculus
atacgaaccattgcttgcaatctgt

SEQ ID NO: 228911 - DNA, 25 bp, Mus musculus
atacgaacccgcagatgatctccag

SEQ ID NO: 228912 - DNA, 25 bp, Mus musculus
atacgaacccgctgatgatctccag

SEQ ID NO: 228913 - DNA, 25 bp, Mus musculus
atacgaacgcccagcagatcctgct

SEQ ID NO: 228914 - DNA, 25 bp, Mus musculus
atacgaacgccctgcagatcctgct

SEQ ID NO: 228915 - DNA, 25 bp, Mus musculus
atacgaacggttctgcaactgcctt

SEQ ID NO: 228916 - DNA, 25 bp, Mus musculus
atacgaacggttgtgcaactgcctt

SEQ ID NO: 228917 - DNA, 25 bp, Mus musculus
atacgaagttccagaagacctccta

SEQ ID NO: 228918 - DNA, 25 bp, Mus musculus
atacgaagttcctgaagacctccta

SEQ ID NO: 228919 - DNA, 25 bp, Mus musculus
atacgacagccacctggtgccaagt

SEQ ID NO: 228920 - DNA, 25 bp, Mus musculus
atacgacagccagctggtgccaagt

SEQ ID NO: 228921 - DNA, 25 bp, Mus musculus
atacgacatttgatggagaaagacc

SEQ ID NO: 228922 - DNA, 25 bp, Mus musculus
atacgacatttgttggagaaagacc

SEQ ID NO: 228923 - DNA, 25 bp, Mus musculus
atacgaccctctcaagatttgcaca

SEQ ID NO: 228924 - DNA, 25 bp, Mus musculus
atacgaccctctgaagatttgcaca

SEQ ID NO: 228925 - DNA, 25 bp, Mus musculus
atacgaccggtacgtggccatctgt

SEQ ID NO: 228926 - DNA, 25 bp, Mus musculus
atacgaccggtaggtggccatctgt

SEQ ID NO: 228927 - DNA, 25 bp, Mus musculus
atacgacctgtacatcacttacgac

SEQ ID NO: 228928 - DNA, 25 bp, Mus musculus
atacgacctgtagatcacttacgac

SEQ ID NO: 228929 - DNA, 25 bp, Mus musculus
atacgactaaatctcatcactctgt

SEQ ID NO: 228930 - DNA, 25 bp, Mus musculus
atacgactaaatgtcatcactctgt

SEQ ID NO: 228931 - DNA, 25 bp, Mus musculus
atacgactctatcccgaccttagag

SEQ ID NO: 228932 - DNA, 25 bp, Mus musculus
atacgactctatgccgaccttagag

SEQ ID NO: 228933 - DNA, 25 bp, Mus musculus
atacgagagcagcagaggcgctttc

SEQ ID NO: 228934 - DNA, 25 bp, Mus musculus
atacgagagcaggagaggcgctttc

SEQ ID NO: 228935 - DNA, 25 bp, Mus musculus
atacgagcaggccttccagctgctg

SEQ ID NO: 228936 - DNA, 25 bp, Mus musculus
atacgagcaggcgttccagctgctg

SEQ ID NO: 228937 - DNA, 25 bp, Mus musculus
atacgagcatgtctagcttccaggt

SEQ ID NO: 228938 - DNA, 25 bp, Mus musculus
atacgagcatgtgtagcttccaggt

SEQ ID NO: 228939 - DNA, 25 bp, Mus musculus
atacgagcctcgaaatttgctgcac

SEQ ID NO: 228940 - DNA, 25 bp, Mus musculus
atacgagcctcgagtgtcgtggatg

SEQ ID NO: 228941 - DNA, 25 bp, Mus musculus
atacgagcctcgtaatttgctgcac

SEQ ID NO: 228942 - DNA, 25 bp, Mus musculus
atacgagcctcgtgtgtcgtggatg

SEQ ID NO: 228943 - DNA, 25 bp, Mus musculus
atacgagctcgacatgggactgtgt

SEQ ID NO: 228944 - DNA, 25 bp, Mus musculus
atacgagctcgagatgggactgtgt

SEQ ID NO: 228945 - DNA, 25 bp, Mus musculus
atacgagctgagactggcagggcac

SEQ ID NO: 228946 - DNA, 25 bp, Mus musculus
atacgagctgagtctggcagggcac

SEQ ID NO: 228947 - DNA, 25 bp, Mus musculus
atacgagggcctcatgagctacgtc

SEQ ID NO: 228948 - DNA, 25 bp, Mus musculus
atacgagggcctgatgagctacgtc

SEQ ID NO: 228949 - DNA, 25 bp, Mus musculus
atacgagttggtctgttatgtgaat

SEQ ID NO: 228950 - DNA, 25 bp, Mus musculus
atacgagttggtgtgttatgtgaat

SEQ ID NO: 228951 - DNA, 25 bp, Mus musculus
atacgagtttctagttcatattgtg

SEQ ID NO: 228952 - DNA, 25 bp, Mus musculus
atacgagtttcttgttcatattgtg

SEQ ID NO: 228953 - DNA, 25 bp, Mus musculus
atacgatctgcgagagacccaaaac

SEQ ID NO: 228954 - DNA, 25 bp, Mus musculus
atacgatctgcgtgagacccaaaac

SEQ ID NO: 228955 - DNA, 25 bp, Mus musculus
atacgatgcaatcccagctcatctc

SEQ ID NO: 228956 - DNA, 25 bp, Mus musculus
atacgatgcaatgccagctcatctc

SEQ ID NO: 228957 - DNA, 25 bp, Mus musculus
atacgatgcgacctgtctcgtgaag

SEQ ID NO: 228958 - DNA, 25 bp, Mus musculus
atacgatgcgacgtgtctcgtgaag

SEQ ID NO: 228959 - DNA, 25 bp, Mus musculus
atacgatggagtcccagttcagctc

SEQ ID NO: 228960 - DNA, 25 bp, Mus musculus
atacgatggagtgccagttcagctc

SEQ ID NO: 228961 - DNA, 25 bp, Mus musculus
atacgatgggaaaccgagttccaga

SEQ ID NO: 228962 - DNA, 25 bp, Mus musculus
atacgatgggaatccgagttccaga

SEQ ID NO: 228963 - DNA, 25 bp, Mus musculus
atacgattacttactagtttccaga

SEQ ID NO: 228964 - DNA, 25 bp, Mus musculus
atacgattactttctagtttccaga

SEQ ID NO: 228965 - DNA, 25 bp, Mus musculus
atacgattcattacacagtccgggt

SEQ ID NO: 228966 - DNA, 25 bp, Mus musculus
atacgattcatttcacagtccgggt

SEQ ID NO: 228967 - DNA, 25 bp, Mus musculus
atacgcaaatctatcttcatcatcc

SEQ ID NO: 228968 - DNA, 25 bp, Mus musculus
atacgcaaatctttcttcatcatcc

SEQ ID NO: 228969 - DNA, 25 bp, Mus musculus
atacgcaacgtacatgctttaatat

SEQ ID NO: 228970 - DNA, 25 bp, Mus musculus
atacgcaacgtagatgctttaatat

SEQ ID NO: 228971 - DNA, 25 bp, Mus musculus
atacgcactgacaaaatgtccctta

SEQ ID NO: 228972 - DNA, 25 bp, Mus musculus
atacgcactgactaaatgtccctta

SEQ ID NO: 228973 - DNA, 25 bp, Mus musculus
atacgcactttcatatgacctagaa

SEQ ID NO: 228974 - DNA, 25 bp, Mus musculus
atacgcactttcttatgacctagaa

SEQ ID NO: 228975 - DNA, 25 bp, Mus musculus
atacgcagtcgcatcctatcttacg

SEQ ID NO: 228976 - DNA, 25 bp, Mus musculus
atacgcagtcgcttcctatcttacg

SEQ ID NO: 228977 - DNA, 25 bp, Mus musculus
atacgcatatgtcatcacaccactg

SEQ ID NO: 228978 - DNA, 25 bp, Mus musculus
atacgcatatgtgatcacaccactg

SEQ ID NO: 228979 - DNA, 25 bp, Mus musculus
atacgcatctatcgagatcctgctg

SEQ ID NO: 228980 - DNA, 25 bp, Mus musculus
atacgcatctatggagatcctgctg

SEQ ID NO: 228981 - DNA, 25 bp, Mus musculus
atacgcatgactacattacaacggg

SEQ ID NO: 228982 - DNA, 25 bp, Mus musculus
atacgcatgacttcattacaacggg

SEQ ID NO: 228983 - DNA, 25 bp, Mus musculus
atacgcattggtacgaattctcagt

SEQ ID NO: 228984 - DNA, 25 bp, Mus musculus
atacgcattggttcgaattctcagt

SEQ ID NO: 228985 - DNA, 25 bp, Mus musculus
atacgccacgatactctggaagctg

SEQ ID NO: 228986 - DNA, 25 bp, Mus musculus
atacgccacgattctctggaagctg

SEQ ID NO: 228987 - DNA, 25 bp, Mus musculus
atacgcccaatgaagtaatgccctt

SEQ ID NO: 228988 - DNA, 25 bp, Mus musculus
atacgcccaatgtagtaatgccctt

SEQ ID NO: 228989 - DNA, 25 bp, Mus musculus
atacgcccttttacatttaactcag

SEQ ID NO: 228990 - DNA, 25 bp, Mus musculus
atacgccctttttcatttaactcag

SEQ ID NO: 228991 - DNA, 25 bp, Mus musculus
atacgccgattgctatatgaaccgc

SEQ ID NO: 228992 - DNA, 25 bp, Mus musculus
atacgccgattggtatatgaaccgc

SEQ ID NO: 228993 - DNA, 25 bp, Mus musculus
atacgccgggagactacacaaaact

SEQ ID NO: 228994 - DNA, 25 bp, Mus musculus
atacgccgggagtctacacaaaact

SEQ ID NO: 228995 - DNA, 25 bp, Mus musculus
atacgcctgcttccaaggagcctgg

SEQ ID NO: 228996 - DNA, 25 bp, Mus musculus
atacgcctgcttgcaaggagcctgg

SEQ ID NO: 228997 - DNA, 25 bp, Mus musculus
atacgccttactccaaagtgggcct

SEQ ID NO: 228998 - DNA, 25 bp, Mus musculus
atacgccttactgcaaagtgggcct

SEQ ID NO: 228999 - DNA, 25 bp, Mus musculus
atacgctcagagacgtgtataaggt

SEQ ID NO: 229000 - DNA, 25 bp, Mus musculus
atacgctcagagtcgtgtataaggt

SEQ ID NO: 229001 - DNA, 25 bp, Mus musculus
atacgctgaaagagtgtggcccaca

SEQ ID NO: 229002 - DNA, 25 bp, Mus musculus
atacgctgaaagtgtgtggcccaca

SEQ ID NO: 229003 - DNA, 25 bp, Mus musculus
atacgctggaaaaagtgcgcgatgc

SEQ ID NO: 229004 - DNA, 25 bp, Mus musculus
atacgctggaaatagtgcgcgatgc

SEQ ID NO: 229005 - DNA, 25 bp, Mus musculus
atacgctggagcaatctccttggaa

SEQ ID NO: 229006 - DNA, 25 bp, Mus musculus
atacgctggagctatctccttggaa

SEQ ID NO: 229007 - DNA, 25 bp, Mus musculus
atacgctgggtaaattgttcctttc

SEQ ID NO: 229008 - DNA, 25 bp, Mus musculus
atacgctgggtatattgttcctttc

SEQ ID NO: 229009 - DNA, 25 bp, Mus musculus
atacgctgtatcagcaaatgagcaa

SEQ ID NO: 229010 - DNA, 25 bp, Mus musculus
atacgctgtatctgcaaatgagcaa

SEQ ID NO: 229011 - DNA, 25 bp, Mus musculus
atacgctgtcacattgaagcactgg

SEQ ID NO: 229012 - DNA, 25 bp, Mus musculus
atacgctgtcactttgaagcactgg

SEQ ID NO: 229013 - DNA, 25 bp, Mus musculus
atacgctgtggcatgaggttgctgc

SEQ ID NO: 229014 - DNA, 25 bp, Mus musculus
atacgctgtggcttgaggttgctgc

SEQ ID NO: 229015 - DNA, 25 bp, Mus musculus
atacgctgtttgaatgtggaagaac

SEQ ID NO: 229016 - DNA, 25 bp, Mus musculus
atacgctgtttgtatgtggaagaac

SEQ ID NO: 229017 - DNA, 25 bp, Mus musculus
atacgcttacgtacggacgcttacg

SEQ ID NO: 229018 - DNA, 25 bp, Mus musculus
atacgcttacgttcggacgcttacg

SEQ ID NO: 229019 - DNA, 25 bp, Mus musculus
atacgcttcatgctaaattttatct

SEQ ID NO: 229020 - DNA, 25 bp, Mus musculus
atacgcttcatggtaaattttatct

SEQ ID NO: 229021 - DNA, 25 bp, Mus musculus
atacgcttgcagcatccatctttga

SEQ ID NO: 229022 - DNA, 25 bp, Mus musculus
atacgcttgcaggatccatctttga

SEQ ID NO: 229023 - DNA, 25 bp, Mus musculus
atacgctttccaagtgctttgcttt

SEQ ID NO: 229024 - DNA, 25 bp, Mus musculus
atacgctttccatgtgctttgcttt

SEQ ID NO: 229025 - DNA, 25 bp, Mus musculus
atacggaatataaatcaccagattt

SEQ ID NO: 229026 - DNA, 25 bp, Mus musculus
atacggaatatatatcaccagattt

SEQ ID NO: 229027 - DNA, 25 bp, Mus musculus
atacggacagagagggcggacccca

SEQ ID NO: 229028 - DNA, 25 bp, Mus musculus
atacggacagagtgggcggacccca

SEQ ID NO: 229029 - DNA, 25 bp, Mus musculus
atacggactaggaatctggccccac

SEQ ID NO: 229030 - DNA, 25 bp, Mus musculus
atacggactaggtatctggccccac

SEQ ID NO: 229031 - DNA, 25 bp, Mus musculus
atacggagatccacaggctttttcc

SEQ ID NO: 229032 - DNA, 25 bp, Mus musculus
atacggagatcctcaggctttttcc

SEQ ID NO: 229033 - DNA, 25 bp, Mus musculus
atacggaggaagctggccatgctct

SEQ ID NO: 229034 - DNA, 25 bp, Mus musculus
atacggaggaaggtggccatgctct

SEQ ID NO: 229035 - DNA, 25 bp, Mus musculus
atacggagtaatccttctacgtcgg

SEQ ID NO: 229036 - DNA, 25 bp, Mus musculus
atacggagtaatgcttctacgtcgg

SEQ ID NO: 229037 - DNA, 25 bp, Mus musculus
atacggatgctcagcagtacaccac

SEQ ID NO: 229038 - DNA, 25 bp, Mus musculus
atacggatgctctgcagtacaccac

SEQ ID NO: 229039 - DNA, 25 bp, Mus musculus
atacggcaagtgctcctttggtgcg

SEQ ID NO: 229040 - DNA, 25 bp, Mus musculus
atacggcaagtggtcctttggtgcg

SEQ ID NO: 229041 - DNA, 25 bp, Mus musculus
atacggcacctccacacgtgtgcaa

SEQ ID NO: 229042 - DNA, 25 bp, Mus musculus
atacggcacctcgacacgtgtgcaa

SEQ ID NO: 229043 - DNA, 25 bp, Mus musculus
atacggccggttatgtgttagcagc

SEQ ID NO: 229044 - DNA, 25 bp, Mus musculus
atacggccggttttgtgttagcagc

SEQ ID NO: 229045 - DNA, 25 bp, Mus musculus
atacggcgccaaccgctacagttac

SEQ ID NO: 229046 - DNA, 25 bp, Mus musculus
atacggcgccaagcgctacagttac

SEQ ID NO: 229047 - DNA, 25 bp, Mus musculus
atacggcgctcacattgtgtgggca

SEQ ID NO: 229048 - DNA, 25 bp, Mus musculus
atacggcgctcagattgtgtgggca

SEQ ID NO: 229049 - DNA, 25 bp, Mus musculus
atacggctacagcaacagggtggtg

SEQ ID NO: 229050 - DNA, 25 bp, Mus musculus
atacggctacaggaacagggtggtg

SEQ ID NO: 229051 - DNA, 25 bp, Mus musculus
atacggctcaagatatggctatggc

SEQ ID NO: 229052 - DNA, 25 bp, Mus musculus
atacggctcaagttatggctatggc

SEQ ID NO: 229053 - DNA, 25 bp, Mus musculus
atacggcttctcacctgagtggatc

SEQ ID NO: 229054 - DNA, 25 bp, Mus musculus
atacggcttctctcctgagtggatc

SEQ ID NO: 229055 - DNA, 25 bp, Mus musculus
atacggcttgctcgctcacctttca

SEQ ID NO: 229056 - DNA, 25 bp, Mus musculus
atacggcttgctggctcacctttca

SEQ ID NO: 229057 - DNA, 25 bp, Mus musculus
atacgggaaatcatcactgcaggga

SEQ ID NO: 229058 - DNA, 25 bp, Mus musculus
atacgggaaatcttcactgcaggga

SEQ ID NO: 229059 - DNA, 25 bp, Mus musculus
atacgggccactcgacagacgtgtg

SEQ ID NO: 229060 - DNA, 25 bp, Mus musculus
atacgggccactggacagacgtgtg

SEQ ID NO: 229061 - DNA, 25 bp, Mus musculus
atacgggtgcatcccaactgaggga

SEQ ID NO: 229062 - DNA, 25 bp, Mus musculus
atacgggtgcatgccaactgaggga

SEQ ID NO: 229063 - DNA, 25 bp, Mus musculus
atacgggtgccacacatcgcaattg

SEQ ID NO: 229064 - DNA, 25 bp, Mus musculus
atacgggtgccagacatcgcaattg

SEQ ID NO: 229065 - DNA, 25 bp, Mus musculus
atacggtcaataacactaactgctg

SEQ ID NO: 229066 - DNA, 25 bp, Mus musculus
atacggtcaatatcactaactgctg

SEQ ID NO: 229067 - DNA, 25 bp, Mus musculus
atacggtcaatgaggccagcaggat

SEQ ID NO: 229068 - DNA, 25 bp, Mus musculus
atacggtcaatgtggccagcaggat

SEQ ID NO: 229069 - DNA, 25 bp, Mus musculus
atacggtccacactatcccaaatgg

SEQ ID NO: 229070 - DNA, 25 bp, Mus musculus
atacggtccacagtatcccaaatgg

SEQ ID NO: 229071 - DNA, 25 bp, Mus musculus
atacggtgagaccagcttacatgaa

SEQ ID NO: 229072 - DNA, 25 bp, Mus musculus
atacggtgagacgagcttacatgaa

SEQ ID NO: 229073 - DNA, 25 bp, Mus musculus
atacggtggatcattgactgactca

SEQ ID NO: 229074 - DNA, 25 bp, Mus musculus
atacggtggatctttgactgactca

SEQ ID NO: 229075 - DNA, 25 bp, Mus musculus
atacggtggtataggctctcttaac

SEQ ID NO: 229076 - DNA, 25 bp, Mus musculus
atacggtggtattggctctcttaac

SEQ ID NO: 229077 - DNA, 25 bp, Mus musculus
atacggttatggcttacctggaaag

SEQ ID NO: 229078 - DNA, 25 bp, Mus musculus
atacggttatgggttacctggaaag

SEQ ID NO: 229079 - DNA, 25 bp, Mus musculus
atacggttattacatctttccacag

SEQ ID NO: 229080 - DNA, 25 bp, Mus musculus
atacggttattagatctttccacag

SEQ ID NO: 229081 - DNA, 25 bp, Mus musculus
atacggttcagactgatgtggtttt

SEQ ID NO: 229082 - DNA, 25 bp, Mus musculus
atacggttcagagtgatgtggtttt

SEQ ID NO: 229083 - DNA, 25 bp, Mus musculus
atacggtttcagatgagtggagttt

SEQ ID NO: 229084 - DNA, 25 bp, Mus musculus
atacggtttcagttgagtggagttt

SEQ ID NO: 229085 - DNA, 25 bp, Mus musculus
atacgtaagaacagccctgtttgga

SEQ ID NO: 229086 - DNA, 25 bp, Mus musculus
atacgtaagaactgccctgtttgga

SEQ ID NO: 229087 - DNA, 25 bp, Mus musculus
atacgtaatctaagccaaattggct

SEQ ID NO: 229088 - DNA, 25 bp, Mus musculus
atacgtaatctatgccaaattggct

SEQ ID NO: 229089 - DNA, 25 bp, Mus musculus
atacgtacaagactcactgggaaca

SEQ ID NO: 229090 - DNA, 25 bp, Mus musculus
atacgtacaagagtcactgggaaca

SEQ ID NO: 229091 - DNA, 25 bp, Mus musculus
atacgtacatagctctatatttggg

SEQ ID NO: 229092 - DNA, 25 bp, Mus musculus
atacgtacataggtctatatttggg

SEQ ID NO: 229093 - DNA, 25 bp, Mus musculus
atacgtagagtcagtgtctttttct

SEQ ID NO: 229094 - DNA, 25 bp, Mus musculus
atacgtagagtctgtgtctttttct

SEQ ID NO: 229095 - DNA, 25 bp, Mus musculus
atacgtagcatcctactgtgtgctt

SEQ ID NO: 229096 - DNA, 25 bp, Mus musculus
atacgtagcatcgtactgtgtgctt

SEQ ID NO: 229097 - DNA, 25 bp, Mus musculus
atacgtatgccgaatgtgttcccga

SEQ ID NO: 229098 - DNA, 25 bp, Mus musculus
atacgtatgccgtatgtgttcccga

SEQ ID NO: 229099 - DNA, 25 bp, Mus musculus
atacgtcaggatcggactccgggcc

SEQ ID NO: 229100 - DNA, 25 bp, Mus musculus
atacgtcaggatgggactccgggcc

SEQ ID NO: 229101 - DNA, 25 bp, Mus musculus
atacgtcattcaacaatttgtgctt

SEQ ID NO: 229102 - DNA, 25 bp, Mus musculus
atacgtcattcatcaatttgtgctt

SEQ ID NO: 229103 - DNA, 25 bp, Mus musculus
atacgtccagatattgaacctccaa

SEQ ID NO: 229104 - DNA, 25 bp, Mus musculus
atacgtccagattttgaacctccaa

SEQ ID NO: 229105 - DNA, 25 bp, Mus musculus
atacgtccttatagcctttagttgc

SEQ ID NO: 229106 - DNA, 25 bp, Mus musculus
atacgtccttattgcctttagttgc

SEQ ID NO: 229107 - DNA, 25 bp, Mus musculus
atacgtcgaggaagagtgttttcaa

SEQ ID NO: 229108 - DNA, 25 bp, Mus musculus
atacgtcgaggatgagtgttttcaa

SEQ ID NO: 229109 - DNA, 25 bp, Mus musculus
atacgtcgtaccaatagtcccttgc

SEQ ID NO: 229110 - DNA, 25 bp, Mus musculus
atacgtcgtacctatagtcccttgc

SEQ ID NO: 229111 - DNA, 25 bp, Mus musculus
atacgtctatgactagtgatttcac

SEQ ID NO: 229112 - DNA, 25 bp, Mus musculus
atacgtctatgagtagtgatttcac

SEQ ID NO: 229113 - DNA, 25 bp, Mus musculus
atacgtctatttacttcagattctg

SEQ ID NO: 229114 - DNA, 25 bp, Mus musculus
atacgtctattttcttcagattctg

SEQ ID NO: 229115 - DNA, 25 bp, Mus musculus
atacgtctcatacttcatttcagca

SEQ ID NO: 229116 - DNA, 25 bp, Mus musculus
atacgtctcatagttcatttcagca

SEQ ID NO: 229117 - DNA, 25 bp, Mus musculus
atacgtctccgtcctaaccatggta

SEQ ID NO: 229118 - DNA, 25 bp, Mus musculus
atacgtctccgtgctaaccatggta

SEQ ID NO: 229119 - DNA, 25 bp, Mus musculus
atacgtctgctacgatatacatgtg

SEQ ID NO: 229120 - DNA, 25 bp, Mus musculus
atacgtctgctaggatatacatgtg

SEQ ID NO: 229121 - DNA, 25 bp, Mus musculus
atacgtgaacgacatgtggcccggc

SEQ ID NO: 229122 - DNA, 25 bp, Mus musculus
atacgtgaacgagatgtggcccggc

SEQ ID NO: 229123 - DNA, 25 bp, Mus musculus
atacgtgacatcagtcgtctggtac

SEQ ID NO: 229124 - DNA, 25 bp, Mus musculus
atacgtgacatctgtcgtctggtac

SEQ ID NO: 229125 - DNA, 25 bp, Mus musculus
atacgtgacgagagtgtgtggcctt

SEQ ID NO: 229126 - DNA, 25 bp, Mus musculus
atacgtgacgagtgtgtgtggcctt

SEQ ID NO: 229127 - DNA, 25 bp, Mus musculus
atacgtgataatcaagtgaccatgt

SEQ ID NO: 229128 - DNA, 25 bp, Mus musculus
atacgtgataatgaagtgaccatgt

SEQ ID NO: 229129 - DNA, 25 bp, Mus musculus
atacgtgcacgaattcttatacata

SEQ ID NO: 229130 - DNA, 25 bp, Mus musculus
atacgtgcacgatttcttatacata

SEQ ID NO: 229131 - DNA, 25 bp, Mus musculus
atacgtgcattgacccacaggacat

SEQ ID NO: 229132 - DNA, 25 bp, Mus musculus
atacgtgcattgtcccacaggacat

SEQ ID NO: 229133 - DNA, 25 bp, Mus musculus
atacgtgctcagcttgcatagtagc

SEQ ID NO: 229134 - DNA, 25 bp, Mus musculus
atacgtgctcaggttgcatagtagc

SEQ ID NO: 229135 - DNA, 25 bp, Mus musculus
atacgtgctcatacatgcttcctag

SEQ ID NO: 229136 - DNA, 25 bp, Mus musculus
atacgtgctcattcatgcttcctag

SEQ ID NO: 229137 - DNA, 25 bp, Mus musculus
atacgtgcttcaaccgtctggacct

SEQ ID NO: 229138 - DNA, 25 bp, Mus musculus
atacgtgcttcatccgtctggacct

SEQ ID NO: 229139 - DNA, 25 bp, Mus musculus
atacgtggcagcaagatccgatttc

SEQ ID NO: 229140 - DNA, 25 bp, Mus musculus
atacgtggcagctagatccgatttc

SEQ ID NO: 229141 - DNA, 25 bp, Mus musculus
atacgtggccgaatcccagtgattg

SEQ ID NO: 229142 - DNA, 25 bp, Mus musculus
atacgtggccgattcccagtgattg

SEQ ID NO: 229143 - DNA, 25 bp, Mus musculus
atacgtggctccactggcgcttagg

SEQ ID NO: 229144 - DNA, 25 bp, Mus musculus
atacgtggctcctctggcgcttagg

SEQ ID NO: 229145 - DNA, 25 bp, Mus musculus
atacgtgggctcacctcaggattat

SEQ ID NO: 229146 - DNA, 25 bp, Mus musculus
atacgtgggctctcctcaggattat

SEQ ID NO: 229147 - DNA, 25 bp, Mus musculus
atacgtgttgacagtacaaggtggt

SEQ ID NO: 229148 - DNA, 25 bp, Mus musculus
atacgtgttgactgtacaaggtggt

SEQ ID NO: 229149 - DNA, 25 bp, Mus musculus
atacgtgtttaaaagccctgcgatt

SEQ ID NO: 229150 - DNA, 25 bp, Mus musculus
atacgtgtttaatagccctgcgatt

SEQ ID NO: 229151 - DNA, 25 bp, Mus musculus
atacgttagcacatgagcaactgga

SEQ ID NO: 229152 - DNA, 25 bp, Mus musculus
atacgttagcacttgagcaactgga

SEQ ID NO: 229153 - DNA, 25 bp, Mus musculus
atacgttcccaaccatgtcaccatg

SEQ ID NO: 229154 - DNA, 25 bp, Mus musculus
atacgttcccaagcatgtcaccatg

SEQ ID NO: 229155 - DNA, 25 bp, Mus musculus
atacgttcctgaatgtacatactgt

SEQ ID NO: 229156 - DNA, 25 bp, Mus musculus
atacgttcctgattgtacatactgt

SEQ ID NO: 229157 - DNA, 25 bp, Mus musculus
atacgttgcaataaacaatcaagga

SEQ ID NO: 229158 - DNA, 25 bp, Mus musculus
atacgttgcaattaacaatcaagga

SEQ ID NO: 229159 - DNA, 25 bp, Mus musculus
atacgttgcagcagtttgaccctga

SEQ ID NO: 229160 - DNA, 25 bp, Mus musculus
atacgttgcagctgtttgaccctga

SEQ ID NO: 229161 - DNA, 25 bp, Mus musculus
atacgtttgaagctgtgtgacctct

SEQ ID NO: 229162 - DNA, 25 bp, Mus musculus
atacgtttgaaggtgtgtgacctct

SEQ ID NO: 229163 - DNA, 25 bp, Mus musculus
atacgtttgtacaatgtgtgggaaa

SEQ ID NO: 229164 - DNA, 25 bp, Mus musculus
atacgtttgtactatgtgtgggaaa

SEQ ID NO: 229165 - DNA, 25 bp, Mus musculus
atactaaaactcactctggaagcag

SEQ ID NO: 229166 - DNA, 25 bp, Mus musculus
atactaaaactctctctggaagcag

SEQ ID NO: 229167 - DNA, 25 bp, Mus musculus
atactaaaattacatgtccccatat

SEQ ID NO: 229168 - DNA, 25 bp, Mus musculus
atactaaaattagatgtccccatat

SEQ ID NO: 229169 - DNA, 25 bp, Mus musculus
atactaaacacactcttgacttcta

SEQ ID NO: 229170 - DNA, 25 bp, Mus musculus
atactaaacacagtcttgacttcta

SEQ ID NO: 229171 - DNA, 25 bp, Mus musculus
atactaaagcaacctctagctcacc

SEQ ID NO: 229172 - DNA, 25 bp, Mus musculus
atactaaagcaagctctagctcacc

SEQ ID NO: 229173 - DNA, 25 bp, Mus musculus
atactaaatgtacaggcttctctca

SEQ ID NO: 229174 - DNA, 25 bp, Mus musculus
atactaaatgtagaggcttctctca

SEQ ID NO: 229175 - DNA, 25 bp, Mus musculus
atactaacaacactggtcctgcctc

SEQ ID NO: 229176 - DNA, 25 bp, Mus musculus
atactaacaacagtggtcctgcctc

SEQ ID NO: 229177 - DNA, 25 bp, Mus musculus
atactaacacacagactgcacatga

SEQ ID NO: 229178 - DNA, 25 bp, Mus musculus
atactaacacactgactgcacatga

SEQ ID NO: 229179 - DNA, 25 bp, Mus musculus
atactaacagaacacatgaccacct

SEQ ID NO: 229180 - DNA, 25 bp, Mus musculus
atactaacagaacttttggaggact

SEQ ID NO: 229181 - DNA, 25 bp, Mus musculus
atactaacagaagacatgaccacct

SEQ ID NO: 229182 - DNA, 25 bp, Mus musculus
atactaacagaagttttggaggact

SEQ ID NO: 229183 - DNA, 25 bp, Mus musculus
atactaaccacacctcaccaatatt

SEQ ID NO: 229184 - DNA, 25 bp, Mus musculus
atactaaccacagctcaccaatatt

SEQ ID NO: 229185 - DNA, 25 bp, Mus musculus
atactaacgatgactgcagctttcc

SEQ ID NO: 229186 - DNA, 25 bp, Mus musculus
atactaacgatgtctgcagctttcc

SEQ ID NO: 229187 - DNA, 25 bp, Mus musculus
atactaactgaccaaaccatacctc

SEQ ID NO: 229188 - DNA, 25 bp, Mus musculus
atactaactgacgaaaccatacctc

SEQ ID NO: 229189 - DNA, 25 bp, Mus musculus
atactaactgtaagctaatcatgat

SEQ ID NO: 229190 - DNA, 25 bp, Mus musculus
atactaactgtatgctaatcatgat

SEQ ID NO: 229191 - DNA, 25 bp, Mus musculus
atactaagccaccggtggtctccct

SEQ ID NO: 229192 - DNA, 25 bp, Mus musculus
atactaagccacgggtggtctccct

SEQ ID NO: 229193 - DNA, 25 bp, Mus musculus
atactaagccccaggatttggttgc

SEQ ID NO: 229194 - DNA, 25 bp, Mus musculus
atactaagcccctggatttggttgc

SEQ ID NO: 229195 - DNA, 25 bp, Mus musculus
atactaaggctcatctgggctccag

SEQ ID NO: 229196 - DNA, 25 bp, Mus musculus
atactaaggctcttctgggctccag

SEQ ID NO: 229197 - DNA, 25 bp, Mus musculus
atactaagtagcaagtctgggcttt

SEQ ID NO: 229198 - DNA, 25 bp, Mus musculus
atactaagtagctagtctgggcttt

SEQ ID NO: 229199 - DNA, 25 bp, Mus musculus
atactaatatctctcctcactgata

SEQ ID NO: 229200 - DNA, 25 bp, Mus musculus
atactaatatctgtcctcactgata

SEQ ID NO: 229201 - DNA, 25 bp, Mus musculus
atactaatgaagagctcacttacgt

SEQ ID NO: 229202 - DNA, 25 bp, Mus musculus
atactaatgaagtgctcacttacgt

SEQ ID NO: 229203 - DNA, 25 bp, Mus musculus
atactaatgctgcagaccgtggaca

SEQ ID NO: 229204 - DNA, 25 bp, Mus musculus
atactaatgctggagaccgtggaca

SEQ ID NO: 229205 - DNA, 25 bp, Mus musculus
atactaatgcttagttggtggtttg

SEQ ID NO: 229206 - DNA, 25 bp, Mus musculus
atactaatgctttgttggtggtttg

SEQ ID NO: 229207 - DNA, 25 bp, Mus musculus
atactaatgggacacgggcacagct

SEQ ID NO: 229208 - DNA, 25 bp, Mus musculus
atactaatgggagacgggcacagct

SEQ ID NO: 229209 - DNA, 25 bp, Mus musculus
atactaatttatagccgtcctggac

SEQ ID NO: 229210 - DNA, 25 bp, Mus musculus
atactaatttatatgccccgcctcg

SEQ ID NO: 229211 - DNA, 25 bp, Mus musculus
atactaatttattgccgtcctggac

SEQ ID NO: 229212 - DNA, 25 bp, Mus musculus
atactaatttatttgccccgcctcg

SEQ ID NO: 229213 - DNA, 25 bp, Mus musculus
atactaatttccagcggttgcttca

SEQ ID NO: 229214 - DNA, 25 bp, Mus musculus
atactaatttcctgcggttgcttca

SEQ ID NO: 229215 - DNA, 25 bp, Mus musculus
atactacagcgcatgacgtcttcgg

SEQ ID NO: 229216 - DNA, 25 bp, Mus musculus
atactacagcgcttgacgtcttcgg

SEQ ID NO: 229217 - DNA, 25 bp, Mus musculus
atactaccaaaactacagagcagac

SEQ ID NO: 229218 - DNA, 25 bp, Mus musculus
atactaccaaaagtacagagcagac

SEQ ID NO: 229219 - DNA, 25 bp, Mus musculus
atactaccaagcactcctgactttg

SEQ ID NO: 229220 - DNA, 25 bp, Mus musculus
atactaccaagctctcctgactttg

SEQ ID NO: 229221 - DNA, 25 bp, Mus musculus
atactaccacaacatgttccctgtc

SEQ ID NO: 229222 - DNA, 25 bp, Mus musculus
atactaccacaagatgttccctgtc

SEQ ID NO: 229223 - DNA, 25 bp, Mus musculus
atactacgagttcgtctagctcctt

SEQ ID NO: 229224 - DNA, 25 bp, Mus musculus
atactacgagttggtctagctcctt

SEQ ID NO: 229225 - DNA, 25 bp, Mus musculus
atactactacgcactctgccaaatg

SEQ ID NO: 229226 - DNA, 25 bp, Mus musculus
atactactacgctctctgccaaatg

SEQ ID NO: 229227 - DNA, 25 bp, Mus musculus
atactactacgtcgccgagtacaag

SEQ ID NO: 229228 - DNA, 25 bp, Mus musculus
atactactacgtggccgagtacaag

SEQ ID NO: 229229 - DNA, 25 bp, Mus musculus
atactactcatcaaatgtcgcctta

SEQ ID NO: 229230 - DNA, 25 bp, Mus musculus
atactactcatctaatgtcgcctta

SEQ ID NO: 229231 - DNA, 25 bp, Mus musculus
atactactccccatggtttctgaga

SEQ ID NO: 229232 - DNA, 25 bp, Mus musculus
atactactccccttggtttctgaga

SEQ ID NO: 229233 - DNA, 25 bp, Mus musculus
atactactccctcgtgtcagagcag

SEQ ID NO: 229234 - DNA, 25 bp, Mus musculus
atactactccctggtgtcagagcag

SEQ ID NO: 229235 - DNA, 25 bp, Mus musculus
atactactcttgctgtttctatcag

SEQ ID NO: 229236 - DNA, 25 bp, Mus musculus
atactactcttggtgtttctatcag

SEQ ID NO: 229237 - DNA, 25 bp, Mus musculus
atactactgaaaatcctggccactg

SEQ ID NO: 229238 - DNA, 25 bp, Mus musculus
atactactgaaattcctggccactg

SEQ ID NO: 229239 - DNA, 25 bp, Mus musculus
atactactgctactgcctgagttta

SEQ ID NO: 229240 - DNA, 25 bp, Mus musculus
atactactgctagtgcctgagttta

SEQ ID NO: 229241 - DNA, 25 bp, Mus musculus
atactacttcaaatgccccatcatc

SEQ ID NO: 229242 - DNA, 25 bp, Mus musculus
atactacttcaattgccccatcatc

SEQ ID NO: 229243 - DNA, 25 bp, Mus musculus
atactacttctaattattagggcaa

SEQ ID NO: 229244 - DNA, 25 bp, Mus musculus
atactacttctatttattagggcaa

SEQ ID NO: 229245 - DNA, 25 bp, Mus musculus
atactagagagacatccacatgagg

SEQ ID NO: 229246 - DNA, 25 bp, Mus musculus
atactagagagagatccacatgagg

SEQ ID NO: 229247 - DNA, 25 bp, Mus musculus
atactagatagactccacccaggag

SEQ ID NO: 229248 - DNA, 25 bp, Mus musculus
atactagatagagtccacccaggag

SEQ ID NO: 229249 - DNA, 25 bp, Mus musculus
atactagattatacacgtgtcagtg

SEQ ID NO: 229250 - DNA, 25 bp, Mus musculus
atactagattatatgccactttggg

SEQ ID NO: 229251 - DNA, 25 bp, Mus musculus
atactagattattcacgtgtcagtg

SEQ ID NO: 229252 - DNA, 25 bp, Mus musculus
atactagattatttgccactttggg

SEQ ID NO: 229253 - DNA, 25 bp, Mus musculus
atactagcacctccaaagctcagag

SEQ ID NO: 229254 - DNA, 25 bp, Mus musculus
atactagcacctgcaaagctcagag

SEQ ID NO: 229255 - DNA, 25 bp, Mus musculus
atactagccttcatctttccatagc

SEQ ID NO: 229256 - DNA, 25 bp, Mus musculus
atactagccttcttctttccatagc

SEQ ID NO: 229257 - DNA, 25 bp, Mus musculus
atactaggacaacggccaaacagga

SEQ ID NO: 229258 - DNA, 25 bp, Mus musculus
atactaggacaagggccaaacagga

SEQ ID NO: 229259 - DNA, 25 bp, Mus musculus
atactaggtcgcatttcaactaaca

SEQ ID NO: 229260 - DNA, 25 bp, Mus musculus
atactaggtcgcttttcaactaaca

SEQ ID NO: 229261 - DNA, 25 bp, Mus musculus
atactagtctacagggccctgctgt

SEQ ID NO: 229262 - DNA, 25 bp, Mus musculus
atactagtctactgggccctgctgt

SEQ ID NO: 229263 - DNA, 25 bp, Mus musculus
atactataaccacacgggccgcata

SEQ ID NO: 229264 - DNA, 25 bp, Mus musculus
atactataaccagacgggccgcata

SEQ ID NO: 229265 - DNA, 25 bp, Mus musculus
atactatatttgcatgccttttggg

SEQ ID NO: 229266 - DNA, 25 bp, Mus musculus
atactatatttggatgccttttggg

SEQ ID NO: 229267 - DNA, 25 bp, Mus musculus
atactatcacaaacctatggcttta

SEQ ID NO: 229268 - DNA, 25 bp, Mus musculus
atactatcacaatcctatggcttta

SEQ ID NO: 229269 - DNA, 25 bp, Mus musculus
atactatcgtccattcaaacataca

SEQ ID NO: 229270 - DNA, 25 bp, Mus musculus
atactatcgtcctttcaaacataca

SEQ ID NO: 229271 - DNA, 25 bp, Mus musculus
atactatctagcataatggcctgta

SEQ ID NO: 229272 - DNA, 25 bp, Mus musculus
atactatctagcttaatggcctgta

SEQ ID NO: 229273 - DNA, 25 bp, Mus musculus
atactatctcatatagcccttacac

SEQ ID NO: 229274 - DNA, 25 bp, Mus musculus
atactatctcatttagcccttacac

SEQ ID NO: 229275 - DNA, 25 bp, Mus musculus
atactatggctaagctcgtctcttc

SEQ ID NO: 229276 - DNA, 25 bp, Mus musculus
atactatggctatgctcgtctcttc

SEQ ID NO: 229277 - DNA, 25 bp, Mus musculus
atactatgtaacattgcctgcgttt

SEQ ID NO: 229278 - DNA, 25 bp, Mus musculus
atactatgtaacattttcatctatt

SEQ ID NO: 229279 - DNA, 25 bp, Mus musculus
atactatgtaactttgcctgcgttt

SEQ ID NO: 229280 - DNA, 25 bp, Mus musculus
atactatgtaactttttcatctatt

SEQ ID NO: 229281 - DNA, 25 bp, Mus musculus
atactattcaagctgcacgccgttt

SEQ ID NO: 229282 - DNA, 25 bp, Mus musculus
atactattcaaggtgcacgccgttt

SEQ ID NO: 229283 - DNA, 25 bp, Mus musculus
atactattccctattctaatcccat

SEQ ID NO: 229284 - DNA, 25 bp, Mus musculus
atactattcccttttctaatcccat

SEQ ID NO: 229285 - DNA, 25 bp, Mus musculus
atactattctctcttacgatcctgc

SEQ ID NO: 229286 - DNA, 25 bp, Mus musculus
atactattctctgttacgatcctgc

SEQ ID NO: 229287 - DNA, 25 bp, Mus musculus
atactattggagctgaactgtcctg

SEQ ID NO: 229288 - DNA, 25 bp, Mus musculus
atactattggaggtgaactgtcctg

SEQ ID NO: 229289 - DNA, 25 bp, Mus musculus
atactatttcatctgctttctgcca

SEQ ID NO: 229290 - DNA, 25 bp, Mus musculus
atactatttcatgtgctttctgcca

SEQ ID NO: 229291 - DNA, 25 bp, Mus musculus
atactcaacaccaggcttcctaatt

SEQ ID NO: 229292 - DNA, 25 bp, Mus musculus
atactcaacacctggcttcctaatt

SEQ ID NO: 229293 - DNA, 25 bp, Mus musculus
atactcaactacagaacccacaggg

SEQ ID NO: 229294 - DNA, 25 bp, Mus musculus
atactcaactactgaacccacaggg

SEQ ID NO: 229295 - DNA, 25 bp, Mus musculus
atactcaatttgcataacagggaat

SEQ ID NO: 229296 - DNA, 25 bp, Mus musculus
atactcaatttggataacagggaat

SEQ ID NO: 229297 - DNA, 25 bp, Mus musculus
atactcacacgcagaaaatccctat

SEQ ID NO: 229298 - DNA, 25 bp, Mus musculus
atactcacacgctgaaaatccctat

SEQ ID NO: 229299 - DNA, 25 bp, Mus musculus
atactcacagagatccttaccacat

SEQ ID NO: 229300 - DNA, 25 bp, Mus musculus
atactcacagagttccttaccacat

SEQ ID NO: 229301 - DNA, 25 bp, Mus musculus
atactcacatgcaatcaattaccta

SEQ ID NO: 229302 - DNA, 25 bp, Mus musculus
atactcacatgctatcaattaccta

SEQ ID NO: 229303 - DNA, 25 bp, Mus musculus
atactcacgctgaagtttgtctctt

SEQ ID NO: 229304 - DNA, 25 bp, Mus musculus
atactcacgctgtagtttgtctctt

SEQ ID NO: 229305 - DNA, 25 bp, Mus musculus
atactcactcagagactgatgctga

SEQ ID NO: 229306 - DNA, 25 bp, Mus musculus
atactcactcagtgactgatgctga

SEQ ID NO: 229307 - DNA, 25 bp, Mus musculus
atactcactcatagtaaacaccgcc

SEQ ID NO: 229308 - DNA, 25 bp, Mus musculus
atactcactcattgtaaacaccgcc

SEQ ID NO: 229309 - DNA, 25 bp, Mus musculus
atactcactcccaaaggctcagaat

SEQ ID NO: 229310 - DNA, 25 bp, Mus musculus
atactcactccctaaggctcagaat

SEQ ID NO: 229311 - DNA, 25 bp, Mus musculus
atactcacttttacttgaagagcct

SEQ ID NO: 229312 - DNA, 25 bp, Mus musculus
atactcactttttcttgaagagcct

SEQ ID NO: 229313 - DNA, 25 bp, Mus musculus
atactcagaagtctgatccccacca

SEQ ID NO: 229314 - DNA, 25 bp, Mus musculus
atactcagaagtgtgatccccacca

SEQ ID NO: 229315 - DNA, 25 bp, Mus musculus
atactcagcatcatgccagaagagt

SEQ ID NO: 229316 - DNA, 25 bp, Mus musculus
atactcagcatcttgccagaagagt

SEQ ID NO: 229317 - DNA, 25 bp, Mus musculus
atactcagcctaccgtggatggcgc

SEQ ID NO: 229318 - DNA, 25 bp, Mus musculus
atactcagcctagcgtggatggcgc

SEQ ID NO: 229319 - DNA, 25 bp, Mus musculus
atactcagctcacggtctctctttg

SEQ ID NO: 229320 - DNA, 25 bp, Mus musculus
atactcagctcagggtctctctttg

SEQ ID NO: 229321 - DNA, 25 bp, Mus musculus
atactcagtgacatttccacaccga

SEQ ID NO: 229322 - DNA, 25 bp, Mus musculus
atactcagtgacttttccacaccga

SEQ ID NO: 229323 - DNA, 25 bp, Mus musculus
atactcagtgctaacagctctgggt

SEQ ID NO: 229324 - DNA, 25 bp, Mus musculus
atactcagtgcttacagctctgggt

SEQ ID NO: 229325 - DNA, 25 bp, Mus musculus
atactcagtgtaagcgctttagtta

SEQ ID NO: 229326 - DNA, 25 bp, Mus musculus
atactcagtgtatgcgctttagtta

SEQ ID NO: 229327 - DNA, 25 bp, Mus musculus
atactcatcaagagccccgggaagt

SEQ ID NO: 229328 - DNA, 25 bp, Mus musculus
atactcatcaagtgccccgggaagt

SEQ ID NO: 229329 - DNA, 25 bp, Mus musculus
atactcatcgccacaagaagccgga

SEQ ID NO: 229330 - DNA, 25 bp, Mus musculus
atactcatcgcctcaagaagccgga

SEQ ID NO: 229331 - DNA, 25 bp, Mus musculus
atactcatgggaaatcaggttcttg

SEQ ID NO: 229332 - DNA, 25 bp, Mus musculus
atactcatgggatatcaggttcttg

SEQ ID NO: 229333 - DNA, 25 bp, Mus musculus
atactcatggtacctaaactttaga

SEQ ID NO: 229334 - DNA, 25 bp, Mus musculus
atactcatggtagctaaactttaga

SEQ ID NO: 229335 - DNA, 25 bp, Mus musculus
atactcatttagctccctgaagttt

SEQ ID NO: 229336 - DNA, 25 bp, Mus musculus
atactcatttaggtccctgaagttt

SEQ ID NO: 229337 - DNA, 25 bp, Mus musculus
atactcatttatcggttcaagaaac

SEQ ID NO: 229338 - DNA, 25 bp, Mus musculus
atactcatttatgggttcaagaaac

SEQ ID NO: 229339 - DNA, 25 bp, Mus musculus
atactccacggacacttcagagaca

SEQ ID NO: 229340 - DNA, 25 bp, Mus musculus
atactccacggagacttcagagaca

SEQ ID NO: 229341 - DNA, 25 bp, Mus musculus
atactccagaccatgtatcctctgg

SEQ ID NO: 229342 - DNA, 25 bp, Mus musculus
atactccagaccttgtatcctctgg

SEQ ID NO: 229343 - DNA, 25 bp, Mus musculus
atactccagagaacaattcacagtg

SEQ ID NO: 229344 - DNA, 25 bp, Mus musculus
atactccagagatcaattcacagtg

SEQ ID NO: 229345 - DNA, 25 bp, Mus musculus
atactccagcacagctccaggcagg

SEQ ID NO: 229346 - DNA, 25 bp, Mus musculus
atactccagcactgctccaggcagg

SEQ ID NO: 229347 - DNA, 25 bp, Mus musculus
atactccaggctacttctgttaggc

SEQ ID NO: 229348 - DNA, 25 bp, Mus musculus
atactccaggcttcttctgttaggc

SEQ ID NO: 229349 - DNA, 25 bp, Mus musculus
atactcccaaatcgcctttatttca

SEQ ID NO: 229350 - DNA, 25 bp, Mus musculus
atactcccaaatggcctttatttca

SEQ ID NO: 229351 - DNA, 25 bp, Mus musculus
atactcccaagaactagctcatgat

SEQ ID NO: 229352 - DNA, 25 bp, Mus musculus
atactcccaagatctagctcatgat

SEQ ID NO: 229353 - DNA, 25 bp, Mus musculus
atactcccagaaaccagctacaaac

SEQ ID NO: 229354 - DNA, 25 bp, Mus musculus
atactcccagaatccagctacaaac

SEQ ID NO: 229355 - DNA, 25 bp, Mus musculus
atactcccaggacttcttattaaga

SEQ ID NO: 229356 - DNA, 25 bp, Mus musculus
atactcccaggagttcttattaaga

SEQ ID NO: 229357 - DNA, 25 bp, Mus musculus
atactccctctcaaaataaatgtgc

SEQ ID NO: 229358 - DNA, 25 bp, Mus musculus
atactccctctctaaataaatgtgc

SEQ ID NO: 229359 - DNA, 25 bp, Mus musculus
atactccctgatatgtatgtgtgtg

SEQ ID NO: 229360 - DNA, 25 bp, Mus musculus
atactccctgatttgtatgtgtgtg

SEQ ID NO: 229361 - DNA, 25 bp, Mus musculus
atactccctggaaccaataccttca

SEQ ID NO: 229362 - DNA, 25 bp, Mus musculus
atactccctggatccaataccttca

SEQ ID NO: 229363 - DNA, 25 bp, Mus musculus
atactcccttgcactcgggttggat

SEQ ID NO: 229364 - DNA, 25 bp, Mus musculus
atactcccttgctctcgggttggat

SEQ ID NO: 229365 - DNA, 25 bp, Mus musculus
atactccgaggcatgctggcgtctg

SEQ ID NO: 229366 - DNA, 25 bp, Mus musculus
atactccgaggcttgctggcgtctg

SEQ ID NO: 229367 - DNA, 25 bp, Mus musculus
atactccgatggctttggccgcctt

SEQ ID NO: 229368 - DNA, 25 bp, Mus musculus
atactccgatgggtttggccgcctt

SEQ ID NO: 229369 - DNA, 25 bp, Mus musculus
atactcctgggacgccttgaactca

SEQ ID NO: 229370 - DNA, 25 bp, Mus musculus
atactcctgggaggccttgaactca

SEQ ID NO: 229371 - DNA, 25 bp, Mus musculus
atactcctgtttctgaggtgatctc

SEQ ID NO: 229372 - DNA, 25 bp, Mus musculus
atactcctgtttgtgaggtgatctc

SEQ ID NO: 229373 - DNA, 25 bp, Mus musculus
atactccttattcttagtgtccatg

SEQ ID NO: 229374 - DNA, 25 bp, Mus musculus
atactccttattgttagtgtccatg

SEQ ID NO: 229375 - DNA, 25 bp, Mus musculus
atactcctttggctggtatctggca

SEQ ID NO: 229376 - DNA, 25 bp, Mus musculus
atactcctttgggtggtatctggca

SEQ ID NO: 229377 - DNA, 25 bp, Mus musculus
atactcgaccaaatcatttgctctg

SEQ ID NO: 229378 - DNA, 25 bp, Mus musculus
atactcgaccaattcatttgctctg

SEQ ID NO: 229379 - DNA, 25 bp, Mus musculus
atactcgaggctcgccaagtccaca

SEQ ID NO: 229380 - DNA, 25 bp, Mus musculus
atactcgaggctggccaagtccaca

SEQ ID NO: 229381 - DNA, 25 bp, Mus musculus
atactcgaggtgcatgtcgcgtcct

SEQ ID NO: 229382 - DNA, 25 bp, Mus musculus
atactcgaggtggatgtcgcgtcct

SEQ ID NO: 229383 - DNA, 25 bp, Mus musculus
atactcgatacaagtgcttctgctt

SEQ ID NO: 229384 - DNA, 25 bp, Mus musculus
atactcgatacatgtgcttctgctt

SEQ ID NO: 229385 - DNA, 25 bp, Mus musculus
atactcgatcctatggtgtccacac

SEQ ID NO: 229386 - DNA, 25 bp, Mus musculus
atactcgatcctttggtgtccacac

SEQ ID NO: 229387 - DNA, 25 bp, Mus musculus
atactcgccagtctgatatcttcag

SEQ ID NO: 229388 - DNA, 25 bp, Mus musculus
atactcgccagtgtgatatcttcag

SEQ ID NO: 229389 - DNA, 25 bp, Mus musculus
atactcgctgagatgggtcccatta

SEQ ID NO: 229390 - DNA, 25 bp, Mus musculus
atactcgctgagttgggtcccatta

SEQ ID NO: 229391 - DNA, 25 bp, Mus musculus
atactcgcttatagagattcattaa

SEQ ID NO: 229392 - DNA, 25 bp, Mus musculus
atactcgcttatatcatgtgctgcc

SEQ ID NO: 229393 - DNA, 25 bp, Mus musculus
atactcgcttattgagattcattaa

SEQ ID NO: 229394 - DNA, 25 bp, Mus musculus
atactcgcttatttcatgtgctgcc

SEQ ID NO: 229395 - DNA, 25 bp, Mus musculus
atactcggccttcggatataaatat

SEQ ID NO: 229396 - DNA, 25 bp, Mus musculus
atactcggccttgggatataaatat

SEQ ID NO: 229397 - DNA, 25 bp, Mus musculus
atactcgggtatctgggaccttggc

SEQ ID NO: 229398 - DNA, 25 bp, Mus musculus
atactcgggtatgtgggaccttggc

SEQ ID NO: 229399 - DNA, 25 bp, Mus musculus
atactcggtgttcttttctactaag

SEQ ID NO: 229400 - DNA, 25 bp, Mus musculus
atactcggtgttgttttctactaag

SEQ ID NO: 229401 - DNA, 25 bp, Mus musculus
atactcgtattcataattgcacagg

SEQ ID NO: 229402 - DNA, 25 bp, Mus musculus
atactcgtattcttaattgcacagg

SEQ ID NO: 229403 - DNA, 25 bp, Mus musculus
atactcgtcattattctgttgaatc

SEQ ID NO: 229404 - DNA, 25 bp, Mus musculus
atactcgtcatttttctgttgaatc

SEQ ID NO: 229405 - DNA, 25 bp, Mus musculus
atactcgttcatcttccattttaag

SEQ ID NO: 229406 - DNA, 25 bp, Mus musculus
atactcgttcatgttccattttaag

SEQ ID NO: 229407 - DNA, 25 bp, Mus musculus
atactctaaaacatcctcagcactt

SEQ ID NO: 229408 - DNA, 25 bp, Mus musculus
atactctaaaacttcctcagcactt

SEQ ID NO: 229409 - DNA, 25 bp, Mus musculus
atactctaacatctcacttgattct

SEQ ID NO: 229410 - DNA, 25 bp, Mus musculus
atactctaacatgtcacttgattct

SEQ ID NO: 229411 - DNA, 25 bp, Mus musculus
atactctaacttaatttgcctgcaa

SEQ ID NO: 229412 - DNA, 25 bp, Mus musculus
atactctaactttatttgcctgcaa

SEQ ID NO: 229413 - DNA, 25 bp, Mus musculus
atactctaagcaccagggttcccaa

SEQ ID NO: 229414 - DNA, 25 bp, Mus musculus
atactctaagcagcagggttcccaa

SEQ ID NO: 229415 - DNA, 25 bp, Mus musculus
atactctatgggaccttagcttctc

SEQ ID NO: 229416 - DNA, 25 bp, Mus musculus
atactctatgggtccttagcttctc

SEQ ID NO: 229417 - DNA, 25 bp, Mus musculus
atactctatgtaatcctgggtcagg

SEQ ID NO: 229418 - DNA, 25 bp, Mus musculus
atactctatgtattcctgggtcagg

SEQ ID NO: 229419 - DNA, 25 bp, Mus musculus
atactctcaggcctgatgggagaca

SEQ ID NO: 229420 - DNA, 25 bp, Mus musculus
atactctcaggcgtgatgggagaca

SEQ ID NO: 229421 - DNA, 25 bp, Mus musculus
atactctccttaccttgatcttggt

SEQ ID NO: 229422 - DNA, 25 bp, Mus musculus
atactctccttagcttgatcttggt

SEQ ID NO: 229423 - DNA, 25 bp, Mus musculus
atactctccttgactcgcattgggc

SEQ ID NO: 229424 - DNA, 25 bp, Mus musculus
atactctccttgtctcgcattgggc

SEQ ID NO: 229425 - DNA, 25 bp, Mus musculus
atactctcgcccagtatcatggagg

SEQ ID NO: 229426 - DNA, 25 bp, Mus musculus
atactctcgccctgtatcatggagg

SEQ ID NO: 229427 - DNA, 25 bp, Mus musculus
atactctctcaaagatccattgccc

SEQ ID NO: 229428 - DNA, 25 bp, Mus musculus
atactctctcaatgatccattgccc

SEQ ID NO: 229429 - DNA, 25 bp, Mus musculus
atactctctcacacatgttgcggga

SEQ ID NO: 229430 - DNA, 25 bp, Mus musculus
atactctctcactcatgttgcggga

SEQ ID NO: 229431 - DNA, 25 bp, Mus musculus
atactctctctacagctttggtctc

SEQ ID NO: 229432 - DNA, 25 bp, Mus musculus
atactctctctaccatggagggttt

SEQ ID NO: 229433 - DNA, 25 bp, Mus musculus
atactctctctagagctttggtctc

SEQ ID NO: 229434 - DNA, 25 bp, Mus musculus
atactctctctagcatggagggttt

SEQ ID NO: 229435 - DNA, 25 bp, Mus musculus
atactctcttaaccggtggcgcccg

SEQ ID NO: 229436 - DNA, 25 bp, Mus musculus
atactctcttaagcggtggcgcccg

SEQ ID NO: 229437 - DNA, 25 bp, Mus musculus
atactctcttgtcttttccagttac

SEQ ID NO: 229438 - DNA, 25 bp, Mus musculus
atactctcttgtgttttccagttac

SEQ ID NO: 229439 - DNA, 25 bp, Mus musculus
atactctgacagatttctgacagac

SEQ ID NO: 229440 - DNA, 25 bp, Mus musculus
atactctgacagttttctgacagac

SEQ ID NO: 229441 - DNA, 25 bp, Mus musculus
atactctgactcaccctaatgaaga

SEQ ID NO: 229442 - DNA, 25 bp, Mus musculus
atactctgactccaggctcccagag

SEQ ID NO: 229443 - DNA, 25 bp, Mus musculus
atactctgactcgaggctcccagag

SEQ ID NO: 229444 - DNA, 25 bp, Mus musculus
atactctgactctccctaatgaaga

SEQ ID NO: 229445 - DNA, 25 bp, Mus musculus
atactctgatgaatctcatgccggg

SEQ ID NO: 229446 - DNA, 25 bp, Mus musculus
atactctgatgattctcatgccggg

SEQ ID NO: 229447 - DNA, 25 bp, Mus musculus
atactctgatggcttctagccctgc

SEQ ID NO: 229448 - DNA, 25 bp, Mus musculus
atactctgatgggttctagccctgc

SEQ ID NO: 229449 - DNA, 25 bp, Mus musculus
atactctggacgaggcggagcgcca

SEQ ID NO: 229450 - DNA, 25 bp, Mus musculus
atactctggacgtggcggagcgcca

SEQ ID NO: 229451 - DNA, 25 bp, Mus musculus
atactctggatacgccatggcagca

SEQ ID NO: 229452 - DNA, 25 bp, Mus musculus
atactctggataggccatggcagca

SEQ ID NO: 229453 - DNA, 25 bp, Mus musculus
atactctggatgctcttgctctgac

SEQ ID NO: 229454 - DNA, 25 bp, Mus musculus
atactctggatggtcttgctctgac

SEQ ID NO: 229455 - DNA, 25 bp, Mus musculus
atactctgtagcctgtgtgcatgcg

SEQ ID NO: 229456 - DNA, 25 bp, Mus musculus
atactctgtagcgtgtgtgcatgcg

SEQ ID NO: 229457 - DNA, 25 bp, Mus musculus
atactctgtcgtcagtggaatcaca

SEQ ID NO: 229458 - DNA, 25 bp, Mus musculus
atactctgtcgtgagtggaatcaca

SEQ ID NO: 229459 - DNA, 25 bp, Mus musculus
atactcttaccaccctgtagaggca

SEQ ID NO: 229460 - DNA, 25 bp, Mus musculus
atactcttaccagcctgtagaggca

SEQ ID NO: 229461 - DNA, 25 bp, Mus musculus
atactcttcaatcgtccagatgcca

SEQ ID NO: 229462 - DNA, 25 bp, Mus musculus
atactcttcaatggtccagatgcca

SEQ ID NO: 229463 - DNA, 25 bp, Mus musculus
atactcttcagcctgcagcgtgttc

SEQ ID NO: 229464 - DNA, 25 bp, Mus musculus
atactcttcagcgtgcagcgtgttc

SEQ ID NO: 229465 - DNA, 25 bp, Mus musculus
atactcttctcgatttcagattcca

SEQ ID NO: 229466 - DNA, 25 bp, Mus musculus
atactcttctcgttttcagattcca

SEQ ID NO: 229467 - DNA, 25 bp, Mus musculus
atactcttctctaccggatgactac

SEQ ID NO: 229468 - DNA, 25 bp, Mus musculus
atactcttctcttccggatgactac

SEQ ID NO: 229469 - DNA, 25 bp, Mus musculus
atactcttcttcaacaacttgggtc

SEQ ID NO: 229470 - DNA, 25 bp, Mus musculus
atactcttcttctacaacttgggtc

SEQ ID NO: 229471 - DNA, 25 bp, Mus musculus
atactcttggagagtgtgagatgat

SEQ ID NO: 229472 - DNA, 25 bp, Mus musculus
atactcttggagtgtgtgagatgat

SEQ ID NO: 229473 - DNA, 25 bp, Mus musculus
atactcttgtggctgtctgccatac

SEQ ID NO: 229474 - DNA, 25 bp, Mus musculus
atactcttgtgggtgtctgccatac

SEQ ID NO: 229475 - DNA, 25 bp, Mus musculus
atactctttggaagttgccttatga

SEQ ID NO: 229476 - DNA, 25 bp, Mus musculus
atactctttggatgttgccttatga

SEQ ID NO: 229477 - DNA, 25 bp, Mus musculus
atactgaaagcaatacctctcgtta

SEQ ID NO: 229478 - DNA, 25 bp, Mus musculus
atactgaaagcattacctctcgtta

SEQ ID NO: 229479 - DNA, 25 bp, Mus musculus
atactgaacatcactgcatcggtgg

SEQ ID NO: 229480 - DNA, 25 bp, Mus musculus
atactgaacatctctgcatcggtgg

SEQ ID NO: 229481 - DNA, 25 bp, Mus musculus
atactgaacatgcttagtctctcca

SEQ ID NO: 229482 - DNA, 25 bp, Mus musculus
atactgaacatggttagtctctcca

SEQ ID NO: 229483 - DNA, 25 bp, Mus musculus
atactgaagccactagtctcttttc

SEQ ID NO: 229484 - DNA, 25 bp, Mus musculus
atactgaagccagtagtctcttttc

SEQ ID NO: 229485 - DNA, 25 bp, Mus musculus
atactgaataaaacaaccctggaga

SEQ ID NO: 229486 - DNA, 25 bp, Mus musculus
atactgaataaaaccttgtatggtg

SEQ ID NO: 229487 - DNA, 25 bp, Mus musculus
atactgaataaatcaaccctggaga

SEQ ID NO: 229488 - DNA, 25 bp, Mus musculus
atactgaataaatccttgtatggtg

SEQ ID NO: 229489 - DNA, 25 bp, Mus musculus
atactgaatacccaatcaccccaag

SEQ ID NO: 229490 - DNA, 25 bp, Mus musculus
atactgaataccgaatcaccccaag

SEQ ID NO: 229491 - DNA, 25 bp, Mus musculus
atactgaatatgacccagatttatc

SEQ ID NO: 229492 - DNA, 25 bp, Mus musculus
atactgaatatgtcccagatttatc

SEQ ID NO: 229493 - DNA, 25 bp, Mus musculus
atactgacaatgacacagaagctgg

SEQ ID NO: 229494 - DNA, 25 bp, Mus musculus
atactgacaatgtcacagaagctgg

SEQ ID NO: 229495 - DNA, 25 bp, Mus musculus
atactgacagtcaatttgcttccca

SEQ ID NO: 229496 - DNA, 25 bp, Mus musculus
atactgacagtctatttgcttccca

SEQ ID NO: 229497 - DNA, 25 bp, Mus musculus
atactgacatgcaagcaaggcttgt

SEQ ID NO: 229498 - DNA, 25 bp, Mus musculus
atactgacatgctagcaaggcttgt

SEQ ID NO: 229499 - DNA, 25 bp, Mus musculus
atactgaccatgacttcaagttgga

SEQ ID NO: 229500 - DNA, 25 bp, Mus musculus
atactgaccatgtcttcaagttgga

SEQ ID NO: 229501 - DNA, 25 bp, Mus musculus
atactgacccatctctacagacctt

SEQ ID NO: 229502 - DNA, 25 bp, Mus musculus
atactgacccatgtctacagacctt

SEQ ID NO: 229503 - DNA, 25 bp, Mus musculus
atactgaccctgagtgcagaggcgt

SEQ ID NO: 229504 - DNA, 25 bp, Mus musculus
atactgaccctgtgtgcagaggcgt

SEQ ID NO: 229505 - DNA, 25 bp, Mus musculus
atactgaccgcacgtgttatggcct

SEQ ID NO: 229506 - DNA, 25 bp, Mus musculus
atactgaccgcaggtgttatggcct

SEQ ID NO: 229507 - DNA, 25 bp, Mus musculus
atactgacgattcttggttgcccct

SEQ ID NO: 229508 - DNA, 25 bp, Mus musculus
atactgacgattgttggttgcccct

SEQ ID NO: 229509 - DNA, 25 bp, Mus musculus
atactgactaagcatccttcttcca

SEQ ID NO: 229510 - DNA, 25 bp, Mus musculus
atactgactaaggatccttcttcca

SEQ ID NO: 229511 - DNA, 25 bp, Mus musculus
atactgactatgctaatgctggcct

SEQ ID NO: 229512 - DNA, 25 bp, Mus musculus
atactgactatggtaatgctggcct

SEQ ID NO: 229513 - DNA, 25 bp, Mus musculus
atactgactggcagggctgtgcatc

SEQ ID NO: 229514 - DNA, 25 bp, Mus musculus
atactgactggctgggctgtgcatc

SEQ ID NO: 229515 - DNA, 25 bp, Mus musculus
atactgacttatcagaacccaaaaa

SEQ ID NO: 229516 - DNA, 25 bp, Mus musculus
atactgacttatgagaacccaaaaa

SEQ ID NO: 229517 - DNA, 25 bp, Mus musculus
atactgagactcaaaagcacacccc

SEQ ID NO: 229518 - DNA, 25 bp, Mus musculus
atactgagactctaaagcacacccc

SEQ ID NO: 229519 - DNA, 25 bp, Mus musculus
atactgagcagcagggcccgagtga

SEQ ID NO: 229520 - DNA, 25 bp, Mus musculus
atactgagcagctgggcccgagtga

SEQ ID NO: 229521 - DNA, 25 bp, Mus musculus
atactgaggactactttggcaatgt

SEQ ID NO: 229522 - DNA, 25 bp, Mus musculus
atactgaggacttctttggcaatgt

SEQ ID NO: 229523 - DNA, 25 bp, Mus musculus
atactgaggctgacattggccagaa

SEQ ID NO: 229524 - DNA, 25 bp, Mus musculus
atactgaggctgtcattggccagaa

SEQ ID NO: 229525 - DNA, 25 bp, Mus musculus
atactgaggcttcgtctgggctgca

SEQ ID NO: 229526 - DNA, 25 bp, Mus musculus
atactgaggcttggtctgggctgca

SEQ ID NO: 229527 - DNA, 25 bp, Mus musculus
atactgagtcaaagctggattattc

SEQ ID NO: 229528 - DNA, 25 bp, Mus musculus
atactgagtcaatgctggattattc

SEQ ID NO: 229529 - DNA, 25 bp, Mus musculus
atactgagtctgctgttggtcacac

SEQ ID NO: 229530 - DNA, 25 bp, Mus musculus
atactgagtctggtgttggtcacac

SEQ ID NO: 229531 - DNA, 25 bp, Mus musculus
atactgagtgaaagcccggtggcct

SEQ ID NO: 229532 - DNA, 25 bp, Mus musculus
atactgagtgaatgcccggtggcct

SEQ ID NO: 229533 - DNA, 25 bp, Mus musculus
atactgagtgggatcattcctctct

SEQ ID NO: 229534 - DNA, 25 bp, Mus musculus
atactgagtgggttcattcctctct

SEQ ID NO: 229535 - DNA, 25 bp, Mus musculus
atactgagttcgatgaggactttga

SEQ ID NO: 229536 - DNA, 25 bp, Mus musculus
atactgagttcgttgaggactttga

SEQ ID NO: 229537 - DNA, 25 bp, Mus musculus
atactgataaacactcaccttctga

SEQ ID NO: 229538 - DNA, 25 bp, Mus musculus
atactgataaactctcaccttctga

SEQ ID NO: 229539 - DNA, 25 bp, Mus musculus
atactgatcatcctacagctgctgt

SEQ ID NO: 229540 - DNA, 25 bp, Mus musculus
atactgatcatcgtacagctgctgt

SEQ ID NO: 229541 - DNA, 25 bp, Mus musculus
atactgatcctcaacaggcttcttt

SEQ ID NO: 229542 - DNA, 25 bp, Mus musculus
atactgatcctctacaggcttcttt

SEQ ID NO: 229543 - DNA, 25 bp, Mus musculus
atactgatcctgagagtcctggtga

SEQ ID NO: 229544 - DNA, 25 bp, Mus musculus
atactgatcctgtgagtcctggtga

SEQ ID NO: 229545 - DNA, 25 bp, Mus musculus
atactgatgagcacccaggtagctt

SEQ ID NO: 229546 - DNA, 25 bp, Mus musculus
atactgatgagctcccaggtagctt

SEQ ID NO: 229547 - DNA, 25 bp, Mus musculus
atactgatgggcctcgcctgtaaaa

SEQ ID NO: 229548 - DNA, 25 bp, Mus musculus
atactgatgggcgtcgcctgtaaaa

SEQ ID NO: 229549 - DNA, 25 bp, Mus musculus
atactgattacactttccagaaatg

SEQ ID NO: 229550 - DNA, 25 bp, Mus musculus
atactgattacagtttccagaaatg

SEQ ID NO: 229551 - DNA, 25 bp, Mus musculus
atactgatttatcatagactatcaa

SEQ ID NO: 229552 - DNA, 25 bp, Mus musculus
atactgatttatgatagactatcaa

SEQ ID NO: 229553 - DNA, 25 bp, Mus musculus
atactgatttgtcttaattggatgt

SEQ ID NO: 229554 - DNA, 25 bp, Mus musculus
atactgatttgtgttaattggatgt

SEQ ID NO: 229555 - DNA, 25 bp, Mus musculus
atactgcaagcccttcatgtgattg

SEQ ID NO: 229556 - DNA, 25 bp, Mus musculus
atactgcaagccgttcatgtgattg

SEQ ID NO: 229557 - DNA, 25 bp, Mus musculus
atactgcaagttaggcatccattgt

SEQ ID NO: 229558 - DNA, 25 bp, Mus musculus
atactgcaagtttggcatccattgt

SEQ ID NO: 229559 - DNA, 25 bp, Mus musculus
atactgcaatgtcccaggttggtta

SEQ ID NO: 229560 - DNA, 25 bp, Mus musculus
atactgcaatgtgccaggttggtta

SEQ ID NO: 229561 - DNA, 25 bp, Mus musculus
atactgcacggcatcatggttcctg

SEQ ID NO: 229562 - DNA, 25 bp, Mus musculus
atactgcacggcttcatggttcctg

SEQ ID NO: 229563 - DNA, 25 bp, Mus musculus
atactgcacgtgaagaaatactctc

SEQ ID NO: 229564 - DNA, 25 bp, Mus musculus
atactgcacgtgtagaaatactctc

SEQ ID NO: 229565 - DNA, 25 bp, Mus musculus
atactgcactatagagacttatcac

SEQ ID NO: 229566 - DNA, 25 bp, Mus musculus
atactgcactattgagacttatcac

SEQ ID NO: 229567 - DNA, 25 bp, Mus musculus
atactgcagagcagttggcttcggt

SEQ ID NO: 229568 - DNA, 25 bp, Mus musculus
atactgcagagctgttggcttcggt

SEQ ID NO: 229569 - DNA, 25 bp, Mus musculus
atactgcagctaccgaaaccgcagg

SEQ ID NO: 229570 - DNA, 25 bp, Mus musculus
atactgcagctagcgaaaccgcagg

SEQ ID NO: 229571 - DNA, 25 bp, Mus musculus
atactgcatcataacatcgccagat

SEQ ID NO: 229572 - DNA, 25 bp, Mus musculus
atactgcatcattacatcgccagat

SEQ ID NO: 229573 - DNA, 25 bp, Mus musculus
atactgcatcttcttaatctgttct

SEQ ID NO: 229574 - DNA, 25 bp, Mus musculus
atactgcatcttgttaatctgttct

SEQ ID NO: 229575 - DNA, 25 bp, Mus musculus
atactgcatgcacgtggttcataca

SEQ ID NO: 229576 - DNA, 25 bp, Mus musculus
atactgcatgcaggtggttcataca

SEQ ID NO: 229577 - DNA, 25 bp, Mus musculus
atactgcattgtacccagacatgat

SEQ ID NO: 229578 - DNA, 25 bp, Mus musculus
atactgcattgttcccagacatgat

SEQ ID NO: 229579 - DNA, 25 bp, Mus musculus
atactgccaagtctctgcaaaccag

SEQ ID NO: 229580 - DNA, 25 bp, Mus musculus
atactgccaagtgtctgcaaaccag

SEQ ID NO: 229581 - DNA, 25 bp, Mus musculus
atactgccagctactacatcattac

SEQ ID NO: 229582 - DNA, 25 bp, Mus musculus
atactgccagcttctacatcattac

SEQ ID NO: 229583 - DNA, 25 bp, Mus musculus
atactgccagtaccaggcagccatg

SEQ ID NO: 229584 - DNA, 25 bp, Mus musculus
atactgccagtagcaggcagccatg

SEQ ID NO: 229585 - DNA, 25 bp, Mus musculus
atactgccagtcacttcccaagata

SEQ ID NO: 229586 - DNA, 25 bp, Mus musculus
atactgccagtctcttcccaagata

SEQ ID NO: 229587 - DNA, 25 bp, Mus musculus
atactgccagtgatttctccaggag

SEQ ID NO: 229588 - DNA, 25 bp, Mus musculus
atactgccagtgttttctccaggag

SEQ ID NO: 229589 - DNA, 25 bp, Mus musculus
atactgccagttaatctcatttgtg

SEQ ID NO: 229590 - DNA, 25 bp, Mus musculus
atactgccagtttatctcatttgtg

SEQ ID NO: 229591 - DNA, 25 bp, Mus musculus
atactgccatataaagaacttctta

SEQ ID NO: 229592 - DNA, 25 bp, Mus musculus
atactgccatattaagaacttctta

SEQ ID NO: 229593 - DNA, 25 bp, Mus musculus
atactgccatgaaaccaagctacaa

SEQ ID NO: 229594 - DNA, 25 bp, Mus musculus
atactgccatgataccaagctacaa

SEQ ID NO: 229595 - DNA, 25 bp, Mus musculus
atactgccattaagacttgtcctga

SEQ ID NO: 229596 - DNA, 25 bp, Mus musculus
atactgccattatgacttgtcctga

SEQ ID NO: 229597 - DNA, 25 bp, Mus musculus
atactgcccaggaacagggtcctga

SEQ ID NO: 229598 - DNA, 25 bp, Mus musculus
atactgcccaggtacagggtcctga

SEQ ID NO: 229599 - DNA, 25 bp, Mus musculus
atactgcccagtacaagagacgaga

SEQ ID NO: 229600 - DNA, 25 bp, Mus musculus
atactgcccagttcaagagacgaga

SEQ ID NO: 229601 - DNA, 25 bp, Mus musculus
atactgcccattctcaaccttaagg

SEQ ID NO: 229602 - DNA, 25 bp, Mus musculus
atactgcccattgtcaaccttaagg

SEQ ID NO: 229603 - DNA, 25 bp, Mus musculus
atactgcccgttactgtcacagttt

SEQ ID NO: 229604 - DNA, 25 bp, Mus musculus
atactgcccgtttctgtcacagttt

SEQ ID NO: 229605 - DNA, 25 bp, Mus musculus
atactgcccttgagtaaggcccaag

SEQ ID NO: 229606 - DNA, 25 bp, Mus musculus
atactgcccttgtgtaaggcccaag

SEQ ID NO: 229607 - DNA, 25 bp, Mus musculus
atactgcctggacagaaccatgcca

SEQ ID NO: 229608 - DNA, 25 bp, Mus musculus
atactgcctggagagaaccatgcca

SEQ ID NO: 229609 - DNA, 25 bp, Mus musculus
atactgcctgggattcaagtccctt

SEQ ID NO: 229610 - DNA, 25 bp, Mus musculus
atactgcctgggtttcaagtccctt

SEQ ID NO: 229611 - DNA, 25 bp, Mus musculus
atactgcctgtgatatctttgatcc

SEQ ID NO: 229612 - DNA, 25 bp, Mus musculus
atactgcctgtgttatctttgatcc

SEQ ID NO: 229613 - DNA, 25 bp, Mus musculus
atactgccttaaattgactctgcat

SEQ ID NO: 229614 - DNA, 25 bp, Mus musculus
atactgccttaatttgactctgcat

SEQ ID NO: 229615 - DNA, 25 bp, Mus musculus
atactgcggatcctgcaggctctgg

SEQ ID NO: 229616 - DNA, 25 bp, Mus musculus
atactgcggatcgtgcaggctctgg

SEQ ID NO: 229617 - DNA, 25 bp, Mus musculus
atactgcgggccctgacttatagga

SEQ ID NO: 229618 - DNA, 25 bp, Mus musculus
atactgcgggccgtgacttatagga

SEQ ID NO: 229619 - DNA, 25 bp, Mus musculus
atactgctagcacctgctcatactg

SEQ ID NO: 229620 - DNA, 25 bp, Mus musculus
atactgctagcagctgctcatactg

SEQ ID NO: 229621 - DNA, 25 bp, Mus musculus
atactgctatgccattaaggtttta

SEQ ID NO: 229622 - DNA, 25 bp, Mus musculus
atactgctatgcgattaaggtttta

SEQ ID NO: 229623 - DNA, 25 bp, Mus musculus
atactgctattcataccacgaccaa

SEQ ID NO: 229624 - DNA, 25 bp, Mus musculus
atactgctattcttaccacgaccaa

SEQ ID NO: 229625 - DNA, 25 bp, Mus musculus
atactgctattgctccagcatgcat

SEQ ID NO: 229626 - DNA, 25 bp, Mus musculus
atactgctattggtccagcatgcat

SEQ ID NO: 229627 - DNA, 25 bp, Mus musculus
atactgctctggatatatggagctg

SEQ ID NO: 229628 - DNA, 25 bp, Mus musculus
atactgctctggttatatggagctg

SEQ ID NO: 229629 - DNA, 25 bp, Mus musculus
atactgctgaatcttctgatcgccc

SEQ ID NO: 229630 - DNA, 25 bp, Mus musculus
atactgctgaatgttctgatcgccc

SEQ ID NO: 229631 - DNA, 25 bp, Mus musculus
atactgctgctacctggctgtgcca

SEQ ID NO: 229632 - DNA, 25 bp, Mus musculus
atactgctgctagctggctgtgcca

SEQ ID NO: 229633 - DNA, 25 bp, Mus musculus
atactgctgcttcagtgaccccaga

SEQ ID NO: 229634 - DNA, 25 bp, Mus musculus
atactgctgcttgagtgaccccaga

SEQ ID NO: 229635 - DNA, 25 bp, Mus musculus
atactgctggtgatggaagagccaa

SEQ ID NO: 229636 - DNA, 25 bp, Mus musculus
atactgctggtgttggaagagccaa

SEQ ID NO: 229637 - DNA, 25 bp, Mus musculus
atactgctgtctacgttggtgccac

SEQ ID NO: 229638 - DNA, 25 bp, Mus musculus
atactgctgtcttcgttggtgccac

SEQ ID NO: 229639 - DNA, 25 bp, Mus musculus
atactgctgttaattgctgccactg

SEQ ID NO: 229640 - DNA, 25 bp, Mus musculus
atactgctgttatttgctgccactg

SEQ ID NO: 229641 - DNA, 25 bp, Mus musculus
atactgcttcccaaacaacactaat

SEQ ID NO: 229642 - DNA, 25 bp, Mus musculus
atactgcttccctaacaacactaat

SEQ ID NO: 229643 - DNA, 25 bp, Mus musculus
atactgcttcctaaccctagaagtc

SEQ ID NO: 229644 - DNA, 25 bp, Mus musculus
atactgcttccttaccctagaagtc

SEQ ID NO: 229645 - DNA, 25 bp, Mus musculus
atactgcttgcccaaaatacttgca

SEQ ID NO: 229646 - DNA, 25 bp, Mus musculus
atactgcttgccgaaaatacttgca

SEQ ID NO: 229647 - DNA, 25 bp, Mus musculus
atactgcttgttatccaggccaata

SEQ ID NO: 229648 - DNA, 25 bp, Mus musculus
atactgcttgttttccaggccaata

SEQ ID NO: 229649 - DNA, 25 bp, Mus musculus
atactggaaataactgtagctagcc

SEQ ID NO: 229650 - DNA, 25 bp, Mus musculus
atactggaaatatctgtagctagcc

SEQ ID NO: 229651 - DNA, 25 bp, Mus musculus
atactggactctagatatctcgcct

SEQ ID NO: 229652 - DNA, 25 bp, Mus musculus
atactggactcttgatatctcgcct

SEQ ID NO: 229653 - DNA, 25 bp, Mus musculus
atactggagaatcgctgtgcagctc

SEQ ID NO: 229654 - DNA, 25 bp, Mus musculus
atactggagaatggctgtgcagctc

SEQ ID NO: 229655 - DNA, 25 bp, Mus musculus
atactggaggtgacagcttctctgc

SEQ ID NO: 229656 - DNA, 25 bp, Mus musculus
atactggaggtgtcagcttctctgc

SEQ ID NO: 229657 - DNA, 25 bp, Mus musculus
atactggatggcagacgtgctcccg

SEQ ID NO: 229658 - DNA, 25 bp, Mus musculus
atactggatggctgacgtgctcccg

SEQ ID NO: 229659 - DNA, 25 bp, Mus musculus
atactggcctttaagacctttggtg

SEQ ID NO: 229660 - DNA, 25 bp, Mus musculus
atactggccttttagacctttggtg

SEQ ID NO: 229661 - DNA, 25 bp, Mus musculus
atactggcggccatttcttagctga

SEQ ID NO: 229662 - DNA, 25 bp, Mus musculus
atactggcggccttttcttagctga

SEQ ID NO: 229663 - DNA, 25 bp, Mus musculus
atactggcgtccagctggcctcatt

SEQ ID NO: 229664 - DNA, 25 bp, Mus musculus
atactggcgtcctgctggcctcatt

SEQ ID NO: 229665 - DNA, 25 bp, Mus musculus
atactggctatgacggcttaaagaa

SEQ ID NO: 229666 - DNA, 25 bp, Mus musculus
atactggctatgtcggcttaaagaa

SEQ ID NO: 229667 - DNA, 25 bp, Mus musculus
atactggctgttctcacatcagtca

SEQ ID NO: 229668 - DNA, 25 bp, Mus musculus
atactggctgttgtcacatcagtca

SEQ ID NO: 229669 - DNA, 25 bp, Mus musculus
atactgggaagacatgctctccaca

SEQ ID NO: 229670 - DNA, 25 bp, Mus musculus
atactgggaagagatgctctccaca

SEQ ID NO: 229671 - DNA, 25 bp, Mus musculus
atactgggagccaacgccatctact

SEQ ID NO: 229672 - DNA, 25 bp, Mus musculus
atactgggagcctacgccatctact

SEQ ID NO: 229673 - DNA, 25 bp, Mus musculus
atactgggatctcatgcttcatctg

SEQ ID NO: 229674 - DNA, 25 bp, Mus musculus
atactgggatctgatgcttcatctg

SEQ ID NO: 229675 - DNA, 25 bp, Mus musculus
atactgggcatcaatcctggccttc

SEQ ID NO: 229676 - DNA, 25 bp, Mus musculus
atactgggcatctatcctggccttc

SEQ ID NO: 229677 - DNA, 25 bp, Mus musculus
atactgggcatgcaggtaccaccac

SEQ ID NO: 229678 - DNA, 25 bp, Mus musculus
atactgggcatggaggtaccaccac

SEQ ID NO: 229679 - DNA, 25 bp, Mus musculus
atactgggcattccctgttccacat

SEQ ID NO: 229680 - DNA, 25 bp, Mus musculus
atactgggcattgcctgttccacat

SEQ ID NO: 229681 - DNA, 25 bp, Mus musculus
atactgggccctattcagtggcagc

SEQ ID NO: 229682 - DNA, 25 bp, Mus musculus
atactgggcccttttcagtggcagc

SEQ ID NO: 229683 - DNA, 25 bp, Mus musculus
atactgggggatatcagcatcacca

SEQ ID NO: 229684 - DNA, 25 bp, Mus musculus
atactgggggatttcagcatcacca

SEQ ID NO: 229685 - DNA, 25 bp, Mus musculus
atactgggtataactatgggaacta

SEQ ID NO: 229686 - DNA, 25 bp, Mus musculus
atactgggtatatctatgggaacta

SEQ ID NO: 229687 - DNA, 25 bp, Mus musculus
atactgggtgctacatataggaact

SEQ ID NO: 229688 - DNA, 25 bp, Mus musculus
atactgggtgcttcatataggaact

SEQ ID NO: 229689 - DNA, 25 bp, Mus musculus
atactgggttttcatctgggtgaga

SEQ ID NO: 229690 - DNA, 25 bp, Mus musculus
atactgggttttgatctgggtgaga

SEQ ID NO: 229691 - DNA, 25 bp, Mus musculus
atactggtagcactcagctggcttg

SEQ ID NO: 229692 - DNA, 25 bp, Mus musculus
atactggtagcagtcagctggcttg

SEQ ID NO: 229693 - DNA, 25 bp, Mus musculus
atactggtccctctgtcaagacatc

SEQ ID NO: 229694 - DNA, 25 bp, Mus musculus
atactggtccctgtgtcaagacatc

SEQ ID NO: 229695 - DNA, 25 bp, Mus musculus
atactggtctgaacttttaatgcaa

SEQ ID NO: 229696 - DNA, 25 bp, Mus musculus
atactggtctgatcttttaatgcaa

SEQ ID NO: 229697 - DNA, 25 bp, Mus musculus
atactggtgtaacactggctgtcct

SEQ ID NO: 229698 - DNA, 25 bp, Mus musculus
atactggtgtaagactggctgtcct

SEQ ID NO: 229699 - DNA, 25 bp, Mus musculus
atactggttctgctaccaaactaaa

SEQ ID NO: 229700 - DNA, 25 bp, Mus musculus
atactggttctggtaccaaactaaa

SEQ ID NO: 229701 - DNA, 25 bp, Mus musculus
atactggttcttcttactgctggga

SEQ ID NO: 229702 - DNA, 25 bp, Mus musculus
atactggttcttgttactgctggga

SEQ ID NO: 229703 - DNA, 25 bp, Mus musculus
atactgtaactaaaccttaatgttg

SEQ ID NO: 229704 - DNA, 25 bp, Mus musculus
atactgtaactataccttaatgttg

SEQ ID NO: 229705 - DNA, 25 bp, Mus musculus
atactgtaatttcagcctttagata

SEQ ID NO: 229706 - DNA, 25 bp, Mus musculus
atactgtaatttgagcctttagata

SEQ ID NO: 229707 - DNA, 25 bp, Mus musculus
atactgtaccctatattttgcccat

SEQ ID NO: 229708 - DNA, 25 bp, Mus musculus
atactgtaccctttattttgcccat

SEQ ID NO: 229709 - DNA, 25 bp, Mus musculus
atactgtacttcctttctcctcaag

SEQ ID NO: 229710 - DNA, 25 bp, Mus musculus
atactgtacttcgtttctcctcaag

SEQ ID NO: 229711 - DNA, 25 bp, Mus musculus
atactgtactttcggcagggcaaac

SEQ ID NO: 229712 - DNA, 25 bp, Mus musculus
atactgtactttgggcagggcaaac

SEQ ID NO: 229713 - DNA, 25 bp, Mus musculus
atactgtataccatggattttgtac

SEQ ID NO: 229714 - DNA, 25 bp, Mus musculus
atactgtataccttggattttgtac

SEQ ID NO: 229715 - DNA, 25 bp, Mus musculus
atactgtatgctctttggctcttac

SEQ ID NO: 229716 - DNA, 25 bp, Mus musculus
atactgtatgctgtttggctcttac

SEQ ID NO: 229717 - DNA, 25 bp, Mus musculus
atactgtatttgctcccttctgact

SEQ ID NO: 229718 - DNA, 25 bp, Mus musculus
atactgtatttggtcccttctgact

SEQ ID NO: 229719 - DNA, 25 bp, Mus musculus
atactgtattttcacctctttctgc

SEQ ID NO: 229720 - DNA, 25 bp, Mus musculus
atactgtattttgacctctttctgc

SEQ ID NO: 229721 - DNA, 25 bp, Mus musculus
atactgtcaccaagttcttctttgc

SEQ ID NO: 229722 - DNA, 25 bp, Mus musculus
atactgtcaccatgttcttctttgc

SEQ ID NO: 229723 - DNA, 25 bp, Mus musculus
atactgtcatttattgattggctga

SEQ ID NO: 229724 - DNA, 25 bp, Mus musculus
atactgtcattttttgattggctga

SEQ ID NO: 229725 - DNA, 25 bp, Mus musculus
atactgtccagcatatctctccaat

SEQ ID NO: 229726 - DNA, 25 bp, Mus musculus
atactgtccagcttatctctccaat

SEQ ID NO: 229727 - DNA, 25 bp, Mus musculus
atactgtcccaaaatgctttccttc

SEQ ID NO: 229728 - DNA, 25 bp, Mus musculus
atactgtcccaatatgctttccttc

SEQ ID NO: 229729 - DNA, 25 bp, Mus musculus
atactgtccccacccagaggttagt

SEQ ID NO: 229730 - DNA, 25 bp, Mus musculus
atactgtccccagccagaggttagt

SEQ ID NO: 229731 - DNA, 25 bp, Mus musculus
atactgtcctcgatttctatgaacc

SEQ ID NO: 229732 - DNA, 25 bp, Mus musculus
atactgtcctcgttttctatgaacc

SEQ ID NO: 229733 - DNA, 25 bp, Mus musculus
atactgtcctgtctagaatcctaat

SEQ ID NO: 229734 - DNA, 25 bp, Mus musculus
atactgtcctgtgtagaatcctaat

SEQ ID NO: 229735 - DNA, 25 bp, Mus musculus
atactgtcgtatagttcattttacc

SEQ ID NO: 229736 - DNA, 25 bp, Mus musculus
atactgtcgtattgttcattttacc

SEQ ID NO: 229737 - DNA, 25 bp, Mus musculus
atactgtctaatcgcctttggtccc

SEQ ID NO: 229738 - DNA, 25 bp, Mus musculus
atactgtctaatggcctttggtccc

SEQ ID NO: 229739 - DNA, 25 bp, Mus musculus
atactgtctacgatccttcaagggt

SEQ ID NO: 229740 - DNA, 25 bp, Mus musculus
atactgtctacgttccttcaagggt

SEQ ID NO: 229741 - DNA, 25 bp, Mus musculus
atactgtctgtcctgtctatcggga

SEQ ID NO: 229742 - DNA, 25 bp, Mus musculus
atactgtctgtcgtgtctatcggga

SEQ ID NO: 229743 - DNA, 25 bp, Mus musculus
atactgtcttttagtggactctcgg

SEQ ID NO: 229744 - DNA, 25 bp, Mus musculus
atactgtctttttgtggactctcgg

SEQ ID NO: 229745 - DNA, 25 bp, Mus musculus
atactgtgaaacactgtgaactctt

SEQ ID NO: 229746 - DNA, 25 bp, Mus musculus
atactgtgaaactctgtgaactctt

SEQ ID NO: 229747 - DNA, 25 bp, Mus musculus
atactgtgaagccacactcctacag

SEQ ID NO: 229748 - DNA, 25 bp, Mus musculus
atactgtgaagcgacactcctacag

SEQ ID NO: 229749 - DNA, 25 bp, Mus musculus
atactgtgacttaggatcacgcccc

SEQ ID NO: 229750 - DNA, 25 bp, Mus musculus
atactgtgactttggatcacgcccc

SEQ ID NO: 229751 - DNA, 25 bp, Mus musculus
atactgtgccttatcaaattcatgt

SEQ ID NO: 229752 - DNA, 25 bp, Mus musculus
atactgtgccttttcaaattcatgt

SEQ ID NO: 229753 - DNA, 25 bp, Mus musculus
atactgtggccaatcctgaagcttc

SEQ ID NO: 229754 - DNA, 25 bp, Mus musculus
atactgtggccattcctgaagcttc

SEQ ID NO: 229755 - DNA, 25 bp, Mus musculus
atactgtggcctaattaccttactg

SEQ ID NO: 229756 - DNA, 25 bp, Mus musculus
atactgtggccttattaccttactg

SEQ ID NO: 229757 - DNA, 25 bp, Mus musculus
atactgtggcttagtggcgcacacc

SEQ ID NO: 229758 - DNA, 25 bp, Mus musculus
atactgtggctttgtggcgcacacc

SEQ ID NO: 229759 - DNA, 25 bp, Mus musculus
atactgtgggataaaagattcattg

SEQ ID NO: 229760 - DNA, 25 bp, Mus musculus
atactgtgggattaaagattcattg

SEQ ID NO: 229761 - DNA, 25 bp, Mus musculus
atactgtggtttagacccattcaga

SEQ ID NO: 229762 - DNA, 25 bp, Mus musculus
atactgtggtttctccctttatgaa

SEQ ID NO: 229763 - DNA, 25 bp, Mus musculus
atactgtggtttgtccctttatgaa

SEQ ID NO: 229764 - DNA, 25 bp, Mus musculus
atactgtggttttgacccattcaga

SEQ ID NO: 229765 - DNA, 25 bp, Mus musculus
atactgtgtatgatgctgcactctt

SEQ ID NO: 229766 - DNA, 25 bp, Mus musculus
atactgtgtatgttgctgcactctt

SEQ ID NO: 229767 - DNA, 25 bp, Mus musculus
atactgtgtcctatagtccacctca

SEQ ID NO: 229768 - DNA, 25 bp, Mus musculus
atactgtgtcctttagtccacctca

SEQ ID NO: 229769 - DNA, 25 bp, Mus musculus
atactgtgtctcctcttactgggaa

SEQ ID NO: 229770 - DNA, 25 bp, Mus musculus
atactgtgtctcgtcttactgggaa

SEQ ID NO: 229771 - DNA, 25 bp, Mus musculus
atactgtgtgcgacgtggagagatt

SEQ ID NO: 229772 - DNA, 25 bp, Mus musculus
atactgtgtgcgtcgtggagagatt

SEQ ID NO: 229773 - DNA, 25 bp, Mus musculus
atactgttaacaagaccctagttgc

SEQ ID NO: 229774 - DNA, 25 bp, Mus musculus
atactgttaacatgaccctagttgc

SEQ ID NO: 229775 - DNA, 25 bp, Mus musculus
atactgttaagaagtagttgctgac

SEQ ID NO: 229776 - DNA, 25 bp, Mus musculus
atactgttaagatgtagttgctgac

SEQ ID NO: 229777 - DNA, 25 bp, Mus musculus
atactgttagagagatattgttttc

SEQ ID NO: 229778 - DNA, 25 bp, Mus musculus
atactgttagagtgatattgttttc

SEQ ID NO: 229779 - DNA, 25 bp, Mus musculus
atactgttagctccttcagtcacac

SEQ ID NO: 229780 - DNA, 25 bp, Mus musculus
atactgttagctgcttcagtcacac

SEQ ID NO: 229781 - DNA, 25 bp, Mus musculus
atactgttccaactcttcccagaaa

SEQ ID NO: 229782 - DNA, 25 bp, Mus musculus
atactgttccaagtcttcccagaaa

SEQ ID NO: 229783 - DNA, 25 bp, Mus musculus
atactgttctctcccaaaggcctgt

SEQ ID NO: 229784 - DNA, 25 bp, Mus musculus
atactgttctctgccaaaggcctgt

SEQ ID NO: 229785 - DNA, 25 bp, Mus musculus
atactgttcttcaatattcccacct

SEQ ID NO: 229786 - DNA, 25 bp, Mus musculus
atactgttcttctatattcccacct

SEQ ID NO: 229787 - DNA, 25 bp, Mus musculus
atactgttgtacatgggtcatcttt

SEQ ID NO: 229788 - DNA, 25 bp, Mus musculus
atactgttgtacttgggtcatcttt

SEQ ID NO: 229789 - DNA, 25 bp, Mus musculus
atactgtttgttcaagatcctgtct

SEQ ID NO: 229790 - DNA, 25 bp, Mus musculus
atactgtttgttgaagatcctgtct

SEQ ID NO: 229791 - DNA, 25 bp, Mus musculus
atactgttttagaaagcgctggaaa

SEQ ID NO: 229792 - DNA, 25 bp, Mus musculus
atactgttttagtaagcgctggaaa

SEQ ID NO: 229793 - DNA, 25 bp, Mus musculus
atactgttttataacaaagccaggg

SEQ ID NO: 229794 - DNA, 25 bp, Mus musculus
atactgttttattacaaagccaggg

SEQ ID NO: 229795 - DNA, 25 bp, Mus musculus
atactgttttgacggctcaggctcc

SEQ ID NO: 229796 - DNA, 25 bp, Mus musculus
atactgttttgagggctcaggctcc

SEQ ID NO: 229797 - DNA, 25 bp, Mus musculus
atactgttttgtaagccaggcttcc

SEQ ID NO: 229798 - DNA, 25 bp, Mus musculus
atactgttttgttagccaggcttcc

SEQ ID NO: 229799 - DNA, 25 bp, Mus musculus
atacttaaatagcagcatggcagct

SEQ ID NO: 229800 - DNA, 25 bp, Mus musculus
atacttaaataggagcatggcagct

SEQ ID NO: 229801 - DNA, 25 bp, Mus musculus
atacttaaattaagctctatgtggg

SEQ ID NO: 229802 - DNA, 25 bp, Mus musculus
atacttaaattatgctctatgtggg

SEQ ID NO: 229803 - DNA, 25 bp, Mus musculus
atacttaacttcaagttgcgctcgc

SEQ ID NO: 229804 - DNA, 25 bp, Mus musculus
atacttaacttctagttgcgctcgc

SEQ ID NO: 229805 - DNA, 25 bp, Mus musculus
atacttaattatatgtcccggacat

SEQ ID NO: 229806 - DNA, 25 bp, Mus musculus
atacttaattatttgtcccggacat

SEQ ID NO: 229807 - DNA, 25 bp, Mus musculus
atacttaattctactctgctcctgt

SEQ ID NO: 229808 - DNA, 25 bp, Mus musculus
atacttaattcttctctgctcctgt

SEQ ID NO: 229809 - DNA, 25 bp, Mus musculus
atacttacaaacatttgcttatagt

SEQ ID NO: 229810 - DNA, 25 bp, Mus musculus
atacttacaaacttttgcttatagt

SEQ ID NO: 229811 - DNA, 25 bp, Mus musculus
atacttaccatacatatacccttcc

SEQ ID NO: 229812 - DNA, 25 bp, Mus musculus
atacttaccatagatatacccttcc

SEQ ID NO: 229813 - DNA, 25 bp, Mus musculus
atacttacctacattcatttcatga

SEQ ID NO: 229814 - DNA, 25 bp, Mus musculus
atacttacctactttcatttcatga

SEQ ID NO: 229815 - DNA, 25 bp, Mus musculus
atacttacctgtaatctctaccaaa

SEQ ID NO: 229816 - DNA, 25 bp, Mus musculus
atacttacctgttatctctaccaaa

SEQ ID NO: 229817 - DNA, 25 bp, Mus musculus
atacttacgaaaacactcctctcat

SEQ ID NO: 229818 - DNA, 25 bp, Mus musculus
atacttacgaaatcactcctctcat

SEQ ID NO: 229819 - DNA, 25 bp, Mus musculus
atacttactaacaacagagatactg

SEQ ID NO: 229820 - DNA, 25 bp, Mus musculus
atacttactaactacagagatactg

SEQ ID NO: 229821 - DNA, 25 bp, Mus musculus
atacttactgcacgacggtacccga

SEQ ID NO: 229822 - DNA, 25 bp, Mus musculus
atacttactgcaggacggtacccga

SEQ ID NO: 229823 - DNA, 25 bp, Mus musculus
atacttacttcgaaccatgggacaa

SEQ ID NO: 229824 - DNA, 25 bp, Mus musculus
atacttacttcgtaccatgggacaa

SEQ ID NO: 229825 - DNA, 25 bp, Mus musculus
atacttagaatgatacagggtgagt

SEQ ID NO: 229826 - DNA, 25 bp, Mus musculus
atacttagaatgttacagggtgagt

SEQ ID NO: 229827 - DNA, 25 bp, Mus musculus
atacttagagatatgttgccttttg

SEQ ID NO: 229828 - DNA, 25 bp, Mus musculus
atacttagagatttgttgccttttg

SEQ ID NO: 229829 - DNA, 25 bp, Mus musculus
atacttagatgcacacagtactttg

SEQ ID NO: 229830 - DNA, 25 bp, Mus musculus
atacttagatgctcacagtactttg

SEQ ID NO: 229831 - DNA, 25 bp, Mus musculus
atacttagcaatcctgggtcgacct

SEQ ID NO: 229832 - DNA, 25 bp, Mus musculus
atacttagcaatgctgggtcgacct

SEQ ID NO: 229833 - DNA, 25 bp, Mus musculus
atacttagcttaatccacttcatgg

SEQ ID NO: 229834 - DNA, 25 bp, Mus musculus
atacttagcttattccacttcatgg

SEQ ID NO: 229835 - DNA, 25 bp, Mus musculus
atacttagcttgaatactcttctgt

SEQ ID NO: 229836 - DNA, 25 bp, Mus musculus
atacttagcttgtatactcttctgt

SEQ ID NO: 229837 - DNA, 25 bp, Mus musculus
atacttaggccccagtgatcagcca

SEQ ID NO: 229838 - DNA, 25 bp, Mus musculus
atacttaggcccgagtgatcagcca

SEQ ID NO: 229839 - DNA, 25 bp, Mus musculus
atacttaggttgactcattgtgtaa

SEQ ID NO: 229840 - DNA, 25 bp, Mus musculus
atacttaggttgtctcattgtgtaa

SEQ ID NO: 229841 - DNA, 25 bp, Mus musculus
atacttatatacatgactagctcta

SEQ ID NO: 229842 - DNA, 25 bp, Mus musculus
atacttatatacttgactagctcta

SEQ ID NO: 229843 - DNA, 25 bp, Mus musculus
atacttatcccaagttagtggcgcc

SEQ ID NO: 229844 - DNA, 25 bp, Mus musculus
atacttatcccatgttagtggcgcc

SEQ ID NO: 229845 - DNA, 25 bp, Mus musculus
atacttatcctacactggctcttcc

SEQ ID NO: 229846 - DNA, 25 bp, Mus musculus
atacttatcctagactggctcttcc

SEQ ID NO: 229847 - DNA, 25 bp, Mus musculus
atacttatcttccagtacagcgccg

SEQ ID NO: 229848 - DNA, 25 bp, Mus musculus
atacttatcttcgagtacagcgccg

SEQ ID NO: 229849 - DNA, 25 bp, Mus musculus
atacttatgatcatgggaaccctgg

SEQ ID NO: 229850 - DNA, 25 bp, Mus musculus
atacttatgatcttgggaaccctgg

SEQ ID NO: 229851 - DNA, 25 bp, Mus musculus
atacttatggctatatgagggctct

SEQ ID NO: 229852 - DNA, 25 bp, Mus musculus
atacttatggctttatgagggctct

SEQ ID NO: 229853 - DNA, 25 bp, Mus musculus
atacttattcctccatgggaatctc

SEQ ID NO: 229854 - DNA, 25 bp, Mus musculus
atacttattcctgcatgggaatctc

SEQ ID NO: 229855 - DNA, 25 bp, Mus musculus
atacttcaacagagcatcttcagcc

SEQ ID NO: 229856 - DNA, 25 bp, Mus musculus
atacttcaacagtgcatcttcagcc

SEQ ID NO: 229857 - DNA, 25 bp, Mus musculus
atacttcacatacagtgcccacttg

SEQ ID NO: 229858 - DNA, 25 bp, Mus musculus
atacttcacatagagtgcccacttg

SEQ ID NO: 229859 - DNA, 25 bp, Mus musculus
atacttcactacaggatgctcacac

SEQ ID NO: 229860 - DNA, 25 bp, Mus musculus
atacttcactactggatgctcacac

SEQ ID NO: 229861 - DNA, 25 bp, Mus musculus
atacttcactatattggcccatctg

SEQ ID NO: 229862 - DNA, 25 bp, Mus musculus
atacttcactattttggcccatctg

SEQ ID NO: 229863 - DNA, 25 bp, Mus musculus
atacttcacttacaatgttccttgg

SEQ ID NO: 229864 - DNA, 25 bp, Mus musculus
atacttcacttagaatgttccttgg

SEQ ID NO: 229865 - DNA, 25 bp, Mus musculus
atacttcagcctcaatgtctctata

SEQ ID NO: 229866 - DNA, 25 bp, Mus musculus
atacttcagcctgaatgtctctata

SEQ ID NO: 229867 - DNA, 25 bp, Mus musculus
atacttcaggacacatcttctggaa

SEQ ID NO: 229868 - DNA, 25 bp, Mus musculus
atacttcaggactcatcttctggaa

SEQ ID NO: 229869 - DNA, 25 bp, Mus musculus
atacttcagggcatgacttttgtac

SEQ ID NO: 229870 - DNA, 25 bp, Mus musculus
atacttcagggcttgacttttgtac

SEQ ID NO: 229871 - DNA, 25 bp, Mus musculus
atacttcagtgcctgtgtgtccatg

SEQ ID NO: 229872 - DNA, 25 bp, Mus musculus
atacttcagtgcgtgtgtgtccatg

SEQ ID NO: 229873 - DNA, 25 bp, Mus musculus
atacttcatactactcagaggtgcg

SEQ ID NO: 229874 - DNA, 25 bp, Mus musculus
atacttcatacttctcagaggtgcg

SEQ ID NO: 229875 - DNA, 25 bp, Mus musculus
atacttcatcccaagttggtagaac

SEQ ID NO: 229876 - DNA, 25 bp, Mus musculus
atacttcatccctagttggtagaac

SEQ ID NO: 229877 - DNA, 25 bp, Mus musculus
atacttcatgatacccagagtccct

SEQ ID NO: 229878 - DNA, 25 bp, Mus musculus
atacttcatgattcccagagtccct

SEQ ID NO: 229879 - DNA, 25 bp, Mus musculus
atacttcattctatggcctgcctgc

SEQ ID NO: 229880 - DNA, 25 bp, Mus musculus
atacttcattctttggcctgcctgc

SEQ ID NO: 229881 - DNA, 25 bp, Mus musculus
atacttccaaataattccttcctca

SEQ ID NO: 229882 - DNA, 25 bp, Mus musculus
atacttccaaattattccttcctca

SEQ ID NO: 229883 - DNA, 25 bp, Mus musculus
atacttccagctatactgaccaagt

SEQ ID NO: 229884 - DNA, 25 bp, Mus musculus
atacttccagctttactgaccaagt

SEQ ID NO: 229885 - DNA, 25 bp, Mus musculus
atacttccaggcattggatgatttt

SEQ ID NO: 229886 - DNA, 25 bp, Mus musculus
atacttccaggctttggatgatttt

SEQ ID NO: 229887 - DNA, 25 bp, Mus musculus
atacttccccacaaaacatgctgat

SEQ ID NO: 229888 - DNA, 25 bp, Mus musculus
atacttccccactaaacatgctgat

SEQ ID NO: 229889 - DNA, 25 bp, Mus musculus
atacttcccgagcacctatgactat

SEQ ID NO: 229890 - DNA, 25 bp, Mus musculus
atacttcccgaggacctatgactat

SEQ ID NO: 229891 - DNA, 25 bp, Mus musculus
atacttccctggctttgactggttc

SEQ ID NO: 229892 - DNA, 25 bp, Mus musculus
atacttccctgggtttgactggttc

SEQ ID NO: 229893 - DNA, 25 bp, Mus musculus
atacttcctcccaaacagcagggtg

SEQ ID NO: 229894 - DNA, 25 bp, Mus musculus
atacttcctccctaacagcagggtg

SEQ ID NO: 229895 - DNA, 25 bp, Mus musculus
atacttcctgtgactcattttggac

SEQ ID NO: 229896 - DNA, 25 bp, Mus musculus
atacttcctgtgtctcattttggac

SEQ ID NO: 229897 - DNA, 25 bp, Mus musculus
atacttcgaggcctccctgaagatc

SEQ ID NO: 229898 - DNA, 25 bp, Mus musculus
atacttcgaggcgtccctgaagatc

SEQ ID NO: 229899 - DNA, 25 bp, Mus musculus
atacttcgctgcagtgatactatgc

SEQ ID NO: 229900 - DNA, 25 bp, Mus musculus
atacttcgctgctgtgatactatgc

SEQ ID NO: 229901 - DNA, 25 bp, Mus musculus
atacttcgtagacagtgtggctcca

SEQ ID NO: 229902 - DNA, 25 bp, Mus musculus
atacttcgtagagagtgtggctcca

SEQ ID NO: 229903 - DNA, 25 bp, Mus musculus
atacttctagctcttgtgttataaa

SEQ ID NO: 229904 - DNA, 25 bp, Mus musculus
atacttctagctgttgtgttataaa

SEQ ID NO: 229905 - DNA, 25 bp, Mus musculus
atacttctaggacattattgaccac

SEQ ID NO: 229906 - DNA, 25 bp, Mus musculus
atacttctaggagattattgaccac

SEQ ID NO: 229907 - DNA, 25 bp, Mus musculus
atacttctcaaaaacactctcttcc

SEQ ID NO: 229908 - DNA, 25 bp, Mus musculus
atacttctcaaatacactctcttcc

SEQ ID NO: 229909 - DNA, 25 bp, Mus musculus
atacttctcaggacactggttctta

SEQ ID NO: 229910 - DNA, 25 bp, Mus musculus
atacttctcaggtcactggttctta

SEQ ID NO: 229911 - DNA, 25 bp, Mus musculus
atacttctcgttcattaaattgttt

SEQ ID NO: 229912 - DNA, 25 bp, Mus musculus
atacttctcgttgattaaattgttt

SEQ ID NO: 229913 - DNA, 25 bp, Mus musculus
atacttctctatacctgccatttac

SEQ ID NO: 229914 - DNA, 25 bp, Mus musculus
atacttctctattcctgccatttac

SEQ ID NO: 229915 - DNA, 25 bp, Mus musculus
atacttctctccatatttccgaaat

SEQ ID NO: 229916 - DNA, 25 bp, Mus musculus
atacttctctccttatttccgaaat

SEQ ID NO: 229917 - DNA, 25 bp, Mus musculus
atacttctgatgactcttttctccc

SEQ ID NO: 229918 - DNA, 25 bp, Mus musculus
atacttctgatgtctcttttctccc

SEQ ID NO: 229919 - DNA, 25 bp, Mus musculus
atacttctgcagaggatcgacagct

SEQ ID NO: 229920 - DNA, 25 bp, Mus musculus
atacttctgcagtggatcgacagct

SEQ ID NO: 229921 - DNA, 25 bp, Mus musculus
atacttctgctccaaggtcatggtg

SEQ ID NO: 229922 - DNA, 25 bp, Mus musculus
atacttctgctcgaaggtcatggtg

SEQ ID NO: 229923 - DNA, 25 bp, Mus musculus
atacttctgcttatagggctaattg

SEQ ID NO: 229924 - DNA, 25 bp, Mus musculus
atacttctgcttttagggctaattg

SEQ ID NO: 229925 - DNA, 25 bp, Mus musculus
atacttctgtcaaagtgcctgtctg

SEQ ID NO: 229926 - DNA, 25 bp, Mus musculus
atacttctgtcaagctcattttaaa

SEQ ID NO: 229927 - DNA, 25 bp, Mus musculus
atacttctgtcatagtgcctgtctg

SEQ ID NO: 229928 - DNA, 25 bp, Mus musculus
atacttctgtcatgctcattttaaa

SEQ ID NO: 229929 - DNA, 25 bp, Mus musculus
atacttctgtgaacctttctcttct

SEQ ID NO: 229930 - DNA, 25 bp, Mus musculus
atacttctgtgatcctttctcttct

SEQ ID NO: 229931 - DNA, 25 bp, Mus musculus
atacttctgtgcaacaggccagcgt

SEQ ID NO: 229932 - DNA, 25 bp, Mus musculus
atacttctgtgctacaggccagcgt

SEQ ID NO: 229933 - DNA, 25 bp, Mus musculus
atacttctgtttcctttgttcaggg

SEQ ID NO: 229934 - DNA, 25 bp, Mus musculus
atacttctgtttgctttgttcaggg

SEQ ID NO: 229935 - DNA, 25 bp, Mus musculus
atacttcttgccaactttattgggt

SEQ ID NO: 229936 - DNA, 25 bp, Mus musculus
atacttcttgcctactttattgggt

SEQ ID NO: 229937 - DNA, 25 bp, Mus musculus
atacttcttgctcatcatgcgttgt

SEQ ID NO: 229938 - DNA, 25 bp, Mus musculus
atacttcttgctgatcatgcgttgt

SEQ ID NO: 229939 - DNA, 25 bp, Mus musculus
atacttcttgtaatctgctatccca

SEQ ID NO: 229940 - DNA, 25 bp, Mus musculus
atacttcttgtattctgctatccca

SEQ ID NO: 229941 - DNA, 25 bp, Mus musculus
atacttctttaaattattgaacata

SEQ ID NO: 229942 - DNA, 25 bp, Mus musculus
atacttctttaatttattgaacata

SEQ ID NO: 229943 - DNA, 25 bp, Mus musculus
atacttgaaactagaatgcttaatg

SEQ ID NO: 229944 - DNA, 25 bp, Mus musculus
atacttgaaacttgaatgcttaatg

SEQ ID NO: 229945 - DNA, 25 bp, Mus musculus
atacttgaacccagcaccctttggc

SEQ ID NO: 229946 - DNA, 25 bp, Mus musculus
atacttgaaccctgcaccctttggc

SEQ ID NO: 229947 - DNA, 25 bp, Mus musculus
atacttgaagacagaatgcctgaca

SEQ ID NO: 229948 - DNA, 25 bp, Mus musculus
atacttgaagactgaatgcctgaca

SEQ ID NO: 229949 - DNA, 25 bp, Mus musculus
atacttgaattccagttgttatcaa

SEQ ID NO: 229950 - DNA, 25 bp, Mus musculus
atacttgaattcgagttgttatcaa

SEQ ID NO: 229951 - DNA, 25 bp, Mus musculus
atacttgactttcgcactgccacag

SEQ ID NO: 229952 - DNA, 25 bp, Mus musculus
atacttgactttggcactgccacag

SEQ ID NO: 229953 - DNA, 25 bp, Mus musculus
atacttgagcccactgatactctct

SEQ ID NO: 229954 - DNA, 25 bp, Mus musculus
atacttgagccctctgatactctct

SEQ ID NO: 229955 - DNA, 25 bp, Mus musculus
atacttgatatcagttctgagacaa

SEQ ID NO: 229956 - DNA, 25 bp, Mus musculus
atacttgatatctgttctgagacaa

SEQ ID NO: 229957 - DNA, 25 bp, Mus musculus
atacttgatggcatcttcacacgtg

SEQ ID NO: 229958 - DNA, 25 bp, Mus musculus
atacttgatggcttcttcacacgtg

SEQ ID NO: 229959 - DNA, 25 bp, Mus musculus
atacttgattgcacccagttgatgg

SEQ ID NO: 229960 - DNA, 25 bp, Mus musculus
atacttgattgctcccagttgatgg

SEQ ID NO: 229961 - DNA, 25 bp, Mus musculus
atacttgcacaaactgagacattca

SEQ ID NO: 229962 - DNA, 25 bp, Mus musculus
atacttgcacaatctgagacattca

SEQ ID NO: 229963 - DNA, 25 bp, Mus musculus
atacttgcacacacgtgctcgtata

SEQ ID NO: 229964 - DNA, 25 bp, Mus musculus
atacttgcacactcgtgctcgtata

SEQ ID NO: 229965 - DNA, 25 bp, Mus musculus
atacttgcacatccatgggctgcta

SEQ ID NO: 229966 - DNA, 25 bp, Mus musculus
atacttgcacatgcatgggctgcta

SEQ ID NO: 229967 - DNA, 25 bp, Mus musculus
atacttgcaggtctggcaggtcctt

SEQ ID NO: 229968 - DNA, 25 bp, Mus musculus
atacttgcaggtgtggcaggtcctt

SEQ ID NO: 229969 - DNA, 25 bp, Mus musculus
atacttgcagttaaaggcttgctcc

SEQ ID NO: 229970 - DNA, 25 bp, Mus musculus
atacttgcagtttaaggcttgctcc

SEQ ID NO: 229971 - DNA, 25 bp, Mus musculus
atacttgcatgaactccgtgggaac

SEQ ID NO: 229972 - DNA, 25 bp, Mus musculus
atacttgcatgatctccgtgggaac

SEQ ID NO: 229973 - DNA, 25 bp, Mus musculus
atacttgccatgcatgtaacctaaa

SEQ ID NO: 229974 - DNA, 25 bp, Mus musculus
atacttgccatgctgaagaacattt

SEQ ID NO: 229975 - DNA, 25 bp, Mus musculus
atacttgccatggatgtaacctaaa

SEQ ID NO: 229976 - DNA, 25 bp, Mus musculus
atacttgccatggtgaagaacattt

SEQ ID NO: 229977 - DNA, 25 bp, Mus musculus
atacttgccgtccttctattgaaga

SEQ ID NO: 229978 - DNA, 25 bp, Mus musculus
atacttgccgtcgttctattgaaga

SEQ ID NO: 229979 - DNA, 25 bp, Mus musculus
atacttgcctagcaggtcctggttt

SEQ ID NO: 229980 - DNA, 25 bp, Mus musculus
atacttgcctaggaggtcctggttt

SEQ ID NO: 229981 - DNA, 25 bp, Mus musculus
atacttgcctctaacacgtttttct

SEQ ID NO: 229982 - DNA, 25 bp, Mus musculus
atacttgcctcttacacgtttttct

SEQ ID NO: 229983 - DNA, 25 bp, Mus musculus
atacttgctcagatggacctttgtc

SEQ ID NO: 229984 - DNA, 25 bp, Mus musculus
atacttgctcagttggacctttgtc

SEQ ID NO: 229985 - DNA, 25 bp, Mus musculus
atacttgctgctctttctaaaaacc

SEQ ID NO: 229986 - DNA, 25 bp, Mus musculus
atacttgctgctgtttctaaaaacc

SEQ ID NO: 229987 - DNA, 25 bp, Mus musculus
atacttgctgtaaagatgctgagga

SEQ ID NO: 229988 - DNA, 25 bp, Mus musculus
atacttgctgtatagatgctgagga

SEQ ID NO: 229989 - DNA, 25 bp, Mus musculus
atacttggaagtcagcatggctagg

SEQ ID NO: 229990 - DNA, 25 bp, Mus musculus
atacttggaagtgagcatggctagg

SEQ ID NO: 229991 - DNA, 25 bp, Mus musculus
atacttggaatcaatctgatcaatg

SEQ ID NO: 229992 - DNA, 25 bp, Mus musculus
atacttggaatctatctgatcaatg

SEQ ID NO: 229993 - DNA, 25 bp, Mus musculus
atacttggactgattttctttcctc

SEQ ID NO: 229994 - DNA, 25 bp, Mus musculus
atacttggactgtttttctttcctc

SEQ ID NO: 229995 - DNA, 25 bp, Mus musculus
atacttggatgaagcttttctttgt

SEQ ID NO: 229996 - DNA, 25 bp, Mus musculus
atacttggatgatgcttttctttgt

SEQ ID NO: 229997 - DNA, 25 bp, Mus musculus
atacttggctaccagcttgtttgca

SEQ ID NO: 229998 - DNA, 25 bp, Mus musculus
atacttggctacgagcttgtttgca

SEQ ID NO: 229999 - DNA, 25 bp, Mus musculus
atacttgggtggagctcaggaccct

SEQ ID NO: 230000 - DNA, 25 bp, Mus musculus
atacttgggtggtgctcaggaccct

SEQ ID NO: 230001 - DNA, 25 bp, Mus musculus
atacttggtatgattcaggaagatt

SEQ ID NO: 230002 - DNA, 25 bp, Mus musculus
atacttggtatgtttcaggaagatt

SEQ ID NO: 230003 - DNA, 25 bp, Mus musculus
atacttgtagatcttcagttctgct

SEQ ID NO: 230004 - DNA, 25 bp, Mus musculus
atacttgtagatgttcagttctgct

SEQ ID NO: 230005 - DNA, 25 bp, Mus musculus
atacttgtaggtccgggtgatcctc

SEQ ID NO: 230006 - DNA, 25 bp, Mus musculus
atacttgtaggtgcgggtgatcctc

SEQ ID NO: 230007 - DNA, 25 bp, Mus musculus
atacttgtatggatgggttaccaca

SEQ ID NO: 230008 - DNA, 25 bp, Mus musculus
atacttgtatggttgggttaccaca

SEQ ID NO: 230009 - DNA, 25 bp, Mus musculus
atacttgtcaatctctagccatgat

SEQ ID NO: 230010 - DNA, 25 bp, Mus musculus
atacttgtcaatgtctagccatgat

SEQ ID NO: 230011 - DNA, 25 bp, Mus musculus
atacttgtccacaatcttaggtaag

SEQ ID NO: 230012 - DNA, 25 bp, Mus musculus
atacttgtccactatcttaggtaag

SEQ ID NO: 230013 - DNA, 25 bp, Mus musculus
atacttgtgaaaacaatttcctttt

SEQ ID NO: 230014 - DNA, 25 bp, Mus musculus
atacttgtgaaatcaatttcctttt

SEQ ID NO: 230015 - DNA, 25 bp, Mus musculus
atacttgtgagaattctgcttaaca

SEQ ID NO: 230016 - DNA, 25 bp, Mus musculus
atacttgtgagatttctgcttaaca

SEQ ID NO: 230017 - DNA, 25 bp, Mus musculus
atacttgtgagtaaccagcttcagt

SEQ ID NO: 230018 - DNA, 25 bp, Mus musculus
atacttgtgagttaccagcttcagt

SEQ ID NO: 230019 - DNA, 25 bp, Mus musculus
atacttgtgcagcacttctatccag

SEQ ID NO: 230020 - DNA, 25 bp, Mus musculus
atacttgtgcaggacttctatccag

SEQ ID NO: 230021 - DNA, 25 bp, Mus musculus
atacttgtgcatagtgcttcatttc

SEQ ID NO: 230022 - DNA, 25 bp, Mus musculus
atacttgtgcattgtgcttcatttc

SEQ ID NO: 230023 - DNA, 25 bp, Mus musculus
atacttgtgcttcaaccagtctaaa

SEQ ID NO: 230024 - DNA, 25 bp, Mus musculus
atacttgtgcttgaaccagtctaaa

SEQ ID NO: 230025 - DNA, 25 bp, Mus musculus
atacttgtggacacagtgagttcca

SEQ ID NO: 230026 - DNA, 25 bp, Mus musculus
atacttgtggactcagtgagttcca

SEQ ID NO: 230027 - DNA, 25 bp, Mus musculus
atacttgtgtgcaagcttctgttat

SEQ ID NO: 230028 - DNA, 25 bp, Mus musculus
atacttgtgtgctagcttctgttat

SEQ ID NO: 230029 - DNA, 25 bp, Mus musculus
atacttgttcacctgattaactgaa

SEQ ID NO: 230030 - DNA, 25 bp, Mus musculus
atacttgttcacgtgattaactgaa

SEQ ID NO: 230031 - DNA, 25 bp, Mus musculus
atacttgttcctaaatgaaaaccag

SEQ ID NO: 230032 - DNA, 25 bp, Mus musculus
atacttgttccttaatgaaaaccag

SEQ ID NO: 230033 - DNA, 25 bp, Mus musculus
atactttaatttctgctgttggctg

SEQ ID NO: 230034 - DNA, 25 bp, Mus musculus
atactttaatttgtgctgttggctg

SEQ ID NO: 230035 - DNA, 25 bp, Mus musculus
atactttaccgtatctggcatccag

SEQ ID NO: 230036 - DNA, 25 bp, Mus musculus
atactttaccgtttctggcatccag

SEQ ID NO: 230037 - DNA, 25 bp, Mus musculus
atactttaccttcaacgctctagtg

SEQ ID NO: 230038 - DNA, 25 bp, Mus musculus
atactttaccttgaacgctctagtg

SEQ ID NO: 230039 - DNA, 25 bp, Mus musculus
atactttactctcatgctgctgtgc

SEQ ID NO: 230040 - DNA, 25 bp, Mus musculus
atactttactctgatgctgctgtgc

SEQ ID NO: 230041 - DNA, 25 bp, Mus musculus
atactttagctaacattccgtgtag

SEQ ID NO: 230042 - DNA, 25 bp, Mus musculus
atactttagctatcattccgtgtag

SEQ ID NO: 230043 - DNA, 25 bp, Mus musculus
atactttaggcaaaccttatttagt

SEQ ID NO: 230044 - DNA, 25 bp, Mus musculus
atactttaggcataccttatttagt

SEQ ID NO: 230045 - DNA, 25 bp, Mus musculus
atactttatctgaagttgctctgat

SEQ ID NO: 230046 - DNA, 25 bp, Mus musculus
atactttatctgtagttgctctgat

SEQ ID NO: 230047 - DNA, 25 bp, Mus musculus
atactttatcttctgtgggctttcg

SEQ ID NO: 230048 - DNA, 25 bp, Mus musculus
atactttatcttgtgtgggctttcg

SEQ ID NO: 230049 - DNA, 25 bp, Mus musculus
atactttattgtagtcagctgcatg

SEQ ID NO: 230050 - DNA, 25 bp, Mus musculus
atactttattgttgtcagctgcatg

SEQ ID NO: 230051 - DNA, 25 bp, Mus musculus
atactttcaaagatctcacaaggga

SEQ ID NO: 230052 - DNA, 25 bp, Mus musculus
atactttcaaagttctcacaaggga

SEQ ID NO: 230053 - DNA, 25 bp, Mus musculus
atactttcagcaaatgtccggcctg

SEQ ID NO: 230054 - DNA, 25 bp, Mus musculus
atactttcagcatatgtccggcctg

SEQ ID NO: 230055 - DNA, 25 bp, Mus musculus
atactttcatagcatcttaccgaat

SEQ ID NO: 230056 - DNA, 25 bp, Mus musculus
atactttcataggatcttaccgaat

SEQ ID NO: 230057 - DNA, 25 bp, Mus musculus
atactttcatgtattccttcttagg

SEQ ID NO: 230058 - DNA, 25 bp, Mus musculus
atactttcatgttttccttcttagg

SEQ ID NO: 230059 - DNA, 25 bp, Mus musculus
atactttcattcagtccaaggaggg

SEQ ID NO: 230060 - DNA, 25 bp, Mus musculus
atactttcattctgtccaaggaggg

SEQ ID NO: 230061 - DNA, 25 bp, Mus musculus
atactttcccatcatattcacccag

SEQ ID NO: 230062 - DNA, 25 bp, Mus musculus
atactttcccatgatattcacccag

SEQ ID NO: 230063 - DNA, 25 bp, Mus musculus
atactttccctaaggagtgctgtaa

SEQ ID NO: 230064 - DNA, 25 bp, Mus musculus
atactttccctatggagtgctgtaa

SEQ ID NO: 230065 - DNA, 25 bp, Mus musculus
atactttcctacaaagatctccttc

SEQ ID NO: 230066 - DNA, 25 bp, Mus musculus
atactttcctactaagatctccttc

SEQ ID NO: 230067 - DNA, 25 bp, Mus musculus
atactttcctccaaatgaatataaa

SEQ ID NO: 230068 - DNA, 25 bp, Mus musculus
atactttcctcctaatgaatataaa

SEQ ID NO: 230069 - DNA, 25 bp, Mus musculus
atactttcgatcctgactgggtggc

SEQ ID NO: 230070 - DNA, 25 bp, Mus musculus
atactttcgatcgtgactgggtggc

SEQ ID NO: 230071 - DNA, 25 bp, Mus musculus
atactttcggttaaatctcaatttg

SEQ ID NO: 230072 - DNA, 25 bp, Mus musculus
atactttcggtttaatctcaatttg

SEQ ID NO: 230073 - DNA, 25 bp, Mus musculus
atactttctagaactttcagtccag

SEQ ID NO: 230074 - DNA, 25 bp, Mus musculus
atactttctagatctttcagtccag

SEQ ID NO: 230075 - DNA, 25 bp, Mus musculus
atactttctcatatgatctgccctc

SEQ ID NO: 230076 - DNA, 25 bp, Mus musculus
atactttctcatttgatctgccctc

SEQ ID NO: 230077 - DNA, 25 bp, Mus musculus
atactttctcctcggacgagtccaa

SEQ ID NO: 230078 - DNA, 25 bp, Mus musculus
atactttctcctgggacgagtccaa

SEQ ID NO: 230079 - DNA, 25 bp, Mus musculus
atactttctctaaggaagaacctag

SEQ ID NO: 230080 - DNA, 25 bp, Mus musculus
atactttctctatggaagaacctag

SEQ ID NO: 230081 - DNA, 25 bp, Mus musculus
atactttctgacactttgctagaaa

SEQ ID NO: 230082 - DNA, 25 bp, Mus musculus
atactttctgactctttgctagaaa

SEQ ID NO: 230083 - DNA, 25 bp, Mus musculus
atactttcttatagatctgtgagag

SEQ ID NO: 230084 - DNA, 25 bp, Mus musculus
atactttcttattgatctgtgagag

SEQ ID NO: 230085 - DNA, 25 bp, Mus musculus
atactttgagggatcgcagattttc

SEQ ID NO: 230086 - DNA, 25 bp, Mus musculus
atactttgagggttcgcagattttc

SEQ ID NO: 230087 - DNA, 25 bp, Mus musculus
atactttgattgacacagtggtgca

SEQ ID NO: 230088 - DNA, 25 bp, Mus musculus
atactttgattgtcacagtggtgca

SEQ ID NO: 230089 - DNA, 25 bp, Mus musculus
atactttgccatacctggcttttaa

SEQ ID NO: 230090 - DNA, 25 bp, Mus musculus
atactttgccattcctggcttttaa

SEQ ID NO: 230091 - DNA, 25 bp, Mus musculus
atactttggacaactctttccttag

SEQ ID NO: 230092 - DNA, 25 bp, Mus musculus
atactttggacatctctttccttag

SEQ ID NO: 230093 - DNA, 25 bp, Mus musculus
atactttgggagagtgtgtcaggtc

SEQ ID NO: 230094 - DNA, 25 bp, Mus musculus
atactttgggagtgtgtgtcaggtc

SEQ ID NO: 230095 - DNA, 25 bp, Mus musculus
atactttgggtaatttgtggcttca

SEQ ID NO: 230096 - DNA, 25 bp, Mus musculus
atactttgggtactgcactatggat

SEQ ID NO: 230097 - DNA, 25 bp, Mus musculus
atactttgggtagtgcactatggat

SEQ ID NO: 230098 - DNA, 25 bp, Mus musculus
atactttgggtattttgtggcttca

SEQ ID NO: 230099 - DNA, 25 bp, Mus musculus
atactttggtgcaatgtgggctgca

SEQ ID NO: 230100 - DNA, 25 bp, Mus musculus
atactttggtgctatgtgggctgca

SEQ ID NO: 230101 - DNA, 25 bp, Mus musculus
atactttggtttcatcacatgtaga

SEQ ID NO: 230102 - DNA, 25 bp, Mus musculus
atactttggtttgatcacatgtaga

SEQ ID NO: 230103 - DNA, 25 bp, Mus musculus
atactttgtgacatcatcttacaga

SEQ ID NO: 230104 - DNA, 25 bp, Mus musculus
atactttgtgacccattcttttggg

SEQ ID NO: 230105 - DNA, 25 bp, Mus musculus
atactttgtgacgcattcttttggg

SEQ ID NO: 230106 - DNA, 25 bp, Mus musculus
atactttgtgacttcatcttacaga

SEQ ID NO: 230107 - DNA, 25 bp, Mus musculus
atactttgttagagtcatggctgac

SEQ ID NO: 230108 - DNA, 25 bp, Mus musculus
atactttgttagtgtcatggctgac

SEQ ID NO: 230109 - DNA, 25 bp, Mus musculus
atactttgttatccggcctgtacat

SEQ ID NO: 230110 - DNA, 25 bp, Mus musculus
atactttgttatgcggcctgtacat

SEQ ID NO: 230111 - DNA, 25 bp, Mus musculus
atactttgttctctctgttcccctt

SEQ ID NO: 230112 - DNA, 25 bp, Mus musculus
atactttgttctgtctgttcccctt

SEQ ID NO: 230113 - DNA, 25 bp, Mus musculus
atactttgttgtatcctcagtgtgg

SEQ ID NO: 230114 - DNA, 25 bp, Mus musculus
atactttgttgtttcctcagtgtgg

SEQ ID NO: 230115 - DNA, 25 bp, Mus musculus
atacttttaactactgatggcacca

SEQ ID NO: 230116 - DNA, 25 bp, Mus musculus
atacttttaacttctgatggcacca

SEQ ID NO: 230117 - DNA, 25 bp, Mus musculus
atacttttcaccaagtctgacttga

SEQ ID NO: 230118 - DNA, 25 bp, Mus musculus
atacttttcacctagtctgacttga

SEQ ID NO: 230119 - DNA, 25 bp, Mus musculus
atacttttcatcatatgccggtggt

SEQ ID NO: 230120 - DNA, 25 bp, Mus musculus
atacttttcatcttatgccggtggt

SEQ ID NO: 230121 - DNA, 25 bp, Mus musculus
atacttttccacagtttcagctctg

SEQ ID NO: 230122 - DNA, 25 bp, Mus musculus
atacttttccactgtttcagctctg

SEQ ID NO: 230123 - DNA, 25 bp, Mus musculus
atacttttccatctaactggtgtac

SEQ ID NO: 230124 - DNA, 25 bp, Mus musculus
atacttttccatgtaactggtgtac

SEQ ID NO: 230125 - DNA, 25 bp, Mus musculus
atacttttcctgatttataatgcac

SEQ ID NO: 230126 - DNA, 25 bp, Mus musculus
atacttttcctgttttataatgcac

SEQ ID NO: 230127 - DNA, 25 bp, Mus musculus
atacttttcgtgaagaattcctgat

SEQ ID NO: 230128 - DNA, 25 bp, Mus musculus
atacttttcgtgtagaattcctgat

SEQ ID NO: 230129 - DNA, 25 bp, Mus musculus
atacttttctatcttgagcgtggag

SEQ ID NO: 230130 - DNA, 25 bp, Mus musculus
atacttttctatgttgagcgtggag

SEQ ID NO: 230131 - DNA, 25 bp, Mus musculus
atacttttgatcatgtggttcttta

SEQ ID NO: 230132 - DNA, 25 bp, Mus musculus
atacttttgatcttgtggttcttta

SEQ ID NO: 230133 - DNA, 25 bp, Mus musculus
atacttttgcacaacggacatcgag

SEQ ID NO: 230134 - DNA, 25 bp, Mus musculus
atacttttgcactacggacatcgag

SEQ ID NO: 230135 - DNA, 25 bp, Mus musculus
atacttttgcttacaagtctcaaaa

SEQ ID NO: 230136 - DNA, 25 bp, Mus musculus
atacttttgctttcaagtctcaaaa

SEQ ID NO: 230137 - DNA, 25 bp, Mus musculus
atacttttggatcctcctctgcagg

SEQ ID NO: 230138 - DNA, 25 bp, Mus musculus
atacttttggatgctcctctgcagg

SEQ ID NO: 230139 - DNA, 25 bp, Mus musculus
atacttttgttgaggttaaggccat

SEQ ID NO: 230140 - DNA, 25 bp, Mus musculus
atacttttgttgtggttaaggccat

SEQ ID NO: 230141 - DNA, 25 bp, Mus musculus
atactttttattacaaggctgctag

SEQ ID NO: 230142 - DNA, 25 bp, Mus musculus
atactttttatttcaaggctgctag

SEQ ID NO: 230143 - DNA, 25 bp, Mus musculus
atactttttcgaagaagaagcccaa

SEQ ID NO: 230144 - DNA, 25 bp, Mus musculus
atactttttcgatgaagaagcccaa

SEQ ID NO: 230145 - DNA, 25 bp, Mus musculus
atactttttggcagcattaaatatt

SEQ ID NO: 230146 - DNA, 25 bp, Mus musculus
atactttttggctgcattaaatatt

SEQ ID NO: 230147 - DNA, 25 bp, Mus musculus
atactttttggtctcgctatatccc

SEQ ID NO: 230148 - DNA, 25 bp, Mus musculus
atactttttggtgtcgctatatccc

SEQ ID NO: 230149 - DNA, 25 bp, Mus musculus
atagaaaaccacacgaagtcgttat

SEQ ID NO: 230150 - DNA, 25 bp, Mus musculus
atagaaaaccactcgaagtcgttat

SEQ ID NO: 230151 - DNA, 25 bp, Mus musculus
atagaaaaccctacagtcatgtgga

SEQ ID NO: 230152 - DNA, 25 bp, Mus musculus
atagaaaacccttcagtcatgtgga

SEQ ID NO: 230153 - DNA, 25 bp, Mus musculus
atagaaaactaacgctgcaggcttc

SEQ ID NO: 230154 - DNA, 25 bp, Mus musculus
atagaaaactaaggctgcaggcttc

SEQ ID NO: 230155 - DNA, 25 bp, Mus musculus
atagaaaagcggagccttcttctcc

SEQ ID NO: 230156 - DNA, 25 bp, Mus musculus
atagaaaagcggtgccttcttctcc

SEQ ID NO: 230157 - DNA, 25 bp, Mus musculus
atagaaaatgcactgcctctccttt

SEQ ID NO: 230158 - DNA, 25 bp, Mus musculus
atagaaaatgcagtgcctctccttt

SEQ ID NO: 230159 - DNA, 25 bp, Mus musculus
atagaaaatgctagccttgccctga

SEQ ID NO: 230160 - DNA, 25 bp, Mus musculus
atagaaaatgcttgccttgccctga

SEQ ID NO: 230161 - DNA, 25 bp, Mus musculus
atagaaacacacacactgtgcccac

SEQ ID NO: 230162 - DNA, 25 bp, Mus musculus
atagaaacacactcactgtgcccac

SEQ ID NO: 230163 - DNA, 25 bp, Mus musculus
atagaaactctgaccgcagctgctg

SEQ ID NO: 230164 - DNA, 25 bp, Mus musculus
atagaaactctgtccgcagctgctg

SEQ ID NO: 230165 - DNA, 25 bp, Mus musculus
atagaaactgagaagtcacctccag

SEQ ID NO: 230166 - DNA, 25 bp, Mus musculus
atagaaactgagtagtcacctccag

SEQ ID NO: 230167 - DNA, 25 bp, Mus musculus
atagaaacttctctaggccactcag

SEQ ID NO: 230168 - DNA, 25 bp, Mus musculus
atagaaacttctgtaggccactcag

SEQ ID NO: 230169 - DNA, 25 bp, Mus musculus
atagaaagactgcactgccgatccc

SEQ ID NO: 230170 - DNA, 25 bp, Mus musculus
atagaaagactggactgccgatccc

SEQ ID NO: 230171 - DNA, 25 bp, Mus musculus
atagaaagctgtagatggacacccc

SEQ ID NO: 230172 - DNA, 25 bp, Mus musculus
atagaaagctgttgatggacacccc

SEQ ID NO: 230173 - DNA, 25 bp, Mus musculus
atagaaaggacaatggcttccgtgc

SEQ ID NO: 230174 - DNA, 25 bp, Mus musculus
atagaaaggacattggcttccgtgc

SEQ ID NO: 230175 - DNA, 25 bp, Mus musculus
atagaaaggctcaagttccctcagg

SEQ ID NO: 230176 - DNA, 25 bp, Mus musculus
atagaaaggctctagttccctcagg

SEQ ID NO: 230177 - DNA, 25 bp, Mus musculus
atagaaagtagtagtggcgcagtgt

SEQ ID NO: 230178 - DNA, 25 bp, Mus musculus
atagaaagtagttgtggcgcagtgt

SEQ ID NO: 230179 - DNA, 25 bp, Mus musculus
atagaaagtgccctttcctcacgga

SEQ ID NO: 230180 - DNA, 25 bp, Mus musculus
atagaaagtgccgtttcctcacgga

SEQ ID NO: 230181 - DNA, 25 bp, Mus musculus
atagaaatcagaccccaaactcttg

SEQ ID NO: 230182 - DNA, 25 bp, Mus musculus
atagaaatcagagcccaaactcttg

SEQ ID NO: 230183 - DNA, 25 bp, Mus musculus
atagaaatgaacctcccctggctgt

SEQ ID NO: 230184 - DNA, 25 bp, Mus musculus
atagaaatgaacgtcccctggctgt

SEQ ID NO: 230185 - DNA, 25 bp, Mus musculus
atagaaatgagtccctccggtcagc

SEQ ID NO: 230186 - DNA, 25 bp, Mus musculus
atagaaatgagtgcctccggtcagc

SEQ ID NO: 230187 - DNA, 25 bp, Mus musculus
atagaaatttggagccaggcacggc

SEQ ID NO: 230188 - DNA, 25 bp, Mus musculus
atagaaatttggtgccaggcacggc

SEQ ID NO: 230189 - DNA, 25 bp, Mus musculus
atagaacacctacttcaatgcccat

SEQ ID NO: 230190 - DNA, 25 bp, Mus musculus
atagaacacctagttcaatgcccat

SEQ ID NO: 230191 - DNA, 25 bp, Mus musculus
atagaacatattaaggcattgccct

SEQ ID NO: 230192 - DNA, 25 bp, Mus musculus
atagaacatatttaggcattgccct

SEQ ID NO: 230193 - DNA, 25 bp, Mus musculus
atagaacatgatcgttcatctggac

SEQ ID NO: 230194 - DNA, 25 bp, Mus musculus
atagaacatgatggttcatctggac

SEQ ID NO: 230195 - DNA, 25 bp, Mus musculus
atagaacatttcatcctgagccaac

SEQ ID NO: 230196 - DNA, 25 bp, Mus musculus
atagaacatttcttcctgagccaac

SEQ ID NO: 230197 - DNA, 25 bp, Mus musculus
atagaacatttgacctcctgcagtg

SEQ ID NO: 230198 - DNA, 25 bp, Mus musculus
atagaacatttgtcctcctgcagtg

SEQ ID NO: 230199 - DNA, 25 bp, Mus musculus
atagaaccagctccatggtgttcct

SEQ ID NO: 230200 - DNA, 25 bp, Mus musculus
atagaaccagctgcatggtgttcct

SEQ ID NO: 230201 - DNA, 25 bp, Mus musculus
atagaaccccagactgaggcagtag

SEQ ID NO: 230202 - DNA, 25 bp, Mus musculus
atagaaccccagtctgaggcagtag

SEQ ID NO: 230203 - DNA, 25 bp, Mus musculus
atagaacctgctactctgggtacag

SEQ ID NO: 230204 - DNA, 25 bp, Mus musculus
atagaacctgctccttggttagctt

SEQ ID NO: 230205 - DNA, 25 bp, Mus musculus
atagaacctgctgcttggttagctt

SEQ ID NO: 230206 - DNA, 25 bp, Mus musculus
atagaacctgcttctctgggtacag

SEQ ID NO: 230207 - DNA, 25 bp, Mus musculus
atagaaccttacagtagatgcctaa

SEQ ID NO: 230208 - DNA, 25 bp, Mus musculus
atagaaccttactgtagatgcctaa

SEQ ID NO: 230209 - DNA, 25 bp, Mus musculus
atagaacgacagaactaagtttgct

SEQ ID NO: 230210 - DNA, 25 bp, Mus musculus
atagaacgacagtactaagtttgct

SEQ ID NO: 230211 - DNA, 25 bp, Mus musculus
atagaacgccttcgttctctgagcc

SEQ ID NO: 230212 - DNA, 25 bp, Mus musculus
atagaacgccttggttctctgagcc

SEQ ID NO: 230213 - DNA, 25 bp, Mus musculus
atagaacggattctcttcatcagca

SEQ ID NO: 230214 - DNA, 25 bp, Mus musculus
atagaacggattgtcttcatcagca

SEQ ID NO: 230215 - DNA, 25 bp, Mus musculus
atagaacgttcgctgtcttttggtg

SEQ ID NO: 230216 - DNA, 25 bp, Mus musculus
atagaacgttcggtgtcttttggtg

SEQ ID NO: 230217 - DNA, 25 bp, Mus musculus
atagaactctgaatagctgatcatt

SEQ ID NO: 230218 - DNA, 25 bp, Mus musculus
atagaactctgattagctgatcatt

SEQ ID NO: 230219 - DNA, 25 bp, Mus musculus
atagaactgaccagaagcctcaaac

SEQ ID NO: 230220 - DNA, 25 bp, Mus musculus
atagaactgacctgaagcctcaaac

SEQ ID NO: 230221 - DNA, 25 bp, Mus musculus
atagaactgcagcaggtatcaccat

SEQ ID NO: 230222 - DNA, 25 bp, Mus musculus
atagaactgcaggaggtatcaccat

SEQ ID NO: 230223 - DNA, 25 bp, Mus musculus
atagaactggatattttgcctcatt

SEQ ID NO: 230224 - DNA, 25 bp, Mus musculus
atagaactggattttttgcctcatt

SEQ ID NO: 230225 - DNA, 25 bp, Mus musculus
atagaactggccagcgggcgtgtct

SEQ ID NO: 230226 - DNA, 25 bp, Mus musculus
atagaactggcctgcgggcgtgtct

SEQ ID NO: 230227 - DNA, 25 bp, Mus musculus
atagaactgttacgagcgccactcc

SEQ ID NO: 230228 - DNA, 25 bp, Mus musculus
atagaactgttaggagcgccactcc

SEQ ID NO: 230229 - DNA, 25 bp, Mus musculus
atagaactgttcatcccatctctag

SEQ ID NO: 230230 - DNA, 25 bp, Mus musculus
atagaactgttcttcccatctctag

SEQ ID NO: 230231 - DNA, 25 bp, Mus musculus
atagaacttaataggcacaagcccc

SEQ ID NO: 230232 - DNA, 25 bp, Mus musculus
atagaacttaattggcacaagcccc

SEQ ID NO: 230233 - DNA, 25 bp, Mus musculus
atagaacttcatattgtattattgt

SEQ ID NO: 230234 - DNA, 25 bp, Mus musculus
atagaacttcattttgtattattgt

SEQ ID NO: 230235 - DNA, 25 bp, Mus musculus
atagaacttcttagccagatggcac

SEQ ID NO: 230236 - DNA, 25 bp, Mus musculus
atagaacttctttgccagatggcac

SEQ ID NO: 230237 - DNA, 25 bp, Mus musculus
atagaacttggtacctacagtagga

SEQ ID NO: 230238 - DNA, 25 bp, Mus musculus
atagaacttggttcctacagtagga

SEQ ID NO: 230239 - DNA, 25 bp, Mus musculus
atagaactttacagccaaggctgaa

SEQ ID NO: 230240 - DNA, 25 bp, Mus musculus
atagaactttactgccaaggctgaa

SEQ ID NO: 230241 - DNA, 25 bp, Mus musculus
atagaactttctatgtatctttaag

SEQ ID NO: 230242 - DNA, 25 bp, Mus musculus
atagaactttctttgtatctttaag

SEQ ID NO: 230243 - DNA, 25 bp, Mus musculus
atagaagaacccatcatccctgtgg

SEQ ID NO: 230244 - DNA, 25 bp, Mus musculus
atagaagaacccttcatccctgtgg

SEQ ID NO: 230245 - DNA, 25 bp, Mus musculus
atagaagaatatcctgtctcccaaa

SEQ ID NO: 230246 - DNA, 25 bp, Mus musculus
atagaagaatatgctgtctcccaaa

SEQ ID NO: 230247 - DNA, 25 bp, Mus musculus
atagaagacagaacccagaacccaa

SEQ ID NO: 230248 - DNA, 25 bp, Mus musculus
atagaagacagatcccagaacccaa

SEQ ID NO: 230249 - DNA, 25 bp, Mus musculus
atagaagacgatctgtgaaagcccc

SEQ ID NO: 230250 - DNA, 25 bp, Mus musculus
atagaagacgatgtgtgaaagcccc

SEQ ID NO: 230251 - DNA, 25 bp, Mus musculus
atagaagacgttccagtttttgaca

SEQ ID NO: 230252 - DNA, 25 bp, Mus musculus
atagaagacgttgcagtttttgaca

SEQ ID NO: 230253 - DNA, 25 bp, Mus musculus
atagaagactgtcacccgccatgtg

SEQ ID NO: 230254 - DNA, 25 bp, Mus musculus
atagaagactgtgacccgccatgtg

SEQ ID NO: 230255 - DNA, 25 bp, Mus musculus
atagaagaggcccttcacgtcggta

SEQ ID NO: 230256 - DNA, 25 bp, Mus musculus
atagaagaggccgttcacgtcggta

SEQ ID NO: 230257 - DNA, 25 bp, Mus musculus
atagaagatgctaaccctctggcag

SEQ ID NO: 230258 - DNA, 25 bp, Mus musculus
atagaagatgcttaccctctggcag

SEQ ID NO: 230259 - DNA, 25 bp, Mus musculus
atagaagattcccaggccgctacag

SEQ ID NO: 230260 - DNA, 25 bp, Mus musculus
atagaagattccgaggccgctacag

SEQ ID NO: 230261 - DNA, 25 bp, Mus musculus
atagaagcatctaccttgtaaaaat

SEQ ID NO: 230262 - DNA, 25 bp, Mus musculus
atagaagcatcttccttgtaaaaat

SEQ ID NO: 230263 - DNA, 25 bp, Mus musculus
atagaagccaatacaccaggaggta

SEQ ID NO: 230264 - DNA, 25 bp, Mus musculus
atagaagccaattcaccaggaggta

SEQ ID NO: 230265 - DNA, 25 bp, Mus musculus
atagaagcccacactgtacagatct

SEQ ID NO: 230266 - DNA, 25 bp, Mus musculus
atagaagcccactctgtacagatct

SEQ ID NO: 230267 - DNA, 25 bp, Mus musculus
atagaagccctcattgcctgagtcc

SEQ ID NO: 230268 - DNA, 25 bp, Mus musculus
atagaagccctctttgcctgagtcc

SEQ ID NO: 230269 - DNA, 25 bp, Mus musculus
atagaagctatcagtttttggtgtt

SEQ ID NO: 230270 - DNA, 25 bp, Mus musculus
atagaagctatctgtttttggtgtt

SEQ ID NO: 230271 - DNA, 25 bp, Mus musculus
atagaagctgccctgctattgggaa

SEQ ID NO: 230272 - DNA, 25 bp, Mus musculus
atagaagctgccgtgctattgggaa

SEQ ID NO: 230273 - DNA, 25 bp, Mus musculus
atagaagcttgacagttggctccat

SEQ ID NO: 230274 - DNA, 25 bp, Mus musculus
atagaagcttgagagttggctccat

SEQ ID NO: 230275 - DNA, 25 bp, Mus musculus
atagaaggcactcgactctgtagct

SEQ ID NO: 230276 - DNA, 25 bp, Mus musculus
atagaaggcactggactctgtagct

SEQ ID NO: 230277 - DNA, 25 bp, Mus musculus
atagaagggccaccaccacagttgt

SEQ ID NO: 230278 - DNA, 25 bp, Mus musculus
atagaagggccagcaccacagttgt

SEQ ID NO: 230279 - DNA, 25 bp, Mus musculus
atagaagggctacggagtgtcactt

SEQ ID NO: 230280 - DNA, 25 bp, Mus musculus
atagaagggctagggagtgtcactt

SEQ ID NO: 230281 - DNA, 25 bp, Mus musculus
atagaagggtacatcagacttcctg

SEQ ID NO: 230282 - DNA, 25 bp, Mus musculus
atagaagggtacttcagacttcctg

SEQ ID NO: 230283 - DNA, 25 bp, Mus musculus
atagaaggtctactagctccctctg

SEQ ID NO: 230284 - DNA, 25 bp, Mus musculus
atagaaggtctagtagctccctctg

SEQ ID NO: 230285 - DNA, 25 bp, Mus musculus
atagaaggttcaccatcacaccaaa

SEQ ID NO: 230286 - DNA, 25 bp, Mus musculus
atagaaggttcagcatcacaccaaa

SEQ ID NO: 230287 - DNA, 25 bp, Mus musculus
atagaaggttctaacatctcccctc

SEQ ID NO: 230288 - DNA, 25 bp, Mus musculus
atagaaggttcttacatctcccctc

SEQ ID NO: 230289 - DNA, 25 bp, Mus musculus
atagaagtaaccacttgggccagcc

SEQ ID NO: 230290 - DNA, 25 bp, Mus musculus
atagaagtaacctcttgggccagcc

SEQ ID NO: 230291 - DNA, 25 bp, Mus musculus
atagaagtcaacagtagacctgccc

SEQ ID NO: 230292 - DNA, 25 bp, Mus musculus
atagaagtcaactgtagacctgccc

SEQ ID NO: 230293 - DNA, 25 bp, Mus musculus
atagaagtcgaaaagtgaaggagct

SEQ ID NO: 230294 - DNA, 25 bp, Mus musculus
atagaagtcgaatagtgaaggagct

SEQ ID NO: 230295 - DNA, 25 bp, Mus musculus
atagaagtctgccagccaactcgtc

SEQ ID NO: 230296 - DNA, 25 bp, Mus musculus
atagaagtctgcgagccaactcgtc

SEQ ID NO: 230297 - DNA, 25 bp, Mus musculus
atagaagtgcctcagacctttccct

SEQ ID NO: 230298 - DNA, 25 bp, Mus musculus
atagaagtgcctgagacctttccct

SEQ ID NO: 230299 - DNA, 25 bp, Mus musculus
atagaataagaacccgcatgcccat

SEQ ID NO: 230300 - DNA, 25 bp, Mus musculus
atagaataagaagccgcatgcccat

SEQ ID NO: 230301 - DNA, 25 bp, Mus musculus
atagaatacaggacccaaggcccac

SEQ ID NO: 230302 - DNA, 25 bp, Mus musculus
atagaatacaggtcccaaggcccac

SEQ ID NO: 230303 - DNA, 25 bp, Mus musculus
atagaatacttgatacggaccagac

SEQ ID NO: 230304 - DNA, 25 bp, Mus musculus
atagaatacttgttacggaccagac

SEQ ID NO: 230305 - DNA, 25 bp, Mus musculus
atagaatctcttcctgacagacttg

SEQ ID NO: 230306 - DNA, 25 bp, Mus musculus
atagaatctcttgctgacagacttg

SEQ ID NO: 230307 - DNA, 25 bp, Mus musculus
atagaatctgtccactttgaattga

SEQ ID NO: 230308 - DNA, 25 bp, Mus musculus
atagaatctgtcgactttgaattga

SEQ ID NO: 230309 - DNA, 25 bp, Mus musculus
atagaatcttcaatctactccctct

SEQ ID NO: 230310 - DNA, 25 bp, Mus musculus
atagaatcttcattctactccctct

SEQ ID NO: 230311 - DNA, 25 bp, Mus musculus
atagaatcttgaacatctcccgctt

SEQ ID NO: 230312 - DNA, 25 bp, Mus musculus
atagaatcttgaactgtttgttgac

SEQ ID NO: 230313 - DNA, 25 bp, Mus musculus
atagaatcttgatcatctcccgctt

SEQ ID NO: 230314 - DNA, 25 bp, Mus musculus
atagaatcttgatctgtttgttgac

SEQ ID NO: 230315 - DNA, 25 bp, Mus musculus
atagaatggaacatctctcctggct

SEQ ID NO: 230316 - DNA, 25 bp, Mus musculus
atagaatggaacttctctcctggct

SEQ ID NO: 230317 - DNA, 25 bp, Mus musculus
atagaatggccaaaaggtcccctgt

SEQ ID NO: 230318 - DNA, 25 bp, Mus musculus
atagaatggccataaggtcccctgt

SEQ ID NO: 230319 - DNA, 25 bp, Mus musculus
atagaatggctgactgggcacctac

SEQ ID NO: 230320 - DNA, 25 bp, Mus musculus
atagaatggctgtctgggcacctac

SEQ ID NO: 230321 - DNA, 25 bp, Mus musculus
atagaatggcttcgcccaagtgaga

SEQ ID NO: 230322 - DNA, 25 bp, Mus musculus
atagaatggcttggcccaagtgaga

SEQ ID NO: 230323 - DNA, 25 bp, Mus musculus
atagaatgggtgacttttctatgtc

SEQ ID NO: 230324 - DNA, 25 bp, Mus musculus
atagaatgggtgtcttttctatgtc

SEQ ID NO: 230325 - DNA, 25 bp, Mus musculus
atagaatgttccagtttgaaacttc

SEQ ID NO: 230326 - DNA, 25 bp, Mus musculus
atagaatgttcctgtttgaaacttc

SEQ ID NO: 230327 - DNA, 25 bp, Mus musculus
atagaattcagtagcttcccctgta

SEQ ID NO: 230328 - DNA, 25 bp, Mus musculus
atagaattcagtcgcccattctgta

SEQ ID NO: 230329 - DNA, 25 bp, Mus musculus
atagaattcagtggcccattctgta

SEQ ID NO: 230330 - DNA, 25 bp, Mus musculus
atagaattcagttgcttcccctgta

SEQ ID NO: 230331 - DNA, 25 bp, Mus musculus
atagaattcttgatctgcttcaaat

SEQ ID NO: 230332 - DNA, 25 bp, Mus musculus
atagaattcttgttctgcttcaaat

SEQ ID NO: 230333 - DNA, 25 bp, Mus musculus
atagaattgaatcgccaccctgtgt

SEQ ID NO: 230334 - DNA, 25 bp, Mus musculus
atagaattgaatggccaccctgtgt

SEQ ID NO: 230335 - DNA, 25 bp, Mus musculus
atagaattgtgtcctggaagccagg

SEQ ID NO: 230336 - DNA, 25 bp, Mus musculus
atagaattgtgtgctggaagccagg

SEQ ID NO: 230337 - DNA, 25 bp, Mus musculus
atagaatttattctggctctgatta

SEQ ID NO: 230338 - DNA, 25 bp, Mus musculus
atagaatttattgtggctctgatta

SEQ ID NO: 230339 - DNA, 25 bp, Mus musculus
atagaatttctgatacccagctttg

SEQ ID NO: 230340 - DNA, 25 bp, Mus musculus
atagaatttctgttacccagctttg

SEQ ID NO: 230341 - DNA, 25 bp, Mus musculus
atagaattttccatggtgtctccca

SEQ ID NO: 230342 - DNA, 25 bp, Mus musculus
atagaattttccttggtgtctccca

SEQ ID NO: 230343 - DNA, 25 bp, Mus musculus
atagacaaaaacagcccagtccctt

SEQ ID NO: 230344 - DNA, 25 bp, Mus musculus
atagacaaaaactgcccagtccctt

SEQ ID NO: 230345 - DNA, 25 bp, Mus musculus
atagacaaacacaagtaatggcccc

SEQ ID NO: 230346 - DNA, 25 bp, Mus musculus
atagacaaacactagtaatggcccc

SEQ ID NO: 230347 - DNA, 25 bp, Mus musculus
atagacaaccccaacaccaacactt

SEQ ID NO: 230348 - DNA, 25 bp, Mus musculus
atagacaacccctacaccaacactt

SEQ ID NO: 230349 - DNA, 25 bp, Mus musculus
atagacaaccgaaacctcccgtgtg

SEQ ID NO: 230350 - DNA, 25 bp, Mus musculus
atagacaaccgatacctcccgtgtg

SEQ ID NO: 230351 - DNA, 25 bp, Mus musculus
atagacaaggttcgccccaaactca

SEQ ID NO: 230352 - DNA, 25 bp, Mus musculus
atagacaaggttggccccaaactca

SEQ ID NO: 230353 - DNA, 25 bp, Mus musculus
atagacaatgctcttgtggcaaaca

SEQ ID NO: 230354 - DNA, 25 bp, Mus musculus
atagacaatgctgttgtggcaaaca

SEQ ID NO: 230355 - DNA, 25 bp, Mus musculus
atagacaatgtcagtctcccctgtg

SEQ ID NO: 230356 - DNA, 25 bp, Mus musculus
atagacaatgtctgtctcccctgtg

SEQ ID NO: 230357 - DNA, 25 bp, Mus musculus
atagacaattgtcccttttagaagt

SEQ ID NO: 230358 - DNA, 25 bp, Mus musculus
atagacaattgtgccttttagaagt

SEQ ID NO: 230359 - DNA, 25 bp, Mus musculus
atagacacacaaatggagactgaac

SEQ ID NO: 230360 - DNA, 25 bp, Mus musculus
atagacacacaattggagactgaac

SEQ ID NO: 230361 - DNA, 25 bp, Mus musculus
atagacacactaattgacaccccac

SEQ ID NO: 230362 - DNA, 25 bp, Mus musculus
atagacacactatttgacaccccac

SEQ ID NO: 230363 - DNA, 25 bp, Mus musculus
atagacacattcagcggctgttagc

SEQ ID NO: 230364 - DNA, 25 bp, Mus musculus
atagacacattctgcggctgttagc

SEQ ID NO: 230365 - DNA, 25 bp, Mus musculus
atagacaccaccatgcgtggaggcc

SEQ ID NO: 230366 - DNA, 25 bp, Mus musculus
atagacaccaccttgcgtggaggcc

SEQ ID NO: 230367 - DNA, 25 bp, Mus musculus
atagacacctcgagatagaccacct

SEQ ID NO: 230368 - DNA, 25 bp, Mus musculus
atagacacctcgtgatagaccacct

SEQ ID NO: 230369 - DNA, 25 bp, Mus musculus
atagacacctggcttccgcggatga

SEQ ID NO: 230370 - DNA, 25 bp, Mus musculus
atagacacctgggttccgcggatga

SEQ ID NO: 230371 - DNA, 25 bp, Mus musculus
atagacacgtcaaattttcccaggc

SEQ ID NO: 230372 - DNA, 25 bp, Mus musculus
atagacacgtcatattttcccaggc

SEQ ID NO: 230373 - DNA, 25 bp, Mus musculus
atagacacttaacgacagctagggc

SEQ ID NO: 230374 - DNA, 25 bp, Mus musculus
atagacacttaaggacagctagggc

SEQ ID NO: 230375 - DNA, 25 bp, Mus musculus
atagacacttctagcagcatgtctc

SEQ ID NO: 230376 - DNA, 25 bp, Mus musculus
atagacacttcttgcagcatgtctc

SEQ ID NO: 230377 - DNA, 25 bp, Mus musculus
atagacagagctagccacaccagta

SEQ ID NO: 230378 - DNA, 25 bp, Mus musculus
atagacagagcttgccacaccagta

SEQ ID NO: 230379 - DNA, 25 bp, Mus musculus
atagacagaggccagtctcagcctt

SEQ ID NO: 230380 - DNA, 25 bp, Mus musculus
atagacagaggcgagtctcagcctt

SEQ ID NO: 230381 - DNA, 25 bp, Mus musculus
atagacagaggtccacctggatgga

SEQ ID NO: 230382 - DNA, 25 bp, Mus musculus
atagacagaggtgcacctggatgga

SEQ ID NO: 230383 - DNA, 25 bp, Mus musculus
atagacagatggacccgcatcgtgt

SEQ ID NO: 230384 - DNA, 25 bp, Mus musculus
atagacagatggtcccgcatcgtgt

SEQ ID NO: 230385 - DNA, 25 bp, Mus musculus
atagacaggcgcaatggcctcactt

SEQ ID NO: 230386 - DNA, 25 bp, Mus musculus
atagacaggcgctatggcctcactt

SEQ ID NO: 230387 - DNA, 25 bp, Mus musculus
atagacagggaccagctgctcacca

SEQ ID NO: 230388 - DNA, 25 bp, Mus musculus
atagacagggacgagctgctcacca

SEQ ID NO: 230389 - DNA, 25 bp, Mus musculus
atagacagtaccaggtttctctgct

SEQ ID NO: 230390 - DNA, 25 bp, Mus musculus
atagacagtacctggtttctctgct

SEQ ID NO: 230391 - DNA, 25 bp, Mus musculus
atagacagtctgcatgctttctctc

SEQ ID NO: 230392 - DNA, 25 bp, Mus musculus
atagacagtctggatgctttctctc

SEQ ID NO: 230393 - DNA, 25 bp, Mus musculus
atagacagttccaggtctcagcttc

SEQ ID NO: 230394 - DNA, 25 bp, Mus musculus
atagacagttcctggtctcagcttc

SEQ ID NO: 230395 - DNA, 25 bp, Mus musculus
atagacatacccatatatgaaggag

SEQ ID NO: 230396 - DNA, 25 bp, Mus musculus
atagacatacccttatatgaaggag

SEQ ID NO: 230397 - DNA, 25 bp, Mus musculus
atagacatcgaaatagaccgtttat

SEQ ID NO: 230398 - DNA, 25 bp, Mus musculus
atagacatcgaaccatttacacccc

SEQ ID NO: 230399 - DNA, 25 bp, Mus musculus
atagacatcgaagcatttacacccc

SEQ ID NO: 230400 - DNA, 25 bp, Mus musculus
atagacatcgaattagaccgtttat

SEQ ID NO: 230401 - DNA, 25 bp, Mus musculus
atagacatgagcaagggccagccga

SEQ ID NO: 230402 - DNA, 25 bp, Mus musculus
atagacatgagctagggccagccga

SEQ ID NO: 230403 - DNA, 25 bp, Mus musculus
atagacatggtgagggggctcccca

SEQ ID NO: 230404 - DNA, 25 bp, Mus musculus
atagacatggtgtgggggctcccca

SEQ ID NO: 230405 - DNA, 25 bp, Mus musculus
atagacatgtccaccaccatgttca

SEQ ID NO: 230406 - DNA, 25 bp, Mus musculus
atagacatgtcctccaccatgttca

SEQ ID NO: 230407 - DNA, 25 bp, Mus musculus
atagacattaccaacattcagtggg

SEQ ID NO: 230408 - DNA, 25 bp, Mus musculus
atagacattacctacattcagtggg

SEQ ID NO: 230409 - DNA, 25 bp, Mus musculus
atagacattatgacaggcaggccaa

SEQ ID NO: 230410 - DNA, 25 bp, Mus musculus
atagacattatgtcaggcaggccaa

SEQ ID NO: 230411 - DNA, 25 bp, Mus musculus
atagacattcccagattcctactcc

SEQ ID NO: 230412 - DNA, 25 bp, Mus musculus
atagacattccctgattcctactcc

SEQ ID NO: 230413 - DNA, 25 bp, Mus musculus
atagacattgaaaaacctggcattt

SEQ ID NO: 230414 - DNA, 25 bp, Mus musculus
atagacattgaataacctggcattt

SEQ ID NO: 230415 - DNA, 25 bp, Mus musculus
atagaccaacatattgtgccagaaa

SEQ ID NO: 230416 - DNA, 25 bp, Mus musculus
atagaccaacattttgtgccagaaa

SEQ ID NO: 230417 - DNA, 25 bp, Mus musculus
atagaccaagcaccgcttctttctc

SEQ ID NO: 230418 - DNA, 25 bp, Mus musculus
atagaccaagcagcgcttctttctc

SEQ ID NO: 230419 - DNA, 25 bp, Mus musculus
atagaccacatacctagcaggctct

SEQ ID NO: 230420 - DNA, 25 bp, Mus musculus
atagaccacatagctagcaggctct

SEQ ID NO: 230421 - DNA, 25 bp, Mus musculus
atagaccacatcatgggccacggtg

SEQ ID NO: 230422 - DNA, 25 bp, Mus musculus
atagaccacatcttgggccacggtg

SEQ ID NO: 230423 - DNA, 25 bp, Mus musculus
atagaccactcacggagcctgggaa

SEQ ID NO: 230424 - DNA, 25 bp, Mus musculus
atagaccactcagggagcctgggaa

SEQ ID NO: 230425 - DNA, 25 bp, Mus musculus
atagaccactctctcatcaaactag

SEQ ID NO: 230426 - DNA, 25 bp, Mus musculus
atagaccactctgtcatcaaactag

SEQ ID NO: 230427 - DNA, 25 bp, Mus musculus
atagaccactttcgctctcaaactg

SEQ ID NO: 230428 - DNA, 25 bp, Mus musculus
atagaccactttggctctcaaactg

SEQ ID NO: 230429 - DNA, 25 bp, Mus musculus
atagaccagcttattgcatcaaatg

SEQ ID NO: 230430 - DNA, 25 bp, Mus musculus
atagaccagctttttgcatcaaatg

SEQ ID NO: 230431 - DNA, 25 bp, Mus musculus
atagaccatcacctgatcctgattt

SEQ ID NO: 230432 - DNA, 25 bp, Mus musculus
atagaccatcacgtgatcctgattt

SEQ ID NO: 230433 - DNA, 25 bp, Mus musculus
atagaccatgttagcatcctggata

SEQ ID NO: 230434 - DNA, 25 bp, Mus musculus
atagaccatgtttgcatcctggata

SEQ ID NO: 230435 - DNA, 25 bp, Mus musculus
atagacccactaaactcttgtcacc

SEQ ID NO: 230436 - DNA, 25 bp, Mus musculus
atagacccactatactcttgtcacc

SEQ ID NO: 230437 - DNA, 25 bp, Mus musculus
atagacccactcacaaagaactcaa

SEQ ID NO: 230438 - DNA, 25 bp, Mus musculus
atagacccactctcaaagaactcaa

SEQ ID NO: 230439 - DNA, 25 bp, Mus musculus
atagacccactgattcatcaggtac

SEQ ID NO: 230440 - DNA, 25 bp, Mus musculus
atagacccactgtttcatcaggtac

SEQ ID NO: 230441 - DNA, 25 bp, Mus musculus
atagacccagagcaggtttgctttc

SEQ ID NO: 230442 - DNA, 25 bp, Mus musculus
atagacccagaggaggtttgctttc

SEQ ID NO: 230443 - DNA, 25 bp, Mus musculus
atagaccccagtatatagctccata

SEQ ID NO: 230444 - DNA, 25 bp, Mus musculus
atagaccccagtttatagctccata

SEQ ID NO: 230445 - DNA, 25 bp, Mus musculus
atagaccccggccagcatgagacaa

SEQ ID NO: 230446 - DNA, 25 bp, Mus musculus
atagaccccggcgagcatgagacaa

SEQ ID NO: 230447 - DNA, 25 bp, Mus musculus
atagacccctctaattagtgaatta

SEQ ID NO: 230448 - DNA, 25 bp, Mus musculus
atagacccctcttattagtgaatta

SEQ ID NO: 230449 - DNA, 25 bp, Mus musculus
atagaccctgaaaatctccacttca

SEQ ID NO: 230450 - DNA, 25 bp, Mus musculus
atagaccctgaatatctccacttca

SEQ ID NO: 230451 - DNA, 25 bp, Mus musculus
atagaccgtgagaggccacagcctg

SEQ ID NO: 230452 - DNA, 25 bp, Mus musculus
atagaccgtgagtggccacagcctg

SEQ ID NO: 230453 - DNA, 25 bp, Mus musculus
atagacctagtcattgcttttagtt

SEQ ID NO: 230454 - DNA, 25 bp, Mus musculus
atagacctagtctttgcttttagtt

SEQ ID NO: 230455 - DNA, 25 bp, Mus musculus
atagacctatgaacgggctttcttg

SEQ ID NO: 230456 - DNA, 25 bp, Mus musculus
atagacctatgatcgggctttcttg

SEQ ID NO: 230457 - DNA, 25 bp, Mus musculus
atagacctcaagatggaacatgcct

SEQ ID NO: 230458 - DNA, 25 bp, Mus musculus
atagacctcaagttggaacatgcct

SEQ ID NO: 230459 - DNA, 25 bp, Mus musculus
atagacctcaataatggttcaggaa

SEQ ID NO: 230460 - DNA, 25 bp, Mus musculus
atagacctcaattatggttcaggaa

SEQ ID NO: 230461 - DNA, 25 bp, Mus musculus
atagacctcttaccctcagggaagg

SEQ ID NO: 230462 - DNA, 25 bp, Mus musculus
atagacctcttagcctcagggaagg

SEQ ID NO: 230463 - DNA, 25 bp, Mus musculus
atagacctgcccctgggaggagcat

SEQ ID NO: 230464 - DNA, 25 bp, Mus musculus
atagacctgcccgtgggaggagcat

SEQ ID NO: 230465 - DNA, 25 bp, Mus musculus
atagacctgggaccagacgcgagtt

SEQ ID NO: 230466 - DNA, 25 bp, Mus musculus
atagacctgggagcagacgcgagtt

SEQ ID NO: 230467 - DNA, 25 bp, Mus musculus
atagaccttaggaattgtcaagttc

SEQ ID NO: 230468 - DNA, 25 bp, Mus musculus
atagaccttaggtattgtcaagttc

SEQ ID NO: 230469 - DNA, 25 bp, Mus musculus
atagaccttgatagatccctcattt

SEQ ID NO: 230470 - DNA, 25 bp, Mus musculus
atagaccttgattgatccctcattt

SEQ ID NO: 230471 - DNA, 25 bp, Mus musculus
atagaccttttcactacagacatcc

SEQ ID NO: 230472 - DNA, 25 bp, Mus musculus
atagaccttttctctacagacatcc

SEQ ID NO: 230473 - DNA, 25 bp, Mus musculus
atagacgatttgaccgctgtgtaaa

SEQ ID NO: 230474 - DNA, 25 bp, Mus musculus
atagacgatttgtccgctgtgtaaa

SEQ ID NO: 230475 - DNA, 25 bp, Mus musculus
atagacgcagccatgggtcgggcta

SEQ ID NO: 230476 - DNA, 25 bp, Mus musculus
atagacgcagccttgggtcgggcta

SEQ ID NO: 230477 - DNA, 25 bp, Mus musculus
atagacgccaacagctgcttatgtg

SEQ ID NO: 230478 - DNA, 25 bp, Mus musculus
atagacgccaactgctgcttatgtg

SEQ ID NO: 230479 - DNA, 25 bp, Mus musculus
atagacgccaccctttcgatggctt

SEQ ID NO: 230480 - DNA, 25 bp, Mus musculus
atagacgccaccgtttcgatggctt

SEQ ID NO: 230481 - DNA, 25 bp, Mus musculus
atagacgctgccagccaggcctcag

SEQ ID NO: 230482 - DNA, 25 bp, Mus musculus
atagacgctgcctgccaggcctcag

SEQ ID NO: 230483 - DNA, 25 bp, Mus musculus
atagacgtccttcagcccctgatcg

SEQ ID NO: 230484 - DNA, 25 bp, Mus musculus
atagacgtccttgagcccctgatcg

SEQ ID NO: 230485 - DNA, 25 bp, Mus musculus
atagacgtgcatcccctgtttgaag

SEQ ID NO: 230486 - DNA, 25 bp, Mus musculus
atagacgtgcatgccctgtttgaag

SEQ ID NO: 230487 - DNA, 25 bp, Mus musculus
atagactacgacaggaagtttaggg

SEQ ID NO: 230488 - DNA, 25 bp, Mus musculus
atagactacgactggaagtttaggg

SEQ ID NO: 230489 - DNA, 25 bp, Mus musculus
atagactaggccatttgtaaaacac

SEQ ID NO: 230490 - DNA, 25 bp, Mus musculus
atagactaggccttttgtaaaacac

SEQ ID NO: 230491 - DNA, 25 bp, Mus musculus
atagactatctaatccaagctccag

SEQ ID NO: 230492 - DNA, 25 bp, Mus musculus
atagactatctattccaagctccag

SEQ ID NO: 230493 - DNA, 25 bp, Mus musculus
atagactatgaaagacgccccgaaa

SEQ ID NO: 230494 - DNA, 25 bp, Mus musculus
atagactatgaatgacgccccgaaa

SEQ ID NO: 230495 - DNA, 25 bp, Mus musculus
atagactatgagcctgcgaaggcag

SEQ ID NO: 230496 - DNA, 25 bp, Mus musculus
atagactatgaggctgcgaaggcag

SEQ ID NO: 230497 - DNA, 25 bp, Mus musculus
atagactattggagctctgagcaca

SEQ ID NO: 230498 - DNA, 25 bp, Mus musculus
atagactattggtgctctgagcaca

SEQ ID NO: 230499 - DNA, 25 bp, Mus musculus
atagactcaaaactctcgaatagtt

SEQ ID NO: 230500 - DNA, 25 bp, Mus musculus
atagactcaaaagtctcgaatagtt

SEQ ID NO: 230501 - DNA, 25 bp, Mus musculus
atagactcacagcagaggcccagga

SEQ ID NO: 230502 - DNA, 25 bp, Mus musculus
atagactcacaggagaggcccagga

SEQ ID NO: 230503 - DNA, 25 bp, Mus musculus
atagactcagaacagattacaaggt

SEQ ID NO: 230504 - DNA, 25 bp, Mus musculus
atagactcagaagagattacaaggt

SEQ ID NO: 230505 - DNA, 25 bp, Mus musculus
atagactccatgaagggtctgtcac

SEQ ID NO: 230506 - DNA, 25 bp, Mus musculus
atagactccatgtagggtctgtcac

SEQ ID NO: 230507 - DNA, 25 bp, Mus musculus
atagactccttgattggctgctgca

SEQ ID NO: 230508 - DNA, 25 bp, Mus musculus
atagactccttgtttggctgctgca

SEQ ID NO: 230509 - DNA, 25 bp, Mus musculus
atagactctaccacggagcaagata

SEQ ID NO: 230510 - DNA, 25 bp, Mus musculus
atagactctacctcggagcaagata

SEQ ID NO: 230511 - DNA, 25 bp, Mus musculus
atagactctcagattgacttgacag

SEQ ID NO: 230512 - DNA, 25 bp, Mus musculus
atagactctcagtttgacttgacag

SEQ ID NO: 230513 - DNA, 25 bp, Mus musculus
atagactctccaagctgaatgacag

SEQ ID NO: 230514 - DNA, 25 bp, Mus musculus
atagactctccatgctgaatgacag

SEQ ID NO: 230515 - DNA, 25 bp, Mus musculus
atagactctgatcaccacacggatg

SEQ ID NO: 230516 - DNA, 25 bp, Mus musculus
atagactctgatgaccacacggatg

SEQ ID NO: 230517 - DNA, 25 bp, Mus musculus
atagactctggcatagttcctcact

SEQ ID NO: 230518 - DNA, 25 bp, Mus musculus
atagactctggcttagttcctcact

SEQ ID NO: 230519 - DNA, 25 bp, Mus musculus
atagactctgttcaactactaccac

SEQ ID NO: 230520 - DNA, 25 bp, Mus musculus
atagactctgttgaactactaccac

SEQ ID NO: 230521 - DNA, 25 bp, Mus musculus
atagactcttaacgtggcccgggcg

SEQ ID NO: 230522 - DNA, 25 bp, Mus musculus
atagactcttaaggtggcccgggcg

SEQ ID NO: 230523 - DNA, 25 bp, Mus musculus
atagactgaaccagaccttctcaag

SEQ ID NO: 230524 - DNA, 25 bp, Mus musculus
atagactgaacctgaccttctcaag

SEQ ID NO: 230525 - DNA, 25 bp, Mus musculus
atagactgacttcggacctcacaca

SEQ ID NO: 230526 - DNA, 25 bp, Mus musculus
atagactgacttgggacctcacaca

SEQ ID NO: 230527 - DNA, 25 bp, Mus musculus
atagactgctcacactgggctccag

SEQ ID NO: 230528 - DNA, 25 bp, Mus musculus
atagactgctcagactgggctccag

SEQ ID NO: 230529 - DNA, 25 bp, Mus musculus
atagactgctctccacccagtatgt

SEQ ID NO: 230530 - DNA, 25 bp, Mus musculus
atagactgctctgcacccagtatgt

SEQ ID NO: 230531 - DNA, 25 bp, Mus musculus
atagactgctggcttagtgtgcaca

SEQ ID NO: 230532 - DNA, 25 bp, Mus musculus
atagactgctgggttagtgtgcaca

SEQ ID NO: 230533 - DNA, 25 bp, Mus musculus
atagactggccactaggatccccgg

SEQ ID NO: 230534 - DNA, 25 bp, Mus musculus
atagactggccagtaggatccccgg

SEQ ID NO: 230535 - DNA, 25 bp, Mus musculus
atagactgggagacgcagcgcagat

SEQ ID NO: 230536 - DNA, 25 bp, Mus musculus
atagactgggagtcgcagcgcagat

SEQ ID NO: 230537 - DNA, 25 bp, Mus musculus
atagactgtacgctccaagagggca

SEQ ID NO: 230538 - DNA, 25 bp, Mus musculus
atagactgtacggtccaagagggca

SEQ ID NO: 230539 - DNA, 25 bp, Mus musculus
atagactgttccacacctccttcat

SEQ ID NO: 230540 - DNA, 25 bp, Mus musculus
atagactgttcctcacctccttcat

SEQ ID NO: 230541 - DNA, 25 bp, Mus musculus
atagactgttctatgcgtgatttca

SEQ ID NO: 230542 - DNA, 25 bp, Mus musculus
atagactgttctttgcgtgatttca

SEQ ID NO: 230543 - DNA, 25 bp, Mus musculus
atagactgtttcattttgctttgtt

SEQ ID NO: 230544 - DNA, 25 bp, Mus musculus
atagactgtttctttttgctttgtt

SEQ ID NO: 230545 - DNA, 25 bp, Mus musculus
atagacttaactactgttcccagag

SEQ ID NO: 230546 - DNA, 25 bp, Mus musculus
atagacttaacttctgttcccagag

SEQ ID NO: 230547 - DNA, 25 bp, Mus musculus
atagacttctgcatcatgatgatga

SEQ ID NO: 230548 - DNA, 25 bp, Mus musculus
atagacttctgcttcatgatgatga

SEQ ID NO: 230549 - DNA, 25 bp, Mus musculus
atagacttgattcgacacctcataa

SEQ ID NO: 230550 - DNA, 25 bp, Mus musculus
atagacttgattggacacctcataa

SEQ ID NO: 230551 - DNA, 25 bp, Mus musculus
atagacttggagagccgctgaggct

SEQ ID NO: 230552 - DNA, 25 bp, Mus musculus
atagacttggagtgccgctgaggct

SEQ ID NO: 230553 - DNA, 25 bp, Mus musculus
atagacttggtgatcctgtaccaga

SEQ ID NO: 230554 - DNA, 25 bp, Mus musculus
atagacttggtgttcctgtaccaga

SEQ ID NO: 230555 - DNA, 25 bp, Mus musculus
atagagaaagttagccctgtaagta

SEQ ID NO: 230556 - DNA, 25 bp, Mus musculus
atagagaaagtttgccctgtaagta

SEQ ID NO: 230557 - DNA, 25 bp, Mus musculus
atagagaaataacctggtacgtcca

SEQ ID NO: 230558 - DNA, 25 bp, Mus musculus
atagagaaataagctggtacgtcca

SEQ ID NO: 230559 - DNA, 25 bp, Mus musculus
atagagaacatcatcgggcgggact

SEQ ID NO: 230560 - DNA, 25 bp, Mus musculus
atagagaacatccttttaccacaaa

SEQ ID NO: 230561 - DNA, 25 bp, Mus musculus
atagagaacatcgttttaccacaaa

SEQ ID NO: 230562 - DNA, 25 bp, Mus musculus
atagagaacatcttcgggcgggact

SEQ ID NO: 230563 - DNA, 25 bp, Mus musculus
atagagaaggacctccactgtcaac

SEQ ID NO: 230564 - DNA, 25 bp, Mus musculus
atagagaaggacgtccactgtcaac

SEQ ID NO: 230565 - DNA, 25 bp, Mus musculus
atagagaatcatatcagggttcacg

SEQ ID NO: 230566 - DNA, 25 bp, Mus musculus
atagagaatcatttcagggttcacg

SEQ ID NO: 230567 - DNA, 25 bp, Mus musculus
atagagaatgcaagtctgtcccgcc

SEQ ID NO: 230568 - DNA, 25 bp, Mus musculus
atagagaatgcatgtctgtcccgcc

SEQ ID NO: 230569 - DNA, 25 bp, Mus musculus
atagagacacttaccagggtctccc

SEQ ID NO: 230570 - DNA, 25 bp, Mus musculus
atagagacactttccagggtctccc

SEQ ID NO: 230571 - DNA, 25 bp, Mus musculus
atagagacagtaagcatcttgggaa

SEQ ID NO: 230572 - DNA, 25 bp, Mus musculus
atagagacagtatgcatcttgggaa

SEQ ID NO: 230573 - DNA, 25 bp, Mus musculus
atagagaccctgatctgtggcctgg

SEQ ID NO: 230574 - DNA, 25 bp, Mus musculus
atagagaccctgttctgtggcctgg

SEQ ID NO: 230575 - DNA, 25 bp, Mus musculus
atagagacggtcaccagtgccgtgg

SEQ ID NO: 230576 - DNA, 25 bp, Mus musculus
atagagacggtctccagtgccgtgg

SEQ ID NO: 230577 - DNA, 25 bp, Mus musculus
atagagactcaccagggtctgctac

SEQ ID NO: 230578 - DNA, 25 bp, Mus musculus
atagagactcacgagggtctgctac

SEQ ID NO: 230579 - DNA, 25 bp, Mus musculus
atagagactttaacaccacgggata

SEQ ID NO: 230580 - DNA, 25 bp, Mus musculus
atagagactttatcaccacgggata

SEQ ID NO: 230581 - DNA, 25 bp, Mus musculus
atagagagaacactaaatgccatgt

SEQ ID NO: 230582 - DNA, 25 bp, Mus musculus
atagagagaacagtaaatgccatgt

SEQ ID NO: 230583 - DNA, 25 bp, Mus musculus
atagagagcagaattcaccgattgg

SEQ ID NO: 230584 - DNA, 25 bp, Mus musculus
atagagagcagatttcaccgattgg

SEQ ID NO: 230585 - DNA, 25 bp, Mus musculus
atagagagcagcagcccaggtgtct

SEQ ID NO: 230586 - DNA, 25 bp, Mus musculus
atagagagcagctgcccaggtgtct

SEQ ID NO: 230587 - DNA, 25 bp, Mus musculus
atagagagctccagtttttgcacac

SEQ ID NO: 230588 - DNA, 25 bp, Mus musculus
atagagagctcctgtttttgcacac

SEQ ID NO: 230589 - DNA, 25 bp, Mus musculus
atagagagtgagagcagagaacccc

SEQ ID NO: 230590 - DNA, 25 bp, Mus musculus
atagagagtgagcatccggaacgct

SEQ ID NO: 230591 - DNA, 25 bp, Mus musculus
atagagagtgaggatccggaacgct

SEQ ID NO: 230592 - DNA, 25 bp, Mus musculus
atagagagtgagtgcagagaacccc

SEQ ID NO: 230593 - DNA, 25 bp, Mus musculus
atagagatagctcggctctcctact

SEQ ID NO: 230594 - DNA, 25 bp, Mus musculus
atagagatagctgggctctcctact

SEQ ID NO: 230595 - DNA, 25 bp, Mus musculus
atagagatcatccaagcattacaac

SEQ ID NO: 230596 - DNA, 25 bp, Mus musculus
atagagatcatcgaagcattacaac

SEQ ID NO: 230597 - DNA, 25 bp, Mus musculus
atagagatcggacaggacctcccct

SEQ ID NO: 230598 - DNA, 25 bp, Mus musculus
atagagatcggagaggacctcccct

SEQ ID NO: 230599 - DNA, 25 bp, Mus musculus
atagagatctggagggcgccatgct

SEQ ID NO: 230600 - DNA, 25 bp, Mus musculus
atagagatctggtgggcgccatgct

SEQ ID NO: 230601 - DNA, 25 bp, Mus musculus
atagagatcttaccatccttccaga

SEQ ID NO: 230602 - DNA, 25 bp, Mus musculus
atagagatcttagcatccttccaga

SEQ ID NO: 230603 - DNA, 25 bp, Mus musculus
atagagattcccagcactctcatgc

SEQ ID NO: 230604 - DNA, 25 bp, Mus musculus
atagagattccctgcactctcatgc

SEQ ID NO: 230605 - DNA, 25 bp, Mus musculus
atagagcactcacctttcgctttta

SEQ ID NO: 230606 - DNA, 25 bp, Mus musculus
atagagcactcagctttcgctttta

SEQ ID NO: 230607 - DNA, 25 bp, Mus musculus
atagagcactgccttctgagaacag

SEQ ID NO: 230608 - DNA, 25 bp, Mus musculus
atagagcactgcgttctgagaacag

SEQ ID NO: 230609 - DNA, 25 bp, Mus musculus
atagagcacttgcacctcccttgta

SEQ ID NO: 230610 - DNA, 25 bp, Mus musculus
atagagcacttggacctcccttgta

SEQ ID NO: 230611 - DNA, 25 bp, Mus musculus
atagagcagcagatcccaaaccctg

SEQ ID NO: 230612 - DNA, 25 bp, Mus musculus
atagagcagcagttcccaaaccctg

SEQ ID NO: 230613 - DNA, 25 bp, Mus musculus
atagagcaggtgagtcttacccgcc

SEQ ID NO: 230614 - DNA, 25 bp, Mus musculus
atagagcaggtgtgtcttacccgcc

SEQ ID NO: 230615 - DNA, 25 bp, Mus musculus
atagagcatagcacctgggcccttc

SEQ ID NO: 230616 - DNA, 25 bp, Mus musculus
atagagcatagctcctgggcccttc

SEQ ID NO: 230617 - DNA, 25 bp, Mus musculus
atagagcatgccaaacatcccagac

SEQ ID NO: 230618 - DNA, 25 bp, Mus musculus
atagagcatgcctaacatcccagac

SEQ ID NO: 230619 - DNA, 25 bp, Mus musculus
atagagccaaatctccagtaaacgc

SEQ ID NO: 230620 - DNA, 25 bp, Mus musculus
atagagccaaatgtccagtaaacgc

SEQ ID NO: 230621 - DNA, 25 bp, Mus musculus
atagagccaatgctggaaacccctc

SEQ ID NO: 230622 - DNA, 25 bp, Mus musculus
atagagccaatggtggaaacccctc

SEQ ID NO: 230623 - DNA, 25 bp, Mus musculus
atagagccaccactatttctgtttt

SEQ ID NO: 230624 - DNA, 25 bp, Mus musculus
atagagccaccagtatttctgtttt

SEQ ID NO: 230625 - DNA, 25 bp, Mus musculus
atagagccacctaattctcccgttt

SEQ ID NO: 230626 - DNA, 25 bp, Mus musculus
atagagccaccttattctcccgttt

SEQ ID NO: 230627 - DNA, 25 bp, Mus musculus
atagagcccatcaccagcacagtgg

SEQ ID NO: 230628 - DNA, 25 bp, Mus musculus
atagagcccatctccagcacagtgg

SEQ ID NO: 230629 - DNA, 25 bp, Mus musculus
atagagccctagattttctgtccat

SEQ ID NO: 230630 - DNA, 25 bp, Mus musculus
atagagccctagtttttctgtccat

SEQ ID NO: 230631 - DNA, 25 bp, Mus musculus
atagagcccttgattatcccagttg

SEQ ID NO: 230632 - DNA, 25 bp, Mus musculus
atagagcccttgtttatcccagttg

SEQ ID NO: 230633 - DNA, 25 bp, Mus musculus
atagagccgctgcagatatttccaa

SEQ ID NO: 230634 - DNA, 25 bp, Mus musculus
atagagccgctggagatatttccaa

SEQ ID NO: 230635 - DNA, 25 bp, Mus musculus
atagagccgtctctacctgccaaag

SEQ ID NO: 230636 - DNA, 25 bp, Mus musculus
atagagccgtctgtacctgccaaag

SEQ ID NO: 230637 - DNA, 25 bp, Mus musculus
atagagcctcgcacacaccatctgg

SEQ ID NO: 230638 - DNA, 25 bp, Mus musculus
atagagcctcgctcacaccatctgg

SEQ ID NO: 230639 - DNA, 25 bp, Mus musculus
atagagcctctgctagatccctgca

SEQ ID NO: 230640 - DNA, 25 bp, Mus musculus
atagagcctctggtagatccctgca

SEQ ID NO: 230641 - DNA, 25 bp, Mus musculus
atagagcctgccatatccaacataa

SEQ ID NO: 230642 - DNA, 25 bp, Mus musculus
atagagcctgccttatccaacataa

SEQ ID NO: 230643 - DNA, 25 bp, Mus musculus
atagagccttgcaagcaccctcatg

SEQ ID NO: 230644 - DNA, 25 bp, Mus musculus
atagagccttgctagcaccctcatg

SEQ ID NO: 230645 - DNA, 25 bp, Mus musculus
atagagcgccaacagtcagtcagaa

SEQ ID NO: 230646 - DNA, 25 bp, Mus musculus
atagagcgccaagagtcagtcagaa

SEQ ID NO: 230647 - DNA, 25 bp, Mus musculus
atagagcgggcccacatgcgattgc

SEQ ID NO: 230648 - DNA, 25 bp, Mus musculus
atagagcgggccgacatgcgattgc

SEQ ID NO: 230649 - DNA, 25 bp, Mus musculus
atagagctacccacagagtgctgga

SEQ ID NO: 230650 - DNA, 25 bp, Mus musculus
atagagctaccctcagagtgctgga

SEQ ID NO: 230651 - DNA, 25 bp, Mus musculus
atagagctagagatccttgtcggtc

SEQ ID NO: 230652 - DNA, 25 bp, Mus musculus
atagagctagagttccttgtcggtc

SEQ ID NO: 230653 - DNA, 25 bp, Mus musculus
atagagctccggacatcaggcttgc

SEQ ID NO: 230654 - DNA, 25 bp, Mus musculus
atagagctccggtcatcaggcttgc

SEQ ID NO: 230655 - DNA, 25 bp, Mus musculus
atagagctgcctactttattccatc

SEQ ID NO: 230656 - DNA, 25 bp, Mus musculus
atagagctgccttctttattccatc

SEQ ID NO: 230657 - DNA, 25 bp, Mus musculus
atagagctgctcattactgtctttc

SEQ ID NO: 230658 - DNA, 25 bp, Mus musculus
atagagctgctctttactgtctttc

SEQ ID NO: 230659 - DNA, 25 bp, Mus musculus
atagagctgcttcgcctagaattgg

SEQ ID NO: 230660 - DNA, 25 bp, Mus musculus
atagagctgcttggcctagaattgg

SEQ ID NO: 230661 - DNA, 25 bp, Mus musculus
atagagctggccatactggctcgcg

SEQ ID NO: 230662 - DNA, 25 bp, Mus musculus
atagagctggccttactggctcgcg

SEQ ID NO: 230663 - DNA, 25 bp, Mus musculus
atagagctggctcttgtggatcctg

SEQ ID NO: 230664 - DNA, 25 bp, Mus musculus
atagagctggctgttgtggatcctg

SEQ ID NO: 230665 - DNA, 25 bp, Mus musculus
atagagctgttcagccgccagacct

SEQ ID NO: 230666 - DNA, 25 bp, Mus musculus
atagagctgttctgccgccagacct

SEQ ID NO: 230667 - DNA, 25 bp, Mus musculus
atagagcttggcatttgagtcagac

SEQ ID NO: 230668 - DNA, 25 bp, Mus musculus
atagagcttggcttttgagtcagac

SEQ ID NO: 230669 - DNA, 25 bp, Mus musculus
atagagctttgcatgtggctatgct

SEQ ID NO: 230670 - DNA, 25 bp, Mus musculus
atagagctttgcttgtggctatgct

SEQ ID NO: 230671 - DNA, 25 bp, Mus musculus
atagaggaaactacccttgtgagtt

SEQ ID NO: 230672 - DNA, 25 bp, Mus musculus
atagaggaaacttcccttgtgagtt

SEQ ID NO: 230673 - DNA, 25 bp, Mus musculus
atagaggaactgcaccgccatctgt

SEQ ID NO: 230674 - DNA, 25 bp, Mus musculus
atagaggaactggaccgccatctgt

SEQ ID NO: 230675 - DNA, 25 bp, Mus musculus
atagaggacaccagcagctcatgct

SEQ ID NO: 230676 - DNA, 25 bp, Mus musculus
atagaggacacctgcagctcatgct

SEQ ID NO: 230677 - DNA, 25 bp, Mus musculus
atagaggaccacagcctggtccatc

SEQ ID NO: 230678 - DNA, 25 bp, Mus musculus
atagaggaccactgcctggtccatc

SEQ ID NO: 230679 - DNA, 25 bp, Mus musculus
atagaggactcacaggctctgcaca

SEQ ID NO: 230680 - DNA, 25 bp, Mus musculus
atagaggactcagaggctctgcaca

SEQ ID NO: 230681 - DNA, 25 bp, Mus musculus
atagaggataccatgtctcttggtt

SEQ ID NO: 230682 - DNA, 25 bp, Mus musculus
atagaggataccttgtctcttggtt

SEQ ID NO: 230683 - DNA, 25 bp, Mus musculus
atagaggcaaatctctctgcaccgg

SEQ ID NO: 230684 - DNA, 25 bp, Mus musculus
atagaggcaaatgtctctgcaccgg

SEQ ID NO: 230685 - DNA, 25 bp, Mus musculus
atagaggcatctactcagctgaggc

SEQ ID NO: 230686 - DNA, 25 bp, Mus musculus
atagaggcatcttctcagctgaggc

SEQ ID NO: 230687 - DNA, 25 bp, Mus musculus
atagaggcatttatacatacgtatt

SEQ ID NO: 230688 - DNA, 25 bp, Mus musculus
atagaggcatttttacatacgtatt

SEQ ID NO: 230689 - DNA, 25 bp, Mus musculus
atagaggccacacgttaggtaggac

SEQ ID NO: 230690 - DNA, 25 bp, Mus musculus
atagaggccacaggttaggtaggac

SEQ ID NO: 230691 - DNA, 25 bp, Mus musculus
atagaggccccaattagtgagagac

SEQ ID NO: 230692 - DNA, 25 bp, Mus musculus
atagaggccccatttagtgagagac

SEQ ID NO: 230693 - DNA, 25 bp, Mus musculus
atagaggcccgacaggccatcttga

SEQ ID NO: 230694 - DNA, 25 bp, Mus musculus
atagaggcccgagaggccatcttga

SEQ ID NO: 230695 - DNA, 25 bp, Mus musculus
atagaggctaggcaagttgctgact

SEQ ID NO: 230696 - DNA, 25 bp, Mus musculus
atagaggctagggaagttgctgact

SEQ ID NO: 230697 - DNA, 25 bp, Mus musculus
atagaggctctcaatgcctactttg

SEQ ID NO: 230698 - DNA, 25 bp, Mus musculus
atagaggctctctatgcctactttg

SEQ ID NO: 230699 - DNA, 25 bp, Mus musculus
atagaggctgccattctgcatgtcg

SEQ ID NO: 230700 - DNA, 25 bp, Mus musculus
atagaggctgcctttctgcatgtcg

SEQ ID NO: 230701 - DNA, 25 bp, Mus musculus
atagaggctgtcagacactctccag

SEQ ID NO: 230702 - DNA, 25 bp, Mus musculus
atagaggctgtctgacactctccag

SEQ ID NO: 230703 - DNA, 25 bp, Mus musculus
atagaggcttcaaggaagcaccctt

SEQ ID NO: 230704 - DNA, 25 bp, Mus musculus
atagaggcttcatggaagcaccctt

SEQ ID NO: 230705 - DNA, 25 bp, Mus musculus
atagagggactaatgagaggagaaa

SEQ ID NO: 230706 - DNA, 25 bp, Mus musculus
atagagggactattgagaggagaaa

SEQ ID NO: 230707 - DNA, 25 bp, Mus musculus
atagagggagtcacggagctcgcca

SEQ ID NO: 230708 - DNA, 25 bp, Mus musculus
atagagggagtcatgcggccaccat

SEQ ID NO: 230709 - DNA, 25 bp, Mus musculus
atagagggagtctcggagctcgcca

SEQ ID NO: 230710 - DNA, 25 bp, Mus musculus
atagagggagtcttgcggccaccat

SEQ ID NO: 230711 - DNA, 25 bp, Mus musculus
atagagggcatcactcccaggtgac

SEQ ID NO: 230712 - DNA, 25 bp, Mus musculus
atagagggcatctctcccaggtgac

SEQ ID NO: 230713 - DNA, 25 bp, Mus musculus
atagagggcccaagatacatgcatc

SEQ ID NO: 230714 - DNA, 25 bp, Mus musculus
atagagggcccatgatacatgcatc

SEQ ID NO: 230715 - DNA, 25 bp, Mus musculus
atagagggcggtacctgtacatgcc

SEQ ID NO: 230716 - DNA, 25 bp, Mus musculus
atagagggcggttcctgtacatgcc

SEQ ID NO: 230717 - DNA, 25 bp, Mus musculus
atagagggctccaacagcgtcttct

SEQ ID NO: 230718 - DNA, 25 bp, Mus musculus
atagagggctccacttctgtctttc

SEQ ID NO: 230719 - DNA, 25 bp, Mus musculus
atagagggctcctacagcgtcttct

SEQ ID NO: 230720 - DNA, 25 bp, Mus musculus
atagagggctcctcttctgtctttc

SEQ ID NO: 230721 - DNA, 25 bp, Mus musculus
atagagggttggacacatcagaaaa

SEQ ID NO: 230722 - DNA, 25 bp, Mus musculus
atagagggttggtcacatcagaaaa

SEQ ID NO: 230723 - DNA, 25 bp, Mus musculus
atagaggtcacaaagagaagtctgt

SEQ ID NO: 230724 - DNA, 25 bp, Mus musculus
atagaggtcacatagagaagtctgt

SEQ ID NO: 230725 - DNA, 25 bp, Mus musculus
atagaggtggcaccctggcatcgtt

SEQ ID NO: 230726 - DNA, 25 bp, Mus musculus
atagaggtggcagcctggcatcgtt

SEQ ID NO: 230727 - DNA, 25 bp, Mus musculus
atagaggtggttctgattctttgac

SEQ ID NO: 230728 - DNA, 25 bp, Mus musculus
atagaggtggttgtgattctttgac

SEQ ID NO: 230729 - DNA, 25 bp, Mus musculus
atagaggttaccatggtcatggtgt

SEQ ID NO: 230730 - DNA, 25 bp, Mus musculus
atagaggttaccttggtcatggtgt

SEQ ID NO: 230731 - DNA, 25 bp, Mus musculus
atagaggttcctaatgtacgataca

SEQ ID NO: 230732 - DNA, 25 bp, Mus musculus
atagaggttccttatgtacgataca

SEQ ID NO: 230733 - DNA, 25 bp, Mus musculus
atagaggttggcagtactgctacac

SEQ ID NO: 230734 - DNA, 25 bp, Mus musculus
atagaggttggctgtactgctacac

SEQ ID NO: 230735 - DNA, 25 bp, Mus musculus
atagagtacctacacccacattaaa

SEQ ID NO: 230736 - DNA, 25 bp, Mus musculus
atagagtacctagacccacattaaa

SEQ ID NO: 230737 - DNA, 25 bp, Mus musculus
atagagtagctcattgtacataaaa

SEQ ID NO: 230738 - DNA, 25 bp, Mus musculus
atagagtagctctttgtacataaaa

SEQ ID NO: 230739 - DNA, 25 bp, Mus musculus
atagagtatgggatcctctccctga

SEQ ID NO: 230740 - DNA, 25 bp, Mus musculus
atagagtatgggttcctctccctga

SEQ ID NO: 230741 - DNA, 25 bp, Mus musculus
atagagtcagctccaagccaccggg

SEQ ID NO: 230742 - DNA, 25 bp, Mus musculus
atagagtcagctgcaagccaccggg

SEQ ID NO: 230743 - DNA, 25 bp, Mus musculus
atagagtcagggataggtagaagta

SEQ ID NO: 230744 - DNA, 25 bp, Mus musculus
atagagtcagggttaggtagaagta

SEQ ID NO: 230745 - DNA, 25 bp, Mus musculus
atagagtccaatctagtccaggctg

SEQ ID NO: 230746 - DNA, 25 bp, Mus musculus
atagagtccaatgtagtccaggctg

SEQ ID NO: 230747 - DNA, 25 bp, Mus musculus
atagagtccaggcacttgtctccat

SEQ ID NO: 230748 - DNA, 25 bp, Mus musculus
atagagtccagggacttgtctccat

SEQ ID NO: 230749 - DNA, 25 bp, Mus musculus
atagagtcccacattcactctgtga

SEQ ID NO: 230750 - DNA, 25 bp, Mus musculus
atagagtcccactttcactctgtga

SEQ ID NO: 230751 - DNA, 25 bp, Mus musculus
atagagtccctactatgacaggcct

SEQ ID NO: 230752 - DNA, 25 bp, Mus musculus
atagagtccctagtatgacaggcct

SEQ ID NO: 230753 - DNA, 25 bp, Mus musculus
atagagtcccttataccatctacac

SEQ ID NO: 230754 - DNA, 25 bp, Mus musculus
atagagtcccttttaccatctacac

SEQ ID NO: 230755 - DNA, 25 bp, Mus musculus
atagagtcctctcactctaaggcac

SEQ ID NO: 230756 - DNA, 25 bp, Mus musculus
atagagtcctctcagcggattggct

SEQ ID NO: 230757 - DNA, 25 bp, Mus musculus
atagagtcctctgactctaaggcac

SEQ ID NO: 230758 - DNA, 25 bp, Mus musculus
atagagtcctctgagcggattggct

SEQ ID NO: 230759 - DNA, 25 bp, Mus musculus
atagagtctattactcaagcacttt

SEQ ID NO: 230760 - DNA, 25 bp, Mus musculus
atagagtctatttctcaagcacttt

SEQ ID NO: 230761 - DNA, 25 bp, Mus musculus
atagagtctcagctgggctgttctt

SEQ ID NO: 230762 - DNA, 25 bp, Mus musculus
atagagtctcaggtgggctgttctt

SEQ ID NO: 230763 - DNA, 25 bp, Mus musculus
atagagtctgtcatcatgggctggg

SEQ ID NO: 230764 - DNA, 25 bp, Mus musculus
atagagtctgtcttcatgggctggg

SEQ ID NO: 230765 - DNA, 25 bp, Mus musculus
atagagtgcaataccctgctcttca

SEQ ID NO: 230766 - DNA, 25 bp, Mus musculus
atagagtgcaattccctgctcttca

SEQ ID NO: 230767 - DNA, 25 bp, Mus musculus
atagagtgcagcacacgctcaaggg

SEQ ID NO: 230768 - DNA, 25 bp, Mus musculus
atagagtgcagctcacgctcaaggg

SEQ ID NO: 230769 - DNA, 25 bp, Mus musculus
atagagtgctacagctcctcagagc

SEQ ID NO: 230770 - DNA, 25 bp, Mus musculus
atagagtgctactgctcctcagagc

SEQ ID NO: 230771 - DNA, 25 bp, Mus musculus
atagagtgctccatgataatcatca

SEQ ID NO: 230772 - DNA, 25 bp, Mus musculus
atagagtgctccttgataatcatca

SEQ ID NO: 230773 - DNA, 25 bp, Mus musculus
atagagtggagcctttcaccattcc

SEQ ID NO: 230774 - DNA, 25 bp, Mus musculus
atagagtggagcgtttcaccattcc

SEQ ID NO: 230775 - DNA, 25 bp, Mus musculus
atagagtggagtcaccaaagcacca

SEQ ID NO: 230776 - DNA, 25 bp, Mus musculus
atagagtggagtgaccaaagcacca

SEQ ID NO: 230777 - DNA, 25 bp, Mus musculus
atagagtgggccagctagccaacta

SEQ ID NO: 230778 - DNA, 25 bp, Mus musculus
atagagtgggcctgctagccaacta

SEQ ID NO: 230779 - DNA, 25 bp, Mus musculus
atagagttatccactgtctttgccc

SEQ ID NO: 230780 - DNA, 25 bp, Mus musculus
atagagttatcctctgtctttgccc

SEQ ID NO: 230781 - DNA, 25 bp, Mus musculus
atagagttccatcctttgggaatcc

SEQ ID NO: 230782 - DNA, 25 bp, Mus musculus
atagagttccatgctttgggaatcc

SEQ ID NO: 230783 - DNA, 25 bp, Mus musculus
atagagttccgcaaagccttcctca

SEQ ID NO: 230784 - DNA, 25 bp, Mus musculus
atagagttccgctaagccttcctca

SEQ ID NO: 230785 - DNA, 25 bp, Mus musculus
atagagttccttctacagaataatt

SEQ ID NO: 230786 - DNA, 25 bp, Mus musculus
atagagttccttgtacagaataatt

SEQ ID NO: 230787 - DNA, 25 bp, Mus musculus
atagagtttatgactttgccagaga

SEQ ID NO: 230788 - DNA, 25 bp, Mus musculus
atagagtttatgtctttgccagaga

SEQ ID NO: 230789 - DNA, 25 bp, Mus musculus
atagagttttctataccatctccag

SEQ ID NO: 230790 - DNA, 25 bp, Mus musculus
atagagttttctttaccatctccag

SEQ ID NO: 230791 - DNA, 25 bp, Mus musculus
atagataacgtcatcctcgtggttc

SEQ ID NO: 230792 - DNA, 25 bp, Mus musculus
atagataacgtcttcctcgtggttc

SEQ ID NO: 230793 - DNA, 25 bp, Mus musculus
atagataccacgacacagccattaa

SEQ ID NO: 230794 - DNA, 25 bp, Mus musculus
atagataccacgtcacagccattaa

SEQ ID NO: 230795 - DNA, 25 bp, Mus musculus
atagataccatgatggttgacctta

SEQ ID NO: 230796 - DNA, 25 bp, Mus musculus
atagataccatgttggttgacctta

SEQ ID NO: 230797 - DNA, 25 bp, Mus musculus
atagataccgccagaataatattca

SEQ ID NO: 230798 - DNA, 25 bp, Mus musculus
atagataccgcctgaataatattca

SEQ ID NO: 230799 - DNA, 25 bp, Mus musculus
atagataccttcagacgaaccagaa

SEQ ID NO: 230800 - DNA, 25 bp, Mus musculus
atagataccttctgacgaaccagaa

SEQ ID NO: 230801 - DNA, 25 bp, Mus musculus
atagatactcttcttccctttctac

SEQ ID NO: 230802 - DNA, 25 bp, Mus musculus
atagatactcttgttccctttctac

SEQ ID NO: 230803 - DNA, 25 bp, Mus musculus
atagatactgatcggatgccaggct

SEQ ID NO: 230804 - DNA, 25 bp, Mus musculus
atagatactgatgggatgccaggct

SEQ ID NO: 230805 - DNA, 25 bp, Mus musculus
atagatacttcccttaactctacca

SEQ ID NO: 230806 - DNA, 25 bp, Mus musculus
atagatacttccgttaactctacca

SEQ ID NO: 230807 - DNA, 25 bp, Mus musculus
atagatagcagcagagcctcatcct

SEQ ID NO: 230808 - DNA, 25 bp, Mus musculus
atagatagcagctgagcctcatcct

SEQ ID NO: 230809 - DNA, 25 bp, Mus musculus
atagatagctctcccttcatatgaa

SEQ ID NO: 230810 - DNA, 25 bp, Mus musculus
atagatagctctgccttcatatgaa

SEQ ID NO: 230811 - DNA, 25 bp, Mus musculus
atagatagctgaccccaccttgtgg

SEQ ID NO: 230812 - DNA, 25 bp, Mus musculus
atagatagctgagcccaccttgtgg

SEQ ID NO: 230813 - DNA, 25 bp, Mus musculus
atagatagggtcatgccctgtatgg

SEQ ID NO: 230814 - DNA, 25 bp, Mus musculus
atagatagggtcttgccctgtatgg

SEQ ID NO: 230815 - DNA, 25 bp, Mus musculus
atagatagtcctctcctactttgct

SEQ ID NO: 230816 - DNA, 25 bp, Mus musculus
atagatagtcctgtcctactttgct

SEQ ID NO: 230817 - DNA, 25 bp, Mus musculus
atagatagtgtcatgttgcaggttc

SEQ ID NO: 230818 - DNA, 25 bp, Mus musculus
atagatagtgtcttgttgcaggttc

SEQ ID NO: 230819 - DNA, 25 bp, Mus musculus
atagatatacacacaaatcaacttt

SEQ ID NO: 230820 - DNA, 25 bp, Mus musculus
atagatatacactcaaatcaacttt

SEQ ID NO: 230821 - DNA, 25 bp, Mus musculus
atagatatgtatctccagctagagt

SEQ ID NO: 230822 - DNA, 25 bp, Mus musculus
atagatatgtatgtccagctagagt

SEQ ID NO: 230823 - DNA, 25 bp, Mus musculus
atagatcaatatattccaatgcatt

SEQ ID NO: 230824 - DNA, 25 bp, Mus musculus
atagatcaatattttccaatgcatt

SEQ ID NO: 230825 - DNA, 25 bp, Mus musculus
atagatcacgtgacaggtgcctctg

SEQ ID NO: 230826 - DNA, 25 bp, Mus musculus
atagatcacgtgtcaggtgcctctg

SEQ ID NO: 230827 - DNA, 25 bp, Mus musculus
atagatcactctcaaagttactcat

SEQ ID NO: 230828 - DNA, 25 bp, Mus musculus
atagatcactctgaaagttactcat

SEQ ID NO: 230829 - DNA, 25 bp, Mus musculus
atagatcagccgcttatctctgcag

SEQ ID NO: 230830 - DNA, 25 bp, Mus musculus
atagatcagccggttatctctgcag

SEQ ID NO: 230831 - DNA, 25 bp, Mus musculus
atagatcaggctagctttaaactca

SEQ ID NO: 230832 - DNA, 25 bp, Mus musculus
atagatcaggcttgctttaaactca

SEQ ID NO: 230833 - DNA, 25 bp, Mus musculus
atagatcagtatccactcacacaca

SEQ ID NO: 230834 - DNA, 25 bp, Mus musculus
atagatcagtatgcactcacacaca

SEQ ID NO: 230835 - DNA, 25 bp, Mus musculus
atagatcattgtcggtgatgccatc

SEQ ID NO: 230836 - DNA, 25 bp, Mus musculus
atagatcattgtgggtgatgccatc

SEQ ID NO: 230837 - DNA, 25 bp, Mus musculus
atagatccacagcagcaactggcat

SEQ ID NO: 230838 - DNA, 25 bp, Mus musculus
atagatccacaggagcaactggcat

SEQ ID NO: 230839 - DNA, 25 bp, Mus musculus
atagatccaggcacgtgattctcct

SEQ ID NO: 230840 - DNA, 25 bp, Mus musculus
atagatccaggctcgtgattctcct

SEQ ID NO: 230841 - DNA, 25 bp, Mus musculus
atagatccatttcttagtgctcttt

SEQ ID NO: 230842 - DNA, 25 bp, Mus musculus
atagatccatttgttagtgctcttt

SEQ ID NO: 230843 - DNA, 25 bp, Mus musculus
atagatcccgccatgtgctccttcg

SEQ ID NO: 230844 - DNA, 25 bp, Mus musculus
atagatcccgccttgtgctccttcg

SEQ ID NO: 230845 - DNA, 25 bp, Mus musculus
atagatccgtctcgcctcacagtca

SEQ ID NO: 230846 - DNA, 25 bp, Mus musculus
atagatccgtctggcctcacagtca

SEQ ID NO: 230847 - DNA, 25 bp, Mus musculus
atagatcctcgcagtgtagttatgc

SEQ ID NO: 230848 - DNA, 25 bp, Mus musculus
atagatcctcgctgtgtagttatgc

SEQ ID NO: 230849 - DNA, 25 bp, Mus musculus
atagatcctcttcagttccatatgg

SEQ ID NO: 230850 - DNA, 25 bp, Mus musculus
atagatcctcttgagttccatatgg

SEQ ID NO: 230851 - DNA, 25 bp, Mus musculus
atagatcctttgatggcaaattgga

SEQ ID NO: 230852 - DNA, 25 bp, Mus musculus
atagatcctttgttggcaaattgga

SEQ ID NO: 230853 - DNA, 25 bp, Mus musculus
atagatcggattcaagttacgcccc

SEQ ID NO: 230854 - DNA, 25 bp, Mus musculus
atagatcggattgaagttacgcccc

SEQ ID NO: 230855 - DNA, 25 bp, Mus musculus
atagatcgtggcacaccaagttcca

SEQ ID NO: 230856 - DNA, 25 bp, Mus musculus
atagatcgtggctcaccaagttcca

SEQ ID NO: 230857 - DNA, 25 bp, Mus musculus
atagatctctttagatgccctgctg

SEQ ID NO: 230858 - DNA, 25 bp, Mus musculus
atagatctcttttgatgccctgctg

SEQ ID NO: 230859 - DNA, 25 bp, Mus musculus
atagatctgagtccttccttaagga

SEQ ID NO: 230860 - DNA, 25 bp, Mus musculus
atagatctgagtgcttccttaagga

SEQ ID NO: 230861 - DNA, 25 bp, Mus musculus
atagatctgccaatggtgccgttct

SEQ ID NO: 230862 - DNA, 25 bp, Mus musculus
atagatctgccattggtgccgttct

SEQ ID NO: 230863 - DNA, 25 bp, Mus musculus
atagatctgcctactttgcgtagac

SEQ ID NO: 230864 - DNA, 25 bp, Mus musculus
atagatctgccttctttgcgtagac

SEQ ID NO: 230865 - DNA, 25 bp, Mus musculus
atagatgacataattccacacacct

SEQ ID NO: 230866 - DNA, 25 bp, Mus musculus
atagatgacatatttccacacacct

SEQ ID NO: 230867 - DNA, 25 bp, Mus musculus
atagatgacatccaggtcccacggt

SEQ ID NO: 230868 - DNA, 25 bp, Mus musculus
atagatgacatcgaggtcccacggt

SEQ ID NO: 230869 - DNA, 25 bp, Mus musculus
atagatgaccagcagaatacaagat

SEQ ID NO: 230870 - DNA, 25 bp, Mus musculus
atagatgaccaggagaatacaagat

SEQ ID NO: 230871 - DNA, 25 bp, Mus musculus
atagatgactgcaacacttcagcca

SEQ ID NO: 230872 - DNA, 25 bp, Mus musculus
atagatgactgctacacttcagcca

SEQ ID NO: 230873 - DNA, 25 bp, Mus musculus
atagatgactttccctttcagctta

SEQ ID NO: 230874 - DNA, 25 bp, Mus musculus
atagatgactttgcctttcagctta

SEQ ID NO: 230875 - DNA, 25 bp, Mus musculus
atagatgagcccctcggtgcttcct

SEQ ID NO: 230876 - DNA, 25 bp, Mus musculus
atagatgagcccgtcggtgcttcct

SEQ ID NO: 230877 - DNA, 25 bp, Mus musculus
atagatgagtgaacagtgcccacat

SEQ ID NO: 230878 - DNA, 25 bp, Mus musculus
atagatgagtgatcagtgcccacat

SEQ ID NO: 230879 - DNA, 25 bp, Mus musculus
atagatgatgctcttctggcatcaa

SEQ ID NO: 230880 - DNA, 25 bp, Mus musculus
atagatgatgctgttctggcatcaa

SEQ ID NO: 230881 - DNA, 25 bp, Mus musculus
atagatgatggcagggagcgtccct

SEQ ID NO: 230882 - DNA, 25 bp, Mus musculus
atagatgatggctgggagcgtccct

SEQ ID NO: 230883 - DNA, 25 bp, Mus musculus
atagatgcaaccatgtgtttagcgt

SEQ ID NO: 230884 - DNA, 25 bp, Mus musculus
atagatgcaaccttgtgtttagcgt

SEQ ID NO: 230885 - DNA, 25 bp, Mus musculus
atagatgcacaaaggagccctgggt

SEQ ID NO: 230886 - DNA, 25 bp, Mus musculus
atagatgcacaatggagccctgggt

SEQ ID NO: 230887 - DNA, 25 bp, Mus musculus
atagatgcacagagagtcccacgaa

SEQ ID NO: 230888 - DNA, 25 bp, Mus musculus
atagatgcacagtgagtcccacgaa

SEQ ID NO: 230889 - DNA, 25 bp, Mus musculus
atagatgcacctaggcctgaagctc

SEQ ID NO: 230890 - DNA, 25 bp, Mus musculus
atagatgcaccttggcctgaagctc

SEQ ID NO: 230891 - DNA, 25 bp, Mus musculus
atagatgcatacagtactaaaataa

SEQ ID NO: 230892 - DNA, 25 bp, Mus musculus
atagatgcatactgtactaaaataa

SEQ ID NO: 230893 - DNA, 25 bp, Mus musculus
atagatgccatcaacctgctgatca

SEQ ID NO: 230894 - DNA, 25 bp, Mus musculus
atagatgccatctacctgctgatca

SEQ ID NO: 230895 - DNA, 25 bp, Mus musculus
atagatgccattctccaggagcagc

SEQ ID NO: 230896 - DNA, 25 bp, Mus musculus
atagatgccattgtccaggagcagc

SEQ ID NO: 230897 - DNA, 25 bp, Mus musculus
atagatgccttgcatcctgcctatg

SEQ ID NO: 230898 - DNA, 25 bp, Mus musculus
atagatgccttggatcctgcctatg

SEQ ID NO: 230899 - DNA, 25 bp, Mus musculus
atagatgcggatccaggagctcagc

SEQ ID NO: 230900 - DNA, 25 bp, Mus musculus
atagatgcggatgcaggagctcagc

SEQ ID NO: 230901 - DNA, 25 bp, Mus musculus
atagatgcgttcatctgcatccatc

SEQ ID NO: 230902 - DNA, 25 bp, Mus musculus
atagatgcgttcttctgcatccatc

SEQ ID NO: 230903 - DNA, 25 bp, Mus musculus
atagatgctgctacatggtctgtcc

SEQ ID NO: 230904 - DNA, 25 bp, Mus musculus
atagatgctgcttcatggtctgtcc

SEQ ID NO: 230905 - DNA, 25 bp, Mus musculus
atagatgctgtacacgtgctcccta

SEQ ID NO: 230906 - DNA, 25 bp, Mus musculus
atagatgctgtagacgtgctcccta

SEQ ID NO: 230907 - DNA, 25 bp, Mus musculus
atagatggaaacactgcagctggaa

SEQ ID NO: 230908 - DNA, 25 bp, Mus musculus
atagatggaaacatctgctccaaat

SEQ ID NO: 230909 - DNA, 25 bp, Mus musculus
atagatggaaactctgcagctggaa

SEQ ID NO: 230910 - DNA, 25 bp, Mus musculus
atagatggaaacttctgctccaaat

SEQ ID NO: 230911 - DNA, 25 bp, Mus musculus
atagatggagtcagggtcacagtgt

SEQ ID NO: 230912 - DNA, 25 bp, Mus musculus
atagatggagtctgggtcacagtgt

SEQ ID NO: 230913 - DNA, 25 bp, Mus musculus
atagatggtctgctcccaagccggt

SEQ ID NO: 230914 - DNA, 25 bp, Mus musculus
atagatggtctggtcccaagccggt

SEQ ID NO: 230915 - DNA, 25 bp, Mus musculus
atagatgtatacagtactttgggca

SEQ ID NO: 230916 - DNA, 25 bp, Mus musculus
atagatgtatactgtactttgggca

SEQ ID NO: 230917 - DNA, 25 bp, Mus musculus
atagatgtatatctccaaggcttgg

SEQ ID NO: 230918 - DNA, 25 bp, Mus musculus
atagatgtatatgtccaaggcttgg

SEQ ID NO: 230919 - DNA, 25 bp, Mus musculus
atagatgtatcaccaccctgatcat

SEQ ID NO: 230920 - DNA, 25 bp, Mus musculus
atagatgtatcagcaccctgatcat

SEQ ID NO: 230921 - DNA, 25 bp, Mus musculus
atagatgtcccaaaactgtcaaatt

SEQ ID NO: 230922 - DNA, 25 bp, Mus musculus
atagatgtcccataactgtcaaatt

SEQ ID NO: 230923 - DNA, 25 bp, Mus musculus
atagatgtccgacggcgctgcaaga

SEQ ID NO: 230924 - DNA, 25 bp, Mus musculus
atagatgtccgagggcgctgcaaga

SEQ ID NO: 230925 - DNA, 25 bp, Mus musculus
atagatgtcgcccagcaagatggaa

SEQ ID NO: 230926 - DNA, 25 bp, Mus musculus
atagatgtcgccgagcaagatggaa

SEQ ID NO: 230927 - DNA, 25 bp, Mus musculus
atagatgtgcatcatacaactctgg

SEQ ID NO: 230928 - DNA, 25 bp, Mus musculus
atagatgtgcatgatacaactctgg

SEQ ID NO: 230929 - DNA, 25 bp, Mus musculus
atagatgtttgcatgtcatccctcc

SEQ ID NO: 230930 - DNA, 25 bp, Mus musculus
atagatgtttgcttgtcatccctcc

SEQ ID NO: 230931 - DNA, 25 bp, Mus musculus
atagattacacacaggtcccagttg

SEQ ID NO: 230932 - DNA, 25 bp, Mus musculus
atagattacacagaggtcccagttg

SEQ ID NO: 230933 - DNA, 25 bp, Mus musculus
atagattacatacatccagcttccc

SEQ ID NO: 230934 - DNA, 25 bp, Mus musculus
atagattacatagatccagcttccc

SEQ ID NO: 230935 - DNA, 25 bp, Mus musculus
atagattagctgaaacccgactgtt

SEQ ID NO: 230936 - DNA, 25 bp, Mus musculus
atagattagctgtaacccgactgtt

SEQ ID NO: 230937 - DNA, 25 bp, Mus musculus
atagattagcttatggaccaaaccc

SEQ ID NO: 230938 - DNA, 25 bp, Mus musculus
atagattagcttttggaccaaaccc

SEQ ID NO: 230939 - DNA, 25 bp, Mus musculus
atagattagtgtctcctgttctgaa

SEQ ID NO: 230940 - DNA, 25 bp, Mus musculus
atagattagtgtgtcctgttctgaa

SEQ ID NO: 230941 - DNA, 25 bp, Mus musculus
atagattcactcaaaggtaggtcga

SEQ ID NO: 230942 - DNA, 25 bp, Mus musculus
atagattcactctaaggtaggtcga

SEQ ID NO: 230943 - DNA, 25 bp, Mus musculus
atagattcctagcataccattgtga

SEQ ID NO: 230944 - DNA, 25 bp, Mus musculus
atagattcctaggataccattgtga

SEQ ID NO: 230945 - DNA, 25 bp, Mus musculus
atagattcctatccatgcacgtgtg

SEQ ID NO: 230946 - DNA, 25 bp, Mus musculus
atagattcctatgcatgcacgtgtg

SEQ ID NO: 230947 - DNA, 25 bp, Mus musculus
atagattctacccacactgcatggg

SEQ ID NO: 230948 - DNA, 25 bp, Mus musculus
atagattctaccgacactgcatggg

SEQ ID NO: 230949 - DNA, 25 bp, Mus musculus
atagattctgagactttcctcacca

SEQ ID NO: 230950 - DNA, 25 bp, Mus musculus
atagattctgagtctttcctcacca

SEQ ID NO: 230951 - DNA, 25 bp, Mus musculus
atagattctggtatctcagcctcac

SEQ ID NO: 230952 - DNA, 25 bp, Mus musculus
atagattctggtttctcagcctcac

SEQ ID NO: 230953 - DNA, 25 bp, Mus musculus
atagattctgtgaccatcccctcat

SEQ ID NO: 230954 - DNA, 25 bp, Mus musculus
atagattctgtgtccatcccctcat

SEQ ID NO: 230955 - DNA, 25 bp, Mus musculus
atagattcttccacagcatcaactg

SEQ ID NO: 230956 - DNA, 25 bp, Mus musculus
atagattcttcctcagcatcaactg

SEQ ID NO: 230957 - DNA, 25 bp, Mus musculus
atagattgacatccagccattagga

SEQ ID NO: 230958 - DNA, 25 bp, Mus musculus
atagattgacatgcagccattagga

SEQ ID NO: 230959 - DNA, 25 bp, Mus musculus
atagattgaccacagctcttcttgt

SEQ ID NO: 230960 - DNA, 25 bp, Mus musculus
atagattgaccagagctcttcttgt

SEQ ID NO: 230961 - DNA, 25 bp, Mus musculus
atagattgcaatctgttgctccgcc

SEQ ID NO: 230962 - DNA, 25 bp, Mus musculus
atagattgcaatgtgttgctccgcc

SEQ ID NO: 230963 - DNA, 25 bp, Mus musculus
atagattggcgcaatgggcccataa

SEQ ID NO: 230964 - DNA, 25 bp, Mus musculus
atagattggcgctatgggcccataa

SEQ ID NO: 230965 - DNA, 25 bp, Mus musculus
atagattggtacaatggtccctttg

SEQ ID NO: 230966 - DNA, 25 bp, Mus musculus
atagattggtactatggtccctttg

SEQ ID NO: 230967 - DNA, 25 bp, Mus musculus
atagattggtttactccctaggtga

SEQ ID NO: 230968 - DNA, 25 bp, Mus musculus
atagattggtttctattcagccgtg

SEQ ID NO: 230969 - DNA, 25 bp, Mus musculus
atagattggtttgtattcagccgtg

SEQ ID NO: 230970 - DNA, 25 bp, Mus musculus
atagattggttttctccctaggtga

SEQ ID NO: 230971 - DNA, 25 bp, Mus musculus
atagatttccttctgggcgagctgg

SEQ ID NO: 230972 - DNA, 25 bp, Mus musculus
atagatttccttgtgggcgagctgg

SEQ ID NO: 230973 - DNA, 25 bp, Mus musculus
atagatttctatagacaaggctgtc

SEQ ID NO: 230974 - DNA, 25 bp, Mus musculus
atagatttctattgacaaggctgtc

SEQ ID NO: 230975 - DNA, 25 bp, Mus musculus
atagatttgtaccacgagccagaga

SEQ ID NO: 230976 - DNA, 25 bp, Mus musculus
atagatttgtacgacgagccagaga

SEQ ID NO: 230977 - DNA, 25 bp, Mus musculus
atagatttgtctaccagagcacatg

SEQ ID NO: 230978 - DNA, 25 bp, Mus musculus
atagatttgtcttccagagcacatg

SEQ ID NO: 230979 - DNA, 25 bp, Mus musculus
atagattttactacactaactctga

SEQ ID NO: 230980 - DNA, 25 bp, Mus musculus
atagattttacttcactaactctga

SEQ ID NO: 230981 - DNA, 25 bp, Mus musculus
atagattttcttccacttttcaaag

SEQ ID NO: 230982 - DNA, 25 bp, Mus musculus
atagattttcttgcacttttcaaag

SEQ ID NO: 230983 - DNA, 25 bp, Mus musculus
atagattttgctagctccagtgcag

SEQ ID NO: 230984 - DNA, 25 bp, Mus musculus
atagattttgcttgctccagtgcag

SEQ ID NO: 230985 - DNA, 25 bp, Mus musculus
atagattttgttcggatcgcccatc

SEQ ID NO: 230986 - DNA, 25 bp, Mus musculus
atagattttgttgggatcgcccatc

SEQ ID NO: 230987 - DNA, 25 bp, Mus musculus
atagcaaaacctctcatcttggacc

SEQ ID NO: 230988 - DNA, 25 bp, Mus musculus
atagcaaaacctgtcatcttggacc

SEQ ID NO: 230989 - DNA, 25 bp, Mus musculus
atagcaaacgaacgaatggtgggaa

SEQ ID NO: 230990 - DNA, 25 bp, Mus musculus
atagcaaacgaaggaatggtgggaa

SEQ ID NO: 230991 - DNA, 25 bp, Mus musculus
atagcaaactttaaggacctgaagc

SEQ ID NO: 230992 - DNA, 25 bp, Mus musculus
atagcaaacttttaggacctgaagc

SEQ ID NO: 230993 - DNA, 25 bp, Mus musculus
atagcaaagctgaaatcccttctgt

SEQ ID NO: 230994 - DNA, 25 bp, Mus musculus
atagcaaagctgtaatcccttctgt

SEQ ID NO: 230995 - DNA, 25 bp, Mus musculus
atagcaaatacactgtccgtccatt

SEQ ID NO: 230996 - DNA, 25 bp, Mus musculus
atagcaaatacagtgtccgtccatt

SEQ ID NO: 230997 - DNA, 25 bp, Mus musculus
atagcaacaaccagcactctgtagt

SEQ ID NO: 230998 - DNA, 25 bp, Mus musculus
atagcaacaacctgcactctgtagt

SEQ ID NO: 230999 - DNA, 25 bp, Mus musculus
atagcaacagagagccttccactag

SEQ ID NO: 231000 - DNA, 25 bp, Mus musculus
atagcaacagagtgccttccactag

SEQ ID NO: 231001 - DNA, 25 bp, Mus musculus
atagcaaccaagctggtccttctca

SEQ ID NO: 231002 - DNA, 25 bp, Mus musculus
atagcaaccaaggtggtccttctca

SEQ ID NO: 231003 - DNA, 25 bp, Mus musculus
atagcaacccgaagtgtttgtctgc

SEQ ID NO: 231004 - DNA, 25 bp, Mus musculus
atagcaacccgatgtgtttgtctgc

SEQ ID NO: 231005 - DNA, 25 bp, Mus musculus
atagcaaccgtgctggtagccaaac

SEQ ID NO: 231006 - DNA, 25 bp, Mus musculus
atagcaaccgtggtggtagccaaac

SEQ ID NO: 231007 - DNA, 25 bp, Mus musculus
atagcaacctgcctctatttgtggg

SEQ ID NO: 231008 - DNA, 25 bp, Mus musculus
atagcaacctgcgtctatttgtggg

SEQ ID NO: 231009 - DNA, 25 bp, Mus musculus
atagcaactcggcaacttttgattg

SEQ ID NO: 231010 - DNA, 25 bp, Mus musculus
atagcaactcgggaacttttgattg

SEQ ID NO: 231011 - DNA, 25 bp, Mus musculus
atagcaactcttaggccattttgtt

SEQ ID NO: 231012 - DNA, 25 bp, Mus musculus
atagcaactctttggccattttgtt

SEQ ID NO: 231013 - DNA, 25 bp, Mus musculus
atagcaagaaagcaggtcctagaac

SEQ ID NO: 231014 - DNA, 25 bp, Mus musculus
atagcaagaaaggaggtcctagaac

SEQ ID NO: 231015 - DNA, 25 bp, Mus musculus
atagcaagatccagaaccccaggtt

SEQ ID NO: 231016 - DNA, 25 bp, Mus musculus
atagcaagatcctgaaccccaggtt

SEQ ID NO: 231017 - DNA, 25 bp, Mus musculus
atagcaagcactactttggaagaca

SEQ ID NO: 231018 - DNA, 25 bp, Mus musculus
atagcaagcacttctttggaagaca

SEQ ID NO: 231019 - DNA, 25 bp, Mus musculus
atagcaagccccaaagagcacacgg

SEQ ID NO: 231020 - DNA, 25 bp, Mus musculus
atagcaagcccctaagagcacacgg

SEQ ID NO: 231021 - DNA, 25 bp, Mus musculus
atagcaagccgcagcttactagctt

SEQ ID NO: 231022 - DNA, 25 bp, Mus musculus
atagcaagccgctgcttactagctt

SEQ ID NO: 231023 - DNA, 25 bp, Mus musculus
atagcaaggttacttagcctgagct

SEQ ID NO: 231024 - DNA, 25 bp, Mus musculus
atagcaaggttagttagcctgagct

SEQ ID NO: 231025 - DNA, 25 bp, Mus musculus
atagcaagtgtaccccatggtattt

SEQ ID NO: 231026 - DNA, 25 bp, Mus musculus
atagcaagtgtagcccatggtattt

SEQ ID NO: 231027 - DNA, 25 bp, Mus musculus
atagcaatattaaactgtccccaga

SEQ ID NO: 231028 - DNA, 25 bp, Mus musculus
atagcaatattatactgtccccaga

SEQ ID NO: 231029 - DNA, 25 bp, Mus musculus
atagcaatccaacgtggccctctgt

SEQ ID NO: 231030 - DNA, 25 bp, Mus musculus
atagcaatccaaggtggccctctgt

SEQ ID NO: 231031 - DNA, 25 bp, Mus musculus
atagcaatctgtcattttaccttaa

SEQ ID NO: 231032 - DNA, 25 bp, Mus musculus
atagcaatctgtgattttaccttaa

SEQ ID NO: 231033 - DNA, 25 bp, Mus musculus
atagcaattgtcattgtctctccat

SEQ ID NO: 231034 - DNA, 25 bp, Mus musculus
atagcaattgtctttgtctctccat

SEQ ID NO: 231035 - DNA, 25 bp, Mus musculus
atagcacaaagtatttccccactct

SEQ ID NO: 231036 - DNA, 25 bp, Mus musculus
atagcacaaagtttttccccactct

SEQ ID NO: 231037 - DNA, 25 bp, Mus musculus
atagcacaaattcagcccagccaga

SEQ ID NO: 231038 - DNA, 25 bp, Mus musculus
atagcacaaattgagcccagccaga

SEQ ID NO: 231039 - DNA, 25 bp, Mus musculus
atagcacaagctcggtcgccattta

SEQ ID NO: 231040 - DNA, 25 bp, Mus musculus
atagcacaagctgggtcgccattta

SEQ ID NO: 231041 - DNA, 25 bp, Mus musculus
atagcacaagttatactgttccgta

SEQ ID NO: 231042 - DNA, 25 bp, Mus musculus
atagcacaagttttactgttccgta

SEQ ID NO: 231043 - DNA, 25 bp, Mus musculus
atagcacaatgtcgcctgtcttcac

SEQ ID NO: 231044 - DNA, 25 bp, Mus musculus
atagcacaatgtggcctgtcttcac

SEQ ID NO: 231045 - DNA, 25 bp, Mus musculus
atagcacacaagctgcagccatagc

SEQ ID NO: 231046 - DNA, 25 bp, Mus musculus
atagcacacaaggtgcagccatagc

SEQ ID NO: 231047 - DNA, 25 bp, Mus musculus
atagcacacagacattaccagcctc

SEQ ID NO: 231048 - DNA, 25 bp, Mus musculus
atagcacacagagattaccagcctc

SEQ ID NO: 231049 - DNA, 25 bp, Mus musculus
atagcacacatgatttccatagtaa

SEQ ID NO: 231050 - DNA, 25 bp, Mus musculus
atagcacacatgttttccatagtaa

SEQ ID NO: 231051 - DNA, 25 bp, Mus musculus
atagcacagccaaattacatcccaa

SEQ ID NO: 231052 - DNA, 25 bp, Mus musculus
atagcacagccacggtagcactcag

SEQ ID NO: 231053 - DNA, 25 bp, Mus musculus
atagcacagccagggtagcactcag

SEQ ID NO: 231054 - DNA, 25 bp, Mus musculus
atagcacagccatattacatcccaa

SEQ ID NO: 231055 - DNA, 25 bp, Mus musculus
atagcacagggacagaccatggcat

SEQ ID NO: 231056 - DNA, 25 bp, Mus musculus
atagcacagggagagaccatggcat

SEQ ID NO: 231057 - DNA, 25 bp, Mus musculus
atagcacaggtaagggctcagcggt

SEQ ID NO: 231058 - DNA, 25 bp, Mus musculus
atagcacaggtaattcttcatcgga

SEQ ID NO: 231059 - DNA, 25 bp, Mus musculus
atagcacaggtatgggctcagcggt

SEQ ID NO: 231060 - DNA, 25 bp, Mus musculus
atagcacaggtatttcttcatcgga

SEQ ID NO: 231061 - DNA, 25 bp, Mus musculus
atagcacagtctatacctgcctctc

SEQ ID NO: 231062 - DNA, 25 bp, Mus musculus
atagcacagtctttacctgcctctc

SEQ ID NO: 231063 - DNA, 25 bp, Mus musculus
atagcacatctaaagttggcactca

SEQ ID NO: 231064 - DNA, 25 bp, Mus musculus
atagcacatctatagttggcactca

SEQ ID NO: 231065 - DNA, 25 bp, Mus musculus
atagcacatgacctttctcttcttc

SEQ ID NO: 231066 - DNA, 25 bp, Mus musculus
atagcacatgacgtttctcttcttc

SEQ ID NO: 231067 - DNA, 25 bp, Mus musculus
atagcacatgtccagaaatcccagc

SEQ ID NO: 231068 - DNA, 25 bp, Mus musculus
atagcacatgtcgagaaatcccagc

SEQ ID NO: 231069 - DNA, 25 bp, Mus musculus
atagcaccaaacagccctggttttg

SEQ ID NO: 231070 - DNA, 25 bp, Mus musculus
atagcaccaaactgccctggttttg

SEQ ID NO: 231071 - DNA, 25 bp, Mus musculus
atagcaccacaaccagattcttcct

SEQ ID NO: 231072 - DNA, 25 bp, Mus musculus
atagcaccacaagcagattcttcct

SEQ ID NO: 231073 - DNA, 25 bp, Mus musculus
atagcaccaccaacatcagttctag

SEQ ID NO: 231074 - DNA, 25 bp, Mus musculus
atagcaccaccatcatcagttctag

SEQ ID NO: 231075 - DNA, 25 bp, Mus musculus
atagcaccaggaattctacccactg

SEQ ID NO: 231076 - DNA, 25 bp, Mus musculus
atagcaccaggatttctacccactg

SEQ ID NO: 231077 - DNA, 25 bp, Mus musculus
atagcaccaggcactgaggctcagg

SEQ ID NO: 231078 - DNA, 25 bp, Mus musculus
atagcaccaggctctgaggctcagg

SEQ ID NO: 231079 - DNA, 25 bp, Mus musculus
atagcacccagacgctggaggcgat

SEQ ID NO: 231080 - DNA, 25 bp, Mus musculus
atagcacccagaggctggaggcgat

SEQ ID NO: 231081 - DNA, 25 bp, Mus musculus
atagcacctcagaatgtggctgtta

SEQ ID NO: 231082 - DNA, 25 bp, Mus musculus
atagcacctcagtatgtggctgtta

SEQ ID NO: 231083 - DNA, 25 bp, Mus musculus
atagcacctgtacatggctctcact

SEQ ID NO: 231084 - DNA, 25 bp, Mus musculus
atagcacctgtagatggctctcact

SEQ ID NO: 231085 - DNA, 25 bp, Mus musculus
atagcacctttgactgacctgacat

SEQ ID NO: 231086 - DNA, 25 bp, Mus musculus
atagcacctttgtctgacctgacat

SEQ ID NO: 231087 - DNA, 25 bp, Mus musculus
atagcacgagttcttcttccagaag

SEQ ID NO: 231088 - DNA, 25 bp, Mus musculus
atagcacgagttgttcttccagaag

SEQ ID NO: 231089 - DNA, 25 bp, Mus musculus
atagcacgcaagactctggagcaca

SEQ ID NO: 231090 - DNA, 25 bp, Mus musculus
atagcacgcaagtctctggagcaca

SEQ ID NO: 231091 - DNA, 25 bp, Mus musculus
atagcacgcgttagactgctgatcc

SEQ ID NO: 231092 - DNA, 25 bp, Mus musculus
atagcacgcgtttgactgctgatcc

SEQ ID NO: 231093 - DNA, 25 bp, Mus musculus
atagcacggcagacttagcactcac

SEQ ID NO: 231094 - DNA, 25 bp, Mus musculus
atagcacggcagtcttagcactcac

SEQ ID NO: 231095 - DNA, 25 bp, Mus musculus
atagcacggctcctcttgaattgag

SEQ ID NO: 231096 - DNA, 25 bp, Mus musculus
atagcacggctcgtcttgaattgag

SEQ ID NO: 231097 - DNA, 25 bp, Mus musculus
atagcactaaaaagcaaccctgtat

SEQ ID NO: 231098 - DNA, 25 bp, Mus musculus
atagcactaaaaccaacatcctttg

SEQ ID NO: 231099 - DNA, 25 bp, Mus musculus
atagcactaaaagcaacatcctttg

SEQ ID NO: 231100 - DNA, 25 bp, Mus musculus
atagcactaaaatgcaaccctgtat

SEQ ID NO: 231101 - DNA, 25 bp, Mus musculus
atagcactaaccaatgcctttttag

SEQ ID NO: 231102 - DNA, 25 bp, Mus musculus
atagcactaacctatgcctttttag

SEQ ID NO: 231103 - DNA, 25 bp, Mus musculus
atagcactaatgctgcctcctgaca

SEQ ID NO: 231104 - DNA, 25 bp, Mus musculus
atagcactaatggtgcctcctgaca

SEQ ID NO: 231105 - DNA, 25 bp, Mus musculus
atagcactatataccctcatacact

SEQ ID NO: 231106 - DNA, 25 bp, Mus musculus
atagcactatattccctcatacact

SEQ ID NO: 231107 - DNA, 25 bp, Mus musculus
atagcactcactccatctgattctg

SEQ ID NO: 231108 - DNA, 25 bp, Mus musculus
atagcactcactgcatctgattctg

SEQ ID NO: 231109 - DNA, 25 bp, Mus musculus
atagcactcatgattgcataccggt

SEQ ID NO: 231110 - DNA, 25 bp, Mus musculus
atagcactcatgtttgcataccggt

SEQ ID NO: 231111 - DNA, 25 bp, Mus musculus
atagcactctatcctatcctgatga

SEQ ID NO: 231112 - DNA, 25 bp, Mus musculus
atagcactctatgctatcctgatga

SEQ ID NO: 231113 - DNA, 25 bp, Mus musculus
atagcactgctaccctaggttcttt

SEQ ID NO: 231114 - DNA, 25 bp, Mus musculus
atagcactgctagcctaggttcttt

SEQ ID NO: 231115 - DNA, 25 bp, Mus musculus
atagcactggacctgccaggcacat

SEQ ID NO: 231116 - DNA, 25 bp, Mus musculus
atagcactggacgtgccaggcacat

SEQ ID NO: 231117 - DNA, 25 bp, Mus musculus
atagcacttcatctttttgagtaac

SEQ ID NO: 231118 - DNA, 25 bp, Mus musculus
atagcacttcatgtttttgagtaac

SEQ ID NO: 231119 - DNA, 25 bp, Mus musculus
atagcacttgggatgttaagcttat

SEQ ID NO: 231120 - DNA, 25 bp, Mus musculus
atagcacttgggttgttaagcttat

SEQ ID NO: 231121 - DNA, 25 bp, Mus musculus
atagcagaagttcgccagagctgat

SEQ ID NO: 231122 - DNA, 25 bp, Mus musculus
atagcagaagttggccagagctgat

SEQ ID NO: 231123 - DNA, 25 bp, Mus musculus
atagcagaatgtaattaatgacact

SEQ ID NO: 231124 - DNA, 25 bp, Mus musculus
atagcagaatgttattaatgacact

SEQ ID NO: 231125 - DNA, 25 bp, Mus musculus
atagcagacaatccccttgctgagc

SEQ ID NO: 231126 - DNA, 25 bp, Mus musculus
atagcagacaatgcccttgctgagc

SEQ ID NO: 231127 - DNA, 25 bp, Mus musculus
atagcagaccgacagttcctggcca

SEQ ID NO: 231128 - DNA, 25 bp, Mus musculus
atagcagaccgagagttcctggcca

SEQ ID NO: 231129 - DNA, 25 bp, Mus musculus
atagcagagcgtatctgtccagcta

SEQ ID NO: 231130 - DNA, 25 bp, Mus musculus
atagcagagcgtttctgtccagcta

SEQ ID NO: 231131 - DNA, 25 bp, Mus musculus
atagcagagctgaataccagtgata

SEQ ID NO: 231132 - DNA, 25 bp, Mus musculus
atagcagagctgtataccagtgata

SEQ ID NO: 231133 - DNA, 25 bp, Mus musculus
atagcagaggcaccatcaaggtcaa

SEQ ID NO: 231134 - DNA, 25 bp, Mus musculus
atagcagaggcagcatcaaggtcaa

SEQ ID NO: 231135 - DNA, 25 bp, Mus musculus
atagcagagttgctgatccatcagg

SEQ ID NO: 231136 - DNA, 25 bp, Mus musculus
atagcagagttggtgatccatcagg

SEQ ID NO: 231137 - DNA, 25 bp, Mus musculus
atagcagatagcacctgaggcctgg

SEQ ID NO: 231138 - DNA, 25 bp, Mus musculus
atagcagatagctcctgaggcctgg

SEQ ID NO: 231139 - DNA, 25 bp, Mus musculus
atagcagatccgatgccagttacct

SEQ ID NO: 231140 - DNA, 25 bp, Mus musculus
atagcagatccgttgccagttacct

SEQ ID NO: 231141 - DNA, 25 bp, Mus musculus
atagcagatgcaatggtttgccaac

SEQ ID NO: 231142 - DNA, 25 bp, Mus musculus
atagcagatgcattggtttgccaac

SEQ ID NO: 231143 - DNA, 25 bp, Mus musculus
atagcagatgccagtggtcggccac

SEQ ID NO: 231144 - DNA, 25 bp, Mus musculus
atagcagatgcctgtggtcggccac

SEQ ID NO: 231145 - DNA, 25 bp, Mus musculus
atagcagcaaggcagccctgggtcc

SEQ ID NO: 231146 - DNA, 25 bp, Mus musculus
atagcagcaagggagccctgggtcc

SEQ ID NO: 231147 - DNA, 25 bp, Mus musculus
atagcagcaatgacaagggtcaact

SEQ ID NO: 231148 - DNA, 25 bp, Mus musculus
atagcagcaatgtcaagggtcaact

SEQ ID NO: 231149 - DNA, 25 bp, Mus musculus
atagcagcacccagggacctctcag

SEQ ID NO: 231150 - DNA, 25 bp, Mus musculus
atagcagcaccctgggacctctcag

SEQ ID NO: 231151 - DNA, 25 bp, Mus musculus
atagcagcagacagtcgggccctgg

SEQ ID NO: 231152 - DNA, 25 bp, Mus musculus
atagcagcagactgtcgggccctgg

SEQ ID NO: 231153 - DNA, 25 bp, Mus musculus
atagcagcattgaacatagcctcgg

SEQ ID NO: 231154 - DNA, 25 bp, Mus musculus
atagcagcattgtacatagcctcgg

SEQ ID NO: 231155 - DNA, 25 bp, Mus musculus
atagcagccaggagatgcagggcat

SEQ ID NO: 231156 - DNA, 25 bp, Mus musculus
atagcagccaggtgatgcagggcat

SEQ ID NO: 231157 - DNA, 25 bp, Mus musculus
atagcagcccttacaagttgtttct

SEQ ID NO: 231158 - DNA, 25 bp, Mus musculus
atagcagccctttcaagttgtttct

SEQ ID NO: 231159 - DNA, 25 bp, Mus musculus
atagcagcctaacatgtcatacagt

SEQ ID NO: 231160 - DNA, 25 bp, Mus musculus
atagcagcctaagatgtcatacagt

SEQ ID NO: 231161 - DNA, 25 bp, Mus musculus
atagcagcgtctaactttgtctcct

SEQ ID NO: 231162 - DNA, 25 bp, Mus musculus
atagcagcgtcttactttgtctcct

SEQ ID NO: 231163 - DNA, 25 bp, Mus musculus
atagcagcgttaagtacaatcctta

SEQ ID NO: 231164 - DNA, 25 bp, Mus musculus
atagcagcgttatgtacaatcctta

SEQ ID NO: 231165 - DNA, 25 bp, Mus musculus
atagcagctcagacagatgtgccat

SEQ ID NO: 231166 - DNA, 25 bp, Mus musculus
atagcagctcagtcagatgtgccat

SEQ ID NO: 231167 - DNA, 25 bp, Mus musculus
atagcagctgtcctaggattggcct

SEQ ID NO: 231168 - DNA, 25 bp, Mus musculus
atagcagctgtcgtaggattggcct

SEQ ID NO: 231169 - DNA, 25 bp, Mus musculus
atagcagcttacagggtaatcccac

SEQ ID NO: 231170 - DNA, 25 bp, Mus musculus
atagcagcttactgggtaatcccac

SEQ ID NO: 231171 - DNA, 25 bp, Mus musculus
atagcagcttctccatcgacaaggt

SEQ ID NO: 231172 - DNA, 25 bp, Mus musculus
atagcagcttctgcatcgacaaggt

SEQ ID NO: 231173 - DNA, 25 bp, Mus musculus
atagcaggaaacagaccgggacaaa

SEQ ID NO: 231174 - DNA, 25 bp, Mus musculus
atagcaggaaactgaccgggacaaa

SEQ ID NO: 231175 - DNA, 25 bp, Mus musculus
atagcaggacccagtaatcctgtca

SEQ ID NO: 231176 - DNA, 25 bp, Mus musculus
atagcaggaccctgtaatcctgtca

SEQ ID NO: 231177 - DNA, 25 bp, Mus musculus
atagcaggagctcatgtctttaaaa

SEQ ID NO: 231178 - DNA, 25 bp, Mus musculus
atagcaggagctccatggtcaaatc

SEQ ID NO: 231179 - DNA, 25 bp, Mus musculus
atagcaggagctgatgtctttaaaa

SEQ ID NO: 231180 - DNA, 25 bp, Mus musculus
atagcaggagctgcatggtcaaatc

SEQ ID NO: 231181 - DNA, 25 bp, Mus musculus
atagcaggattcatcctcggaacaa

SEQ ID NO: 231182 - DNA, 25 bp, Mus musculus
atagcaggattcttcctcggaacaa

SEQ ID NO: 231183 - DNA, 25 bp, Mus musculus
atagcagggcctaggataaccagaa

SEQ ID NO: 231184 - DNA, 25 bp, Mus musculus
atagcagggccttggataaccagaa

SEQ ID NO: 231185 - DNA, 25 bp, Mus musculus
atagcagggtccactcgtccggcag

SEQ ID NO: 231186 - DNA, 25 bp, Mus musculus
atagcagggtcctctcgtccggcag

SEQ ID NO: 231187 - DNA, 25 bp, Mus musculus
atagcagggttacaagcttggagtt

SEQ ID NO: 231188 - DNA, 25 bp, Mus musculus
atagcagggttagaagcttggagtt

SEQ ID NO: 231189 - DNA, 25 bp, Mus musculus
atagcaggtgttcgccatcttgggt

SEQ ID NO: 231190 - DNA, 25 bp, Mus musculus
atagcaggtgttggccatcttgggt

SEQ ID NO: 231191 - DNA, 25 bp, Mus musculus
atagcagtaacacccttgggtttag

SEQ ID NO: 231192 - DNA, 25 bp, Mus musculus
atagcagtaacagccttgggtttag

SEQ ID NO: 231193 - DNA, 25 bp, Mus musculus
atagcagtaccaagtcatgttatat

SEQ ID NO: 231194 - DNA, 25 bp, Mus musculus
atagcagtaccatgtcatgttatat

SEQ ID NO: 231195 - DNA, 25 bp, Mus musculus
atagcagtccctacggtgctggcta

SEQ ID NO: 231196 - DNA, 25 bp, Mus musculus
atagcagtcccttcggtgctggcta

SEQ ID NO: 231197 - DNA, 25 bp, Mus musculus
atagcagtcggacttgctgcctttg

SEQ ID NO: 231198 - DNA, 25 bp, Mus musculus
atagcagtcggagttgctgcctttg

SEQ ID NO: 231199 - DNA, 25 bp, Mus musculus
atagcagtctccatgggtgtgcgcc

SEQ ID NO: 231200 - DNA, 25 bp, Mus musculus
atagcagtctccattcttttgacag

SEQ ID NO: 231201 - DNA, 25 bp, Mus musculus
atagcagtctccttgggtgtgcgcc

SEQ ID NO: 231202 - DNA, 25 bp, Mus musculus
atagcagtctcctttcttttgacag

SEQ ID NO: 231203 - DNA, 25 bp, Mus musculus
atagcagtgaccacacttcttggaa

SEQ ID NO: 231204 - DNA, 25 bp, Mus musculus
atagcagtgacctcacttcttggaa

SEQ ID NO: 231205 - DNA, 25 bp, Mus musculus
atagcagtgatcaccttggttttaa

SEQ ID NO: 231206 - DNA, 25 bp, Mus musculus
atagcagtgatctccttggttttaa

SEQ ID NO: 231207 - DNA, 25 bp, Mus musculus
atagcagtgggcctggtcagcattc

SEQ ID NO: 231208 - DNA, 25 bp, Mus musculus
atagcagtgggcgtggtcagcattc

SEQ ID NO: 231209 - DNA, 25 bp, Mus musculus
atagcagttacacctgccaggtcac

SEQ ID NO: 231210 - DNA, 25 bp, Mus musculus
atagcagttacagctgccaggtcac

SEQ ID NO: 231211 - DNA, 25 bp, Mus musculus
atagcagttattaaccacatagtgg

SEQ ID NO: 231212 - DNA, 25 bp, Mus musculus
atagcagttatttaccacatagtgg

SEQ ID NO: 231213 - DNA, 25 bp, Mus musculus
atagcagttcctactgtgtgcgcag

SEQ ID NO: 231214 - DNA, 25 bp, Mus musculus
atagcagttccttctgtgtgcgcag

SEQ ID NO: 231215 - DNA, 25 bp, Mus musculus
atagcagttctaaaaatccctttgt

SEQ ID NO: 231216 - DNA, 25 bp, Mus musculus
atagcagttctaaagggccattctc

SEQ ID NO: 231217 - DNA, 25 bp, Mus musculus
atagcagttctataaatccctttgt

SEQ ID NO: 231218 - DNA, 25 bp, Mus musculus
atagcagttctatagggccattctc

SEQ ID NO: 231219 - DNA, 25 bp, Mus musculus
atagcagttctgagcaagtgaggac

SEQ ID NO: 231220 - DNA, 25 bp, Mus musculus
atagcagttctgtgcaagtgaggac

SEQ ID NO: 231221 - DNA, 25 bp, Mus musculus
atagcagtttccagtggagcccttc

SEQ ID NO: 231222 - DNA, 25 bp, Mus musculus
atagcagtttcctgtggagcccttc

SEQ ID NO: 231223 - DNA, 25 bp, Mus musculus
atagcataaaaaacctttgccgagg

SEQ ID NO: 231224 - DNA, 25 bp, Mus musculus
atagcataaaaatcctttgccgagg

SEQ ID NO: 231225 - DNA, 25 bp, Mus musculus
atagcatacagcatttctctgtcct

SEQ ID NO: 231226 - DNA, 25 bp, Mus musculus
atagcatacagcttttctctgtcct

SEQ ID NO: 231227 - DNA, 25 bp, Mus musculus
atagcatacttcctgtcattagact

SEQ ID NO: 231228 - DNA, 25 bp, Mus musculus
atagcatacttcgtgtcattagact

SEQ ID NO: 231229 - DNA, 25 bp, Mus musculus
atagcataggccagtctctttcgtt

SEQ ID NO: 231230 - DNA, 25 bp, Mus musculus
atagcataggcctgtctctttcgtt

SEQ ID NO: 231231 - DNA, 25 bp, Mus musculus
atagcatagggcctggtccacagca

SEQ ID NO: 231232 - DNA, 25 bp, Mus musculus
atagcatagggcgtggtccacagca

SEQ ID NO: 231233 - DNA, 25 bp, Mus musculus
atagcatcaccaatatttcggccat

SEQ ID NO: 231234 - DNA, 25 bp, Mus musculus
atagcatcaccattatttcggccat

SEQ ID NO: 231235 - DNA, 25 bp, Mus musculus
atagcatcatgcctgtcttagagga

SEQ ID NO: 231236 - DNA, 25 bp, Mus musculus
atagcatcatgcgtgtcttagagga

SEQ ID NO: 231237 - DNA, 25 bp, Mus musculus
atagcatcatggcacacaggcaagg

SEQ ID NO: 231238 - DNA, 25 bp, Mus musculus
atagcatcatgggacacaggcaagg

SEQ ID NO: 231239 - DNA, 25 bp, Mus musculus
atagcatcatgtagcgtctcaggac

SEQ ID NO: 231240 - DNA, 25 bp, Mus musculus
atagcatcatgttgcgtctcaggac

SEQ ID NO: 231241 - DNA, 25 bp, Mus musculus
atagcatccttcattctctttgtag

SEQ ID NO: 231242 - DNA, 25 bp, Mus musculus
atagcatccttctttctctttgtag

SEQ ID NO: 231243 - DNA, 25 bp, Mus musculus
atagcatctatcattcgcccctcag

SEQ ID NO: 231244 - DNA, 25 bp, Mus musculus
atagcatctatctttcgcccctcag

SEQ ID NO: 231245 - DNA, 25 bp, Mus musculus
atagcatcttagatctcactatccc

SEQ ID NO: 231246 - DNA, 25 bp, Mus musculus
atagcatcttagttctcactatccc

SEQ ID NO: 231247 - DNA, 25 bp, Mus musculus
atagcatcttcactgattccactgt

SEQ ID NO: 231248 - DNA, 25 bp, Mus musculus
atagcatcttcagtgattccactgt

SEQ ID NO: 231249 - DNA, 25 bp, Mus musculus
atagcatgatgcacacctctgctgg

SEQ ID NO: 231250 - DNA, 25 bp, Mus musculus
atagcatgatgctcacctctgctgg

SEQ ID NO: 231251 - DNA, 25 bp, Mus musculus
atagcatgattgcacgctgcagcaa

SEQ ID NO: 231252 - DNA, 25 bp, Mus musculus
atagcatgattggacgctgcagcaa

SEQ ID NO: 231253 - DNA, 25 bp, Mus musculus
atagcatgcaacaaaacgtctttat

SEQ ID NO: 231254 - DNA, 25 bp, Mus musculus
atagcatgcaactaaacgtctttat

SEQ ID NO: 231255 - DNA, 25 bp, Mus musculus
atagcatgcatgcagtcctggttcc

SEQ ID NO: 231256 - DNA, 25 bp, Mus musculus
atagcatgcatggagtcctggttcc

SEQ ID NO: 231257 - DNA, 25 bp, Mus musculus
atagcatgccatcggctctgtgagg

SEQ ID NO: 231258 - DNA, 25 bp, Mus musculus
atagcatgccatgggctctgtgagg

SEQ ID NO: 231259 - DNA, 25 bp, Mus musculus
atagcatgcgctcccttggagttgt

SEQ ID NO: 231260 - DNA, 25 bp, Mus musculus
atagcatgcgctgccttggagttgt

SEQ ID NO: 231261 - DNA, 25 bp, Mus musculus
atagcatggaccataccgggcagaa

SEQ ID NO: 231262 - DNA, 25 bp, Mus musculus
atagcatggaccttaccgggcagaa

SEQ ID NO: 231263 - DNA, 25 bp, Mus musculus
atagcatggcgtacaaagggaaatc

SEQ ID NO: 231264 - DNA, 25 bp, Mus musculus
atagcatggcgttcaaagggaaatc

SEQ ID NO: 231265 - DNA, 25 bp, Mus musculus
atagcatgtgcccagtgtgagctga

SEQ ID NO: 231266 - DNA, 25 bp, Mus musculus
atagcatgtgccgagtgtgagctga

SEQ ID NO: 231267 - DNA, 25 bp, Mus musculus
atagcatgtgggaccattctgcttc

SEQ ID NO: 231268 - DNA, 25 bp, Mus musculus
atagcatgtgggtccattctgcttc

SEQ ID NO: 231269 - DNA, 25 bp, Mus musculus
atagcatgttcacgtccctgggttc

SEQ ID NO: 231270 - DNA, 25 bp, Mus musculus
atagcatgttcaggtccctgggttc

SEQ ID NO: 231271 - DNA, 25 bp, Mus musculus
atagcattacgtaatcttggaaaat

SEQ ID NO: 231272 - DNA, 25 bp, Mus musculus
atagcattacgttatcttggaaaat

SEQ ID NO: 231273 - DNA, 25 bp, Mus musculus
atagcattactcattctattcacta

SEQ ID NO: 231274 - DNA, 25 bp, Mus musculus
atagcattactctttctattcacta

SEQ ID NO: 231275 - DNA, 25 bp, Mus musculus
atagcattatatacttcccagaccc

SEQ ID NO: 231276 - DNA, 25 bp, Mus musculus
atagcattatattcttcccagaccc

SEQ ID NO: 231277 - DNA, 25 bp, Mus musculus
atagcattccccaagtttttaatgg

SEQ ID NO: 231278 - DNA, 25 bp, Mus musculus
atagcattcccctagtttttaatgg

SEQ ID NO: 231279 - DNA, 25 bp, Mus musculus
atagcattcctgaacgtctggacta

SEQ ID NO: 231280 - DNA, 25 bp, Mus musculus
atagcattcctgtacgtctggacta

SEQ ID NO: 231281 - DNA, 25 bp, Mus musculus
atagcattctcactgtggcccacac

SEQ ID NO: 231282 - DNA, 25 bp, Mus musculus
atagcattctcagtgtggcccacac

SEQ ID NO: 231283 - DNA, 25 bp, Mus musculus
atagcattgctaacagtactggtct

SEQ ID NO: 231284 - DNA, 25 bp, Mus musculus
atagcattgctatcagtactggtct

SEQ ID NO: 231285 - DNA, 25 bp, Mus musculus
atagcattgggcctacttaaggaca

SEQ ID NO: 231286 - DNA, 25 bp, Mus musculus
atagcattgggcgtacttaaggaca

SEQ ID NO: 231287 - DNA, 25 bp, Mus musculus
atagcattgtggctattatctccct

SEQ ID NO: 231288 - DNA, 25 bp, Mus musculus
atagcattgtgggtattatctccct

SEQ ID NO: 231289 - DNA, 25 bp, Mus musculus
atagcatttatcactcaacctcttc

SEQ ID NO: 231290 - DNA, 25 bp, Mus musculus
atagcatttatctctcaacctcttc

SEQ ID NO: 231291 - DNA, 25 bp, Mus musculus
atagcatttctaacatactcgtttt

SEQ ID NO: 231292 - DNA, 25 bp, Mus musculus
atagcatttctaatgcaaccagatg

SEQ ID NO: 231293 - DNA, 25 bp, Mus musculus
atagcatttctatcatactcgtttt

SEQ ID NO: 231294 - DNA, 25 bp, Mus musculus
atagcatttctattgcaaccagatg

SEQ ID NO: 231295 - DNA, 25 bp, Mus musculus
atagcatttggaccggcagaggcct

SEQ ID NO: 231296 - DNA, 25 bp, Mus musculus
atagcatttggagcggcagaggcct

SEQ ID NO: 231297 - DNA, 25 bp, Mus musculus
atagcatttgtgaaagttaccttta

SEQ ID NO: 231298 - DNA, 25 bp, Mus musculus
atagcatttgtgtaagttaccttta

SEQ ID NO: 231299 - DNA, 25 bp, Mus musculus
atagcattttaccttcctcgaatta

SEQ ID NO: 231300 - DNA, 25 bp, Mus musculus
atagcattttacgttcctcgaatta

SEQ ID NO: 231301 - DNA, 25 bp, Mus musculus
atagcattttgcaggtctggctcag

SEQ ID NO: 231302 - DNA, 25 bp, Mus musculus
atagcattttgctggtctggctcag

SEQ ID NO: 231303 - DNA, 25 bp, Mus musculus
atagccaaagacctgtcgcctggaa

SEQ ID NO: 231304 - DNA, 25 bp, Mus musculus
atagccaaagacgtgtcgcctggaa

SEQ ID NO: 231305 - DNA, 25 bp, Mus musculus
atagccaacaaactactcttaactg

SEQ ID NO: 231306 - DNA, 25 bp, Mus musculus
atagccaacaaagtactcttaactg

SEQ ID NO: 231307 - DNA, 25 bp, Mus musculus
atagccaaccaccacggtgctggtt

SEQ ID NO: 231308 - DNA, 25 bp, Mus musculus
atagccaaccacgacggtgctggtt

SEQ ID NO: 231309 - DNA, 25 bp, Mus musculus
atagccaacctcactgtacatcgga

SEQ ID NO: 231310 - DNA, 25 bp, Mus musculus
atagccaacctctctgtacatcgga

SEQ ID NO: 231311 - DNA, 25 bp, Mus musculus
atagccaacgctcttattctttgac

SEQ ID NO: 231312 - DNA, 25 bp, Mus musculus
atagccaacgctgttattctttgac

SEQ ID NO: 231313 - DNA, 25 bp, Mus musculus
atagccaacttcattatgtaggttc

SEQ ID NO: 231314 - DNA, 25 bp, Mus musculus
atagccaacttctttatgtaggttc

SEQ ID NO: 231315 - DNA, 25 bp, Mus musculus
atagccaagactcagactcggtacc

SEQ ID NO: 231316 - DNA, 25 bp, Mus musculus
atagccaagactgagactcggtacc

SEQ ID NO: 231317 - DNA, 25 bp, Mus musculus
atagccaataggactcctgcatgcc

SEQ ID NO: 231318 - DNA, 25 bp, Mus musculus
atagccaataggtctcctgcatgcc

SEQ ID NO: 231319 - DNA, 25 bp, Mus musculus
atagccaatcgaatgtcctcttcaa

SEQ ID NO: 231320 - DNA, 25 bp, Mus musculus
atagccaatcgattgtcctcttcaa

SEQ ID NO: 231321 - DNA, 25 bp, Mus musculus
atagccaatgctctgaccatcagac

SEQ ID NO: 231322 - DNA, 25 bp, Mus musculus
atagccaatgctgtgaccatcagac

SEQ ID NO: 231323 - DNA, 25 bp, Mus musculus
atagccaatggcactctctactggg

SEQ ID NO: 231324 - DNA, 25 bp, Mus musculus
atagccaatggctctctctactggg

SEQ ID NO: 231325 - DNA, 25 bp, Mus musculus
atagccaattttaccgactgtgtat

SEQ ID NO: 231326 - DNA, 25 bp, Mus musculus
atagccaatttttccgactgtgtat

SEQ ID NO: 231327 - DNA, 25 bp, Mus musculus
atagccacaaagctacccgagggct

SEQ ID NO: 231328 - DNA, 25 bp, Mus musculus
atagccacaaaggtacccgagggct

SEQ ID NO: 231329 - DNA, 25 bp, Mus musculus
atagccacacacatcgggattggag

SEQ ID NO: 231330 - DNA, 25 bp, Mus musculus
atagccacacacttcgggattggag

SEQ ID NO: 231331 - DNA, 25 bp, Mus musculus
atagccacaccacatctcaagtgca

SEQ ID NO: 231332 - DNA, 25 bp, Mus musculus
atagccacaccagatctcaagtgca

SEQ ID NO: 231333 - DNA, 25 bp, Mus musculus
atagccacagatcagtgctgctctc

SEQ ID NO: 231334 - DNA, 25 bp, Mus musculus
atagccacagatgagtgctgctctc

SEQ ID NO: 231335 - DNA, 25 bp, Mus musculus
atagccacaggtattttgcttttgt

SEQ ID NO: 231336 - DNA, 25 bp, Mus musculus
atagccacaggttttttgcttttgt

SEQ ID NO: 231337 - DNA, 25 bp, Mus musculus
atagccacccctctgaaggagcact

SEQ ID NO: 231338 - DNA, 25 bp, Mus musculus
atagccacccctgtgaaggagcact

SEQ ID NO: 231339 - DNA, 25 bp, Mus musculus
atagccaccggcaaaagcaagcctt

SEQ ID NO: 231340 - DNA, 25 bp, Mus musculus
atagccaccggctaaagcaagcctt

SEQ ID NO: 231341 - DNA, 25 bp, Mus musculus
atagccacctagaggttctgttttc

SEQ ID NO: 231342 - DNA, 25 bp, Mus musculus
atagccacctagtggttctgttttc

SEQ ID NO: 231343 - DNA, 25 bp, Mus musculus
atagccacctgcctgggatggcaat

SEQ ID NO: 231344 - DNA, 25 bp, Mus musculus
atagccacctgcgtgggatggcaat

SEQ ID NO: 231345 - DNA, 25 bp, Mus musculus
atagccacgtcaacgatccgctgat

SEQ ID NO: 231346 - DNA, 25 bp, Mus musculus
atagccacgtcatcgatccgctgat

SEQ ID NO: 231347 - DNA, 25 bp, Mus musculus
atagccactcctcggcgcctaatag

SEQ ID NO: 231348 - DNA, 25 bp, Mus musculus
atagccactcctgggcgcctaatag

SEQ ID NO: 231349 - DNA, 25 bp, Mus musculus
atagccactggccaagacttgctga

SEQ ID NO: 231350 - DNA, 25 bp, Mus musculus
atagccactggcgaagacttgctga

SEQ ID NO: 231351 - DNA, 25 bp, Mus musculus
atagccactgtccttaggtgccaag

SEQ ID NO: 231352 - DNA, 25 bp, Mus musculus
atagccactgtcgttaggtgccaag

SEQ ID NO: 231353 - DNA, 25 bp, Mus musculus
atagccactttcctggagagctgtg

SEQ ID NO: 231354 - DNA, 25 bp, Mus musculus
atagccactttcgtggagagctgtg

SEQ ID NO: 231355 - DNA, 25 bp, Mus musculus
atagccagaaccacaggtctgctgt

SEQ ID NO: 231356 - DNA, 25 bp, Mus musculus
atagccagaacctcaggtctgctgt

SEQ ID NO: 231357 - DNA, 25 bp, Mus musculus
atagccagcctcaaatatcctgtga

SEQ ID NO: 231358 - DNA, 25 bp, Mus musculus
atagccagcctctaatatcctgtga

SEQ ID NO: 231359 - DNA, 25 bp, Mus musculus
atagccagcgccagcagtgtttccg

SEQ ID NO: 231360 - DNA, 25 bp, Mus musculus
atagccagcgcctgcagtgtttccg

SEQ ID NO: 231361 - DNA, 25 bp, Mus musculus
atagccagctctatccagagcatca

SEQ ID NO: 231362 - DNA, 25 bp, Mus musculus
atagccagctctttccagagcatca

SEQ ID NO: 231363 - DNA, 25 bp, Mus musculus
atagccagctgtccataattgttaa

SEQ ID NO: 231364 - DNA, 25 bp, Mus musculus
atagccagctgtgcataattgttaa

SEQ ID NO: 231365 - DNA, 25 bp, Mus musculus
atagccaggaaaacgcctctctttt

SEQ ID NO: 231366 - DNA, 25 bp, Mus musculus
atagccaggaaatcgcctctctttt

SEQ ID NO: 231367 - DNA, 25 bp, Mus musculus
atagccaggatgcttgcacatgcct

SEQ ID NO: 231368 - DNA, 25 bp, Mus musculus
atagccaggatggttgcacatgcct

SEQ ID NO: 231369 - DNA, 25 bp, Mus musculus
atagccagggctagtcttgacacaa

SEQ ID NO: 231370 - DNA, 25 bp, Mus musculus
atagccagggcttgtcttgacacaa

SEQ ID NO: 231371 - DNA, 25 bp, Mus musculus
atagccagtaccacagaacgttcac

SEQ ID NO: 231372 - DNA, 25 bp, Mus musculus
atagccagtacctcagaacgttcac

SEQ ID NO: 231373 - DNA, 25 bp, Mus musculus
atagccagttatctattttctgcca

SEQ ID NO: 231374 - DNA, 25 bp, Mus musculus
atagccagttatgtattttctgcca

SEQ ID NO: 231375 - DNA, 25 bp, Mus musculus
atagccagttgccatttatcttctc

SEQ ID NO: 231376 - DNA, 25 bp, Mus musculus
atagccagttgcgatttatcttctc

SEQ ID NO: 231377 - DNA, 25 bp, Mus musculus
atagccatagccaaggcctccatag

SEQ ID NO: 231378 - DNA, 25 bp, Mus musculus
atagccatagccatgcttagctcac

SEQ ID NO: 231379 - DNA, 25 bp, Mus musculus
atagccatagcctaggcctccatag

SEQ ID NO: 231380 - DNA, 25 bp, Mus musculus
atagccatagccttgcttagctcac

SEQ ID NO: 231381 - DNA, 25 bp, Mus musculus
atagccatcacacaaaaccctcaga

SEQ ID NO: 231382 - DNA, 25 bp, Mus musculus
atagccatcacagaaaaccctcaga

SEQ ID NO: 231383 - DNA, 25 bp, Mus musculus
atagccatcacgcctccaaatcggg

SEQ ID NO: 231384 - DNA, 25 bp, Mus musculus
atagccatcacggctccaaatcggg

SEQ ID NO: 231385 - DNA, 25 bp, Mus musculus
atagccatcactctcttgttttctg

SEQ ID NO: 231386 - DNA, 25 bp, Mus musculus
atagccatcactgtcttgttttctg

SEQ ID NO: 231387 - DNA, 25 bp, Mus musculus
atagccatgattcttatgtttcccc

SEQ ID NO: 231388 - DNA, 25 bp, Mus musculus
atagccatgattgttatgtttcccc

SEQ ID NO: 231389 - DNA, 25 bp, Mus musculus
atagccatgcatccttcaggtcaaa

SEQ ID NO: 231390 - DNA, 25 bp, Mus musculus
atagccatgcatgcttcaggtcaaa

SEQ ID NO: 231391 - DNA, 25 bp, Mus musculus
atagccatggagatgcctgctctgc

SEQ ID NO: 231392 - DNA, 25 bp, Mus musculus
atagccatggagttgcctgctctgc

SEQ ID NO: 231393 - DNA, 25 bp, Mus musculus
atagccatgggcataatcgtccata

SEQ ID NO: 231394 - DNA, 25 bp, Mus musculus
atagccatgggcttaatcgtccata

SEQ ID NO: 231395 - DNA, 25 bp, Mus musculus
atagccatgttgagcacacctaccg

SEQ ID NO: 231396 - DNA, 25 bp, Mus musculus
atagccatgttgtgcacacctaccg

SEQ ID NO: 231397 - DNA, 25 bp, Mus musculus
atagccatgtttctcccaacacaga

SEQ ID NO: 231398 - DNA, 25 bp, Mus musculus
atagccatgtttgtcccaacacaga

SEQ ID NO: 231399 - DNA, 25 bp, Mus musculus
atagccatttggatagccggaagta

SEQ ID NO: 231400 - DNA, 25 bp, Mus musculus
atagccatttggttagccggaagta

SEQ ID NO: 231401 - DNA, 25 bp, Mus musculus
atagcccaaagtctcttcatcagtt

SEQ ID NO: 231402 - DNA, 25 bp, Mus musculus
atagcccaaagtgtcttcatcagtt

SEQ ID NO: 231403 - DNA, 25 bp, Mus musculus
atagcccaaggccaatgagatcact

SEQ ID NO: 231404 - DNA, 25 bp, Mus musculus
atagcccaaggcgaatgagatcact

SEQ ID NO: 231405 - DNA, 25 bp, Mus musculus
atagcccaagtccgcacttatcagc

SEQ ID NO: 231406 - DNA, 25 bp, Mus musculus
atagcccaagtcggcacttatcagc

SEQ ID NO: 231407 - DNA, 25 bp, Mus musculus
atagcccaagttctcgatcggatgt

SEQ ID NO: 231408 - DNA, 25 bp, Mus musculus
atagcccaagttgtcgatcggatgt

SEQ ID NO: 231409 - DNA, 25 bp, Mus musculus
atagcccaccctctgttttgagcac

SEQ ID NO: 231410 - DNA, 25 bp, Mus musculus
atagcccaccctgtgttttgagcac

SEQ ID NO: 231411 - DNA, 25 bp, Mus musculus
atagcccacttgatttctctggtat

SEQ ID NO: 231412 - DNA, 25 bp, Mus musculus
atagcccacttgttttctctggtat

SEQ ID NO: 231413 - DNA, 25 bp, Mus musculus
atagcccagactcagcttagcatgg

SEQ ID NO: 231414 - DNA, 25 bp, Mus musculus
atagcccagactgagcttagcatgg

SEQ ID NO: 231415 - DNA, 25 bp, Mus musculus
atagcccagcccatagaatatgtga

SEQ ID NO: 231416 - DNA, 25 bp, Mus musculus
atagcccagcccttagaatatgtga

SEQ ID NO: 231417 - DNA, 25 bp, Mus musculus
atagcccagggcacaagcattgcac

SEQ ID NO: 231418 - DNA, 25 bp, Mus musculus
atagcccagggctcaagcattgcac

SEQ ID NO: 231419 - DNA, 25 bp, Mus musculus
atagcccagtatccagtcacttaga

SEQ ID NO: 231420 - DNA, 25 bp, Mus musculus
atagcccagtatgcagtcacttaga

SEQ ID NO: 231421 - DNA, 25 bp, Mus musculus
atagcccattgtcccatgtgtgtgt

SEQ ID NO: 231422 - DNA, 25 bp, Mus musculus
atagcccattgtgccatgtgtgtgt

SEQ ID NO: 231423 - DNA, 25 bp, Mus musculus
atagccccaaaccatgctgtagtgt

SEQ ID NO: 231424 - DNA, 25 bp, Mus musculus
atagccccaaacgatgctgtagtgt

SEQ ID NO: 231425 - DNA, 25 bp, Mus musculus
atagccccaactagtaaccataatg

SEQ ID NO: 231426 - DNA, 25 bp, Mus musculus
atagccccaacttgtaaccataatg

SEQ ID NO: 231427 - DNA, 25 bp, Mus musculus
atagccccacacatcttacgaggaa

SEQ ID NO: 231428 - DNA, 25 bp, Mus musculus
atagccccacacttcttacgaggaa

SEQ ID NO: 231429 - DNA, 25 bp, Mus musculus
atagccccagtaccagaggtggcat

SEQ ID NO: 231430 - DNA, 25 bp, Mus musculus
atagccccagtagcagaggtggcat

SEQ ID NO: 231431 - DNA, 25 bp, Mus musculus
atagccccatgactcccagatgtta

SEQ ID NO: 231432 - DNA, 25 bp, Mus musculus
atagccccatgagtcccagatgtta

SEQ ID NO: 231433 - DNA, 25 bp, Mus musculus
atagccccgaggcttaggcaccata

SEQ ID NO: 231434 - DNA, 25 bp, Mus musculus
atagccccgagggttaggcaccata

SEQ ID NO: 231435 - DNA, 25 bp, Mus musculus
atagcccctcctcatctgtgatgga

SEQ ID NO: 231436 - DNA, 25 bp, Mus musculus
atagcccctcctgatctgtgatgga

SEQ ID NO: 231437 - DNA, 25 bp, Mus musculus
atagcccctcttatttgatttactg

SEQ ID NO: 231438 - DNA, 25 bp, Mus musculus
atagcccctcttttttgatttactg

SEQ ID NO: 231439 - DNA, 25 bp, Mus musculus
atagcccctgctctaatttatttct

SEQ ID NO: 231440 - DNA, 25 bp, Mus musculus
atagcccctgctgtaatttatttct

SEQ ID NO: 231441 - DNA, 25 bp, Mus musculus
atagcccctggcaactactttgttg

SEQ ID NO: 231442 - DNA, 25 bp, Mus musculus
atagcccctggctactactttgttg

SEQ ID NO: 231443 - DNA, 25 bp, Mus musculus
atagccccttgtagccgacttgtta

SEQ ID NO: 231444 - DNA, 25 bp, Mus musculus
atagccccttgttgccgacttgtta

SEQ ID NO: 231445 - DNA, 25 bp, Mus musculus
atagcccgactgctgtcacagctaa

SEQ ID NO: 231446 - DNA, 25 bp, Mus musculus
atagcccgactggtgtcacagctaa

SEQ ID NO: 231447 - DNA, 25 bp, Mus musculus
atagcccgatataacttccaatctg

SEQ ID NO: 231448 - DNA, 25 bp, Mus musculus
atagcccgatattacttccaatctg

SEQ ID NO: 231449 - DNA, 25 bp, Mus musculus
atagcccggagcctgtagctacgga

SEQ ID NO: 231450 - DNA, 25 bp, Mus musculus
atagcccggagcgtgtagctacgga

SEQ ID NO: 231451 - DNA, 25 bp, Mus musculus
atagccctgagacgccttcacagag

SEQ ID NO: 231452 - DNA, 25 bp, Mus musculus
atagccctgagaggccttcacagag

SEQ ID NO: 231453 - DNA, 25 bp, Mus musculus
atagccctgctgcagacagtttcta

SEQ ID NO: 231454 - DNA, 25 bp, Mus musculus
atagccctgctggagacagtttcta

SEQ ID NO: 231455 - DNA, 25 bp, Mus musculus
atagccctggcaatctgcaaggcat

SEQ ID NO: 231456 - DNA, 25 bp, Mus musculus
atagccctggcattctgcaaggcat

SEQ ID NO: 231457 - DNA, 25 bp, Mus musculus
atagccctggctatgcaagatgaag

SEQ ID NO: 231458 - DNA, 25 bp, Mus musculus
atagccctggctttgcaagatgaag

SEQ ID NO: 231459 - DNA, 25 bp, Mus musculus
atagccctgtctcgtctatagaaca

SEQ ID NO: 231460 - DNA, 25 bp, Mus musculus
atagccctgtctggtctatagaaca

SEQ ID NO: 231461 - DNA, 25 bp, Mus musculus
atagcccttcctatgcatttctgaa

SEQ ID NO: 231462 - DNA, 25 bp, Mus musculus
atagcccttcctttgcatttctgaa

SEQ ID NO: 231463 - DNA, 25 bp, Mus musculus
atagcccttgcactagtttgctaac

SEQ ID NO: 231464 - DNA, 25 bp, Mus musculus
atagcccttgcagtagtttgctaac

SEQ ID NO: 231465 - DNA, 25 bp, Mus musculus
atagccctttagaaggtgtgcacac

SEQ ID NO: 231466 - DNA, 25 bp, Mus musculus
atagccctttagtaggtgtgcacac

SEQ ID NO: 231467 - DNA, 25 bp, Mus musculus
atagccgaagggacagcacaacgtt

SEQ ID NO: 231468 - DNA, 25 bp, Mus musculus
atagccgaagggtcagcacaacgtt

SEQ ID NO: 231469 - DNA, 25 bp, Mus musculus
atagccgaatctatgatgtcctcct

SEQ ID NO: 231470 - DNA, 25 bp, Mus musculus
atagccgaatctttgatgtcctcct

SEQ ID NO: 231471 - DNA, 25 bp, Mus musculus
atagccgacacaataccttttcagg

SEQ ID NO: 231472 - DNA, 25 bp, Mus musculus
atagccgacacattaccttttcagg

SEQ ID NO: 231473 - DNA, 25 bp, Mus musculus
atagccgcatagagcaatagtatca

SEQ ID NO: 231474 - DNA, 25 bp, Mus musculus
atagccgcatagtgcaatagtatca

SEQ ID NO: 231475 - DNA, 25 bp, Mus musculus
atagccgcctatccactaagtttgg

SEQ ID NO: 231476 - DNA, 25 bp, Mus musculus
atagccgcctatgcactaagtttgg

SEQ ID NO: 231477 - DNA, 25 bp, Mus musculus
atagccgcgagtaccagctgtgcga

SEQ ID NO: 231478 - DNA, 25 bp, Mus musculus
atagccgcgagttccagctgtgcga

SEQ ID NO: 231479 - DNA, 25 bp, Mus musculus
atagccgctggcacgtttttatatg

SEQ ID NO: 231480 - DNA, 25 bp, Mus musculus
atagccgctggctcgtttttatatg

SEQ ID NO: 231481 - DNA, 25 bp, Mus musculus
atagccgcttggaatgcagtaactt

SEQ ID NO: 231482 - DNA, 25 bp, Mus musculus
atagccgcttggtatgcagtaactt

SEQ ID NO: 231483 - DNA, 25 bp, Mus musculus
atagccggcgtacgaggttgtcctt

SEQ ID NO: 231484 - DNA, 25 bp, Mus musculus
atagccggcgtaggaggttgtcctt

SEQ ID NO: 231485 - DNA, 25 bp, Mus musculus
atagccgtctgtaatgcctttgtat

SEQ ID NO: 231486 - DNA, 25 bp, Mus musculus
atagccgtctgttatgcctttgtat

SEQ ID NO: 231487 - DNA, 25 bp, Mus musculus
atagccgtttttactacagattgaa

SEQ ID NO: 231488 - DNA, 25 bp, Mus musculus
atagccgttttttctacagattgaa

SEQ ID NO: 231489 - DNA, 25 bp, Mus musculus
atagcctaaaagatggactccgcag

SEQ ID NO: 231490 - DNA, 25 bp, Mus musculus
atagcctaaaagttggactccgcag

SEQ ID NO: 231491 - DNA, 25 bp, Mus musculus
atagcctacgttcccagaacacaag

SEQ ID NO: 231492 - DNA, 25 bp, Mus musculus
atagcctacgttgccagaacacaag

SEQ ID NO: 231493 - DNA, 25 bp, Mus musculus
atagcctagcttcctttttgagata

SEQ ID NO: 231494 - DNA, 25 bp, Mus musculus
atagcctagcttgctttttgagata

SEQ ID NO: 231495 - DNA, 25 bp, Mus musculus
atagcctaggccacctgtggatcta

SEQ ID NO: 231496 - DNA, 25 bp, Mus musculus
atagcctaggcctcctgtggatcta

SEQ ID NO: 231497 - DNA, 25 bp, Mus musculus
atagcctaggctcgccatgctgatg

SEQ ID NO: 231498 - DNA, 25 bp, Mus musculus
atagcctaggctggccatgctgatg

SEQ ID NO: 231499 - DNA, 25 bp, Mus musculus
atagcctagtagaggccagcaaccc

SEQ ID NO: 231500 - DNA, 25 bp, Mus musculus
atagcctagtagtggccagcaaccc

SEQ ID NO: 231501 - DNA, 25 bp, Mus musculus
atagcctattagaagtcctccaaat

SEQ ID NO: 231502 - DNA, 25 bp, Mus musculus
atagcctattagtagtcctccaaat

SEQ ID NO: 231503 - DNA, 25 bp, Mus musculus
atagcctatttgagcttcacgtgca

SEQ ID NO: 231504 - DNA, 25 bp, Mus musculus
atagcctatttgtgcttcacgtgca

SEQ ID NO: 231505 - DNA, 25 bp, Mus musculus
atagcctcaagcatccagaactgac

SEQ ID NO: 231506 - DNA, 25 bp, Mus musculus
atagcctcaagcttccagaactgac

SEQ ID NO: 231507 - DNA, 25 bp, Mus musculus
atagcctcacagcactctgtagcaa

SEQ ID NO: 231508 - DNA, 25 bp, Mus musculus
atagcctcacaggactctgtagcaa

SEQ ID NO: 231509 - DNA, 25 bp, Mus musculus
atagcctcactaataacgtaataca

SEQ ID NO: 231510 - DNA, 25 bp, Mus musculus
atagcctcactattaacgtaataca

SEQ ID NO: 231511 - DNA, 25 bp, Mus musculus
atagcctcaggaatgagtctacatg

SEQ ID NO: 231512 - DNA, 25 bp, Mus musculus
atagcctcaggattgagtctacatg

SEQ ID NO: 231513 - DNA, 25 bp, Mus musculus
atagcctccccaagagccaggaaga

SEQ ID NO: 231514 - DNA, 25 bp, Mus musculus
atagcctccccatgagccaggaaga

SEQ ID NO: 231515 - DNA, 25 bp, Mus musculus
atagcctccctaatggttaggttca

SEQ ID NO: 231516 - DNA, 25 bp, Mus musculus
atagcctccctattggttaggttca

SEQ ID NO: 231517 - DNA, 25 bp, Mus musculus
atagcctcctctctagccttaagaa

SEQ ID NO: 231518 - DNA, 25 bp, Mus musculus
atagcctcctctgtagccttaagaa

SEQ ID NO: 231519 - DNA, 25 bp, Mus musculus
atagcctctcagagaccagtcagca

SEQ ID NO: 231520 - DNA, 25 bp, Mus musculus
atagcctctcagtgaccagtcagca

SEQ ID NO: 231521 - DNA, 25 bp, Mus musculus
atagcctctctcatcacatggtaat

SEQ ID NO: 231522 - DNA, 25 bp, Mus musculus
atagcctctctcttcacatggtaat

SEQ ID NO: 231523 - DNA, 25 bp, Mus musculus
atagcctctgatcgcctgctaatgg

SEQ ID NO: 231524 - DNA, 25 bp, Mus musculus
atagcctctgatggcctgctaatgg

SEQ ID NO: 231525 - DNA, 25 bp, Mus musculus
atagcctctgctatagagactgcca

SEQ ID NO: 231526 - DNA, 25 bp, Mus musculus
atagcctctgctttagagactgcca

SEQ ID NO: 231527 - DNA, 25 bp, Mus musculus
atagcctcttgcaggcagatcagat

SEQ ID NO: 231528 - DNA, 25 bp, Mus musculus
atagcctcttgctggcagatcagat

SEQ ID NO: 231529 - DNA, 25 bp, Mus musculus
atagcctgaactctggaaccggcag

SEQ ID NO: 231530 - DNA, 25 bp, Mus musculus
atagcctgaactgtggaaccggcag

SEQ ID NO: 231531 - DNA, 25 bp, Mus musculus
atagcctgaaggaattcctgcctgg

SEQ ID NO: 231532 - DNA, 25 bp, Mus musculus
atagcctgaaggtattcctgcctgg

SEQ ID NO: 231533 - DNA, 25 bp, Mus musculus
atagcctgacgacagcacagcagtc

SEQ ID NO: 231534 - DNA, 25 bp, Mus musculus
atagcctgacgagagcacagcagtc

SEQ ID NO: 231535 - DNA, 25 bp, Mus musculus
atagcctgagcaacactgacaactc

SEQ ID NO: 231536 - DNA, 25 bp, Mus musculus
atagcctgagcatcactgacaactc

SEQ ID NO: 231537 - DNA, 25 bp, Mus musculus
atagcctgagccaccctggatgtga

SEQ ID NO: 231538 - DNA, 25 bp, Mus musculus
atagcctgagcctccctggatgtga

SEQ ID NO: 231539 - DNA, 25 bp, Mus musculus
atagcctgccataaggacacttttt

SEQ ID NO: 231540 - DNA, 25 bp, Mus musculus
atagcctgccattaggacacttttt

SEQ ID NO: 231541 - DNA, 25 bp, Mus musculus
atagcctgcctactgcttggatgca

SEQ ID NO: 231542 - DNA, 25 bp, Mus musculus
atagcctgcctagtgcttggatgca

SEQ ID NO: 231543 - DNA, 25 bp, Mus musculus
atagcctgctcgaacggctctacat

SEQ ID NO: 231544 - DNA, 25 bp, Mus musculus
atagcctgctcgtacggctctacat

SEQ ID NO: 231545 - DNA, 25 bp, Mus musculus
atagcctgcttgctttccgaagaca

SEQ ID NO: 231546 - DNA, 25 bp, Mus musculus
atagcctgcttggtttccgaagaca

SEQ ID NO: 231547 - DNA, 25 bp, Mus musculus
atagcctggctgaaattgggtgacc

SEQ ID NO: 231548 - DNA, 25 bp, Mus musculus
atagcctggctgtaattgggtgacc

SEQ ID NO: 231549 - DNA, 25 bp, Mus musculus
atagcctgggtcacccagtttgtca

SEQ ID NO: 231550 - DNA, 25 bp, Mus musculus
atagcctgggtcatagcagctttga

SEQ ID NO: 231551 - DNA, 25 bp, Mus musculus
atagcctgggtctcccagtttgtca

SEQ ID NO: 231552 - DNA, 25 bp, Mus musculus
atagcctgggtcttagcagctttga

SEQ ID NO: 231553 - DNA, 25 bp, Mus musculus
atagcctggtgacatcctgctagtc

SEQ ID NO: 231554 - DNA, 25 bp, Mus musculus
atagcctggtgagatcctgctagtc

SEQ ID NO: 231555 - DNA, 25 bp, Mus musculus
atagcctgtagtccgaactctgaga

SEQ ID NO: 231556 - DNA, 25 bp, Mus musculus
atagcctgtagtgcgaactctgaga

SEQ ID NO: 231557 - DNA, 25 bp, Mus musculus
atagcctgtgctccagagtcctgga

SEQ ID NO: 231558 - DNA, 25 bp, Mus musculus
atagcctgtgctgcagagtcctgga

SEQ ID NO: 231559 - DNA, 25 bp, Mus musculus
atagcctgtgtgaagaccatgagag

SEQ ID NO: 231560 - DNA, 25 bp, Mus musculus
atagcctgtgtgatgtctttacgga

SEQ ID NO: 231561 - DNA, 25 bp, Mus musculus
atagcctgtgtgtagaccatgagag

SEQ ID NO: 231562 - DNA, 25 bp, Mus musculus
atagcctgtgtgttgtctttacgga

SEQ ID NO: 231563 - DNA, 25 bp, Mus musculus
atagcctgtgttaatctgagttcga

SEQ ID NO: 231564 - DNA, 25 bp, Mus musculus
atagcctgtgtttatctgagttcga

SEQ ID NO: 231565 - DNA, 25 bp, Mus musculus
atagcctgttttacatccaatttgt

SEQ ID NO: 231566 - DNA, 25 bp, Mus musculus
atagcctgtttttcatccaatttgt

SEQ ID NO: 231567 - DNA, 25 bp, Mus musculus
atagccttactgcactggcagacca

SEQ ID NO: 231568 - DNA, 25 bp, Mus musculus
atagccttactggactggcagacca

SEQ ID NO: 231569 - DNA, 25 bp, Mus musculus
atagccttaggtcatttcagtggga

SEQ ID NO: 231570 - DNA, 25 bp, Mus musculus
atagccttaggtgatttcagtggga

SEQ ID NO: 231571 - DNA, 25 bp, Mus musculus
atagccttcttactaaaagcaatct

SEQ ID NO: 231572 - DNA, 25 bp, Mus musculus
atagccttcttagtaaaagcaatct

SEQ ID NO: 231573 - DNA, 25 bp, Mus musculus
atagccttgaagcatgctttccact

SEQ ID NO: 231574 - DNA, 25 bp, Mus musculus
atagccttgaaggatgctttccact

SEQ ID NO: 231575 - DNA, 25 bp, Mus musculus
atagccttgaggattccagctcgag

SEQ ID NO: 231576 - DNA, 25 bp, Mus musculus
atagccttgaggtttccagctcgag

SEQ ID NO: 231577 - DNA, 25 bp, Mus musculus
atagccttgagtaccaacactgtcc

SEQ ID NO: 231578 - DNA, 25 bp, Mus musculus
atagccttgagttccaacactgtcc

SEQ ID NO: 231579 - DNA, 25 bp, Mus musculus
atagccttgctgagtgaaaccaact

SEQ ID NO: 231580 - DNA, 25 bp, Mus musculus
atagccttgctgtgtgaaaccaact

SEQ ID NO: 231581 - DNA, 25 bp, Mus musculus
atagccttgcttagctctgattata

SEQ ID NO: 231582 - DNA, 25 bp, Mus musculus
atagccttgctttgctctgattata

SEQ ID NO: 231583 - DNA, 25 bp, Mus musculus
atagccttggaaacctacacagtac

SEQ ID NO: 231584 - DNA, 25 bp, Mus musculus
atagccttggaatcctacacagtac

SEQ ID NO: 231585 - DNA, 25 bp, Mus musculus
atagccttggtactgtcctggatgc

SEQ ID NO: 231586 - DNA, 25 bp, Mus musculus
atagccttggtagtgtcctggatgc

SEQ ID NO: 231587 - DNA, 25 bp, Mus musculus
atagcctttctaaacaggtagagat

SEQ ID NO: 231588 - DNA, 25 bp, Mus musculus
atagcctttctatacaggtagagat

SEQ ID NO: 231589 - DNA, 25 bp, Mus musculus
atagcctttcttcatgcttttcaac

SEQ ID NO: 231590 - DNA, 25 bp, Mus musculus
atagcctttcttgatgcttttcaac

SEQ ID NO: 231591 - DNA, 25 bp, Mus musculus
atagcctttgagatctagttcagtg

SEQ ID NO: 231592 - DNA, 25 bp, Mus musculus
atagcctttgagttctagttcagtg

SEQ ID NO: 231593 - DNA, 25 bp, Mus musculus
atagcctttgcacctggccgagaca

SEQ ID NO: 231594 - DNA, 25 bp, Mus musculus
atagcctttgcagctggccgagaca

SEQ ID NO: 231595 - DNA, 25 bp, Mus musculus
atagcctttgccatctttaaatcac

SEQ ID NO: 231596 - DNA, 25 bp, Mus musculus
atagcctttgccttctttaaatcac

SEQ ID NO: 231597 - DNA, 25 bp, Mus musculus
atagcctttgctatgccgctgatac

SEQ ID NO: 231598 - DNA, 25 bp, Mus musculus
atagcctttgctttgccgctgatac

SEQ ID NO: 231599 - DNA, 25 bp, Mus musculus
atagcctttgggaatccagagtcct

SEQ ID NO: 231600 - DNA, 25 bp, Mus musculus
atagcctttgggtatccagagtcct

SEQ ID NO: 231601 - DNA, 25 bp, Mus musculus
atagcctttggtcggcgagcttgac

SEQ ID NO: 231602 - DNA, 25 bp, Mus musculus
atagcctttggtgggcgagcttgac

SEQ ID NO: 231603 - DNA, 25 bp, Mus musculus
atagcctttgtaccaaatccaattg

SEQ ID NO: 231604 - DNA, 25 bp, Mus musculus
atagcctttgtagcaaatccaattg

SEQ ID NO: 231605 - DNA, 25 bp, Mus musculus
atagcctttgtcagtttggcctata

SEQ ID NO: 231606 - DNA, 25 bp, Mus musculus
atagcctttgtctgtttggcctata

SEQ ID NO: 231607 - DNA, 25 bp, Mus musculus
atagcgacttagcttccaggccgat

SEQ ID NO: 231608 - DNA, 25 bp, Mus musculus
atagcgacttaggttccaggccgat

SEQ ID NO: 231609 - DNA, 25 bp, Mus musculus
atagcgcaagctacgagtgctgctg

SEQ ID NO: 231610 - DNA, 25 bp, Mus musculus
atagcgcaagcttcgagtgctgctg

SEQ ID NO: 231611 - DNA, 25 bp, Mus musculus
atagcgcagcctcctcagcttagat

SEQ ID NO: 231612 - DNA, 25 bp, Mus musculus
atagcgcagcctgctcagcttagat

SEQ ID NO: 231613 - DNA, 25 bp, Mus musculus
atagcgcatcgtatggtcactctgt

SEQ ID NO: 231614 - DNA, 25 bp, Mus musculus
atagcgcatcgtttggtcactctgt

SEQ ID NO: 231615 - DNA, 25 bp, Mus musculus
atagcgcattgtcctgttcaccagc

SEQ ID NO: 231616 - DNA, 25 bp, Mus musculus
atagcgcattgtgctgttcaccagc

SEQ ID NO: 231617 - DNA, 25 bp, Mus musculus
atagcgccatcgacagcgggatcaa

SEQ ID NO: 231618 - DNA, 25 bp, Mus musculus
atagcgccatcgtcagcgggatcaa

SEQ ID NO: 231619 - DNA, 25 bp, Mus musculus
atagcgccatttaccttgtaacaag

SEQ ID NO: 231620 - DNA, 25 bp, Mus musculus
atagcgccattttccttgtaacaag

SEQ ID NO: 231621 - DNA, 25 bp, Mus musculus
atagcgccgagcacgagcacacagt

SEQ ID NO: 231622 - DNA, 25 bp, Mus musculus
atagcgccgagctcgagcacacagt

SEQ ID NO: 231623 - DNA, 25 bp, Mus musculus
atagcgccgcttcccgcagggagaa

SEQ ID NO: 231624 - DNA, 25 bp, Mus musculus
atagcgccgcttgccgcagggagaa

SEQ ID NO: 231625 - DNA, 25 bp, Mus musculus
atagcgcctggaacctggtgggcac

SEQ ID NO: 231626 - DNA, 25 bp, Mus musculus
atagcgcctggatcctggtgggcac

SEQ ID NO: 231627 - DNA, 25 bp, Mus musculus
atagcgccttggatctgattgccca

SEQ ID NO: 231628 - DNA, 25 bp, Mus musculus
atagcgccttggttctgattgccca

SEQ ID NO: 231629 - DNA, 25 bp, Mus musculus
atagcgctactccttgggcagaaag

SEQ ID NO: 231630 - DNA, 25 bp, Mus musculus
atagcgctactcgttgggcagaaag

SEQ ID NO: 231631 - DNA, 25 bp, Mus musculus
atagcgctgaggcttcattcttgtc

SEQ ID NO: 231632 - DNA, 25 bp, Mus musculus
atagcgctgagggttcattcttgtc

SEQ ID NO: 231633 - DNA, 25 bp, Mus musculus
atagcggaaacaccctgcgtcatca

SEQ ID NO: 231634 - DNA, 25 bp, Mus musculus
atagcggaaacagcctgcgtcatca

SEQ ID NO: 231635 - DNA, 25 bp, Mus musculus
atagcggcctctatgaaataggaaa

SEQ ID NO: 231636 - DNA, 25 bp, Mus musculus
atagcggcctctttgaaataggaaa

SEQ ID NO: 231637 - DNA, 25 bp, Mus musculus
atagcggctacactctttggatctc

SEQ ID NO: 231638 - DNA, 25 bp, Mus musculus
atagcggctacagtctttggatctc

SEQ ID NO: 231639 - DNA, 25 bp, Mus musculus
atagcggctcacagcaaggagtaca

SEQ ID NO: 231640 - DNA, 25 bp, Mus musculus
atagcggctcactgcaaggagtaca

SEQ ID NO: 231641 - DNA, 25 bp, Mus musculus
atagcggctcgcaattttgtcctgg

SEQ ID NO: 231642 - DNA, 25 bp, Mus musculus
atagcggctcgctattttgtcctgg

SEQ ID NO: 231643 - DNA, 25 bp, Mus musculus
atagcggctggaccgaaatccgtcg

SEQ ID NO: 231644 - DNA, 25 bp, Mus musculus
atagcggctggagcgaaatccgtcg

SEQ ID NO: 231645 - DNA, 25 bp, Mus musculus
atagcggtaagaagctgcgtcccca

SEQ ID NO: 231646 - DNA, 25 bp, Mus musculus
atagcggtaagatgctgcgtcccca

SEQ ID NO: 231647 - DNA, 25 bp, Mus musculus
atagcggttctactcaagcagccaa

SEQ ID NO: 231648 - DNA, 25 bp, Mus musculus
atagcggttctagtcaagcagccaa

SEQ ID NO: 231649 - DNA, 25 bp, Mus musculus
atagcggtttgtaggaagtgatagt

SEQ ID NO: 231650 - DNA, 25 bp, Mus musculus
atagcggtttgttggaagtgatagt

SEQ ID NO: 231651 - DNA, 25 bp, Mus musculus
atagcgtgcccgactaagataaaaa

SEQ ID NO: 231652 - DNA, 25 bp, Mus musculus
atagcgtgcccgtctaagataaaaa

SEQ ID NO: 231653 - DNA, 25 bp, Mus musculus
atagcgtgtaccacatgacagaagt

SEQ ID NO: 231654 - DNA, 25 bp, Mus musculus
atagcgtgtacctcatgacagaagt

SEQ ID NO: 231655 - DNA, 25 bp, Mus musculus
atagcgttcactaaacatcacaaag

SEQ ID NO: 231656 - DNA, 25 bp, Mus musculus
atagcgttcacttaacatcacaaag

SEQ ID NO: 231657 - DNA, 25 bp, Mus musculus
atagcgttgcgtctttttgtccagc

SEQ ID NO: 231658 - DNA, 25 bp, Mus musculus
atagcgttgcgtgtttttgtccagc

SEQ ID NO: 231659 - DNA, 25 bp, Mus musculus
atagcgttgggcaccagttagccag

SEQ ID NO: 231660 - DNA, 25 bp, Mus musculus
atagcgttgggctccagttagccag

SEQ ID NO: 231661 - DNA, 25 bp, Mus musculus
atagcgttgtgtatcaaagtgggca

SEQ ID NO: 231662 - DNA, 25 bp, Mus musculus
atagcgttgtgtttcaaagtgggca

SEQ ID NO: 231663 - DNA, 25 bp, Mus musculus
atagctaaccttctaccttgtagaa

SEQ ID NO: 231664 - DNA, 25 bp, Mus musculus
atagctaaccttgtaccttgtagaa

SEQ ID NO: 231665 - DNA, 25 bp, Mus musculus
atagctaagatgatgtggttttgtt

SEQ ID NO: 231666 - DNA, 25 bp, Mus musculus
atagctaagatgttgtggttttgtt

SEQ ID NO: 231667 - DNA, 25 bp, Mus musculus
atagctaaggttcccttctgacctc

SEQ ID NO: 231668 - DNA, 25 bp, Mus musculus
atagctaaggttgccttctgacctc

SEQ ID NO: 231669 - DNA, 25 bp, Mus musculus
atagctacacaaccatcatggctct

SEQ ID NO: 231670 - DNA, 25 bp, Mus musculus
atagctacacaagcatcatggctct

SEQ ID NO: 231671 - DNA, 25 bp, Mus musculus
atagctaccattcctgaacaccaga

SEQ ID NO: 231672 - DNA, 25 bp, Mus musculus
atagctaccattgctgaacaccaga

SEQ ID NO: 231673 - DNA, 25 bp, Mus musculus
atagctacggtcatcttctcatgtt

SEQ ID NO: 231674 - DNA, 25 bp, Mus musculus
atagctacggtcttcttctcatgtt

SEQ ID NO: 231675 - DNA, 25 bp, Mus musculus
atagctactctgaggcaggcgttgt

SEQ ID NO: 231676 - DNA, 25 bp, Mus musculus
atagctactctgtggcaggcgttgt

SEQ ID NO: 231677 - DNA, 25 bp, Mus musculus
atagctactgacattgctcgcatag

SEQ ID NO: 231678 - DNA, 25 bp, Mus musculus
atagctactgactttgctcgcatag

SEQ ID NO: 231679 - DNA, 25 bp, Mus musculus
atagctactgagattttaatttcac

SEQ ID NO: 231680 - DNA, 25 bp, Mus musculus
atagctactgagtttttaatttcac

SEQ ID NO: 231681 - DNA, 25 bp, Mus musculus
atagctactgcgctccatcaatata

SEQ ID NO: 231682 - DNA, 25 bp, Mus musculus
atagctactgcggtccatcaatata

SEQ ID NO: 231683 - DNA, 25 bp, Mus musculus
atagctactggtcctgttagttgac

SEQ ID NO: 231684 - DNA, 25 bp, Mus musculus
atagctactggtgctgttagttgac

SEQ ID NO: 231685 - DNA, 25 bp, Mus musculus
atagctacttagagcttcctttctg

SEQ ID NO: 231686 - DNA, 25 bp, Mus musculus
atagctacttagtgcttcctttctg

SEQ ID NO: 231687 - DNA, 25 bp, Mus musculus
atagctagcatcaatgtccccgtgt

SEQ ID NO: 231688 - DNA, 25 bp, Mus musculus
atagctagcatctatgtccccgtgt

SEQ ID NO: 231689 - DNA, 25 bp, Mus musculus
atagctagccacaaaactttcaagg

SEQ ID NO: 231690 - DNA, 25 bp, Mus musculus
atagctagccacagctggtgtttat

SEQ ID NO: 231691 - DNA, 25 bp, Mus musculus
atagctagccactaaactttcaagg

SEQ ID NO: 231692 - DNA, 25 bp, Mus musculus
atagctagccactgctggtgtttat

SEQ ID NO: 231693 - DNA, 25 bp, Mus musculus
atagctagccttctttggcttgcta

SEQ ID NO: 231694 - DNA, 25 bp, Mus musculus
atagctagccttgtttggcttgcta

SEQ ID NO: 231695 - DNA, 25 bp, Mus musculus
atagctagctttagcctatatggct

SEQ ID NO: 231696 - DNA, 25 bp, Mus musculus
atagctagcttttgcctatatggct

SEQ ID NO: 231697 - DNA, 25 bp, Mus musculus
atagctagggagcttgcttctcctc

SEQ ID NO: 231698 - DNA, 25 bp, Mus musculus
atagctagggaggttgcttctcctc

SEQ ID NO: 231699 - DNA, 25 bp, Mus musculus
atagctagggctctaccttgaccac

SEQ ID NO: 231700 - DNA, 25 bp, Mus musculus
atagctagggctgtaccttgaccac

SEQ ID NO: 231701 - DNA, 25 bp, Mus musculus
atagctaggttcaggatcagagaga

SEQ ID NO: 231702 - DNA, 25 bp, Mus musculus
atagctaggttctggatcagagaga

SEQ ID NO: 231703 - DNA, 25 bp, Mus musculus
atagctagtgccaattccagtgtgt

SEQ ID NO: 231704 - DNA, 25 bp, Mus musculus
atagctagtgcctattccagtgtgt

SEQ ID NO: 231705 - DNA, 25 bp, Mus musculus
atagctagttgcaaatgctgaatgc

SEQ ID NO: 231706 - DNA, 25 bp, Mus musculus
atagctagttgctaatgctgaatgc

SEQ ID NO: 231707 - DNA, 25 bp, Mus musculus
atagctatcagtatgctgtgggcaa

SEQ ID NO: 231708 - DNA, 25 bp, Mus musculus
atagctatcagtttgctgtgggcaa

SEQ ID NO: 231709 - DNA, 25 bp, Mus musculus
atagctatccagactttgctgtgtc

SEQ ID NO: 231710 - DNA, 25 bp, Mus musculus
atagctatccagtctttgctgtgtc

SEQ ID NO: 231711 - DNA, 25 bp, Mus musculus
atagctatgtttacaatgcccaatg

SEQ ID NO: 231712 - DNA, 25 bp, Mus musculus
atagctatgttttcaatgcccaatg

SEQ ID NO: 231713 - DNA, 25 bp, Mus musculus
atagctattcatcagcatgtatcaa

SEQ ID NO: 231714 - DNA, 25 bp, Mus musculus
atagctattcatgagcatgtatcaa

SEQ ID NO: 231715 - DNA, 25 bp, Mus musculus
atagctattctaatctgagcaagaa

SEQ ID NO: 231716 - DNA, 25 bp, Mus musculus
atagctattctattctgagcaagaa

SEQ ID NO: 231717 - DNA, 25 bp, Mus musculus
atagctatttatcgtgtcttgggta

SEQ ID NO: 231718 - DNA, 25 bp, Mus musculus
atagctatttatggtgtcttgggta

SEQ ID NO: 231719 - DNA, 25 bp, Mus musculus
atagctcaaagcatcatttttaatt

SEQ ID NO: 231720 - DNA, 25 bp, Mus musculus
atagctcaaagcttcatttttaatt

SEQ ID NO: 231721 - DNA, 25 bp, Mus musculus
atagctcaatgaaacaccccagttt

SEQ ID NO: 231722 - DNA, 25 bp, Mus musculus
atagctcaatgatacaccccagttt

SEQ ID NO: 231723 - DNA, 25 bp, Mus musculus
atagctcacaacatattaatagatt

SEQ ID NO: 231724 - DNA, 25 bp, Mus musculus
atagctcacaacttattaatagatt

SEQ ID NO: 231725 - DNA, 25 bp, Mus musculus
atagctcaccttagaaccgggccat

SEQ ID NO: 231726 - DNA, 25 bp, Mus musculus
atagctcacctttgaaccgggccat

SEQ ID NO: 231727 - DNA, 25 bp, Mus musculus
atagctcacttgctgctggaagtta

SEQ ID NO: 231728 - DNA, 25 bp, Mus musculus
atagctcacttggtgctggaagtta

SEQ ID NO: 231729 - DNA, 25 bp, Mus musculus
atagctcaggaaatacttaatatca

SEQ ID NO: 231730 - DNA, 25 bp, Mus musculus
atagctcaggaattacttaatatca

SEQ ID NO: 231731 - DNA, 25 bp, Mus musculus
atagctcaggacacgaaggacttct

SEQ ID NO: 231732 - DNA, 25 bp, Mus musculus
atagctcaggactcgaaggacttct

SEQ ID NO: 231733 - DNA, 25 bp, Mus musculus
atagctcaggcaagtcatgacctta

SEQ ID NO: 231734 - DNA, 25 bp, Mus musculus
atagctcaggcatgtcatgacctta

SEQ ID NO: 231735 - DNA, 25 bp, Mus musculus
atagctcaggctctactggaattca

SEQ ID NO: 231736 - DNA, 25 bp, Mus musculus
atagctcaggctgtactggaattca

SEQ ID NO: 231737 - DNA, 25 bp, Mus musculus
atagctcagggcattggcttcttgt

SEQ ID NO: 231738 - DNA, 25 bp, Mus musculus
atagctcagggctttggcttcttgt

SEQ ID NO: 231739 - DNA, 25 bp, Mus musculus
atagctcagggtaaactgcctgctt

SEQ ID NO: 231740 - DNA, 25 bp, Mus musculus
atagctcagggttaactgcctgctt

SEQ ID NO: 231741 - DNA, 25 bp, Mus musculus
atagctcagtcactatggccatgaa

SEQ ID NO: 231742 - DNA, 25 bp, Mus musculus
atagctcagtcagtatggccatgaa

SEQ ID NO: 231743 - DNA, 25 bp, Mus musculus
atagctcagttgaagagcactctcc

SEQ ID NO: 231744 - DNA, 25 bp, Mus musculus
atagctcagttgtagagcactctcc

SEQ ID NO: 231745 - DNA, 25 bp, Mus musculus
atagctcatctaacctcttgcagaa

SEQ ID NO: 231746 - DNA, 25 bp, Mus musculus
atagctcatctatcctcttgcagaa

SEQ ID NO: 231747 - DNA, 25 bp, Mus musculus
atagctcattctctcacactggcaa

SEQ ID NO: 231748 - DNA, 25 bp, Mus musculus
atagctcattctgtcacactggcaa

SEQ ID NO: 231749 - DNA, 25 bp, Mus musculus
atagctcattgtccactgtatagtc

SEQ ID NO: 231750 - DNA, 25 bp, Mus musculus
atagctcattgtgcactgtatagtc

SEQ ID NO: 231751 - DNA, 25 bp, Mus musculus
atagctccagagctttagctgggtg

SEQ ID NO: 231752 - DNA, 25 bp, Mus musculus
atagctccagaggtttagctgggtg

SEQ ID NO: 231753 - DNA, 25 bp, Mus musculus
atagctccagctatctcagaaatgg

SEQ ID NO: 231754 - DNA, 25 bp, Mus musculus
atagctccagctttctcagaaatgg

SEQ ID NO: 231755 - DNA, 25 bp, Mus musculus
atagctccagtaaagaccatgtcaa

SEQ ID NO: 231756 - DNA, 25 bp, Mus musculus
atagctccagtatagaccatgtcaa

SEQ ID NO: 231757 - DNA, 25 bp, Mus musculus
atagctccatgtctaggccatgaca

SEQ ID NO: 231758 - DNA, 25 bp, Mus musculus
atagctccatgtgtaggccatgaca

SEQ ID NO: 231759 - DNA, 25 bp, Mus musculus
atagctccattcataacacttttga

SEQ ID NO: 231760 - DNA, 25 bp, Mus musculus
atagctccattcttaacacttttga

SEQ ID NO: 231761 - DNA, 25 bp, Mus musculus
atagctcccaagacagcagttctcc

SEQ ID NO: 231762 - DNA, 25 bp, Mus musculus
atagctcccaagtcagcagttctcc

SEQ ID NO: 231763 - DNA, 25 bp, Mus musculus
atagctcccatgagcccgccagact

SEQ ID NO: 231764 - DNA, 25 bp, Mus musculus
atagctcccatgtgcccgccagact

SEQ ID NO: 231765 - DNA, 25 bp, Mus musculus
atagctccctacagaactttcatac

SEQ ID NO: 231766 - DNA, 25 bp, Mus musculus
atagctccctactgaactttcatac

SEQ ID NO: 231767 - DNA, 25 bp, Mus musculus
atagctccctcaccatggaaaggct

SEQ ID NO: 231768 - DNA, 25 bp, Mus musculus
atagctccctcagcatggaaaggct

SEQ ID NO: 231769 - DNA, 25 bp, Mus musculus
atagctcctaatacaatgaacattc

SEQ ID NO: 231770 - DNA, 25 bp, Mus musculus
atagctcctaattcaatgaacattc

SEQ ID NO: 231771 - DNA, 25 bp, Mus musculus
atagctcctacacttgactgttaaa

SEQ ID NO: 231772 - DNA, 25 bp, Mus musculus
atagctcctacagttgactgttaaa

SEQ ID NO: 231773 - DNA, 25 bp, Mus musculus
atagctcctagcatcatggagatta

SEQ ID NO: 231774 - DNA, 25 bp, Mus musculus
atagctcctagcttcatggagatta

SEQ ID NO: 231775 - DNA, 25 bp, Mus musculus
atagctcctgagcagactttcagaa

SEQ ID NO: 231776 - DNA, 25 bp, Mus musculus
atagctcctgaggagactttcagaa

SEQ ID NO: 231777 - DNA, 25 bp, Mus musculus
atagctcgcctaacaaagcagctta

SEQ ID NO: 231778 - DNA, 25 bp, Mus musculus
atagctcgcctatcaaagcagctta

SEQ ID NO: 231779 - DNA, 25 bp, Mus musculus
atagctcggagcactggccctgtta

SEQ ID NO: 231780 - DNA, 25 bp, Mus musculus
atagctcggagctctggccctgtta

SEQ ID NO: 231781 - DNA, 25 bp, Mus musculus
atagctcgtccaaacttacacttgt

SEQ ID NO: 231782 - DNA, 25 bp, Mus musculus
atagctcgtccatacttacacttgt

SEQ ID NO: 231783 - DNA, 25 bp, Mus musculus
atagctcgtctgctagaagacaaac

SEQ ID NO: 231784 - DNA, 25 bp, Mus musculus
atagctcgtctggtagaagacaaac

SEQ ID NO: 231785 - DNA, 25 bp, Mus musculus
atagctcgtgccattcaacagaaac

SEQ ID NO: 231786 - DNA, 25 bp, Mus musculus
atagctcgtgcctttcaacagaaac

SEQ ID NO: 231787 - DNA, 25 bp, Mus musculus
atagctctatgcatactgttgtgca

SEQ ID NO: 231788 - DNA, 25 bp, Mus musculus
atagctctatgcttactgttgtgca

SEQ ID NO: 231789 - DNA, 25 bp, Mus musculus
atagctctccaacactgatactgac

SEQ ID NO: 231790 - DNA, 25 bp, Mus musculus
atagctctccaagactgatactgac

SEQ ID NO: 231791 - DNA, 25 bp, Mus musculus
atagctctcctcagaatacttccta

SEQ ID NO: 231792 - DNA, 25 bp, Mus musculus
atagctctcctctgaatacttccta

SEQ ID NO: 231793 - DNA, 25 bp, Mus musculus
atagctctctggatcctgcaatgta

SEQ ID NO: 231794 - DNA, 25 bp, Mus musculus
atagctctctggcttttacacagtt

SEQ ID NO: 231795 - DNA, 25 bp, Mus musculus
atagctctctgggttttacacagtt

SEQ ID NO: 231796 - DNA, 25 bp, Mus musculus
atagctctctggttcctgcaatgta

SEQ ID NO: 231797 - DNA, 25 bp, Mus musculus
atagctctgactcccaccaaaaaga

SEQ ID NO: 231798 - DNA, 25 bp, Mus musculus
atagctctgactgccaccaaaaaga

SEQ ID NO: 231799 - DNA, 25 bp, Mus musculus
atagctctgagtaaccatgactggg

SEQ ID NO: 231800 - DNA, 25 bp, Mus musculus
atagctctgagttaccatgactggg

SEQ ID NO: 231801 - DNA, 25 bp, Mus musculus
atagctctgcagatcacctgagtgc

SEQ ID NO: 231802 - DNA, 25 bp, Mus musculus
atagctctgcagttcacctgagtgc

SEQ ID NO: 231803 - DNA, 25 bp, Mus musculus
atagctctgcttacaggtgccccag

SEQ ID NO: 231804 - DNA, 25 bp, Mus musculus
atagctctgcttataatctgtttgg

SEQ ID NO: 231805 - DNA, 25 bp, Mus musculus
atagctctgctttcaggtgccccag

SEQ ID NO: 231806 - DNA, 25 bp, Mus musculus
atagctctgcttttaatctgtttgg

SEQ ID NO: 231807 - DNA, 25 bp, Mus musculus
atagctctggctctcaatctttttt

SEQ ID NO: 231808 - DNA, 25 bp, Mus musculus
atagctctggctgtcaatctttttt

SEQ ID NO: 231809 - DNA, 25 bp, Mus musculus
atagctctgtataaaaatcagccct

SEQ ID NO: 231810 - DNA, 25 bp, Mus musculus
atagctctgtattaaaatcagccct

SEQ ID NO: 231811 - DNA, 25 bp, Mus musculus
atagctctgtgcattctctgtacac

SEQ ID NO: 231812 - DNA, 25 bp, Mus musculus
atagctctgtgctttctctgtacac

SEQ ID NO: 231813 - DNA, 25 bp, Mus musculus
atagctctgtttagtatttgtcttt

SEQ ID NO: 231814 - DNA, 25 bp, Mus musculus
atagctctgttttgtatttgtcttt

SEQ ID NO: 231815 - DNA, 25 bp, Mus musculus
atagctcttcagatgtgcttacaaa

SEQ ID NO: 231816 - DNA, 25 bp, Mus musculus
atagctcttcagttgtgcttacaaa

SEQ ID NO: 231817 - DNA, 25 bp, Mus musculus
atagctcttgccagccagggacaga

SEQ ID NO: 231818 - DNA, 25 bp, Mus musculus
atagctcttgcctgccagggacaga

SEQ ID NO: 231819 - DNA, 25 bp, Mus musculus
atagctctttagcaatatgacatct

SEQ ID NO: 231820 - DNA, 25 bp, Mus musculus
atagctctttaggaatatgacatct

SEQ ID NO: 231821 - DNA, 25 bp, Mus musculus
atagctctttgacggctggtagtca

SEQ ID NO: 231822 - DNA, 25 bp, Mus musculus
atagctctttgagggctggtagtca

SEQ ID NO: 231823 - DNA, 25 bp, Mus musculus
atagctgaacaaatttctggctcac

SEQ ID NO: 231824 - DNA, 25 bp, Mus musculus
atagctgaacaattttctggctcac

SEQ ID NO: 231825 - DNA, 25 bp, Mus musculus
atagctgaaggccttttatttaacg

SEQ ID NO: 231826 - DNA, 25 bp, Mus musculus
atagctgaaggcgttttatttaacg

SEQ ID NO: 231827 - DNA, 25 bp, Mus musculus
atagctgaatgtctcttaactggcc

SEQ ID NO: 231828 - DNA, 25 bp, Mus musculus
atagctgaatgtgtcttaactggcc

SEQ ID NO: 231829 - DNA, 25 bp, Mus musculus
atagctgaccaaccctgttgccctt

SEQ ID NO: 231830 - DNA, 25 bp, Mus musculus
atagctgaccaagcctgttgccctt

SEQ ID NO: 231831 - DNA, 25 bp, Mus musculus
atagctgaccataaataaaacatta

SEQ ID NO: 231832 - DNA, 25 bp, Mus musculus
atagctgaccattaataaaacatta

SEQ ID NO: 231833 - DNA, 25 bp, Mus musculus
atagctgacctcattgtgacttgaa

SEQ ID NO: 231834 - DNA, 25 bp, Mus musculus
atagctgacctctttgtgacttgaa

SEQ ID NO: 231835 - DNA, 25 bp, Mus musculus
atagctgacgaaatccaggcccatc

SEQ ID NO: 231836 - DNA, 25 bp, Mus musculus
atagctgacgaattccaggcccatc

SEQ ID NO: 231837 - DNA, 25 bp, Mus musculus
atagctgagcgtcgcatctgttgat

SEQ ID NO: 231838 - DNA, 25 bp, Mus musculus
atagctgagcgtggcatctgttgat

SEQ ID NO: 231839 - DNA, 25 bp, Mus musculus
atagctgaggcacagagctctcttg

SEQ ID NO: 231840 - DNA, 25 bp, Mus musculus
atagctgaggcagagagctctcttg

SEQ ID NO: 231841 - DNA, 25 bp, Mus musculus
atagctgagtaacttggccaccttt

SEQ ID NO: 231842 - DNA, 25 bp, Mus musculus
atagctgagtaagttggccaccttt

SEQ ID NO: 231843 - DNA, 25 bp, Mus musculus
atagctgagtagagctgggagccat

SEQ ID NO: 231844 - DNA, 25 bp, Mus musculus
atagctgagtagtgctgggagccat

SEQ ID NO: 231845 - DNA, 25 bp, Mus musculus
atagctgatatgactgcttcactcc

SEQ ID NO: 231846 - DNA, 25 bp, Mus musculus
atagctgatatgtctgcttcactcc

SEQ ID NO: 231847 - DNA, 25 bp, Mus musculus
atagctgatcacatccacggtgtgg

SEQ ID NO: 231848 - DNA, 25 bp, Mus musculus
atagctgatcacttccacggtgtgg

SEQ ID NO: 231849 - DNA, 25 bp, Mus musculus
atagctgcaacccttggaacttgac

SEQ ID NO: 231850 - DNA, 25 bp, Mus musculus
atagctgcaaccgttggaacttgac

SEQ ID NO: 231851 - DNA, 25 bp, Mus musculus
atagctgcaactagatagggtctga

SEQ ID NO: 231852 - DNA, 25 bp, Mus musculus
atagctgcaacttgatagggtctga

SEQ ID NO: 231853 - DNA, 25 bp, Mus musculus
atagctgcacaaaggatgacaacga

SEQ ID NO: 231854 - DNA, 25 bp, Mus musculus
atagctgcacaatggatgacaacga

SEQ ID NO: 231855 - DNA, 25 bp, Mus musculus
atagctgcatgaacgtgaggtccct

SEQ ID NO: 231856 - DNA, 25 bp, Mus musculus
atagctgcatgatcgtgaggtccct

SEQ ID NO: 231857 - DNA, 25 bp, Mus musculus
atagctgcatgcaacgtgcacacga

SEQ ID NO: 231858 - DNA, 25 bp, Mus musculus
atagctgcatgctacgtgcacacga

SEQ ID NO: 231859 - DNA, 25 bp, Mus musculus
atagctgccaaacttgggtcaattg

SEQ ID NO: 231860 - DNA, 25 bp, Mus musculus
atagctgccaaagttgggtcaattg

SEQ ID NO: 231861 - DNA, 25 bp, Mus musculus
atagctgccaataagttcctctgtt

SEQ ID NO: 231862 - DNA, 25 bp, Mus musculus
atagctgccaattagttcctctgtt

SEQ ID NO: 231863 - DNA, 25 bp, Mus musculus
atagctgccagccagaactcagaca

SEQ ID NO: 231864 - DNA, 25 bp, Mus musculus
atagctgccagcgagaactcagaca

SEQ ID NO: 231865 - DNA, 25 bp, Mus musculus
atagctgccagtctgtaaccctggg

SEQ ID NO: 231866 - DNA, 25 bp, Mus musculus
atagctgccagtgtgtaaccctggg

SEQ ID NO: 231867 - DNA, 25 bp, Mus musculus
atagctgccatcaagacgaagcgca

SEQ ID NO: 231868 - DNA, 25 bp, Mus musculus
atagctgccatctagacgaagcgca

SEQ ID NO: 231869 - DNA, 25 bp, Mus musculus
atagctgccatgaggagggctccta

SEQ ID NO: 231870 - DNA, 25 bp, Mus musculus
atagctgccatgtggagggctccta

SEQ ID NO: 231871 - DNA, 25 bp, Mus musculus
atagctgcctagattgctgttctag

SEQ ID NO: 231872 - DNA, 25 bp, Mus musculus
atagctgcctagtttgctgttctag

SEQ ID NO: 231873 - DNA, 25 bp, Mus musculus
atagctgcctatcactggtgtatca

SEQ ID NO: 231874 - DNA, 25 bp, Mus musculus
atagctgcctatgactggtgtatca

SEQ ID NO: 231875 - DNA, 25 bp, Mus musculus
atagctgcctcactgatgttgccat

SEQ ID NO: 231876 - DNA, 25 bp, Mus musculus
atagctgcctcagtgatgttgccat

SEQ ID NO: 231877 - DNA, 25 bp, Mus musculus
atagctgcgcctcaagagtcagcct

SEQ ID NO: 231878 - DNA, 25 bp, Mus musculus
atagctgcgcctgaagagtcagcct

SEQ ID NO: 231879 - DNA, 25 bp, Mus musculus
atagctgctaggatagagagggttt

SEQ ID NO: 231880 - DNA, 25 bp, Mus musculus
atagctgctaggttagagagggttt

SEQ ID NO: 231881 - DNA, 25 bp, Mus musculus
atagctgctccacctggctttgtgt

SEQ ID NO: 231882 - DNA, 25 bp, Mus musculus
atagctgctccagctggctttgtgt

SEQ ID NO: 231883 - DNA, 25 bp, Mus musculus
atagctgctgctacctctagggata

SEQ ID NO: 231884 - DNA, 25 bp, Mus musculus
atagctgctgctagaacaccttgaa

SEQ ID NO: 231885 - DNA, 25 bp, Mus musculus
atagctgctgcttcctctagggata

SEQ ID NO: 231886 - DNA, 25 bp, Mus musculus
atagctgctgcttgaacaccttgaa

SEQ ID NO: 231887 - DNA, 25 bp, Mus musculus
atagctgctgtacttttcacgtttt

SEQ ID NO: 231888 - DNA, 25 bp, Mus musculus
atagctgctgtagttttcacgtttt

SEQ ID NO: 231889 - DNA, 25 bp, Mus musculus
atagctgcttatatgtctctttcct

SEQ ID NO: 231890 - DNA, 25 bp, Mus musculus
atagctgcttatttgtctctttcct

SEQ ID NO: 231891 - DNA, 25 bp, Mus musculus
atagctggactgaccgaagtctgca

SEQ ID NO: 231892 - DNA, 25 bp, Mus musculus
atagctggactgtccgaagtctgca

SEQ ID NO: 231893 - DNA, 25 bp, Mus musculus
atagctggatgcacatattttcctt

SEQ ID NO: 231894 - DNA, 25 bp, Mus musculus
atagctggatgctcatattttcctt

SEQ ID NO: 231895 - DNA, 25 bp, Mus musculus
atagctggctttaatgtccactaaa

SEQ ID NO: 231896 - DNA, 25 bp, Mus musculus
atagctggcttttatgtccactaaa

SEQ ID NO: 231897 - DNA, 25 bp, Mus musculus
atagctgggcatctagcacttggta

SEQ ID NO: 231898 - DNA, 25 bp, Mus musculus
atagctgggcatgtagcacttggta

SEQ ID NO: 231899 - DNA, 25 bp, Mus musculus
atagctgggccaaatgacaggcgca

SEQ ID NO: 231900 - DNA, 25 bp, Mus musculus
atagctgggccatatgacaggcgca

SEQ ID NO: 231901 - DNA, 25 bp, Mus musculus
atagctggtgtacagattcggcgac

SEQ ID NO: 231902 - DNA, 25 bp, Mus musculus
atagctggtgtagagattcggcgac

SEQ ID NO: 231903 - DNA, 25 bp, Mus musculus
atagctggtgtcattgaatgcttac

SEQ ID NO: 231904 - DNA, 25 bp, Mus musculus
atagctggtgtctttgaatgcttac

SEQ ID NO: 231905 - DNA, 25 bp, Mus musculus
atagctggttcccagatccctgctg

SEQ ID NO: 231906 - DNA, 25 bp, Mus musculus
atagctggttccgagatccctgctg

SEQ ID NO: 231907 - DNA, 25 bp, Mus musculus
atagctggtttgacttcagtgccaa

SEQ ID NO: 231908 - DNA, 25 bp, Mus musculus
atagctggtttgtcttcagtgccaa

SEQ ID NO: 231909 - DNA, 25 bp, Mus musculus
atagctgtaccaatgtttacccaag

SEQ ID NO: 231910 - DNA, 25 bp, Mus musculus
atagctgtaccacaactcgtgactg

SEQ ID NO: 231911 - DNA, 25 bp, Mus musculus
atagctgtaccagaactcgtgactg

SEQ ID NO: 231912 - DNA, 25 bp, Mus musculus
atagctgtaccattgtttacccaag

SEQ ID NO: 231913 - DNA, 25 bp, Mus musculus
atagctgtactaaccataaatttta

SEQ ID NO: 231914 - DNA, 25 bp, Mus musculus
atagctgtactatccataaatttta

SEQ ID NO: 231915 - DNA, 25 bp, Mus musculus
atagctgtacttactggaccaccaa

SEQ ID NO: 231916 - DNA, 25 bp, Mus musculus
atagctgtactttctggaccaccaa

SEQ ID NO: 231917 - DNA, 25 bp, Mus musculus
atagctgtagcgcttgggccccagt

SEQ ID NO: 231918 - DNA, 25 bp, Mus musculus
atagctgtagcggttgggccccagt

SEQ ID NO: 231919 - DNA, 25 bp, Mus musculus
atagctgtaggcacagatgctgaca

SEQ ID NO: 231920 - DNA, 25 bp, Mus musculus
atagctgtaggctcagatgctgaca

SEQ ID NO: 231921 - DNA, 25 bp, Mus musculus
atagctgtatcactaatgattatac

SEQ ID NO: 231922 - DNA, 25 bp, Mus musculus
atagctgtatcagtaatgattatac

SEQ ID NO: 231923 - DNA, 25 bp, Mus musculus
atagctgtatccctcttttttacat

SEQ ID NO: 231924 - DNA, 25 bp, Mus musculus
atagctgtatccgtcttttttacat

SEQ ID NO: 231925 - DNA, 25 bp, Mus musculus
atagctgtatttaaccaatatccag

SEQ ID NO: 231926 - DNA, 25 bp, Mus musculus
atagctgtattttaccaatatccag

SEQ ID NO: 231927 - DNA, 25 bp, Mus musculus
atagctgtcagtacacaccggttga

SEQ ID NO: 231928 - DNA, 25 bp, Mus musculus
atagctgtcagtagtacctgggctt

SEQ ID NO: 231929 - DNA, 25 bp, Mus musculus
atagctgtcagttcacaccggttga

SEQ ID NO: 231930 - DNA, 25 bp, Mus musculus
atagctgtcagttgtacctgggctt

SEQ ID NO: 231931 - DNA, 25 bp, Mus musculus
atagctgtcataaccttgtcaaacg

SEQ ID NO: 231932 - DNA, 25 bp, Mus musculus
atagctgtcatatccttgtcaaacg

SEQ ID NO: 231933 - DNA, 25 bp, Mus musculus
atagctgtcatcctgcactggtcca

SEQ ID NO: 231934 - DNA, 25 bp, Mus musculus
atagctgtcatcgtgcactggtcca

SEQ ID NO: 231935 - DNA, 25 bp, Mus musculus
atagctgtcctcagtttctcaagaa

SEQ ID NO: 231936 - DNA, 25 bp, Mus musculus
atagctgtcctccagacgtggtgga

SEQ ID NO: 231937 - DNA, 25 bp, Mus musculus
atagctgtcctcgagacgtggtgga

SEQ ID NO: 231938 - DNA, 25 bp, Mus musculus
atagctgtcctctgtttctcaagaa

SEQ ID NO: 231939 - DNA, 25 bp, Mus musculus
atagctgtctctattggtttgtcct

SEQ ID NO: 231940 - DNA, 25 bp, Mus musculus
atagctgtctcttttggtttgtcct

SEQ ID NO: 231941 - DNA, 25 bp, Mus musculus
atagctgtctgcaagattcccaggc

SEQ ID NO: 231942 - DNA, 25 bp, Mus musculus
atagctgtctgctagattcccaggc

SEQ ID NO: 231943 - DNA, 25 bp, Mus musculus
atagctgtcttaagcaacctcgtca

SEQ ID NO: 231944 - DNA, 25 bp, Mus musculus
atagctgtcttatgcaacctcgtca

SEQ ID NO: 231945 - DNA, 25 bp, Mus musculus
atagctgtgaccattgaccatattt

SEQ ID NO: 231946 - DNA, 25 bp, Mus musculus
atagctgtgacctttgaccatattt

SEQ ID NO: 231947 - DNA, 25 bp, Mus musculus
atagctgtgataagtaagtctccgg

SEQ ID NO: 231948 - DNA, 25 bp, Mus musculus
atagctgtgatatgtaagtctccgg

SEQ ID NO: 231949 - DNA, 25 bp, Mus musculus
atagctgtgcagcagttgataagtc

SEQ ID NO: 231950 - DNA, 25 bp, Mus musculus
atagctgtgcaggagttgataagtc

SEQ ID NO: 231951 - DNA, 25 bp, Mus musculus
atagctgtggtcatgtctgcaaaac

SEQ ID NO: 231952 - DNA, 25 bp, Mus musculus
atagctgtggtcttgtctgcaaaac

SEQ ID NO: 231953 - DNA, 25 bp, Mus musculus
atagctgtgtatagccttgttatat

SEQ ID NO: 231954 - DNA, 25 bp, Mus musculus
atagctgtgtattgccttgttatat

SEQ ID NO: 231955 - DNA, 25 bp, Mus musculus
atagctgtgtgcaccatcagtggtc

SEQ ID NO: 231956 - DNA, 25 bp, Mus musculus
atagctgtgtgctccatcagtggtc

SEQ ID NO: 231957 - DNA, 25 bp, Mus musculus
atagctgttacaaggcaagtggcac

SEQ ID NO: 231958 - DNA, 25 bp, Mus musculus
atagctgttacatggcaagtggcac

SEQ ID NO: 231959 - DNA, 25 bp, Mus musculus
atagctgttcctctatcatagtgta

SEQ ID NO: 231960 - DNA, 25 bp, Mus musculus
atagctgttcctgtatcatagtgta

SEQ ID NO: 231961 - DNA, 25 bp, Mus musculus
atagctgtttccaatcatgaagtac

SEQ ID NO: 231962 - DNA, 25 bp, Mus musculus
atagctgtttcctatcatgaagtac

SEQ ID NO: 231963 - DNA, 25 bp, Mus musculus
atagcttaacagaacactcacaatg

SEQ ID NO: 231964 - DNA, 25 bp, Mus musculus
atagcttaacagtacactcacaatg

SEQ ID NO: 231965 - DNA, 25 bp, Mus musculus
atagcttacaaactaattcggcggt

SEQ ID NO: 231966 - DNA, 25 bp, Mus musculus
atagcttacaaagtaattcggcggt

SEQ ID NO: 231967 - DNA, 25 bp, Mus musculus
atagcttacagtctgtgtctctgca

SEQ ID NO: 231968 - DNA, 25 bp, Mus musculus
atagcttacagtgtgtgtctctgca

SEQ ID NO: 231969 - DNA, 25 bp, Mus musculus
atagcttaccctaggaagactcgtg

SEQ ID NO: 231970 - DNA, 25 bp, Mus musculus
atagcttacccttggaagactcgtg

SEQ ID NO: 231971 - DNA, 25 bp, Mus musculus
atagcttactttccacttccatgtc

SEQ ID NO: 231972 - DNA, 25 bp, Mus musculus
atagcttactttgcacttccatgtc

SEQ ID NO: 231973 - DNA, 25 bp, Mus musculus
atagcttagactcttggacctctgt

SEQ ID NO: 231974 - DNA, 25 bp, Mus musculus
atagcttagactgttggacctctgt

SEQ ID NO: 231975 - DNA, 25 bp, Mus musculus
atagcttaggacacaagccagctct

SEQ ID NO: 231976 - DNA, 25 bp, Mus musculus
atagcttaggactcaagccagctct

SEQ ID NO: 231977 - DNA, 25 bp, Mus musculus
atagcttaggctcacctgatcttct

SEQ ID NO: 231978 - DNA, 25 bp, Mus musculus
atagcttaggctgacctgatcttct

SEQ ID NO: 231979 - DNA, 25 bp, Mus musculus
atagcttagtaaacgcagtagtgag

SEQ ID NO: 231980 - DNA, 25 bp, Mus musculus
atagcttagtaatcgcagtagtgag

SEQ ID NO: 231981 - DNA, 25 bp, Mus musculus
atagcttatcacacatattccacct

SEQ ID NO: 231982 - DNA, 25 bp, Mus musculus
atagcttatcactcatattccacct

SEQ ID NO: 231983 - DNA, 25 bp, Mus musculus
atagcttatgagaactccacgattc

SEQ ID NO: 231984 - DNA, 25 bp, Mus musculus
atagcttatgagtactccacgattc

SEQ ID NO: 231985 - DNA, 25 bp, Mus musculus
atagcttcaccaactatcagcacag

SEQ ID NO: 231986 - DNA, 25 bp, Mus musculus
atagcttcaccatctatcagcacag

SEQ ID NO: 231987 - DNA, 25 bp, Mus musculus
atagcttcacttcaattgaaccagc

SEQ ID NO: 231988 - DNA, 25 bp, Mus musculus
atagcttcacttgaattgaaccagc

SEQ ID NO: 231989 - DNA, 25 bp, Mus musculus
atagcttcatttcatagaaacacga

SEQ ID NO: 231990 - DNA, 25 bp, Mus musculus
atagcttcatttgatagaaacacga

SEQ ID NO: 231991 - DNA, 25 bp, Mus musculus
atagcttccaggattttcagctctt

SEQ ID NO: 231992 - DNA, 25 bp, Mus musculus
atagcttccaggtttttcagctctt

SEQ ID NO: 231993 - DNA, 25 bp, Mus musculus
atagcttcccagaggttctggtact

SEQ ID NO: 231994 - DNA, 25 bp, Mus musculus
atagcttcccagtggttctggtact

SEQ ID NO: 231995 - DNA, 25 bp, Mus musculus
atagcttcccatacttctatgcttt

SEQ ID NO: 231996 - DNA, 25 bp, Mus musculus
atagcttcccattcttctatgcttt

SEQ ID NO: 231997 - DNA, 25 bp, Mus musculus
atagcttccctaagtttgtgtgact

SEQ ID NO: 231998 - DNA, 25 bp, Mus musculus
atagcttccctatgtttgtgtgact

SEQ ID NO: 231999 - DNA, 25 bp, Mus musculus
atagcttctaaaacaagcctcatgg

SEQ ID NO: 232000 - DNA, 25 bp, Mus musculus
atagcttctaaatcaagcctcatgg

SEQ ID NO: 232001 - DNA, 25 bp, Mus musculus
atagcttctgtgattgagaccctcg

SEQ ID NO: 232002 - DNA, 25 bp, Mus musculus
atagcttctgtgtttgagaccctcg

SEQ ID NO: 232003 - DNA, 25 bp, Mus musculus
atagcttctttcctgcagggaggca

SEQ ID NO: 232004 - DNA, 25 bp, Mus musculus
atagcttctttcgtgcagggaggca

SEQ ID NO: 232005 - DNA, 25 bp, Mus musculus
atagcttgaagaattcggagttccc

SEQ ID NO: 232006 - DNA, 25 bp, Mus musculus
atagcttgaagatttcggagttccc

SEQ ID NO: 232007 - DNA, 25 bp, Mus musculus
atagcttgagcaaacgacacctcaa

SEQ ID NO: 232008 - DNA, 25 bp, Mus musculus
atagcttgagcatacgacacctcaa

SEQ ID NO: 232009 - DNA, 25 bp, Mus musculus
atagcttgatccaagaggcctcttc

SEQ ID NO: 232010 - DNA, 25 bp, Mus musculus
atagcttgatcctagaggcctcttc

SEQ ID NO: 232011 - DNA, 25 bp, Mus musculus
atagcttgccaaagtttgctgacaa

SEQ ID NO: 232012 - DNA, 25 bp, Mus musculus
atagcttgccaatgtttgctgacaa

SEQ ID NO: 232013 - DNA, 25 bp, Mus musculus
atagcttgcctcctaatgaagttgg

SEQ ID NO: 232014 - DNA, 25 bp, Mus musculus
atagcttgcctcgtaatgaagttgg

SEQ ID NO: 232015 - DNA, 25 bp, Mus musculus
atagcttgctatcatttctctcccc

SEQ ID NO: 232016 - DNA, 25 bp, Mus musculus
atagcttgctatgatttctctcccc

SEQ ID NO: 232017 - DNA, 25 bp, Mus musculus
atagcttggcatcgcctgaatttgc

SEQ ID NO: 232018 - DNA, 25 bp, Mus musculus
atagcttggcatggcctgaatttgc

SEQ ID NO: 232019 - DNA, 25 bp, Mus musculus
atagcttgggtgagatcctgctcga

SEQ ID NO: 232020 - DNA, 25 bp, Mus musculus
atagcttgggtgtgatcctgctcga

SEQ ID NO: 232021 - DNA, 25 bp, Mus musculus
atagcttggtgaaatgagaaacttc

SEQ ID NO: 232022 - DNA, 25 bp, Mus musculus
atagcttggtgatatgagaaacttc

SEQ ID NO: 232023 - DNA, 25 bp, Mus musculus
atagcttgtaaaccacttgctcggc

SEQ ID NO: 232024 - DNA, 25 bp, Mus musculus
atagcttgtaaagcacttgctcggc

SEQ ID NO: 232025 - DNA, 25 bp, Mus musculus
atagcttgtactaaatgccttcaga

SEQ ID NO: 232026 - DNA, 25 bp, Mus musculus
atagcttgtacttaatgccttcaga

SEQ ID NO: 232027 - DNA, 25 bp, Mus musculus
atagcttgttggcttttggcttgtt

SEQ ID NO: 232028 - DNA, 25 bp, Mus musculus
atagcttgttgggttttggcttgtt

SEQ ID NO: 232029 - DNA, 25 bp, Mus musculus
atagctttaaagagcggctctctaa

SEQ ID NO: 232030 - DNA, 25 bp, Mus musculus
atagctttaaagtgcggctctctaa

SEQ ID NO: 232031 - DNA, 25 bp, Mus musculus
atagctttagggatgactacttagt

SEQ ID NO: 232032 - DNA, 25 bp, Mus musculus
atagctttagggttgactacttagt

SEQ ID NO: 232033 - DNA, 25 bp, Mus musculus
atagctttattaacccacacaggcc

SEQ ID NO: 232034 - DNA, 25 bp, Mus musculus
atagctttattatcccacacaggcc

SEQ ID NO: 232035 - DNA, 25 bp, Mus musculus
atagctttatttccttgcctgtact

SEQ ID NO: 232036 - DNA, 25 bp, Mus musculus
atagctttatttgcttgcctgtact

SEQ ID NO: 232037 - DNA, 25 bp, Mus musculus
atagctttcagaagctactcgactg

SEQ ID NO: 232038 - DNA, 25 bp, Mus musculus
atagctttcagatgctactcgactg

SEQ ID NO: 232039 - DNA, 25 bp, Mus musculus
atagctttccccactgtgtcattta

SEQ ID NO: 232040 - DNA, 25 bp, Mus musculus
atagctttcccctctgtgtcattta

SEQ ID NO: 232041 - DNA, 25 bp, Mus musculus
atagctttccctacaagactgctgt

SEQ ID NO: 232042 - DNA, 25 bp, Mus musculus
atagctttcccttcaagactgctgt

SEQ ID NO: 232043 - DNA, 25 bp, Mus musculus
atagctttctatctcggtgcttacc

SEQ ID NO: 232044 - DNA, 25 bp, Mus musculus
atagctttctatgtcggtgcttacc

SEQ ID NO: 232045 - DNA, 25 bp, Mus musculus
atagctttcttaatcctgatggttt

SEQ ID NO: 232046 - DNA, 25 bp, Mus musculus
atagctttcttattcctgatggttt

SEQ ID NO: 232047 - DNA, 25 bp, Mus musculus
atagctttgaggaagtccctgcctg

SEQ ID NO: 232048 - DNA, 25 bp, Mus musculus
atagctttgaggtagtccctgcctg

SEQ ID NO: 232049 - DNA, 25 bp, Mus musculus
atagctttgagtcatttattcccaa

SEQ ID NO: 232050 - DNA, 25 bp, Mus musculus
atagctttgagtgatttattcccaa

SEQ ID NO: 232051 - DNA, 25 bp, Mus musculus
atagctttgctaagatcaccgttgt

SEQ ID NO: 232052 - DNA, 25 bp, Mus musculus
atagctttgctatgatcaccgttgt

SEQ ID NO: 232053 - DNA, 25 bp, Mus musculus
atagctttgctgagtatcctttctg

SEQ ID NO: 232054 - DNA, 25 bp, Mus musculus
atagctttgctgtgtatcctttctg

SEQ ID NO: 232055 - DNA, 25 bp, Mus musculus
atagctttggaaatgtactctggga

SEQ ID NO: 232056 - DNA, 25 bp, Mus musculus
atagctttggaattgtactctggga

SEQ ID NO: 232057 - DNA, 25 bp, Mus musculus
atagctttggagacctatcctctgc

SEQ ID NO: 232058 - DNA, 25 bp, Mus musculus
atagctttggagtcctatcctctgc

SEQ ID NO: 232059 - DNA, 25 bp, Mus musculus
atagctttggctcttccccaactag

SEQ ID NO: 232060 - DNA, 25 bp, Mus musculus
atagctttggctgttccccaactag

SEQ ID NO: 232061 - DNA, 25 bp, Mus musculus
atagctttgtggcttctggcccttc

SEQ ID NO: 232062 - DNA, 25 bp, Mus musculus
atagctttgtgggttctggcccttc

SEQ ID NO: 232063 - DNA, 25 bp, Mus musculus
atagctttgtttactagcgaagtgc

SEQ ID NO: 232064 - DNA, 25 bp, Mus musculus
atagctttgttttctagcgaagtgc

SEQ ID NO: 232065 - DNA, 25 bp, Mus musculus
atagcttttcatactagtgctcaaa

SEQ ID NO: 232066 - DNA, 25 bp, Mus musculus
atagcttttcattctagtgctcaaa

SEQ ID NO: 232067 - DNA, 25 bp, Mus musculus
atagcttttcccctggtatcatgaa

SEQ ID NO: 232068 - DNA, 25 bp, Mus musculus
atagcttttcccgtggtatcatgaa

SEQ ID NO: 232069 - DNA, 25 bp, Mus musculus
atagcttttctcagccgccgaggac

SEQ ID NO: 232070 - DNA, 25 bp, Mus musculus
atagcttttctctgccgccgaggac

SEQ ID NO: 232071 - DNA, 25 bp, Mus musculus
atagcttttgacagatggtgacttc

SEQ ID NO: 232072 - DNA, 25 bp, Mus musculus
atagcttttgactgatggtgacttc

SEQ ID NO: 232073 - DNA, 25 bp, Mus musculus
atagcttttgcaactttattactgg

SEQ ID NO: 232074 - DNA, 25 bp, Mus musculus
atagcttttgcatctttattactgg

SEQ ID NO: 232075 - DNA, 25 bp, Mus musculus
atagcttttggacgtgctggcttca

SEQ ID NO: 232076 - DNA, 25 bp, Mus musculus
atagcttttggaggtgctggcttca

SEQ ID NO: 232077 - DNA, 25 bp, Mus musculus
atagcttttttgagttctcgtggaa

SEQ ID NO: 232078 - DNA, 25 bp, Mus musculus
atagcttttttgtgttctcgtggaa

SEQ ID NO: 232079 - DNA, 25 bp, Mus musculus
ataggaaacgtgactccccgtgtat

SEQ ID NO: 232080 - DNA, 25 bp, Mus musculus
ataggaaacgtgtctccccgtgtat

SEQ ID NO: 232081 - DNA, 25 bp, Mus musculus
ataggaaaggttcagtctccctcgt

SEQ ID NO: 232082 - DNA, 25 bp, Mus musculus
ataggaaaggttgagtctccctcgt

SEQ ID NO: 232083 - DNA, 25 bp, Mus musculus
ataggaaccatgacagccctgctca

SEQ ID NO: 232084 - DNA, 25 bp, Mus musculus
ataggaaccatgtcagccctgctca

SEQ ID NO: 232085 - DNA, 25 bp, Mus musculus
ataggaaccctaccaacgagagtgt

SEQ ID NO: 232086 - DNA, 25 bp, Mus musculus
ataggaaccctagcaacgagagtgt

SEQ ID NO: 232087 - DNA, 25 bp, Mus musculus
ataggaaccgaaactgtgtcctctg

SEQ ID NO: 232088 - DNA, 25 bp, Mus musculus
ataggaaccgaatctgtgtcctctg

SEQ ID NO: 232089 - DNA, 25 bp, Mus musculus
ataggaactcagacctttcactctt

SEQ ID NO: 232090 - DNA, 25 bp, Mus musculus
ataggaactcagtcctttcactctt

SEQ ID NO: 232091 - DNA, 25 bp, Mus musculus
ataggaacttccactgcttagcttt

SEQ ID NO: 232092 - DNA, 25 bp, Mus musculus
ataggaacttcctctgcttagcttt

SEQ ID NO: 232093 - DNA, 25 bp, Mus musculus
ataggaaggcgcagaccaccattgt

SEQ ID NO: 232094 - DNA, 25 bp, Mus musculus
ataggaaggcgctgaccaccattgt

SEQ ID NO: 232095 - DNA, 25 bp, Mus musculus
ataggaagtctgattatcagccaaa

SEQ ID NO: 232096 - DNA, 25 bp, Mus musculus
ataggaagtctgtttatcagccaaa

SEQ ID NO: 232097 - DNA, 25 bp, Mus musculus
ataggaagttccctcctgcagctga

SEQ ID NO: 232098 - DNA, 25 bp, Mus musculus
ataggaagttccgtcctgcagctga

SEQ ID NO: 232099 - DNA, 25 bp, Mus musculus
ataggaagttgtatccagaccacca

SEQ ID NO: 232100 - DNA, 25 bp, Mus musculus
ataggaagttgtttccagaccacca

SEQ ID NO: 232101 - DNA, 25 bp, Mus musculus
ataggaagtttcacgcaagccaggg

SEQ ID NO: 232102 - DNA, 25 bp, Mus musculus
ataggaagtttctcgcaagccaggg

SEQ ID NO: 232103 - DNA, 25 bp, Mus musculus
ataggaatgctgctggctctgtgta

SEQ ID NO: 232104 - DNA, 25 bp, Mus musculus
ataggaatgctggtggctctgtgta

SEQ ID NO: 232105 - DNA, 25 bp, Mus musculus
ataggaatggcgacccctactgcag

SEQ ID NO: 232106 - DNA, 25 bp, Mus musculus
ataggaatggcgtcccctactgcag

SEQ ID NO: 232107 - DNA, 25 bp, Mus musculus
ataggaatggttactctgcttgctt

SEQ ID NO: 232108 - DNA, 25 bp, Mus musculus
ataggaatggtttctctgcttgctt

SEQ ID NO: 232109 - DNA, 25 bp, Mus musculus
ataggaatgttccacacaattaaaa

SEQ ID NO: 232110 - DNA, 25 bp, Mus musculus
ataggaatgttcgacacaattaaaa

SEQ ID NO: 232111 - DNA, 25 bp, Mus musculus
ataggaattgacaccggcgtgcaca

SEQ ID NO: 232112 - DNA, 25 bp, Mus musculus
ataggaattgactccggcgtgcaca

SEQ ID NO: 232113 - DNA, 25 bp, Mus musculus
ataggacaatacctcacccaggaag

SEQ ID NO: 232114 - DNA, 25 bp, Mus musculus
ataggacaatacgtcacccaggaag

SEQ ID NO: 232115 - DNA, 25 bp, Mus musculus
ataggacacatgattcttttcaaat

SEQ ID NO: 232116 - DNA, 25 bp, Mus musculus
ataggacacatgtttcttttcaaat

SEQ ID NO: 232117 - DNA, 25 bp, Mus musculus
ataggacagccacagccgatgataa

SEQ ID NO: 232118 - DNA, 25 bp, Mus musculus
ataggacagccagagccgatgataa

SEQ ID NO: 232119 - DNA, 25 bp, Mus musculus
ataggacaggccatgggactcacac

SEQ ID NO: 232120 - DNA, 25 bp, Mus musculus
ataggacaggccttgggactcacac

SEQ ID NO: 232121 - DNA, 25 bp, Mus musculus
ataggacattgtattctatgcagtc

SEQ ID NO: 232122 - DNA, 25 bp, Mus musculus
ataggacattgttttctatgcagtc

SEQ ID NO: 232123 - DNA, 25 bp, Mus musculus
ataggacatttcactacggtaagca

SEQ ID NO: 232124 - DNA, 25 bp, Mus musculus
ataggacatttctctacggtaagca

SEQ ID NO: 232125 - DNA, 25 bp, Mus musculus
ataggacattttacagaggctcttc

SEQ ID NO: 232126 - DNA, 25 bp, Mus musculus
ataggacattttatcaccagacaca

SEQ ID NO: 232127 - DNA, 25 bp, Mus musculus
ataggacatttttcagaggctcttc

SEQ ID NO: 232128 - DNA, 25 bp, Mus musculus
ataggacattttttcaccagacaca

SEQ ID NO: 232129 - DNA, 25 bp, Mus musculus
ataggaccagctcttcgaacacaga

SEQ ID NO: 232130 - DNA, 25 bp, Mus musculus
ataggaccagctgttcgaacacaga

SEQ ID NO: 232131 - DNA, 25 bp, Mus musculus
ataggaccgagcaggcgtcaggccc

SEQ ID NO: 232132 - DNA, 25 bp, Mus musculus
ataggaccgagctggcgtcaggccc

SEQ ID NO: 232133 - DNA, 25 bp, Mus musculus
ataggacctcaaaaacttgctgata

SEQ ID NO: 232134 - DNA, 25 bp, Mus musculus
ataggacctcaataacttgctgata

SEQ ID NO: 232135 - DNA, 25 bp, Mus musculus
ataggaccttgcctctgctgtgtct

SEQ ID NO: 232136 - DNA, 25 bp, Mus musculus
ataggaccttgcgtctgctgtgtct

SEQ ID NO: 232137 - DNA, 25 bp, Mus musculus
ataggacgcgtgactcccatggaga

SEQ ID NO: 232138 - DNA, 25 bp, Mus musculus
ataggacgcgtgtctcccatggaga

SEQ ID NO: 232139 - DNA, 25 bp, Mus musculus
ataggacggactccgcagcctaagt

SEQ ID NO: 232140 - DNA, 25 bp, Mus musculus
ataggacggactgcgcagcctaagt

SEQ ID NO: 232141 - DNA, 25 bp, Mus musculus
ataggactataaagacactggttta

SEQ ID NO: 232142 - DNA, 25 bp, Mus musculus
ataggactataatgacactggttta

SEQ ID NO: 232143 - DNA, 25 bp, Mus musculus
ataggactcacactgttgaccctgc

SEQ ID NO: 232144 - DNA, 25 bp, Mus musculus
ataggactcacagtgttgaccctgc

SEQ ID NO: 232145 - DNA, 25 bp, Mus musculus
ataggactcctgcacttgctgacca

SEQ ID NO: 232146 - DNA, 25 bp, Mus musculus
ataggactcctggacttgctgacca

SEQ ID NO: 232147 - DNA, 25 bp, Mus musculus
ataggactctgcatgtctgtaacct

SEQ ID NO: 232148 - DNA, 25 bp, Mus musculus
ataggactctgcttgtctgtaacct

SEQ ID NO: 232149 - DNA, 25 bp, Mus musculus
ataggactgagaactggcttggtag

SEQ ID NO: 232150 - DNA, 25 bp, Mus musculus
ataggactgagatctggcttggtag

SEQ ID NO: 232151 - DNA, 25 bp, Mus musculus
ataggactgcatctaacaggtaaac

SEQ ID NO: 232152 - DNA, 25 bp, Mus musculus
ataggactgcatgtaacaggtaaac

SEQ ID NO: 232153 - DNA, 25 bp, Mus musculus
ataggactgcgtacgtaggcatccc

SEQ ID NO: 232154 - DNA, 25 bp, Mus musculus
ataggactgcgttcgtaggcatccc

SEQ ID NO: 232155 - DNA, 25 bp, Mus musculus
ataggacttactatttcagcttatc

SEQ ID NO: 232156 - DNA, 25 bp, Mus musculus
ataggacttactttttcagcttatc

SEQ ID NO: 232157 - DNA, 25 bp, Mus musculus
ataggacttcccctttctgttgaat

SEQ ID NO: 232158 - DNA, 25 bp, Mus musculus
ataggacttcccgtttctgttgaat

SEQ ID NO: 232159 - DNA, 25 bp, Mus musculus
ataggacttgtgataggattgtgaa

SEQ ID NO: 232160 - DNA, 25 bp, Mus musculus
ataggacttgtgttaggattgtgaa

SEQ ID NO: 232161 - DNA, 25 bp, Mus musculus
ataggactttcgcatttcttcgttg

SEQ ID NO: 232162 - DNA, 25 bp, Mus musculus
ataggactttcggatttcttcgttg

SEQ ID NO: 232163 - DNA, 25 bp, Mus musculus
ataggagaaactcccagagtcactt

SEQ ID NO: 232164 - DNA, 25 bp, Mus musculus
ataggagaaactgccagagtcactt

SEQ ID NO: 232165 - DNA, 25 bp, Mus musculus
ataggagacagcaggtaccacccac

SEQ ID NO: 232166 - DNA, 25 bp, Mus musculus
ataggagacagctggtaccacccac

SEQ ID NO: 232167 - DNA, 25 bp, Mus musculus
ataggagactcgctattccctgtgt

SEQ ID NO: 232168 - DNA, 25 bp, Mus musculus
ataggagactcggtattccctgtgt

SEQ ID NO: 232169 - DNA, 25 bp, Mus musculus
ataggagagttacctaccccacact

SEQ ID NO: 232170 - DNA, 25 bp, Mus musculus
ataggagagttagctaccccacact

SEQ ID NO: 232171 - DNA, 25 bp, Mus musculus
ataggagatatcagccaccgtctgc

SEQ ID NO: 232172 - DNA, 25 bp, Mus musculus
ataggagatatctgccaccgtctgc

SEQ ID NO: 232173 - DNA, 25 bp, Mus musculus
ataggagatctgatttatgtcaata

SEQ ID NO: 232174 - DNA, 25 bp, Mus musculus
ataggagatctgttttatgtcaata

SEQ ID NO: 232175 - DNA, 25 bp, Mus musculus
ataggagattcaccagccacgggcc

SEQ ID NO: 232176 - DNA, 25 bp, Mus musculus
ataggagattcagcagccacgggcc

SEQ ID NO: 232177 - DNA, 25 bp, Mus musculus
ataggagcacggagatcccgcgctc

SEQ ID NO: 232178 - DNA, 25 bp, Mus musculus
ataggagcacggtgatcccgcgctc

SEQ ID NO: 232179 - DNA, 25 bp, Mus musculus
ataggagcagcaacatcagcaaaaa

SEQ ID NO: 232180 - DNA, 25 bp, Mus musculus
ataggagcagcatcatcagcaaaaa

SEQ ID NO: 232181 - DNA, 25 bp, Mus musculus
ataggagcagtaacatcccaccatg

SEQ ID NO: 232182 - DNA, 25 bp, Mus musculus
ataggagcagtatcatcccaccatg

SEQ ID NO: 232183 - DNA, 25 bp, Mus musculus
ataggagcctttatagcctggcaga

SEQ ID NO: 232184 - DNA, 25 bp, Mus musculus
ataggagcctttctctgagtccaga

SEQ ID NO: 232185 - DNA, 25 bp, Mus musculus
ataggagcctttgtctgagtccaga

SEQ ID NO: 232186 - DNA, 25 bp, Mus musculus
ataggagcctttttagcctggcaga

SEQ ID NO: 232187 - DNA, 25 bp, Mus musculus
ataggagcgtgccagacctgctgta

SEQ ID NO: 232188 - DNA, 25 bp, Mus musculus
ataggagcgtgcgagacctgctgta

SEQ ID NO: 232189 - DNA, 25 bp, Mus musculus
ataggagctaaacccatccagtggg

SEQ ID NO: 232190 - DNA, 25 bp, Mus musculus
ataggagctaaagccatccagtggg

SEQ ID NO: 232191 - DNA, 25 bp, Mus musculus
ataggagctagtctggcttttgcct

SEQ ID NO: 232192 - DNA, 25 bp, Mus musculus
ataggagctagtgtggcttttgcct

SEQ ID NO: 232193 - DNA, 25 bp, Mus musculus
ataggagctatgaagactctgtctc

SEQ ID NO: 232194 - DNA, 25 bp, Mus musculus
ataggagctatgtagactctgtctc

SEQ ID NO: 232195 - DNA, 25 bp, Mus musculus
ataggagctgcgactacaattaaag

SEQ ID NO: 232196 - DNA, 25 bp, Mus musculus
ataggagctgcgtctacaattaaag

SEQ ID NO: 232197 - DNA, 25 bp, Mus musculus
ataggagctgctcacatggacctgg

SEQ ID NO: 232198 - DNA, 25 bp, Mus musculus
ataggagctgctgacatggacctgg

SEQ ID NO: 232199 - DNA, 25 bp, Mus musculus
ataggaggccataatactgatgaaa

SEQ ID NO: 232200 - DNA, 25 bp, Mus musculus
ataggaggccattatactgatgaaa

SEQ ID NO: 232201 - DNA, 25 bp, Mus musculus
ataggaggctttctctgctgcctgc

SEQ ID NO: 232202 - DNA, 25 bp, Mus musculus
ataggaggctttgtctgctgcctgc

SEQ ID NO: 232203 - DNA, 25 bp, Mus musculus
ataggaggtgatccttggctacata

SEQ ID NO: 232204 - DNA, 25 bp, Mus musculus
ataggaggtgatgcttggctacata

SEQ ID NO: 232205 - DNA, 25 bp, Mus musculus
ataggaggtggtactgtccgaatcc

SEQ ID NO: 232206 - DNA, 25 bp, Mus musculus
ataggaggtggttctgtccgaatcc

SEQ ID NO: 232207 - DNA, 25 bp, Mus musculus
ataggaggttcccttggtcatgttg

SEQ ID NO: 232208 - DNA, 25 bp, Mus musculus
ataggaggttccgttggtcatgttg

SEQ ID NO: 232209 - DNA, 25 bp, Mus musculus
ataggagtcggacccctgcttttag

SEQ ID NO: 232210 - DNA, 25 bp, Mus musculus
ataggagtcggagccctgcttttag

SEQ ID NO: 232211 - DNA, 25 bp, Mus musculus
ataggagtcgttcaaggtagccacc

SEQ ID NO: 232212 - DNA, 25 bp, Mus musculus
ataggagtcgttgaaggtagccacc

SEQ ID NO: 232213 - DNA, 25 bp, Mus musculus
ataggagtgcagagacacccgttgc

SEQ ID NO: 232214 - DNA, 25 bp, Mus musculus
ataggagtgcagtgacacccgttgc

SEQ ID NO: 232215 - DNA, 25 bp, Mus musculus
ataggagtggcaccgtggatcccca

SEQ ID NO: 232216 - DNA, 25 bp, Mus musculus
ataggagtggcagcgtggatcccca

SEQ ID NO: 232217 - DNA, 25 bp, Mus musculus
ataggagttgaacgcaggtcctctg

SEQ ID NO: 232218 - DNA, 25 bp, Mus musculus
ataggagttgaaggcaggtcctctg

SEQ ID NO: 232219 - DNA, 25 bp, Mus musculus
ataggagtttgccaccataccaagc

SEQ ID NO: 232220 - DNA, 25 bp, Mus musculus
ataggagtttgcgaccataccaagc

SEQ ID NO: 232221 - DNA, 25 bp, Mus musculus
ataggatacaggctctgagtctcct

SEQ ID NO: 232222 - DNA, 25 bp, Mus musculus
ataggatacagggtctgagtctcct

SEQ ID NO: 232223 - DNA, 25 bp, Mus musculus
ataggatacctaccgtgtttacttg

SEQ ID NO: 232224 - DNA, 25 bp, Mus musculus
ataggatacctagcgtgtttacttg

SEQ ID NO: 232225 - DNA, 25 bp, Mus musculus
ataggatactgcctgtcatcactgg

SEQ ID NO: 232226 - DNA, 25 bp, Mus musculus
ataggatactgcgtgtcatcactgg

SEQ ID NO: 232227 - DNA, 25 bp, Mus musculus
ataggatactttacagacccaattt

SEQ ID NO: 232228 - DNA, 25 bp, Mus musculus
ataggatacttttcagacccaattt

SEQ ID NO: 232229 - DNA, 25 bp, Mus musculus
ataggatagcctcacgtagcatagt

SEQ ID NO: 232230 - DNA, 25 bp, Mus musculus
ataggatagcctgacgtagcatagt

SEQ ID NO: 232231 - DNA, 25 bp, Mus musculus
ataggatagcttctgccagttgttt

SEQ ID NO: 232232 - DNA, 25 bp, Mus musculus
ataggatagcttgtgccagttgttt

SEQ ID NO: 232233 - DNA, 25 bp, Mus musculus
ataggatatgcccacaactgccacc

SEQ ID NO: 232234 - DNA, 25 bp, Mus musculus
ataggatatgccgacaactgccacc

SEQ ID NO: 232235 - DNA, 25 bp, Mus musculus
ataggatattatactcttcctttcc

SEQ ID NO: 232236 - DNA, 25 bp, Mus musculus
ataggatattattctcttcctttcc

SEQ ID NO: 232237 - DNA, 25 bp, Mus musculus
ataggatcaaggagggccctctggt

SEQ ID NO: 232238 - DNA, 25 bp, Mus musculus
ataggatcaaggtgggccctctggt

SEQ ID NO: 232239 - DNA, 25 bp, Mus musculus
ataggatcaatcacagtggcagcag

SEQ ID NO: 232240 - DNA, 25 bp, Mus musculus
ataggatcaatctcagtggcagcag

SEQ ID NO: 232241 - DNA, 25 bp, Mus musculus
ataggatcacacaaagttgcccagg

SEQ ID NO: 232242 - DNA, 25 bp, Mus musculus
ataggatcacactaagttgcccagg

SEQ ID NO: 232243 - DNA, 25 bp, Mus musculus
ataggatccctgacatggcgtatgt

SEQ ID NO: 232244 - DNA, 25 bp, Mus musculus
ataggatccctgtcatggcgtatgt

SEQ ID NO: 232245 - DNA, 25 bp, Mus musculus
ataggatctaaccacttcagcacag

SEQ ID NO: 232246 - DNA, 25 bp, Mus musculus
ataggatctaacgacttcagcacag

SEQ ID NO: 232247 - DNA, 25 bp, Mus musculus
ataggatctataactcaggaggctc

SEQ ID NO: 232248 - DNA, 25 bp, Mus musculus
ataggatctatatctcaggaggctc

SEQ ID NO: 232249 - DNA, 25 bp, Mus musculus
ataggatctctgctagtttgaatga

SEQ ID NO: 232250 - DNA, 25 bp, Mus musculus
ataggatctctggtagtttgaatga

SEQ ID NO: 232251 - DNA, 25 bp, Mus musculus
ataggatctggtcactctttccaag

SEQ ID NO: 232252 - DNA, 25 bp, Mus musculus
ataggatctggtgactctttccaag

SEQ ID NO: 232253 - DNA, 25 bp, Mus musculus
ataggatctgttacaccatggttaa

SEQ ID NO: 232254 - DNA, 25 bp, Mus musculus
ataggatctgtttcaccatggttaa

SEQ ID NO: 232255 - DNA, 25 bp, Mus musculus
ataggatcttacctttgtccacagg

SEQ ID NO: 232256 - DNA, 25 bp, Mus musculus
ataggatcttacgtttgtccacagg

SEQ ID NO: 232257 - DNA, 25 bp, Mus musculus
ataggatcttccaaactgcttctct

SEQ ID NO: 232258 - DNA, 25 bp, Mus musculus
ataggatcttcctaactgcttctct

SEQ ID NO: 232259 - DNA, 25 bp, Mus musculus
ataggatgcacccttctagcacctg

SEQ ID NO: 232260 - DNA, 25 bp, Mus musculus
ataggatgcaccgttctagcacctg

SEQ ID NO: 232261 - DNA, 25 bp, Mus musculus
ataggatgccatcagccatcgaggg

SEQ ID NO: 232262 - DNA, 25 bp, Mus musculus
ataggatgccatgagccatcgaggg

SEQ ID NO: 232263 - DNA, 25 bp, Mus musculus
ataggatgtactcaagaaagcttag

SEQ ID NO: 232264 - DNA, 25 bp, Mus musculus
ataggatgtactgaagaaagcttag

SEQ ID NO: 232265 - DNA, 25 bp, Mus musculus
ataggatgtgaccactggcagagct

SEQ ID NO: 232266 - DNA, 25 bp, Mus musculus
ataggatgtgacgactggcagagct

SEQ ID NO: 232267 - DNA, 25 bp, Mus musculus
ataggatgtgccagggcctgcaagt

SEQ ID NO: 232268 - DNA, 25 bp, Mus musculus
ataggatgtgcctgggcctgcaagt

SEQ ID NO: 232269 - DNA, 25 bp, Mus musculus
ataggattaactctgccttgtcacc

SEQ ID NO: 232270 - DNA, 25 bp, Mus musculus
ataggattaactgtgccttgtcacc

SEQ ID NO: 232271 - DNA, 25 bp, Mus musculus
ataggattccagctcagtgtcaaat

SEQ ID NO: 232272 - DNA, 25 bp, Mus musculus
ataggattccaggtcagtgtcaaat

SEQ ID NO: 232273 - DNA, 25 bp, Mus musculus
ataggattccccactaagtgtgaaa

SEQ ID NO: 232274 - DNA, 25 bp, Mus musculus
ataggattcccctctaagtgtgaaa

SEQ ID NO: 232275 - DNA, 25 bp, Mus musculus
ataggattgctcatctgtccgaggc

SEQ ID NO: 232276 - DNA, 25 bp, Mus musculus
ataggattgctcttctgtccgaggc

SEQ ID NO: 232277 - DNA, 25 bp, Mus musculus
ataggattggctatctctttctcca

SEQ ID NO: 232278 - DNA, 25 bp, Mus musculus
ataggattggctttctctttctcca

SEQ ID NO: 232279 - DNA, 25 bp, Mus musculus
ataggatttctcatcttaacacatg

SEQ ID NO: 232280 - DNA, 25 bp, Mus musculus
ataggatttctcttcttaacacatg

SEQ ID NO: 232281 - DNA, 25 bp, Mus musculus
ataggatttctgatgcattcaccga

SEQ ID NO: 232282 - DNA, 25 bp, Mus musculus
ataggatttctgttgcattcaccga

SEQ ID NO: 232283 - DNA, 25 bp, Mus musculus
ataggatttcttaaaacccaatgtg

SEQ ID NO: 232284 - DNA, 25 bp, Mus musculus
ataggatttctttaaacccaatgtg

SEQ ID NO: 232285 - DNA, 25 bp, Mus musculus
ataggattttgcatgcttctagaac

SEQ ID NO: 232286 - DNA, 25 bp, Mus musculus
ataggattttgcttgcttctagaac

SEQ ID NO: 232287 - DNA, 25 bp, Mus musculus
ataggcaacagtcagggcaacagct

SEQ ID NO: 232288 - DNA, 25 bp, Mus musculus
ataggcaacagtgagggcaacagct

SEQ ID NO: 232289 - DNA, 25 bp, Mus musculus
ataggcaatttgctccatctaggag

SEQ ID NO: 232290 - DNA, 25 bp, Mus musculus
ataggcaatttggtccatctaggag

SEQ ID NO: 232291 - DNA, 25 bp, Mus musculus
ataggcacacataaccagtctggcg

SEQ ID NO: 232292 - DNA, 25 bp, Mus musculus
ataggcacacattaccagtctggcg

SEQ ID NO: 232293 - DNA, 25 bp, Mus musculus
ataggcacactcagtttcacaaagc

SEQ ID NO: 232294 - DNA, 25 bp, Mus musculus
ataggcacactctgtttcacaaagc

SEQ ID NO: 232295 - DNA, 25 bp, Mus musculus
ataggcacatgtatgttgtcattgg

SEQ ID NO: 232296 - DNA, 25 bp, Mus musculus
ataggcacatgtttgttgtcattgg

SEQ ID NO: 232297 - DNA, 25 bp, Mus musculus
ataggcacggagacacgaagacttc

SEQ ID NO: 232298 - DNA, 25 bp, Mus musculus
ataggcacggagtcacgaagacttc

SEQ ID NO: 232299 - DNA, 25 bp, Mus musculus
ataggcactctcattggacggcgta

SEQ ID NO: 232300 - DNA, 25 bp, Mus musculus
ataggcactctctttggacggcgta

SEQ ID NO: 232301 - DNA, 25 bp, Mus musculus
ataggcactgccacgtgatgaactt

SEQ ID NO: 232302 - DNA, 25 bp, Mus musculus
ataggcactgcctcgtgatgaactt

SEQ ID NO: 232303 - DNA, 25 bp, Mus musculus
ataggcagaactcgtctgacatgct

SEQ ID NO: 232304 - DNA, 25 bp, Mus musculus
ataggcagaactggtctgacatgct

SEQ ID NO: 232305 - DNA, 25 bp, Mus musculus
ataggcagaatcctggaccccagta

SEQ ID NO: 232306 - DNA, 25 bp, Mus musculus
ataggcagaatcgtggaccccagta

SEQ ID NO: 232307 - DNA, 25 bp, Mus musculus
ataggcagagataagcttgattagt

SEQ ID NO: 232308 - DNA, 25 bp, Mus musculus
ataggcagagattagcttgattagt

SEQ ID NO: 232309 - DNA, 25 bp, Mus musculus
ataggcagcttccaggatctacagc

SEQ ID NO: 232310 - DNA, 25 bp, Mus musculus
ataggcagcttcgaggatctacagc

SEQ ID NO: 232311 - DNA, 25 bp, Mus musculus
ataggcaggacacctgtccctgacc

SEQ ID NO: 232312 - DNA, 25 bp, Mus musculus
ataggcaggacagctgtccctgacc

SEQ ID NO: 232313 - DNA, 25 bp, Mus musculus
ataggcaggatcataggttggagct

SEQ ID NO: 232314 - DNA, 25 bp, Mus musculus
ataggcaggatcttaggttggagct

SEQ ID NO: 232315 - DNA, 25 bp, Mus musculus
ataggcagggtgctcctcgacaaac

SEQ ID NO: 232316 - DNA, 25 bp, Mus musculus
ataggcagggtggtcctcgacaaac

SEQ ID NO: 232317 - DNA, 25 bp, Mus musculus
ataggcagtacaataatttctcatt

SEQ ID NO: 232318 - DNA, 25 bp, Mus musculus
ataggcagtacattaatttctcatt

SEQ ID NO: 232319 - DNA, 25 bp, Mus musculus
ataggcagtactctgaacagctgag

SEQ ID NO: 232320 - DNA, 25 bp, Mus musculus
ataggcagtactgtgaacagctgag

SEQ ID NO: 232321 - DNA, 25 bp, Mus musculus
ataggcagtccgaggacacggcttc

SEQ ID NO: 232322 - DNA, 25 bp, Mus musculus
ataggcagtccgctgcctggcccag

SEQ ID NO: 232323 - DNA, 25 bp, Mus musculus
ataggcagtccggtgcctggcccag

SEQ ID NO: 232324 - DNA, 25 bp, Mus musculus
ataggcagtccgtggacacggcttc

SEQ ID NO: 232325 - DNA, 25 bp, Mus musculus
ataggcagttctatgccgccctgcg

SEQ ID NO: 232326 - DNA, 25 bp, Mus musculus
ataggcagttctttgccgccctgcg

SEQ ID NO: 232327 - DNA, 25 bp, Mus musculus
ataggcagttgaagtccttctgtgt

SEQ ID NO: 232328 - DNA, 25 bp, Mus musculus
ataggcagttgatgtccttctgtgt

SEQ ID NO: 232329 - DNA, 25 bp, Mus musculus
ataggcatatgcactagcacccaca

SEQ ID NO: 232330 - DNA, 25 bp, Mus musculus
ataggcatatgctctagcacccaca

SEQ ID NO: 232331 - DNA, 25 bp, Mus musculus
ataggcatcaaccagtgggcttcaa

SEQ ID NO: 232332 - DNA, 25 bp, Mus musculus
ataggcatcaacgagtgggcttcaa

SEQ ID NO: 232333 - DNA, 25 bp, Mus musculus
ataggcatcacaaacatgtcagaag

SEQ ID NO: 232334 - DNA, 25 bp, Mus musculus
ataggcatcacatacatgtcagaag

SEQ ID NO: 232335 - DNA, 25 bp, Mus musculus
ataggcatcgatctccgatctggat

SEQ ID NO: 232336 - DNA, 25 bp, Mus musculus
ataggcatcgatgtccgatctggat

SEQ ID NO: 232337 - DNA, 25 bp, Mus musculus
ataggcatcgttagcttttagttca

SEQ ID NO: 232338 - DNA, 25 bp, Mus musculus
ataggcatcgtttgcttttagttca

SEQ ID NO: 232339 - DNA, 25 bp, Mus musculus
ataggcatgagcaccatacagcaga

SEQ ID NO: 232340 - DNA, 25 bp, Mus musculus
ataggcatgagctccatacagcaga

SEQ ID NO: 232341 - DNA, 25 bp, Mus musculus
ataggcatgggtatacttagaaatt

SEQ ID NO: 232342 - DNA, 25 bp, Mus musculus
ataggcatgggtttacttagaaatt

SEQ ID NO: 232343 - DNA, 25 bp, Mus musculus
ataggcattattatgctctccccac

SEQ ID NO: 232344 - DNA, 25 bp, Mus musculus
ataggcattattttgctctccccac

SEQ ID NO: 232345 - DNA, 25 bp, Mus musculus
ataggcattggaagtaagcactcaa

SEQ ID NO: 232346 - DNA, 25 bp, Mus musculus
ataggcattggatgtaagcactcaa

SEQ ID NO: 232347 - DNA, 25 bp, Mus musculus
ataggcatttccactgctctttaaa

SEQ ID NO: 232348 - DNA, 25 bp, Mus musculus
ataggcatttcctctgctctttaaa

SEQ ID NO: 232349 - DNA, 25 bp, Mus musculus
ataggccaaagcactgatcaggaat

SEQ ID NO: 232350 - DNA, 25 bp, Mus musculus
ataggccaaagctctgatcaggaat

SEQ ID NO: 232351 - DNA, 25 bp, Mus musculus
ataggccaacctagtggttcccaag

SEQ ID NO: 232352 - DNA, 25 bp, Mus musculus
ataggccaaccttgtggttcccaag

SEQ ID NO: 232353 - DNA, 25 bp, Mus musculus
ataggccacattatagtaataatat

SEQ ID NO: 232354 - DNA, 25 bp, Mus musculus
ataggccacattttagtaataatat

SEQ ID NO: 232355 - DNA, 25 bp, Mus musculus
ataggccaccagatgggctcctgag

SEQ ID NO: 232356 - DNA, 25 bp, Mus musculus
ataggccaccagttgggctcctgag

SEQ ID NO: 232357 - DNA, 25 bp, Mus musculus
ataggccacctaagtgactcattcc

SEQ ID NO: 232358 - DNA, 25 bp, Mus musculus
ataggccacctatgtgactcattcc

SEQ ID NO: 232359 - DNA, 25 bp, Mus musculus
ataggccacctgaacatatcccaga

SEQ ID NO: 232360 - DNA, 25 bp, Mus musculus
ataggccacctgtacatatcccaga

SEQ ID NO: 232361 - DNA, 25 bp, Mus musculus
ataggccactctaccaaacaaatac

SEQ ID NO: 232362 - DNA, 25 bp, Mus musculus
ataggccactcttccaaacaaatac

SEQ ID NO: 232363 - DNA, 25 bp, Mus musculus
ataggccagagaacattcccactca

SEQ ID NO: 232364 - DNA, 25 bp, Mus musculus
ataggccagagatcattcccactca

SEQ ID NO: 232365 - DNA, 25 bp, Mus musculus
ataggccagctactgagtgttccct

SEQ ID NO: 232366 - DNA, 25 bp, Mus musculus
ataggccagctagtgagtgttccct

SEQ ID NO: 232367 - DNA, 25 bp, Mus musculus
ataggccaggctatagaattctgcc

SEQ ID NO: 232368 - DNA, 25 bp, Mus musculus
ataggccaggctttagaattctgcc

SEQ ID NO: 232369 - DNA, 25 bp, Mus musculus
ataggccagggcacctgatggcaca

SEQ ID NO: 232370 - DNA, 25 bp, Mus musculus
ataggccagggctcctgatggcaca

SEQ ID NO: 232371 - DNA, 25 bp, Mus musculus
ataggccagtggacccaaggccctg

SEQ ID NO: 232372 - DNA, 25 bp, Mus musculus
ataggccagtggtcccaaggccctg

SEQ ID NO: 232373 - DNA, 25 bp, Mus musculus
ataggccagtgtatacacctccaag

SEQ ID NO: 232374 - DNA, 25 bp, Mus musculus
ataggccagtgtttacacctccaag

SEQ ID NO: 232375 - DNA, 25 bp, Mus musculus
ataggcccactacacgtcatttgtt

SEQ ID NO: 232376 - DNA, 25 bp, Mus musculus
ataggcccactagacgtcatttgtt

SEQ ID NO: 232377 - DNA, 25 bp, Mus musculus
ataggccccaagcttgattaatcac

SEQ ID NO: 232378 - DNA, 25 bp, Mus musculus
ataggccccaaggttgattaatcac

SEQ ID NO: 232379 - DNA, 25 bp, Mus musculus
ataggccccactaggtgctatttgt

SEQ ID NO: 232380 - DNA, 25 bp, Mus musculus
ataggccccacttggtgctatttgt

SEQ ID NO: 232381 - DNA, 25 bp, Mus musculus
ataggcccctacagtgattcatttg

SEQ ID NO: 232382 - DNA, 25 bp, Mus musculus
ataggcccctactgtgattcatttg

SEQ ID NO: 232383 - DNA, 25 bp, Mus musculus
ataggccctaggaattcctcctcat

SEQ ID NO: 232384 - DNA, 25 bp, Mus musculus
ataggccctaggtattcctcctcat

SEQ ID NO: 232385 - DNA, 25 bp, Mus musculus
ataggccctcagcaccaggcaggat

SEQ ID NO: 232386 - DNA, 25 bp, Mus musculus
ataggccctcaggaccaggcaggat

SEQ ID NO: 232387 - DNA, 25 bp, Mus musculus
ataggcccttatcctttcttctggt

SEQ ID NO: 232388 - DNA, 25 bp, Mus musculus
ataggcccttatgctttcttctggt

SEQ ID NO: 232389 - DNA, 25 bp, Mus musculus
ataggccgcgtgaacctgaagtaac

SEQ ID NO: 232390 - DNA, 25 bp, Mus musculus
ataggccgcgtgtacctgaagtaac

SEQ ID NO: 232391 - DNA, 25 bp, Mus musculus
ataggccgctttagctggcctctaa

SEQ ID NO: 232392 - DNA, 25 bp, Mus musculus
ataggccgcttttgctggcctctaa

SEQ ID NO: 232393 - DNA, 25 bp, Mus musculus
ataggccgtggcacttcaactggac

SEQ ID NO: 232394 - DNA, 25 bp, Mus musculus
ataggccgtggctcttcaactggac

SEQ ID NO: 232395 - DNA, 25 bp, Mus musculus
ataggccgtgtgctgaaatcctccc

SEQ ID NO: 232396 - DNA, 25 bp, Mus musculus
ataggccgtgtggtgaaatcctccc

SEQ ID NO: 232397 - DNA, 25 bp, Mus musculus
ataggcctacataaagcttccaaga

SEQ ID NO: 232398 - DNA, 25 bp, Mus musculus
ataggcctacattaagcttccaaga

SEQ ID NO: 232399 - DNA, 25 bp, Mus musculus
ataggcctacctatctacatgagat

SEQ ID NO: 232400 - DNA, 25 bp, Mus musculus
ataggcctacctttctacatgagat

SEQ ID NO: 232401 - DNA, 25 bp, Mus musculus
ataggcctagaccttcatgtttaga

SEQ ID NO: 232402 - DNA, 25 bp, Mus musculus
ataggcctagacgttcatgtttaga

SEQ ID NO: 232403 - DNA, 25 bp, Mus musculus
ataggcctaggtcatattctttaga

SEQ ID NO: 232404 - DNA, 25 bp, Mus musculus
ataggcctaggtgatattctttaga

SEQ ID NO: 232405 - DNA, 25 bp, Mus musculus
ataggcctcagcaaacaaggcactt

SEQ ID NO: 232406 - DNA, 25 bp, Mus musculus
ataggcctcagctaacaaggcactt

SEQ ID NO: 232407 - DNA, 25 bp, Mus musculus
ataggcctcagtatttcatatacaa

SEQ ID NO: 232408 - DNA, 25 bp, Mus musculus
ataggcctcagtttttcatatacaa

SEQ ID NO: 232409 - DNA, 25 bp, Mus musculus
ataggcctccatcaatgcgtctact

SEQ ID NO: 232410 - DNA, 25 bp, Mus musculus
ataggcctccatgaatgcgtctact

SEQ ID NO: 232411 - DNA, 25 bp, Mus musculus
ataggcctgcgcatcgtccccgagg

SEQ ID NO: 232412 - DNA, 25 bp, Mus musculus
ataggcctgcgcttcgtccccgagg

SEQ ID NO: 232413 - DNA, 25 bp, Mus musculus
ataggcctgtctctttcgttaaaag

SEQ ID NO: 232414 - DNA, 25 bp, Mus musculus
ataggcctgtctgtttcgttaaaag

SEQ ID NO: 232415 - DNA, 25 bp, Mus musculus
ataggccttaggacaatgttctgta

SEQ ID NO: 232416 - DNA, 25 bp, Mus musculus
ataggccttaggtcaatgttctgta

SEQ ID NO: 232417 - DNA, 25 bp, Mus musculus
ataggccttcaactgctaggcaagg

SEQ ID NO: 232418 - DNA, 25 bp, Mus musculus
ataggccttcaagtgctaggcaagg

SEQ ID NO: 232419 - DNA, 25 bp, Mus musculus
ataggccttcctcacggcaaagcca

SEQ ID NO: 232420 - DNA, 25 bp, Mus musculus
ataggccttcctgacggcaaagcca

SEQ ID NO: 232421 - DNA, 25 bp, Mus musculus
ataggccttgtcctcggccgccaag

SEQ ID NO: 232422 - DNA, 25 bp, Mus musculus
ataggccttgtcgtcggccgccaag

SEQ ID NO: 232423 - DNA, 25 bp, Mus musculus
ataggcctttcccatacagttgcaa

SEQ ID NO: 232424 - DNA, 25 bp, Mus musculus
ataggcctttccgatacagttgcaa

SEQ ID NO: 232425 - DNA, 25 bp, Mus musculus
ataggccttttgatgttccatctgc

SEQ ID NO: 232426 - DNA, 25 bp, Mus musculus
ataggccttttgttgttccatctgc

SEQ ID NO: 232427 - DNA, 25 bp, Mus musculus
ataggcgacgtcattgcaggcttcc

SEQ ID NO: 232428 - DNA, 25 bp, Mus musculus
ataggcgacgtctttgcaggcttcc

SEQ ID NO: 232429 - DNA, 25 bp, Mus musculus
ataggcgcagctatcttggataatc

SEQ ID NO: 232430 - DNA, 25 bp, Mus musculus
ataggcgcagctttcttggataatc

SEQ ID NO: 232431 - DNA, 25 bp, Mus musculus
ataggcgctaccacgattggggcgc

SEQ ID NO: 232432 - DNA, 25 bp, Mus musculus
ataggcgctacctcgattggggcgc

SEQ ID NO: 232433 - DNA, 25 bp, Mus musculus
ataggcgctgacattcatcctctga

SEQ ID NO: 232434 - DNA, 25 bp, Mus musculus
ataggcgctgactttcatcctctga

SEQ ID NO: 232435 - DNA, 25 bp, Mus musculus
ataggcgctgtaccctcacacatgc

SEQ ID NO: 232436 - DNA, 25 bp, Mus musculus
ataggcgctgtagcctcacacatgc

SEQ ID NO: 232437 - DNA, 25 bp, Mus musculus
ataggcgtcttcatgcatgttttac

SEQ ID NO: 232438 - DNA, 25 bp, Mus musculus
ataggcgtcttcttgcatgttttac

SEQ ID NO: 232439 - DNA, 25 bp, Mus musculus
ataggctaaagcaaccagagggtgc

SEQ ID NO: 232440 - DNA, 25 bp, Mus musculus
ataggctaaagctaccagagggtgc

SEQ ID NO: 232441 - DNA, 25 bp, Mus musculus
ataggctaatgcactgtaaaccggg

SEQ ID NO: 232442 - DNA, 25 bp, Mus musculus
ataggctaatgctctgtaaaccggg

SEQ ID NO: 232443 - DNA, 25 bp, Mus musculus
ataggctacctcaaatctatctgaa

SEQ ID NO: 232444 - DNA, 25 bp, Mus musculus
ataggctacctctaatctatctgaa

SEQ ID NO: 232445 - DNA, 25 bp, Mus musculus
ataggctacttgaatacctggtatc

SEQ ID NO: 232446 - DNA, 25 bp, Mus musculus
ataggctacttgtatacctggtatc

SEQ ID NO: 232447 - DNA, 25 bp, Mus musculus
ataggctagcctcactaggtagcaa

SEQ ID NO: 232448 - DNA, 25 bp, Mus musculus
ataggctagcctgactaggtagcaa

SEQ ID NO: 232449 - DNA, 25 bp, Mus musculus
ataggctagctcagaatgcctacct

SEQ ID NO: 232450 - DNA, 25 bp, Mus musculus
ataggctagctctgaatgcctacct

SEQ ID NO: 232451 - DNA, 25 bp, Mus musculus
ataggctagcttcccaaacagtggc

SEQ ID NO: 232452 - DNA, 25 bp, Mus musculus
ataggctagcttgccaaacagtggc

SEQ ID NO: 232453 - DNA, 25 bp, Mus musculus
ataggctaggttagcccagtgggtt

SEQ ID NO: 232454 - DNA, 25 bp, Mus musculus
ataggctaggtttgcccagtgggtt

SEQ ID NO: 232455 - DNA, 25 bp, Mus musculus
ataggctcaccactcataacacaag

SEQ ID NO: 232456 - DNA, 25 bp, Mus musculus
ataggctcaccagtcataacacaag

SEQ ID NO: 232457 - DNA, 25 bp, Mus musculus
ataggctccataacactgggttcag

SEQ ID NO: 232458 - DNA, 25 bp, Mus musculus
ataggctccatatcactgggttcag

SEQ ID NO: 232459 - DNA, 25 bp, Mus musculus
ataggctccctgacgacaggaggaa

SEQ ID NO: 232460 - DNA, 25 bp, Mus musculus
ataggctccctgtcgacaggaggaa

SEQ ID NO: 232461 - DNA, 25 bp, Mus musculus
ataggctcctgacatgaggacccag

SEQ ID NO: 232462 - DNA, 25 bp, Mus musculus
ataggctcctgagatgaggacccag

SEQ ID NO: 232463 - DNA, 25 bp, Mus musculus
ataggctccttacaatccttaccac

SEQ ID NO: 232464 - DNA, 25 bp, Mus musculus
ataggctccttagaatccttaccac

SEQ ID NO: 232465 - DNA, 25 bp, Mus musculus
ataggctctcagacagttctcatgg

SEQ ID NO: 232466 - DNA, 25 bp, Mus musculus
ataggctctcagtcagttctcatgg

SEQ ID NO: 232467 - DNA, 25 bp, Mus musculus
ataggctctcttcacagtgctaagc

SEQ ID NO: 232468 - DNA, 25 bp, Mus musculus
ataggctctcttgacagtgctaagc

SEQ ID NO: 232469 - DNA, 25 bp, Mus musculus
ataggctctgctcattggctgtgat

SEQ ID NO: 232470 - DNA, 25 bp, Mus musculus
ataggctctgctgattggctgtgat

SEQ ID NO: 232471 - DNA, 25 bp, Mus musculus
ataggctcttggactcgtgcaaagc

SEQ ID NO: 232472 - DNA, 25 bp, Mus musculus
ataggctcttggtctcgtgcaaagc

SEQ ID NO: 232473 - DNA, 25 bp, Mus musculus
ataggctctttcctagattccacag

SEQ ID NO: 232474 - DNA, 25 bp, Mus musculus
ataggctctttcgtagattccacag

SEQ ID NO: 232475 - DNA, 25 bp, Mus musculus
ataggctgaaaccactctgagggag

SEQ ID NO: 232476 - DNA, 25 bp, Mus musculus
ataggctgaaacgactctgagggag

SEQ ID NO: 232477 - DNA, 25 bp, Mus musculus
ataggctgacgaagggcaaatgaca

SEQ ID NO: 232478 - DNA, 25 bp, Mus musculus
ataggctgacgatgggcaaatgaca

SEQ ID NO: 232479 - DNA, 25 bp, Mus musculus
ataggctggctaatgcttatggcta

SEQ ID NO: 232480 - DNA, 25 bp, Mus musculus
ataggctggctattgcttatggcta

SEQ ID NO: 232481 - DNA, 25 bp, Mus musculus
ataggctgggacaatgctcaccctg

SEQ ID NO: 232482 - DNA, 25 bp, Mus musculus
ataggctgggactatgctcaccctg

SEQ ID NO: 232483 - DNA, 25 bp, Mus musculus
ataggctgtcatccgcacggagtac

SEQ ID NO: 232484 - DNA, 25 bp, Mus musculus
ataggctgtcatgcgcacggagtac

SEQ ID NO: 232485 - DNA, 25 bp, Mus musculus
ataggctgtgaccagtggttgtgag

SEQ ID NO: 232486 - DNA, 25 bp, Mus musculus
ataggctgtgacgagtggttgtgag

SEQ ID NO: 232487 - DNA, 25 bp, Mus musculus
ataggctgtgttagctcccaaatct

SEQ ID NO: 232488 - DNA, 25 bp, Mus musculus
ataggctgtgttcgtttatggagac

SEQ ID NO: 232489 - DNA, 25 bp, Mus musculus
ataggctgtgttggtttatggagac

SEQ ID NO: 232490 - DNA, 25 bp, Mus musculus
ataggctgtgtttgctcccaaatct

SEQ ID NO: 232491 - DNA, 25 bp, Mus musculus
ataggctgttagacgaagtgctcac

SEQ ID NO: 232492 - DNA, 25 bp, Mus musculus
ataggctgttagtcgaagtgctcac

SEQ ID NO: 232493 - DNA, 25 bp, Mus musculus
ataggcttatttaatagcaaaagtg

SEQ ID NO: 232494 - DNA, 25 bp, Mus musculus
ataggcttattttatagcaaaagtg

SEQ ID NO: 232495 - DNA, 25 bp, Mus musculus
ataggcttcaatacttggtcaggca

SEQ ID NO: 232496 - DNA, 25 bp, Mus musculus
ataggcttcaattcttggtcaggca

SEQ ID NO: 232497 - DNA, 25 bp, Mus musculus
ataggcttcagcatcaaggcagaat

SEQ ID NO: 232498 - DNA, 25 bp, Mus musculus
ataggcttcagcttcaaggcagaat

SEQ ID NO: 232499 - DNA, 25 bp, Mus musculus
ataggcttcattctcattcttgtgt

SEQ ID NO: 232500 - DNA, 25 bp, Mus musculus
ataggcttcattgtcattcttgtgt

SEQ ID NO: 232501 - DNA, 25 bp, Mus musculus
ataggcttccagattaacatggtat

SEQ ID NO: 232502 - DNA, 25 bp, Mus musculus
ataggcttccagtttaacatggtat

SEQ ID NO: 232503 - DNA, 25 bp, Mus musculus
ataggcttctctaaagtggctgtat

SEQ ID NO: 232504 - DNA, 25 bp, Mus musculus
ataggcttctctcgttttcgagtcc

SEQ ID NO: 232505 - DNA, 25 bp, Mus musculus
ataggcttctctggttttcgagtcc

SEQ ID NO: 232506 - DNA, 25 bp, Mus musculus
ataggcttctcttaagtggctgtat

SEQ ID NO: 232507 - DNA, 25 bp, Mus musculus
ataggcttgctgagggcaactcagt

SEQ ID NO: 232508 - DNA, 25 bp, Mus musculus
ataggcttgctgtgggcaactcagt

SEQ ID NO: 232509 - DNA, 25 bp, Mus musculus
ataggcttggagatgcaccattgaa

SEQ ID NO: 232510 - DNA, 25 bp, Mus musculus
ataggcttggagttgcaccattgaa

SEQ ID NO: 232511 - DNA, 25 bp, Mus musculus
ataggcttggccaggaacttcctgt

SEQ ID NO: 232512 - DNA, 25 bp, Mus musculus
ataggcttggcctggaacttcctgt

SEQ ID NO: 232513 - DNA, 25 bp, Mus musculus
ataggcttgtgtcctctgggagatc

SEQ ID NO: 232514 - DNA, 25 bp, Mus musculus
ataggcttgtgtgctctgggagatc

SEQ ID NO: 232515 - DNA, 25 bp, Mus musculus
ataggctttatgagtagttactaca

SEQ ID NO: 232516 - DNA, 25 bp, Mus musculus
ataggctttatgtgtagttactaca

SEQ ID NO: 232517 - DNA, 25 bp, Mus musculus
ataggctttcccaggtggctttcca

SEQ ID NO: 232518 - DNA, 25 bp, Mus musculus
ataggctttccctggtggctttcca

SEQ ID NO: 232519 - DNA, 25 bp, Mus musculus
ataggctttctcatttatattccaa

SEQ ID NO: 232520 - DNA, 25 bp, Mus musculus
ataggctttctcttttatattccaa

SEQ ID NO: 232521 - DNA, 25 bp, Mus musculus
ataggcttttgcatcgtaaacttca

SEQ ID NO: 232522 - DNA, 25 bp, Mus musculus
ataggcttttgcttcgtaaacttca

SEQ ID NO: 232523 - DNA, 25 bp, Mus musculus
ataggcttttttctcttgtcctcta

SEQ ID NO: 232524 - DNA, 25 bp, Mus musculus
ataggcttttttgtcttgtcctcta

SEQ ID NO: 232525 - DNA, 25 bp, Mus musculus
atagggaaactaacttgatgttcaa

SEQ ID NO: 232526 - DNA, 25 bp, Mus musculus
atagggaaactatcttgatgttcaa

SEQ ID NO: 232527 - DNA, 25 bp, Mus musculus
atagggacaatgatgtgcatggcct

SEQ ID NO: 232528 - DNA, 25 bp, Mus musculus
atagggacaatgttgtgcatggcct

SEQ ID NO: 232529 - DNA, 25 bp, Mus musculus
atagggacatccatgagaaagcccc

SEQ ID NO: 232530 - DNA, 25 bp, Mus musculus
atagggacatccttgagaaagcccc

SEQ ID NO: 232531 - DNA, 25 bp, Mus musculus
atagggaccagcacatgcttgtcag

SEQ ID NO: 232532 - DNA, 25 bp, Mus musculus
atagggaccagctcatgcttgtcag

SEQ ID NO: 232533 - DNA, 25 bp, Mus musculus
atagggacccctaatgacttctgtg

SEQ ID NO: 232534 - DNA, 25 bp, Mus musculus
atagggaccccttatgacttctgtg

SEQ ID NO: 232535 - DNA, 25 bp, Mus musculus
atagggactgagaggccttagctgt

SEQ ID NO: 232536 - DNA, 25 bp, Mus musculus
atagggactgagtggccttagctgt

SEQ ID NO: 232537 - DNA, 25 bp, Mus musculus
atagggactttgcttaggccaaggc

SEQ ID NO: 232538 - DNA, 25 bp, Mus musculus
atagggactttggttaggccaaggc

SEQ ID NO: 232539 - DNA, 25 bp, Mus musculus
atagggagagaaccctgaggcgagc

SEQ ID NO: 232540 - DNA, 25 bp, Mus musculus
atagggagagaagcctgaggcgagc

SEQ ID NO: 232541 - DNA, 25 bp, Mus musculus
atagggagagctcagacgccccgcc

SEQ ID NO: 232542 - DNA, 25 bp, Mus musculus
atagggagagctgagacgccccgcc

SEQ ID NO: 232543 - DNA, 25 bp, Mus musculus
atagggagctagagtctaaaggact

SEQ ID NO: 232544 - DNA, 25 bp, Mus musculus
atagggagctagtgtctaaaggact

SEQ ID NO: 232545 - DNA, 25 bp, Mus musculus
atagggaggactaagcacaggcagc

SEQ ID NO: 232546 - DNA, 25 bp, Mus musculus
atagggaggacttagcacaggcagc

SEQ ID NO: 232547 - DNA, 25 bp, Mus musculus
atagggaggatgaattaccaggatt

SEQ ID NO: 232548 - DNA, 25 bp, Mus musculus
atagggaggatgtattaccaggatt

SEQ ID NO: 232549 - DNA, 25 bp, Mus musculus
atagggagttcgagttcaatgttga

SEQ ID NO: 232550 - DNA, 25 bp, Mus musculus
atagggagttcgtgttcaatgttga

SEQ ID NO: 232551 - DNA, 25 bp, Mus musculus
atagggatccctctggatgctgccc

SEQ ID NO: 232552 - DNA, 25 bp, Mus musculus
atagggatccctgtggatgctgccc

SEQ ID NO: 232553 - DNA, 25 bp, Mus musculus
atagggatgtggcaccccatgtgtt

SEQ ID NO: 232554 - DNA, 25 bp, Mus musculus
atagggatgtgggaccccatgtgtt

SEQ ID NO: 232555 - DNA, 25 bp, Mus musculus
atagggcagagcaagtcagccagtt

SEQ ID NO: 232556 - DNA, 25 bp, Mus musculus
atagggcagagccagctcgtctcag

SEQ ID NO: 232557 - DNA, 25 bp, Mus musculus
atagggcagagcgagctcgtctcag

SEQ ID NO: 232558 - DNA, 25 bp, Mus musculus
atagggcagagctagtcagccagtt

SEQ ID NO: 232559 - DNA, 25 bp, Mus musculus
atagggcagataaccttccctccgt

SEQ ID NO: 232560 - DNA, 25 bp, Mus musculus
atagggcagatatccttccctccgt

SEQ ID NO: 232561 - DNA, 25 bp, Mus musculus
atagggcagtcgattgttcaaattc

SEQ ID NO: 232562 - DNA, 25 bp, Mus musculus
atagggcagtcgtttgttcaaattc

SEQ ID NO: 232563 - DNA, 25 bp, Mus musculus
atagggcatgacactgtttacacag

SEQ ID NO: 232564 - DNA, 25 bp, Mus musculus
atagggcatgactctgtttacacag

SEQ ID NO: 232565 - DNA, 25 bp, Mus musculus
atagggcctgcaagggtctgtacca

SEQ ID NO: 232566 - DNA, 25 bp, Mus musculus
atagggcctgcatgggtctgtacca

SEQ ID NO: 232567 - DNA, 25 bp, Mus musculus
atagggccttcacacactcatgtgg

SEQ ID NO: 232568 - DNA, 25 bp, Mus musculus
atagggccttcagacactcatgtgg

SEQ ID NO: 232569 - DNA, 25 bp, Mus musculus
atagggccttccagaaacctcagag

SEQ ID NO: 232570 - DNA, 25 bp, Mus musculus
atagggccttcctgaaacctcagag

SEQ ID NO: 232571 - DNA, 25 bp, Mus musculus
atagggcgtgcactggtagcacaac

SEQ ID NO: 232572 - DNA, 25 bp, Mus musculus
atagggcgtgcagtggtagcacaac

SEQ ID NO: 232573 - DNA, 25 bp, Mus musculus
atagggctcggcacataagtactca

SEQ ID NO: 232574 - DNA, 25 bp, Mus musculus
atagggctcggctcataagtactca

SEQ ID NO: 232575 - DNA, 25 bp, Mus musculus
atagggctgaggataaactctgggt

SEQ ID NO: 232576 - DNA, 25 bp, Mus musculus
atagggctgaggttaaactctgggt

SEQ ID NO: 232577 - DNA, 25 bp, Mus musculus
atagggctgattagatttgtgggat

SEQ ID NO: 232578 - DNA, 25 bp, Mus musculus
atagggctgatttgatttgtgggat

SEQ ID NO: 232579 - DNA, 25 bp, Mus musculus
atagggctgcctattctcataggaa

SEQ ID NO: 232580 - DNA, 25 bp, Mus musculus
atagggctgccttttctcataggaa

SEQ ID NO: 232581 - DNA, 25 bp, Mus musculus
atagggctgggacggctattctttt

SEQ ID NO: 232582 - DNA, 25 bp, Mus musculus
atagggctgggagggctattctttt

SEQ ID NO: 232583 - DNA, 25 bp, Mus musculus
atagggctgtaccacttgctttgtc

SEQ ID NO: 232584 - DNA, 25 bp, Mus musculus
atagggctgtacgacttgctttgtc

SEQ ID NO: 232585 - DNA, 25 bp, Mus musculus
atagggcttcctctggctagtgtct

SEQ ID NO: 232586 - DNA, 25 bp, Mus musculus
atagggcttcctgtggctagtgtct

SEQ ID NO: 232587 - DNA, 25 bp, Mus musculus
ataggggtctgcctcaagccaagag

SEQ ID NO: 232588 - DNA, 25 bp, Mus musculus
ataggggtctgcgtcaagccaagag

SEQ ID NO: 232589 - DNA, 25 bp, Mus musculus
atagggtaatgcacatggcccctca

SEQ ID NO: 232590 - DNA, 25 bp, Mus musculus
atagggtaatgctcatggcccctca

SEQ ID NO: 232591 - DNA, 25 bp, Mus musculus
atagggtaccacactaacctgacag

SEQ ID NO: 232592 - DNA, 25 bp, Mus musculus
atagggtaccactctaacctgacag

SEQ ID NO: 232593 - DNA, 25 bp, Mus musculus
atagggtagcctatatcatatgtaa

SEQ ID NO: 232594 - DNA, 25 bp, Mus musculus
atagggtagcctttatcatatgtaa

SEQ ID NO: 232595 - DNA, 25 bp, Mus musculus
atagggtagcttccagacacctcaa

SEQ ID NO: 232596 - DNA, 25 bp, Mus musculus
atagggtagcttgcagacacctcaa

SEQ ID NO: 232597 - DNA, 25 bp, Mus musculus
atagggtagtacctccaacgtggag

SEQ ID NO: 232598 - DNA, 25 bp, Mus musculus
atagggtagtacgtccaacgtggag

SEQ ID NO: 232599 - DNA, 25 bp, Mus musculus
atagggtcaagtacaccagccacct

SEQ ID NO: 232600 - DNA, 25 bp, Mus musculus
atagggtcaagttcaccagccacct

SEQ ID NO: 232601 - DNA, 25 bp, Mus musculus
atagggtcatcaactccacgtaata

SEQ ID NO: 232602 - DNA, 25 bp, Mus musculus
atagggtcatcatctccacgtaata

SEQ ID NO: 232603 - DNA, 25 bp, Mus musculus
atagggtcatccatgagtggctgtc

SEQ ID NO: 232604 - DNA, 25 bp, Mus musculus
atagggtcatccttgagtggctgtc

SEQ ID NO: 232605 - DNA, 25 bp, Mus musculus
atagggtccagccaatctgcacaga

SEQ ID NO: 232606 - DNA, 25 bp, Mus musculus
atagggtccagcgaatctgcacaga

SEQ ID NO: 232607 - DNA, 25 bp, Mus musculus
atagggtccatcacttccagaatca

SEQ ID NO: 232608 - DNA, 25 bp, Mus musculus
atagggtccatctcttccagaatca

SEQ ID NO: 232609 - DNA, 25 bp, Mus musculus
atagggtccttaactactctcagat

SEQ ID NO: 232610 - DNA, 25 bp, Mus musculus
atagggtccttactcggttctgaga

SEQ ID NO: 232611 - DNA, 25 bp, Mus musculus
atagggtccttagtcggttctgaga

SEQ ID NO: 232612 - DNA, 25 bp, Mus musculus
atagggtccttatctactctcagat

SEQ ID NO: 232613 - DNA, 25 bp, Mus musculus
atagggtctaagctgacctgtgaga

SEQ ID NO: 232614 - DNA, 25 bp, Mus musculus
atagggtctaaggtgacctgtgaga

SEQ ID NO: 232615 - DNA, 25 bp, Mus musculus
atagggtctcatcactgtgttgtag

SEQ ID NO: 232616 - DNA, 25 bp, Mus musculus
atagggtctcatgactgtgttgtag

SEQ ID NO: 232617 - DNA, 25 bp, Mus musculus
atagggtctctgctccgcaatttcc

SEQ ID NO: 232618 - DNA, 25 bp, Mus musculus
atagggtctctggtccgcaatttcc

SEQ ID NO: 232619 - DNA, 25 bp, Mus musculus
atagggtctgaccagtgctctcaat

SEQ ID NO: 232620 - DNA, 25 bp, Mus musculus
atagggtctgacgagtgctctcaat

SEQ ID NO: 232621 - DNA, 25 bp, Mus musculus
atagggtgagttactacgttgtata

SEQ ID NO: 232622 - DNA, 25 bp, Mus musculus
atagggtgagtttctacgttgtata

SEQ ID NO: 232623 - DNA, 25 bp, Mus musculus
atagggtgctggattgtgccatacc

SEQ ID NO: 232624 - DNA, 25 bp, Mus musculus
atagggtgctggtttgtgccatacc

SEQ ID NO: 232625 - DNA, 25 bp, Mus musculus
atagggtgtaatctatttcaggctg

SEQ ID NO: 232626 - DNA, 25 bp, Mus musculus
atagggtgtaatgtatttcaggctg

SEQ ID NO: 232627 - DNA, 25 bp, Mus musculus
atagggtgtcagatctaccggaagt

SEQ ID NO: 232628 - DNA, 25 bp, Mus musculus
atagggtgtcagttctaccggaagt

SEQ ID NO: 232629 - DNA, 25 bp, Mus musculus
atagggtgtcgtatcttactctcaa

SEQ ID NO: 232630 - DNA, 25 bp, Mus musculus
atagggtgtcgtttcttactctcaa

SEQ ID NO: 232631 - DNA, 25 bp, Mus musculus
atagggtgttatacaagattgtctt

SEQ ID NO: 232632 - DNA, 25 bp, Mus musculus
atagggtgttattcaagattgtctt

SEQ ID NO: 232633 - DNA, 25 bp, Mus musculus
atagggtgttctacaacttggacag

SEQ ID NO: 232634 - DNA, 25 bp, Mus musculus
atagggtgttcttcaacttggacag

SEQ ID NO: 232635 - DNA, 25 bp, Mus musculus
atagggttgtggcatacaggccatc

SEQ ID NO: 232636 - DNA, 25 bp, Mus musculus
atagggttgtgggatacaggccatc

SEQ ID NO: 232637 - DNA, 25 bp, Mus musculus
atagggtttatgaactgcttgaaat

SEQ ID NO: 232638 - DNA, 25 bp, Mus musculus
atagggtttatgtactgcttgaaat

SEQ ID NO: 232639 - DNA, 25 bp, Mus musculus
ataggtaatccaacgtccttcattc

SEQ ID NO: 232640 - DNA, 25 bp, Mus musculus
ataggtaatccatcgtccttcattc

SEQ ID NO: 232641 - DNA, 25 bp, Mus musculus
ataggtaatgtcacccacagatcaa

SEQ ID NO: 232642 - DNA, 25 bp, Mus musculus
ataggtaatgtctcccacagatcaa

SEQ ID NO: 232643 - DNA, 25 bp, Mus musculus
ataggtaatttcacaccctgcagtt

SEQ ID NO: 232644 - DNA, 25 bp, Mus musculus
ataggtaatttctcaccctgcagtt

SEQ ID NO: 232645 - DNA, 25 bp, Mus musculus
ataggtacatgcatacgggaagtca

SEQ ID NO: 232646 - DNA, 25 bp, Mus musculus
ataggtacatgcttacgggaagtca

SEQ ID NO: 232647 - DNA, 25 bp, Mus musculus
ataggtacctacaaacttggcatca

SEQ ID NO: 232648 - DNA, 25 bp, Mus musculus
ataggtacctactaacttggcatca

SEQ ID NO: 232649 - DNA, 25 bp, Mus musculus
ataggtactccaactctcacggatt

SEQ ID NO: 232650 - DNA, 25 bp, Mus musculus
ataggtactccatctctcacggatt

SEQ ID NO: 232651 - DNA, 25 bp, Mus musculus
ataggtacttttagcaagatttcaa

SEQ ID NO: 232652 - DNA, 25 bp, Mus musculus
ataggtactttttgcaagatttcaa

SEQ ID NO: 232653 - DNA, 25 bp, Mus musculus
ataggtagagtcatttcctgtatct

SEQ ID NO: 232654 - DNA, 25 bp, Mus musculus
ataggtagagtcttttcctgtatct

SEQ ID NO: 232655 - DNA, 25 bp, Mus musculus
ataggtaggcttagtctttctgagt

SEQ ID NO: 232656 - DNA, 25 bp, Mus musculus
ataggtaggctttgtctttctgagt

SEQ ID NO: 232657 - DNA, 25 bp, Mus musculus
ataggtagtggcattcctgtagctc

SEQ ID NO: 232658 - DNA, 25 bp, Mus musculus
ataggtagtggctttcctgtagctc

SEQ ID NO: 232659 - DNA, 25 bp, Mus musculus
ataggtagtgtcacctctaggccag

SEQ ID NO: 232660 - DNA, 25 bp, Mus musculus
ataggtagtgtctcctctaggccag

SEQ ID NO: 232661 - DNA, 25 bp, Mus musculus
ataggtatcatgctatttgtattta

SEQ ID NO: 232662 - DNA, 25 bp, Mus musculus
ataggtatcatggtatttgtattta

SEQ ID NO: 232663 - DNA, 25 bp, Mus musculus
ataggtatccctaccctgaccaagt

SEQ ID NO: 232664 - DNA, 25 bp, Mus musculus
ataggtatccctacgctgaatcctt

SEQ ID NO: 232665 - DNA, 25 bp, Mus musculus
ataggtatcccttccctgaccaagt

SEQ ID NO: 232666 - DNA, 25 bp, Mus musculus
ataggtatcccttcgctgaatcctt

SEQ ID NO: 232667 - DNA, 25 bp, Mus musculus
ataggtatgcgtagtctcctgccat

SEQ ID NO: 232668 - DNA, 25 bp, Mus musculus
ataggtatgcgttgtctcctgccat

SEQ ID NO: 232669 - DNA, 25 bp, Mus musculus
ataggtatgtgtactacctctgagc

SEQ ID NO: 232670 - DNA, 25 bp, Mus musculus
ataggtatgtgttctacctctgagc

SEQ ID NO: 232671 - DNA, 25 bp, Mus musculus
ataggtattctcaggccaaatcttc

SEQ ID NO: 232672 - DNA, 25 bp, Mus musculus
ataggtattctctggccaaatcttc

SEQ ID NO: 232673 - DNA, 25 bp, Mus musculus
ataggtattttcacagctgaggttc

SEQ ID NO: 232674 - DNA, 25 bp, Mus musculus
ataggtattttctcagctgaggttc

SEQ ID NO: 232675 - DNA, 25 bp, Mus musculus
ataggtcaccagcatatgccggcag

SEQ ID NO: 232676 - DNA, 25 bp, Mus musculus
ataggtcaccaggatatgccggcag

SEQ ID NO: 232677 - DNA, 25 bp, Mus musculus
ataggtcaccttcatgcaggcacct

SEQ ID NO: 232678 - DNA, 25 bp, Mus musculus
ataggtcaccttgatgcaggcacct

SEQ ID NO: 232679 - DNA, 25 bp, Mus musculus
ataggtcactgtcgcctgttatcca

SEQ ID NO: 232680 - DNA, 25 bp, Mus musculus
ataggtcactgtctcttgtgccaac

SEQ ID NO: 232681 - DNA, 25 bp, Mus musculus
ataggtcactgtggcctgttatcca

SEQ ID NO: 232682 - DNA, 25 bp, Mus musculus
ataggtcactgtgtcttgtgccaac

SEQ ID NO: 232683 - DNA, 25 bp, Mus musculus
ataggtcagtgcagaagcctggcgt

SEQ ID NO: 232684 - DNA, 25 bp, Mus musculus
ataggtcagtgctgaagcctggcgt

SEQ ID NO: 232685 - DNA, 25 bp, Mus musculus
ataggtcattctagtcttcctcaaa

SEQ ID NO: 232686 - DNA, 25 bp, Mus musculus
ataggtcattcttgtcttcctcaaa

SEQ ID NO: 232687 - DNA, 25 bp, Mus musculus
ataggtcccttgagttctctaacca

SEQ ID NO: 232688 - DNA, 25 bp, Mus musculus
ataggtcccttgtgttctctaacca

SEQ ID NO: 232689 - DNA, 25 bp, Mus musculus
ataggtctaacgataatgactaata

SEQ ID NO: 232690 - DNA, 25 bp, Mus musculus
ataggtctaacgttaatgactaata

SEQ ID NO: 232691 - DNA, 25 bp, Mus musculus
ataggtctcagcaatctgttccgga

SEQ ID NO: 232692 - DNA, 25 bp, Mus musculus
ataggtctcagctatctgttccgga

SEQ ID NO: 232693 - DNA, 25 bp, Mus musculus
ataggtctcatgcttgacaagtact

SEQ ID NO: 232694 - DNA, 25 bp, Mus musculus
ataggtctcatggttgacaagtact

SEQ ID NO: 232695 - DNA, 25 bp, Mus musculus
ataggtctccagatttgcttacacc

SEQ ID NO: 232696 - DNA, 25 bp, Mus musculus
ataggtctccagttttgcttacacc

SEQ ID NO: 232697 - DNA, 25 bp, Mus musculus
ataggtctccatactacctgttgcc

SEQ ID NO: 232698 - DNA, 25 bp, Mus musculus
ataggtctccatctgtaagctctgt

SEQ ID NO: 232699 - DNA, 25 bp, Mus musculus
ataggtctccatgtgtaagctctgt

SEQ ID NO: 232700 - DNA, 25 bp, Mus musculus
ataggtctccattctacctgttgcc

SEQ ID NO: 232701 - DNA, 25 bp, Mus musculus
ataggtctcctcacaaaaatgcatg

SEQ ID NO: 232702 - DNA, 25 bp, Mus musculus
ataggtctcctctcaaaaatgcatg

SEQ ID NO: 232703 - DNA, 25 bp, Mus musculus
ataggtctgaaactcgtgctgcatt

SEQ ID NO: 232704 - DNA, 25 bp, Mus musculus
ataggtctgaaagtcgtgctgcatt

SEQ ID NO: 232705 - DNA, 25 bp, Mus musculus
ataggtctgaacaggaatcatccct

SEQ ID NO: 232706 - DNA, 25 bp, Mus musculus
ataggtctgaactggaatcatccct

SEQ ID NO: 232707 - DNA, 25 bp, Mus musculus
ataggtctgatcatatctcaattgt

SEQ ID NO: 232708 - DNA, 25 bp, Mus musculus
ataggtctgatcttatctcaattgt

SEQ ID NO: 232709 - DNA, 25 bp, Mus musculus
ataggtctggctatttcacccaaga

SEQ ID NO: 232710 - DNA, 25 bp, Mus musculus
ataggtctggctttttcacccaaga

SEQ ID NO: 232711 - DNA, 25 bp, Mus musculus
ataggtctgggcaaggaaccaaaca

SEQ ID NO: 232712 - DNA, 25 bp, Mus musculus
ataggtctgggctaggaaccaaaca

SEQ ID NO: 232713 - DNA, 25 bp, Mus musculus
ataggtctggttctacccagctaaa

SEQ ID NO: 232714 - DNA, 25 bp, Mus musculus
ataggtctggttgtacccagctaaa

SEQ ID NO: 232715 - DNA, 25 bp, Mus musculus
ataggtcttcctatgcggtcgccct

SEQ ID NO: 232716 - DNA, 25 bp, Mus musculus
ataggtcttcctttgcggtcgccct

SEQ ID NO: 232717 - DNA, 25 bp, Mus musculus
ataggtcttcgaataactccctggg

SEQ ID NO: 232718 - DNA, 25 bp, Mus musculus
ataggtcttcgattaactccctggg

SEQ ID NO: 232719 - DNA, 25 bp, Mus musculus
ataggtcttgtcatatagctcaggc

SEQ ID NO: 232720 - DNA, 25 bp, Mus musculus
ataggtcttgtcttatagctcaggc

SEQ ID NO: 232721 - DNA, 25 bp, Mus musculus
ataggtctttaaacacagtcagctt

SEQ ID NO: 232722 - DNA, 25 bp, Mus musculus
ataggtctttaatcacagtcagctt

SEQ ID NO: 232723 - DNA, 25 bp, Mus musculus
ataggtctttttcatgggctgaaca

SEQ ID NO: 232724 - DNA, 25 bp, Mus musculus
ataggtctttttgatgggctgaaca

SEQ ID NO: 232725 - DNA, 25 bp, Mus musculus
ataggtgaacctagagagaacatta

SEQ ID NO: 232726 - DNA, 25 bp, Mus musculus
ataggtgaaccttgagagaacatta

SEQ ID NO: 232727 - DNA, 25 bp, Mus musculus
ataggtgaatccacctgatatggga

SEQ ID NO: 232728 - DNA, 25 bp, Mus musculus
ataggtgaatcctcctgatatggga

SEQ ID NO: 232729 - DNA, 25 bp, Mus musculus
ataggtgacaccagttgccatgaca

SEQ ID NO: 232730 - DNA, 25 bp, Mus musculus
ataggtgacacctgttgccatgaca

SEQ ID NO: 232731 - DNA, 25 bp, Mus musculus
ataggtgaccctactgttagtgctg

SEQ ID NO: 232732 - DNA, 25 bp, Mus musculus
ataggtgacccttctgttagtgctg

SEQ ID NO: 232733 - DNA, 25 bp, Mus musculus
ataggtgagcgcagagcatcttcct

SEQ ID NO: 232734 - DNA, 25 bp, Mus musculus
ataggtgagcgctgagcatcttcct

SEQ ID NO: 232735 - DNA, 25 bp, Mus musculus
ataggtgatcgtatgattacattgt

SEQ ID NO: 232736 - DNA, 25 bp, Mus musculus
ataggtgatcgtttgattacattgt

SEQ ID NO: 232737 - DNA, 25 bp, Mus musculus
ataggtgattacacctcttctgcac

SEQ ID NO: 232738 - DNA, 25 bp, Mus musculus
ataggtgattactcctcttctgcac

SEQ ID NO: 232739 - DNA, 25 bp, Mus musculus
ataggtgccataccagatctttgtg

SEQ ID NO: 232740 - DNA, 25 bp, Mus musculus
ataggtgccatagcagatctttgtg

SEQ ID NO: 232741 - DNA, 25 bp, Mus musculus
ataggtgcccctaagactgtggatg

SEQ ID NO: 232742 - DNA, 25 bp, Mus musculus
ataggtgccccttagactgtggatg

SEQ ID NO: 232743 - DNA, 25 bp, Mus musculus
ataggtgcccgtaggattttttcat

SEQ ID NO: 232744 - DNA, 25 bp, Mus musculus
ataggtgcccgttggattttttcat

SEQ ID NO: 232745 - DNA, 25 bp, Mus musculus
ataggtgccggaattcacctgtttc

SEQ ID NO: 232746 - DNA, 25 bp, Mus musculus
ataggtgccggatttcacctgtttc

SEQ ID NO: 232747 - DNA, 25 bp, Mus musculus
ataggtgcctagagtcctctggcct

SEQ ID NO: 232748 - DNA, 25 bp, Mus musculus
ataggtgcctagtgtcctctggcct

SEQ ID NO: 232749 - DNA, 25 bp, Mus musculus
ataggtgcggccaatttccaaaact

SEQ ID NO: 232750 - DNA, 25 bp, Mus musculus
ataggtgcggcctatttccaaaact

SEQ ID NO: 232751 - DNA, 25 bp, Mus musculus
ataggtgctaatcggactcgcttct

SEQ ID NO: 232752 - DNA, 25 bp, Mus musculus
ataggtgctaatgggactcgcttct

SEQ ID NO: 232753 - DNA, 25 bp, Mus musculus
ataggtgctggacactattaccaag

SEQ ID NO: 232754 - DNA, 25 bp, Mus musculus
ataggtgctggagactattaccaag

SEQ ID NO: 232755 - DNA, 25 bp, Mus musculus
ataggtgcttgtctcatctctggat

SEQ ID NO: 232756 - DNA, 25 bp, Mus musculus
ataggtgcttgtgtcatctctggat

SEQ ID NO: 232757 - DNA, 25 bp, Mus musculus
ataggtggcttgcatcctgacattc

SEQ ID NO: 232758 - DNA, 25 bp, Mus musculus
ataggtggcttggatcctgacattc

SEQ ID NO: 232759 - DNA, 25 bp, Mus musculus
ataggtgggctaaatgtggctttcc

SEQ ID NO: 232760 - DNA, 25 bp, Mus musculus
ataggtgggctatatgtggctttcc

SEQ ID NO: 232761 - DNA, 25 bp, Mus musculus
ataggtggtggcacagactgtcaat

SEQ ID NO: 232762 - DNA, 25 bp, Mus musculus
ataggtggtggctcagactgtcaat

SEQ ID NO: 232763 - DNA, 25 bp, Mus musculus
ataggtgtccaaaactcgagggatt

SEQ ID NO: 232764 - DNA, 25 bp, Mus musculus
ataggtgtccaatactcgagggatt

SEQ ID NO: 232765 - DNA, 25 bp, Mus musculus
ataggtgtccatactgggccagtct

SEQ ID NO: 232766 - DNA, 25 bp, Mus musculus
ataggtgtccattctgggccagtct

SEQ ID NO: 232767 - DNA, 25 bp, Mus musculus
ataggtgtccccattcacagaacca

SEQ ID NO: 232768 - DNA, 25 bp, Mus musculus
ataggtgtcccctttcacagaacca

SEQ ID NO: 232769 - DNA, 25 bp, Mus musculus
ataggtgtcctcactctatagtgac

SEQ ID NO: 232770 - DNA, 25 bp, Mus musculus
ataggtgtcctctctctatagtgac

SEQ ID NO: 232771 - DNA, 25 bp, Mus musculus
ataggtgtctgtactcatcttggtt

SEQ ID NO: 232772 - DNA, 25 bp, Mus musculus
ataggtgtctgttctcatcttggtt

SEQ ID NO: 232773 - DNA, 25 bp, Mus musculus
ataggtgtgtgccactagcttagtc

SEQ ID NO: 232774 - DNA, 25 bp, Mus musculus
ataggtgtgtgcgactagcttagtc

SEQ ID NO: 232775 - DNA, 25 bp, Mus musculus
ataggtgttatccttcacaaggcct

SEQ ID NO: 232776 - DNA, 25 bp, Mus musculus
ataggtgttatcgttcacaaggcct

SEQ ID NO: 232777 - DNA, 25 bp, Mus musculus
ataggtgttcacactgtagcgcatg

SEQ ID NO: 232778 - DNA, 25 bp, Mus musculus
ataggtgttcactctgtagcgcatg

SEQ ID NO: 232779 - DNA, 25 bp, Mus musculus
ataggtgttcctaagtctgctgctg

SEQ ID NO: 232780 - DNA, 25 bp, Mus musculus
ataggtgttccttagtctgctgctg

SEQ ID NO: 232781 - DNA, 25 bp, Mus musculus
ataggtgtttccactgcatttgcat

SEQ ID NO: 232782 - DNA, 25 bp, Mus musculus
ataggtgtttcctctgcatttgcat

SEQ ID NO: 232783 - DNA, 25 bp, Mus musculus
ataggtgtttgcagagctcttccat

SEQ ID NO: 232784 - DNA, 25 bp, Mus musculus
ataggtgtttgcatggcacgcagga

SEQ ID NO: 232785 - DNA, 25 bp, Mus musculus
ataggtgtttgctgagctcttccat

SEQ ID NO: 232786 - DNA, 25 bp, Mus musculus
ataggtgtttgcttggcacgcagga

SEQ ID NO: 232787 - DNA, 25 bp, Mus musculus
ataggttaattacacagctgcctta

SEQ ID NO: 232788 - DNA, 25 bp, Mus musculus
ataggttaattagacagctgcctta

SEQ ID NO: 232789 - DNA, 25 bp, Mus musculus
ataggttaccatattgaggcaatta

SEQ ID NO: 232790 - DNA, 25 bp, Mus musculus
ataggttaccattttgaggcaatta

SEQ ID NO: 232791 - DNA, 25 bp, Mus musculus
ataggttagaataatgccatggcca

SEQ ID NO: 232792 - DNA, 25 bp, Mus musculus
ataggttagaattatgccatggcca

SEQ ID NO: 232793 - DNA, 25 bp, Mus musculus
ataggttataccacaagctgtgctt

SEQ ID NO: 232794 - DNA, 25 bp, Mus musculus
ataggttatacctcaagctgtgctt

SEQ ID NO: 232795 - DNA, 25 bp, Mus musculus
ataggttatcctctgatctccatcc

SEQ ID NO: 232796 - DNA, 25 bp, Mus musculus
ataggttatcctgtgatctccatcc

SEQ ID NO: 232797 - DNA, 25 bp, Mus musculus
ataggttattttcccaccagtggtg

SEQ ID NO: 232798 - DNA, 25 bp, Mus musculus
ataggttattttgccaccagtggtg

SEQ ID NO: 232799 - DNA, 25 bp, Mus musculus
ataggttcacggattcagacctgat

SEQ ID NO: 232800 - DNA, 25 bp, Mus musculus
ataggttcacggtttcagacctgat

SEQ ID NO: 232801 - DNA, 25 bp, Mus musculus
ataggttcatctatccctgagcaag

SEQ ID NO: 232802 - DNA, 25 bp, Mus musculus
ataggttcatctttccctgagcaag

SEQ ID NO: 232803 - DNA, 25 bp, Mus musculus
ataggttcatgccaagctatcctca

SEQ ID NO: 232804 - DNA, 25 bp, Mus musculus
ataggttcatgcgaagctatcctca

SEQ ID NO: 232805 - DNA, 25 bp, Mus musculus
ataggttccctgacttgcatgggag

SEQ ID NO: 232806 - DNA, 25 bp, Mus musculus
ataggttccctgtcttgcatgggag

SEQ ID NO: 232807 - DNA, 25 bp, Mus musculus
ataggttctcctaatgtagctcagg

SEQ ID NO: 232808 - DNA, 25 bp, Mus musculus
ataggttctccttatgtagctcagg

SEQ ID NO: 232809 - DNA, 25 bp, Mus musculus
ataggttgaaatacctctggtcagg

SEQ ID NO: 232810 - DNA, 25 bp, Mus musculus
ataggttgaaattcctctggtcagg

SEQ ID NO: 232811 - DNA, 25 bp, Mus musculus
ataggttgacttcgttctagccgct

SEQ ID NO: 232812 - DNA, 25 bp, Mus musculus
ataggttgacttggttctagccgct

SEQ ID NO: 232813 - DNA, 25 bp, Mus musculus
ataggttgcaccaccatactctgat

SEQ ID NO: 232814 - DNA, 25 bp, Mus musculus
ataggttgcacctccatactctgat

SEQ ID NO: 232815 - DNA, 25 bp, Mus musculus
ataggttgggaaattcaggcatgat

SEQ ID NO: 232816 - DNA, 25 bp, Mus musculus
ataggttgggaatttcaggcatgat

SEQ ID NO: 232817 - DNA, 25 bp, Mus musculus
ataggttgtattcgccagattttga

SEQ ID NO: 232818 - DNA, 25 bp, Mus musculus
ataggttgtattggccagattttga

SEQ ID NO: 232819 - DNA, 25 bp, Mus musculus
ataggttgtccaaatattactttga

SEQ ID NO: 232820 - DNA, 25 bp, Mus musculus
ataggttgtccatatattactttga

SEQ ID NO: 232821 - DNA, 25 bp, Mus musculus
ataggttgtccgctgtcactgggac

SEQ ID NO: 232822 - DNA, 25 bp, Mus musculus
ataggttgtccggtgtcactgggac

SEQ ID NO: 232823 - DNA, 25 bp, Mus musculus
ataggttgtggtcctgtcttatgac

SEQ ID NO: 232824 - DNA, 25 bp, Mus musculus
ataggttgtggtgctgtcttatgac

SEQ ID NO: 232825 - DNA, 25 bp, Mus musculus
ataggtttaagcacctctttcgctt

SEQ ID NO: 232826 - DNA, 25 bp, Mus musculus
ataggtttaagctcctctttcgctt

SEQ ID NO: 232827 - DNA, 25 bp, Mus musculus
ataggtttacatctgtgtccgccca

SEQ ID NO: 232828 - DNA, 25 bp, Mus musculus
ataggtttacatgtgtgtccgccca

SEQ ID NO: 232829 - DNA, 25 bp, Mus musculus
ataggtttagagacccacatgggat

SEQ ID NO: 232830 - DNA, 25 bp, Mus musculus
ataggtttagagtcccacatgggat

SEQ ID NO: 232831 - DNA, 25 bp, Mus musculus
ataggtttagggatagcattacaca

SEQ ID NO: 232832 - DNA, 25 bp, Mus musculus
ataggtttagggttagcattacaca

SEQ ID NO: 232833 - DNA, 25 bp, Mus musculus
ataggtttcacacataatttcttca

SEQ ID NO: 232834 - DNA, 25 bp, Mus musculus
ataggtttcacagataatttcttca

SEQ ID NO: 232835 - DNA, 25 bp, Mus musculus
ataggtttcagaacacttcctgtcc

SEQ ID NO: 232836 - DNA, 25 bp, Mus musculus
ataggtttcagatcacttcctgtcc

SEQ ID NO: 232837 - DNA, 25 bp, Mus musculus
ataggtttctaaaaggtccactagc

SEQ ID NO: 232838 - DNA, 25 bp, Mus musculus
ataggtttctaataggtccactagc

SEQ ID NO: 232839 - DNA, 25 bp, Mus musculus
ataggtttcttgaatcgtcacttct

SEQ ID NO: 232840 - DNA, 25 bp, Mus musculus
ataggtttcttgtatcgtcacttct

SEQ ID NO: 232841 - DNA, 25 bp, Mus musculus
ataggtttgcaccatgacacccgac

SEQ ID NO: 232842 - DNA, 25 bp, Mus musculus
ataggtttgcacgatgacacccgac

SEQ ID NO: 232843 - DNA, 25 bp, Mus musculus
ataggtttgcttctgattgcttcag

SEQ ID NO: 232844 - DNA, 25 bp, Mus musculus
ataggtttgcttgtgattgcttcag

SEQ ID NO: 232845 - DNA, 25 bp, Mus musculus
ataggtttggacatactcctctaat

SEQ ID NO: 232846 - DNA, 25 bp, Mus musculus
ataggtttggacttactcctctaat

SEQ ID NO: 232847 - DNA, 25 bp, Mus musculus
ataggttttccaagtttctgtggga

SEQ ID NO: 232848 - DNA, 25 bp, Mus musculus
ataggttttccatgtttctgtggga

SEQ ID NO: 232849 - DNA, 25 bp, Mus musculus
atagtaaaaccccatattgcattaa

SEQ ID NO: 232850 - DNA, 25 bp, Mus musculus
atagtaaaacccgatattgcattaa

SEQ ID NO: 232851 - DNA, 25 bp, Mus musculus
atagtaaaatgtctaccctctcctg

SEQ ID NO: 232852 - DNA, 25 bp, Mus musculus
atagtaaaatgtgtaccctctcctg

SEQ ID NO: 232853 - DNA, 25 bp, Mus musculus
atagtaaactatacagcaatggctg

SEQ ID NO: 232854 - DNA, 25 bp, Mus musculus
atagtaaactattcagcaatggctg

SEQ ID NO: 232855 - DNA, 25 bp, Mus musculus
atagtaaagcacaatatcgtctctg

SEQ ID NO: 232856 - DNA, 25 bp, Mus musculus
atagtaaagcactatatcgtctctg

SEQ ID NO: 232857 - DNA, 25 bp, Mus musculus
atagtaaaggccattcagcctgccc

SEQ ID NO: 232858 - DNA, 25 bp, Mus musculus
atagtaaaggcctttcagcctgccc

SEQ ID NO: 232859 - DNA, 25 bp, Mus musculus
atagtaaccagaagagcaccaccac

SEQ ID NO: 232860 - DNA, 25 bp, Mus musculus
atagtaaccagatgagcaccaccac

SEQ ID NO: 232861 - DNA, 25 bp, Mus musculus
atagtaacccatagctcagttgtaa

SEQ ID NO: 232862 - DNA, 25 bp, Mus musculus
atagtaacccattgctcagttgtaa

SEQ ID NO: 232863 - DNA, 25 bp, Mus musculus
atagtaaccccaaatctgaggttta

SEQ ID NO: 232864 - DNA, 25 bp, Mus musculus
atagtaaccccatatctgaggttta

SEQ ID NO: 232865 - DNA, 25 bp, Mus musculus
atagtaacccggacagacatttgga

SEQ ID NO: 232866 - DNA, 25 bp, Mus musculus
atagtaacccggtcagacatttgga

SEQ ID NO: 232867 - DNA, 25 bp, Mus musculus
atagtaactgagctctggaaaggga

SEQ ID NO: 232868 - DNA, 25 bp, Mus musculus
atagtaactgaggtctggaaaggga

SEQ ID NO: 232869 - DNA, 25 bp, Mus musculus
atagtaacttcacaccagctgcaga

SEQ ID NO: 232870 - DNA, 25 bp, Mus musculus
atagtaacttcagaccagctgcaga

SEQ ID NO: 232871 - DNA, 25 bp, Mus musculus
atagtaacttgtctcgcctcacttt

SEQ ID NO: 232872 - DNA, 25 bp, Mus musculus
atagtaacttgtgtcgcctcacttt

SEQ ID NO: 232873 - DNA, 25 bp, Mus musculus
atagtaactttgaatggcaatgtaa

SEQ ID NO: 232874 - DNA, 25 bp, Mus musculus
atagtaactttgtatggcaatgtaa

SEQ ID NO: 232875 - DNA, 25 bp, Mus musculus
atagtaagactgcaactggctcctc

SEQ ID NO: 232876 - DNA, 25 bp, Mus musculus
atagtaagactggaactggctcctc

SEQ ID NO: 232877 - DNA, 25 bp, Mus musculus
atagtaagatctatagcctccatga

SEQ ID NO: 232878 - DNA, 25 bp, Mus musculus
atagtaagatctttagcctccatga

SEQ ID NO: 232879 - DNA, 25 bp, Mus musculus
atagtaagcccacggctagcccaca

SEQ ID NO: 232880 - DNA, 25 bp, Mus musculus
atagtaagcccagggctagcccaca

SEQ ID NO: 232881 - DNA, 25 bp, Mus musculus
atagtaagccgtactcggcgctgac

SEQ ID NO: 232882 - DNA, 25 bp, Mus musculus
atagtaagccgttctcggcgctgac

SEQ ID NO: 232883 - DNA, 25 bp, Mus musculus
atagtaaggcctccatctcaaaaag

SEQ ID NO: 232884 - DNA, 25 bp, Mus musculus
atagtaaggcctgcatctcaaaaag

SEQ ID NO: 232885 - DNA, 25 bp, Mus musculus
atagtaagtggccagtgcctttcct

SEQ ID NO: 232886 - DNA, 25 bp, Mus musculus
atagtaagtggcgagtgcctttcct

SEQ ID NO: 232887 - DNA, 25 bp, Mus musculus
atagtaagtttgaatccggcctgaa

SEQ ID NO: 232888 - DNA, 25 bp, Mus musculus
atagtaagtttgtatccggcctgaa

SEQ ID NO: 232889 - DNA, 25 bp, Mus musculus
atagtaatagccctgaaggcacaga

SEQ ID NO: 232890 - DNA, 25 bp, Mus musculus
atagtaatagccgtgaaggcacaga

SEQ ID NO: 232891 - DNA, 25 bp, Mus musculus
atagtaatctaccttactccgagcc

SEQ ID NO: 232892 - DNA, 25 bp, Mus musculus
atagtaatctacgttactccgagcc

SEQ ID NO: 232893 - DNA, 25 bp, Mus musculus
atagtaatggccaggtgcctgccgc

SEQ ID NO: 232894 - DNA, 25 bp, Mus musculus
atagtaatggcctggtgcctgccgc

SEQ ID NO: 232895 - DNA, 25 bp, Mus musculus
atagtaattccaattctgcttttag

SEQ ID NO: 232896 - DNA, 25 bp, Mus musculus
atagtaattccatttctgcttttag

SEQ ID NO: 232897 - DNA, 25 bp, Mus musculus
atagtacaactgagacagccacctt

SEQ ID NO: 232898 - DNA, 25 bp, Mus musculus
atagtacaactgtgacagccacctt

SEQ ID NO: 232899 - DNA, 25 bp, Mus musculus
atagtacaagctctcttcaaactcc

SEQ ID NO: 232900 - DNA, 25 bp, Mus musculus
atagtacaagctgtcttcaaactcc

SEQ ID NO: 232901 - DNA, 25 bp, Mus musculus
atagtacaggccattaaatcacagt

SEQ ID NO: 232902 - DNA, 25 bp, Mus musculus
atagtacaggcctttaaatcacagt

SEQ ID NO: 232903 - DNA, 25 bp, Mus musculus
atagtacccagcaccactcagtggc

SEQ ID NO: 232904 - DNA, 25 bp, Mus musculus
atagtacccagctccactcagtggc

SEQ ID NO: 232905 - DNA, 25 bp, Mus musculus
atagtacctactattgatcttccct

SEQ ID NO: 232906 - DNA, 25 bp, Mus musculus
atagtacctacttttgatcttccct

SEQ ID NO: 232907 - DNA, 25 bp, Mus musculus
atagtacctgacattagctgctccc

SEQ ID NO: 232908 - DNA, 25 bp, Mus musculus
atagtacctgactttagctgctccc

SEQ ID NO: 232909 - DNA, 25 bp, Mus musculus
atagtacctgccaattcgcatgaat

SEQ ID NO: 232910 - DNA, 25 bp, Mus musculus
atagtacctgcctattcgcatgaat

SEQ ID NO: 232911 - DNA, 25 bp, Mus musculus
atagtacgtacaacataaggtggtt

SEQ ID NO: 232912 - DNA, 25 bp, Mus musculus
atagtacgtacatcataaggtggtt

SEQ ID NO: 232913 - DNA, 25 bp, Mus musculus
atagtactctgaacacttgtccgta

SEQ ID NO: 232914 - DNA, 25 bp, Mus musculus
atagtactctgatcacttgtccgta

SEQ ID NO: 232915 - DNA, 25 bp, Mus musculus
atagtactggagagggcttctccca

SEQ ID NO: 232916 - DNA, 25 bp, Mus musculus
atagtactggagtgggcttctccca

SEQ ID NO: 232917 - DNA, 25 bp, Mus musculus
atagtagaaggccactcagttccct

SEQ ID NO: 232918 - DNA, 25 bp, Mus musculus
atagtagaaggcgactcagttccct

SEQ ID NO: 232919 - DNA, 25 bp, Mus musculus
atagtagactctaccacacatttcc

SEQ ID NO: 232920 - DNA, 25 bp, Mus musculus
atagtagactcttccacacatttcc

SEQ ID NO: 232921 - DNA, 25 bp, Mus musculus
atagtagagaacctggtagaggcaa

SEQ ID NO: 232922 - DNA, 25 bp, Mus musculus
atagtagagaacgtggtagaggcaa

SEQ ID NO: 232923 - DNA, 25 bp, Mus musculus
atagtagagtcactgctttcctgta

SEQ ID NO: 232924 - DNA, 25 bp, Mus musculus
atagtagagtcagtgctttcctgta

SEQ ID NO: 232925 - DNA, 25 bp, Mus musculus
atagtagagtgtattccctcagcag

SEQ ID NO: 232926 - DNA, 25 bp, Mus musculus
atagtagagtgttttccctcagcag

SEQ ID NO: 232927 - DNA, 25 bp, Mus musculus
atagtagcaagaacactccctgcca

SEQ ID NO: 232928 - DNA, 25 bp, Mus musculus
atagtagcaagatcactccctgcca

SEQ ID NO: 232929 - DNA, 25 bp, Mus musculus
atagtagcacttacccttgggctgg

SEQ ID NO: 232930 - DNA, 25 bp, Mus musculus
atagtagcactttcccttgggctgg

SEQ ID NO: 232931 - DNA, 25 bp, Mus musculus
atagtagcagctatcatgggctgag

SEQ ID NO: 232932 - DNA, 25 bp, Mus musculus
atagtagcagctttcatgggctgag

SEQ ID NO: 232933 - DNA, 25 bp, Mus musculus
atagtagctcccagaggaagcaagc

SEQ ID NO: 232934 - DNA, 25 bp, Mus musculus
atagtagctccctgaggaagcaagc

SEQ ID NO: 232935 - DNA, 25 bp, Mus musculus
atagtagcttttccaggcacagcga

SEQ ID NO: 232936 - DNA, 25 bp, Mus musculus
atagtagcttttgcaggcacagcga

SEQ ID NO: 232937 - DNA, 25 bp, Mus musculus
atagtaggtgttacacctgctccca

SEQ ID NO: 232938 - DNA, 25 bp, Mus musculus
atagtaggtgtttcacctgctccca

SEQ ID NO: 232939 - DNA, 25 bp, Mus musculus
atagtagtattcatccaccctttaa

SEQ ID NO: 232940 - DNA, 25 bp, Mus musculus
atagtagtattcttccaccctttaa

SEQ ID NO: 232941 - DNA, 25 bp, Mus musculus
atagtagtcttaatctggtaatctg

SEQ ID NO: 232942 - DNA, 25 bp, Mus musculus
atagtagtcttattctggtaatctg

SEQ ID NO: 232943 - DNA, 25 bp, Mus musculus
atagtagttttcatctcatccgttt

SEQ ID NO: 232944 - DNA, 25 bp, Mus musculus
atagtagttttcatgtgctgttggc

SEQ ID NO: 232945 - DNA, 25 bp, Mus musculus
atagtagttttcttctcatccgttt

SEQ ID NO: 232946 - DNA, 25 bp, Mus musculus
atagtagttttcttgtgctgttggc

SEQ ID NO: 232947 - DNA, 25 bp, Mus musculus
atagtataaagcatctccctcgtag

SEQ ID NO: 232948 - DNA, 25 bp, Mus musculus
atagtataaagcttctccctcgtag

SEQ ID NO: 232949 - DNA, 25 bp, Mus musculus
atagtataagcaatattctgtgtgt

SEQ ID NO: 232950 - DNA, 25 bp, Mus musculus
atagtataagcattattctgtgtgt

SEQ ID NO: 232951 - DNA, 25 bp, Mus musculus
atagtatacctcagtacactaccgc

SEQ ID NO: 232952 - DNA, 25 bp, Mus musculus
atagtatacctctgtacactaccgc

SEQ ID NO: 232953 - DNA, 25 bp, Mus musculus
atagtatatcttagcctccgtttag

SEQ ID NO: 232954 - DNA, 25 bp, Mus musculus
atagtatatctttgcctccgtttag

SEQ ID NO: 232955 - DNA, 25 bp, Mus musculus
atagtatattctctgtgttccccgg

SEQ ID NO: 232956 - DNA, 25 bp, Mus musculus
atagtatattctgtgtgttccccgg

SEQ ID NO: 232957 - DNA, 25 bp, Mus musculus
atagtatcacagaagcgcgcagtcc

SEQ ID NO: 232958 - DNA, 25 bp, Mus musculus
atagtatcacagtagcgcgcagtcc

SEQ ID NO: 232959 - DNA, 25 bp, Mus musculus
atagtatccccactgagtatcccca

SEQ ID NO: 232960 - DNA, 25 bp, Mus musculus
atagtatccccagtgagtatcccca

SEQ ID NO: 232961 - DNA, 25 bp, Mus musculus
atagtatctgtgacatcagcccagt

SEQ ID NO: 232962 - DNA, 25 bp, Mus musculus
atagtatctgtgtcatcagcccagt

SEQ ID NO: 232963 - DNA, 25 bp, Mus musculus
atagtatgccttactcagtacaatg

SEQ ID NO: 232964 - DNA, 25 bp, Mus musculus
atagtatgcctttctcagtacaatg

SEQ ID NO: 232965 - DNA, 25 bp, Mus musculus
atagtatgtttacccatcgcatgga

SEQ ID NO: 232966 - DNA, 25 bp, Mus musculus
atagtatgtttagccatcgcatgga

SEQ ID NO: 232967 - DNA, 25 bp, Mus musculus
atagtattaactcctggtgctttgt

SEQ ID NO: 232968 - DNA, 25 bp, Mus musculus
atagtattaactgctggtgctttgt

SEQ ID NO: 232969 - DNA, 25 bp, Mus musculus
atagtattgggcatgggtcgtcaca

SEQ ID NO: 232970 - DNA, 25 bp, Mus musculus
atagtattgggcttgggtcgtcaca

SEQ ID NO: 232971 - DNA, 25 bp, Mus musculus
atagtatttaggagtcccgctcacg

SEQ ID NO: 232972 - DNA, 25 bp, Mus musculus
atagtatttaggtgtcccgctcacg

SEQ ID NO: 232973 - DNA, 25 bp, Mus musculus
atagtattttcccttgcattgtgac

SEQ ID NO: 232974 - DNA, 25 bp, Mus musculus
atagtattttccgttgcattgtgac

SEQ ID NO: 232975 - DNA, 25 bp, Mus musculus
atagtatttttgaagctggatttct

SEQ ID NO: 232976 - DNA, 25 bp, Mus musculus
atagtatttttgtagctggatttct

SEQ ID NO: 232977 - DNA, 25 bp, Mus musculus
atagtcaaacatatccgggcacggg

SEQ ID NO: 232978 - DNA, 25 bp, Mus musculus
atagtcaaacatttccgggcacggg

SEQ ID NO: 232979 - DNA, 25 bp, Mus musculus
atagtcaaattacgactgtttctct

SEQ ID NO: 232980 - DNA, 25 bp, Mus musculus
atagtcaaattaggactgtttctct

SEQ ID NO: 232981 - DNA, 25 bp, Mus musculus
atagtcaacataaccatgtcctccc

SEQ ID NO: 232982 - DNA, 25 bp, Mus musculus
atagtcaacatatccatgtcctccc

SEQ ID NO: 232983 - DNA, 25 bp, Mus musculus
atagtcaactaaaggctgctgagga

SEQ ID NO: 232984 - DNA, 25 bp, Mus musculus
atagtcaactaatggctgctgagga

SEQ ID NO: 232985 - DNA, 25 bp, Mus musculus
atagtcaagaaaatcctctcctcct

SEQ ID NO: 232986 - DNA, 25 bp, Mus musculus
atagtcaagaaattcctctcctcct

SEQ ID NO: 232987 - DNA, 25 bp, Mus musculus
atagtcaaggcccactcctcagtct

SEQ ID NO: 232988 - DNA, 25 bp, Mus musculus
atagtcaaggccgactcctcagtct

SEQ ID NO: 232989 - DNA, 25 bp, Mus musculus
atagtcaagtgtaagccctacccag

SEQ ID NO: 232990 - DNA, 25 bp, Mus musculus
atagtcaagtgtatacactccctcc

SEQ ID NO: 232991 - DNA, 25 bp, Mus musculus
atagtcaagtgttagccctacccag

SEQ ID NO: 232992 - DNA, 25 bp, Mus musculus
atagtcaagtgtttacactccctcc

SEQ ID NO: 232993 - DNA, 25 bp, Mus musculus
atagtcaattgtcacctcagctggg

SEQ ID NO: 232994 - DNA, 25 bp, Mus musculus
atagtcaattgtgacctcagctggg

SEQ ID NO: 232995 - DNA, 25 bp, Mus musculus
atagtcacagtgagtctccctttct

SEQ ID NO: 232996 - DNA, 25 bp, Mus musculus
atagtcacagtgtgtctccctttct

SEQ ID NO: 232997 - DNA, 25 bp, Mus musculus
atagtcaccaaaatccactcatcta

SEQ ID NO: 232998 - DNA, 25 bp, Mus musculus
atagtcaccaaattccactcatcta

SEQ ID NO: 232999 - DNA, 25 bp, Mus musculus
atagtcagagccatatccatagccc

SEQ ID NO: 233000 - DNA, 25 bp, Mus musculus
atagtcagagccttatccatagccc

SEQ ID NO: 233001 - DNA, 25 bp, Mus musculus
atagtcagcactatttgcctcggtg

SEQ ID NO: 233002 - DNA, 25 bp, Mus musculus
atagtcagcactttttgcctcggtg

SEQ ID NO: 233003 - DNA, 25 bp, Mus musculus
atagtcagcccacatgtagatgtca

SEQ ID NO: 233004 - DNA, 25 bp, Mus musculus
atagtcagcccagatgtagatgtca

SEQ ID NO: 233005 - DNA, 25 bp, Mus musculus
atagtcaggcacaggaaacttttcc

SEQ ID NO: 233006 - DNA, 25 bp, Mus musculus
atagtcaggcactggaaacttttcc

SEQ ID NO: 233007 - DNA, 25 bp, Mus musculus
atagtcagtagacccctggccaagc

SEQ ID NO: 233008 - DNA, 25 bp, Mus musculus
atagtcagtagagccctggccaagc

SEQ ID NO: 233009 - DNA, 25 bp, Mus musculus
atagtcagtcagacctagctgttag

SEQ ID NO: 233010 - DNA, 25 bp, Mus musculus
atagtcagtcagtcctagctgttag

SEQ ID NO: 233011 - DNA, 25 bp, Mus musculus
atagtcataggtaaagtatcttcaa

SEQ ID NO: 233012 - DNA, 25 bp, Mus musculus
atagtcataggttaagtatcttcaa

SEQ ID NO: 233013 - DNA, 25 bp, Mus musculus
atagtcatcctgagagcttacatca

SEQ ID NO: 233014 - DNA, 25 bp, Mus musculus
atagtcatcctgtgagcttacatca

SEQ ID NO: 233015 - DNA, 25 bp, Mus musculus
atagtcatctgtaagcatgctgctg

SEQ ID NO: 233016 - DNA, 25 bp, Mus musculus
atagtcatctgttagcatgctgctg

SEQ ID NO: 233017 - DNA, 25 bp, Mus musculus
atagtcatgcgtctcttcattttga

SEQ ID NO: 233018 - DNA, 25 bp, Mus musculus
atagtcatgcgtgtcttcattttga

SEQ ID NO: 233019 - DNA, 25 bp, Mus musculus
atagtcatgctgagtctggactcgg

SEQ ID NO: 233020 - DNA, 25 bp, Mus musculus
atagtcatgctgtgtctggactcgg

SEQ ID NO: 233021 - DNA, 25 bp, Mus musculus
atagtcatggttctgattgctttac

SEQ ID NO: 233022 - DNA, 25 bp, Mus musculus
atagtcatggttgtgattgctttac

SEQ ID NO: 233023 - DNA, 25 bp, Mus musculus
atagtcatgtaacctactggccagg

SEQ ID NO: 233024 - DNA, 25 bp, Mus musculus
atagtcatgtaagctactggccagg

SEQ ID NO: 233025 - DNA, 25 bp, Mus musculus
atagtcattttacgcacatcacagt

SEQ ID NO: 233026 - DNA, 25 bp, Mus musculus
atagtcattttaggcacatcacagt

SEQ ID NO: 233027 - DNA, 25 bp, Mus musculus
atagtccaagccaagtctcaccttt

SEQ ID NO: 233028 - DNA, 25 bp, Mus musculus
atagtccaagcctagtctcaccttt

SEQ ID NO: 233029 - DNA, 25 bp, Mus musculus
atagtccaccagatgtcagtaccca

SEQ ID NO: 233030 - DNA, 25 bp, Mus musculus
atagtccaccagttgtcagtaccca

SEQ ID NO: 233031 - DNA, 25 bp, Mus musculus
atagtccactgcaacactggcacat

SEQ ID NO: 233032 - DNA, 25 bp, Mus musculus
atagtccactgctacactggcacat

SEQ ID NO: 233033 - DNA, 25 bp, Mus musculus
atagtccagcagatgtatcatcatc

SEQ ID NO: 233034 - DNA, 25 bp, Mus musculus
atagtccagcagttgtatcatcatc

SEQ ID NO: 233035 - DNA, 25 bp, Mus musculus
atagtccccaacctaatggttcagg

SEQ ID NO: 233036 - DNA, 25 bp, Mus musculus
atagtccccaacgtaatggttcagg

SEQ ID NO: 233037 - DNA, 25 bp, Mus musculus
atagtccccatactcagtgcttgaa

SEQ ID NO: 233038 - DNA, 25 bp, Mus musculus
atagtccccatagtcagtgcttgaa

SEQ ID NO: 233039 - DNA, 25 bp, Mus musculus
atagtcccgcctcagtatagtattg

SEQ ID NO: 233040 - DNA, 25 bp, Mus musculus
atagtcccgcctgagtatagtattg

SEQ ID NO: 233041 - DNA, 25 bp, Mus musculus
atagtcccggctcagagtttaaaca

SEQ ID NO: 233042 - DNA, 25 bp, Mus musculus
atagtcccggctgagagtttaaaca

SEQ ID NO: 233043 - DNA, 25 bp, Mus musculus
atagtcccgtgcatcatgtcattca

SEQ ID NO: 233044 - DNA, 25 bp, Mus musculus
atagtcccgtgcttcatgtcattca

SEQ ID NO: 233045 - DNA, 25 bp, Mus musculus
atagtccctttcagacagcactgag

SEQ ID NO: 233046 - DNA, 25 bp, Mus musculus
atagtccctttctgacagcactgag

SEQ ID NO: 233047 - DNA, 25 bp, Mus musculus
atagtcctaagtcacgctaacctcc

SEQ ID NO: 233048 - DNA, 25 bp, Mus musculus
atagtcctaagtgacgctaacctcc

SEQ ID NO: 233049 - DNA, 25 bp, Mus musculus
atagtcctattcatcagcttcactg

SEQ ID NO: 233050 - DNA, 25 bp, Mus musculus
atagtcctattcttcagcttcactg

SEQ ID NO: 233051 - DNA, 25 bp, Mus musculus
atagtcctgtatagagctcagtcag

SEQ ID NO: 233052 - DNA, 25 bp, Mus musculus
atagtcctgtattgagctcagtcag

SEQ ID NO: 233053 - DNA, 25 bp, Mus musculus
atagtcctgttcacctcagatgcct

SEQ ID NO: 233054 - DNA, 25 bp, Mus musculus
atagtcctgttctcctcagatgcct

SEQ ID NO: 233055 - DNA, 25 bp, Mus musculus
atagtccttgaacgccggcagtcat

SEQ ID NO: 233056 - DNA, 25 bp, Mus musculus
atagtccttgaaggccggcagtcat

SEQ ID NO: 233057 - DNA, 25 bp, Mus musculus
atagtccttgacatcatacctttgc

SEQ ID NO: 233058 - DNA, 25 bp, Mus musculus
atagtccttgacttcatacctttgc

SEQ ID NO: 233059 - DNA, 25 bp, Mus musculus
atagtcctttgtagcccagataaat

SEQ ID NO: 233060 - DNA, 25 bp, Mus musculus
atagtcctttgttgcccagataaat

SEQ ID NO: 233061 - DNA, 25 bp, Mus musculus
atagtccttttcagaaacttgtgtc

SEQ ID NO: 233062 - DNA, 25 bp, Mus musculus
atagtccttttcattagctgtgaac

SEQ ID NO: 233063 - DNA, 25 bp, Mus musculus
atagtccttttctgaaacttgtgtc

SEQ ID NO: 233064 - DNA, 25 bp, Mus musculus
atagtccttttctttagctgtgaac

SEQ ID NO: 233065 - DNA, 25 bp, Mus musculus
atagtccttttgatattccccatag

SEQ ID NO: 233066 - DNA, 25 bp, Mus musculus
atagtccttttgttattccccatag

SEQ ID NO: 233067 - DNA, 25 bp, Mus musculus
atagtcgatcctaccggcgaggagg

SEQ ID NO: 233068 - DNA, 25 bp, Mus musculus
atagtcgatccttccggcgaggagg

SEQ ID NO: 233069 - DNA, 25 bp, Mus musculus
atagtcgccaggatgcagctgccct

SEQ ID NO: 233070 - DNA, 25 bp, Mus musculus
atagtcgccaggttgcagctgccct

SEQ ID NO: 233071 - DNA, 25 bp, Mus musculus
atagtcgctgccctagagttgcaaa

SEQ ID NO: 233072 - DNA, 25 bp, Mus musculus
atagtcgctgccgtagagttgcaaa

SEQ ID NO: 233073 - DNA, 25 bp, Mus musculus
atagtcgttgacagttcttctttaa

SEQ ID NO: 233074 - DNA, 25 bp, Mus musculus
atagtcgttgactgttcttctttaa

SEQ ID NO: 233075 - DNA, 25 bp, Mus musculus
atagtcgttgtgaaagagctttctg

SEQ ID NO: 233076 - DNA, 25 bp, Mus musculus
atagtcgttgtgtaagagctttctg

SEQ ID NO: 233077 - DNA, 25 bp, Mus musculus
atagtctatttcattgtcactcaaa

SEQ ID NO: 233078 - DNA, 25 bp, Mus musculus
atagtctatttctttgtcactcaaa

SEQ ID NO: 233079 - DNA, 25 bp, Mus musculus
atagtctcagcactcctgtgcaaga

SEQ ID NO: 233080 - DNA, 25 bp, Mus musculus
atagtctcagcagtcctgtgcaaga

SEQ ID NO: 233081 - DNA, 25 bp, Mus musculus
atagtctcctataatggtccataag

SEQ ID NO: 233082 - DNA, 25 bp, Mus musculus
atagtctcctattatggtccataag

SEQ ID NO: 233083 - DNA, 25 bp, Mus musculus
atagtctcggctatcttgtctgaaa

SEQ ID NO: 233084 - DNA, 25 bp, Mus musculus
atagtctcggctttcttgtctgaaa

SEQ ID NO: 233085 - DNA, 25 bp, Mus musculus
atagtctctactcctgggtaaccct

SEQ ID NO: 233086 - DNA, 25 bp, Mus musculus
atagtctctactgctgggtaaccct

SEQ ID NO: 233087 - DNA, 25 bp, Mus musculus
atagtctctctcaaccctattaatc

SEQ ID NO: 233088 - DNA, 25 bp, Mus musculus
atagtctctctctaccctattaatc

SEQ ID NO: 233089 - DNA, 25 bp, Mus musculus
atagtctctggacttcactgatcca

SEQ ID NO: 233090 - DNA, 25 bp, Mus musculus
atagtctctggagttcactgatcca

SEQ ID NO: 233091 - DNA, 25 bp, Mus musculus
atagtctctggtacttgttaagtca

SEQ ID NO: 233092 - DNA, 25 bp, Mus musculus
atagtctctggttcttgttaagtca

SEQ ID NO: 233093 - DNA, 25 bp, Mus musculus
atagtctctgttaaccctgtctgag

SEQ ID NO: 233094 - DNA, 25 bp, Mus musculus
atagtctctgtttaccctgtctgag

SEQ ID NO: 233095 - DNA, 25 bp, Mus musculus
atagtctgcaatcgcgctttttgcc

SEQ ID NO: 233096 - DNA, 25 bp, Mus musculus
atagtctgcaatggcgctttttgcc

SEQ ID NO: 233097 - DNA, 25 bp, Mus musculus
atagtctgcgcgcttctcgtgatga

SEQ ID NO: 233098 - DNA, 25 bp, Mus musculus
atagtctgcgcggttctcgtgatga

SEQ ID NO: 233099 - DNA, 25 bp, Mus musculus
atagtctgctacacttccttgaaga

SEQ ID NO: 233100 - DNA, 25 bp, Mus musculus
atagtctgctactcttccttgaaga

SEQ ID NO: 233101 - DNA, 25 bp, Mus musculus
atagtctggctactcagtttctccc

SEQ ID NO: 233102 - DNA, 25 bp, Mus musculus
atagtctggctagtcagtttctccc

SEQ ID NO: 233103 - DNA, 25 bp, Mus musculus
atagtctgggacacacacttcggaa

SEQ ID NO: 233104 - DNA, 25 bp, Mus musculus
atagtctgggactcacacttcggaa

SEQ ID NO: 233105 - DNA, 25 bp, Mus musculus
atagtctgtcttctatgtgtctcct

SEQ ID NO: 233106 - DNA, 25 bp, Mus musculus
atagtctgtcttgtatgtgtctcct

SEQ ID NO: 233107 - DNA, 25 bp, Mus musculus
atagtctgtgctaagagatcttgtc

SEQ ID NO: 233108 - DNA, 25 bp, Mus musculus
atagtctgtgcttagagatcttgtc

SEQ ID NO: 233109 - DNA, 25 bp, Mus musculus
atagtctgtttcaatcccttttcag

SEQ ID NO: 233110 - DNA, 25 bp, Mus musculus
atagtctgtttctatcccttttcag

SEQ ID NO: 233111 - DNA, 25 bp, Mus musculus
atagtcttacatacacggtgagcca

SEQ ID NO: 233112 - DNA, 25 bp, Mus musculus
atagtcttacattcacggtgagcca

SEQ ID NO: 233113 - DNA, 25 bp, Mus musculus
atagtcttagaaagggcctccgtca

SEQ ID NO: 233114 - DNA, 25 bp, Mus musculus
atagtcttagaatgggcctccgtca

SEQ ID NO: 233115 - DNA, 25 bp, Mus musculus
atagtcttcacaccattgcttatct

SEQ ID NO: 233116 - DNA, 25 bp, Mus musculus
atagtcttcacagcattgcttatct

SEQ ID NO: 233117 - DNA, 25 bp, Mus musculus
atagtcttcatgcagcacgtctaag

SEQ ID NO: 233118 - DNA, 25 bp, Mus musculus
atagtcttcatggagcacgtctaag

SEQ ID NO: 233119 - DNA, 25 bp, Mus musculus
atagtcttcttcagccttgcttttg

SEQ ID NO: 233120 - DNA, 25 bp, Mus musculus
atagtcttcttctgccttgcttttg

SEQ ID NO: 233121 - DNA, 25 bp, Mus musculus
atagtcttgactacttctctgagta

SEQ ID NO: 233122 - DNA, 25 bp, Mus musculus
atagtcttgacttcttctctgagta

SEQ ID NO: 233123 - DNA, 25 bp, Mus musculus
atagtctttcccagactggactgtg

SEQ ID NO: 233124 - DNA, 25 bp, Mus musculus
atagtctttccctgactggactgtg

SEQ ID NO: 233125 - DNA, 25 bp, Mus musculus
atagtgaactgtaccatacctgggt

SEQ ID NO: 233126 - DNA, 25 bp, Mus musculus
atagtgaactgttccatacctgggt

SEQ ID NO: 233127 - DNA, 25 bp, Mus musculus
atagtgaagatacccacgtgcgttc

SEQ ID NO: 233128 - DNA, 25 bp, Mus musculus
atagtgaagatagccacgtgcgttc

SEQ ID NO: 233129 - DNA, 25 bp, Mus musculus
atagtgaagctgagttaaaacatca

SEQ ID NO: 233130 - DNA, 25 bp, Mus musculus
atagtgaagctgtgttaaaacatca

SEQ ID NO: 233131 - DNA, 25 bp, Mus musculus
atagtgaagtttccctgtgaagact

SEQ ID NO: 233132 - DNA, 25 bp, Mus musculus
atagtgaagtttgcctgtgaagact

SEQ ID NO: 233133 - DNA, 25 bp, Mus musculus
atagtgaatcccacgtcaaccaagg

SEQ ID NO: 233134 - DNA, 25 bp, Mus musculus
atagtgaatccctcgtcaaccaagg

SEQ ID NO: 233135 - DNA, 25 bp, Mus musculus
atagtgaatgttccacagtggcacg

SEQ ID NO: 233136 - DNA, 25 bp, Mus musculus
atagtgaatgttgcacagtggcacg

SEQ ID NO: 233137 - DNA, 25 bp, Mus musculus
atagtgacaagcctatacctcttcc

SEQ ID NO: 233138 - DNA, 25 bp, Mus musculus
atagtgacaagcgtatacctcttcc

SEQ ID NO: 233139 - DNA, 25 bp, Mus musculus
atagtgacccttctcacagtgtcct

SEQ ID NO: 233140 - DNA, 25 bp, Mus musculus
atagtgacccttgtcacagtgtcct

SEQ ID NO: 233141 - DNA, 25 bp, Mus musculus
atagtgactcccacctgtacataca

SEQ ID NO: 233142 - DNA, 25 bp, Mus musculus
atagtgactccctcctgtacataca

SEQ ID NO: 233143 - DNA, 25 bp, Mus musculus
atagtgagcctacgtttgggcctga

SEQ ID NO: 233144 - DNA, 25 bp, Mus musculus
atagtgagcctaggtttgggcctga

SEQ ID NO: 233145 - DNA, 25 bp, Mus musculus
atagtgagctccaacacagccaagt

SEQ ID NO: 233146 - DNA, 25 bp, Mus musculus
atagtgagctcctacacagccaagt

SEQ ID NO: 233147 - DNA, 25 bp, Mus musculus
atagtgaggactctcccatcaatgc

SEQ ID NO: 233148 - DNA, 25 bp, Mus musculus
atagtgaggactgtcccatcaatgc

SEQ ID NO: 233149 - DNA, 25 bp, Mus musculus
atagtgaggcctcttccagcctaac

SEQ ID NO: 233150 - DNA, 25 bp, Mus musculus
atagtgaggcctgttccagcctaac

SEQ ID NO: 233151 - DNA, 25 bp, Mus musculus
atagtgagggttagctctgcctcca

SEQ ID NO: 233152 - DNA, 25 bp, Mus musculus
atagtgagggtttgctctgcctcca

SEQ ID NO: 233153 - DNA, 25 bp, Mus musculus
atagtgagttagatccaagccagac

SEQ ID NO: 233154 - DNA, 25 bp, Mus musculus
atagtgagttagttccaagccagac

SEQ ID NO: 233155 - DNA, 25 bp, Mus musculus
atagtgatccgtatgctgggctgaa

SEQ ID NO: 233156 - DNA, 25 bp, Mus musculus
atagtgatccgtttgctgggctgaa

SEQ ID NO: 233157 - DNA, 25 bp, Mus musculus
atagtgatcttaattatgtcaaaac

SEQ ID NO: 233158 - DNA, 25 bp, Mus musculus
atagtgatcttatttatgtcaaaac

SEQ ID NO: 233159 - DNA, 25 bp, Mus musculus
atagtgatcttcatgtgggcaactt

SEQ ID NO: 233160 - DNA, 25 bp, Mus musculus
atagtgatcttcttgtgggcaactt

SEQ ID NO: 233161 - DNA, 25 bp, Mus musculus
atagtgattgacactgcattttctc

SEQ ID NO: 233162 - DNA, 25 bp, Mus musculus
atagtgattgactctgcattttctc

SEQ ID NO: 233163 - DNA, 25 bp, Mus musculus
atagtgatttccacacctgcttttg

SEQ ID NO: 233164 - DNA, 25 bp, Mus musculus
atagtgatttcctcacctgcttttg

SEQ ID NO: 233165 - DNA, 25 bp, Mus musculus
atagtgcaacacacgcctggctgga

SEQ ID NO: 233166 - DNA, 25 bp, Mus musculus
atagtgcaacactcgcctggctgga

SEQ ID NO: 233167 - DNA, 25 bp, Mus musculus
atagtgcacaaccaacagctgccaa

SEQ ID NO: 233168 - DNA, 25 bp, Mus musculus
atagtgcacaacgaacagctgccaa

SEQ ID NO: 233169 - DNA, 25 bp, Mus musculus
atagtgcacagtattatgcttacac

SEQ ID NO: 233170 - DNA, 25 bp, Mus musculus
atagtgcacagttttatgcttacac

SEQ ID NO: 233171 - DNA, 25 bp, Mus musculus
atagtgcagtgccttgttctccctc

SEQ ID NO: 233172 - DNA, 25 bp, Mus musculus
atagtgcagtgcgttgttctccctc

SEQ ID NO: 233173 - DNA, 25 bp, Mus musculus
atagtgcatgttaccttctgttatc

SEQ ID NO: 233174 - DNA, 25 bp, Mus musculus
atagtgcatgtttccttctgttatc

SEQ ID NO: 233175 - DNA, 25 bp, Mus musculus
atagtgcatttgaagccctttcatt

SEQ ID NO: 233176 - DNA, 25 bp, Mus musculus
atagtgcatttgaatccagatctct

SEQ ID NO: 233177 - DNA, 25 bp, Mus musculus
atagtgcatttgtagccctttcatt

SEQ ID NO: 233178 - DNA, 25 bp, Mus musculus
atagtgcatttgtatccagatctct

SEQ ID NO: 233179 - DNA, 25 bp, Mus musculus
atagtgccacctatactgtgctttt

SEQ ID NO: 233180 - DNA, 25 bp, Mus musculus
atagtgccacctttactgtgctttt

SEQ ID NO: 233181 - DNA, 25 bp, Mus musculus
atagtgcccaagaagcattcaaagg

SEQ ID NO: 233182 - DNA, 25 bp, Mus musculus
atagtgcccaagtagcattcaaagg

SEQ ID NO: 233183 - DNA, 25 bp, Mus musculus
atagtgcccacacagaagcccagtg

SEQ ID NO: 233184 - DNA, 25 bp, Mus musculus
atagtgcccacagagaagcccagtg

SEQ ID NO: 233185 - DNA, 25 bp, Mus musculus
atagtgcccagaattcattccccag

SEQ ID NO: 233186 - DNA, 25 bp, Mus musculus
atagtgcccagatttcattccccag

SEQ ID NO: 233187 - DNA, 25 bp, Mus musculus
atagtgcccataccctagtgcggta

SEQ ID NO: 233188 - DNA, 25 bp, Mus musculus
atagtgcccatagcctagtgcggta

SEQ ID NO: 233189 - DNA, 25 bp, Mus musculus
atagtgccccacattcaagaaccag

SEQ ID NO: 233190 - DNA, 25 bp, Mus musculus
atagtgccccactttcaagaaccag

SEQ ID NO: 233191 - DNA, 25 bp, Mus musculus
atagtgccccgtcttataaagataa

SEQ ID NO: 233192 - DNA, 25 bp, Mus musculus
atagtgccccgtgttataaagataa

SEQ ID NO: 233193 - DNA, 25 bp, Mus musculus
atagtgcccggcatgcactccctgg

SEQ ID NO: 233194 - DNA, 25 bp, Mus musculus
atagtgcccggcttgcactccctgg

SEQ ID NO: 233195 - DNA, 25 bp, Mus musculus
atagtgcctcttatgtcatcttgtg

SEQ ID NO: 233196 - DNA, 25 bp, Mus musculus
atagtgcctcttttgtcatcttgtg

SEQ ID NO: 233197 - DNA, 25 bp, Mus musculus
atagtgcgacgacgaactgccttcc

SEQ ID NO: 233198 - DNA, 25 bp, Mus musculus
atagtgcgacgaggaactgccttcc

SEQ ID NO: 233199 - DNA, 25 bp, Mus musculus
atagtgctacccagtcaaggctgca

SEQ ID NO: 233200 - DNA, 25 bp, Mus musculus
atagtgctaccctgtcaaggctgca

SEQ ID NO: 233201 - DNA, 25 bp, Mus musculus
atagtgctcatcagtagctagggca

SEQ ID NO: 233202 - DNA, 25 bp, Mus musculus
atagtgctcatctgtagctagggca

SEQ ID NO: 233203 - DNA, 25 bp, Mus musculus
atagtgctgttcatgtttggctcac

SEQ ID NO: 233204 - DNA, 25 bp, Mus musculus
atagtgctgttcttgtttggctcac

SEQ ID NO: 233205 - DNA, 25 bp, Mus musculus
atagtggacaggaggcccctgcata

SEQ ID NO: 233206 - DNA, 25 bp, Mus musculus
atagtggacaggcttcttgcttatt

SEQ ID NO: 233207 - DNA, 25 bp, Mus musculus
atagtggacagggttcttgcttatt

SEQ ID NO: 233208 - DNA, 25 bp, Mus musculus
atagtggacaggtggcccctgcata

SEQ ID NO: 233209 - DNA, 25 bp, Mus musculus
atagtggaccagcaagcgccccttg

SEQ ID NO: 233210 - DNA, 25 bp, Mus musculus
atagtggaccaggaagcgccccttg

SEQ ID NO: 233211 - DNA, 25 bp, Mus musculus
atagtggacgggaaatctctgacaa

SEQ ID NO: 233212 - DNA, 25 bp, Mus musculus
atagtggacgggtaatctctgacaa

SEQ ID NO: 233213 - DNA, 25 bp, Mus musculus
atagtggagatcactacagaactgt

SEQ ID NO: 233214 - DNA, 25 bp, Mus musculus
atagtggagatctctacagaactgt

SEQ ID NO: 233215 - DNA, 25 bp, Mus musculus
atagtggagtctacagccagccaga

SEQ ID NO: 233216 - DNA, 25 bp, Mus musculus
atagtggagtcttcagccagccaga

SEQ ID NO: 233217 - DNA, 25 bp, Mus musculus
atagtggataccacggatctgcctg

SEQ ID NO: 233218 - DNA, 25 bp, Mus musculus
atagtggatacctcggatctgcctg

SEQ ID NO: 233219 - DNA, 25 bp, Mus musculus
atagtggatcttctgtccacaccca

SEQ ID NO: 233220 - DNA, 25 bp, Mus musculus
atagtggatcttgtgtccacaccca

SEQ ID NO: 233221 - DNA, 25 bp, Mus musculus
atagtggcacagaggcaaagcccct

SEQ ID NO: 233222 - DNA, 25 bp, Mus musculus
atagtggcacagtggcaaagcccct

SEQ ID NO: 233223 - DNA, 25 bp, Mus musculus
atagtggccacaacctcacaactta

SEQ ID NO: 233224 - DNA, 25 bp, Mus musculus
atagtggccacatcctcacaactta

SEQ ID NO: 233225 - DNA, 25 bp, Mus musculus
atagtggccctgattcggagagctc

SEQ ID NO: 233226 - DNA, 25 bp, Mus musculus
atagtggccctgtttcggagagctc

SEQ ID NO: 233227 - DNA, 25 bp, Mus musculus
atagtggcctttatcagtatttcct

SEQ ID NO: 233228 - DNA, 25 bp, Mus musculus
atagtggcctttttcagtatttcct

SEQ ID NO: 233229 - DNA, 25 bp, Mus musculus
atagtggcggaaagacatgacctaa

SEQ ID NO: 233230 - DNA, 25 bp, Mus musculus
atagtggcggaatgacatgacctaa

SEQ ID NO: 233231 - DNA, 25 bp, Mus musculus
atagtggctatgactgtcgaaccaa

SEQ ID NO: 233232 - DNA, 25 bp, Mus musculus
atagtggctatgtctgtcgaaccaa

SEQ ID NO: 233233 - DNA, 25 bp, Mus musculus
atagtggctcctacacggaatggcc

SEQ ID NO: 233234 - DNA, 25 bp, Mus musculus
atagtggctcctcttaaaatccgtc

SEQ ID NO: 233235 - DNA, 25 bp, Mus musculus
atagtggctcctgttaaaatccgtc

SEQ ID NO: 233236 - DNA, 25 bp, Mus musculus
atagtggctccttcacggaatggcc

SEQ ID NO: 233237 - DNA, 25 bp, Mus musculus
atagtggcttctcgtcaaggacgca

SEQ ID NO: 233238 - DNA, 25 bp, Mus musculus
atagtggcttctggtcaaggacgca

SEQ ID NO: 233239 - DNA, 25 bp, Mus musculus
atagtggctttcagattttggtagt

SEQ ID NO: 233240 - DNA, 25 bp, Mus musculus
atagtggctttctgattttggtagt

SEQ ID NO: 233241 - DNA, 25 bp, Mus musculus
atagtgggaactagctgccttttct

SEQ ID NO: 233242 - DNA, 25 bp, Mus musculus
atagtgggaacttgctgccttttct

SEQ ID NO: 233243 - DNA, 25 bp, Mus musculus
atagtgggttggcaccacatccctt

SEQ ID NO: 233244 - DNA, 25 bp, Mus musculus
atagtgggttgggaccacatccctt

SEQ ID NO: 233245 - DNA, 25 bp, Mus musculus
atagtgggtttcatccttgttgaca

SEQ ID NO: 233246 - DNA, 25 bp, Mus musculus
atagtgggtttcttccttgttgaca

SEQ ID NO: 233247 - DNA, 25 bp, Mus musculus
atagtggtctttcctgccatcatag

SEQ ID NO: 233248 - DNA, 25 bp, Mus musculus
atagtggtctttgctgccatcatag

SEQ ID NO: 233249 - DNA, 25 bp, Mus musculus
atagtggtgagaaaacagaccccaa

SEQ ID NO: 233250 - DNA, 25 bp, Mus musculus
atagtggtgagataacagaccccaa

SEQ ID NO: 233251 - DNA, 25 bp, Mus musculus
atagtggttcttaactctcatggta

SEQ ID NO: 233252 - DNA, 25 bp, Mus musculus
atagtggttctttactctcatggta

SEQ ID NO: 233253 - DNA, 25 bp, Mus musculus
atagtggttgtgctattagtgtccc

SEQ ID NO: 233254 - DNA, 25 bp, Mus musculus
atagtggttgtggtattagtgtccc

SEQ ID NO: 233255 - DNA, 25 bp, Mus musculus
atagtggtttggacacattttaaga

SEQ ID NO: 233256 - DNA, 25 bp, Mus musculus
atagtggtttggtcacattttaaga

SEQ ID NO: 233257 - DNA, 25 bp, Mus musculus
atagtgtaataccagaggcaattct

SEQ ID NO: 233258 - DNA, 25 bp, Mus musculus
atagtgtaatacgagaggcaattct

SEQ ID NO: 233259 - DNA, 25 bp, Mus musculus
atagtgtcaagtagtccatgagacc

SEQ ID NO: 233260 - DNA, 25 bp, Mus musculus
atagtgtcaagttgtccatgagacc

SEQ ID NO: 233261 - DNA, 25 bp, Mus musculus
atagtgtcacccctaaagcattgaa

SEQ ID NO: 233262 - DNA, 25 bp, Mus musculus
atagtgtcacccgtaaagcattgaa

SEQ ID NO: 233263 - DNA, 25 bp, Mus musculus
atagtgtcagccattctcttcttaa

SEQ ID NO: 233264 - DNA, 25 bp, Mus musculus
atagtgtcagcctttctcttcttaa

SEQ ID NO: 233265 - DNA, 25 bp, Mus musculus
atagtgtcaggcctttgagcctgcc

SEQ ID NO: 233266 - DNA, 25 bp, Mus musculus
atagtgtcaggcgtttgagcctgcc

SEQ ID NO: 233267 - DNA, 25 bp, Mus musculus
atagtgtccagacacctggccaggc

SEQ ID NO: 233268 - DNA, 25 bp, Mus musculus
atagtgtccagagacctggccaggc

SEQ ID NO: 233269 - DNA, 25 bp, Mus musculus
atagtgtcttaactcatgtcccatc

SEQ ID NO: 233270 - DNA, 25 bp, Mus musculus
atagtgtcttaagtcatgtcccatc

SEQ ID NO: 233271 - DNA, 25 bp, Mus musculus
atagtgtgaaccactttcaagatca

SEQ ID NO: 233272 - DNA, 25 bp, Mus musculus
atagtgtgaacctctttcaagatca

SEQ ID NO: 233273 - DNA, 25 bp, Mus musculus
atagtgtgagatctgacgtcctttt

SEQ ID NO: 233274 - DNA, 25 bp, Mus musculus
atagtgtgagatgtgacgtcctttt

SEQ ID NO: 233275 - DNA, 25 bp, Mus musculus
atagtgtgagcaccaagtagccctt

SEQ ID NO: 233276 - DNA, 25 bp, Mus musculus
atagtgtgagcagcaagtagccctt

SEQ ID NO: 233277 - DNA, 25 bp, Mus musculus
atagtgtgatgcaagcctgagctac

SEQ ID NO: 233278 - DNA, 25 bp, Mus musculus
atagtgtgatgctagcctgagctac

SEQ ID NO: 233279 - DNA, 25 bp, Mus musculus
atagtgtgctacaagtgctctgtct

SEQ ID NO: 233280 - DNA, 25 bp, Mus musculus
atagtgtgctactagtgctctgtct

SEQ ID NO: 233281 - DNA, 25 bp, Mus musculus
atagtgtgctccaccgtgtgtgcca

SEQ ID NO: 233282 - DNA, 25 bp, Mus musculus
atagtgtgctcctccgtgtgtgcca

SEQ ID NO: 233283 - DNA, 25 bp, Mus musculus
atagtgtgctgaatgaagccaccac

SEQ ID NO: 233284 - DNA, 25 bp, Mus musculus
atagtgtgctgattgaagccaccac

SEQ ID NO: 233285 - DNA, 25 bp, Mus musculus
atagtgtggcctatgggacagatca

SEQ ID NO: 233286 - DNA, 25 bp, Mus musculus
atagtgtggcctttgggacagatca

SEQ ID NO: 233287 - DNA, 25 bp, Mus musculus
atagtgtgtcttatcgtttcccagt

SEQ ID NO: 233288 - DNA, 25 bp, Mus musculus
atagtgtgtcttttcgtttcccagt

SEQ ID NO: 233289 - DNA, 25 bp, Mus musculus
atagtgtgtgcccttgcccaggtgt

SEQ ID NO: 233290 - DNA, 25 bp, Mus musculus
atagtgtgtgccgttgcccaggtgt

SEQ ID NO: 233291 - DNA, 25 bp, Mus musculus
atagtgtgtgctatgccatttggaa

SEQ ID NO: 233292 - DNA, 25 bp, Mus musculus
atagtgtgtgctttgccatttggaa

SEQ ID NO: 233293 - DNA, 25 bp, Mus musculus
atagtgtgtgtacatctttcgatga

SEQ ID NO: 233294 - DNA, 25 bp, Mus musculus
atagtgtgtgtagatctttcgatga

SEQ ID NO: 233295 - DNA, 25 bp, Mus musculus
atagtgtgtgttcctactgtgcttc

SEQ ID NO: 233296 - DNA, 25 bp, Mus musculus
atagtgtgtgttgctactgtgcttc

SEQ ID NO: 233297 - DNA, 25 bp, Mus musculus
atagtgtgttttaagagggctccaa

SEQ ID NO: 233298 - DNA, 25 bp, Mus musculus
atagtgtgtttttagagggctccaa

SEQ ID NO: 233299 - DNA, 25 bp, Mus musculus
atagtgttaacaagcttagttgcaa

SEQ ID NO: 233300 - DNA, 25 bp, Mus musculus
atagtgttaacatgcttagttgcaa

SEQ ID NO: 233301 - DNA, 25 bp, Mus musculus
atagtgttacttcacccgggctggc

SEQ ID NO: 233302 - DNA, 25 bp, Mus musculus
atagtgttacttgacccgggctggc

SEQ ID NO: 233303 - DNA, 25 bp, Mus musculus
atagtgttcacaagagtccttttct

SEQ ID NO: 233304 - DNA, 25 bp, Mus musculus
atagtgttcacatgagtccttttct

SEQ ID NO: 233305 - DNA, 25 bp, Mus musculus
atagtgttctctatcaccctgatct

SEQ ID NO: 233306 - DNA, 25 bp, Mus musculus
atagtgttctctttcaccctgatct

SEQ ID NO: 233307 - DNA, 25 bp, Mus musculus
atagtgttcttcacttgaactaatc

SEQ ID NO: 233308 - DNA, 25 bp, Mus musculus
atagtgttcttctcttgaactaatc

SEQ ID NO: 233309 - DNA, 25 bp, Mus musculus
atagtgttggacaagccttctccca

SEQ ID NO: 233310 - DNA, 25 bp, Mus musculus
atagtgttggactagccttctccca

SEQ ID NO: 233311 - DNA, 25 bp, Mus musculus
atagtgttggttcactcatctccag

SEQ ID NO: 233312 - DNA, 25 bp, Mus musculus
atagtgttggttgactcatctccag

SEQ ID NO: 233313 - DNA, 25 bp, Mus musculus
atagtgtttagaattcaaggtccct

SEQ ID NO: 233314 - DNA, 25 bp, Mus musculus
atagtgtttagatttcaaggtccct

SEQ ID NO: 233315 - DNA, 25 bp, Mus musculus
atagttaacaatcctcatggcccgg

SEQ ID NO: 233316 - DNA, 25 bp, Mus musculus
atagttaacaatgctcatggcccgg

SEQ ID NO: 233317 - DNA, 25 bp, Mus musculus
atagttaatgtgaccaggtgtatcc

SEQ ID NO: 233318 - DNA, 25 bp, Mus musculus
atagttaatgtgtccaggtgtatcc

SEQ ID NO: 233319 - DNA, 25 bp, Mus musculus
atagttacagatcctctgtaattct

SEQ ID NO: 233320 - DNA, 25 bp, Mus musculus
atagttacagatgctctgtaattct

SEQ ID NO: 233321 - DNA, 25 bp, Mus musculus
atagttacattacacatttagcaag

SEQ ID NO: 233322 - DNA, 25 bp, Mus musculus
atagttacattagacatttagcaag

SEQ ID NO: 233323 - DNA, 25 bp, Mus musculus
atagttactatactttcctttgtct

SEQ ID NO: 233324 - DNA, 25 bp, Mus musculus
atagttactatagtttcctttgtct

SEQ ID NO: 233325 - DNA, 25 bp, Mus musculus
atagttactcggattgctcgggcaa

SEQ ID NO: 233326 - DNA, 25 bp, Mus musculus
atagttactcggtttgctcgggcaa

SEQ ID NO: 233327 - DNA, 25 bp, Mus musculus
atagttagatccattgagtagtcat

SEQ ID NO: 233328 - DNA, 25 bp, Mus musculus
atagttagatcctttgagtagtcat

SEQ ID NO: 233329 - DNA, 25 bp, Mus musculus
atagttagttccatcacgtctttgt

SEQ ID NO: 233330 - DNA, 25 bp, Mus musculus
atagttagttccttcacgtctttgt

SEQ ID NO: 233331 - DNA, 25 bp, Mus musculus
atagttagtttcacagaccatctgg

SEQ ID NO: 233332 - DNA, 25 bp, Mus musculus
atagttagtttctcagaccatctgg

SEQ ID NO: 233333 - DNA, 25 bp, Mus musculus
atagttatcccacgaggttgaccct

SEQ ID NO: 233334 - DNA, 25 bp, Mus musculus
atagttatcccaggaggttgaccct

SEQ ID NO: 233335 - DNA, 25 bp, Mus musculus
atagttattaccatcctgaggggag

SEQ ID NO: 233336 - DNA, 25 bp, Mus musculus
atagttattaccttcctgaggggag

SEQ ID NO: 233337 - DNA, 25 bp, Mus musculus
atagttattattcctgatgggcaat

SEQ ID NO: 233338 - DNA, 25 bp, Mus musculus
atagttattattgctgatgggcaat

SEQ ID NO: 233339 - DNA, 25 bp, Mus musculus
atagttattgtaatcttctggcctg

SEQ ID NO: 233340 - DNA, 25 bp, Mus musculus
atagttattgtattcttctggcctg

SEQ ID NO: 233341 - DNA, 25 bp, Mus musculus
atagttatttccctggcccaagagt

SEQ ID NO: 233342 - DNA, 25 bp, Mus musculus
atagttatttccgtggcccaagagt

SEQ ID NO: 233343 - DNA, 25 bp, Mus musculus
atagttcaaaatcttcccacaggga

SEQ ID NO: 233344 - DNA, 25 bp, Mus musculus
atagttcaaaatgttcccacaggga

SEQ ID NO: 233345 - DNA, 25 bp, Mus musculus
atagttcacccaacttgcacatgcg

SEQ ID NO: 233346 - DNA, 25 bp, Mus musculus
atagttcacccatcttgcacatgcg

SEQ ID NO: 233347 - DNA, 25 bp, Mus musculus
atagttcagttcactgcacctgaga

SEQ ID NO: 233348 - DNA, 25 bp, Mus musculus
atagttcagttctctgcacctgaga

SEQ ID NO: 233349 - DNA, 25 bp, Mus musculus
atagttcatgctatctgcctctgtg

SEQ ID NO: 233350 - DNA, 25 bp, Mus musculus
atagttcatgctttctgcctctgtg

SEQ ID NO: 233351 - DNA, 25 bp, Mus musculus
atagttcatgtcaatgtctgaccaa

SEQ ID NO: 233352 - DNA, 25 bp, Mus musculus
atagttcatgtctatgtctgaccaa

SEQ ID NO: 233353 - DNA, 25 bp, Mus musculus
atagttcattatatatcccttccct

SEQ ID NO: 233354 - DNA, 25 bp, Mus musculus
atagttcattatttatcccttccct

SEQ ID NO: 233355 - DNA, 25 bp, Mus musculus
atagttccacaaccaatcatgtagg

SEQ ID NO: 233356 - DNA, 25 bp, Mus musculus
atagttccacaagcaatcatgtagg

SEQ ID NO: 233357 - DNA, 25 bp, Mus musculus
atagttccacttaccagtctggatg

SEQ ID NO: 233358 - DNA, 25 bp, Mus musculus
atagttccactttccagtctggatg

SEQ ID NO: 233359 - DNA, 25 bp, Mus musculus
atagttcccacgagactggattagt

SEQ ID NO: 233360 - DNA, 25 bp, Mus musculus
atagttcccacgtgactggattagt

SEQ ID NO: 233361 - DNA, 25 bp, Mus musculus
atagttccccatacacagtgcattt

SEQ ID NO: 233362 - DNA, 25 bp, Mus musculus
atagttccccattcacagtgcattt

SEQ ID NO: 233363 - DNA, 25 bp, Mus musculus
atagttcccctactcaatgtggact

SEQ ID NO: 233364 - DNA, 25 bp, Mus musculus
atagttcccctagtcaatgtggact

SEQ ID NO: 233365 - DNA, 25 bp, Mus musculus
atagttcccggaaacatttgcccag

SEQ ID NO: 233366 - DNA, 25 bp, Mus musculus
atagttcccggatacatttgcccag

SEQ ID NO: 233367 - DNA, 25 bp, Mus musculus
atagttcctaatctagtccatgtgt

SEQ ID NO: 233368 - DNA, 25 bp, Mus musculus
atagttcctaatgtagtccatgtgt

SEQ ID NO: 233369 - DNA, 25 bp, Mus musculus
atagttcctatgatctgccagaaac

SEQ ID NO: 233370 - DNA, 25 bp, Mus musculus
atagttcctatgttctgccagaaac

SEQ ID NO: 233371 - DNA, 25 bp, Mus musculus
atagttcctcacatggttccgctac

SEQ ID NO: 233372 - DNA, 25 bp, Mus musculus
atagttcctcacttggttccgctac

SEQ ID NO: 233373 - DNA, 25 bp, Mus musculus
atagttcctgagattgtggttagat

SEQ ID NO: 233374 - DNA, 25 bp, Mus musculus
atagttcctgagtttgtggttagat

SEQ ID NO: 233375 - DNA, 25 bp, Mus musculus
atagttccttgtcagagtggcttat

SEQ ID NO: 233376 - DNA, 25 bp, Mus musculus
atagttccttgtgagagtggcttat

SEQ ID NO: 233377 - DNA, 25 bp, Mus musculus
atagttcgcggtatcttccactcag

SEQ ID NO: 233378 - DNA, 25 bp, Mus musculus
atagttcgcggtttcttccactcag

SEQ ID NO: 233379 - DNA, 25 bp, Mus musculus
atagttctaaatcttctgagttcca

SEQ ID NO: 233380 - DNA, 25 bp, Mus musculus
atagttctaaatgttctgagttcca

SEQ ID NO: 233381 - DNA, 25 bp, Mus musculus
atagttctacacatggaaatttttt

SEQ ID NO: 233382 - DNA, 25 bp, Mus musculus
atagttctacacttggaaatttttt

SEQ ID NO: 233383 - DNA, 25 bp, Mus musculus
atagttctaccaatgtagccgatgt

SEQ ID NO: 233384 - DNA, 25 bp, Mus musculus
atagttctaccattgtagccgatgt

SEQ ID NO: 233385 - DNA, 25 bp, Mus musculus
atagttctactcaatgctctcctta

SEQ ID NO: 233386 - DNA, 25 bp, Mus musculus
atagttctactctatgctctcctta

SEQ ID NO: 233387 - DNA, 25 bp, Mus musculus
atagttctaggtatacaacagagag

SEQ ID NO: 233388 - DNA, 25 bp, Mus musculus
atagttctaggtttacaacagagag

SEQ ID NO: 233389 - DNA, 25 bp, Mus musculus
atagttctatatatctgtatggtgg

SEQ ID NO: 233390 - DNA, 25 bp, Mus musculus
atagttctatatttctgtatggtgg

SEQ ID NO: 233391 - DNA, 25 bp, Mus musculus
atagttctcacaataacatacttag

SEQ ID NO: 233392 - DNA, 25 bp, Mus musculus
atagttctcacattaacatacttag

SEQ ID NO: 233393 - DNA, 25 bp, Mus musculus
atagttctcatcaactggtgacatg

SEQ ID NO: 233394 - DNA, 25 bp, Mus musculus
atagttctcatctactggtgacatg

SEQ ID NO: 233395 - DNA, 25 bp, Mus musculus
atagttctctaaccttgtttaccaa

SEQ ID NO: 233396 - DNA, 25 bp, Mus musculus
atagttctctaagcttgtttaccaa

SEQ ID NO: 233397 - DNA, 25 bp, Mus musculus
atagttctctatcatgttgccctta

SEQ ID NO: 233398 - DNA, 25 bp, Mus musculus
atagttctctatgatgttgccctta

SEQ ID NO: 233399 - DNA, 25 bp, Mus musculus
atagttctgtgaaatgtcctccaaa

SEQ ID NO: 233400 - DNA, 25 bp, Mus musculus
atagttctgtgatatgtcctccaaa

SEQ ID NO: 233401 - DNA, 25 bp, Mus musculus
atagttcttagccatgtattgcaaa

SEQ ID NO: 233402 - DNA, 25 bp, Mus musculus
atagttcttagcgatgtattgcaaa

SEQ ID NO: 233403 - DNA, 25 bp, Mus musculus
atagttcttaggaagctggcttgct

SEQ ID NO: 233404 - DNA, 25 bp, Mus musculus
atagttcttaggtagctggcttgct

SEQ ID NO: 233405 - DNA, 25 bp, Mus musculus
atagttcttcccacattttgatcag

SEQ ID NO: 233406 - DNA, 25 bp, Mus musculus
atagttcttccctcattttgatcag

SEQ ID NO: 233407 - DNA, 25 bp, Mus musculus
atagttctttgcatgttaacatcac

SEQ ID NO: 233408 - DNA, 25 bp, Mus musculus
atagttctttgcttgttaacatcac

SEQ ID NO: 233409 - DNA, 25 bp, Mus musculus
atagttgaaataatgatttcctctc

SEQ ID NO: 233410 - DNA, 25 bp, Mus musculus
atagttgaaatattgatttcctctc

SEQ ID NO: 233411 - DNA, 25 bp, Mus musculus
atagttgaagctcatcccatgccta

SEQ ID NO: 233412 - DNA, 25 bp, Mus musculus
atagttgaagctgatcccatgccta

SEQ ID NO: 233413 - DNA, 25 bp, Mus musculus
atagttgagagccaccccgaggatg

SEQ ID NO: 233414 - DNA, 25 bp, Mus musculus
atagttgagagcgaccccgaggatg

SEQ ID NO: 233415 - DNA, 25 bp, Mus musculus
atagttgagccaccagacattgtca

SEQ ID NO: 233416 - DNA, 25 bp, Mus musculus
atagttgagccagcagacattgtca

SEQ ID NO: 233417 - DNA, 25 bp, Mus musculus
atagttgagccccacacaggttctt

SEQ ID NO: 233418 - DNA, 25 bp, Mus musculus
atagttgagcccgacacaggttctt

SEQ ID NO: 233419 - DNA, 25 bp, Mus musculus
atagttgaggaacacttagaacgtc

SEQ ID NO: 233420 - DNA, 25 bp, Mus musculus
atagttgaggaagacttagaacgtc

SEQ ID NO: 233421 - DNA, 25 bp, Mus musculus
atagttgaggttcctgtatccattt

SEQ ID NO: 233422 - DNA, 25 bp, Mus musculus
atagttgaggttgctgtatccattt

SEQ ID NO: 233423 - DNA, 25 bp, Mus musculus
atagttgatgagatagtaaattcca

SEQ ID NO: 233424 - DNA, 25 bp, Mus musculus
atagttgatgagttagtaaattcca

SEQ ID NO: 233425 - DNA, 25 bp, Mus musculus
atagttgatgtgagcagcgccagct

SEQ ID NO: 233426 - DNA, 25 bp, Mus musculus
atagttgatgtgtgcagcgccagct

SEQ ID NO: 233427 - DNA, 25 bp, Mus musculus
atagttgcaaatacaccatttctta

SEQ ID NO: 233428 - DNA, 25 bp, Mus musculus
atagttgcaaattcaccatttctta

SEQ ID NO: 233429 - DNA, 25 bp, Mus musculus
atagttgcaagtcggaggccagccc

SEQ ID NO: 233430 - DNA, 25 bp, Mus musculus
atagttgcaagtgggaggccagccc

SEQ ID NO: 233431 - DNA, 25 bp, Mus musculus
atagttgcacttcattaccgttctc

SEQ ID NO: 233432 - DNA, 25 bp, Mus musculus
atagttgcacttgattaccgttctc

SEQ ID NO: 233433 - DNA, 25 bp, Mus musculus
atagttgcagcacaggattccaccc

SEQ ID NO: 233434 - DNA, 25 bp, Mus musculus
atagttgcagcagaggattccaccc

SEQ ID NO: 233435 - DNA, 25 bp, Mus musculus
atagttgcatatatgtggtctggaa

SEQ ID NO: 233436 - DNA, 25 bp, Mus musculus
atagttgcatatttgtggtctggaa

SEQ ID NO: 233437 - DNA, 25 bp, Mus musculus
atagttgccagcaacttgtgggcag

SEQ ID NO: 233438 - DNA, 25 bp, Mus musculus
atagttgccagctacttgtgggcag

SEQ ID NO: 233439 - DNA, 25 bp, Mus musculus
atagttgccccaaagatcctgactg

SEQ ID NO: 233440 - DNA, 25 bp, Mus musculus
atagttgccccatagatcctgactg

SEQ ID NO: 233441 - DNA, 25 bp, Mus musculus
atagttgcctccacgggccaataaa

SEQ ID NO: 233442 - DNA, 25 bp, Mus musculus
atagttgcctcctcgggccaataaa

SEQ ID NO: 233443 - DNA, 25 bp, Mus musculus
atagttgcttacaggctgagaggca

SEQ ID NO: 233444 - DNA, 25 bp, Mus musculus
atagttgcttactggctgagaggca

SEQ ID NO: 233445 - DNA, 25 bp, Mus musculus
atagttgggactatatcctctgaag

SEQ ID NO: 233446 - DNA, 25 bp, Mus musculus
atagttgggactttatcctctgaag

SEQ ID NO: 233447 - DNA, 25 bp, Mus musculus
atagttgggctcatcgctggttctt

SEQ ID NO: 233448 - DNA, 25 bp, Mus musculus
atagttgggctcttcgctggttctt

SEQ ID NO: 233449 - DNA, 25 bp, Mus musculus
atagttggtctcatatttattgtga

SEQ ID NO: 233450 - DNA, 25 bp, Mus musculus
atagttggtctcttatttattgtga

SEQ ID NO: 233451 - DNA, 25 bp, Mus musculus
atagttggtggtaaagcttatgaga

SEQ ID NO: 233452 - DNA, 25 bp, Mus musculus
atagttggtggttaagcttatgaga

SEQ ID NO: 233453 - DNA, 25 bp, Mus musculus
atagttgtaaaacctggacccagtt

SEQ ID NO: 233454 - DNA, 25 bp, Mus musculus
atagttgtaaaagctggacccagtt

SEQ ID NO: 233455 - DNA, 25 bp, Mus musculus
atagttgtaagcaggtcaggtggtt

SEQ ID NO: 233456 - DNA, 25 bp, Mus musculus
atagttgtaagctggtcaggtggtt

SEQ ID NO: 233457 - DNA, 25 bp, Mus musculus
atagttgtaggaagcatcagccttt

SEQ ID NO: 233458 - DNA, 25 bp, Mus musculus
atagttgtaggatgcatcagccttt

SEQ ID NO: 233459 - DNA, 25 bp, Mus musculus
atagttgtcagcacaatgcatgttc

SEQ ID NO: 233460 - DNA, 25 bp, Mus musculus
atagttgtcagctcaatgcatgttc

SEQ ID NO: 233461 - DNA, 25 bp, Mus musculus
atagttgtctgtcacgttgtctctg

SEQ ID NO: 233462 - DNA, 25 bp, Mus musculus
atagttgtctgtgacgttgtctctg

SEQ ID NO: 233463 - DNA, 25 bp, Mus musculus
atagttgtgccaccatcgccggagt

SEQ ID NO: 233464 - DNA, 25 bp, Mus musculus
atagttgtgccagcatcgccggagt

SEQ ID NO: 233465 - DNA, 25 bp, Mus musculus
atagttgtggaaccagcagcgtgat

SEQ ID NO: 233466 - DNA, 25 bp, Mus musculus
atagttgtggaagcagcagcgtgat

SEQ ID NO: 233467 - DNA, 25 bp, Mus musculus
atagttgtgttactctctcctggaa

SEQ ID NO: 233468 - DNA, 25 bp, Mus musculus
atagttgtgttagtctctcctggaa

SEQ ID NO: 233469 - DNA, 25 bp, Mus musculus
atagttgttatcagtgccttggacc

SEQ ID NO: 233470 - DNA, 25 bp, Mus musculus
atagttgttatctgtgccttggacc

SEQ ID NO: 233471 - DNA, 25 bp, Mus musculus
atagttgttcttattgaggatccac

SEQ ID NO: 233472 - DNA, 25 bp, Mus musculus
atagttgttctttttgaggatccac

SEQ ID NO: 233473 - DNA, 25 bp, Mus musculus
atagttgtttccaaggtcagtgaac

SEQ ID NO: 233474 - DNA, 25 bp, Mus musculus
atagttgtttcctaggtcagtgaac

SEQ ID NO: 233475 - DNA, 25 bp, Mus musculus
atagttgtttgtcccgaagcgtctc

SEQ ID NO: 233476 - DNA, 25 bp, Mus musculus
atagttgtttgtgccgaagcgtctc

SEQ ID NO: 233477 - DNA, 25 bp, Mus musculus
atagtttaaaatatccagtagctga

SEQ ID NO: 233478 - DNA, 25 bp, Mus musculus
atagtttaaaatttccagtagctga

SEQ ID NO: 233479 - DNA, 25 bp, Mus musculus
atagtttagcttaccgctcatttga

SEQ ID NO: 233480 - DNA, 25 bp, Mus musculus
atagtttagctttccgctcatttga

SEQ ID NO: 233481 - DNA, 25 bp, Mus musculus
atagtttagtatcgcagattattag

SEQ ID NO: 233482 - DNA, 25 bp, Mus musculus
atagtttagtatggcagattattag

SEQ ID NO: 233483 - DNA, 25 bp, Mus musculus
atagtttattcacctgcaacaggac

SEQ ID NO: 233484 - DNA, 25 bp, Mus musculus
atagtttattcagctgcaacaggac

SEQ ID NO: 233485 - DNA, 25 bp, Mus musculus
atagtttcaagaatcactccggctc

SEQ ID NO: 233486 - DNA, 25 bp, Mus musculus
atagtttcaagattcactccggctc

SEQ ID NO: 233487 - DNA, 25 bp, Mus musculus
atagtttcagcaatgtcggtcctca

SEQ ID NO: 233488 - DNA, 25 bp, Mus musculus
atagtttcagcattgtcggtcctca

SEQ ID NO: 233489 - DNA, 25 bp, Mus musculus
atagtttccctgaagccacatagct

SEQ ID NO: 233490 - DNA, 25 bp, Mus musculus
atagtttccctgtagccacatagct

SEQ ID NO: 233491 - DNA, 25 bp, Mus musculus
atagtttcctctagagcaccatgct

SEQ ID NO: 233492 - DNA, 25 bp, Mus musculus
atagtttcctcttgagcaccatgct

SEQ ID NO: 233493 - DNA, 25 bp, Mus musculus
atagtttctatgcacttttcccact

SEQ ID NO: 233494 - DNA, 25 bp, Mus musculus
atagtttctatggacttttcccact

SEQ ID NO: 233495 - DNA, 25 bp, Mus musculus
atagtttctgaaccaccacatgctc

SEQ ID NO: 233496 - DNA, 25 bp, Mus musculus
atagtttctgaagcaccacatgctc

SEQ ID NO: 233497 - DNA, 25 bp, Mus musculus
atagtttctgcaaattagtctttag

SEQ ID NO: 233498 - DNA, 25 bp, Mus musculus
atagtttctgcatattagtctttag

SEQ ID NO: 233499 - DNA, 25 bp, Mus musculus
atagtttcttggagccagtggttcc

SEQ ID NO: 233500 - DNA, 25 bp, Mus musculus
atagtttcttggtgccagtggttcc

SEQ ID NO: 233501 - DNA, 25 bp, Mus musculus
atagtttctttcagtagagcacggt

SEQ ID NO: 233502 - DNA, 25 bp, Mus musculus
atagtttctttctgtagagcacggt

SEQ ID NO: 233503 - DNA, 25 bp, Mus musculus
atagtttgaacactctttctcccct

SEQ ID NO: 233504 - DNA, 25 bp, Mus musculus
atagtttgaacagtctttctcccct

SEQ ID NO: 233505 - DNA, 25 bp, Mus musculus
atagtttgctttaacttcagagtat

SEQ ID NO: 233506 - DNA, 25 bp, Mus musculus
atagtttgcttttacttcagagtat

SEQ ID NO: 233507 - DNA, 25 bp, Mus musculus
atagtttggcttccacgctaagtca

SEQ ID NO: 233508 - DNA, 25 bp, Mus musculus
atagtttggcttgcacgctaagtca

SEQ ID NO: 233509 - DNA, 25 bp, Mus musculus
atagtttgtcaaacacctgttccca

SEQ ID NO: 233510 - DNA, 25 bp, Mus musculus
atagtttgtcaatcacctgttccca

SEQ ID NO: 233511 - DNA, 25 bp, Mus musculus
atagtttgtcacagccctgctcttt

SEQ ID NO: 233512 - DNA, 25 bp, Mus musculus
atagtttgtcactgccctgctcttt

SEQ ID NO: 233513 - DNA, 25 bp, Mus musculus
atagtttgtgggacttacttggaga

SEQ ID NO: 233514 - DNA, 25 bp, Mus musculus
atagtttgtgggtcttacttggaga

SEQ ID NO: 233515 - DNA, 25 bp, Mus musculus
atagtttgttgaatctaaagtccaa

SEQ ID NO: 233516 - DNA, 25 bp, Mus musculus
atagtttgttgattctaaagtccaa

SEQ ID NO: 233517 - DNA, 25 bp, Mus musculus
atagtttgttttcttgatccgcctc

SEQ ID NO: 233518 - DNA, 25 bp, Mus musculus
atagtttgttttgttgatccgcctc

SEQ ID NO: 233519 - DNA, 25 bp, Mus musculus
atagttttcaaaagtgttatctcac

SEQ ID NO: 233520 - DNA, 25 bp, Mus musculus
atagttttcaaatgtgttatctcac

SEQ ID NO: 233521 - DNA, 25 bp, Mus musculus
atagttttcagcacaattccggtct

SEQ ID NO: 233522 - DNA, 25 bp, Mus musculus
atagttttcagctcaattccggtct

SEQ ID NO: 233523 - DNA, 25 bp, Mus musculus
atagttttccctacaagtcaagcgt

SEQ ID NO: 233524 - DNA, 25 bp, Mus musculus
atagttttcccttcaagtcaagcgt

SEQ ID NO: 233525 - DNA, 25 bp, Mus musculus
atagttttgattatgtctcctgccc

SEQ ID NO: 233526 - DNA, 25 bp, Mus musculus
atagttttgattttgtctcctgccc

SEQ ID NO: 233527 - DNA, 25 bp, Mus musculus
atagttttgccccatcaacatcaca

SEQ ID NO: 233528 - DNA, 25 bp, Mus musculus
atagttttgcccgatcaacatcaca

SEQ ID NO: 233529 - DNA, 25 bp, Mus musculus
atagttttgtacatttctaccatgt

SEQ ID NO: 233530 - DNA, 25 bp, Mus musculus
atagttttgtacttttctaccatgt

SEQ ID NO: 233531 - DNA, 25 bp, Mus musculus
atagtttttctcatacttcagtatg

SEQ ID NO: 233532 - DNA, 25 bp, Mus musculus
atagtttttctcttacttcagtatg

SEQ ID NO: 233533 - DNA, 25 bp, Mus musculus
atataaaacaccaggctgcactcgc

SEQ ID NO: 233534 - DNA, 25 bp, Mus musculus
atataaaacacctggctgcactcgc

SEQ ID NO: 233535 - DNA, 25 bp, Mus musculus
atataaaacactactctctagtaaa

SEQ ID NO: 233536 - DNA, 25 bp, Mus musculus
atataaaacacttctctctagtaaa

SEQ ID NO: 233537 - DNA, 25 bp, Mus musculus
atataaaacagccttcgtctccgga

SEQ ID NO: 233538 - DNA, 25 bp, Mus musculus
atataaaacagcgttcgtctccgga

SEQ ID NO: 233539 - DNA, 25 bp, Mus musculus
atataaaactgtaagacattgggtt

SEQ ID NO: 233540 - DNA, 25 bp, Mus musculus
atataaaactgttagacattgggtt

SEQ ID NO: 233541 - DNA, 25 bp, Mus musculus
atataaaagtgacaccccacccagt

SEQ ID NO: 233542 - DNA, 25 bp, Mus musculus
atataaaagtgagaccccacccagt

SEQ ID NO: 233543 - DNA, 25 bp, Mus musculus
atataaaatcctctctaccctcacc

SEQ ID NO: 233544 - DNA, 25 bp, Mus musculus
atataaaatcctgtctaccctcacc

SEQ ID NO: 233545 - DNA, 25 bp, Mus musculus
atataaaatggtatatctgccctgc

SEQ ID NO: 233546 - DNA, 25 bp, Mus musculus
atataaaatggtttatctgccctgc

SEQ ID NO: 233547 - DNA, 25 bp, Mus musculus
atataaaatgtcctgtcctttctca

SEQ ID NO: 233548 - DNA, 25 bp, Mus musculus
atataaaatgtcgtgtcctttctca

SEQ ID NO: 233549 - DNA, 25 bp, Mus musculus
atataaacccctagcaactgtgttt

SEQ ID NO: 233550 - DNA, 25 bp, Mus musculus
atataaaccccttgcaactgtgttt

SEQ ID NO: 233551 - DNA, 25 bp, Mus musculus
atataaacctgtagaactcttacgt

SEQ ID NO: 233552 - DNA, 25 bp, Mus musculus
atataaacctgttgaactcttacgt

SEQ ID NO: 233553 - DNA, 25 bp, Mus musculus
atataaacttgtccgaagcgccacc

SEQ ID NO: 233554 - DNA, 25 bp, Mus musculus
atataaacttgtgcgaagcgccacc

SEQ ID NO: 233555 - DNA, 25 bp, Mus musculus
atataaacttttccttcatccttag

SEQ ID NO: 233556 - DNA, 25 bp, Mus musculus
atataaacttttgcttcatccttag

SEQ ID NO: 233557 - DNA, 25 bp, Mus musculus
atataaagcctgagtggctctctgt

SEQ ID NO: 233558 - DNA, 25 bp, Mus musculus
atataaagcctgtgtggctctctgt

SEQ ID NO: 233559 - DNA, 25 bp, Mus musculus
atataaagttctctcctgtgccctg

SEQ ID NO: 233560 - DNA, 25 bp, Mus musculus
atataaagttctgtcctgtgccctg

SEQ ID NO: 233561 - DNA, 25 bp, Mus musculus
atataaagtttaagtccacctagac

SEQ ID NO: 233562 - DNA, 25 bp, Mus musculus
atataaagtttatgtccacctagac

SEQ ID NO: 233563 - DNA, 25 bp, Mus musculus
atataaataatactcctactgtgga

SEQ ID NO: 233564 - DNA, 25 bp, Mus musculus
atataaataatagtcctactgtgga

SEQ ID NO: 233565 - DNA, 25 bp, Mus musculus
atataaatactgacacgggccctat

SEQ ID NO: 233566 - DNA, 25 bp, Mus musculus
atataaatactgtcacgggccctat

SEQ ID NO: 233567 - DNA, 25 bp, Mus musculus
atataaatcctaacgggccacatag

SEQ ID NO: 233568 - DNA, 25 bp, Mus musculus
atataaatcctatcgggccacatag

SEQ ID NO: 233569 - DNA, 25 bp, Mus musculus
atataaatctccctggcagcttcca

SEQ ID NO: 233570 - DNA, 25 bp, Mus musculus
atataaatctccgtggcagcttcca

SEQ ID NO: 233571 - DNA, 25 bp, Mus musculus
atataaatttaactgatggcctctt

SEQ ID NO: 233572 - DNA, 25 bp, Mus musculus
atataaatttaagtgatggcctctt

SEQ ID NO: 233573 - DNA, 25 bp, Mus musculus
atataacagaaaaaaccccaccatt

SEQ ID NO: 233574 - DNA, 25 bp, Mus musculus
atataacagaaataaccccaccatt

SEQ ID NO: 233575 - DNA, 25 bp, Mus musculus
atataacagacacagactccaagca

SEQ ID NO: 233576 - DNA, 25 bp, Mus musculus
atataacagacacccacaaccgaag

SEQ ID NO: 233577 - DNA, 25 bp, Mus musculus
atataacagacagagactccaagca

SEQ ID NO: 233578 - DNA, 25 bp, Mus musculus
atataacagacagccacaaccgaag

SEQ ID NO: 233579 - DNA, 25 bp, Mus musculus
atataacaggcaactcctgcagaca

SEQ ID NO: 233580 - DNA, 25 bp, Mus musculus
atataacaggcatctcctgcagaca

SEQ ID NO: 233581 - DNA, 25 bp, Mus musculus
atataacataacactgggcctggac

SEQ ID NO: 233582 - DNA, 25 bp, Mus musculus
atataacataactctgggcctggac

SEQ ID NO: 233583 - DNA, 25 bp, Mus musculus
atataacatgctagtggattgccac

SEQ ID NO: 233584 - DNA, 25 bp, Mus musculus
atataacatgcttgtggattgccac

SEQ ID NO: 233585 - DNA, 25 bp, Mus musculus
atataaccactccatacacttaggc

SEQ ID NO: 233586 - DNA, 25 bp, Mus musculus
atataaccactcgatacacttaggc

SEQ ID NO: 233587 - DNA, 25 bp, Mus musculus
atataaccatcacgatacctcgatt

SEQ ID NO: 233588 - DNA, 25 bp, Mus musculus
atataaccatcaggatacctcgatt

SEQ ID NO: 233589 - DNA, 25 bp, Mus musculus
atataaccccatcatccttactgtt

SEQ ID NO: 233590 - DNA, 25 bp, Mus musculus
atataaccccatgatccttactgtt

SEQ ID NO: 233591 - DNA, 25 bp, Mus musculus
atataaccctcaacttctcatttta

SEQ ID NO: 233592 - DNA, 25 bp, Mus musculus
atataaccctcatcttctcatttta

SEQ ID NO: 233593 - DNA, 25 bp, Mus musculus
atataacctactagccatctgccgt

SEQ ID NO: 233594 - DNA, 25 bp, Mus musculus
atataacctacttgccatctgccgt

SEQ ID NO: 233595 - DNA, 25 bp, Mus musculus
atataacctgctctcagaagcctga

SEQ ID NO: 233596 - DNA, 25 bp, Mus musculus
atataacctgctgtcagaagcctga

SEQ ID NO: 233597 - DNA, 25 bp, Mus musculus
atataacctgtacctattgtcgtgg

SEQ ID NO: 233598 - DNA, 25 bp, Mus musculus
atataacctgtagctattgtcgtgg

SEQ ID NO: 233599 - DNA, 25 bp, Mus musculus
atataacctttgagtaaccctgact

SEQ ID NO: 233600 - DNA, 25 bp, Mus musculus
atataacctttgtgtaaccctgact

SEQ ID NO: 233601 - DNA, 25 bp, Mus musculus
atataactcccgagctttgaacagc

SEQ ID NO: 233602 - DNA, 25 bp, Mus musculus
atataactcccgtgctttgaacagc

SEQ ID NO: 233603 - DNA, 25 bp, Mus musculus
atataactgatgctcggctctctga

SEQ ID NO: 233604 - DNA, 25 bp, Mus musculus
atataactgatggtcggctctctga

SEQ ID NO: 233605 - DNA, 25 bp, Mus musculus
atataagaccatagtcccaatccct

SEQ ID NO: 233606 - DNA, 25 bp, Mus musculus
atataagaccattgtcccaatccct

SEQ ID NO: 233607 - DNA, 25 bp, Mus musculus
atataagagaagatactccggtcag

SEQ ID NO: 233608 - DNA, 25 bp, Mus musculus
atataagagaagttactccggtcag

SEQ ID NO: 233609 - DNA, 25 bp, Mus musculus
atataagcactcaccaagcagttgg

SEQ ID NO: 233610 - DNA, 25 bp, Mus musculus
atataagcactctccaagcagttgg

SEQ ID NO: 233611 - DNA, 25 bp, Mus musculus
atataagcagtacaattggcaaata

SEQ ID NO: 233612 - DNA, 25 bp, Mus musculus
atataagcagtagaattggcaaata

SEQ ID NO: 233613 - DNA, 25 bp, Mus musculus
atataagcccttcctctttatggat

SEQ ID NO: 233614 - DNA, 25 bp, Mus musculus
atataagcccttgctctttatggat

SEQ ID NO: 233615 - DNA, 25 bp, Mus musculus
atataagcctacagggcattttatt

SEQ ID NO: 233616 - DNA, 25 bp, Mus musculus
atataagcctactgggcattttatt

SEQ ID NO: 233617 - DNA, 25 bp, Mus musculus
atataaggagaccagctcccaggcc

SEQ ID NO: 233618 - DNA, 25 bp, Mus musculus
atataaggagacgagctcccaggcc

SEQ ID NO: 233619 - DNA, 25 bp, Mus musculus
atataaggccttagtatctcactac

SEQ ID NO: 233620 - DNA, 25 bp, Mus musculus
atataaggcctttgtatctcactac

SEQ ID NO: 233621 - DNA, 25 bp, Mus musculus
atataaggcgtcatgcacagtgcct

SEQ ID NO: 233622 - DNA, 25 bp, Mus musculus
atataaggcgtcttgcacagtgcct

SEQ ID NO: 233623 - DNA, 25 bp, Mus musculus
atataaggctacactgtcacgcttt

SEQ ID NO: 233624 - DNA, 25 bp, Mus musculus
atataaggctactctgtcacgcttt

SEQ ID NO: 233625 - DNA, 25 bp, Mus musculus
atataagtatcacaccccctttaag

SEQ ID NO: 233626 - DNA, 25 bp, Mus musculus
atataagtatcagaccccctttaag

SEQ ID NO: 233627 - DNA, 25 bp, Mus musculus
atataagtggtgataggatttctct

SEQ ID NO: 233628 - DNA, 25 bp, Mus musculus
atataagtggtgttaggatttctct

SEQ ID NO: 233629 - DNA, 25 bp, Mus musculus
atataagtgtcgaaagtcacacggg

SEQ ID NO: 233630 - DNA, 25 bp, Mus musculus
atataagtgtcgtaagtcacacggg

SEQ ID NO: 233631 - DNA, 25 bp, Mus musculus
atataataacgtacctatccagact

SEQ ID NO: 233632 - DNA, 25 bp, Mus musculus
atataataacgttcctatccagact

SEQ ID NO: 233633 - DNA, 25 bp, Mus musculus
atataataatatcctctgctgtcct

SEQ ID NO: 233634 - DNA, 25 bp, Mus musculus
atataataatatgctctgctgtcct

SEQ ID NO: 233635 - DNA, 25 bp, Mus musculus
atataatactcaattgtccctcgga

SEQ ID NO: 233636 - DNA, 25 bp, Mus musculus
atataatactcatttgtccctcgga

SEQ ID NO: 233637 - DNA, 25 bp, Mus musculus
atataatatacgaacatagctctat

SEQ ID NO: 233638 - DNA, 25 bp, Mus musculus
atataatatacgtacatagctctat

SEQ ID NO: 233639 - DNA, 25 bp, Mus musculus
atataatatcgtaatcctccttttt

SEQ ID NO: 233640 - DNA, 25 bp, Mus musculus
atataatatcgttatcctccttttt

SEQ ID NO: 233641 - DNA, 25 bp, Mus musculus
atataatcagacaggcagatgcaga

SEQ ID NO: 233642 - DNA, 25 bp, Mus musculus
atataatcagactggcagatgcaga

SEQ ID NO: 233643 - DNA, 25 bp, Mus musculus
atataatctacacaatctccccaat

SEQ ID NO: 233644 - DNA, 25 bp, Mus musculus
atataatctacagaatctccccaat

SEQ ID NO: 233645 - DNA, 25 bp, Mus musculus
atataatgagctcgcatgacacaga

SEQ ID NO: 233646 - DNA, 25 bp, Mus musculus
atataatgagctggcatgacacaga

SEQ ID NO: 233647 - DNA, 25 bp, Mus musculus
atataatgccttacattactctagt

SEQ ID NO: 233648 - DNA, 25 bp, Mus musculus
atataatgccttcatcgtctcatct

SEQ ID NO: 233649 - DNA, 25 bp, Mus musculus
atataatgccttgatcgtctcatct

SEQ ID NO: 233650 - DNA, 25 bp, Mus musculus
atataatgcctttcattactctagt

SEQ ID NO: 233651 - DNA, 25 bp, Mus musculus
atataatgctacctataagtcacat

SEQ ID NO: 233652 - DNA, 25 bp, Mus musculus
atataatgctacgtataagtcacat

SEQ ID NO: 233653 - DNA, 25 bp, Mus musculus
atataatgtgttctaggactatgta

SEQ ID NO: 233654 - DNA, 25 bp, Mus musculus
atataatgtgttgtaggactatgta

SEQ ID NO: 233655 - DNA, 25 bp, Mus musculus
atataatgttgacaatttctgccta

SEQ ID NO: 233656 - DNA, 25 bp, Mus musculus
atataatgttgagaatttctgccta

SEQ ID NO: 233657 - DNA, 25 bp, Mus musculus
atataattcagacccataccaagga

SEQ ID NO: 233658 - DNA, 25 bp, Mus musculus
atataattcagagccataccaagga

SEQ ID NO: 233659 - DNA, 25 bp, Mus musculus
atataattcattccatccagtcata

SEQ ID NO: 233660 - DNA, 25 bp, Mus musculus
atataattcattgcatccagtcata

SEQ ID NO: 233661 - DNA, 25 bp, Mus musculus
atataattccatcgtccttgcattt

SEQ ID NO: 233662 - DNA, 25 bp, Mus musculus
atataattccatggtccttgcattt

SEQ ID NO: 233663 - DNA, 25 bp, Mus musculus
atataattctccatgttgtggtgac

SEQ ID NO: 233664 - DNA, 25 bp, Mus musculus
atataattctccctttctactgctg

SEQ ID NO: 233665 - DNA, 25 bp, Mus musculus
atataattctccgtttctactgctg

SEQ ID NO: 233666 - DNA, 25 bp, Mus musculus
atataattctccttgttgtggtgac

SEQ ID NO: 233667 - DNA, 25 bp, Mus musculus
atataatttaccagttcccaggatt

SEQ ID NO: 233668 - DNA, 25 bp, Mus musculus
atataatttacctgttcccaggatt

SEQ ID NO: 233669 - DNA, 25 bp, Mus musculus
atatacaaaaacattccctgccgca

SEQ ID NO: 233670 - DNA, 25 bp, Mus musculus
atatacaaaaactttccctgccgca

SEQ ID NO: 233671 - DNA, 25 bp, Mus musculus
atatacaaactactggcccaagagc

SEQ ID NO: 233672 - DNA, 25 bp, Mus musculus
atatacaaactagtggcccaagagc

SEQ ID NO: 233673 - DNA, 25 bp, Mus musculus
atatacaaaggaatggctcttcccc

SEQ ID NO: 233674 - DNA, 25 bp, Mus musculus
atatacaaaggattggctcttcccc

SEQ ID NO: 233675 - DNA, 25 bp, Mus musculus
atatacaacgccctgaaactcttca

SEQ ID NO: 233676 - DNA, 25 bp, Mus musculus
atatacaacgccgtgaaactcttca

SEQ ID NO: 233677 - DNA, 25 bp, Mus musculus
atatacaagcacatcacacacatcc

SEQ ID NO: 233678 - DNA, 25 bp, Mus musculus
atatacaagcacttcacacacatcc

SEQ ID NO: 233679 - DNA, 25 bp, Mus musculus
atatacaaggtgacctttctcctgc

SEQ ID NO: 233680 - DNA, 25 bp, Mus musculus
atatacaaggtgtcctttctcctgc

SEQ ID NO: 233681 - DNA, 25 bp, Mus musculus
atatacacacataagcgagtcgtgt

SEQ ID NO: 233682 - DNA, 25 bp, Mus musculus
atatacacacatatagggattttgt

SEQ ID NO: 233683 - DNA, 25 bp, Mus musculus
atatacacacattagcgagtcgtgt

SEQ ID NO: 233684 - DNA, 25 bp, Mus musculus
atatacacacatttagggattttgt

SEQ ID NO: 233685 - DNA, 25 bp, Mus musculus
atatacacagcaacttggctttggt

SEQ ID NO: 233686 - DNA, 25 bp, Mus musculus
atatacacagcatcttggctttggt

SEQ ID NO: 233687 - DNA, 25 bp, Mus musculus
atatacaccctaagaccacagcatg

SEQ ID NO: 233688 - DNA, 25 bp, Mus musculus
atatacaccctatgaccacagcatg

SEQ ID NO: 233689 - DNA, 25 bp, Mus musculus
atatacaccgtgcagtacgcctgca

SEQ ID NO: 233690 - DNA, 25 bp, Mus musculus
atatacaccgtggagtacgcctgca

SEQ ID NO: 233691 - DNA, 25 bp, Mus musculus
atatacacctatcccagcctgttcc

SEQ ID NO: 233692 - DNA, 25 bp, Mus musculus
atatacacctatgccagcctgttcc

SEQ ID NO: 233693 - DNA, 25 bp, Mus musculus
atatacactccaagaaagcagcctg

SEQ ID NO: 233694 - DNA, 25 bp, Mus musculus
atatacactccatgaaagcagcctg

SEQ ID NO: 233695 - DNA, 25 bp, Mus musculus
atatacactgctatcctggcatatg

SEQ ID NO: 233696 - DNA, 25 bp, Mus musculus
atatacactgctttcctggcatatg

SEQ ID NO: 233697 - DNA, 25 bp, Mus musculus
atatacactggcagtagcatacaat

SEQ ID NO: 233698 - DNA, 25 bp, Mus musculus
atatacactggctgtagcatacaat

SEQ ID NO: 233699 - DNA, 25 bp, Mus musculus
atatacacttctacatcccaataca

SEQ ID NO: 233700 - DNA, 25 bp, Mus musculus
atatacacttcttcatcccaataca

SEQ ID NO: 233701 - DNA, 25 bp, Mus musculus
atatacagggtgactagaagccagt

SEQ ID NO: 233702 - DNA, 25 bp, Mus musculus
atatacagggtgtctagaagccagt

SEQ ID NO: 233703 - DNA, 25 bp, Mus musculus
atatacaggtaaccccacatcatat

SEQ ID NO: 233704 - DNA, 25 bp, Mus musculus
atatacaggtaagcccacatcatat

SEQ ID NO: 233705 - DNA, 25 bp, Mus musculus
atatacagtgctaggcatgcatgcg

SEQ ID NO: 233706 - DNA, 25 bp, Mus musculus
atatacagtgcttggcatgcatgcg

SEQ ID NO: 233707 - DNA, 25 bp, Mus musculus
atatacatagctacttactgactgc

SEQ ID NO: 233708 - DNA, 25 bp, Mus musculus
atatacatagcttcttactgactgc

SEQ ID NO: 233709 - DNA, 25 bp, Mus musculus
atatacatattcatctaaaaagcaa

SEQ ID NO: 233710 - DNA, 25 bp, Mus musculus
atatacatattcttctaaaaagcaa

SEQ ID NO: 233711 - DNA, 25 bp, Mus musculus
atatacatcaggatggccacagcct

SEQ ID NO: 233712 - DNA, 25 bp, Mus musculus
atatacatcaggttggccacagcct

SEQ ID NO: 233713 - DNA, 25 bp, Mus musculus
atatacattggtcccctttattcgg

SEQ ID NO: 233714 - DNA, 25 bp, Mus musculus
atatacattggtgccctttattcgg

SEQ ID NO: 233715 - DNA, 25 bp, Mus musculus
atatacattgtgcaaactcaagaca

SEQ ID NO: 233716 - DNA, 25 bp, Mus musculus
atatacattgtgcttactgttgtag

SEQ ID NO: 233717 - DNA, 25 bp, Mus musculus
atatacattgtggaaactcaagaca

SEQ ID NO: 233718 - DNA, 25 bp, Mus musculus
atatacattgtggttactgttgtag

SEQ ID NO: 233719 - DNA, 25 bp, Mus musculus
atataccacattagtagctcctttt

SEQ ID NO: 233720 - DNA, 25 bp, Mus musculus
atataccacatttgtagctcctttt

SEQ ID NO: 233721 - DNA, 25 bp, Mus musculus
atataccaggcgacatcttccacca

SEQ ID NO: 233722 - DNA, 25 bp, Mus musculus
atataccaggcgtcatcttccacca

SEQ ID NO: 233723 - DNA, 25 bp, Mus musculus
atataccatatcagcatcctctgca

SEQ ID NO: 233724 - DNA, 25 bp, Mus musculus
atataccatatctgcatcctctgca

SEQ ID NO: 233725 - DNA, 25 bp, Mus musculus
atataccatgctatccatatcaggg

SEQ ID NO: 233726 - DNA, 25 bp, Mus musculus
atataccatgctttccatatcaggg

SEQ ID NO: 233727 - DNA, 25 bp, Mus musculus
atataccattcacttgcctgatgtc

SEQ ID NO: 233728 - DNA, 25 bp, Mus musculus
atataccattcagttgcctgatgtc

SEQ ID NO: 233729 - DNA, 25 bp, Mus musculus
atataccattcgctgatctccgtgc

SEQ ID NO: 233730 - DNA, 25 bp, Mus musculus
atataccattcggtgatctccgtgc

SEQ ID NO: 233731 - DNA, 25 bp, Mus musculus
atatacccaaaccaaagacaccgca

SEQ ID NO: 233732 - DNA, 25 bp, Mus musculus
atatacccaaacgaaagacaccgca

SEQ ID NO: 233733 - DNA, 25 bp, Mus musculus
atatacccaatgacttatgtttcta

SEQ ID NO: 233734 - DNA, 25 bp, Mus musculus
atatacccaatgtcttatgtttcta

SEQ ID NO: 233735 - DNA, 25 bp, Mus musculus
atatacccagacattgtgcgactcc

SEQ ID NO: 233736 - DNA, 25 bp, Mus musculus
atatacccagactttgtgcgactcc

SEQ ID NO: 233737 - DNA, 25 bp, Mus musculus
atatacccgaaaaacctgaccttca

SEQ ID NO: 233738 - DNA, 25 bp, Mus musculus
atatacccgaaatacctgaccttca

SEQ ID NO: 233739 - DNA, 25 bp, Mus musculus
atataccgaatgaagtctgcaagac

SEQ ID NO: 233740 - DNA, 25 bp, Mus musculus
atataccgaatgtagtctgcaagac

SEQ ID NO: 233741 - DNA, 25 bp, Mus musculus
atatacctaaggctgcttctgtggt

SEQ ID NO: 233742 - DNA, 25 bp, Mus musculus
atatacctaagggtgcttctgtggt

SEQ ID NO: 233743 - DNA, 25 bp, Mus musculus
atatacctacccaacatgtgcattt

SEQ ID NO: 233744 - DNA, 25 bp, Mus musculus
atatacctaccctacatgtgcattt

SEQ ID NO: 233745 - DNA, 25 bp, Mus musculus
atatacctcagtcttccatcacggt

SEQ ID NO: 233746 - DNA, 25 bp, Mus musculus
atatacctcagtgttccatcacggt

SEQ ID NO: 233747 - DNA, 25 bp, Mus musculus
atatacctcattctgacacctgtgt

SEQ ID NO: 233748 - DNA, 25 bp, Mus musculus
atatacctcattgtgacacctgtgt

SEQ ID NO: 233749 - DNA, 25 bp, Mus musculus
atatacctccacacacttttatagg

SEQ ID NO: 233750 - DNA, 25 bp, Mus musculus
atatacctccactcacttttatagg

SEQ ID NO: 233751 - DNA, 25 bp, Mus musculus
atatacctcccaagtgtctttaaga

SEQ ID NO: 233752 - DNA, 25 bp, Mus musculus
atatacctcccatgtgtctttaaga

SEQ ID NO: 233753 - DNA, 25 bp, Mus musculus
atatacctcctgaccacacctatat

SEQ ID NO: 233754 - DNA, 25 bp, Mus musculus
atatacctcctgtccacacctatat

SEQ ID NO: 233755 - DNA, 25 bp, Mus musculus
atatacctctctcaagcctggactg

SEQ ID NO: 233756 - DNA, 25 bp, Mus musculus
atatacctctctgaagcctggactg

SEQ ID NO: 233757 - DNA, 25 bp, Mus musculus
atatacctgggaataaccacgctcc

SEQ ID NO: 233758 - DNA, 25 bp, Mus musculus
atatacctgggattaaccacgctcc

SEQ ID NO: 233759 - DNA, 25 bp, Mus musculus
atatacctgtaactggacctggaga

SEQ ID NO: 233760 - DNA, 25 bp, Mus musculus
atatacctgtaagtggacctggaga

SEQ ID NO: 233761 - DNA, 25 bp, Mus musculus
atataccttaataccacagagtggc

SEQ ID NO: 233762 - DNA, 25 bp, Mus musculus
atataccttaattccacagagtggc

SEQ ID NO: 233763 - DNA, 25 bp, Mus musculus
atataccttatcagcaagcctgaag

SEQ ID NO: 233764 - DNA, 25 bp, Mus musculus
atataccttatctgcaagcctgaag

SEQ ID NO: 233765 - DNA, 25 bp, Mus musculus
atataccttcagacaacttgaccag

SEQ ID NO: 233766 - DNA, 25 bp, Mus musculus
atataccttcagtcaacttgaccag

SEQ ID NO: 233767 - DNA, 25 bp, Mus musculus
atataccttctcctagccctggtgg

SEQ ID NO: 233768 - DNA, 25 bp, Mus musculus
atataccttctcgtagccctggtgg

SEQ ID NO: 233769 - DNA, 25 bp, Mus musculus
atataccttcttctcgcacttcatg

SEQ ID NO: 233770 - DNA, 25 bp, Mus musculus
atataccttcttgtcgcacttcatg

SEQ ID NO: 233771 - DNA, 25 bp, Mus musculus
atatacctttgcataagcttcttta

SEQ ID NO: 233772 - DNA, 25 bp, Mus musculus
atatacctttgcttaagcttcttta

SEQ ID NO: 233773 - DNA, 25 bp, Mus musculus
atatacgatacgctacctgtacaca

SEQ ID NO: 233774 - DNA, 25 bp, Mus musculus
atatacgatacggtacctgtacaca

SEQ ID NO: 233775 - DNA, 25 bp, Mus musculus
atatacgccatacactacttcttct

SEQ ID NO: 233776 - DNA, 25 bp, Mus musculus
atatacgccatagactacttcttct

SEQ ID NO: 233777 - DNA, 25 bp, Mus musculus
atatacgctgtgctgtgggttctta

SEQ ID NO: 233778 - DNA, 25 bp, Mus musculus
atatacgctgtggtgtgggttctta

SEQ ID NO: 233779 - DNA, 25 bp, Mus musculus
atatacggtgagaccagcttacatg

SEQ ID NO: 233780 - DNA, 25 bp, Mus musculus
atatacggtgagaccctgaggacta

SEQ ID NO: 233781 - DNA, 25 bp, Mus musculus
atatacggtgagtccagcttacatg

SEQ ID NO: 233782 - DNA, 25 bp, Mus musculus
atatacggtgagtccctgaggacta

SEQ ID NO: 233783 - DNA, 25 bp, Mus musculus
atatacgtagcacaggctgacctca

SEQ ID NO: 233784 - DNA, 25 bp, Mus musculus
atatacgtagcagaggctgacctca

SEQ ID NO: 233785 - DNA, 25 bp, Mus musculus
atatacgtttcaccctcaagatcca

SEQ ID NO: 233786 - DNA, 25 bp, Mus musculus
atatacgtttcagcctcaagatcca

SEQ ID NO: 233787 - DNA, 25 bp, Mus musculus
atatactacacaagctgagccccgt

SEQ ID NO: 233788 - DNA, 25 bp, Mus musculus
atatactacacatgctgagccccgt

SEQ ID NO: 233789 - DNA, 25 bp, Mus musculus
atatactactaccttaaactccctg

SEQ ID NO: 233790 - DNA, 25 bp, Mus musculus
atatactactacgttaaactccctg

SEQ ID NO: 233791 - DNA, 25 bp, Mus musculus
atatactactatatacactctccca

SEQ ID NO: 233792 - DNA, 25 bp, Mus musculus
atatactactatttacactctccca

SEQ ID NO: 233793 - DNA, 25 bp, Mus musculus
atatactaggttctcagtggccagt

SEQ ID NO: 233794 - DNA, 25 bp, Mus musculus
atatactaggttgtcagtggccagt

SEQ ID NO: 233795 - DNA, 25 bp, Mus musculus
atatactatacaattttctcccaca

SEQ ID NO: 233796 - DNA, 25 bp, Mus musculus
atatactatacatttttctcccaca

SEQ ID NO: 233797 - DNA, 25 bp, Mus musculus
atatactatgatacgaagcccggtc

SEQ ID NO: 233798 - DNA, 25 bp, Mus musculus
atatactatgattcgaagcccggtc

SEQ ID NO: 233799 - DNA, 25 bp, Mus musculus
atatactcactcacaaccttattac

SEQ ID NO: 233800 - DNA, 25 bp, Mus musculus
atatactcactctcaaccttattac

SEQ ID NO: 233801 - DNA, 25 bp, Mus musculus
atatactccaggcattttctttccc

SEQ ID NO: 233802 - DNA, 25 bp, Mus musculus
atatactccagggattttctttccc

SEQ ID NO: 233803 - DNA, 25 bp, Mus musculus
atatactcctacaacctgcatgaag

SEQ ID NO: 233804 - DNA, 25 bp, Mus musculus
atatactcctactacctgcatgaag

SEQ ID NO: 233805 - DNA, 25 bp, Mus musculus
atatactcctagctgagccacaagc

SEQ ID NO: 233806 - DNA, 25 bp, Mus musculus
atatactcctaggtgagccacaagc

SEQ ID NO: 233807 - DNA, 25 bp, Mus musculus
atatactcctccagctctttgttct

SEQ ID NO: 233808 - DNA, 25 bp, Mus musculus
atatactcctcctgctctttgttct

SEQ ID NO: 233809 - DNA, 25 bp, Mus musculus
atatactcctggctgtgcatgggat

SEQ ID NO: 233810 - DNA, 25 bp, Mus musculus
atatactcctgggtgtgcatgggat

SEQ ID NO: 233811 - DNA, 25 bp, Mus musculus
atatactgcagtatccttactttta

SEQ ID NO: 233812 - DNA, 25 bp, Mus musculus
atatactgcagtttccttactttta

SEQ ID NO: 233813 - DNA, 25 bp, Mus musculus
atatactgcctgctacccgggcttg

SEQ ID NO: 233814 - DNA, 25 bp, Mus musculus
atatactgcctggtacccgggcttg

SEQ ID NO: 233815 - DNA, 25 bp, Mus musculus
atatactgctgtcatcctgatgttc

SEQ ID NO: 233816 - DNA, 25 bp, Mus musculus
atatactgctgtgatcctgatgttc

SEQ ID NO: 233817 - DNA, 25 bp, Mus musculus
atatactggaatcctacagctccca

SEQ ID NO: 233818 - DNA, 25 bp, Mus musculus
atatactggaatgctacagctccca

SEQ ID NO: 233819 - DNA, 25 bp, Mus musculus
atatactggattcatgctgttttta

SEQ ID NO: 233820 - DNA, 25 bp, Mus musculus
atatactggattgatgctgttttta

SEQ ID NO: 233821 - DNA, 25 bp, Mus musculus
atatactggcagaagctttcaccaa

SEQ ID NO: 233822 - DNA, 25 bp, Mus musculus
atatactggcagtagctttcaccaa

SEQ ID NO: 233823 - DNA, 25 bp, Mus musculus
atatactgtgcccttgagtcctgct

SEQ ID NO: 233824 - DNA, 25 bp, Mus musculus
atatactgtgccgttgagtcctgct

SEQ ID NO: 233825 - DNA, 25 bp, Mus musculus
atatacttaatcactcctgtgtcct

SEQ ID NO: 233826 - DNA, 25 bp, Mus musculus
atatacttaatctctcctgtgtcct

SEQ ID NO: 233827 - DNA, 25 bp, Mus musculus
atatacttacctattcctgctcagt

SEQ ID NO: 233828 - DNA, 25 bp, Mus musculus
atatacttaccttttcctgctcagt

SEQ ID NO: 233829 - DNA, 25 bp, Mus musculus
atatacttcccaagtgaccctgaaa

SEQ ID NO: 233830 - DNA, 25 bp, Mus musculus
atatacttcccatgtgaccctgaaa

SEQ ID NO: 233831 - DNA, 25 bp, Mus musculus
atatacttgctgatgctgtgactat

SEQ ID NO: 233832 - DNA, 25 bp, Mus musculus
atatacttgctgttgctgtgactat

SEQ ID NO: 233833 - DNA, 25 bp, Mus musculus
atatacttggctctagacttaacag

SEQ ID NO: 233834 - DNA, 25 bp, Mus musculus
atatacttggctgtagacttaacag

SEQ ID NO: 233835 - DNA, 25 bp, Mus musculus
atatacttgggtcgtcttgtgaaaa

SEQ ID NO: 233836 - DNA, 25 bp, Mus musculus
atatacttgggtggtcttgtgaaaa

SEQ ID NO: 233837 - DNA, 25 bp, Mus musculus
atatacttggttatctggactggca

SEQ ID NO: 233838 - DNA, 25 bp, Mus musculus
atatacttggttttctggactggca

SEQ ID NO: 233839 - DNA, 25 bp, Mus musculus
atatactttagtcaggaggagctga

SEQ ID NO: 233840 - DNA, 25 bp, Mus musculus
atatactttagtgaggaggagctga

SEQ ID NO: 233841 - DNA, 25 bp, Mus musculus
atatactttcctccaaatgaatata

SEQ ID NO: 233842 - DNA, 25 bp, Mus musculus
atatactttcctgcaaatgaatata

SEQ ID NO: 233843 - DNA, 25 bp, Mus musculus
atatagaagataatcttggcctggg

SEQ ID NO: 233844 - DNA, 25 bp, Mus musculus
atatagaagatattcttggcctggg

SEQ ID NO: 233845 - DNA, 25 bp, Mus musculus
atatagaaggtaacctcctcactgg

SEQ ID NO: 233846 - DNA, 25 bp, Mus musculus
atatagaaggtatcctcctcactgg

SEQ ID NO: 233847 - DNA, 25 bp, Mus musculus
atatagacaatgaggcaaatcctgt

SEQ ID NO: 233848 - DNA, 25 bp, Mus musculus
atatagacaatgtggcaaatcctgt

SEQ ID NO: 233849 - DNA, 25 bp, Mus musculus
atatagacagccactcttccttctg

SEQ ID NO: 233850 - DNA, 25 bp, Mus musculus
atatagacagcctctcttccttctg

SEQ ID NO: 233851 - DNA, 25 bp, Mus musculus
atatagacaggtaccagggtgtgtt

SEQ ID NO: 233852 - DNA, 25 bp, Mus musculus
atatagacaggttccagggtgtgtt

SEQ ID NO: 233853 - DNA, 25 bp, Mus musculus
atatagacatgtaaggcagctcctg

SEQ ID NO: 233854 - DNA, 25 bp, Mus musculus
atatagacatgttaggcagctcctg

SEQ ID NO: 233855 - DNA, 25 bp, Mus musculus
atatagacatttaaacctcagtctg

SEQ ID NO: 233856 - DNA, 25 bp, Mus musculus
atatagacattttaacctcagtctg

SEQ ID NO: 233857 - DNA, 25 bp, Mus musculus
atatagaccaggatctctccaactc

SEQ ID NO: 233858 - DNA, 25 bp, Mus musculus
atatagaccaggttctctccaactc

SEQ ID NO: 233859 - DNA, 25 bp, Mus musculus
atatagacgttcctgtcgatccttg

SEQ ID NO: 233860 - DNA, 25 bp, Mus musculus
atatagacgttcgtgtcgatccttg

SEQ ID NO: 233861 - DNA, 25 bp, Mus musculus
atatagacttctcatctttccaaga

SEQ ID NO: 233862 - DNA, 25 bp, Mus musculus
atatagacttctgatctttccaaga

SEQ ID NO: 233863 - DNA, 25 bp, Mus musculus
atatagaggctacggcggcaacgca

SEQ ID NO: 233864 - DNA, 25 bp, Mus musculus
atatagaggctagggcggcaacgca

SEQ ID NO: 233865 - DNA, 25 bp, Mus musculus
atatagagtgccctactgggaccca

SEQ ID NO: 233866 - DNA, 25 bp, Mus musculus
atatagagtgccgtactgggaccca

SEQ ID NO: 233867 - DNA, 25 bp, Mus musculus
atatagatacctaccgggcagcctt

SEQ ID NO: 233868 - DNA, 25 bp, Mus musculus
atatagataccttccgggcagcctt

SEQ ID NO: 233869 - DNA, 25 bp, Mus musculus
atatagatctacctgcctgagacta

SEQ ID NO: 233870 - DNA, 25 bp, Mus musculus
atatagatctacgtgcctgagacta

SEQ ID NO: 233871 - DNA, 25 bp, Mus musculus
atatagatgctaacactgctcaaag

SEQ ID NO: 233872 - DNA, 25 bp, Mus musculus
atatagatgctatcactgctcaaag

SEQ ID NO: 233873 - DNA, 25 bp, Mus musculus
atatagattaccactctcctggaca

SEQ ID NO: 233874 - DNA, 25 bp, Mus musculus
atatagattacctctctcctggaca

SEQ ID NO: 233875 - DNA, 25 bp, Mus musculus
atatagattattccacaccagtgag

SEQ ID NO: 233876 - DNA, 25 bp, Mus musculus
atatagattattgcacaccagtgag

SEQ ID NO: 233877 - DNA, 25 bp, Mus musculus
atatagcaagtgatcttcagaagac

SEQ ID NO: 233878 - DNA, 25 bp, Mus musculus
atatagcaagtgttcttcagaagac

SEQ ID NO: 233879 - DNA, 25 bp, Mus musculus
atatagcaatagaaattctgggtaa

SEQ ID NO: 233880 - DNA, 25 bp, Mus musculus
atatagcaatagtaattctgggtaa

SEQ ID NO: 233881 - DNA, 25 bp, Mus musculus
atatagcactgccttgatgctctca

SEQ ID NO: 233882 - DNA, 25 bp, Mus musculus
atatagcactgcgttgatgctctca

SEQ ID NO: 233883 - DNA, 25 bp, Mus musculus
atatagcacttgaccttggcttgac

SEQ ID NO: 233884 - DNA, 25 bp, Mus musculus
atatagcacttgtccttggcttgac

SEQ ID NO: 233885 - DNA, 25 bp, Mus musculus
atatagcagttcactggcactcacc

SEQ ID NO: 233886 - DNA, 25 bp, Mus musculus
atatagcagttctctggcactcacc

SEQ ID NO: 233887 - DNA, 25 bp, Mus musculus
atatagcatgtcatttgcaacatac

SEQ ID NO: 233888 - DNA, 25 bp, Mus musculus
atatagcatgtcttttgcaacatac

SEQ ID NO: 233889 - DNA, 25 bp, Mus musculus
atatagcatgttcaggtccctgggt

SEQ ID NO: 233890 - DNA, 25 bp, Mus musculus
atatagcatgttgaggtccctgggt

SEQ ID NO: 233891 - DNA, 25 bp, Mus musculus
atatagccatcaccaggcctggaag

SEQ ID NO: 233892 - DNA, 25 bp, Mus musculus
atatagccatcagcaggcctggaag

SEQ ID NO: 233893 - DNA, 25 bp, Mus musculus
atatagcccagactagcctacaact

SEQ ID NO: 233894 - DNA, 25 bp, Mus musculus
atatagcccagagtagcctacaact

SEQ ID NO: 233895 - DNA, 25 bp, Mus musculus
atatagccccaaatgcactggatct

SEQ ID NO: 233896 - DNA, 25 bp, Mus musculus
atatagccccaattgcactggatct

SEQ ID NO: 233897 - DNA, 25 bp, Mus musculus
atatagccccggcatctgtcagtat

SEQ ID NO: 233898 - DNA, 25 bp, Mus musculus
atatagccccgggatctgtcagtat

SEQ ID NO: 233899 - DNA, 25 bp, Mus musculus
atatagcctttcatccttgtattct

SEQ ID NO: 233900 - DNA, 25 bp, Mus musculus
atatagcctttcttccttgtattct

SEQ ID NO: 233901 - DNA, 25 bp, Mus musculus
atatagcgacttctgcccaaaacaa

SEQ ID NO: 233902 - DNA, 25 bp, Mus musculus
atatagcgacttgtgcccaaaacaa

SEQ ID NO: 233903 - DNA, 25 bp, Mus musculus
atatagcgtgggaaccagggccctc

SEQ ID NO: 233904 - DNA, 25 bp, Mus musculus
atatagcgtgggtaccagggccctc

SEQ ID NO: 233905 - DNA, 25 bp, Mus musculus
atatagctaatgcatcccagatccc

SEQ ID NO: 233906 - DNA, 25 bp, Mus musculus
atatagctaatggatcccagatccc

SEQ ID NO: 233907 - DNA, 25 bp, Mus musculus
atatagctagttcatctctgacctc

SEQ ID NO: 233908 - DNA, 25 bp, Mus musculus
atatagctagttgatctctgacctc

SEQ ID NO: 233909 - DNA, 25 bp, Mus musculus
atatagctcacgagtgtcccagcac

SEQ ID NO: 233910 - DNA, 25 bp, Mus musculus
atatagctcacgtgtgtcccagcac

SEQ ID NO: 233911 - DNA, 25 bp, Mus musculus
atatagctcagtaccgacagctctg

SEQ ID NO: 233912 - DNA, 25 bp, Mus musculus
atatagctcagttccgacagctctg

SEQ ID NO: 233913 - DNA, 25 bp, Mus musculus
atatagctgaccattaataaaacat

SEQ ID NO: 233914 - DNA, 25 bp, Mus musculus
atatagctgacctttaataaaacat

SEQ ID NO: 233915 - DNA, 25 bp, Mus musculus
atatagctgcatatatccttttggc

SEQ ID NO: 233916 - DNA, 25 bp, Mus musculus
atatagctgcatttatccttttggc

SEQ ID NO: 233917 - DNA, 25 bp, Mus musculus
atatagctgccaattagttcctctg

SEQ ID NO: 233918 - DNA, 25 bp, Mus musculus
atatagctgccatttagttcctctg

SEQ ID NO: 233919 - DNA, 25 bp, Mus musculus
atatagctgggaccctgagcgtagc

SEQ ID NO: 233920 - DNA, 25 bp, Mus musculus
atatagctgggagcctgagcgtagc

SEQ ID NO: 233921 - DNA, 25 bp, Mus musculus
atatagctgtgcactgcaacttcta

SEQ ID NO: 233922 - DNA, 25 bp, Mus musculus
atatagctgtgctctgcaacttcta

SEQ ID NO: 233923 - DNA, 25 bp, Mus musculus
atataggaactaatgctgtgacagc

SEQ ID NO: 233924 - DNA, 25 bp, Mus musculus
atataggaactattgctgtgacagc

SEQ ID NO: 233925 - DNA, 25 bp, Mus musculus
atataggcaattctttccgaggaga

SEQ ID NO: 233926 - DNA, 25 bp, Mus musculus
atataggcaattgtttccgaggaga

SEQ ID NO: 233927 - DNA, 25 bp, Mus musculus
atataggcacagagcacttccagcc

SEQ ID NO: 233928 - DNA, 25 bp, Mus musculus
atataggcacagtgcacttccagcc

SEQ ID NO: 233929 - DNA, 25 bp, Mus musculus
atataggcacataaccgttcatggt

SEQ ID NO: 233930 - DNA, 25 bp, Mus musculus
atataggcacattaccgttcatggt

SEQ ID NO: 233931 - DNA, 25 bp, Mus musculus
atataggctgggaccatttgtttaa

SEQ ID NO: 233932 - DNA, 25 bp, Mus musculus
atataggctgggtccatttgtttaa

SEQ ID NO: 233933 - DNA, 25 bp, Mus musculus
atatagggccacctggcctggaact

SEQ ID NO: 233934 - DNA, 25 bp, Mus musculus
atatagggccacgtggcctggaact

SEQ ID NO: 233935 - DNA, 25 bp, Mus musculus
atataggtatgcctgcagacatata

SEQ ID NO: 233936 - DNA, 25 bp, Mus musculus
atataggtatgcgtgcagacatata

SEQ ID NO: 233937 - DNA, 25 bp, Mus musculus
atataggtcattaaccctcggctat

SEQ ID NO: 233938 - DNA, 25 bp, Mus musculus
atataggtcatttaccctcggctat

SEQ ID NO: 233939 - DNA, 25 bp, Mus musculus
atataggtcttccatttgctgtggc

SEQ ID NO: 233940 - DNA, 25 bp, Mus musculus
atataggtcttcgatttgctgtggc

SEQ ID NO: 233941 - DNA, 25 bp, Mus musculus
atataggtgatcacctctcgagcag

SEQ ID NO: 233942 - DNA, 25 bp, Mus musculus
atataggtgatctcctctcgagcag

SEQ ID NO: 233943 - DNA, 25 bp, Mus musculus
atataggtgtgtcctcatctctgtg

SEQ ID NO: 233944 - DNA, 25 bp, Mus musculus
atataggtgtgtgctcatctctgtg

SEQ ID NO: 233945 - DNA, 25 bp, Mus musculus
atataggttaccattaagcttttca

SEQ ID NO: 233946 - DNA, 25 bp, Mus musculus
atataggttacctttaagcttttca

SEQ ID NO: 233947 - DNA, 25 bp, Mus musculus
atataggttcctacagccaagccaa

SEQ ID NO: 233948 - DNA, 25 bp, Mus musculus
atataggttccttcagccaagccaa

SEQ ID NO: 233949 - DNA, 25 bp, Mus musculus
atatagtaactcacacctttgtggt

SEQ ID NO: 233950 - DNA, 25 bp, Mus musculus
atatagtaactctcacctttgtggt

SEQ ID NO: 233951 - DNA, 25 bp, Mus musculus
atatagtaagttcctctgtcaaaaa

SEQ ID NO: 233952 - DNA, 25 bp, Mus musculus
atatagtaagttgctctgtcaaaaa

SEQ ID NO: 233953 - DNA, 25 bp, Mus musculus
atatagtaatcaatagtagactgtt

SEQ ID NO: 233954 - DNA, 25 bp, Mus musculus
atatagtaatcattagtagactgtt

SEQ ID NO: 233955 - DNA, 25 bp, Mus musculus
atatagtactcgctgctcaccgagg

SEQ ID NO: 233956 - DNA, 25 bp, Mus musculus
atatagtactcggtgctcaccgagg

SEQ ID NO: 233957 - DNA, 25 bp, Mus musculus
atatagtactggcagttgaactagg

SEQ ID NO: 233958 - DNA, 25 bp, Mus musculus
atatagtactgggagttgaactagg

SEQ ID NO: 233959 - DNA, 25 bp, Mus musculus
atatagtacttcattgtgtggtggg

SEQ ID NO: 233960 - DNA, 25 bp, Mus musculus
atatagtacttctttgtgtggtggg

SEQ ID NO: 233961 - DNA, 25 bp, Mus musculus
atatagtagacccatcccagtcaga

SEQ ID NO: 233962 - DNA, 25 bp, Mus musculus
atatagtagaccgatcccagtcaga

SEQ ID NO: 233963 - DNA, 25 bp, Mus musculus
atatagtatgttctcattgtggaca

SEQ ID NO: 233964 - DNA, 25 bp, Mus musculus
atatagtatgttgtcattgtggaca

SEQ ID NO: 233965 - DNA, 25 bp, Mus musculus
atatagtcaatcacctacatgcagg

SEQ ID NO: 233966 - DNA, 25 bp, Mus musculus
atatagtcaatctcctacatgcagg

SEQ ID NO: 233967 - DNA, 25 bp, Mus musculus
atatagtcctatagtatcagattta

SEQ ID NO: 233968 - DNA, 25 bp, Mus musculus
atatagtcctattgtatcagattta

SEQ ID NO: 233969 - DNA, 25 bp, Mus musculus
atatagtctatgcttgctctgcttc

SEQ ID NO: 233970 - DNA, 25 bp, Mus musculus
atatagtctatggttgctctgcttc

SEQ ID NO: 233971 - DNA, 25 bp, Mus musculus
atatagtctctactcctgggtaacc

SEQ ID NO: 233972 - DNA, 25 bp, Mus musculus
atatagtctctagtcctgggtaacc

SEQ ID NO: 233973 - DNA, 25 bp, Mus musculus
atatagttactaagagtccctgaaa

SEQ ID NO: 233974 - DNA, 25 bp, Mus musculus
atatagttactatgagtccctgaaa

SEQ ID NO: 233975 - DNA, 25 bp, Mus musculus
atatagttaggcagacgcacccaag

SEQ ID NO: 233976 - DNA, 25 bp, Mus musculus
atatagttaggctgacgcacccaag

SEQ ID NO: 233977 - DNA, 25 bp, Mus musculus
atatagttattcacattccagatga

SEQ ID NO: 233978 - DNA, 25 bp, Mus musculus
atatagttattctcattccagatga

SEQ ID NO: 233979 - DNA, 25 bp, Mus musculus
atatagttcagactccgattcccat

SEQ ID NO: 233980 - DNA, 25 bp, Mus musculus
atatagttcagagtccgattcccat

SEQ ID NO: 233981 - DNA, 25 bp, Mus musculus
atatagttcccacacatgggtccag

SEQ ID NO: 233982 - DNA, 25 bp, Mus musculus
atatagttcccagacatgggtccag

SEQ ID NO: 233983 - DNA, 25 bp, Mus musculus
atatagttctggaggaggctccaga

SEQ ID NO: 233984 - DNA, 25 bp, Mus musculus
atatagttctggtggaggctccaga

SEQ ID NO: 233985 - DNA, 25 bp, Mus musculus
atatagttgcttaacattcccctcc

SEQ ID NO: 233986 - DNA, 25 bp, Mus musculus
atatagttgctttacattcccctcc

SEQ ID NO: 233987 - DNA, 25 bp, Mus musculus
atatagtttctcatacaagcccaac

SEQ ID NO: 233988 - DNA, 25 bp, Mus musculus
atatagtttctcttacaagcccaac

SEQ ID NO: 233989 - DNA, 25 bp, Mus musculus
atatagtttggactgccttcgcttc

SEQ ID NO: 233990 - DNA, 25 bp, Mus musculus
atatagtttggagtgccttcgcttc

SEQ ID NO: 233991 - DNA, 25 bp, Mus musculus
atatagttttctccatttccccaag

SEQ ID NO: 233992 - DNA, 25 bp, Mus musculus
atatagttttctgcatttccccaag

SEQ ID NO: 233993 - DNA, 25 bp, Mus musculus
atatataaccaacgaggccctctga

SEQ ID NO: 233994 - DNA, 25 bp, Mus musculus
atatataaccaaggaggccctctga

SEQ ID NO: 233995 - DNA, 25 bp, Mus musculus
atatataaccgtctgtgtgccaaac

SEQ ID NO: 233996 - DNA, 25 bp, Mus musculus
atatataaccgtgtgtgtgccaaac

SEQ ID NO: 233997 - DNA, 25 bp, Mus musculus
atatataacttcatgtctttccctc

SEQ ID NO: 233998 - DNA, 25 bp, Mus musculus
atatataacttcttgtctttccctc

SEQ ID NO: 233999 - DNA, 25 bp, Mus musculus
atatataagcgcctggcccagtccc

SEQ ID NO: 234000 - DNA, 25 bp, Mus musculus
atatataagcgcgtggcccagtccc

SEQ ID NO: 234001 - DNA, 25 bp, Mus musculus
atatataagttaattcctccctgtg

SEQ ID NO: 234002 - DNA, 25 bp, Mus musculus
atatataagttatttcctccctgtg

SEQ ID NO: 234003 - DNA, 25 bp, Mus musculus
atatatacaagcactaagcagtgtt

SEQ ID NO: 234004 - DNA, 25 bp, Mus musculus
atatatacaagctctaagcagtgtt

SEQ ID NO: 234005 - DNA, 25 bp, Mus musculus
atatatacgtctccgtcctaaccat

SEQ ID NO: 234006 - DNA, 25 bp, Mus musculus
atatatacgtctgcgtcctaaccat

SEQ ID NO: 234007 - DNA, 25 bp, Mus musculus
atatatactgccactatggttagaa

SEQ ID NO: 234008 - DNA, 25 bp, Mus musculus
atatatactgcctctatggttagaa

SEQ ID NO: 234009 - DNA, 25 bp, Mus musculus
atatatactgctacacactcatcct

SEQ ID NO: 234010 - DNA, 25 bp, Mus musculus
atatatactgcttcacactcatcct

SEQ ID NO: 234011 - DNA, 25 bp, Mus musculus
atatatacttacagatttttgcaaa

SEQ ID NO: 234012 - DNA, 25 bp, Mus musculus
atatatacttactgatttttgcaaa

SEQ ID NO: 234013 - DNA, 25 bp, Mus musculus
atatatacttgtagggagccgacac

SEQ ID NO: 234014 - DNA, 25 bp, Mus musculus
atatatacttgttgggagccgacac

SEQ ID NO: 234015 - DNA, 25 bp, Mus musculus
atatatatctctccctcattcttac

SEQ ID NO: 234016 - DNA, 25 bp, Mus musculus
atatatatctctgcctcattcttac

SEQ ID NO: 234017 - DNA, 25 bp, Mus musculus
atatatatgagtacagtgccactgt

SEQ ID NO: 234018 - DNA, 25 bp, Mus musculus
atatatatgagttcagtgccactgt

SEQ ID NO: 234019 - DNA, 25 bp, Mus musculus
atatatatgatcatctgctcttccc

SEQ ID NO: 234020 - DNA, 25 bp, Mus musculus
atatatatgatcttctgctcttccc

SEQ ID NO: 234021 - DNA, 25 bp, Mus musculus
atatatatggccctgcctagtctac

SEQ ID NO: 234022 - DNA, 25 bp, Mus musculus
atatatatggccgtgcctagtctac

SEQ ID NO: 234023 - DNA, 25 bp, Mus musculus
atatatattgagagaaccttgtgga

SEQ ID NO: 234024 - DNA, 25 bp, Mus musculus
atatatattgagtgaaccttgtgga

SEQ ID NO: 234025 - DNA, 25 bp, Mus musculus
atatatcaaatacttctccccatct

SEQ ID NO: 234026 - DNA, 25 bp, Mus musculus
atatatcaaatagttctccccatct

SEQ ID NO: 234027 - DNA, 25 bp, Mus musculus
atatatcacagcaacccagttcagc

SEQ ID NO: 234028 - DNA, 25 bp, Mus musculus
atatatcacagctacccagttcagc

SEQ ID NO: 234029 - DNA, 25 bp, Mus musculus
atatatcaccctaccttgcatgatt

SEQ ID NO: 234030 - DNA, 25 bp, Mus musculus
atatatcacccttccttgcatgatt

SEQ ID NO: 234031 - DNA, 25 bp, Mus musculus
atatatccacacctgcatgcacata

SEQ ID NO: 234032 - DNA, 25 bp, Mus musculus
atatatccacacgtgcatgcacata

SEQ ID NO: 234033 - DNA, 25 bp, Mus musculus
atatatccagcaaccgtagagtcag

SEQ ID NO: 234034 - DNA, 25 bp, Mus musculus
atatatccagcatccgtagagtcag

SEQ ID NO: 234035 - DNA, 25 bp, Mus musculus
atatatccatatactcacacgcaga

SEQ ID NO: 234036 - DNA, 25 bp, Mus musculus
atatatccatattctcacacgcaga

SEQ ID NO: 234037 - DNA, 25 bp, Mus musculus
atatatcccaagatactgcacctat

SEQ ID NO: 234038 - DNA, 25 bp, Mus musculus
atatatcccaagttactgcacctat

SEQ ID NO: 234039 - DNA, 25 bp, Mus musculus
atatatcccagactatccatgaatg

SEQ ID NO: 234040 - DNA, 25 bp, Mus musculus
atatatcccagagtatccatgaatg

SEQ ID NO: 234041 - DNA, 25 bp, Mus musculus
atatatccgtctaagtttccctagg

SEQ ID NO: 234042 - DNA, 25 bp, Mus musculus
atatatccgtcttagtttccctagg

SEQ ID NO: 234043 - DNA, 25 bp, Mus musculus
atatatcctacaaatacttcggcaa

SEQ ID NO: 234044 - DNA, 25 bp, Mus musculus
atatatcctacatatacttcggcaa

SEQ ID NO: 234045 - DNA, 25 bp, Mus musculus
atatatcctagcattgtatcccaca

SEQ ID NO: 234046 - DNA, 25 bp, Mus musculus
atatatcctagctttgtatcccaca

SEQ ID NO: 234047 - DNA, 25 bp, Mus musculus
atatatcctcacaggcataacccac

SEQ ID NO: 234048 - DNA, 25 bp, Mus musculus
atatatcctcactggcataacccac

SEQ ID NO: 234049 - DNA, 25 bp, Mus musculus
atatatcctcttcccaggagtttga

SEQ ID NO: 234050 - DNA, 25 bp, Mus musculus
atatatcctcttgccaggagtttga

SEQ ID NO: 234051 - DNA, 25 bp, Mus musculus
atatatccttgtccatttacccacc

SEQ ID NO: 234052 - DNA, 25 bp, Mus musculus
atatatccttgtgcatttacccacc

SEQ ID NO: 234053 - DNA, 25 bp, Mus musculus
atatatcgccagagcaggagctgat

SEQ ID NO: 234054 - DNA, 25 bp, Mus musculus
atatatcgccagtgcaggagctgat

SEQ ID NO: 234055 - DNA, 25 bp, Mus musculus
atatatcgtaccactgcaagagcgt

SEQ ID NO: 234056 - DNA, 25 bp, Mus musculus
atatatcgtacctctgcaagagcgt

SEQ ID NO: 234057 - DNA, 25 bp, Mus musculus
atatatctacgcagggcacggagcc

SEQ ID NO: 234058 - DNA, 25 bp, Mus musculus
atatatctacgctgggcacggagcc

SEQ ID NO: 234059 - DNA, 25 bp, Mus musculus
atatatctagtcacaatggtctgaa

SEQ ID NO: 234060 - DNA, 25 bp, Mus musculus
atatatctagtctcaatggtctgaa

SEQ ID NO: 234061 - DNA, 25 bp, Mus musculus
atatatctatctaaaccatgggtgc

SEQ ID NO: 234062 - DNA, 25 bp, Mus musculus
atatatctatctaccttgattcttt

SEQ ID NO: 234063 - DNA, 25 bp, Mus musculus
atatatctatcttaaccatgggtgc

SEQ ID NO: 234064 - DNA, 25 bp, Mus musculus
atatatctatcttccttgattcttt

SEQ ID NO: 234065 - DNA, 25 bp, Mus musculus
atatatctattcactcttgctgtgg

SEQ ID NO: 234066 - DNA, 25 bp, Mus musculus
atatatctattctctcttgctgtgg

SEQ ID NO: 234067 - DNA, 25 bp, Mus musculus
atatatctatttagcccaggtctgg

SEQ ID NO: 234068 - DNA, 25 bp, Mus musculus
atatatctattttgcccaggtctgg

SEQ ID NO: 234069 - DNA, 25 bp, Mus musculus
atatatctcacaaatgcgggccaca

SEQ ID NO: 234070 - DNA, 25 bp, Mus musculus
atatatctcacatatgcgggccaca

SEQ ID NO: 234071 - DNA, 25 bp, Mus musculus
atatatctctccatgacctctttca

SEQ ID NO: 234072 - DNA, 25 bp, Mus musculus
atatatctctccttgacctctttca

SEQ ID NO: 234073 - DNA, 25 bp, Mus musculus
atatatctctgtaagcttcaagtag

SEQ ID NO: 234074 - DNA, 25 bp, Mus musculus
atatatctctgttagcttcaagtag

SEQ ID NO: 234075 - DNA, 25 bp, Mus musculus
atatatctggtaatctctgcttgca

SEQ ID NO: 234076 - DNA, 25 bp, Mus musculus
atatatctggtattctctgcttgca

SEQ ID NO: 234077 - DNA, 25 bp, Mus musculus
atatatcttggaccacaacacgcgc

SEQ ID NO: 234078 - DNA, 25 bp, Mus musculus
atatatcttggagcacaacacgcgc

SEQ ID NO: 234079 - DNA, 25 bp, Mus musculus
atatatctttatatgggatcaggag

SEQ ID NO: 234080 - DNA, 25 bp, Mus musculus
atatatctttatttgggatcaggag

SEQ ID NO: 234081 - DNA, 25 bp, Mus musculus
atatatgaatgcagactgtgtgtgc

SEQ ID NO: 234082 - DNA, 25 bp, Mus musculus
atatatgaatgctgactgtgtgtgc

SEQ ID NO: 234083 - DNA, 25 bp, Mus musculus
atatatgaccccatcatgtcctaag

SEQ ID NO: 234084 - DNA, 25 bp, Mus musculus
atatatgaccccttcatgtcctaag

SEQ ID NO: 234085 - DNA, 25 bp, Mus musculus
atatatgacctccaggccatgctga

SEQ ID NO: 234086 - DNA, 25 bp, Mus musculus
atatatgacctcgaggccatgctga

SEQ ID NO: 234087 - DNA, 25 bp, Mus musculus
atatatgactctagcttgctgtcag

SEQ ID NO: 234088 - DNA, 25 bp, Mus musculus
atatatgactcttgcttgctgtcag

SEQ ID NO: 234089 - DNA, 25 bp, Mus musculus
atatatgactgaatgtatttatgta

SEQ ID NO: 234090 - DNA, 25 bp, Mus musculus
atatatgactgattgtatttatgta

SEQ ID NO: 234091 - DNA, 25 bp, Mus musculus
atatatgatataatatctcctcccc

SEQ ID NO: 234092 - DNA, 25 bp, Mus musculus
atatatgatatattatctcctcccc

SEQ ID NO: 234093 - DNA, 25 bp, Mus musculus
atatatgcaaataatgccccacccc

SEQ ID NO: 234094 - DNA, 25 bp, Mus musculus
atatatgcaaattatgccccacccc

SEQ ID NO: 234095 - DNA, 25 bp, Mus musculus
atatatgcagggaagatcagttgtc

SEQ ID NO: 234096 - DNA, 25 bp, Mus musculus
atatatgcagggtagatcagttgtc

SEQ ID NO: 234097 - DNA, 25 bp, Mus musculus
atatatgcatgtagtcttgtattca

SEQ ID NO: 234098 - DNA, 25 bp, Mus musculus
atatatgcatgttgtcttgtattca

SEQ ID NO: 234099 - DNA, 25 bp, Mus musculus
atatatgcccttcctgcaatatgtg

SEQ ID NO: 234100 - DNA, 25 bp, Mus musculus
atatatgcccttgctgcaatatgtg

SEQ ID NO: 234101 - DNA, 25 bp, Mus musculus
atatatgcctccaggtatctttttc

SEQ ID NO: 234102 - DNA, 25 bp, Mus musculus
atatatgcctcctggtatctttttc

SEQ ID NO: 234103 - DNA, 25 bp, Mus musculus
atatatgcctgaagtctgtggaatc

SEQ ID NO: 234104 - DNA, 25 bp, Mus musculus
atatatgcctgatgtctgtggaatc

SEQ ID NO: 234105 - DNA, 25 bp, Mus musculus
atatatgcctggagggtttgcctgc

SEQ ID NO: 234106 - DNA, 25 bp, Mus musculus
atatatgcctggtgggtttgcctgc

SEQ ID NO: 234107 - DNA, 25 bp, Mus musculus
atatatgcgcagcaggctgacctca

SEQ ID NO: 234108 - DNA, 25 bp, Mus musculus
atatatgcgcaggaggctgacctca

SEQ ID NO: 234109 - DNA, 25 bp, Mus musculus
atatatgctcatagtgtcctaaaga

SEQ ID NO: 234110 - DNA, 25 bp, Mus musculus
atatatgctcattgtgtcctaaaga

SEQ ID NO: 234111 - DNA, 25 bp, Mus musculus
atatatgctctcaattggttccttc

SEQ ID NO: 234112 - DNA, 25 bp, Mus musculus
atatatgctctctattggttccttc

SEQ ID NO: 234113 - DNA, 25 bp, Mus musculus
atatatggaactaaagcattagctt

SEQ ID NO: 234114 - DNA, 25 bp, Mus musculus
atatatggaacttaagcattagctt

SEQ ID NO: 234115 - DNA, 25 bp, Mus musculus
atatatggacctagcttaaggcgat

SEQ ID NO: 234116 - DNA, 25 bp, Mus musculus
atatatggaccttgcttaaggcgat

SEQ ID NO: 234117 - DNA, 25 bp, Mus musculus
atatatggactcagttactgtttga

SEQ ID NO: 234118 - DNA, 25 bp, Mus musculus
atatatggactctgttactgtttga

SEQ ID NO: 234119 - DNA, 25 bp, Mus musculus
atatatggcagcattcagctctcac

SEQ ID NO: 234120 - DNA, 25 bp, Mus musculus
atatatggcagctttcagctctcac

SEQ ID NO: 234121 - DNA, 25 bp, Mus musculus
atatatggcctactatactaaggat

SEQ ID NO: 234122 - DNA, 25 bp, Mus musculus
atatatggcctagtatactaaggat

SEQ ID NO: 234123 - DNA, 25 bp, Mus musculus
atatatggctcccaggactgtgtgc

SEQ ID NO: 234124 - DNA, 25 bp, Mus musculus
atatatggctccgaggactgtgtgc

SEQ ID NO: 234125 - DNA, 25 bp, Mus musculus
atatatggctgacacagcctcgcct

SEQ ID NO: 234126 - DNA, 25 bp, Mus musculus
atatatggctgagacagcctcgcct

SEQ ID NO: 234127 - DNA, 25 bp, Mus musculus
atatatggtgacatttccacatcag

SEQ ID NO: 234128 - DNA, 25 bp, Mus musculus
atatatggtgacttttccacatcag

SEQ ID NO: 234129 - DNA, 25 bp, Mus musculus
atatatgtaggcaggacctctctgt

SEQ ID NO: 234130 - DNA, 25 bp, Mus musculus
atatatgtaggctggacctctctgt

SEQ ID NO: 234131 - DNA, 25 bp, Mus musculus
atatatgtatctcccaaggtggagc

SEQ ID NO: 234132 - DNA, 25 bp, Mus musculus
atatatgtatctgccaaggtggagc

SEQ ID NO: 234133 - DNA, 25 bp, Mus musculus
atatatgtatggctgccacttgcat

SEQ ID NO: 234134 - DNA, 25 bp, Mus musculus
atatatgtatgggtgccacttgcat

SEQ ID NO: 234135 - DNA, 25 bp, Mus musculus
atatatgtgtaccacagtgtgcaga

SEQ ID NO: 234136 - DNA, 25 bp, Mus musculus
atatatgtgtacgacagtgtgcaga

SEQ ID NO: 234137 - DNA, 25 bp, Mus musculus
atatatgttctaactgactgcttca

SEQ ID NO: 234138 - DNA, 25 bp, Mus musculus
atatatgttctatctgactgcttca

SEQ ID NO: 234139 - DNA, 25 bp, Mus musculus
atatatgttgtgctacatttgccca

SEQ ID NO: 234140 - DNA, 25 bp, Mus musculus
atatatgttgtggtacatttgccca

SEQ ID NO: 234141 - DNA, 25 bp, Mus musculus
atatatgttttgagctcaacctccc

SEQ ID NO: 234142 - DNA, 25 bp, Mus musculus
atatatgttttgtgctcaacctccc

SEQ ID NO: 234143 - DNA, 25 bp, Mus musculus
atatattaaatacataccattactg

SEQ ID NO: 234144 - DNA, 25 bp, Mus musculus
atatattaaatagataccattactg

SEQ ID NO: 234145 - DNA, 25 bp, Mus musculus
atatattaacctacttgacttatgt

SEQ ID NO: 234146 - DNA, 25 bp, Mus musculus
atatattaaccttcttgacttatgt

SEQ ID NO: 234147 - DNA, 25 bp, Mus musculus
atatattacaccatgctgcagtagt

SEQ ID NO: 234148 - DNA, 25 bp, Mus musculus
atatattacaccttgctgcagtagt

SEQ ID NO: 234149 - DNA, 25 bp, Mus musculus
atatattacactcccatttcccatt

SEQ ID NO: 234150 - DNA, 25 bp, Mus musculus
atatattacactgccatttcccatt

SEQ ID NO: 234151 - DNA, 25 bp, Mus musculus
atatattatcttagtgccctggacc

SEQ ID NO: 234152 - DNA, 25 bp, Mus musculus
atatattatctttgtgccctggacc

SEQ ID NO: 234153 - DNA, 25 bp, Mus musculus
atatattcagtgctctaagtataga

SEQ ID NO: 234154 - DNA, 25 bp, Mus musculus
atatattcagtggtctaagtataga

SEQ ID NO: 234155 - DNA, 25 bp, Mus musculus
atatattcattgactctttggccag

SEQ ID NO: 234156 - DNA, 25 bp, Mus musculus
atatattcattgtctctttggccag

SEQ ID NO: 234157 - DNA, 25 bp, Mus musculus
atatattccctacggcatctagcag

SEQ ID NO: 234158 - DNA, 25 bp, Mus musculus
atatattccctagggcatctagcag

SEQ ID NO: 234159 - DNA, 25 bp, Mus musculus
atatattctcacatgtttccttctt

SEQ ID NO: 234160 - DNA, 25 bp, Mus musculus
atatattctcacttgtttccttctt

SEQ ID NO: 234161 - DNA, 25 bp, Mus musculus
atatattctgtcctgctttttggca

SEQ ID NO: 234162 - DNA, 25 bp, Mus musculus
atatattctgtcgtgctttttggca

SEQ ID NO: 234163 - DNA, 25 bp, Mus musculus
atatattcttgtatccctttctgtt

SEQ ID NO: 234164 - DNA, 25 bp, Mus musculus
atatattcttgtttccctttctgtt

SEQ ID NO: 234165 - DNA, 25 bp, Mus musculus
atatattgacaaaccaccgctcttc

SEQ ID NO: 234166 - DNA, 25 bp, Mus musculus
atatattgacaatccaccgctcttc

SEQ ID NO: 234167 - DNA, 25 bp, Mus musculus
atatattgctgcattgctgaccaat

SEQ ID NO: 234168 - DNA, 25 bp, Mus musculus
atatattgctgctttgctgaccaat

SEQ ID NO: 234169 - DNA, 25 bp, Mus musculus
atatattggttacgcggtgccgatt

SEQ ID NO: 234170 - DNA, 25 bp, Mus musculus
atatattggttaggcggtgccgatt

SEQ ID NO: 234171 - DNA, 25 bp, Mus musculus
atatattgtacaacgaggaccacat

SEQ ID NO: 234172 - DNA, 25 bp, Mus musculus
atatattgtacatcgaggaccacat

SEQ ID NO: 234173 - DNA, 25 bp, Mus musculus
atatattgtactcaggtgcctgccc

SEQ ID NO: 234174 - DNA, 25 bp, Mus musculus
atatattgtactgaggtgcctgccc

SEQ ID NO: 234175 - DNA, 25 bp, Mus musculus
atatattgtggaactgcgtggaaac

SEQ ID NO: 234176 - DNA, 25 bp, Mus musculus
atatattgtggatctgcgtggaaac

SEQ ID NO: 234177 - DNA, 25 bp, Mus musculus
atatatttaattattgttctctgac

SEQ ID NO: 234178 - DNA, 25 bp, Mus musculus
atatatttaatttttgttctctgac

SEQ ID NO: 234179 - DNA, 25 bp, Mus musculus
atatatttagctcgtttcagtaaag

SEQ ID NO: 234180 - DNA, 25 bp, Mus musculus
atatatttagctggtttcagtaaag

SEQ ID NO: 234181 - DNA, 25 bp, Mus musculus
atatatttagggaccaaatgtgtag

SEQ ID NO: 234182 - DNA, 25 bp, Mus musculus
atatatttagggtccaaatgtgtag

SEQ ID NO: 234183 - DNA, 25 bp, Mus musculus
atatatttcagtatctcagaggcat

SEQ ID NO: 234184 - DNA, 25 bp, Mus musculus
atatatttcagtttctcagaggcat

SEQ ID NO: 234185 - DNA, 25 bp, Mus musculus
atatatttcattctacctgttcaaa

SEQ ID NO: 234186 - DNA, 25 bp, Mus musculus
atatatttcattgtacctgttcaaa

SEQ ID NO: 234187 - DNA, 25 bp, Mus musculus
atatatttcctaatcattccttgtg

SEQ ID NO: 234188 - DNA, 25 bp, Mus musculus
atatatttcctattcattccttgtg

SEQ ID NO: 234189 - DNA, 25 bp, Mus musculus
atatatttctgcaacctggattttc

SEQ ID NO: 234190 - DNA, 25 bp, Mus musculus
atatatttctgctacctggattttc

SEQ ID NO: 234191 - DNA, 25 bp, Mus musculus
atatatttggagatggcagcaggcc

SEQ ID NO: 234192 - DNA, 25 bp, Mus musculus
atatatttggagttggcagcaggcc

SEQ ID NO: 234193 - DNA, 25 bp, Mus musculus
atatatttggcaacttgtgtttgta

SEQ ID NO: 234194 - DNA, 25 bp, Mus musculus
atatatttggcatcttgtgtttgta

SEQ ID NO: 234195 - DNA, 25 bp, Mus musculus
atatattttactaccagcttcaaac

SEQ ID NO: 234196 - DNA, 25 bp, Mus musculus
atatattttacttccagcttcaaac

SEQ ID NO: 234197 - DNA, 25 bp, Mus musculus
atatattttatcacccagtcctcac

SEQ ID NO: 234198 - DNA, 25 bp, Mus musculus
atatattttatctcccagtcctcac

SEQ ID NO: 234199 - DNA, 25 bp, Mus musculus
atatattttcagaaactacccagtt

SEQ ID NO: 234200 - DNA, 25 bp, Mus musculus
atatattttcagcttctgcccacac

SEQ ID NO: 234201 - DNA, 25 bp, Mus musculus
atatattttcaggttctgcccacac

SEQ ID NO: 234202 - DNA, 25 bp, Mus musculus
atatattttcagtaactacccagtt

SEQ ID NO: 234203 - DNA, 25 bp, Mus musculus
atatattttgctaatggtggtacat

SEQ ID NO: 234204 - DNA, 25 bp, Mus musculus
atatattttgcttatggtggtacat

SEQ ID NO: 234205 - DNA, 25 bp, Mus musculus
atatatttttggctcacaggaggag

SEQ ID NO: 234206 - DNA, 25 bp, Mus musculus
atatatttttgggtcacaggaggag

SEQ ID NO: 234207 - DNA, 25 bp, Mus musculus
atatattttttaactctgtgtactt

SEQ ID NO: 234208 - DNA, 25 bp, Mus musculus
atatattttttatctctgtgtactt

SEQ ID NO: 234209 - DNA, 25 bp, Mus musculus
atatcaaaacagaaggcattcccta

SEQ ID NO: 234210 - DNA, 25 bp, Mus musculus
atatcaaaacagtaggcattcccta

SEQ ID NO: 234211 - DNA, 25 bp, Mus musculus
atatcaaacacaatggatcccacga

SEQ ID NO: 234212 - DNA, 25 bp, Mus musculus
atatcaaacacattggatcccacga

SEQ ID NO: 234213 - DNA, 25 bp, Mus musculus
atatcaaaggccaataagctctttt

SEQ ID NO: 234214 - DNA, 25 bp, Mus musculus
atatcaaaggcctataagctctttt

SEQ ID NO: 234215 - DNA, 25 bp, Mus musculus
atatcaaatacgagcgtgtgcgcgc

SEQ ID NO: 234216 - DNA, 25 bp, Mus musculus
atatcaaatacgtgcgtgtgcgcgc

SEQ ID NO: 234217 - DNA, 25 bp, Mus musculus
atatcaaatgtcattaaacactgag

SEQ ID NO: 234218 - DNA, 25 bp, Mus musculus
atatcaaatgtctttaaacactgag

SEQ ID NO: 234219 - DNA, 25 bp, Mus musculus
atatcaacaaatcgcctgtggtgca

SEQ ID NO: 234220 - DNA, 25 bp, Mus musculus
atatcaacaaatggcctgtggtgca

SEQ ID NO: 234221 - DNA, 25 bp, Mus musculus
atatcaacagacaattaatgggctc

SEQ ID NO: 234222 - DNA, 25 bp, Mus musculus
atatcaacagactattaatgggctc

SEQ ID NO: 234223 - DNA, 25 bp, Mus musculus
atatcaacagagctattttaccata

SEQ ID NO: 234224 - DNA, 25 bp, Mus musculus
atatcaacagaggtattttaccata

SEQ ID NO: 234225 - DNA, 25 bp, Mus musculus
atatcaaccactccagactccttag

SEQ ID NO: 234226 - DNA, 25 bp, Mus musculus
atatcaaccactgcagactccttag

SEQ ID NO: 234227 - DNA, 25 bp, Mus musculus
atatcaacggcactctcagttcagg

SEQ ID NO: 234228 - DNA, 25 bp, Mus musculus
atatcaacggcagtctcagttcagg

SEQ ID NO: 234229 - DNA, 25 bp, Mus musculus
atatcaactctaacggccagtcaat

SEQ ID NO: 234230 - DNA, 25 bp, Mus musculus
atatcaactctatcggccagtcaat

SEQ ID NO: 234231 - DNA, 25 bp, Mus musculus
atatcaagctcccaaagatccgggc

SEQ ID NO: 234232 - DNA, 25 bp, Mus musculus
atatcaagctccgaaagatccgggc

SEQ ID NO: 234233 - DNA, 25 bp, Mus musculus
atatcaaggtgtcccccaagaattc

SEQ ID NO: 234234 - DNA, 25 bp, Mus musculus
atatcaaggtgtgccccaagaattc

SEQ ID NO: 234235 - DNA, 25 bp, Mus musculus
atatcaagttggcttcccttgtgct

SEQ ID NO: 234236 - DNA, 25 bp, Mus musculus
atatcaagttgggttcccttgtgct

SEQ ID NO: 234237 - DNA, 25 bp, Mus musculus
atatcaatccggcagggacttgagt

SEQ ID NO: 234238 - DNA, 25 bp, Mus musculus
atatcaatccgggagggacttgagt

SEQ ID NO: 234239 - DNA, 25 bp, Mus musculus
atatcacaagcaccaggccaggcct

SEQ ID NO: 234240 - DNA, 25 bp, Mus musculus
atatcacaagcagcaggccaggcct

SEQ ID NO: 234241 - DNA, 25 bp, Mus musculus
atatcacaagtaaggtctctagccc

SEQ ID NO: 234242 - DNA, 25 bp, Mus musculus
atatcacaagtatggtctctagccc

SEQ ID NO: 234243 - DNA, 25 bp, Mus musculus
atatcacacaccagcagcatggaca

SEQ ID NO: 234244 - DNA, 25 bp, Mus musculus
atatcacacacctgcagcatggaca

SEQ ID NO: 234245 - DNA, 25 bp, Mus musculus
atatcacaccagacagatgcgctca

SEQ ID NO: 234246 - DNA, 25 bp, Mus musculus
atatcacaccagtcagatgcgctca

SEQ ID NO: 234247 - DNA, 25 bp, Mus musculus
atatcacacctccaaggtcaggaag

SEQ ID NO: 234248 - DNA, 25 bp, Mus musculus
atatcacacctcgaaggtcaggaag

SEQ ID NO: 234249 - DNA, 25 bp, Mus musculus
atatcacagatgaattagagacacc

SEQ ID NO: 234250 - DNA, 25 bp, Mus musculus
atatcacagatgtattagagacacc

SEQ ID NO: 234251 - DNA, 25 bp, Mus musculus
atatcacaggtgaaccatctggcct

SEQ ID NO: 234252 - DNA, 25 bp, Mus musculus
atatcacaggtgtaccatctggcct

SEQ ID NO: 234253 - DNA, 25 bp, Mus musculus
atatcacagtttcagatttcatggt

SEQ ID NO: 234254 - DNA, 25 bp, Mus musculus
atatcacagtttgagatttcatggt

SEQ ID NO: 234255 - DNA, 25 bp, Mus musculus
atatcacataataccaaggcttgtc

SEQ ID NO: 234256 - DNA, 25 bp, Mus musculus
atatcacataattccaaggcttgtc

SEQ ID NO: 234257 - DNA, 25 bp, Mus musculus
atatcacatgcccaatggcccaata

SEQ ID NO: 234258 - DNA, 25 bp, Mus musculus
atatcacatgccgaatggcccaata

SEQ ID NO: 234259 - DNA, 25 bp, Mus musculus
atatcacatgtaattaactgccagc

SEQ ID NO: 234260 - DNA, 25 bp, Mus musculus
atatcacatgtacaatgccgacagc

SEQ ID NO: 234261 - DNA, 25 bp, Mus musculus
atatcacatgtagaatgccgacagc

SEQ ID NO: 234262 - DNA, 25 bp, Mus musculus
atatcacatgtatttaactgccagc

SEQ ID NO: 234263 - DNA, 25 bp, Mus musculus
atatcaccatccatgtgacactggc

SEQ ID NO: 234264 - DNA, 25 bp, Mus musculus
atatcaccatccttgtgacactggc

SEQ ID NO: 234265 - DNA, 25 bp, Mus musculus
atatcaccatttaccctacgaacag

SEQ ID NO: 234266 - DNA, 25 bp, Mus musculus
atatcaccattttccctacgaacag

SEQ ID NO: 234267 - DNA, 25 bp, Mus musculus
atatcacccgtcattattctctggg

SEQ ID NO: 234268 - DNA, 25 bp, Mus musculus
atatcacccgtctttattctctggg

SEQ ID NO: 234269 - DNA, 25 bp, Mus musculus
atatcacccttcaggctatatctac

SEQ ID NO: 234270 - DNA, 25 bp, Mus musculus
atatcacccttctggctatatctac

SEQ ID NO: 234271 - DNA, 25 bp, Mus musculus
atatcacctaccatcgaatctcagt

SEQ ID NO: 234272 - DNA, 25 bp, Mus musculus
atatcacctaccttcgaatctcagt

SEQ ID NO: 234273 - DNA, 25 bp, Mus musculus
atatcacctcacaggctgtgaagcg

SEQ ID NO: 234274 - DNA, 25 bp, Mus musculus
atatcacctcactggctgtgaagcg

SEQ ID NO: 234275 - DNA, 25 bp, Mus musculus
atatcacctctcaaaagcatcacct

SEQ ID NO: 234276 - DNA, 25 bp, Mus musculus
atatcacctctctaaagcatcacct

SEQ ID NO: 234277 - DNA, 25 bp, Mus musculus
atatcacctgaaccctcgaaaccat

SEQ ID NO: 234278 - DNA, 25 bp, Mus musculus
atatcacctgaagcctcgaaaccat

SEQ ID NO: 234279 - DNA, 25 bp, Mus musculus
atatcacctgcaacaacttgacaag

SEQ ID NO: 234280 - DNA, 25 bp, Mus musculus
atatcacctgcatcaacttgacaag

SEQ ID NO: 234281 - DNA, 25 bp, Mus musculus
atatcacctgttcaggacaggcccc

SEQ ID NO: 234282 - DNA, 25 bp, Mus musculus
atatcacctgttgaggacaggcccc

SEQ ID NO: 234283 - DNA, 25 bp, Mus musculus
atatcaccttcgatcacggtctcgt

SEQ ID NO: 234284 - DNA, 25 bp, Mus musculus
atatcaccttcgttcacggtctcgt

SEQ ID NO: 234285 - DNA, 25 bp, Mus musculus
atatcaccttctcagttttacgcgg

SEQ ID NO: 234286 - DNA, 25 bp, Mus musculus
atatcaccttctgagttttacgcgg

SEQ ID NO: 234287 - DNA, 25 bp, Mus musculus
atatcaccttgaccacccatgaatg

SEQ ID NO: 234288 - DNA, 25 bp, Mus musculus
atatcaccttgagcacccatgaatg

SEQ ID NO: 234289 - DNA, 25 bp, Mus musculus
atatcacgagtaagattcgcgtcct

SEQ ID NO: 234290 - DNA, 25 bp, Mus musculus
atatcacgagtatgattcgcgtcct

SEQ ID NO: 234291 - DNA, 25 bp, Mus musculus
atatcacgggtaatagctaagcatc

SEQ ID NO: 234292 - DNA, 25 bp, Mus musculus
atatcacgggtattagctaagcatc

SEQ ID NO: 234293 - DNA, 25 bp, Mus musculus
atatcacgtagaacagaaggactta

SEQ ID NO: 234294 - DNA, 25 bp, Mus musculus
atatcacgtagatcagaaggactta

SEQ ID NO: 234295 - DNA, 25 bp, Mus musculus
atatcactaactagatttcgggtta

SEQ ID NO: 234296 - DNA, 25 bp, Mus musculus
atatcactaacttgatttcgggtta

SEQ ID NO: 234297 - DNA, 25 bp, Mus musculus
atatcactaagaagcctaggctggc

SEQ ID NO: 234298 - DNA, 25 bp, Mus musculus
atatcactaagatgcctaggctggc

SEQ ID NO: 234299 - DNA, 25 bp, Mus musculus
atatcactatgcacacacagcagag

SEQ ID NO: 234300 - DNA, 25 bp, Mus musculus
atatcactatgctcacacagcagag

SEQ ID NO: 234301 - DNA, 25 bp, Mus musculus
atatcactgacactatttatatagc

SEQ ID NO: 234302 - DNA, 25 bp, Mus musculus
atatcactgacagtatttatatagc

SEQ ID NO: 234303 - DNA, 25 bp, Mus musculus
atatcactgataacccactctgaag

SEQ ID NO: 234304 - DNA, 25 bp, Mus musculus
atatcactgatatcccactctgaag

SEQ ID NO: 234305 - DNA, 25 bp, Mus musculus
atatcactgcttactattcaaatgg

SEQ ID NO: 234306 - DNA, 25 bp, Mus musculus
atatcactgctttctattcaaatgg

SEQ ID NO: 234307 - DNA, 25 bp, Mus musculus
atatcactggtcctgagtggttggt

SEQ ID NO: 234308 - DNA, 25 bp, Mus musculus
atatcactggtcgtgagtggttggt

SEQ ID NO: 234309 - DNA, 25 bp, Mus musculus
atatcactgtcaatatatccatcag

SEQ ID NO: 234310 - DNA, 25 bp, Mus musculus
atatcactgtcattatatccatcag

SEQ ID NO: 234311 - DNA, 25 bp, Mus musculus
atatcactgtggacagatgcctgaa

SEQ ID NO: 234312 - DNA, 25 bp, Mus musculus
atatcactgtggtcagatgcctgaa

SEQ ID NO: 234313 - DNA, 25 bp, Mus musculus
atatcacttacacctttttggacag

SEQ ID NO: 234314 - DNA, 25 bp, Mus musculus
atatcacttacagctttttggacag

SEQ ID NO: 234315 - DNA, 25 bp, Mus musculus
atatcacttggtaccttgtttagaa

SEQ ID NO: 234316 - DNA, 25 bp, Mus musculus
atatcacttggttccttgtttagaa

SEQ ID NO: 234317 - DNA, 25 bp, Mus musculus
atatcacttgtaaagcttgggtctc

SEQ ID NO: 234318 - DNA, 25 bp, Mus musculus
atatcacttgtatagcttgggtctc

SEQ ID NO: 234319 - DNA, 25 bp, Mus musculus
atatcacttttcaatagctgcttta

SEQ ID NO: 234320 - DNA, 25 bp, Mus musculus
atatcacttttctatagctgcttta

SEQ ID NO: 234321 - DNA, 25 bp, Mus musculus
atatcagaacatcgccctgaagaca

SEQ ID NO: 234322 - DNA, 25 bp, Mus musculus
atatcagaacatggccctgaagaca

SEQ ID NO: 234323 - DNA, 25 bp, Mus musculus
atatcagaacctaactgggtcttta

SEQ ID NO: 234324 - DNA, 25 bp, Mus musculus
atatcagaaccttactgggtcttta

SEQ ID NO: 234325 - DNA, 25 bp, Mus musculus
atatcagaacttcaccctgcatggt

SEQ ID NO: 234326 - DNA, 25 bp, Mus musculus
atatcagaacttgaccctgcatggt

SEQ ID NO: 234327 - DNA, 25 bp, Mus musculus
atatcagacagcacaaactgcttat

SEQ ID NO: 234328 - DNA, 25 bp, Mus musculus
atatcagacagctcaaactgcttat

SEQ ID NO: 234329 - DNA, 25 bp, Mus musculus
atatcagaccaccacggagcggcct

SEQ ID NO: 234330 - DNA, 25 bp, Mus musculus
atatcagaccacgacggagcggcct

SEQ ID NO: 234331 - DNA, 25 bp, Mus musculus
atatcagactgcatatccttgccaa

SEQ ID NO: 234332 - DNA, 25 bp, Mus musculus
atatcagactgcttatccttgccaa

SEQ ID NO: 234333 - DNA, 25 bp, Mus musculus
atatcagagaccagctaactccctg

SEQ ID NO: 234334 - DNA, 25 bp, Mus musculus
atatcagagacctgctaactccctg

SEQ ID NO: 234335 - DNA, 25 bp, Mus musculus
atatcagagcccagttgacgccttt

SEQ ID NO: 234336 - DNA, 25 bp, Mus musculus
atatcagagccctgttgacgccttt

SEQ ID NO: 234337 - DNA, 25 bp, Mus musculus
atatcagatatcatgcccctgctat

SEQ ID NO: 234338 - DNA, 25 bp, Mus musculus
atatcagatatcttgcccctgctat

SEQ ID NO: 234339 - DNA, 25 bp, Mus musculus
atatcagatgccatgcaaccacttg

SEQ ID NO: 234340 - DNA, 25 bp, Mus musculus
atatcagatgccttgcaaccacttg

SEQ ID NO: 234341 - DNA, 25 bp, Mus musculus
atatcagatgttatttaccacgttt

SEQ ID NO: 234342 - DNA, 25 bp, Mus musculus
atatcagatgttttttaccacgttt

SEQ ID NO: 234343 - DNA, 25 bp, Mus musculus
atatcagcacatccgttctatctcc

SEQ ID NO: 234344 - DNA, 25 bp, Mus musculus
atatcagcacatgcgttctatctcc

SEQ ID NO: 234345 - DNA, 25 bp, Mus musculus
atatcagccaccaggactacataac

SEQ ID NO: 234346 - DNA, 25 bp, Mus musculus
atatcagccacctggactacataac

SEQ ID NO: 234347 - DNA, 25 bp, Mus musculus
atatcagcctaaagttcctgttggt

SEQ ID NO: 234348 - DNA, 25 bp, Mus musculus
atatcagcctaatgttcctgttggt

SEQ ID NO: 234349 - DNA, 25 bp, Mus musculus
atatcagcctgacaacggagggact

SEQ ID NO: 234350 - DNA, 25 bp, Mus musculus
atatcagcctgagaacggagggact

SEQ ID NO: 234351 - DNA, 25 bp, Mus musculus
atatcaggagctagcatcttttcta

SEQ ID NO: 234352 - DNA, 25 bp, Mus musculus
atatcaggagcttgcatcttttcta

SEQ ID NO: 234353 - DNA, 25 bp, Mus musculus
atatcaggcacacaggctctttgag

SEQ ID NO: 234354 - DNA, 25 bp, Mus musculus
atatcaggcacagaggctctttgag

SEQ ID NO: 234355 - DNA, 25 bp, Mus musculus
atatcaggccttcaaactacagctg

SEQ ID NO: 234356 - DNA, 25 bp, Mus musculus
atatcaggccttgaaactacagctg

SEQ ID NO: 234357 - DNA, 25 bp, Mus musculus
atatcaggtaccctgcttggagtca

SEQ ID NO: 234358 - DNA, 25 bp, Mus musculus
atatcaggtaccgtgcttggagtca

SEQ ID NO: 234359 - DNA, 25 bp, Mus musculus
atatcagtacaacttaccccttctc

SEQ ID NO: 234360 - DNA, 25 bp, Mus musculus
atatcagtacaagttaccccttctc

SEQ ID NO: 234361 - DNA, 25 bp, Mus musculus
atatcagtagagaccccacataaga

SEQ ID NO: 234362 - DNA, 25 bp, Mus musculus
atatcagtagagtccccacataaga

SEQ ID NO: 234363 - DNA, 25 bp, Mus musculus
atatcagtgggacgaacagcccttg

SEQ ID NO: 234364 - DNA, 25 bp, Mus musculus
atatcagtgggaggaacagcccttg

SEQ ID NO: 234365 - DNA, 25 bp, Mus musculus
atatcagtgtacaactccagagaga

SEQ ID NO: 234366 - DNA, 25 bp, Mus musculus
atatcagtgtactactccagagaga

SEQ ID NO: 234367 - DNA, 25 bp, Mus musculus
atatcagtgtgacttgtcgatccat

SEQ ID NO: 234368 - DNA, 25 bp, Mus musculus
atatcagtgtgagttgtcgatccat

SEQ ID NO: 234369 - DNA, 25 bp, Mus musculus
atatcagttgagaattcatttatgc

SEQ ID NO: 234370 - DNA, 25 bp, Mus musculus
atatcagttgagtattcatttatgc

SEQ ID NO: 234371 - DNA, 25 bp, Mus musculus
atatcagttgccatctgcataggag

SEQ ID NO: 234372 - DNA, 25 bp, Mus musculus
atatcagttgccttctgcataggag

SEQ ID NO: 234373 - DNA, 25 bp, Mus musculus
atatcataaatgcatctggtcagta

SEQ ID NO: 234374 - DNA, 25 bp, Mus musculus
atatcataaatggatctggtcagta

SEQ ID NO: 234375 - DNA, 25 bp, Mus musculus
atatcataattcatgtgttgctttc

SEQ ID NO: 234376 - DNA, 25 bp, Mus musculus
atatcataattcttgtgttgctttc

SEQ ID NO: 234377 - DNA, 25 bp, Mus musculus
atatcatacacaaacgagcagggcc

SEQ ID NO: 234378 - DNA, 25 bp, Mus musculus
atatcatacacatacgagcagggcc

SEQ ID NO: 234379 - DNA, 25 bp, Mus musculus
atatcataccaaatacctacaaaca

SEQ ID NO: 234380 - DNA, 25 bp, Mus musculus
atatcataccaattacctacaaaca

SEQ ID NO: 234381 - DNA, 25 bp, Mus musculus
atatcataccataccttgcctggtg

SEQ ID NO: 234382 - DNA, 25 bp, Mus musculus
atatcataccattccttgcctggtg

SEQ ID NO: 234383 - DNA, 25 bp, Mus musculus
atatcatatattatcagcttctctt

SEQ ID NO: 234384 - DNA, 25 bp, Mus musculus
atatcatatattttcagcttctctt

SEQ ID NO: 234385 - DNA, 25 bp, Mus musculus
atatcatattatcttctggttaccg

SEQ ID NO: 234386 - DNA, 25 bp, Mus musculus
atatcatattatgttctggttaccg

SEQ ID NO: 234387 - DNA, 25 bp, Mus musculus
atatcatcaactagcctgacttaga

SEQ ID NO: 234388 - DNA, 25 bp, Mus musculus
atatcatcaacttgcctgacttaga

SEQ ID NO: 234389 - DNA, 25 bp, Mus musculus
atatcatcaccccaactttttatat

SEQ ID NO: 234390 - DNA, 25 bp, Mus musculus
atatcatcacccgaactttttatat

SEQ ID NO: 234391 - DNA, 25 bp, Mus musculus
atatcatcactccagcaggtgggca

SEQ ID NO: 234392 - DNA, 25 bp, Mus musculus
atatcatcactcgagcaggtgggca

SEQ ID NO: 234393 - DNA, 25 bp, Mus musculus
atatcatccacaagacggcgggcaa

SEQ ID NO: 234394 - DNA, 25 bp, Mus musculus
atatcatccacatgacggcgggcaa

SEQ ID NO: 234395 - DNA, 25 bp, Mus musculus
atatcatcctatatttagcaatatg

SEQ ID NO: 234396 - DNA, 25 bp, Mus musculus
atatcatcctatttttagcaatatg

SEQ ID NO: 234397 - DNA, 25 bp, Mus musculus
atatcatcggctcccagcagaagtt

SEQ ID NO: 234398 - DNA, 25 bp, Mus musculus
atatcatcggctgccagcagaagtt

SEQ ID NO: 234399 - DNA, 25 bp, Mus musculus
atatcatcgtggctacccctggccg

SEQ ID NO: 234400 - DNA, 25 bp, Mus musculus
atatcatcgtgggtacccctggccg

SEQ ID NO: 234401 - DNA, 25 bp, Mus musculus
atatcatctcaaccaaaagctgcag

SEQ ID NO: 234402 - DNA, 25 bp, Mus musculus
atatcatctcaagcaaaagctgcag

SEQ ID NO: 234403 - DNA, 25 bp, Mus musculus
atatcatctcggatgaaactcccac

SEQ ID NO: 234404 - DNA, 25 bp, Mus musculus
atatcatctcggttgaaactcccac

SEQ ID NO: 234405 - DNA, 25 bp, Mus musculus
atatcatctgctccacatgtggttc

SEQ ID NO: 234406 - DNA, 25 bp, Mus musculus
atatcatctgctgcacatgtggttc

SEQ ID NO: 234407 - DNA, 25 bp, Mus musculus
atatcatcttgaaggccagctgcca

SEQ ID NO: 234408 - DNA, 25 bp, Mus musculus
atatcatcttgatggccagctgcca

SEQ ID NO: 234409 - DNA, 25 bp, Mus musculus
atatcatgaagactagttttccagg

SEQ ID NO: 234410 - DNA, 25 bp, Mus musculus
atatcatgaagagtagttttccagg

SEQ ID NO: 234411 - DNA, 25 bp, Mus musculus
atatcatgacccctaatgtttggga

SEQ ID NO: 234412 - DNA, 25 bp, Mus musculus
atatcatgacccgtaatgtttggga

SEQ ID NO: 234413 - DNA, 25 bp, Mus musculus
atatcatgcaagagtggcagatggc

SEQ ID NO: 234414 - DNA, 25 bp, Mus musculus
atatcatgcaagtgtggcagatggc

SEQ ID NO: 234415 - DNA, 25 bp, Mus musculus
atatcatgcctactttctcctcgta

SEQ ID NO: 234416 - DNA, 25 bp, Mus musculus
atatcatgcctagtttctcctcgta

SEQ ID NO: 234417 - DNA, 25 bp, Mus musculus
atatcatggcgacctgagcctctca

SEQ ID NO: 234418 - DNA, 25 bp, Mus musculus
atatcatggcgagctgagcctctca

SEQ ID NO: 234419 - DNA, 25 bp, Mus musculus
atatcatggttgcacaggcccgcga

SEQ ID NO: 234420 - DNA, 25 bp, Mus musculus
atatcatggttggacaggcccgcga

SEQ ID NO: 234421 - DNA, 25 bp, Mus musculus
atatcatgtacacggcacgccttga

SEQ ID NO: 234422 - DNA, 25 bp, Mus musculus
atatcatgtacagggcacgccttga

SEQ ID NO: 234423 - DNA, 25 bp, Mus musculus
atatcatgtgctcccgacgggaagg

SEQ ID NO: 234424 - DNA, 25 bp, Mus musculus
atatcatgtgctgccgacgggaagg

SEQ ID NO: 234425 - DNA, 25 bp, Mus musculus
atatcatgtgtgcacactgaaggat

SEQ ID NO: 234426 - DNA, 25 bp, Mus musculus
atatcatgtgtggacactgaaggat

SEQ ID NO: 234427 - DNA, 25 bp, Mus musculus
atatcattcaaaacagaggcagggt

SEQ ID NO: 234428 - DNA, 25 bp, Mus musculus
atatcattcaaatcagaggcagggt

SEQ ID NO: 234429 - DNA, 25 bp, Mus musculus
atatcattcataacggactgcttga

SEQ ID NO: 234430 - DNA, 25 bp, Mus musculus
atatcattcataatccagcctctgt

SEQ ID NO: 234431 - DNA, 25 bp, Mus musculus
atatcattcatatcggactgcttga

SEQ ID NO: 234432 - DNA, 25 bp, Mus musculus
atatcattcatattccagcctctgt

SEQ ID NO: 234433 - DNA, 25 bp, Mus musculus
atatcattccagaacattccgttgt

SEQ ID NO: 234434 - DNA, 25 bp, Mus musculus
atatcattccagtacattccgttgt

SEQ ID NO: 234435 - DNA, 25 bp, Mus musculus
atatcattcctgcttaagctccttt

SEQ ID NO: 234436 - DNA, 25 bp, Mus musculus
atatcattcctggttaagctccttt

SEQ ID NO: 234437 - DNA, 25 bp, Mus musculus
atatcattcttgctcgtagctttgc

SEQ ID NO: 234438 - DNA, 25 bp, Mus musculus
atatcattcttggtcgtagctttgc

SEQ ID NO: 234439 - DNA, 25 bp, Mus musculus
atatcattgcttcctttcatggctg

SEQ ID NO: 234440 - DNA, 25 bp, Mus musculus
atatcattgcttgctttcatggctg

SEQ ID NO: 234441 - DNA, 25 bp, Mus musculus
atatcattgtgtacatacagagagc

SEQ ID NO: 234442 - DNA, 25 bp, Mus musculus
atatcattgtgttcatacagagagc

SEQ ID NO: 234443 - DNA, 25 bp, Mus musculus
atatccaaatttctctggactcccc

SEQ ID NO: 234444 - DNA, 25 bp, Mus musculus
atatccaaatttgtctggactcccc

SEQ ID NO: 234445 - DNA, 25 bp, Mus musculus
atatccaagtacatttcctgcttcc

SEQ ID NO: 234446 - DNA, 25 bp, Mus musculus
atatccaagtacttttcctgcttcc

SEQ ID NO: 234447 - DNA, 25 bp, Mus musculus
atatccaatactcacatcttaaaag

SEQ ID NO: 234448 - DNA, 25 bp, Mus musculus
atatccaatactgacatcttaaaag

SEQ ID NO: 234449 - DNA, 25 bp, Mus musculus
atatccaatctcatttaaaattcaa

SEQ ID NO: 234450 - DNA, 25 bp, Mus musculus
atatccaatctcttttaaaattcaa

SEQ ID NO: 234451 - DNA, 25 bp, Mus musculus
atatccaattccaatccaccctata

SEQ ID NO: 234452 - DNA, 25 bp, Mus musculus
atatccaattcctatccaccctata

SEQ ID NO: 234453 - DNA, 25 bp, Mus musculus
atatccacacaaacagtttcacacc

SEQ ID NO: 234454 - DNA, 25 bp, Mus musculus
atatccacacaatcagtttcacacc

SEQ ID NO: 234455 - DNA, 25 bp, Mus musculus
atatccacagataagtgtagctctt

SEQ ID NO: 234456 - DNA, 25 bp, Mus musculus
atatccacagattagtgtagctctt

SEQ ID NO: 234457 - DNA, 25 bp, Mus musculus
atatccaccagtcaacctgagcgtg

SEQ ID NO: 234458 - DNA, 25 bp, Mus musculus
atatccaccagtgaacctgagcgtg

SEQ ID NO: 234459 - DNA, 25 bp, Mus musculus
atatccaccattctctggctgcctt

SEQ ID NO: 234460 - DNA, 25 bp, Mus musculus
atatccaccattgtctggctgcctt

SEQ ID NO: 234461 - DNA, 25 bp, Mus musculus
atatccacccatatgagcatgtgac

SEQ ID NO: 234462 - DNA, 25 bp, Mus musculus
atatccacccatttgagcatgtgac

SEQ ID NO: 234463 - DNA, 25 bp, Mus musculus
atatccaccctccagtgacactgat

SEQ ID NO: 234464 - DNA, 25 bp, Mus musculus
atatccaccctcgagtgacactgat

SEQ ID NO: 234465 - DNA, 25 bp, Mus musculus
atatccaccgctacttttaattcct

SEQ ID NO: 234466 - DNA, 25 bp, Mus musculus
atatccaccgcttcttttaattcct

SEQ ID NO: 234467 - DNA, 25 bp, Mus musculus
atatccaccttcatttcaacagttc

SEQ ID NO: 234468 - DNA, 25 bp, Mus musculus
atatccaccttcttttcaacagttc

SEQ ID NO: 234469 - DNA, 25 bp, Mus musculus
atatccacggtacactgaggcatgt

SEQ ID NO: 234470 - DNA, 25 bp, Mus musculus
atatccacggtagactgaggcatgt

SEQ ID NO: 234471 - DNA, 25 bp, Mus musculus
atatccactacaagtgctgctgtgc

SEQ ID NO: 234472 - DNA, 25 bp, Mus musculus
atatccactacatgtgctgctgtgc

SEQ ID NO: 234473 - DNA, 25 bp, Mus musculus
atatccactctcatacttttatgct

SEQ ID NO: 234474 - DNA, 25 bp, Mus musculus
atatccactctcttacttttatgct

SEQ ID NO: 234475 - DNA, 25 bp, Mus musculus
atatccactgcaaactcagttgtag

SEQ ID NO: 234476 - DNA, 25 bp, Mus musculus
atatccactgcatactcagttgtag

SEQ ID NO: 234477 - DNA, 25 bp, Mus musculus
atatccagcggaatgaagtcagcag

SEQ ID NO: 234478 - DNA, 25 bp, Mus musculus
atatccagcggattgaagtcagcag

SEQ ID NO: 234479 - DNA, 25 bp, Mus musculus
atatccagcggtaattttattcatt

SEQ ID NO: 234480 - DNA, 25 bp, Mus musculus
atatccagcggttattttattcatt

SEQ ID NO: 234481 - DNA, 25 bp, Mus musculus
atatccaggaaactctgtgtgccct

SEQ ID NO: 234482 - DNA, 25 bp, Mus musculus
atatccaggaaagtctgtgtgccct

SEQ ID NO: 234483 - DNA, 25 bp, Mus musculus
atatccaggagcacattcggtctgc

SEQ ID NO: 234484 - DNA, 25 bp, Mus musculus
atatccaggagctcattcggtctgc

SEQ ID NO: 234485 - DNA, 25 bp, Mus musculus
atatccagggcacagtgcggtgtaa

SEQ ID NO: 234486 - DNA, 25 bp, Mus musculus
atatccagggcagagtgcggtgtaa

SEQ ID NO: 234487 - DNA, 25 bp, Mus musculus
atatccagtagcagattctgttact

SEQ ID NO: 234488 - DNA, 25 bp, Mus musculus
atatccagtagctgattctgttact

SEQ ID NO: 234489 - DNA, 25 bp, Mus musculus
atatccagtcaccaaatccagacac

SEQ ID NO: 234490 - DNA, 25 bp, Mus musculus
atatccagtcacgaaatccagacac

SEQ ID NO: 234491 - DNA, 25 bp, Mus musculus
atatccagtcatcttgaccgccatg

SEQ ID NO: 234492 - DNA, 25 bp, Mus musculus
atatccagtcatgttgaccgccatg

SEQ ID NO: 234493 - DNA, 25 bp, Mus musculus
atatccagtgacaaccatgtttact

SEQ ID NO: 234494 - DNA, 25 bp, Mus musculus
atatccagtgactaccatgtttact

SEQ ID NO: 234495 - DNA, 25 bp, Mus musculus
atatccagtgtcatggtggtggcag

SEQ ID NO: 234496 - DNA, 25 bp, Mus musculus
atatccagtgtcttggtggtggcag

SEQ ID NO: 234497 - DNA, 25 bp, Mus musculus
atatccagttataaccatttgggtt

SEQ ID NO: 234498 - DNA, 25 bp, Mus musculus
atatccagttattaccatttgggtt

SEQ ID NO: 234499 - DNA, 25 bp, Mus musculus
atatccatatctaaggtcttgcctc

SEQ ID NO: 234500 - DNA, 25 bp, Mus musculus
atatccatatcttaggtcttgcctc

SEQ ID NO: 234501 - DNA, 25 bp, Mus musculus
atatccatccttagatgctctcttc

SEQ ID NO: 234502 - DNA, 25 bp, Mus musculus
atatccatccttcggctttgaggat

SEQ ID NO: 234503 - DNA, 25 bp, Mus musculus
atatccatccttgggctttgaggat

SEQ ID NO: 234504 - DNA, 25 bp, Mus musculus
atatccatcctttgatgctctcttc

SEQ ID NO: 234505 - DNA, 25 bp, Mus musculus
atatccatctttcttgtggcaggtg

SEQ ID NO: 234506 - DNA, 25 bp, Mus musculus
atatccatctttgttgtggcaggtg

SEQ ID NO: 234507 - DNA, 25 bp, Mus musculus
atatccatgatgatttccagttaac

SEQ ID NO: 234508 - DNA, 25 bp, Mus musculus
atatccatgatgttttccagttaac

SEQ ID NO: 234509 - DNA, 25 bp, Mus musculus
atatccatgccaaatcatgtgtgca

SEQ ID NO: 234510 - DNA, 25 bp, Mus musculus
atatccatgccatatcatgtgtgca

SEQ ID NO: 234511 - DNA, 25 bp, Mus musculus
atatccatgggcacaccgaatctat

SEQ ID NO: 234512 - DNA, 25 bp, Mus musculus
atatccatgggctcaccgaatctat

SEQ ID NO: 234513 - DNA, 25 bp, Mus musculus
atatccatggttctgtggtcctgaa

SEQ ID NO: 234514 - DNA, 25 bp, Mus musculus
atatccatggttgtgtggtcctgaa

SEQ ID NO: 234515 - DNA, 25 bp, Mus musculus
atatccatgtctaccagaaggctgg

SEQ ID NO: 234516 - DNA, 25 bp, Mus musculus
atatccatgtcttccagaaggctgg

SEQ ID NO: 234517 - DNA, 25 bp, Mus musculus
atatccatgtgcactggtcactttc

SEQ ID NO: 234518 - DNA, 25 bp, Mus musculus
atatccatgtgctctggtcactttc

SEQ ID NO: 234519 - DNA, 25 bp, Mus musculus
atatccattggccaggaagctcaga

SEQ ID NO: 234520 - DNA, 25 bp, Mus musculus
atatccattggcgaggaagctcaga

SEQ ID NO: 234521 - DNA, 25 bp, Mus musculus
atatccatttaaactccttttatag

SEQ ID NO: 234522 - DNA, 25 bp, Mus musculus
atatccatttaatctccttttatag

SEQ ID NO: 234523 - DNA, 25 bp, Mus musculus
atatccatttgtccgttaatgttta

SEQ ID NO: 234524 - DNA, 25 bp, Mus musculus
atatccatttgtgcgttaatgttta

SEQ ID NO: 234525 - DNA, 25 bp, Mus musculus
atatccattttcatcttccaatagc

SEQ ID NO: 234526 - DNA, 25 bp, Mus musculus
atatccattttcttcttccaatagc

SEQ ID NO: 234527 - DNA, 25 bp, Mus musculus
atatcccaaaggaagatctcttgtc

SEQ ID NO: 234528 - DNA, 25 bp, Mus musculus
atatcccaaaggtagatctcttgtc

SEQ ID NO: 234529 - DNA, 25 bp, Mus musculus
atatcccaacccaatgaactggtaa

SEQ ID NO: 234530 - DNA, 25 bp, Mus musculus
atatcccaaccctatgaactggtaa

SEQ ID NO: 234531 - DNA, 25 bp, Mus musculus
atatcccaactcattctaagtgccc

SEQ ID NO: 234532 - DNA, 25 bp, Mus musculus
atatcccaactctttctaagtgccc

SEQ ID NO: 234533 - DNA, 25 bp, Mus musculus
atatcccaagttcttggtgccctaa

SEQ ID NO: 234534 - DNA, 25 bp, Mus musculus
atatcccaagttgttggtgccctaa

SEQ ID NO: 234535 - DNA, 25 bp, Mus musculus
atatcccaatgtcacggtagccagt

SEQ ID NO: 234536 - DNA, 25 bp, Mus musculus
atatcccaatgtgacggtagccagt

SEQ ID NO: 234537 - DNA, 25 bp, Mus musculus
atatcccaattcaacttcttggaag

SEQ ID NO: 234538 - DNA, 25 bp, Mus musculus
atatcccaattctacttcttggaag

SEQ ID NO: 234539 - DNA, 25 bp, Mus musculus
atatcccacatgctgcctttgactt

SEQ ID NO: 234540 - DNA, 25 bp, Mus musculus
atatcccacatggtgcctttgactt

SEQ ID NO: 234541 - DNA, 25 bp, Mus musculus
atatcccacgtcagaacctgctctt

SEQ ID NO: 234542 - DNA, 25 bp, Mus musculus
atatcccacgtctgaacctgctctt

SEQ ID NO: 234543 - DNA, 25 bp, Mus musculus
atatcccagcccatgtgagttggaa

SEQ ID NO: 234544 - DNA, 25 bp, Mus musculus
atatcccagcccttgtgagttggaa

SEQ ID NO: 234545 - DNA, 25 bp, Mus musculus
atatcccaggacatctcaagcggta

SEQ ID NO: 234546 - DNA, 25 bp, Mus musculus
atatcccaggacttctcaagcggta

SEQ ID NO: 234547 - DNA, 25 bp, Mus musculus
atatcccaggtaaacgtcacactct

SEQ ID NO: 234548 - DNA, 25 bp, Mus musculus
atatcccaggtatacgtcacactct

SEQ ID NO: 234549 - DNA, 25 bp, Mus musculus
atatcccatactaacactctgactt

SEQ ID NO: 234550 - DNA, 25 bp, Mus musculus
atatcccatacttacactctgactt

SEQ ID NO: 234551 - DNA, 25 bp, Mus musculus
atatcccatgtgcaacactgaccac

SEQ ID NO: 234552 - DNA, 25 bp, Mus musculus
atatcccatgtggaacactgaccac

SEQ ID NO: 234553 - DNA, 25 bp, Mus musculus
atatcccattggattgtttcagagg

SEQ ID NO: 234554 - DNA, 25 bp, Mus musculus
atatcccattggtttgtttcagagg

SEQ ID NO: 234555 - DNA, 25 bp, Mus musculus
atatccccaaagctacatgaccaaa

SEQ ID NO: 234556 - DNA, 25 bp, Mus musculus
atatccccaaaggtacatgaccaaa

SEQ ID NO: 234557 - DNA, 25 bp, Mus musculus
atatccccaagcaccaagaatcatg

SEQ ID NO: 234558 - DNA, 25 bp, Mus musculus
atatccccaagctccaagaatcatg

SEQ ID NO: 234559 - DNA, 25 bp, Mus musculus
atatccccaagtcggaactgtttct

SEQ ID NO: 234560 - DNA, 25 bp, Mus musculus
atatccccaagtgggaactgtttct

SEQ ID NO: 234561 - DNA, 25 bp, Mus musculus
atatccccagtaattcatcattttc

SEQ ID NO: 234562 - DNA, 25 bp, Mus musculus
atatccccagtatttcatcattttc

SEQ ID NO: 234563 - DNA, 25 bp, Mus musculus
atatccccagtcagtggagctgtgt

SEQ ID NO: 234564 - DNA, 25 bp, Mus musculus
atatccccagtctgtggagctgtgt

SEQ ID NO: 234565 - DNA, 25 bp, Mus musculus
atatcccccactaaacaaatcatca

SEQ ID NO: 234566 - DNA, 25 bp, Mus musculus
atatcccccacttaacaaatcatca

SEQ ID NO: 234567 - DNA, 25 bp, Mus musculus
atatcccctataaagatctcgtccc

SEQ ID NO: 234568 - DNA, 25 bp, Mus musculus
atatcccctatatagatctcgtccc

SEQ ID NO: 234569 - DNA, 25 bp, Mus musculus
atatcccctcttcgtacactgttaa

SEQ ID NO: 234570 - DNA, 25 bp, Mus musculus
atatcccctcttggtacactgttaa

SEQ ID NO: 234571 - DNA, 25 bp, Mus musculus
atatcccgaactaacctggccagag

SEQ ID NO: 234572 - DNA, 25 bp, Mus musculus
atatcccgaacttacctggccagag

SEQ ID NO: 234573 - DNA, 25 bp, Mus musculus
atatcccgactaagagtccaaaggc

SEQ ID NO: 234574 - DNA, 25 bp, Mus musculus
atatcccgactatgagtccaaaggc

SEQ ID NO: 234575 - DNA, 25 bp, Mus musculus
atatcccgccagagggtgggcagca

SEQ ID NO: 234576 - DNA, 25 bp, Mus musculus
atatcccgccagtgggtgggcagca

SEQ ID NO: 234577 - DNA, 25 bp, Mus musculus
atatcccgtaccaatgatgcaacaa

SEQ ID NO: 234578 - DNA, 25 bp, Mus musculus
atatcccgtacctatgatgcaacaa

SEQ ID NO: 234579 - DNA, 25 bp, Mus musculus
atatcccgtactcagcatctcatgg

SEQ ID NO: 234580 - DNA, 25 bp, Mus musculus
atatcccgtactgagcatctcatgg

SEQ ID NO: 234581 - DNA, 25 bp, Mus musculus
atatcccgtgctcgttctgtggagc

SEQ ID NO: 234582 - DNA, 25 bp, Mus musculus
atatcccgtgctggttctgtggagc

SEQ ID NO: 234583 - DNA, 25 bp, Mus musculus
atatccctatctctatcaatgagca

SEQ ID NO: 234584 - DNA, 25 bp, Mus musculus
atatccctatctgtatcaatgagca

SEQ ID NO: 234585 - DNA, 25 bp, Mus musculus
atatccctcattccttgttcaaatt

SEQ ID NO: 234586 - DNA, 25 bp, Mus musculus
atatccctcattgcttgttcaaatt

SEQ ID NO: 234587 - DNA, 25 bp, Mus musculus
atatccctcctccagaagatcactg

SEQ ID NO: 234588 - DNA, 25 bp, Mus musculus
atatccctcctcgagaagatcactg

SEQ ID NO: 234589 - DNA, 25 bp, Mus musculus
atatccctcgcaacttgttccgtat

SEQ ID NO: 234590 - DNA, 25 bp, Mus musculus
atatccctcgcatcttgttccgtat

SEQ ID NO: 234591 - DNA, 25 bp, Mus musculus
atatccctctctaggctattgaata

SEQ ID NO: 234592 - DNA, 25 bp, Mus musculus
atatccctctcttggctattgaata

SEQ ID NO: 234593 - DNA, 25 bp, Mus musculus
atatccctctgacgcacagggcgag

SEQ ID NO: 234594 - DNA, 25 bp, Mus musculus
atatccctctgaggcacagggcgag

SEQ ID NO: 234595 - DNA, 25 bp, Mus musculus
atatccctctttccttttgtatcac

SEQ ID NO: 234596 - DNA, 25 bp, Mus musculus
atatccctctttgcttttgtatcac

SEQ ID NO: 234597 - DNA, 25 bp, Mus musculus
atatccctgaacctcaggctctgaa

SEQ ID NO: 234598 - DNA, 25 bp, Mus musculus
atatccctgaacgtcaggctctgaa

SEQ ID NO: 234599 - DNA, 25 bp, Mus musculus
atatccctgactacttgtgtggcaa

SEQ ID NO: 234600 - DNA, 25 bp, Mus musculus
atatccctgacttcttgtgtggcaa

SEQ ID NO: 234601 - DNA, 25 bp, Mus musculus
atatccctgatgcttttggctttat

SEQ ID NO: 234602 - DNA, 25 bp, Mus musculus
atatccctgatggttttggctttat

SEQ ID NO: 234603 - DNA, 25 bp, Mus musculus
atatccctgggcctctgaagcacag

SEQ ID NO: 234604 - DNA, 25 bp, Mus musculus
atatccctgggcgtctgaagcacag

SEQ ID NO: 234605 - DNA, 25 bp, Mus musculus
atatccctgtacatcttaagccaag

SEQ ID NO: 234606 - DNA, 25 bp, Mus musculus
atatccctgtacttcttaagccaag

SEQ ID NO: 234607 - DNA, 25 bp, Mus musculus
atatccctgtgcaattatcacccag

SEQ ID NO: 234608 - DNA, 25 bp, Mus musculus
atatccctgtgctattatcacccag

SEQ ID NO: 234609 - DNA, 25 bp, Mus musculus
atatccctgttacccatacactcat

SEQ ID NO: 234610 - DNA, 25 bp, Mus musculus
atatccctgttagccatacactcat

SEQ ID NO: 234611 - DNA, 25 bp, Mus musculus
atatcccttacaccttgcctgggtg

SEQ ID NO: 234612 - DNA, 25 bp, Mus musculus
atatcccttacagcttgcctgggtg

SEQ ID NO: 234613 - DNA, 25 bp, Mus musculus
atatcccttgggatcatatccgtct

SEQ ID NO: 234614 - DNA, 25 bp, Mus musculus
atatcccttgggttcatatccgtct

SEQ ID NO: 234615 - DNA, 25 bp, Mus musculus
atatccctttccatgtgtgtcttat

SEQ ID NO: 234616 - DNA, 25 bp, Mus musculus
atatccctttcccagcatgagattg

SEQ ID NO: 234617 - DNA, 25 bp, Mus musculus
atatccctttccgagcatgagattg

SEQ ID NO: 234618 - DNA, 25 bp, Mus musculus
atatccctttccttgtgtgtcttat

SEQ ID NO: 234619 - DNA, 25 bp, Mus musculus
atatccctttgaagcaccaggcagg

SEQ ID NO: 234620 - DNA, 25 bp, Mus musculus
atatccctttgatgcaccaggcagg

SEQ ID NO: 234621 - DNA, 25 bp, Mus musculus
atatccgaagccaccatagccagag

SEQ ID NO: 234622 - DNA, 25 bp, Mus musculus
atatccgaagcctccatagccagag

SEQ ID NO: 234623 - DNA, 25 bp, Mus musculus
atatccgatttgagctctagttaga

SEQ ID NO: 234624 - DNA, 25 bp, Mus musculus
atatccgatttgtgctctagttaga

SEQ ID NO: 234625 - DNA, 25 bp, Mus musculus
atatccgcaccaagatgggccgagt

SEQ ID NO: 234626 - DNA, 25 bp, Mus musculus
atatccgcaccatgatgggccgagt

SEQ ID NO: 234627 - DNA, 25 bp, Mus musculus
atatccgctagtccctctgtgaaga

SEQ ID NO: 234628 - DNA, 25 bp, Mus musculus
atatccgctagtgcctctgtgaaga

SEQ ID NO: 234629 - DNA, 25 bp, Mus musculus
atatccggacttctttgcttcccat

SEQ ID NO: 234630 - DNA, 25 bp, Mus musculus
atatccggacttgtttgcttcccat

SEQ ID NO: 234631 - DNA, 25 bp, Mus musculus
atatccggctcactcagtacatcga

SEQ ID NO: 234632 - DNA, 25 bp, Mus musculus
atatccggctcagtcagtacatcga

SEQ ID NO: 234633 - DNA, 25 bp, Mus musculus
atatccggtccaagtgctgagtgtt

SEQ ID NO: 234634 - DNA, 25 bp, Mus musculus
atatccggtccatgtgctgagtgtt

SEQ ID NO: 234635 - DNA, 25 bp, Mus musculus
atatccggttgaccacctcagagga

SEQ ID NO: 234636 - DNA, 25 bp, Mus musculus
atatccggttgagcacctcagagga

SEQ ID NO: 234637 - DNA, 25 bp, Mus musculus
atatccgtctgcagagaacttcaaa

SEQ ID NO: 234638 - DNA, 25 bp, Mus musculus
atatccgtctgctgagaacttcaaa

SEQ ID NO: 234639 - DNA, 25 bp, Mus musculus
atatccgttagacacttgttatgaa

SEQ ID NO: 234640 - DNA, 25 bp, Mus musculus
atatccgttagagacttgttatgaa

SEQ ID NO: 234641 - DNA, 25 bp, Mus musculus
atatccgttgtgaggctggtacctt

SEQ ID NO: 234642 - DNA, 25 bp, Mus musculus
atatccgttgtgtggctggtacctt

SEQ ID NO: 234643 - DNA, 25 bp, Mus musculus
atatcctaaaatccgtgcatggaga

SEQ ID NO: 234644 - DNA, 25 bp, Mus musculus
atatcctaaaatgcgtgcatggaga

SEQ ID NO: 234645 - DNA, 25 bp, Mus musculus
atatcctacacacctaatctgtcaa

SEQ ID NO: 234646 - DNA, 25 bp, Mus musculus
atatcctacacagctaatctgtcaa

SEQ ID NO: 234647 - DNA, 25 bp, Mus musculus
atatcctaccctacttacagcagat

SEQ ID NO: 234648 - DNA, 25 bp, Mus musculus
atatcctacccttcttacagcagat

SEQ ID NO: 234649 - DNA, 25 bp, Mus musculus
atatcctagagtactggagctgagc

SEQ ID NO: 234650 - DNA, 25 bp, Mus musculus
atatcctagagttctggagctgagc

SEQ ID NO: 234651 - DNA, 25 bp, Mus musculus
atatcctaggccactgctgtaataa

SEQ ID NO: 234652 - DNA, 25 bp, Mus musculus
atatcctaggcctctgctgtaataa

SEQ ID NO: 234653 - DNA, 25 bp, Mus musculus
atatcctagtacattgaagcctcaa

SEQ ID NO: 234654 - DNA, 25 bp, Mus musculus
atatcctagtactttgaagcctcaa

SEQ ID NO: 234655 - DNA, 25 bp, Mus musculus
atatcctatcttacatgtgggtgta

SEQ ID NO: 234656 - DNA, 25 bp, Mus musculus
atatcctatctttcatgtgggtgta

SEQ ID NO: 234657 - DNA, 25 bp, Mus musculus
atatcctcagctatgacacagtggt

SEQ ID NO: 234658 - DNA, 25 bp, Mus musculus
atatcctcagctttgacacagtggt

SEQ ID NO: 234659 - DNA, 25 bp, Mus musculus
atatcctcaggaaacttttattata

SEQ ID NO: 234660 - DNA, 25 bp, Mus musculus
atatcctcaggatacttttattata

SEQ ID NO: 234661 - DNA, 25 bp, Mus musculus
atatcctcatgcatgtacccataac

SEQ ID NO: 234662 - DNA, 25 bp, Mus musculus
atatcctcatgcttgtacccataac

SEQ ID NO: 234663 - DNA, 25 bp, Mus musculus
atatcctcatggagacgggtggcaa

SEQ ID NO: 234664 - DNA, 25 bp, Mus musculus
atatcctcatggtgacgggtggcaa

SEQ ID NO: 234665 - DNA, 25 bp, Mus musculus
atatcctcggaacagtgcgcccagg

SEQ ID NO: 234666 - DNA, 25 bp, Mus musculus
atatcctcggaagagtgcgcccagg

SEQ ID NO: 234667 - DNA, 25 bp, Mus musculus
atatcctcggtgaagcacttgtccg

SEQ ID NO: 234668 - DNA, 25 bp, Mus musculus
atatcctcggtgtagcacttgtccg

SEQ ID NO: 234669 - DNA, 25 bp, Mus musculus
atatcctcgtagaagttacctctgg

SEQ ID NO: 234670 - DNA, 25 bp, Mus musculus
atatcctcgtagtagttacctctgg

SEQ ID NO: 234671 - DNA, 25 bp, Mus musculus
atatcctcgttcaatggttctcaca

SEQ ID NO: 234672 - DNA, 25 bp, Mus musculus
atatcctcgttctatggttctcaca

SEQ ID NO: 234673 - DNA, 25 bp, Mus musculus
atatcctctaccctagttaaatgta

SEQ ID NO: 234674 - DNA, 25 bp, Mus musculus
atatcctctaccgtagttaaatgta

SEQ ID NO: 234675 - DNA, 25 bp, Mus musculus
atatcctctactctgatagccacta

SEQ ID NO: 234676 - DNA, 25 bp, Mus musculus
atatcctctactgtgatagccacta

SEQ ID NO: 234677 - DNA, 25 bp, Mus musculus
atatcctctgatacttcatggtctc

SEQ ID NO: 234678 - DNA, 25 bp, Mus musculus
atatcctctgattcttcatggtctc

SEQ ID NO: 234679 - DNA, 25 bp, Mus musculus
atatcctctgctagggaaagctgcc

SEQ ID NO: 234680 - DNA, 25 bp, Mus musculus
atatcctctgcttgggaaagctgcc

SEQ ID NO: 234681 - DNA, 25 bp, Mus musculus
atatcctcttttactcattgtctgt

SEQ ID NO: 234682 - DNA, 25 bp, Mus musculus
atatcctcttttatacttccctggg

SEQ ID NO: 234683 - DNA, 25 bp, Mus musculus
atatcctctttttctcattgtctgt

SEQ ID NO: 234684 - DNA, 25 bp, Mus musculus
atatcctcttttttacttccctggg

SEQ ID NO: 234685 - DNA, 25 bp, Mus musculus
atatcctgaaaacggttccagcatg

SEQ ID NO: 234686 - DNA, 25 bp, Mus musculus
atatcctgaaaagggttccagcatg

SEQ ID NO: 234687 - DNA, 25 bp, Mus musculus
atatcctgaataaaaagtcttggcc

SEQ ID NO: 234688 - DNA, 25 bp, Mus musculus
atatcctgaatataaagtcttggcc

SEQ ID NO: 234689 - DNA, 25 bp, Mus musculus
atatcctgacaaagggtgaaatcaa

SEQ ID NO: 234690 - DNA, 25 bp, Mus musculus
atatcctgacaatgggtgaaatcaa

SEQ ID NO: 234691 - DNA, 25 bp, Mus musculus
atatcctgattcatgatctgtgcaa

SEQ ID NO: 234692 - DNA, 25 bp, Mus musculus
atatcctgattcttgatctgtgcaa

SEQ ID NO: 234693 - DNA, 25 bp, Mus musculus
atatcctgattgaggtttcttctcc

SEQ ID NO: 234694 - DNA, 25 bp, Mus musculus
atatcctgattgtggtttcttctcc

SEQ ID NO: 234695 - DNA, 25 bp, Mus musculus
atatcctgctctaagtcaaaccatt

SEQ ID NO: 234696 - DNA, 25 bp, Mus musculus
atatcctgctcttagtcaaaccatt

SEQ ID NO: 234697 - DNA, 25 bp, Mus musculus
atatcctggctcacactgaattcac

SEQ ID NO: 234698 - DNA, 25 bp, Mus musculus
atatcctggctctcactgaattcac

SEQ ID NO: 234699 - DNA, 25 bp, Mus musculus
atatcctggtggagctctttcccca

SEQ ID NO: 234700 - DNA, 25 bp, Mus musculus
atatcctggtggtgctctttcccca

SEQ ID NO: 234701 - DNA, 25 bp, Mus musculus
atatcctgtcaacctatatacttaa

SEQ ID NO: 234702 - DNA, 25 bp, Mus musculus
atatcctgtcaagctatatacttaa

SEQ ID NO: 234703 - DNA, 25 bp, Mus musculus
atatcctgtcttagcttttctgtag

SEQ ID NO: 234704 - DNA, 25 bp, Mus musculus
atatcctgtctttgcttttctgtag

SEQ ID NO: 234705 - DNA, 25 bp, Mus musculus
atatccttaaggcttgtcggtgtat

SEQ ID NO: 234706 - DNA, 25 bp, Mus musculus
atatccttaagggttgtcggtgtat

SEQ ID NO: 234707 - DNA, 25 bp, Mus musculus
atatccttaatcaacaactgcccca

SEQ ID NO: 234708 - DNA, 25 bp, Mus musculus
atatccttaatctacaactgcccca

SEQ ID NO: 234709 - DNA, 25 bp, Mus musculus
atatccttaccccacatatcaacca

SEQ ID NO: 234710 - DNA, 25 bp, Mus musculus
atatccttacccgacatatcaacca

SEQ ID NO: 234711 - DNA, 25 bp, Mus musculus
atatccttacttctaatggcatcga

SEQ ID NO: 234712 - DNA, 25 bp, Mus musculus
atatccttacttgtaatggcatcga

SEQ ID NO: 234713 - DNA, 25 bp, Mus musculus
atatccttagacagtgtattcgaga

SEQ ID NO: 234714 - DNA, 25 bp, Mus musculus
atatccttagactgtgtattcgaga

SEQ ID NO: 234715 - DNA, 25 bp, Mus musculus
atatccttagctattctacttccaa

SEQ ID NO: 234716 - DNA, 25 bp, Mus musculus
atatccttagcttttctacttccaa

SEQ ID NO: 234717 - DNA, 25 bp, Mus musculus
atatccttagttctggttctgggtc

SEQ ID NO: 234718 - DNA, 25 bp, Mus musculus
atatccttagttgtggttctgggtc

SEQ ID NO: 234719 - DNA, 25 bp, Mus musculus
atatccttatatccgctgagccatc

SEQ ID NO: 234720 - DNA, 25 bp, Mus musculus
atatccttatatgcgctgagccatc

SEQ ID NO: 234721 - DNA, 25 bp, Mus musculus
atatccttatgtacactggcgagac

SEQ ID NO: 234722 - DNA, 25 bp, Mus musculus
atatccttatgttcactggcgagac

SEQ ID NO: 234723 - DNA, 25 bp, Mus musculus
atatccttcctgagaccagaacagc

SEQ ID NO: 234724 - DNA, 25 bp, Mus musculus
atatccttcctgtgaccagaacagc

SEQ ID NO: 234725 - DNA, 25 bp, Mus musculus
atatccttctatatgtacttctgct

SEQ ID NO: 234726 - DNA, 25 bp, Mus musculus
atatccttctatttgtacttctgct

SEQ ID NO: 234727 - DNA, 25 bp, Mus musculus
atatccttgagacttggtgtataat

SEQ ID NO: 234728 - DNA, 25 bp, Mus musculus
atatccttgagagttggtgtataat

SEQ ID NO: 234729 - DNA, 25 bp, Mus musculus
atatccttgcaaagcacggtgatac

SEQ ID NO: 234730 - DNA, 25 bp, Mus musculus
atatccttgcaatgcacggtgatac

SEQ ID NO: 234731 - DNA, 25 bp, Mus musculus
atatccttgcagcagtttgttggta

SEQ ID NO: 234732 - DNA, 25 bp, Mus musculus
atatccttgcaggagtttgttggta

SEQ ID NO: 234733 - DNA, 25 bp, Mus musculus
atatccttgcctacctttggaattc

SEQ ID NO: 234734 - DNA, 25 bp, Mus musculus
atatccttgccttcctttggaattc

SEQ ID NO: 234735 - DNA, 25 bp, Mus musculus
atatccttggagcactgcgctccac

SEQ ID NO: 234736 - DNA, 25 bp, Mus musculus
atatccttggaggactgcgctccac

SEQ ID NO: 234737 - DNA, 25 bp, Mus musculus
atatccttgtatacacacggtgagt

SEQ ID NO: 234738 - DNA, 25 bp, Mus musculus
atatccttgtatatgggctgccacc

SEQ ID NO: 234739 - DNA, 25 bp, Mus musculus
atatccttgtattcacacggtgagt

SEQ ID NO: 234740 - DNA, 25 bp, Mus musculus
atatccttgtatttgggctgccacc

SEQ ID NO: 234741 - DNA, 25 bp, Mus musculus
atatcctttcagaactactacccga

SEQ ID NO: 234742 - DNA, 25 bp, Mus musculus
atatcctttcagtactactacccga

SEQ ID NO: 234743 - DNA, 25 bp, Mus musculus
atatcctttcctagcatattctgga

SEQ ID NO: 234744 - DNA, 25 bp, Mus musculus
atatcctttccttgcatattctgga

SEQ ID NO: 234745 - DNA, 25 bp, Mus musculus
atatcctttgagacgtgcaccgcaa

SEQ ID NO: 234746 - DNA, 25 bp, Mus musculus
atatcctttgagtcgtgcaccgcaa

SEQ ID NO: 234747 - DNA, 25 bp, Mus musculus
atatcctttggtctgggcgtcagct

SEQ ID NO: 234748 - DNA, 25 bp, Mus musculus
atatcctttggtgtgggcgtcagct

SEQ ID NO: 234749 - DNA, 25 bp, Mus musculus
atatccttttacctagccattctgg

SEQ ID NO: 234750 - DNA, 25 bp, Mus musculus
atatccttttacgtagccattctgg

SEQ ID NO: 234751 - DNA, 25 bp, Mus musculus
atatccttttagaatcagtctttca

SEQ ID NO: 234752 - DNA, 25 bp, Mus musculus
atatccttttagtatcagtctttca

SEQ ID NO: 234753 - DNA, 25 bp, Mus musculus
atatccttttctcgcttaagtgtgt

SEQ ID NO: 234754 - DNA, 25 bp, Mus musculus
atatccttttctggcttaagtgtgt

SEQ ID NO: 234755 - DNA, 25 bp, Mus musculus
atatcgacatggatgcaccagagac

SEQ ID NO: 234756 - DNA, 25 bp, Mus musculus
atatcgacatggttgcaccagagac

SEQ ID NO: 234757 - DNA, 25 bp, Mus musculus
atatcgactctgctgatcgctagca

SEQ ID NO: 234758 - DNA, 25 bp, Mus musculus
atatcgactctggtgatcgctagca

SEQ ID NO: 234759 - DNA, 25 bp, Mus musculus
atatcgagctcacacagactacatc

SEQ ID NO: 234760 - DNA, 25 bp, Mus musculus
atatcgagctcagacagactacatc

SEQ ID NO: 234761 - DNA, 25 bp, Mus musculus
atatcgagggtcatcaagctttcag

SEQ ID NO: 234762 - DNA, 25 bp, Mus musculus
atatcgagggtcttcaagctttcag

SEQ ID NO: 234763 - DNA, 25 bp, Mus musculus
atatcgatacagagagcattttgaa

SEQ ID NO: 234764 - DNA, 25 bp, Mus musculus
atatcgatacagtgagcattttgaa

SEQ ID NO: 234765 - DNA, 25 bp, Mus musculus
atatcgatagaactgtttggtagag

SEQ ID NO: 234766 - DNA, 25 bp, Mus musculus
atatcgatagaagtgtttggtagag

SEQ ID NO: 234767 - DNA, 25 bp, Mus musculus
atatcgatgatgagatggacccaga

SEQ ID NO: 234768 - DNA, 25 bp, Mus musculus
atatcgatgatgtgatggacccaga

SEQ ID NO: 234769 - DNA, 25 bp, Mus musculus
atatcgatgccgagacgggctggct

SEQ ID NO: 234770 - DNA, 25 bp, Mus musculus
atatcgatgccgtgacgggctggct

SEQ ID NO: 234771 - DNA, 25 bp, Mus musculus
atatcgatgggccaccagtgctgtg

SEQ ID NO: 234772 - DNA, 25 bp, Mus musculus
atatcgatgggcgaccagtgctgtg

SEQ ID NO: 234773 - DNA, 25 bp, Mus musculus
atatcgcaaaccctgggagaagccc

SEQ ID NO: 234774 - DNA, 25 bp, Mus musculus
atatcgcaaaccgtgggagaagccc

SEQ ID NO: 234775 - DNA, 25 bp, Mus musculus
atatcgcagcaaaccagcaagcaga

SEQ ID NO: 234776 - DNA, 25 bp, Mus musculus
atatcgcagcaatccagcaagcaga

SEQ ID NO: 234777 - DNA, 25 bp, Mus musculus
atatcgcagcttataaatctcagga

SEQ ID NO: 234778 - DNA, 25 bp, Mus musculus
atatcgcagcttttaaatctcagga

SEQ ID NO: 234779 - DNA, 25 bp, Mus musculus
atatcgcctcccatacaatgtaatt

SEQ ID NO: 234780 - DNA, 25 bp, Mus musculus
atatcgcctcccttacaatgtaatt

SEQ ID NO: 234781 - DNA, 25 bp, Mus musculus
atatcgcctctaccaatgacagtga

SEQ ID NO: 234782 - DNA, 25 bp, Mus musculus
atatcgcctctagcaatgacagtga

SEQ ID NO: 234783 - DNA, 25 bp, Mus musculus
atatcgcctctgatccaggaagtct

SEQ ID NO: 234784 - DNA, 25 bp, Mus musculus
atatcgcctctgttccaggaagtct

SEQ ID NO: 234785 - DNA, 25 bp, Mus musculus
atatcgcgacacagcggcctaccgg

SEQ ID NO: 234786 - DNA, 25 bp, Mus musculus
atatcgcgacactgcggcctaccgg

SEQ ID NO: 234787 - DNA, 25 bp, Mus musculus
atatcggcaggcactgatggatgct

SEQ ID NO: 234788 - DNA, 25 bp, Mus musculus
atatcggcaggctctgatggatgct

SEQ ID NO: 234789 - DNA, 25 bp, Mus musculus
atatcggctgacaaaaatttctctg

SEQ ID NO: 234790 - DNA, 25 bp, Mus musculus
atatcggctgactaaaatttctctg

SEQ ID NO: 234791 - DNA, 25 bp, Mus musculus
atatcgggaggcagctaagctcttc

SEQ ID NO: 234792 - DNA, 25 bp, Mus musculus
atatcgggaggctgctaagctcttc

SEQ ID NO: 234793 - DNA, 25 bp, Mus musculus
atatcgggattaattacctgtgctt

SEQ ID NO: 234794 - DNA, 25 bp, Mus musculus
atatcgggattatttacctgtgctt

SEQ ID NO: 234795 - DNA, 25 bp, Mus musculus
atatcgggccatcttatgtgtttta

SEQ ID NO: 234796 - DNA, 25 bp, Mus musculus
atatcgggccatgttatgtgtttta

SEQ ID NO: 234797 - DNA, 25 bp, Mus musculus
atatcggtaagcactaggtttggca

SEQ ID NO: 234798 - DNA, 25 bp, Mus musculus
atatcggtaagctctaggtttggca

SEQ ID NO: 234799 - DNA, 25 bp, Mus musculus
atatcgtccttaatgggctagctca

SEQ ID NO: 234800 - DNA, 25 bp, Mus musculus
atatcgtccttattgggctagctca

SEQ ID NO: 234801 - DNA, 25 bp, Mus musculus
atatcgtctggtacagcatgagcat

SEQ ID NO: 234802 - DNA, 25 bp, Mus musculus
atatcgtctggttcagcatgagcat

SEQ ID NO: 234803 - DNA, 25 bp, Mus musculus
atatcgttgctgatcgctgttatga

SEQ ID NO: 234804 - DNA, 25 bp, Mus musculus
atatcgttgctgttcgctgttatga

SEQ ID NO: 234805 - DNA, 25 bp, Mus musculus
atatcgtttcagcagctagtcacaa

SEQ ID NO: 234806 - DNA, 25 bp, Mus musculus
atatcgtttcaggagctagtcacaa

SEQ ID NO: 234807 - DNA, 25 bp, Mus musculus
atatctaaactgaatgtcacatcta

SEQ ID NO: 234808 - DNA, 25 bp, Mus musculus
atatctaaactgtatgtcacatcta

SEQ ID NO: 234809 - DNA, 25 bp, Mus musculus
atatctaagcatagtgcatatgtaa

SEQ ID NO: 234810 - DNA, 25 bp, Mus musculus
atatctaagcattgtgcatatgtaa

SEQ ID NO: 234811 - DNA, 25 bp, Mus musculus
atatctaaggctcccttcgaactca

SEQ ID NO: 234812 - DNA, 25 bp, Mus musculus
atatctaaggctgccttcgaactca

SEQ ID NO: 234813 - DNA, 25 bp, Mus musculus
atatctacaacaacaatggctatgg

SEQ ID NO: 234814 - DNA, 25 bp, Mus musculus
atatctacaacatcaatggctatgg

SEQ ID NO: 234815 - DNA, 25 bp, Mus musculus
atatctacaattatcttcaccatga

SEQ ID NO: 234816 - DNA, 25 bp, Mus musculus
atatctacaattttcttcaccatga

SEQ ID NO: 234817 - DNA, 25 bp, Mus musculus
atatctacacgtcgctgttttcttc

SEQ ID NO: 234818 - DNA, 25 bp, Mus musculus
atatctacacgtggctgttttcttc

SEQ ID NO: 234819 - DNA, 25 bp, Mus musculus
atatctacagccctggagtgccaaa

SEQ ID NO: 234820 - DNA, 25 bp, Mus musculus
atatctacagccgtggagtgccaaa

SEQ ID NO: 234821 - DNA, 25 bp, Mus musculus
atatctacatatacactgttgttgg

SEQ ID NO: 234822 - DNA, 25 bp, Mus musculus
atatctacatattcactgttgttgg

SEQ ID NO: 234823 - DNA, 25 bp, Mus musculus
atatctaccgggagcgctggagtgc

SEQ ID NO: 234824 - DNA, 25 bp, Mus musculus
atatctaccgggtgcgctggagtgc

SEQ ID NO: 234825 - DNA, 25 bp, Mus musculus
atatctacctccagtgtaaatttaa

SEQ ID NO: 234826 - DNA, 25 bp, Mus musculus
atatctacctcctgtgtaaatttaa

SEQ ID NO: 234827 - DNA, 25 bp, Mus musculus
atatctacctgcagagctttgtggc

SEQ ID NO: 234828 - DNA, 25 bp, Mus musculus
atatctacctgctgagctttgtggc

SEQ ID NO: 234829 - DNA, 25 bp, Mus musculus
atatctacctgtataaccctccgta

SEQ ID NO: 234830 - DNA, 25 bp, Mus musculus
atatctacctgtcatttgcaagtat

SEQ ID NO: 234831 - DNA, 25 bp, Mus musculus
atatctacctgtgatttgcaagtat

SEQ ID NO: 234832 - DNA, 25 bp, Mus musculus
atatctacctgtttaaccctccgta

SEQ ID NO: 234833 - DNA, 25 bp, Mus musculus
atatctaccttgacttccccaaaat

SEQ ID NO: 234834 - DNA, 25 bp, Mus musculus
atatctaccttgtcttccccaaaat

SEQ ID NO: 234835 - DNA, 25 bp, Mus musculus
atatctacgtctccatgatctcctc

SEQ ID NO: 234836 - DNA, 25 bp, Mus musculus
atatctacgtctgcatgatctcctc

SEQ ID NO: 234837 - DNA, 25 bp, Mus musculus
atatctacttggactcctcccttag

SEQ ID NO: 234838 - DNA, 25 bp, Mus musculus
atatctacttggtctcctcccttag

SEQ ID NO: 234839 - DNA, 25 bp, Mus musculus
atatctagagcacccctaattcaaa

SEQ ID NO: 234840 - DNA, 25 bp, Mus musculus
atatctagagcagccctaattcaaa

SEQ ID NO: 234841 - DNA, 25 bp, Mus musculus
atatctagcatactgtgaccaaccc

SEQ ID NO: 234842 - DNA, 25 bp, Mus musculus
atatctagcatagtgtgaccaaccc

SEQ ID NO: 234843 - DNA, 25 bp, Mus musculus
atatctagccaaactgggccaagga

SEQ ID NO: 234844 - DNA, 25 bp, Mus musculus
atatctagccaatctgggccaagga

SEQ ID NO: 234845 - DNA, 25 bp, Mus musculus
atatctaggtgtattcagtacaggt

SEQ ID NO: 234846 - DNA, 25 bp, Mus musculus
atatctaggtgttttcagtacaggt

SEQ ID NO: 234847 - DNA, 25 bp, Mus musculus
atatctataacacagcctatccccg

SEQ ID NO: 234848 - DNA, 25 bp, Mus musculus
atatctataacagagcctatccccg

SEQ ID NO: 234849 - DNA, 25 bp, Mus musculus
atatctatacctaccatatacctag

SEQ ID NO: 234850 - DNA, 25 bp, Mus musculus
atatctataccttccatatacctag

SEQ ID NO: 234851 - DNA, 25 bp, Mus musculus
atatctatagcccagaaggttacca

SEQ ID NO: 234852 - DNA, 25 bp, Mus musculus
atatctatagcccaggaaccgcctg

SEQ ID NO: 234853 - DNA, 25 bp, Mus musculus
atatctatagccgagaaggttacca

SEQ ID NO: 234854 - DNA, 25 bp, Mus musculus
atatctatagccgaggaaccgcctg

SEQ ID NO: 234855 - DNA, 25 bp, Mus musculus
atatctatatgtctccaggatcctg

SEQ ID NO: 234856 - DNA, 25 bp, Mus musculus
atatctatatgtgtccaggatcctg

SEQ ID NO: 234857 - DNA, 25 bp, Mus musculus
atatctatcgctcccattattttca

SEQ ID NO: 234858 - DNA, 25 bp, Mus musculus
atatctatcgctgccattattttca

SEQ ID NO: 234859 - DNA, 25 bp, Mus musculus
atatctatcttaaaccctgctcaac

SEQ ID NO: 234860 - DNA, 25 bp, Mus musculus
atatctatcttacctgttgtgctat

SEQ ID NO: 234861 - DNA, 25 bp, Mus musculus
atatctatcttagctgttgtgctat

SEQ ID NO: 234862 - DNA, 25 bp, Mus musculus
atatctatcttataccctgctcaac

SEQ ID NO: 234863 - DNA, 25 bp, Mus musculus
atatctatctttagtcagtcgtctc

SEQ ID NO: 234864 - DNA, 25 bp, Mus musculus
atatctatcttttgtcagtcgtctc

SEQ ID NO: 234865 - DNA, 25 bp, Mus musculus
atatctatggccactgttagcccat

SEQ ID NO: 234866 - DNA, 25 bp, Mus musculus
atatctatggcctctgttagcccat

SEQ ID NO: 234867 - DNA, 25 bp, Mus musculus
atatctattttcacactccactttg

SEQ ID NO: 234868 - DNA, 25 bp, Mus musculus
atatctattttcacgcacaggcaaa

SEQ ID NO: 234869 - DNA, 25 bp, Mus musculus
atatctattttctcactccactttg

SEQ ID NO: 234870 - DNA, 25 bp, Mus musculus
atatctattttctcgcacaggcaaa

SEQ ID NO: 234871 - DNA, 25 bp, Mus musculus
atatctcacaccaggctactgtgta

SEQ ID NO: 234872 - DNA, 25 bp, Mus musculus
atatctcacacctggctactgtgta

SEQ ID NO: 234873 - DNA, 25 bp, Mus musculus
atatctcacctcaattctacatcag

SEQ ID NO: 234874 - DNA, 25 bp, Mus musculus
atatctcacctctattctacatcag

SEQ ID NO: 234875 - DNA, 25 bp, Mus musculus
atatctcagaaaaggtctcccgtcg

SEQ ID NO: 234876 - DNA, 25 bp, Mus musculus
atatctcagaaatggtctcccgtcg

SEQ ID NO: 234877 - DNA, 25 bp, Mus musculus
atatctcagatgaggctctccagca

SEQ ID NO: 234878 - DNA, 25 bp, Mus musculus
atatctcagatgtggctctccagca

SEQ ID NO: 234879 - DNA, 25 bp, Mus musculus
atatctcagcggataggcctggttg

SEQ ID NO: 234880 - DNA, 25 bp, Mus musculus
atatctcagcggttaggcctggttg

SEQ ID NO: 234881 - DNA, 25 bp, Mus musculus
atatctcagtgcacggtttcagtat

SEQ ID NO: 234882 - DNA, 25 bp, Mus musculus
atatctcagtgctcggtttcagtat

SEQ ID NO: 234883 - DNA, 25 bp, Mus musculus
atatctcagttcagccatccaggct

SEQ ID NO: 234884 - DNA, 25 bp, Mus musculus
atatctcagttctgccatccaggct

SEQ ID NO: 234885 - DNA, 25 bp, Mus musculus
atatctcatcaccacttcataaaag

SEQ ID NO: 234886 - DNA, 25 bp, Mus musculus
atatctcatcacgacttcataaaag

SEQ ID NO: 234887 - DNA, 25 bp, Mus musculus
atatctcattaacaaagtcactttc

SEQ ID NO: 234888 - DNA, 25 bp, Mus musculus
atatctcattaagaaagtcactttc

SEQ ID NO: 234889 - DNA, 25 bp, Mus musculus
atatctccaactctttcttgtgttc

SEQ ID NO: 234890 - DNA, 25 bp, Mus musculus
atatctccaactgtttcttgtgttc

SEQ ID NO: 234891 - DNA, 25 bp, Mus musculus
atatctccacccatatctttgattc

SEQ ID NO: 234892 - DNA, 25 bp, Mus musculus
atatctccacccttatctttgattc

SEQ ID NO: 234893 - DNA, 25 bp, Mus musculus
atatctccactcactgatagcggga

SEQ ID NO: 234894 - DNA, 25 bp, Mus musculus
atatctccactctctgatagcggga

SEQ ID NO: 234895 - DNA, 25 bp, Mus musculus
atatctccagagattgatctctagc

SEQ ID NO: 234896 - DNA, 25 bp, Mus musculus
atatctccagagtttgatctctagc

SEQ ID NO: 234897 - DNA, 25 bp, Mus musculus
atatctccatttcctggatgacaga

SEQ ID NO: 234898 - DNA, 25 bp, Mus musculus
atatctccatttgctggatgacaga

SEQ ID NO: 234899 - DNA, 25 bp, Mus musculus
atatctcccaacattctatctgaat

SEQ ID NO: 234900 - DNA, 25 bp, Mus musculus
atatctcccaactttctatctgaat

SEQ ID NO: 234901 - DNA, 25 bp, Mus musculus
atatctcccgagcaccagagcaaga

SEQ ID NO: 234902 - DNA, 25 bp, Mus musculus
atatctcccgaggaccagagcaaga

SEQ ID NO: 234903 - DNA, 25 bp, Mus musculus
atatctcccggtagcttgagttaaa

SEQ ID NO: 234904 - DNA, 25 bp, Mus musculus
atatctcccggttgcttgagttaaa

SEQ ID NO: 234905 - DNA, 25 bp, Mus musculus
atatctccctgcctgaacattcaca

SEQ ID NO: 234906 - DNA, 25 bp, Mus musculus
atatctccctgcctgtcctgaagac

SEQ ID NO: 234907 - DNA, 25 bp, Mus musculus
atatctccctgcgtgaacattcaca

SEQ ID NO: 234908 - DNA, 25 bp, Mus musculus
atatctccctgcgtgtcctgaagac

SEQ ID NO: 234909 - DNA, 25 bp, Mus musculus
atatctccctttagataatatgcag

SEQ ID NO: 234910 - DNA, 25 bp, Mus musculus
atatctcccttttgataatatgcag

SEQ ID NO: 234911 - DNA, 25 bp, Mus musculus
atatctccgttaagggttctgtaag

SEQ ID NO: 234912 - DNA, 25 bp, Mus musculus
atatctccgttatgggttctgtaag

SEQ ID NO: 234913 - DNA, 25 bp, Mus musculus
atatctcctattatggatcttttaa

SEQ ID NO: 234914 - DNA, 25 bp, Mus musculus
atatctcctattttggatcttttaa

SEQ ID NO: 234915 - DNA, 25 bp, Mus musculus
atatctcctcatcacatatcaggtg

SEQ ID NO: 234916 - DNA, 25 bp, Mus musculus
atatctcctcatgacatatcaggtg

SEQ ID NO: 234917 - DNA, 25 bp, Mus musculus
atatctcctgggactagggttgcag

SEQ ID NO: 234918 - DNA, 25 bp, Mus musculus
atatctcctgggtctagggttgcag

SEQ ID NO: 234919 - DNA, 25 bp, Mus musculus
atatctcctgtacagctagcctgaa

SEQ ID NO: 234920 - DNA, 25 bp, Mus musculus
atatctcctgtagagctagcctgaa

SEQ ID NO: 234921 - DNA, 25 bp, Mus musculus
atatctcgaggtaaggcatggcatc

SEQ ID NO: 234922 - DNA, 25 bp, Mus musculus
atatctcgaggttaggcatggcatc

SEQ ID NO: 234923 - DNA, 25 bp, Mus musculus
atatctcgttttctctgctaattcc

SEQ ID NO: 234924 - DNA, 25 bp, Mus musculus
atatctcgttttgtctgctaattcc

SEQ ID NO: 234925 - DNA, 25 bp, Mus musculus
atatctctaagacagctttccgggt

SEQ ID NO: 234926 - DNA, 25 bp, Mus musculus
atatctctaagagagctttccgggt

SEQ ID NO: 234927 - DNA, 25 bp, Mus musculus
atatctctaggacttttcccttggt

SEQ ID NO: 234928 - DNA, 25 bp, Mus musculus
atatctctaggagttttcccttggt

SEQ ID NO: 234929 - DNA, 25 bp, Mus musculus
atatctctcaagagccaacttccct

SEQ ID NO: 234930 - DNA, 25 bp, Mus musculus
atatctctcaagtgccaacttccct

SEQ ID NO: 234931 - DNA, 25 bp, Mus musculus
atatctctcattagactcgtgggcc

SEQ ID NO: 234932 - DNA, 25 bp, Mus musculus
atatctctcatttgactcgtgggcc

SEQ ID NO: 234933 - DNA, 25 bp, Mus musculus
atatctctgaatctgcttgtaagtg

SEQ ID NO: 234934 - DNA, 25 bp, Mus musculus
atatctctgaatgtgcttgtaagtg

SEQ ID NO: 234935 - DNA, 25 bp, Mus musculus
atatctctgcccatacttgtgatga

SEQ ID NO: 234936 - DNA, 25 bp, Mus musculus
atatctctgcccttacttgtgatga

SEQ ID NO: 234937 - DNA, 25 bp, Mus musculus
atatctctgcggatcccagaatgaa

SEQ ID NO: 234938 - DNA, 25 bp, Mus musculus
atatctctgcggttcccagaatgaa

SEQ ID NO: 234939 - DNA, 25 bp, Mus musculus
atatctctgtccctggaacggctaa

SEQ ID NO: 234940 - DNA, 25 bp, Mus musculus
atatctctgtccgtggaacggctaa

SEQ ID NO: 234941 - DNA, 25 bp, Mus musculus
atatctcttagtagtcactcccttt

SEQ ID NO: 234942 - DNA, 25 bp, Mus musculus
atatctcttagttgtcactcccttt

SEQ ID NO: 234943 - DNA, 25 bp, Mus musculus
atatctcttcatcacatcttatgtg

SEQ ID NO: 234944 - DNA, 25 bp, Mus musculus
atatctcttcatgacatcttatgtg

SEQ ID NO: 234945 - DNA, 25 bp, Mus musculus
atatctcttcgacttacttcacact

SEQ ID NO: 234946 - DNA, 25 bp, Mus musculus
atatctcttcgagttacttcacact

SEQ ID NO: 234947 - DNA, 25 bp, Mus musculus
atatctcttgacagattgcctccac

SEQ ID NO: 234948 - DNA, 25 bp, Mus musculus
atatctcttgactgattgcctccac

SEQ ID NO: 234949 - DNA, 25 bp, Mus musculus
atatctctttggatgtctctagcct

SEQ ID NO: 234950 - DNA, 25 bp, Mus musculus
atatctctttggttgtctctagcct

SEQ ID NO: 234951 - DNA, 25 bp, Mus musculus
atatctcttttaagctttctttccc

SEQ ID NO: 234952 - DNA, 25 bp, Mus musculus
atatctcttttatgctttctttccc

SEQ ID NO: 234953 - DNA, 25 bp, Mus musculus
atatctgaaaccaattttacctaat

SEQ ID NO: 234954 - DNA, 25 bp, Mus musculus
atatctgaaacccaacaccctgtgc

SEQ ID NO: 234955 - DNA, 25 bp, Mus musculus
atatctgaaaccgaacaccctgtgc

SEQ ID NO: 234956 - DNA, 25 bp, Mus musculus
atatctgaaacctattttacctaat

SEQ ID NO: 234957 - DNA, 25 bp, Mus musculus
atatctgacataatgcactaactaa

SEQ ID NO: 234958 - DNA, 25 bp, Mus musculus
atatctgacatattgcactaactaa

SEQ ID NO: 234959 - DNA, 25 bp, Mus musculus
atatctgacatgcatactatcattc

SEQ ID NO: 234960 - DNA, 25 bp, Mus musculus
atatctgacatggatactatcattc

SEQ ID NO: 234961 - DNA, 25 bp, Mus musculus
atatctgaccctcagacatccagac

SEQ ID NO: 234962 - DNA, 25 bp, Mus musculus
atatctgaccctgagacatccagac

SEQ ID NO: 234963 - DNA, 25 bp, Mus musculus
atatctgacctgacatgggtttgta

SEQ ID NO: 234964 - DNA, 25 bp, Mus musculus
atatctgacctgctacatataacct

SEQ ID NO: 234965 - DNA, 25 bp, Mus musculus
atatctgacctggtacatataacct

SEQ ID NO: 234966 - DNA, 25 bp, Mus musculus
atatctgacctgtcatgggtttgta

SEQ ID NO: 234967 - DNA, 25 bp, Mus musculus
atatctgactccatctcctggagtg

SEQ ID NO: 234968 - DNA, 25 bp, Mus musculus
atatctgactccttctcctggagtg

SEQ ID NO: 234969 - DNA, 25 bp, Mus musculus
atatctgagggcaggtgctttcact

SEQ ID NO: 234970 - DNA, 25 bp, Mus musculus
atatctgagggctggtgctttcact

SEQ ID NO: 234971 - DNA, 25 bp, Mus musculus
atatctgataacaccagtgggccaa

SEQ ID NO: 234972 - DNA, 25 bp, Mus musculus
atatctgataactccagtgggccaa

SEQ ID NO: 234973 - DNA, 25 bp, Mus musculus
atatctgatatactgtggtttactc

SEQ ID NO: 234974 - DNA, 25 bp, Mus musculus
atatctgatatagtgtggtttactc

SEQ ID NO: 234975 - DNA, 25 bp, Mus musculus
atatctgatcacatttgtatttgtt

SEQ ID NO: 234976 - DNA, 25 bp, Mus musculus
atatctgatcacttttgtatttgtt

SEQ ID NO: 234977 - DNA, 25 bp, Mus musculus
atatctgatcttagcactccaacaa

SEQ ID NO: 234978 - DNA, 25 bp, Mus musculus
atatctgatctttgcactccaacaa

SEQ ID NO: 234979 - DNA, 25 bp, Mus musculus
atatctgattttctgtcccagccag

SEQ ID NO: 234980 - DNA, 25 bp, Mus musculus
atatctgattttgtgtcccagccag

SEQ ID NO: 234981 - DNA, 25 bp, Mus musculus
atatctgcacatctgtaggctttta

SEQ ID NO: 234982 - DNA, 25 bp, Mus musculus
atatctgcacatgtgtaggctttta

SEQ ID NO: 234983 - DNA, 25 bp, Mus musculus
atatctgcagaacaccacggactcg

SEQ ID NO: 234984 - DNA, 25 bp, Mus musculus
atatctgcagaagaccacggactcg

SEQ ID NO: 234985 - DNA, 25 bp, Mus musculus
atatctgcattgctcatgccttact

SEQ ID NO: 234986 - DNA, 25 bp, Mus musculus
atatctgcattggtcatgccttact

SEQ ID NO: 234987 - DNA, 25 bp, Mus musculus
atatctgccaggaccatctgaggat

SEQ ID NO: 234988 - DNA, 25 bp, Mus musculus
atatctgccaggtccatctgaggat

SEQ ID NO: 234989 - DNA, 25 bp, Mus musculus
atatctgccgtgcatccagaagact

SEQ ID NO: 234990 - DNA, 25 bp, Mus musculus
atatctgccgtggatccagaagact

SEQ ID NO: 234991 - DNA, 25 bp, Mus musculus
atatctgcctttacaagactagggt

SEQ ID NO: 234992 - DNA, 25 bp, Mus musculus
atatctgccttttcaagactagggt

SEQ ID NO: 234993 - DNA, 25 bp, Mus musculus
atatctgctgcccagaggcctgtct

SEQ ID NO: 234994 - DNA, 25 bp, Mus musculus
atatctgctgccgagaggcctgtct

SEQ ID NO: 234995 - DNA, 25 bp, Mus musculus
atatctggaaatatcataagcttat

SEQ ID NO: 234996 - DNA, 25 bp, Mus musculus
atatctggaaatttcataagcttat

SEQ ID NO: 234997 - DNA, 25 bp, Mus musculus
atatctggcagcaaattgctctgta

SEQ ID NO: 234998 - DNA, 25 bp, Mus musculus
atatctggcagctaattgctctgta

SEQ ID NO: 234999 - DNA, 25 bp, Mus musculus
atatctggcccacaatagacatgtt

SEQ ID NO: 235000 - DNA, 25 bp, Mus musculus
atatctggcccagaatagacatgtt

SEQ ID NO: 235001 - DNA, 25 bp, Mus musculus
atatctggcctgcaattgaagcggt

SEQ ID NO: 235002 - DNA, 25 bp, Mus musculus
atatctggcctggaattgaagcggt

SEQ ID NO: 235003 - DNA, 25 bp, Mus musculus
atatctggctttagcatatccctgt

SEQ ID NO: 235004 - DNA, 25 bp, Mus musculus
atatctggcttttgcatatccctgt

SEQ ID NO: 235005 - DNA, 25 bp, Mus musculus
atatctgggtggattacctgcatat

SEQ ID NO: 235006 - DNA, 25 bp, Mus musculus
atatctgggtggtttacctgcatat

SEQ ID NO: 235007 - DNA, 25 bp, Mus musculus
atatctggtaatctattgtgctgac

SEQ ID NO: 235008 - DNA, 25 bp, Mus musculus
atatctggtaatgtattgtgctgac

SEQ ID NO: 235009 - DNA, 25 bp, Mus musculus
atatctggtccacagggaacctgaa

SEQ ID NO: 235010 - DNA, 25 bp, Mus musculus
atatctggtccagagggaacctgaa

SEQ ID NO: 235011 - DNA, 25 bp, Mus musculus
atatctggtcgtatcctggatgcta

SEQ ID NO: 235012 - DNA, 25 bp, Mus musculus
atatctggtcgtttcctggatgcta

SEQ ID NO: 235013 - DNA, 25 bp, Mus musculus
atatctgtaactatatgctttagtg

SEQ ID NO: 235014 - DNA, 25 bp, Mus musculus
atatctgtaactttatgctttagtg

SEQ ID NO: 235015 - DNA, 25 bp, Mus musculus
atatctgtacagaggcgagaaacct

SEQ ID NO: 235016 - DNA, 25 bp, Mus musculus
atatctgtacagtggcgagaaacct

SEQ ID NO: 235017 - DNA, 25 bp, Mus musculus
atatctgtatgtccctggagttctc

SEQ ID NO: 235018 - DNA, 25 bp, Mus musculus
atatctgtatgtgcctggagttctc

SEQ ID NO: 235019 - DNA, 25 bp, Mus musculus
atatctgtattcagcttggttaacg

SEQ ID NO: 235020 - DNA, 25 bp, Mus musculus
atatctgtattctgcttggttaacg

SEQ ID NO: 235021 - DNA, 25 bp, Mus musculus
atatctgtcacacgccattattttc

SEQ ID NO: 235022 - DNA, 25 bp, Mus musculus
atatctgtcacaggccattattttc

SEQ ID NO: 235023 - DNA, 25 bp, Mus musculus
atatctgtcagtagcaaacatacca

SEQ ID NO: 235024 - DNA, 25 bp, Mus musculus
atatctgtcagttgcaaacatacca

SEQ ID NO: 235025 - DNA, 25 bp, Mus musculus
atatctgtcattccaggccaactga

SEQ ID NO: 235026 - DNA, 25 bp, Mus musculus
atatctgtcattgcaggccaactga

SEQ ID NO: 235027 - DNA, 25 bp, Mus musculus
atatctgtccttacttttaaacgag

SEQ ID NO: 235028 - DNA, 25 bp, Mus musculus
atatctgtcctttcttttaaacgag

SEQ ID NO: 235029 - DNA, 25 bp, Mus musculus
atatctgtctttagtccttttggta

SEQ ID NO: 235030 - DNA, 25 bp, Mus musculus
atatctgtcttttgtccttttggta

SEQ ID NO: 235031 - DNA, 25 bp, Mus musculus
atatctgtgaaaacacctgtggaga

SEQ ID NO: 235032 - DNA, 25 bp, Mus musculus
atatctgtgaaatcacctgtggaga

SEQ ID NO: 235033 - DNA, 25 bp, Mus musculus
atatctgtgaacagggttcctcctc

SEQ ID NO: 235034 - DNA, 25 bp, Mus musculus
atatctgtgaactgggttcctcctc

SEQ ID NO: 235035 - DNA, 25 bp, Mus musculus
atatctgtgaccatctgctcctgat

SEQ ID NO: 235036 - DNA, 25 bp, Mus musculus
atatctgtgaccttctgctcctgat

SEQ ID NO: 235037 - DNA, 25 bp, Mus musculus
atatctgtgtaacttattgagcatt

SEQ ID NO: 235038 - DNA, 25 bp, Mus musculus
atatctgtgtaagttattgagcatt

SEQ ID NO: 235039 - DNA, 25 bp, Mus musculus
atatctgtgtgaatggtagccaatc

SEQ ID NO: 235040 - DNA, 25 bp, Mus musculus
atatctgtgtgattggtagccaatc

SEQ ID NO: 235041 - DNA, 25 bp, Mus musculus
atatctgtgtttccagctatcccag

SEQ ID NO: 235042 - DNA, 25 bp, Mus musculus
atatctgtgtttgcagctatcccag

SEQ ID NO: 235043 - DNA, 25 bp, Mus musculus
atatctgttctaccccagcaggcag

SEQ ID NO: 235044 - DNA, 25 bp, Mus musculus
atatctgttctagcccagcaggcag

SEQ ID NO: 235045 - DNA, 25 bp, Mus musculus
atatctgttgaaccagtatgaaggg

SEQ ID NO: 235046 - DNA, 25 bp, Mus musculus
atatctgttgaagcagtatgaaggg

SEQ ID NO: 235047 - DNA, 25 bp, Mus musculus
atatctgttgccagtgacccacagt

SEQ ID NO: 235048 - DNA, 25 bp, Mus musculus
atatctgttgcctgtgacccacagt

SEQ ID NO: 235049 - DNA, 25 bp, Mus musculus
atatctgttgctatgtagacttgga

SEQ ID NO: 235050 - DNA, 25 bp, Mus musculus
atatctgttgctttgtagacttgga

SEQ ID NO: 235051 - DNA, 25 bp, Mus musculus
atatctgtttcccttattagaggat

SEQ ID NO: 235052 - DNA, 25 bp, Mus musculus
atatctgtttccgttattagaggat

SEQ ID NO: 235053 - DNA, 25 bp, Mus musculus
atatcttaacctcgactctagtttg

SEQ ID NO: 235054 - DNA, 25 bp, Mus musculus
atatcttaacctggactctagtttg

SEQ ID NO: 235055 - DNA, 25 bp, Mus musculus
atatcttacaagatccacagtcagg

SEQ ID NO: 235056 - DNA, 25 bp, Mus musculus
atatcttacaagttccacagtcagg

SEQ ID NO: 235057 - DNA, 25 bp, Mus musculus
atatcttacaggcagcctcgactgc

SEQ ID NO: 235058 - DNA, 25 bp, Mus musculus
atatcttacagggagcctcgactgc

SEQ ID NO: 235059 - DNA, 25 bp, Mus musculus
atatcttacataaagacctttctga

SEQ ID NO: 235060 - DNA, 25 bp, Mus musculus
atatcttacatatagacctttctga

SEQ ID NO: 235061 - DNA, 25 bp, Mus musculus
atatcttagagactggcccaagctg

SEQ ID NO: 235062 - DNA, 25 bp, Mus musculus
atatcttagagagtggcccaagctg

SEQ ID NO: 235063 - DNA, 25 bp, Mus musculus
atatcttaggttctgagtgctgtac

SEQ ID NO: 235064 - DNA, 25 bp, Mus musculus
atatcttaggttgtgagtgctgtac

SEQ ID NO: 235065 - DNA, 25 bp, Mus musculus
atatcttatgtaatgtgctttgtaa

SEQ ID NO: 235066 - DNA, 25 bp, Mus musculus
atatcttatgtattgtgctttgtaa

SEQ ID NO: 235067 - DNA, 25 bp, Mus musculus
atatcttatttcaacctttactgca

SEQ ID NO: 235068 - DNA, 25 bp, Mus musculus
atatcttatttctacctttactgca

SEQ ID NO: 235069 - DNA, 25 bp, Mus musculus
atatcttatttgcaacaaccaccga

SEQ ID NO: 235070 - DNA, 25 bp, Mus musculus
atatcttatttggaacaaccaccga

SEQ ID NO: 235071 - DNA, 25 bp, Mus musculus
atatcttcaacaatgtctccagaca

SEQ ID NO: 235072 - DNA, 25 bp, Mus musculus
atatcttcaacattgtctccagaca

SEQ ID NO: 235073 - DNA, 25 bp, Mus musculus
atatcttcacaccttgcatgattga

SEQ ID NO: 235074 - DNA, 25 bp, Mus musculus
atatcttcacacgttgcatgattga

SEQ ID NO: 235075 - DNA, 25 bp, Mus musculus
atatcttccagacctcattgtgcca

SEQ ID NO: 235076 - DNA, 25 bp, Mus musculus
atatcttccagagctcattgtgcca

SEQ ID NO: 235077 - DNA, 25 bp, Mus musculus
atatcttcccatagagtgctttcat

SEQ ID NO: 235078 - DNA, 25 bp, Mus musculus
atatcttcccattgagtgctttcat

SEQ ID NO: 235079 - DNA, 25 bp, Mus musculus
atatcttcccgcctgtgatcaatgt

SEQ ID NO: 235080 - DNA, 25 bp, Mus musculus
atatcttcccgcgtgtgatcaatgt

SEQ ID NO: 235081 - DNA, 25 bp, Mus musculus
atatcttccctaaatagccactgct

SEQ ID NO: 235082 - DNA, 25 bp, Mus musculus
atatcttccctatatagccactgct

SEQ ID NO: 235083 - DNA, 25 bp, Mus musculus
atatcttcctacatgtttaatgcag

SEQ ID NO: 235084 - DNA, 25 bp, Mus musculus
atatcttcctacttgtttaatgcag

SEQ ID NO: 235085 - DNA, 25 bp, Mus musculus
atatcttcgattcaactgtccaaca

SEQ ID NO: 235086 - DNA, 25 bp, Mus musculus
atatcttcgattgaactgtccaaca

SEQ ID NO: 235087 - DNA, 25 bp, Mus musculus
atatcttcggtacacgtgctctgga

SEQ ID NO: 235088 - DNA, 25 bp, Mus musculus
atatcttcggtagacgtgctctgga

SEQ ID NO: 235089 - DNA, 25 bp, Mus musculus
atatcttcggtgcagtcttttccta

SEQ ID NO: 235090 - DNA, 25 bp, Mus musculus
atatcttcggtggagtcttttccta

SEQ ID NO: 235091 - DNA, 25 bp, Mus musculus
atatcttctagcactctagtgactg

SEQ ID NO: 235092 - DNA, 25 bp, Mus musculus
atatcttctagctctctagtgactg

SEQ ID NO: 235093 - DNA, 25 bp, Mus musculus
atatcttctgatatctctactggcc

SEQ ID NO: 235094 - DNA, 25 bp, Mus musculus
atatcttctgatttctctactggcc

SEQ ID NO: 235095 - DNA, 25 bp, Mus musculus
atatcttctgttcctagctgtttac

SEQ ID NO: 235096 - DNA, 25 bp, Mus musculus
atatcttctgttgctagctgtttac

SEQ ID NO: 235097 - DNA, 25 bp, Mus musculus
atatcttcttagcttaggtgcaaag

SEQ ID NO: 235098 - DNA, 25 bp, Mus musculus
atatcttcttaggttaggtgcaaag

SEQ ID NO: 235099 - DNA, 25 bp, Mus musculus
atatcttgactgaccttggtctgta

SEQ ID NO: 235100 - DNA, 25 bp, Mus musculus
atatcttgactgtccttggtctgta

SEQ ID NO: 235101 - DNA, 25 bp, Mus musculus
atatcttgacttagtggaccagggt

SEQ ID NO: 235102 - DNA, 25 bp, Mus musculus
atatcttgactttgtggaccagggt

SEQ ID NO: 235103 - DNA, 25 bp, Mus musculus
atatcttggaaaccctcatcgtcac

SEQ ID NO: 235104 - DNA, 25 bp, Mus musculus
atatcttggaaagcctcatcgtcac

SEQ ID NO: 235105 - DNA, 25 bp, Mus musculus
atatcttggaccacaacacgcgcct

SEQ ID NO: 235106 - DNA, 25 bp, Mus musculus
atatcttggacctcaacacgcgcct

SEQ ID NO: 235107 - DNA, 25 bp, Mus musculus
atatcttggatgatgctggtctgaa

SEQ ID NO: 235108 - DNA, 25 bp, Mus musculus
atatcttggatgttgctggtctgaa

SEQ ID NO: 235109 - DNA, 25 bp, Mus musculus
atatcttggccaaattaacaaacaa

SEQ ID NO: 235110 - DNA, 25 bp, Mus musculus
atatcttggccatattaacaaacaa

SEQ ID NO: 235111 - DNA, 25 bp, Mus musculus
atatcttgggacataaatcacctta

SEQ ID NO: 235112 - DNA, 25 bp, Mus musculus
atatcttgggacttaaatcacctta

SEQ ID NO: 235113 - DNA, 25 bp, Mus musculus
atatcttgtcccatgacttcagatg

SEQ ID NO: 235114 - DNA, 25 bp, Mus musculus
atatcttgtcccttgacttcagatg

SEQ ID NO: 235115 - DNA, 25 bp, Mus musculus
atatcttgtctactggcctgtaaaa

SEQ ID NO: 235116 - DNA, 25 bp, Mus musculus
atatcttgtctagtggcctgtaaaa

SEQ ID NO: 235117 - DNA, 25 bp, Mus musculus
atatcttgtgcgaccgagaggcaac

SEQ ID NO: 235118 - DNA, 25 bp, Mus musculus
atatcttgtgcgtccgagaggcaac

SEQ ID NO: 235119 - DNA, 25 bp, Mus musculus
atatctttaaatcctcaaataccag

SEQ ID NO: 235120 - DNA, 25 bp, Mus musculus
atatctttaaatgctcaaataccag

SEQ ID NO: 235121 - DNA, 25 bp, Mus musculus
atatctttagctccacacctacttt

SEQ ID NO: 235122 - DNA, 25 bp, Mus musculus
atatctttagctgcacacctacttt

SEQ ID NO: 235123 - DNA, 25 bp, Mus musculus
atatctttattaccagaaatctgag

SEQ ID NO: 235124 - DNA, 25 bp, Mus musculus
atatctttattagcagaaatctgag

SEQ ID NO: 235125 - DNA, 25 bp, Mus musculus
atatctttcaacaaatctctctatg

SEQ ID NO: 235126 - DNA, 25 bp, Mus musculus
atatctttcaactaatctctctatg

SEQ ID NO: 235127 - DNA, 25 bp, Mus musculus
atatctttcaatccataatctttag

SEQ ID NO: 235128 - DNA, 25 bp, Mus musculus
atatctttcaatgcataatctttag

SEQ ID NO: 235129 - DNA, 25 bp, Mus musculus
atatctttgaacctccattttctgt

SEQ ID NO: 235130 - DNA, 25 bp, Mus musculus
atatctttgaacgtccattttctgt

SEQ ID NO: 235131 - DNA, 25 bp, Mus musculus
atatctttgcatacctgcaggcagg

SEQ ID NO: 235132 - DNA, 25 bp, Mus musculus
atatctttgcattcctgcaggcagg

SEQ ID NO: 235133 - DNA, 25 bp, Mus musculus
atatctttgccacagatgggctctg

SEQ ID NO: 235134 - DNA, 25 bp, Mus musculus
atatctttgccagagatgggctctg

SEQ ID NO: 235135 - DNA, 25 bp, Mus musculus
atatctttgcccaggtggctgaaag

SEQ ID NO: 235136 - DNA, 25 bp, Mus musculus
atatctttgccctggtggctgaaag

SEQ ID NO: 235137 - DNA, 25 bp, Mus musculus
atatctttgttgaagagtctgttca

SEQ ID NO: 235138 - DNA, 25 bp, Mus musculus
atatctttgttgtagagtctgttca

SEQ ID NO: 235139 - DNA, 25 bp, Mus musculus
atatcttttataaactctgcataac

SEQ ID NO: 235140 - DNA, 25 bp, Mus musculus
atatcttttatatactctgcataac

SEQ ID NO: 235141 - DNA, 25 bp, Mus musculus
atatcttttcgacaagcacacgctt

SEQ ID NO: 235142 - DNA, 25 bp, Mus musculus
atatcttttcgagaagcacacgctt

SEQ ID NO: 235143 - DNA, 25 bp, Mus musculus
atatctttttgtcaccttccttgac

SEQ ID NO: 235144 - DNA, 25 bp, Mus musculus
atatctttttgtgaccttccttgac

SEQ ID NO: 235145 - DNA, 25 bp, Mus musculus
atatgaaaagtaaccggaagccgtc

SEQ ID NO: 235146 - DNA, 25 bp, Mus musculus
atatgaaaagtatccggaagccgtc

SEQ ID NO: 235147 - DNA, 25 bp, Mus musculus
atatgaaactcacctccgcagatac

SEQ ID NO: 235148 - DNA, 25 bp, Mus musculus
atatgaaactcagctccgcagatac

SEQ ID NO: 235149 - DNA, 25 bp, Mus musculus
atatgaacacagctccccagttttg

SEQ ID NO: 235150 - DNA, 25 bp, Mus musculus
atatgaacacaggtccccagttttg

SEQ ID NO: 235151 - DNA, 25 bp, Mus musculus
atatgaacacttacactcagcatta

SEQ ID NO: 235152 - DNA, 25 bp, Mus musculus
atatgaacactttcactcagcatta

SEQ ID NO: 235153 - DNA, 25 bp, Mus musculus
atatgaaccacaaatgcctgccgtc

SEQ ID NO: 235154 - DNA, 25 bp, Mus musculus
atatgaaccacatatgcctgccgtc

SEQ ID NO: 235155 - DNA, 25 bp, Mus musculus
atatgaaccagacacattccccaag

SEQ ID NO: 235156 - DNA, 25 bp, Mus musculus
atatgaaccagagacattccccaag

SEQ ID NO: 235157 - DNA, 25 bp, Mus musculus
atatgaacgagcacagctcccgatc

SEQ ID NO: 235158 - DNA, 25 bp, Mus musculus
atatgaacgagctcagctcccgatc

SEQ ID NO: 235159 - DNA, 25 bp, Mus musculus
atatgaacggcaacaggcgcagata

SEQ ID NO: 235160 - DNA, 25 bp, Mus musculus
atatgaacggcatcaggcgcagata

SEQ ID NO: 235161 - DNA, 25 bp, Mus musculus
atatgaacgtgcatggtgtcctggg

SEQ ID NO: 235162 - DNA, 25 bp, Mus musculus
atatgaacgtgcttggtgtcctggg

SEQ ID NO: 235163 - DNA, 25 bp, Mus musculus
atatgaactacccagcaaccctcag

SEQ ID NO: 235164 - DNA, 25 bp, Mus musculus
atatgaactaccgagcaaccctcag

SEQ ID NO: 235165 - DNA, 25 bp, Mus musculus
atatgaagacaaagttctggttgtg

SEQ ID NO: 235166 - DNA, 25 bp, Mus musculus
atatgaagacaatgttctggttgtg

SEQ ID NO: 235167 - DNA, 25 bp, Mus musculus
atatgaagacatcggccaaaggaac

SEQ ID NO: 235168 - DNA, 25 bp, Mus musculus
atatgaagacatgggccaaaggaac

SEQ ID NO: 235169 - DNA, 25 bp, Mus musculus
atatgaagcaatataagctctttag

SEQ ID NO: 235170 - DNA, 25 bp, Mus musculus
atatgaagcaatttaagctctttag

SEQ ID NO: 235171 - DNA, 25 bp, Mus musculus
atatgaagccgtacgccgcggcccg

SEQ ID NO: 235172 - DNA, 25 bp, Mus musculus
atatgaagccgttcgccgcggcccg

SEQ ID NO: 235173 - DNA, 25 bp, Mus musculus
atatgaaggcaccacatgtcgcctc

SEQ ID NO: 235174 - DNA, 25 bp, Mus musculus
atatgaaggcacgacatgtcgcctc

SEQ ID NO: 235175 - DNA, 25 bp, Mus musculus
atatgaagttgtctgtttggagagt

SEQ ID NO: 235176 - DNA, 25 bp, Mus musculus
atatgaagttgtgtgtttggagagt

SEQ ID NO: 235177 - DNA, 25 bp, Mus musculus
atatgaatacccagatgagctccag

SEQ ID NO: 235178 - DNA, 25 bp, Mus musculus
atatgaataccctgatgagctccag

SEQ ID NO: 235179 - DNA, 25 bp, Mus musculus
atatgaatacgccaattctaccggg

SEQ ID NO: 235180 - DNA, 25 bp, Mus musculus
atatgaatacgcgaattctaccggg

SEQ ID NO: 235181 - DNA, 25 bp, Mus musculus
atatgaatcattaaccttggagata

SEQ ID NO: 235182 - DNA, 25 bp, Mus musculus
atatgaatcatttaccttggagata

SEQ ID NO: 235183 - DNA, 25 bp, Mus musculus
atatgaatccttcaccgtttaccgt

SEQ ID NO: 235184 - DNA, 25 bp, Mus musculus
atatgaatccttgaccgtttaccgt

SEQ ID NO: 235185 - DNA, 25 bp, Mus musculus
atatgaatgactcccgaggtcccat

SEQ ID NO: 235186 - DNA, 25 bp, Mus musculus
atatgaatgactgccgaggtcccat

SEQ ID NO: 235187 - DNA, 25 bp, Mus musculus
atatgaatggctccagcttcagaag

SEQ ID NO: 235188 - DNA, 25 bp, Mus musculus
atatgaatggctgcagcttcagaag

SEQ ID NO: 235189 - DNA, 25 bp, Mus musculus
atatgaattcctagattctttactg

SEQ ID NO: 235190 - DNA, 25 bp, Mus musculus
atatgaattccttgattctttactg

SEQ ID NO: 235191 - DNA, 25 bp, Mus musculus
atatgaattgtaccgaccccagact

SEQ ID NO: 235192 - DNA, 25 bp, Mus musculus
atatgaattgtagcgaccccagact

SEQ ID NO: 235193 - DNA, 25 bp, Mus musculus
atatgacaacaaactccaaactgaa

SEQ ID NO: 235194 - DNA, 25 bp, Mus musculus
atatgacaacaatctccaaactgaa

SEQ ID NO: 235195 - DNA, 25 bp, Mus musculus
atatgacaacctcttgggattctgg

SEQ ID NO: 235196 - DNA, 25 bp, Mus musculus
atatgacaacctgttgggattctgg

SEQ ID NO: 235197 - DNA, 25 bp, Mus musculus
atatgacaagtcactacaccaagcc

SEQ ID NO: 235198 - DNA, 25 bp, Mus musculus
atatgacaagtctctacaccaagcc

SEQ ID NO: 235199 - DNA, 25 bp, Mus musculus
atatgacaccctccatagtgatgaa

SEQ ID NO: 235200 - DNA, 25 bp, Mus musculus
atatgacaccctgcatagtgatgaa

SEQ ID NO: 235201 - DNA, 25 bp, Mus musculus
atatgacacgttaatccagaggatc

SEQ ID NO: 235202 - DNA, 25 bp, Mus musculus
atatgacacgtttatccagaggatc

SEQ ID NO: 235203 - DNA, 25 bp, Mus musculus
atatgacagatactttccagagtac

SEQ ID NO: 235204 - DNA, 25 bp, Mus musculus
atatgacagatagtttccagagtac

SEQ ID NO: 235205 - DNA, 25 bp, Mus musculus
atatgacagcctcgacccgctggaa

SEQ ID NO: 235206 - DNA, 25 bp, Mus musculus
atatgacagcctggacccgctggaa

SEQ ID NO: 235207 - DNA, 25 bp, Mus musculus
atatgacatcagctttctcatcacc

SEQ ID NO: 235208 - DNA, 25 bp, Mus musculus
atatgacatcaggtttctcatcacc

SEQ ID NO: 235209 - DNA, 25 bp, Mus musculus
atatgacatgccctgtttgacagtc

SEQ ID NO: 235210 - DNA, 25 bp, Mus musculus
atatgacatgccgtgtttgacagtc

SEQ ID NO: 235211 - DNA, 25 bp, Mus musculus
atatgacatgtcatttcttttgaaa

SEQ ID NO: 235212 - DNA, 25 bp, Mus musculus
atatgacatgtcttttcttttgaaa

SEQ ID NO: 235213 - DNA, 25 bp, Mus musculus
atatgaccagaacccagggctcctg

SEQ ID NO: 235214 - DNA, 25 bp, Mus musculus
atatgaccagaagccagggctcctg

SEQ ID NO: 235215 - DNA, 25 bp, Mus musculus
atatgacccaagaggtgtcaggctg

SEQ ID NO: 235216 - DNA, 25 bp, Mus musculus
atatgacccaagtggtgtcaggctg

SEQ ID NO: 235217 - DNA, 25 bp, Mus musculus
atatgacccataacacctggcgctt

SEQ ID NO: 235218 - DNA, 25 bp, Mus musculus
atatgacccatatcacctggcgctt

SEQ ID NO: 235219 - DNA, 25 bp, Mus musculus
atatgacccattatttcctagtgca

SEQ ID NO: 235220 - DNA, 25 bp, Mus musculus
atatgacccattttttcctagtgca

SEQ ID NO: 235221 - DNA, 25 bp, Mus musculus
atatgaccccagaacaatgaagcac

SEQ ID NO: 235222 - DNA, 25 bp, Mus musculus
atatgaccccagtacaatgaagcac

SEQ ID NO: 235223 - DNA, 25 bp, Mus musculus
atatgaccccttcatgtcctaagga

SEQ ID NO: 235224 - DNA, 25 bp, Mus musculus
atatgaccccttgatgtcctaagga

SEQ ID NO: 235225 - DNA, 25 bp, Mus musculus
atatgacccgcaagtcagtcttccg

SEQ ID NO: 235226 - DNA, 25 bp, Mus musculus
atatgacccgcatgtcagtcttccg

SEQ ID NO: 235227 - DNA, 25 bp, Mus musculus
atatgaccctaaaggctttagacag

SEQ ID NO: 235228 - DNA, 25 bp, Mus musculus
atatgaccctaatggctttagacag

SEQ ID NO: 235229 - DNA, 25 bp, Mus musculus
atatgacctaaacagtccaggcagt

SEQ ID NO: 235230 - DNA, 25 bp, Mus musculus
atatgacctaaagagtccaggcagt

SEQ ID NO: 235231 - DNA, 25 bp, Mus musculus
atatgacctcctaacacttgtttga

SEQ ID NO: 235232 - DNA, 25 bp, Mus musculus
atatgacctccttacacttgtttga

SEQ ID NO: 235233 - DNA, 25 bp, Mus musculus
atatgacgaggacgccaaacggccc

SEQ ID NO: 235234 - DNA, 25 bp, Mus musculus
atatgacgaggaggccaaacggccc

SEQ ID NO: 235235 - DNA, 25 bp, Mus musculus
atatgacggactccttcgtgctgga

SEQ ID NO: 235236 - DNA, 25 bp, Mus musculus
atatgacggactgcttcgtgctgga

SEQ ID NO: 235237 - DNA, 25 bp, Mus musculus
atatgacgggtcatctcgggcaagg

SEQ ID NO: 235238 - DNA, 25 bp, Mus musculus
atatgacgggtcttctcgggcaagg

SEQ ID NO: 235239 - DNA, 25 bp, Mus musculus
atatgactacagctacctccaagag

SEQ ID NO: 235240 - DNA, 25 bp, Mus musculus
atatgactacaggtacctccaagag

SEQ ID NO: 235241 - DNA, 25 bp, Mus musculus
atatgactatggagagcacacgagc

SEQ ID NO: 235242 - DNA, 25 bp, Mus musculus
atatgactatggtgagcacacgagc

SEQ ID NO: 235243 - DNA, 25 bp, Mus musculus
atatgactcagaatggaatccgcaa

SEQ ID NO: 235244 - DNA, 25 bp, Mus musculus
atatgactcagattggaatccgcaa

SEQ ID NO: 235245 - DNA, 25 bp, Mus musculus
atatgactcatgaccttgctaagac

SEQ ID NO: 235246 - DNA, 25 bp, Mus musculus
atatgactcatgtccttgctaagac

SEQ ID NO: 235247 - DNA, 25 bp, Mus musculus
atatgactctgtcatttgctattca

SEQ ID NO: 235248 - DNA, 25 bp, Mus musculus
atatgactctgtgatttgctattca

SEQ ID NO: 235249 - DNA, 25 bp, Mus musculus
atatgactgcctatctactaactct

SEQ ID NO: 235250 - DNA, 25 bp, Mus musculus
atatgactgcctttctactaactct

SEQ ID NO: 235251 - DNA, 25 bp, Mus musculus
atatgactggtgctggatccctaaa

SEQ ID NO: 235252 - DNA, 25 bp, Mus musculus
atatgactggtggtggatccctaaa

SEQ ID NO: 235253 - DNA, 25 bp, Mus musculus
atatgacttcaactggcacaggaag

SEQ ID NO: 235254 - DNA, 25 bp, Mus musculus
atatgacttcaagtggcacaggaag

SEQ ID NO: 235255 - DNA, 25 bp, Mus musculus
atatgacttcccaggagtctagcaa

SEQ ID NO: 235256 - DNA, 25 bp, Mus musculus
atatgacttccctggagtctagcaa

SEQ ID NO: 235257 - DNA, 25 bp, Mus musculus
atatgacttctccatgagcccaggg

SEQ ID NO: 235258 - DNA, 25 bp, Mus musculus
atatgacttctcgatgagcccaggg

SEQ ID NO: 235259 - DNA, 25 bp, Mus musculus
atatgacttgttcttggagtactgt

SEQ ID NO: 235260 - DNA, 25 bp, Mus musculus
atatgacttgttgttggagtactgt

SEQ ID NO: 235261 - DNA, 25 bp, Mus musculus
atatgactttacaggttttactctg

SEQ ID NO: 235262 - DNA, 25 bp, Mus musculus
atatgactttactggttttactctg

SEQ ID NO: 235263 - DNA, 25 bp, Mus musculus
atatgactttttctgtctgccctct

SEQ ID NO: 235264 - DNA, 25 bp, Mus musculus
atatgactttttgtgtctgccctct

SEQ ID NO: 235265 - DNA, 25 bp, Mus musculus
atatgagacctcagagttgcctcca

SEQ ID NO: 235266 - DNA, 25 bp, Mus musculus
atatgagacctctgagttgcctcca

SEQ ID NO: 235267 - DNA, 25 bp, Mus musculus
atatgagactagactctgccgtgcc

SEQ ID NO: 235268 - DNA, 25 bp, Mus musculus
atatgagactagtctctgccgtgcc

SEQ ID NO: 235269 - DNA, 25 bp, Mus musculus
atatgagactatattccacctggga

SEQ ID NO: 235270 - DNA, 25 bp, Mus musculus
atatgagactatccagcctccatgc

SEQ ID NO: 235271 - DNA, 25 bp, Mus musculus
atatgagactatgcagcctccatgc

SEQ ID NO: 235272 - DNA, 25 bp, Mus musculus
atatgagactattttccacctggga

SEQ ID NO: 235273 - DNA, 25 bp, Mus musculus
atatgagactcacctctggcactaa

SEQ ID NO: 235274 - DNA, 25 bp, Mus musculus
atatgagactcagctctggcactaa

SEQ ID NO: 235275 - DNA, 25 bp, Mus musculus
atatgagactctcggctcgatctcc

SEQ ID NO: 235276 - DNA, 25 bp, Mus musculus
atatgagactctgggctcgatctcc

SEQ ID NO: 235277 - DNA, 25 bp, Mus musculus
atatgagagatgaccgccgttcctt

SEQ ID NO: 235278 - DNA, 25 bp, Mus musculus
atatgagagatgtccgccgttcctt

SEQ ID NO: 235279 - DNA, 25 bp, Mus musculus
atatgagatacaacagcctcctcct

SEQ ID NO: 235280 - DNA, 25 bp, Mus musculus
atatgagatacatcagcctcctcct

SEQ ID NO: 235281 - DNA, 25 bp, Mus musculus
atatgagatctaagcacaattttaa

SEQ ID NO: 235282 - DNA, 25 bp, Mus musculus
atatgagatctatgcacaattttaa

SEQ ID NO: 235283 - DNA, 25 bp, Mus musculus
atatgagatgcaccttttgttttct

SEQ ID NO: 235284 - DNA, 25 bp, Mus musculus
atatgagatgcagcttttgttttct

SEQ ID NO: 235285 - DNA, 25 bp, Mus musculus
atatgagcagcactcggctatgatt

SEQ ID NO: 235286 - DNA, 25 bp, Mus musculus
atatgagcagcagtcggctatgatt

SEQ ID NO: 235287 - DNA, 25 bp, Mus musculus
atatgagccaaacctgaccactagc

SEQ ID NO: 235288 - DNA, 25 bp, Mus musculus
atatgagccaaagctgaccactagc

SEQ ID NO: 235289 - DNA, 25 bp, Mus musculus
atatgagccagtaagtacacagtac

SEQ ID NO: 235290 - DNA, 25 bp, Mus musculus
atatgagccagttagtacacagtac

SEQ ID NO: 235291 - DNA, 25 bp, Mus musculus
atatgagcccctcttgatatatgca

SEQ ID NO: 235292 - DNA, 25 bp, Mus musculus
atatgagcccctgttgatatatgca

SEQ ID NO: 235293 - DNA, 25 bp, Mus musculus
atatgagcctatagacaccctgaaa

SEQ ID NO: 235294 - DNA, 25 bp, Mus musculus
atatgagcctattgacaccctgaaa

SEQ ID NO: 235295 - DNA, 25 bp, Mus musculus
atatgagctagacctcttggaggca

SEQ ID NO: 235296 - DNA, 25 bp, Mus musculus
atatgagctagagctcttggaggca

SEQ ID NO: 235297 - DNA, 25 bp, Mus musculus
atatgagctagcacacagctcccag

SEQ ID NO: 235298 - DNA, 25 bp, Mus musculus
atatgagctagctcacagctcccag

SEQ ID NO: 235299 - DNA, 25 bp, Mus musculus
atatgagcttcccagacctgaaacc

SEQ ID NO: 235300 - DNA, 25 bp, Mus musculus
atatgagcttccgagacctgaaacc

SEQ ID NO: 235301 - DNA, 25 bp, Mus musculus
atatgaggagttagtgcgcctccac

SEQ ID NO: 235302 - DNA, 25 bp, Mus musculus
atatgaggagtttgtgcgcctccac

SEQ ID NO: 235303 - DNA, 25 bp, Mus musculus
atatgagggtcacactcttcccatt

SEQ ID NO: 235304 - DNA, 25 bp, Mus musculus
atatgagggtcagactcttcccatt

SEQ ID NO: 235305 - DNA, 25 bp, Mus musculus
atatgaggtcagagggagctagcct

SEQ ID NO: 235306 - DNA, 25 bp, Mus musculus
atatgaggtcagtgggagctagcct

SEQ ID NO: 235307 - DNA, 25 bp, Mus musculus
atatgaggttctctgatacccactc

SEQ ID NO: 235308 - DNA, 25 bp, Mus musculus
atatgaggttctgtgatacccactc

SEQ ID NO: 235309 - DNA, 25 bp, Mus musculus
atatgagtatgtcgttcgtctttta

SEQ ID NO: 235310 - DNA, 25 bp, Mus musculus
atatgagtatgtggttcgtctttta

SEQ ID NO: 235311 - DNA, 25 bp, Mus musculus
atatgagtcgatcagagccattctt

SEQ ID NO: 235312 - DNA, 25 bp, Mus musculus
atatgagtcgatgagagccattctt

SEQ ID NO: 235313 - DNA, 25 bp, Mus musculus
atatgagtctccatctggtagttgg

SEQ ID NO: 235314 - DNA, 25 bp, Mus musculus
atatgagtctccttctggtagttgg

SEQ ID NO: 235315 - DNA, 25 bp, Mus musculus
atatgagtctctctctttcaaaaca

SEQ ID NO: 235316 - DNA, 25 bp, Mus musculus
atatgagtctctgtctttcaaaaca

SEQ ID NO: 235317 - DNA, 25 bp, Mus musculus
atatgagtctgaaccccagagccaa

SEQ ID NO: 235318 - DNA, 25 bp, Mus musculus
atatgagtctgatccccagagccaa

SEQ ID NO: 235319 - DNA, 25 bp, Mus musculus
atatgagttctcatcgacgtgattc

SEQ ID NO: 235320 - DNA, 25 bp, Mus musculus
atatgagttctcttcgacgtgattc

SEQ ID NO: 235321 - DNA, 25 bp, Mus musculus
atatgatagtagactccgagtgcat

SEQ ID NO: 235322 - DNA, 25 bp, Mus musculus
atatgatagtagtctccgagtgcat

SEQ ID NO: 235323 - DNA, 25 bp, Mus musculus
atatgatatcataagctctgctcca

SEQ ID NO: 235324 - DNA, 25 bp, Mus musculus
atatgatatcattagctctgctcca

SEQ ID NO: 235325 - DNA, 25 bp, Mus musculus
atatgatcagcacttgtatcacaac

SEQ ID NO: 235326 - DNA, 25 bp, Mus musculus
atatgatcagcagttgtatcacaac

SEQ ID NO: 235327 - DNA, 25 bp, Mus musculus
atatgatcagtacagcctggcccat

SEQ ID NO: 235328 - DNA, 25 bp, Mus musculus
atatgatcagtagagcctggcccat

SEQ ID NO: 235329 - DNA, 25 bp, Mus musculus
atatgatcattgaagacacctgcat

SEQ ID NO: 235330 - DNA, 25 bp, Mus musculus
atatgatcattgtagacacctgcat

SEQ ID NO: 235331 - DNA, 25 bp, Mus musculus
atatgatcgatcatatccgccccta

SEQ ID NO: 235332 - DNA, 25 bp, Mus musculus
atatgatcgatcttatccgccccta

SEQ ID NO: 235333 - DNA, 25 bp, Mus musculus
atatgatctcccaggctgtggagtg

SEQ ID NO: 235334 - DNA, 25 bp, Mus musculus
atatgatctccctggctgtggagtg

SEQ ID NO: 235335 - DNA, 25 bp, Mus musculus
atatgatgacaaagcccctcatttg

SEQ ID NO: 235336 - DNA, 25 bp, Mus musculus
atatgatgacaatgcccctcatttg

SEQ ID NO: 235337 - DNA, 25 bp, Mus musculus
atatgatgaccacacctatgaggct

SEQ ID NO: 235338 - DNA, 25 bp, Mus musculus
atatgatgaccagacctatgaggct

SEQ ID NO: 235339 - DNA, 25 bp, Mus musculus
atatgatgcttcctttcccattggg

SEQ ID NO: 235340 - DNA, 25 bp, Mus musculus
atatgatgcttcgtttcccattggg

SEQ ID NO: 235341 - DNA, 25 bp, Mus musculus
atatgatggtgtacgtctggacgct

SEQ ID NO: 235342 - DNA, 25 bp, Mus musculus
atatgatggtgttcgtctggacgct

SEQ ID NO: 235343 - DNA, 25 bp, Mus musculus
atatgatgtctgatgccggagagca

SEQ ID NO: 235344 - DNA, 25 bp, Mus musculus
atatgatgtctgttgccggagagca

SEQ ID NO: 235345 - DNA, 25 bp, Mus musculus
atatgatgtgtgacgttcctttatc

SEQ ID NO: 235346 - DNA, 25 bp, Mus musculus
atatgatgtgtgtcgttcctttatc

SEQ ID NO: 235347 - DNA, 25 bp, Mus musculus
atatgatgttctccagtttcaccca

SEQ ID NO: 235348 - DNA, 25 bp, Mus musculus
atatgatgttctgcagtttcaccca

SEQ ID NO: 235349 - DNA, 25 bp, Mus musculus
atatgatgtttaatggctccgtctc

SEQ ID NO: 235350 - DNA, 25 bp, Mus musculus
atatgatgtttattggctccgtctc

SEQ ID NO: 235351 - DNA, 25 bp, Mus musculus
atatgattaacaatttactcagaac

SEQ ID NO: 235352 - DNA, 25 bp, Mus musculus
atatgattaacattttactcagaac

SEQ ID NO: 235353 - DNA, 25 bp, Mus musculus
atatgattacacacacactgtctag

SEQ ID NO: 235354 - DNA, 25 bp, Mus musculus
atatgattacactcacactgtctag

SEQ ID NO: 235355 - DNA, 25 bp, Mus musculus
atatgattacatcctggccagcact

SEQ ID NO: 235356 - DNA, 25 bp, Mus musculus
atatgattacatgctggccagcact

SEQ ID NO: 235357 - DNA, 25 bp, Mus musculus
atatgattacgcagtgactgtcttc

SEQ ID NO: 235358 - DNA, 25 bp, Mus musculus
atatgattacgctgtgactgtcttc

SEQ ID NO: 235359 - DNA, 25 bp, Mus musculus
atatgattcaacagtggagtttttt

SEQ ID NO: 235360 - DNA, 25 bp, Mus musculus
atatgattcaactgtggagtttttt

SEQ ID NO: 235361 - DNA, 25 bp, Mus musculus
atatgattggccagcattcagtctg

SEQ ID NO: 235362 - DNA, 25 bp, Mus musculus
atatgattggcctgcattcagtctg

SEQ ID NO: 235363 - DNA, 25 bp, Mus musculus
atatgattggcgcagcacgtgctct

SEQ ID NO: 235364 - DNA, 25 bp, Mus musculus
atatgattggcggagcacgtgctct

SEQ ID NO: 235365 - DNA, 25 bp, Mus musculus
atatgatttattcccacgactgcag

SEQ ID NO: 235366 - DNA, 25 bp, Mus musculus
atatgatttattgccacgactgcag

SEQ ID NO: 235367 - DNA, 25 bp, Mus musculus
atatgatttcacagtgtatattacc

SEQ ID NO: 235368 - DNA, 25 bp, Mus musculus
atatgatttcactgtgtatattacc

SEQ ID NO: 235369 - DNA, 25 bp, Mus musculus
atatgatttgggatctgagtaactg

SEQ ID NO: 235370 - DNA, 25 bp, Mus musculus
atatgatttgggttctgagtaactg

SEQ ID NO: 235371 - DNA, 25 bp, Mus musculus
atatgcaaacatcagatggaggctc

SEQ ID NO: 235372 - DNA, 25 bp, Mus musculus
atatgcaaacatgagatggaggctc

SEQ ID NO: 235373 - DNA, 25 bp, Mus musculus
atatgcaacaccatgttcaggttga

SEQ ID NO: 235374 - DNA, 25 bp, Mus musculus
atatgcaacaccttgttcaggttga

SEQ ID NO: 235375 - DNA, 25 bp, Mus musculus
atatgcaaccagacaaaaccttttt

SEQ ID NO: 235376 - DNA, 25 bp, Mus musculus
atatgcaaccagtcaaaaccttttt

SEQ ID NO: 235377 - DNA, 25 bp, Mus musculus
atatgcaactgccttcaagagagac

SEQ ID NO: 235378 - DNA, 25 bp, Mus musculus
atatgcaactgcgttcaagagagac

SEQ ID NO: 235379 - DNA, 25 bp, Mus musculus
atatgcaagccaacatagccggcgt

SEQ ID NO: 235380 - DNA, 25 bp, Mus musculus
atatgcaagccatcatagccggcgt

SEQ ID NO: 235381 - DNA, 25 bp, Mus musculus
atatgcaaggcaatgctttcccact

SEQ ID NO: 235382 - DNA, 25 bp, Mus musculus
atatgcaaggcattgctttcccact

SEQ ID NO: 235383 - DNA, 25 bp, Mus musculus
atatgcaatctaattgaccgcaatt

SEQ ID NO: 235384 - DNA, 25 bp, Mus musculus
atatgcaatctatttgaccgcaatt

SEQ ID NO: 235385 - DNA, 25 bp, Mus musculus
atatgcacacaaaacggaaaggatc

SEQ ID NO: 235386 - DNA, 25 bp, Mus musculus
atatgcacacaatacggaaaggatc

SEQ ID NO: 235387 - DNA, 25 bp, Mus musculus
atatgcacacacagaccatcacatg

SEQ ID NO: 235388 - DNA, 25 bp, Mus musculus
atatgcacacactgaccatcacatg

SEQ ID NO: 235389 - DNA, 25 bp, Mus musculus
atatgcacacctcgtgccagtggag

SEQ ID NO: 235390 - DNA, 25 bp, Mus musculus
atatgcacacctggtgccagtggag

SEQ ID NO: 235391 - DNA, 25 bp, Mus musculus
atatgcacagctcagaatctccgag

SEQ ID NO: 235392 - DNA, 25 bp, Mus musculus
atatgcacagctgagaatctccgag

SEQ ID NO: 235393 - DNA, 25 bp, Mus musculus
atatgcacattaccagtgtcctggg

SEQ ID NO: 235394 - DNA, 25 bp, Mus musculus
atatgcacattagcagtgtcctggg

SEQ ID NO: 235395 - DNA, 25 bp, Mus musculus
atatgcacatttccatgcgcttgct

SEQ ID NO: 235396 - DNA, 25 bp, Mus musculus
atatgcacatttgcatgcgcttgct

SEQ ID NO: 235397 - DNA, 25 bp, Mus musculus
atatgcaccaaacccagcgtgctag

SEQ ID NO: 235398 - DNA, 25 bp, Mus musculus
atatgcaccaaagccagcgtgctag

SEQ ID NO: 235399 - DNA, 25 bp, Mus musculus
atatgcacctggaagcagatgatgc

SEQ ID NO: 235400 - DNA, 25 bp, Mus musculus
atatgcacctggtagcagatgatgc

SEQ ID NO: 235401 - DNA, 25 bp, Mus musculus
atatgcaccttgactttcatacgct

SEQ ID NO: 235402 - DNA, 25 bp, Mus musculus
atatgcaccttgtctttcatacgct

SEQ ID NO: 235403 - DNA, 25 bp, Mus musculus
atatgcactacactggtatctgata

SEQ ID NO: 235404 - DNA, 25 bp, Mus musculus
atatgcactacagtggtatctgata

SEQ ID NO: 235405 - DNA, 25 bp, Mus musculus
atatgcactctcacaggatgtctgt

SEQ ID NO: 235406 - DNA, 25 bp, Mus musculus
atatgcactctctcaggatgtctgt

SEQ ID NO: 235407 - DNA, 25 bp, Mus musculus
atatgcactgcaaggtcctgcccct

SEQ ID NO: 235408 - DNA, 25 bp, Mus musculus
atatgcactgcatggtcctgcccct

SEQ ID NO: 235409 - DNA, 25 bp, Mus musculus
atatgcactgccagctggaccattt

SEQ ID NO: 235410 - DNA, 25 bp, Mus musculus
atatgcactgcctgctggaccattt

SEQ ID NO: 235411 - DNA, 25 bp, Mus musculus
atatgcactgcgctgttaaggtccc

SEQ ID NO: 235412 - DNA, 25 bp, Mus musculus
atatgcactgcggtgttaaggtccc

SEQ ID NO: 235413 - DNA, 25 bp, Mus musculus
atatgcactgggatattcaagtgta

SEQ ID NO: 235414 - DNA, 25 bp, Mus musculus
atatgcactgggttattcaagtgta

SEQ ID NO: 235415 - DNA, 25 bp, Mus musculus
atatgcactgttcgggatcagaaca

SEQ ID NO: 235416 - DNA, 25 bp, Mus musculus
atatgcactgttggggatcagaaca

SEQ ID NO: 235417 - DNA, 25 bp, Mus musculus
atatgcacttctatctagccagcgt

SEQ ID NO: 235418 - DNA, 25 bp, Mus musculus
atatgcacttctttctagccagcgt

SEQ ID NO: 235419 - DNA, 25 bp, Mus musculus
atatgcagaagtaaccccttattaa

SEQ ID NO: 235420 - DNA, 25 bp, Mus musculus
atatgcagaagttaccccttattaa

SEQ ID NO: 235421 - DNA, 25 bp, Mus musculus
atatgcagaatccaccctttgaacc

SEQ ID NO: 235422 - DNA, 25 bp, Mus musculus
atatgcagaatcgaccctttgaacc

SEQ ID NO: 235423 - DNA, 25 bp, Mus musculus
atatgcagcagtcacaaacaccaat

SEQ ID NO: 235424 - DNA, 25 bp, Mus musculus
atatgcagcagtgacaaacaccaat

SEQ ID NO: 235425 - DNA, 25 bp, Mus musculus
atatgcagcatccagatctagcgga

SEQ ID NO: 235426 - DNA, 25 bp, Mus musculus
atatgcagcatcgagatctagcgga

SEQ ID NO: 235427 - DNA, 25 bp, Mus musculus
atatgcagccgaagctctgctggaa

SEQ ID NO: 235428 - DNA, 25 bp, Mus musculus
atatgcagccgatgctctgctggaa

SEQ ID NO: 235429 - DNA, 25 bp, Mus musculus
atatgcagcctacgaagctcttcca

SEQ ID NO: 235430 - DNA, 25 bp, Mus musculus
atatgcagcctaggaagctcttcca

SEQ ID NO: 235431 - DNA, 25 bp, Mus musculus
atatgcagccttctccttaaatcac

SEQ ID NO: 235432 - DNA, 25 bp, Mus musculus
atatgcagccttgtccttaaatcac

SEQ ID NO: 235433 - DNA, 25 bp, Mus musculus
atatgcagctcaatcccaagtgtct

SEQ ID NO: 235434 - DNA, 25 bp, Mus musculus
atatgcagctcattcccaagtgtct

SEQ ID NO: 235435 - DNA, 25 bp, Mus musculus
atatgcagctgtagccatgggtcct

SEQ ID NO: 235436 - DNA, 25 bp, Mus musculus
atatgcagctgttgccatgggtcct

SEQ ID NO: 235437 - DNA, 25 bp, Mus musculus
atatgcaggcctcggataacccgga

SEQ ID NO: 235438 - DNA, 25 bp, Mus musculus
atatgcaggcctgggataacccgga

SEQ ID NO: 235439 - DNA, 25 bp, Mus musculus
atatgcagtaagcacgcgcagtgaa

SEQ ID NO: 235440 - DNA, 25 bp, Mus musculus
atatgcagtaaggacgcgcagtgaa

SEQ ID NO: 235441 - DNA, 25 bp, Mus musculus
atatgcagtccaaggccacgctggg

SEQ ID NO: 235442 - DNA, 25 bp, Mus musculus
atatgcagtccatggccacgctggg

SEQ ID NO: 235443 - DNA, 25 bp, Mus musculus
atatgcataccccagatattggagg

SEQ ID NO: 235444 - DNA, 25 bp, Mus musculus
atatgcatacccgagatattggagg

SEQ ID NO: 235445 - DNA, 25 bp, Mus musculus
atatgcatacggaacccacagagac

SEQ ID NO: 235446 - DNA, 25 bp, Mus musculus
atatgcatacggtacccacagagac

SEQ ID NO: 235447 - DNA, 25 bp, Mus musculus
atatgcatagcaacccatttttgta

SEQ ID NO: 235448 - DNA, 25 bp, Mus musculus
atatgcatagcatcccatttttgta

SEQ ID NO: 235449 - DNA, 25 bp, Mus musculus
atatgcatatgccaccatacccaac

SEQ ID NO: 235450 - DNA, 25 bp, Mus musculus
atatgcatatgcgaccatacccaac

SEQ ID NO: 235451 - DNA, 25 bp, Mus musculus
atatgcatcattacactcctataac

SEQ ID NO: 235452 - DNA, 25 bp, Mus musculus
atatgcatcatttcactcctataac

SEQ ID NO: 235453 - DNA, 25 bp, Mus musculus
atatgcatccctaaacaacgctttg

SEQ ID NO: 235454 - DNA, 25 bp, Mus musculus
atatgcatcccttaacaacgctttg

SEQ ID NO: 235455 - DNA, 25 bp, Mus musculus
atatgcatctagagaggccttccct

SEQ ID NO: 235456 - DNA, 25 bp, Mus musculus
atatgcatctagtgaggccttccct

SEQ ID NO: 235457 - DNA, 25 bp, Mus musculus
atatgcatctcaacagattgctgta

SEQ ID NO: 235458 - DNA, 25 bp, Mus musculus
atatgcatctcatcagattgctgta

SEQ ID NO: 235459 - DNA, 25 bp, Mus musculus
atatgcatgcacacggacattaact

SEQ ID NO: 235460 - DNA, 25 bp, Mus musculus
atatgcatgcactcggacattaact

SEQ ID NO: 235461 - DNA, 25 bp, Mus musculus
atatgcatgctcagttggcatccct

SEQ ID NO: 235462 - DNA, 25 bp, Mus musculus
atatgcatgctctgttggcatccct

SEQ ID NO: 235463 - DNA, 25 bp, Mus musculus
atatgcatggtaactttcaccgata

SEQ ID NO: 235464 - DNA, 25 bp, Mus musculus
atatgcatggtatctttcaccgata

SEQ ID NO: 235465 - DNA, 25 bp, Mus musculus
atatgcatgtcacggacttacaccc

SEQ ID NO: 235466 - DNA, 25 bp, Mus musculus
atatgcatgtcagggacttacaccc

SEQ ID NO: 235467 - DNA, 25 bp, Mus musculus
atatgcattcttatattatactcaa

SEQ ID NO: 235468 - DNA, 25 bp, Mus musculus
atatgcattcttttattatactcaa

SEQ ID NO: 235469 - DNA, 25 bp, Mus musculus
atatgcattgtcacatgcctgtttg

SEQ ID NO: 235470 - DNA, 25 bp, Mus musculus
atatgcattgtctcatgcctgtttg

SEQ ID NO: 235471 - DNA, 25 bp, Mus musculus
atatgcattgttagccacctttggc

SEQ ID NO: 235472 - DNA, 25 bp, Mus musculus
atatgcattgtttgccacctttggc

SEQ ID NO: 235473 - DNA, 25 bp, Mus musculus
atatgcatttaactccctgcagctg

SEQ ID NO: 235474 - DNA, 25 bp, Mus musculus
atatgcatttaagtccctgcagctg

SEQ ID NO: 235475 - DNA, 25 bp, Mus musculus
atatgcatttggactgtactgatca

SEQ ID NO: 235476 - DNA, 25 bp, Mus musculus
atatgcatttggtctgtactgatca

SEQ ID NO: 235477 - DNA, 25 bp, Mus musculus
atatgccaacacctcaagtgcattt

SEQ ID NO: 235478 - DNA, 25 bp, Mus musculus
atatgccaacacgtcaagtgcattt

SEQ ID NO: 235479 - DNA, 25 bp, Mus musculus
atatgccaagacagattgatatcta

SEQ ID NO: 235480 - DNA, 25 bp, Mus musculus
atatgccaagactgattgatatcta

SEQ ID NO: 235481 - DNA, 25 bp, Mus musculus
atatgccaaggactgactgggccta

SEQ ID NO: 235482 - DNA, 25 bp, Mus musculus
atatgccaaggagtgactgggccta

SEQ ID NO: 235483 - DNA, 25 bp, Mus musculus
atatgccaataaacctaatgcttag

SEQ ID NO: 235484 - DNA, 25 bp, Mus musculus
atatgccaataatcctaatgcttag

SEQ ID NO: 235485 - DNA, 25 bp, Mus musculus
atatgccacagtagtcttcccagga

SEQ ID NO: 235486 - DNA, 25 bp, Mus musculus
atatgccacagttgtcttcccagga

SEQ ID NO: 235487 - DNA, 25 bp, Mus musculus
atatgccacataagtatgacatttt

SEQ ID NO: 235488 - DNA, 25 bp, Mus musculus
atatgccacatatgtatgacatttt

SEQ ID NO: 235489 - DNA, 25 bp, Mus musculus
atatgccacccacgaggtatccagc

SEQ ID NO: 235490 - DNA, 25 bp, Mus musculus
atatgccacccaggaggtatccagc

SEQ ID NO: 235491 - DNA, 25 bp, Mus musculus
atatgccactgtaccttacatgttt

SEQ ID NO: 235492 - DNA, 25 bp, Mus musculus
atatgccactgttccttacatgttt

SEQ ID NO: 235493 - DNA, 25 bp, Mus musculus
atatgccagagacaggagcttgcca

SEQ ID NO: 235494 - DNA, 25 bp, Mus musculus
atatgccagagagaggagcttgcca

SEQ ID NO: 235495 - DNA, 25 bp, Mus musculus
atatgccagcttaggccaaggtgct

SEQ ID NO: 235496 - DNA, 25 bp, Mus musculus
atatgccagctttggccaaggtgct

SEQ ID NO: 235497 - DNA, 25 bp, Mus musculus
atatgccaggcacgtgcaacagtgc

SEQ ID NO: 235498 - DNA, 25 bp, Mus musculus
atatgccaggcaggtgcaacagtgc

SEQ ID NO: 235499 - DNA, 25 bp, Mus musculus
atatgccagggtcttccctttcaat

SEQ ID NO: 235500 - DNA, 25 bp, Mus musculus
atatgccagggtgttccctttcaat

SEQ ID NO: 235501 - DNA, 25 bp, Mus musculus
atatgccagtgtatcaacttttcaa

SEQ ID NO: 235502 - DNA, 25 bp, Mus musculus
atatgccagtgtttcaacttttcaa

SEQ ID NO: 235503 - DNA, 25 bp, Mus musculus
atatgccatgatagtaagacccttg

SEQ ID NO: 235504 - DNA, 25 bp, Mus musculus
atatgccatgattgtaagacccttg

SEQ ID NO: 235505 - DNA, 25 bp, Mus musculus
atatgccatgtgaaatttccatgat

SEQ ID NO: 235506 - DNA, 25 bp, Mus musculus
atatgccatgtgtaatttccatgat

SEQ ID NO: 235507 - DNA, 25 bp, Mus musculus
atatgcccaaaactcagatctttag

SEQ ID NO: 235508 - DNA, 25 bp, Mus musculus
atatgcccaaaagtcagatctttag

SEQ ID NO: 235509 - DNA, 25 bp, Mus musculus
atatgcccacttatatttactacaa

SEQ ID NO: 235510 - DNA, 25 bp, Mus musculus
atatgcccacttttatttactacaa

SEQ ID NO: 235511 - DNA, 25 bp, Mus musculus
atatgcccagctctttccttgaatg

SEQ ID NO: 235512 - DNA, 25 bp, Mus musculus
atatgcccagctgtttccttgaatg

SEQ ID NO: 235513 - DNA, 25 bp, Mus musculus
atatgccccaaaagcaacttggtta

SEQ ID NO: 235514 - DNA, 25 bp, Mus musculus
atatgccccaaatgcaacttggtta

SEQ ID NO: 235515 - DNA, 25 bp, Mus musculus
atatgcccccatctatctatgtgtg

SEQ ID NO: 235516 - DNA, 25 bp, Mus musculus
atatgcccccatgtatctatgtgtg

SEQ ID NO: 235517 - DNA, 25 bp, Mus musculus
atatgcccgaggaaccggtgcgcat

SEQ ID NO: 235518 - DNA, 25 bp, Mus musculus
atatgcccgaggtaccggtgcgcat

SEQ ID NO: 235519 - DNA, 25 bp, Mus musculus
atatgcccgggcaggctgtaggcat

SEQ ID NO: 235520 - DNA, 25 bp, Mus musculus
atatgcccgggctggctgtaggcat

SEQ ID NO: 235521 - DNA, 25 bp, Mus musculus
atatgccgggcactcagtgtactaa

SEQ ID NO: 235522 - DNA, 25 bp, Mus musculus
atatgccgggcagtcagtgtactaa

SEQ ID NO: 235523 - DNA, 25 bp, Mus musculus
atatgcctacgaagtattatcagtc

SEQ ID NO: 235524 - DNA, 25 bp, Mus musculus
atatgcctacgatgtattatcagtc

SEQ ID NO: 235525 - DNA, 25 bp, Mus musculus
atatgcctagtaagtgggccacctt

SEQ ID NO: 235526 - DNA, 25 bp, Mus musculus
atatgcctagtatgtgggccacctt

SEQ ID NO: 235527 - DNA, 25 bp, Mus musculus
atatgcctatggaggatatttccta

SEQ ID NO: 235528 - DNA, 25 bp, Mus musculus
atatgcctatggtggatatttccta

SEQ ID NO: 235529 - DNA, 25 bp, Mus musculus
atatgcctcagaaatttaacccgta

SEQ ID NO: 235530 - DNA, 25 bp, Mus musculus
atatgcctcagatatttaacccgta

SEQ ID NO: 235531 - DNA, 25 bp, Mus musculus
atatgcctcctgacacaataattac

SEQ ID NO: 235532 - DNA, 25 bp, Mus musculus
atatgcctcctgtcacaataattac

SEQ ID NO: 235533 - DNA, 25 bp, Mus musculus
atatgcctcttcagtcaggagtaca

SEQ ID NO: 235534 - DNA, 25 bp, Mus musculus
atatgcctcttctgtcaggagtaca

SEQ ID NO: 235535 - DNA, 25 bp, Mus musculus
atatgcctgagtcgtgtacccttgt

SEQ ID NO: 235536 - DNA, 25 bp, Mus musculus
atatgcctgagtggtgtacccttgt

SEQ ID NO: 235537 - DNA, 25 bp, Mus musculus
atatgcctgccacgccgaagcaatg

SEQ ID NO: 235538 - DNA, 25 bp, Mus musculus
atatgcctgccaggccgaagcaatg

SEQ ID NO: 235539 - DNA, 25 bp, Mus musculus
atatgcctgctcaatttctcttatt

SEQ ID NO: 235540 - DNA, 25 bp, Mus musculus
atatgcctgctctatttctcttatt

SEQ ID NO: 235541 - DNA, 25 bp, Mus musculus
atatgcctgtagatataatcatgaa

SEQ ID NO: 235542 - DNA, 25 bp, Mus musculus
atatgcctgtagttataatcatgaa

SEQ ID NO: 235543 - DNA, 25 bp, Mus musculus
atatgcctgtggaaccggcaggctt

SEQ ID NO: 235544 - DNA, 25 bp, Mus musculus
atatgcctgtggtaccggcaggctt

SEQ ID NO: 235545 - DNA, 25 bp, Mus musculus
atatgccttaatagttatggtgaaa

SEQ ID NO: 235546 - DNA, 25 bp, Mus musculus
atatgccttaattgttatggtgaaa

SEQ ID NO: 235547 - DNA, 25 bp, Mus musculus
atatgccttctcctaacagttctcc

SEQ ID NO: 235548 - DNA, 25 bp, Mus musculus
atatgccttctcgtaacagttctcc

SEQ ID NO: 235549 - DNA, 25 bp, Mus musculus
atatgccttttgaaacttcacttgg

SEQ ID NO: 235550 - DNA, 25 bp, Mus musculus
atatgccttttgtaacttcacttgg

SEQ ID NO: 235551 - DNA, 25 bp, Mus musculus
atatgcgacgggaggaggacctcta

SEQ ID NO: 235552 - DNA, 25 bp, Mus musculus
atatgcgacgggtggaggacctcta

SEQ ID NO: 235553 - DNA, 25 bp, Mus musculus
atatgcgccgtgctggctaccgcca

SEQ ID NO: 235554 - DNA, 25 bp, Mus musculus
atatgcgccgtggtggctaccgcca

SEQ ID NO: 235555 - DNA, 25 bp, Mus musculus
atatgcgctgtcatttttccttttt

SEQ ID NO: 235556 - DNA, 25 bp, Mus musculus
atatgcgctgtcttttttccttttt

SEQ ID NO: 235557 - DNA, 25 bp, Mus musculus
atatgcgctttcagaactgtaccgg

SEQ ID NO: 235558 - DNA, 25 bp, Mus musculus
atatgcgctttctgaactgtaccgg

SEQ ID NO: 235559 - DNA, 25 bp, Mus musculus
atatgcggattcactcttttcctac

SEQ ID NO: 235560 - DNA, 25 bp, Mus musculus
atatgcggattctctcttttcctac

SEQ ID NO: 235561 - DNA, 25 bp, Mus musculus
atatgcggttgtcatctgacccagg

SEQ ID NO: 235562 - DNA, 25 bp, Mus musculus
atatgcggttgtgatctgacccagg

SEQ ID NO: 235563 - DNA, 25 bp, Mus musculus
atatgcgtgcgtatttatgtatgtg

SEQ ID NO: 235564 - DNA, 25 bp, Mus musculus
atatgcgtgcgtttttatgtatgtg

SEQ ID NO: 235565 - DNA, 25 bp, Mus musculus
atatgcgtgtggctgacagtcctca

SEQ ID NO: 235566 - DNA, 25 bp, Mus musculus
atatgcgtgtgggtgacagtcctca

SEQ ID NO: 235567 - DNA, 25 bp, Mus musculus
atatgctaacccatgtgggtgctgg

SEQ ID NO: 235568 - DNA, 25 bp, Mus musculus
atatgctaacccttgtgggtgctgg

SEQ ID NO: 235569 - DNA, 25 bp, Mus musculus
atatgctaatccatcctaggctctg

SEQ ID NO: 235570 - DNA, 25 bp, Mus musculus
atatgctaatccttcctaggctctg

SEQ ID NO: 235571 - DNA, 25 bp, Mus musculus
atatgctacgctccatcacgtcata

SEQ ID NO: 235572 - DNA, 25 bp, Mus musculus
atatgctacgctgcatcacgtcata

SEQ ID NO: 235573 - DNA, 25 bp, Mus musculus
atatgctactacaactagtttgtac

SEQ ID NO: 235574 - DNA, 25 bp, Mus musculus
atatgctactactactagtttgtac

SEQ ID NO: 235575 - DNA, 25 bp, Mus musculus
atatgctactctatcagactccgtt

SEQ ID NO: 235576 - DNA, 25 bp, Mus musculus
atatgctactctttcagactccgtt

SEQ ID NO: 235577 - DNA, 25 bp, Mus musculus
atatgctactgtctgttggttccaa

SEQ ID NO: 235578 - DNA, 25 bp, Mus musculus
atatgctactgtgtgttggttccaa

SEQ ID NO: 235579 - DNA, 25 bp, Mus musculus
atatgctagacactatgatgcctcc

SEQ ID NO: 235580 - DNA, 25 bp, Mus musculus
atatgctagacagtatgatgcctcc

SEQ ID NO: 235581 - DNA, 25 bp, Mus musculus
atatgctagagcctcactcgtgcca

SEQ ID NO: 235582 - DNA, 25 bp, Mus musculus
atatgctagagcgtcactcgtgcca

SEQ ID NO: 235583 - DNA, 25 bp, Mus musculus
atatgctaggaactgtcctccgtct

SEQ ID NO: 235584 - DNA, 25 bp, Mus musculus
atatgctaggaagtgtcctccgtct

SEQ ID NO: 235585 - DNA, 25 bp, Mus musculus
atatgctatatactggtctccctta

SEQ ID NO: 235586 - DNA, 25 bp, Mus musculus
atatgctatatagtggtctccctta

SEQ ID NO: 235587 - DNA, 25 bp, Mus musculus
atatgctatgagaacccatgcccca

SEQ ID NO: 235588 - DNA, 25 bp, Mus musculus
atatgctatgagtacccatgcccca

SEQ ID NO: 235589 - DNA, 25 bp, Mus musculus
atatgctatgtgaccaaaccctgtt

SEQ ID NO: 235590 - DNA, 25 bp, Mus musculus
atatgctatgtgtccaaaccctgtt

SEQ ID NO: 235591 - DNA, 25 bp, Mus musculus
atatgctcatgtcgtgttgaggaaa

SEQ ID NO: 235592 - DNA, 25 bp, Mus musculus
atatgctcatgtggtgttgaggaaa

SEQ ID NO: 235593 - DNA, 25 bp, Mus musculus
atatgctcctacagcaaccagctat

SEQ ID NO: 235594 - DNA, 25 bp, Mus musculus
atatgctcctactgcaaccagctat

SEQ ID NO: 235595 - DNA, 25 bp, Mus musculus
atatgctcctccaaaacccatgaac

SEQ ID NO: 235596 - DNA, 25 bp, Mus musculus
atatgctcctcctaaacccatgaac

SEQ ID NO: 235597 - DNA, 25 bp, Mus musculus
atatgctcctgtaaggtgcctccta

SEQ ID NO: 235598 - DNA, 25 bp, Mus musculus
atatgctcctgttaggtgcctccta

SEQ ID NO: 235599 - DNA, 25 bp, Mus musculus
atatgctctataatcatgcagaaca

SEQ ID NO: 235600 - DNA, 25 bp, Mus musculus
atatgctctatattcatgcagaaca

SEQ ID NO: 235601 - DNA, 25 bp, Mus musculus
atatgctctcccaaaaccatggttg

SEQ ID NO: 235602 - DNA, 25 bp, Mus musculus
atatgctctccctaaaccatggttg

SEQ ID NO: 235603 - DNA, 25 bp, Mus musculus
atatgctctgcgaaaactggatgac

SEQ ID NO: 235604 - DNA, 25 bp, Mus musculus
atatgctctgcgtaaactggatgac

SEQ ID NO: 235605 - DNA, 25 bp, Mus musculus
atatgctctgctacaatgactccca

SEQ ID NO: 235606 - DNA, 25 bp, Mus musculus
atatgctctgcttcaatgactccca

SEQ ID NO: 235607 - DNA, 25 bp, Mus musculus
atatgctcttaaaatgcaactttga

SEQ ID NO: 235608 - DNA, 25 bp, Mus musculus
atatgctcttaatatgcaactttga

SEQ ID NO: 235609 - DNA, 25 bp, Mus musculus
atatgctcttccaaacctccttttt

SEQ ID NO: 235610 - DNA, 25 bp, Mus musculus
atatgctcttccagcgtttctacag

SEQ ID NO: 235611 - DNA, 25 bp, Mus musculus
atatgctcttcctaacctccttttt

SEQ ID NO: 235612 - DNA, 25 bp, Mus musculus
atatgctcttcctgcgtttctacag

SEQ ID NO: 235613 - DNA, 25 bp, Mus musculus
atatgctcttgcatgtctactcttc

SEQ ID NO: 235614 - DNA, 25 bp, Mus musculus
atatgctcttgcttgtctactcttc

SEQ ID NO: 235615 - DNA, 25 bp, Mus musculus
atatgctcttttaggagtcagacaa

SEQ ID NO: 235616 - DNA, 25 bp, Mus musculus
atatgctctttttggagtcagacaa

SEQ ID NO: 235617 - DNA, 25 bp, Mus musculus
atatgctgagctcacatatcccttt

SEQ ID NO: 235618 - DNA, 25 bp, Mus musculus
atatgctgagctgacatatcccttt

SEQ ID NO: 235619 - DNA, 25 bp, Mus musculus
atatgctgatagacacatgattaac

SEQ ID NO: 235620 - DNA, 25 bp, Mus musculus
atatgctgatagtcacatgattaac

SEQ ID NO: 235621 - DNA, 25 bp, Mus musculus
atatgctgcctaacctcaacaagag

SEQ ID NO: 235622 - DNA, 25 bp, Mus musculus
atatgctgcctatcctcaacaagag

SEQ ID NO: 235623 - DNA, 25 bp, Mus musculus
atatgctgcctgataaagtgacact

SEQ ID NO: 235624 - DNA, 25 bp, Mus musculus
atatgctgcctgttaaagtgacact

SEQ ID NO: 235625 - DNA, 25 bp, Mus musculus
atatgctgcgtcagggaaagtctgt

SEQ ID NO: 235626 - DNA, 25 bp, Mus musculus
atatgctgcgtctgggaaagtctgt

SEQ ID NO: 235627 - DNA, 25 bp, Mus musculus
atatgctgcttgaggttggaatctc

SEQ ID NO: 235628 - DNA, 25 bp, Mus musculus
atatgctgcttgtggttggaatctc

SEQ ID NO: 235629 - DNA, 25 bp, Mus musculus
atatgctggaaaatgctccctgtaa

SEQ ID NO: 235630 - DNA, 25 bp, Mus musculus
atatgctggaaattgctccctgtaa

SEQ ID NO: 235631 - DNA, 25 bp, Mus musculus
atatgctggatgagaaagtccactc

SEQ ID NO: 235632 - DNA, 25 bp, Mus musculus
atatgctggatgtgaaagtccactc

SEQ ID NO: 235633 - DNA, 25 bp, Mus musculus
atatgctggtcaacacccagggccg

SEQ ID NO: 235634 - DNA, 25 bp, Mus musculus
atatgctggtcatcacccagggccg

SEQ ID NO: 235635 - DNA, 25 bp, Mus musculus
atatgctgtatcataatgtggtttt

SEQ ID NO: 235636 - DNA, 25 bp, Mus musculus
atatgctgtatcttaatgtggtttt

SEQ ID NO: 235637 - DNA, 25 bp, Mus musculus
atatgctgtgtgagccacattttta

SEQ ID NO: 235638 - DNA, 25 bp, Mus musculus
atatgctgtgtgtgccacattttta

SEQ ID NO: 235639 - DNA, 25 bp, Mus musculus
atatgctgttgtatgcctttaggac

SEQ ID NO: 235640 - DNA, 25 bp, Mus musculus
atatgctgttgtttgcctttaggac

SEQ ID NO: 235641 - DNA, 25 bp, Mus musculus
atatgcttagccaagggtgtggcac

SEQ ID NO: 235642 - DNA, 25 bp, Mus musculus
atatgcttagcctagggtgtggcac

SEQ ID NO: 235643 - DNA, 25 bp, Mus musculus
atatgcttagctatagttttcggcc

SEQ ID NO: 235644 - DNA, 25 bp, Mus musculus
atatgcttagctttagttttcggcc

SEQ ID NO: 235645 - DNA, 25 bp, Mus musculus
atatgcttatccaatcgcttagttc

SEQ ID NO: 235646 - DNA, 25 bp, Mus musculus
atatgcttatcctatcgcttagttc

SEQ ID NO: 235647 - DNA, 25 bp, Mus musculus
atatgcttcaacagtcatccttcaa

SEQ ID NO: 235648 - DNA, 25 bp, Mus musculus
atatgcttcaactgtcatccttcaa

SEQ ID NO: 235649 - DNA, 25 bp, Mus musculus
atatgcttccacaacatttgcccat

SEQ ID NO: 235650 - DNA, 25 bp, Mus musculus
atatgcttccactacatttgcccat

SEQ ID NO: 235651 - DNA, 25 bp, Mus musculus
atatgcttgaatccacagccatcca

SEQ ID NO: 235652 - DNA, 25 bp, Mus musculus
atatgcttgaatgcacagccatcca

SEQ ID NO: 235653 - DNA, 25 bp, Mus musculus
atatgcttggagagctccggacctt

SEQ ID NO: 235654 - DNA, 25 bp, Mus musculus
atatgcttggagtgctccggacctt

SEQ ID NO: 235655 - DNA, 25 bp, Mus musculus
atatgcttggcaaggattttaaaga

SEQ ID NO: 235656 - DNA, 25 bp, Mus musculus
atatgcttggcatggattttaaaga

SEQ ID NO: 235657 - DNA, 25 bp, Mus musculus
atatgcttgggtatttgctgtcacg

SEQ ID NO: 235658 - DNA, 25 bp, Mus musculus
atatgcttgggtttttgctgtcacg

SEQ ID NO: 235659 - DNA, 25 bp, Mus musculus
atatgcttgtgaaacgtctgcttgc

SEQ ID NO: 235660 - DNA, 25 bp, Mus musculus
atatgcttgtgatacgtctgcttgc

SEQ ID NO: 235661 - DNA, 25 bp, Mus musculus
atatgctttcagagtgtagcccggg

SEQ ID NO: 235662 - DNA, 25 bp, Mus musculus
atatgctttcagtgtgtagcccggg

SEQ ID NO: 235663 - DNA, 25 bp, Mus musculus
atatgctttctaatcctttgggtta

SEQ ID NO: 235664 - DNA, 25 bp, Mus musculus
atatgctttctattcctttgggtta

SEQ ID NO: 235665 - DNA, 25 bp, Mus musculus
atatgctttgatccttttgctaaac

SEQ ID NO: 235666 - DNA, 25 bp, Mus musculus
atatgctttgatgcttttgctaaac

SEQ ID NO: 235667 - DNA, 25 bp, Mus musculus
atatgctttgcacttagcttccagc

SEQ ID NO: 235668 - DNA, 25 bp, Mus musculus
atatgctttgcagttagcttccagc

SEQ ID NO: 235669 - DNA, 25 bp, Mus musculus
atatgctttgtaaattcccttgcaa

SEQ ID NO: 235670 - DNA, 25 bp, Mus musculus
atatgctttgtatattcccttgcaa

SEQ ID NO: 235671 - DNA, 25 bp, Mus musculus
atatgcttttaacgcagcccaccca

SEQ ID NO: 235672 - DNA, 25 bp, Mus musculus
atatgcttttaaggcagcccaccca

SEQ ID NO: 235673 - DNA, 25 bp, Mus musculus
atatgcttttccataatttccaagg

SEQ ID NO: 235674 - DNA, 25 bp, Mus musculus
atatgcttttccttaatttccaagg

SEQ ID NO: 235675 - DNA, 25 bp, Mus musculus
atatgcttttgcctctctagaatgt

SEQ ID NO: 235676 - DNA, 25 bp, Mus musculus
atatgcttttgcgtctctagaatgt

SEQ ID NO: 235677 - DNA, 25 bp, Mus musculus
atatgcttttgtacactgcttaaga

SEQ ID NO: 235678 - DNA, 25 bp, Mus musculus
atatgcttttgttcactgcttaaga

SEQ ID NO: 235679 - DNA, 25 bp, Mus musculus
atatggaaaccacagtactctagtt

SEQ ID NO: 235680 - DNA, 25 bp, Mus musculus
atatggaaaccagagtactctagtt

SEQ ID NO: 235681 - DNA, 25 bp, Mus musculus
atatggaaaccgacaggaggctcat

SEQ ID NO: 235682 - DNA, 25 bp, Mus musculus
atatggaaaccgtcaggaggctcat

SEQ ID NO: 235683 - DNA, 25 bp, Mus musculus
atatggaaactcatgatgggctaca

SEQ ID NO: 235684 - DNA, 25 bp, Mus musculus
atatggaaactcttgatgggctaca

SEQ ID NO: 235685 - DNA, 25 bp, Mus musculus
atatggaaatcaaccctcactgggc

SEQ ID NO: 235686 - DNA, 25 bp, Mus musculus
atatggaaatcatccctcactgggc

SEQ ID NO: 235687 - DNA, 25 bp, Mus musculus
atatggaacggcactcagcggagca

SEQ ID NO: 235688 - DNA, 25 bp, Mus musculus
atatggaacggctctcagcggagca

SEQ ID NO: 235689 - DNA, 25 bp, Mus musculus
atatggaatctcctacctgcttgag

SEQ ID NO: 235690 - DNA, 25 bp, Mus musculus
atatggaatctcgtacctgcttgag

SEQ ID NO: 235691 - DNA, 25 bp, Mus musculus
atatggaatgaacgtcccctccctg

SEQ ID NO: 235692 - DNA, 25 bp, Mus musculus
atatggaatgaaggtcccctccctg

SEQ ID NO: 235693 - DNA, 25 bp, Mus musculus
atatggacagagatgcattcagtgc

SEQ ID NO: 235694 - DNA, 25 bp, Mus musculus
atatggacagagttgcattcagtgc

SEQ ID NO: 235695 - DNA, 25 bp, Mus musculus
atatggacagttaccttggacttaa

SEQ ID NO: 235696 - DNA, 25 bp, Mus musculus
atatggacagttctttggaatgctc

SEQ ID NO: 235697 - DNA, 25 bp, Mus musculus
atatggacagttgtttggaatgctc

SEQ ID NO: 235698 - DNA, 25 bp, Mus musculus
atatggacagtttccttggacttaa

SEQ ID NO: 235699 - DNA, 25 bp, Mus musculus
atatggacattgctcagggtgtgca

SEQ ID NO: 235700 - DNA, 25 bp, Mus musculus
atatggacattggtcagggtgtgca

SEQ ID NO: 235701 - DNA, 25 bp, Mus musculus
atatggaccgcaaggcaagccatca

SEQ ID NO: 235702 - DNA, 25 bp, Mus musculus
atatggaccgcatggcaagccatca

SEQ ID NO: 235703 - DNA, 25 bp, Mus musculus
atatggactagtaagtaggctttgc

SEQ ID NO: 235704 - DNA, 25 bp, Mus musculus
atatggactagttagtaggctttgc

SEQ ID NO: 235705 - DNA, 25 bp, Mus musculus
atatggactgctatctttcaaaatt

SEQ ID NO: 235706 - DNA, 25 bp, Mus musculus
atatggactgctttctttcaaaatt

SEQ ID NO: 235707 - DNA, 25 bp, Mus musculus
atatggactggcatgtacctgccac

SEQ ID NO: 235708 - DNA, 25 bp, Mus musculus
atatggactggcttgtacctgccac

SEQ ID NO: 235709 - DNA, 25 bp, Mus musculus
atatggacttgtatacaccgccagc

SEQ ID NO: 235710 - DNA, 25 bp, Mus musculus
atatggacttgtttacaccgccagc

SEQ ID NO: 235711 - DNA, 25 bp, Mus musculus
atatggacttttcatcccgtgttag

SEQ ID NO: 235712 - DNA, 25 bp, Mus musculus
atatggacttttgatcccgtgttag

SEQ ID NO: 235713 - DNA, 25 bp, Mus musculus
atatggagacatactactagtaagg

SEQ ID NO: 235714 - DNA, 25 bp, Mus musculus
atatggagacattctactagtaagg

SEQ ID NO: 235715 - DNA, 25 bp, Mus musculus
atatggagacgtagtccggttccgc

SEQ ID NO: 235716 - DNA, 25 bp, Mus musculus
atatggagacgttgtccggttccgc

SEQ ID NO: 235717 - DNA, 25 bp, Mus musculus
atatggagcaggagctctcttcggc

SEQ ID NO: 235718 - DNA, 25 bp, Mus musculus
atatggagcaggtgctctcttcggc

SEQ ID NO: 235719 - DNA, 25 bp, Mus musculus
atatggagccatagctaacctaccc

SEQ ID NO: 235720 - DNA, 25 bp, Mus musculus
atatggagccattgctaacctaccc

SEQ ID NO: 235721 - DNA, 25 bp, Mus musculus
atatggaggcatccagtgggcaact

SEQ ID NO: 235722 - DNA, 25 bp, Mus musculus
atatggaggcatgcagtgggcaact

SEQ ID NO: 235723 - DNA, 25 bp, Mus musculus
atatggaggcctctgcgaattccac

SEQ ID NO: 235724 - DNA, 25 bp, Mus musculus
atatggaggcctgtgcgaattccac

SEQ ID NO: 235725 - DNA, 25 bp, Mus musculus
atatggagggctacataccttgctc

SEQ ID NO: 235726 - DNA, 25 bp, Mus musculus
atatggagggcttcataccttgctc

SEQ ID NO: 235727 - DNA, 25 bp, Mus musculus
atatggagtcctctttggaccgcct

SEQ ID NO: 235728 - DNA, 25 bp, Mus musculus
atatggagtcctgtttggaccgcct

SEQ ID NO: 235729 - DNA, 25 bp, Mus musculus
atatggatacgtctccaagcttggc

SEQ ID NO: 235730 - DNA, 25 bp, Mus musculus
atatggatacgtgtccaagcttggc

SEQ ID NO: 235731 - DNA, 25 bp, Mus musculus
atatggatcatgaaggccctataag

SEQ ID NO: 235732 - DNA, 25 bp, Mus musculus
atatggatcatgtaggccctataag

SEQ ID NO: 235733 - DNA, 25 bp, Mus musculus
atatggatgtttcttgtggctcact

SEQ ID NO: 235734 - DNA, 25 bp, Mus musculus
atatggatgtttgttgtggctcact

SEQ ID NO: 235735 - DNA, 25 bp, Mus musculus
atatggattcctacacattcaacag

SEQ ID NO: 235736 - DNA, 25 bp, Mus musculus
atatggattccttcacattcaacag

SEQ ID NO: 235737 - DNA, 25 bp, Mus musculus
atatggattctacggcccagggact

SEQ ID NO: 235738 - DNA, 25 bp, Mus musculus
atatggattctagggcccagggact

SEQ ID NO: 235739 - DNA, 25 bp, Mus musculus
atatggattgtgattctcttgctgc

SEQ ID NO: 235740 - DNA, 25 bp, Mus musculus
atatggattgtgtttctcttgctgc

SEQ ID NO: 235741 - DNA, 25 bp, Mus musculus
atatggcaagatatcctctcactgt

SEQ ID NO: 235742 - DNA, 25 bp, Mus musculus
atatggcaagatttcctctcactgt

SEQ ID NO: 235743 - DNA, 25 bp, Mus musculus
atatggcacctacttacatcccttt

SEQ ID NO: 235744 - DNA, 25 bp, Mus musculus
atatggcacctagttacatcccttt

SEQ ID NO: 235745 - DNA, 25 bp, Mus musculus
atatggcagctcacgagaagtccgt

SEQ ID NO: 235746 - DNA, 25 bp, Mus musculus
atatggcagctctcgagaagtccgt

SEQ ID NO: 235747 - DNA, 25 bp, Mus musculus
atatggcaggcgaccgaacagaaga

SEQ ID NO: 235748 - DNA, 25 bp, Mus musculus
atatggcaggcgtccgaacagaaga

SEQ ID NO: 235749 - DNA, 25 bp, Mus musculus
atatggcataacacttctctggaaa

SEQ ID NO: 235750 - DNA, 25 bp, Mus musculus
atatggcataactcttctctggaaa

SEQ ID NO: 235751 - DNA, 25 bp, Mus musculus
atatggcatattccatgcactcagt

SEQ ID NO: 235752 - DNA, 25 bp, Mus musculus
atatggcatattgcatgcactcagt

SEQ ID NO: 235753 - DNA, 25 bp, Mus musculus
atatggcatgtccaacgttccaatg

SEQ ID NO: 235754 - DNA, 25 bp, Mus musculus
atatggcatgtcgaacgttccaatg

SEQ ID NO: 235755 - DNA, 25 bp, Mus musculus
atatggccaactcccttttagctgg

SEQ ID NO: 235756 - DNA, 25 bp, Mus musculus
atatggccaactgccttttagctgg

SEQ ID NO: 235757 - DNA, 25 bp, Mus musculus
atatggccacatctgaaaacgtcaa

SEQ ID NO: 235758 - DNA, 25 bp, Mus musculus
atatggccacatgtgaaaacgtcaa

SEQ ID NO: 235759 - DNA, 25 bp, Mus musculus
atatggccattacttcacacataga

SEQ ID NO: 235760 - DNA, 25 bp, Mus musculus
atatggccattagttcacacataga

SEQ ID NO: 235761 - DNA, 25 bp, Mus musculus
atatggccattcctgtcatctgaaa

SEQ ID NO: 235762 - DNA, 25 bp, Mus musculus
atatggccattcgtgtcatctgaaa

SEQ ID NO: 235763 - DNA, 25 bp, Mus musculus
atatggccctcaacgtcgtgtaatg

SEQ ID NO: 235764 - DNA, 25 bp, Mus musculus
atatggccctcatcgtcgtgtaatg

SEQ ID NO: 235765 - DNA, 25 bp, Mus musculus
atatggcctactagggtgacccttc

SEQ ID NO: 235766 - DNA, 25 bp, Mus musculus
atatggcctacttgggtgacccttc

SEQ ID NO: 235767 - DNA, 25 bp, Mus musculus
atatggcctcttaattttctctgct

SEQ ID NO: 235768 - DNA, 25 bp, Mus musculus
atatggcctctttattttctctgct

SEQ ID NO: 235769 - DNA, 25 bp, Mus musculus
atatggcctggcagtagaaacctca

SEQ ID NO: 235770 - DNA, 25 bp, Mus musculus
atatggcctggctgtagaaacctca

SEQ ID NO: 235771 - DNA, 25 bp, Mus musculus
atatggcctttgctttactgagtaa

SEQ ID NO: 235772 - DNA, 25 bp, Mus musculus
atatggcctttggtttactgagtaa

SEQ ID NO: 235773 - DNA, 25 bp, Mus musculus
atatggccttttcccggcagcaaga

SEQ ID NO: 235774 - DNA, 25 bp, Mus musculus
atatggccttttgccggcagcaaga

SEQ ID NO: 235775 - DNA, 25 bp, Mus musculus
atatggcggcctcttgactatgatc

SEQ ID NO: 235776 - DNA, 25 bp, Mus musculus
atatggcggcctgttgactatgatc

SEQ ID NO: 235777 - DNA, 25 bp, Mus musculus
atatggcgtccgctactcgcgttat

SEQ ID NO: 235778 - DNA, 25 bp, Mus musculus
atatggcgtccggtactcgcgttat

SEQ ID NO: 235779 - DNA, 25 bp, Mus musculus
atatggcgttatatgtacgtgtgta

SEQ ID NO: 235780 - DNA, 25 bp, Mus musculus
atatggcgttatttgtacgtgtgta

SEQ ID NO: 235781 - DNA, 25 bp, Mus musculus
atatggctacacctgtgttatcaga

SEQ ID NO: 235782 - DNA, 25 bp, Mus musculus
atatggctacacgtgtgttatcaga

SEQ ID NO: 235783 - DNA, 25 bp, Mus musculus
atatggctaggaagctgctgagcta

SEQ ID NO: 235784 - DNA, 25 bp, Mus musculus
atatggctaggatgctgctgagcta

SEQ ID NO: 235785 - DNA, 25 bp, Mus musculus
atatggctatcaacaaatgcaagga

SEQ ID NO: 235786 - DNA, 25 bp, Mus musculus
atatggctatcatcaaatgcaagga

SEQ ID NO: 235787 - DNA, 25 bp, Mus musculus
atatggctcccgctatattgtgggt

SEQ ID NO: 235788 - DNA, 25 bp, Mus musculus
atatggctcccggtatattgtgggt

SEQ ID NO: 235789 - DNA, 25 bp, Mus musculus
atatggctcggacaccagcgacttc

SEQ ID NO: 235790 - DNA, 25 bp, Mus musculus
atatggctcggagaccagcgacttc

SEQ ID NO: 235791 - DNA, 25 bp, Mus musculus
atatggctcgggaatagtgatgtaa

SEQ ID NO: 235792 - DNA, 25 bp, Mus musculus
atatggctcgggtatagtgatgtaa

SEQ ID NO: 235793 - DNA, 25 bp, Mus musculus
atatggctctagattggcaccttca

SEQ ID NO: 235794 - DNA, 25 bp, Mus musculus
atatggctctagtttggcaccttca

SEQ ID NO: 235795 - DNA, 25 bp, Mus musculus
atatggctctcgagtctgccttcct

SEQ ID NO: 235796 - DNA, 25 bp, Mus musculus
atatggctctcgtgtctgccttcct

SEQ ID NO: 235797 - DNA, 25 bp, Mus musculus
atatggctctgtatttcttgcatgc

SEQ ID NO: 235798 - DNA, 25 bp, Mus musculus
atatggctctgtttttcttgcatgc

SEQ ID NO: 235799 - DNA, 25 bp, Mus musculus
atatggctcttgatgatatccagct

SEQ ID NO: 235800 - DNA, 25 bp, Mus musculus
atatggctcttgttgatatccagct

SEQ ID NO: 235801 - DNA, 25 bp, Mus musculus
atatggctgcttaagctccctcaga

SEQ ID NO: 235802 - DNA, 25 bp, Mus musculus
atatggctgctttagctccctcaga

SEQ ID NO: 235803 - DNA, 25 bp, Mus musculus
atatggctggacatctgtttctatg

SEQ ID NO: 235804 - DNA, 25 bp, Mus musculus
atatggctggacttctgtttctatg

SEQ ID NO: 235805 - DNA, 25 bp, Mus musculus
atatggctggttatatatcctcaga

SEQ ID NO: 235806 - DNA, 25 bp, Mus musculus
atatggctggttttatatcctcaga

SEQ ID NO: 235807 - DNA, 25 bp, Mus musculus
atatggctgtatactgacctcaaac

SEQ ID NO: 235808 - DNA, 25 bp, Mus musculus
atatggctgtattctgacctcaaac

SEQ ID NO: 235809 - DNA, 25 bp, Mus musculus
atatggcttcatagatttcaaggat

SEQ ID NO: 235810 - DNA, 25 bp, Mus musculus
atatggcttcatcccacaacaagat

SEQ ID NO: 235811 - DNA, 25 bp, Mus musculus
atatggcttcatgccacaacaagat

SEQ ID NO: 235812 - DNA, 25 bp, Mus musculus
atatggcttcattgatttcaaggat

SEQ ID NO: 235813 - DNA, 25 bp, Mus musculus
atatggcttccacagtcacgattcc

SEQ ID NO: 235814 - DNA, 25 bp, Mus musculus
atatggcttccagagtcacgattcc

SEQ ID NO: 235815 - DNA, 25 bp, Mus musculus
atatggcttgcactaggcccagcat

SEQ ID NO: 235816 - DNA, 25 bp, Mus musculus
atatggcttgcagtaggcccagcat

SEQ ID NO: 235817 - DNA, 25 bp, Mus musculus
atatgggaacgcaggcttatggcat

SEQ ID NO: 235818 - DNA, 25 bp, Mus musculus
atatgggaacgctggcttatggcat

SEQ ID NO: 235819 - DNA, 25 bp, Mus musculus
atatgggacagaacacacctctgct

SEQ ID NO: 235820 - DNA, 25 bp, Mus musculus
atatgggacagatcacacctctgct

SEQ ID NO: 235821 - DNA, 25 bp, Mus musculus
atatgggacaggctttcacagtaca

SEQ ID NO: 235822 - DNA, 25 bp, Mus musculus
atatgggacagggtttcacagtaca

SEQ ID NO: 235823 - DNA, 25 bp, Mus musculus
atatgggacagtacttgttctcgaa

SEQ ID NO: 235824 - DNA, 25 bp, Mus musculus
atatgggacagttcttgttctcgaa

SEQ ID NO: 235825 - DNA, 25 bp, Mus musculus
atatgggactctcacacctcaggtt

SEQ ID NO: 235826 - DNA, 25 bp, Mus musculus
atatgggactctgacacctcaggtt

SEQ ID NO: 235827 - DNA, 25 bp, Mus musculus
atatgggaggcacaagataagcttt

SEQ ID NO: 235828 - DNA, 25 bp, Mus musculus
atatgggaggcagaagataagcttt

SEQ ID NO: 235829 - DNA, 25 bp, Mus musculus
atatgggataatccttggctctcca

SEQ ID NO: 235830 - DNA, 25 bp, Mus musculus
atatgggataatgcttggctctcca

SEQ ID NO: 235831 - DNA, 25 bp, Mus musculus
atatgggatatgatcccctaatcct

SEQ ID NO: 235832 - DNA, 25 bp, Mus musculus
atatgggatatgttcccctaatcct

SEQ ID NO: 235833 - DNA, 25 bp, Mus musculus
atatgggcacttccctagaatgcat

SEQ ID NO: 235834 - DNA, 25 bp, Mus musculus
atatgggcacttgcctagaatgcat

SEQ ID NO: 235835 - DNA, 25 bp, Mus musculus
atatgggcatacacaactttccttg

SEQ ID NO: 235836 - DNA, 25 bp, Mus musculus
atatgggcatactcaactttccttg

SEQ ID NO: 235837 - DNA, 25 bp, Mus musculus
atatgggccatcattcaccaagaaa

SEQ ID NO: 235838 - DNA, 25 bp, Mus musculus
atatgggccatctttcaccaagaaa

SEQ ID NO: 235839 - DNA, 25 bp, Mus musculus
atatgggccccaatgtgtaaataat

SEQ ID NO: 235840 - DNA, 25 bp, Mus musculus
atatgggccccattgtgtaaataat

SEQ ID NO: 235841 - DNA, 25 bp, Mus musculus
atatgggcccttctgagacttggaa

SEQ ID NO: 235842 - DNA, 25 bp, Mus musculus
atatgggcccttgtgagacttggaa

SEQ ID NO: 235843 - DNA, 25 bp, Mus musculus
atatgggctcagcatttaactcaga

SEQ ID NO: 235844 - DNA, 25 bp, Mus musculus
atatgggctcaggatttaactcaga

SEQ ID NO: 235845 - DNA, 25 bp, Mus musculus
atatgggctgtcagtaatggtgaaa

SEQ ID NO: 235846 - DNA, 25 bp, Mus musculus
atatgggctgtctgtaatggtgaaa

SEQ ID NO: 235847 - DNA, 25 bp, Mus musculus
atatgggcttcaacagccacctgtt

SEQ ID NO: 235848 - DNA, 25 bp, Mus musculus
atatgggcttcatcagccacctgtt

SEQ ID NO: 235849 - DNA, 25 bp, Mus musculus
atatggggcaacaatcttcctgatt

SEQ ID NO: 235850 - DNA, 25 bp, Mus musculus
atatggggcaactatcttcctgatt

SEQ ID NO: 235851 - DNA, 25 bp, Mus musculus
atatgggtaggcctccttgagaacc

SEQ ID NO: 235852 - DNA, 25 bp, Mus musculus
atatgggtaggcgtccttgagaacc

SEQ ID NO: 235853 - DNA, 25 bp, Mus musculus
atatgggtcactctttctctggaaa

SEQ ID NO: 235854 - DNA, 25 bp, Mus musculus
atatgggtcactgtttctctggaaa

SEQ ID NO: 235855 - DNA, 25 bp, Mus musculus
atatgggtccttagatggtatgcct

SEQ ID NO: 235856 - DNA, 25 bp, Mus musculus
atatgggtcctttgatggtatgcct

SEQ ID NO: 235857 - DNA, 25 bp, Mus musculus
atatgggtgataaatttccctcctc

SEQ ID NO: 235858 - DNA, 25 bp, Mus musculus
atatgggtgatatatttccctcctc

SEQ ID NO: 235859 - DNA, 25 bp, Mus musculus
atatgggtgcccagatactccagca

SEQ ID NO: 235860 - DNA, 25 bp, Mus musculus
atatgggtgccctgatactccagca

SEQ ID NO: 235861 - DNA, 25 bp, Mus musculus
atatgggtttatcccagctctggtc

SEQ ID NO: 235862 - DNA, 25 bp, Mus musculus
atatgggtttatgccagctctggtc

SEQ ID NO: 235863 - DNA, 25 bp, Mus musculus
atatggtacttaactagaccttgga

SEQ ID NO: 235864 - DNA, 25 bp, Mus musculus
atatggtacttatctagaccttgga

SEQ ID NO: 235865 - DNA, 25 bp, Mus musculus
atatggtagaggacttccgggtctg

SEQ ID NO: 235866 - DNA, 25 bp, Mus musculus
atatggtagaggtcttccgggtctg

SEQ ID NO: 235867 - DNA, 25 bp, Mus musculus
atatggtagctgaacttgtgatgac

SEQ ID NO: 235868 - DNA, 25 bp, Mus musculus
atatggtagctgtacttgtgatgac

SEQ ID NO: 235869 - DNA, 25 bp, Mus musculus
atatggtatttacttgcttccccgc

SEQ ID NO: 235870 - DNA, 25 bp, Mus musculus
atatggtatttagttgcttccccgc

SEQ ID NO: 235871 - DNA, 25 bp, Mus musculus
atatggtatttgacctctgggttct

SEQ ID NO: 235872 - DNA, 25 bp, Mus musculus
atatggtatttgtcctctgggttct

SEQ ID NO: 235873 - DNA, 25 bp, Mus musculus
atatggtcaagcacccgtttaagaa

SEQ ID NO: 235874 - DNA, 25 bp, Mus musculus
atatggtcaagctcccgtttaagaa

SEQ ID NO: 235875 - DNA, 25 bp, Mus musculus
atatggtcacacacatggtcttaaa

SEQ ID NO: 235876 - DNA, 25 bp, Mus musculus
atatggtcacactcatggtcttaaa

SEQ ID NO: 235877 - DNA, 25 bp, Mus musculus
atatggtcacatccaactctagccc

SEQ ID NO: 235878 - DNA, 25 bp, Mus musculus
atatggtcacatgcaactctagccc

SEQ ID NO: 235879 - DNA, 25 bp, Mus musculus
atatggtcactcagtatctcttgtg

SEQ ID NO: 235880 - DNA, 25 bp, Mus musculus
atatggtcactctgtatctcttgtg

SEQ ID NO: 235881 - DNA, 25 bp, Mus musculus
atatggtcagaaataactccacaga

SEQ ID NO: 235882 - DNA, 25 bp, Mus musculus
atatggtcagaattaactccacaga

SEQ ID NO: 235883 - DNA, 25 bp, Mus musculus
atatggtcatccattagcactgagt

SEQ ID NO: 235884 - DNA, 25 bp, Mus musculus
atatggtcatcctttagcactgagt

SEQ ID NO: 235885 - DNA, 25 bp, Mus musculus
atatggtcatctctgtgctcacatt

SEQ ID NO: 235886 - DNA, 25 bp, Mus musculus
atatggtcatctgtgtgctcacatt

SEQ ID NO: 235887 - DNA, 25 bp, Mus musculus
atatggtcattcagactcctgctgg

SEQ ID NO: 235888 - DNA, 25 bp, Mus musculus
atatggtcattctgactcctgctgg

SEQ ID NO: 235889 - DNA, 25 bp, Mus musculus
atatggtccataatcccctgatgag

SEQ ID NO: 235890 - DNA, 25 bp, Mus musculus
atatggtccatattcccctgatgag

SEQ ID NO: 235891 - DNA, 25 bp, Mus musculus
atatggtccccactgagtgtgcttt

SEQ ID NO: 235892 - DNA, 25 bp, Mus musculus
atatggtccccagtgagtgtgcttt

SEQ ID NO: 235893 - DNA, 25 bp, Mus musculus
atatggtcggacctgtagcccagaa

SEQ ID NO: 235894 - DNA, 25 bp, Mus musculus
atatggtcggacgtgtagcccagaa

SEQ ID NO: 235895 - DNA, 25 bp, Mus musculus
atatggtctggaaaacagagggata

SEQ ID NO: 235896 - DNA, 25 bp, Mus musculus
atatggtctggataacagagggata

SEQ ID NO: 235897 - DNA, 25 bp, Mus musculus
atatggtctgtgaacaagccacggt

SEQ ID NO: 235898 - DNA, 25 bp, Mus musculus
atatggtctgtgtacaagccacggt

SEQ ID NO: 235899 - DNA, 25 bp, Mus musculus
atatggtcttagctcggcctcttta

SEQ ID NO: 235900 - DNA, 25 bp, Mus musculus
atatggtcttaggtcggcctcttta

SEQ ID NO: 235901 - DNA, 25 bp, Mus musculus
atatggtcttggcaatcttgtcaaa

SEQ ID NO: 235902 - DNA, 25 bp, Mus musculus
atatggtcttgggaatcttgtcaaa

SEQ ID NO: 235903 - DNA, 25 bp, Mus musculus
atatggtctttgatggtggcattag

SEQ ID NO: 235904 - DNA, 25 bp, Mus musculus
atatggtctttgttggtggcattag

SEQ ID NO: 235905 - DNA, 25 bp, Mus musculus
atatggtgccaaactatcttctgaa

SEQ ID NO: 235906 - DNA, 25 bp, Mus musculus
atatggtgccaatctatcttctgaa

SEQ ID NO: 235907 - DNA, 25 bp, Mus musculus
atatggtgcccacacatccatgcag

SEQ ID NO: 235908 - DNA, 25 bp, Mus musculus
atatggtgcccagacatccatgcag

SEQ ID NO: 235909 - DNA, 25 bp, Mus musculus
atatggtgctatcatcccaggccca

SEQ ID NO: 235910 - DNA, 25 bp, Mus musculus
atatggtgctatgatcccaggccca

SEQ ID NO: 235911 - DNA, 25 bp, Mus musculus
atatggtgctctactgaggtgggca

SEQ ID NO: 235912 - DNA, 25 bp, Mus musculus
atatggtgctcttctgaggtgggca

SEQ ID NO: 235913 - DNA, 25 bp, Mus musculus
atatggtggaggcaactatggtcct

SEQ ID NO: 235914 - DNA, 25 bp, Mus musculus
atatggtggagggaactatggtcct

SEQ ID NO: 235915 - DNA, 25 bp, Mus musculus
atatggtgtcctactgagtctgagc

SEQ ID NO: 235916 - DNA, 25 bp, Mus musculus
atatggtgtccttctgagtctgagc

SEQ ID NO: 235917 - DNA, 25 bp, Mus musculus
atatggttatatcctttattttcaa

SEQ ID NO: 235918 - DNA, 25 bp, Mus musculus
atatggttatatgctttattttcaa

SEQ ID NO: 235919 - DNA, 25 bp, Mus musculus
atatggttccagaccacaacttcct

SEQ ID NO: 235920 - DNA, 25 bp, Mus musculus
atatggttccagtccacaacttcct

SEQ ID NO: 235921 - DNA, 25 bp, Mus musculus
atatggttctagatgagcctttcag

SEQ ID NO: 235922 - DNA, 25 bp, Mus musculus
atatggttctagatggcctggaact

SEQ ID NO: 235923 - DNA, 25 bp, Mus musculus
atatggttctagttgagcctttcag

SEQ ID NO: 235924 - DNA, 25 bp, Mus musculus
atatggttctagttggcctggaact

SEQ ID NO: 235925 - DNA, 25 bp, Mus musculus
atatggttgaccctgtggtgtcact

SEQ ID NO: 235926 - DNA, 25 bp, Mus musculus
atatggttgaccgtgtggtgtcact

SEQ ID NO: 235927 - DNA, 25 bp, Mus musculus
atatggttgggtccccagaccagga

SEQ ID NO: 235928 - DNA, 25 bp, Mus musculus
atatggttgggtgcccagaccagga

SEQ ID NO: 235929 - DNA, 25 bp, Mus musculus
atatggtttataacacagtggcaat

SEQ ID NO: 235930 - DNA, 25 bp, Mus musculus
atatggtttatatcacagtggcaat

SEQ ID NO: 235931 - DNA, 25 bp, Mus musculus
atatggtttctcattctattttggg

SEQ ID NO: 235932 - DNA, 25 bp, Mus musculus
atatggtttctctttctattttggg

SEQ ID NO: 235933 - DNA, 25 bp, Mus musculus
atatgtaaaactagtgtccctcccg

SEQ ID NO: 235934 - DNA, 25 bp, Mus musculus
atatgtaaaacttgtgtccctcccg

SEQ ID NO: 235935 - DNA, 25 bp, Mus musculus
atatgtaaagctagtgtgggtatgt

SEQ ID NO: 235936 - DNA, 25 bp, Mus musculus
atatgtaaagcttgtgtgggtatgt

SEQ ID NO: 235937 - DNA, 25 bp, Mus musculus
atatgtaactgtccttattctttgt

SEQ ID NO: 235938 - DNA, 25 bp, Mus musculus
atatgtaactgtgcttattctttgt

SEQ ID NO: 235939 - DNA, 25 bp, Mus musculus
atatgtaagtgcatcctgcataaca

SEQ ID NO: 235940 - DNA, 25 bp, Mus musculus
atatgtaagtgcattctccaccaca

SEQ ID NO: 235941 - DNA, 25 bp, Mus musculus
atatgtaagtgcttcctgcataaca

SEQ ID NO: 235942 - DNA, 25 bp, Mus musculus
atatgtaagtgctttctccaccaca

SEQ ID NO: 235943 - DNA, 25 bp, Mus musculus
atatgtaatagcatcgttgtcaggg

SEQ ID NO: 235944 - DNA, 25 bp, Mus musculus
atatgtaatagcttcgttgtcaggg

SEQ ID NO: 235945 - DNA, 25 bp, Mus musculus
atatgtaatcagacacctgggtggt

SEQ ID NO: 235946 - DNA, 25 bp, Mus musculus
atatgtaatcagtcacctgggtggt

SEQ ID NO: 235947 - DNA, 25 bp, Mus musculus
atatgtaatctaacttgttctatga

SEQ ID NO: 235948 - DNA, 25 bp, Mus musculus
atatgtaatctatcttgttctatga

SEQ ID NO: 235949 - DNA, 25 bp, Mus musculus
atatgtacaacacgcaaacacccat

SEQ ID NO: 235950 - DNA, 25 bp, Mus musculus
atatgtacaacaggcaaacacccat

SEQ ID NO: 235951 - DNA, 25 bp, Mus musculus
atatgtacacagagtagggcgcact

SEQ ID NO: 235952 - DNA, 25 bp, Mus musculus
atatgtacacagtgtagggcgcact

SEQ ID NO: 235953 - DNA, 25 bp, Mus musculus
atatgtacacatctgcctgtattta

SEQ ID NO: 235954 - DNA, 25 bp, Mus musculus
atatgtacacatgtgcctgtattta

SEQ ID NO: 235955 - DNA, 25 bp, Mus musculus
atatgtacacctattatgttttcag

SEQ ID NO: 235956 - DNA, 25 bp, Mus musculus
atatgtacaccttttatgttttcag

SEQ ID NO: 235957 - DNA, 25 bp, Mus musculus
atatgtacatatcagtcttgctaga

SEQ ID NO: 235958 - DNA, 25 bp, Mus musculus
atatgtacatatgagtcttgctaga

SEQ ID NO: 235959 - DNA, 25 bp, Mus musculus
atatgtacatttctcaggccagggc

SEQ ID NO: 235960 - DNA, 25 bp, Mus musculus
atatgtacatttgtcaggccagggc

SEQ ID NO: 235961 - DNA, 25 bp, Mus musculus
atatgtaccagtaagtttattcaga

SEQ ID NO: 235962 - DNA, 25 bp, Mus musculus
atatgtaccagttagtttattcaga

SEQ ID NO: 235963 - DNA, 25 bp, Mus musculus
atatgtaccataagcactacactgg

SEQ ID NO: 235964 - DNA, 25 bp, Mus musculus
atatgtaccatatgcactacactgg

SEQ ID NO: 235965 - DNA, 25 bp, Mus musculus
atatgtaccatcaagcactctggag

SEQ ID NO: 235966 - DNA, 25 bp, Mus musculus
atatgtaccatctagcactctggag

SEQ ID NO: 235967 - DNA, 25 bp, Mus musculus
atatgtacctgacctcctggtccta

SEQ ID NO: 235968 - DNA, 25 bp, Mus musculus
atatgtacctgagctcctggtccta

SEQ ID NO: 235969 - DNA, 25 bp, Mus musculus
atatgtacgtaaaggctgggacagc

SEQ ID NO: 235970 - DNA, 25 bp, Mus musculus
atatgtacgtaatggctgggacagc

SEQ ID NO: 235971 - DNA, 25 bp, Mus musculus
atatgtacgtatctgtattccccgt

SEQ ID NO: 235972 - DNA, 25 bp, Mus musculus
atatgtacgtatgtgtattccccgt

SEQ ID NO: 235973 - DNA, 25 bp, Mus musculus
atatgtactacaccctccttagtga

SEQ ID NO: 235974 - DNA, 25 bp, Mus musculus
atatgtactacagcctccttagtga

SEQ ID NO: 235975 - DNA, 25 bp, Mus musculus
atatgtactagtagtggtaacccac

SEQ ID NO: 235976 - DNA, 25 bp, Mus musculus
atatgtactagttgtggtaacccac

SEQ ID NO: 235977 - DNA, 25 bp, Mus musculus
atatgtactataattctggttttaa

SEQ ID NO: 235978 - DNA, 25 bp, Mus musculus
atatgtactatatttctggttttaa

SEQ ID NO: 235979 - DNA, 25 bp, Mus musculus
atatgtactcacaccttgctaagtt

SEQ ID NO: 235980 - DNA, 25 bp, Mus musculus
atatgtactcactccttgctaagtt

SEQ ID NO: 235981 - DNA, 25 bp, Mus musculus
atatgtactcagcaagcactcagct

SEQ ID NO: 235982 - DNA, 25 bp, Mus musculus
atatgtactcaggaagcactcagct

SEQ ID NO: 235983 - DNA, 25 bp, Mus musculus
atatgtactcggatatagtaggagc

SEQ ID NO: 235984 - DNA, 25 bp, Mus musculus
atatgtactcggttatagtaggagc

SEQ ID NO: 235985 - DNA, 25 bp, Mus musculus
atatgtacttagctgaatcacctca

SEQ ID NO: 235986 - DNA, 25 bp, Mus musculus
atatgtacttaggtgaatcacctca

SEQ ID NO: 235987 - DNA, 25 bp, Mus musculus
atatgtacttctctgtatgtgagga

SEQ ID NO: 235988 - DNA, 25 bp, Mus musculus
atatgtacttctgtgtatgtgagga

SEQ ID NO: 235989 - DNA, 25 bp, Mus musculus
atatgtagaccccagaagcgcactc

SEQ ID NO: 235990 - DNA, 25 bp, Mus musculus
atatgtagacccgagaagcgcactc

SEQ ID NO: 235991 - DNA, 25 bp, Mus musculus
atatgtagagcactctgcccttgaa

SEQ ID NO: 235992 - DNA, 25 bp, Mus musculus
atatgtagagcagtctgcccttgaa

SEQ ID NO: 235993 - DNA, 25 bp, Mus musculus
atatgtagcatcattccatgtcctc

SEQ ID NO: 235994 - DNA, 25 bp, Mus musculus
atatgtagcatctttccatgtcctc

SEQ ID NO: 235995 - DNA, 25 bp, Mus musculus
atatgtagcccaaagaaggtttccg

SEQ ID NO: 235996 - DNA, 25 bp, Mus musculus
atatgtagcccatagaaggtttccg

SEQ ID NO: 235997 - DNA, 25 bp, Mus musculus
atatgtaggccgatttcacactctg

SEQ ID NO: 235998 - DNA, 25 bp, Mus musculus
atatgtaggccgttttcacactctg

SEQ ID NO: 235999 - DNA, 25 bp, Mus musculus
atatgtaggtgtatatgggcatcct

SEQ ID NO: 236000 - DNA, 25 bp, Mus musculus
atatgtaggtgtttatgggcatcct

SEQ ID NO: 236001 - DNA, 25 bp, Mus musculus
atatgtagtaccataatctctgaag

SEQ ID NO: 236002 - DNA, 25 bp, Mus musculus
atatgtagtaccttaatctctgaag

SEQ ID NO: 236003 - DNA, 25 bp, Mus musculus
atatgtagtgcaagcattttgtgaa

SEQ ID NO: 236004 - DNA, 25 bp, Mus musculus
atatgtagtgcatgcattttgtgaa

SEQ ID NO: 236005 - DNA, 25 bp, Mus musculus
atatgtagttagactctgtccttaa

SEQ ID NO: 236006 - DNA, 25 bp, Mus musculus
atatgtagttagtctctgtccttaa

SEQ ID NO: 236007 - DNA, 25 bp, Mus musculus
atatgtagttctatccatcacccta

SEQ ID NO: 236008 - DNA, 25 bp, Mus musculus
atatgtagttctttccatcacccta

SEQ ID NO: 236009 - DNA, 25 bp, Mus musculus
atatgtatatacctttcagcctcaa

SEQ ID NO: 236010 - DNA, 25 bp, Mus musculus
atatgtatatacgtttcagcctcaa

SEQ ID NO: 236011 - DNA, 25 bp, Mus musculus
atatgtatcgagacatgaccaaaca

SEQ ID NO: 236012 - DNA, 25 bp, Mus musculus
atatgtatcgagtcatgaccaaaca

SEQ ID NO: 236013 - DNA, 25 bp, Mus musculus
atatgtatctgtagccccgtgaata

SEQ ID NO: 236014 - DNA, 25 bp, Mus musculus
atatgtatctgttgccccgtgaata

SEQ ID NO: 236015 - DNA, 25 bp, Mus musculus
atatgtatgcatacaccttgcctct

SEQ ID NO: 236016 - DNA, 25 bp, Mus musculus
atatgtatgcattcaccttgcctct

SEQ ID NO: 236017 - DNA, 25 bp, Mus musculus
atatgtatgcctcgtcctatggaag

SEQ ID NO: 236018 - DNA, 25 bp, Mus musculus
atatgtatgcctggtcctatggaag

SEQ ID NO: 236019 - DNA, 25 bp, Mus musculus
atatgtatggttatgaggcgctaag

SEQ ID NO: 236020 - DNA, 25 bp, Mus musculus
atatgtatggttttgaggcgctaag

SEQ ID NO: 236021 - DNA, 25 bp, Mus musculus
atatgtattggtaccagcagaagcc

SEQ ID NO: 236022 - DNA, 25 bp, Mus musculus
atatgtattggttccagcagaagcc

SEQ ID NO: 236023 - DNA, 25 bp, Mus musculus
atatgtatttatccgggtggcttaa

SEQ ID NO: 236024 - DNA, 25 bp, Mus musculus
atatgtatttatgcgggtggcttaa

SEQ ID NO: 236025 - DNA, 25 bp, Mus musculus
atatgtcaactccagacttgtccag

SEQ ID NO: 236026 - DNA, 25 bp, Mus musculus
atatgtcaactcgagacttgtccag

SEQ ID NO: 236027 - DNA, 25 bp, Mus musculus
atatgtcactacagggtgtccaacc

SEQ ID NO: 236028 - DNA, 25 bp, Mus musculus
atatgtcactactgggtgtccaacc

SEQ ID NO: 236029 - DNA, 25 bp, Mus musculus
atatgtcacttcctgtacaagcctt

SEQ ID NO: 236030 - DNA, 25 bp, Mus musculus
atatgtcacttcgtgtacaagcctt

SEQ ID NO: 236031 - DNA, 25 bp, Mus musculus
atatgtcatagcctttctctgctgt

SEQ ID NO: 236032 - DNA, 25 bp, Mus musculus
atatgtcatagcgtttctctgctgt

SEQ ID NO: 236033 - DNA, 25 bp, Mus musculus
atatgtcatcttatctgtctgtctg

SEQ ID NO: 236034 - DNA, 25 bp, Mus musculus
atatgtcatcttttctgtctgtctg

SEQ ID NO: 236035 - DNA, 25 bp, Mus musculus
atatgtccagagagggcacgccatt

SEQ ID NO: 236036 - DNA, 25 bp, Mus musculus
atatgtccagagtgggcacgccatt

SEQ ID NO: 236037 - DNA, 25 bp, Mus musculus
atatgtccaggcaatgacctctacc

SEQ ID NO: 236038 - DNA, 25 bp, Mus musculus
atatgtccaggctatgacctctacc

SEQ ID NO: 236039 - DNA, 25 bp, Mus musculus
atatgtcccaagagaccagatcaga

SEQ ID NO: 236040 - DNA, 25 bp, Mus musculus
atatgtcccaagtgaccagatcaga

SEQ ID NO: 236041 - DNA, 25 bp, Mus musculus
atatgtcccaatattcaatcctagt

SEQ ID NO: 236042 - DNA, 25 bp, Mus musculus
atatgtcccaattttcaatcctagt

SEQ ID NO: 236043 - DNA, 25 bp, Mus musculus
atatgtccccatactttacctggca

SEQ ID NO: 236044 - DNA, 25 bp, Mus musculus
atatgtccccattctttacctggca

SEQ ID NO: 236045 - DNA, 25 bp, Mus musculus
atatgtcccgacagtgtgcaacgga

SEQ ID NO: 236046 - DNA, 25 bp, Mus musculus
atatgtcccgactgtgtgcaacgga

SEQ ID NO: 236047 - DNA, 25 bp, Mus musculus
atatgtcccgcaccagatgaagaga

SEQ ID NO: 236048 - DNA, 25 bp, Mus musculus
atatgtcccgcagcagatgaagaga

SEQ ID NO: 236049 - DNA, 25 bp, Mus musculus
atatgtccggccagagtactggatt

SEQ ID NO: 236050 - DNA, 25 bp, Mus musculus
atatgtccggcctgagtactggatt

SEQ ID NO: 236051 - DNA, 25 bp, Mus musculus
atatgtcctcatctcaagggcaccc

SEQ ID NO: 236052 - DNA, 25 bp, Mus musculus
atatgtcctcatgtcaagggcaccc

SEQ ID NO: 236053 - DNA, 25 bp, Mus musculus
atatgtccttccatgtgatatgcag

SEQ ID NO: 236054 - DNA, 25 bp, Mus musculus
atatgtccttccttgtgatatgcag

SEQ ID NO: 236055 - DNA, 25 bp, Mus musculus
atatgtctcaccatcatggttactt

SEQ ID NO: 236056 - DNA, 25 bp, Mus musculus
atatgtctcaccttcatggttactt

SEQ ID NO: 236057 - DNA, 25 bp, Mus musculus
atatgtctcatcatctctagataca

SEQ ID NO: 236058 - DNA, 25 bp, Mus musculus
atatgtctcatcttctctagataca

SEQ ID NO: 236059 - DNA, 25 bp, Mus musculus
atatgtctccaaattacttgtacag

SEQ ID NO: 236060 - DNA, 25 bp, Mus musculus
atatgtctccaatttacttgtacag

SEQ ID NO: 236061 - DNA, 25 bp, Mus musculus
atatgtctccccatcttagaaaagt

SEQ ID NO: 236062 - DNA, 25 bp, Mus musculus
atatgtctccccttcttagaaaagt

SEQ ID NO: 236063 - DNA, 25 bp, Mus musculus
atatgtctccttagctacaaacggg

SEQ ID NO: 236064 - DNA, 25 bp, Mus musculus
atatgtctcctttgctacaaacggg

SEQ ID NO: 236065 - DNA, 25 bp, Mus musculus
atatgtctcgaaacacagcagctta

SEQ ID NO: 236066 - DNA, 25 bp, Mus musculus
atatgtctcgaatcacagcagctta

SEQ ID NO: 236067 - DNA, 25 bp, Mus musculus
atatgtctctatcgtctcttactaa

SEQ ID NO: 236068 - DNA, 25 bp, Mus musculus
atatgtctctatggtctcttactaa

SEQ ID NO: 236069 - DNA, 25 bp, Mus musculus
atatgtctcttaccagtgaactctt

SEQ ID NO: 236070 - DNA, 25 bp, Mus musculus
atatgtctcttactcaagtctttta

SEQ ID NO: 236071 - DNA, 25 bp, Mus musculus
atatgtctcttagcagtgaactctt

SEQ ID NO: 236072 - DNA, 25 bp, Mus musculus
atatgtctcttagtcaagtctttta

SEQ ID NO: 236073 - DNA, 25 bp, Mus musculus
atatgtctgaatatatggagtgcaa

SEQ ID NO: 236074 - DNA, 25 bp, Mus musculus
atatgtctgaatttatggagtgcaa

SEQ ID NO: 236075 - DNA, 25 bp, Mus musculus
atatgtctgcatatcctattttgtt

SEQ ID NO: 236076 - DNA, 25 bp, Mus musculus
atatgtctgcatttcctattttgtt

SEQ ID NO: 236077 - DNA, 25 bp, Mus musculus
atatgtctgctgctgatctgcatca

SEQ ID NO: 236078 - DNA, 25 bp, Mus musculus
atatgtctgctggtgatctgcatca

SEQ ID NO: 236079 - DNA, 25 bp, Mus musculus
atatgtctgtggaccagcttctagg

SEQ ID NO: 236080 - DNA, 25 bp, Mus musculus
atatgtctgtggtccagcttctagg

SEQ ID NO: 236081 - DNA, 25 bp, Mus musculus
atatgtctgtgtacctcgtgtgttt

SEQ ID NO: 236082 - DNA, 25 bp, Mus musculus
atatgtctgtgttcctcgtgtgttt

SEQ ID NO: 236083 - DNA, 25 bp, Mus musculus
atatgtcttccacgaccaagctcag

SEQ ID NO: 236084 - DNA, 25 bp, Mus musculus
atatgtcttccaggaccaagctcag

SEQ ID NO: 236085 - DNA, 25 bp, Mus musculus
atatgtcttccccaatgcatgttga

SEQ ID NO: 236086 - DNA, 25 bp, Mus musculus
atatgtcttcccgaatgcatgttga

SEQ ID NO: 236087 - DNA, 25 bp, Mus musculus
atatgtcttgctaactgaaggacta

SEQ ID NO: 236088 - DNA, 25 bp, Mus musculus
atatgtcttgcttactgaaggacta

SEQ ID NO: 236089 - DNA, 25 bp, Mus musculus
atatgtcttggtatgcgttccgaac

SEQ ID NO: 236090 - DNA, 25 bp, Mus musculus
atatgtcttggtttgcgttccgaac

SEQ ID NO: 236091 - DNA, 25 bp, Mus musculus
atatgtcttgtcatggtatctggat

SEQ ID NO: 236092 - DNA, 25 bp, Mus musculus
atatgtcttgtcttggtatctggat

SEQ ID NO: 236093 - DNA, 25 bp, Mus musculus
atatgtctttatagtaatccaggga

SEQ ID NO: 236094 - DNA, 25 bp, Mus musculus
atatgtctttattgtaatccaggga

SEQ ID NO: 236095 - DNA, 25 bp, Mus musculus
atatgtctttgtcctactgtctgca

SEQ ID NO: 236096 - DNA, 25 bp, Mus musculus
atatgtctttgtgctactgtctgca

SEQ ID NO: 236097 - DNA, 25 bp, Mus musculus
atatgtgaacatatccagcggttat

SEQ ID NO: 236098 - DNA, 25 bp, Mus musculus
atatgtgaacatttccagcggttat

SEQ ID NO: 236099 - DNA, 25 bp, Mus musculus
atatgtgaactaactctgagaaggt

SEQ ID NO: 236100 - DNA, 25 bp, Mus musculus
atatgtgaactatctctgagaaggt

SEQ ID NO: 236101 - DNA, 25 bp, Mus musculus
atatgtgaagtaatagggctagcct

SEQ ID NO: 236102 - DNA, 25 bp, Mus musculus
atatgtgaagtattagggctagcct

SEQ ID NO: 236103 - DNA, 25 bp, Mus musculus
atatgtgaccccaaaaggtctctgc

SEQ ID NO: 236104 - DNA, 25 bp, Mus musculus
atatgtgacccctaaaggtctctgc

SEQ ID NO: 236105 - DNA, 25 bp, Mus musculus
atatgtgaccgacccctgggaaagg

SEQ ID NO: 236106 - DNA, 25 bp, Mus musculus
atatgtgaccgagccctgggaaagg

SEQ ID NO: 236107 - DNA, 25 bp, Mus musculus
atatgtgagcccctgcatagcaagc

SEQ ID NO: 236108 - DNA, 25 bp, Mus musculus
atatgtgagcccgtgcatagcaagc

SEQ ID NO: 236109 - DNA, 25 bp, Mus musculus
atatgtgatgtgcttttccagtatc

SEQ ID NO: 236110 - DNA, 25 bp, Mus musculus
atatgtgatgtggttttccagtatc

SEQ ID NO: 236111 - DNA, 25 bp, Mus musculus
atatgtgattctctactcttagctg

SEQ ID NO: 236112 - DNA, 25 bp, Mus musculus
atatgtgattctgtactcttagctg

SEQ ID NO: 236113 - DNA, 25 bp, Mus musculus
atatgtgcaagacagtggtagcccc

SEQ ID NO: 236114 - DNA, 25 bp, Mus musculus
atatgtgcaagagagtggtagcccc

SEQ ID NO: 236115 - DNA, 25 bp, Mus musculus
atatgtgcacatcttgatttttcca

SEQ ID NO: 236116 - DNA, 25 bp, Mus musculus
atatgtgcacatgttgatttttcca

SEQ ID NO: 236117 - DNA, 25 bp, Mus musculus
atatgtgcaccaatccaggaacatg

SEQ ID NO: 236118 - DNA, 25 bp, Mus musculus
atatgtgcaccattccaggaacatg

SEQ ID NO: 236119 - DNA, 25 bp, Mus musculus
atatgtgcagagctccttgtgtatg

SEQ ID NO: 236120 - DNA, 25 bp, Mus musculus
atatgtgcagaggtccttgtgtatg

SEQ ID NO: 236121 - DNA, 25 bp, Mus musculus
atatgtgcaggacgccctccagctg

SEQ ID NO: 236122 - DNA, 25 bp, Mus musculus
atatgtgcaggaggccctccagctg

SEQ ID NO: 236123 - DNA, 25 bp, Mus musculus
atatgtgcaggtcgctcaggcgcct

SEQ ID NO: 236124 - DNA, 25 bp, Mus musculus
atatgtgcaggtggctcaggcgcct

SEQ ID NO: 236125 - DNA, 25 bp, Mus musculus
atatgtgcataaattgtgctgtaaa

SEQ ID NO: 236126 - DNA, 25 bp, Mus musculus
atatgtgcataatttgtgctgtaaa

SEQ ID NO: 236127 - DNA, 25 bp, Mus musculus
atatgtgcatgccatgtcctttcac

SEQ ID NO: 236128 - DNA, 25 bp, Mus musculus
atatgtgcatgcgatgtcctttcac

SEQ ID NO: 236129 - DNA, 25 bp, Mus musculus
atatgtgcctcaatgaccgctggga

SEQ ID NO: 236130 - DNA, 25 bp, Mus musculus
atatgtgcctcattgaccgctggga

SEQ ID NO: 236131 - DNA, 25 bp, Mus musculus
atatgtgcctggagtgcattgtcgc

SEQ ID NO: 236132 - DNA, 25 bp, Mus musculus
atatgtgcctggtgtgcattgtcgc

SEQ ID NO: 236133 - DNA, 25 bp, Mus musculus
atatgtgctcgaactcatcgtcaca

SEQ ID NO: 236134 - DNA, 25 bp, Mus musculus
atatgtgctcgatctcatcgtcaca

SEQ ID NO: 236135 - DNA, 25 bp, Mus musculus
atatgtgctctgcagcataccactt

SEQ ID NO: 236136 - DNA, 25 bp, Mus musculus
atatgtgctctggagcataccactt

SEQ ID NO: 236137 - DNA, 25 bp, Mus musculus
atatgtgctgaacacgttgtttcca

SEQ ID NO: 236138 - DNA, 25 bp, Mus musculus
atatgtgctgaagacgttgtttcca

SEQ ID NO: 236139 - DNA, 25 bp, Mus musculus
atatgtgctgaccagattctaaatt

SEQ ID NO: 236140 - DNA, 25 bp, Mus musculus
atatgtgctgacgagattctaaatt

SEQ ID NO: 236141 - DNA, 25 bp, Mus musculus
atatgtgctgcacaagggcttgacc

SEQ ID NO: 236142 - DNA, 25 bp, Mus musculus
atatgtgctgcagaagggcttgacc

SEQ ID NO: 236143 - DNA, 25 bp, Mus musculus
atatgtgctgtacgagctctgacac

SEQ ID NO: 236144 - DNA, 25 bp, Mus musculus
atatgtgctgtaggagctctgacac

SEQ ID NO: 236145 - DNA, 25 bp, Mus musculus
atatgtgcttcaatatcaacaatgt

SEQ ID NO: 236146 - DNA, 25 bp, Mus musculus
atatgtgcttcattatcaacaatgt

SEQ ID NO: 236147 - DNA, 25 bp, Mus musculus
atatgtgcttgactcgagactcttc

SEQ ID NO: 236148 - DNA, 25 bp, Mus musculus
atatgtgcttgagtcgagactcttc

SEQ ID NO: 236149 - DNA, 25 bp, Mus musculus
atatgtggaacaccacccctgcacg

SEQ ID NO: 236150 - DNA, 25 bp, Mus musculus
atatgtggaacagcacccctgcacg

SEQ ID NO: 236151 - DNA, 25 bp, Mus musculus
atatgtggaattagcctggccctgc

SEQ ID NO: 236152 - DNA, 25 bp, Mus musculus
atatgtggaatttgcctggccctgc

SEQ ID NO: 236153 - DNA, 25 bp, Mus musculus
atatgtggcggaaagactcaactct

SEQ ID NO: 236154 - DNA, 25 bp, Mus musculus
atatgtggcggatagactcaactct

SEQ ID NO: 236155 - DNA, 25 bp, Mus musculus
atatgtggctgtccccaaggaccat

SEQ ID NO: 236156 - DNA, 25 bp, Mus musculus
atatgtggctgtgcccaaggaccat

SEQ ID NO: 236157 - DNA, 25 bp, Mus musculus
atatgtgggaaactctgcctgcccc

SEQ ID NO: 236158 - DNA, 25 bp, Mus musculus
atatgtgggaaagtctgcctgcccc

SEQ ID NO: 236159 - DNA, 25 bp, Mus musculus
atatgtgggacaagaagtgctcaac

SEQ ID NO: 236160 - DNA, 25 bp, Mus musculus
atatgtgggacatgaagtgctcaac

SEQ ID NO: 236161 - DNA, 25 bp, Mus musculus
atatgtgggactaagtacatgctca

SEQ ID NO: 236162 - DNA, 25 bp, Mus musculus
atatgtgggacttagtacatgctca

SEQ ID NO: 236163 - DNA, 25 bp, Mus musculus
atatgtgggcttatttgggctgcag

SEQ ID NO: 236164 - DNA, 25 bp, Mus musculus
atatgtgggcttttttgggctgcag

SEQ ID NO: 236165 - DNA, 25 bp, Mus musculus
atatgtggtaaaaccttggctctga

SEQ ID NO: 236166 - DNA, 25 bp, Mus musculus
atatgtggtaaatccttggctctga

SEQ ID NO: 236167 - DNA, 25 bp, Mus musculus
atatgtggttaaacgcagactgtca

SEQ ID NO: 236168 - DNA, 25 bp, Mus musculus
atatgtggttaatcgcagactgtca

SEQ ID NO: 236169 - DNA, 25 bp, Mus musculus
atatgtggttcccagggaggtcttc

SEQ ID NO: 236170 - DNA, 25 bp, Mus musculus
atatgtggttccgagggaggtcttc

SEQ ID NO: 236171 - DNA, 25 bp, Mus musculus
atatgtgtagcgatgtgatcacact

SEQ ID NO: 236172 - DNA, 25 bp, Mus musculus
atatgtgtagcgttgtgatcacact

SEQ ID NO: 236173 - DNA, 25 bp, Mus musculus
atatgtgtatatacatggtcctaaa

SEQ ID NO: 236174 - DNA, 25 bp, Mus musculus
atatgtgtatattcatggtcctaaa

SEQ ID NO: 236175 - DNA, 25 bp, Mus musculus
atatgtgtatgtctctaggttggta

SEQ ID NO: 236176 - DNA, 25 bp, Mus musculus
atatgtgtatgtgtctaggttggta

SEQ ID NO: 236177 - DNA, 25 bp, Mus musculus
atatgtgtattcactacctcagggc

SEQ ID NO: 236178 - DNA, 25 bp, Mus musculus
atatgtgtattctctacctcagggc

SEQ ID NO: 236179 - DNA, 25 bp, Mus musculus
atatgtgtattgatgcacgtgtgca

SEQ ID NO: 236180 - DNA, 25 bp, Mus musculus
atatgtgtattgttgcacgtgtgca

SEQ ID NO: 236181 - DNA, 25 bp, Mus musculus
atatgtgtatttctgcgtgcccgcc

SEQ ID NO: 236182 - DNA, 25 bp, Mus musculus
atatgtgtatttgtgcgtgcccgcc

SEQ ID NO: 236183 - DNA, 25 bp, Mus musculus
atatgtgtcaagacaggctatcctt

SEQ ID NO: 236184 - DNA, 25 bp, Mus musculus
atatgtgtcaagtcaggctatcctt

SEQ ID NO: 236185 - DNA, 25 bp, Mus musculus
atatgtgtccacctttctacttgga

SEQ ID NO: 236186 - DNA, 25 bp, Mus musculus
atatgtgtccacgtttctacttgga

SEQ ID NO: 236187 - DNA, 25 bp, Mus musculus
atatgtgtcccgaaagccctgctct

SEQ ID NO: 236188 - DNA, 25 bp, Mus musculus
atatgtgtcccgtaagccctgctct

SEQ ID NO: 236189 - DNA, 25 bp, Mus musculus
atatgtgtcttacaggcaacctgaa

SEQ ID NO: 236190 - DNA, 25 bp, Mus musculus
atatgtgtcttagaggcaacctgaa

SEQ ID NO: 236191 - DNA, 25 bp, Mus musculus
atatgtgtgaatcctcgtgccaaat

SEQ ID NO: 236192 - DNA, 25 bp, Mus musculus
atatgtgtgaatgctcgtgccaaat

SEQ ID NO: 236193 - DNA, 25 bp, Mus musculus
atatgtgtgccaacatccctaatcc

SEQ ID NO: 236194 - DNA, 25 bp, Mus musculus
atatgtgtgccatcatccctaatcc

SEQ ID NO: 236195 - DNA, 25 bp, Mus musculus
atatgtgtgcctactgtgtgatgaa

SEQ ID NO: 236196 - DNA, 25 bp, Mus musculus
atatgtgtgccttctgtgtgatgaa

SEQ ID NO: 236197 - DNA, 25 bp, Mus musculus
atatgtgtgggaaggagaaagttcc

SEQ ID NO: 236198 - DNA, 25 bp, Mus musculus
atatgtgtgggatggagaaagttcc

SEQ ID NO: 236199 - DNA, 25 bp, Mus musculus
atatgtgtggtaaggtgtgcaccca

SEQ ID NO: 236200 - DNA, 25 bp, Mus musculus
atatgtgtggtatggtgtgcaccca

SEQ ID NO: 236201 - DNA, 25 bp, Mus musculus
atatgtgtgtagcaagctgctgtac

SEQ ID NO: 236202 - DNA, 25 bp, Mus musculus
atatgtgtgtaggaagctgctgtac

SEQ ID NO: 236203 - DNA, 25 bp, Mus musculus
atatgtgtgtgcacaggcctgccga

SEQ ID NO: 236204 - DNA, 25 bp, Mus musculus
atatgtgtgtgctcaggcctgccga

SEQ ID NO: 236205 - DNA, 25 bp, Mus musculus
atatgtgtgtggcacgtgcctgact

SEQ ID NO: 236206 - DNA, 25 bp, Mus musculus
atatgtgtgtgggacgtgcctgact

SEQ ID NO: 236207 - DNA, 25 bp, Mus musculus
atatgtgtgtgtatcctgggtaccc

SEQ ID NO: 236208 - DNA, 25 bp, Mus musculus
atatgtgtgtgtttcctgggtaccc

SEQ ID NO: 236209 - DNA, 25 bp, Mus musculus
atatgtgtgttgagtccttctatct

SEQ ID NO: 236210 - DNA, 25 bp, Mus musculus
atatgtgtgttgatgccatacctgg

SEQ ID NO: 236211 - DNA, 25 bp, Mus musculus
atatgtgtgttgtgtccttctatct

SEQ ID NO: 236212 - DNA, 25 bp, Mus musculus
atatgtgtgttgttgccatacctgg

SEQ ID NO: 236213 - DNA, 25 bp, Mus musculus
atatgtgttactatccctgtactct

SEQ ID NO: 236214 - DNA, 25 bp, Mus musculus
atatgtgttactttccctgtactct

SEQ ID NO: 236215 - DNA, 25 bp, Mus musculus
atatgtgttagcaagtttttctgtt

SEQ ID NO: 236216 - DNA, 25 bp, Mus musculus
atatgtgttagctagtttttctgtt

SEQ ID NO: 236217 - DNA, 25 bp, Mus musculus
atatgtgttgcacctcacagaatat

SEQ ID NO: 236218 - DNA, 25 bp, Mus musculus
atatgtgttgcagctcacagaatat

SEQ ID NO: 236219 - DNA, 25 bp, Mus musculus
atatgtgtttctcattcggtggcag

SEQ ID NO: 236220 - DNA, 25 bp, Mus musculus
atatgtgtttctgattcggtggcag

SEQ ID NO: 236221 - DNA, 25 bp, Mus musculus
atatgtgtttgaactctcatgataa

SEQ ID NO: 236222 - DNA, 25 bp, Mus musculus
atatgtgtttgatctctcatgataa

SEQ ID NO: 236223 - DNA, 25 bp, Mus musculus
atatgtgttttgaaccctgcagctc

SEQ ID NO: 236224 - DNA, 25 bp, Mus musculus
atatgtgttttgtaccctgcagctc

SEQ ID NO: 236225 - DNA, 25 bp, Mus musculus
atatgttaactaagagcagcccaaa

SEQ ID NO: 236226 - DNA, 25 bp, Mus musculus
atatgttaactatgagcagcccaaa

SEQ ID NO: 236227 - DNA, 25 bp, Mus musculus
atatgttaagaccacattctgctta

SEQ ID NO: 236228 - DNA, 25 bp, Mus musculus
atatgttaagacgacattctgctta

SEQ ID NO: 236229 - DNA, 25 bp, Mus musculus
atatgttacccgccaagcctcgaac

SEQ ID NO: 236230 - DNA, 25 bp, Mus musculus
atatgttacccggcaagcctcgaac

SEQ ID NO: 236231 - DNA, 25 bp, Mus musculus
atatgttactcaaagccagggctgt

SEQ ID NO: 236232 - DNA, 25 bp, Mus musculus
atatgttactcatagccagggctgt

SEQ ID NO: 236233 - DNA, 25 bp, Mus musculus
atatgttagcacacggagcgtctcc

SEQ ID NO: 236234 - DNA, 25 bp, Mus musculus
atatgttagcactcggagcgtctcc

SEQ ID NO: 236235 - DNA, 25 bp, Mus musculus
atatgttaggtccatgagaaggcac

SEQ ID NO: 236236 - DNA, 25 bp, Mus musculus
atatgttaggtcgatgagaaggcac

SEQ ID NO: 236237 - DNA, 25 bp, Mus musculus
atatgttatgttatatacccagtaa

SEQ ID NO: 236238 - DNA, 25 bp, Mus musculus
atatgttatgttttatacccagtaa

SEQ ID NO: 236239 - DNA, 25 bp, Mus musculus
atatgttattggaacctggtccttc

SEQ ID NO: 236240 - DNA, 25 bp, Mus musculus
atatgttattggtacctggtccttc

SEQ ID NO: 236241 - DNA, 25 bp, Mus musculus
atatgttcacacatagctcttcttc

SEQ ID NO: 236242 - DNA, 25 bp, Mus musculus
atatgttcacacttagctcttcttc

SEQ ID NO: 236243 - DNA, 25 bp, Mus musculus
atatgttcccggcaaaggaaagaag

SEQ ID NO: 236244 - DNA, 25 bp, Mus musculus
atatgttcccgggaaaggaaagaag

SEQ ID NO: 236245 - DNA, 25 bp, Mus musculus
atatgttcgcatctattttttggtt

SEQ ID NO: 236246 - DNA, 25 bp, Mus musculus
atatgttcgcatgtattttttggtt

SEQ ID NO: 236247 - DNA, 25 bp, Mus musculus
atatgttcgcgtagtggcttctcca

SEQ ID NO: 236248 - DNA, 25 bp, Mus musculus
atatgttcgcgttgtggcttctcca

SEQ ID NO: 236249 - DNA, 25 bp, Mus musculus
atatgttcggctaggtgggctgcct

SEQ ID NO: 236250 - DNA, 25 bp, Mus musculus
atatgttcggcttggtgggctgcct

SEQ ID NO: 236251 - DNA, 25 bp, Mus musculus
atatgttcgtgtatggctatcttga

SEQ ID NO: 236252 - DNA, 25 bp, Mus musculus
atatgttcgtgtttggctatcttga

SEQ ID NO: 236253 - DNA, 25 bp, Mus musculus
atatgttctataatctgggctgtct

SEQ ID NO: 236254 - DNA, 25 bp, Mus musculus
atatgttctatattctgggctgtct

SEQ ID NO: 236255 - DNA, 25 bp, Mus musculus
atatgttctcagatctacctacttc

SEQ ID NO: 236256 - DNA, 25 bp, Mus musculus
atatgttctcagttctacctacttc

SEQ ID NO: 236257 - DNA, 25 bp, Mus musculus
atatgttctcgcagctttctagatg

SEQ ID NO: 236258 - DNA, 25 bp, Mus musculus
atatgttctcgctgctttctagatg

SEQ ID NO: 236259 - DNA, 25 bp, Mus musculus
atatgttctgagctgttccagtgac

SEQ ID NO: 236260 - DNA, 25 bp, Mus musculus
atatgttctgaggtgttccagtgac

SEQ ID NO: 236261 - DNA, 25 bp, Mus musculus
atatgttctgggacctactaggtgc

SEQ ID NO: 236262 - DNA, 25 bp, Mus musculus
atatgttctgggtcctactaggtgc

SEQ ID NO: 236263 - DNA, 25 bp, Mus musculus
atatgttcttatatggttttcatgg

SEQ ID NO: 236264 - DNA, 25 bp, Mus musculus
atatgttcttatttggttttcatgg

SEQ ID NO: 236265 - DNA, 25 bp, Mus musculus
atatgttcttcgatcagtgctggta

SEQ ID NO: 236266 - DNA, 25 bp, Mus musculus
atatgttcttcgttcagtgctggta

SEQ ID NO: 236267 - DNA, 25 bp, Mus musculus
atatgttcttttcacattgtgccca

SEQ ID NO: 236268 - DNA, 25 bp, Mus musculus
atatgttcttttctacaactgttga

SEQ ID NO: 236269 - DNA, 25 bp, Mus musculus
atatgttcttttgacattgtgccca

SEQ ID NO: 236270 - DNA, 25 bp, Mus musculus
atatgttcttttgtacaactgttga

SEQ ID NO: 236271 - DNA, 25 bp, Mus musculus
atatgttggtaactgaacttgggtc

SEQ ID NO: 236272 - DNA, 25 bp, Mus musculus
atatgttggtaagtgaacttgggtc

SEQ ID NO: 236273 - DNA, 25 bp, Mus musculus
atatgttgtcccctggcctgcaagg

SEQ ID NO: 236274 - DNA, 25 bp, Mus musculus
atatgttgtcccgtggcctgcaagg

SEQ ID NO: 236275 - DNA, 25 bp, Mus musculus
atatgtttacatctttcactttgaa

SEQ ID NO: 236276 - DNA, 25 bp, Mus musculus
atatgtttacatgtttcactttgaa

SEQ ID NO: 236277 - DNA, 25 bp, Mus musculus
atatgtttatgtactgactgtcact

SEQ ID NO: 236278 - DNA, 25 bp, Mus musculus
atatgtttatgttctgactgtcact

SEQ ID NO: 236279 - DNA, 25 bp, Mus musculus
atatgtttccctatggcttatagtt

SEQ ID NO: 236280 - DNA, 25 bp, Mus musculus
atatgtttccctttggcttatagtt

SEQ ID NO: 236281 - DNA, 25 bp, Mus musculus
atatgtttccttaatggtttcttcg

SEQ ID NO: 236282 - DNA, 25 bp, Mus musculus
atatgtttcctttatggtttcttcg

SEQ ID NO: 236283 - DNA, 25 bp, Mus musculus
atatgtttctgaagattttttgcga

SEQ ID NO: 236284 - DNA, 25 bp, Mus musculus
atatgtttctgatgattttttgcga

SEQ ID NO: 236285 - DNA, 25 bp, Mus musculus
atatgtttcttccttctttgctggc

SEQ ID NO: 236286 - DNA, 25 bp, Mus musculus
atatgtttcttcgttctttgctggc

SEQ ID NO: 236287 - DNA, 25 bp, Mus musculus
atatgtttgcccagtgggccacgga

SEQ ID NO: 236288 - DNA, 25 bp, Mus musculus
atatgtttgccctgtgggccacgga

SEQ ID NO: 236289 - DNA, 25 bp, Mus musculus
atatgtttggagctatgacagccac

SEQ ID NO: 236290 - DNA, 25 bp, Mus musculus
atatgtttggaggtatgacagccac

SEQ ID NO: 236291 - DNA, 25 bp, Mus musculus
atatgtttgtagcacttatgtagag

SEQ ID NO: 236292 - DNA, 25 bp, Mus musculus
atatgtttgtaggacttatgtagag

SEQ ID NO: 236293 - DNA, 25 bp, Mus musculus
atatgtttgtccctcctgctgggtc

SEQ ID NO: 236294 - DNA, 25 bp, Mus musculus
atatgtttgtccgtcctgctgggtc

SEQ ID NO: 236295 - DNA, 25 bp, Mus musculus
atatgtttgttgagctgagacttgt

SEQ ID NO: 236296 - DNA, 25 bp, Mus musculus
atatgtttgttgtgctgagacttgt

SEQ ID NO: 236297 - DNA, 25 bp, Mus musculus
atatgttttataccccttgagacaa

SEQ ID NO: 236298 - DNA, 25 bp, Mus musculus
atatgttttatagcccttgagacaa

SEQ ID NO: 236299 - DNA, 25 bp, Mus musculus
atatgttttatcataccccatctct

SEQ ID NO: 236300 - DNA, 25 bp, Mus musculus
atatgttttatcttaccccatctct

SEQ ID NO: 236301 - DNA, 25 bp, Mus musculus
atatgttttcccatatttaggtcat

SEQ ID NO: 236302 - DNA, 25 bp, Mus musculus
atatgttttcccttatttaggtcat

SEQ ID NO: 236303 - DNA, 25 bp, Mus musculus
atatgttttgctaatttctagtata

SEQ ID NO: 236304 - DNA, 25 bp, Mus musculus
atatgttttgcttatttctagtata

SEQ ID NO: 236305 - DNA, 25 bp, Mus musculus
atatgttttgtaatagttggagcac

SEQ ID NO: 236306 - DNA, 25 bp, Mus musculus
atatgttttgtattagttggagcac

SEQ ID NO: 236307 - DNA, 25 bp, Mus musculus
atatgtttttatcagcgcttggtgg

SEQ ID NO: 236308 - DNA, 25 bp, Mus musculus
atatgtttttatgagcgcttggtgg

SEQ ID NO: 236309 - DNA, 25 bp, Mus musculus
atattaaaagtgaaccccgctgtga

SEQ ID NO: 236310 - DNA, 25 bp, Mus musculus
atattaaaagtgtaccccgctgtga

SEQ ID NO: 236311 - DNA, 25 bp, Mus musculus
atattaaaatcccacacaaggctgg

SEQ ID NO: 236312 - DNA, 25 bp, Mus musculus
atattaaaatccgacacaaggctgg

SEQ ID NO: 236313 - DNA, 25 bp, Mus musculus
atattaaaattcaattgggcttcaa

SEQ ID NO: 236314 - DNA, 25 bp, Mus musculus
atattaaaattctattgggcttcaa

SEQ ID NO: 236315 - DNA, 25 bp, Mus musculus
atattaaacgttcgccctccaacag

SEQ ID NO: 236316 - DNA, 25 bp, Mus musculus
atattaaacgttggccctccaacag

SEQ ID NO: 236317 - DNA, 25 bp, Mus musculus
atattaaagcgacgcatcactgcct

SEQ ID NO: 236318 - DNA, 25 bp, Mus musculus
atattaaagcgaggcatcactgcct

SEQ ID NO: 236319 - DNA, 25 bp, Mus musculus
atattaaccatgcagcctggaccat

SEQ ID NO: 236320 - DNA, 25 bp, Mus musculus
atattaaccatggagcctggaccat

SEQ ID NO: 236321 - DNA, 25 bp, Mus musculus
atattaactatcattggccactgct

SEQ ID NO: 236322 - DNA, 25 bp, Mus musculus
atattaactatctttggccactgct

SEQ ID NO: 236323 - DNA, 25 bp, Mus musculus
atattaactatgcttcttcaggaga

SEQ ID NO: 236324 - DNA, 25 bp, Mus musculus
atattaactatggttcttcaggaga

SEQ ID NO: 236325 - DNA, 25 bp, Mus musculus
atattaactcgtccgtggaaagcct

SEQ ID NO: 236326 - DNA, 25 bp, Mus musculus
atattaactcgtgcgtggaaagcct

SEQ ID NO: 236327 - DNA, 25 bp, Mus musculus
atattaacttaaacggtgctctata

SEQ ID NO: 236328 - DNA, 25 bp, Mus musculus
atattaacttaatcggtgctctata

SEQ ID NO: 236329 - DNA, 25 bp, Mus musculus
atattaactttccatgtgctgccat

SEQ ID NO: 236330 - DNA, 25 bp, Mus musculus
atattaactttcgatgtgctgccat

SEQ ID NO: 236331 - DNA, 25 bp, Mus musculus
atattaagagatactagggcctcca

SEQ ID NO: 236332 - DNA, 25 bp, Mus musculus
atattaagagattctagggcctcca

SEQ ID NO: 236333 - DNA, 25 bp, Mus musculus
atattaagatggaggcccttgccac

SEQ ID NO: 236334 - DNA, 25 bp, Mus musculus
atattaagatggtggcccttgccac

SEQ ID NO: 236335 - DNA, 25 bp, Mus musculus
atattaatcatcacaactccatccc

SEQ ID NO: 236336 - DNA, 25 bp, Mus musculus
atattaatcatctcaactccatccc

SEQ ID NO: 236337 - DNA, 25 bp, Mus musculus
atattaatgctaattttcggaggga

SEQ ID NO: 236338 - DNA, 25 bp, Mus musculus
atattaatgctatttttcggaggga

SEQ ID NO: 236339 - DNA, 25 bp, Mus musculus
atattaatgggaagggtggttgatt

SEQ ID NO: 236340 - DNA, 25 bp, Mus musculus
atattaatgggatgggtggttgatt

SEQ ID NO: 236341 - DNA, 25 bp, Mus musculus
atattaatggtgctccagggcccac

SEQ ID NO: 236342 - DNA, 25 bp, Mus musculus
atattaatggtggtccagggcccac

SEQ ID NO: 236343 - DNA, 25 bp, Mus musculus
atattaatgttcaagttagcatctt

SEQ ID NO: 236344 - DNA, 25 bp, Mus musculus
atattaatgttctagttagcatctt

SEQ ID NO: 236345 - DNA, 25 bp, Mus musculus
atattaatttccatctaactgcaaa

SEQ ID NO: 236346 - DNA, 25 bp, Mus musculus
atattaatttccttctaactgcaaa

SEQ ID NO: 236347 - DNA, 25 bp, Mus musculus
atattacaacgccgcagcattatga

SEQ ID NO: 236348 - DNA, 25 bp, Mus musculus
atattacaacgcggcagcattatga

SEQ ID NO: 236349 - DNA, 25 bp, Mus musculus
atattacagcaaaacactgggctag

SEQ ID NO: 236350 - DNA, 25 bp, Mus musculus
atattacagcaatacactgggctag

SEQ ID NO: 236351 - DNA, 25 bp, Mus musculus
atattacagtcacaagcccagcatc

SEQ ID NO: 236352 - DNA, 25 bp, Mus musculus
atattacagtcagaagcccagcatc

SEQ ID NO: 236353 - DNA, 25 bp, Mus musculus
atattacattttatcttgtgctgaa

SEQ ID NO: 236354 - DNA, 25 bp, Mus musculus
atattacattttttcttgtgctgaa

SEQ ID NO: 236355 - DNA, 25 bp, Mus musculus
atattaccaaatcgccgggcgaggt

SEQ ID NO: 236356 - DNA, 25 bp, Mus musculus
atattaccaaatggccgggcgaggt

SEQ ID NO: 236357 - DNA, 25 bp, Mus musculus
atattaccagtaatgcagtgctgcg

SEQ ID NO: 236358 - DNA, 25 bp, Mus musculus
atattaccagtattgcagtgctgcg

SEQ ID NO: 236359 - DNA, 25 bp, Mus musculus
atattacccccaagtttacatccca

SEQ ID NO: 236360 - DNA, 25 bp, Mus musculus
atattacccccatgtttacatccca

SEQ ID NO: 236361 - DNA, 25 bp, Mus musculus
atattaccgagtctgctgcgttcca

SEQ ID NO: 236362 - DNA, 25 bp, Mus musculus
atattaccgagtgtgctgcgttcca

SEQ ID NO: 236363 - DNA, 25 bp, Mus musculus
atattacggtcaagcaccaactgct

SEQ ID NO: 236364 - DNA, 25 bp, Mus musculus
atattacggtcatgcaccaactgct

SEQ ID NO: 236365 - DNA, 25 bp, Mus musculus
atattacgtttgattaattctgcta

SEQ ID NO: 236366 - DNA, 25 bp, Mus musculus
atattacgtttgtttaattctgcta

SEQ ID NO: 236367 - DNA, 25 bp, Mus musculus
atattactacctcgctctcgtaaac

SEQ ID NO: 236368 - DNA, 25 bp, Mus musculus
atattactacctggctctcgtaaac

SEQ ID NO: 236369 - DNA, 25 bp, Mus musculus
atattactagagactgtgcaggaac

SEQ ID NO: 236370 - DNA, 25 bp, Mus musculus
atattactagagtctgtgcaggaac

SEQ ID NO: 236371 - DNA, 25 bp, Mus musculus
atattactatatatggagctgggac

SEQ ID NO: 236372 - DNA, 25 bp, Mus musculus
atattactatatttggagctgggac

SEQ ID NO: 236373 - DNA, 25 bp, Mus musculus
atattactatctactttctctgctg

SEQ ID NO: 236374 - DNA, 25 bp, Mus musculus
atattactatcttctttctctgctg

SEQ ID NO: 236375 - DNA, 25 bp, Mus musculus
atattactctgcataatcccacagc

SEQ ID NO: 236376 - DNA, 25 bp, Mus musculus
atattactctgcttaatcccacagc

SEQ ID NO: 236377 - DNA, 25 bp, Mus musculus
atattactggttcctgttgtggaga

SEQ ID NO: 236378 - DNA, 25 bp, Mus musculus
atattactggttgctgttgtggaga

SEQ ID NO: 236379 - DNA, 25 bp, Mus musculus
atattacttcccatcttgttactgc

SEQ ID NO: 236380 - DNA, 25 bp, Mus musculus
atattacttcccttcttgttactgc

SEQ ID NO: 236381 - DNA, 25 bp, Mus musculus
atattacttctccatcatttagtga

SEQ ID NO: 236382 - DNA, 25 bp, Mus musculus
atattacttctcgatcatttagtga

SEQ ID NO: 236383 - DNA, 25 bp, Mus musculus
atattactttacagcaaagtgcccc

SEQ ID NO: 236384 - DNA, 25 bp, Mus musculus
atattactttactgcaaagtgcccc

SEQ ID NO: 236385 - DNA, 25 bp, Mus musculus
atattagcactgaaaggtctggtca

SEQ ID NO: 236386 - DNA, 25 bp, Mus musculus
atattagcactgtaaggtctggtca

SEQ ID NO: 236387 - DNA, 25 bp, Mus musculus
atattagccacaccactggatatta

SEQ ID NO: 236388 - DNA, 25 bp, Mus musculus
atattagccacagcactggatatta

SEQ ID NO: 236389 - DNA, 25 bp, Mus musculus
atattagccatactccaccagggtc

SEQ ID NO: 236390 - DNA, 25 bp, Mus musculus
atattagccatagtccaccagggtc

SEQ ID NO: 236391 - DNA, 25 bp, Mus musculus
atattagccattctactcactctgt

SEQ ID NO: 236392 - DNA, 25 bp, Mus musculus
atattagccattgtactcactctgt

SEQ ID NO: 236393 - DNA, 25 bp, Mus musculus
atattagcctcaccccttaaagtca

SEQ ID NO: 236394 - DNA, 25 bp, Mus musculus
atattagcctcagcccttaaagtca

SEQ ID NO: 236395 - DNA, 25 bp, Mus musculus
atattagccttcaagtctgtaatgg

SEQ ID NO: 236396 - DNA, 25 bp, Mus musculus
atattagccttctagtctgtaatgg

SEQ ID NO: 236397 - DNA, 25 bp, Mus musculus
atattagctgcccattttagttaat

SEQ ID NO: 236398 - DNA, 25 bp, Mus musculus
atattagctgccgattttagttaat

SEQ ID NO: 236399 - DNA, 25 bp, Mus musculus
atattagctgttctttttaggctgc

SEQ ID NO: 236400 - DNA, 25 bp, Mus musculus
atattagctgttgtttttaggctgc

SEQ ID NO: 236401 - DNA, 25 bp, Mus musculus
atattagcttagagcccaccgcata

SEQ ID NO: 236402 - DNA, 25 bp, Mus musculus
atattagcttagtgcccaccgcata

SEQ ID NO: 236403 - DNA, 25 bp, Mus musculus
atattaggtgtcaccatctcaacaa

SEQ ID NO: 236404 - DNA, 25 bp, Mus musculus
atattaggtgtctccatctcaacaa

SEQ ID NO: 236405 - DNA, 25 bp, Mus musculus
atattatacatcagcctccaactaa

SEQ ID NO: 236406 - DNA, 25 bp, Mus musculus
atattatacatctgcctccaactaa

SEQ ID NO: 236407 - DNA, 25 bp, Mus musculus
atattatactgaagaggtctgctct

SEQ ID NO: 236408 - DNA, 25 bp, Mus musculus
atattatactgatgaggtctgctct

SEQ ID NO: 236409 - DNA, 25 bp, Mus musculus
atattatagttcactgcatccaggg

SEQ ID NO: 236410 - DNA, 25 bp, Mus musculus
atattatagttctctgcatccaggg

SEQ ID NO: 236411 - DNA, 25 bp, Mus musculus
atattatatgccatccttccattac

SEQ ID NO: 236412 - DNA, 25 bp, Mus musculus
atattatatgccttccttccattac

SEQ ID NO: 236413 - DNA, 25 bp, Mus musculus
atattatcacagaggccaagcagca

SEQ ID NO: 236414 - DNA, 25 bp, Mus musculus
atattatcacagtggccaagcagca

SEQ ID NO: 236415 - DNA, 25 bp, Mus musculus
atattatcagtgatctcagacttgt

SEQ ID NO: 236416 - DNA, 25 bp, Mus musculus
atattatcagtgttctcagacttgt

SEQ ID NO: 236417 - DNA, 25 bp, Mus musculus
atattatccaaacatagctgcttta

SEQ ID NO: 236418 - DNA, 25 bp, Mus musculus
atattatccaaagatagctgcttta

SEQ ID NO: 236419 - DNA, 25 bp, Mus musculus
atattatccctaagtattgcatgag

SEQ ID NO: 236420 - DNA, 25 bp, Mus musculus
atattatccctatgtattgcatgag

SEQ ID NO: 236421 - DNA, 25 bp, Mus musculus
atattatctactatctgcatgcgtc

SEQ ID NO: 236422 - DNA, 25 bp, Mus musculus
atattatctactttctgcatgcgtc

SEQ ID NO: 236423 - DNA, 25 bp, Mus musculus
atattatcttaaaaactgtcaataa

SEQ ID NO: 236424 - DNA, 25 bp, Mus musculus
atattatcttaataactgtcaataa

SEQ ID NO: 236425 - DNA, 25 bp, Mus musculus
atattatgacacattctttcttatg

SEQ ID NO: 236426 - DNA, 25 bp, Mus musculus
atattatgacactttctttcttatg

SEQ ID NO: 236427 - DNA, 25 bp, Mus musculus
atattatgcaaaatcccagatctga

SEQ ID NO: 236428 - DNA, 25 bp, Mus musculus
atattatgcaaattcccagatctga

SEQ ID NO: 236429 - DNA, 25 bp, Mus musculus
atattatgcgtacaagaggcggaat

SEQ ID NO: 236430 - DNA, 25 bp, Mus musculus
atattatgcgtagaagaggcggaat

SEQ ID NO: 236431 - DNA, 25 bp, Mus musculus
atattatggtttactagttctgtgt

SEQ ID NO: 236432 - DNA, 25 bp, Mus musculus
atattatggttttctagttctgtgt

SEQ ID NO: 236433 - DNA, 25 bp, Mus musculus
atattatgtatgactgtgcgtgtgt

SEQ ID NO: 236434 - DNA, 25 bp, Mus musculus
atattatgtatgtctgtgcgtgtgt

SEQ ID NO: 236435 - DNA, 25 bp, Mus musculus
atattatgtggccttgtgtgttttc

SEQ ID NO: 236436 - DNA, 25 bp, Mus musculus
atattatgtggcgttgtgtgttttc

SEQ ID NO: 236437 - DNA, 25 bp, Mus musculus
atattattctggaagctggctagac

SEQ ID NO: 236438 - DNA, 25 bp, Mus musculus
atattattctggtagctggctagac

SEQ ID NO: 236439 - DNA, 25 bp, Mus musculus
atattattgtccactcagttactga

SEQ ID NO: 236440 - DNA, 25 bp, Mus musculus
atattattgtcctctcagttactga

SEQ ID NO: 236441 - DNA, 25 bp, Mus musculus
atattatttagtagccctcattggg

SEQ ID NO: 236442 - DNA, 25 bp, Mus musculus
atattatttagttgccctcattggg

SEQ ID NO: 236443 - DNA, 25 bp, Mus musculus
atattcaaagtcctgaggtgggtgc

SEQ ID NO: 236444 - DNA, 25 bp, Mus musculus
atattcaaagtcgtgaggtgggtgc

SEQ ID NO: 236445 - DNA, 25 bp, Mus musculus
atattcaaatccagttccacgtttt

SEQ ID NO: 236446 - DNA, 25 bp, Mus musculus
atattcaaatcctgttccacgtttt

SEQ ID NO: 236447 - DNA, 25 bp, Mus musculus
atattcaacaaacgccacactcatg

SEQ ID NO: 236448 - DNA, 25 bp, Mus musculus
atattcaacaaaggccacactcatg

SEQ ID NO: 236449 - DNA, 25 bp, Mus musculus
atattcaacatgaggctaccttgcc

SEQ ID NO: 236450 - DNA, 25 bp, Mus musculus
atattcaacatgtggctaccttgcc

SEQ ID NO: 236451 - DNA, 25 bp, Mus musculus
atattcaacattatacaactgcagt

SEQ ID NO: 236452 - DNA, 25 bp, Mus musculus
atattcaacattttacaactgcagt

SEQ ID NO: 236453 - DNA, 25 bp, Mus musculus
atattcaacgaactatccaccttca

SEQ ID NO: 236454 - DNA, 25 bp, Mus musculus
atattcaacgaagtatccaccttca

SEQ ID NO: 236455 - DNA, 25 bp, Mus musculus
atattcaagacccagctcaagcaga

SEQ ID NO: 236456 - DNA, 25 bp, Mus musculus
atattcaagaccgagctcaagcaga

SEQ ID NO: 236457 - DNA, 25 bp, Mus musculus
atattcaagctgatggtctgattac

SEQ ID NO: 236458 - DNA, 25 bp, Mus musculus
atattcaagctgttggtctgattac

SEQ ID NO: 236459 - DNA, 25 bp, Mus musculus
atattcacactcatgttctgagatg

SEQ ID NO: 236460 - DNA, 25 bp, Mus musculus
atattcacactcttgttctgagatg

SEQ ID NO: 236461 - DNA, 25 bp, Mus musculus
atattcacagctatcctgggataca

SEQ ID NO: 236462 - DNA, 25 bp, Mus musculus
atattcacagctttcctgggataca

SEQ ID NO: 236463 - DNA, 25 bp, Mus musculus
atattcaccaatagccccattgcgg

SEQ ID NO: 236464 - DNA, 25 bp, Mus musculus
atattcaccaattgccccattgcgg

SEQ ID NO: 236465 - DNA, 25 bp, Mus musculus
atattcaccccgagtgtttgccaga

SEQ ID NO: 236466 - DNA, 25 bp, Mus musculus
atattcaccccgtgtgtttgccaga

SEQ ID NO: 236467 - DNA, 25 bp, Mus musculus
atattcaccctgaagcaagctttcc

SEQ ID NO: 236468 - DNA, 25 bp, Mus musculus
atattcaccctgtagcaagctttcc

SEQ ID NO: 236469 - DNA, 25 bp, Mus musculus
atattcacctgaacacttgtgccaa

SEQ ID NO: 236470 - DNA, 25 bp, Mus musculus
atattcacctgatcacttgtgccaa

SEQ ID NO: 236471 - DNA, 25 bp, Mus musculus
atattcacgcaaacctgacagctct

SEQ ID NO: 236472 - DNA, 25 bp, Mus musculus
atattcacgcaatcctgacagctct

SEQ ID NO: 236473 - DNA, 25 bp, Mus musculus
atattcacggtaatcttcaactgta

SEQ ID NO: 236474 - DNA, 25 bp, Mus musculus
atattcacggtattcttcaactgta

SEQ ID NO: 236475 - DNA, 25 bp, Mus musculus
atattcactacactcaatttatgga

SEQ ID NO: 236476 - DNA, 25 bp, Mus musculus
atattcactacagtcaatttatgga

SEQ ID NO: 236477 - DNA, 25 bp, Mus musculus
atattcactcctctatcttgcattc

SEQ ID NO: 236478 - DNA, 25 bp, Mus musculus
atattcactcctgtatcttgcattc

SEQ ID NO: 236479 - DNA, 25 bp, Mus musculus
atattcagagatcacattttttctt

SEQ ID NO: 236480 - DNA, 25 bp, Mus musculus
atattcagagatgacattttttctt

SEQ ID NO: 236481 - DNA, 25 bp, Mus musculus
atattcagatataccaagcaatgct

SEQ ID NO: 236482 - DNA, 25 bp, Mus musculus
atattcagatattccaagcaatgct

SEQ ID NO: 236483 - DNA, 25 bp, Mus musculus
atattcagattccagtgcctatagg

SEQ ID NO: 236484 - DNA, 25 bp, Mus musculus
atattcagattcgagtgcctatagg

SEQ ID NO: 236485 - DNA, 25 bp, Mus musculus
atattcagcacgcacatgctagact

SEQ ID NO: 236486 - DNA, 25 bp, Mus musculus
atattcagcacggacatgctagact

SEQ ID NO: 236487 - DNA, 25 bp, Mus musculus
atattcagcataagctatttcattt

SEQ ID NO: 236488 - DNA, 25 bp, Mus musculus
atattcagcatatgctatttcattt

SEQ ID NO: 236489 - DNA, 25 bp, Mus musculus
atattcagcccacaaagtttccttt

SEQ ID NO: 236490 - DNA, 25 bp, Mus musculus
atattcagcccagaaagtttccttt

SEQ ID NO: 236491 - DNA, 25 bp, Mus musculus
atattcagcctaagatactctccct

SEQ ID NO: 236492 - DNA, 25 bp, Mus musculus
atattcagcctacttggctatccgc

SEQ ID NO: 236493 - DNA, 25 bp, Mus musculus
atattcagcctagttggctatccgc

SEQ ID NO: 236494 - DNA, 25 bp, Mus musculus
atattcagcctatgatactctccct

SEQ ID NO: 236495 - DNA, 25 bp, Mus musculus
atattcagcgggaggatgctccatc

SEQ ID NO: 236496 - DNA, 25 bp, Mus musculus
atattcagcgggtggatgctccatc

SEQ ID NO: 236497 - DNA, 25 bp, Mus musculus
atattcagctggagggcaggccatc

SEQ ID NO: 236498 - DNA, 25 bp, Mus musculus
atattcagctggtgggcaggccatc

SEQ ID NO: 236499 - DNA, 25 bp, Mus musculus
atattcaggtaccatgcttctgtct

SEQ ID NO: 236500 - DNA, 25 bp, Mus musculus
atattcaggtacgatgcttctgtct

SEQ ID NO: 236501 - DNA, 25 bp, Mus musculus
atattcaggttacagcttgcgctca

SEQ ID NO: 236502 - DNA, 25 bp, Mus musculus
atattcaggttagagcttgcgctca

SEQ ID NO: 236503 - DNA, 25 bp, Mus musculus
atattcagtcatcgtgcctcagcct

SEQ ID NO: 236504 - DNA, 25 bp, Mus musculus
atattcagtcatggtgcctcagcct

SEQ ID NO: 236505 - DNA, 25 bp, Mus musculus
atattcagtcttaaatgctcttgga

SEQ ID NO: 236506 - DNA, 25 bp, Mus musculus
atattcagtctttaatgctcttgga

SEQ ID NO: 236507 - DNA, 25 bp, Mus musculus
atattcagtggtatccttcctcgtg

SEQ ID NO: 236508 - DNA, 25 bp, Mus musculus
atattcagtggtttccttcctcgtg

SEQ ID NO: 236509 - DNA, 25 bp, Mus musculus
atattcagttctctgtactctagag

SEQ ID NO: 236510 - DNA, 25 bp, Mus musculus
atattcagttctgtgtactctagag

SEQ ID NO: 236511 - DNA, 25 bp, Mus musculus
atattcagtttcagcttccatcatg

SEQ ID NO: 236512 - DNA, 25 bp, Mus musculus
atattcagtttctgcttccatcatg

SEQ ID NO: 236513 - DNA, 25 bp, Mus musculus
atattcataaaccttaccctccatg

SEQ ID NO: 236514 - DNA, 25 bp, Mus musculus
atattcataaacgttaccctccatg

SEQ ID NO: 236515 - DNA, 25 bp, Mus musculus
atattcatacacatgctgatttcag

SEQ ID NO: 236516 - DNA, 25 bp, Mus musculus
atattcatacacttgctgatttcag

SEQ ID NO: 236517 - DNA, 25 bp, Mus musculus
atattcatacctacccattttctat

SEQ ID NO: 236518 - DNA, 25 bp, Mus musculus
atattcataccttcccattttctat

SEQ ID NO: 236519 - DNA, 25 bp, Mus musculus
atattcatctatctttccttgttta

SEQ ID NO: 236520 - DNA, 25 bp, Mus musculus
atattcatctatgtttccttgttta

SEQ ID NO: 236521 - DNA, 25 bp, Mus musculus
atattcatctttcctattggttgat

SEQ ID NO: 236522 - DNA, 25 bp, Mus musculus
atattcatctttgctattggttgat

SEQ ID NO: 236523 - DNA, 25 bp, Mus musculus
atattcatgggcattggcttactga

SEQ ID NO: 236524 - DNA, 25 bp, Mus musculus
atattcatgggctttggcttactga

SEQ ID NO: 236525 - DNA, 25 bp, Mus musculus
atattcattagcagcccagtgcacc

SEQ ID NO: 236526 - DNA, 25 bp, Mus musculus
atattcattagctgcccagtgcacc

SEQ ID NO: 236527 - DNA, 25 bp, Mus musculus
atattcattctcaggattttgtagc

SEQ ID NO: 236528 - DNA, 25 bp, Mus musculus
atattcattctctggattttgtagc

SEQ ID NO: 236529 - DNA, 25 bp, Mus musculus
atattcattgctatcctggttacat

SEQ ID NO: 236530 - DNA, 25 bp, Mus musculus
atattcattgctttcctggttacat

SEQ ID NO: 236531 - DNA, 25 bp, Mus musculus
atattcattggtctattgcttgcat

SEQ ID NO: 236532 - DNA, 25 bp, Mus musculus
atattcattggtgtattgcttgcat

SEQ ID NO: 236533 - DNA, 25 bp, Mus musculus
atattcatttccctgtgttttcctg

SEQ ID NO: 236534 - DNA, 25 bp, Mus musculus
atattcatttccgtgtgttttcctg

SEQ ID NO: 236535 - DNA, 25 bp, Mus musculus
atattccaaacacaacagcatctgt

SEQ ID NO: 236536 - DNA, 25 bp, Mus musculus
atattccaaacagaacagcatctgt

SEQ ID NO: 236537 - DNA, 25 bp, Mus musculus
atattccaaagtccaaggtcctcag

SEQ ID NO: 236538 - DNA, 25 bp, Mus musculus
atattccaaagtgcaaggtcctcag

SEQ ID NO: 236539 - DNA, 25 bp, Mus musculus
atattccaactgctagcctctatgg

SEQ ID NO: 236540 - DNA, 25 bp, Mus musculus
atattccaactggtagcctctatgg

SEQ ID NO: 236541 - DNA, 25 bp, Mus musculus
atattccaacttcgaggtctttctc

SEQ ID NO: 236542 - DNA, 25 bp, Mus musculus
atattccaacttggaggtctttctc

SEQ ID NO: 236543 - DNA, 25 bp, Mus musculus
atattccaagagctggccgacaagt

SEQ ID NO: 236544 - DNA, 25 bp, Mus musculus
atattccaagaggtggccgacaagt

SEQ ID NO: 236545 - DNA, 25 bp, Mus musculus
atattccaattacacatgctccctc

SEQ ID NO: 236546 - DNA, 25 bp, Mus musculus
atattccaattagacatgctccctc

SEQ ID NO: 236547 - DNA, 25 bp, Mus musculus
atattccaccagattgtacccgaag

SEQ ID NO: 236548 - DNA, 25 bp, Mus musculus
atattccaccagtttgtacccgaag

SEQ ID NO: 236549 - DNA, 25 bp, Mus musculus
atattccataatcgaccaggttagt

SEQ ID NO: 236550 - DNA, 25 bp, Mus musculus
atattccataatggaccaggttagt

SEQ ID NO: 236551 - DNA, 25 bp, Mus musculus
atattccatacccagctatcttttt

SEQ ID NO: 236552 - DNA, 25 bp, Mus musculus
atattccataccgagctatcttttt

SEQ ID NO: 236553 - DNA, 25 bp, Mus musculus
atattccatcagaagcatcgtccag

SEQ ID NO: 236554 - DNA, 25 bp, Mus musculus
atattccatcagtagcatcgtccag

SEQ ID NO: 236555 - DNA, 25 bp, Mus musculus
atattccatcctctttgtgctggga

SEQ ID NO: 236556 - DNA, 25 bp, Mus musculus
atattccatcctgtttgtgctggga

SEQ ID NO: 236557 - DNA, 25 bp, Mus musculus
atattccatctaacagttgcaaggt

SEQ ID NO: 236558 - DNA, 25 bp, Mus musculus
atattccatctatcagttgcaaggt

SEQ ID NO: 236559 - DNA, 25 bp, Mus musculus
atattccatgttatcccttctgaga

SEQ ID NO: 236560 - DNA, 25 bp, Mus musculus
atattccatgttttcccttctgaga

SEQ ID NO: 236561 - DNA, 25 bp, Mus musculus
atattccattccaatttttgaaggt

SEQ ID NO: 236562 - DNA, 25 bp, Mus musculus
atattccattcctatttttgaaggt

SEQ ID NO: 236563 - DNA, 25 bp, Mus musculus
atattcccaaggaggctgactccgg

SEQ ID NO: 236564 - DNA, 25 bp, Mus musculus
atattcccaaggtggctgactccgg

SEQ ID NO: 236565 - DNA, 25 bp, Mus musculus
atattcccaagtactttttgcttgt

SEQ ID NO: 236566 - DNA, 25 bp, Mus musculus
atattcccaagttctttttgcttgt

SEQ ID NO: 236567 - DNA, 25 bp, Mus musculus
atattcccaggaacaggcatgccat

SEQ ID NO: 236568 - DNA, 25 bp, Mus musculus
atattcccaggatcaggcatgccat

SEQ ID NO: 236569 - DNA, 25 bp, Mus musculus
atattccccacccacttatatttca

SEQ ID NO: 236570 - DNA, 25 bp, Mus musculus
atattccccaccgacttatatttca

SEQ ID NO: 236571 - DNA, 25 bp, Mus musculus
atattcccgtggcttctgatgggcc

SEQ ID NO: 236572 - DNA, 25 bp, Mus musculus
atattcccgtgggttctgatgggcc

SEQ ID NO: 236573 - DNA, 25 bp, Mus musculus
atattccctattatcagataacttt

SEQ ID NO: 236574 - DNA, 25 bp, Mus musculus
atattccctattttcagataacttt

SEQ ID NO: 236575 - DNA, 25 bp, Mus musculus
atattccctcggcagctgaggtcag

SEQ ID NO: 236576 - DNA, 25 bp, Mus musculus
atattccctcgggagctgaggtcag

SEQ ID NO: 236577 - DNA, 25 bp, Mus musculus
atattccctctgagaaatctacctc

SEQ ID NO: 236578 - DNA, 25 bp, Mus musculus
atattccctctgtgaaatctacctc

SEQ ID NO: 236579 - DNA, 25 bp, Mus musculus
atattccctgttcctgagtcacttg

SEQ ID NO: 236580 - DNA, 25 bp, Mus musculus
atattccctgttcgttcctgtttca

SEQ ID NO: 236581 - DNA, 25 bp, Mus musculus
atattccctgttgctgagtcacttg

SEQ ID NO: 236582 - DNA, 25 bp, Mus musculus
atattccctgttggttcctgtttca

SEQ ID NO: 236583 - DNA, 25 bp, Mus musculus
atattccgaccccactgaggagttt

SEQ ID NO: 236584 - DNA, 25 bp, Mus musculus
atattccgacccgactgaggagttt

SEQ ID NO: 236585 - DNA, 25 bp, Mus musculus
atattccgatctattatttcttgca

SEQ ID NO: 236586 - DNA, 25 bp, Mus musculus
atattccgatcttttatttcttgca

SEQ ID NO: 236587 - DNA, 25 bp, Mus musculus
atattccgtattagtgacgccctgg

SEQ ID NO: 236588 - DNA, 25 bp, Mus musculus
atattccgtatttgtgacgccctgg

SEQ ID NO: 236589 - DNA, 25 bp, Mus musculus
atattccgtcttcgccaaatcgtgg

SEQ ID NO: 236590 - DNA, 25 bp, Mus musculus
atattccgtcttggccaaatcgtgg

SEQ ID NO: 236591 - DNA, 25 bp, Mus musculus
atattcctaattacctcatcttgta

SEQ ID NO: 236592 - DNA, 25 bp, Mus musculus
atattcctaatttcctcatcttgta

SEQ ID NO: 236593 - DNA, 25 bp, Mus musculus
atattcctacatacaatcgctctca

SEQ ID NO: 236594 - DNA, 25 bp, Mus musculus
atattcctacattcaatcgctctca

SEQ ID NO: 236595 - DNA, 25 bp, Mus musculus
atattcctactgagccttcgacgct

SEQ ID NO: 236596 - DNA, 25 bp, Mus musculus
atattcctactgtgccttcgacgct

SEQ ID NO: 236597 - DNA, 25 bp, Mus musculus
atattcctatgtcgttcaccctctg

SEQ ID NO: 236598 - DNA, 25 bp, Mus musculus
atattcctatgtggttcaccctctg

SEQ ID NO: 236599 - DNA, 25 bp, Mus musculus
atattcctcaaaattactgggatgg

SEQ ID NO: 236600 - DNA, 25 bp, Mus musculus
atattcctcaaatttactgggatgg

SEQ ID NO: 236601 - DNA, 25 bp, Mus musculus
atattcctccaaaaattggcacagt

SEQ ID NO: 236602 - DNA, 25 bp, Mus musculus
atattcctccaataattggcacagt

SEQ ID NO: 236603 - DNA, 25 bp, Mus musculus
atattcctcccaccatcagaacgaa

SEQ ID NO: 236604 - DNA, 25 bp, Mus musculus
atattcctcccagcatcagaacgaa

SEQ ID NO: 236605 - DNA, 25 bp, Mus musculus
atattcctcctgatctatttgctag

SEQ ID NO: 236606 - DNA, 25 bp, Mus musculus
atattcctcctgttctatttgctag

SEQ ID NO: 236607 - DNA, 25 bp, Mus musculus
atattcctgccgcatcgaaccagga

SEQ ID NO: 236608 - DNA, 25 bp, Mus musculus
atattcctgccggatcgaaccagga

SEQ ID NO: 236609 - DNA, 25 bp, Mus musculus
atattcctgcctaaactgttaatgt

SEQ ID NO: 236610 - DNA, 25 bp, Mus musculus
atattcctgcctcaggaccagttgt

SEQ ID NO: 236611 - DNA, 25 bp, Mus musculus
atattcctgcctgaggaccagttgt

SEQ ID NO: 236612 - DNA, 25 bp, Mus musculus
atattcctgccttaactgttaatgt

SEQ ID NO: 236613 - DNA, 25 bp, Mus musculus
atattcctggaaatgttgccagtgt

SEQ ID NO: 236614 - DNA, 25 bp, Mus musculus
atattcctggaattgttgccagtgt

SEQ ID NO: 236615 - DNA, 25 bp, Mus musculus
atattcctggatatcttttcaagga

SEQ ID NO: 236616 - DNA, 25 bp, Mus musculus
atattcctggatttcttttcaagga

SEQ ID NO: 236617 - DNA, 25 bp, Mus musculus
atattcctgggactagcatagataa

SEQ ID NO: 236618 - DNA, 25 bp, Mus musculus
atattcctgggagtagcatagataa

SEQ ID NO: 236619 - DNA, 25 bp, Mus musculus
atattcctgttacttctgtgtacca

SEQ ID NO: 236620 - DNA, 25 bp, Mus musculus
atattcctgttagttctgtgtacca

SEQ ID NO: 236621 - DNA, 25 bp, Mus musculus
atattccttaggcttctcctagcgg

SEQ ID NO: 236622 - DNA, 25 bp, Mus musculus
atattccttagggttctcctagcgg

SEQ ID NO: 236623 - DNA, 25 bp, Mus musculus
atattccttcccaataaatgctaag

SEQ ID NO: 236624 - DNA, 25 bp, Mus musculus
atattccttccctataaatgctaag

SEQ ID NO: 236625 - DNA, 25 bp, Mus musculus
atattccttctgaataacgctaaat

SEQ ID NO: 236626 - DNA, 25 bp, Mus musculus
atattccttctgtataacgctaaat

SEQ ID NO: 236627 - DNA, 25 bp, Mus musculus
atattccttggacacttaaaatggg

SEQ ID NO: 236628 - DNA, 25 bp, Mus musculus
atattccttggagacttaaaatggg

SEQ ID NO: 236629 - DNA, 25 bp, Mus musculus
atattccttgggattttgacttttg

SEQ ID NO: 236630 - DNA, 25 bp, Mus musculus
atattccttgggtttttgacttttg

SEQ ID NO: 236631 - DNA, 25 bp, Mus musculus
atattccttggtaatctcctttaga

SEQ ID NO: 236632 - DNA, 25 bp, Mus musculus
atattccttggttatctcctttaga

SEQ ID NO: 236633 - DNA, 25 bp, Mus musculus
atattcctttggatacatgtgagag

SEQ ID NO: 236634 - DNA, 25 bp, Mus musculus
atattcctttggttacatgtgagag

SEQ ID NO: 236635 - DNA, 25 bp, Mus musculus
atattcgaaacgacagctcctgttg

SEQ ID NO: 236636 - DNA, 25 bp, Mus musculus
atattcgaaacgtcagctcctgttg

SEQ ID NO: 236637 - DNA, 25 bp, Mus musculus
atattcgaagctctcgccaaacgtg

SEQ ID NO: 236638 - DNA, 25 bp, Mus musculus
atattcgaagctgtcgccaaacgtg

SEQ ID NO: 236639 - DNA, 25 bp, Mus musculus
atattcgaagttcgccttatgtccg

SEQ ID NO: 236640 - DNA, 25 bp, Mus musculus
atattcgaagttggccttatgtccg

SEQ ID NO: 236641 - DNA, 25 bp, Mus musculus
atattcgagaataaccactggagtt

SEQ ID NO: 236642 - DNA, 25 bp, Mus musculus
atattcgagaattaccactggagtt

SEQ ID NO: 236643 - DNA, 25 bp, Mus musculus
atattcgatatcatctctttccctc

SEQ ID NO: 236644 - DNA, 25 bp, Mus musculus
atattcgatatcttctctttccctc

SEQ ID NO: 236645 - DNA, 25 bp, Mus musculus
atattcgcgggcaaacagctggagg

SEQ ID NO: 236646 - DNA, 25 bp, Mus musculus
atattcgcgggctaacagctggagg

SEQ ID NO: 236647 - DNA, 25 bp, Mus musculus
atattcggaactccggagtctgacc

SEQ ID NO: 236648 - DNA, 25 bp, Mus musculus
atattcggaactgcggagtctgacc

SEQ ID NO: 236649 - DNA, 25 bp, Mus musculus
atattcgggtctctgtgcaggcctg

SEQ ID NO: 236650 - DNA, 25 bp, Mus musculus
atattcgggtctgtgtgcaggcctg

SEQ ID NO: 236651 - DNA, 25 bp, Mus musculus
atattcgggtgaaggctggctccaa

SEQ ID NO: 236652 - DNA, 25 bp, Mus musculus
atattcgggtgatggctggctccaa

SEQ ID NO: 236653 - DNA, 25 bp, Mus musculus
atattcgtataccatgcagctctca

SEQ ID NO: 236654 - DNA, 25 bp, Mus musculus
atattcgtatacgatgcagctctca

SEQ ID NO: 236655 - DNA, 25 bp, Mus musculus
atattcgtcccacatcagcaaccat

SEQ ID NO: 236656 - DNA, 25 bp, Mus musculus
atattcgtcccagatcagcaaccat

SEQ ID NO: 236657 - DNA, 25 bp, Mus musculus
atattcgtcgtcacccttgtctttg

SEQ ID NO: 236658 - DNA, 25 bp, Mus musculus
atattcgtcgtctcccttgtctttg

SEQ ID NO: 236659 - DNA, 25 bp, Mus musculus
atattctaccctacaggtcatgcca

SEQ ID NO: 236660 - DNA, 25 bp, Mus musculus
atattctacccttcaggtcatgcca

SEQ ID NO: 236661 - DNA, 25 bp, Mus musculus
atattctacggcagaagccccgtga

SEQ ID NO: 236662 - DNA, 25 bp, Mus musculus
atattctacggctgaagccccgtga

SEQ ID NO: 236663 - DNA, 25 bp, Mus musculus
atattctagagacgatcccgtttct

SEQ ID NO: 236664 - DNA, 25 bp, Mus musculus
atattctagagaggatcccgtttct

SEQ ID NO: 236665 - DNA, 25 bp, Mus musculus
atattctagccaattgtgtgtgtgt

SEQ ID NO: 236666 - DNA, 25 bp, Mus musculus
atattctagccatttgtgtgtgtgt

SEQ ID NO: 236667 - DNA, 25 bp, Mus musculus
atattctagcgacagatggcccaga

SEQ ID NO: 236668 - DNA, 25 bp, Mus musculus
atattctagcgagagatggcccaga

SEQ ID NO: 236669 - DNA, 25 bp, Mus musculus
atattctatgctctcgttcagtatg

SEQ ID NO: 236670 - DNA, 25 bp, Mus musculus
atattctatgctgtcgttcagtatg

SEQ ID NO: 236671 - DNA, 25 bp, Mus musculus
atattctcaagtaccatccatgtgt

SEQ ID NO: 236672 - DNA, 25 bp, Mus musculus
atattctcaagttccatccatgtgt

SEQ ID NO: 236673 - DNA, 25 bp, Mus musculus
atattctcaggtctgaatcctcatc

SEQ ID NO: 236674 - DNA, 25 bp, Mus musculus
atattctcaggtgtgaatcctcatc

SEQ ID NO: 236675 - DNA, 25 bp, Mus musculus
atattctcagttacaatttctgaca

SEQ ID NO: 236676 - DNA, 25 bp, Mus musculus
atattctcagtttcaatttctgaca

SEQ ID NO: 236677 - DNA, 25 bp, Mus musculus
atattctccagaagcgtctgtctgt

SEQ ID NO: 236678 - DNA, 25 bp, Mus musculus
atattctccagatgcgtctgtctgt

SEQ ID NO: 236679 - DNA, 25 bp, Mus musculus
atattctccctactagcacactgtg

SEQ ID NO: 236680 - DNA, 25 bp, Mus musculus
atattctccctagtagcacactgtg

SEQ ID NO: 236681 - DNA, 25 bp, Mus musculus
atattctccctgagcatatgtgcca

SEQ ID NO: 236682 - DNA, 25 bp, Mus musculus
atattctccctgtgcatatgtgcca

SEQ ID NO: 236683 - DNA, 25 bp, Mus musculus
atattctctataattgggaggtgga

SEQ ID NO: 236684 - DNA, 25 bp, Mus musculus
atattctctatatttgggaggtgga

SEQ ID NO: 236685 - DNA, 25 bp, Mus musculus
atattctctctactgagtcctctac

SEQ ID NO: 236686 - DNA, 25 bp, Mus musculus
atattctctctagtgagtcctctac

SEQ ID NO: 236687 - DNA, 25 bp, Mus musculus
atattctcttatactctataccacc

SEQ ID NO: 236688 - DNA, 25 bp, Mus musculus
atattctcttattctctataccacc

SEQ ID NO: 236689 - DNA, 25 bp, Mus musculus
atattctcttgaacatggcggcctg

SEQ ID NO: 236690 - DNA, 25 bp, Mus musculus
atattctcttgatcatggcggcctg

SEQ ID NO: 236691 - DNA, 25 bp, Mus musculus
atattctctttacaaagggcctctc

SEQ ID NO: 236692 - DNA, 25 bp, Mus musculus
atattctctttagaaagggcctctc

SEQ ID NO: 236693 - DNA, 25 bp, Mus musculus
atattctgaagacctgattctgctt

SEQ ID NO: 236694 - DNA, 25 bp, Mus musculus
atattctgaagagctgattctgctt

SEQ ID NO: 236695 - DNA, 25 bp, Mus musculus
atattctgattaaggctaccatcat

SEQ ID NO: 236696 - DNA, 25 bp, Mus musculus
atattctgattatggctaccatcat

SEQ ID NO: 236697 - DNA, 25 bp, Mus musculus
atattctgcactctctaatgttcgt

SEQ ID NO: 236698 - DNA, 25 bp, Mus musculus
atattctgcactgtctaatgttcgt

SEQ ID NO: 236699 - DNA, 25 bp, Mus musculus
atattctgcagcctttcttaagagc

SEQ ID NO: 236700 - DNA, 25 bp, Mus musculus
atattctgcagcgtttcttaagagc

SEQ ID NO: 236701 - DNA, 25 bp, Mus musculus
atattctgcgcaatgtcactactgt

SEQ ID NO: 236702 - DNA, 25 bp, Mus musculus
atattctgcgcattgtcactactgt

SEQ ID NO: 236703 - DNA, 25 bp, Mus musculus
atattctggacaatgaacgcttaca

SEQ ID NO: 236704 - DNA, 25 bp, Mus musculus
atattctggacattgaacgcttaca

SEQ ID NO: 236705 - DNA, 25 bp, Mus musculus
atattctgggacaggcaactgggtc

SEQ ID NO: 236706 - DNA, 25 bp, Mus musculus
atattctgggactggcaactgggtc

SEQ ID NO: 236707 - DNA, 25 bp, Mus musculus
atattctggtaactgtgccctgtac

SEQ ID NO: 236708 - DNA, 25 bp, Mus musculus
atattctggtaagtgtgccctgtac

SEQ ID NO: 236709 - DNA, 25 bp, Mus musculus
atattctggtatacagcctgctggc

SEQ ID NO: 236710 - DNA, 25 bp, Mus musculus
atattctggtattcagcctgctggc

SEQ ID NO: 236711 - DNA, 25 bp, Mus musculus
atattctgtaccaggagtccgtttg

SEQ ID NO: 236712 - DNA, 25 bp, Mus musculus
atattctgtacctggagtccgtttg

SEQ ID NO: 236713 - DNA, 25 bp, Mus musculus
atattctgtgtcagtttgcactcga

SEQ ID NO: 236714 - DNA, 25 bp, Mus musculus
atattctgtgtctgtttgcactcga

SEQ ID NO: 236715 - DNA, 25 bp, Mus musculus
atattctgttctcattgagcacccc

SEQ ID NO: 236716 - DNA, 25 bp, Mus musculus
atattctgttctgattgagcacccc

SEQ ID NO: 236717 - DNA, 25 bp, Mus musculus
atattcttcaaccccatactctaaa

SEQ ID NO: 236718 - DNA, 25 bp, Mus musculus
atattcttcaacgccatactctaaa

SEQ ID NO: 236719 - DNA, 25 bp, Mus musculus
atattcttcatcagttggtttgtta

SEQ ID NO: 236720 - DNA, 25 bp, Mus musculus
atattcttcatctgttggtttgtta

SEQ ID NO: 236721 - DNA, 25 bp, Mus musculus
atattcttctaaccttatttccatc

SEQ ID NO: 236722 - DNA, 25 bp, Mus musculus
atattcttctaagcttatttccatc

SEQ ID NO: 236723 - DNA, 25 bp, Mus musculus
atattcttctacatggctgcgttct

SEQ ID NO: 236724 - DNA, 25 bp, Mus musculus
atattcttctacttggctgcgttct

SEQ ID NO: 236725 - DNA, 25 bp, Mus musculus
atattcttctcacgctgcagacttg

SEQ ID NO: 236726 - DNA, 25 bp, Mus musculus
atattcttctcaggctgcagacttg

SEQ ID NO: 236727 - DNA, 25 bp, Mus musculus
atattcttgaatcgatagcttttgt

SEQ ID NO: 236728 - DNA, 25 bp, Mus musculus
atattcttgaatctactgtgatgtc

SEQ ID NO: 236729 - DNA, 25 bp, Mus musculus
atattcttgaatggatagcttttgt

SEQ ID NO: 236730 - DNA, 25 bp, Mus musculus
atattcttgaatgtactgtgatgtc

SEQ ID NO: 236731 - DNA, 25 bp, Mus musculus
atattcttgcaccttttgcacaccc

SEQ ID NO: 236732 - DNA, 25 bp, Mus musculus
atattcttgcacgttttgcacaccc

SEQ ID NO: 236733 - DNA, 25 bp, Mus musculus
atattcttgcttcctgtggcagcta

SEQ ID NO: 236734 - DNA, 25 bp, Mus musculus
atattcttgcttgctgtggcagcta

SEQ ID NO: 236735 - DNA, 25 bp, Mus musculus
atattcttgtccaagtcaatcagag

SEQ ID NO: 236736 - DNA, 25 bp, Mus musculus
atattcttgtcctagtcaatcagag

SEQ ID NO: 236737 - DNA, 25 bp, Mus musculus
atattcttgttgcatgtgtcctcgg

SEQ ID NO: 236738 - DNA, 25 bp, Mus musculus
atattcttgttggatgtgtcctcgg

SEQ ID NO: 236739 - DNA, 25 bp, Mus musculus
atattctttaagatgatgtcataat

SEQ ID NO: 236740 - DNA, 25 bp, Mus musculus
atattctttaagttgatgtcataat

SEQ ID NO: 236741 - DNA, 25 bp, Mus musculus
atattctttatcataccacttttgt

SEQ ID NO: 236742 - DNA, 25 bp, Mus musculus
atattctttatcttaccacttttgt

SEQ ID NO: 236743 - DNA, 25 bp, Mus musculus
atattctttatgcagttattttcta

SEQ ID NO: 236744 - DNA, 25 bp, Mus musculus
atattctttatggagttattttcta

SEQ ID NO: 236745 - DNA, 25 bp, Mus musculus
atattctttgcaatgtttcaggtag

SEQ ID NO: 236746 - DNA, 25 bp, Mus musculus
atattctttgcattgtttcaggtag

SEQ ID NO: 236747 - DNA, 25 bp, Mus musculus
atattctttgccagctggttgatga

SEQ ID NO: 236748 - DNA, 25 bp, Mus musculus
atattctttgcctgctggttgatga

SEQ ID NO: 236749 - DNA, 25 bp, Mus musculus
atattctttggcatatcttgtagac

SEQ ID NO: 236750 - DNA, 25 bp, Mus musculus
atattctttggcttatcttgtagac

SEQ ID NO: 236751 - DNA, 25 bp, Mus musculus
atattctttttcaacctgactttca

SEQ ID NO: 236752 - DNA, 25 bp, Mus musculus
atattctttttctacctgactttca

SEQ ID NO: 236753 - DNA, 25 bp, Mus musculus
atattgaaactcaggatttgtgaca

SEQ ID NO: 236754 - DNA, 25 bp, Mus musculus
atattgaaactctggatttgtgaca

SEQ ID NO: 236755 - DNA, 25 bp, Mus musculus
atattgaaatctccatgccacacac

SEQ ID NO: 236756 - DNA, 25 bp, Mus musculus
atattgaaatctgcatgccacacac

SEQ ID NO: 236757 - DNA, 25 bp, Mus musculus
atattgaagcatcctccccagactc

SEQ ID NO: 236758 - DNA, 25 bp, Mus musculus
atattgaagcatgctccccagactc

SEQ ID NO: 236759 - DNA, 25 bp, Mus musculus
atattgaattgtaactctctagcag

SEQ ID NO: 236760 - DNA, 25 bp, Mus musculus
atattgaattgttactctctagcag

SEQ ID NO: 236761 - DNA, 25 bp, Mus musculus
atattgaattttcccgccccaatgt

SEQ ID NO: 236762 - DNA, 25 bp, Mus musculus
atattgaattttgccgccccaatgt

SEQ ID NO: 236763 - DNA, 25 bp, Mus musculus
atattgacaaggcttcttgtgggcc

SEQ ID NO: 236764 - DNA, 25 bp, Mus musculus
atattgacaagggttcttgtgggcc

SEQ ID NO: 236765 - DNA, 25 bp, Mus musculus
atattgacatcccacagtcctgtat

SEQ ID NO: 236766 - DNA, 25 bp, Mus musculus
atattgacatccgacagtcctgtat

SEQ ID NO: 236767 - DNA, 25 bp, Mus musculus
atattgaccaagaccatctgtgccc

SEQ ID NO: 236768 - DNA, 25 bp, Mus musculus
atattgaccaagtccatctgtgccc

SEQ ID NO: 236769 - DNA, 25 bp, Mus musculus
atattgaccaggaggcatccttggc

SEQ ID NO: 236770 - DNA, 25 bp, Mus musculus
atattgaccaggtggcatccttggc

SEQ ID NO: 236771 - DNA, 25 bp, Mus musculus
atattgaccttgatatttcttttct

SEQ ID NO: 236772 - DNA, 25 bp, Mus musculus
atattgaccttgttatttcttttct

SEQ ID NO: 236773 - DNA, 25 bp, Mus musculus
atattgactgatctgtgcccgtcca

SEQ ID NO: 236774 - DNA, 25 bp, Mus musculus
atattgactgatgtgtgcccgtcca

SEQ ID NO: 236775 - DNA, 25 bp, Mus musculus
atattgagacttaagggtatgacca

SEQ ID NO: 236776 - DNA, 25 bp, Mus musculus
atattgagactttagggtatgacca

SEQ ID NO: 236777 - DNA, 25 bp, Mus musculus
atattgagccaaaactagtccagtt

SEQ ID NO: 236778 - DNA, 25 bp, Mus musculus
atattgagccaatactagtccagtt

SEQ ID NO: 236779 - DNA, 25 bp, Mus musculus
atattgagcttgatgttacctgtcg

SEQ ID NO: 236780 - DNA, 25 bp, Mus musculus
atattgagcttgttgttacctgtcg

SEQ ID NO: 236781 - DNA, 25 bp, Mus musculus
atattgagtgacctaacccagctat

SEQ ID NO: 236782 - DNA, 25 bp, Mus musculus
atattgagtgacgtaacccagctat

SEQ ID NO: 236783 - DNA, 25 bp, Mus musculus
atattgatatctacgctgacttaac

SEQ ID NO: 236784 - DNA, 25 bp, Mus musculus
atattgatatcttcgctgacttaac

SEQ ID NO: 236785 - DNA, 25 bp, Mus musculus
atattgatccctagtgagtacccca

SEQ ID NO: 236786 - DNA, 25 bp, Mus musculus
atattgatccctcatcctatttccc

SEQ ID NO: 236787 - DNA, 25 bp, Mus musculus
atattgatccctgatcctatttccc

SEQ ID NO: 236788 - DNA, 25 bp, Mus musculus
atattgatcccttgtgagtacccca

SEQ ID NO: 236789 - DNA, 25 bp, Mus musculus
atattgatccttacaatggtgatac

SEQ ID NO: 236790 - DNA, 25 bp, Mus musculus
atattgatcctttcaatggtgatac

SEQ ID NO: 236791 - DNA, 25 bp, Mus musculus
atattgatctctatccttttgtctc

SEQ ID NO: 236792 - DNA, 25 bp, Mus musculus
atattgatctctttccttttgtctc

SEQ ID NO: 236793 - DNA, 25 bp, Mus musculus
atattgatgcctcattgcctctggt

SEQ ID NO: 236794 - DNA, 25 bp, Mus musculus
atattgatgcctgattgcctctggt

SEQ ID NO: 236795 - DNA, 25 bp, Mus musculus
atattgatggcccttcctcaagttg

SEQ ID NO: 236796 - DNA, 25 bp, Mus musculus
atattgatggccgttcctcaagttg

SEQ ID NO: 236797 - DNA, 25 bp, Mus musculus
atattgatggtaactgaacttaatt

SEQ ID NO: 236798 - DNA, 25 bp, Mus musculus
atattgatggtatctgaacttaatt

SEQ ID NO: 236799 - DNA, 25 bp, Mus musculus
atattgatgtgtctggagaacagct

SEQ ID NO: 236800 - DNA, 25 bp, Mus musculus
atattgatgtgtgtggagaacagct

SEQ ID NO: 236801 - DNA, 25 bp, Mus musculus
atattgattacacatccagacccgc

SEQ ID NO: 236802 - DNA, 25 bp, Mus musculus
atattgattacagatccagacccgc

SEQ ID NO: 236803 - DNA, 25 bp, Mus musculus
atattgattcgaagcctggagaggg

SEQ ID NO: 236804 - DNA, 25 bp, Mus musculus
atattgattcgatgcctggagaggg

SEQ ID NO: 236805 - DNA, 25 bp, Mus musculus
atattgatttccagcatcagtaagc

SEQ ID NO: 236806 - DNA, 25 bp, Mus musculus
atattgatttccatccattcctaag

SEQ ID NO: 236807 - DNA, 25 bp, Mus musculus
atattgatttcctgcatcagtaagc

SEQ ID NO: 236808 - DNA, 25 bp, Mus musculus
atattgatttccttccattcctaag

SEQ ID NO: 236809 - DNA, 25 bp, Mus musculus
atattgcaactgcttcaggctacct

SEQ ID NO: 236810 - DNA, 25 bp, Mus musculus
atattgcaactggttcaggctacct

SEQ ID NO: 236811 - DNA, 25 bp, Mus musculus
atattgcaattgctcttgcccaaag

SEQ ID NO: 236812 - DNA, 25 bp, Mus musculus
atattgcaattggtcttgcccaaag

SEQ ID NO: 236813 - DNA, 25 bp, Mus musculus
atattgcacattatcctggcccatt

SEQ ID NO: 236814 - DNA, 25 bp, Mus musculus
atattgcacattttcctggcccatt

SEQ ID NO: 236815 - DNA, 25 bp, Mus musculus
atattgcaccatccatgttttaggc

SEQ ID NO: 236816 - DNA, 25 bp, Mus musculus
atattgcaccatgcatgttttaggc

SEQ ID NO: 236817 - DNA, 25 bp, Mus musculus
atattgcagttcatgtcgatgacct

SEQ ID NO: 236818 - DNA, 25 bp, Mus musculus
atattgcagttcttgtcgatgacct

SEQ ID NO: 236819 - DNA, 25 bp, Mus musculus
atattgcatgcaacccttcatttaa

SEQ ID NO: 236820 - DNA, 25 bp, Mus musculus
atattgcatgcatcccttcatttaa

SEQ ID NO: 236821 - DNA, 25 bp, Mus musculus
atattgccaactccaaccttgtacc

SEQ ID NO: 236822 - DNA, 25 bp, Mus musculus
atattgccaactgcaaccttgtacc

SEQ ID NO: 236823 - DNA, 25 bp, Mus musculus
atattgccaagtaactgttcactgc

SEQ ID NO: 236824 - DNA, 25 bp, Mus musculus
atattgccaagttactgttcactgc

SEQ ID NO: 236825 - DNA, 25 bp, Mus musculus
atattgccactgagcttggttgtac

SEQ ID NO: 236826 - DNA, 25 bp, Mus musculus
atattgccactgtgcttggttgtac

SEQ ID NO: 236827 - DNA, 25 bp, Mus musculus
atattgccagttaccaagtgatact

SEQ ID NO: 236828 - DNA, 25 bp, Mus musculus
atattgccagtttccaagtgatact

SEQ ID NO: 236829 - DNA, 25 bp, Mus musculus
atattgccatgaacccactttgata

SEQ ID NO: 236830 - DNA, 25 bp, Mus musculus
atattgccatgatcccactttgata

SEQ ID NO: 236831 - DNA, 25 bp, Mus musculus
atattgcccaacataatgctgtggt

SEQ ID NO: 236832 - DNA, 25 bp, Mus musculus
atattgcccaacttaatgctgtggt

SEQ ID NO: 236833 - DNA, 25 bp, Mus musculus
atattgcccattatcacggaggact

SEQ ID NO: 236834 - DNA, 25 bp, Mus musculus
atattgcccattttcacggaggact

SEQ ID NO: 236835 - DNA, 25 bp, Mus musculus
atattgcccctgcaagtgcgtttag

SEQ ID NO: 236836 - DNA, 25 bp, Mus musculus
atattgcccctggaagtgcgtttag

SEQ ID NO: 236837 - DNA, 25 bp, Mus musculus
atattgccctgtcactccagtatat

SEQ ID NO: 236838 - DNA, 25 bp, Mus musculus
atattgccctgtgactccagtatat

SEQ ID NO: 236839 - DNA, 25 bp, Mus musculus
atattgccggcaagggtagtgtaca

SEQ ID NO: 236840 - DNA, 25 bp, Mus musculus
atattgccggcatgggtagtgtaca

SEQ ID NO: 236841 - DNA, 25 bp, Mus musculus
atattgcctgggacatcgtggccat

SEQ ID NO: 236842 - DNA, 25 bp, Mus musculus
atattgcctgggtcatcgtggccat

SEQ ID NO: 236843 - DNA, 25 bp, Mus musculus
atattgcgatacagactagactagc

SEQ ID NO: 236844 - DNA, 25 bp, Mus musculus
atattgcgatactgactagactagc

SEQ ID NO: 236845 - DNA, 25 bp, Mus musculus
atattgcgcacgctttcgtgttcac

SEQ ID NO: 236846 - DNA, 25 bp, Mus musculus
atattgcgcacggtttcgtgttcac

SEQ ID NO: 236847 - DNA, 25 bp, Mus musculus
atattgcgcctgcaggatttaaggt

SEQ ID NO: 236848 - DNA, 25 bp, Mus musculus
atattgcgcctggaggatttaaggt

SEQ ID NO: 236849 - DNA, 25 bp, Mus musculus
atattgcgctatccttgcagcctag

SEQ ID NO: 236850 - DNA, 25 bp, Mus musculus
atattgcgctatgcttgcagcctag

SEQ ID NO: 236851 - DNA, 25 bp, Mus musculus
atattgctacataggcctgctaatc

SEQ ID NO: 236852 - DNA, 25 bp, Mus musculus
atattgctacattggcctgctaatc

SEQ ID NO: 236853 - DNA, 25 bp, Mus musculus
atattgctacgcctccgaggtcagg

SEQ ID NO: 236854 - DNA, 25 bp, Mus musculus
atattgctacgcgtccgaggtcagg

SEQ ID NO: 236855 - DNA, 25 bp, Mus musculus
atattgctaggaagctggacattac

SEQ ID NO: 236856 - DNA, 25 bp, Mus musculus
atattgctaggatgctggacattac

SEQ ID NO: 236857 - DNA, 25 bp, Mus musculus
atattgctcaggatgtttcagacag

SEQ ID NO: 236858 - DNA, 25 bp, Mus musculus
atattgctcaggctggcttcggact

SEQ ID NO: 236859 - DNA, 25 bp, Mus musculus
atattgctcagggtggcttcggact

SEQ ID NO: 236860 - DNA, 25 bp, Mus musculus
atattgctcaggttgtttcagacag

SEQ ID NO: 236861 - DNA, 25 bp, Mus musculus
atattgctctcacccattacagttg

SEQ ID NO: 236862 - DNA, 25 bp, Mus musculus
atattgctctcagccattacagttg

SEQ ID NO: 236863 - DNA, 25 bp, Mus musculus
atattgctctgtcactattgttttg

SEQ ID NO: 236864 - DNA, 25 bp, Mus musculus
atattgctctgtgactattgttttg

SEQ ID NO: 236865 - DNA, 25 bp, Mus musculus
atattgctgaccagcccttttgagt

SEQ ID NO: 236866 - DNA, 25 bp, Mus musculus
atattgctgacctgcccttttgagt

SEQ ID NO: 236867 - DNA, 25 bp, Mus musculus
atattgctgatcacggagggtcttc

SEQ ID NO: 236868 - DNA, 25 bp, Mus musculus
atattgctgatctcggagggtcttc

SEQ ID NO: 236869 - DNA, 25 bp, Mus musculus
atattgctgcctacagagctaaagg

SEQ ID NO: 236870 - DNA, 25 bp, Mus musculus
atattgctgccttcagagctaaagg

SEQ ID NO: 236871 - DNA, 25 bp, Mus musculus
atattgctgctacgatccagaaata

SEQ ID NO: 236872 - DNA, 25 bp, Mus musculus
atattgctgctaggatccagaaata

SEQ ID NO: 236873 - DNA, 25 bp, Mus musculus
atattgcttcccatagtgcaggaga

SEQ ID NO: 236874 - DNA, 25 bp, Mus musculus
atattgcttcccttagtgcaggaga

SEQ ID NO: 236875 - DNA, 25 bp, Mus musculus
atattgcttctaaaaatgcttccca

SEQ ID NO: 236876 - DNA, 25 bp, Mus musculus
atattgcttctataaatgcttccca

SEQ ID NO: 236877 - DNA, 25 bp, Mus musculus
atattgcttctcctgcatggcgaaa

SEQ ID NO: 236878 - DNA, 25 bp, Mus musculus
atattgcttctcgtgcatggcgaaa

SEQ ID NO: 236879 - DNA, 25 bp, Mus musculus
atattgcttcttaccactgatgata

SEQ ID NO: 236880 - DNA, 25 bp, Mus musculus
atattgcttctttccactgatgata

SEQ ID NO: 236881 - DNA, 25 bp, Mus musculus
atattgcttgcactgttccacagca

SEQ ID NO: 236882 - DNA, 25 bp, Mus musculus
atattgcttgcagtgttccacagca

SEQ ID NO: 236883 - DNA, 25 bp, Mus musculus
atattgcttgtaatcctgtcacaga

SEQ ID NO: 236884 - DNA, 25 bp, Mus musculus
atattgcttgtattcctgtcacaga

SEQ ID NO: 236885 - DNA, 25 bp, Mus musculus
atattggacaaaatggctggcttca

SEQ ID NO: 236886 - DNA, 25 bp, Mus musculus
atattggacaaattggctggcttca

SEQ ID NO: 236887 - DNA, 25 bp, Mus musculus
atattggacatcagagctgggcccc

SEQ ID NO: 236888 - DNA, 25 bp, Mus musculus
atattggacatctgagctgggcccc

SEQ ID NO: 236889 - DNA, 25 bp, Mus musculus
atattggaccctcagcgcgtttaag

SEQ ID NO: 236890 - DNA, 25 bp, Mus musculus
atattggaccctgagcgcgtttaag

SEQ ID NO: 236891 - DNA, 25 bp, Mus musculus
atattggagctgagagcgatggcac

SEQ ID NO: 236892 - DNA, 25 bp, Mus musculus
atattggagctgatcctcgaagcca

SEQ ID NO: 236893 - DNA, 25 bp, Mus musculus
atattggagctgtgagcgatggcac

SEQ ID NO: 236894 - DNA, 25 bp, Mus musculus
atattggagctgttcctcgaagcca

SEQ ID NO: 236895 - DNA, 25 bp, Mus musculus
atattggcacataacttgctagaga

SEQ ID NO: 236896 - DNA, 25 bp, Mus musculus
atattggcacattacttgctagaga

SEQ ID NO: 236897 - DNA, 25 bp, Mus musculus
atattggcatgcagtgtcttcagag

SEQ ID NO: 236898 - DNA, 25 bp, Mus musculus
atattggcatgctgtgtcttcagag

SEQ ID NO: 236899 - DNA, 25 bp, Mus musculus
atattggcattgagacagtaaattc

SEQ ID NO: 236900 - DNA, 25 bp, Mus musculus
atattggcattgtgacagtaaattc

SEQ ID NO: 236901 - DNA, 25 bp, Mus musculus
atattggcccacagacacaacgtgt

SEQ ID NO: 236902 - DNA, 25 bp, Mus musculus
atattggcccactgacacaacgtgt

SEQ ID NO: 236903 - DNA, 25 bp, Mus musculus
atattggccccacaaggagcacttc

SEQ ID NO: 236904 - DNA, 25 bp, Mus musculus
atattggccccagaaggagcacttc

SEQ ID NO: 236905 - DNA, 25 bp, Mus musculus
atattggctcatatgctttttggct

SEQ ID NO: 236906 - DNA, 25 bp, Mus musculus
atattggctcatttgctttttggct

SEQ ID NO: 236907 - DNA, 25 bp, Mus musculus
atattggctcttcttttcctggcac

SEQ ID NO: 236908 - DNA, 25 bp, Mus musculus
atattggctcttgttttcctggcac

SEQ ID NO: 236909 - DNA, 25 bp, Mus musculus
atattgggactactgccacaccctc

SEQ ID NO: 236910 - DNA, 25 bp, Mus musculus
atattgggactagtgccacaccctc

SEQ ID NO: 236911 - DNA, 25 bp, Mus musculus
atattgggcagtactctgtggtgaa

SEQ ID NO: 236912 - DNA, 25 bp, Mus musculus
atattgggcagttctctgtggtgaa

SEQ ID NO: 236913 - DNA, 25 bp, Mus musculus
atattgggcttgaaatttcagtaat

SEQ ID NO: 236914 - DNA, 25 bp, Mus musculus
atattgggcttgtaatttcagtaat

SEQ ID NO: 236915 - DNA, 25 bp, Mus musculus
atattgggtcagcaccaggagccct

SEQ ID NO: 236916 - DNA, 25 bp, Mus musculus
atattgggtcaggaccaggagccct

SEQ ID NO: 236917 - DNA, 25 bp, Mus musculus
atattgggtcccctggagttggaat

SEQ ID NO: 236918 - DNA, 25 bp, Mus musculus
atattgggtcccgtggagttggaat

SEQ ID NO: 236919 - DNA, 25 bp, Mus musculus
atattgggtctcatgtaacaacact

SEQ ID NO: 236920 - DNA, 25 bp, Mus musculus
atattgggtctcttgtaacaacact

SEQ ID NO: 236921 - DNA, 25 bp, Mus musculus
atattggtacaaaatcccaaatgtt

SEQ ID NO: 236922 - DNA, 25 bp, Mus musculus
atattggtacaatatcccaaatgtt

SEQ ID NO: 236923 - DNA, 25 bp, Mus musculus
atattggtatccaccatgcagatat

SEQ ID NO: 236924 - DNA, 25 bp, Mus musculus
atattggtatcctccatgcagatat

SEQ ID NO: 236925 - DNA, 25 bp, Mus musculus
atattggtccttacagtctggtaca

SEQ ID NO: 236926 - DNA, 25 bp, Mus musculus
atattggtcctttcagtctggtaca

SEQ ID NO: 236927 - DNA, 25 bp, Mus musculus
atattggtgcacacactctggcaag

SEQ ID NO: 236928 - DNA, 25 bp, Mus musculus
atattggtgcactcactctggcaag

SEQ ID NO: 236929 - DNA, 25 bp, Mus musculus
atattggtttggatcacttctctga

SEQ ID NO: 236930 - DNA, 25 bp, Mus musculus
atattggtttggttcacttctctga

SEQ ID NO: 236931 - DNA, 25 bp, Mus musculus
atattgtaagccctgaacatgttta

SEQ ID NO: 236932 - DNA, 25 bp, Mus musculus
atattgtaagccgtgaacatgttta

SEQ ID NO: 236933 - DNA, 25 bp, Mus musculus
atattgtactgacgtgcctgccctg

SEQ ID NO: 236934 - DNA, 25 bp, Mus musculus
atattgtactgaggtgcctgccctg

SEQ ID NO: 236935 - DNA, 25 bp, Mus musculus
atattgtatcccacagttgtctggt

SEQ ID NO: 236936 - DNA, 25 bp, Mus musculus
atattgtatccctcagttgtctggt

SEQ ID NO: 236937 - DNA, 25 bp, Mus musculus
atattgtatcttatgggttcaccac

SEQ ID NO: 236938 - DNA, 25 bp, Mus musculus
atattgtatcttttgggttcaccac

SEQ ID NO: 236939 - DNA, 25 bp, Mus musculus
atattgtattatcccttgaagtttt

SEQ ID NO: 236940 - DNA, 25 bp, Mus musculus
atattgtattatgccttgaagtttt

SEQ ID NO: 236941 - DNA, 25 bp, Mus musculus
atattgtcacccaaggtgggctgtc

SEQ ID NO: 236942 - DNA, 25 bp, Mus musculus
atattgtcaccctaggtgggctgtc

SEQ ID NO: 236943 - DNA, 25 bp, Mus musculus
atattgtcactaaacactgcgttga

SEQ ID NO: 236944 - DNA, 25 bp, Mus musculus
atattgtcactacatccaggcagat

SEQ ID NO: 236945 - DNA, 25 bp, Mus musculus
atattgtcactagatccaggcagat

SEQ ID NO: 236946 - DNA, 25 bp, Mus musculus
atattgtcactatacactgcgttga

SEQ ID NO: 236947 - DNA, 25 bp, Mus musculus
atattgtcatatccagcgcaccctg

SEQ ID NO: 236948 - DNA, 25 bp, Mus musculus
atattgtcatatgcagcgcaccctg

SEQ ID NO: 236949 - DNA, 25 bp, Mus musculus
atattgtcccttaggagatccctgg

SEQ ID NO: 236950 - DNA, 25 bp, Mus musculus
atattgtccctttggagatccctgg

SEQ ID NO: 236951 - DNA, 25 bp, Mus musculus
atattgtctgctcttagtctcttac

SEQ ID NO: 236952 - DNA, 25 bp, Mus musculus
atattgtctgctgttagtctcttac

SEQ ID NO: 236953 - DNA, 25 bp, Mus musculus
atattgtcttggaatctgagttgaa

SEQ ID NO: 236954 - DNA, 25 bp, Mus musculus
atattgtcttggtatctgagttgaa

SEQ ID NO: 236955 - DNA, 25 bp, Mus musculus
atattgtgcataactccaggttaca

SEQ ID NO: 236956 - DNA, 25 bp, Mus musculus
atattgtgcatatctccaggttaca

SEQ ID NO: 236957 - DNA, 25 bp, Mus musculus
atattgtgcattcctttcatatgtt

SEQ ID NO: 236958 - DNA, 25 bp, Mus musculus
atattgtgcattgctttcatatgtt

SEQ ID NO: 236959 - DNA, 25 bp, Mus musculus
atattgtgccaaaaagccttgtaat

SEQ ID NO: 236960 - DNA, 25 bp, Mus musculus
atattgtgccaataagccttgtaat

SEQ ID NO: 236961 - DNA, 25 bp, Mus musculus
atattgtgccaccatggggcattcc

SEQ ID NO: 236962 - DNA, 25 bp, Mus musculus
atattgtgccacgatggggcattcc

SEQ ID NO: 236963 - DNA, 25 bp, Mus musculus
atattgtgcccaagattacggtgga

SEQ ID NO: 236964 - DNA, 25 bp, Mus musculus
atattgtgcccatgattacggtgga

SEQ ID NO: 236965 - DNA, 25 bp, Mus musculus
atattgtggactaggtttcctgttt

SEQ ID NO: 236966 - DNA, 25 bp, Mus musculus
atattgtggacttggtttcctgttt

SEQ ID NO: 236967 - DNA, 25 bp, Mus musculus
atattgtggataatgcctctcgttt

SEQ ID NO: 236968 - DNA, 25 bp, Mus musculus
atattgtggatacaccaaggcagca

SEQ ID NO: 236969 - DNA, 25 bp, Mus musculus
atattgtggatagaccaaggcagca

SEQ ID NO: 236970 - DNA, 25 bp, Mus musculus
atattgtggatattgcctctcgttt

SEQ ID NO: 236971 - DNA, 25 bp, Mus musculus
atattgtggccgacgtgcagagcag

SEQ ID NO: 236972 - DNA, 25 bp, Mus musculus
atattgtggccgtcgtgcagagcag

SEQ ID NO: 236973 - DNA, 25 bp, Mus musculus
atattgtggctcctcgctgctgctt

SEQ ID NO: 236974 - DNA, 25 bp, Mus musculus
atattgtggctcgtcgctgctgctt

SEQ ID NO: 236975 - DNA, 25 bp, Mus musculus
atattgtggtgtctggctttgctgc

SEQ ID NO: 236976 - DNA, 25 bp, Mus musculus
atattgtggtgtgtggctttgctgc

SEQ ID NO: 236977 - DNA, 25 bp, Mus musculus
atattgtgtaatagcctgagtctaa

SEQ ID NO: 236978 - DNA, 25 bp, Mus musculus
atattgtgtaattgcctgagtctaa

SEQ ID NO: 236979 - DNA, 25 bp, Mus musculus
atattgtgtacccaggttcgctctt

SEQ ID NO: 236980 - DNA, 25 bp, Mus musculus
atattgtgtaccgaggttcgctctt

SEQ ID NO: 236981 - DNA, 25 bp, Mus musculus
atattgtgtgtaatgtaacgtatgt

SEQ ID NO: 236982 - DNA, 25 bp, Mus musculus
atattgtgtgtattgtaacgtatgt

SEQ ID NO: 236983 - DNA, 25 bp, Mus musculus
atattgttaacactcaggttcacct

SEQ ID NO: 236984 - DNA, 25 bp, Mus musculus
atattgttaacagtcaggttcacct

SEQ ID NO: 236985 - DNA, 25 bp, Mus musculus
atattgttacatatccttgtacaga

SEQ ID NO: 236986 - DNA, 25 bp, Mus musculus
atattgttacatttccttgtacaga

SEQ ID NO: 236987 - DNA, 25 bp, Mus musculus
atattgttatatagcgtcccctgtc

SEQ ID NO: 236988 - DNA, 25 bp, Mus musculus
atattgttatattgcgtcccctgtc

SEQ ID NO: 236989 - DNA, 25 bp, Mus musculus
atattgttcctcaatctggctcaca

SEQ ID NO: 236990 - DNA, 25 bp, Mus musculus
atattgttcctctatctggctcaca

SEQ ID NO: 236991 - DNA, 25 bp, Mus musculus
atattgttctccagactgggtggta

SEQ ID NO: 236992 - DNA, 25 bp, Mus musculus
atattgttctcctgactgggtggta

SEQ ID NO: 236993 - DNA, 25 bp, Mus musculus
atattgttgctaatgcgtgtcgggt

SEQ ID NO: 236994 - DNA, 25 bp, Mus musculus
atattgttgctattgcgtgtcgggt

SEQ ID NO: 236995 - DNA, 25 bp, Mus musculus
atattgttgtggcttcacacttaaa

SEQ ID NO: 236996 - DNA, 25 bp, Mus musculus
atattgttgtgggttcacacttaaa

SEQ ID NO: 236997 - DNA, 25 bp, Mus musculus
atattgttttaaagcaccatgttgc

SEQ ID NO: 236998 - DNA, 25 bp, Mus musculus
atattgttttaatgcaccatgttgc

SEQ ID NO: 236999 - DNA, 25 bp, Mus musculus
atatttaaactaccacagttgagtt

SEQ ID NO: 237000 - DNA, 25 bp, Mus musculus
atatttaaactagcacagttgagtt

SEQ ID NO: 237001 - DNA, 25 bp, Mus musculus
atatttaagcctacttcttgatctt

SEQ ID NO: 237002 - DNA, 25 bp, Mus musculus
atatttaagccttcttcttgatctt

SEQ ID NO: 237003 - DNA, 25 bp, Mus musculus
atatttaagtggagctcttgcctcc

SEQ ID NO: 237004 - DNA, 25 bp, Mus musculus
atatttaagtggtgctcttgcctcc

SEQ ID NO: 237005 - DNA, 25 bp, Mus musculus
atatttaatagacctcaccaaggca

SEQ ID NO: 237006 - DNA, 25 bp, Mus musculus
atatttaatagagctcaccaaggca

SEQ ID NO: 237007 - DNA, 25 bp, Mus musculus
atatttaatctgctacacactggta

SEQ ID NO: 237008 - DNA, 25 bp, Mus musculus
atatttaatctggtacacactggta

SEQ ID NO: 237009 - DNA, 25 bp, Mus musculus
atatttaattatagttctctgacaa

SEQ ID NO: 237010 - DNA, 25 bp, Mus musculus
atatttaattattgttctctgacaa

SEQ ID NO: 237011 - DNA, 25 bp, Mus musculus
atatttaatttcagcccagtttcgt

SEQ ID NO: 237012 - DNA, 25 bp, Mus musculus
atatttaatttctgcccagtttcgt

SEQ ID NO: 237013 - DNA, 25 bp, Mus musculus
atatttaattttctcccttgctctc

SEQ ID NO: 237014 - DNA, 25 bp, Mus musculus
atatttaattttgtcccttgctctc

SEQ ID NO: 237015 - DNA, 25 bp, Mus musculus
atatttacaaaaactctgaggccac

SEQ ID NO: 237016 - DNA, 25 bp, Mus musculus
atatttacaaaatctctgaggccac

SEQ ID NO: 237017 - DNA, 25 bp, Mus musculus
atatttacatacaacctgcatctaa

SEQ ID NO: 237018 - DNA, 25 bp, Mus musculus
atatttacatactacctgcatctaa

SEQ ID NO: 237019 - DNA, 25 bp, Mus musculus
atatttacatctatgctttagcagt

SEQ ID NO: 237020 - DNA, 25 bp, Mus musculus
atatttacatctttgctttagcagt

SEQ ID NO: 237021 - DNA, 25 bp, Mus musculus
atatttaccagtcaaaggtaccaca

SEQ ID NO: 237022 - DNA, 25 bp, Mus musculus
atatttaccagtgaaaggtaccaca

SEQ ID NO: 237023 - DNA, 25 bp, Mus musculus
atatttacctccatctgttgcttac

SEQ ID NO: 237024 - DNA, 25 bp, Mus musculus
atatttacctccttctgttgcttac

SEQ ID NO: 237025 - DNA, 25 bp, Mus musculus
atatttactcatagctgcagtacag

SEQ ID NO: 237026 - DNA, 25 bp, Mus musculus
atatttactcattgctgcagtacag

SEQ ID NO: 237027 - DNA, 25 bp, Mus musculus
atatttactcttattcatggtctca

SEQ ID NO: 237028 - DNA, 25 bp, Mus musculus
atatttactctttttcatggtctca

SEQ ID NO: 237029 - DNA, 25 bp, Mus musculus
atatttacttgaatggagccagtct

SEQ ID NO: 237030 - DNA, 25 bp, Mus musculus
atatttacttgattggagccagtct

SEQ ID NO: 237031 - DNA, 25 bp, Mus musculus
atatttagaaaactggcctgtatta

SEQ ID NO: 237032 - DNA, 25 bp, Mus musculus
atatttagaaaagtggcctgtatta

SEQ ID NO: 237033 - DNA, 25 bp, Mus musculus
atatttagaagtcctcccttccggc

SEQ ID NO: 237034 - DNA, 25 bp, Mus musculus
atatttagaagtgctcccttccggc

SEQ ID NO: 237035 - DNA, 25 bp, Mus musculus
atatttagacacaagccgctgttct

SEQ ID NO: 237036 - DNA, 25 bp, Mus musculus
atatttagacactagccgctgttct

SEQ ID NO: 237037 - DNA, 25 bp, Mus musculus
atatttagacatactgtcctgcaaa

SEQ ID NO: 237038 - DNA, 25 bp, Mus musculus
atatttagacattctgtcctgcaaa

SEQ ID NO: 237039 - DNA, 25 bp, Mus musculus
atatttagagatatccttttcctca

SEQ ID NO: 237040 - DNA, 25 bp, Mus musculus
atatttagagatttccttttcctca

SEQ ID NO: 237041 - DNA, 25 bp, Mus musculus
atatttagctgtataactgctttat

SEQ ID NO: 237042 - DNA, 25 bp, Mus musculus
atatttagctgtttaactgctttat

SEQ ID NO: 237043 - DNA, 25 bp, Mus musculus
atatttagcttaatcaccccaacgg

SEQ ID NO: 237044 - DNA, 25 bp, Mus musculus
atatttagcttattcaccccaacgg

SEQ ID NO: 237045 - DNA, 25 bp, Mus musculus
atatttagctttcttttcctcctgg

SEQ ID NO: 237046 - DNA, 25 bp, Mus musculus
atatttagctttgttttcctcctgg

SEQ ID NO: 237047 - DNA, 25 bp, Mus musculus
atatttagggcccatgtttcacaaa

SEQ ID NO: 237048 - DNA, 25 bp, Mus musculus
atatttagggccgatgtttcacaaa

SEQ ID NO: 237049 - DNA, 25 bp, Mus musculus
atatttaggtatcttctcagaatgc

SEQ ID NO: 237050 - DNA, 25 bp, Mus musculus
atatttaggtatgttctcagaatgc

SEQ ID NO: 237051 - DNA, 25 bp, Mus musculus
atatttagtcttactttggtcacct

SEQ ID NO: 237052 - DNA, 25 bp, Mus musculus
atatttagtctttctttggtcacct

SEQ ID NO: 237053 - DNA, 25 bp, Mus musculus
atatttataattccccgtcattcca

SEQ ID NO: 237054 - DNA, 25 bp, Mus musculus
atatttataattgcccgtcattcca

SEQ ID NO: 237055 - DNA, 25 bp, Mus musculus
atatttatacggactctctctgtct

SEQ ID NO: 237056 - DNA, 25 bp, Mus musculus
atatttatacggtctctctctgtct

SEQ ID NO: 237057 - DNA, 25 bp, Mus musculus
atatttatatttaccctgacttcag

SEQ ID NO: 237058 - DNA, 25 bp, Mus musculus
atatttatattttccctgacttcag

SEQ ID NO: 237059 - DNA, 25 bp, Mus musculus
atatttatcctacctgcctctgaat

SEQ ID NO: 237060 - DNA, 25 bp, Mus musculus
atatttatcctagctgcctctgaat

SEQ ID NO: 237061 - DNA, 25 bp, Mus musculus
atatttatcgatctgaacctgtgca

SEQ ID NO: 237062 - DNA, 25 bp, Mus musculus
atatttatcgatgtgaacctgtgca

SEQ ID NO: 237063 - DNA, 25 bp, Mus musculus
atatttatgcctagtaaagccagga

SEQ ID NO: 237064 - DNA, 25 bp, Mus musculus
atatttatgccttgtaaagccagga

SEQ ID NO: 237065 - DNA, 25 bp, Mus musculus
atatttatgtccagttctgtttctc

SEQ ID NO: 237066 - DNA, 25 bp, Mus musculus
atatttatgtcctgttctgtttctc

SEQ ID NO: 237067 - DNA, 25 bp, Mus musculus
atatttatgttactaatcatctgtg

SEQ ID NO: 237068 - DNA, 25 bp, Mus musculus
atatttatgttagtaatcatctgtg

SEQ ID NO: 237069 - DNA, 25 bp, Mus musculus
atatttattaccactgatacctcag

SEQ ID NO: 237070 - DNA, 25 bp, Mus musculus
atatttattacctctgatacctcag

SEQ ID NO: 237071 - DNA, 25 bp, Mus musculus
atatttattcagacattggatggtt

SEQ ID NO: 237072 - DNA, 25 bp, Mus musculus
atatttattcagtcattggatggtt

SEQ ID NO: 237073 - DNA, 25 bp, Mus musculus
atatttattgcgacactactgtgtg

SEQ ID NO: 237074 - DNA, 25 bp, Mus musculus
atatttattgcgtcactactgtgtg

SEQ ID NO: 237075 - DNA, 25 bp, Mus musculus
atatttattgctctgtgaatgcaca

SEQ ID NO: 237076 - DNA, 25 bp, Mus musculus
atatttattgctgtgtgaatgcaca

SEQ ID NO: 237077 - DNA, 25 bp, Mus musculus
atatttatttctctcagcctccctt

SEQ ID NO: 237078 - DNA, 25 bp, Mus musculus
atatttatttctgtcagcctccctt

SEQ ID NO: 237079 - DNA, 25 bp, Mus musculus
atatttattttgaagctctatttta

SEQ ID NO: 237080 - DNA, 25 bp, Mus musculus
atatttattttgtagctctatttta

SEQ ID NO: 237081 - DNA, 25 bp, Mus musculus
atatttcaagctaagatctgctttg

SEQ ID NO: 237082 - DNA, 25 bp, Mus musculus
atatttcaagctaataaccagggct

SEQ ID NO: 237083 - DNA, 25 bp, Mus musculus
atatttcaagcttagatctgctttg

SEQ ID NO: 237084 - DNA, 25 bp, Mus musculus
atatttcaagcttataaccagggct

SEQ ID NO: 237085 - DNA, 25 bp, Mus musculus
atatttcaagtacaagtagtctcga

SEQ ID NO: 237086 - DNA, 25 bp, Mus musculus
atatttcaagtagaagtagtctcga

SEQ ID NO: 237087 - DNA, 25 bp, Mus musculus
atatttcagacaatccagtatggag

SEQ ID NO: 237088 - DNA, 25 bp, Mus musculus
atatttcagacattccagtatggag

SEQ ID NO: 237089 - DNA, 25 bp, Mus musculus
atatttcaggctattttggcttaaa

SEQ ID NO: 237090 - DNA, 25 bp, Mus musculus
atatttcaggcttttttggcttaaa

SEQ ID NO: 237091 - DNA, 25 bp, Mus musculus
atatttcatcacagatccattttat

SEQ ID NO: 237092 - DNA, 25 bp, Mus musculus
atatttcatcactgatccattttat

SEQ ID NO: 237093 - DNA, 25 bp, Mus musculus
atatttcatcatactatgctgatcc

SEQ ID NO: 237094 - DNA, 25 bp, Mus musculus
atatttcatcattctatgctgatcc

SEQ ID NO: 237095 - DNA, 25 bp, Mus musculus
atatttcatggccagggcagctcgc

SEQ ID NO: 237096 - DNA, 25 bp, Mus musculus
atatttcatggcgagggcagctcgc

SEQ ID NO: 237097 - DNA, 25 bp, Mus musculus
atatttcattatacctgtttcctat

SEQ ID NO: 237098 - DNA, 25 bp, Mus musculus
atatttcattattcctgtttcctat

SEQ ID NO: 237099 - DNA, 25 bp, Mus musculus
atatttccaatcagccggcgatttc

SEQ ID NO: 237100 - DNA, 25 bp, Mus musculus
atatttccaatctgccggcgatttc

SEQ ID NO: 237101 - DNA, 25 bp, Mus musculus
atatttccagtaaaattcctgtata

SEQ ID NO: 237102 - DNA, 25 bp, Mus musculus
atatttccagtataattcctgtata

SEQ ID NO: 237103 - DNA, 25 bp, Mus musculus
atatttccagtcatcgtgacacggg

SEQ ID NO: 237104 - DNA, 25 bp, Mus musculus
atatttccagtcttcgtgacacggg

SEQ ID NO: 237105 - DNA, 25 bp, Mus musculus
atatttccatatccagatggccaca

SEQ ID NO: 237106 - DNA, 25 bp, Mus musculus
atatttccatatgcagatggccaca

SEQ ID NO: 237107 - DNA, 25 bp, Mus musculus
atatttcccaaactgtgccattgct

SEQ ID NO: 237108 - DNA, 25 bp, Mus musculus
atatttcccaaagtgtgccattgct

SEQ ID NO: 237109 - DNA, 25 bp, Mus musculus
atatttcccaatagtttatctcttg

SEQ ID NO: 237110 - DNA, 25 bp, Mus musculus
atatttcccaatatggttcctgacc

SEQ ID NO: 237111 - DNA, 25 bp, Mus musculus
atatttcccaattgtttatctcttg

SEQ ID NO: 237112 - DNA, 25 bp, Mus musculus
atatttcccaatttggttcctgacc

SEQ ID NO: 237113 - DNA, 25 bp, Mus musculus
atatttcccaccatcctagtctttc

SEQ ID NO: 237114 - DNA, 25 bp, Mus musculus
atatttcccaccttcctagtctttc

SEQ ID NO: 237115 - DNA, 25 bp, Mus musculus
atatttcccatacgtctcagcaatc

SEQ ID NO: 237116 - DNA, 25 bp, Mus musculus
atatttcccataggtctcagcaatc

SEQ ID NO: 237117 - DNA, 25 bp, Mus musculus
atatttcccattactgtcatgcttg

SEQ ID NO: 237118 - DNA, 25 bp, Mus musculus
atatttcccattcttcactgcattt

SEQ ID NO: 237119 - DNA, 25 bp, Mus musculus
atatttcccattgttcactgcattt

SEQ ID NO: 237120 - DNA, 25 bp, Mus musculus
atatttcccatttctgtcatgcttg

SEQ ID NO: 237121 - DNA, 25 bp, Mus musculus
atatttcccgtgaaatgctgcaaca

SEQ ID NO: 237122 - DNA, 25 bp, Mus musculus
atatttcccgtgtaatgctgcaaca

SEQ ID NO: 237123 - DNA, 25 bp, Mus musculus
atatttccctccacgaatggccaaa

SEQ ID NO: 237124 - DNA, 25 bp, Mus musculus
atatttccctcctcgaatggccaaa

SEQ ID NO: 237125 - DNA, 25 bp, Mus musculus
atatttccgtatcagaagggactat

SEQ ID NO: 237126 - DNA, 25 bp, Mus musculus
atatttccgtatgagaagggactat

SEQ ID NO: 237127 - DNA, 25 bp, Mus musculus
atatttcctaataggttttcacagg

SEQ ID NO: 237128 - DNA, 25 bp, Mus musculus
atatttcctaattggttttcacagg

SEQ ID NO: 237129 - DNA, 25 bp, Mus musculus
atatttcctagaccacctgtgtttt

SEQ ID NO: 237130 - DNA, 25 bp, Mus musculus
atatttcctagagcacctgtgtttt

SEQ ID NO: 237131 - DNA, 25 bp, Mus musculus
atatttcctattacacaggtgccat

SEQ ID NO: 237132 - DNA, 25 bp, Mus musculus
atatttcctatttcacaggtgccat

SEQ ID NO: 237133 - DNA, 25 bp, Mus musculus
atatttctacagctgggtcaggttt

SEQ ID NO: 237134 - DNA, 25 bp, Mus musculus
atatttctacaggtgggtcaggttt

SEQ ID NO: 237135 - DNA, 25 bp, Mus musculus
atatttctagagacttcacaatcaa

SEQ ID NO: 237136 - DNA, 25 bp, Mus musculus
atatttctagagtcttcacaatcaa

SEQ ID NO: 237137 - DNA, 25 bp, Mus musculus
atatttctaggtaactaactattga

SEQ ID NO: 237138 - DNA, 25 bp, Mus musculus
atatttctaggttactaactattga

SEQ ID NO: 237139 - DNA, 25 bp, Mus musculus
atatttctagtgattgaccagtgct

SEQ ID NO: 237140 - DNA, 25 bp, Mus musculus
atatttctagtgtttgaccagtgct

SEQ ID NO: 237141 - DNA, 25 bp, Mus musculus
atatttctagttccttggtgttcct

SEQ ID NO: 237142 - DNA, 25 bp, Mus musculus
atatttctagttgcttggtgttcct

SEQ ID NO: 237143 - DNA, 25 bp, Mus musculus
atatttctatataccccctttctct

SEQ ID NO: 237144 - DNA, 25 bp, Mus musculus
atatttctatattccccctttctct

SEQ ID NO: 237145 - DNA, 25 bp, Mus musculus
atatttctatctaaattctccgcaa

SEQ ID NO: 237146 - DNA, 25 bp, Mus musculus
atatttctatcttaattctccgcaa

SEQ ID NO: 237147 - DNA, 25 bp, Mus musculus
atatttctcacaacaatgctgccac

SEQ ID NO: 237148 - DNA, 25 bp, Mus musculus
atatttctcacatcaatgctgccac

SEQ ID NO: 237149 - DNA, 25 bp, Mus musculus
atatttctcatcaatcaggcatggc

SEQ ID NO: 237150 - DNA, 25 bp, Mus musculus
atatttctcatctatcaggcatggc

SEQ ID NO: 237151 - DNA, 25 bp, Mus musculus
atatttctccaaatgctaaggttag

SEQ ID NO: 237152 - DNA, 25 bp, Mus musculus
atatttctccaattgctaaggttag

SEQ ID NO: 237153 - DNA, 25 bp, Mus musculus
atatttctcgagctgccaccgctga

SEQ ID NO: 237154 - DNA, 25 bp, Mus musculus
atatttctcgaggtgccaccgctga

SEQ ID NO: 237155 - DNA, 25 bp, Mus musculus
atatttctcgatatctgggctaatg

SEQ ID NO: 237156 - DNA, 25 bp, Mus musculus
atatttctcgatttctgggctaatg

SEQ ID NO: 237157 - DNA, 25 bp, Mus musculus
atatttctcgctcagttgtttcagg

SEQ ID NO: 237158 - DNA, 25 bp, Mus musculus
atatttctcgctgagttgtttcagg

SEQ ID NO: 237159 - DNA, 25 bp, Mus musculus
atatttctctagctcaatttagcag

SEQ ID NO: 237160 - DNA, 25 bp, Mus musculus
atatttctctaggtcaatttagcag

SEQ ID NO: 237161 - DNA, 25 bp, Mus musculus
atatttctctatatcgagccacatg

SEQ ID NO: 237162 - DNA, 25 bp, Mus musculus
atatttctctatttcgagccacatg

SEQ ID NO: 237163 - DNA, 25 bp, Mus musculus
atatttctctcccagtaagttcctt

SEQ ID NO: 237164 - DNA, 25 bp, Mus musculus
atatttctctccgagtaagttcctt

SEQ ID NO: 237165 - DNA, 25 bp, Mus musculus
atatttctctctcccagtggaagca

SEQ ID NO: 237166 - DNA, 25 bp, Mus musculus
atatttctctctgccagtggaagca

SEQ ID NO: 237167 - DNA, 25 bp, Mus musculus
atatttctctggacgaatcacgcca

SEQ ID NO: 237168 - DNA, 25 bp, Mus musculus
atatttctctggtcgaatcacgcca

SEQ ID NO: 237169 - DNA, 25 bp, Mus musculus
atatttctgaagactatgtaggcca

SEQ ID NO: 237170 - DNA, 25 bp, Mus musculus
atatttctgaagtctatgtaggcca

SEQ ID NO: 237171 - DNA, 25 bp, Mus musculus
atatttctgacaatcttttggattc

SEQ ID NO: 237172 - DNA, 25 bp, Mus musculus
atatttctgacattcttttggattc

SEQ ID NO: 237173 - DNA, 25 bp, Mus musculus
atatttctgataagatgctcactca

SEQ ID NO: 237174 - DNA, 25 bp, Mus musculus
atatttctgatatgatgctcactca

SEQ ID NO: 237175 - DNA, 25 bp, Mus musculus
atatttctgccactgacttgtaaag

SEQ ID NO: 237176 - DNA, 25 bp, Mus musculus
atatttctgccagtgacttgtaaag

SEQ ID NO: 237177 - DNA, 25 bp, Mus musculus
atatttctgctaccaccaagactgt

SEQ ID NO: 237178 - DNA, 25 bp, Mus musculus
atatttctgctagcaccaagactgt

SEQ ID NO: 237179 - DNA, 25 bp, Mus musculus
atatttctgtagattgccagggaca

SEQ ID NO: 237180 - DNA, 25 bp, Mus musculus
atatttctgtagtttgccagggaca

SEQ ID NO: 237181 - DNA, 25 bp, Mus musculus
atatttctgtgaatctatgagtcaa

SEQ ID NO: 237182 - DNA, 25 bp, Mus musculus
atatttctgtgattctatgagtcaa

SEQ ID NO: 237183 - DNA, 25 bp, Mus musculus
atatttctgtttctagagacataaa

SEQ ID NO: 237184 - DNA, 25 bp, Mus musculus
atatttctgtttgtagagacataaa

SEQ ID NO: 237185 - DNA, 25 bp, Mus musculus
atatttcttaccatgtgcctgtgac

SEQ ID NO: 237186 - DNA, 25 bp, Mus musculus
atatttcttaccttgtgcctgtgac

SEQ ID NO: 237187 - DNA, 25 bp, Mus musculus
atatttcttagcaacttgtgaacag

SEQ ID NO: 237188 - DNA, 25 bp, Mus musculus
atatttcttagctacttgtgaacag

SEQ ID NO: 237189 - DNA, 25 bp, Mus musculus
atatttcttgaaaacagcatatggc

SEQ ID NO: 237190 - DNA, 25 bp, Mus musculus
atatttcttgaatacagcatatggc

SEQ ID NO: 237191 - DNA, 25 bp, Mus musculus
atatttcttgccaaatgtctgtcag

SEQ ID NO: 237192 - DNA, 25 bp, Mus musculus
atatttcttgcctaatgtctgtcag

SEQ ID NO: 237193 - DNA, 25 bp, Mus musculus
atatttcttggcaaggtacttctga

SEQ ID NO: 237194 - DNA, 25 bp, Mus musculus
atatttcttggcagacctgttagtc

SEQ ID NO: 237195 - DNA, 25 bp, Mus musculus
atatttcttggctaggtacttctga

SEQ ID NO: 237196 - DNA, 25 bp, Mus musculus
atatttcttggctgacctgttagtc

SEQ ID NO: 237197 - DNA, 25 bp, Mus musculus
atatttctttcacgcatctgtccac

SEQ ID NO: 237198 - DNA, 25 bp, Mus musculus
atatttctttcaggcatctgtccac

SEQ ID NO: 237199 - DNA, 25 bp, Mus musculus
atatttgaacttactctctgggttt

SEQ ID NO: 237200 - DNA, 25 bp, Mus musculus
atatttgaactttctctctgggttt

SEQ ID NO: 237201 - DNA, 25 bp, Mus musculus
atatttgacaagctacgccaggagg

SEQ ID NO: 237202 - DNA, 25 bp, Mus musculus
atatttgacaaggtacgccaggagg

SEQ ID NO: 237203 - DNA, 25 bp, Mus musculus
atatttgacagaagttgctggaaat

SEQ ID NO: 237204 - DNA, 25 bp, Mus musculus
atatttgacagatgttgctggaaat

SEQ ID NO: 237205 - DNA, 25 bp, Mus musculus
atatttgacccaatcttatttcaat

SEQ ID NO: 237206 - DNA, 25 bp, Mus musculus
atatttgacccattcttatttcaat

SEQ ID NO: 237207 - DNA, 25 bp, Mus musculus
atatttgactagctcgccacaagac

SEQ ID NO: 237208 - DNA, 25 bp, Mus musculus
atatttgactaggtcgccacaagac

SEQ ID NO: 237209 - DNA, 25 bp, Mus musculus
atatttgatgctatggtgaggtcca

SEQ ID NO: 237210 - DNA, 25 bp, Mus musculus
atatttgatgctttggtgaggtcca

SEQ ID NO: 237211 - DNA, 25 bp, Mus musculus
atatttgattgcatgggttccagtg

SEQ ID NO: 237212 - DNA, 25 bp, Mus musculus
atatttgattgcttgggttccagtg

SEQ ID NO: 237213 - DNA, 25 bp, Mus musculus
atatttgattggagctttctaaaca

SEQ ID NO: 237214 - DNA, 25 bp, Mus musculus
atatttgattggtgctttctaaaca

SEQ ID NO: 237215 - DNA, 25 bp, Mus musculus
atatttgcaataatcccgccatgga

SEQ ID NO: 237216 - DNA, 25 bp, Mus musculus
atatttgcaatattcccgccatgga

SEQ ID NO: 237217 - DNA, 25 bp, Mus musculus
atatttgcacacataggattcttat

SEQ ID NO: 237218 - DNA, 25 bp, Mus musculus
atatttgcacacttaggattcttat

SEQ ID NO: 237219 - DNA, 25 bp, Mus musculus
atatttgcagacaataatgttgact

SEQ ID NO: 237220 - DNA, 25 bp, Mus musculus
atatttgcagactataatgttgact

SEQ ID NO: 237221 - DNA, 25 bp, Mus musculus
atatttgcagccaatactcttacat

SEQ ID NO: 237222 - DNA, 25 bp, Mus musculus
atatttgcagcctatactcttacat

SEQ ID NO: 237223 - DNA, 25 bp, Mus musculus
atatttgcagtcatggctagtgtca

SEQ ID NO: 237224 - DNA, 25 bp, Mus musculus
atatttgcagtcttggctagtgtca

SEQ ID NO: 237225 - DNA, 25 bp, Mus musculus
atatttgcatccatcttagtattga

SEQ ID NO: 237226 - DNA, 25 bp, Mus musculus
atatttgcatccttcttagtattga

SEQ ID NO: 237227 - DNA, 25 bp, Mus musculus
atatttgcatgcctggtaccagaaa

SEQ ID NO: 237228 - DNA, 25 bp, Mus musculus
atatttgcatgcgtggtaccagaaa

SEQ ID NO: 237229 - DNA, 25 bp, Mus musculus
atatttgccatgagacagacccctg

SEQ ID NO: 237230 - DNA, 25 bp, Mus musculus
atatttgccatgtgacagacccctg

SEQ ID NO: 237231 - DNA, 25 bp, Mus musculus
atatttgccccgatgagctggaaaa

SEQ ID NO: 237232 - DNA, 25 bp, Mus musculus
atatttgccccgttgagctggaaaa

SEQ ID NO: 237233 - DNA, 25 bp, Mus musculus
atatttgcccgtactggtgtgactt

SEQ ID NO: 237234 - DNA, 25 bp, Mus musculus
atatttgcccgttctggtgtgactt

SEQ ID NO: 237235 - DNA, 25 bp, Mus musculus
atatttgcccttactacaagctcca

SEQ ID NO: 237236 - DNA, 25 bp, Mus musculus
atatttgccctttctacaagctcca

SEQ ID NO: 237237 - DNA, 25 bp, Mus musculus
atatttgccgttaatgacttttcag

SEQ ID NO: 237238 - DNA, 25 bp, Mus musculus
atatttgccgtttatgacttttcag

SEQ ID NO: 237239 - DNA, 25 bp, Mus musculus
atatttgcctatacttactcaagac

SEQ ID NO: 237240 - DNA, 25 bp, Mus musculus
atatttgcctattcttactcaagac

SEQ ID NO: 237241 - DNA, 25 bp, Mus musculus
atatttgcgctcatctgacagggct

SEQ ID NO: 237242 - DNA, 25 bp, Mus musculus
atatttgcgctcttctgacagggct

SEQ ID NO: 237243 - DNA, 25 bp, Mus musculus
atatttgctattatctgcctgtaaa

SEQ ID NO: 237244 - DNA, 25 bp, Mus musculus
atatttgctattttctgcctgtaaa

SEQ ID NO: 237245 - DNA, 25 bp, Mus musculus
atatttgctgccaggaagcttctgg

SEQ ID NO: 237246 - DNA, 25 bp, Mus musculus
atatttgctgcctggaagcttctgg

SEQ ID NO: 237247 - DNA, 25 bp, Mus musculus
atatttgcttaacttgcgtctggag

SEQ ID NO: 237248 - DNA, 25 bp, Mus musculus
atatttgcttaagttgcgtctggag

SEQ ID NO: 237249 - DNA, 25 bp, Mus musculus
atatttgcttgcaggaaaatcacac

SEQ ID NO: 237250 - DNA, 25 bp, Mus musculus
atatttgcttgctggaaaatcacac

SEQ ID NO: 237251 - DNA, 25 bp, Mus musculus
atatttgcttggaactgactctcag

SEQ ID NO: 237252 - DNA, 25 bp, Mus musculus
atatttgcttggtactgactctcag

SEQ ID NO: 237253 - DNA, 25 bp, Mus musculus
atatttgcttgtagtgccaccaggg

SEQ ID NO: 237254 - DNA, 25 bp, Mus musculus
atatttgcttgttgtgccaccaggg

SEQ ID NO: 237255 - DNA, 25 bp, Mus musculus
atatttgcttttagtctgactcgct

SEQ ID NO: 237256 - DNA, 25 bp, Mus musculus
atatttgctttttgtctgactcgct

SEQ ID NO: 237257 - DNA, 25 bp, Mus musculus
atatttggatgtctacctgtaagca

SEQ ID NO: 237258 - DNA, 25 bp, Mus musculus
atatttggatgtgtacctgtaagca

SEQ ID NO: 237259 - DNA, 25 bp, Mus musculus
atatttggcatcactaaggtggaat

SEQ ID NO: 237260 - DNA, 25 bp, Mus musculus
atatttggcatctctaaggtggaat

SEQ ID NO: 237261 - DNA, 25 bp, Mus musculus
atatttggctagacaccttccgggt

SEQ ID NO: 237262 - DNA, 25 bp, Mus musculus
atatttggctagtcaccttccgggt

SEQ ID NO: 237263 - DNA, 25 bp, Mus musculus
atatttggctctatatgtgttcaga

SEQ ID NO: 237264 - DNA, 25 bp, Mus musculus
atatttggctctttatgtgttcaga

SEQ ID NO: 237265 - DNA, 25 bp, Mus musculus
atatttggctgcaggacccaccatc

SEQ ID NO: 237266 - DNA, 25 bp, Mus musculus
atatttggctgctggacccaccatc

SEQ ID NO: 237267 - DNA, 25 bp, Mus musculus
atatttggcttccactctttttaag

SEQ ID NO: 237268 - DNA, 25 bp, Mus musculus
atatttggcttcgactctttttaag

SEQ ID NO: 237269 - DNA, 25 bp, Mus musculus
atatttggtatgcttgaaaatctct

SEQ ID NO: 237270 - DNA, 25 bp, Mus musculus
atatttggtatggttgaaaatctct

SEQ ID NO: 237271 - DNA, 25 bp, Mus musculus
atatttggtctaagcctaagggaaa

SEQ ID NO: 237272 - DNA, 25 bp, Mus musculus
atatttggtctatgcctaagggaaa

SEQ ID NO: 237273 - DNA, 25 bp, Mus musculus
atatttggtggtccataggtggaac

SEQ ID NO: 237274 - DNA, 25 bp, Mus musculus
atatttggtggtgcataggtggaac

SEQ ID NO: 237275 - DNA, 25 bp, Mus musculus
atatttggtgttctatgattgagct

SEQ ID NO: 237276 - DNA, 25 bp, Mus musculus
atatttggtgttgtatgattgagct

SEQ ID NO: 237277 - DNA, 25 bp, Mus musculus
atatttgtaacccatgtcggaactg

SEQ ID NO: 237278 - DNA, 25 bp, Mus musculus
atatttgtaaccgatgtcggaactg

SEQ ID NO: 237279 - DNA, 25 bp, Mus musculus
atatttgtaataatgttgactgact

SEQ ID NO: 237280 - DNA, 25 bp, Mus musculus
atatttgtaatattgttgactgact

SEQ ID NO: 237281 - DNA, 25 bp, Mus musculus
atatttgtaccacaccctagtagct

SEQ ID NO: 237282 - DNA, 25 bp, Mus musculus
atatttgtaccagaccctagtagct

SEQ ID NO: 237283 - DNA, 25 bp, Mus musculus
atatttgtatacaccagtttgaagc

SEQ ID NO: 237284 - DNA, 25 bp, Mus musculus
atatttgtatactccagtttgaagc

SEQ ID NO: 237285 - DNA, 25 bp, Mus musculus
atatttgtatggaatagcttcgatg

SEQ ID NO: 237286 - DNA, 25 bp, Mus musculus
atatttgtatggtatagcttcgatg

SEQ ID NO: 237287 - DNA, 25 bp, Mus musculus
atatttgtcaagaaggtccaagaaa

SEQ ID NO: 237288 - DNA, 25 bp, Mus musculus
atatttgtcaagtaggtccaagaaa

SEQ ID NO: 237289 - DNA, 25 bp, Mus musculus
atatttgtcaatatctctgctccat

SEQ ID NO: 237290 - DNA, 25 bp, Mus musculus
atatttgtcaatttctctgctccat

SEQ ID NO: 237291 - DNA, 25 bp, Mus musculus
atatttgtcacactccttcttcctc

SEQ ID NO: 237292 - DNA, 25 bp, Mus musculus
atatttgtcacagtccttcttcctc

SEQ ID NO: 237293 - DNA, 25 bp, Mus musculus
atatttgtcctcctgggccataaat

SEQ ID NO: 237294 - DNA, 25 bp, Mus musculus
atatttgtcctcgtgggccataaat

SEQ ID NO: 237295 - DNA, 25 bp, Mus musculus
atatttgtggttcagacttcctctc

SEQ ID NO: 237296 - DNA, 25 bp, Mus musculus
atatttgtggttgagacttcctctc

SEQ ID NO: 237297 - DNA, 25 bp, Mus musculus
atatttgtgttcccagtacctcagt

SEQ ID NO: 237298 - DNA, 25 bp, Mus musculus
atatttgtgttcgcagtacctcagt

SEQ ID NO: 237299 - DNA, 25 bp, Mus musculus
atatttgttaacagtatgtacactt

SEQ ID NO: 237300 - DNA, 25 bp, Mus musculus
atatttgttaactgtatgtacactt

SEQ ID NO: 237301 - DNA, 25 bp, Mus musculus
atatttgttatgcttcaggtaatgc

SEQ ID NO: 237302 - DNA, 25 bp, Mus musculus
atatttgttatggttcaggtaatgc

SEQ ID NO: 237303 - DNA, 25 bp, Mus musculus
atatttgttggcagcctttttctct

SEQ ID NO: 237304 - DNA, 25 bp, Mus musculus
atatttgttggctgcctttttctct

SEQ ID NO: 237305 - DNA, 25 bp, Mus musculus
atatttgtttaccatctggcagcta

SEQ ID NO: 237306 - DNA, 25 bp, Mus musculus
atatttgtttacgatctggcagcta

SEQ ID NO: 237307 - DNA, 25 bp, Mus musculus
atattttaactcaaccccatagaag

SEQ ID NO: 237308 - DNA, 25 bp, Mus musculus
atattttaactctaccccatagaag

SEQ ID NO: 237309 - DNA, 25 bp, Mus musculus
atattttagcttctgtgagttctgt

SEQ ID NO: 237310 - DNA, 25 bp, Mus musculus
atattttagcttgtgtgagttctgt

SEQ ID NO: 237311 - DNA, 25 bp, Mus musculus
atattttatgctctaactggagttt

SEQ ID NO: 237312 - DNA, 25 bp, Mus musculus
atattttatgctgtaactggagttt

SEQ ID NO: 237313 - DNA, 25 bp, Mus musculus
atattttatggacaccgctcagcag

SEQ ID NO: 237314 - DNA, 25 bp, Mus musculus
atattttatggagaccgctcagcag

SEQ ID NO: 237315 - DNA, 25 bp, Mus musculus
atattttatggccaaactattttga

SEQ ID NO: 237316 - DNA, 25 bp, Mus musculus
atattttatggcgaaactattttga

SEQ ID NO: 237317 - DNA, 25 bp, Mus musculus
atattttcaatgcatggttggctga

SEQ ID NO: 237318 - DNA, 25 bp, Mus musculus
atattttcaatggatggttggctga

SEQ ID NO: 237319 - DNA, 25 bp, Mus musculus
atattttcactcctggggatgagac

SEQ ID NO: 237320 - DNA, 25 bp, Mus musculus
atattttcactcgtggggatgagac

SEQ ID NO: 237321 - DNA, 25 bp, Mus musculus
atattttcacttatccatgtatcag

SEQ ID NO: 237322 - DNA, 25 bp, Mus musculus
atattttcacttttccatgtatcag

SEQ ID NO: 237323 - DNA, 25 bp, Mus musculus
atattttcagtgagactttgctgtc

SEQ ID NO: 237324 - DNA, 25 bp, Mus musculus
atattttcagtgtgactttgctgtc

SEQ ID NO: 237325 - DNA, 25 bp, Mus musculus
atattttcatagcacataaaagagc

SEQ ID NO: 237326 - DNA, 25 bp, Mus musculus
atattttcataggacataaaagagc

SEQ ID NO: 237327 - DNA, 25 bp, Mus musculus
atattttcatcccttactttccagc

SEQ ID NO: 237328 - DNA, 25 bp, Mus musculus
atattttcatccgttactttccagc

SEQ ID NO: 237329 - DNA, 25 bp, Mus musculus
atattttccaccaattcataacatg

SEQ ID NO: 237330 - DNA, 25 bp, Mus musculus
atattttccacctattcataacatg

SEQ ID NO: 237331 - DNA, 25 bp, Mus musculus
atattttccatgatccctggtgcca

SEQ ID NO: 237332 - DNA, 25 bp, Mus musculus
atattttccatgctctacactctat

SEQ ID NO: 237333 - DNA, 25 bp, Mus musculus
atattttccatggtctacactctat

SEQ ID NO: 237334 - DNA, 25 bp, Mus musculus
atattttccatgttccctggtgcca

SEQ ID NO: 237335 - DNA, 25 bp, Mus musculus
atattttcccacattagtacatctg

SEQ ID NO: 237336 - DNA, 25 bp, Mus musculus
atattttcccactttagtacatctg

SEQ ID NO: 237337 - DNA, 25 bp, Mus musculus
atattttcccagctgtggctttagc

SEQ ID NO: 237338 - DNA, 25 bp, Mus musculus
atattttcccaggtgtggctttagc

SEQ ID NO: 237339 - DNA, 25 bp, Mus musculus
atattttccccaaactgggtgcagt

SEQ ID NO: 237340 - DNA, 25 bp, Mus musculus
atattttccccaattgttaatgagg

SEQ ID NO: 237341 - DNA, 25 bp, Mus musculus
atattttccccatactgggtgcagt

SEQ ID NO: 237342 - DNA, 25 bp, Mus musculus
atattttccccatttgttaatgagg

SEQ ID NO: 237343 - DNA, 25 bp, Mus musculus
atattttcccctacatgatgccctg

SEQ ID NO: 237344 - DNA, 25 bp, Mus musculus
atattttccccttcatgatgccctg

SEQ ID NO: 237345 - DNA, 25 bp, Mus musculus
atattttccctgcttcctctatgtg

SEQ ID NO: 237346 - DNA, 25 bp, Mus musculus
atattttccctggttcctctatgtg

SEQ ID NO: 237347 - DNA, 25 bp, Mus musculus
atattttcctggaagcatatgacaa

SEQ ID NO: 237348 - DNA, 25 bp, Mus musculus
atattttcctggtagcatatgacaa

SEQ ID NO: 237349 - DNA, 25 bp, Mus musculus
atattttcgccacttatgatcacaa

SEQ ID NO: 237350 - DNA, 25 bp, Mus musculus
atattttcgccagttatgatcacaa

SEQ ID NO: 237351 - DNA, 25 bp, Mus musculus
atattttctaacattcagcctgggt

SEQ ID NO: 237352 - DNA, 25 bp, Mus musculus
atattttctaactttcagcctgggt

SEQ ID NO: 237353 - DNA, 25 bp, Mus musculus
atattttctattctctcctgtttaa

SEQ ID NO: 237354 - DNA, 25 bp, Mus musculus
atattttctattgtctcctgtttaa

SEQ ID NO: 237355 - DNA, 25 bp, Mus musculus
atattttctccaaatggcattccag

SEQ ID NO: 237356 - DNA, 25 bp, Mus musculus
atattttctccatatggcattccag

SEQ ID NO: 237357 - DNA, 25 bp, Mus musculus
atattttctgcccacctgtgataag

SEQ ID NO: 237358 - DNA, 25 bp, Mus musculus
atattttctgccgacctgtgataag

SEQ ID NO: 237359 - DNA, 25 bp, Mus musculus
atattttcttctacgattctactgt

SEQ ID NO: 237360 - DNA, 25 bp, Mus musculus
atattttcttcttcgattctactgt

SEQ ID NO: 237361 - DNA, 25 bp, Mus musculus
atattttcttgactttcaccagttt

SEQ ID NO: 237362 - DNA, 25 bp, Mus musculus
atattttcttgagtttcaccagttt

SEQ ID NO: 237363 - DNA, 25 bp, Mus musculus
atattttctttcacccaccagttga

SEQ ID NO: 237364 - DNA, 25 bp, Mus musculus
atattttctttccagtatgcagtat

SEQ ID NO: 237365 - DNA, 25 bp, Mus musculus
atattttctttcgagtatgcagtat

SEQ ID NO: 237366 - DNA, 25 bp, Mus musculus
atattttctttctcccaccagttga

SEQ ID NO: 237367 - DNA, 25 bp, Mus musculus
atattttgattcattctcctggccc

SEQ ID NO: 237368 - DNA, 25 bp, Mus musculus
atattttgattctttctcctggccc

SEQ ID NO: 237369 - DNA, 25 bp, Mus musculus
atattttgccagatctatcattatt

SEQ ID NO: 237370 - DNA, 25 bp, Mus musculus
atattttgccagttctatcattatt

SEQ ID NO: 237371 - DNA, 25 bp, Mus musculus
atattttgctaaactatgctatcag

SEQ ID NO: 237372 - DNA, 25 bp, Mus musculus
atattttgctaatctatgctatcag

SEQ ID NO: 237373 - DNA, 25 bp, Mus musculus
atattttgcttcatttacttaacct

SEQ ID NO: 237374 - DNA, 25 bp, Mus musculus
atattttgcttcctatacttgtgaa

SEQ ID NO: 237375 - DNA, 25 bp, Mus musculus
atattttgcttcgtatacttgtgaa

SEQ ID NO: 237376 - DNA, 25 bp, Mus musculus
atattttgcttcttttacttaacct

SEQ ID NO: 237377 - DNA, 25 bp, Mus musculus
atattttgggctaatctggatttag

SEQ ID NO: 237378 - DNA, 25 bp, Mus musculus
atattttgggcttatctggatttag

SEQ ID NO: 237379 - DNA, 25 bp, Mus musculus
atattttggtgtcgctatctgagga

SEQ ID NO: 237380 - DNA, 25 bp, Mus musculus
atattttggtgtggctatctgagga

SEQ ID NO: 237381 - DNA, 25 bp, Mus musculus
atattttgtcagactttggatgtac

SEQ ID NO: 237382 - DNA, 25 bp, Mus musculus
atattttgtcagtctttggatgtac

SEQ ID NO: 237383 - DNA, 25 bp, Mus musculus
atattttgtctacctatggtggtgc

SEQ ID NO: 237384 - DNA, 25 bp, Mus musculus
atattttgtctagctatggtggtgc

SEQ ID NO: 237385 - DNA, 25 bp, Mus musculus
atattttgtgctcctacctatatag

SEQ ID NO: 237386 - DNA, 25 bp, Mus musculus
atattttgtgctgctacctatatag

SEQ ID NO: 237387 - DNA, 25 bp, Mus musculus
atattttgtggcctccagagcgctg

SEQ ID NO: 237388 - DNA, 25 bp, Mus musculus
atattttgtggcgtccagagcgctg

SEQ ID NO: 237389 - DNA, 25 bp, Mus musculus
atattttgttggcttatactgtgac

SEQ ID NO: 237390 - DNA, 25 bp, Mus musculus
atattttgttgggttatactgtgac

SEQ ID NO: 237391 - DNA, 25 bp, Mus musculus
atattttgttgtcacacacgcccag

SEQ ID NO: 237392 - DNA, 25 bp, Mus musculus
atattttgttgtgacacacgcccag

SEQ ID NO: 237393 - DNA, 25 bp, Mus musculus
atatttttaactcctatctcacggg

SEQ ID NO: 237394 - DNA, 25 bp, Mus musculus
atatttttaactgctatctcacggg

SEQ ID NO: 237395 - DNA, 25 bp, Mus musculus
atatttttacaacctttcctgtgtt

SEQ ID NO: 237396 - DNA, 25 bp, Mus musculus
atatttttacaagctttcctgtgtt

SEQ ID NO: 237397 - DNA, 25 bp, Mus musculus
atatttttacccagcatttctatgc

SEQ ID NO: 237398 - DNA, 25 bp, Mus musculus
atatttttaccctgcatttctatgc

SEQ ID NO: 237399 - DNA, 25 bp, Mus musculus
atatttttactcagttcctttgcca

SEQ ID NO: 237400 - DNA, 25 bp, Mus musculus
atatttttactctgttcctttgcca

SEQ ID NO: 237401 - DNA, 25 bp, Mus musculus
atatttttatagcactgacctcccc

SEQ ID NO: 237402 - DNA, 25 bp, Mus musculus
atatttttataggactgacctcccc

SEQ ID NO: 237403 - DNA, 25 bp, Mus musculus
atatttttatctctgcaatgctgag

SEQ ID NO: 237404 - DNA, 25 bp, Mus musculus
atatttttatctgtgcaatgctgag

SEQ ID NO: 237405 - DNA, 25 bp, Mus musculus
atatttttcaacacaactgccacag

SEQ ID NO: 237406 - DNA, 25 bp, Mus musculus
atatttttcaactcaactgccacag

SEQ ID NO: 237407 - DNA, 25 bp, Mus musculus
atatttttccctatcctagcagata

SEQ ID NO: 237408 - DNA, 25 bp, Mus musculus
atatttttccctttcctagcagata

SEQ ID NO: 237409 - DNA, 25 bp, Mus musculus
atatttttcctgaattcttcacaat

SEQ ID NO: 237410 - DNA, 25 bp, Mus musculus
atatttttcctgtattcttcacaat

SEQ ID NO: 237411 - DNA, 25 bp, Mus musculus
atatttttctagatggtgtgcctgt

SEQ ID NO: 237412 - DNA, 25 bp, Mus musculus
atatttttctagttggtgtgcctgt

SEQ ID NO: 237413 - DNA, 25 bp, Mus musculus
atatttttctccctcctgaactgga

SEQ ID NO: 237414 - DNA, 25 bp, Mus musculus
atatttttctccgtcctgaactgga

SEQ ID NO: 237415 - DNA, 25 bp, Mus musculus
atatttttgagtacctaaggacagc

SEQ ID NO: 237416 - DNA, 25 bp, Mus musculus
atatttttgagttcctaaggacagc

SEQ ID NO: 237417 - DNA, 25 bp, Mus musculus
atatttttgcccctcacacagaatt

SEQ ID NO: 237418 - DNA, 25 bp, Mus musculus
atatttttgcccgtcacacagaatt

SEQ ID NO: 237419 - DNA, 25 bp, Mus musculus
atatttttgcctagttcatgttgcc

SEQ ID NO: 237420 - DNA, 25 bp, Mus musculus
atatttttgccttgttcatgttgcc

SEQ ID NO: 237421 - DNA, 25 bp, Mus musculus
atatttttgctacgagccccagctt

SEQ ID NO: 237422 - DNA, 25 bp, Mus musculus
atatttttgctaggagccccagctt

SEQ ID NO: 237423 - DNA, 25 bp, Mus musculus
atatttttggcaaccacctcagcat

SEQ ID NO: 237424 - DNA, 25 bp, Mus musculus
atatttttggcatccacctcagcat

SEQ ID NO: 237425 - DNA, 25 bp, Mus musculus
atatttttgtggactgcatcttact

SEQ ID NO: 237426 - DNA, 25 bp, Mus musculus
atatttttgtggcaatgggccctgc

SEQ ID NO: 237427 - DNA, 25 bp, Mus musculus
atatttttgtgggaatgggccctgc

SEQ ID NO: 237428 - DNA, 25 bp, Mus musculus
atatttttgtggtctgcatcttact

SEQ ID NO: 237429 - DNA, 25 bp, Mus musculus
atatttttgtttccatgcctctagg

SEQ ID NO: 237430 - DNA, 25 bp, Mus musculus
atatttttgtttgcatgcctctagg

SEQ ID NO: 237431 - DNA, 25 bp, Mus musculus
atattttttaagcatcctgttccct

SEQ ID NO: 237432 - DNA, 25 bp, Mus musculus
atattttttaaggatcctgttccct

SEQ ID NO: 237433 - DNA, 25 bp, Mus musculus
atattttttacaacctactaacagt

SEQ ID NO: 237434 - DNA, 25 bp, Mus musculus
atattttttacatcctactaacagt

SEQ ID NO: 237435 - DNA, 25 bp, Mus musculus
atattttttgcacatgtttccatac

SEQ ID NO: 237436 - DNA, 25 bp, Mus musculus
atattttttgcagatgtttccatac

SEQ ID NO: 237437 - DNA, 25 bp, Mus musculus
atcaaaaaccaccagggcgggctga

SEQ ID NO: 237438 - DNA, 25 bp, Mus musculus
atcaaaaaccacgagggcgggctga

SEQ ID NO: 237439 - DNA, 25 bp, Mus musculus
atcaaaaactctactgtcgtggaac

SEQ ID NO: 237440 - DNA, 25 bp, Mus musculus
atcaaaaactcttctgtcgtggaac

SEQ ID NO: 237441 - DNA, 25 bp, Mus musculus
atcaaaaattctatcaccttctatt

SEQ ID NO: 237442 - DNA, 25 bp, Mus musculus
atcaaaaattctttcaccttctatt

SEQ ID NO: 237443 - DNA, 25 bp, Mus musculus
atcaaaacacacaactacctcttaa

SEQ ID NO: 237444 - DNA, 25 bp, Mus musculus
atcaaaacacactactacctcttaa

SEQ ID NO: 237445 - DNA, 25 bp, Mus musculus
atcaaaacatacactgaacaccctg

SEQ ID NO: 237446 - DNA, 25 bp, Mus musculus
atcaaaacatactctgaacaccctg

SEQ ID NO: 237447 - DNA, 25 bp, Mus musculus
atcaaaacgaggatcggccctgtgc

SEQ ID NO: 237448 - DNA, 25 bp, Mus musculus
atcaaaacgaggttcggccctgtgc

SEQ ID NO: 237449 - DNA, 25 bp, Mus musculus
atcaaaacgccccatcagttcagtg

SEQ ID NO: 237450 - DNA, 25 bp, Mus musculus
atcaaaacgcccgatcagttcagtg

SEQ ID NO: 237451 - DNA, 25 bp, Mus musculus
atcaaaactagtcaaatggtatgct

SEQ ID NO: 237452 - DNA, 25 bp, Mus musculus
atcaaaactagtgaaatggtatgct

SEQ ID NO: 237453 - DNA, 25 bp, Mus musculus
atcaaaactatcattgtgctcccaa

SEQ ID NO: 237454 - DNA, 25 bp, Mus musculus
atcaaaactatctttgtgctcccaa

SEQ ID NO: 237455 - DNA, 25 bp, Mus musculus
atcaaaacttccactagcctattta

SEQ ID NO: 237456 - DNA, 25 bp, Mus musculus
atcaaaacttcctctagcctattta

SEQ ID NO: 237457 - DNA, 25 bp, Mus musculus
atcaaaagacgacttgtacatacaa

SEQ ID NO: 237458 - DNA, 25 bp, Mus musculus
atcaaaagacgagttgtacatacaa

SEQ ID NO: 237459 - DNA, 25 bp, Mus musculus
atcaaaagccctcctactgggttag

SEQ ID NO: 237460 - DNA, 25 bp, Mus musculus
atcaaaagccctgctactgggttag

SEQ ID NO: 237461 - DNA, 25 bp, Mus musculus
atcaaaaggattcatgttctcacaa

SEQ ID NO: 237462 - DNA, 25 bp, Mus musculus
atcaaaaggattgatgttctcacaa

SEQ ID NO: 237463 - DNA, 25 bp, Mus musculus
atcaaaaggttgatcccatagtgac

SEQ ID NO: 237464 - DNA, 25 bp, Mus musculus
atcaaaaggttgttcccatagtgac

SEQ ID NO: 237465 - DNA, 25 bp, Mus musculus
atcaaaagtttcatgcctgcagagc

SEQ ID NO: 237466 - DNA, 25 bp, Mus musculus
atcaaaagtttcttgcctgcagagc

SEQ ID NO: 237467 - DNA, 25 bp, Mus musculus
atcaaaagttttagcgccttccttg

SEQ ID NO: 237468 - DNA, 25 bp, Mus musculus
atcaaaagtttttgcgccttccttg

SEQ ID NO: 237469 - DNA, 25 bp, Mus musculus
atcaaaatgtgtactttgtgcttat

SEQ ID NO: 237470 - DNA, 25 bp, Mus musculus
atcaaaatgtgttctttgtgcttat

SEQ ID NO: 237471 - DNA, 25 bp, Mus musculus
atcaaaatgttgaccctctttatga

SEQ ID NO: 237472 - DNA, 25 bp, Mus musculus
atcaaaatgttgtccctctttatga

SEQ ID NO: 237473 - DNA, 25 bp, Mus musculus
atcaaaatgtttccccgtgtctgaa

SEQ ID NO: 237474 - DNA, 25 bp, Mus musculus
atcaaaatgtttgcccgtgtctgaa

SEQ ID NO: 237475 - DNA, 25 bp, Mus musculus
atcaaaattctaagctccctactca

SEQ ID NO: 237476 - DNA, 25 bp, Mus musculus
atcaaaattctatgctccctactca

SEQ ID NO: 237477 - DNA, 25 bp, Mus musculus
atcaaaattcttctgttgtatctgt

SEQ ID NO: 237478 - DNA, 25 bp, Mus musculus
atcaaaattcttgtgttgtatctgt

SEQ ID NO: 237479 - DNA, 25 bp, Mus musculus
atcaaacagggcattcattcagaca

SEQ ID NO: 237480 - DNA, 25 bp, Mus musculus
atcaaacagggctttcattcagaca

SEQ ID NO: 237481 - DNA, 25 bp, Mus musculus
atcaaacagtccctgccaggccaag

SEQ ID NO: 237482 - DNA, 25 bp, Mus musculus
atcaaacagtccgtgccaggccaag

SEQ ID NO: 237483 - DNA, 25 bp, Mus musculus
atcaaacagtgccagctgttgccct

SEQ ID NO: 237484 - DNA, 25 bp, Mus musculus
atcaaacagtgcgagctgttgccct

SEQ ID NO: 237485 - DNA, 25 bp, Mus musculus
atcaaaccaacgctgtttgtctcct

SEQ ID NO: 237486 - DNA, 25 bp, Mus musculus
atcaaaccaacggtgtttgtctcct

SEQ ID NO: 237487 - DNA, 25 bp, Mus musculus
atcaaaccagatataggaatacttt

SEQ ID NO: 237488 - DNA, 25 bp, Mus musculus
atcaaaccagatttaggaatacttt

SEQ ID NO: 237489 - DNA, 25 bp, Mus musculus
atcaaacccagtaaggtgtcacctt

SEQ ID NO: 237490 - DNA, 25 bp, Mus musculus
atcaaacccagttaggtgtcacctt

SEQ ID NO: 237491 - DNA, 25 bp, Mus musculus
atcaaacccccaatgacaccgttga

SEQ ID NO: 237492 - DNA, 25 bp, Mus musculus
atcaaacccccattgacaccgttga

SEQ ID NO: 237493 - DNA, 25 bp, Mus musculus
atcaaaccggtgagcaggaagctga

SEQ ID NO: 237494 - DNA, 25 bp, Mus musculus
atcaaaccggtgtgcaggaagctga

SEQ ID NO: 237495 - DNA, 25 bp, Mus musculus
atcaaacctgaaattctcaacaaca

SEQ ID NO: 237496 - DNA, 25 bp, Mus musculus
atcaaacctgaatttctcaacaaca

SEQ ID NO: 237497 - DNA, 25 bp, Mus musculus
atcaaacgattactggcctgtcact

SEQ ID NO: 237498 - DNA, 25 bp, Mus musculus
atcaaacgattagtggcctgtcact

SEQ ID NO: 237499 - DNA, 25 bp, Mus musculus
atcaaacggactatgggtgcgtcgc

SEQ ID NO: 237500 - DNA, 25 bp, Mus musculus
atcaaacggactttgggtgcgtcgc

SEQ ID NO: 237501 - DNA, 25 bp, Mus musculus
atcaaactacaacctcaaacgtctg

SEQ ID NO: 237502 - DNA, 25 bp, Mus musculus
atcaaactacaagctcaaacgtctg

SEQ ID NO: 237503 - DNA, 25 bp, Mus musculus
atcaaactagagagatttccctgcc

SEQ ID NO: 237504 - DNA, 25 bp, Mus musculus
atcaaactagagtgatttccctgcc

SEQ ID NO: 237505 - DNA, 25 bp, Mus musculus
atcaaactcagacatcaggtgcgga

SEQ ID NO: 237506 - DNA, 25 bp, Mus musculus
atcaaactcagagatcaggtgcgga

SEQ ID NO: 237507 - DNA, 25 bp, Mus musculus
atcaaactcagcagttaggtgtggc

SEQ ID NO: 237508 - DNA, 25 bp, Mus musculus
atcaaactcagctgttaggtgtggc

SEQ ID NO: 237509 - DNA, 25 bp, Mus musculus
atcaaactccttcagacttcttcct

SEQ ID NO: 237510 - DNA, 25 bp, Mus musculus
atcaaactccttgagacttcttcct

SEQ ID NO: 237511 - DNA, 25 bp, Mus musculus
atcaaactgaaacgctttgttctta

SEQ ID NO: 237512 - DNA, 25 bp, Mus musculus
atcaaactgaaaggctttgttctta

SEQ ID NO: 237513 - DNA, 25 bp, Mus musculus
atcaaactgaagctctgtacaacaa

SEQ ID NO: 237514 - DNA, 25 bp, Mus musculus
atcaaactgaaggtctgtacaacaa

SEQ ID NO: 237515 - DNA, 25 bp, Mus musculus
atcaaactgatgcatttaacgtgtt

SEQ ID NO: 237516 - DNA, 25 bp, Mus musculus
atcaaactgatggatttaacgtgtt

SEQ ID NO: 237517 - DNA, 25 bp, Mus musculus
atcaaacttaagctccatctggtgg

SEQ ID NO: 237518 - DNA, 25 bp, Mus musculus
atcaaacttaaggtccatctggtgg

SEQ ID NO: 237519 - DNA, 25 bp, Mus musculus
atcaaagacatgcaccgctgcacct

SEQ ID NO: 237520 - DNA, 25 bp, Mus musculus
atcaaagacatggaccgctgcacct

SEQ ID NO: 237521 - DNA, 25 bp, Mus musculus
atcaaagactctcacgaatacccac

SEQ ID NO: 237522 - DNA, 25 bp, Mus musculus
atcaaagactctgacgaatacccac

SEQ ID NO: 237523 - DNA, 25 bp, Mus musculus
atcaaagagacaccagtgtttctat

SEQ ID NO: 237524 - DNA, 25 bp, Mus musculus
atcaaagagacagcagtgtttctat

SEQ ID NO: 237525 - DNA, 25 bp, Mus musculus
atcaaagatccaaagcctcgcgttt

SEQ ID NO: 237526 - DNA, 25 bp, Mus musculus
atcaaagatccatagcctcgcgttt

SEQ ID NO: 237527 - DNA, 25 bp, Mus musculus
atcaaagcagcgaagaagctggcga

SEQ ID NO: 237528 - DNA, 25 bp, Mus musculus
atcaaagcagcgtagaagctggcga

SEQ ID NO: 237529 - DNA, 25 bp, Mus musculus
atcaaagcagctaccaaccatgtca

SEQ ID NO: 237530 - DNA, 25 bp, Mus musculus
atcaaagcagcttccaaccatgtca

SEQ ID NO: 237531 - DNA, 25 bp, Mus musculus
atcaaagccagtatggttccaaggt

SEQ ID NO: 237532 - DNA, 25 bp, Mus musculus
atcaaagccagtttggttccaaggt

SEQ ID NO: 237533 - DNA, 25 bp, Mus musculus
atcaaagcccggagagtgcagtagc

SEQ ID NO: 237534 - DNA, 25 bp, Mus musculus
atcaaagcccggtgagtgcagtagc

SEQ ID NO: 237535 - DNA, 25 bp, Mus musculus
atcaaagctcttatttaattgcaca

SEQ ID NO: 237536 - DNA, 25 bp, Mus musculus
atcaaagctcttttttaattgcaca

SEQ ID NO: 237537 - DNA, 25 bp, Mus musculus
atcaaagctgctacccagaatatga

SEQ ID NO: 237538 - DNA, 25 bp, Mus musculus
atcaaagctgcttcccagaatatga

SEQ ID NO: 237539 - DNA, 25 bp, Mus musculus
atcaaagctggcaaggtacggactc

SEQ ID NO: 237540 - DNA, 25 bp, Mus musculus
atcaaagctggctaggtacggactc

SEQ ID NO: 237541 - DNA, 25 bp, Mus musculus
atcaaagctgtaattaaagggttct

SEQ ID NO: 237542 - DNA, 25 bp, Mus musculus
atcaaagctgtatttaaagggttct

SEQ ID NO: 237543 - DNA, 25 bp, Mus musculus
atcaaaggaccacccatattctgtt

SEQ ID NO: 237544 - DNA, 25 bp, Mus musculus
atcaaaggaccagccatattctgtt

SEQ ID NO: 237545 - DNA, 25 bp, Mus musculus
atcaaaggatctatggaagcccgtt

SEQ ID NO: 237546 - DNA, 25 bp, Mus musculus
atcaaaggatctttggaagcccgtt

SEQ ID NO: 237547 - DNA, 25 bp, Mus musculus
atcaaaggcctgcagctgcttggtc

SEQ ID NO: 237548 - DNA, 25 bp, Mus musculus
atcaaaggcctggagctgcttggtc

SEQ ID NO: 237549 - DNA, 25 bp, Mus musculus
atcaaaggtgttagagggccagtgt

SEQ ID NO: 237550 - DNA, 25 bp, Mus musculus
atcaaaggtgtttgagggccagtgt

SEQ ID NO: 237551 - DNA, 25 bp, Mus musculus
atcaaagtcacaaggctggaggcaa

SEQ ID NO: 237552 - DNA, 25 bp, Mus musculus
atcaaagtcacatggctggaggcaa

SEQ ID NO: 237553 - DNA, 25 bp, Mus musculus
atcaaagtctgtatcctgcagtaga

SEQ ID NO: 237554 - DNA, 25 bp, Mus musculus
atcaaagtctgtttcctgcagtaga

SEQ ID NO: 237555 - DNA, 25 bp, Mus musculus
atcaaagttctcacgatgactccag

SEQ ID NO: 237556 - DNA, 25 bp, Mus musculus
atcaaagttctctcgatgactccag

SEQ ID NO: 237557 - DNA, 25 bp, Mus musculus
atcaaagtttgaacccctagagttg

SEQ ID NO: 237558 - DNA, 25 bp, Mus musculus
atcaaagtttgatcccctagagttg

SEQ ID NO: 237559 - DNA, 25 bp, Mus musculus
atcaaatacatgagggacgcccagt

SEQ ID NO: 237560 - DNA, 25 bp, Mus musculus
atcaaatacatgtgggacgcccagt

SEQ ID NO: 237561 - DNA, 25 bp, Mus musculus
atcaaatattatacagtgcttccaa

SEQ ID NO: 237562 - DNA, 25 bp, Mus musculus
atcaaatattattcagtgcttccaa

SEQ ID NO: 237563 - DNA, 25 bp, Mus musculus
atcaaatatttcaaaacctcagatt

SEQ ID NO: 237564 - DNA, 25 bp, Mus musculus
atcaaatatttctaaacctcagatt

SEQ ID NO: 237565 - DNA, 25 bp, Mus musculus
atcaaatatttgacattcctataaa

SEQ ID NO: 237566 - DNA, 25 bp, Mus musculus
atcaaatatttgtcattcctataaa

SEQ ID NO: 237567 - DNA, 25 bp, Mus musculus
atcaaatcaaggactttgtgcctaa

SEQ ID NO: 237568 - DNA, 25 bp, Mus musculus
atcaaatcaaggtctttgtgcctaa

SEQ ID NO: 237569 - DNA, 25 bp, Mus musculus
atcaaatccactatggtatcttttt

SEQ ID NO: 237570 - DNA, 25 bp, Mus musculus
atcaaatccactttggtatcttttt

SEQ ID NO: 237571 - DNA, 25 bp, Mus musculus
atcaaatcctggatcagtgacccca

SEQ ID NO: 237572 - DNA, 25 bp, Mus musculus
atcaaatcctggttcagtgacccca

SEQ ID NO: 237573 - DNA, 25 bp, Mus musculus
atcaaatcttataatggatggctgt

SEQ ID NO: 237574 - DNA, 25 bp, Mus musculus
atcaaatcttattatggatggctgt

SEQ ID NO: 237575 - DNA, 25 bp, Mus musculus
atcaaatgcaacacacaacaccacg

SEQ ID NO: 237576 - DNA, 25 bp, Mus musculus
atcaaatgcaactcacaacaccacg

SEQ ID NO: 237577 - DNA, 25 bp, Mus musculus
atcaaatgcattagtgcgactggca

SEQ ID NO: 237578 - DNA, 25 bp, Mus musculus
atcaaatgcatttgtgcgactggca

SEQ ID NO: 237579 - DNA, 25 bp, Mus musculus
atcaaatgctacattgcctttttta

SEQ ID NO: 237580 - DNA, 25 bp, Mus musculus
atcaaatgctactttgcctttttta

SEQ ID NO: 237581 - DNA, 25 bp, Mus musculus
atcaaatgcttacaactaccagtgg

SEQ ID NO: 237582 - DNA, 25 bp, Mus musculus
atcaaatgcttagaactaccagtgg

SEQ ID NO: 237583 - DNA, 25 bp, Mus musculus
atcaaatgtcatcctatagagtcag

SEQ ID NO: 237584 - DNA, 25 bp, Mus musculus
atcaaatgtcatgctatagagtcag

SEQ ID NO: 237585 - DNA, 25 bp, Mus musculus
atcaaattcccactgaccacggagt

SEQ ID NO: 237586 - DNA, 25 bp, Mus musculus
atcaaattcccagtgaccacggagt

SEQ ID NO: 237587 - DNA, 25 bp, Mus musculus
atcaaattcgacctagcttttgccc

SEQ ID NO: 237588 - DNA, 25 bp, Mus musculus
atcaaattcgacgtagcttttgccc

SEQ ID NO: 237589 - DNA, 25 bp, Mus musculus
atcaaattctagctgtttgctgcca

SEQ ID NO: 237590 - DNA, 25 bp, Mus musculus
atcaaattctaggtgtttgctgcca

SEQ ID NO: 237591 - DNA, 25 bp, Mus musculus
atcaaattctatatccaagtccata

SEQ ID NO: 237592 - DNA, 25 bp, Mus musculus
atcaaattctatttccaagtccata

SEQ ID NO: 237593 - DNA, 25 bp, Mus musculus
atcaaattgatgagcttcaggttca

SEQ ID NO: 237594 - DNA, 25 bp, Mus musculus
atcaaattgatgtgcttcaggttca

SEQ ID NO: 237595 - DNA, 25 bp, Mus musculus
atcaaattggtaaaatgctgctgtg

SEQ ID NO: 237596 - DNA, 25 bp, Mus musculus
atcaaattggtataatgctgctgtg

SEQ ID NO: 237597 - DNA, 25 bp, Mus musculus
atcaaattgtccagtagtaaatgta

SEQ ID NO: 237598 - DNA, 25 bp, Mus musculus
atcaaattgtcctgtagtaaatgta

SEQ ID NO: 237599 - DNA, 25 bp, Mus musculus
atcaaatttgaaccgtgggttagtt

SEQ ID NO: 237600 - DNA, 25 bp, Mus musculus
atcaaatttgaagcgtgggttagtt

SEQ ID NO: 237601 - DNA, 25 bp, Mus musculus
atcaaattttatatcttccgttctt

SEQ ID NO: 237602 - DNA, 25 bp, Mus musculus
atcaaattttatttcttccgttctt

SEQ ID NO: 237603 - DNA, 25 bp, Mus musculus
atcaacaaatgacagggcctagctg

SEQ ID NO: 237604 - DNA, 25 bp, Mus musculus
atcaacaaatgagagggcctagctg

SEQ ID NO: 237605 - DNA, 25 bp, Mus musculus
atcaacaacaagacgtgtgagcagt

SEQ ID NO: 237606 - DNA, 25 bp, Mus musculus
atcaacaacaagtcgtgtgagcagt

SEQ ID NO: 237607 - DNA, 25 bp, Mus musculus
atcaacaactatataaccttagaca

SEQ ID NO: 237608 - DNA, 25 bp, Mus musculus
atcaacaactatttaaccttagaca

SEQ ID NO: 237609 - DNA, 25 bp, Mus musculus
atcaacaagcaccacgctcagaggg

SEQ ID NO: 237610 - DNA, 25 bp, Mus musculus
atcaacaagcacgacgctcagaggg

SEQ ID NO: 237611 - DNA, 25 bp, Mus musculus
atcaacaaggtaactggcactggag

SEQ ID NO: 237612 - DNA, 25 bp, Mus musculus
atcaacaaggtatctggcactggag

SEQ ID NO: 237613 - DNA, 25 bp, Mus musculus
atcaacaatatccagtgccccatgg

SEQ ID NO: 237614 - DNA, 25 bp, Mus musculus
atcaacaatatcgagtgccccatgg

SEQ ID NO: 237615 - DNA, 25 bp, Mus musculus
atcaacaatgcaagctttgaagcag

SEQ ID NO: 237616 - DNA, 25 bp, Mus musculus
atcaacaatgcatgctttgaagcag

SEQ ID NO: 237617 - DNA, 25 bp, Mus musculus
atcaacaatgtgcagtgggcctcca

SEQ ID NO: 237618 - DNA, 25 bp, Mus musculus
atcaacaatgtggagtgggcctcca

SEQ ID NO: 237619 - DNA, 25 bp, Mus musculus
atcaacacctgccaaggcccaggga

SEQ ID NO: 237620 - DNA, 25 bp, Mus musculus
atcaacacctgcgaaggcccaggga

SEQ ID NO: 237621 - DNA, 25 bp, Mus musculus
atcaacactacacttgctgctgtgg

SEQ ID NO: 237622 - DNA, 25 bp, Mus musculus
atcaacactacagttgctgctgtgg

SEQ ID NO: 237623 - DNA, 25 bp, Mus musculus
atcaacactcccagaatcctagagg

SEQ ID NO: 237624 - DNA, 25 bp, Mus musculus
atcaacactccctgaatcctagagg

SEQ ID NO: 237625 - DNA, 25 bp, Mus musculus
atcaacactgctagcagcagcttag

SEQ ID NO: 237626 - DNA, 25 bp, Mus musculus
atcaacactgcttgcagcagcttag

SEQ ID NO: 237627 - DNA, 25 bp, Mus musculus
atcaacacttgtatctggtctctgt

SEQ ID NO: 237628 - DNA, 25 bp, Mus musculus
atcaacacttgtttctggtctctgt

SEQ ID NO: 237629 - DNA, 25 bp, Mus musculus
atcaacagacacagcgtgctgctgg

SEQ ID NO: 237630 - DNA, 25 bp, Mus musculus
atcaacagacactgcgtgctgctgg

SEQ ID NO: 237631 - DNA, 25 bp, Mus musculus
atcaacatcagtcctatccctgaca

SEQ ID NO: 237632 - DNA, 25 bp, Mus musculus
atcaacatcagtgctatccctgaca

SEQ ID NO: 237633 - DNA, 25 bp, Mus musculus
atcaacatcataatcagcccatcac

SEQ ID NO: 237634 - DNA, 25 bp, Mus musculus
atcaacatcatattcagcccatcac

SEQ ID NO: 237635 - DNA, 25 bp, Mus musculus
atcaacatcgttatcctttcaactg

SEQ ID NO: 237636 - DNA, 25 bp, Mus musculus
atcaacatcgttttcctttcaactg

SEQ ID NO: 237637 - DNA, 25 bp, Mus musculus
atcaacatctggcatgcacacatgt

SEQ ID NO: 237638 - DNA, 25 bp, Mus musculus
atcaacatctgggatgcacacatgt

SEQ ID NO: 237639 - DNA, 25 bp, Mus musculus
atcaacatctttaccttctgtccct

SEQ ID NO: 237640 - DNA, 25 bp, Mus musculus
atcaacatcttttccttctgtccct

SEQ ID NO: 237641 - DNA, 25 bp, Mus musculus
atcaacatgcacattctccgcgtag

SEQ ID NO: 237642 - DNA, 25 bp, Mus musculus
atcaacatgcactttctccgcgtag

SEQ ID NO: 237643 - DNA, 25 bp, Mus musculus
atcaacattaccctggtgtactcac

SEQ ID NO: 237644 - DNA, 25 bp, Mus musculus
atcaacattaccgtggtgtactcac

SEQ ID NO: 237645 - DNA, 25 bp, Mus musculus
atcaacattgatatattccacattt

SEQ ID NO: 237646 - DNA, 25 bp, Mus musculus
atcaacattgatttattccacattt

SEQ ID NO: 237647 - DNA, 25 bp, Mus musculus
atcaacatttgtccagatgctgctg

SEQ ID NO: 237648 - DNA, 25 bp, Mus musculus
atcaacatttgtgcagatgctgctg

SEQ ID NO: 237649 - DNA, 25 bp, Mus musculus
atcaaccaaggacagcacttcgcag

SEQ ID NO: 237650 - DNA, 25 bp, Mus musculus
atcaaccaaggagagcacttcgcag

SEQ ID NO: 237651 - DNA, 25 bp, Mus musculus
atcaaccaatggactgcaagcatag

SEQ ID NO: 237652 - DNA, 25 bp, Mus musculus
atcaaccaatggtctgcaagcatag

SEQ ID NO: 237653 - DNA, 25 bp, Mus musculus
atcaaccactccagactccttagga

SEQ ID NO: 237654 - DNA, 25 bp, Mus musculus
atcaaccactcctgactccttagga

SEQ ID NO: 237655 - DNA, 25 bp, Mus musculus
atcaaccagcagcagtttggccgtc

SEQ ID NO: 237656 - DNA, 25 bp, Mus musculus
atcaaccagcaggagtttggccgtc

SEQ ID NO: 237657 - DNA, 25 bp, Mus musculus
atcaaccagtgtccaagcggcccgg

SEQ ID NO: 237658 - DNA, 25 bp, Mus musculus
atcaaccagtgtgcaagcggcccgg

SEQ ID NO: 237659 - DNA, 25 bp, Mus musculus
atcaacccagatctctaccttaaga

SEQ ID NO: 237660 - DNA, 25 bp, Mus musculus
atcaacccagatgtctaccttaaga

SEQ ID NO: 237661 - DNA, 25 bp, Mus musculus
atcaacccatccctacatttatata

SEQ ID NO: 237662 - DNA, 25 bp, Mus musculus
atcaacccatccgtacatttatata

SEQ ID NO: 237663 - DNA, 25 bp, Mus musculus
atcaaccccacaactttgcgggaga

SEQ ID NO: 237664 - DNA, 25 bp, Mus musculus
atcaaccccacatctttgcgggaga

SEQ ID NO: 237665 - DNA, 25 bp, Mus musculus
atcaaccccgtgctgtgtttcctct

SEQ ID NO: 237666 - DNA, 25 bp, Mus musculus
atcaaccccgtggtgtgtttcctct

SEQ ID NO: 237667 - DNA, 25 bp, Mus musculus
atcaacccctagacgtgtagcacag

SEQ ID NO: 237668 - DNA, 25 bp, Mus musculus
atcaacccctagtcgtgtagcacag

SEQ ID NO: 237669 - DNA, 25 bp, Mus musculus
atcaaccctcaactaaggacttttg

SEQ ID NO: 237670 - DNA, 25 bp, Mus musculus
atcaaccctcaagtaaggacttttg

SEQ ID NO: 237671 - DNA, 25 bp, Mus musculus
atcaaccctctcagtgtgtgacttt

SEQ ID NO: 237672 - DNA, 25 bp, Mus musculus
atcaaccctctctgtgtgtgacttt

SEQ ID NO: 237673 - DNA, 25 bp, Mus musculus
atcaaccctgcactggatccagtgt

SEQ ID NO: 237674 - DNA, 25 bp, Mus musculus
atcaaccctgcagtggatccagtgt

SEQ ID NO: 237675 - DNA, 25 bp, Mus musculus
atcaaccctggcacaatgctgacag

SEQ ID NO: 237676 - DNA, 25 bp, Mus musculus
atcaaccctggctcaatgctgacag

SEQ ID NO: 237677 - DNA, 25 bp, Mus musculus
atcaaccctggtctgtgggcaggtt

SEQ ID NO: 237678 - DNA, 25 bp, Mus musculus
atcaaccctggtgtgtgggcaggtt

SEQ ID NO: 237679 - DNA, 25 bp, Mus musculus
atcaacccttgtctggaaaagccag

SEQ ID NO: 237680 - DNA, 25 bp, Mus musculus
atcaacccttgtgtggaaaagccag

SEQ ID NO: 237681 - DNA, 25 bp, Mus musculus
atcaaccctttcaatagtcacatct

SEQ ID NO: 237682 - DNA, 25 bp, Mus musculus
atcaaccctttctatagtcacatct

SEQ ID NO: 237683 - DNA, 25 bp, Mus musculus
atcaacctactgcagaccagcagag

SEQ ID NO: 237684 - DNA, 25 bp, Mus musculus
atcaacctactggagaccagcagag

SEQ ID NO: 237685 - DNA, 25 bp, Mus musculus
atcaacctagaccttgtcctctatc

SEQ ID NO: 237686 - DNA, 25 bp, Mus musculus
atcaacctagacgttgtcctctatc

SEQ ID NO: 237687 - DNA, 25 bp, Mus musculus
atcaacctatagatcaggtagatga

SEQ ID NO: 237688 - DNA, 25 bp, Mus musculus
atcaacctatagttcaggtagatga

SEQ ID NO: 237689 - DNA, 25 bp, Mus musculus
atcaacctatcaatctgcctaaaac

SEQ ID NO: 237690 - DNA, 25 bp, Mus musculus
atcaacctatcattctgcctaaaac

SEQ ID NO: 237691 - DNA, 25 bp, Mus musculus
atcaacctcgtccaggccaagaagc

SEQ ID NO: 237692 - DNA, 25 bp, Mus musculus
atcaacctcgtcgaggccaagaagc

SEQ ID NO: 237693 - DNA, 25 bp, Mus musculus
atcaacctctttatctcaggatcca

SEQ ID NO: 237694 - DNA, 25 bp, Mus musculus
atcaacctctttttctcaggatcca

SEQ ID NO: 237695 - DNA, 25 bp, Mus musculus
atcaacctgcagctacggctgggag

SEQ ID NO: 237696 - DNA, 25 bp, Mus musculus
atcaacctgcaggtacggctgggag

SEQ ID NO: 237697 - DNA, 25 bp, Mus musculus
atcaacctggagatgtatgcctcct

SEQ ID NO: 237698 - DNA, 25 bp, Mus musculus
atcaacctggagttgtatgcctcct

SEQ ID NO: 237699 - DNA, 25 bp, Mus musculus
atcaacctgtacatttcctacctcg

SEQ ID NO: 237700 - DNA, 25 bp, Mus musculus
atcaacctgtacttttcctacctcg

SEQ ID NO: 237701 - DNA, 25 bp, Mus musculus
atcaaccttcagagaggcaacacca

SEQ ID NO: 237702 - DNA, 25 bp, Mus musculus
atcaaccttcagtgaggcaacacca

SEQ ID NO: 237703 - DNA, 25 bp, Mus musculus
atcaacgaaatcagtgaagtccctg

SEQ ID NO: 237704 - DNA, 25 bp, Mus musculus
atcaacgaaatctgtgaagtccctg

SEQ ID NO: 237705 - DNA, 25 bp, Mus musculus
atcaacgacgctctgcttctggaag

SEQ ID NO: 237706 - DNA, 25 bp, Mus musculus
atcaacgacgctgtgcttctggaag

SEQ ID NO: 237707 - DNA, 25 bp, Mus musculus
atcaacgatctcactgtttgctaac

SEQ ID NO: 237708 - DNA, 25 bp, Mus musculus
atcaacgatctctctgtttgctaac

SEQ ID NO: 237709 - DNA, 25 bp, Mus musculus
atcaacgatgctagggtttgcacca

SEQ ID NO: 237710 - DNA, 25 bp, Mus musculus
atcaacgatgcttgggtttgcacca

SEQ ID NO: 237711 - DNA, 25 bp, Mus musculus
atcaacgcagcacttcagaatcaca

SEQ ID NO: 237712 - DNA, 25 bp, Mus musculus
atcaacgcagcagttcagaatcaca

SEQ ID NO: 237713 - DNA, 25 bp, Mus musculus
atcaacgccatgaccatagagagct

SEQ ID NO: 237714 - DNA, 25 bp, Mus musculus
atcaacgccatgtccatagagagct

SEQ ID NO: 237715 - DNA, 25 bp, Mus musculus
atcaacgcccggcatgctatgaaag

SEQ ID NO: 237716 - DNA, 25 bp, Mus musculus
atcaacgcccgggatgctatgaaag

SEQ ID NO: 237717 - DNA, 25 bp, Mus musculus
atcaacgcgcagatgaaggccttcc

SEQ ID NO: 237718 - DNA, 25 bp, Mus musculus
atcaacgcgcagttgaaggccttcc

SEQ ID NO: 237719 - DNA, 25 bp, Mus musculus
atcaacgcggccattgagaggctgc

SEQ ID NO: 237720 - DNA, 25 bp, Mus musculus
atcaacgcggcctttgagaggctgc

SEQ ID NO: 237721 - DNA, 25 bp, Mus musculus
atcaacgctgccaatattgccacag

SEQ ID NO: 237722 - DNA, 25 bp, Mus musculus
atcaacgctgcctatattgccacag

SEQ ID NO: 237723 - DNA, 25 bp, Mus musculus
atcaacggcttccatccaagatatg

SEQ ID NO: 237724 - DNA, 25 bp, Mus musculus
atcaacggcttcgatccaagatatg

SEQ ID NO: 237725 - DNA, 25 bp, Mus musculus
atcaacggtattatcctgctggcgg

SEQ ID NO: 237726 - DNA, 25 bp, Mus musculus
atcaacggtattttcctgctggcgg

SEQ ID NO: 237727 - DNA, 25 bp, Mus musculus
atcaacgtctggaatgatccttcag

SEQ ID NO: 237728 - DNA, 25 bp, Mus musculus
atcaacgtctggtatgatccttcag

SEQ ID NO: 237729 - DNA, 25 bp, Mus musculus
atcaacgtggagcacgagctgcccg

SEQ ID NO: 237730 - DNA, 25 bp, Mus musculus
atcaacgtggaggacgagctgcccg

SEQ ID NO: 237731 - DNA, 25 bp, Mus musculus
atcaacgtgggaaccaagtacttaa

SEQ ID NO: 237732 - DNA, 25 bp, Mus musculus
atcaacgtgggatccaagtacttaa

SEQ ID NO: 237733 - DNA, 25 bp, Mus musculus
atcaacgtgtctcaaaagaggaagt

SEQ ID NO: 237734 - DNA, 25 bp, Mus musculus
atcaacgtgtctgaaaagaggaagt

SEQ ID NO: 237735 - DNA, 25 bp, Mus musculus
atcaactaagcccagctcatatggg

SEQ ID NO: 237736 - DNA, 25 bp, Mus musculus
atcaactaagccgagctcatatggg

SEQ ID NO: 237737 - DNA, 25 bp, Mus musculus
atcaactaattccatgggcacaccc

SEQ ID NO: 237738 - DNA, 25 bp, Mus musculus
atcaactaattcgatgggcacaccc

SEQ ID NO: 237739 - DNA, 25 bp, Mus musculus
atcaactacctcagctacggagtca

SEQ ID NO: 237740 - DNA, 25 bp, Mus musculus
atcaactacctctgctacggagtca

SEQ ID NO: 237741 - DNA, 25 bp, Mus musculus
atcaactagcaaataaaccgtcatc

SEQ ID NO: 237742 - DNA, 25 bp, Mus musculus
atcaactagcaattaaaccgtcatc

SEQ ID NO: 237743 - DNA, 25 bp, Mus musculus
atcaactccagacccatcgaagacg

SEQ ID NO: 237744 - DNA, 25 bp, Mus musculus
atcaactccagagccatcgaagacg

SEQ ID NO: 237745 - DNA, 25 bp, Mus musculus
atcaactcctaccaatgttaccatg

SEQ ID NO: 237746 - DNA, 25 bp, Mus musculus
atcaactcctacgaatgttaccatg

SEQ ID NO: 237747 - DNA, 25 bp, Mus musculus
atcaactctaggctccaacttgtta

SEQ ID NO: 237748 - DNA, 25 bp, Mus musculus
atcaactctagggtccaacttgtta

SEQ ID NO: 237749 - DNA, 25 bp, Mus musculus
atcaactctctacgccttactttgg

SEQ ID NO: 237750 - DNA, 25 bp, Mus musculus
atcaactctctaggccttactttgg

SEQ ID NO: 237751 - DNA, 25 bp, Mus musculus
atcaactctctgagatttgagagga

SEQ ID NO: 237752 - DNA, 25 bp, Mus musculus
atcaactctctgtgatttgagagga

SEQ ID NO: 237753 - DNA, 25 bp, Mus musculus
atcaactctgccaaattccagactc

SEQ ID NO: 237754 - DNA, 25 bp, Mus musculus
atcaactctgcctaattccagactc

SEQ ID NO: 237755 - DNA, 25 bp, Mus musculus
atcaactcttctcgtacctcaaggt

SEQ ID NO: 237756 - DNA, 25 bp, Mus musculus
atcaactcttctggtacctcaaggt

SEQ ID NO: 237757 - DNA, 25 bp, Mus musculus
atcaactcttggctttgaccatggc

SEQ ID NO: 237758 - DNA, 25 bp, Mus musculus
atcaactcttgggtttgaccatggc

SEQ ID NO: 237759 - DNA, 25 bp, Mus musculus
atcaactgtcaccaaggtggctcct

SEQ ID NO: 237760 - DNA, 25 bp, Mus musculus
atcaactgtcacgaaggtggctcct

SEQ ID NO: 237761 - DNA, 25 bp, Mus musculus
atcaactgtctcactagcctgagtt

SEQ ID NO: 237762 - DNA, 25 bp, Mus musculus
atcaactgtctctctagcctgagtt

SEQ ID NO: 237763 - DNA, 25 bp, Mus musculus
atcaacttattccaactgcttgcat

SEQ ID NO: 237764 - DNA, 25 bp, Mus musculus
atcaacttattcgaactgcttgcat

SEQ ID NO: 237765 - DNA, 25 bp, Mus musculus
atcaacttcacacttgtcctcatca

SEQ ID NO: 237766 - DNA, 25 bp, Mus musculus
atcaacttcacagttgtcctcatca

SEQ ID NO: 237767 - DNA, 25 bp, Mus musculus
atcaacttcatgaggatgctctatc

SEQ ID NO: 237768 - DNA, 25 bp, Mus musculus
atcaacttcatgtggatgctctatc

SEQ ID NO: 237769 - DNA, 25 bp, Mus musculus
atcaacttcttcactgtttggaaat

SEQ ID NO: 237770 - DNA, 25 bp, Mus musculus
atcaacttcttctctgtttggaaat

SEQ ID NO: 237771 - DNA, 25 bp, Mus musculus
atcaacttggtcatgtacttcctct

SEQ ID NO: 237772 - DNA, 25 bp, Mus musculus
atcaacttggtcttgtacttcctct

SEQ ID NO: 237773 - DNA, 25 bp, Mus musculus
atcaactttatcattctcttcaaca

SEQ ID NO: 237774 - DNA, 25 bp, Mus musculus
atcaactttatctttctcttcaaca

SEQ ID NO: 237775 - DNA, 25 bp, Mus musculus
atcaactttcatagactgtacatgg

SEQ ID NO: 237776 - DNA, 25 bp, Mus musculus
atcaactttcattgactgtacatgg

SEQ ID NO: 237777 - DNA, 25 bp, Mus musculus
atcaactttctgatgactcccagga

SEQ ID NO: 237778 - DNA, 25 bp, Mus musculus
atcaactttctgatgcaggagcgca

SEQ ID NO: 237779 - DNA, 25 bp, Mus musculus
atcaactttctgttgactcccagga

SEQ ID NO: 237780 - DNA, 25 bp, Mus musculus
atcaactttctgttgcaggagcgca

SEQ ID NO: 237781 - DNA, 25 bp, Mus musculus
atcaactttgtcctcttgaagctgc

SEQ ID NO: 237782 - DNA, 25 bp, Mus musculus
atcaactttgtcgtcttgaagctgc

SEQ ID NO: 237783 - DNA, 25 bp, Mus musculus
atcaactttttaatgccttctcacc

SEQ ID NO: 237784 - DNA, 25 bp, Mus musculus
atcaactttttattgccttctcacc

SEQ ID NO: 237785 - DNA, 25 bp, Mus musculus
atcaagaaaggtcatgtcagcggga

SEQ ID NO: 237786 - DNA, 25 bp, Mus musculus
atcaagaaaggtgatgtcagcggga

SEQ ID NO: 237787 - DNA, 25 bp, Mus musculus
atcaagaactacctccagggcatca

SEQ ID NO: 237788 - DNA, 25 bp, Mus musculus
atcaagaactacgtccagggcatca

SEQ ID NO: 237789 - DNA, 25 bp, Mus musculus
atcaagaagcccatctccgtggagg

SEQ ID NO: 237790 - DNA, 25 bp, Mus musculus
atcaagaagcccttctccgtggagg

SEQ ID NO: 237791 - DNA, 25 bp, Mus musculus
atcaagaatattattccacccgcct

SEQ ID NO: 237792 - DNA, 25 bp, Mus musculus
atcaagaatatttttccacccgcct

SEQ ID NO: 237793 - DNA, 25 bp, Mus musculus
atcaagaatgtcatctcagccgggc

SEQ ID NO: 237794 - DNA, 25 bp, Mus musculus
atcaagaatgtcttctcagccgggc

SEQ ID NO: 237795 - DNA, 25 bp, Mus musculus
atcaagacaagcctacatccaagtt

SEQ ID NO: 237796 - DNA, 25 bp, Mus musculus
atcaagacaagcgtacatccaagtt

SEQ ID NO: 237797 - DNA, 25 bp, Mus musculus
atcaagacagtaaagccatagggtt

SEQ ID NO: 237798 - DNA, 25 bp, Mus musculus
atcaagacagtatagccatagggtt

SEQ ID NO: 237799 - DNA, 25 bp, Mus musculus
atcaagacctatatcatctgggagg

SEQ ID NO: 237800 - DNA, 25 bp, Mus musculus
atcaagacctatttcatctgggagg

SEQ ID NO: 237801 - DNA, 25 bp, Mus musculus
atcaagacctttcgcagatataacc

SEQ ID NO: 237802 - DNA, 25 bp, Mus musculus
atcaagacctttggcagatataacc

SEQ ID NO: 237803 - DNA, 25 bp, Mus musculus
atcaagacggtgattgccttctgta

SEQ ID NO: 237804 - DNA, 25 bp, Mus musculus
atcaagacggtgtttgccttctgta

SEQ ID NO: 237805 - DNA, 25 bp, Mus musculus
atcaagagcacaatggacaatccca

SEQ ID NO: 237806 - DNA, 25 bp, Mus musculus
atcaagagcacattggacaatccca

SEQ ID NO: 237807 - DNA, 25 bp, Mus musculus
atcaagaggatgctccacgggcatt

SEQ ID NO: 237808 - DNA, 25 bp, Mus musculus
atcaagaggatggtccacgggcatt

SEQ ID NO: 237809 - DNA, 25 bp, Mus musculus
atcaagagggctattccaaatttca

SEQ ID NO: 237810 - DNA, 25 bp, Mus musculus
atcaagagggcttttccaaatttca

SEQ ID NO: 237811 - DNA, 25 bp, Mus musculus
atcaagagtactatccacatctccc

SEQ ID NO: 237812 - DNA, 25 bp, Mus musculus
atcaagagtactttccacatctccc

SEQ ID NO: 237813 - DNA, 25 bp, Mus musculus
atcaagatatacaattttaactcca

SEQ ID NO: 237814 - DNA, 25 bp, Mus musculus
atcaagatatactattttaactcca

SEQ ID NO: 237815 - DNA, 25 bp, Mus musculus
atcaagatcaccattcaagttcagc

SEQ ID NO: 237816 - DNA, 25 bp, Mus musculus
atcaagatcacctttcaagttcagc

SEQ ID NO: 237817 - DNA, 25 bp, Mus musculus
atcaagatcccacccttattcaagg

SEQ ID NO: 237818 - DNA, 25 bp, Mus musculus
atcaagatcccagccttattcaagg

SEQ ID NO: 237819 - DNA, 25 bp, Mus musculus
atcaagatctatcgcagcgcaggcc

SEQ ID NO: 237820 - DNA, 25 bp, Mus musculus
atcaagatctatggcagcgcaggcc

SEQ ID NO: 237821 - DNA, 25 bp, Mus musculus
atcaagatgactcagcgggcaaagg

SEQ ID NO: 237822 - DNA, 25 bp, Mus musculus
atcaagatgactgagcgggcaaagg

SEQ ID NO: 237823 - DNA, 25 bp, Mus musculus
atcaagattaaccattctgcccctg

SEQ ID NO: 237824 - DNA, 25 bp, Mus musculus
atcaagattaacgattctgcccctg

SEQ ID NO: 237825 - DNA, 25 bp, Mus musculus
atcaagattgacaaccagaggcagc

SEQ ID NO: 237826 - DNA, 25 bp, Mus musculus
atcaagattgactaccagaggcagc

SEQ ID NO: 237827 - DNA, 25 bp, Mus musculus
atcaagattgctccctctctcaagg

SEQ ID NO: 237828 - DNA, 25 bp, Mus musculus
atcaagattgctgcctctctcaagg

SEQ ID NO: 237829 - DNA, 25 bp, Mus musculus
atcaagatttgactgttcgaggaaa

SEQ ID NO: 237830 - DNA, 25 bp, Mus musculus
atcaagatttgagtgttcgaggaaa

SEQ ID NO: 237831 - DNA, 25 bp, Mus musculus
atcaagattttcctgaagctttgtt

SEQ ID NO: 237832 - DNA, 25 bp, Mus musculus
atcaagattttcgtgaagctttgtt

SEQ ID NO: 237833 - DNA, 25 bp, Mus musculus
atcaagcaacacatacctgtctata

SEQ ID NO: 237834 - DNA, 25 bp, Mus musculus
atcaagcaacacttacctgtctata

SEQ ID NO: 237835 - DNA, 25 bp, Mus musculus
atcaagcaacttagccactcaccta

SEQ ID NO: 237836 - DNA, 25 bp, Mus musculus
atcaagcaactttgccactcaccta

SEQ ID NO: 237837 - DNA, 25 bp, Mus musculus
atcaagcagaaacaccgcctccgtg

SEQ ID NO: 237838 - DNA, 25 bp, Mus musculus
atcaagcagaaagaccgcctccgtg

SEQ ID NO: 237839 - DNA, 25 bp, Mus musculus
atcaagcagcttaacattaccaccc

SEQ ID NO: 237840 - DNA, 25 bp, Mus musculus
atcaagcagctttacattaccaccc

SEQ ID NO: 237841 - DNA, 25 bp, Mus musculus
atcaagcagtctcatttctattaat

SEQ ID NO: 237842 - DNA, 25 bp, Mus musculus
atcaagcagtctgatttctattaat

SEQ ID NO: 237843 - DNA, 25 bp, Mus musculus
atcaagcatcacattccctgtaaag

SEQ ID NO: 237844 - DNA, 25 bp, Mus musculus
atcaagcatcactttccctgtaaag

SEQ ID NO: 237845 - DNA, 25 bp, Mus musculus
atcaagcatcctaatggtacctcct

SEQ ID NO: 237846 - DNA, 25 bp, Mus musculus
atcaagcatccttatggtacctcct

SEQ ID NO: 237847 - DNA, 25 bp, Mus musculus
atcaagcattaacttagcatagagg

SEQ ID NO: 237848 - DNA, 25 bp, Mus musculus
atcaagcattaagttagcatagagg

SEQ ID NO: 237849 - DNA, 25 bp, Mus musculus
atcaagcatttaactgtgtgtatcc

SEQ ID NO: 237850 - DNA, 25 bp, Mus musculus
atcaagcatttatctgtgtgtatcc

SEQ ID NO: 237851 - DNA, 25 bp, Mus musculus
atcaagccatacaaccagaagaaag

SEQ ID NO: 237852 - DNA, 25 bp, Mus musculus
atcaagccatactaccagaagaaag

SEQ ID NO: 237853 - DNA, 25 bp, Mus musculus
atcaagcctagccaggacctttgta

SEQ ID NO: 237854 - DNA, 25 bp, Mus musculus
atcaagcctagcgaggacctttgta

SEQ ID NO: 237855 - DNA, 25 bp, Mus musculus
atcaagcgcacacttctcagacatc

SEQ ID NO: 237856 - DNA, 25 bp, Mus musculus
atcaagcgcacagttctcagacatc

SEQ ID NO: 237857 - DNA, 25 bp, Mus musculus
atcaagcggtggagtgacagccaat

SEQ ID NO: 237858 - DNA, 25 bp, Mus musculus
atcaagcggtggtgtgacagccaat

SEQ ID NO: 237859 - DNA, 25 bp, Mus musculus
atcaagcgtgcacagacgggctctg

SEQ ID NO: 237860 - DNA, 25 bp, Mus musculus
atcaagcgtgcagagacgggctctg

SEQ ID NO: 237861 - DNA, 25 bp, Mus musculus
atcaagctcctaccagggcaaagag

SEQ ID NO: 237862 - DNA, 25 bp, Mus musculus
atcaagctcctagcagggcaaagag

SEQ ID NO: 237863 - DNA, 25 bp, Mus musculus
atcaagctctaaacactaaggacct

SEQ ID NO: 237864 - DNA, 25 bp, Mus musculus
atcaagctctaatcactaaggacct

SEQ ID NO: 237865 - DNA, 25 bp, Mus musculus
atcaagctgctgattattaatcgga

SEQ ID NO: 237866 - DNA, 25 bp, Mus musculus
atcaagctgctgtttattaatcgga

SEQ ID NO: 237867 - DNA, 25 bp, Mus musculus
atcaagctgggacggttcggctcca

SEQ ID NO: 237868 - DNA, 25 bp, Mus musculus
atcaagctgggagggttcggctcca

SEQ ID NO: 237869 - DNA, 25 bp, Mus musculus
atcaagctggttactgctggattcc

SEQ ID NO: 237870 - DNA, 25 bp, Mus musculus
atcaagctggtttctgctggattcc

SEQ ID NO: 237871 - DNA, 25 bp, Mus musculus
atcaagctttgccatcacatagaga

SEQ ID NO: 237872 - DNA, 25 bp, Mus musculus
atcaagctttgcgatcacatagaga

SEQ ID NO: 237873 - DNA, 25 bp, Mus musculus
atcaaggaaataacccgttctctgg

SEQ ID NO: 237874 - DNA, 25 bp, Mus musculus
atcaaggaaatatcccgttctctgg

SEQ ID NO: 237875 - DNA, 25 bp, Mus musculus
atcaaggaattactgtcccggatcc

SEQ ID NO: 237876 - DNA, 25 bp, Mus musculus
atcaaggaattagtgtcccggatcc

SEQ ID NO: 237877 - DNA, 25 bp, Mus musculus
atcaaggacaaccactccaacaaca

SEQ ID NO: 237878 - DNA, 25 bp, Mus musculus
atcaaggacaacgactccaacaaca

SEQ ID NO: 237879 - DNA, 25 bp, Mus musculus
atcaaggacaggctggtaagtacct

SEQ ID NO: 237880 - DNA, 25 bp, Mus musculus
atcaaggacagggtggtaagtacct

SEQ ID NO: 237881 - DNA, 25 bp, Mus musculus
atcaaggacctcatgggctaactaa

SEQ ID NO: 237882 - DNA, 25 bp, Mus musculus
atcaaggacctcttgggctaactaa

SEQ ID NO: 237883 - DNA, 25 bp, Mus musculus
atcaaggacgatctgtgccatttca

SEQ ID NO: 237884 - DNA, 25 bp, Mus musculus
atcaaggacgatgtgtgccatttca

SEQ ID NO: 237885 - DNA, 25 bp, Mus musculus
atcaaggacttgcagcaccgtctgg

SEQ ID NO: 237886 - DNA, 25 bp, Mus musculus
atcaaggacttggagcaccgtctgg

SEQ ID NO: 237887 - DNA, 25 bp, Mus musculus
atcaaggagagaagccaccccatac

SEQ ID NO: 237888 - DNA, 25 bp, Mus musculus
atcaaggagagatgccaccccatac

SEQ ID NO: 237889 - DNA, 25 bp, Mus musculus
atcaaggagatgagacccaaggtca

SEQ ID NO: 237890 - DNA, 25 bp, Mus musculus
atcaaggagatgtgacccaaggtca

SEQ ID NO: 237891 - DNA, 25 bp, Mus musculus
atcaaggagtttccagccggctaca

SEQ ID NO: 237892 - DNA, 25 bp, Mus musculus
atcaaggagtttgcagccggctaca

SEQ ID NO: 237893 - DNA, 25 bp, Mus musculus
atcaaggataagctctgtgcccttc

SEQ ID NO: 237894 - DNA, 25 bp, Mus musculus
atcaaggataaggtctgtgcccttc

SEQ ID NO: 237895 - DNA, 25 bp, Mus musculus
atcaaggatgagatggagcccagct

SEQ ID NO: 237896 - DNA, 25 bp, Mus musculus
atcaaggatgagttggagcccagct

SEQ ID NO: 237897 - DNA, 25 bp, Mus musculus
atcaaggatgccctggcttagctcc

SEQ ID NO: 237898 - DNA, 25 bp, Mus musculus
atcaaggatgccgtggcttagctcc

SEQ ID NO: 237899 - DNA, 25 bp, Mus musculus
atcaaggattgcaccagacccctat

SEQ ID NO: 237900 - DNA, 25 bp, Mus musculus
atcaaggattgctccagacccctat

SEQ ID NO: 237901 - DNA, 25 bp, Mus musculus
atcaaggcagtcaacatatttcagt

SEQ ID NO: 237902 - DNA, 25 bp, Mus musculus
atcaaggcagtctacatatttcagt

SEQ ID NO: 237903 - DNA, 25 bp, Mus musculus
atcaaggccaggcagcaggtcaaac

SEQ ID NO: 237904 - DNA, 25 bp, Mus musculus
atcaaggccagggagcaggtcaaac

SEQ ID NO: 237905 - DNA, 25 bp, Mus musculus
atcaaggcccataacatcatgttaa

SEQ ID NO: 237906 - DNA, 25 bp, Mus musculus
atcaaggcccattacatcatgttaa

SEQ ID NO: 237907 - DNA, 25 bp, Mus musculus
atcaaggcctcgctgggcaactgtc

SEQ ID NO: 237908 - DNA, 25 bp, Mus musculus
atcaaggcctcggtgggcaactgtc

SEQ ID NO: 237909 - DNA, 25 bp, Mus musculus
atcaaggcgctgacaaggctgtggc

SEQ ID NO: 237910 - DNA, 25 bp, Mus musculus
atcaaggcgctgtcaaggctgtggc

SEQ ID NO: 237911 - DNA, 25 bp, Mus musculus
atcaaggctgtcagcttctttatac

SEQ ID NO: 237912 - DNA, 25 bp, Mus musculus
atcaaggctgtctgcttctttatac

SEQ ID NO: 237913 - DNA, 25 bp, Mus musculus
atcaaggctgtgaggtgcctcctca

SEQ ID NO: 237914 - DNA, 25 bp, Mus musculus
atcaaggctgtgtggtgcctcctca

SEQ ID NO: 237915 - DNA, 25 bp, Mus musculus
atcaaggcttagcaggcccagagct

SEQ ID NO: 237916 - DNA, 25 bp, Mus musculus
atcaaggcttaggaggcccagagct

SEQ ID NO: 237917 - DNA, 25 bp, Mus musculus
atcaaggcttgcagagggcatcaac

SEQ ID NO: 237918 - DNA, 25 bp, Mus musculus
atcaaggcttgctgagggcatcaac

SEQ ID NO: 237919 - DNA, 25 bp, Mus musculus
atcaagggaacccatccaggtcctg

SEQ ID NO: 237920 - DNA, 25 bp, Mus musculus
atcaagggaaccgatccaggtcctg

SEQ ID NO: 237921 - DNA, 25 bp, Mus musculus
atcaagggacggctgaacagacttc

SEQ ID NO: 237922 - DNA, 25 bp, Mus musculus
atcaagggacgggtgaacagacttc

SEQ ID NO: 237923 - DNA, 25 bp, Mus musculus
atcaagggagtcagacctgtgggta

SEQ ID NO: 237924 - DNA, 25 bp, Mus musculus
atcaagggagtctgacctgtgggta

SEQ ID NO: 237925 - DNA, 25 bp, Mus musculus
atcaagggatggctatattcacaat

SEQ ID NO: 237926 - DNA, 25 bp, Mus musculus
atcaagggatgggtatattcacaat

SEQ ID NO: 237927 - DNA, 25 bp, Mus musculus
atcaagggcaagagcgcgctcatgt

SEQ ID NO: 237928 - DNA, 25 bp, Mus musculus
atcaagggcaagtgcgcgctcatgt

SEQ ID NO: 237929 - DNA, 25 bp, Mus musculus
atcaagggccgcagcaagttgggca

SEQ ID NO: 237930 - DNA, 25 bp, Mus musculus
atcaagggccgctgcaagttgggca

SEQ ID NO: 237931 - DNA, 25 bp, Mus musculus
atcaagggcttgataattccggatg

SEQ ID NO: 237932 - DNA, 25 bp, Mus musculus
atcaagggcttgttaattccggatg

SEQ ID NO: 237933 - DNA, 25 bp, Mus musculus
atcaagggtgaccacacagggccca

SEQ ID NO: 237934 - DNA, 25 bp, Mus musculus
atcaagggtgacgacacagggccca

SEQ ID NO: 237935 - DNA, 25 bp, Mus musculus
atcaaggtcattagttacggtgcta

SEQ ID NO: 237936 - DNA, 25 bp, Mus musculus
atcaaggtcatttgttacggtgcta

SEQ ID NO: 237937 - DNA, 25 bp, Mus musculus
atcaaggtgtctacctcagttactt

SEQ ID NO: 237938 - DNA, 25 bp, Mus musculus
atcaaggtgtctcagcatctggctg

SEQ ID NO: 237939 - DNA, 25 bp, Mus musculus
atcaaggtgtctgagcatctggctg

SEQ ID NO: 237940 - DNA, 25 bp, Mus musculus
atcaaggtgtcttcctcagttactt

SEQ ID NO: 237941 - DNA, 25 bp, Mus musculus
atcaaggttcctctatctgacccca

SEQ ID NO: 237942 - DNA, 25 bp, Mus musculus
atcaaggttcctgtatctgacccca

SEQ ID NO: 237943 - DNA, 25 bp, Mus musculus
atcaaggttttgatgcagggcctat

SEQ ID NO: 237944 - DNA, 25 bp, Mus musculus
atcaaggttttgttgcagggcctat

SEQ ID NO: 237945 - DNA, 25 bp, Mus musculus
atcaagtaaggcaggcgatgcttgt

SEQ ID NO: 237946 - DNA, 25 bp, Mus musculus
atcaagtaaggctggcgatgcttgt

SEQ ID NO: 237947 - DNA, 25 bp, Mus musculus
atcaagtaccatcgcttccaagtcc

SEQ ID NO: 237948 - DNA, 25 bp, Mus musculus
atcaagtaccatggcttccaagtcc

SEQ ID NO: 237949 - DNA, 25 bp, Mus musculus
atcaagtattatctctttgagtctc

SEQ ID NO: 237950 - DNA, 25 bp, Mus musculus
atcaagtattatgtctttgagtctc

SEQ ID NO: 237951 - DNA, 25 bp, Mus musculus
atcaagtattttactctattctagc

SEQ ID NO: 237952 - DNA, 25 bp, Mus musculus
atcaagtatttttctctattctagc

SEQ ID NO: 237953 - DNA, 25 bp, Mus musculus
atcaagtcagaaccagtgtccccaa

SEQ ID NO: 237954 - DNA, 25 bp, Mus musculus
atcaagtcagaagcagtgtccccaa

SEQ ID NO: 237955 - DNA, 25 bp, Mus musculus
atcaagtcagacctccacatcaagg

SEQ ID NO: 237956 - DNA, 25 bp, Mus musculus
atcaagtcagacgtccacatcaagg

SEQ ID NO: 237957 - DNA, 25 bp, Mus musculus
atcaagtcagagcacaacatgtggc

SEQ ID NO: 237958 - DNA, 25 bp, Mus musculus
atcaagtcagaggacaacatgtggc

SEQ ID NO: 237959 - DNA, 25 bp, Mus musculus
atcaagtcagctacaatgcatccgt

SEQ ID NO: 237960 - DNA, 25 bp, Mus musculus
atcaagtcagcttcaatgcatccgt

SEQ ID NO: 237961 - DNA, 25 bp, Mus musculus
atcaagtcaggaactccatctttac

SEQ ID NO: 237962 - DNA, 25 bp, Mus musculus
atcaagtcaggatctccatctttac

SEQ ID NO: 237963 - DNA, 25 bp, Mus musculus
atcaagtcagtcctggaagcctcaa

SEQ ID NO: 237964 - DNA, 25 bp, Mus musculus
atcaagtcagtcgtggaagcctcaa

SEQ ID NO: 237965 - DNA, 25 bp, Mus musculus
atcaagtcatttcctttgcacttcg

SEQ ID NO: 237966 - DNA, 25 bp, Mus musculus
atcaagtcatttgctttgcacttcg

SEQ ID NO: 237967 - DNA, 25 bp, Mus musculus
atcaagtcctagacttagggaaact

SEQ ID NO: 237968 - DNA, 25 bp, Mus musculus
atcaagtcctagtcttagggaaact

SEQ ID NO: 237969 - DNA, 25 bp, Mus musculus
atcaagtcgctgattgtgcatccgt

SEQ ID NO: 237970 - DNA, 25 bp, Mus musculus
atcaagtcgctgtttgtgcatccgt

SEQ ID NO: 237971 - DNA, 25 bp, Mus musculus
atcaagtctaagattaaccaagcct

SEQ ID NO: 237972 - DNA, 25 bp, Mus musculus
atcaagtctaagtttaaccaagcct

SEQ ID NO: 237973 - DNA, 25 bp, Mus musculus
atcaagtctcataatgtatggcatt

SEQ ID NO: 237974 - DNA, 25 bp, Mus musculus
atcaagtctcattatgtatggcatt

SEQ ID NO: 237975 - DNA, 25 bp, Mus musculus
atcaagtctgagatctccatgctct

SEQ ID NO: 237976 - DNA, 25 bp, Mus musculus
atcaagtctgagttctccatgctct

SEQ ID NO: 237977 - DNA, 25 bp, Mus musculus
atcaagtctgtcatcggccacctgc

SEQ ID NO: 237978 - DNA, 25 bp, Mus musculus
atcaagtctgtcttcggccacctgc

SEQ ID NO: 237979 - DNA, 25 bp, Mus musculus
atcaagtcttaaatgctcagagctg

SEQ ID NO: 237980 - DNA, 25 bp, Mus musculus
atcaagtcttaattgctcagagctg

SEQ ID NO: 237981 - DNA, 25 bp, Mus musculus
atcaagtgagataacatgaatggta

SEQ ID NO: 237982 - DNA, 25 bp, Mus musculus
atcaagtgagattacatgaatggta

SEQ ID NO: 237983 - DNA, 25 bp, Mus musculus
atcaagtgccctacaaggtgatcat

SEQ ID NO: 237984 - DNA, 25 bp, Mus musculus
atcaagtgcccttcaaggtgatcat

SEQ ID NO: 237985 - DNA, 25 bp, Mus musculus
atcaagtgcctcaagagctggaatt

SEQ ID NO: 237986 - DNA, 25 bp, Mus musculus
atcaagtgcctctagagctggaatt

SEQ ID NO: 237987 - DNA, 25 bp, Mus musculus
atcaagtgccttaaatcatccaccc

SEQ ID NO: 237988 - DNA, 25 bp, Mus musculus
atcaagtgcctttaatcatccaccc

SEQ ID NO: 237989 - DNA, 25 bp, Mus musculus
atcaagtgctggaggccggagccat

SEQ ID NO: 237990 - DNA, 25 bp, Mus musculus
atcaagtgctggtggccggagccat

SEQ ID NO: 237991 - DNA, 25 bp, Mus musculus
atcaagtggcacaagttaaatccat

SEQ ID NO: 237992 - DNA, 25 bp, Mus musculus
atcaagtggcactagttaaatccat

SEQ ID NO: 237993 - DNA, 25 bp, Mus musculus
atcaagtggtttatcataaggttct

SEQ ID NO: 237994 - DNA, 25 bp, Mus musculus
atcaagtggtttttcataaggttct

SEQ ID NO: 237995 - DNA, 25 bp, Mus musculus
atcaagtgtttgctctcacgccaag

SEQ ID NO: 237996 - DNA, 25 bp, Mus musculus
atcaagtgtttggtctcacgccaag

SEQ ID NO: 237997 - DNA, 25 bp, Mus musculus
atcaagttcaccaaggatctgccgc

SEQ ID NO: 237998 - DNA, 25 bp, Mus musculus
atcaagttcacctaggatctgccgc

SEQ ID NO: 237999 - DNA, 25 bp, Mus musculus
atcaagttcccactttgatgggcaa

SEQ ID NO: 238000 - DNA, 25 bp, Mus musculus
atcaagttcccagtttgatgggcaa

SEQ ID NO: 238001 - DNA, 25 bp, Mus musculus
atcaagttcgtgacagtccactgca

SEQ ID NO: 238002 - DNA, 25 bp, Mus musculus
atcaagttcgtgtcagtccactgca

SEQ ID NO: 238003 - DNA, 25 bp, Mus musculus
atcaagttctaaaactgtcccaatg

SEQ ID NO: 238004 - DNA, 25 bp, Mus musculus
atcaagttctaatactgtcccaatg

SEQ ID NO: 238005 - DNA, 25 bp, Mus musculus
atcaagttgacgaaagaactatcca

SEQ ID NO: 238006 - DNA, 25 bp, Mus musculus
atcaagttgacgtaagaactatcca

SEQ ID NO: 238007 - DNA, 25 bp, Mus musculus
atcaagtttcataagctcgccctat

SEQ ID NO: 238008 - DNA, 25 bp, Mus musculus
atcaagtttcattagctcgccctat

SEQ ID NO: 238009 - DNA, 25 bp, Mus musculus
atcaagtttcttcatgggagagcgg

SEQ ID NO: 238010 - DNA, 25 bp, Mus musculus
atcaagtttcttgatgggagagcgg

SEQ ID NO: 238011 - DNA, 25 bp, Mus musculus
atcaagtttgataccggcaacctgt

SEQ ID NO: 238012 - DNA, 25 bp, Mus musculus
atcaagtttgattccggcaacctgt

SEQ ID NO: 238013 - DNA, 25 bp, Mus musculus
atcaagttttccacctctttgagtt

SEQ ID NO: 238014 - DNA, 25 bp, Mus musculus
atcaagttttcctcctctttgagtt

SEQ ID NO: 238015 - DNA, 25 bp, Mus musculus
atcaagttttttctggcatgtattc

SEQ ID NO: 238016 - DNA, 25 bp, Mus musculus
atcaagttttttgtggcatgtattc

SEQ ID NO: 238017 - DNA, 25 bp, Mus musculus
atcaataaatggacaagtggcacta

SEQ ID NO: 238018 - DNA, 25 bp, Mus musculus
atcaataaatggtcaagtggcacta

SEQ ID NO: 238019 - DNA, 25 bp, Mus musculus
atcaataacgttcattctgcagaga

SEQ ID NO: 238020 - DNA, 25 bp, Mus musculus
atcaataacgttgattctgcagaga

SEQ ID NO: 238021 - DNA, 25 bp, Mus musculus
atcaataccagcatccgagaggaat

SEQ ID NO: 238022 - DNA, 25 bp, Mus musculus
atcaataccagcttccgagaggaat

SEQ ID NO: 238023 - DNA, 25 bp, Mus musculus
atcaataccctaactgcctagatcc

SEQ ID NO: 238024 - DNA, 25 bp, Mus musculus
atcaataccctatctgcctagatcc

SEQ ID NO: 238025 - DNA, 25 bp, Mus musculus
atcaatagagaccatgtcacgtatt

SEQ ID NO: 238026 - DNA, 25 bp, Mus musculus
atcaatagagacgatgtcacgtatt

SEQ ID NO: 238027 - DNA, 25 bp, Mus musculus
atcaatagcattacggattcccaat

SEQ ID NO: 238028 - DNA, 25 bp, Mus musculus
atcaatagcatttcggattcccaat

SEQ ID NO: 238029 - DNA, 25 bp, Mus musculus
atcaatagctttacaaatgactgag

SEQ ID NO: 238030 - DNA, 25 bp, Mus musculus
atcaatagcttttcaaatgactgag

SEQ ID NO: 238031 - DNA, 25 bp, Mus musculus
atcaatagggaaatctccagcaatg

SEQ ID NO: 238032 - DNA, 25 bp, Mus musculus
atcaatagggaattctccagcaatg

SEQ ID NO: 238033 - DNA, 25 bp, Mus musculus
atcaatattaagagcgcccattagt

SEQ ID NO: 238034 - DNA, 25 bp, Mus musculus
atcaatattaagtgcgcccattagt

SEQ ID NO: 238035 - DNA, 25 bp, Mus musculus
atcaatatttaaacctggctcaagg

SEQ ID NO: 238036 - DNA, 25 bp, Mus musculus
atcaatatttaatcctggctcaagg

SEQ ID NO: 238037 - DNA, 25 bp, Mus musculus
atcaatatttctcttatctgctgaa

SEQ ID NO: 238038 - DNA, 25 bp, Mus musculus
atcaatatttctgttatctgctgaa

SEQ ID NO: 238039 - DNA, 25 bp, Mus musculus
atcaatcacaccacaatttctcaca

SEQ ID NO: 238040 - DNA, 25 bp, Mus musculus
atcaatcacacctcaatttctcaca

SEQ ID NO: 238041 - DNA, 25 bp, Mus musculus
atcaatcagcccatgatgcttggcg

SEQ ID NO: 238042 - DNA, 25 bp, Mus musculus
atcaatcagcccttgatgcttggcg

SEQ ID NO: 238043 - DNA, 25 bp, Mus musculus
atcaatcagtccaaccagatggatt

SEQ ID NO: 238044 - DNA, 25 bp, Mus musculus
atcaatcagtcctaccagatggatt

SEQ ID NO: 238045 - DNA, 25 bp, Mus musculus
atcaatcatactcgagcgggcactc

SEQ ID NO: 238046 - DNA, 25 bp, Mus musculus
atcaatcatactggagcgggcactc

SEQ ID NO: 238047 - DNA, 25 bp, Mus musculus
atcaatcatggtattctttctgtct

SEQ ID NO: 238048 - DNA, 25 bp, Mus musculus
atcaatcatggttttctttctgtct

SEQ ID NO: 238049 - DNA, 25 bp, Mus musculus
atcaatcatgtcacttgtacctctc

SEQ ID NO: 238050 - DNA, 25 bp, Mus musculus
atcaatcatgtctcttgtacctctc

SEQ ID NO: 238051 - DNA, 25 bp, Mus musculus
atcaatccacctatgcagaatgcta

SEQ ID NO: 238052 - DNA, 25 bp, Mus musculus
atcaatccacctttgcagaatgcta

SEQ ID NO: 238053 - DNA, 25 bp, Mus musculus
atcaatccagttcgttttgggtcac

SEQ ID NO: 238054 - DNA, 25 bp, Mus musculus
atcaatccagttggttttgggtcac

SEQ ID NO: 238055 - DNA, 25 bp, Mus musculus
atcaatccatgaagcttgtaagtga

SEQ ID NO: 238056 - DNA, 25 bp, Mus musculus
atcaatccatgatgcttgtaagtga

SEQ ID NO: 238057 - DNA, 25 bp, Mus musculus
atcaatccatgtcagttcgcttttg

SEQ ID NO: 238058 - DNA, 25 bp, Mus musculus
atcaatccatgtgagttcgcttttg

SEQ ID NO: 238059 - DNA, 25 bp, Mus musculus
atcaatccctggaacttcaagcaca

SEQ ID NO: 238060 - DNA, 25 bp, Mus musculus
atcaatccctggtacttcaagcaca

SEQ ID NO: 238061 - DNA, 25 bp, Mus musculus
atcaatcctagcaggctctgcagaa

SEQ ID NO: 238062 - DNA, 25 bp, Mus musculus
atcaatcctagctggctctgcagaa

SEQ ID NO: 238063 - DNA, 25 bp, Mus musculus
atcaatcctgtgaggtttagtgtaa

SEQ ID NO: 238064 - DNA, 25 bp, Mus musculus
atcaatcctgtgtggtttagtgtaa

SEQ ID NO: 238065 - DNA, 25 bp, Mus musculus
atcaatccttatcgtggccagcctt

SEQ ID NO: 238066 - DNA, 25 bp, Mus musculus
atcaatccttatggtggccagcctt

SEQ ID NO: 238067 - DNA, 25 bp, Mus musculus
atcaatcctttgatggaacctcaaa

SEQ ID NO: 238068 - DNA, 25 bp, Mus musculus
atcaatcctttgttggaacctcaaa

SEQ ID NO: 238069 - DNA, 25 bp, Mus musculus
atcaatctatcaaggcgtacaggtt

SEQ ID NO: 238070 - DNA, 25 bp, Mus musculus
atcaatctatcatggcgtacaggtt

SEQ ID NO: 238071 - DNA, 25 bp, Mus musculus
atcaatctatcgatcggccctgtgg

SEQ ID NO: 238072 - DNA, 25 bp, Mus musculus
atcaatctatcgttcggccctgtgg

SEQ ID NO: 238073 - DNA, 25 bp, Mus musculus
atcaatctatgaagccaggcctcct

SEQ ID NO: 238074 - DNA, 25 bp, Mus musculus
atcaatctatgatgccaggcctcct

SEQ ID NO: 238075 - DNA, 25 bp, Mus musculus
atcaatctggtcagcagcccgggca

SEQ ID NO: 238076 - DNA, 25 bp, Mus musculus
atcaatctggtctgcagcccgggca

SEQ ID NO: 238077 - DNA, 25 bp, Mus musculus
atcaatctggttactcattatggtg

SEQ ID NO: 238078 - DNA, 25 bp, Mus musculus
atcaatctggtttctcattatggtg

SEQ ID NO: 238079 - DNA, 25 bp, Mus musculus
atcaatcttgtcactcttgaggtgg

SEQ ID NO: 238080 - DNA, 25 bp, Mus musculus
atcaatcttgtctctcttgaggtgg

SEQ ID NO: 238081 - DNA, 25 bp, Mus musculus
atcaatcttgttactgctgattctt

SEQ ID NO: 238082 - DNA, 25 bp, Mus musculus
atcaatcttgtttctgctgattctt

SEQ ID NO: 238083 - DNA, 25 bp, Mus musculus
atcaatgaaagacctgtgctgtgct

SEQ ID NO: 238084 - DNA, 25 bp, Mus musculus
atcaatgaaagagctgtgctgtgct

SEQ ID NO: 238085 - DNA, 25 bp, Mus musculus
atcaatgacccaagcttcagttctt

SEQ ID NO: 238086 - DNA, 25 bp, Mus musculus
atcaatgacccatgcttcagttctt

SEQ ID NO: 238087 - DNA, 25 bp, Mus musculus
atcaatgacctccagctgggggctg

SEQ ID NO: 238088 - DNA, 25 bp, Mus musculus
atcaatgacctcgagctgggggctg

SEQ ID NO: 238089 - DNA, 25 bp, Mus musculus
atcaatgacgttcctgccgtgcgtt

SEQ ID NO: 238090 - DNA, 25 bp, Mus musculus
atcaatgacgttgctgccgtgcgtt

SEQ ID NO: 238091 - DNA, 25 bp, Mus musculus
atcaatgactggctaggaaggaact

SEQ ID NO: 238092 - DNA, 25 bp, Mus musculus
atcaatgactgggtaggaaggaact

SEQ ID NO: 238093 - DNA, 25 bp, Mus musculus
atcaatgactgtcacccccaatttg

SEQ ID NO: 238094 - DNA, 25 bp, Mus musculus
atcaatgactgtgacccccaatttg

SEQ ID NO: 238095 - DNA, 25 bp, Mus musculus
atcaatgactttacctgcatgctgc

SEQ ID NO: 238096 - DNA, 25 bp, Mus musculus
atcaatgacttttcctgcatgctgc

SEQ ID NO: 238097 - DNA, 25 bp, Mus musculus
atcaatgagaacacaggcagtgtct

SEQ ID NO: 238098 - DNA, 25 bp, Mus musculus
atcaatgagaactcaggcagtgtct

SEQ ID NO: 238099 - DNA, 25 bp, Mus musculus
atcaatgagatacagcccagcgtcc

SEQ ID NO: 238100 - DNA, 25 bp, Mus musculus
atcaatgagatagagcccagcgtcc

SEQ ID NO: 238101 - DNA, 25 bp, Mus musculus
atcaatgagatcctctacttcctcc

SEQ ID NO: 238102 - DNA, 25 bp, Mus musculus
atcaatgagatcgtctacttcctcc

SEQ ID NO: 238103 - DNA, 25 bp, Mus musculus
atcaatgagattagggagcttggtt

SEQ ID NO: 238104 - DNA, 25 bp, Mus musculus
atcaatgagatttgggagcttggtt

SEQ ID NO: 238105 - DNA, 25 bp, Mus musculus
atcaatgaggccactctgtttcatc

SEQ ID NO: 238106 - DNA, 25 bp, Mus musculus
atcaatgaggcctctctgtttcatc

SEQ ID NO: 238107 - DNA, 25 bp, Mus musculus
atcaatgaggtcaggcccaaccttt

SEQ ID NO: 238108 - DNA, 25 bp, Mus musculus
atcaatgaggtctggcccaaccttt

SEQ ID NO: 238109 - DNA, 25 bp, Mus musculus
atcaatgagtgtatgtctccccagg

SEQ ID NO: 238110 - DNA, 25 bp, Mus musculus
atcaatgagtgtttgtctccccagg

SEQ ID NO: 238111 - DNA, 25 bp, Mus musculus
atcaatgataatcgtcccgggcagt

SEQ ID NO: 238112 - DNA, 25 bp, Mus musculus
atcaatgataatggtcccgggcagt

SEQ ID NO: 238113 - DNA, 25 bp, Mus musculus
atcaatgatctgagtgagctttcaa

SEQ ID NO: 238114 - DNA, 25 bp, Mus musculus
atcaatgatctgtgtgagctttcaa

SEQ ID NO: 238115 - DNA, 25 bp, Mus musculus
atcaatgatggaccccgtcagcaca

SEQ ID NO: 238116 - DNA, 25 bp, Mus musculus
atcaatgatggagcccgtcagcaca

SEQ ID NO: 238117 - DNA, 25 bp, Mus musculus
atcaatgcacacacctgctgttgct

SEQ ID NO: 238118 - DNA, 25 bp, Mus musculus
atcaatgcacactcctgctgttgct

SEQ ID NO: 238119 - DNA, 25 bp, Mus musculus
atcaatgccaaactatccccagatt

SEQ ID NO: 238120 - DNA, 25 bp, Mus musculus
atcaatgccaaagtatccccagatt

SEQ ID NO: 238121 - DNA, 25 bp, Mus musculus
atcaatgcccatacactggacccag

SEQ ID NO: 238122 - DNA, 25 bp, Mus musculus
atcaatgcccattcactggacccag

SEQ ID NO: 238123 - DNA, 25 bp, Mus musculus
atcaatgcccgtctgggttacatgg

SEQ ID NO: 238124 - DNA, 25 bp, Mus musculus
atcaatgcccgtgtgggttacatgg

SEQ ID NO: 238125 - DNA, 25 bp, Mus musculus
atcaatgcctggacattgcaattca

SEQ ID NO: 238126 - DNA, 25 bp, Mus musculus
atcaatgcctggtcattgcaattca

SEQ ID NO: 238127 - DNA, 25 bp, Mus musculus
atcaatgcttggctggagtctctcc

SEQ ID NO: 238128 - DNA, 25 bp, Mus musculus
atcaatgcttgggtggagtctctcc

SEQ ID NO: 238129 - DNA, 25 bp, Mus musculus
atcaatggagccactccagctggag

SEQ ID NO: 238130 - DNA, 25 bp, Mus musculus
atcaatggagcctctccagctggag

SEQ ID NO: 238131 - DNA, 25 bp, Mus musculus
atcaatggcactacgtaagctcggc

SEQ ID NO: 238132 - DNA, 25 bp, Mus musculus
atcaatggcacttcgtaagctcggc

SEQ ID NO: 238133 - DNA, 25 bp, Mus musculus
atcaatggctttcctttaccactca

SEQ ID NO: 238134 - DNA, 25 bp, Mus musculus
atcaatggctttgctttaccactca

SEQ ID NO: 238135 - DNA, 25 bp, Mus musculus
atcaatggtattaatatcccgaaag

SEQ ID NO: 238136 - DNA, 25 bp, Mus musculus
atcaatggtatttatatcccgaaag

SEQ ID NO: 238137 - DNA, 25 bp, Mus musculus
atcaatgtaaacacagttccctctt

SEQ ID NO: 238138 - DNA, 25 bp, Mus musculus
atcaatgtaaactcagttccctctt

SEQ ID NO: 238139 - DNA, 25 bp, Mus musculus
atcaatgtagagactttccctcctc

SEQ ID NO: 238140 - DNA, 25 bp, Mus musculus
atcaatgtagagtctttccctcctc

SEQ ID NO: 238141 - DNA, 25 bp, Mus musculus
atcaatgtatgtaacggtgttcagt

SEQ ID NO: 238142 - DNA, 25 bp, Mus musculus
atcaatgtatgttacggtgttcagt

SEQ ID NO: 238143 - DNA, 25 bp, Mus musculus
atcaatgtcaatcttgctgggctat

SEQ ID NO: 238144 - DNA, 25 bp, Mus musculus
atcaatgtcaatgttgctgggctat

SEQ ID NO: 238145 - DNA, 25 bp, Mus musculus
atcaatgtcatcatgcggcctccag

SEQ ID NO: 238146 - DNA, 25 bp, Mus musculus
atcaatgtcatcttgcggcctccag

SEQ ID NO: 238147 - DNA, 25 bp, Mus musculus
atcaatgtcatgatggccttccagg

SEQ ID NO: 238148 - DNA, 25 bp, Mus musculus
atcaatgtcatgttggccttccagg

SEQ ID NO: 238149 - DNA, 25 bp, Mus musculus
atcaatgtgatgatcttggctgctc

SEQ ID NO: 238150 - DNA, 25 bp, Mus musculus
atcaatgtgatgttcttggctgctc

SEQ ID NO: 238151 - DNA, 25 bp, Mus musculus
atcaatgtgtcaagcagagtgtctg

SEQ ID NO: 238152 - DNA, 25 bp, Mus musculus
atcaatgtgtcatgcagagtgtctg

SEQ ID NO: 238153 - DNA, 25 bp, Mus musculus
atcaatgtgttccatgcccattcgg

SEQ ID NO: 238154 - DNA, 25 bp, Mus musculus
atcaatgtgttcgatgcccattcgg

SEQ ID NO: 238155 - DNA, 25 bp, Mus musculus
atcaatgttttacctcagcactcta

SEQ ID NO: 238156 - DNA, 25 bp, Mus musculus
atcaatgttttagctcagcactcta

SEQ ID NO: 238157 - DNA, 25 bp, Mus musculus
atcaattacccaacagtgcctcgcg

SEQ ID NO: 238158 - DNA, 25 bp, Mus musculus
atcaattacccatcagtgcctcgcg

SEQ ID NO: 238159 - DNA, 25 bp, Mus musculus
atcaattaccgacaggagagacact

SEQ ID NO: 238160 - DNA, 25 bp, Mus musculus
atcaattaccgagaggagagacact

SEQ ID NO: 238161 - DNA, 25 bp, Mus musculus
atcaattacgtcactgttgctacag

SEQ ID NO: 238162 - DNA, 25 bp, Mus musculus
atcaattacgtctctgttgctacag

SEQ ID NO: 238163 - DNA, 25 bp, Mus musculus
atcaattagcagagcccggatctgg

SEQ ID NO: 238164 - DNA, 25 bp, Mus musculus
atcaattagcagtgcccggatctgg

SEQ ID NO: 238165 - DNA, 25 bp, Mus musculus
atcaattcattacttgcacaagctt

SEQ ID NO: 238166 - DNA, 25 bp, Mus musculus
atcaattcattagttgcacaagctt

SEQ ID NO: 238167 - DNA, 25 bp, Mus musculus
atcaattccacccacacttgcaaaa

SEQ ID NO: 238168 - DNA, 25 bp, Mus musculus
atcaattccaccgacacttgcaaaa

SEQ ID NO: 238169 - DNA, 25 bp, Mus musculus
atcaattccccacctacaaagtaat

SEQ ID NO: 238170 - DNA, 25 bp, Mus musculus
atcaattccccagctacaaagtaat

SEQ ID NO: 238171 - DNA, 25 bp, Mus musculus
atcaattcctcacggacacaagcca

SEQ ID NO: 238172 - DNA, 25 bp, Mus musculus
atcaattcctcagggacacaagcca

SEQ ID NO: 238173 - DNA, 25 bp, Mus musculus
atcaattccttgatcacatctctga

SEQ ID NO: 238174 - DNA, 25 bp, Mus musculus
atcaattccttgttcacatctctga

SEQ ID NO: 238175 - DNA, 25 bp, Mus musculus
atcaattgcactccaagagcttcca

SEQ ID NO: 238176 - DNA, 25 bp, Mus musculus
atcaattgcactgcaagagcttcca

SEQ ID NO: 238177 - DNA, 25 bp, Mus musculus
atcaattgggcaatccattccttga

SEQ ID NO: 238178 - DNA, 25 bp, Mus musculus
atcaattgggcattccattccttga

SEQ ID NO: 238179 - DNA, 25 bp, Mus musculus
atcaattgtcagacccaccagagct

SEQ ID NO: 238180 - DNA, 25 bp, Mus musculus
atcaattgtcagtcccaccagagct

SEQ ID NO: 238181 - DNA, 25 bp, Mus musculus
atcaattgtcataaccttggtggtc

SEQ ID NO: 238182 - DNA, 25 bp, Mus musculus
atcaattgtcattaccttggtggtc

SEQ ID NO: 238183 - DNA, 25 bp, Mus musculus
atcaatttaaaaaacccatagggcg

SEQ ID NO: 238184 - DNA, 25 bp, Mus musculus
atcaatttaaaatacccatagggcg

SEQ ID NO: 238185 - DNA, 25 bp, Mus musculus
atcaatttcatactcctgatgtggg

SEQ ID NO: 238186 - DNA, 25 bp, Mus musculus
atcaatttcatagtcctgatgtggg

SEQ ID NO: 238187 - DNA, 25 bp, Mus musculus
atcaatttccttcgcttctcttggc

SEQ ID NO: 238188 - DNA, 25 bp, Mus musculus
atcaatttccttggcttctcttggc

SEQ ID NO: 238189 - DNA, 25 bp, Mus musculus
atcaatttctttatcttctcctcac

SEQ ID NO: 238190 - DNA, 25 bp, Mus musculus
atcaatttctttccacccttgtggc

SEQ ID NO: 238191 - DNA, 25 bp, Mus musculus
atcaatttctttgcacccttgtggc

SEQ ID NO: 238192 - DNA, 25 bp, Mus musculus
atcaatttctttttcttctcctcac

SEQ ID NO: 238193 - DNA, 25 bp, Mus musculus
atcaatttgcctaagctggatagct

SEQ ID NO: 238194 - DNA, 25 bp, Mus musculus
atcaatttgccttagctggatagct

SEQ ID NO: 238195 - DNA, 25 bp, Mus musculus
atcaatttgtgccaccaaagcggtg

SEQ ID NO: 238196 - DNA, 25 bp, Mus musculus
atcaatttgtgcgaccaaagcggtg

SEQ ID NO: 238197 - DNA, 25 bp, Mus musculus
atcaattttgccctaggccatacat

SEQ ID NO: 238198 - DNA, 25 bp, Mus musculus
atcaattttgccgtaggccatacat

SEQ ID NO: 238199 - DNA, 25 bp, Mus musculus
atcacaaaatgtcacgttctttgtc

SEQ ID NO: 238200 - DNA, 25 bp, Mus musculus
atcacaaaatgtgacgttctttgtc

SEQ ID NO: 238201 - DNA, 25 bp, Mus musculus
atcacaaccggcaccagacggagga

SEQ ID NO: 238202 - DNA, 25 bp, Mus musculus
atcacaaccggctccagacggagga

SEQ ID NO: 238203 - DNA, 25 bp, Mus musculus
atcacaacctgaaagtggctgaggc

SEQ ID NO: 238204 - DNA, 25 bp, Mus musculus
atcacaacctgatagtggctgaggc

SEQ ID NO: 238205 - DNA, 25 bp, Mus musculus
atcacaactgatacactccatacta

SEQ ID NO: 238206 - DNA, 25 bp, Mus musculus
atcacaactgattcactccatacta

SEQ ID NO: 238207 - DNA, 25 bp, Mus musculus
atcacaacttctacctgaggcaggg

SEQ ID NO: 238208 - DNA, 25 bp, Mus musculus
atcacaacttcttcctgaggcaggg

SEQ ID NO: 238209 - DNA, 25 bp, Mus musculus
atcacaacttggcatccattccctt

SEQ ID NO: 238210 - DNA, 25 bp, Mus musculus
atcacaacttgggatccattccctt

SEQ ID NO: 238211 - DNA, 25 bp, Mus musculus
atcacaacttgtcgtgtctcctgta

SEQ ID NO: 238212 - DNA, 25 bp, Mus musculus
atcacaacttgtggtgtctcctgta

SEQ ID NO: 238213 - DNA, 25 bp, Mus musculus
atcacaagcatacaggtacctttcc

SEQ ID NO: 238214 - DNA, 25 bp, Mus musculus
atcacaagcatagaggtacctttcc

SEQ ID NO: 238215 - DNA, 25 bp, Mus musculus
atcacaagccaaagcgttccggtca

SEQ ID NO: 238216 - DNA, 25 bp, Mus musculus
atcacaagccaatgcgttccggtca

SEQ ID NO: 238217 - DNA, 25 bp, Mus musculus
atcacaagctggaggcaagctacaa

SEQ ID NO: 238218 - DNA, 25 bp, Mus musculus
atcacaagctggtggcaagctacaa

SEQ ID NO: 238219 - DNA, 25 bp, Mus musculus
atcacaaggcacagtgtgcgctaca

SEQ ID NO: 238220 - DNA, 25 bp, Mus musculus
atcacaaggcactgtgtgcgctaca

SEQ ID NO: 238221 - DNA, 25 bp, Mus musculus
atcacaaggtttacatctggcacaa

SEQ ID NO: 238222 - DNA, 25 bp, Mus musculus
atcacaaggttttcatctggcacaa

SEQ ID NO: 238223 - DNA, 25 bp, Mus musculus
atcacaatcactcatctcagttctt

SEQ ID NO: 238224 - DNA, 25 bp, Mus musculus
atcacaatcactgatctcagttctt

SEQ ID NO: 238225 - DNA, 25 bp, Mus musculus
atcacaatccatcagtctggccaga

SEQ ID NO: 238226 - DNA, 25 bp, Mus musculus
atcacaatccatgagtctggccaga

SEQ ID NO: 238227 - DNA, 25 bp, Mus musculus
atcacaatcccaccgctaagtagca

SEQ ID NO: 238228 - DNA, 25 bp, Mus musculus
atcacaatcccagcgctaagtagca

SEQ ID NO: 238229 - DNA, 25 bp, Mus musculus
atcacaatccggctgtagggaccaa

SEQ ID NO: 238230 - DNA, 25 bp, Mus musculus
atcacaatccgggtgtagggaccaa

SEQ ID NO: 238231 - DNA, 25 bp, Mus musculus
atcacaatgattctagtctgcgttt

SEQ ID NO: 238232 - DNA, 25 bp, Mus musculus
atcacaatgattgtagtctgcgttt

SEQ ID NO: 238233 - DNA, 25 bp, Mus musculus
atcacaatggccattcacatatgca

SEQ ID NO: 238234 - DNA, 25 bp, Mus musculus
atcacaatggcctttcacatatgca

SEQ ID NO: 238235 - DNA, 25 bp, Mus musculus
atcacaatggtcaagatgggccaga

SEQ ID NO: 238236 - DNA, 25 bp, Mus musculus
atcacaatggtctagatgggccaga

SEQ ID NO: 238237 - DNA, 25 bp, Mus musculus
atcacaatgtagacaattatttttc

SEQ ID NO: 238238 - DNA, 25 bp, Mus musculus
atcacaatgtagtcaattatttttc

SEQ ID NO: 238239 - DNA, 25 bp, Mus musculus
atcacaatgttaagaggaaccttag

SEQ ID NO: 238240 - DNA, 25 bp, Mus musculus
atcacaatgttatgaggaaccttag

SEQ ID NO: 238241 - DNA, 25 bp, Mus musculus
atcacaattcccagcttaaatacag

SEQ ID NO: 238242 - DNA, 25 bp, Mus musculus
atcacaattccctgcttaaatacag

SEQ ID NO: 238243 - DNA, 25 bp, Mus musculus
atcacaatttgaacctagtaactgg

SEQ ID NO: 238244 - DNA, 25 bp, Mus musculus
atcacaatttgatcctagtaactgg

SEQ ID NO: 238245 - DNA, 25 bp, Mus musculus
atcacacaacctcaagtccttaaga

SEQ ID NO: 238246 - DNA, 25 bp, Mus musculus
atcacacaacctgaagtccttaaga

SEQ ID NO: 238247 - DNA, 25 bp, Mus musculus
atcacacaagtcactcccaggaaat

SEQ ID NO: 238248 - DNA, 25 bp, Mus musculus
atcacacaagtctctcccaggaaat

SEQ ID NO: 238249 - DNA, 25 bp, Mus musculus
atcacacacaggctgcgggtcagca

SEQ ID NO: 238250 - DNA, 25 bp, Mus musculus
atcacacacagggtgcgggtcagca

SEQ ID NO: 238251 - DNA, 25 bp, Mus musculus
atcacacacatacatctttcagtag

SEQ ID NO: 238252 - DNA, 25 bp, Mus musculus
atcacacacatagatctttcagtag

SEQ ID NO: 238253 - DNA, 25 bp, Mus musculus
atcacacaccaacgtattccaatag

SEQ ID NO: 238254 - DNA, 25 bp, Mus musculus
atcacacaccaaggtattccaatag

SEQ ID NO: 238255 - DNA, 25 bp, Mus musculus
atcacacacgaccactttgtttttt

SEQ ID NO: 238256 - DNA, 25 bp, Mus musculus
atcacacacgacgactttgtttttt

SEQ ID NO: 238257 - DNA, 25 bp, Mus musculus
atcacacagaccatggactttcctg

SEQ ID NO: 238258 - DNA, 25 bp, Mus musculus
atcacacagaccttggactttcctg

SEQ ID NO: 238259 - DNA, 25 bp, Mus musculus
atcacacagcagaagcctggctgac

SEQ ID NO: 238260 - DNA, 25 bp, Mus musculus
atcacacagcagtagcctggctgac

SEQ ID NO: 238261 - DNA, 25 bp, Mus musculus
atcacacagctaactgcgggtcttt

SEQ ID NO: 238262 - DNA, 25 bp, Mus musculus
atcacacagctacaggcttgcttgg

SEQ ID NO: 238263 - DNA, 25 bp, Mus musculus
atcacacagctagaggcttgcttgg

SEQ ID NO: 238264 - DNA, 25 bp, Mus musculus
atcacacagctatctgcgggtcttt

SEQ ID NO: 238265 - DNA, 25 bp, Mus musculus
atcacacagtaacctcatctcaact

SEQ ID NO: 238266 - DNA, 25 bp, Mus musculus
atcacacagtaagctcatctcaact

SEQ ID NO: 238267 - DNA, 25 bp, Mus musculus
atcacacatcccagcggccaggttg

SEQ ID NO: 238268 - DNA, 25 bp, Mus musculus
atcacacatccctgcggccaggttg

SEQ ID NO: 238269 - DNA, 25 bp, Mus musculus
atcacacatctcaatatattttaat

SEQ ID NO: 238270 - DNA, 25 bp, Mus musculus
atcacacatctctatatattttaat

SEQ ID NO: 238271 - DNA, 25 bp, Mus musculus
atcacacatgttcttgctatacatt

SEQ ID NO: 238272 - DNA, 25 bp, Mus musculus
atcacacatgttgttgctatacatt

SEQ ID NO: 238273 - DNA, 25 bp, Mus musculus
atcacaccaaatacttaagcacctg

SEQ ID NO: 238274 - DNA, 25 bp, Mus musculus
atcacaccaaattcttaagcacctg

SEQ ID NO: 238275 - DNA, 25 bp, Mus musculus
atcacaccactacttttgtgctcat

SEQ ID NO: 238276 - DNA, 25 bp, Mus musculus
atcacaccactagttttgtgctcat

SEQ ID NO: 238277 - DNA, 25 bp, Mus musculus
atcacaccagacagtaccactaggg

SEQ ID NO: 238278 - DNA, 25 bp, Mus musculus
atcacaccagactgtaccactaggg

SEQ ID NO: 238279 - DNA, 25 bp, Mus musculus
atcacaccagccatgatctgtgccg

SEQ ID NO: 238280 - DNA, 25 bp, Mus musculus
atcacaccagccttgatctgtgccg

SEQ ID NO: 238281 - DNA, 25 bp, Mus musculus
atcacaccaggcaaattcttacaat

SEQ ID NO: 238282 - DNA, 25 bp, Mus musculus
atcacaccaggcattataatgttct

SEQ ID NO: 238283 - DNA, 25 bp, Mus musculus
atcacaccaggctaattcttacaat

SEQ ID NO: 238284 - DNA, 25 bp, Mus musculus
atcacaccaggctttataatgttct

SEQ ID NO: 238285 - DNA, 25 bp, Mus musculus
atcacacccagcaatggatacagga

SEQ ID NO: 238286 - DNA, 25 bp, Mus musculus
atcacacccagctatggatacagga

SEQ ID NO: 238287 - DNA, 25 bp, Mus musculus
atcacaccccgcagatgatgaactt

SEQ ID NO: 238288 - DNA, 25 bp, Mus musculus
atcacaccccgctgatgatgaactt

SEQ ID NO: 238289 - DNA, 25 bp, Mus musculus
atcacacccgctcgtgactcaggat

SEQ ID NO: 238290 - DNA, 25 bp, Mus musculus
atcacacccgctggtgactcaggat

SEQ ID NO: 238291 - DNA, 25 bp, Mus musculus
atcacaccctggcagaggatgcagc

SEQ ID NO: 238292 - DNA, 25 bp, Mus musculus
atcacaccctgggagaggatgcagc

SEQ ID NO: 238293 - DNA, 25 bp, Mus musculus
atcacaccctgtatcagagaccatg

SEQ ID NO: 238294 - DNA, 25 bp, Mus musculus
atcacaccctgtctgggatggctgc

SEQ ID NO: 238295 - DNA, 25 bp, Mus musculus
atcacaccctgtgtgggatggctgc

SEQ ID NO: 238296 - DNA, 25 bp, Mus musculus
atcacaccctgtttcagagaccatg

SEQ ID NO: 238297 - DNA, 25 bp, Mus musculus
atcacaccgttgaagcagtctcctg

SEQ ID NO: 238298 - DNA, 25 bp, Mus musculus
atcacaccgttgtagcagtctcctg

SEQ ID NO: 238299 - DNA, 25 bp, Mus musculus
atcacacctagcagagaaatccaag

SEQ ID NO: 238300 - DNA, 25 bp, Mus musculus
atcacacctagctgagaaatccaag

SEQ ID NO: 238301 - DNA, 25 bp, Mus musculus
atcacacctattctgcagctgtgta

SEQ ID NO: 238302 - DNA, 25 bp, Mus musculus
atcacacctattgtgcagctgtgta

SEQ ID NO: 238303 - DNA, 25 bp, Mus musculus
atcacacctctcagtttttagttag

SEQ ID NO: 238304 - DNA, 25 bp, Mus musculus
atcacacctctctgtttttagttag

SEQ ID NO: 238305 - DNA, 25 bp, Mus musculus
atcacacctcttatgtcagcatttc

SEQ ID NO: 238306 - DNA, 25 bp, Mus musculus
atcacacctcttttgtcagcatttc

SEQ ID NO: 238307 - DNA, 25 bp, Mus musculus
atcacacctgacctgtaattggagt

SEQ ID NO: 238308 - DNA, 25 bp, Mus musculus
atcacacctgacgtgtaattggagt

SEQ ID NO: 238309 - DNA, 25 bp, Mus musculus
atcacaccttgcatacccagatggg

SEQ ID NO: 238310 - DNA, 25 bp, Mus musculus
atcacaccttgcttacccagatggg

SEQ ID NO: 238311 - DNA, 25 bp, Mus musculus
atcacacgcagtcagcgctacgttt

SEQ ID NO: 238312 - DNA, 25 bp, Mus musculus
atcacacgcagtgagcgctacgttt

SEQ ID NO: 238313 - DNA, 25 bp, Mus musculus
atcacacgtccaatgatgggcagta

SEQ ID NO: 238314 - DNA, 25 bp, Mus musculus
atcacacgtccattgatgggcagta

SEQ ID NO: 238315 - DNA, 25 bp, Mus musculus
atcacacgtgggatgtcgagataca

SEQ ID NO: 238316 - DNA, 25 bp, Mus musculus
atcacacgtgggttgtcgagataca

SEQ ID NO: 238317 - DNA, 25 bp, Mus musculus
atcacacgtgttcgctggctgtaaa

SEQ ID NO: 238318 - DNA, 25 bp, Mus musculus
atcacacgtgttggctggctgtaaa

SEQ ID NO: 238319 - DNA, 25 bp, Mus musculus
atcacactactgagggaccgcgagg

SEQ ID NO: 238320 - DNA, 25 bp, Mus musculus
atcacactactgtgggaccgcgagg

SEQ ID NO: 238321 - DNA, 25 bp, Mus musculus
atcacactatttccctttgacagag

SEQ ID NO: 238322 - DNA, 25 bp, Mus musculus
atcacactatttgcctttgacagag

SEQ ID NO: 238323 - DNA, 25 bp, Mus musculus
atcacactcgtcaaagaaaccaagg

SEQ ID NO: 238324 - DNA, 25 bp, Mus musculus
atcacactcgtctaagaaaccaagg

SEQ ID NO: 238325 - DNA, 25 bp, Mus musculus
atcacactgaagcaatccctccagg

SEQ ID NO: 238326 - DNA, 25 bp, Mus musculus
atcacactgaaggaatccctccagg

SEQ ID NO: 238327 - DNA, 25 bp, Mus musculus
atcacactgaccattattcccactg

SEQ ID NO: 238328 - DNA, 25 bp, Mus musculus
atcacactgacctttattcccactg

SEQ ID NO: 238329 - DNA, 25 bp, Mus musculus
atcacactgccaagtaggattgcta

SEQ ID NO: 238330 - DNA, 25 bp, Mus musculus
atcacactgccatgtaggattgcta

SEQ ID NO: 238331 - DNA, 25 bp, Mus musculus
atcacactgtgaaggctaccctgct

SEQ ID NO: 238332 - DNA, 25 bp, Mus musculus
atcacactgtgatggctaccctgct

SEQ ID NO: 238333 - DNA, 25 bp, Mus musculus
atcacacttaggctttcttcagaaa

SEQ ID NO: 238334 - DNA, 25 bp, Mus musculus
atcacacttagggtttcttcagaaa

SEQ ID NO: 238335 - DNA, 25 bp, Mus musculus
atcacacttgccaagggacgctgtc

SEQ ID NO: 238336 - DNA, 25 bp, Mus musculus
atcacacttgcctagggacgctgtc

SEQ ID NO: 238337 - DNA, 25 bp, Mus musculus
atcacacttgctatcagcagcattc

SEQ ID NO: 238338 - DNA, 25 bp, Mus musculus
atcacacttgctttcagcagcattc

SEQ ID NO: 238339 - DNA, 25 bp, Mus musculus
atcacactttggatcccattagcca

SEQ ID NO: 238340 - DNA, 25 bp, Mus musculus
atcacactttggttcccattagcca

SEQ ID NO: 238341 - DNA, 25 bp, Mus musculus
atcacagaacttaagagccagctaa

SEQ ID NO: 238342 - DNA, 25 bp, Mus musculus
atcacagaactttagagccagctaa

SEQ ID NO: 238343 - DNA, 25 bp, Mus musculus
atcacagacactatacttttccaat

SEQ ID NO: 238344 - DNA, 25 bp, Mus musculus
atcacagacactttacttttccaat

SEQ ID NO: 238345 - DNA, 25 bp, Mus musculus
atcacagacagtacctgctagcctt

SEQ ID NO: 238346 - DNA, 25 bp, Mus musculus
atcacagacagttcctgctagcctt

SEQ ID NO: 238347 - DNA, 25 bp, Mus musculus
atcacagacattactctatccagaa

SEQ ID NO: 238348 - DNA, 25 bp, Mus musculus
atcacagacatttctctatccagaa

SEQ ID NO: 238349 - DNA, 25 bp, Mus musculus
atcacagactccaaatattttcctt

SEQ ID NO: 238350 - DNA, 25 bp, Mus musculus
atcacagactcctaatattttcctt

SEQ ID NO: 238351 - DNA, 25 bp, Mus musculus
atcacagactcgagtgcctgttgaa

SEQ ID NO: 238352 - DNA, 25 bp, Mus musculus
atcacagactcgtgtgcctgttgaa

SEQ ID NO: 238353 - DNA, 25 bp, Mus musculus
atcacagagcacatcatagcggtaa

SEQ ID NO: 238354 - DNA, 25 bp, Mus musculus
atcacagagcacttcatagcggtaa

SEQ ID NO: 238355 - DNA, 25 bp, Mus musculus
atcacagaggatacgcgcgccttgg

SEQ ID NO: 238356 - DNA, 25 bp, Mus musculus
atcacagaggattcgcgcgccttgg

SEQ ID NO: 238357 - DNA, 25 bp, Mus musculus
atcacagagggcaaagttcaacgct

SEQ ID NO: 238358 - DNA, 25 bp, Mus musculus
atcacagagggcactgcttcagtcc

SEQ ID NO: 238359 - DNA, 25 bp, Mus musculus
atcacagagggctaagttcaacgct

SEQ ID NO: 238360 - DNA, 25 bp, Mus musculus
atcacagagggctctgcttcagtcc

SEQ ID NO: 238361 - DNA, 25 bp, Mus musculus
atcacagagtgaagaccttcggctt

SEQ ID NO: 238362 - DNA, 25 bp, Mus musculus
atcacagagtgatgaccttcggctt

SEQ ID NO: 238363 - DNA, 25 bp, Mus musculus
atcacagatagccttcttcgaagcc

SEQ ID NO: 238364 - DNA, 25 bp, Mus musculus
atcacagatagcgttcttcgaagcc

SEQ ID NO: 238365 - DNA, 25 bp, Mus musculus
atcacagatatgctccttcttctta

SEQ ID NO: 238366 - DNA, 25 bp, Mus musculus
atcacagatatggtccttcttctta

SEQ ID NO: 238367 - DNA, 25 bp, Mus musculus
atcacagatccgctgttctgtaaaa

SEQ ID NO: 238368 - DNA, 25 bp, Mus musculus
atcacagatccggtgttctgtaaaa

SEQ ID NO: 238369 - DNA, 25 bp, Mus musculus
atcacagatgctcagtggaccaaga

SEQ ID NO: 238370 - DNA, 25 bp, Mus musculus
atcacagatgctgagtggaccaaga

SEQ ID NO: 238371 - DNA, 25 bp, Mus musculus
atcacagcacacagcagggggccag

SEQ ID NO: 238372 - DNA, 25 bp, Mus musculus
atcacagcacactgcagggggccag

SEQ ID NO: 238373 - DNA, 25 bp, Mus musculus
atcacagcaggtatcctcatccaga

SEQ ID NO: 238374 - DNA, 25 bp, Mus musculus
atcacagcaggtttcctcatccaga

SEQ ID NO: 238375 - DNA, 25 bp, Mus musculus
atcacagccaacatcctggctgtgt

SEQ ID NO: 238376 - DNA, 25 bp, Mus musculus
atcacagccaacttcctggctgtgt

SEQ ID NO: 238377 - DNA, 25 bp, Mus musculus
atcacagcccttcactgaggaaaat

SEQ ID NO: 238378 - DNA, 25 bp, Mus musculus
atcacagcccttgactgaggaaaat

SEQ ID NO: 238379 - DNA, 25 bp, Mus musculus
atcacagcctaacccagaatttact

SEQ ID NO: 238380 - DNA, 25 bp, Mus musculus
atcacagcctaagccagaatttact

SEQ ID NO: 238381 - DNA, 25 bp, Mus musculus
atcacagcctctctagggagcaagg

SEQ ID NO: 238382 - DNA, 25 bp, Mus musculus
atcacagcctctgtagggagcaagg

SEQ ID NO: 238383 - DNA, 25 bp, Mus musculus
atcacagcctgaaggttctggtcgt

SEQ ID NO: 238384 - DNA, 25 bp, Mus musculus
atcacagcctgatggttctggtcgt

SEQ ID NO: 238385 - DNA, 25 bp, Mus musculus
atcacagcctttatttttcaagcca

SEQ ID NO: 238386 - DNA, 25 bp, Mus musculus
atcacagcctttttttttcaagcca

SEQ ID NO: 238387 - DNA, 25 bp, Mus musculus
atcacagcggagatagcttgttcta

SEQ ID NO: 238388 - DNA, 25 bp, Mus musculus
atcacagcggagttagcttgttcta

SEQ ID NO: 238389 - DNA, 25 bp, Mus musculus
atcacagcggcaaagcagagcacga

SEQ ID NO: 238390 - DNA, 25 bp, Mus musculus
atcacagcggcatagcagagcacga

SEQ ID NO: 238391 - DNA, 25 bp, Mus musculus
atcacagctaacactgcattcctga

SEQ ID NO: 238392 - DNA, 25 bp, Mus musculus
atcacagctaactctgcattcctga

SEQ ID NO: 238393 - DNA, 25 bp, Mus musculus
atcacagctaccatggcacagaggg

SEQ ID NO: 238394 - DNA, 25 bp, Mus musculus
atcacagctaccttggcacagaggg

SEQ ID NO: 238395 - DNA, 25 bp, Mus musculus
atcacagctagacgactgcccgagg

SEQ ID NO: 238396 - DNA, 25 bp, Mus musculus
atcacagctagaggactgcccgagg

SEQ ID NO: 238397 - DNA, 25 bp, Mus musculus
atcacagctattacagggcttttgt

SEQ ID NO: 238398 - DNA, 25 bp, Mus musculus
atcacagctatttcagggcttttgt

SEQ ID NO: 238399 - DNA, 25 bp, Mus musculus
atcacagctctcagccatgacaata

SEQ ID NO: 238400 - DNA, 25 bp, Mus musculus
atcacagctctctgccatgacaata

SEQ ID NO: 238401 - DNA, 25 bp, Mus musculus
atcacagctttactctttcaggtca

SEQ ID NO: 238402 - DNA, 25 bp, Mus musculus
atcacagctttagtctttcaggtca

SEQ ID NO: 238403 - DNA, 25 bp, Mus musculus
atcacaggatacatcatcaccagct

SEQ ID NO: 238404 - DNA, 25 bp, Mus musculus
atcacaggatacttcatcaccagct

SEQ ID NO: 238405 - DNA, 25 bp, Mus musculus
atcacaggatgacccagtcggagtc

SEQ ID NO: 238406 - DNA, 25 bp, Mus musculus
atcacaggatgagccagtcggagtc

SEQ ID NO: 238407 - DNA, 25 bp, Mus musculus
atcacaggatgcagggtgcacaccc

SEQ ID NO: 238408 - DNA, 25 bp, Mus musculus
atcacaggatgctgggtgcacaccc

SEQ ID NO: 238409 - DNA, 25 bp, Mus musculus
atcacaggcaaaccacaacctttag

SEQ ID NO: 238410 - DNA, 25 bp, Mus musculus
atcacaggcaaagcacaacctttag

SEQ ID NO: 238411 - DNA, 25 bp, Mus musculus
atcacaggcatgagtcaccaggctt

SEQ ID NO: 238412 - DNA, 25 bp, Mus musculus
atcacaggcatgtgtcaccaggctt

SEQ ID NO: 238413 - DNA, 25 bp, Mus musculus
atcacaggcccaaagtctagcgtta

SEQ ID NO: 238414 - DNA, 25 bp, Mus musculus
atcacaggcccatagtctagcgtta

SEQ ID NO: 238415 - DNA, 25 bp, Mus musculus
atcacaggcctgatcatctatagca

SEQ ID NO: 238416 - DNA, 25 bp, Mus musculus
atcacaggcctgcagacatttttag

SEQ ID NO: 238417 - DNA, 25 bp, Mus musculus
atcacaggcctggagacatttttag

SEQ ID NO: 238418 - DNA, 25 bp, Mus musculus
atcacaggcctgttcatctatagca

SEQ ID NO: 238419 - DNA, 25 bp, Mus musculus
atcacaggccttccgaaggtctatt

SEQ ID NO: 238420 - DNA, 25 bp, Mus musculus
atcacaggccttgcgaaggtctatt

SEQ ID NO: 238421 - DNA, 25 bp, Mus musculus
atcacaggcttaaaagacctttccc

SEQ ID NO: 238422 - DNA, 25 bp, Mus musculus
atcacaggcttataagacctttccc

SEQ ID NO: 238423 - DNA, 25 bp, Mus musculus
atcacagggaaccttcgggagccag

SEQ ID NO: 238424 - DNA, 25 bp, Mus musculus
atcacagggaacgttcgggagccag

SEQ ID NO: 238425 - DNA, 25 bp, Mus musculus
atcacagggcaccttagacggtctg

SEQ ID NO: 238426 - DNA, 25 bp, Mus musculus
atcacagggcacgttagacggtctg

SEQ ID NO: 238427 - DNA, 25 bp, Mus musculus
atcacagggcagaggtggtctccta

SEQ ID NO: 238428 - DNA, 25 bp, Mus musculus
atcacagggcagtggtggtctccta

SEQ ID NO: 238429 - DNA, 25 bp, Mus musculus
atcacagggcgacaagagttggaat

SEQ ID NO: 238430 - DNA, 25 bp, Mus musculus
atcacagggcgagaagagttggaat

SEQ ID NO: 238431 - DNA, 25 bp, Mus musculus
atcacagggctccactgaacatggt

SEQ ID NO: 238432 - DNA, 25 bp, Mus musculus
atcacagggctcgactgaacatggt

SEQ ID NO: 238433 - DNA, 25 bp, Mus musculus
atcacaggtgctcttgctgcaagga

SEQ ID NO: 238434 - DNA, 25 bp, Mus musculus
atcacaggtgctgttgctgcaagga

SEQ ID NO: 238435 - DNA, 25 bp, Mus musculus
atcacaggtggcaccagtcaggagc

SEQ ID NO: 238436 - DNA, 25 bp, Mus musculus
atcacaggtggctccagtcaggagc

SEQ ID NO: 238437 - DNA, 25 bp, Mus musculus
atcacaggtgtgagcggagacactt

SEQ ID NO: 238438 - DNA, 25 bp, Mus musculus
atcacaggtgtgtgcggagacactt

SEQ ID NO: 238439 - DNA, 25 bp, Mus musculus
atcacagtaacaagacaggtggtta

SEQ ID NO: 238440 - DNA, 25 bp, Mus musculus
atcacagtaacatgacaggtggtta

SEQ ID NO: 238441 - DNA, 25 bp, Mus musculus
atcacagtaaggctcgctcttcaga

SEQ ID NO: 238442 - DNA, 25 bp, Mus musculus
atcacagtaagggtcgctcttcaga

SEQ ID NO: 238443 - DNA, 25 bp, Mus musculus
atcacagtacttaggtgctgatact

SEQ ID NO: 238444 - DNA, 25 bp, Mus musculus
atcacagtactttggtgctgatact

SEQ ID NO: 238445 - DNA, 25 bp, Mus musculus
atcacagtcgctctgtggacccctg

SEQ ID NO: 238446 - DNA, 25 bp, Mus musculus
atcacagtcgctgtgtggacccctg

SEQ ID NO: 238447 - DNA, 25 bp, Mus musculus
atcacagtctaaatgtttacacaaa

SEQ ID NO: 238448 - DNA, 25 bp, Mus musculus
atcacagtctaattgtttacacaaa

SEQ ID NO: 238449 - DNA, 25 bp, Mus musculus
atcacagtctggacctatgtgcctt

SEQ ID NO: 238450 - DNA, 25 bp, Mus musculus
atcacagtctggtcctatgtgcctt

SEQ ID NO: 238451 - DNA, 25 bp, Mus musculus
atcacagtgaacatcctggctatgt

SEQ ID NO: 238452 - DNA, 25 bp, Mus musculus
atcacagtgaacttcctggctatgt

SEQ ID NO: 238453 - DNA, 25 bp, Mus musculus
atcacagtgactccatctgattctg

SEQ ID NO: 238454 - DNA, 25 bp, Mus musculus
atcacagtgactgcatctgattctg

SEQ ID NO: 238455 - DNA, 25 bp, Mus musculus
atcacagtgcccagtatccgaaata

SEQ ID NO: 238456 - DNA, 25 bp, Mus musculus
atcacagtgccctgtatccgaaata

SEQ ID NO: 238457 - DNA, 25 bp, Mus musculus
atcacagtgcgcctggccggtccat

SEQ ID NO: 238458 - DNA, 25 bp, Mus musculus
atcacagtgcgcgtggccggtccat

SEQ ID NO: 238459 - DNA, 25 bp, Mus musculus
atcacagtgcggagaaagcccggct

SEQ ID NO: 238460 - DNA, 25 bp, Mus musculus
atcacagtgcggtgaaagcccggct

SEQ ID NO: 238461 - DNA, 25 bp, Mus musculus
atcacagtggatcaatttattcagc

SEQ ID NO: 238462 - DNA, 25 bp, Mus musculus
atcacagtggatgaatttattcagc

SEQ ID NO: 238463 - DNA, 25 bp, Mus musculus
atcacagttcccaacgatgccatga

SEQ ID NO: 238464 - DNA, 25 bp, Mus musculus
atcacagttccctacgatgccatga

SEQ ID NO: 238465 - DNA, 25 bp, Mus musculus
atcacagttcgactttgaccccaat

SEQ ID NO: 238466 - DNA, 25 bp, Mus musculus
atcacagttcgagtttgaccccaat

SEQ ID NO: 238467 - DNA, 25 bp, Mus musculus
atcacagttctcaatggagccccag

SEQ ID NO: 238468 - DNA, 25 bp, Mus musculus
atcacagttctctatggagccccag

SEQ ID NO: 238469 - DNA, 25 bp, Mus musculus
atcacatacgtgctgctggctggaa

SEQ ID NO: 238470 - DNA, 25 bp, Mus musculus
atcacatacgtggtgctggctggaa

SEQ ID NO: 238471 - DNA, 25 bp, Mus musculus
atcacatactttagtctatcatgtt

SEQ ID NO: 238472 - DNA, 25 bp, Mus musculus
atcacatacttttgtctatcatgtt

SEQ ID NO: 238473 - DNA, 25 bp, Mus musculus
atcacatagcgaatcatggtcactc

SEQ ID NO: 238474 - DNA, 25 bp, Mus musculus
atcacatagcgattcatggtcactc

SEQ ID NO: 238475 - DNA, 25 bp, Mus musculus
atcacatagtctaacagccctgaag

SEQ ID NO: 238476 - DNA, 25 bp, Mus musculus
atcacatagtcttacagccctgaag

SEQ ID NO: 238477 - DNA, 25 bp, Mus musculus
atcacatatgagaggccctgccatg

SEQ ID NO: 238478 - DNA, 25 bp, Mus musculus
atcacatatgagtggccctgccatg

SEQ ID NO: 238479 - DNA, 25 bp, Mus musculus
atcacatcatatcgagagacgtgtc

SEQ ID NO: 238480 - DNA, 25 bp, Mus musculus
atcacatcatatggagagacgtgtc

SEQ ID NO: 238481 - DNA, 25 bp, Mus musculus
atcacatccagtccaatatccgata

SEQ ID NO: 238482 - DNA, 25 bp, Mus musculus
atcacatccagtgcaatatccgata

SEQ ID NO: 238483 - DNA, 25 bp, Mus musculus
atcacatccctcccctgagagagag

SEQ ID NO: 238484 - DNA, 25 bp, Mus musculus
atcacatccctcgcctgagagagag

SEQ ID NO: 238485 - DNA, 25 bp, Mus musculus
atcacatcctgaaatgcaagccaaa

SEQ ID NO: 238486 - DNA, 25 bp, Mus musculus
atcacatcctgatatgcaagccaaa

SEQ ID NO: 238487 - DNA, 25 bp, Mus musculus
atcacatcctgcctaaagtgtctgg

SEQ ID NO: 238488 - DNA, 25 bp, Mus musculus
atcacatcctgcgtaaagtgtctgg

SEQ ID NO: 238489 - DNA, 25 bp, Mus musculus
atcacatcctgtctggaccagcaga

SEQ ID NO: 238490 - DNA, 25 bp, Mus musculus
atcacatcctgtgtggaccagcaga

SEQ ID NO: 238491 - DNA, 25 bp, Mus musculus
atcacatcgactacactcacgctgt

SEQ ID NO: 238492 - DNA, 25 bp, Mus musculus
atcacatcgacttcactcacgctgt

SEQ ID NO: 238493 - DNA, 25 bp, Mus musculus
atcacatctcacatatatgggtcga

SEQ ID NO: 238494 - DNA, 25 bp, Mus musculus
atcacatctcacttatatgggtcga

SEQ ID NO: 238495 - DNA, 25 bp, Mus musculus
atcacatctgagaccgcgtcaacaa

SEQ ID NO: 238496 - DNA, 25 bp, Mus musculus
atcacatctgagtccgcgtcaacaa

SEQ ID NO: 238497 - DNA, 25 bp, Mus musculus
atcacatctgataagatctgaggag

SEQ ID NO: 238498 - DNA, 25 bp, Mus musculus
atcacatctgattagatctgaggag

SEQ ID NO: 238499 - DNA, 25 bp, Mus musculus
atcacatctggcagctccagtcatg

SEQ ID NO: 238500 - DNA, 25 bp, Mus musculus
atcacatctggctgctccagtcatg

SEQ ID NO: 238501 - DNA, 25 bp, Mus musculus
atcacatgacaccagctgagtggta

SEQ ID NO: 238502 - DNA, 25 bp, Mus musculus
atcacatgacacgagctgagtggta

SEQ ID NO: 238503 - DNA, 25 bp, Mus musculus
atcacatgaccaatattgtgtcaaa

SEQ ID NO: 238504 - DNA, 25 bp, Mus musculus
atcacatgaccattattgtgtcaaa

SEQ ID NO: 238505 - DNA, 25 bp, Mus musculus
atcacatgatgtactcctggtgaac

SEQ ID NO: 238506 - DNA, 25 bp, Mus musculus
atcacatgatgttctcctggtgaac

SEQ ID NO: 238507 - DNA, 25 bp, Mus musculus
atcacatgcagcactcatgcttctg

SEQ ID NO: 238508 - DNA, 25 bp, Mus musculus
atcacatgcagctctcatgcttctg

SEQ ID NO: 238509 - DNA, 25 bp, Mus musculus
atcacatgcgtaccccaaacacata

SEQ ID NO: 238510 - DNA, 25 bp, Mus musculus
atcacatgcgtagcccaaacacata

SEQ ID NO: 238511 - DNA, 25 bp, Mus musculus
atcacatgctctcctttgccttttt

SEQ ID NO: 238512 - DNA, 25 bp, Mus musculus
atcacatgctctgctttgccttttt

SEQ ID NO: 238513 - DNA, 25 bp, Mus musculus
atcacatggacaccagggagcctta

SEQ ID NO: 238514 - DNA, 25 bp, Mus musculus
atcacatggacactaaggcacgttt

SEQ ID NO: 238515 - DNA, 25 bp, Mus musculus
atcacatggacagcagggagcctta

SEQ ID NO: 238516 - DNA, 25 bp, Mus musculus
atcacatggacagtaaggcacgttt

SEQ ID NO: 238517 - DNA, 25 bp, Mus musculus
atcacatggcacagccgtcgcaggc

SEQ ID NO: 238518 - DNA, 25 bp, Mus musculus
atcacatggcactgccgtcgcaggc

SEQ ID NO: 238519 - DNA, 25 bp, Mus musculus
atcacatggcctatctgtgtggcta

SEQ ID NO: 238520 - DNA, 25 bp, Mus musculus
atcacatggcctttctgtgtggcta

SEQ ID NO: 238521 - DNA, 25 bp, Mus musculus
atcacatgggtgcaaacttacgaag

SEQ ID NO: 238522 - DNA, 25 bp, Mus musculus
atcacatgggtggaaacttacgaag

SEQ ID NO: 238523 - DNA, 25 bp, Mus musculus
atcacatggtcaactcgaaggcgca

SEQ ID NO: 238524 - DNA, 25 bp, Mus musculus
atcacatggtcatctcgaaggcgca

SEQ ID NO: 238525 - DNA, 25 bp, Mus musculus
atcacatgtcctaccacaggacttg

SEQ ID NO: 238526 - DNA, 25 bp, Mus musculus
atcacatgtccttccacaggacttg

SEQ ID NO: 238527 - DNA, 25 bp, Mus musculus
atcacatgtctcaacactaacaggg

SEQ ID NO: 238528 - DNA, 25 bp, Mus musculus
atcacatgtctctacactaacaggg

SEQ ID NO: 238529 - DNA, 25 bp, Mus musculus
atcacatgtgacctagactggcctt

SEQ ID NO: 238530 - DNA, 25 bp, Mus musculus
atcacatgtgacgtagactggcctt

SEQ ID NO: 238531 - DNA, 25 bp, Mus musculus
atcacattaagaaagtactcggctt

SEQ ID NO: 238532 - DNA, 25 bp, Mus musculus
atcacattaagatagtactcggctt

SEQ ID NO: 238533 - DNA, 25 bp, Mus musculus
atcacattacatacaaccggccgtt

SEQ ID NO: 238534 - DNA, 25 bp, Mus musculus
atcacattacattcaaccggccgtt

SEQ ID NO: 238535 - DNA, 25 bp, Mus musculus
atcacattagtgatcagaaatgagg

SEQ ID NO: 238536 - DNA, 25 bp, Mus musculus
atcacattagtgttcagaaatgagg

SEQ ID NO: 238537 - DNA, 25 bp, Mus musculus
atcacattcagacctcaggacctgg

SEQ ID NO: 238538 - DNA, 25 bp, Mus musculus
atcacattcagagctcaggacctgg

SEQ ID NO: 238539 - DNA, 25 bp, Mus musculus
atcacattccttacggtttcttggt

SEQ ID NO: 238540 - DNA, 25 bp, Mus musculus
atcacattcctttcggtttcttggt

SEQ ID NO: 238541 - DNA, 25 bp, Mus musculus
atcacattgtttccttcggtgtcac

SEQ ID NO: 238542 - DNA, 25 bp, Mus musculus
atcacattgtttgcttcggtgtcac

SEQ ID NO: 238543 - DNA, 25 bp, Mus musculus
atcacatttaaactgtcttgtctcc

SEQ ID NO: 238544 - DNA, 25 bp, Mus musculus
atcacatttaaagtgtcttgtctcc

SEQ ID NO: 238545 - DNA, 25 bp, Mus musculus
atcacatttataatcctgcaaccac

SEQ ID NO: 238546 - DNA, 25 bp, Mus musculus
atcacatttatattcctgcaaccac

SEQ ID NO: 238547 - DNA, 25 bp, Mus musculus
atcacatttcctctagcgcagataa

SEQ ID NO: 238548 - DNA, 25 bp, Mus musculus
atcacatttcctgtagcgcagataa

SEQ ID NO: 238549 - DNA, 25 bp, Mus musculus
atcacatttgttaaacttgcccaga

SEQ ID NO: 238550 - DNA, 25 bp, Mus musculus
atcacatttgtttaacttgcccaga

SEQ ID NO: 238551 - DNA, 25 bp, Mus musculus
atcacattttagatacacgttccta

SEQ ID NO: 238552 - DNA, 25 bp, Mus musculus
atcacattttagttacacgttccta

SEQ ID NO: 238553 - DNA, 25 bp, Mus musculus
atcaccaaatttcagctgaccatgc

SEQ ID NO: 238554 - DNA, 25 bp, Mus musculus
atcaccaaatttgagctgaccatgc

SEQ ID NO: 238555 - DNA, 25 bp, Mus musculus
atcaccaacatgctgtcttctgacg

SEQ ID NO: 238556 - DNA, 25 bp, Mus musculus
atcaccaacatggtgtcttctgacg

SEQ ID NO: 238557 - DNA, 25 bp, Mus musculus
atcaccaacgtgagcatgctttcgg

SEQ ID NO: 238558 - DNA, 25 bp, Mus musculus
atcaccaacgtgtgcatgctttcgg

SEQ ID NO: 238559 - DNA, 25 bp, Mus musculus
atcaccaagcagcagtacgacgagg

SEQ ID NO: 238560 - DNA, 25 bp, Mus musculus
atcaccaagcaggagtacgacgagg

SEQ ID NO: 238561 - DNA, 25 bp, Mus musculus
atcaccaagccccatgaaagtatgc

SEQ ID NO: 238562 - DNA, 25 bp, Mus musculus
atcaccaagcccgatgaaagtatgc

SEQ ID NO: 238563 - DNA, 25 bp, Mus musculus
atcaccaaggacaccagcgatgaga

SEQ ID NO: 238564 - DNA, 25 bp, Mus musculus
atcaccaaggacctggttctgcagt

SEQ ID NO: 238565 - DNA, 25 bp, Mus musculus
atcaccaaggacgtggttctgcagt

SEQ ID NO: 238566 - DNA, 25 bp, Mus musculus
atcaccaaggactccagcgatgaga

SEQ ID NO: 238567 - DNA, 25 bp, Mus musculus
atcaccaaggagaactggcccatgc

SEQ ID NO: 238568 - DNA, 25 bp, Mus musculus
atcaccaaggagtactggcccatgc

SEQ ID NO: 238569 - DNA, 25 bp, Mus musculus
atcaccaagtctactgagaccagct

SEQ ID NO: 238570 - DNA, 25 bp, Mus musculus
atcaccaagtcttctgagaccagct

SEQ ID NO: 238571 - DNA, 25 bp, Mus musculus
atcaccaagtggaacctgggctgga

SEQ ID NO: 238572 - DNA, 25 bp, Mus musculus
atcaccaagtggtacctgggctgga

SEQ ID NO: 238573 - DNA, 25 bp, Mus musculus
atcaccaataccatgacattgggcg

SEQ ID NO: 238574 - DNA, 25 bp, Mus musculus
atcaccaataccttgacattgggcg

SEQ ID NO: 238575 - DNA, 25 bp, Mus musculus
atcaccacaagccatctgttttcac

SEQ ID NO: 238576 - DNA, 25 bp, Mus musculus
atcaccacaagcgatctgttttcac

SEQ ID NO: 238577 - DNA, 25 bp, Mus musculus
atcaccacacgcacttatcaggaac

SEQ ID NO: 238578 - DNA, 25 bp, Mus musculus
atcaccacacgctcttatcaggaac

SEQ ID NO: 238579 - DNA, 25 bp, Mus musculus
atcaccaccacaaggcttggtttta

SEQ ID NO: 238580 - DNA, 25 bp, Mus musculus
atcaccaccacatggcttggtttta

SEQ ID NO: 238581 - DNA, 25 bp, Mus musculus
atcaccaccgctcggatgctatggc

SEQ ID NO: 238582 - DNA, 25 bp, Mus musculus
atcaccaccgctgggatgctatggc

SEQ ID NO: 238583 - DNA, 25 bp, Mus musculus
atcaccacgaaactgttcaccagct

SEQ ID NO: 238584 - DNA, 25 bp, Mus musculus
atcaccacgaaagtgttcaccagct

SEQ ID NO: 238585 - DNA, 25 bp, Mus musculus
atcaccacgaccaagatcatcgata

SEQ ID NO: 238586 - DNA, 25 bp, Mus musculus
atcaccacgacctagatcatcgata

SEQ ID NO: 238587 - DNA, 25 bp, Mus musculus
atcaccacgggaagctatgtagttt

SEQ ID NO: 238588 - DNA, 25 bp, Mus musculus
atcaccacgggatgctatgtagttt

SEQ ID NO: 238589 - DNA, 25 bp, Mus musculus
atcaccacggttacgagggacatct

SEQ ID NO: 238590 - DNA, 25 bp, Mus musculus
atcaccacggttcttcagagaatat

SEQ ID NO: 238591 - DNA, 25 bp, Mus musculus
atcaccacggttgttcagagaatat

SEQ ID NO: 238592 - DNA, 25 bp, Mus musculus
atcaccacggtttcgagggacatct

SEQ ID NO: 238593 - DNA, 25 bp, Mus musculus
atcaccacttccctgagaacagtga

SEQ ID NO: 238594 - DNA, 25 bp, Mus musculus
atcaccacttccgtgagaacagtga

SEQ ID NO: 238595 - DNA, 25 bp, Mus musculus
atcaccacttctcatgtacccgtgg

SEQ ID NO: 238596 - DNA, 25 bp, Mus musculus
atcaccacttctgatgtacccgtgg

SEQ ID NO: 238597 - DNA, 25 bp, Mus musculus
atcaccacttgtacgcactcaagag

SEQ ID NO: 238598 - DNA, 25 bp, Mus musculus
atcaccacttgttcgcactcaagag

SEQ ID NO: 238599 - DNA, 25 bp, Mus musculus
atcaccagaggcacgtgttggtggc

SEQ ID NO: 238600 - DNA, 25 bp, Mus musculus
atcaccagaggctcgtgttggtggc

SEQ ID NO: 238601 - DNA, 25 bp, Mus musculus
atcaccagcacacactcgggagaca

SEQ ID NO: 238602 - DNA, 25 bp, Mus musculus
atcaccagcacagactcgggagaca

SEQ ID NO: 238603 - DNA, 25 bp, Mus musculus
atcaccagcaggctggctaggctac

SEQ ID NO: 238604 - DNA, 25 bp, Mus musculus
atcaccagcagggtggctaggctac

SEQ ID NO: 238605 - DNA, 25 bp, Mus musculus
atcaccagcattaagttttgctcaa

SEQ ID NO: 238606 - DNA, 25 bp, Mus musculus
atcaccagcatttagttttgctcaa

SEQ ID NO: 238607 - DNA, 25 bp, Mus musculus
atcaccagccgtctggccgtggaag

SEQ ID NO: 238608 - DNA, 25 bp, Mus musculus
atcaccagccgtgtggccgtggaag

SEQ ID NO: 238609 - DNA, 25 bp, Mus musculus
atcaccaggattatgcacatctcct

SEQ ID NO: 238610 - DNA, 25 bp, Mus musculus
atcaccaggattttgcacatctcct

SEQ ID NO: 238611 - DNA, 25 bp, Mus musculus
atcaccaggcgcaggaagcacctca

SEQ ID NO: 238612 - DNA, 25 bp, Mus musculus
atcaccaggcgctggaagcacctca

SEQ ID NO: 238613 - DNA, 25 bp, Mus musculus
atcaccaggctaaggactgtatcga

SEQ ID NO: 238614 - DNA, 25 bp, Mus musculus
atcaccaggctatggactgtatcga

SEQ ID NO: 238615 - DNA, 25 bp, Mus musculus
atcaccaggcttaagagacaatatc

SEQ ID NO: 238616 - DNA, 25 bp, Mus musculus
atcaccaggctttagagacaatatc

SEQ ID NO: 238617 - DNA, 25 bp, Mus musculus
atcaccagggaacatattgtgtttt

SEQ ID NO: 238618 - DNA, 25 bp, Mus musculus
atcaccagggaagatattgtgtttt

SEQ ID NO: 238619 - DNA, 25 bp, Mus musculus
atcaccagggatctcagcgcaatta

SEQ ID NO: 238620 - DNA, 25 bp, Mus musculus
atcaccagggatgtcagcgcaatta

SEQ ID NO: 238621 - DNA, 25 bp, Mus musculus
atcaccagggcgaggtcatcgtgac

SEQ ID NO: 238622 - DNA, 25 bp, Mus musculus
atcaccagggcgtggtcatcgtgac

SEQ ID NO: 238623 - DNA, 25 bp, Mus musculus
atcaccagtgatcagtccctgtcag

SEQ ID NO: 238624 - DNA, 25 bp, Mus musculus
atcaccagtgatgagtccctgtcag

SEQ ID NO: 238625 - DNA, 25 bp, Mus musculus
atcaccagtttccttcaggaggctt

SEQ ID NO: 238626 - DNA, 25 bp, Mus musculus
atcaccagtttcgttcaggaggctt

SEQ ID NO: 238627 - DNA, 25 bp, Mus musculus
atcaccataccaccagaagacaaag

SEQ ID NO: 238628 - DNA, 25 bp, Mus musculus
atcaccataccagcagaagacaaag

SEQ ID NO: 238629 - DNA, 25 bp, Mus musculus
atcaccatagctacgagatgagatt

SEQ ID NO: 238630 - DNA, 25 bp, Mus musculus
atcaccatagcttcgagatgagatt

SEQ ID NO: 238631 - DNA, 25 bp, Mus musculus
atcaccatagtaagcatctgcaccc

SEQ ID NO: 238632 - DNA, 25 bp, Mus musculus
atcaccatagtatgcatctgcaccc

SEQ ID NO: 238633 - DNA, 25 bp, Mus musculus
atcaccatagtgcagattttatttt

SEQ ID NO: 238634 - DNA, 25 bp, Mus musculus
atcaccatagtggagattttatttt

SEQ ID NO: 238635 - DNA, 25 bp, Mus musculus
atcaccatcaacaccgctgttgtgt

SEQ ID NO: 238636 - DNA, 25 bp, Mus musculus
atcaccatcaactccgctgttgtgt

SEQ ID NO: 238637 - DNA, 25 bp, Mus musculus
atcaccatcaagactctggcagaaa

SEQ ID NO: 238638 - DNA, 25 bp, Mus musculus
atcaccatcaagtctctggcagaaa

SEQ ID NO: 238639 - DNA, 25 bp, Mus musculus
atcaccatccaacttacttttactg

SEQ ID NO: 238640 - DNA, 25 bp, Mus musculus
atcaccatccaagttacttttactg

SEQ ID NO: 238641 - DNA, 25 bp, Mus musculus
atcaccatccccaggattgaagtgc

SEQ ID NO: 238642 - DNA, 25 bp, Mus musculus
atcaccatcccctggattgaagtgc

SEQ ID NO: 238643 - DNA, 25 bp, Mus musculus
atcaccatcgagactcaggttggag

SEQ ID NO: 238644 - DNA, 25 bp, Mus musculus
atcaccatcgagtctcaggttggag

SEQ ID NO: 238645 - DNA, 25 bp, Mus musculus
atcaccatctcacgctttacacgtg

SEQ ID NO: 238646 - DNA, 25 bp, Mus musculus
atcaccatctcaggctttacacgtg

SEQ ID NO: 238647 - DNA, 25 bp, Mus musculus
atcaccatctgcagcattgtctgga

SEQ ID NO: 238648 - DNA, 25 bp, Mus musculus
atcaccatctgctgcattgtctgga

SEQ ID NO: 238649 - DNA, 25 bp, Mus musculus
atcaccatggagattaggcttgcag

SEQ ID NO: 238650 - DNA, 25 bp, Mus musculus
atcaccatggagtttaggcttgcag

SEQ ID NO: 238651 - DNA, 25 bp, Mus musculus
atcaccatgggacttgtctgcaagc

SEQ ID NO: 238652 - DNA, 25 bp, Mus musculus
atcaccatgggagttgtctgcaagc

SEQ ID NO: 238653 - DNA, 25 bp, Mus musculus
atcaccatggttactgttgcctgca

SEQ ID NO: 238654 - DNA, 25 bp, Mus musculus
atcaccatggtttctgttgcctgca

SEQ ID NO: 238655 - DNA, 25 bp, Mus musculus
atcaccattccgcttactttcgagg

SEQ ID NO: 238656 - DNA, 25 bp, Mus musculus
atcaccattccggttactttcgagg

SEQ ID NO: 238657 - DNA, 25 bp, Mus musculus
atcaccattcggctactgagtttta

SEQ ID NO: 238658 - DNA, 25 bp, Mus musculus
atcaccattcgggtactgagtttta

SEQ ID NO: 238659 - DNA, 25 bp, Mus musculus
atcaccattgagctaatgtttgagc

SEQ ID NO: 238660 - DNA, 25 bp, Mus musculus
atcaccattgaggtaatgtttgagc

SEQ ID NO: 238661 - DNA, 25 bp, Mus musculus
atcacccaaaaaatagttctcagaa

SEQ ID NO: 238662 - DNA, 25 bp, Mus musculus
atcacccaaaaattagttctcagaa

SEQ ID NO: 238663 - DNA, 25 bp, Mus musculus
atcacccacaatctacactacgaga

SEQ ID NO: 238664 - DNA, 25 bp, Mus musculus
atcacccacaatgtacactacgaga

SEQ ID NO: 238665 - DNA, 25 bp, Mus musculus
atcacccacagaacatgagtccttt

SEQ ID NO: 238666 - DNA, 25 bp, Mus musculus
atcacccacagatcatgagtccttt

SEQ ID NO: 238667 - DNA, 25 bp, Mus musculus
atcacccacattccagaggcattta

SEQ ID NO: 238668 - DNA, 25 bp, Mus musculus
atcacccacattcttctgaaggctg

SEQ ID NO: 238669 - DNA, 25 bp, Mus musculus
atcacccacattgcagaggcattta

SEQ ID NO: 238670 - DNA, 25 bp, Mus musculus
atcacccacattgttctgaaggctg

SEQ ID NO: 238671 - DNA, 25 bp, Mus musculus
atcacccaccagagtccccccttca

SEQ ID NO: 238672 - DNA, 25 bp, Mus musculus
atcacccaccagtgtccccccttca

SEQ ID NO: 238673 - DNA, 25 bp, Mus musculus
atcacccaccgtcctaagtgaagat

SEQ ID NO: 238674 - DNA, 25 bp, Mus musculus
atcacccaccgtgctaagtgaagat

SEQ ID NO: 238675 - DNA, 25 bp, Mus musculus
atcacccacgagactaacctttagt

SEQ ID NO: 238676 - DNA, 25 bp, Mus musculus
atcacccacgagtctaacctttagt

SEQ ID NO: 238677 - DNA, 25 bp, Mus musculus
atcacccagaatcctctacacagag

SEQ ID NO: 238678 - DNA, 25 bp, Mus musculus
atcacccagaatcttcactactgtg

SEQ ID NO: 238679 - DNA, 25 bp, Mus musculus
atcacccagaatgctctacacagag

SEQ ID NO: 238680 - DNA, 25 bp, Mus musculus
atcacccagaatgttcactactgtg

SEQ ID NO: 238681 - DNA, 25 bp, Mus musculus
atcacccagcacatactgcatgaag

SEQ ID NO: 238682 - DNA, 25 bp, Mus musculus
atcacccagcacttactgcatgaag

SEQ ID NO: 238683 - DNA, 25 bp, Mus musculus
atcacccagcgcctcctggagcagg

SEQ ID NO: 238684 - DNA, 25 bp, Mus musculus
atcacccagcgcgtcctggagcagg

SEQ ID NO: 238685 - DNA, 25 bp, Mus musculus
atcacccaggatcacctcattattt

SEQ ID NO: 238686 - DNA, 25 bp, Mus musculus
atcacccaggatgacctcattattt

SEQ ID NO: 238687 - DNA, 25 bp, Mus musculus
atcacccagggcagtagctgctcta

SEQ ID NO: 238688 - DNA, 25 bp, Mus musculus
atcacccagggctgtagctgctcta

SEQ ID NO: 238689 - DNA, 25 bp, Mus musculus
atcacccagggtctggacacttcaa

SEQ ID NO: 238690 - DNA, 25 bp, Mus musculus
atcacccagggtgtggacacttcaa

SEQ ID NO: 238691 - DNA, 25 bp, Mus musculus
atcacccaggtgaaatagcgtctag

SEQ ID NO: 238692 - DNA, 25 bp, Mus musculus
atcacccaggtgtaatagcgtctag

SEQ ID NO: 238693 - DNA, 25 bp, Mus musculus
atcacccagtgaacaagtttctgtt

SEQ ID NO: 238694 - DNA, 25 bp, Mus musculus
atcacccagtgatcaagtttctgtt

SEQ ID NO: 238695 - DNA, 25 bp, Mus musculus
atcacccatctaagcttgccttgaa

SEQ ID NO: 238696 - DNA, 25 bp, Mus musculus
atcacccatctacagagctttgcta

SEQ ID NO: 238697 - DNA, 25 bp, Mus musculus
atcacccatctagagagctttgcta

SEQ ID NO: 238698 - DNA, 25 bp, Mus musculus
atcacccatctatgcttgccttgaa

SEQ ID NO: 238699 - DNA, 25 bp, Mus musculus
atcacccatggccaacaactgcagg

SEQ ID NO: 238700 - DNA, 25 bp, Mus musculus
atcacccatggcgaacaactgcagg

SEQ ID NO: 238701 - DNA, 25 bp, Mus musculus
atcaccccaaacagcttgagaccta

SEQ ID NO: 238702 - DNA, 25 bp, Mus musculus
atcaccccaaactgcttgagaccta

SEQ ID NO: 238703 - DNA, 25 bp, Mus musculus
atcaccccaattaaaatggctcctt

SEQ ID NO: 238704 - DNA, 25 bp, Mus musculus
atcaccccaatttaaatggctcctt

SEQ ID NO: 238705 - DNA, 25 bp, Mus musculus
atcaccccagggagagtatctgcca

SEQ ID NO: 238706 - DNA, 25 bp, Mus musculus
atcaccccagggtgagtatctgcca

SEQ ID NO: 238707 - DNA, 25 bp, Mus musculus
atcaccccgggcacagtaattttgt

SEQ ID NO: 238708 - DNA, 25 bp, Mus musculus
atcaccccgggctcagtaattttgt

SEQ ID NO: 238709 - DNA, 25 bp, Mus musculus
atcacccctgacatgcgggccttgg

SEQ ID NO: 238710 - DNA, 25 bp, Mus musculus
atcacccctgacttgcgggccttgg

SEQ ID NO: 238711 - DNA, 25 bp, Mus musculus
atcacccgacacaactgccaggagg

SEQ ID NO: 238712 - DNA, 25 bp, Mus musculus
atcacccgacactactgccaggagg

SEQ ID NO: 238713 - DNA, 25 bp, Mus musculus
atcacccggcatcttttggattttt

SEQ ID NO: 238714 - DNA, 25 bp, Mus musculus
atcacccggcatgttttggattttt

SEQ ID NO: 238715 - DNA, 25 bp, Mus musculus
atcacccgtcctcctgaacgtgtga

SEQ ID NO: 238716 - DNA, 25 bp, Mus musculus
atcacccgtcctgctgaacgtgtga

SEQ ID NO: 238717 - DNA, 25 bp, Mus musculus
atcaccctcaaaatcttattttcct

SEQ ID NO: 238718 - DNA, 25 bp, Mus musculus
atcaccctcaaattcttattttcct

SEQ ID NO: 238719 - DNA, 25 bp, Mus musculus
atcaccctcaaccaggtagctgttg

SEQ ID NO: 238720 - DNA, 25 bp, Mus musculus
atcaccctcaacgaggtagctgttg

SEQ ID NO: 238721 - DNA, 25 bp, Mus musculus
atcaccctcagcctagaggtacagg

SEQ ID NO: 238722 - DNA, 25 bp, Mus musculus
atcaccctcagcgtagaggtacagg

SEQ ID NO: 238723 - DNA, 25 bp, Mus musculus
atcaccctcaggcttgccgtggact

SEQ ID NO: 238724 - DNA, 25 bp, Mus musculus
atcaccctcagggttgccgtggact

SEQ ID NO: 238725 - DNA, 25 bp, Mus musculus
atcaccctccggactgacagaatag

SEQ ID NO: 238726 - DNA, 25 bp, Mus musculus
atcaccctccggtctgacagaatag

SEQ ID NO: 238727 - DNA, 25 bp, Mus musculus
atcaccctgaaacagctggacggct

SEQ ID NO: 238728 - DNA, 25 bp, Mus musculus
atcaccctgaaagagctggacggct

SEQ ID NO: 238729 - DNA, 25 bp, Mus musculus
atcaccctgaatccacgggctctgg

SEQ ID NO: 238730 - DNA, 25 bp, Mus musculus
atcaccctgaatgcacgggctctgg

SEQ ID NO: 238731 - DNA, 25 bp, Mus musculus
atcaccctgagcattgtcctggagc

SEQ ID NO: 238732 - DNA, 25 bp, Mus musculus
atcaccctgagctttgtcctggagc

SEQ ID NO: 238733 - DNA, 25 bp, Mus musculus
atcaccctgattctgactattatcg

SEQ ID NO: 238734 - DNA, 25 bp, Mus musculus
atcaccctgattgtgactattatcg

SEQ ID NO: 238735 - DNA, 25 bp, Mus musculus
atcaccctgcccagttatagaaaac

SEQ ID NO: 238736 - DNA, 25 bp, Mus musculus
atcaccctgccctgttatagaaaac

SEQ ID NO: 238737 - DNA, 25 bp, Mus musculus
atcaccctgctgcaagtgccacatg

SEQ ID NO: 238738 - DNA, 25 bp, Mus musculus
atcaccctgctggaagtgccacatg

SEQ ID NO: 238739 - DNA, 25 bp, Mus musculus
atcaccctgggtaaggctgggaagc

SEQ ID NO: 238740 - DNA, 25 bp, Mus musculus
atcaccctgggttaggctgggaagc

SEQ ID NO: 238741 - DNA, 25 bp, Mus musculus
atcaccctgtgcagtttcctgagga

SEQ ID NO: 238742 - DNA, 25 bp, Mus musculus
atcaccctgtgctgtttcctgagga

SEQ ID NO: 238743 - DNA, 25 bp, Mus musculus
atcacccttaaaacgttgcagcagc

SEQ ID NO: 238744 - DNA, 25 bp, Mus musculus
atcacccttaaatcgttgcagcagc

SEQ ID NO: 238745 - DNA, 25 bp, Mus musculus
atcacccttcataactttgggttct

SEQ ID NO: 238746 - DNA, 25 bp, Mus musculus
atcacccttcattactttgggttct

SEQ ID NO: 238747 - DNA, 25 bp, Mus musculus
atcacccttggcaacatactttgtg

SEQ ID NO: 238748 - DNA, 25 bp, Mus musculus
atcacccttggctacatactttgtg

SEQ ID NO: 238749 - DNA, 25 bp, Mus musculus
atcaccctttacctagcactgtgat

SEQ ID NO: 238750 - DNA, 25 bp, Mus musculus
atcaccctttacgtagcactgtgat

SEQ ID NO: 238751 - DNA, 25 bp, Mus musculus
atcaccctttttctacacaattgct

SEQ ID NO: 238752 - DNA, 25 bp, Mus musculus
atcaccctttttgtacacaattgct

SEQ ID NO: 238753 - DNA, 25 bp, Mus musculus
atcaccgagataacccaaaactgcc

SEQ ID NO: 238754 - DNA, 25 bp, Mus musculus
atcaccgagatatcccaaaactgcc

SEQ ID NO: 238755 - DNA, 25 bp, Mus musculus
atcaccgatgaccagtttgactttc

SEQ ID NO: 238756 - DNA, 25 bp, Mus musculus
atcaccgatgacgagtttgactttc

SEQ ID NO: 238757 - DNA, 25 bp, Mus musculus
atcaccgcagcaaatgtggagatga

SEQ ID NO: 238758 - DNA, 25 bp, Mus musculus
atcaccgcagcatatgtggagatga

SEQ ID NO: 238759 - DNA, 25 bp, Mus musculus
atcaccgcctctaacagtcaagaaa

SEQ ID NO: 238760 - DNA, 25 bp, Mus musculus
atcaccgcctcttacagtcaagaaa

SEQ ID NO: 238761 - DNA, 25 bp, Mus musculus
atcaccgcgagacactttctaagta

SEQ ID NO: 238762 - DNA, 25 bp, Mus musculus
atcaccgcgagagactttctaagta

SEQ ID NO: 238763 - DNA, 25 bp, Mus musculus
atcaccgggatgctgctggaaatcg

SEQ ID NO: 238764 - DNA, 25 bp, Mus musculus
atcaccgggatggtgctggaaatcg

SEQ ID NO: 238765 - DNA, 25 bp, Mus musculus
atcaccgtagttaagtatccaaggc

SEQ ID NO: 238766 - DNA, 25 bp, Mus musculus
atcaccgtagtttagtatccaaggc

SEQ ID NO: 238767 - DNA, 25 bp, Mus musculus
atcaccgtctaacctcaggtccagt

SEQ ID NO: 238768 - DNA, 25 bp, Mus musculus
atcaccgtctaagctcaggtccagt

SEQ ID NO: 238769 - DNA, 25 bp, Mus musculus
atcaccgtctggatgcttgtcatgt

SEQ ID NO: 238770 - DNA, 25 bp, Mus musculus
atcaccgtctggttgcttgtcatgt

SEQ ID NO: 238771 - DNA, 25 bp, Mus musculus
atcaccgtgcataatgggattccaa

SEQ ID NO: 238772 - DNA, 25 bp, Mus musculus
atcaccgtgcatacacatttgctat

SEQ ID NO: 238773 - DNA, 25 bp, Mus musculus
atcaccgtgcattatgggattccaa

SEQ ID NO: 238774 - DNA, 25 bp, Mus musculus
atcaccgtgcattcacatttgctat

SEQ ID NO: 238775 - DNA, 25 bp, Mus musculus
atcaccgtgcccatcaaggcctggg

SEQ ID NO: 238776 - DNA, 25 bp, Mus musculus
atcaccgtgcccttcaaggcctggg

SEQ ID NO: 238777 - DNA, 25 bp, Mus musculus
atcaccgtggacacgaagcgcttct

SEQ ID NO: 238778 - DNA, 25 bp, Mus musculus
atcaccgtggactcgaagcgcttct

SEQ ID NO: 238779 - DNA, 25 bp, Mus musculus
atcaccgtttatctctcaatctatg

SEQ ID NO: 238780 - DNA, 25 bp, Mus musculus
atcaccgtttatgtctcaatctatg

SEQ ID NO: 238781 - DNA, 25 bp, Mus musculus
atcacctaaattcctgcttgtctgt

SEQ ID NO: 238782 - DNA, 25 bp, Mus musculus
atcacctaaattgctgcttgtctgt

SEQ ID NO: 238783 - DNA, 25 bp, Mus musculus
atcacctaagaacgaggcctaccag

SEQ ID NO: 238784 - DNA, 25 bp, Mus musculus
atcacctaagaaggaggcctaccag

SEQ ID NO: 238785 - DNA, 25 bp, Mus musculus
atcacctacaagctgctccgttaga

SEQ ID NO: 238786 - DNA, 25 bp, Mus musculus
atcacctacaaggtgctccgttaga

SEQ ID NO: 238787 - DNA, 25 bp, Mus musculus
atcacctacatgctcttctttgtca

SEQ ID NO: 238788 - DNA, 25 bp, Mus musculus
atcacctacatggtcttctttgtca

SEQ ID NO: 238789 - DNA, 25 bp, Mus musculus
atcacctaccagatcatgaagccag

SEQ ID NO: 238790 - DNA, 25 bp, Mus musculus
atcacctaccagttcatgaagccag

SEQ ID NO: 238791 - DNA, 25 bp, Mus musculus
atcacctaccgcatcaagcggtgat

SEQ ID NO: 238792 - DNA, 25 bp, Mus musculus
atcacctaccgcttcaagcggtgat

SEQ ID NO: 238793 - DNA, 25 bp, Mus musculus
atcacctagtagactgtccctacac

SEQ ID NO: 238794 - DNA, 25 bp, Mus musculus
atcacctagtagtctgtccctacac

SEQ ID NO: 238795 - DNA, 25 bp, Mus musculus
atcacctatgccctgactgttgtat

SEQ ID NO: 238796 - DNA, 25 bp, Mus musculus
atcacctatgccgtgactgttgtat

SEQ ID NO: 238797 - DNA, 25 bp, Mus musculus
atcacctatggcctcagtcagctgt

SEQ ID NO: 238798 - DNA, 25 bp, Mus musculus
atcacctatggcgtcagtcagctgt

SEQ ID NO: 238799 - DNA, 25 bp, Mus musculus
atcacctcaacgagggtgtggccca

SEQ ID NO: 238800 - DNA, 25 bp, Mus musculus
atcacctcaacgtgggtgtggccca

SEQ ID NO: 238801 - DNA, 25 bp, Mus musculus
atcacctcaactatcagggctccga

SEQ ID NO: 238802 - DNA, 25 bp, Mus musculus
atcacctcaactttcagggctccga

SEQ ID NO: 238803 - DNA, 25 bp, Mus musculus
atcacctcacaaatcatactagact

SEQ ID NO: 238804 - DNA, 25 bp, Mus musculus
atcacctcacaattcatactagact

SEQ ID NO: 238805 - DNA, 25 bp, Mus musculus
atcacctcacatcgaccctggatga

SEQ ID NO: 238806 - DNA, 25 bp, Mus musculus
atcacctcacatggaccctggatga

SEQ ID NO: 238807 - DNA, 25 bp, Mus musculus
atcacctcagagaccttatcaaaag

SEQ ID NO: 238808 - DNA, 25 bp, Mus musculus
atcacctcagagtccttatcaaaag

SEQ ID NO: 238809 - DNA, 25 bp, Mus musculus
atcacctcagatcagtgtggctcgc

SEQ ID NO: 238810 - DNA, 25 bp, Mus musculus
atcacctcagatgagtgtggctcgc

SEQ ID NO: 238811 - DNA, 25 bp, Mus musculus
atcacctcagctcgaagttccttgt

SEQ ID NO: 238812 - DNA, 25 bp, Mus musculus
atcacctcagctggaagttccttgt

SEQ ID NO: 238813 - DNA, 25 bp, Mus musculus
atcacctcatagaacgctctttgtt

SEQ ID NO: 238814 - DNA, 25 bp, Mus musculus
atcacctcatagtacgctctttgtt

SEQ ID NO: 238815 - DNA, 25 bp, Mus musculus
atcacctcccttatacatggacaga

SEQ ID NO: 238816 - DNA, 25 bp, Mus musculus
atcacctcccttttacatggacaga

SEQ ID NO: 238817 - DNA, 25 bp, Mus musculus
atcacctcctgactcatctaaagac

SEQ ID NO: 238818 - DNA, 25 bp, Mus musculus
atcacctcctgagtcatctaaagac

SEQ ID NO: 238819 - DNA, 25 bp, Mus musculus
atcacctccttgcacaccaagcata

SEQ ID NO: 238820 - DNA, 25 bp, Mus musculus
atcacctccttggacaccaagcata

SEQ ID NO: 238821 - DNA, 25 bp, Mus musculus
atcacctcgcctaacgtatgtacag

SEQ ID NO: 238822 - DNA, 25 bp, Mus musculus
atcacctcgccttacgtatgtacag

SEQ ID NO: 238823 - DNA, 25 bp, Mus musculus
atcacctctactatctgggcagttg

SEQ ID NO: 238824 - DNA, 25 bp, Mus musculus
atcacctctactttctgggcagttg

SEQ ID NO: 238825 - DNA, 25 bp, Mus musculus
atcacctctatcatcagcaaccgag

SEQ ID NO: 238826 - DNA, 25 bp, Mus musculus
atcacctctatcttcagcaaccgag

SEQ ID NO: 238827 - DNA, 25 bp, Mus musculus
atcacctctgacaatttatgttggg

SEQ ID NO: 238828 - DNA, 25 bp, Mus musculus
atcacctctgactatttatgttggg

SEQ ID NO: 238829 - DNA, 25 bp, Mus musculus
atcacctctgcgaggcatgtgacaa

SEQ ID NO: 238830 - DNA, 25 bp, Mus musculus
atcacctctgcgtggcatgtgacaa

SEQ ID NO: 238831 - DNA, 25 bp, Mus musculus
atcacctctgctaaagttattttcg

SEQ ID NO: 238832 - DNA, 25 bp, Mus musculus
atcacctctgcttaagttattttcg

SEQ ID NO: 238833 - DNA, 25 bp, Mus musculus
atcacctcttccagggtatccaagg

SEQ ID NO: 238834 - DNA, 25 bp, Mus musculus
atcacctcttcctgggtatccaagg

SEQ ID NO: 238835 - DNA, 25 bp, Mus musculus
atcacctctttgaattgccactctc

SEQ ID NO: 238836 - DNA, 25 bp, Mus musculus
atcacctctttgtattgccactctc

SEQ ID NO: 238837 - DNA, 25 bp, Mus musculus
atcacctgaaccaccggatcagtgg

SEQ ID NO: 238838 - DNA, 25 bp, Mus musculus
atcacctgaacctccggatcagtgg

SEQ ID NO: 238839 - DNA, 25 bp, Mus musculus
atcacctgagacagattccgtacag

SEQ ID NO: 238840 - DNA, 25 bp, Mus musculus
atcacctgagactgattccgtacag

SEQ ID NO: 238841 - DNA, 25 bp, Mus musculus
atcacctgagcactcgagccgaggc

SEQ ID NO: 238842 - DNA, 25 bp, Mus musculus
atcacctgagcagtcgagccgaggc

SEQ ID NO: 238843 - DNA, 25 bp, Mus musculus
atcacctgatagctttcaaagaggg

SEQ ID NO: 238844 - DNA, 25 bp, Mus musculus
atcacctgataggtttcaaagaggg

SEQ ID NO: 238845 - DNA, 25 bp, Mus musculus
atcacctgatcgctggatcgattgg

SEQ ID NO: 238846 - DNA, 25 bp, Mus musculus
atcacctgatcggtggatcgattgg

SEQ ID NO: 238847 - DNA, 25 bp, Mus musculus
atcacctgattgcagttgacaacca

SEQ ID NO: 238848 - DNA, 25 bp, Mus musculus
atcacctgattggagttgacaacca

SEQ ID NO: 238849 - DNA, 25 bp, Mus musculus
atcacctgcacaagggaggctacaa

SEQ ID NO: 238850 - DNA, 25 bp, Mus musculus
atcacctgcacatgggaggctacaa

SEQ ID NO: 238851 - DNA, 25 bp, Mus musculus
atcacctgcgggagagtctggcagc

SEQ ID NO: 238852 - DNA, 25 bp, Mus musculus
atcacctgcgggtgagtctggcagc

SEQ ID NO: 238853 - DNA, 25 bp, Mus musculus
atcacctgctggctgaaagaccttc

SEQ ID NO: 238854 - DNA, 25 bp, Mus musculus
atcacctgctgggtgaaagaccttc

SEQ ID NO: 238855 - DNA, 25 bp, Mus musculus
atcacctggagaattgctgtcccac

SEQ ID NO: 238856 - DNA, 25 bp, Mus musculus
atcacctggagatttgctgtcccac

SEQ ID NO: 238857 - DNA, 25 bp, Mus musculus
atcacctgggatagtcgaacacctc

SEQ ID NO: 238858 - DNA, 25 bp, Mus musculus
atcacctgggattgtcgaacacctc

SEQ ID NO: 238859 - DNA, 25 bp, Mus musculus
atcacctgggccctgaagggtgctc

SEQ ID NO: 238860 - DNA, 25 bp, Mus musculus
atcacctgggccgtgaagggtgctc

SEQ ID NO: 238861 - DNA, 25 bp, Mus musculus
atcacctggttcctgttattctgga

SEQ ID NO: 238862 - DNA, 25 bp, Mus musculus
atcacctggttcgtgttattctgga

SEQ ID NO: 238863 - DNA, 25 bp, Mus musculus
atcacctgtatcaagatcttcatta

SEQ ID NO: 238864 - DNA, 25 bp, Mus musculus
atcacctgtatctagatcttcatta

SEQ ID NO: 238865 - DNA, 25 bp, Mus musculus
atcacctgtgtacgttggcctggag

SEQ ID NO: 238866 - DNA, 25 bp, Mus musculus
atcacctgtgtaggttggcctggag

SEQ ID NO: 238867 - DNA, 25 bp, Mus musculus
atcacctgtgttaaagccactccaa

SEQ ID NO: 238868 - DNA, 25 bp, Mus musculus
atcacctgtgtttaagccactccaa

SEQ ID NO: 238869 - DNA, 25 bp, Mus musculus
atcacctgttcaatgtggcttgtgc

SEQ ID NO: 238870 - DNA, 25 bp, Mus musculus
atcacctgttcacgacaggccccct

SEQ ID NO: 238871 - DNA, 25 bp, Mus musculus
atcacctgttcaggacaggccccct

SEQ ID NO: 238872 - DNA, 25 bp, Mus musculus
atcacctgttcattgtggcttgtgc

SEQ ID NO: 238873 - DNA, 25 bp, Mus musculus
atcaccttaactacggaatcatttt

SEQ ID NO: 238874 - DNA, 25 bp, Mus musculus
atcaccttaacttcggaatcatttt

SEQ ID NO: 238875 - DNA, 25 bp, Mus musculus
atcaccttacgactaagaccatctc

SEQ ID NO: 238876 - DNA, 25 bp, Mus musculus
atcaccttacgagtaagaccatctc

SEQ ID NO: 238877 - DNA, 25 bp, Mus musculus
atcaccttatacatcacttcctgtt

SEQ ID NO: 238878 - DNA, 25 bp, Mus musculus
atcaccttatacttcacttcctgtt

SEQ ID NO: 238879 - DNA, 25 bp, Mus musculus
atcaccttcaaaagtgcagaaacca

SEQ ID NO: 238880 - DNA, 25 bp, Mus musculus
atcaccttcaaatgtgcagaaacca

SEQ ID NO: 238881 - DNA, 25 bp, Mus musculus
atcaccttcaccattgctaatggag

SEQ ID NO: 238882 - DNA, 25 bp, Mus musculus
atcaccttcacctttgctaatggag

SEQ ID NO: 238883 - DNA, 25 bp, Mus musculus
atcaccttccacaaatttcagtcac

SEQ ID NO: 238884 - DNA, 25 bp, Mus musculus
atcaccttccactaatttcagtcac

SEQ ID NO: 238885 - DNA, 25 bp, Mus musculus
atcaccttccagaagtaattcatat

SEQ ID NO: 238886 - DNA, 25 bp, Mus musculus
atcaccttccagtagtaattcatat

SEQ ID NO: 238887 - DNA, 25 bp, Mus musculus
atcaccttccttaactccataggag

SEQ ID NO: 238888 - DNA, 25 bp, Mus musculus
atcaccttcctttactccataggag

SEQ ID NO: 238889 - DNA, 25 bp, Mus musculus
atcaccttctttacctgcgtggtat

SEQ ID NO: 238890 - DNA, 25 bp, Mus musculus
atcaccttctttactattctagacc

SEQ ID NO: 238891 - DNA, 25 bp, Mus musculus
atcaccttcttttcctgcgtggtat

SEQ ID NO: 238892 - DNA, 25 bp, Mus musculus
atcaccttcttttctattctagacc

SEQ ID NO: 238893 - DNA, 25 bp, Mus musculus
atcaccttgaccatcattgacaaga

SEQ ID NO: 238894 - DNA, 25 bp, Mus musculus
atcaccttgaccttcattgacaaga

SEQ ID NO: 238895 - DNA, 25 bp, Mus musculus
atcaccttggtgctggagacgctct

SEQ ID NO: 238896 - DNA, 25 bp, Mus musculus
atcaccttggtggtggagacgctct

SEQ ID NO: 238897 - DNA, 25 bp, Mus musculus
atcacctttattctttgttctccta

SEQ ID NO: 238898 - DNA, 25 bp, Mus musculus
atcacctttattgtttgttctccta

SEQ ID NO: 238899 - DNA, 25 bp, Mus musculus
atcacctttcagcaagtagtcattt

SEQ ID NO: 238900 - DNA, 25 bp, Mus musculus
atcacctttcaggaagtagtcattt

SEQ ID NO: 238901 - DNA, 25 bp, Mus musculus
atcacctttcctaggcttaagcatt

SEQ ID NO: 238902 - DNA, 25 bp, Mus musculus
atcacctttccttggcttaagcatt

SEQ ID NO: 238903 - DNA, 25 bp, Mus musculus
atcacctttgtaaaagtgtgccgca

SEQ ID NO: 238904 - DNA, 25 bp, Mus musculus
atcacctttgtataagtgtgccgca

SEQ ID NO: 238905 - DNA, 25 bp, Mus musculus
atcaccttttctaggcagacacatt

SEQ ID NO: 238906 - DNA, 25 bp, Mus musculus
atcaccttttcttggcagacacatt

SEQ ID NO: 238907 - DNA, 25 bp, Mus musculus
atcacgaaggatcctggctggcttc

SEQ ID NO: 238908 - DNA, 25 bp, Mus musculus
atcacgaaggatgctggctggcttc

SEQ ID NO: 238909 - DNA, 25 bp, Mus musculus
atcacgaatccaatgtaccgccttt

SEQ ID NO: 238910 - DNA, 25 bp, Mus musculus
atcacgaatccattgtaccgccttt

SEQ ID NO: 238911 - DNA, 25 bp, Mus musculus
atcacgaatcccatctgggttgtgg

SEQ ID NO: 238912 - DNA, 25 bp, Mus musculus
atcacgaatcccttctgggttgtgg

SEQ ID NO: 238913 - DNA, 25 bp, Mus musculus
atcacgaccgtcactcgaggtggga

SEQ ID NO: 238914 - DNA, 25 bp, Mus musculus
atcacgaccgtctctcgaggtggga

SEQ ID NO: 238915 - DNA, 25 bp, Mus musculus
atcacgagcgcccaggaggagccac

SEQ ID NO: 238916 - DNA, 25 bp, Mus musculus
atcacgagcgccgaggaggagccac

SEQ ID NO: 238917 - DNA, 25 bp, Mus musculus
atcacgaggcacacgaacatctagg

SEQ ID NO: 238918 - DNA, 25 bp, Mus musculus
atcacgaggcactcgaacatctagg

SEQ ID NO: 238919 - DNA, 25 bp, Mus musculus
atcacgagtgagagcaccggctggt

SEQ ID NO: 238920 - DNA, 25 bp, Mus musculus
atcacgagtgagtgcaccggctggt

SEQ ID NO: 238921 - DNA, 25 bp, Mus musculus
atcacgagtggcaccgaggcgtctg

SEQ ID NO: 238922 - DNA, 25 bp, Mus musculus
atcacgagtggctccgaggcgtctg

SEQ ID NO: 238923 - DNA, 25 bp, Mus musculus
atcacgagtggtattcctctgggac

SEQ ID NO: 238924 - DNA, 25 bp, Mus musculus
atcacgagtggttttcctctgggac

SEQ ID NO: 238925 - DNA, 25 bp, Mus musculus
atcacgatacccatttctggagctc

SEQ ID NO: 238926 - DNA, 25 bp, Mus musculus
atcacgatacccttttctggagctc

SEQ ID NO: 238927 - DNA, 25 bp, Mus musculus
atcacgatatggctggattccatcc

SEQ ID NO: 238928 - DNA, 25 bp, Mus musculus
atcacgatatgggtggattccatcc

SEQ ID NO: 238929 - DNA, 25 bp, Mus musculus
atcacgatggctatggcgcctacag

SEQ ID NO: 238930 - DNA, 25 bp, Mus musculus
atcacgatggctttggcgcctacag

SEQ ID NO: 238931 - DNA, 25 bp, Mus musculus
atcacgcagcaacaagggccagcca

SEQ ID NO: 238932 - DNA, 25 bp, Mus musculus
atcacgcagcaagaagggccagcca

SEQ ID NO: 238933 - DNA, 25 bp, Mus musculus
atcacgcaggccacatgtgagtatg

SEQ ID NO: 238934 - DNA, 25 bp, Mus musculus
atcacgcaggcctcatgtgagtatg

SEQ ID NO: 238935 - DNA, 25 bp, Mus musculus
atcacgccacgcaggagcccggtgt

SEQ ID NO: 238936 - DNA, 25 bp, Mus musculus
atcacgccacgctggagcccggtgt

SEQ ID NO: 238937 - DNA, 25 bp, Mus musculus
atcacgccagagacggaggcgcaat

SEQ ID NO: 238938 - DNA, 25 bp, Mus musculus
atcacgccagagtcggaggcgcaat

SEQ ID NO: 238939 - DNA, 25 bp, Mus musculus
atcacgccgtccaggtggttggcta

SEQ ID NO: 238940 - DNA, 25 bp, Mus musculus
atcacgccgtcctggtggttggcta

SEQ ID NO: 238941 - DNA, 25 bp, Mus musculus
atcacgcctcttctgctttgcagat

SEQ ID NO: 238942 - DNA, 25 bp, Mus musculus
atcacgcctcttgtgctttgcagat

SEQ ID NO: 238943 - DNA, 25 bp, Mus musculus
atcacgcctgagaacatatgcaagc

SEQ ID NO: 238944 - DNA, 25 bp, Mus musculus
atcacgcctgagtacatatgcaagc

SEQ ID NO: 238945 - DNA, 25 bp, Mus musculus
atcacgctcgtgaggcaaaaacgcg

SEQ ID NO: 238946 - DNA, 25 bp, Mus musculus
atcacgctcgtgtggcaaaaacgcg

SEQ ID NO: 238947 - DNA, 25 bp, Mus musculus
atcacgctgatgcagatctgagccc

SEQ ID NO: 238948 - DNA, 25 bp, Mus musculus
atcacgctgatggagatctgagccc

SEQ ID NO: 238949 - DNA, 25 bp, Mus musculus
atcacgctgcgccacctgaagcagt

SEQ ID NO: 238950 - DNA, 25 bp, Mus musculus
atcacgctgcgcgacctgaagcagt

SEQ ID NO: 238951 - DNA, 25 bp, Mus musculus
atcacgctgggcattgtctgtctgt

SEQ ID NO: 238952 - DNA, 25 bp, Mus musculus
atcacgctgggctttgtctgtctgt

SEQ ID NO: 238953 - DNA, 25 bp, Mus musculus
atcacgctgtggattgatgatgcgc

SEQ ID NO: 238954 - DNA, 25 bp, Mus musculus
atcacgctgtggtttgatgatgcgc

SEQ ID NO: 238955 - DNA, 25 bp, Mus musculus
atcacgcttacgacgggatgacaga

SEQ ID NO: 238956 - DNA, 25 bp, Mus musculus
atcacgcttacgtcgggatgacaga

SEQ ID NO: 238957 - DNA, 25 bp, Mus musculus
atcacggacctaaggacacgcgtca

SEQ ID NO: 238958 - DNA, 25 bp, Mus musculus
atcacggacctatggacacgcgtca

SEQ ID NO: 238959 - DNA, 25 bp, Mus musculus
atcacggagatgagtgaccccacag

SEQ ID NO: 238960 - DNA, 25 bp, Mus musculus
atcacggagatgtgtgaccccacag

SEQ ID NO: 238961 - DNA, 25 bp, Mus musculus
atcacggaggcccatgagagcttca

SEQ ID NO: 238962 - DNA, 25 bp, Mus musculus
atcacggaggccgatgagagcttca

SEQ ID NO: 238963 - DNA, 25 bp, Mus musculus
atcacggaggctagacgggtccaga

SEQ ID NO: 238964 - DNA, 25 bp, Mus musculus
atcacggaggcttgacgggtccaga

SEQ ID NO: 238965 - DNA, 25 bp, Mus musculus
atcacggagttccatcagctaacac

SEQ ID NO: 238966 - DNA, 25 bp, Mus musculus
atcacggagttcgatcagctaacac

SEQ ID NO: 238967 - DNA, 25 bp, Mus musculus
atcacggatgctccactgagactgt

SEQ ID NO: 238968 - DNA, 25 bp, Mus musculus
atcacggatgctgcactgagactgt

SEQ ID NO: 238969 - DNA, 25 bp, Mus musculus
atcacggccgctctcgtaatcaatg

SEQ ID NO: 238970 - DNA, 25 bp, Mus musculus
atcacggccgctgtcgtaatcaatg

SEQ ID NO: 238971 - DNA, 25 bp, Mus musculus
atcacggcggctaggactgtcctgt

SEQ ID NO: 238972 - DNA, 25 bp, Mus musculus
atcacggcggcttggactgtcctgt

SEQ ID NO: 238973 - DNA, 25 bp, Mus musculus
atcacggctacaacacaggctttgg

SEQ ID NO: 238974 - DNA, 25 bp, Mus musculus
atcacggctacatcacaggctttgg

SEQ ID NO: 238975 - DNA, 25 bp, Mus musculus
atcacgggcaccacgcagaactgga

SEQ ID NO: 238976 - DNA, 25 bp, Mus musculus
atcacgggcacctcgcagaactgga

SEQ ID NO: 238977 - DNA, 25 bp, Mus musculus
atcacgggcatgaggaaccccaacg

SEQ ID NO: 238978 - DNA, 25 bp, Mus musculus
atcacgggcatgtggaaccccaacg

SEQ ID NO: 238979 - DNA, 25 bp, Mus musculus
atcacgggccctctggaattcgaga

SEQ ID NO: 238980 - DNA, 25 bp, Mus musculus
atcacgggccctgtggaattcgaga

SEQ ID NO: 238981 - DNA, 25 bp, Mus musculus
atcacgggtccaattccagaggaat

SEQ ID NO: 238982 - DNA, 25 bp, Mus musculus
atcacgggtccatttccagaggaat

SEQ ID NO: 238983 - DNA, 25 bp, Mus musculus
atcacgggtgtgaacactgtcacag

SEQ ID NO: 238984 - DNA, 25 bp, Mus musculus
atcacgggtgtgtacactgtcacag

SEQ ID NO: 238985 - DNA, 25 bp, Mus musculus
atcacggtcatcagtccctgggaag

SEQ ID NO: 238986 - DNA, 25 bp, Mus musculus
atcacggtcatctgtccctgggaag

SEQ ID NO: 238987 - DNA, 25 bp, Mus musculus
atcacggtccatatcattactctca

SEQ ID NO: 238988 - DNA, 25 bp, Mus musculus
atcacggtccatttcattactctca

SEQ ID NO: 238989 - DNA, 25 bp, Mus musculus
atcacggtccttaggctcttagaat

SEQ ID NO: 238990 - DNA, 25 bp, Mus musculus
atcacggtcctttggctcttagaat

SEQ ID NO: 238991 - DNA, 25 bp, Mus musculus
atcacggtgcaccaaggccagaaca

SEQ ID NO: 238992 - DNA, 25 bp, Mus musculus
atcacggtgcacgaaggccagaaca

SEQ ID NO: 238993 - DNA, 25 bp, Mus musculus
atcacggttgtcaggcagagctata

SEQ ID NO: 238994 - DNA, 25 bp, Mus musculus
atcacggttgtctggcagagctata

SEQ ID NO: 238995 - DNA, 25 bp, Mus musculus
atcacgtaatcccaatgcctttatt

SEQ ID NO: 238996 - DNA, 25 bp, Mus musculus
atcacgtaatccgaatgcctttatt

SEQ ID NO: 238997 - DNA, 25 bp, Mus musculus
atcacgtccagcactttttctgttg

SEQ ID NO: 238998 - DNA, 25 bp, Mus musculus
atcacgtccagctctttttctgttg

SEQ ID NO: 238999 - DNA, 25 bp, Mus musculus
atcacgtcccgccaggtgcagacgg

SEQ ID NO: 239000 - DNA, 25 bp, Mus musculus
atcacgtcccgcgaggtgcagacgg

SEQ ID NO: 239001 - DNA, 25 bp, Mus musculus
atcacgtcccggcagatccagacgg

SEQ ID NO: 239002 - DNA, 25 bp, Mus musculus
atcacgtcccgggagatccagacgg

SEQ ID NO: 239003 - DNA, 25 bp, Mus musculus
atcacgtcgcatacggagccaggag

SEQ ID NO: 239004 - DNA, 25 bp, Mus musculus
atcacgtcgcattcggagccaggag

SEQ ID NO: 239005 - DNA, 25 bp, Mus musculus
atcacgtctctgactatccaaagaa

SEQ ID NO: 239006 - DNA, 25 bp, Mus musculus
atcacgtctctgtctatccaaagaa

SEQ ID NO: 239007 - DNA, 25 bp, Mus musculus
atcacgtctcttacctagacttggg

SEQ ID NO: 239008 - DNA, 25 bp, Mus musculus
atcacgtctctttcctagacttggg

SEQ ID NO: 239009 - DNA, 25 bp, Mus musculus
atcacgtgatgcatcgatgctggga

SEQ ID NO: 239010 - DNA, 25 bp, Mus musculus
atcacgtgatgcttcgatgctggga

SEQ ID NO: 239011 - DNA, 25 bp, Mus musculus
atcacgtgcttgagccaggttcccc

SEQ ID NO: 239012 - DNA, 25 bp, Mus musculus
atcacgtgcttgtgccaggttcccc

SEQ ID NO: 239013 - DNA, 25 bp, Mus musculus
atcacgtggctgatcttgtagttta

SEQ ID NO: 239014 - DNA, 25 bp, Mus musculus
atcacgtggctgttcttgtagttta

SEQ ID NO: 239015 - DNA, 25 bp, Mus musculus
atcacgtgggctccgtttctgtaat

SEQ ID NO: 239016 - DNA, 25 bp, Mus musculus
atcacgtgggctgcgtttctgtaat

SEQ ID NO: 239017 - DNA, 25 bp, Mus musculus
atcacgtggtgtcaagccagatttt

SEQ ID NO: 239018 - DNA, 25 bp, Mus musculus
atcacgtggtgtgaagccagatttt

SEQ ID NO: 239019 - DNA, 25 bp, Mus musculus
atcacgttattgattcttaatcagt

SEQ ID NO: 239020 - DNA, 25 bp, Mus musculus
atcacgttattgtttcttaatcagt

SEQ ID NO: 239021 - DNA, 25 bp, Mus musculus
atcacgttcgccacaaagcgtaatt

SEQ ID NO: 239022 - DNA, 25 bp, Mus musculus
atcacgttcgcctcaaagcgtaatt

SEQ ID NO: 239023 - DNA, 25 bp, Mus musculus
atcacgtttgtgaccacgggagtgg

SEQ ID NO: 239024 - DNA, 25 bp, Mus musculus
atcacgtttgtgatgtcttccttac

SEQ ID NO: 239025 - DNA, 25 bp, Mus musculus
atcacgtttgtgtccacgggagtgg

SEQ ID NO: 239026 - DNA, 25 bp, Mus musculus
atcacgtttgtgttgtcttccttac

SEQ ID NO: 239027 - DNA, 25 bp, Mus musculus
atcactaacaggcagctggagttaa

SEQ ID NO: 239028 - DNA, 25 bp, Mus musculus
atcactaacagggagctggagttaa

SEQ ID NO: 239029 - DNA, 25 bp, Mus musculus
atcactaaccggaggctgctttgat

SEQ ID NO: 239030 - DNA, 25 bp, Mus musculus
atcactaaccggtggctgctttgat

SEQ ID NO: 239031 - DNA, 25 bp, Mus musculus
atcactaactcaaagaaggcaagca

SEQ ID NO: 239032 - DNA, 25 bp, Mus musculus
atcactaactcatagaaggcaagca

SEQ ID NO: 239033 - DNA, 25 bp, Mus musculus
atcactaactctcccttttgggatt

SEQ ID NO: 239034 - DNA, 25 bp, Mus musculus
atcactaactctgccttttgggatt

SEQ ID NO: 239035 - DNA, 25 bp, Mus musculus
atcactaacttaaatcatcattggg

SEQ ID NO: 239036 - DNA, 25 bp, Mus musculus
atcactaacttatatcatcattggg

SEQ ID NO: 239037 - DNA, 25 bp, Mus musculus
atcactaactttaccctggcacatc

SEQ ID NO: 239038 - DNA, 25 bp, Mus musculus
atcactaacttttccctggcacatc

SEQ ID NO: 239039 - DNA, 25 bp, Mus musculus
atcactacaaacacctggctgtgga

SEQ ID NO: 239040 - DNA, 25 bp, Mus musculus
atcactacaaactcctggctgtgga

SEQ ID NO: 239041 - DNA, 25 bp, Mus musculus
atcactacactgagctgggagtttt

SEQ ID NO: 239042 - DNA, 25 bp, Mus musculus
atcactacactgtgctgggagtttt

SEQ ID NO: 239043 - DNA, 25 bp, Mus musculus
atcactacatctccctgcggaatga

SEQ ID NO: 239044 - DNA, 25 bp, Mus musculus
atcactacatctgcctgcggaatga

SEQ ID NO: 239045 - DNA, 25 bp, Mus musculus
atcactacctccaggcagcgaggga

SEQ ID NO: 239046 - DNA, 25 bp, Mus musculus
atcactacctcctggcagcgaggga

SEQ ID NO: 239047 - DNA, 25 bp, Mus musculus
atcactacgagaagacctccaaaag

SEQ ID NO: 239048 - DNA, 25 bp, Mus musculus
atcactacgagatgacctccaaaag

SEQ ID NO: 239049 - DNA, 25 bp, Mus musculus
atcactagacctatgtaatgtattt

SEQ ID NO: 239050 - DNA, 25 bp, Mus musculus
atcactagacctttgtaatgtattt

SEQ ID NO: 239051 - DNA, 25 bp, Mus musculus
atcactagctacatggcaagttcaa

SEQ ID NO: 239052 - DNA, 25 bp, Mus musculus
atcactagctacttggcaagttcaa

SEQ ID NO: 239053 - DNA, 25 bp, Mus musculus
atcactaggatcaccccaggtcaca

SEQ ID NO: 239054 - DNA, 25 bp, Mus musculus
atcactaggatctccccaggtcaca

SEQ ID NO: 239055 - DNA, 25 bp, Mus musculus
atcactagggatcttctacactcta

SEQ ID NO: 239056 - DNA, 25 bp, Mus musculus
atcactagggatgttctacactcta

SEQ ID NO: 239057 - DNA, 25 bp, Mus musculus
atcactaggtgcattgtcctttttg

SEQ ID NO: 239058 - DNA, 25 bp, Mus musculus
atcactaggtgctttgtcctttttg

SEQ ID NO: 239059 - DNA, 25 bp, Mus musculus
atcactagtaataatggtgccgcag

SEQ ID NO: 239060 - DNA, 25 bp, Mus musculus
atcactagtaatcggtgtgcccagc

SEQ ID NO: 239061 - DNA, 25 bp, Mus musculus
atcactagtaatgggtgtgcccagc

SEQ ID NO: 239062 - DNA, 25 bp, Mus musculus
atcactagtaattatggtgccgcag

SEQ ID NO: 239063 - DNA, 25 bp, Mus musculus
atcactagtttaagttctgcccttg

SEQ ID NO: 239064 - DNA, 25 bp, Mus musculus
atcactagtttatgttctgcccttg

SEQ ID NO: 239065 - DNA, 25 bp, Mus musculus
atcactataatacgagttggtctgt

SEQ ID NO: 239066 - DNA, 25 bp, Mus musculus
atcactataataggagttggtctgt

SEQ ID NO: 239067 - DNA, 25 bp, Mus musculus
atcactatatgtaggcgatgtcaac

SEQ ID NO: 239068 - DNA, 25 bp, Mus musculus
atcactatatgttggcgatgtcaac

SEQ ID NO: 239069 - DNA, 25 bp, Mus musculus
atcactatcacgatacaaaatttgg

SEQ ID NO: 239070 - DNA, 25 bp, Mus musculus
atcactatcacgttacaaaatttgg

SEQ ID NO: 239071 - DNA, 25 bp, Mus musculus
atcactatcaggcatgtgttaccaa

SEQ ID NO: 239072 - DNA, 25 bp, Mus musculus
atcactatcagggatgtgttaccaa

SEQ ID NO: 239073 - DNA, 25 bp, Mus musculus
atcactatcctgctgggtgttttca

SEQ ID NO: 239074 - DNA, 25 bp, Mus musculus
atcactatcctggtgggtgttttca

SEQ ID NO: 239075 - DNA, 25 bp, Mus musculus
atcactatgataatcggttacccaa

SEQ ID NO: 239076 - DNA, 25 bp, Mus musculus
atcactatgatattcggttacccaa

SEQ ID NO: 239077 - DNA, 25 bp, Mus musculus
atcactatgcaaatcttgaccccag

SEQ ID NO: 239078 - DNA, 25 bp, Mus musculus
atcactatgcaattcttgaccccag

SEQ ID NO: 239079 - DNA, 25 bp, Mus musculus
atcactattggcaacgagcggttcc

SEQ ID NO: 239080 - DNA, 25 bp, Mus musculus
atcactattggctacgagcggttcc

SEQ ID NO: 239081 - DNA, 25 bp, Mus musculus
atcactcaaagtaccactggctcga

SEQ ID NO: 239082 - DNA, 25 bp, Mus musculus
atcactcaaagttccactggctcga

SEQ ID NO: 239083 - DNA, 25 bp, Mus musculus
atcactcacccaaccatattgtgta

SEQ ID NO: 239084 - DNA, 25 bp, Mus musculus
atcactcacccatccatattgtgta

SEQ ID NO: 239085 - DNA, 25 bp, Mus musculus
atcactcacgacagtctctgattta

SEQ ID NO: 239086 - DNA, 25 bp, Mus musculus
atcactcacgactgtctctgattta

SEQ ID NO: 239087 - DNA, 25 bp, Mus musculus
atcactcacgcacacaggaaggcat

SEQ ID NO: 239088 - DNA, 25 bp, Mus musculus
atcactcacgcagacaggaaggcat

SEQ ID NO: 239089 - DNA, 25 bp, Mus musculus
atcactcacgtaaacacccatttct

SEQ ID NO: 239090 - DNA, 25 bp, Mus musculus
atcactcacgtatacacccatttct

SEQ ID NO: 239091 - DNA, 25 bp, Mus musculus
atcactcagtgaattggttgcaagt

SEQ ID NO: 239092 - DNA, 25 bp, Mus musculus
atcactcagtgatttggttgcaagt

SEQ ID NO: 239093 - DNA, 25 bp, Mus musculus
atcactcagtgcacatctggctctt

SEQ ID NO: 239094 - DNA, 25 bp, Mus musculus
atcactcagtgctcatctggctctt

SEQ ID NO: 239095 - DNA, 25 bp, Mus musculus
atcactcagttcaagtacctcatcc

SEQ ID NO: 239096 - DNA, 25 bp, Mus musculus
atcactcagttctagtacctcatcc

SEQ ID NO: 239097 - DNA, 25 bp, Mus musculus
atcactcataacattctggctccat

SEQ ID NO: 239098 - DNA, 25 bp, Mus musculus
atcactcataactttctggctccat

SEQ ID NO: 239099 - DNA, 25 bp, Mus musculus
atcactcatcgaaccgtgccgggtt

SEQ ID NO: 239100 - DNA, 25 bp, Mus musculus
atcactcatcgatccgtgccgggtt

SEQ ID NO: 239101 - DNA, 25 bp, Mus musculus
atcactcattcactgtattcaactg

SEQ ID NO: 239102 - DNA, 25 bp, Mus musculus
atcactcattcagtgtattcaactg

SEQ ID NO: 239103 - DNA, 25 bp, Mus musculus
atcactccccgaaagtgaagggaag

SEQ ID NO: 239104 - DNA, 25 bp, Mus musculus
atcactccccgatagtgaagggaag

SEQ ID NO: 239105 - DNA, 25 bp, Mus musculus
atcactcccgaacactacattagct

SEQ ID NO: 239106 - DNA, 25 bp, Mus musculus
atcactcccgaagactacattagct

SEQ ID NO: 239107 - DNA, 25 bp, Mus musculus
atcactcccgggatgtacactgctg

SEQ ID NO: 239108 - DNA, 25 bp, Mus musculus
atcactcccgggttgtacactgctg

SEQ ID NO: 239109 - DNA, 25 bp, Mus musculus
atcactcctgtcacgaaggccaata

SEQ ID NO: 239110 - DNA, 25 bp, Mus musculus
atcactcctgtctcgaaggccaata

SEQ ID NO: 239111 - DNA, 25 bp, Mus musculus
atcactcgaagcatgcatgggcctt

SEQ ID NO: 239112 - DNA, 25 bp, Mus musculus
atcactcgaagcttgcatgggcctt

SEQ ID NO: 239113 - DNA, 25 bp, Mus musculus
atcactcgccgacgtgtggatgtcg

SEQ ID NO: 239114 - DNA, 25 bp, Mus musculus
atcactcgccgaggtgtggatgtcg

SEQ ID NO: 239115 - DNA, 25 bp, Mus musculus
atcactcgtgccctttatgagatgt

SEQ ID NO: 239116 - DNA, 25 bp, Mus musculus
atcactcgtgccgtttatgagatgt

SEQ ID NO: 239117 - DNA, 25 bp, Mus musculus
atcactcgtggactcgttcttaggg

SEQ ID NO: 239118 - DNA, 25 bp, Mus musculus
atcactcgtggagtcgttcttaggg

SEQ ID NO: 239119 - DNA, 25 bp, Mus musculus
atcactctctggctaatgactctga

SEQ ID NO: 239120 - DNA, 25 bp, Mus musculus
atcactctctgggtaatgactctga

SEQ ID NO: 239121 - DNA, 25 bp, Mus musculus
atcactctctttagtcttggctttt

SEQ ID NO: 239122 - DNA, 25 bp, Mus musculus
atcactctcttttgtcttggctttt

SEQ ID NO: 239123 - DNA, 25 bp, Mus musculus
atcactctgagcctgcaggagagag

SEQ ID NO: 239124 - DNA, 25 bp, Mus musculus
atcactctgagcgtgcaggagagag

SEQ ID NO: 239125 - DNA, 25 bp, Mus musculus
atcactctggaacgctatcactcaa

SEQ ID NO: 239126 - DNA, 25 bp, Mus musculus
atcactctggaactctcagtagcca

SEQ ID NO: 239127 - DNA, 25 bp, Mus musculus
atcactctggaaggctatcactcaa

SEQ ID NO: 239128 - DNA, 25 bp, Mus musculus
atcactctggaagtctcagtagcca

SEQ ID NO: 239129 - DNA, 25 bp, Mus musculus
atcactctggccatgaaccgagatg

SEQ ID NO: 239130 - DNA, 25 bp, Mus musculus
atcactctggccttgaaccgagatg

SEQ ID NO: 239131 - DNA, 25 bp, Mus musculus
atcactctgggaactggtaggacac

SEQ ID NO: 239132 - DNA, 25 bp, Mus musculus
atcactctgggatctggtaggacac

SEQ ID NO: 239133 - DNA, 25 bp, Mus musculus
atcactctgtgaaatccttgagaca

SEQ ID NO: 239134 - DNA, 25 bp, Mus musculus
atcactctgtgatatccttgagaca

SEQ ID NO: 239135 - DNA, 25 bp, Mus musculus
atcactcttaatatcaacttttata

SEQ ID NO: 239136 - DNA, 25 bp, Mus musculus
atcactcttaatttcaacttttata

SEQ ID NO: 239137 - DNA, 25 bp, Mus musculus
atcactcttagcaaccagcatcaag

SEQ ID NO: 239138 - DNA, 25 bp, Mus musculus
atcactcttagctaccagcatcaag

SEQ ID NO: 239139 - DNA, 25 bp, Mus musculus
atcactcttcaactcaaaacttaac

SEQ ID NO: 239140 - DNA, 25 bp, Mus musculus
atcactcttcaagtcaaaacttaac

SEQ ID NO: 239141 - DNA, 25 bp, Mus musculus
atcactcttcatcgatctcccagga

SEQ ID NO: 239142 - DNA, 25 bp, Mus musculus
atcactcttcatggatctcccagga

SEQ ID NO: 239143 - DNA, 25 bp, Mus musculus
atcactctttccagtctggaagcca

SEQ ID NO: 239144 - DNA, 25 bp, Mus musculus
atcactctttcctgtctggaagcca

SEQ ID NO: 239145 - DNA, 25 bp, Mus musculus
atcactcttttcaatgatggacatg

SEQ ID NO: 239146 - DNA, 25 bp, Mus musculus
atcactcttttctatgatggacatg

SEQ ID NO: 239147 - DNA, 25 bp, Mus musculus
atcactgaaattccctggagtctcc

SEQ ID NO: 239148 - DNA, 25 bp, Mus musculus
atcactgaaattgcctggagtctcc

SEQ ID NO: 239149 - DNA, 25 bp, Mus musculus
atcactgacagcattggtaggcatc

SEQ ID NO: 239150 - DNA, 25 bp, Mus musculus
atcactgacagctttggtaggcatc

SEQ ID NO: 239151 - DNA, 25 bp, Mus musculus
atcactgaccacacagcaggatctg

SEQ ID NO: 239152 - DNA, 25 bp, Mus musculus
atcactgaccactcagcaggatctg

SEQ ID NO: 239153 - DNA, 25 bp, Mus musculus
atcactgacctcaggagtcggcaag

SEQ ID NO: 239154 - DNA, 25 bp, Mus musculus
atcactgacctctggagtcggcaag

SEQ ID NO: 239155 - DNA, 25 bp, Mus musculus
atcactgactggagaccgagtgcca

SEQ ID NO: 239156 - DNA, 25 bp, Mus musculus
atcactgactggtgaccgagtgcca

SEQ ID NO: 239157 - DNA, 25 bp, Mus musculus
atcactgagactaggttctttggac

SEQ ID NO: 239158 - DNA, 25 bp, Mus musculus
atcactgagacttggttctttggac

SEQ ID NO: 239159 - DNA, 25 bp, Mus musculus
atcactgagcccactcaggactgct

SEQ ID NO: 239160 - DNA, 25 bp, Mus musculus
atcactgagccctctcaggactgct

SEQ ID NO: 239161 - DNA, 25 bp, Mus musculus
atcactgagctaccactgtacctag

SEQ ID NO: 239162 - DNA, 25 bp, Mus musculus
atcactgagctagcactgtacctag

SEQ ID NO: 239163 - DNA, 25 bp, Mus musculus
atcactgagctgaccaggtctatgg

SEQ ID NO: 239164 - DNA, 25 bp, Mus musculus
atcactgagctgtccaggtctatgg

SEQ ID NO: 239165 - DNA, 25 bp, Mus musculus
atcactgagcttctaagtccgggtc

SEQ ID NO: 239166 - DNA, 25 bp, Mus musculus
atcactgagcttgtaagtccgggtc

SEQ ID NO: 239167 - DNA, 25 bp, Mus musculus
atcactgaggacactggtctgttca

SEQ ID NO: 239168 - DNA, 25 bp, Mus musculus
atcactgaggactctggtctgttca

SEQ ID NO: 239169 - DNA, 25 bp, Mus musculus
atcactgatgctcttacccatgcgg

SEQ ID NO: 239170 - DNA, 25 bp, Mus musculus
atcactgatgctgttacccatgcgg

SEQ ID NO: 239171 - DNA, 25 bp, Mus musculus
atcactgatttgctgtgtaagtctt

SEQ ID NO: 239172 - DNA, 25 bp, Mus musculus
atcactgatttggtgtgtaagtctt

SEQ ID NO: 239173 - DNA, 25 bp, Mus musculus
atcactgcacgtccacagcaggtgg

SEQ ID NO: 239174 - DNA, 25 bp, Mus musculus
atcactgcacgtgcacagcaggtgg

SEQ ID NO: 239175 - DNA, 25 bp, Mus musculus
atcactgcagaaagatgctcaagat

SEQ ID NO: 239176 - DNA, 25 bp, Mus musculus
atcactgcagaatgatgctcaagat

SEQ ID NO: 239177 - DNA, 25 bp, Mus musculus
atcactgcaggcatgtggttgtgtt

SEQ ID NO: 239178 - DNA, 25 bp, Mus musculus
atcactgcaggcttgtggttgtgtt

SEQ ID NO: 239179 - DNA, 25 bp, Mus musculus
atcactgcagtgattatcggcatct

SEQ ID NO: 239180 - DNA, 25 bp, Mus musculus
atcactgcagtgtttatcggcatct

SEQ ID NO: 239181 - DNA, 25 bp, Mus musculus
atcactgccacccagaagactgtgg

SEQ ID NO: 239182 - DNA, 25 bp, Mus musculus
atcactgccaccgagaagactgtgg

SEQ ID NO: 239183 - DNA, 25 bp, Mus musculus
atcactgccatactgcatccatggt

SEQ ID NO: 239184 - DNA, 25 bp, Mus musculus
atcactgccatagtgcatccatggt

SEQ ID NO: 239185 - DNA, 25 bp, Mus musculus
atcactgccatgatagctgggcttc

SEQ ID NO: 239186 - DNA, 25 bp, Mus musculus
atcactgccatgttagctgggcttc

SEQ ID NO: 239187 - DNA, 25 bp, Mus musculus
atcactgccccaccatattgcttta

SEQ ID NO: 239188 - DNA, 25 bp, Mus musculus
atcactgccccagcatattgcttta

SEQ ID NO: 239189 - DNA, 25 bp, Mus musculus
atcactgcccgtaacattccaagag

SEQ ID NO: 239190 - DNA, 25 bp, Mus musculus
atcactgcccgttacattccaagag

SEQ ID NO: 239191 - DNA, 25 bp, Mus musculus
atcactgccctccagacaatgtgaa

SEQ ID NO: 239192 - DNA, 25 bp, Mus musculus
atcactgccctcgagacaatgtgaa

SEQ ID NO: 239193 - DNA, 25 bp, Mus musculus
atcactgcggcaactcggtagccac

SEQ ID NO: 239194 - DNA, 25 bp, Mus musculus
atcactgcggcatctcggtagccac

SEQ ID NO: 239195 - DNA, 25 bp, Mus musculus
atcactgctaacactagatgctctc

SEQ ID NO: 239196 - DNA, 25 bp, Mus musculus
atcactgctaactctagatgctctc

SEQ ID NO: 239197 - DNA, 25 bp, Mus musculus
atcactgctagaatgtatttgcttt

SEQ ID NO: 239198 - DNA, 25 bp, Mus musculus
atcactgctagattgtatttgcttt

SEQ ID NO: 239199 - DNA, 25 bp, Mus musculus
atcactgctctgaagaccatccaag

SEQ ID NO: 239200 - DNA, 25 bp, Mus musculus
atcactgctctgtagaccatccaag

SEQ ID NO: 239201 - DNA, 25 bp, Mus musculus
atcactgctcttcggactgcacaca

SEQ ID NO: 239202 - DNA, 25 bp, Mus musculus
atcactgctcttgggactgcacaca

SEQ ID NO: 239203 - DNA, 25 bp, Mus musculus
atcactgctggcagcaagtgatggt

SEQ ID NO: 239204 - DNA, 25 bp, Mus musculus
atcactgctggctgcaagtgatggt

SEQ ID NO: 239205 - DNA, 25 bp, Mus musculus
atcactgctggtcctggacttattg

SEQ ID NO: 239206 - DNA, 25 bp, Mus musculus
atcactgctggtgctggacttattg

SEQ ID NO: 239207 - DNA, 25 bp, Mus musculus
atcactgctgttcttgtctctgctg

SEQ ID NO: 239208 - DNA, 25 bp, Mus musculus
atcactgctgttgttgtctctgctg

SEQ ID NO: 239209 - DNA, 25 bp, Mus musculus
atcactgcttcaatagcttggaagt

SEQ ID NO: 239210 - DNA, 25 bp, Mus musculus
atcactgcttcattagcttggaagt

SEQ ID NO: 239211 - DNA, 25 bp, Mus musculus
atcactgcttcccatgctaacattc

SEQ ID NO: 239212 - DNA, 25 bp, Mus musculus
atcactgcttccgatgctaacattc

SEQ ID NO: 239213 - DNA, 25 bp, Mus musculus
atcactgcttctcagggatgccggc

SEQ ID NO: 239214 - DNA, 25 bp, Mus musculus
atcactgcttctgagggatgccggc

SEQ ID NO: 239215 - DNA, 25 bp, Mus musculus
atcactgcttggcatggtttctgta

SEQ ID NO: 239216 - DNA, 25 bp, Mus musculus
atcactgcttgggatggtttctgta

SEQ ID NO: 239217 - DNA, 25 bp, Mus musculus
atcactggacacaaaagtgcatctg

SEQ ID NO: 239218 - DNA, 25 bp, Mus musculus
atcactggacactaaagtgcatctg

SEQ ID NO: 239219 - DNA, 25 bp, Mus musculus
atcactggacagacggctggcaagg

SEQ ID NO: 239220 - DNA, 25 bp, Mus musculus
atcactggacagtcggctggcaagg

SEQ ID NO: 239221 - DNA, 25 bp, Mus musculus
atcactggagtcaacatatgtagag

SEQ ID NO: 239222 - DNA, 25 bp, Mus musculus
atcactggagtctacatatgtagag

SEQ ID NO: 239223 - DNA, 25 bp, Mus musculus
atcactggatatcagctgcctgttt

SEQ ID NO: 239224 - DNA, 25 bp, Mus musculus
atcactggatatgagctgcctgttt

SEQ ID NO: 239225 - DNA, 25 bp, Mus musculus
atcactggatctcctgccagcatta

SEQ ID NO: 239226 - DNA, 25 bp, Mus musculus
atcactggatctgctgccagcatta

SEQ ID NO: 239227 - DNA, 25 bp, Mus musculus
atcactggcacactaacgtcggact

SEQ ID NO: 239228 - DNA, 25 bp, Mus musculus
atcactggcacagtaacgtcggact

SEQ ID NO: 239229 - DNA, 25 bp, Mus musculus
atcactggcagacagtctaattaca

SEQ ID NO: 239230 - DNA, 25 bp, Mus musculus
atcactggcagagagtctaattaca

SEQ ID NO: 239231 - DNA, 25 bp, Mus musculus
atcactggcatgagtgctgcttgac

SEQ ID NO: 239232 - DNA, 25 bp, Mus musculus
atcactggcatgtgtgctgcttgac

SEQ ID NO: 239233 - DNA, 25 bp, Mus musculus
atcactggctgaactaactcattgg

SEQ ID NO: 239234 - DNA, 25 bp, Mus musculus
atcactggctgatctaactcattgg

SEQ ID NO: 239235 - DNA, 25 bp, Mus musculus
atcactgggcagatggaacaaacat

SEQ ID NO: 239236 - DNA, 25 bp, Mus musculus
atcactgggcagttggaacaaacat

SEQ ID NO: 239237 - DNA, 25 bp, Mus musculus
atcactgggctcaactgcttaggtt

SEQ ID NO: 239238 - DNA, 25 bp, Mus musculus
atcactgggctctactgcttaggtt

SEQ ID NO: 239239 - DNA, 25 bp, Mus musculus
atcactggtaagctgctgtgttcct

SEQ ID NO: 239240 - DNA, 25 bp, Mus musculus
atcactggtaaggtgctgtgttcct

SEQ ID NO: 239241 - DNA, 25 bp, Mus musculus
atcactggtattattagtactattc

SEQ ID NO: 239242 - DNA, 25 bp, Mus musculus
atcactggtatttttagtactattc

SEQ ID NO: 239243 - DNA, 25 bp, Mus musculus
atcactggtcatcagctcatgagtt

SEQ ID NO: 239244 - DNA, 25 bp, Mus musculus
atcactggtcatgagctcatgagtt

SEQ ID NO: 239245 - DNA, 25 bp, Mus musculus
atcactggtccacttgctagccatt

SEQ ID NO: 239246 - DNA, 25 bp, Mus musculus
atcactggtccagttgctagccatt

SEQ ID NO: 239247 - DNA, 25 bp, Mus musculus
atcactggtgagcatacaccatacc

SEQ ID NO: 239248 - DNA, 25 bp, Mus musculus
atcactggtgaggatacaccatacc

SEQ ID NO: 239249 - DNA, 25 bp, Mus musculus
atcactggtgcacttaaactgtact

SEQ ID NO: 239250 - DNA, 25 bp, Mus musculus
atcactggtgcagttaaactgtact

SEQ ID NO: 239251 - DNA, 25 bp, Mus musculus
atcactggtgctaatggtctccatc

SEQ ID NO: 239252 - DNA, 25 bp, Mus musculus
atcactggtgcttatggtctccatc

SEQ ID NO: 239253 - DNA, 25 bp, Mus musculus
atcactggttggcatgtggaatcct

SEQ ID NO: 239254 - DNA, 25 bp, Mus musculus
atcactggttgggatgtggaatcct

SEQ ID NO: 239255 - DNA, 25 bp, Mus musculus
atcactgtaaaaatcaggcgctctg

SEQ ID NO: 239256 - DNA, 25 bp, Mus musculus
atcactgtaaaattcaggcgctctg

SEQ ID NO: 239257 - DNA, 25 bp, Mus musculus
atcactgtaatcatggagtctgtgt

SEQ ID NO: 239258 - DNA, 25 bp, Mus musculus
atcactgtaatcttggagtctgtgt

SEQ ID NO: 239259 - DNA, 25 bp, Mus musculus
atcactgtacatctggattctagtt

SEQ ID NO: 239260 - DNA, 25 bp, Mus musculus
atcactgtacatgtggattctagtt

SEQ ID NO: 239261 - DNA, 25 bp, Mus musculus
atcactgtagaactgtcccgtgccg

SEQ ID NO: 239262 - DNA, 25 bp, Mus musculus
atcactgtagaagtgtcccgtgccg

SEQ ID NO: 239263 - DNA, 25 bp, Mus musculus
atcactgtatccacgttgctagata

SEQ ID NO: 239264 - DNA, 25 bp, Mus musculus
atcactgtatcctcgttgctagata

SEQ ID NO: 239265 - DNA, 25 bp, Mus musculus
atcactgtatggctacactcatgaa

SEQ ID NO: 239266 - DNA, 25 bp, Mus musculus
atcactgtatgggtacactcatgaa

SEQ ID NO: 239267 - DNA, 25 bp, Mus musculus
atcactgtcaacacacaggtgtaca

SEQ ID NO: 239268 - DNA, 25 bp, Mus musculus
atcactgtcaactcacaggtgtaca

SEQ ID NO: 239269 - DNA, 25 bp, Mus musculus
atcactgtcaagaaactgcttctgt

SEQ ID NO: 239270 - DNA, 25 bp, Mus musculus
atcactgtcaagtaactgcttctgt

SEQ ID NO: 239271 - DNA, 25 bp, Mus musculus
atcactgtcacaacgggctactgga

SEQ ID NO: 239272 - DNA, 25 bp, Mus musculus
atcactgtcacacagtagcctgtca

SEQ ID NO: 239273 - DNA, 25 bp, Mus musculus
atcactgtcacagagtagcctgtca

SEQ ID NO: 239274 - DNA, 25 bp, Mus musculus
atcactgtcacatcgggctactgga

SEQ ID NO: 239275 - DNA, 25 bp, Mus musculus
atcactgtctataccacgcaatttg

SEQ ID NO: 239276 - DNA, 25 bp, Mus musculus
atcactgtctattccacgcaatttg

SEQ ID NO: 239277 - DNA, 25 bp, Mus musculus
atcactgtctgcatcagtatcccta

SEQ ID NO: 239278 - DNA, 25 bp, Mus musculus
atcactgtctgcttcagtatcccta

SEQ ID NO: 239279 - DNA, 25 bp, Mus musculus
atcactgtgaatcctgtgcgcggct

SEQ ID NO: 239280 - DNA, 25 bp, Mus musculus
atcactgtgaatgctgtgcgcggct

SEQ ID NO: 239281 - DNA, 25 bp, Mus musculus
atcactgtgacacgatggcagccca

SEQ ID NO: 239282 - DNA, 25 bp, Mus musculus
atcactgtgacaggatggcagccca

SEQ ID NO: 239283 - DNA, 25 bp, Mus musculus
atcactgtgatcactaatgtggagc

SEQ ID NO: 239284 - DNA, 25 bp, Mus musculus
atcactgtgatctctaatgtggagc

SEQ ID NO: 239285 - DNA, 25 bp, Mus musculus
atcactgtgccacagcaagcacgct

SEQ ID NO: 239286 - DNA, 25 bp, Mus musculus
atcactgtgccagagcaagcacgct

SEQ ID NO: 239287 - DNA, 25 bp, Mus musculus
atcactgtgcctcttgatgtaaaac

SEQ ID NO: 239288 - DNA, 25 bp, Mus musculus
atcactgtgcctgttgatgtaaaac

SEQ ID NO: 239289 - DNA, 25 bp, Mus musculus
atcactgtgctcatgagcctgcaag

SEQ ID NO: 239290 - DNA, 25 bp, Mus musculus
atcactgtgctcttgagcctgcaag

SEQ ID NO: 239291 - DNA, 25 bp, Mus musculus
atcactgtggtgcttgctcgtgtca

SEQ ID NO: 239292 - DNA, 25 bp, Mus musculus
atcactgtggtggttgctcgtgtca

SEQ ID NO: 239293 - DNA, 25 bp, Mus musculus
atcactgttaacctttctgccaaat

SEQ ID NO: 239294 - DNA, 25 bp, Mus musculus
atcactgttaacgtttctgccaaat

SEQ ID NO: 239295 - DNA, 25 bp, Mus musculus
atcactgttctgaagctaaaatgct

SEQ ID NO: 239296 - DNA, 25 bp, Mus musculus
atcactgttctgtagctaaaatgct

SEQ ID NO: 239297 - DNA, 25 bp, Mus musculus
atcactgttggcacacctaatttat

SEQ ID NO: 239298 - DNA, 25 bp, Mus musculus
atcactgttggctcacctaatttat

SEQ ID NO: 239299 - DNA, 25 bp, Mus musculus
atcactgttgtacttgtttctttaa

SEQ ID NO: 239300 - DNA, 25 bp, Mus musculus
atcactgttgtagttgtttctttaa

SEQ ID NO: 239301 - DNA, 25 bp, Mus musculus
atcactgtttatagtatactgcctt

SEQ ID NO: 239302 - DNA, 25 bp, Mus musculus
atcactgtttattgtatactgcctt

SEQ ID NO: 239303 - DNA, 25 bp, Mus musculus
atcacttaaatacctggtctcctgg

SEQ ID NO: 239304 - DNA, 25 bp, Mus musculus
atcacttaaatagctggtctcctgg

SEQ ID NO: 239305 - DNA, 25 bp, Mus musculus
atcacttaagacatgcccagggctc

SEQ ID NO: 239306 - DNA, 25 bp, Mus musculus
atcacttaagacttgcccagggctc

SEQ ID NO: 239307 - DNA, 25 bp, Mus musculus
atcacttaatatccacaatcctgga

SEQ ID NO: 239308 - DNA, 25 bp, Mus musculus
atcacttaatatgcacaatcctgga

SEQ ID NO: 239309 - DNA, 25 bp, Mus musculus
atcacttaccagaatggcttgttta

SEQ ID NO: 239310 - DNA, 25 bp, Mus musculus
atcacttaccagtatggcttgttta

SEQ ID NO: 239311 - DNA, 25 bp, Mus musculus
atcacttacctgacatttcctagaa

SEQ ID NO: 239312 - DNA, 25 bp, Mus musculus
atcacttacctgtcatttcctagaa

SEQ ID NO: 239313 - DNA, 25 bp, Mus musculus
atcacttactgcctaatgctaccaa

SEQ ID NO: 239314 - DNA, 25 bp, Mus musculus
atcacttactgcgtaatgctaccaa

SEQ ID NO: 239315 - DNA, 25 bp, Mus musculus
atcacttaggagatgattctgtctt

SEQ ID NO: 239316 - DNA, 25 bp, Mus musculus
atcacttaggagctgctaccccgga

SEQ ID NO: 239317 - DNA, 25 bp, Mus musculus
atcacttaggaggtgctaccccgga

SEQ ID NO: 239318 - DNA, 25 bp, Mus musculus
atcacttaggagttgattctgtctt

SEQ ID NO: 239319 - DNA, 25 bp, Mus musculus
atcacttatagtcggctcatcagga

SEQ ID NO: 239320 - DNA, 25 bp, Mus musculus
atcacttatagtgggctcatcagga

SEQ ID NO: 239321 - DNA, 25 bp, Mus musculus
atcacttcacaaatggtttcctgag

SEQ ID NO: 239322 - DNA, 25 bp, Mus musculus
atcacttcacaattggtttcctgag

SEQ ID NO: 239323 - DNA, 25 bp, Mus musculus
atcacttcactgatgcatagcggag

SEQ ID NO: 239324 - DNA, 25 bp, Mus musculus
atcacttcactgttgcatagcggag

SEQ ID NO: 239325 - DNA, 25 bp, Mus musculus
atcacttcaggtccttacgggcagg

SEQ ID NO: 239326 - DNA, 25 bp, Mus musculus
atcacttcaggtgcttacgggcagg

SEQ ID NO: 239327 - DNA, 25 bp, Mus musculus
atcacttcagtcaagcctccaagga

SEQ ID NO: 239328 - DNA, 25 bp, Mus musculus
atcacttcagtctagcctccaagga

SEQ ID NO: 239329 - DNA, 25 bp, Mus musculus
atcacttccacccaacattcatgtg

SEQ ID NO: 239330 - DNA, 25 bp, Mus musculus
atcacttccaccgaacattcatgtg

SEQ ID NO: 239331 - DNA, 25 bp, Mus musculus
atcacttccctcatcttcagctttt

SEQ ID NO: 239332 - DNA, 25 bp, Mus musculus
atcacttccctcttcttcagctttt

SEQ ID NO: 239333 - DNA, 25 bp, Mus musculus
atcacttcctgcagcatttcggtat

SEQ ID NO: 239334 - DNA, 25 bp, Mus musculus
atcacttcctgctgcatttcggtat

SEQ ID NO: 239335 - DNA, 25 bp, Mus musculus
atcacttccttcaacatacactgag

SEQ ID NO: 239336 - DNA, 25 bp, Mus musculus
atcacttccttctacatacactgag

SEQ ID NO: 239337 - DNA, 25 bp, Mus musculus
atcacttcgagaactcactccagag

SEQ ID NO: 239338 - DNA, 25 bp, Mus musculus
atcacttcgagatctcactccagag

SEQ ID NO: 239339 - DNA, 25 bp, Mus musculus
atcacttctatcattttgtgccaag

SEQ ID NO: 239340 - DNA, 25 bp, Mus musculus
atcacttctatctttttgtgccaag

SEQ ID NO: 239341 - DNA, 25 bp, Mus musculus
atcacttctctaaacagtcacatgg

SEQ ID NO: 239342 - DNA, 25 bp, Mus musculus
atcacttctctatacagtcacatgg

SEQ ID NO: 239343 - DNA, 25 bp, Mus musculus
atcacttcttctcatggctctggta

SEQ ID NO: 239344 - DNA, 25 bp, Mus musculus
atcacttcttctgatggctctggta

SEQ ID NO: 239345 - DNA, 25 bp, Mus musculus
atcacttgaaaacctgtccctgttt

SEQ ID NO: 239346 - DNA, 25 bp, Mus musculus
atcacttgaaaagctgtccctgttt

SEQ ID NO: 239347 - DNA, 25 bp, Mus musculus
atcacttgaaggaagccacagtcgt

SEQ ID NO: 239348 - DNA, 25 bp, Mus musculus
atcacttgaaggtagccacagtcgt

SEQ ID NO: 239349 - DNA, 25 bp, Mus musculus
atcacttgacctcgtgctttgggcc

SEQ ID NO: 239350 - DNA, 25 bp, Mus musculus
atcacttgacctggtgctttgggcc

SEQ ID NO: 239351 - DNA, 25 bp, Mus musculus
atcacttgcaagatgctaccagctg

SEQ ID NO: 239352 - DNA, 25 bp, Mus musculus
atcacttgcaagttgctaccagctg

SEQ ID NO: 239353 - DNA, 25 bp, Mus musculus
atcacttgcactaaaatcattactg

SEQ ID NO: 239354 - DNA, 25 bp, Mus musculus
atcacttgcacttaaatcattactg

SEQ ID NO: 239355 - DNA, 25 bp, Mus musculus
atcacttggaccacggaggaaacct

SEQ ID NO: 239356 - DNA, 25 bp, Mus musculus
atcacttggacctcggaggaaacct

SEQ ID NO: 239357 - DNA, 25 bp, Mus musculus
atcacttggccaatgcatttcattt

SEQ ID NO: 239358 - DNA, 25 bp, Mus musculus
atcacttggccattgcatttcattt

SEQ ID NO: 239359 - DNA, 25 bp, Mus musculus
atcacttgggatcgctgctttgggt

SEQ ID NO: 239360 - DNA, 25 bp, Mus musculus
atcacttgggatggctgctttgggt

SEQ ID NO: 239361 - DNA, 25 bp, Mus musculus
atcacttgtaacagcttctctggta

SEQ ID NO: 239362 - DNA, 25 bp, Mus musculus
atcacttgtaactgcttctctggta

SEQ ID NO: 239363 - DNA, 25 bp, Mus musculus
atcacttgtagtcagggtgctgtgt

SEQ ID NO: 239364 - DNA, 25 bp, Mus musculus
atcacttgtagtgagggtgctgtgt

SEQ ID NO: 239365 - DNA, 25 bp, Mus musculus
atcacttgtcagagcttcagtttca

SEQ ID NO: 239366 - DNA, 25 bp, Mus musculus
atcacttgtcagtgcttcagtttca

SEQ ID NO: 239367 - DNA, 25 bp, Mus musculus
atcacttgtgtgatttacttcagag

SEQ ID NO: 239368 - DNA, 25 bp, Mus musculus
atcacttgtgtgttttacttcagag

SEQ ID NO: 239369 - DNA, 25 bp, Mus musculus
atcactttacgcaagcatccaggac

SEQ ID NO: 239370 - DNA, 25 bp, Mus musculus
atcactttacgctagcatccaggac

SEQ ID NO: 239371 - DNA, 25 bp, Mus musculus
atcactttagtgagggctccctttt

SEQ ID NO: 239372 - DNA, 25 bp, Mus musculus
atcactttagtgtgggctccctttt

SEQ ID NO: 239373 - DNA, 25 bp, Mus musculus
atcactttataactcaccaccttta

SEQ ID NO: 239374 - DNA, 25 bp, Mus musculus
atcactttataagtcaccaccttta

SEQ ID NO: 239375 - DNA, 25 bp, Mus musculus
atcactttccagaatcacgagagat

SEQ ID NO: 239376 - DNA, 25 bp, Mus musculus
atcactttccagcttttcaaacaca

SEQ ID NO: 239377 - DNA, 25 bp, Mus musculus
atcactttccaggttttcaaacaca

SEQ ID NO: 239378 - DNA, 25 bp, Mus musculus
atcactttccagtatcacgagagat

SEQ ID NO: 239379 - DNA, 25 bp, Mus musculus
atcactttccctagaggcaaatcaa

SEQ ID NO: 239380 - DNA, 25 bp, Mus musculus
atcactttcccttgaggcaaatcaa

SEQ ID NO: 239381 - DNA, 25 bp, Mus musculus
atcactttctgcagaactccaagag

SEQ ID NO: 239382 - DNA, 25 bp, Mus musculus
atcactttctgctgaactccaagag

SEQ ID NO: 239383 - DNA, 25 bp, Mus musculus
atcactttgaataccttgtctctag

SEQ ID NO: 239384 - DNA, 25 bp, Mus musculus
atcactttgaattccttgtctctag

SEQ ID NO: 239385 - DNA, 25 bp, Mus musculus
atcactttgagtagcacatgcccag

SEQ ID NO: 239386 - DNA, 25 bp, Mus musculus
atcactttgagttgcacatgcccag

SEQ ID NO: 239387 - DNA, 25 bp, Mus musculus
atcactttgatgattccgttcctca

SEQ ID NO: 239388 - DNA, 25 bp, Mus musculus
atcactttgatgtttccgttcctca

SEQ ID NO: 239389 - DNA, 25 bp, Mus musculus
atcactttgcagctctttcacaaac

SEQ ID NO: 239390 - DNA, 25 bp, Mus musculus
atcactttgcaggtctttcacaaac

SEQ ID NO: 239391 - DNA, 25 bp, Mus musculus
atcactttggcaactagttcctcta

SEQ ID NO: 239392 - DNA, 25 bp, Mus musculus
atcactttggcatctagttcctcta

SEQ ID NO: 239393 - DNA, 25 bp, Mus musculus
atcactttgggcagggaaccttatt

SEQ ID NO: 239394 - DNA, 25 bp, Mus musculus
atcactttgggctgggaaccttatt

SEQ ID NO: 239395 - DNA, 25 bp, Mus musculus
atcacttttactcattctcaccttt

SEQ ID NO: 239396 - DNA, 25 bp, Mus musculus
atcacttttactgattctcaccttt

SEQ ID NO: 239397 - DNA, 25 bp, Mus musculus
atcacttttagtagggtgcagccac

SEQ ID NO: 239398 - DNA, 25 bp, Mus musculus
atcacttttagttgggtgcagccac

SEQ ID NO: 239399 - DNA, 25 bp, Mus musculus
atcacttttggaagggcagccttgc

SEQ ID NO: 239400 - DNA, 25 bp, Mus musculus
atcacttttggatgggcagccttgc

SEQ ID NO: 239401 - DNA, 25 bp, Mus musculus
atcacttttgttagccaggaagttt

SEQ ID NO: 239402 - DNA, 25 bp, Mus musculus
atcacttttgtttgccaggaagttt

SEQ ID NO: 239403 - DNA, 25 bp, Mus musculus
atcactttttatccaagggatccta

SEQ ID NO: 239404 - DNA, 25 bp, Mus musculus
atcactttttatgcaagggatccta

SEQ ID NO: 239405 - DNA, 25 bp, Mus musculus
atcagaaaccttccaggccatggat

SEQ ID NO: 239406 - DNA, 25 bp, Mus musculus
atcagaaaccttgcaggccatggat

SEQ ID NO: 239407 - DNA, 25 bp, Mus musculus
atcagaaactgtaccggcatcggct

SEQ ID NO: 239408 - DNA, 25 bp, Mus musculus
atcagaaactgttccggcatcggct

SEQ ID NO: 239409 - DNA, 25 bp, Mus musculus
atcagaaaggccaaatagttccaca

SEQ ID NO: 239410 - DNA, 25 bp, Mus musculus
atcagaaaggcctaatagttccaca

SEQ ID NO: 239411 - DNA, 25 bp, Mus musculus
atcagaaagtgccatttcgccctta

SEQ ID NO: 239412 - DNA, 25 bp, Mus musculus
atcagaaagtgcgatttcgccctta

SEQ ID NO: 239413 - DNA, 25 bp, Mus musculus
atcagaacagtcatcctagtggtat

SEQ ID NO: 239414 - DNA, 25 bp, Mus musculus
atcagaacagtcttcctagtggtat

SEQ ID NO: 239415 - DNA, 25 bp, Mus musculus
atcagaacatctccgctccttagaa

SEQ ID NO: 239416 - DNA, 25 bp, Mus musculus
atcagaacatctgcgctccttagaa

SEQ ID NO: 239417 - DNA, 25 bp, Mus musculus
atcagaaccgagaagcctgggcagc

SEQ ID NO: 239418 - DNA, 25 bp, Mus musculus
atcagaaccgagtagcctgggcagc

SEQ ID NO: 239419 - DNA, 25 bp, Mus musculus
atcagaaccttaagatgacagttac

SEQ ID NO: 239420 - DNA, 25 bp, Mus musculus
atcagaaccttatgatgacagttac

SEQ ID NO: 239421 - DNA, 25 bp, Mus musculus
atcagaaccttccttgaatcgggct

SEQ ID NO: 239422 - DNA, 25 bp, Mus musculus
atcagaaccttcgttgaatcgggct

SEQ ID NO: 239423 - DNA, 25 bp, Mus musculus
atcagaactgacatacatatactac

SEQ ID NO: 239424 - DNA, 25 bp, Mus musculus
atcagaactgacttacatatactac

SEQ ID NO: 239425 - DNA, 25 bp, Mus musculus
atcagaactgtcatcccttccagga

SEQ ID NO: 239426 - DNA, 25 bp, Mus musculus
atcagaactgtcttcccttccagga

SEQ ID NO: 239427 - DNA, 25 bp, Mus musculus
atcagaagactgctagtggttttaa

SEQ ID NO: 239428 - DNA, 25 bp, Mus musculus
atcagaagactggtagtggttttaa

SEQ ID NO: 239429 - DNA, 25 bp, Mus musculus
atcagaaggacaccgtgcagactct

SEQ ID NO: 239430 - DNA, 25 bp, Mus musculus
atcagaaggacagcgtgcagactct

SEQ ID NO: 239431 - DNA, 25 bp, Mus musculus
atcagaaggcagcaaggaagagatt

SEQ ID NO: 239432 - DNA, 25 bp, Mus musculus
atcagaaggcaggaaggaagagatt

SEQ ID NO: 239433 - DNA, 25 bp, Mus musculus
atcagaaggccaaatgaagcatcat

SEQ ID NO: 239434 - DNA, 25 bp, Mus musculus
atcagaaggccacaaagcacccatt

SEQ ID NO: 239435 - DNA, 25 bp, Mus musculus
atcagaaggccagaaagcacccatt

SEQ ID NO: 239436 - DNA, 25 bp, Mus musculus
atcagaaggccatatgaagcatcat

SEQ ID NO: 239437 - DNA, 25 bp, Mus musculus
atcagaagtagtatccagagctggc

SEQ ID NO: 239438 - DNA, 25 bp, Mus musculus
atcagaagtagtttccagagctggc

SEQ ID NO: 239439 - DNA, 25 bp, Mus musculus
atcagaagtctgcttgttatggttg

SEQ ID NO: 239440 - DNA, 25 bp, Mus musculus
atcagaagtctggttgttatggttg

SEQ ID NO: 239441 - DNA, 25 bp, Mus musculus
atcagaagtgccatagcgttgctgt

SEQ ID NO: 239442 - DNA, 25 bp, Mus musculus
atcagaagtgccttagcgttgctgt

SEQ ID NO: 239443 - DNA, 25 bp, Mus musculus
atcagaatactgcatgccggtcacc

SEQ ID NO: 239444 - DNA, 25 bp, Mus musculus
atcagaatactggatgccggtcacc

SEQ ID NO: 239445 - DNA, 25 bp, Mus musculus
atcagaatagaaccttcctttgttc

SEQ ID NO: 239446 - DNA, 25 bp, Mus musculus
atcagaatagaagcttcctttgttc

SEQ ID NO: 239447 - DNA, 25 bp, Mus musculus
atcagaatatccaagtcctgtatgt

SEQ ID NO: 239448 - DNA, 25 bp, Mus musculus
atcagaatatcctagtcctgtatgt

SEQ ID NO: 239449 - DNA, 25 bp, Mus musculus
atcagaatctatagtcttctccctc

SEQ ID NO: 239450 - DNA, 25 bp, Mus musculus
atcagaatctattgtcttctccctc

SEQ ID NO: 239451 - DNA, 25 bp, Mus musculus
atcagaatctccacttctaagacgc

SEQ ID NO: 239452 - DNA, 25 bp, Mus musculus
atcagaatctcctcttctaagacgc

SEQ ID NO: 239453 - DNA, 25 bp, Mus musculus
atcagaatctggatctttcctgcct

SEQ ID NO: 239454 - DNA, 25 bp, Mus musculus
atcagaatctggttctttcctgcct

SEQ ID NO: 239455 - DNA, 25 bp, Mus musculus
atcagaatcttgatgactacataaa

SEQ ID NO: 239456 - DNA, 25 bp, Mus musculus
atcagaatcttgttgactacataaa

SEQ ID NO: 239457 - DNA, 25 bp, Mus musculus
atcagaatgtctccctttgtctaca

SEQ ID NO: 239458 - DNA, 25 bp, Mus musculus
atcagaatgtctgcctttgtctaca

SEQ ID NO: 239459 - DNA, 25 bp, Mus musculus
atcagaattcacacatgctccagga

SEQ ID NO: 239460 - DNA, 25 bp, Mus musculus
atcagaattcactcatgctccagga

SEQ ID NO: 239461 - DNA, 25 bp, Mus musculus
atcagaattcttccttgggagggca

SEQ ID NO: 239462 - DNA, 25 bp, Mus musculus
atcagaattcttgcttgggagggca

SEQ ID NO: 239463 - DNA, 25 bp, Mus musculus
atcagaattgttatgctgcctcagg

SEQ ID NO: 239464 - DNA, 25 bp, Mus musculus
atcagaattgttttgctgcctcagg

SEQ ID NO: 239465 - DNA, 25 bp, Mus musculus
atcagacaaaacacccactggtttg

SEQ ID NO: 239466 - DNA, 25 bp, Mus musculus
atcagacaaaactcccactggtttg

SEQ ID NO: 239467 - DNA, 25 bp, Mus musculus
atcagacaagccaagctgcctggaa

SEQ ID NO: 239468 - DNA, 25 bp, Mus musculus
atcagacaagcctagctgcctggaa

SEQ ID NO: 239469 - DNA, 25 bp, Mus musculus
atcagacacagccaagtttcagatt

SEQ ID NO: 239470 - DNA, 25 bp, Mus musculus
atcagacacagcgaagtttcagatt

SEQ ID NO: 239471 - DNA, 25 bp, Mus musculus
atcagacacattaccggctccggga

SEQ ID NO: 239472 - DNA, 25 bp, Mus musculus
atcagacacatttccggctccggga

SEQ ID NO: 239473 - DNA, 25 bp, Mus musculus
atcagacacctcactgtacctgtgg

SEQ ID NO: 239474 - DNA, 25 bp, Mus musculus
atcagacacctctctgtacctgtgg

SEQ ID NO: 239475 - DNA, 25 bp, Mus musculus
atcagacagtttacacactttcagc

SEQ ID NO: 239476 - DNA, 25 bp, Mus musculus
atcagacagttttcacactttcagc

SEQ ID NO: 239477 - DNA, 25 bp, Mus musculus
atcagacatgcaagtaaacccctcc

SEQ ID NO: 239478 - DNA, 25 bp, Mus musculus
atcagacatgcatgtaaacccctcc

SEQ ID NO: 239479 - DNA, 25 bp, Mus musculus
atcagacatggtagatccgcctgct

SEQ ID NO: 239480 - DNA, 25 bp, Mus musculus
atcagacatggttgatccgcctgct

SEQ ID NO: 239481 - DNA, 25 bp, Mus musculus
atcagaccaaagagggtgacacctc

SEQ ID NO: 239482 - DNA, 25 bp, Mus musculus
atcagaccaaagtgggtgacacctc

SEQ ID NO: 239483 - DNA, 25 bp, Mus musculus
atcagaccactcaagttcaaccagt

SEQ ID NO: 239484 - DNA, 25 bp, Mus musculus
atcagaccactctagttcaaccagt

SEQ ID NO: 239485 - DNA, 25 bp, Mus musculus
atcagaccagtgagacttgtatcat

SEQ ID NO: 239486 - DNA, 25 bp, Mus musculus
atcagaccagtgtgacttgtatcat

SEQ ID NO: 239487 - DNA, 25 bp, Mus musculus
atcagaccccgtcctgtttaatcca

SEQ ID NO: 239488 - DNA, 25 bp, Mus musculus
atcagaccccgtgctgtttaatcca

SEQ ID NO: 239489 - DNA, 25 bp, Mus musculus
atcagacctcggcataacttagacg

SEQ ID NO: 239490 - DNA, 25 bp, Mus musculus
atcagacctcgggataacttagacg

SEQ ID NO: 239491 - DNA, 25 bp, Mus musculus
atcagacctctgagccaggtggtag

SEQ ID NO: 239492 - DNA, 25 bp, Mus musculus
atcagacctctgtgccaggtggtag

SEQ ID NO: 239493 - DNA, 25 bp, Mus musculus
atcagacctggtaggctgctatagc

SEQ ID NO: 239494 - DNA, 25 bp, Mus musculus
atcagacctggttggctgctatagc

SEQ ID NO: 239495 - DNA, 25 bp, Mus musculus
atcagacctgtcaatgtgtcacgtc

SEQ ID NO: 239496 - DNA, 25 bp, Mus musculus
atcagacctgtctatgtgtcacgtc

SEQ ID NO: 239497 - DNA, 25 bp, Mus musculus
atcagacgccacagggcttgatgcc

SEQ ID NO: 239498 - DNA, 25 bp, Mus musculus
atcagacgccactgggcttgatgcc

SEQ ID NO: 239499 - DNA, 25 bp, Mus musculus
atcagacgctatcagaagtccactg

SEQ ID NO: 239500 - DNA, 25 bp, Mus musculus
atcagacgctatgagaagtccactg

SEQ ID NO: 239501 - DNA, 25 bp, Mus musculus
atcagacgtcacaggtaagtacaag

SEQ ID NO: 239502 - DNA, 25 bp, Mus musculus
atcagacgtcactggtaagtacaag

SEQ ID NO: 239503 - DNA, 25 bp, Mus musculus
atcagactcaaaactacagctctcc

SEQ ID NO: 239504 - DNA, 25 bp, Mus musculus
atcagactcaaatctacagctctcc

SEQ ID NO: 239505 - DNA, 25 bp, Mus musculus
atcagactgaccatcctatggtgag

SEQ ID NO: 239506 - DNA, 25 bp, Mus musculus
atcagactgaccttcctatggtgag

SEQ ID NO: 239507 - DNA, 25 bp, Mus musculus
atcagactgcatagggcgaacctcg

SEQ ID NO: 239508 - DNA, 25 bp, Mus musculus
atcagactgcattgggcgaacctcg

SEQ ID NO: 239509 - DNA, 25 bp, Mus musculus
atcagactggatatggtgttgcaca

SEQ ID NO: 239510 - DNA, 25 bp, Mus musculus
atcagactggatttggtgttgcaca

SEQ ID NO: 239511 - DNA, 25 bp, Mus musculus
atcagactggcacatgcagatctat

SEQ ID NO: 239512 - DNA, 25 bp, Mus musculus
atcagactggcagatgcagatctat

SEQ ID NO: 239513 - DNA, 25 bp, Mus musculus
atcagactgtaccagagggaagagt

SEQ ID NO: 239514 - DNA, 25 bp, Mus musculus
atcagactgtacgagagggaagagt

SEQ ID NO: 239515 - DNA, 25 bp, Mus musculus
atcagactgtctacggagtcaaggc

SEQ ID NO: 239516 - DNA, 25 bp, Mus musculus
atcagactgtcttcggagtcaaggc

SEQ ID NO: 239517 - DNA, 25 bp, Mus musculus
atcagacttacacagcacctggcca

SEQ ID NO: 239518 - DNA, 25 bp, Mus musculus
atcagacttacagagcacctggcca

SEQ ID NO: 239519 - DNA, 25 bp, Mus musculus
atcagacttctaactcatgtttcag

SEQ ID NO: 239520 - DNA, 25 bp, Mus musculus
atcagacttctatctcatgtttcag

SEQ ID NO: 239521 - DNA, 25 bp, Mus musculus
atcagacttctcatgcaaactcaca

SEQ ID NO: 239522 - DNA, 25 bp, Mus musculus
atcagacttctcttgcaaactcaca

SEQ ID NO: 239523 - DNA, 25 bp, Mus musculus
atcagacttgaaagctgggagccaa

SEQ ID NO: 239524 - DNA, 25 bp, Mus musculus
atcagacttgaatgctgggagccaa

SEQ ID NO: 239525 - DNA, 25 bp, Mus musculus
atcagacttgccaacatggtcggta

SEQ ID NO: 239526 - DNA, 25 bp, Mus musculus
atcagacttgcctacatggtcggta

SEQ ID NO: 239527 - DNA, 25 bp, Mus musculus
atcagactttgaccgttgctgcaag

SEQ ID NO: 239528 - DNA, 25 bp, Mus musculus
atcagactttgagcgttgctgcaag

SEQ ID NO: 239529 - DNA, 25 bp, Mus musculus
atcagactttgtatacaccttgtga

SEQ ID NO: 239530 - DNA, 25 bp, Mus musculus
atcagactttgtttacaccttgtga

SEQ ID NO: 239531 - DNA, 25 bp, Mus musculus
atcagagaactcacgggcgaggaga

SEQ ID NO: 239532 - DNA, 25 bp, Mus musculus
atcagagaactctcgggcgaggaga

SEQ ID NO: 239533 - DNA, 25 bp, Mus musculus
atcagagaactgcaagcatccttgg

SEQ ID NO: 239534 - DNA, 25 bp, Mus musculus
atcagagaactggaagcatccttgg

SEQ ID NO: 239535 - DNA, 25 bp, Mus musculus
atcagagaagacatccatacacata

SEQ ID NO: 239536 - DNA, 25 bp, Mus musculus
atcagagaagacttccatacacata

SEQ ID NO: 239537 - DNA, 25 bp, Mus musculus
atcagagacagcatcatggctcctc

SEQ ID NO: 239538 - DNA, 25 bp, Mus musculus
atcagagacagcttcatggctcctc

SEQ ID NO: 239539 - DNA, 25 bp, Mus musculus
atcagagacctgagacagtgctcag

SEQ ID NO: 239540 - DNA, 25 bp, Mus musculus
atcagagacctgtgacagtgctcag

SEQ ID NO: 239541 - DNA, 25 bp, Mus musculus
atcagagagcagaccggctttcttg

SEQ ID NO: 239542 - DNA, 25 bp, Mus musculus
atcagagagcagatcccaagacctt

SEQ ID NO: 239543 - DNA, 25 bp, Mus musculus
atcagagagcagtccggctttcttg

SEQ ID NO: 239544 - DNA, 25 bp, Mus musculus
atcagagagcagttcccaagacctt

SEQ ID NO: 239545 - DNA, 25 bp, Mus musculus
atcagagagtagacgatcaggcaaa

SEQ ID NO: 239546 - DNA, 25 bp, Mus musculus
atcagagagtagtcgatcaggcaaa

SEQ ID NO: 239547 - DNA, 25 bp, Mus musculus
atcagagataccagctctcgtgtaa

SEQ ID NO: 239548 - DNA, 25 bp, Mus musculus
atcagagatacctgctctcgtgtaa

SEQ ID NO: 239549 - DNA, 25 bp, Mus musculus
atcagagattttactccacgggccc

SEQ ID NO: 239550 - DNA, 25 bp, Mus musculus
atcagagatttttctccacgggccc

SEQ ID NO: 239551 - DNA, 25 bp, Mus musculus
atcagagcacagaacccgagactag

SEQ ID NO: 239552 - DNA, 25 bp, Mus musculus
atcagagcacagtacccgagactag

SEQ ID NO: 239553 - DNA, 25 bp, Mus musculus
atcagagcacatcatacaggtacct

SEQ ID NO: 239554 - DNA, 25 bp, Mus musculus
atcagagcacatgatacaggtacct

SEQ ID NO: 239555 - DNA, 25 bp, Mus musculus
atcagagcagccaagccccatagca

SEQ ID NO: 239556 - DNA, 25 bp, Mus musculus
atcagagcagcctagccccatagca

SEQ ID NO: 239557 - DNA, 25 bp, Mus musculus
atcagagcagcgcttttcctgttca

SEQ ID NO: 239558 - DNA, 25 bp, Mus musculus
atcagagcagcggttttcctgttca

SEQ ID NO: 239559 - DNA, 25 bp, Mus musculus
atcagagcaggccaacttgagcagg

SEQ ID NO: 239560 - DNA, 25 bp, Mus musculus
atcagagcaggcgaacttgagcagg

SEQ ID NO: 239561 - DNA, 25 bp, Mus musculus
atcagagcatctatcattttgtcac

SEQ ID NO: 239562 - DNA, 25 bp, Mus musculus
atcagagcatctttcattttgtcac

SEQ ID NO: 239563 - DNA, 25 bp, Mus musculus
atcagagccaaacccttcctggtgc

SEQ ID NO: 239564 - DNA, 25 bp, Mus musculus
atcagagccaaacgtaggatgttct

SEQ ID NO: 239565 - DNA, 25 bp, Mus musculus
atcagagccaaagccttcctggtgc

SEQ ID NO: 239566 - DNA, 25 bp, Mus musculus
atcagagccaaaggtaggatgttct

SEQ ID NO: 239567 - DNA, 25 bp, Mus musculus
atcagagccatcatctgtttgttaa

SEQ ID NO: 239568 - DNA, 25 bp, Mus musculus
atcagagccatcttctgtttgttaa

SEQ ID NO: 239569 - DNA, 25 bp, Mus musculus
atcagagccatgcataccattaata

SEQ ID NO: 239570 - DNA, 25 bp, Mus musculus
atcagagccatggataccattaata

SEQ ID NO: 239571 - DNA, 25 bp, Mus musculus
atcagagcccagctaaacagtttta

SEQ ID NO: 239572 - DNA, 25 bp, Mus musculus
atcagagcccaggtaaacagtttta

SEQ ID NO: 239573 - DNA, 25 bp, Mus musculus
atcagagcccgtctacgagactaca

SEQ ID NO: 239574 - DNA, 25 bp, Mus musculus
atcagagcccgtgtacgagactaca

SEQ ID NO: 239575 - DNA, 25 bp, Mus musculus
atcagagccctgacaatggaacttt

SEQ ID NO: 239576 - DNA, 25 bp, Mus musculus
atcagagccctgagagtgctaggca

SEQ ID NO: 239577 - DNA, 25 bp, Mus musculus
atcagagccctgtcaatggaacttt

SEQ ID NO: 239578 - DNA, 25 bp, Mus musculus
atcagagccctgtgagtgctaggca

SEQ ID NO: 239579 - DNA, 25 bp, Mus musculus
atcagagcgctgagacctgcttaca

SEQ ID NO: 239580 - DNA, 25 bp, Mus musculus
atcagagcgctgtgacctgcttaca

SEQ ID NO: 239581 - DNA, 25 bp, Mus musculus
atcagagctaaaagatactccattt

SEQ ID NO: 239582 - DNA, 25 bp, Mus musculus
atcagagctaaatgatactccattt

SEQ ID NO: 239583 - DNA, 25 bp, Mus musculus
atcagagctgggactccattcaggt

SEQ ID NO: 239584 - DNA, 25 bp, Mus musculus
atcagagctgggtctccattcaggt

SEQ ID NO: 239585 - DNA, 25 bp, Mus musculus
atcagagctttactgctgcggtccc

SEQ ID NO: 239586 - DNA, 25 bp, Mus musculus
atcagagctttagtgctgcggtccc

SEQ ID NO: 239587 - DNA, 25 bp, Mus musculus
atcagaggaagccacagccagcagc

SEQ ID NO: 239588 - DNA, 25 bp, Mus musculus
atcagaggaagcgacagccagcagc

SEQ ID NO: 239589 - DNA, 25 bp, Mus musculus
atcagaggaccaaacatgacttttt

SEQ ID NO: 239590 - DNA, 25 bp, Mus musculus
atcagaggaccatacatgacttttt

SEQ ID NO: 239591 - DNA, 25 bp, Mus musculus
atcagaggagacatggccctcagtc

SEQ ID NO: 239592 - DNA, 25 bp, Mus musculus
atcagaggagacttggccctcagtc

SEQ ID NO: 239593 - DNA, 25 bp, Mus musculus
atcagaggagcacaacagcctgtca

SEQ ID NO: 239594 - DNA, 25 bp, Mus musculus
atcagaggagcagaacagcctgtca

SEQ ID NO: 239595 - DNA, 25 bp, Mus musculus
atcagaggaggccttacggtctagt

SEQ ID NO: 239596 - DNA, 25 bp, Mus musculus
atcagaggaggcgttacggtctagt

SEQ ID NO: 239597 - DNA, 25 bp, Mus musculus
atcagaggagtgacagcgtccacca

SEQ ID NO: 239598 - DNA, 25 bp, Mus musculus
atcagaggagtgtcagcgtccacca

SEQ ID NO: 239599 - DNA, 25 bp, Mus musculus
atcagaggataacttctggaaatca

SEQ ID NO: 239600 - DNA, 25 bp, Mus musculus
atcagaggataagttctggaaatca

SEQ ID NO: 239601 - DNA, 25 bp, Mus musculus
atcagaggcaccagcaagcctggga

SEQ ID NO: 239602 - DNA, 25 bp, Mus musculus
atcagaggcacctgcaagcctggga

SEQ ID NO: 239603 - DNA, 25 bp, Mus musculus
atcagaggccaacaggtaagggcta

SEQ ID NO: 239604 - DNA, 25 bp, Mus musculus
atcagaggccaagaggtaagggcta

SEQ ID NO: 239605 - DNA, 25 bp, Mus musculus
atcagaggcccaatgatcatatggt

SEQ ID NO: 239606 - DNA, 25 bp, Mus musculus
atcagaggcccattgatcatatggt

SEQ ID NO: 239607 - DNA, 25 bp, Mus musculus
atcagaggccgtccacacagcagaa

SEQ ID NO: 239608 - DNA, 25 bp, Mus musculus
atcagaggccgtgcacacagcagaa

SEQ ID NO: 239609 - DNA, 25 bp, Mus musculus
atcagaggctggcagatggcacaaa

SEQ ID NO: 239610 - DNA, 25 bp, Mus musculus
atcagaggctgggagatggcacaaa

SEQ ID NO: 239611 - DNA, 25 bp, Mus musculus
atcagagggcaaagcttcggaggca

SEQ ID NO: 239612 - DNA, 25 bp, Mus musculus
atcagagggcaatgcttcggaggca

SEQ ID NO: 239613 - DNA, 25 bp, Mus musculus
atcagaggttctcctattatacaca

SEQ ID NO: 239614 - DNA, 25 bp, Mus musculus
atcagaggttctgctattatacaca

SEQ ID NO: 239615 - DNA, 25 bp, Mus musculus
atcagagtaatcctttgtacattga

SEQ ID NO: 239616 - DNA, 25 bp, Mus musculus
atcagagtaatcgtttgtacattga

SEQ ID NO: 239617 - DNA, 25 bp, Mus musculus
atcagagtacgactgcttggcagag

SEQ ID NO: 239618 - DNA, 25 bp, Mus musculus
atcagagtacgagtgcttggcagag

SEQ ID NO: 239619 - DNA, 25 bp, Mus musculus
atcagagtagttagctggttctaag

SEQ ID NO: 239620 - DNA, 25 bp, Mus musculus
atcagagtagtttgctggttctaag

SEQ ID NO: 239621 - DNA, 25 bp, Mus musculus
atcagagtcacacgcagttccccag

SEQ ID NO: 239622 - DNA, 25 bp, Mus musculus
atcagagtcacaggcagttccccag

SEQ ID NO: 239623 - DNA, 25 bp, Mus musculus
atcagagtccggctgggatcctagc

SEQ ID NO: 239624 - DNA, 25 bp, Mus musculus
atcagagtccgggtgggatcctagc

SEQ ID NO: 239625 - DNA, 25 bp, Mus musculus
atcagagtcgcaagtccggtagcaa

SEQ ID NO: 239626 - DNA, 25 bp, Mus musculus
atcagagtcgcatgtccggtagcaa

SEQ ID NO: 239627 - DNA, 25 bp, Mus musculus
atcagagtctgcacgtttgcaggat

SEQ ID NO: 239628 - DNA, 25 bp, Mus musculus
atcagagtctgctcgtttgcaggat

SEQ ID NO: 239629 - DNA, 25 bp, Mus musculus
atcagagtgaatccagcaatgcagt

SEQ ID NO: 239630 - DNA, 25 bp, Mus musculus
atcagagtgaatgcagcaatgcagt

SEQ ID NO: 239631 - DNA, 25 bp, Mus musculus
atcagagtgacactgccagaaagca

SEQ ID NO: 239632 - DNA, 25 bp, Mus musculus
atcagagtgacagtgccagaaagca

SEQ ID NO: 239633 - DNA, 25 bp, Mus musculus
atcagagtgaccaacctcgaagcgg

SEQ ID NO: 239634 - DNA, 25 bp, Mus musculus
atcagagtgacctacctcgaagcgg

SEQ ID NO: 239635 - DNA, 25 bp, Mus musculus
atcagagtggttcgttttctcaggg

SEQ ID NO: 239636 - DNA, 25 bp, Mus musculus
atcagagtggttggttttctcaggg

SEQ ID NO: 239637 - DNA, 25 bp, Mus musculus
atcagagtgtagatcccaggtggta

SEQ ID NO: 239638 - DNA, 25 bp, Mus musculus
atcagagtgtagttcccaggtggta

SEQ ID NO: 239639 - DNA, 25 bp, Mus musculus
atcagagttgatctcttgctaacaa

SEQ ID NO: 239640 - DNA, 25 bp, Mus musculus
atcagagttgatgtcttgctaacaa

SEQ ID NO: 239641 - DNA, 25 bp, Mus musculus
atcagagtttacaggccctgagttc

SEQ ID NO: 239642 - DNA, 25 bp, Mus musculus
atcagagtttactggccctgagttc

SEQ ID NO: 239643 - DNA, 25 bp, Mus musculus
atcagagtttttctaaacattgtag

SEQ ID NO: 239644 - DNA, 25 bp, Mus musculus
atcagagtttttgtaaacattgtag

SEQ ID NO: 239645 - DNA, 25 bp, Mus musculus
atcagataaaggagcctgctggcaa

SEQ ID NO: 239646 - DNA, 25 bp, Mus musculus
atcagataaaggtgcctgctggcaa

SEQ ID NO: 239647 - DNA, 25 bp, Mus musculus
atcagataccagagtagtgcatatg

SEQ ID NO: 239648 - DNA, 25 bp, Mus musculus
atcagataccagtgtagtgcatatg

SEQ ID NO: 239649 - DNA, 25 bp, Mus musculus
atcagatactcccttctggactctt

SEQ ID NO: 239650 - DNA, 25 bp, Mus musculus
atcagatactccgttctggactctt

SEQ ID NO: 239651 - DNA, 25 bp, Mus musculus
atcagatatagactccgacacgctc

SEQ ID NO: 239652 - DNA, 25 bp, Mus musculus
atcagatatagagtccgacacgctc

SEQ ID NO: 239653 - DNA, 25 bp, Mus musculus
atcagatatgttagtttcatcatga

SEQ ID NO: 239654 - DNA, 25 bp, Mus musculus
atcagatatgtttgtttcatcatga

SEQ ID NO: 239655 - DNA, 25 bp, Mus musculus
atcagatattctccaggtattggga

SEQ ID NO: 239656 - DNA, 25 bp, Mus musculus
atcagatattctgcaggtattggga

SEQ ID NO: 239657 - DNA, 25 bp, Mus musculus
atcagatcaaacacggctgtgccag

SEQ ID NO: 239658 - DNA, 25 bp, Mus musculus
atcagatcaaactcggctgtgccag

SEQ ID NO: 239659 - DNA, 25 bp, Mus musculus
atcagatccatcacttttgacagtt

SEQ ID NO: 239660 - DNA, 25 bp, Mus musculus
atcagatccatctcttttgacagtt

SEQ ID NO: 239661 - DNA, 25 bp, Mus musculus
atcagatcctgactgtatcccgaaa

SEQ ID NO: 239662 - DNA, 25 bp, Mus musculus
atcagatcctgagtgtatcccgaaa

SEQ ID NO: 239663 - DNA, 25 bp, Mus musculus
atcagatccttcagcattgccagaa

SEQ ID NO: 239664 - DNA, 25 bp, Mus musculus
atcagatccttctgcattgccagaa

SEQ ID NO: 239665 - DNA, 25 bp, Mus musculus
atcagatctcccacataggatgaat

SEQ ID NO: 239666 - DNA, 25 bp, Mus musculus
atcagatctccctcataggatgaat

SEQ ID NO: 239667 - DNA, 25 bp, Mus musculus
atcagatctgacctgcctgagacaa

SEQ ID NO: 239668 - DNA, 25 bp, Mus musculus
atcagatctgacgtgcctgagacaa

SEQ ID NO: 239669 - DNA, 25 bp, Mus musculus
atcagatctgccactgtgcaggtgg

SEQ ID NO: 239670 - DNA, 25 bp, Mus musculus
atcagatctgccctggaattggtat

SEQ ID NO: 239671 - DNA, 25 bp, Mus musculus
atcagatctgccgtggaattggtat

SEQ ID NO: 239672 - DNA, 25 bp, Mus musculus
atcagatctgcctctgtgcaggtgg

SEQ ID NO: 239673 - DNA, 25 bp, Mus musculus
atcagatctgctagacgttcacgtg

SEQ ID NO: 239674 - DNA, 25 bp, Mus musculus
atcagatctgcttgacgttcacgtg

SEQ ID NO: 239675 - DNA, 25 bp, Mus musculus
atcagatgaaaacagccacctccgt

SEQ ID NO: 239676 - DNA, 25 bp, Mus musculus
atcagatgaaaagagccacctccgt

SEQ ID NO: 239677 - DNA, 25 bp, Mus musculus
atcagatgaaggcacaggccctccc

SEQ ID NO: 239678 - DNA, 25 bp, Mus musculus
atcagatgaagggacaggccctccc

SEQ ID NO: 239679 - DNA, 25 bp, Mus musculus
atcagatgactgacttgccatgaga

SEQ ID NO: 239680 - DNA, 25 bp, Mus musculus
atcagatgactgtcttgccatgaga

SEQ ID NO: 239681 - DNA, 25 bp, Mus musculus
atcagatgcaacagtgtgtgtccag

SEQ ID NO: 239682 - DNA, 25 bp, Mus musculus
atcagatgcaactgtgtgtgtccag

SEQ ID NO: 239683 - DNA, 25 bp, Mus musculus
atcagatgcacaagccatactcaca

SEQ ID NO: 239684 - DNA, 25 bp, Mus musculus
atcagatgcacatgccatactcaca

SEQ ID NO: 239685 - DNA, 25 bp, Mus musculus
atcagatgccttagtctactccgta

SEQ ID NO: 239686 - DNA, 25 bp, Mus musculus
atcagatgcctttgtctactccgta

SEQ ID NO: 239687 - DNA, 25 bp, Mus musculus
atcagatggcgtactgttgttcaaa

SEQ ID NO: 239688 - DNA, 25 bp, Mus musculus
atcagatggcgttctgttgttcaaa

SEQ ID NO: 239689 - DNA, 25 bp, Mus musculus
atcagatggtcaagtgtgaccctcg

SEQ ID NO: 239690 - DNA, 25 bp, Mus musculus
atcagatggtcatgtgtgaccctcg

SEQ ID NO: 239691 - DNA, 25 bp, Mus musculus
atcagatgtctcctgccagtctgtc

SEQ ID NO: 239692 - DNA, 25 bp, Mus musculus
atcagatgtctcgtgccagtctgtc

SEQ ID NO: 239693 - DNA, 25 bp, Mus musculus
atcagatgtcttatgctcggtgaac

SEQ ID NO: 239694 - DNA, 25 bp, Mus musculus
atcagatgtcttttgctcggtgaac

SEQ ID NO: 239695 - DNA, 25 bp, Mus musculus
atcagatgtgagctgtcccgtgtag

SEQ ID NO: 239696 - DNA, 25 bp, Mus musculus
atcagatgtgaggtgtcccgtgtag

SEQ ID NO: 239697 - DNA, 25 bp, Mus musculus
atcagatgtttccagggtgccccaa

SEQ ID NO: 239698 - DNA, 25 bp, Mus musculus
atcagatgtttcgagggtgccccaa

SEQ ID NO: 239699 - DNA, 25 bp, Mus musculus
atcagattcaggatctcggcttccc

SEQ ID NO: 239700 - DNA, 25 bp, Mus musculus
atcagattcaggattttgttaaaat

SEQ ID NO: 239701 - DNA, 25 bp, Mus musculus
atcagattcaggttctcggcttccc

SEQ ID NO: 239702 - DNA, 25 bp, Mus musculus
atcagattcaggtttttgttaaaat

SEQ ID NO: 239703 - DNA, 25 bp, Mus musculus
atcagattccctacctatctggagg

SEQ ID NO: 239704 - DNA, 25 bp, Mus musculus
atcagattcccttcctatctggagg

SEQ ID NO: 239705 - DNA, 25 bp, Mus musculus
atcagattcgtaccactaccttttg

SEQ ID NO: 239706 - DNA, 25 bp, Mus musculus
atcagattcgtagcactaccttttg

SEQ ID NO: 239707 - DNA, 25 bp, Mus musculus
atcagattgagtccaaggcagccta

SEQ ID NO: 239708 - DNA, 25 bp, Mus musculus
atcagattgagtgcaaggcagccta

SEQ ID NO: 239709 - DNA, 25 bp, Mus musculus
atcagattgtaacaagagccttcag

SEQ ID NO: 239710 - DNA, 25 bp, Mus musculus
atcagattgtaagaagagccttcag

SEQ ID NO: 239711 - DNA, 25 bp, Mus musculus
atcagattgtacctaccccattgtt

SEQ ID NO: 239712 - DNA, 25 bp, Mus musculus
atcagattgtacgtaccccattgtt

SEQ ID NO: 239713 - DNA, 25 bp, Mus musculus
atcagattgtcacgcatcagcactt

SEQ ID NO: 239714 - DNA, 25 bp, Mus musculus
atcagattgtcaggcatcagcactt

SEQ ID NO: 239715 - DNA, 25 bp, Mus musculus
atcagatttcccacctgaagcaagg

SEQ ID NO: 239716 - DNA, 25 bp, Mus musculus
atcagatttccctcctgaagcaagg

SEQ ID NO: 239717 - DNA, 25 bp, Mus musculus
atcagattttaaaaaggctcgcaaa

SEQ ID NO: 239718 - DNA, 25 bp, Mus musculus
atcagattttaataaggctcgcaaa

SEQ ID NO: 239719 - DNA, 25 bp, Mus musculus
atcagattttctctgacccctgtag

SEQ ID NO: 239720 - DNA, 25 bp, Mus musculus
atcagattttctgtgacccctgtag

SEQ ID NO: 239721 - DNA, 25 bp, Mus musculus
atcagcaaaaggatggttcagtcct

SEQ ID NO: 239722 - DNA, 25 bp, Mus musculus
atcagcaaaaggttggttcagtcct

SEQ ID NO: 239723 - DNA, 25 bp, Mus musculus
atcagcaaaagtctcatccgcaacg

SEQ ID NO: 239724 - DNA, 25 bp, Mus musculus
atcagcaaaagtctctttcctggta

SEQ ID NO: 239725 - DNA, 25 bp, Mus musculus
atcagcaaaagtgtcatccgcaacg

SEQ ID NO: 239726 - DNA, 25 bp, Mus musculus
atcagcaaaagtgtctttcctggta

SEQ ID NO: 239727 - DNA, 25 bp, Mus musculus
atcagcaaagcccagttcacacaca

SEQ ID NO: 239728 - DNA, 25 bp, Mus musculus
atcagcaaagccgagttcacacaca

SEQ ID NO: 239729 - DNA, 25 bp, Mus musculus
atcagcaaagggagttatgttatct

SEQ ID NO: 239730 - DNA, 25 bp, Mus musculus
atcagcaaagggtgttatgttatct

SEQ ID NO: 239731 - DNA, 25 bp, Mus musculus
atcagcaacacaaggtcctgtatcc

SEQ ID NO: 239732 - DNA, 25 bp, Mus musculus
atcagcaacacatggtcctgtatcc

SEQ ID NO: 239733 - DNA, 25 bp, Mus musculus
atcagcaaccgcaggaagctggcca

SEQ ID NO: 239734 - DNA, 25 bp, Mus musculus
atcagcaaccgctggaagctggcca

SEQ ID NO: 239735 - DNA, 25 bp, Mus musculus
atcagcaacgcccaggatacgcatc

SEQ ID NO: 239736 - DNA, 25 bp, Mus musculus
atcagcaacgccgaggatacgcatc

SEQ ID NO: 239737 - DNA, 25 bp, Mus musculus
atcagcaacttgaatttcttcggtg

SEQ ID NO: 239738 - DNA, 25 bp, Mus musculus
atcagcaacttgtatttcttcggtg

SEQ ID NO: 239739 - DNA, 25 bp, Mus musculus
atcagcaagatgaacaattagaatt

SEQ ID NO: 239740 - DNA, 25 bp, Mus musculus
atcagcaagatgtacaattagaatt

SEQ ID NO: 239741 - DNA, 25 bp, Mus musculus
atcagcaagcgtagtgtctcatcag

SEQ ID NO: 239742 - DNA, 25 bp, Mus musculus
atcagcaagcgttgtgtctcatcag

SEQ ID NO: 239743 - DNA, 25 bp, Mus musculus
atcagcaaggagagtctgtccctct

SEQ ID NO: 239744 - DNA, 25 bp, Mus musculus
atcagcaaggagtgtctgtccctct

SEQ ID NO: 239745 - DNA, 25 bp, Mus musculus
atcagcaagtccaacccttatttaa

SEQ ID NO: 239746 - DNA, 25 bp, Mus musculus
atcagcaagtcctacccttatttaa

SEQ ID NO: 239747 - DNA, 25 bp, Mus musculus
atcagcaatgcccttaatccaagta

SEQ ID NO: 239748 - DNA, 25 bp, Mus musculus
atcagcaatgccgttaatccaagta

SEQ ID NO: 239749 - DNA, 25 bp, Mus musculus
atcagcaattagctctctagccttc

SEQ ID NO: 239750 - DNA, 25 bp, Mus musculus
atcagcaattaggtctctagccttc

SEQ ID NO: 239751 - DNA, 25 bp, Mus musculus
atcagcacacacacagggcagttcc

SEQ ID NO: 239752 - DNA, 25 bp, Mus musculus
atcagcacacactcagggcagttcc

SEQ ID NO: 239753 - DNA, 25 bp, Mus musculus
atcagcacacagctaatgtatattt

SEQ ID NO: 239754 - DNA, 25 bp, Mus musculus
atcagcacacaggtaatgtatattt

SEQ ID NO: 239755 - DNA, 25 bp, Mus musculus
atcagcacacccagaaacagattct

SEQ ID NO: 239756 - DNA, 25 bp, Mus musculus
atcagcacaccctgaaacagattct

SEQ ID NO: 239757 - DNA, 25 bp, Mus musculus
atcagcacactcacgtgcaagacag

SEQ ID NO: 239758 - DNA, 25 bp, Mus musculus
atcagcacactctcgtgcaagacag

SEQ ID NO: 239759 - DNA, 25 bp, Mus musculus
atcagcacagatacaccaatagttt

SEQ ID NO: 239760 - DNA, 25 bp, Mus musculus
atcagcacagattcaccaatagttt

SEQ ID NO: 239761 - DNA, 25 bp, Mus musculus
atcagcacagggaccaaagttctag

SEQ ID NO: 239762 - DNA, 25 bp, Mus musculus
atcagcacagggacttgggaatatc

SEQ ID NO: 239763 - DNA, 25 bp, Mus musculus
atcagcacagggtccaaagttctag

SEQ ID NO: 239764 - DNA, 25 bp, Mus musculus
atcagcacagggtcttgggaatatc

SEQ ID NO: 239765 - DNA, 25 bp, Mus musculus
atcagcacatctatggcacactttg

SEQ ID NO: 239766 - DNA, 25 bp, Mus musculus
atcagcacatctttggcacactttg

SEQ ID NO: 239767 - DNA, 25 bp, Mus musculus
atcagcaccgacctactaatgttaa

SEQ ID NO: 239768 - DNA, 25 bp, Mus musculus
atcagcaccgacgtactaatgttaa

SEQ ID NO: 239769 - DNA, 25 bp, Mus musculus
atcagcacctgaaatgcaaggcgag

SEQ ID NO: 239770 - DNA, 25 bp, Mus musculus
atcagcacctgacgctaggaataat

SEQ ID NO: 239771 - DNA, 25 bp, Mus musculus
atcagcacctgaggctaggaataat

SEQ ID NO: 239772 - DNA, 25 bp, Mus musculus
atcagcacctgatatgcaaggcgag

SEQ ID NO: 239773 - DNA, 25 bp, Mus musculus
atcagcactgaacggaaaatcggat

SEQ ID NO: 239774 - DNA, 25 bp, Mus musculus
atcagcactgaagggaaaatcggat

SEQ ID NO: 239775 - DNA, 25 bp, Mus musculus
atcagcactgtaccttgaggccctt

SEQ ID NO: 239776 - DNA, 25 bp, Mus musculus
atcagcactgtagcttgaggccctt

SEQ ID NO: 239777 - DNA, 25 bp, Mus musculus
atcagcacttctcgctagcatacta

SEQ ID NO: 239778 - DNA, 25 bp, Mus musculus
atcagcacttctggctagcatacta

SEQ ID NO: 239779 - DNA, 25 bp, Mus musculus
atcagcagactcatttcatactttg

SEQ ID NO: 239780 - DNA, 25 bp, Mus musculus
atcagcagactcttttcatactttg

SEQ ID NO: 239781 - DNA, 25 bp, Mus musculus
atcagcagactgcatgcagccggag

SEQ ID NO: 239782 - DNA, 25 bp, Mus musculus
atcagcagactggatgcagccggag

SEQ ID NO: 239783 - DNA, 25 bp, Mus musculus
atcagcagattcattccggaaagtc

SEQ ID NO: 239784 - DNA, 25 bp, Mus musculus
atcagcagattctttccggaaagtc

SEQ ID NO: 239785 - DNA, 25 bp, Mus musculus
atcagcagcaagactaagagcctct

SEQ ID NO: 239786 - DNA, 25 bp, Mus musculus
atcagcagcaagtctaagagcctct

SEQ ID NO: 239787 - DNA, 25 bp, Mus musculus
atcagcagcaccaggcccgggagtg

SEQ ID NO: 239788 - DNA, 25 bp, Mus musculus
atcagcagcacctggcccgggagtg

SEQ ID NO: 239789 - DNA, 25 bp, Mus musculus
atcagcagcactatgtaatttcctt

SEQ ID NO: 239790 - DNA, 25 bp, Mus musculus
atcagcagcactttgtaatttcctt

SEQ ID NO: 239791 - DNA, 25 bp, Mus musculus
atcagcagcatccaggctcagctga

SEQ ID NO: 239792 - DNA, 25 bp, Mus musculus
atcagcagcatcgaggctcagctga

SEQ ID NO: 239793 - DNA, 25 bp, Mus musculus
atcagcagcgaaagcttccacgagg

SEQ ID NO: 239794 - DNA, 25 bp, Mus musculus
atcagcagcgaatgcttccacgagg

SEQ ID NO: 239795 - DNA, 25 bp, Mus musculus
atcagcagggtactggctaaataaa

SEQ ID NO: 239796 - DNA, 25 bp, Mus musculus
atcagcagggtagtggctaaataaa

SEQ ID NO: 239797 - DNA, 25 bp, Mus musculus
atcagcagtcagaatcatcagggaa

SEQ ID NO: 239798 - DNA, 25 bp, Mus musculus
atcagcagtcagtatcatcagggaa

SEQ ID NO: 239799 - DNA, 25 bp, Mus musculus
atcagcagtcatacaatatggtaga

SEQ ID NO: 239800 - DNA, 25 bp, Mus musculus
atcagcagtcattcaatatggtaga

SEQ ID NO: 239801 - DNA, 25 bp, Mus musculus
atcagcagtctacttcatcaggtgt

SEQ ID NO: 239802 - DNA, 25 bp, Mus musculus
atcagcagtctagttcatcaggtgt

SEQ ID NO: 239803 - DNA, 25 bp, Mus musculus
atcagcagtgatcggcgtcctgtac

SEQ ID NO: 239804 - DNA, 25 bp, Mus musculus
atcagcagtgatgggcgtcctgtac

SEQ ID NO: 239805 - DNA, 25 bp, Mus musculus
atcagcagtggaacggcacccctgg

SEQ ID NO: 239806 - DNA, 25 bp, Mus musculus
atcagcagtggatcggcacccctgg

SEQ ID NO: 239807 - DNA, 25 bp, Mus musculus
atcagcagtggccaacagtatccag

SEQ ID NO: 239808 - DNA, 25 bp, Mus musculus
atcagcagtggcgaacagtatccag

SEQ ID NO: 239809 - DNA, 25 bp, Mus musculus
atcagcagttgaaagcatcattctt

SEQ ID NO: 239810 - DNA, 25 bp, Mus musculus
atcagcagttgatagcatcattctt

SEQ ID NO: 239811 - DNA, 25 bp, Mus musculus
atcagcatagtcatggtgtacttcc

SEQ ID NO: 239812 - DNA, 25 bp, Mus musculus
atcagcatagtcttggtgtacttcc

SEQ ID NO: 239813 - DNA, 25 bp, Mus musculus
atcagcatcagcacatgacacctgt

SEQ ID NO: 239814 - DNA, 25 bp, Mus musculus
atcagcatcagctcatgacacctgt

SEQ ID NO: 239815 - DNA, 25 bp, Mus musculus
atcagcatcccaatatccaaccgtg

SEQ ID NO: 239816 - DNA, 25 bp, Mus musculus
atcagcatcccattatccaaccgtg

SEQ ID NO: 239817 - DNA, 25 bp, Mus musculus
atcagcatcgccaggtgtaagagat

SEQ ID NO: 239818 - DNA, 25 bp, Mus musculus
atcagcatcgcctggtgtaagagat

SEQ ID NO: 239819 - DNA, 25 bp, Mus musculus
atcagcatctgcaaggagcccattg

SEQ ID NO: 239820 - DNA, 25 bp, Mus musculus
atcagcatctgctaggagcccattg

SEQ ID NO: 239821 - DNA, 25 bp, Mus musculus
atcagcatgtcacttccctgttttg

SEQ ID NO: 239822 - DNA, 25 bp, Mus musculus
atcagcatgtcagttccctgttttg

SEQ ID NO: 239823 - DNA, 25 bp, Mus musculus
atcagcattataaaagccccatcac

SEQ ID NO: 239824 - DNA, 25 bp, Mus musculus
atcagcattatataagccccatcac

SEQ ID NO: 239825 - DNA, 25 bp, Mus musculus
atcagcattctgagacagcgtgtcc

SEQ ID NO: 239826 - DNA, 25 bp, Mus musculus
atcagcattctgtgacagcgtgtcc

SEQ ID NO: 239827 - DNA, 25 bp, Mus musculus
atcagcattgagaaccggccagctt

SEQ ID NO: 239828 - DNA, 25 bp, Mus musculus
atcagcattgagtaccggccagctt

SEQ ID NO: 239829 - DNA, 25 bp, Mus musculus
atcagcattggcatttgggaccgag

SEQ ID NO: 239830 - DNA, 25 bp, Mus musculus
atcagcattggcttttgggaccgag

SEQ ID NO: 239831 - DNA, 25 bp, Mus musculus
atcagccaagggatcagaggccatt

SEQ ID NO: 239832 - DNA, 25 bp, Mus musculus
atcagccaagggttcagaggccatt

SEQ ID NO: 239833 - DNA, 25 bp, Mus musculus
atcagccaaggtatcctagttcagt

SEQ ID NO: 239834 - DNA, 25 bp, Mus musculus
atcagccaaggtttcctagttcagt

SEQ ID NO: 239835 - DNA, 25 bp, Mus musculus
atcagccacattagtttgttctctt

SEQ ID NO: 239836 - DNA, 25 bp, Mus musculus
atcagccacatttgtttgttctctt

SEQ ID NO: 239837 - DNA, 25 bp, Mus musculus
atcagccaccctactcaggaataaa

SEQ ID NO: 239838 - DNA, 25 bp, Mus musculus
atcagccacccttctcaggaataaa

SEQ ID NO: 239839 - DNA, 25 bp, Mus musculus
atcagccactcacaatgccatttta

SEQ ID NO: 239840 - DNA, 25 bp, Mus musculus
atcagccactcagaatgccatttta

SEQ ID NO: 239841 - DNA, 25 bp, Mus musculus
atcagccagatgctcacagccatga

SEQ ID NO: 239842 - DNA, 25 bp, Mus musculus
atcagccagatggtcacagccatga

SEQ ID NO: 239843 - DNA, 25 bp, Mus musculus
atcagccagcccagacttttaccag

SEQ ID NO: 239844 - DNA, 25 bp, Mus musculus
atcagccagccctgacttttaccag

SEQ ID NO: 239845 - DNA, 25 bp, Mus musculus
atcagccatattagtcagtccacac

SEQ ID NO: 239846 - DNA, 25 bp, Mus musculus
atcagccatatttgtcagtccacac

SEQ ID NO: 239847 - DNA, 25 bp, Mus musculus
atcagccatctgactttactacaga

SEQ ID NO: 239848 - DNA, 25 bp, Mus musculus
atcagccatctgtctttactacaga

SEQ ID NO: 239849 - DNA, 25 bp, Mus musculus
atcagccattcacataagatgccca

SEQ ID NO: 239850 - DNA, 25 bp, Mus musculus
atcagccattcagataagatgccca

SEQ ID NO: 239851 - DNA, 25 bp, Mus musculus
atcagccattccattaagtactagt

SEQ ID NO: 239852 - DNA, 25 bp, Mus musculus
atcagccattcctttaagtactagt

SEQ ID NO: 239853 - DNA, 25 bp, Mus musculus
atcagcccaaaaagagcgaggtggt

SEQ ID NO: 239854 - DNA, 25 bp, Mus musculus
atcagcccaaaatgagcgaggtggt

SEQ ID NO: 239855 - DNA, 25 bp, Mus musculus
atcagcccaaagaggcattgagcac

SEQ ID NO: 239856 - DNA, 25 bp, Mus musculus
atcagcccaaagtggcattgagcac

SEQ ID NO: 239857 - DNA, 25 bp, Mus musculus
atcagcccactcatgaggaagcctg

SEQ ID NO: 239858 - DNA, 25 bp, Mus musculus
atcagcccactcttgaggaagcctg

SEQ ID NO: 239859 - DNA, 25 bp, Mus musculus
atcagcccagccattatctagaaca

SEQ ID NO: 239860 - DNA, 25 bp, Mus musculus
atcagcccagcctttatctagaaca

SEQ ID NO: 239861 - DNA, 25 bp, Mus musculus
atcagcccaggcatgtcgcagcagg

SEQ ID NO: 239862 - DNA, 25 bp, Mus musculus
atcagcccaggcttgtcgcagcagg

SEQ ID NO: 239863 - DNA, 25 bp, Mus musculus
atcagcccagtcacatcgagagttt

SEQ ID NO: 239864 - DNA, 25 bp, Mus musculus
atcagcccagtctcatcgagagttt

SEQ ID NO: 239865 - DNA, 25 bp, Mus musculus
atcagcccatctacttggcagtgaa

SEQ ID NO: 239866 - DNA, 25 bp, Mus musculus
atcagcccatcttcttggcagtgaa

SEQ ID NO: 239867 - DNA, 25 bp, Mus musculus
atcagccccagactatccagtgagg

SEQ ID NO: 239868 - DNA, 25 bp, Mus musculus
atcagccccagagtatccagtgagg

SEQ ID NO: 239869 - DNA, 25 bp, Mus musculus
atcagccccatccaaacgggaattg

SEQ ID NO: 239870 - DNA, 25 bp, Mus musculus
atcagccccatcgaaacgggaattg

SEQ ID NO: 239871 - DNA, 25 bp, Mus musculus
atcagcccctggacagcagtgcagc

SEQ ID NO: 239872 - DNA, 25 bp, Mus musculus
atcagcccctggtcagcagtgcagc

SEQ ID NO: 239873 - DNA, 25 bp, Mus musculus
atcagcccctttctcagtgttgtgg

SEQ ID NO: 239874 - DNA, 25 bp, Mus musculus
atcagcccctttgtcagtgttgtgg

SEQ ID NO: 239875 - DNA, 25 bp, Mus musculus
atcagcccgggtagagacgcagtgc

SEQ ID NO: 239876 - DNA, 25 bp, Mus musculus
atcagcccgggttgagacgcagtgc

SEQ ID NO: 239877 - DNA, 25 bp, Mus musculus
atcagccctcaactgagccgggaag

SEQ ID NO: 239878 - DNA, 25 bp, Mus musculus
atcagccctcaagtgagccgggaag

SEQ ID NO: 239879 - DNA, 25 bp, Mus musculus
atcagccctgaaagtgagagactct

SEQ ID NO: 239880 - DNA, 25 bp, Mus musculus
atcagccctgaatgtgagagactct

SEQ ID NO: 239881 - DNA, 25 bp, Mus musculus
atcagccctgtcctgagacagcagg

SEQ ID NO: 239882 - DNA, 25 bp, Mus musculus
atcagccctgtcgtgagacagcagg

SEQ ID NO: 239883 - DNA, 25 bp, Mus musculus
atcagcccttatagccttaactcac

SEQ ID NO: 239884 - DNA, 25 bp, Mus musculus
atcagcccttattgccttaactcac

SEQ ID NO: 239885 - DNA, 25 bp, Mus musculus
atcagccctttgaagtttactcagt

SEQ ID NO: 239886 - DNA, 25 bp, Mus musculus
atcagccctttgtagtttactcagt

SEQ ID NO: 239887 - DNA, 25 bp, Mus musculus
atcagccgaaagaccagaaatgagt

SEQ ID NO: 239888 - DNA, 25 bp, Mus musculus
atcagccgaaagtccagaaatgagt

SEQ ID NO: 239889 - DNA, 25 bp, Mus musculus
atcagccgagagcagaggttgcaca

SEQ ID NO: 239890 - DNA, 25 bp, Mus musculus
atcagccgagaggagaggttgcaca

SEQ ID NO: 239891 - DNA, 25 bp, Mus musculus
atcagccgagtgaccagaattttac

SEQ ID NO: 239892 - DNA, 25 bp, Mus musculus
atcagccgagtgtccagaattttac

SEQ ID NO: 239893 - DNA, 25 bp, Mus musculus
atcagccgcctgagcgtgctgctgt

SEQ ID NO: 239894 - DNA, 25 bp, Mus musculus
atcagccgcctgtgcgtgctgctgt

SEQ ID NO: 239895 - DNA, 25 bp, Mus musculus
atcagcctagatcttccatgcaaaa

SEQ ID NO: 239896 - DNA, 25 bp, Mus musculus
atcagcctagatgttccatgcaaaa

SEQ ID NO: 239897 - DNA, 25 bp, Mus musculus
atcagcctagggactatagcaccgt

SEQ ID NO: 239898 - DNA, 25 bp, Mus musculus
atcagcctagggtctatagcaccgt

SEQ ID NO: 239899 - DNA, 25 bp, Mus musculus
atcagcctcagcaatatcaatccgg

SEQ ID NO: 239900 - DNA, 25 bp, Mus musculus
atcagcctcagctatatcaatccgg

SEQ ID NO: 239901 - DNA, 25 bp, Mus musculus
atcagcctccagcatctggaaacac

SEQ ID NO: 239902 - DNA, 25 bp, Mus musculus
atcagcctccaggatctggaaacac

SEQ ID NO: 239903 - DNA, 25 bp, Mus musculus
atcagcctctgacagtcattggaga

SEQ ID NO: 239904 - DNA, 25 bp, Mus musculus
atcagcctctgagagtcattggaga

SEQ ID NO: 239905 - DNA, 25 bp, Mus musculus
atcagcctgctaccatgtgcatgag

SEQ ID NO: 239906 - DNA, 25 bp, Mus musculus
atcagcctgctagcatgtgcatgag

SEQ ID NO: 239907 - DNA, 25 bp, Mus musculus
atcagcctgggacctaatctctcca

SEQ ID NO: 239908 - DNA, 25 bp, Mus musculus
atcagcctgggagctaatctctcca

SEQ ID NO: 239909 - DNA, 25 bp, Mus musculus
atcagcctggtcaacttagtaagag

SEQ ID NO: 239910 - DNA, 25 bp, Mus musculus
atcagcctggtctacttagtaagag

SEQ ID NO: 239911 - DNA, 25 bp, Mus musculus
atcagcctggtgctcaacaaaccca

SEQ ID NO: 239912 - DNA, 25 bp, Mus musculus
atcagcctggtggtcaacaaaccca

SEQ ID NO: 239913 - DNA, 25 bp, Mus musculus
atcagcctgtcccaggagcgcatca

SEQ ID NO: 239914 - DNA, 25 bp, Mus musculus
atcagcctgtccgaggagcgcatca

SEQ ID NO: 239915 - DNA, 25 bp, Mus musculus
atcagcctgtgaccgtgtgagacct

SEQ ID NO: 239916 - DNA, 25 bp, Mus musculus
atcagcctgtgagcgtgtgagacct

SEQ ID NO: 239917 - DNA, 25 bp, Mus musculus
atcagcctgtgtccacatttataaa

SEQ ID NO: 239918 - DNA, 25 bp, Mus musculus
atcagcctgtgtgcacatttataaa

SEQ ID NO: 239919 - DNA, 25 bp, Mus musculus
atcagcctgtttctattgatggagg

SEQ ID NO: 239920 - DNA, 25 bp, Mus musculus
atcagcctgtttgtattgatggagg

SEQ ID NO: 239921 - DNA, 25 bp, Mus musculus
atcagccttaacaatgttgtctaac

SEQ ID NO: 239922 - DNA, 25 bp, Mus musculus
atcagccttaactatgttgtctaac

SEQ ID NO: 239923 - DNA, 25 bp, Mus musculus
atcagccttccaagcaagttctggg

SEQ ID NO: 239924 - DNA, 25 bp, Mus musculus
atcagccttccatgcaagttctggg

SEQ ID NO: 239925 - DNA, 25 bp, Mus musculus
atcagccttgtacatgaggaagcat

SEQ ID NO: 239926 - DNA, 25 bp, Mus musculus
atcagccttgtagatgaggaagcat

SEQ ID NO: 239927 - DNA, 25 bp, Mus musculus
atcagcctttctcccatagaggact

SEQ ID NO: 239928 - DNA, 25 bp, Mus musculus
atcagcctttctgccatagaggact

SEQ ID NO: 239929 - DNA, 25 bp, Mus musculus
atcagcctttgtaaagagtatccag

SEQ ID NO: 239930 - DNA, 25 bp, Mus musculus
atcagcctttgtacttaaccacaca

SEQ ID NO: 239931 - DNA, 25 bp, Mus musculus
atcagcctttgttaagagtatccag

SEQ ID NO: 239932 - DNA, 25 bp, Mus musculus
atcagcctttgttcttaaccacaca

SEQ ID NO: 239933 - DNA, 25 bp, Mus musculus
atcagccttttacaagctggttttt

SEQ ID NO: 239934 - DNA, 25 bp, Mus musculus
atcagccttttagaagctggttttt

SEQ ID NO: 239935 - DNA, 25 bp, Mus musculus
atcagcgaaaagagcagcctcctaa

SEQ ID NO: 239936 - DNA, 25 bp, Mus musculus
atcagcgaaaagtgcagcctcctaa

SEQ ID NO: 239937 - DNA, 25 bp, Mus musculus
atcagcgaagtgcagcccaaatact

SEQ ID NO: 239938 - DNA, 25 bp, Mus musculus
atcagcgaagtggagcccaaatact

SEQ ID NO: 239939 - DNA, 25 bp, Mus musculus
atcagcgacattatcaaagacacgt

SEQ ID NO: 239940 - DNA, 25 bp, Mus musculus
atcagcgacattttcaaagacacgt

SEQ ID NO: 239941 - DNA, 25 bp, Mus musculus
atcagcgaccccaggatgaaggtaa

SEQ ID NO: 239942 - DNA, 25 bp, Mus musculus
atcagcgacccctggatgaaggtaa

SEQ ID NO: 239943 - DNA, 25 bp, Mus musculus
atcagcgacgtcatctacgagaacg

SEQ ID NO: 239944 - DNA, 25 bp, Mus musculus
atcagcgacgtcttctacgagaacg

SEQ ID NO: 239945 - DNA, 25 bp, Mus musculus
atcagcgaggacacccattctcctt

SEQ ID NO: 239946 - DNA, 25 bp, Mus musculus
atcagcgaggactcccattctcctt

SEQ ID NO: 239947 - DNA, 25 bp, Mus musculus
atcagcgagtacactgaggccgcca

SEQ ID NO: 239948 - DNA, 25 bp, Mus musculus
atcagcgagtactctgaggccgcca

SEQ ID NO: 239949 - DNA, 25 bp, Mus musculus
atcagcgatctgaactgaccctgtt

SEQ ID NO: 239950 - DNA, 25 bp, Mus musculus
atcagcgatctgtactgaccctgtt

SEQ ID NO: 239951 - DNA, 25 bp, Mus musculus
atcagcgcaagaagctggccgccat

SEQ ID NO: 239952 - DNA, 25 bp, Mus musculus
atcagcgcaagatgctggccgccat

SEQ ID NO: 239953 - DNA, 25 bp, Mus musculus
atcagcgcagctacctgtagcagta

SEQ ID NO: 239954 - DNA, 25 bp, Mus musculus
atcagcgcagcttcctgtagcagta

SEQ ID NO: 239955 - DNA, 25 bp, Mus musculus
atcagcgcgaggagcacttcatgaa

SEQ ID NO: 239956 - DNA, 25 bp, Mus musculus
atcagcgcgaggtgcacttcatgaa

SEQ ID NO: 239957 - DNA, 25 bp, Mus musculus
atcagcgggaggaactttccaccag

SEQ ID NO: 239958 - DNA, 25 bp, Mus musculus
atcagcgggaggtactttccaccag

SEQ ID NO: 239959 - DNA, 25 bp, Mus musculus
atcagcgggtgccttccgaaagacg

SEQ ID NO: 239960 - DNA, 25 bp, Mus musculus
atcagcgggtgcgttccgaaagacg

SEQ ID NO: 239961 - DNA, 25 bp, Mus musculus
atcagcgtcaggacaagttcgaggt

SEQ ID NO: 239962 - DNA, 25 bp, Mus musculus
atcagcgtcaggtcaagttcgaggt

SEQ ID NO: 239963 - DNA, 25 bp, Mus musculus
atcagcgtggaccaactgttcagca

SEQ ID NO: 239964 - DNA, 25 bp, Mus musculus
atcagcgtggacgaactgttcagca

SEQ ID NO: 239965 - DNA, 25 bp, Mus musculus
atcagcgtgtataccatttgcattg

SEQ ID NO: 239966 - DNA, 25 bp, Mus musculus
atcagcgtgtattccatttgcattg

SEQ ID NO: 239967 - DNA, 25 bp, Mus musculus
atcagcgtttctcagtcttggagtc

SEQ ID NO: 239968 - DNA, 25 bp, Mus musculus
atcagcgtttctgagtcttggagtc

SEQ ID NO: 239969 - DNA, 25 bp, Mus musculus
atcagctaaactcggccacaatggt

SEQ ID NO: 239970 - DNA, 25 bp, Mus musculus
atcagctaaactgggccacaatggt

SEQ ID NO: 239971 - DNA, 25 bp, Mus musculus
atcagctaaccgagcttcattaggg

SEQ ID NO: 239972 - DNA, 25 bp, Mus musculus
atcagctaaccgtgcttcattaggg

SEQ ID NO: 239973 - DNA, 25 bp, Mus musculus
atcagctaactccttggactaggga

SEQ ID NO: 239974 - DNA, 25 bp, Mus musculus
atcagctaactcgttggactaggga

SEQ ID NO: 239975 - DNA, 25 bp, Mus musculus
atcagctaagttccagttacaccag

SEQ ID NO: 239976 - DNA, 25 bp, Mus musculus
atcagctaagttgcagttacaccag

SEQ ID NO: 239977 - DNA, 25 bp, Mus musculus
atcagctactcccacagaatttttt

SEQ ID NO: 239978 - DNA, 25 bp, Mus musculus
atcagctactccgacagaatttttt

SEQ ID NO: 239979 - DNA, 25 bp, Mus musculus
atcagctagcaacagaagtaacaag

SEQ ID NO: 239980 - DNA, 25 bp, Mus musculus
atcagctagcaagagaagtaacaag

SEQ ID NO: 239981 - DNA, 25 bp, Mus musculus
atcagctataacatttgcctgtatt

SEQ ID NO: 239982 - DNA, 25 bp, Mus musculus
atcagctataacttttgcctgtatt

SEQ ID NO: 239983 - DNA, 25 bp, Mus musculus
atcagctatattccttgccttcagt

SEQ ID NO: 239984 - DNA, 25 bp, Mus musculus
atcagctatattgcttgccttcagt

SEQ ID NO: 239985 - DNA, 25 bp, Mus musculus
atcagctatgagcacttcttctccg

SEQ ID NO: 239986 - DNA, 25 bp, Mus musculus
atcagctatgaggacttcttctccg

SEQ ID NO: 239987 - DNA, 25 bp, Mus musculus
atcagctatggcctttgaagcggaa

SEQ ID NO: 239988 - DNA, 25 bp, Mus musculus
atcagctatggcgtttgaagcggaa

SEQ ID NO: 239989 - DNA, 25 bp, Mus musculus
atcagctcagtaatgctcaccacaa

SEQ ID NO: 239990 - DNA, 25 bp, Mus musculus
atcagctcagtattgctcaccacaa

SEQ ID NO: 239991 - DNA, 25 bp, Mus musculus
atcagctcattcaaatttgtgccct

SEQ ID NO: 239992 - DNA, 25 bp, Mus musculus
atcagctcattctaatttgtgccct

SEQ ID NO: 239993 - DNA, 25 bp, Mus musculus
atcagctccgaaaagcttgctttct

SEQ ID NO: 239994 - DNA, 25 bp, Mus musculus
atcagctccgaatagcttgctttct

SEQ ID NO: 239995 - DNA, 25 bp, Mus musculus
atcagctcctatatttgtttcccct

SEQ ID NO: 239996 - DNA, 25 bp, Mus musculus
atcagctcctatttttgtttcccct

SEQ ID NO: 239997 - DNA, 25 bp, Mus musculus
atcagctcctggagagttcttcctt

SEQ ID NO: 239998 - DNA, 25 bp, Mus musculus
atcagctcctggctacaagccaaag

SEQ ID NO: 239999 - DNA, 25 bp, Mus musculus
atcagctcctgggtacaagccaaag

SEQ ID NO: 240000 - DNA, 25 bp, Mus musculus
atcagctcctggtgagttcttcctt

SEQ ID NO: 240001 - DNA, 25 bp, Mus musculus
atcagctctataccccagccataat

SEQ ID NO: 240002 - DNA, 25 bp, Mus musculus
atcagctctatagcccagccataat

SEQ ID NO: 240003 - DNA, 25 bp, Mus musculus
atcagctctcccagtaacacagaaa

SEQ ID NO: 240004 - DNA, 25 bp, Mus musculus
atcagctctccctgtaacacagaaa

SEQ ID NO: 240005 - DNA, 25 bp, Mus musculus
atcagctctgtcaccatttaacatg

SEQ ID NO: 240006 - DNA, 25 bp, Mus musculus
atcagctctgtctccatttaacatg

SEQ ID NO: 240007 - DNA, 25 bp, Mus musculus
atcagctctgtgcagtggctcgata

SEQ ID NO: 240008 - DNA, 25 bp, Mus musculus
atcagctctgtggagtggctcgata

SEQ ID NO: 240009 - DNA, 25 bp, Mus musculus
atcagctcttcaaatcacgggatcc

SEQ ID NO: 240010 - DNA, 25 bp, Mus musculus
atcagctcttcatatcacgggatcc

SEQ ID NO: 240011 - DNA, 25 bp, Mus musculus
atcagctcttgaattcttatataga

SEQ ID NO: 240012 - DNA, 25 bp, Mus musculus
atcagctcttgatttcttatataga

SEQ ID NO: 240013 - DNA, 25 bp, Mus musculus
atcagctcttttcttctccgaccta

SEQ ID NO: 240014 - DNA, 25 bp, Mus musculus
atcagctcttttgttctccgaccta

SEQ ID NO: 240015 - DNA, 25 bp, Mus musculus
atcagctgacctaaatggtagagta

SEQ ID NO: 240016 - DNA, 25 bp, Mus musculus
atcagctgaccttaatggtagagta

SEQ ID NO: 240017 - DNA, 25 bp, Mus musculus
atcagctgccaaacttccagagtgt

SEQ ID NO: 240018 - DNA, 25 bp, Mus musculus
atcagctgccaatcttccagagtgt

SEQ ID NO: 240019 - DNA, 25 bp, Mus musculus
atcagctgctggaactgtggagcaa

SEQ ID NO: 240020 - DNA, 25 bp, Mus musculus
atcagctgctggtactgtggagcaa

SEQ ID NO: 240021 - DNA, 25 bp, Mus musculus
atcagctggagtacatcctcaggct

SEQ ID NO: 240022 - DNA, 25 bp, Mus musculus
atcagctggagttcatcctcaggct

SEQ ID NO: 240023 - DNA, 25 bp, Mus musculus
atcagctggccaatgtcgccaaaca

SEQ ID NO: 240024 - DNA, 25 bp, Mus musculus
atcagctggccattgtcgccaaaca

SEQ ID NO: 240025 - DNA, 25 bp, Mus musculus
atcagctggtgcacatctgcaacaa

SEQ ID NO: 240026 - DNA, 25 bp, Mus musculus
atcagctggtgctcatctgcaacaa

SEQ ID NO: 240027 - DNA, 25 bp, Mus musculus
atcagctgtaggcaagtgcacacat

SEQ ID NO: 240028 - DNA, 25 bp, Mus musculus
atcagctgtagggaagtgcacacat

SEQ ID NO: 240029 - DNA, 25 bp, Mus musculus
atcagctgtctcatgggcgctattt

SEQ ID NO: 240030 - DNA, 25 bp, Mus musculus
atcagctgtctcttgggcgctattt

SEQ ID NO: 240031 - DNA, 25 bp, Mus musculus
atcagctgttgcaggcagtgtctta

SEQ ID NO: 240032 - DNA, 25 bp, Mus musculus
atcagctgttgctggcagtgtctta

SEQ ID NO: 240033 - DNA, 25 bp, Mus musculus
atcagcttaagtcattcaatcattt

SEQ ID NO: 240034 - DNA, 25 bp, Mus musculus
atcagcttaagtgattcaatcattt

SEQ ID NO: 240035 - DNA, 25 bp, Mus musculus
atcagcttacacatgcctgtatgtt

SEQ ID NO: 240036 - DNA, 25 bp, Mus musculus
atcagcttacacttgcctgtatgtt

SEQ ID NO: 240037 - DNA, 25 bp, Mus musculus
atcagcttcatcaaattcgcatcta

SEQ ID NO: 240038 - DNA, 25 bp, Mus musculus
atcagcttcatctaattcgcatcta

SEQ ID NO: 240039 - DNA, 25 bp, Mus musculus
atcagcttcccaacagtacatttga

SEQ ID NO: 240040 - DNA, 25 bp, Mus musculus
atcagcttcccaagcacatagtatg

SEQ ID NO: 240041 - DNA, 25 bp, Mus musculus
atcagcttcccactagaggaccagc

SEQ ID NO: 240042 - DNA, 25 bp, Mus musculus
atcagcttcccagtagaggaccagc

SEQ ID NO: 240043 - DNA, 25 bp, Mus musculus
atcagcttcccatcagtacatttga

SEQ ID NO: 240044 - DNA, 25 bp, Mus musculus
atcagcttcccatgcacatagtatg

SEQ ID NO: 240045 - DNA, 25 bp, Mus musculus
atcagcttcgacctgtgcaatgcca

SEQ ID NO: 240046 - DNA, 25 bp, Mus musculus
atcagcttcgacgtgtgcaatgcca

SEQ ID NO: 240047 - DNA, 25 bp, Mus musculus
atcagcttcgctattatagtgttca

SEQ ID NO: 240048 - DNA, 25 bp, Mus musculus
atcagcttcgcttttatagtgttca

SEQ ID NO: 240049 - DNA, 25 bp, Mus musculus
atcagcttctccctgaataactggg

SEQ ID NO: 240050 - DNA, 25 bp, Mus musculus
atcagcttctccgtgaataactggg

SEQ ID NO: 240051 - DNA, 25 bp, Mus musculus
atcagcttgcagatctaccacagta

SEQ ID NO: 240052 - DNA, 25 bp, Mus musculus
atcagcttgcagttctaccacagta

SEQ ID NO: 240053 - DNA, 25 bp, Mus musculus
atcagcttgcccatggtgagccggt

SEQ ID NO: 240054 - DNA, 25 bp, Mus musculus
atcagcttgcccttggtgagccggt

SEQ ID NO: 240055 - DNA, 25 bp, Mus musculus
atcagcttgctgaatagtgtagcag

SEQ ID NO: 240056 - DNA, 25 bp, Mus musculus
atcagcttgctgtatagtgtagcag

SEQ ID NO: 240057 - DNA, 25 bp, Mus musculus
atcagcttgtcaattcagtaaggag

SEQ ID NO: 240058 - DNA, 25 bp, Mus musculus
atcagcttgtcatttcagtaaggag

SEQ ID NO: 240059 - DNA, 25 bp, Mus musculus
atcagcttgtgaccgaaacctgctc

SEQ ID NO: 240060 - DNA, 25 bp, Mus musculus
atcagcttgtgagcgaaacctgctc

SEQ ID NO: 240061 - DNA, 25 bp, Mus musculus
atcagcttgttcctcacagatcttt

SEQ ID NO: 240062 - DNA, 25 bp, Mus musculus
atcagcttgttcgtcacagatcttt

SEQ ID NO: 240063 - DNA, 25 bp, Mus musculus
atcagctttacccattgtgcaaata

SEQ ID NO: 240064 - DNA, 25 bp, Mus musculus
atcagctttaccgattgtgcaaata

SEQ ID NO: 240065 - DNA, 25 bp, Mus musculus
atcagctttcatccatgttattgtg

SEQ ID NO: 240066 - DNA, 25 bp, Mus musculus
atcagctttcatgcatgttattgtg

SEQ ID NO: 240067 - DNA, 25 bp, Mus musculus
atcagctttgcacaaggaaacttaa

SEQ ID NO: 240068 - DNA, 25 bp, Mus musculus
atcagctttgcagaaggaaacttaa

SEQ ID NO: 240069 - DNA, 25 bp, Mus musculus
atcagctttggcactaatgggctct

SEQ ID NO: 240070 - DNA, 25 bp, Mus musculus
atcagctttggctctaatgggctct

SEQ ID NO: 240071 - DNA, 25 bp, Mus musculus
atcagcttttagacacacaggccct

SEQ ID NO: 240072 - DNA, 25 bp, Mus musculus
atcagcttttagtcacacaggccct

SEQ ID NO: 240073 - DNA, 25 bp, Mus musculus
atcaggaaaatacccacaggtgtgc

SEQ ID NO: 240074 - DNA, 25 bp, Mus musculus
atcaggaaaatagccacaggtgtgc

SEQ ID NO: 240075 - DNA, 25 bp, Mus musculus
atcaggaaacccatcacaaggagaa

SEQ ID NO: 240076 - DNA, 25 bp, Mus musculus
atcaggaaacccttcacaaggagaa

SEQ ID NO: 240077 - DNA, 25 bp, Mus musculus
atcaggaaagggactcaagaagtcc

SEQ ID NO: 240078 - DNA, 25 bp, Mus musculus
atcaggaaagggtctcaagaagtcc

SEQ ID NO: 240079 - DNA, 25 bp, Mus musculus
atcaggaaccgacctgacttcttcc

SEQ ID NO: 240080 - DNA, 25 bp, Mus musculus
atcaggaaccgagctgacttcttcc

SEQ ID NO: 240081 - DNA, 25 bp, Mus musculus
atcaggaagagaaccaggagcacag

SEQ ID NO: 240082 - DNA, 25 bp, Mus musculus
atcaggaagagatccaggagcacag

SEQ ID NO: 240083 - DNA, 25 bp, Mus musculus
atcaggaagcctatccatttggcac

SEQ ID NO: 240084 - DNA, 25 bp, Mus musculus
atcaggaagcctttccatttggcac

SEQ ID NO: 240085 - DNA, 25 bp, Mus musculus
atcaggaagcgtctggaattaacac

SEQ ID NO: 240086 - DNA, 25 bp, Mus musculus
atcaggaagcgtgtggaattaacac

SEQ ID NO: 240087 - DNA, 25 bp, Mus musculus
atcaggaaggttactgcttgccagc

SEQ ID NO: 240088 - DNA, 25 bp, Mus musculus
atcaggaaggtttctgcttgccagc

SEQ ID NO: 240089 - DNA, 25 bp, Mus musculus
atcaggaagttcctcatgcctccag

SEQ ID NO: 240090 - DNA, 25 bp, Mus musculus
atcaggaagttcgtcatgcctccag

SEQ ID NO: 240091 - DNA, 25 bp, Mus musculus
atcaggaatactccctcagttattg

SEQ ID NO: 240092 - DNA, 25 bp, Mus musculus
atcaggaatactgcctcagttattg

SEQ ID NO: 240093 - DNA, 25 bp, Mus musculus
atcaggaattcacggatcatcttgt

SEQ ID NO: 240094 - DNA, 25 bp, Mus musculus
atcaggaattcagggatcatcttgt

SEQ ID NO: 240095 - DNA, 25 bp, Mus musculus
atcaggaatttgatctctgcatcct

SEQ ID NO: 240096 - DNA, 25 bp, Mus musculus
atcaggaatttgttctctgcatcct

SEQ ID NO: 240097 - DNA, 25 bp, Mus musculus
atcaggacaaagacttgcatcaagt

SEQ ID NO: 240098 - DNA, 25 bp, Mus musculus
atcaggacaaagtcttgcatcaagt

SEQ ID NO: 240099 - DNA, 25 bp, Mus musculus
atcaggacaactactgttttctaaa

SEQ ID NO: 240100 - DNA, 25 bp, Mus musculus
atcaggacaacttctgttttctaaa

SEQ ID NO: 240101 - DNA, 25 bp, Mus musculus
atcaggacaccgctgcagacaagtg

SEQ ID NO: 240102 - DNA, 25 bp, Mus musculus
atcaggacaccggtgcagacaagtg

SEQ ID NO: 240103 - DNA, 25 bp, Mus musculus
atcaggacagctaccagcttgcaat

SEQ ID NO: 240104 - DNA, 25 bp, Mus musculus
atcaggacagcttccagcttgcaat

SEQ ID NO: 240105 - DNA, 25 bp, Mus musculus
atcaggacagttatgcccagtggtt

SEQ ID NO: 240106 - DNA, 25 bp, Mus musculus
atcaggacagttttgcccagtggtt

SEQ ID NO: 240107 - DNA, 25 bp, Mus musculus
atcaggaccattccttcctatcagg

SEQ ID NO: 240108 - DNA, 25 bp, Mus musculus
atcaggaccattgcttcctatcagg

SEQ ID NO: 240109 - DNA, 25 bp, Mus musculus
atcaggacccctactgtcagaggta

SEQ ID NO: 240110 - DNA, 25 bp, Mus musculus
atcaggaccccttctgtcagaggta

SEQ ID NO: 240111 - DNA, 25 bp, Mus musculus
atcaggacctgaaacactcttcatg

SEQ ID NO: 240112 - DNA, 25 bp, Mus musculus
atcaggacctgatacactcttcatg

SEQ ID NO: 240113 - DNA, 25 bp, Mus musculus
atcaggacgagcatctagacccttg

SEQ ID NO: 240114 - DNA, 25 bp, Mus musculus
atcaggacgagcttctagacccttg

SEQ ID NO: 240115 - DNA, 25 bp, Mus musculus
atcaggactctcaagattccattgg

SEQ ID NO: 240116 - DNA, 25 bp, Mus musculus
atcaggactctctagattccattgg

SEQ ID NO: 240117 - DNA, 25 bp, Mus musculus
atcaggactgagatcttcatccaaa

SEQ ID NO: 240118 - DNA, 25 bp, Mus musculus
atcaggactgagttcttcatccaaa

SEQ ID NO: 240119 - DNA, 25 bp, Mus musculus
atcaggactgtaaccgctggcaacg

SEQ ID NO: 240120 - DNA, 25 bp, Mus musculus
atcaggactgtatccgctggcaacg

SEQ ID NO: 240121 - DNA, 25 bp, Mus musculus
atcaggacttgtcgagacctctgca

SEQ ID NO: 240122 - DNA, 25 bp, Mus musculus
atcaggacttgtggagacctctgca

SEQ ID NO: 240123 - DNA, 25 bp, Mus musculus
atcaggagactcaaggactggtgag

SEQ ID NO: 240124 - DNA, 25 bp, Mus musculus
atcaggagactctaggactggtgag

SEQ ID NO: 240125 - DNA, 25 bp, Mus musculus
atcaggagaggtccactttagggca

SEQ ID NO: 240126 - DNA, 25 bp, Mus musculus
atcaggagaggtgcactttagggca

SEQ ID NO: 240127 - DNA, 25 bp, Mus musculus
atcaggagccccactgaaggctggg

SEQ ID NO: 240128 - DNA, 25 bp, Mus musculus
atcaggagcccctctgaaggctggg

SEQ ID NO: 240129 - DNA, 25 bp, Mus musculus
atcaggagcctgactatagtgtagc

SEQ ID NO: 240130 - DNA, 25 bp, Mus musculus
atcaggagcctgagttgcaaagctg

SEQ ID NO: 240131 - DNA, 25 bp, Mus musculus
atcaggagcctgtctatagtgtagc

SEQ ID NO: 240132 - DNA, 25 bp, Mus musculus
atcaggagcctgtgttgcaaagctg

SEQ ID NO: 240133 - DNA, 25 bp, Mus musculus
atcaggagctgcagttgtggcccag

SEQ ID NO: 240134 - DNA, 25 bp, Mus musculus
atcaggagctgctgttgtggcccag

SEQ ID NO: 240135 - DNA, 25 bp, Mus musculus
atcaggaggactagagcggtcagaa

SEQ ID NO: 240136 - DNA, 25 bp, Mus musculus
atcaggaggacttgagcggtcagaa

SEQ ID NO: 240137 - DNA, 25 bp, Mus musculus
atcaggaggccaaacagcccggagc

SEQ ID NO: 240138 - DNA, 25 bp, Mus musculus
atcaggaggccatacagcccggagc

SEQ ID NO: 240139 - DNA, 25 bp, Mus musculus
atcaggagggagactcagcagcgcc

SEQ ID NO: 240140 - DNA, 25 bp, Mus musculus
atcaggagggagtctcagcagcgcc

SEQ ID NO: 240141 - DNA, 25 bp, Mus musculus
atcaggagggccctgtctgtactgt

SEQ ID NO: 240142 - DNA, 25 bp, Mus musculus
atcaggagggccgtgtctgtactgt

SEQ ID NO: 240143 - DNA, 25 bp, Mus musculus
atcaggaggttcatcttcccagaag

SEQ ID NO: 240144 - DNA, 25 bp, Mus musculus
atcaggaggttcttcttcccagaag

SEQ ID NO: 240145 - DNA, 25 bp, Mus musculus
atcaggatacatctaccctagctac

SEQ ID NO: 240146 - DNA, 25 bp, Mus musculus
atcaggatacatgtaccctagctac

SEQ ID NO: 240147 - DNA, 25 bp, Mus musculus
atcaggatcgaacgccctgggatct

SEQ ID NO: 240148 - DNA, 25 bp, Mus musculus
atcaggatcgaaggccctgggatct

SEQ ID NO: 240149 - DNA, 25 bp, Mus musculus
atcaggatctggcaagcttaaggaa

SEQ ID NO: 240150 - DNA, 25 bp, Mus musculus
atcaggatctgggaagcttaaggaa

SEQ ID NO: 240151 - DNA, 25 bp, Mus musculus
atcaggatgactccagtgggcctct

SEQ ID NO: 240152 - DNA, 25 bp, Mus musculus
atcaggatgactgcagtgggcctct

SEQ ID NO: 240153 - DNA, 25 bp, Mus musculus
atcaggatgcttatctcaccttctg

SEQ ID NO: 240154 - DNA, 25 bp, Mus musculus
atcaggatgcttttctcaccttctg

SEQ ID NO: 240155 - DNA, 25 bp, Mus musculus
atcaggatgtccaagccctgtggta

SEQ ID NO: 240156 - DNA, 25 bp, Mus musculus
atcaggatgtccaatgccctttgta

SEQ ID NO: 240157 - DNA, 25 bp, Mus musculus
atcaggatgtcctagccctgtggta

SEQ ID NO: 240158 - DNA, 25 bp, Mus musculus
atcaggatgtcctatgccctttgta

SEQ ID NO: 240159 - DNA, 25 bp, Mus musculus
atcaggattatgctttcaatgtatc

SEQ ID NO: 240160 - DNA, 25 bp, Mus musculus
atcaggattatggtttcaatgtatc

SEQ ID NO: 240161 - DNA, 25 bp, Mus musculus
atcaggattttcagtgccaccaaac

SEQ ID NO: 240162 - DNA, 25 bp, Mus musculus
atcaggattttctgtgccaccaaac

SEQ ID NO: 240163 - DNA, 25 bp, Mus musculus
atcaggcaaccaccagggcaggaga

SEQ ID NO: 240164 - DNA, 25 bp, Mus musculus
atcaggcaaccagcagggcaggaga

SEQ ID NO: 240165 - DNA, 25 bp, Mus musculus
atcaggcaacttaattcatctaggg

SEQ ID NO: 240166 - DNA, 25 bp, Mus musculus
atcaggcaactttattcatctaggg

SEQ ID NO: 240167 - DNA, 25 bp, Mus musculus
atcaggcaagacacggagtttatcc

SEQ ID NO: 240168 - DNA, 25 bp, Mus musculus
atcaggcaagactcggagtttatcc

SEQ ID NO: 240169 - DNA, 25 bp, Mus musculus
atcaggcaagccacattgcagtggt

SEQ ID NO: 240170 - DNA, 25 bp, Mus musculus
atcaggcaagcctcattgcagtggt

SEQ ID NO: 240171 - DNA, 25 bp, Mus musculus
atcaggcaatttatcggagtcacgt

SEQ ID NO: 240172 - DNA, 25 bp, Mus musculus
atcaggcaatttttcggagtcacgt

SEQ ID NO: 240173 - DNA, 25 bp, Mus musculus
atcaggcaccaaactcaaagtcttc

SEQ ID NO: 240174 - DNA, 25 bp, Mus musculus
atcaggcaccaatctcaaagtcttc

SEQ ID NO: 240175 - DNA, 25 bp, Mus musculus
atcaggcaccagacagaccgatatg

SEQ ID NO: 240176 - DNA, 25 bp, Mus musculus
atcaggcaccagtcagaccgatatg

SEQ ID NO: 240177 - DNA, 25 bp, Mus musculus
atcaggcaccccaagttaaagtggt

SEQ ID NO: 240178 - DNA, 25 bp, Mus musculus
atcaggcacccctagttaaagtggt

SEQ ID NO: 240179 - DNA, 25 bp, Mus musculus
atcaggcacttgcttgagcagagga

SEQ ID NO: 240180 - DNA, 25 bp, Mus musculus
atcaggcacttggttgagcagagga

SEQ ID NO: 240181 - DNA, 25 bp, Mus musculus
atcaggcagctaaaaaccaccagac

SEQ ID NO: 240182 - DNA, 25 bp, Mus musculus
atcaggcagctataaaccaccagac

SEQ ID NO: 240183 - DNA, 25 bp, Mus musculus
atcaggcaggatagttcatccttag

SEQ ID NO: 240184 - DNA, 25 bp, Mus musculus
atcaggcaggattgttcatccttag

SEQ ID NO: 240185 - DNA, 25 bp, Mus musculus
atcaggcagtgcagcgccacaggca

SEQ ID NO: 240186 - DNA, 25 bp, Mus musculus
atcaggcagtgctgcgccacaggca

SEQ ID NO: 240187 - DNA, 25 bp, Mus musculus
atcaggcagttactggtagccgctt

SEQ ID NO: 240188 - DNA, 25 bp, Mus musculus
atcaggcagttagtggtagccgctt

SEQ ID NO: 240189 - DNA, 25 bp, Mus musculus
atcaggcatactctgcccagttcga

SEQ ID NO: 240190 - DNA, 25 bp, Mus musculus
atcaggcatactgtgcccagttcga

SEQ ID NO: 240191 - DNA, 25 bp, Mus musculus
atcaggcatctcaccaggtggtggg

SEQ ID NO: 240192 - DNA, 25 bp, Mus musculus
atcaggcatctctccaggtggtggg

SEQ ID NO: 240193 - DNA, 25 bp, Mus musculus
atcaggcattgtcggttagcactaa

SEQ ID NO: 240194 - DNA, 25 bp, Mus musculus
atcaggcattgtgggttagcactaa

SEQ ID NO: 240195 - DNA, 25 bp, Mus musculus
atcaggccataaagtctcccaagag

SEQ ID NO: 240196 - DNA, 25 bp, Mus musculus
atcaggccataatgtctcccaagag

SEQ ID NO: 240197 - DNA, 25 bp, Mus musculus
atcaggccatgtactaaagtcatcg

SEQ ID NO: 240198 - DNA, 25 bp, Mus musculus
atcaggccatgttctaaagtcatcg

SEQ ID NO: 240199 - DNA, 25 bp, Mus musculus
atcaggcccaggatcccggaccaaa

SEQ ID NO: 240200 - DNA, 25 bp, Mus musculus
atcaggcccaggttcccggaccaaa

SEQ ID NO: 240201 - DNA, 25 bp, Mus musculus
atcaggcccctgaggttgggacctc

SEQ ID NO: 240202 - DNA, 25 bp, Mus musculus
atcaggcccctgtggttgggacctc

SEQ ID NO: 240203 - DNA, 25 bp, Mus musculus
atcaggccccttcaagtgaaggttg

SEQ ID NO: 240204 - DNA, 25 bp, Mus musculus
atcaggccccttgaagtgaaggttg

SEQ ID NO: 240205 - DNA, 25 bp, Mus musculus
atcaggcccggaattggtgggcacc

SEQ ID NO: 240206 - DNA, 25 bp, Mus musculus
atcaggcccggatttggtgggcacc

SEQ ID NO: 240207 - DNA, 25 bp, Mus musculus
atcaggccgaatatgaggagggttt

SEQ ID NO: 240208 - DNA, 25 bp, Mus musculus
atcaggccgaatttgaggagggttt

SEQ ID NO: 240209 - DNA, 25 bp, Mus musculus
atcaggccgcatcgtgtcaggacaa

SEQ ID NO: 240210 - DNA, 25 bp, Mus musculus
atcaggccgcatggtgtcaggacaa

SEQ ID NO: 240211 - DNA, 25 bp, Mus musculus
atcaggcctactccatggtagttta

SEQ ID NO: 240212 - DNA, 25 bp, Mus musculus
atcaggcctactgcatggtagttta

SEQ ID NO: 240213 - DNA, 25 bp, Mus musculus
atcaggcctattctgttatcagtaa

SEQ ID NO: 240214 - DNA, 25 bp, Mus musculus
atcaggcctattgtgttatcagtaa

SEQ ID NO: 240215 - DNA, 25 bp, Mus musculus
atcaggcctcaaatccagtatgttt

SEQ ID NO: 240216 - DNA, 25 bp, Mus musculus
atcaggcctcaattccagtatgttt

SEQ ID NO: 240217 - DNA, 25 bp, Mus musculus
atcaggcctgcaccgtgggtcttga

SEQ ID NO: 240218 - DNA, 25 bp, Mus musculus
atcaggcctgcagcgtgggtcttga

SEQ ID NO: 240219 - DNA, 25 bp, Mus musculus
atcaggcctgccatgagccacgata

SEQ ID NO: 240220 - DNA, 25 bp, Mus musculus
atcaggcctgccttgagccacgata

SEQ ID NO: 240221 - DNA, 25 bp, Mus musculus
atcaggcctggcaccaaagcatcgc

SEQ ID NO: 240222 - DNA, 25 bp, Mus musculus
atcaggcctggctccaaagcatcgc

SEQ ID NO: 240223 - DNA, 25 bp, Mus musculus
atcaggcgttcaagactctgcttca

SEQ ID NO: 240224 - DNA, 25 bp, Mus musculus
atcaggcgttcatgactctgcttca

SEQ ID NO: 240225 - DNA, 25 bp, Mus musculus
atcaggctacacatgagcatcgtta

SEQ ID NO: 240226 - DNA, 25 bp, Mus musculus
atcaggctacacttgagcatcgtta

SEQ ID NO: 240227 - DNA, 25 bp, Mus musculus
atcaggctcaaaaaggtcacatcaa

SEQ ID NO: 240228 - DNA, 25 bp, Mus musculus
atcaggctcaaataggtcacatcaa

SEQ ID NO: 240229 - DNA, 25 bp, Mus musculus
atcaggctcagacgtgcacgccagc

SEQ ID NO: 240230 - DNA, 25 bp, Mus musculus
atcaggctcagaggtgcacgccagc

SEQ ID NO: 240231 - DNA, 25 bp, Mus musculus
atcaggctcctgacacaaaatagcc

SEQ ID NO: 240232 - DNA, 25 bp, Mus musculus
atcaggctcctgtcacaaaatagcc

SEQ ID NO: 240233 - DNA, 25 bp, Mus musculus
atcaggctcgttcatttagctcagc

SEQ ID NO: 240234 - DNA, 25 bp, Mus musculus
atcaggctcgttgatttagctcagc

SEQ ID NO: 240235 - DNA, 25 bp, Mus musculus
atcaggctgccactaatgctcaaat

SEQ ID NO: 240236 - DNA, 25 bp, Mus musculus
atcaggctgccagtaatgctcaaat

SEQ ID NO: 240237 - DNA, 25 bp, Mus musculus
atcaggctgcggctcttcctgctgt

SEQ ID NO: 240238 - DNA, 25 bp, Mus musculus
atcaggctgcgggtcttcctgctgt

SEQ ID NO: 240239 - DNA, 25 bp, Mus musculus
atcaggctgctgcttttccttccat

SEQ ID NO: 240240 - DNA, 25 bp, Mus musculus
atcaggctgctggttttccttccat

SEQ ID NO: 240241 - DNA, 25 bp, Mus musculus
atcaggctggcacaaggcagaccta

SEQ ID NO: 240242 - DNA, 25 bp, Mus musculus
atcaggctggcagaaggcagaccta

SEQ ID NO: 240243 - DNA, 25 bp, Mus musculus
atcaggctggctagcaacttgtagt

SEQ ID NO: 240244 - DNA, 25 bp, Mus musculus
atcaggctggcttgcaacttgtagt

SEQ ID NO: 240245 - DNA, 25 bp, Mus musculus
atcaggcttcggctttttgacagtg

SEQ ID NO: 240246 - DNA, 25 bp, Mus musculus
atcaggcttcgggtttttgacagtg

SEQ ID NO: 240247 - DNA, 25 bp, Mus musculus
atcaggcttcttacttctgtacaag

SEQ ID NO: 240248 - DNA, 25 bp, Mus musculus
atcaggcttctttcttctgtacaag

SEQ ID NO: 240249 - DNA, 25 bp, Mus musculus
atcaggcttgctattatggcacttt

SEQ ID NO: 240250 - DNA, 25 bp, Mus musculus
atcaggcttgcttttatggcacttt

SEQ ID NO: 240251 - DNA, 25 bp, Mus musculus
atcaggcttggcagaggcgcctcta

SEQ ID NO: 240252 - DNA, 25 bp, Mus musculus
atcaggcttggctgaggcgcctcta

SEQ ID NO: 240253 - DNA, 25 bp, Mus musculus
atcaggctttagaactgctttccta

SEQ ID NO: 240254 - DNA, 25 bp, Mus musculus
atcaggctttagtactgctttccta

SEQ ID NO: 240255 - DNA, 25 bp, Mus musculus
atcagggacatgattctagaccagt

SEQ ID NO: 240256 - DNA, 25 bp, Mus musculus
atcagggacatgtttctagaccagt

SEQ ID NO: 240257 - DNA, 25 bp, Mus musculus
atcagggacctgcttgtgaacatgt

SEQ ID NO: 240258 - DNA, 25 bp, Mus musculus
atcagggacctggttgtgaacatgt

SEQ ID NO: 240259 - DNA, 25 bp, Mus musculus
atcagggactgacccttcctgaact

SEQ ID NO: 240260 - DNA, 25 bp, Mus musculus
atcagggactgagccttcctgaact

SEQ ID NO: 240261 - DNA, 25 bp, Mus musculus
atcagggaggatccttgtccagatt

SEQ ID NO: 240262 - DNA, 25 bp, Mus musculus
atcagggaggatgcttgtccagatt

SEQ ID NO: 240263 - DNA, 25 bp, Mus musculus
atcagggaggtcaaagcgcccagct

SEQ ID NO: 240264 - DNA, 25 bp, Mus musculus
atcagggaggtctaagcgcccagct

SEQ ID NO: 240265 - DNA, 25 bp, Mus musculus
atcagggagtgtccctaaggtgccc

SEQ ID NO: 240266 - DNA, 25 bp, Mus musculus
atcagggagtgtgcctaaggtgccc

SEQ ID NO: 240267 - DNA, 25 bp, Mus musculus
atcagggattataacagtcaaactc

SEQ ID NO: 240268 - DNA, 25 bp, Mus musculus
atcagggattattacagtcaaactc

SEQ ID NO: 240269 - DNA, 25 bp, Mus musculus
atcagggcaaagaacacagcttcag

SEQ ID NO: 240270 - DNA, 25 bp, Mus musculus
atcagggcaaagtacacagcttcag

SEQ ID NO: 240271 - DNA, 25 bp, Mus musculus
atcagggcacagatctgatgtgcgt

SEQ ID NO: 240272 - DNA, 25 bp, Mus musculus
atcagggcacagttctgatgtgcgt

SEQ ID NO: 240273 - DNA, 25 bp, Mus musculus
atcagggcaccaagtatagtagaga

SEQ ID NO: 240274 - DNA, 25 bp, Mus musculus
atcagggcaccatgtatagtagaga

SEQ ID NO: 240275 - DNA, 25 bp, Mus musculus
atcagggcacttcgcatccttttgg

SEQ ID NO: 240276 - DNA, 25 bp, Mus musculus
atcagggcacttggcatccttttgg

SEQ ID NO: 240277 - DNA, 25 bp, Mus musculus
atcagggcagtcagtgcacgtcatt

SEQ ID NO: 240278 - DNA, 25 bp, Mus musculus
atcagggcagtctgtgcacgtcatt

SEQ ID NO: 240279 - DNA, 25 bp, Mus musculus
atcagggccaagaccttccatggtt

SEQ ID NO: 240280 - DNA, 25 bp, Mus musculus
atcagggccaagtccttccatggtt

SEQ ID NO: 240281 - DNA, 25 bp, Mus musculus
atcagggcccacatgcgtgaaaaat

SEQ ID NO: 240282 - DNA, 25 bp, Mus musculus
atcagggcccacttgcgtgaaaaat

SEQ ID NO: 240283 - DNA, 25 bp, Mus musculus
atcagggccctgattactagactgg

SEQ ID NO: 240284 - DNA, 25 bp, Mus musculus
atcagggccctgtttactagactgg

SEQ ID NO: 240285 - DNA, 25 bp, Mus musculus
atcagggcgtgaactcttaataatt

SEQ ID NO: 240286 - DNA, 25 bp, Mus musculus
atcagggcgtgatctcttaataatt

SEQ ID NO: 240287 - DNA, 25 bp, Mus musculus
atcagggctccgatgtgcaaaatga

SEQ ID NO: 240288 - DNA, 25 bp, Mus musculus
atcagggctccgttgtgcaaaatga

SEQ ID NO: 240289 - DNA, 25 bp, Mus musculus
atcagggctgctatggttaggtgtt

SEQ ID NO: 240290 - DNA, 25 bp, Mus musculus
atcagggctgctttggttaggtgtt

SEQ ID NO: 240291 - DNA, 25 bp, Mus musculus
atcaggggcgacatcagtgttcaca

SEQ ID NO: 240292 - DNA, 25 bp, Mus musculus
atcaggggcgacttcagtgttcaca

SEQ ID NO: 240293 - DNA, 25 bp, Mus musculus
atcagggtcccacggctatagtgga

SEQ ID NO: 240294 - DNA, 25 bp, Mus musculus
atcagggtcccagggctatagtgga

SEQ ID NO: 240295 - DNA, 25 bp, Mus musculus
atcagggtcctacagaaggaactgg

SEQ ID NO: 240296 - DNA, 25 bp, Mus musculus
atcagggtcctagagaaggaactgg

SEQ ID NO: 240297 - DNA, 25 bp, Mus musculus
atcagggtccttactagagcagtgt

SEQ ID NO: 240298 - DNA, 25 bp, Mus musculus
atcagggtcctttctagagcagtgt

SEQ ID NO: 240299 - DNA, 25 bp, Mus musculus
atcagggtgctcattcatatcaagt

SEQ ID NO: 240300 - DNA, 25 bp, Mus musculus
atcagggtgctctttcatatcaagt

SEQ ID NO: 240301 - DNA, 25 bp, Mus musculus
atcagggttcaacggtcaaactgtc

SEQ ID NO: 240302 - DNA, 25 bp, Mus musculus
atcagggttcaagggtcaaactgtc

SEQ ID NO: 240303 - DNA, 25 bp, Mus musculus
atcagggttcccattttgctcattg

SEQ ID NO: 240304 - DNA, 25 bp, Mus musculus
atcagggttccctttttgctcattg

SEQ ID NO: 240305 - DNA, 25 bp, Mus musculus
atcagggttctgaaaatagtgaatg

SEQ ID NO: 240306 - DNA, 25 bp, Mus musculus
atcagggttctgtaaatagtgaatg

SEQ ID NO: 240307 - DNA, 25 bp, Mus musculus
atcaggtaagcccaagttgcagcaa

SEQ ID NO: 240308 - DNA, 25 bp, Mus musculus
atcaggtaagccgaagttgcagcaa

SEQ ID NO: 240309 - DNA, 25 bp, Mus musculus
atcaggtactcacatctccaaagac

SEQ ID NO: 240310 - DNA, 25 bp, Mus musculus
atcaggtactcagatctccaaagac

SEQ ID NO: 240311 - DNA, 25 bp, Mus musculus
atcaggtactttactgtagggtgga

SEQ ID NO: 240312 - DNA, 25 bp, Mus musculus
atcaggtacttttctgtagggtgga

SEQ ID NO: 240313 - DNA, 25 bp, Mus musculus
atcaggtagcgcaggagcttggcac

SEQ ID NO: 240314 - DNA, 25 bp, Mus musculus
atcaggtagcgctggagcttggcac

SEQ ID NO: 240315 - DNA, 25 bp, Mus musculus
atcaggtataaaaccaactcataga

SEQ ID NO: 240316 - DNA, 25 bp, Mus musculus
atcaggtataaatccaactcataga

SEQ ID NO: 240317 - DNA, 25 bp, Mus musculus
atcaggtcactgcaatcatgaaggc

SEQ ID NO: 240318 - DNA, 25 bp, Mus musculus
atcaggtcactggaatcatgaaggc

SEQ ID NO: 240319 - DNA, 25 bp, Mus musculus
atcaggtcagagatgcggtcaaggc

SEQ ID NO: 240320 - DNA, 25 bp, Mus musculus
atcaggtcagagttgcggtcaaggc

SEQ ID NO: 240321 - DNA, 25 bp, Mus musculus
atcaggtcaggaccatgtggttgtc

SEQ ID NO: 240322 - DNA, 25 bp, Mus musculus
atcaggtcaggagcatgtggttgtc

SEQ ID NO: 240323 - DNA, 25 bp, Mus musculus
atcaggtcatttcgaaggcatttct

SEQ ID NO: 240324 - DNA, 25 bp, Mus musculus
atcaggtcatttggaaggcatttct

SEQ ID NO: 240325 - DNA, 25 bp, Mus musculus
atcaggtccaccatgtggtaggtgc

SEQ ID NO: 240326 - DNA, 25 bp, Mus musculus
atcaggtccaccttgtggtaggtgc

SEQ ID NO: 240327 - DNA, 25 bp, Mus musculus
atcaggtccgtcaaagagggccgcg

SEQ ID NO: 240328 - DNA, 25 bp, Mus musculus
atcaggtccgtctaagagggccgcg

SEQ ID NO: 240329 - DNA, 25 bp, Mus musculus
atcaggtcgggcacaaattcgcaga

SEQ ID NO: 240330 - DNA, 25 bp, Mus musculus
atcaggtcgggctcaaattcgcaga

SEQ ID NO: 240331 - DNA, 25 bp, Mus musculus
atcaggtctcccaatcagattagaa

SEQ ID NO: 240332 - DNA, 25 bp, Mus musculus
atcaggtctccctatcagattagaa

SEQ ID NO: 240333 - DNA, 25 bp, Mus musculus
atcaggtcttaccatcgggttccag

SEQ ID NO: 240334 - DNA, 25 bp, Mus musculus
atcaggtcttacgatcgggttccag

SEQ ID NO: 240335 - DNA, 25 bp, Mus musculus
atcaggtcttagctggccagacaaa

SEQ ID NO: 240336 - DNA, 25 bp, Mus musculus
atcaggtcttaggtggccagacaaa

SEQ ID NO: 240337 - DNA, 25 bp, Mus musculus
atcaggtgaaggaccagctttggga

SEQ ID NO: 240338 - DNA, 25 bp, Mus musculus
atcaggtgaaggtccagctttggga

SEQ ID NO: 240339 - DNA, 25 bp, Mus musculus
atcaggtgacatagatggacttcca

SEQ ID NO: 240340 - DNA, 25 bp, Mus musculus
atcaggtgacattgatggacttcca

SEQ ID NO: 240341 - DNA, 25 bp, Mus musculus
atcaggtgatatagtctgtccctct

SEQ ID NO: 240342 - DNA, 25 bp, Mus musculus
atcaggtgatattgtctgtccctct

SEQ ID NO: 240343 - DNA, 25 bp, Mus musculus
atcaggtgatctcttgccctaacta

SEQ ID NO: 240344 - DNA, 25 bp, Mus musculus
atcaggtgatctgttgccctaacta

SEQ ID NO: 240345 - DNA, 25 bp, Mus musculus
atcaggtgcaggcttcttatttcta

SEQ ID NO: 240346 - DNA, 25 bp, Mus musculus
atcaggtgcagggttcttatttcta

SEQ ID NO: 240347 - DNA, 25 bp, Mus musculus
atcaggtggtccactgagcatttct

SEQ ID NO: 240348 - DNA, 25 bp, Mus musculus
atcaggtggtcctctgagcatttct

SEQ ID NO: 240349 - DNA, 25 bp, Mus musculus
atcaggtgtatcaaactggtgcaca

SEQ ID NO: 240350 - DNA, 25 bp, Mus musculus
atcaggtgtatctaactggtgcaca

SEQ ID NO: 240351 - DNA, 25 bp, Mus musculus
atcaggtgttcacggtggtacaact

SEQ ID NO: 240352 - DNA, 25 bp, Mus musculus
atcaggtgttcagggtggtacaact

SEQ ID NO: 240353 - DNA, 25 bp, Mus musculus
atcaggttaaatctgtttctcttca

SEQ ID NO: 240354 - DNA, 25 bp, Mus musculus
atcaggttaaatgtgtttctcttca

SEQ ID NO: 240355 - DNA, 25 bp, Mus musculus
atcaggttacaaacacgcttcagct

SEQ ID NO: 240356 - DNA, 25 bp, Mus musculus
atcaggttacaatcacgcttcagct

SEQ ID NO: 240357 - DNA, 25 bp, Mus musculus
atcaggttattcacagtcgtatggt

SEQ ID NO: 240358 - DNA, 25 bp, Mus musculus
atcaggttattctcagtcgtatggt

SEQ ID NO: 240359 - DNA, 25 bp, Mus musculus
atcaggttctggagtcaaccatcat

SEQ ID NO: 240360 - DNA, 25 bp, Mus musculus
atcaggttctggtgtcaaccatcat

SEQ ID NO: 240361 - DNA, 25 bp, Mus musculus
atcaggttgctgatcttgctaattt

SEQ ID NO: 240362 - DNA, 25 bp, Mus musculus
atcaggttgctgttcttgctaattt

SEQ ID NO: 240363 - DNA, 25 bp, Mus musculus
atcaggttggacacgaggtcctgca

SEQ ID NO: 240364 - DNA, 25 bp, Mus musculus
atcaggttggactcgaggtcctgca

SEQ ID NO: 240365 - DNA, 25 bp, Mus musculus
atcaggtttctgaggctttgggagt

SEQ ID NO: 240366 - DNA, 25 bp, Mus musculus
atcaggtttctgtggctttgggagt

SEQ ID NO: 240367 - DNA, 25 bp, Mus musculus
atcaggtttgatcctccacattcag

SEQ ID NO: 240368 - DNA, 25 bp, Mus musculus
atcaggtttgatgctccacattcag

SEQ ID NO: 240369 - DNA, 25 bp, Mus musculus
atcaggtttgcactccttccactca

SEQ ID NO: 240370 - DNA, 25 bp, Mus musculus
atcaggtttgcagtccttccactca

SEQ ID NO: 240371 - DNA, 25 bp, Mus musculus
atcaggtttggtcgccaattctgtt

SEQ ID NO: 240372 - DNA, 25 bp, Mus musculus
atcaggtttggtggccaattctgtt

SEQ ID NO: 240373 - DNA, 25 bp, Mus musculus
atcagtaaaatcaagggcactcagt

SEQ ID NO: 240374 - DNA, 25 bp, Mus musculus
atcagtaaaatctagggcactcagt

SEQ ID NO: 240375 - DNA, 25 bp, Mus musculus
atcagtaaaatgaccccatggaaaa

SEQ ID NO: 240376 - DNA, 25 bp, Mus musculus
atcagtaaaatgtccccatggaaaa

SEQ ID NO: 240377 - DNA, 25 bp, Mus musculus
atcagtaacaagattccttccattt

SEQ ID NO: 240378 - DNA, 25 bp, Mus musculus
atcagtaacaagtttccttccattt

SEQ ID NO: 240379 - DNA, 25 bp, Mus musculus
atcagtaacagaattcctcctgaaa

SEQ ID NO: 240380 - DNA, 25 bp, Mus musculus
atcagtaacagatttcctcctgaaa

SEQ ID NO: 240381 - DNA, 25 bp, Mus musculus
atcagtaaccaaagatgacgcactt

SEQ ID NO: 240382 - DNA, 25 bp, Mus musculus
atcagtaaccaatgatgacgcactt

SEQ ID NO: 240383 - DNA, 25 bp, Mus musculus
atcagtaattgtctgcttgcattga

SEQ ID NO: 240384 - DNA, 25 bp, Mus musculus
atcagtaattgtgtgcttgcattga

SEQ ID NO: 240385 - DNA, 25 bp, Mus musculus
atcagtacacttagctattccttaa

SEQ ID NO: 240386 - DNA, 25 bp, Mus musculus
atcagtacactttgctattccttaa

SEQ ID NO: 240387 - DNA, 25 bp, Mus musculus
atcagtacagggagttagcctcaca

SEQ ID NO: 240388 - DNA, 25 bp, Mus musculus
atcagtacagggtgttagcctcaca

SEQ ID NO: 240389 - DNA, 25 bp, Mus musculus
atcagtactaaaaggtgccttaaat

SEQ ID NO: 240390 - DNA, 25 bp, Mus musculus
atcagtactaaatggtgccttaaat

SEQ ID NO: 240391 - DNA, 25 bp, Mus musculus
atcagtactaagattttcatctgct

SEQ ID NO: 240392 - DNA, 25 bp, Mus musculus
atcagtactaagtttttcatctgct

SEQ ID NO: 240393 - DNA, 25 bp, Mus musculus
atcagtactcacatttctatctctc

SEQ ID NO: 240394 - DNA, 25 bp, Mus musculus
atcagtactcacttttctatctctc

SEQ ID NO: 240395 - DNA, 25 bp, Mus musculus
atcagtacttacagtgacccagctc

SEQ ID NO: 240396 - DNA, 25 bp, Mus musculus
atcagtacttactgtgacccagctc

SEQ ID NO: 240397 - DNA, 25 bp, Mus musculus
atcagtacttcgatgttgacccgat

SEQ ID NO: 240398 - DNA, 25 bp, Mus musculus
atcagtacttcgttgttgacccgat

SEQ ID NO: 240399 - DNA, 25 bp, Mus musculus
atcagtagcaacatttaccaccacc

SEQ ID NO: 240400 - DNA, 25 bp, Mus musculus
atcagtagcaacttttaccaccacc

SEQ ID NO: 240401 - DNA, 25 bp, Mus musculus
atcagtagccagatcctagctgtcg

SEQ ID NO: 240402 - DNA, 25 bp, Mus musculus
atcagtagccagttcctagctgtcg

SEQ ID NO: 240403 - DNA, 25 bp, Mus musculus
atcagtagccgacgccgaagaggac

SEQ ID NO: 240404 - DNA, 25 bp, Mus musculus
atcagtagccgaggccgaagaggac

SEQ ID NO: 240405 - DNA, 25 bp, Mus musculus
atcagtagccttcctctattcaaag

SEQ ID NO: 240406 - DNA, 25 bp, Mus musculus
atcagtagccttgctctattcaaag

SEQ ID NO: 240407 - DNA, 25 bp, Mus musculus
atcagtagcgagagacatcccaacc

SEQ ID NO: 240408 - DNA, 25 bp, Mus musculus
atcagtagcgagtgacatcccaacc

SEQ ID NO: 240409 - DNA, 25 bp, Mus musculus
atcagtagcttccatgggaccagca

SEQ ID NO: 240410 - DNA, 25 bp, Mus musculus
atcagtagcttcgatgggaccagca

SEQ ID NO: 240411 - DNA, 25 bp, Mus musculus
atcagtatcaccagtgaaacttttg

SEQ ID NO: 240412 - DNA, 25 bp, Mus musculus
atcagtatcacctgtgaaacttttg

SEQ ID NO: 240413 - DNA, 25 bp, Mus musculus
atcagtatcactcggtacacggcgt

SEQ ID NO: 240414 - DNA, 25 bp, Mus musculus
atcagtatcactgggtacacggcgt

SEQ ID NO: 240415 - DNA, 25 bp, Mus musculus
atcagtatcagcagcgtcgccaaca

SEQ ID NO: 240416 - DNA, 25 bp, Mus musculus
atcagtatcagctgcgtcgccaaca

SEQ ID NO: 240417 - DNA, 25 bp, Mus musculus
atcagtatcattcattcgtgtttgg

SEQ ID NO: 240418 - DNA, 25 bp, Mus musculus
atcagtatcattgattcgtgtttgg

SEQ ID NO: 240419 - DNA, 25 bp, Mus musculus
atcagtatcccaccaggagcagtgg

SEQ ID NO: 240420 - DNA, 25 bp, Mus musculus
atcagtatcccagcaggagcagtgg

SEQ ID NO: 240421 - DNA, 25 bp, Mus musculus
atcagtatcggtatctctggtcagg

SEQ ID NO: 240422 - DNA, 25 bp, Mus musculus
atcagtatcggtttctctggtcagg

SEQ ID NO: 240423 - DNA, 25 bp, Mus musculus
atcagtatcgtcctctctaagagca

SEQ ID NO: 240424 - DNA, 25 bp, Mus musculus
atcagtatcgtcgtctctaagagca

SEQ ID NO: 240425 - DNA, 25 bp, Mus musculus
atcagtatctctatcaggtgactta

SEQ ID NO: 240426 - DNA, 25 bp, Mus musculus
atcagtatctctttcaggtgactta

SEQ ID NO: 240427 - DNA, 25 bp, Mus musculus
atcagtatgaagctgctcttaacct

SEQ ID NO: 240428 - DNA, 25 bp, Mus musculus
atcagtatgaaggtgctcttaacct

SEQ ID NO: 240429 - DNA, 25 bp, Mus musculus
atcagtatgactcccctgagggcgc

SEQ ID NO: 240430 - DNA, 25 bp, Mus musculus
atcagtatgactgccctgagggcgc

SEQ ID NO: 240431 - DNA, 25 bp, Mus musculus
atcagtatgtgcatcctaaatctct

SEQ ID NO: 240432 - DNA, 25 bp, Mus musculus
atcagtatgtgcttcctaaatctct

SEQ ID NO: 240433 - DNA, 25 bp, Mus musculus
atcagtatttctcatggtgtgctag

SEQ ID NO: 240434 - DNA, 25 bp, Mus musculus
atcagtatttctgatggtgtgctag

SEQ ID NO: 240435 - DNA, 25 bp, Mus musculus
atcagtcaagaactgcttcatcagg

SEQ ID NO: 240436 - DNA, 25 bp, Mus musculus
atcagtcaagaagtgcttcatcagg

SEQ ID NO: 240437 - DNA, 25 bp, Mus musculus
atcagtcacaaaacaggtctcaaca

SEQ ID NO: 240438 - DNA, 25 bp, Mus musculus
atcagtcacaaatcaggtctcaaca

SEQ ID NO: 240439 - DNA, 25 bp, Mus musculus
atcagtcacagaaaacaacctgtta

SEQ ID NO: 240440 - DNA, 25 bp, Mus musculus
atcagtcacagataacaacctgtta

SEQ ID NO: 240441 - DNA, 25 bp, Mus musculus
atcagtcacctcctagtggagctaa

SEQ ID NO: 240442 - DNA, 25 bp, Mus musculus
atcagtcacctcgtagtggagctaa

SEQ ID NO: 240443 - DNA, 25 bp, Mus musculus
atcagtcactgcaaatgtccggtcg

SEQ ID NO: 240444 - DNA, 25 bp, Mus musculus
atcagtcactgcagagctgccagag

SEQ ID NO: 240445 - DNA, 25 bp, Mus musculus
atcagtcactgctaatgtccggtcg

SEQ ID NO: 240446 - DNA, 25 bp, Mus musculus
atcagtcactgctgagctgccagag

SEQ ID NO: 240447 - DNA, 25 bp, Mus musculus
atcagtcactgtctcgccagaggcc

SEQ ID NO: 240448 - DNA, 25 bp, Mus musculus
atcagtcactgtgtcgccagaggcc

SEQ ID NO: 240449 - DNA, 25 bp, Mus musculus
atcagtcagtacaacccttggcaag

SEQ ID NO: 240450 - DNA, 25 bp, Mus musculus
atcagtcagtactacccttggcaag

SEQ ID NO: 240451 - DNA, 25 bp, Mus musculus
atcagtcagtctatttcagcagtga

SEQ ID NO: 240452 - DNA, 25 bp, Mus musculus
atcagtcagtctttttcagcagtga

SEQ ID NO: 240453 - DNA, 25 bp, Mus musculus
atcagtcagtgaacttctgcttgta

SEQ ID NO: 240454 - DNA, 25 bp, Mus musculus
atcagtcagtgatcttctgcttgta

SEQ ID NO: 240455 - DNA, 25 bp, Mus musculus
atcagtcatccaaggtgtccaggtc

SEQ ID NO: 240456 - DNA, 25 bp, Mus musculus
atcagtcatccatggtgtccaggtc

SEQ ID NO: 240457 - DNA, 25 bp, Mus musculus
atcagtcatcttagtggattttgtt

SEQ ID NO: 240458 - DNA, 25 bp, Mus musculus
atcagtcatctttgtggattttgtt

SEQ ID NO: 240459 - DNA, 25 bp, Mus musculus
atcagtcatgcgcatagctgttcag

SEQ ID NO: 240460 - DNA, 25 bp, Mus musculus
atcagtcatgcggatagctgttcag

SEQ ID NO: 240461 - DNA, 25 bp, Mus musculus
atcagtccacgaccattgtgcttta

SEQ ID NO: 240462 - DNA, 25 bp, Mus musculus
atcagtccacgagcattgtgcttta

SEQ ID NO: 240463 - DNA, 25 bp, Mus musculus
atcagtccaggaagcaggaaccagc

SEQ ID NO: 240464 - DNA, 25 bp, Mus musculus
atcagtccaggatgcaggaaccagc

SEQ ID NO: 240465 - DNA, 25 bp, Mus musculus
atcagtccatcgaggtcttgttttc

SEQ ID NO: 240466 - DNA, 25 bp, Mus musculus
atcagtccatcgtggtcttgttttc

SEQ ID NO: 240467 - DNA, 25 bp, Mus musculus
atcagtccattcatgttataaattt

SEQ ID NO: 240468 - DNA, 25 bp, Mus musculus
atcagtccattcttgttataaattt

SEQ ID NO: 240469 - DNA, 25 bp, Mus musculus
atcagtcccatgagcgtgtaagcaa

SEQ ID NO: 240470 - DNA, 25 bp, Mus musculus
atcagtcccatgtgcgtgtaagcaa

SEQ ID NO: 240471 - DNA, 25 bp, Mus musculus
atcagtccctcaaaatgtcagcttt

SEQ ID NO: 240472 - DNA, 25 bp, Mus musculus
atcagtccctcataatgtcagcttt

SEQ ID NO: 240473 - DNA, 25 bp, Mus musculus
atcagtccctccaatctgtgaagcg

SEQ ID NO: 240474 - DNA, 25 bp, Mus musculus
atcagtccctcctatctgtgaagcg

SEQ ID NO: 240475 - DNA, 25 bp, Mus musculus
atcagtccctggaagtcttatcaga

SEQ ID NO: 240476 - DNA, 25 bp, Mus musculus
atcagtccctggtagtcttatcaga

SEQ ID NO: 240477 - DNA, 25 bp, Mus musculus
atcagtcctaagcacttgcccagta

SEQ ID NO: 240478 - DNA, 25 bp, Mus musculus
atcagtcctaaggacttgcccagta

SEQ ID NO: 240479 - DNA, 25 bp, Mus musculus
atcagtcctaccagatggatttcaa

SEQ ID NO: 240480 - DNA, 25 bp, Mus musculus
atcagtcctaccatcagtatgtact

SEQ ID NO: 240481 - DNA, 25 bp, Mus musculus
atcagtcctacctgatggatttcaa

SEQ ID NO: 240482 - DNA, 25 bp, Mus musculus
atcagtcctaccttcagtatgtact

SEQ ID NO: 240483 - DNA, 25 bp, Mus musculus
atcagtcctcagatctatgctacat

SEQ ID NO: 240484 - DNA, 25 bp, Mus musculus
atcagtcctcagttctatgctacat

SEQ ID NO: 240485 - DNA, 25 bp, Mus musculus
atcagtcctccccagaaatagatga

SEQ ID NO: 240486 - DNA, 25 bp, Mus musculus
atcagtcctcccgagaaatagatga

SEQ ID NO: 240487 - DNA, 25 bp, Mus musculus
atcagtcctcggcactatagcgagt

SEQ ID NO: 240488 - DNA, 25 bp, Mus musculus
atcagtcctcgggactatagcgagt

SEQ ID NO: 240489 - DNA, 25 bp, Mus musculus
atcagtcctgaactatgtcctgcag

SEQ ID NO: 240490 - DNA, 25 bp, Mus musculus
atcagtcctgaagtatgtcctgcag

SEQ ID NO: 240491 - DNA, 25 bp, Mus musculus
atcagtcctgtaagtacttcgcctt

SEQ ID NO: 240492 - DNA, 25 bp, Mus musculus
atcagtcctgtatgtacttcgcctt

SEQ ID NO: 240493 - DNA, 25 bp, Mus musculus
atcagtcctgttcgcatcactagca

SEQ ID NO: 240494 - DNA, 25 bp, Mus musculus
atcagtcctgttctatggatagcat

SEQ ID NO: 240495 - DNA, 25 bp, Mus musculus
atcagtcctgttggcatcactagca

SEQ ID NO: 240496 - DNA, 25 bp, Mus musculus
atcagtcctgttgtatggatagcat

SEQ ID NO: 240497 - DNA, 25 bp, Mus musculus
atcagtcctttaattttggccagtg

SEQ ID NO: 240498 - DNA, 25 bp, Mus musculus
atcagtcctttatttttggccagtg

SEQ ID NO: 240499 - DNA, 25 bp, Mus musculus
atcagtcctttgctttgagcaggtc

SEQ ID NO: 240500 - DNA, 25 bp, Mus musculus
atcagtcctttggtttgagcaggtc

SEQ ID NO: 240501 - DNA, 25 bp, Mus musculus
atcagtcgattcctctaaagaccca

SEQ ID NO: 240502 - DNA, 25 bp, Mus musculus
atcagtcgattcgtctaaagaccca

SEQ ID NO: 240503 - DNA, 25 bp, Mus musculus
atcagtcgcaatcattcagctcgct

SEQ ID NO: 240504 - DNA, 25 bp, Mus musculus
atcagtcgcaatgattcagctcgct

SEQ ID NO: 240505 - DNA, 25 bp, Mus musculus
atcagtcgccatctttcagtttcaa

SEQ ID NO: 240506 - DNA, 25 bp, Mus musculus
atcagtcgccatgtttcagtttcaa

SEQ ID NO: 240507 - DNA, 25 bp, Mus musculus
atcagtcgtaaacgactcagggcct

SEQ ID NO: 240508 - DNA, 25 bp, Mus musculus
atcagtcgtaaaggactcagggcct

SEQ ID NO: 240509 - DNA, 25 bp, Mus musculus
atcagtcgtcgtctcgcaggaatag

SEQ ID NO: 240510 - DNA, 25 bp, Mus musculus
atcagtcgtcgtgtcgcaggaatag

SEQ ID NO: 240511 - DNA, 25 bp, Mus musculus
atcagtcgttgaaagcctggccaca

SEQ ID NO: 240512 - DNA, 25 bp, Mus musculus
atcagtcgttgatagcctggccaca

SEQ ID NO: 240513 - DNA, 25 bp, Mus musculus
atcagtctaagaatcctcatcttca

SEQ ID NO: 240514 - DNA, 25 bp, Mus musculus
atcagtctaagattcctcatcttca

SEQ ID NO: 240515 - DNA, 25 bp, Mus musculus
atcagtctcaggacacaggtcatgt

SEQ ID NO: 240516 - DNA, 25 bp, Mus musculus
atcagtctcaggtcacaggtcatgt

SEQ ID NO: 240517 - DNA, 25 bp, Mus musculus
atcagtctccaaaactaagtgaatg

SEQ ID NO: 240518 - DNA, 25 bp, Mus musculus
atcagtctccaatactaagtgaatg

SEQ ID NO: 240519 - DNA, 25 bp, Mus musculus
atcagtctccacatggtattctata

SEQ ID NO: 240520 - DNA, 25 bp, Mus musculus
atcagtctccacttggtattctata

SEQ ID NO: 240521 - DNA, 25 bp, Mus musculus
atcagtctcctgaacaaatattaaa

SEQ ID NO: 240522 - DNA, 25 bp, Mus musculus
atcagtctcctgtacaaatattaaa

SEQ ID NO: 240523 - DNA, 25 bp, Mus musculus
atcagtctctggacaaatttttatc

SEQ ID NO: 240524 - DNA, 25 bp, Mus musculus
atcagtctctggtcaaatttttatc

SEQ ID NO: 240525 - DNA, 25 bp, Mus musculus
atcagtctgactcttcttgtccaaa

SEQ ID NO: 240526 - DNA, 25 bp, Mus musculus
atcagtctgactgttcttgtccaaa

SEQ ID NO: 240527 - DNA, 25 bp, Mus musculus
atcagtctgaggctggagctctgct

SEQ ID NO: 240528 - DNA, 25 bp, Mus musculus
atcagtctgagggtggagctctgct

SEQ ID NO: 240529 - DNA, 25 bp, Mus musculus
atcagtctgccacacatggtgacag

SEQ ID NO: 240530 - DNA, 25 bp, Mus musculus
atcagtctgccagacatggtgacag

SEQ ID NO: 240531 - DNA, 25 bp, Mus musculus
atcagtctgctgacgtagttgacaa

SEQ ID NO: 240532 - DNA, 25 bp, Mus musculus
atcagtctgctgtcgtagttgacaa

SEQ ID NO: 240533 - DNA, 25 bp, Mus musculus
atcagtctggcacttatgttttgag

SEQ ID NO: 240534 - DNA, 25 bp, Mus musculus
atcagtctggcagttatgttttgag

SEQ ID NO: 240535 - DNA, 25 bp, Mus musculus
atcagtcttgttaagatatttacct

SEQ ID NO: 240536 - DNA, 25 bp, Mus musculus
atcagtcttgtttagatatttacct

SEQ ID NO: 240537 - DNA, 25 bp, Mus musculus
atcagtgaaaacactcaatgtctgt

SEQ ID NO: 240538 - DNA, 25 bp, Mus musculus
atcagtgaaaactctcaatgtctgt

SEQ ID NO: 240539 - DNA, 25 bp, Mus musculus
atcagtgaaacaaaaccttcagtga

SEQ ID NO: 240540 - DNA, 25 bp, Mus musculus
atcagtgaaacataaccttcagtga

SEQ ID NO: 240541 - DNA, 25 bp, Mus musculus
atcagtgaatagaggcacttgccac

SEQ ID NO: 240542 - DNA, 25 bp, Mus musculus
atcagtgaatagtggcacttgccac

SEQ ID NO: 240543 - DNA, 25 bp, Mus musculus
atcagtgaattgcagcgctctcttg

SEQ ID NO: 240544 - DNA, 25 bp, Mus musculus
atcagtgaattggagcgctctcttg

SEQ ID NO: 240545 - DNA, 25 bp, Mus musculus
atcagtgacactactggcttgggaa

SEQ ID NO: 240546 - DNA, 25 bp, Mus musculus
atcagtgacacttctggcttgggaa

SEQ ID NO: 240547 - DNA, 25 bp, Mus musculus
atcagtgaccataacccagtggagg

SEQ ID NO: 240548 - DNA, 25 bp, Mus musculus
atcagtgaccattacccagtggagg

SEQ ID NO: 240549 - DNA, 25 bp, Mus musculus
atcagtgaccgtctactttgcagct

SEQ ID NO: 240550 - DNA, 25 bp, Mus musculus
atcagtgaccgtgtactttgcagct

SEQ ID NO: 240551 - DNA, 25 bp, Mus musculus
atcagtgacgagatgcccaattccc

SEQ ID NO: 240552 - DNA, 25 bp, Mus musculus
atcagtgacgagttgcccaattccc

SEQ ID NO: 240553 - DNA, 25 bp, Mus musculus
atcagtgacgtgagccatcccatgc

SEQ ID NO: 240554 - DNA, 25 bp, Mus musculus
atcagtgacgtgtgccatcccatgc

SEQ ID NO: 240555 - DNA, 25 bp, Mus musculus
atcagtgactccatgaactggctaa

SEQ ID NO: 240556 - DNA, 25 bp, Mus musculus
atcagtgactccttgaactggctaa

SEQ ID NO: 240557 - DNA, 25 bp, Mus musculus
atcagtgactgcagggtagagactg

SEQ ID NO: 240558 - DNA, 25 bp, Mus musculus
atcagtgactgctgggtagagactg

SEQ ID NO: 240559 - DNA, 25 bp, Mus musculus
atcagtgagagacgctcctggacct

SEQ ID NO: 240560 - DNA, 25 bp, Mus musculus
atcagtgagagaggctcctggacct

SEQ ID NO: 240561 - DNA, 25 bp, Mus musculus
atcagtgagttccaagttcagacaa

SEQ ID NO: 240562 - DNA, 25 bp, Mus musculus
atcagtgagttcgaagttcagacaa

SEQ ID NO: 240563 - DNA, 25 bp, Mus musculus
atcagtgatcctcacctgggcttcc

SEQ ID NO: 240564 - DNA, 25 bp, Mus musculus
atcagtgatcctgacctgggcttcc

SEQ ID NO: 240565 - DNA, 25 bp, Mus musculus
atcagtgatgcaagagagagctttc

SEQ ID NO: 240566 - DNA, 25 bp, Mus musculus
atcagtgatgcatgagagagctttc

SEQ ID NO: 240567 - DNA, 25 bp, Mus musculus
atcagtgatggtcgtaattttttct

SEQ ID NO: 240568 - DNA, 25 bp, Mus musculus
atcagtgatggtggtaattttttct

SEQ ID NO: 240569 - DNA, 25 bp, Mus musculus
atcagtgcaacgaatgtgggaaagc

SEQ ID NO: 240570 - DNA, 25 bp, Mus musculus
atcagtgcaacgtatgtgggaaagc

SEQ ID NO: 240571 - DNA, 25 bp, Mus musculus
atcagtgcactgatcagactcagtt

SEQ ID NO: 240572 - DNA, 25 bp, Mus musculus
atcagtgcactgttcagactcagtt

SEQ ID NO: 240573 - DNA, 25 bp, Mus musculus
atcagtgcagatattaccccatggg

SEQ ID NO: 240574 - DNA, 25 bp, Mus musculus
atcagtgcagattttaccccatggg

SEQ ID NO: 240575 - DNA, 25 bp, Mus musculus
atcagtgcagcaaaggtatccctca

SEQ ID NO: 240576 - DNA, 25 bp, Mus musculus
atcagtgcagcaaatccaagaatca

SEQ ID NO: 240577 - DNA, 25 bp, Mus musculus
atcagtgcagcataggtatccctca

SEQ ID NO: 240578 - DNA, 25 bp, Mus musculus
atcagtgcagcatatccaagaatca

SEQ ID NO: 240579 - DNA, 25 bp, Mus musculus
atcagtgcagtcatactcatctttg

SEQ ID NO: 240580 - DNA, 25 bp, Mus musculus
atcagtgcagtcttactcatctttg

SEQ ID NO: 240581 - DNA, 25 bp, Mus musculus
atcagtgcatagagcttgcccagca

SEQ ID NO: 240582 - DNA, 25 bp, Mus musculus
atcagtgcatagtgcttgcccagca

SEQ ID NO: 240583 - DNA, 25 bp, Mus musculus
atcagtgcatctcttgtgaaagctg

SEQ ID NO: 240584 - DNA, 25 bp, Mus musculus
atcagtgcatctgttgtgaaagctg

SEQ ID NO: 240585 - DNA, 25 bp, Mus musculus
atcagtgccaagatctctggagcca

SEQ ID NO: 240586 - DNA, 25 bp, Mus musculus
atcagtgccaagttctctggagcca

SEQ ID NO: 240587 - DNA, 25 bp, Mus musculus
atcagtgcccagcagttgttgtcaa

SEQ ID NO: 240588 - DNA, 25 bp, Mus musculus
atcagtgcccaggagttgttgtcaa

SEQ ID NO: 240589 - DNA, 25 bp, Mus musculus
atcagtgcccttctgggttatcaga

SEQ ID NO: 240590 - DNA, 25 bp, Mus musculus
atcagtgcccttgtgggttatcaga

SEQ ID NO: 240591 - DNA, 25 bp, Mus musculus
atcagtgcctagcacagcccgggag

SEQ ID NO: 240592 - DNA, 25 bp, Mus musculus
atcagtgcctaggacagcccgggag

SEQ ID NO: 240593 - DNA, 25 bp, Mus musculus
atcagtgcctttcgctacctcgagt

SEQ ID NO: 240594 - DNA, 25 bp, Mus musculus
atcagtgcctttggctacctcgagt

SEQ ID NO: 240595 - DNA, 25 bp, Mus musculus
atcagtgctaccatggaccctggga

SEQ ID NO: 240596 - DNA, 25 bp, Mus musculus
atcagtgctaccttggaccctggga

SEQ ID NO: 240597 - DNA, 25 bp, Mus musculus
atcagtgcttccagtagagttagac

SEQ ID NO: 240598 - DNA, 25 bp, Mus musculus
atcagtgcttcctgtagagttagac

SEQ ID NO: 240599 - DNA, 25 bp, Mus musculus
atcagtggagacaagtggacagaca

SEQ ID NO: 240600 - DNA, 25 bp, Mus musculus
atcagtggagactagtggacagaca

SEQ ID NO: 240601 - DNA, 25 bp, Mus musculus
atcagtggagctcttagtgacgaca

SEQ ID NO: 240602 - DNA, 25 bp, Mus musculus
atcagtggagctgttagtgacgaca

SEQ ID NO: 240603 - DNA, 25 bp, Mus musculus
atcagtggagtaccaaccgagggca

SEQ ID NO: 240604 - DNA, 25 bp, Mus musculus
atcagtggagtactaacccgctcac

SEQ ID NO: 240605 - DNA, 25 bp, Mus musculus
atcagtggagtagcaaccgagggca

SEQ ID NO: 240606 - DNA, 25 bp, Mus musculus
atcagtggagtagtaacccgctcac

SEQ ID NO: 240607 - DNA, 25 bp, Mus musculus
atcagtggcaacaatttaccagttg

SEQ ID NO: 240608 - DNA, 25 bp, Mus musculus
atcagtggcaactatttaccagttg

SEQ ID NO: 240609 - DNA, 25 bp, Mus musculus
atcagtggcactccagttcagagag

SEQ ID NO: 240610 - DNA, 25 bp, Mus musculus
atcagtggcactgcagttcagagag

SEQ ID NO: 240611 - DNA, 25 bp, Mus musculus
atcagtggcatcagacgctgtccag

SEQ ID NO: 240612 - DNA, 25 bp, Mus musculus
atcagtggcatctgacgctgtccag

SEQ ID NO: 240613 - DNA, 25 bp, Mus musculus
atcagtggctctcatgtctctgctc

SEQ ID NO: 240614 - DNA, 25 bp, Mus musculus
atcagtggctctgatgtctctgctc

SEQ ID NO: 240615 - DNA, 25 bp, Mus musculus
atcagtggctttcaatgaaatccag

SEQ ID NO: 240616 - DNA, 25 bp, Mus musculus
atcagtggctttgaatgaaatccag

SEQ ID NO: 240617 - DNA, 25 bp, Mus musculus
atcagtgggatgacaaggttcacaa

SEQ ID NO: 240618 - DNA, 25 bp, Mus musculus
atcagtgggatgtcaaggttcacaa

SEQ ID NO: 240619 - DNA, 25 bp, Mus musculus
atcagtggtatgcatcagcctctcc

SEQ ID NO: 240620 - DNA, 25 bp, Mus musculus
atcagtggtatggatcagcctctcc

SEQ ID NO: 240621 - DNA, 25 bp, Mus musculus
atcagtggttatcctggggtcacag

SEQ ID NO: 240622 - DNA, 25 bp, Mus musculus
atcagtggttatgctggggtcacag

SEQ ID NO: 240623 - DNA, 25 bp, Mus musculus
atcagtggtttcaccaggtctgtgt

SEQ ID NO: 240624 - DNA, 25 bp, Mus musculus
atcagtggtttctccaggtctgtgt

SEQ ID NO: 240625 - DNA, 25 bp, Mus musculus
atcagtgtaaaaaatgtccccgtgg

SEQ ID NO: 240626 - DNA, 25 bp, Mus musculus
atcagtgtaaaatatgtccccgtgg

SEQ ID NO: 240627 - DNA, 25 bp, Mus musculus
atcagtgtaactcttagttggcaaa

SEQ ID NO: 240628 - DNA, 25 bp, Mus musculus
atcagtgtaactgttagttggcaaa

SEQ ID NO: 240629 - DNA, 25 bp, Mus musculus
atcagtgtaggactgtcttcttggt

SEQ ID NO: 240630 - DNA, 25 bp, Mus musculus
atcagtgtaggagtgtcttcttggt

SEQ ID NO: 240631 - DNA, 25 bp, Mus musculus
atcagtgtattactgatgctgtctt

SEQ ID NO: 240632 - DNA, 25 bp, Mus musculus
atcagtgtattagtgatgctgtctt

SEQ ID NO: 240633 - DNA, 25 bp, Mus musculus
atcagtgtcaaacatgtctccatcc

SEQ ID NO: 240634 - DNA, 25 bp, Mus musculus
atcagtgtcaaagatgtctccatcc

SEQ ID NO: 240635 - DNA, 25 bp, Mus musculus
atcagtgtcactcgctggcacagac

SEQ ID NO: 240636 - DNA, 25 bp, Mus musculus
atcagtgtcactggctggcacagac

SEQ ID NO: 240637 - DNA, 25 bp, Mus musculus
atcagtgtcatgaccgaggtggctc

SEQ ID NO: 240638 - DNA, 25 bp, Mus musculus
atcagtgtcatgtccgaggtggctc

SEQ ID NO: 240639 - DNA, 25 bp, Mus musculus
atcagtgtcattaccaaagctggca

SEQ ID NO: 240640 - DNA, 25 bp, Mus musculus
atcagtgtcatttccaaagctggca

SEQ ID NO: 240641 - DNA, 25 bp, Mus musculus
atcagtgtccatcaccaggcaggca

SEQ ID NO: 240642 - DNA, 25 bp, Mus musculus
atcagtgtccatgaccaggcaggca

SEQ ID NO: 240643 - DNA, 25 bp, Mus musculus
atcagtgtcgctaaccaaacagtgg

SEQ ID NO: 240644 - DNA, 25 bp, Mus musculus
atcagtgtcgcttaccaaacagtgg

SEQ ID NO: 240645 - DNA, 25 bp, Mus musculus
atcagtgtcttgaatcctttgaaaa

SEQ ID NO: 240646 - DNA, 25 bp, Mus musculus
atcagtgtcttgtatcctttgaaaa

SEQ ID NO: 240647 - DNA, 25 bp, Mus musculus
atcagtgtgcaaatgggaggccttt

SEQ ID NO: 240648 - DNA, 25 bp, Mus musculus
atcagtgtgcaattgggaggccttt

SEQ ID NO: 240649 - DNA, 25 bp, Mus musculus
atcagtgtgcccatgaagctaagag

SEQ ID NO: 240650 - DNA, 25 bp, Mus musculus
atcagtgtgcccttgaagctaagag

SEQ ID NO: 240651 - DNA, 25 bp, Mus musculus
atcagtgtgctgaagcctggtcttt

SEQ ID NO: 240652 - DNA, 25 bp, Mus musculus
atcagtgtgctgtagcctggtcttt

SEQ ID NO: 240653 - DNA, 25 bp, Mus musculus
atcagtgtggatcaattgttgtacc

SEQ ID NO: 240654 - DNA, 25 bp, Mus musculus
atcagtgtggatcgcctctcgaccc

SEQ ID NO: 240655 - DNA, 25 bp, Mus musculus
atcagtgtggatgaattgttgtacc

SEQ ID NO: 240656 - DNA, 25 bp, Mus musculus
atcagtgtggatggcctctcgaccc

SEQ ID NO: 240657 - DNA, 25 bp, Mus musculus
atcagtgtggccctgggaactagcc

SEQ ID NO: 240658 - DNA, 25 bp, Mus musculus
atcagtgtggccgtgggaactagcc

SEQ ID NO: 240659 - DNA, 25 bp, Mus musculus
atcagtgtgtcactgcggtgtgtcc

SEQ ID NO: 240660 - DNA, 25 bp, Mus musculus
atcagtgtgtcagtgcggtgtgtcc

SEQ ID NO: 240661 - DNA, 25 bp, Mus musculus
atcagtgtgtccctgtaatctgtca

SEQ ID NO: 240662 - DNA, 25 bp, Mus musculus
atcagtgtgtccgtgtaatctgtca

SEQ ID NO: 240663 - DNA, 25 bp, Mus musculus
atcagtgtgtcgatggcaaccaaca

SEQ ID NO: 240664 - DNA, 25 bp, Mus musculus
atcagtgtgtcgttggcaaccaaca

SEQ ID NO: 240665 - DNA, 25 bp, Mus musculus
atcagtgtgtctcggatacttgcgc

SEQ ID NO: 240666 - DNA, 25 bp, Mus musculus
atcagtgtgtctgggatacttgcgc

SEQ ID NO: 240667 - DNA, 25 bp, Mus musculus
atcagtgttaggagtgaattggaca

SEQ ID NO: 240668 - DNA, 25 bp, Mus musculus
atcagtgttaggtgtgaattggaca

SEQ ID NO: 240669 - DNA, 25 bp, Mus musculus
atcagtgttagtcacaagccccgac

SEQ ID NO: 240670 - DNA, 25 bp, Mus musculus
atcagtgttagtgacaagccccgac

SEQ ID NO: 240671 - DNA, 25 bp, Mus musculus
atcagtgttcctaactcctttttgt

SEQ ID NO: 240672 - DNA, 25 bp, Mus musculus
atcagtgttccttactcctttttgt

SEQ ID NO: 240673 - DNA, 25 bp, Mus musculus
atcagtgttctcagtgaaacctcag

SEQ ID NO: 240674 - DNA, 25 bp, Mus musculus
atcagtgttctctgtgaaacctcag

SEQ ID NO: 240675 - DNA, 25 bp, Mus musculus
atcagtgtttccaagattcccaagc

SEQ ID NO: 240676 - DNA, 25 bp, Mus musculus
atcagtgtttcctagattcccaagc

SEQ ID NO: 240677 - DNA, 25 bp, Mus musculus
atcagtgtttgactgctgaggctga

SEQ ID NO: 240678 - DNA, 25 bp, Mus musculus
atcagtgtttgagtgctgaggctga

SEQ ID NO: 240679 - DNA, 25 bp, Mus musculus
atcagtgttttcacgttaggactct

SEQ ID NO: 240680 - DNA, 25 bp, Mus musculus
atcagtgttttctcgttaggactct

SEQ ID NO: 240681 - DNA, 25 bp, Mus musculus
atcagttatcccctacagtatcttt

SEQ ID NO: 240682 - DNA, 25 bp, Mus musculus
atcagttatcccgtacagtatcttt

SEQ ID NO: 240683 - DNA, 25 bp, Mus musculus
atcagttatggtacctttggtcgct

SEQ ID NO: 240684 - DNA, 25 bp, Mus musculus
atcagttatggttcctttggtcgct

SEQ ID NO: 240685 - DNA, 25 bp, Mus musculus
atcagttcaagtatcttgcttttca

SEQ ID NO: 240686 - DNA, 25 bp, Mus musculus
atcagttcaagtttcttgcttttca

SEQ ID NO: 240687 - DNA, 25 bp, Mus musculus
atcagttcaattatactaccagagg

SEQ ID NO: 240688 - DNA, 25 bp, Mus musculus
atcagttcaattttactaccagagg

SEQ ID NO: 240689 - DNA, 25 bp, Mus musculus
atcagttcacctatgagtagcagaa

SEQ ID NO: 240690 - DNA, 25 bp, Mus musculus
atcagttcacctttgagtagcagaa

SEQ ID NO: 240691 - DNA, 25 bp, Mus musculus
atcagttcagcaaaagtggcctaca

SEQ ID NO: 240692 - DNA, 25 bp, Mus musculus
atcagttcagcataagtggcctaca

SEQ ID NO: 240693 - DNA, 25 bp, Mus musculus
atcagttcagtgcacagcacagaga

SEQ ID NO: 240694 - DNA, 25 bp, Mus musculus
atcagttcagtggacagcacagaga

SEQ ID NO: 240695 - DNA, 25 bp, Mus musculus
atcagttcatcacagttcacatttt

SEQ ID NO: 240696 - DNA, 25 bp, Mus musculus
atcagttcatcagagttcacatttt

SEQ ID NO: 240697 - DNA, 25 bp, Mus musculus
atcagttccagtccaaatgtagcaa

SEQ ID NO: 240698 - DNA, 25 bp, Mus musculus
atcagttccagtgcaaatgtagcaa

SEQ ID NO: 240699 - DNA, 25 bp, Mus musculus
atcagttcccctcgagcggatgtta

SEQ ID NO: 240700 - DNA, 25 bp, Mus musculus
atcagttcccctggagcggatgtta

SEQ ID NO: 240701 - DNA, 25 bp, Mus musculus
atcagttccgagacgccagtggcat

SEQ ID NO: 240702 - DNA, 25 bp, Mus musculus
atcagttccgagtcgccagtggcat

SEQ ID NO: 240703 - DNA, 25 bp, Mus musculus
atcagttcctgaagcctctcactaa

SEQ ID NO: 240704 - DNA, 25 bp, Mus musculus
atcagttcctgatgcctctcactaa

SEQ ID NO: 240705 - DNA, 25 bp, Mus musculus
atcagttcgttcatttacccaagca

SEQ ID NO: 240706 - DNA, 25 bp, Mus musculus
atcagttcgttcttttacccaagca

SEQ ID NO: 240707 - DNA, 25 bp, Mus musculus
atcagttctgggaaccaagcgcttc

SEQ ID NO: 240708 - DNA, 25 bp, Mus musculus
atcagttctgggtaccaagcgcttc

SEQ ID NO: 240709 - DNA, 25 bp, Mus musculus
atcagttcttatatccttgtggcat

SEQ ID NO: 240710 - DNA, 25 bp, Mus musculus
atcagttcttatttccttgtggcat

SEQ ID NO: 240711 - DNA, 25 bp, Mus musculus
atcagttgaatgaaagccatcttga

SEQ ID NO: 240712 - DNA, 25 bp, Mus musculus
atcagttgaatgtaagccatcttga

SEQ ID NO: 240713 - DNA, 25 bp, Mus musculus
atcagttgagctacagtgttgaaaa

SEQ ID NO: 240714 - DNA, 25 bp, Mus musculus
atcagttgagcttcagtgttgaaaa

SEQ ID NO: 240715 - DNA, 25 bp, Mus musculus
atcagttgcagcatgatccatttgc

SEQ ID NO: 240716 - DNA, 25 bp, Mus musculus
atcagttgcagcttgatccatttgc

SEQ ID NO: 240717 - DNA, 25 bp, Mus musculus
atcagttgccatagtctttggttct

SEQ ID NO: 240718 - DNA, 25 bp, Mus musculus
atcagttgccattgtctttggttct

SEQ ID NO: 240719 - DNA, 25 bp, Mus musculus
atcagttgccctacatctgccagtt

SEQ ID NO: 240720 - DNA, 25 bp, Mus musculus
atcagttgcccttcatctgccagtt

SEQ ID NO: 240721 - DNA, 25 bp, Mus musculus
atcagttggctgagtgggaattttc

SEQ ID NO: 240722 - DNA, 25 bp, Mus musculus
atcagttggctgtgtgggaattttc

SEQ ID NO: 240723 - DNA, 25 bp, Mus musculus
atcagttggtatattgtcttacact

SEQ ID NO: 240724 - DNA, 25 bp, Mus musculus
atcagttggtattttgtcttacact

SEQ ID NO: 240725 - DNA, 25 bp, Mus musculus
atcagttggtctcctgaggttgaaa

SEQ ID NO: 240726 - DNA, 25 bp, Mus musculus
atcagttggtctgctgaggttgaaa

SEQ ID NO: 240727 - DNA, 25 bp, Mus musculus
atcagttgtatactcaatatggttt

SEQ ID NO: 240728 - DNA, 25 bp, Mus musculus
atcagttgtatagtcaatatggttt

SEQ ID NO: 240729 - DNA, 25 bp, Mus musculus
atcagttgtatgacacatgtacgta

SEQ ID NO: 240730 - DNA, 25 bp, Mus musculus
atcagttgtatgtcacatgtacgta

SEQ ID NO: 240731 - DNA, 25 bp, Mus musculus
atcagttgttagagagttctttccc

SEQ ID NO: 240732 - DNA, 25 bp, Mus musculus
atcagttgttagtgagttctttccc

SEQ ID NO: 240733 - DNA, 25 bp, Mus musculus
atcagtttaaagctggacactccta

SEQ ID NO: 240734 - DNA, 25 bp, Mus musculus
atcagtttaaaggtggacactccta

SEQ ID NO: 240735 - DNA, 25 bp, Mus musculus
atcagtttaattcgagcagtgttca

SEQ ID NO: 240736 - DNA, 25 bp, Mus musculus
atcagtttaattggagcagtgttca

SEQ ID NO: 240737 - DNA, 25 bp, Mus musculus
atcagtttactgagcttgcaaagag

SEQ ID NO: 240738 - DNA, 25 bp, Mus musculus
atcagtttactgtgcttgcaaagag

SEQ ID NO: 240739 - DNA, 25 bp, Mus musculus
atcagtttcattcaccgacaatgtg

SEQ ID NO: 240740 - DNA, 25 bp, Mus musculus
atcagtttcattgaccgacaatgtg

SEQ ID NO: 240741 - DNA, 25 bp, Mus musculus
atcagtttcctaaagcagagtgtca

SEQ ID NO: 240742 - DNA, 25 bp, Mus musculus
atcagtttcctatagcagagtgtca

SEQ ID NO: 240743 - DNA, 25 bp, Mus musculus
atcagtttcgaacgttctggctcct

SEQ ID NO: 240744 - DNA, 25 bp, Mus musculus
atcagtttcgaaggttctggctcct

SEQ ID NO: 240745 - DNA, 25 bp, Mus musculus
atcagtttctatccgagattctcta

SEQ ID NO: 240746 - DNA, 25 bp, Mus musculus
atcagtttctatgcgagattctcta

SEQ ID NO: 240747 - DNA, 25 bp, Mus musculus
atcagtttcttgacctgtgtagggt

SEQ ID NO: 240748 - DNA, 25 bp, Mus musculus
atcagtttcttgtcctgtgtagggt

SEQ ID NO: 240749 - DNA, 25 bp, Mus musculus
atcagtttgcttcagctgtgtcgaa

SEQ ID NO: 240750 - DNA, 25 bp, Mus musculus
atcagtttgcttgagctgtgtcgaa

SEQ ID NO: 240751 - DNA, 25 bp, Mus musculus
atcagtttgggcaggtcttctctcc

SEQ ID NO: 240752 - DNA, 25 bp, Mus musculus
atcagtttgggctggtcttctctcc

SEQ ID NO: 240753 - DNA, 25 bp, Mus musculus
atcagttttcttcctaattttcctg

SEQ ID NO: 240754 - DNA, 25 bp, Mus musculus
atcagttttcttgctaattttcctg

SEQ ID NO: 240755 - DNA, 25 bp, Mus musculus
atcagttttgatagtgtttccccag

SEQ ID NO: 240756 - DNA, 25 bp, Mus musculus
atcagttttgattgtgtttccccag

SEQ ID NO: 240757 - DNA, 25 bp, Mus musculus
atcagttttgttaggatgacatcaa

SEQ ID NO: 240758 - DNA, 25 bp, Mus musculus
atcagttttgtttggatgacatcaa

SEQ ID NO: 240759 - DNA, 25 bp, Mus musculus
atcagtttttccatgctttgtagcg

SEQ ID NO: 240760 - DNA, 25 bp, Mus musculus
atcagtttttccttgctttgtagcg

SEQ ID NO: 240761 - DNA, 25 bp, Mus musculus
atcataaaagatccagccgctaagg

SEQ ID NO: 240762 - DNA, 25 bp, Mus musculus
atcataaaagatgcagccgctaagg

SEQ ID NO: 240763 - DNA, 25 bp, Mus musculus
atcataaaagtgaccaccgtggaaa

SEQ ID NO: 240764 - DNA, 25 bp, Mus musculus
atcataaaagtgtccaccgtggaaa

SEQ ID NO: 240765 - DNA, 25 bp, Mus musculus
atcataaacccaataaacagctctt

SEQ ID NO: 240766 - DNA, 25 bp, Mus musculus
atcataaacccattaaacagctctt

SEQ ID NO: 240767 - DNA, 25 bp, Mus musculus
atcataaaggaaccagcccgtcctg

SEQ ID NO: 240768 - DNA, 25 bp, Mus musculus
atcataaaggaagcagcccgtcctg

SEQ ID NO: 240769 - DNA, 25 bp, Mus musculus
atcataactccccacgccgtttgag

SEQ ID NO: 240770 - DNA, 25 bp, Mus musculus
atcataactcccgacgccgtttgag

SEQ ID NO: 240771 - DNA, 25 bp, Mus musculus
atcataagcctgacattctcctgtg

SEQ ID NO: 240772 - DNA, 25 bp, Mus musculus
atcataagcctgtcattctcctgtg

SEQ ID NO: 240773 - DNA, 25 bp, Mus musculus
atcataatacccacctttcgtcata

SEQ ID NO: 240774 - DNA, 25 bp, Mus musculus
atcataataccctcctttcgtcata

SEQ ID NO: 240775 - DNA, 25 bp, Mus musculus
atcataatgagtatgctcttaactg

SEQ ID NO: 240776 - DNA, 25 bp, Mus musculus
atcataatgagtttgctcttaactg

SEQ ID NO: 240777 - DNA, 25 bp, Mus musculus
atcataattaccatagaaacagctt

SEQ ID NO: 240778 - DNA, 25 bp, Mus musculus
atcataattaccttagaaacagctt

SEQ ID NO: 240779 - DNA, 25 bp, Mus musculus
atcataattcttctgttgctttctt

SEQ ID NO: 240780 - DNA, 25 bp, Mus musculus
atcataattcttgtgttgctttctt

SEQ ID NO: 240781 - DNA, 25 bp, Mus musculus
atcatacacaaacgagcagggccga

SEQ ID NO: 240782 - DNA, 25 bp, Mus musculus
atcatacacaaaggagcagggccga

SEQ ID NO: 240783 - DNA, 25 bp, Mus musculus
atcatacaggatccttgtcaacaaa

SEQ ID NO: 240784 - DNA, 25 bp, Mus musculus
atcatacaggatgcttgtcaacaaa

SEQ ID NO: 240785 - DNA, 25 bp, Mus musculus
atcatacatactaagccttaacata

SEQ ID NO: 240786 - DNA, 25 bp, Mus musculus
atcatacatacttagccttaacata

SEQ ID NO: 240787 - DNA, 25 bp, Mus musculus
atcatacatataacagcggttctca

SEQ ID NO: 240788 - DNA, 25 bp, Mus musculus
atcatacatatatcagcggttctca

SEQ ID NO: 240789 - DNA, 25 bp, Mus musculus
atcataccaataccaatcgtttttt

SEQ ID NO: 240790 - DNA, 25 bp, Mus musculus
atcataccaatagcaatcgtttttt

SEQ ID NO: 240791 - DNA, 25 bp, Mus musculus
atcataccagttaacatcaccagtt

SEQ ID NO: 240792 - DNA, 25 bp, Mus musculus
atcataccagtttacatcaccagtt

SEQ ID NO: 240793 - DNA, 25 bp, Mus musculus
atcataccattccttgcctggtgaa

SEQ ID NO: 240794 - DNA, 25 bp, Mus musculus
atcataccattcgttgcctggtgaa

SEQ ID NO: 240795 - DNA, 25 bp, Mus musculus
atcatacctaataccatgtaaatgg

SEQ ID NO: 240796 - DNA, 25 bp, Mus musculus
atcatacctaattccatgtaaatgg

SEQ ID NO: 240797 - DNA, 25 bp, Mus musculus
atcatacctagtaccaacgggtgat

SEQ ID NO: 240798 - DNA, 25 bp, Mus musculus
atcatacctagttccaacgggtgat

SEQ ID NO: 240799 - DNA, 25 bp, Mus musculus
atcatacctggcattacttgttttt

SEQ ID NO: 240800 - DNA, 25 bp, Mus musculus
atcatacctggctttacttgttttt

SEQ ID NO: 240801 - DNA, 25 bp, Mus musculus
atcataccttgaccgtgtacacgtg

SEQ ID NO: 240802 - DNA, 25 bp, Mus musculus
atcataccttgagcgtgtacacgtg

SEQ ID NO: 240803 - DNA, 25 bp, Mus musculus
atcatactcagtatccgccatctca

SEQ ID NO: 240804 - DNA, 25 bp, Mus musculus
atcatactcagtttccgccatctca

SEQ ID NO: 240805 - DNA, 25 bp, Mus musculus
atcatactccagaccatgtatcctc

SEQ ID NO: 240806 - DNA, 25 bp, Mus musculus
atcatactccagtccatgtatcctc

SEQ ID NO: 240807 - DNA, 25 bp, Mus musculus
atcatactctatagcagccacaatg

SEQ ID NO: 240808 - DNA, 25 bp, Mus musculus
atcatactctattgcagccacaatg

SEQ ID NO: 240809 - DNA, 25 bp, Mus musculus
atcatactgacccatctctacagac

SEQ ID NO: 240810 - DNA, 25 bp, Mus musculus
atcatactgaccgatctctacagac

SEQ ID NO: 240811 - DNA, 25 bp, Mus musculus
atcatactgcgtatccttcagcgat

SEQ ID NO: 240812 - DNA, 25 bp, Mus musculus
atcatactgcgtttccttcagcgat

SEQ ID NO: 240813 - DNA, 25 bp, Mus musculus
atcatacttcacctggtaggagcag

SEQ ID NO: 240814 - DNA, 25 bp, Mus musculus
atcatacttcacgtggtaggagcag

SEQ ID NO: 240815 - DNA, 25 bp, Mus musculus
atcatactttttatgtggacacact

SEQ ID NO: 240816 - DNA, 25 bp, Mus musculus
atcatactttttctgtgggccttgg

SEQ ID NO: 240817 - DNA, 25 bp, Mus musculus
atcatactttttgtgtgggccttgg

SEQ ID NO: 240818 - DNA, 25 bp, Mus musculus
atcatactttttttgtggacacact

SEQ ID NO: 240819 - DNA, 25 bp, Mus musculus
atcatagaccccacctacttattta

SEQ ID NO: 240820 - DNA, 25 bp, Mus musculus
atcatagacccctcctacttattta

SEQ ID NO: 240821 - DNA, 25 bp, Mus musculus
atcatagacctgacaaagcccttcc

SEQ ID NO: 240822 - DNA, 25 bp, Mus musculus
atcatagacctgtcaaagcccttcc

SEQ ID NO: 240823 - DNA, 25 bp, Mus musculus
atcatagagattcgtggtccagctt

SEQ ID NO: 240824 - DNA, 25 bp, Mus musculus
atcatagagattggtggtccagctt

SEQ ID NO: 240825 - DNA, 25 bp, Mus musculus
atcatagatgagagtgtacctcgct

SEQ ID NO: 240826 - DNA, 25 bp, Mus musculus
atcatagatgagtgtgtacctcgct

SEQ ID NO: 240827 - DNA, 25 bp, Mus musculus
atcatagcaattctcatcggcctgg

SEQ ID NO: 240828 - DNA, 25 bp, Mus musculus
atcatagcaattgtcatcggcctgg

SEQ ID NO: 240829 - DNA, 25 bp, Mus musculus
atcatagcagggattggtaagcagc

SEQ ID NO: 240830 - DNA, 25 bp, Mus musculus
atcatagcagggtttggtaagcagc

SEQ ID NO: 240831 - DNA, 25 bp, Mus musculus
atcatagccattacattgctaagaa

SEQ ID NO: 240832 - DNA, 25 bp, Mus musculus
atcatagccatttcattgctaagaa

SEQ ID NO: 240833 - DNA, 25 bp, Mus musculus
atcatagcccagactaacagaccgc

SEQ ID NO: 240834 - DNA, 25 bp, Mus musculus
atcatagcccagtctaacagaccgc

SEQ ID NO: 240835 - DNA, 25 bp, Mus musculus
atcatagccccacacttcttacgag

SEQ ID NO: 240836 - DNA, 25 bp, Mus musculus
atcatagccccagacttcttacgag

SEQ ID NO: 240837 - DNA, 25 bp, Mus musculus
atcatagccgcgatcatcgtgtttg

SEQ ID NO: 240838 - DNA, 25 bp, Mus musculus
atcatagccgcgttcatcgtgtttg

SEQ ID NO: 240839 - DNA, 25 bp, Mus musculus
atcatagctgaccaaccctgttgcc

SEQ ID NO: 240840 - DNA, 25 bp, Mus musculus
atcatagctgacgaaccctgttgcc

SEQ ID NO: 240841 - DNA, 25 bp, Mus musculus
atcataggagtcaccttccctgcag

SEQ ID NO: 240842 - DNA, 25 bp, Mus musculus
atcataggagtctccttccctgcag

SEQ ID NO: 240843 - DNA, 25 bp, Mus musculus
atcataggcctgaactgctactcat

SEQ ID NO: 240844 - DNA, 25 bp, Mus musculus
atcataggcctgtactgctactcat

SEQ ID NO: 240845 - DNA, 25 bp, Mus musculus
atcataggctctctgatgctgacct

SEQ ID NO: 240846 - DNA, 25 bp, Mus musculus
atcataggctctgtgatgctgacct

SEQ ID NO: 240847 - DNA, 25 bp, Mus musculus
atcatagggcctcattttcactgca

SEQ ID NO: 240848 - DNA, 25 bp, Mus musculus
atcatagggcctgattttcactgca

SEQ ID NO: 240849 - DNA, 25 bp, Mus musculus
atcatagtacccaaaacccatgtct

SEQ ID NO: 240850 - DNA, 25 bp, Mus musculus
atcatagtaccctaaacccatgtct

SEQ ID NO: 240851 - DNA, 25 bp, Mus musculus
atcatagtacttaggcatctttggc

SEQ ID NO: 240852 - DNA, 25 bp, Mus musculus
atcatagtactttggcatctttggc

SEQ ID NO: 240853 - DNA, 25 bp, Mus musculus
atcatagtccttcccgtgaagcagg

SEQ ID NO: 240854 - DNA, 25 bp, Mus musculus
atcatagtccttgccgtgaagcagg

SEQ ID NO: 240855 - DNA, 25 bp, Mus musculus
atcatagttagtcactggccagcgg

SEQ ID NO: 240856 - DNA, 25 bp, Mus musculus
atcatagttagtgactggccagcgg

SEQ ID NO: 240857 - DNA, 25 bp, Mus musculus
atcatagttataagtacagttcata

SEQ ID NO: 240858 - DNA, 25 bp, Mus musculus
atcatagttatatgtacagttcata

SEQ ID NO: 240859 - DNA, 25 bp, Mus musculus
atcatagttctcaacattctggact

SEQ ID NO: 240860 - DNA, 25 bp, Mus musculus
atcatagttctcaccgttgccatga

SEQ ID NO: 240861 - DNA, 25 bp, Mus musculus
atcatagttctctacattctggact

SEQ ID NO: 240862 - DNA, 25 bp, Mus musculus
atcatagttctctccgttgccatga

SEQ ID NO: 240863 - DNA, 25 bp, Mus musculus
atcatagttttgaagacttgttcca

SEQ ID NO: 240864 - DNA, 25 bp, Mus musculus
atcatagttttgtagacttgttcca

SEQ ID NO: 240865 - DNA, 25 bp, Mus musculus
atcatataaaatagccttcctggta

SEQ ID NO: 240866 - DNA, 25 bp, Mus musculus
atcatataaaattgccttcctggta

SEQ ID NO: 240867 - DNA, 25 bp, Mus musculus
atcatatacactccttattctctac

SEQ ID NO: 240868 - DNA, 25 bp, Mus musculus
atcatatacactgcttattctctac

SEQ ID NO: 240869 - DNA, 25 bp, Mus musculus
atcatataggatccggcgatctcat

SEQ ID NO: 240870 - DNA, 25 bp, Mus musculus
atcatataggatgcggcgatctcat

SEQ ID NO: 240871 - DNA, 25 bp, Mus musculus
atcatatatggactctacgctccca

SEQ ID NO: 240872 - DNA, 25 bp, Mus musculus
atcatatatggagtctacgctccca

SEQ ID NO: 240873 - DNA, 25 bp, Mus musculus
atcatatcacctcctgtgctcaagg

SEQ ID NO: 240874 - DNA, 25 bp, Mus musculus
atcatatcacctgctgtgctcaagg

SEQ ID NO: 240875 - DNA, 25 bp, Mus musculus
atcatatcagcacatcgatgagtct

SEQ ID NO: 240876 - DNA, 25 bp, Mus musculus
atcatatcagcagatcgatgagtct

SEQ ID NO: 240877 - DNA, 25 bp, Mus musculus
atcatatcgttcatcttccccaaat

SEQ ID NO: 240878 - DNA, 25 bp, Mus musculus
atcatatcgttcttcttccccaaat

SEQ ID NO: 240879 - DNA, 25 bp, Mus musculus
atcatatgatttctgttaggataca

SEQ ID NO: 240880 - DNA, 25 bp, Mus musculus
atcatatgatttgtgttaggataca

SEQ ID NO: 240881 - DNA, 25 bp, Mus musculus
atcatatgcgccatacagatggttg

SEQ ID NO: 240882 - DNA, 25 bp, Mus musculus
atcatatgcgccttacagatggttg

SEQ ID NO: 240883 - DNA, 25 bp, Mus musculus
atcatatggcaaccaggaaaactat

SEQ ID NO: 240884 - DNA, 25 bp, Mus musculus
atcatatggcaagcaggaaaactat

SEQ ID NO: 240885 - DNA, 25 bp, Mus musculus
atcatattaagcactgttctcccta

SEQ ID NO: 240886 - DNA, 25 bp, Mus musculus
atcatattaagctctgttctcccta

SEQ ID NO: 240887 - DNA, 25 bp, Mus musculus
atcatattcaatagggtttacccag

SEQ ID NO: 240888 - DNA, 25 bp, Mus musculus
atcatattcaattgggtttacccag

SEQ ID NO: 240889 - DNA, 25 bp, Mus musculus
atcatattccatagtgtcagttaac

SEQ ID NO: 240890 - DNA, 25 bp, Mus musculus
atcatattccattgtgtcagttaac

SEQ ID NO: 240891 - DNA, 25 bp, Mus musculus
atcatattgttgagccttgtgttag

SEQ ID NO: 240892 - DNA, 25 bp, Mus musculus
atcatattgttgtgccttgtgttag

SEQ ID NO: 240893 - DNA, 25 bp, Mus musculus
atcatatttttgagggaatgggccc

SEQ ID NO: 240894 - DNA, 25 bp, Mus musculus
atcatatttttgtgggaatgggccc

SEQ ID NO: 240895 - DNA, 25 bp, Mus musculus
atcatcaaatcactccaggcagcca

SEQ ID NO: 240896 - DNA, 25 bp, Mus musculus
atcatcaaatcagtccaggcagcca

SEQ ID NO: 240897 - DNA, 25 bp, Mus musculus
atcatcaaccaaaactctttatctg

SEQ ID NO: 240898 - DNA, 25 bp, Mus musculus
atcatcaaccaatactctttatctg

SEQ ID NO: 240899 - DNA, 25 bp, Mus musculus
atcatcaacggtctccacagcatcg

SEQ ID NO: 240900 - DNA, 25 bp, Mus musculus
atcatcaacggtgtccacagcatcg

SEQ ID NO: 240901 - DNA, 25 bp, Mus musculus
atcatcaagaacccgcacaagaagg

SEQ ID NO: 240902 - DNA, 25 bp, Mus musculus
atcatcaagaacgcgcacaagaagg

SEQ ID NO: 240903 - DNA, 25 bp, Mus musculus
atcatcaaggaactgcggttcttac

SEQ ID NO: 240904 - DNA, 25 bp, Mus musculus
atcatcaaggaagtgcggttcttac

SEQ ID NO: 240905 - DNA, 25 bp, Mus musculus
atcatcaagtgtacctaaactgtag

SEQ ID NO: 240906 - DNA, 25 bp, Mus musculus
atcatcaagtgttcctaaactgtag

SEQ ID NO: 240907 - DNA, 25 bp, Mus musculus
atcatcaatccacctttagaccagg

SEQ ID NO: 240908 - DNA, 25 bp, Mus musculus
atcatcaatccagctttagaccagg

SEQ ID NO: 240909 - DNA, 25 bp, Mus musculus
atcatcacactgagggatggcatct

SEQ ID NO: 240910 - DNA, 25 bp, Mus musculus
atcatcacactgtgggatggcatct

SEQ ID NO: 240911 - DNA, 25 bp, Mus musculus
atcatcacagagctccagcaggacg

SEQ ID NO: 240912 - DNA, 25 bp, Mus musculus
atcatcacagaggtccagcaggacg

SEQ ID NO: 240913 - DNA, 25 bp, Mus musculus
atcatcaccaccaaagttttcagaa

SEQ ID NO: 240914 - DNA, 25 bp, Mus musculus
atcatcaccacctaagttttcagaa

SEQ ID NO: 240915 - DNA, 25 bp, Mus musculus
atcatcacccacatcttgaccttgg

SEQ ID NO: 240916 - DNA, 25 bp, Mus musculus
atcatcacccacttcttgaccttgg

SEQ ID NO: 240917 - DNA, 25 bp, Mus musculus
atcatcaccccacgtctgaagaaat

SEQ ID NO: 240918 - DNA, 25 bp, Mus musculus
atcatcaccccaggtctgaagaaat

SEQ ID NO: 240919 - DNA, 25 bp, Mus musculus
atcatcacccggctgtttgaaggac

SEQ ID NO: 240920 - DNA, 25 bp, Mus musculus
atcatcacccgggtgtttgaaggac

SEQ ID NO: 240921 - DNA, 25 bp, Mus musculus
atcatcaccgtgaaagtcccaagat

SEQ ID NO: 240922 - DNA, 25 bp, Mus musculus
atcatcaccgtgtaagtcccaagat

SEQ ID NO: 240923 - DNA, 25 bp, Mus musculus
atcatcacgctgcaacgtttttggc

SEQ ID NO: 240924 - DNA, 25 bp, Mus musculus
atcatcacgctggaacgtttttggc

SEQ ID NO: 240925 - DNA, 25 bp, Mus musculus
atcatcactttgctggtgctgctgc

SEQ ID NO: 240926 - DNA, 25 bp, Mus musculus
atcatcactttggtggtgctgctgc

SEQ ID NO: 240927 - DNA, 25 bp, Mus musculus
atcatcagactgagagcctgggctc

SEQ ID NO: 240928 - DNA, 25 bp, Mus musculus
atcatcagactgtgagcctgggctc

SEQ ID NO: 240929 - DNA, 25 bp, Mus musculus
atcatcagcaagctggccagccaga

SEQ ID NO: 240930 - DNA, 25 bp, Mus musculus
atcatcagcaaggtggccagccaga

SEQ ID NO: 240931 - DNA, 25 bp, Mus musculus
atcatcagccagagcggccgtctca

SEQ ID NO: 240932 - DNA, 25 bp, Mus musculus
atcatcagccagtgcggccgtctca

SEQ ID NO: 240933 - DNA, 25 bp, Mus musculus
atcatcagcgccagattttggagta

SEQ ID NO: 240934 - DNA, 25 bp, Mus musculus
atcatcagcgcctgattttggagta

SEQ ID NO: 240935 - DNA, 25 bp, Mus musculus
atcatcagggagagtgggctctgca

SEQ ID NO: 240936 - DNA, 25 bp, Mus musculus
atcatcagggagtgtgggctctgca

SEQ ID NO: 240937 - DNA, 25 bp, Mus musculus
atcatcaggttcattgttagcttca

SEQ ID NO: 240938 - DNA, 25 bp, Mus musculus
atcatcaggttctttgttagcttca

SEQ ID NO: 240939 - DNA, 25 bp, Mus musculus
atcatcagtgagctggcgctgtgcc

SEQ ID NO: 240940 - DNA, 25 bp, Mus musculus
atcatcagtgaggtggcgctgtgcc

SEQ ID NO: 240941 - DNA, 25 bp, Mus musculus
atcatcagtgggatccagttgcctg

SEQ ID NO: 240942 - DNA, 25 bp, Mus musculus
atcatcagtgggttccagttgcctg

SEQ ID NO: 240943 - DNA, 25 bp, Mus musculus
atcatcagtgtcatgctcatcgcgg

SEQ ID NO: 240944 - DNA, 25 bp, Mus musculus
atcatcagtgtcttgctcatcgcgg

SEQ ID NO: 240945 - DNA, 25 bp, Mus musculus
atcatcagtttcctgtctctgctgg

SEQ ID NO: 240946 - DNA, 25 bp, Mus musculus
atcatcagtttcgtgtctctgctgg

SEQ ID NO: 240947 - DNA, 25 bp, Mus musculus
atcatcatagctaggaagactgtca

SEQ ID NO: 240948 - DNA, 25 bp, Mus musculus
atcatcatagcttggaagactgtca

SEQ ID NO: 240949 - DNA, 25 bp, Mus musculus
atcatcataggaaccagctgtccac

SEQ ID NO: 240950 - DNA, 25 bp, Mus musculus
atcatcataggatccagctgtccac

SEQ ID NO: 240951 - DNA, 25 bp, Mus musculus
atcatcatcagtagagtctcccctt

SEQ ID NO: 240952 - DNA, 25 bp, Mus musculus
atcatcatcagttgagtctcccctt

SEQ ID NO: 240953 - DNA, 25 bp, Mus musculus
atcatcatccacctcatctggatgt

SEQ ID NO: 240954 - DNA, 25 bp, Mus musculus
atcatcatccacgtcatctggatgt

SEQ ID NO: 240955 - DNA, 25 bp, Mus musculus
atcatcatccccatcaagaatgtct

SEQ ID NO: 240956 - DNA, 25 bp, Mus musculus
atcatcatccccttcaagaatgtct

SEQ ID NO: 240957 - DNA, 25 bp, Mus musculus
atcatcatccgaacccagatggagg

SEQ ID NO: 240958 - DNA, 25 bp, Mus musculus
atcatcatccgatcccagatggagg

SEQ ID NO: 240959 - DNA, 25 bp, Mus musculus
atcatcatcgtgaggtgtgtctctt

SEQ ID NO: 240960 - DNA, 25 bp, Mus musculus
atcatcatcgtgtggtgtgtctctt

SEQ ID NO: 240961 - DNA, 25 bp, Mus musculus
atcatcatctctccaagactcatcg

SEQ ID NO: 240962 - DNA, 25 bp, Mus musculus
atcatcatctctgcaagactcatcg

SEQ ID NO: 240963 - DNA, 25 bp, Mus musculus
atcatcatctgtatcgggtttctcc

SEQ ID NO: 240964 - DNA, 25 bp, Mus musculus
atcatcatctgtttcgggtttctcc

SEQ ID NO: 240965 - DNA, 25 bp, Mus musculus
atcatcatgagactctctgtgccgt

SEQ ID NO: 240966 - DNA, 25 bp, Mus musculus
atcatcatgagagtctctgtgccgt

SEQ ID NO: 240967 - DNA, 25 bp, Mus musculus
atcatcatgatacatggagctcaac

SEQ ID NO: 240968 - DNA, 25 bp, Mus musculus
atcatcatgatagatggagctcaac

SEQ ID NO: 240969 - DNA, 25 bp, Mus musculus
atcatcatgatgacgacggcttgga

SEQ ID NO: 240970 - DNA, 25 bp, Mus musculus
atcatcatgatgtcgacggcttgga

SEQ ID NO: 240971 - DNA, 25 bp, Mus musculus
atcatcatggaacgattcatacagt

SEQ ID NO: 240972 - DNA, 25 bp, Mus musculus
atcatcatggaaggattcatacagt

SEQ ID NO: 240973 - DNA, 25 bp, Mus musculus
atcatcatggacctacacacgtgtg

SEQ ID NO: 240974 - DNA, 25 bp, Mus musculus
atcatcatggacgtacacacgtgtg

SEQ ID NO: 240975 - DNA, 25 bp, Mus musculus
atcatcatggatcaaggagcccagt

SEQ ID NO: 240976 - DNA, 25 bp, Mus musculus
atcatcatggatgaaggagcccagt

SEQ ID NO: 240977 - DNA, 25 bp, Mus musculus
atcatcattagaccagtgagcacta

SEQ ID NO: 240978 - DNA, 25 bp, Mus musculus
atcatcattagagcagtgagcacta

SEQ ID NO: 240979 - DNA, 25 bp, Mus musculus
atcatcattagcctggttttctgta

SEQ ID NO: 240980 - DNA, 25 bp, Mus musculus
atcatcattagcgtggttttctgta

SEQ ID NO: 240981 - DNA, 25 bp, Mus musculus
atcatccaattcagttctgtaactg

SEQ ID NO: 240982 - DNA, 25 bp, Mus musculus
atcatccaattctgttctgtaactg

SEQ ID NO: 240983 - DNA, 25 bp, Mus musculus
atcatccacatgaggcgaacatctc

SEQ ID NO: 240984 - DNA, 25 bp, Mus musculus
atcatccacatgtggcgaacatctc

SEQ ID NO: 240985 - DNA, 25 bp, Mus musculus
atcatccactctaggttccttttga

SEQ ID NO: 240986 - DNA, 25 bp, Mus musculus
atcatccactcttggttccttttga

SEQ ID NO: 240987 - DNA, 25 bp, Mus musculus
atcatccagagtactgcttgtcatc

SEQ ID NO: 240988 - DNA, 25 bp, Mus musculus
atcatccagagttctgcttgtcatc

SEQ ID NO: 240989 - DNA, 25 bp, Mus musculus
atcatccagccacagcaaatcttat

SEQ ID NO: 240990 - DNA, 25 bp, Mus musculus
atcatccagccagagcaaatcttat

SEQ ID NO: 240991 - DNA, 25 bp, Mus musculus
atcatccaggacatcagaggcactc

SEQ ID NO: 240992 - DNA, 25 bp, Mus musculus
atcatccaggacttcagaggcactc

SEQ ID NO: 240993 - DNA, 25 bp, Mus musculus
atcatccaggagagactgaaggctt

SEQ ID NO: 240994 - DNA, 25 bp, Mus musculus
atcatccaggagtgactgaaggctt

SEQ ID NO: 240995 - DNA, 25 bp, Mus musculus
atcatccaggataagttattaggcc

SEQ ID NO: 240996 - DNA, 25 bp, Mus musculus
atcatccaggatatttataacccac

SEQ ID NO: 240997 - DNA, 25 bp, Mus musculus
atcatccaggattagttattaggcc

SEQ ID NO: 240998 - DNA, 25 bp, Mus musculus
atcatccaggatttttataacccac

SEQ ID NO: 240999 - DNA, 25 bp, Mus musculus
atcatccagtctatggctgccaaga

SEQ ID NO: 241000 - DNA, 25 bp, Mus musculus
atcatccagtctttggctgccaaga

SEQ ID NO: 241001 - DNA, 25 bp, Mus musculus
atcatccataatattgtctcagcac

SEQ ID NO: 241002 - DNA, 25 bp, Mus musculus
atcatccataattttgtctcagcac

SEQ ID NO: 241003 - DNA, 25 bp, Mus musculus
atcatccatgtgaagagccttttaa

SEQ ID NO: 241004 - DNA, 25 bp, Mus musculus
atcatccatgtgtagagccttttaa

SEQ ID NO: 241005 - DNA, 25 bp, Mus musculus
atcatccattcccatgtcatggcag

SEQ ID NO: 241006 - DNA, 25 bp, Mus musculus
atcatccattccgatgtcatggcag

SEQ ID NO: 241007 - DNA, 25 bp, Mus musculus
atcatccattggcaggtctctattg

SEQ ID NO: 241008 - DNA, 25 bp, Mus musculus
atcatccattgggaggtctctattg

SEQ ID NO: 241009 - DNA, 25 bp, Mus musculus
atcatccatttcatatgcgtccagc

SEQ ID NO: 241010 - DNA, 25 bp, Mus musculus
atcatccatttcttatgcgtccagc

SEQ ID NO: 241011 - DNA, 25 bp, Mus musculus
atcatcccaacacgcggaaaggctg

SEQ ID NO: 241012 - DNA, 25 bp, Mus musculus
atcatcccaacaggcggaaaggctg

SEQ ID NO: 241013 - DNA, 25 bp, Mus musculus
atcatcccaattctagcaggcgtgg

SEQ ID NO: 241014 - DNA, 25 bp, Mus musculus
atcatcccaattgtagcaggcgtgg

SEQ ID NO: 241015 - DNA, 25 bp, Mus musculus
atcatcccagaaatgaactcttgta

SEQ ID NO: 241016 - DNA, 25 bp, Mus musculus
atcatcccagaattgaactcttgta

SEQ ID NO: 241017 - DNA, 25 bp, Mus musculus
atcatcccaggaagactttggtctg

SEQ ID NO: 241018 - DNA, 25 bp, Mus musculus
atcatcccaggatgactttggtctg

SEQ ID NO: 241019 - DNA, 25 bp, Mus musculus
atcatccccagaatcttaacactta

SEQ ID NO: 241020 - DNA, 25 bp, Mus musculus
atcatccccagattcttaacactta

SEQ ID NO: 241021 - DNA, 25 bp, Mus musculus
atcatccccaggatcacgacacaga

SEQ ID NO: 241022 - DNA, 25 bp, Mus musculus
atcatccccaggttcacgacacaga

SEQ ID NO: 241023 - DNA, 25 bp, Mus musculus
atcatcccgaacagagtgtgtgcac

SEQ ID NO: 241024 - DNA, 25 bp, Mus musculus
atcatcccgaactgagtgtgtgcac

SEQ ID NO: 241025 - DNA, 25 bp, Mus musculus
atcatcccgttaaatctcctggaat

SEQ ID NO: 241026 - DNA, 25 bp, Mus musculus
atcatcccgttatatctcctggaat

SEQ ID NO: 241027 - DNA, 25 bp, Mus musculus
atcatccctagtacttttttgccta

SEQ ID NO: 241028 - DNA, 25 bp, Mus musculus
atcatccctagttcttttttgccta

SEQ ID NO: 241029 - DNA, 25 bp, Mus musculus
atcatccctgacagaaatttcatgt

SEQ ID NO: 241030 - DNA, 25 bp, Mus musculus
atcatccctgactgaaatttcatgt

SEQ ID NO: 241031 - DNA, 25 bp, Mus musculus
atcatccctgatattgctcaagaag

SEQ ID NO: 241032 - DNA, 25 bp, Mus musculus
atcatccctgatcttgcgtctgtag

SEQ ID NO: 241033 - DNA, 25 bp, Mus musculus
atcatccctgatgttgcgtctgtag

SEQ ID NO: 241034 - DNA, 25 bp, Mus musculus
atcatccctgattttgctcaagaag

SEQ ID NO: 241035 - DNA, 25 bp, Mus musculus
atcatccctgggattggcgttacag

SEQ ID NO: 241036 - DNA, 25 bp, Mus musculus
atcatccctgggtttggcgttacag

SEQ ID NO: 241037 - DNA, 25 bp, Mus musculus
atcatccctgtgctgtctcaacagc

SEQ ID NO: 241038 - DNA, 25 bp, Mus musculus
atcatccctgtggtgtctcaacagc

SEQ ID NO: 241039 - DNA, 25 bp, Mus musculus
atcatcccttttctcaccataattg

SEQ ID NO: 241040 - DNA, 25 bp, Mus musculus
atcatcccttttgtcaccataattg

SEQ ID NO: 241041 - DNA, 25 bp, Mus musculus
atcatccgcctcattctagatgcat

SEQ ID NO: 241042 - DNA, 25 bp, Mus musculus
atcatccgcctctttctagatgcat

SEQ ID NO: 241043 - DNA, 25 bp, Mus musculus
atcatccgctgaactcttactgact

SEQ ID NO: 241044 - DNA, 25 bp, Mus musculus
atcatccgctgatctcttactgact

SEQ ID NO: 241045 - DNA, 25 bp, Mus musculus
atcatcctattgaattacttagaaa

SEQ ID NO: 241046 - DNA, 25 bp, Mus musculus
atcatcctattgtattacttagaaa

SEQ ID NO: 241047 - DNA, 25 bp, Mus musculus
atcatcctcagtatcaaaatcttgg

SEQ ID NO: 241048 - DNA, 25 bp, Mus musculus
atcatcctcagtttcaaaatcttgg

SEQ ID NO: 241049 - DNA, 25 bp, Mus musculus
atcatcctcattatcataaaacgcg

SEQ ID NO: 241050 - DNA, 25 bp, Mus musculus
atcatcctcattttcataaaacgcg

SEQ ID NO: 241051 - DNA, 25 bp, Mus musculus
atcatcctccatcgaaatctggctc

SEQ ID NO: 241052 - DNA, 25 bp, Mus musculus
atcatcctccatggaaatctggctc

SEQ ID NO: 241053 - DNA, 25 bp, Mus musculus
atcatcctcctcatgtggaagtgcg

SEQ ID NO: 241054 - DNA, 25 bp, Mus musculus
atcatcctcctcttgtggaagtgcg

SEQ ID NO: 241055 - DNA, 25 bp, Mus musculus
atcatcctcctgctaaaagctaaca

SEQ ID NO: 241056 - DNA, 25 bp, Mus musculus
atcatcctcctggtaaaagctaaca

SEQ ID NO: 241057 - DNA, 25 bp, Mus musculus
atcatcctcgaaagtcctctgtgtc

SEQ ID NO: 241058 - DNA, 25 bp, Mus musculus
atcatcctcgaatgtcctctgtgtc

SEQ ID NO: 241059 - DNA, 25 bp, Mus musculus
atcatcctcgcacctattggcatcg

SEQ ID NO: 241060 - DNA, 25 bp, Mus musculus
atcatcctcgcagctattggcatcg

SEQ ID NO: 241061 - DNA, 25 bp, Mus musculus
atcatcctctagacttttttgtttc

SEQ ID NO: 241062 - DNA, 25 bp, Mus musculus
atcatcctctagtcttttttgtttc

SEQ ID NO: 241063 - DNA, 25 bp, Mus musculus
atcatcctctctaccactatttctt

SEQ ID NO: 241064 - DNA, 25 bp, Mus musculus
atcatcctctcttccactatttctt

SEQ ID NO: 241065 - DNA, 25 bp, Mus musculus
atcatcctctgcatacccagtgtgg

SEQ ID NO: 241066 - DNA, 25 bp, Mus musculus
atcatcctctgcttacccagtgtgg

SEQ ID NO: 241067 - DNA, 25 bp, Mus musculus
atcatcctgaccagtggttttgtgt

SEQ ID NO: 241068 - DNA, 25 bp, Mus musculus
atcatcctgacctgtggttttgtgt

SEQ ID NO: 241069 - DNA, 25 bp, Mus musculus
atcatcctgactatagcattggcgg

SEQ ID NO: 241070 - DNA, 25 bp, Mus musculus
atcatcctgactttagcattggcgg

SEQ ID NO: 241071 - DNA, 25 bp, Mus musculus
atcatcctgggaacctaaagctgat

SEQ ID NO: 241072 - DNA, 25 bp, Mus musculus
atcatcctgggatcctaaagctgat

SEQ ID NO: 241073 - DNA, 25 bp, Mus musculus
atcatcctgtacatgaccctgtgga

SEQ ID NO: 241074 - DNA, 25 bp, Mus musculus
atcatcctgtacttgaccctgtgga

SEQ ID NO: 241075 - DNA, 25 bp, Mus musculus
atcatcctgtgacgatgctgccaaa

SEQ ID NO: 241076 - DNA, 25 bp, Mus musculus
atcatcctgtgaggatgctgccaaa

SEQ ID NO: 241077 - DNA, 25 bp, Mus musculus
atcatcctgttcacatgaagttccc

SEQ ID NO: 241078 - DNA, 25 bp, Mus musculus
atcatcctgttcactgggttcctat

SEQ ID NO: 241079 - DNA, 25 bp, Mus musculus
atcatcctgttctcatgaagttccc

SEQ ID NO: 241080 - DNA, 25 bp, Mus musculus
atcatcctgttctctgggttcctat

SEQ ID NO: 241081 - DNA, 25 bp, Mus musculus
atcatcgactctctggagtgcaaca

SEQ ID NO: 241082 - DNA, 25 bp, Mus musculus
atcatcgactctgtggagtgcaaca

SEQ ID NO: 241083 - DNA, 25 bp, Mus musculus
atcatcgactgtacccaagaccaga

SEQ ID NO: 241084 - DNA, 25 bp, Mus musculus
atcatcgactgttcccaagaccaga

SEQ ID NO: 241085 - DNA, 25 bp, Mus musculus
atcatcgagaggcagccgctcatta

SEQ ID NO: 241086 - DNA, 25 bp, Mus musculus
atcatcgagagggagccgctcatta

SEQ ID NO: 241087 - DNA, 25 bp, Mus musculus
atcatcgcacatagttaagtgagca

SEQ ID NO: 241088 - DNA, 25 bp, Mus musculus
atcatcgcacattgttaagtgagca

SEQ ID NO: 241089 - DNA, 25 bp, Mus musculus
atcatcgcagacaacctaagctggt

SEQ ID NO: 241090 - DNA, 25 bp, Mus musculus
atcatcgcagactacctaagctggt

SEQ ID NO: 241091 - DNA, 25 bp, Mus musculus
atcatcgcagcgctcagcacaatta

SEQ ID NO: 241092 - DNA, 25 bp, Mus musculus
atcatcgcagcggtcagcacaatta

SEQ ID NO: 241093 - DNA, 25 bp, Mus musculus
atcatcgcagggaccagctgctact

SEQ ID NO: 241094 - DNA, 25 bp, Mus musculus
atcatcgcagggtccagctgctact

SEQ ID NO: 241095 - DNA, 25 bp, Mus musculus
atcatcgcatgtctttccttctgcc

SEQ ID NO: 241096 - DNA, 25 bp, Mus musculus
atcatcgcatgtgtttccttctgcc

SEQ ID NO: 241097 - DNA, 25 bp, Mus musculus
atcatcgctgctcgatttgctggaa

SEQ ID NO: 241098 - DNA, 25 bp, Mus musculus
atcatcgctgctggatttgctggaa

SEQ ID NO: 241099 - DNA, 25 bp, Mus musculus
atcatcgctgtcattgtggtggtgt

SEQ ID NO: 241100 - DNA, 25 bp, Mus musculus
atcatcgctgtctttgtggtggtgt

SEQ ID NO: 241101 - DNA, 25 bp, Mus musculus
atcatcggcttgcagcgcttctttg

SEQ ID NO: 241102 - DNA, 25 bp, Mus musculus
atcatcggcttggagcgcttctttg

SEQ ID NO: 241103 - DNA, 25 bp, Mus musculus
atcatcggttcaagggatctctctc

SEQ ID NO: 241104 - DNA, 25 bp, Mus musculus
atcatcggttcatgggatctctctc

SEQ ID NO: 241105 - DNA, 25 bp, Mus musculus
atcatcgtaaggatgcgtgtatttc

SEQ ID NO: 241106 - DNA, 25 bp, Mus musculus
atcatcgtaaggttgcgtgtatttc

SEQ ID NO: 241107 - DNA, 25 bp, Mus musculus
atcatcgtctccagcggatgggaca

SEQ ID NO: 241108 - DNA, 25 bp, Mus musculus
atcatcgtctcctgcggatgggaca

SEQ ID NO: 241109 - DNA, 25 bp, Mus musculus
atcatcgtggtcatcgccatcctga

SEQ ID NO: 241110 - DNA, 25 bp, Mus musculus
atcatcgtggtcttcgccatcctga

SEQ ID NO: 241111 - DNA, 25 bp, Mus musculus
atcatcgtgtggcaggtgtcctaca

SEQ ID NO: 241112 - DNA, 25 bp, Mus musculus
atcatcgtgtgggaggtgtcctaca

SEQ ID NO: 241113 - DNA, 25 bp, Mus musculus
atcatcgttagcatattcttccagc

SEQ ID NO: 241114 - DNA, 25 bp, Mus musculus
atcatcgttagcttattcttccagc

SEQ ID NO: 241115 - DNA, 25 bp, Mus musculus
atcatcgttaggatttgactatctt

SEQ ID NO: 241116 - DNA, 25 bp, Mus musculus
atcatcgttaggttttgactatctt

SEQ ID NO: 241117 - DNA, 25 bp, Mus musculus
atcatctagcaccagctaatgctga

SEQ ID NO: 241118 - DNA, 25 bp, Mus musculus
atcatctagcacgagctaatgctga

SEQ ID NO: 241119 - DNA, 25 bp, Mus musculus
atcatctagggcatcaaactttagg

SEQ ID NO: 241120 - DNA, 25 bp, Mus musculus
atcatctagggcttcaaactttagg

SEQ ID NO: 241121 - DNA, 25 bp, Mus musculus
atcatctagtaactgcagatacttc

SEQ ID NO: 241122 - DNA, 25 bp, Mus musculus
atcatctagtaagtgcagatacttc

SEQ ID NO: 241123 - DNA, 25 bp, Mus musculus
atcatctataacatcctgctctttg

SEQ ID NO: 241124 - DNA, 25 bp, Mus musculus
atcatctataacttcctgctctttg

SEQ ID NO: 241125 - DNA, 25 bp, Mus musculus
atcatctataccagtctcaaatacg

SEQ ID NO: 241126 - DNA, 25 bp, Mus musculus
atcatctatacctgtctcaaatacg

SEQ ID NO: 241127 - DNA, 25 bp, Mus musculus
atcatctatgctatattttatctct

SEQ ID NO: 241128 - DNA, 25 bp, Mus musculus
atcatctatgctttattttatctct

SEQ ID NO: 241129 - DNA, 25 bp, Mus musculus
atcatctattatctacaaggccctg

SEQ ID NO: 241130 - DNA, 25 bp, Mus musculus
atcatctattatgtacaaggccctg

SEQ ID NO: 241131 - DNA, 25 bp, Mus musculus
atcatctattcaacagtcatccatc

SEQ ID NO: 241132 - DNA, 25 bp, Mus musculus
atcatctattcatcagtcatccatc

SEQ ID NO: 241133 - DNA, 25 bp, Mus musculus
atcatctattcgcacttcagctttc

SEQ ID NO: 241134 - DNA, 25 bp, Mus musculus
atcatctattcggacttcagctttc

SEQ ID NO: 241135 - DNA, 25 bp, Mus musculus
atcatctcactcagcctcaagtgtg

SEQ ID NO: 241136 - DNA, 25 bp, Mus musculus
atcatctcactctgcctcaagtgtg

SEQ ID NO: 241137 - DNA, 25 bp, Mus musculus
atcatctcatgcagtgtaaccacgg

SEQ ID NO: 241138 - DNA, 25 bp, Mus musculus
atcatctcatgctgtgtaaccacgg

SEQ ID NO: 241139 - DNA, 25 bp, Mus musculus
atcatctccagccaggcggtacagt

SEQ ID NO: 241140 - DNA, 25 bp, Mus musculus
atcatctccagcgaggcggtacagt

SEQ ID NO: 241141 - DNA, 25 bp, Mus musculus
atcatctccaggagggctgttacct

SEQ ID NO: 241142 - DNA, 25 bp, Mus musculus
atcatctccaggtgggctgttacct

SEQ ID NO: 241143 - DNA, 25 bp, Mus musculus
atcatctccatccatatctcgtttt

SEQ ID NO: 241144 - DNA, 25 bp, Mus musculus
atcatctccatcgatatctcgtttt

SEQ ID NO: 241145 - DNA, 25 bp, Mus musculus
atcatctcccgcatgtatggttaga

SEQ ID NO: 241146 - DNA, 25 bp, Mus musculus
atcatctcccgcttgtatggttaga

SEQ ID NO: 241147 - DNA, 25 bp, Mus musculus
atcatctcctagaggctattctgtg

SEQ ID NO: 241148 - DNA, 25 bp, Mus musculus
atcatctcctagtggctattctgtg

SEQ ID NO: 241149 - DNA, 25 bp, Mus musculus
atcatctcctggaatgccacaaggc

SEQ ID NO: 241150 - DNA, 25 bp, Mus musculus
atcatctcctggtatgccacaaggc

SEQ ID NO: 241151 - DNA, 25 bp, Mus musculus
atcatctctaaaatcccaggacctc

SEQ ID NO: 241152 - DNA, 25 bp, Mus musculus
atcatctctaaattcccaggacctc

SEQ ID NO: 241153 - DNA, 25 bp, Mus musculus
atcatctctaataacagtcagcttt

SEQ ID NO: 241154 - DNA, 25 bp, Mus musculus
atcatctctaattacagtcagcttt

SEQ ID NO: 241155 - DNA, 25 bp, Mus musculus
atcatctctctgcattttggcagcg

SEQ ID NO: 241156 - DNA, 25 bp, Mus musculus
atcatctctctggattttggcagcg

SEQ ID NO: 241157 - DNA, 25 bp, Mus musculus
atcatctctggtcccattacttctg

SEQ ID NO: 241158 - DNA, 25 bp, Mus musculus
atcatctctggtgccattacttctg

SEQ ID NO: 241159 - DNA, 25 bp, Mus musculus
atcatctctgtgaagggaatcaagg

SEQ ID NO: 241160 - DNA, 25 bp, Mus musculus
atcatctctgtgtagggaatcaagg

SEQ ID NO: 241161 - DNA, 25 bp, Mus musculus
atcatctcttgacagccatttggaa

SEQ ID NO: 241162 - DNA, 25 bp, Mus musculus
atcatctcttgagagccatttggaa

SEQ ID NO: 241163 - DNA, 25 bp, Mus musculus
atcatctcttgcaacttcttgttag

SEQ ID NO: 241164 - DNA, 25 bp, Mus musculus
atcatctcttgctacttcttgttag

SEQ ID NO: 241165 - DNA, 25 bp, Mus musculus
atcatctctttcatgttggtctctt

SEQ ID NO: 241166 - DNA, 25 bp, Mus musculus
atcatctctttcttgttggtctctt

SEQ ID NO: 241167 - DNA, 25 bp, Mus musculus
atcatctgaggtatccggcttgaga

SEQ ID NO: 241168 - DNA, 25 bp, Mus musculus
atcatctgaggtttccggcttgaga

SEQ ID NO: 241169 - DNA, 25 bp, Mus musculus
atcatctgccttagctggtccattt

SEQ ID NO: 241170 - DNA, 25 bp, Mus musculus
atcatctgcctttgctggtccattt

SEQ ID NO: 241171 - DNA, 25 bp, Mus musculus
atcatctgctgcagtggagctacgg

SEQ ID NO: 241172 - DNA, 25 bp, Mus musculus
atcatctgctgctgtggagctacgg

SEQ ID NO: 241173 - DNA, 25 bp, Mus musculus
atcatctggaatcctgcgtgggacc

SEQ ID NO: 241174 - DNA, 25 bp, Mus musculus
atcatctggaatgctgcgtgggacc

SEQ ID NO: 241175 - DNA, 25 bp, Mus musculus
atcatctggattaaggcatcgtcat

SEQ ID NO: 241176 - DNA, 25 bp, Mus musculus
atcatctggatttaggcatcgtcat

SEQ ID NO: 241177 - DNA, 25 bp, Mus musculus
atcatctggctgactctttaagggt

SEQ ID NO: 241178 - DNA, 25 bp, Mus musculus
atcatctggctgtctctttaagggt

SEQ ID NO: 241179 - DNA, 25 bp, Mus musculus
atcatctggtcgagtggtgtctctt

SEQ ID NO: 241180 - DNA, 25 bp, Mus musculus
atcatctggtcgtgtggtgtctctt

SEQ ID NO: 241181 - DNA, 25 bp, Mus musculus
atcatctgtaatccatgcacttcta

SEQ ID NO: 241182 - DNA, 25 bp, Mus musculus
atcatctgtaatgcatgcacttcta

SEQ ID NO: 241183 - DNA, 25 bp, Mus musculus
atcatctgtagaccagcttcccatt

SEQ ID NO: 241184 - DNA, 25 bp, Mus musculus
atcatctgtagagcagcttcccatt

SEQ ID NO: 241185 - DNA, 25 bp, Mus musculus
atcatctgtcacctgccaatattaa

SEQ ID NO: 241186 - DNA, 25 bp, Mus musculus
atcatctgtcacgtgccaatattaa

SEQ ID NO: 241187 - DNA, 25 bp, Mus musculus
atcatctgtcatcctcctgagcatg

SEQ ID NO: 241188 - DNA, 25 bp, Mus musculus
atcatctgtcatgctcctgagcatg

SEQ ID NO: 241189 - DNA, 25 bp, Mus musculus
atcatctgtgatatctgccaacttg

SEQ ID NO: 241190 - DNA, 25 bp, Mus musculus
atcatctgtgatttctgccaacttg

SEQ ID NO: 241191 - DNA, 25 bp, Mus musculus
atcatctgtggcaattgcttggcaa

SEQ ID NO: 241192 - DNA, 25 bp, Mus musculus
atcatctgtggcattacttctgtgg

SEQ ID NO: 241193 - DNA, 25 bp, Mus musculus
atcatctgtggctattgcttggcaa

SEQ ID NO: 241194 - DNA, 25 bp, Mus musculus
atcatctgtggctttacttctgtgg

SEQ ID NO: 241195 - DNA, 25 bp, Mus musculus
atcatctgttaccacccaaggctgt

SEQ ID NO: 241196 - DNA, 25 bp, Mus musculus
atcatctgttacgacccaaggctgt

SEQ ID NO: 241197 - DNA, 25 bp, Mus musculus
atcatcttacttaacccacgtccaa

SEQ ID NO: 241198 - DNA, 25 bp, Mus musculus
atcatcttactttacccacgtccaa

SEQ ID NO: 241199 - DNA, 25 bp, Mus musculus
atcatcttcattcttgccacacagt

SEQ ID NO: 241200 - DNA, 25 bp, Mus musculus
atcatcttcattgttgccacacagt

SEQ ID NO: 241201 - DNA, 25 bp, Mus musculus
atcatcttccatcatgtcttcagtg

SEQ ID NO: 241202 - DNA, 25 bp, Mus musculus
atcatcttccatgatgtcttcagtg

SEQ ID NO: 241203 - DNA, 25 bp, Mus musculus
atcatcttcctccaagctggcgtag

SEQ ID NO: 241204 - DNA, 25 bp, Mus musculus
atcatcttcctcgaagctggcgtag

SEQ ID NO: 241205 - DNA, 25 bp, Mus musculus
atcatcttccttacggtaacttggt

SEQ ID NO: 241206 - DNA, 25 bp, Mus musculus
atcatcttccttcatttggacctga

SEQ ID NO: 241207 - DNA, 25 bp, Mus musculus
atcatcttccttgatttggacctga

SEQ ID NO: 241208 - DNA, 25 bp, Mus musculus
atcatcttcctttcggtaacttggt

SEQ ID NO: 241209 - DNA, 25 bp, Mus musculus
atcatcttctgtactgagctgcgac

SEQ ID NO: 241210 - DNA, 25 bp, Mus musculus
atcatcttctgttctgagctgcgac

SEQ ID NO: 241211 - DNA, 25 bp, Mus musculus
atcatcttgacaccccatgtagcct

SEQ ID NO: 241212 - DNA, 25 bp, Mus musculus
atcatcttgacagcccatgtagcct

SEQ ID NO: 241213 - DNA, 25 bp, Mus musculus
atcatcttggccaagctttccatcg

SEQ ID NO: 241214 - DNA, 25 bp, Mus musculus
atcatcttggcctagctttccatcg

SEQ ID NO: 241215 - DNA, 25 bp, Mus musculus
atcatcttgggactgatctgcgcca

SEQ ID NO: 241216 - DNA, 25 bp, Mus musculus
atcatcttgggagtgatctgcgcca

SEQ ID NO: 241217 - DNA, 25 bp, Mus musculus
atcatctttagcatatgcaaacctt

SEQ ID NO: 241218 - DNA, 25 bp, Mus musculus
atcatctttagcttatgcaaacctt

SEQ ID NO: 241219 - DNA, 25 bp, Mus musculus
atcatctttctgatcttcctagcat

SEQ ID NO: 241220 - DNA, 25 bp, Mus musculus
atcatctttctgttcttcctagcat

SEQ ID NO: 241221 - DNA, 25 bp, Mus musculus
atcatctttgctaatgtaaaataga

SEQ ID NO: 241222 - DNA, 25 bp, Mus musculus
atcatctttgcttatgtaaaataga

SEQ ID NO: 241223 - DNA, 25 bp, Mus musculus
atcatctttggaccctttgggagaa

SEQ ID NO: 241224 - DNA, 25 bp, Mus musculus
atcatctttggagcctttgggagaa

SEQ ID NO: 241225 - DNA, 25 bp, Mus musculus
atcatctttgtcaatttctgccctt

SEQ ID NO: 241226 - DNA, 25 bp, Mus musculus
atcatctttgtctatttctgccctt

SEQ ID NO: 241227 - DNA, 25 bp, Mus musculus
atcatgaaccccaatacaacgttgc

SEQ ID NO: 241228 - DNA, 25 bp, Mus musculus
atcatgaacccctatacaacgttgc

SEQ ID NO: 241229 - DNA, 25 bp, Mus musculus
atcatgaagagacttctgccctccg

SEQ ID NO: 241230 - DNA, 25 bp, Mus musculus
atcatgaagagagttctgccctccg

SEQ ID NO: 241231 - DNA, 25 bp, Mus musculus
atcatgaagtgccacatcgacatca

SEQ ID NO: 241232 - DNA, 25 bp, Mus musculus
atcatgaagtgcgacatcgacatca

SEQ ID NO: 241233 - DNA, 25 bp, Mus musculus
atcatgaatcgacttctgcctactg

SEQ ID NO: 241234 - DNA, 25 bp, Mus musculus
atcatgaatcgagttctgcctactg

SEQ ID NO: 241235 - DNA, 25 bp, Mus musculus
atcatgaatctcagatacctcctac

SEQ ID NO: 241236 - DNA, 25 bp, Mus musculus
atcatgaatctctgatacctcctac

SEQ ID NO: 241237 - DNA, 25 bp, Mus musculus
atcatgaattgcatgtcattcttca

SEQ ID NO: 241238 - DNA, 25 bp, Mus musculus
atcatgaattgcttgtcattcttca

SEQ ID NO: 241239 - DNA, 25 bp, Mus musculus
atcatgacacttcctattgtaataa

SEQ ID NO: 241240 - DNA, 25 bp, Mus musculus
atcatgacacttgctattgtaataa

SEQ ID NO: 241241 - DNA, 25 bp, Mus musculus
atcatgaccagcagggaaccaagtg

SEQ ID NO: 241242 - DNA, 25 bp, Mus musculus
atcatgaccagctgggaaccaagtg

SEQ ID NO: 241243 - DNA, 25 bp, Mus musculus
atcatgaccatgctggaccccaatg

SEQ ID NO: 241244 - DNA, 25 bp, Mus musculus
atcatgaccatggtggaccccaatg

SEQ ID NO: 241245 - DNA, 25 bp, Mus musculus
atcatgaccgtgatcaggcaggaaa

SEQ ID NO: 241246 - DNA, 25 bp, Mus musculus
atcatgaccgtgttcaggcaggaaa

SEQ ID NO: 241247 - DNA, 25 bp, Mus musculus
atcatgacggctatgtactgtggaa

SEQ ID NO: 241248 - DNA, 25 bp, Mus musculus
atcatgacggctttgtactgtggaa

SEQ ID NO: 241249 - DNA, 25 bp, Mus musculus
atcatgacgttcatcgggcacctag

SEQ ID NO: 241250 - DNA, 25 bp, Mus musculus
atcatgacgttcttcgggcacctag

SEQ ID NO: 241251 - DNA, 25 bp, Mus musculus
atcatgactatgagcctctttgggc

SEQ ID NO: 241252 - DNA, 25 bp, Mus musculus
atcatgactatgtgcctctttgggc

SEQ ID NO: 241253 - DNA, 25 bp, Mus musculus
atcatgactccgagatgtggaccct

SEQ ID NO: 241254 - DNA, 25 bp, Mus musculus
atcatgactccgtgatgtggaccct

SEQ ID NO: 241255 - DNA, 25 bp, Mus musculus
atcatgagagttagccagtgtgact

SEQ ID NO: 241256 - DNA, 25 bp, Mus musculus
atcatgagagtttgccagtgtgact

SEQ ID NO: 241257 - DNA, 25 bp, Mus musculus
atcatgagcccgatctttggccaca

SEQ ID NO: 241258 - DNA, 25 bp, Mus musculus
atcatgagcccgttctttggccaca

SEQ ID NO: 241259 - DNA, 25 bp, Mus musculus
atcatgagctttagctacttccgca

SEQ ID NO: 241260 - DNA, 25 bp, Mus musculus
atcatgagcttttgctacttccgca

SEQ ID NO: 241261 - DNA, 25 bp, Mus musculus
atcatgagtttgaaccagccagggt

SEQ ID NO: 241262 - DNA, 25 bp, Mus musculus
atcatgagtttgtaccagccagggt

SEQ ID NO: 241263 - DNA, 25 bp, Mus musculus
atcatgatccgccttcagaaatgct

SEQ ID NO: 241264 - DNA, 25 bp, Mus musculus
atcatgatccgcgttcagaaatgct

SEQ ID NO: 241265 - DNA, 25 bp, Mus musculus
atcatgatctttacatacatgtgca

SEQ ID NO: 241266 - DNA, 25 bp, Mus musculus
atcatgatcttttcatacatgtgca

SEQ ID NO: 241267 - DNA, 25 bp, Mus musculus
atcatgatggaaccgcttgggtcta

SEQ ID NO: 241268 - DNA, 25 bp, Mus musculus
atcatgatggaagcgcttgggtcta

SEQ ID NO: 241269 - DNA, 25 bp, Mus musculus
atcatgatgtacatcctcctggtct

SEQ ID NO: 241270 - DNA, 25 bp, Mus musculus
atcatgatgtacttcctcctggtct

SEQ ID NO: 241271 - DNA, 25 bp, Mus musculus
atcatgatgtgccagccagggatcc

SEQ ID NO: 241272 - DNA, 25 bp, Mus musculus
atcatgatgtgcgagccagggatcc

SEQ ID NO: 241273 - DNA, 25 bp, Mus musculus
atcatgattaaactgcgcgtgggcc

SEQ ID NO: 241274 - DNA, 25 bp, Mus musculus
atcatgattaaagtgcgcgtgggcc

SEQ ID NO: 241275 - DNA, 25 bp, Mus musculus
atcatgattgaaaacctccggaggc

SEQ ID NO: 241276 - DNA, 25 bp, Mus musculus
atcatgattgaatacctccggaggc

SEQ ID NO: 241277 - DNA, 25 bp, Mus musculus
atcatgcaaagacgaggatgtagac

SEQ ID NO: 241278 - DNA, 25 bp, Mus musculus
atcatgcaaagaggaggatgtagac

SEQ ID NO: 241279 - DNA, 25 bp, Mus musculus
atcatgcaagatagaggcccttagg

SEQ ID NO: 241280 - DNA, 25 bp, Mus musculus
atcatgcaagattgaggcccttagg

SEQ ID NO: 241281 - DNA, 25 bp, Mus musculus
atcatgcaccatatgccaggacagc

SEQ ID NO: 241282 - DNA, 25 bp, Mus musculus
atcatgcaccatttgccaggacagc

SEQ ID NO: 241283 - DNA, 25 bp, Mus musculus
atcatgcagtctcatttttgtttgt

SEQ ID NO: 241284 - DNA, 25 bp, Mus musculus
atcatgcagtctgatttttgtttgt

SEQ ID NO: 241285 - DNA, 25 bp, Mus musculus
atcatgcatagcaaatggccctcct

SEQ ID NO: 241286 - DNA, 25 bp, Mus musculus
atcatgcatagctaatggccctcct

SEQ ID NO: 241287 - DNA, 25 bp, Mus musculus
atcatgcatcaaagccgctcatttt

SEQ ID NO: 241288 - DNA, 25 bp, Mus musculus
atcatgcatcaatgccgctcatttt

SEQ ID NO: 241289 - DNA, 25 bp, Mus musculus
atcatgcatgggacaatctgggctc

SEQ ID NO: 241290 - DNA, 25 bp, Mus musculus
atcatgcatgggtcaatctgggctc

SEQ ID NO: 241291 - DNA, 25 bp, Mus musculus
atcatgcatggtacacttcggactg

SEQ ID NO: 241292 - DNA, 25 bp, Mus musculus
atcatgcatggttcacttcggactg

SEQ ID NO: 241293 - DNA, 25 bp, Mus musculus
atcatgccaaaactagagctgtcag

SEQ ID NO: 241294 - DNA, 25 bp, Mus musculus
atcatgccaaaagtagagctgtcag

SEQ ID NO: 241295 - DNA, 25 bp, Mus musculus
atcatgccaaacaaatcagcccgtg

SEQ ID NO: 241296 - DNA, 25 bp, Mus musculus
atcatgccaaactaatcagcccgtg

SEQ ID NO: 241297 - DNA, 25 bp, Mus musculus
atcatgccactgatcacgagtgttg

SEQ ID NO: 241298 - DNA, 25 bp, Mus musculus
atcatgccactgttcacgagtgttg

SEQ ID NO: 241299 - DNA, 25 bp, Mus musculus
atcatgccatggactggcccttgag

SEQ ID NO: 241300 - DNA, 25 bp, Mus musculus
atcatgccatggtctggcccttgag

SEQ ID NO: 241301 - DNA, 25 bp, Mus musculus
atcatgccggcactgtgtgtgttaa

SEQ ID NO: 241302 - DNA, 25 bp, Mus musculus
atcatgccggcagtgtgtgtgttaa

SEQ ID NO: 241303 - DNA, 25 bp, Mus musculus
atcatgcctacacaaagccctgaac

SEQ ID NO: 241304 - DNA, 25 bp, Mus musculus
atcatgcctacagaaagccctgaac

SEQ ID NO: 241305 - DNA, 25 bp, Mus musculus
atcatgcctcatcctcgtgcagtgg

SEQ ID NO: 241306 - DNA, 25 bp, Mus musculus
atcatgcctcatgctcgtgcagtgg

SEQ ID NO: 241307 - DNA, 25 bp, Mus musculus
atcatgcctgacagcaaggcaactt

SEQ ID NO: 241308 - DNA, 25 bp, Mus musculus
atcatgcctgactgcaaggcaactt

SEQ ID NO: 241309 - DNA, 25 bp, Mus musculus
atcatgcctggcaaggattttcttt

SEQ ID NO: 241310 - DNA, 25 bp, Mus musculus
atcatgcctggctaggattttcttt

SEQ ID NO: 241311 - DNA, 25 bp, Mus musculus
atcatgcctgtcagaacccaggatt

SEQ ID NO: 241312 - DNA, 25 bp, Mus musculus
atcatgcctgtctgaacccaggatt

SEQ ID NO: 241313 - DNA, 25 bp, Mus musculus
atcatgcctttcattacatctcagt

SEQ ID NO: 241314 - DNA, 25 bp, Mus musculus
atcatgcctttctttacatctcagt

SEQ ID NO: 241315 - DNA, 25 bp, Mus musculus
atcatgcgctggagctgcgtcctta

SEQ ID NO: 241316 - DNA, 25 bp, Mus musculus
atcatgcgctggtgctgcgtcctta

SEQ ID NO: 241317 - DNA, 25 bp, Mus musculus
atcatgcggcctccagaggatgcag

SEQ ID NO: 241318 - DNA, 25 bp, Mus musculus
atcatgcggcctgcagaggatgcag

SEQ ID NO: 241319 - DNA, 25 bp, Mus musculus
atcatgctagatattgtacaagtaa

SEQ ID NO: 241320 - DNA, 25 bp, Mus musculus
atcatgctagattttgtacaagtaa

SEQ ID NO: 241321 - DNA, 25 bp, Mus musculus
atcatgctatcaacagtaggcacca

SEQ ID NO: 241322 - DNA, 25 bp, Mus musculus
atcatgctatcatcagtaggcacca

SEQ ID NO: 241323 - DNA, 25 bp, Mus musculus
atcatgctatgcatccagctcaggg

SEQ ID NO: 241324 - DNA, 25 bp, Mus musculus
atcatgctatgcttccagctcaggg

SEQ ID NO: 241325 - DNA, 25 bp, Mus musculus
atcatgctctacatctcatatctgt

SEQ ID NO: 241326 - DNA, 25 bp, Mus musculus
atcatgctctacttctcatatctgt

SEQ ID NO: 241327 - DNA, 25 bp, Mus musculus
atcatgctgaatagctaccatcact

SEQ ID NO: 241328 - DNA, 25 bp, Mus musculus
atcatgctgaattgctaccatcact

SEQ ID NO: 241329 - DNA, 25 bp, Mus musculus
atcatgctgcagagagaaccctgga

SEQ ID NO: 241330 - DNA, 25 bp, Mus musculus
atcatgctgcagtgagaaccctgga

SEQ ID NO: 241331 - DNA, 25 bp, Mus musculus
atcatgctggaacatggcaacctgc

SEQ ID NO: 241332 - DNA, 25 bp, Mus musculus
atcatgctggaagatggcaacctgc

SEQ ID NO: 241333 - DNA, 25 bp, Mus musculus
atcatgctggcaaaggcgggttcca

SEQ ID NO: 241334 - DNA, 25 bp, Mus musculus
atcatgctggcataggcgggttcca

SEQ ID NO: 241335 - DNA, 25 bp, Mus musculus
atcatgctgggtaaagctgctgtgt

SEQ ID NO: 241336 - DNA, 25 bp, Mus musculus
atcatgctgggttaagctgctgtgt

SEQ ID NO: 241337 - DNA, 25 bp, Mus musculus
atcatgctggttcccgcactgaacg

SEQ ID NO: 241338 - DNA, 25 bp, Mus musculus
atcatgctggttgccgcactgaacg

SEQ ID NO: 241339 - DNA, 25 bp, Mus musculus
atcatgcttggtctgagcctcttaa

SEQ ID NO: 241340 - DNA, 25 bp, Mus musculus
atcatgcttggtgtgagcctcttaa

SEQ ID NO: 241341 - DNA, 25 bp, Mus musculus
atcatgctttgaccctgtgctgaaa

SEQ ID NO: 241342 - DNA, 25 bp, Mus musculus
atcatgctttgagcctgtgctgaaa

SEQ ID NO: 241343 - DNA, 25 bp, Mus musculus
atcatgctttggattcttgaagcca

SEQ ID NO: 241344 - DNA, 25 bp, Mus musculus
atcatgctttggtttcttgaagcca

SEQ ID NO: 241345 - DNA, 25 bp, Mus musculus
atcatgcttttcattgacctgaagg

SEQ ID NO: 241346 - DNA, 25 bp, Mus musculus
atcatgcttttctttgacctgaagg

SEQ ID NO: 241347 - DNA, 25 bp, Mus musculus
atcatggaaagacagggctagccct

SEQ ID NO: 241348 - DNA, 25 bp, Mus musculus
atcatggaaagagagggctagccct

SEQ ID NO: 241349 - DNA, 25 bp, Mus musculus
atcatggaactgcaggacgggtaca

SEQ ID NO: 241350 - DNA, 25 bp, Mus musculus
atcatggaactggaggacgggtaca

SEQ ID NO: 241351 - DNA, 25 bp, Mus musculus
atcatggaaggcctcacctcgcaga

SEQ ID NO: 241352 - DNA, 25 bp, Mus musculus
atcatggaaggcgtcacctcgcaga

SEQ ID NO: 241353 - DNA, 25 bp, Mus musculus
atcatggacagacactacccttaag

SEQ ID NO: 241354 - DNA, 25 bp, Mus musculus
atcatggacagagactacccttaag

SEQ ID NO: 241355 - DNA, 25 bp, Mus musculus
atcatggacgtcctcgtctgcaacg

SEQ ID NO: 241356 - DNA, 25 bp, Mus musculus
atcatggacgtcgtcgtctgcaacg

SEQ ID NO: 241357 - DNA, 25 bp, Mus musculus
atcatggatcgcattgactgccagt

SEQ ID NO: 241358 - DNA, 25 bp, Mus musculus
atcatggatcgctttgactgccagt

SEQ ID NO: 241359 - DNA, 25 bp, Mus musculus
atcatggatgctcccaattttgagc

SEQ ID NO: 241360 - DNA, 25 bp, Mus musculus
atcatggatgctgccaattttgagc

SEQ ID NO: 241361 - DNA, 25 bp, Mus musculus
atcatggatttcaattgaattttct

SEQ ID NO: 241362 - DNA, 25 bp, Mus musculus
atcatggatttctattgaattttct

SEQ ID NO: 241363 - DNA, 25 bp, Mus musculus
atcatggcaatgcaggcgactcctt

SEQ ID NO: 241364 - DNA, 25 bp, Mus musculus
atcatggcaatggaggcgactcctt

SEQ ID NO: 241365 - DNA, 25 bp, Mus musculus
atcatggcaattctcatcagcaaca

SEQ ID NO: 241366 - DNA, 25 bp, Mus musculus
atcatggcaattgtcatcagcaaca

SEQ ID NO: 241367 - DNA, 25 bp, Mus musculus
atcatggcatctatccaagaaccct

SEQ ID NO: 241368 - DNA, 25 bp, Mus musculus
atcatggcatctttccaagaaccct

SEQ ID NO: 241369 - DNA, 25 bp, Mus musculus
atcatggccatgatgcattttctct

SEQ ID NO: 241370 - DNA, 25 bp, Mus musculus
atcatggccatgttgcattttctct

SEQ ID NO: 241371 - DNA, 25 bp, Mus musculus
atcatggcgagaccttgtgctagag

SEQ ID NO: 241372 - DNA, 25 bp, Mus musculus
atcatggcgagagcttgtgctagag

SEQ ID NO: 241373 - DNA, 25 bp, Mus musculus
atcatggctcagagtcccaggaaaa

SEQ ID NO: 241374 - DNA, 25 bp, Mus musculus
atcatggctcagtgtcccaggaaaa

SEQ ID NO: 241375 - DNA, 25 bp, Mus musculus
atcatggctctccttcacctgggaa

SEQ ID NO: 241376 - DNA, 25 bp, Mus musculus
atcatggctctcgttcacctgggaa

SEQ ID NO: 241377 - DNA, 25 bp, Mus musculus
atcatggctgacaggagaggctcca

SEQ ID NO: 241378 - DNA, 25 bp, Mus musculus
atcatggctgactggagaggctcca

SEQ ID NO: 241379 - DNA, 25 bp, Mus musculus
atcatggctgagctgttgaccggaa

SEQ ID NO: 241380 - DNA, 25 bp, Mus musculus
atcatggctgaggtgttgaccggaa

SEQ ID NO: 241381 - DNA, 25 bp, Mus musculus
atcatggctgttacaaggatggtgt

SEQ ID NO: 241382 - DNA, 25 bp, Mus musculus
atcatggctgtttcaaggatggtgt

SEQ ID NO: 241383 - DNA, 25 bp, Mus musculus
atcatggcttcccttttcatagctg

SEQ ID NO: 241384 - DNA, 25 bp, Mus musculus
atcatggcttccgttttcatagctg

SEQ ID NO: 241385 - DNA, 25 bp, Mus musculus
atcatggcttttatgtgaggtgtgc

SEQ ID NO: 241386 - DNA, 25 bp, Mus musculus
atcatggcttttttgtgaggtgtgc

SEQ ID NO: 241387 - DNA, 25 bp, Mus musculus
atcatgggacagacttggaacctct

SEQ ID NO: 241388 - DNA, 25 bp, Mus musculus
atcatgggacagtcttggaacctct

SEQ ID NO: 241389 - DNA, 25 bp, Mus musculus
atcatgggactcatggtcgacaccc

SEQ ID NO: 241390 - DNA, 25 bp, Mus musculus
atcatgggactcttggtcgacaccc

SEQ ID NO: 241391 - DNA, 25 bp, Mus musculus
atcatgggactgacgcttatcaccc

SEQ ID NO: 241392 - DNA, 25 bp, Mus musculus
atcatgggactgtcgcttatcaccc

SEQ ID NO: 241393 - DNA, 25 bp, Mus musculus
atcatgggagatcgtaaccatggta

SEQ ID NO: 241394 - DNA, 25 bp, Mus musculus
atcatgggagatggtaaccatggta

SEQ ID NO: 241395 - DNA, 25 bp, Mus musculus
atcatgggcaggcacacactccggc

SEQ ID NO: 241396 - DNA, 25 bp, Mus musculus
atcatgggcagggacacactccggc

SEQ ID NO: 241397 - DNA, 25 bp, Mus musculus
atcatgggccagctcctcagtttct

SEQ ID NO: 241398 - DNA, 25 bp, Mus musculus
atcatgggccaggtcctcagtttct

SEQ ID NO: 241399 - DNA, 25 bp, Mus musculus
atcatgggccctcaagacacttgtt

SEQ ID NO: 241400 - DNA, 25 bp, Mus musculus
atcatgggccctgaagacacttgtt

SEQ ID NO: 241401 - DNA, 25 bp, Mus musculus
atcatgggcgggatgattttccgaa

SEQ ID NO: 241402 - DNA, 25 bp, Mus musculus
atcatgggcgggttgattttccgaa

SEQ ID NO: 241403 - DNA, 25 bp, Mus musculus
atcatgggctgcatgtctgcatgca

SEQ ID NO: 241404 - DNA, 25 bp, Mus musculus
atcatgggctgcttgtctgcatgca

SEQ ID NO: 241405 - DNA, 25 bp, Mus musculus
atcatgggtcgcatgcacgctcccg

SEQ ID NO: 241406 - DNA, 25 bp, Mus musculus
atcatgggtcgcttgcacgctcccg

SEQ ID NO: 241407 - DNA, 25 bp, Mus musculus
atcatgggtcttcttggcttgcccc

SEQ ID NO: 241408 - DNA, 25 bp, Mus musculus
atcatgggtcttgttggcttgcccc

SEQ ID NO: 241409 - DNA, 25 bp, Mus musculus
atcatgggtggaacggactctgtgt

SEQ ID NO: 241410 - DNA, 25 bp, Mus musculus
atcatgggtggatcggactctgtgt

SEQ ID NO: 241411 - DNA, 25 bp, Mus musculus
atcatgggtgggagttcacatgcca

SEQ ID NO: 241412 - DNA, 25 bp, Mus musculus
atcatgggtgggtgttcacatgcca

SEQ ID NO: 241413 - DNA, 25 bp, Mus musculus
atcatgggtttccaccagatgtttc

SEQ ID NO: 241414 - DNA, 25 bp, Mus musculus
atcatgggtttcgaccagatgtttc

SEQ ID NO: 241415 - DNA, 25 bp, Mus musculus
atcatggtcaacagcattctctttc

SEQ ID NO: 241416 - DNA, 25 bp, Mus musculus
atcatggtcaactgcattctctttc

SEQ ID NO: 241417 - DNA, 25 bp, Mus musculus
atcatggtcagcatgcaggtgttga

SEQ ID NO: 241418 - DNA, 25 bp, Mus musculus
atcatggtcagcttgcaggtgttga

SEQ ID NO: 241419 - DNA, 25 bp, Mus musculus
atcatggtcatcatggccccaaatc

SEQ ID NO: 241420 - DNA, 25 bp, Mus musculus
atcatggtcatcttggccccaaatc

SEQ ID NO: 241421 - DNA, 25 bp, Mus musculus
atcatggtgggccttttcctcgtat

SEQ ID NO: 241422 - DNA, 25 bp, Mus musculus
atcatggtgggcgttttcctcgtat

SEQ ID NO: 241423 - DNA, 25 bp, Mus musculus
atcatggtggtgacgtgcatctgct

SEQ ID NO: 241424 - DNA, 25 bp, Mus musculus
atcatggtggtgtcgtgcatctgct

SEQ ID NO: 241425 - DNA, 25 bp, Mus musculus
atcatggtgttcatgtggttggcta

SEQ ID NO: 241426 - DNA, 25 bp, Mus musculus
atcatggtgttcttgtggttggcta

SEQ ID NO: 241427 - DNA, 25 bp, Mus musculus
atcatggttctgacttgagtccgta

SEQ ID NO: 241428 - DNA, 25 bp, Mus musculus
atcatggttctgtcttgagtccgta

SEQ ID NO: 241429 - DNA, 25 bp, Mus musculus
atcatggttgccatgcacttagcaa

SEQ ID NO: 241430 - DNA, 25 bp, Mus musculus
atcatggttgccttgcacttagcaa

SEQ ID NO: 241431 - DNA, 25 bp, Mus musculus
atcatggttggaattactcggagcc

SEQ ID NO: 241432 - DNA, 25 bp, Mus musculus
atcatggttggatttactcggagcc

SEQ ID NO: 241433 - DNA, 25 bp, Mus musculus
atcatggtttctcaggcccctagat

SEQ ID NO: 241434 - DNA, 25 bp, Mus musculus
atcatggtttctgaggcccctagat

SEQ ID NO: 241435 - DNA, 25 bp, Mus musculus
atcatgtaaatgctccatgttcctg

SEQ ID NO: 241436 - DNA, 25 bp, Mus musculus
atcatgtaaatggtccatgttcctg

SEQ ID NO: 241437 - DNA, 25 bp, Mus musculus
atcatgtaagctcagaccctgtctt

SEQ ID NO: 241438 - DNA, 25 bp, Mus musculus
atcatgtaagctgagaccctgtctt

SEQ ID NO: 241439 - DNA, 25 bp, Mus musculus
atcatgtacacacgcacgcttgact

SEQ ID NO: 241440 - DNA, 25 bp, Mus musculus
atcatgtacacaggcacgcttgact

SEQ ID NO: 241441 - DNA, 25 bp, Mus musculus
atcatgtactggctctattttggtt

SEQ ID NO: 241442 - DNA, 25 bp, Mus musculus
atcatgtactgggtctattttggtt

SEQ ID NO: 241443 - DNA, 25 bp, Mus musculus
atcatgtagcgtctcaggactgtta

SEQ ID NO: 241444 - DNA, 25 bp, Mus musculus
atcatgtagcgtgtcaggactgtta

SEQ ID NO: 241445 - DNA, 25 bp, Mus musculus
atcatgtagtctcatatgctgcact

SEQ ID NO: 241446 - DNA, 25 bp, Mus musculus
atcatgtagtctgatatgctgcact

SEQ ID NO: 241447 - DNA, 25 bp, Mus musculus
atcatgtatcagatcccttccccat

SEQ ID NO: 241448 - DNA, 25 bp, Mus musculus
atcatgtatcagttcccttccccat

SEQ ID NO: 241449 - DNA, 25 bp, Mus musculus
atcatgtattacagctgtgtgcaag

SEQ ID NO: 241450 - DNA, 25 bp, Mus musculus
atcatgtattactgctgtgtgcaag

SEQ ID NO: 241451 - DNA, 25 bp, Mus musculus
atcatgtatttgatacaggtgttac

SEQ ID NO: 241452 - DNA, 25 bp, Mus musculus
atcatgtatttgttacaggtgttac

SEQ ID NO: 241453 - DNA, 25 bp, Mus musculus
atcatgtattttactacaccacaag

SEQ ID NO: 241454 - DNA, 25 bp, Mus musculus
atcatgtatttttctacaccacaag

SEQ ID NO: 241455 - DNA, 25 bp, Mus musculus
atcatgtcaaccctagctgcaaaga

SEQ ID NO: 241456 - DNA, 25 bp, Mus musculus
atcatgtcaaccgtagctgcaaaga

SEQ ID NO: 241457 - DNA, 25 bp, Mus musculus
atcatgtcaagaaccccagcaggga

SEQ ID NO: 241458 - DNA, 25 bp, Mus musculus
atcatgtcaagatccccagcaggga

SEQ ID NO: 241459 - DNA, 25 bp, Mus musculus
atcatgtcaagcaagtacctcacat

SEQ ID NO: 241460 - DNA, 25 bp, Mus musculus
atcatgtcaagctagtacctcacat

SEQ ID NO: 241461 - DNA, 25 bp, Mus musculus
atcatgtcatggctatgggcgcctt

SEQ ID NO: 241462 - DNA, 25 bp, Mus musculus
atcatgtcatgggtatgggcgcctt

SEQ ID NO: 241463 - DNA, 25 bp, Mus musculus
atcatgtcctatattatcatctaga

SEQ ID NO: 241464 - DNA, 25 bp, Mus musculus
atcatgtcctattttatcatctaga

SEQ ID NO: 241465 - DNA, 25 bp, Mus musculus
atcatgtctaaccattgttccaagc

SEQ ID NO: 241466 - DNA, 25 bp, Mus musculus
atcatgtctaacgattgttccaagc

SEQ ID NO: 241467 - DNA, 25 bp, Mus musculus
atcatgtctaccagcagaaggcctt

SEQ ID NO: 241468 - DNA, 25 bp, Mus musculus
atcatgtctacctgcagaaggcctt

SEQ ID NO: 241469 - DNA, 25 bp, Mus musculus
atcatgtctcacagacaggtccaat

SEQ ID NO: 241470 - DNA, 25 bp, Mus musculus
atcatgtctcactgacaggtccaat

SEQ ID NO: 241471 - DNA, 25 bp, Mus musculus
atcatgtctgaaaccagcttctctc

SEQ ID NO: 241472 - DNA, 25 bp, Mus musculus
atcatgtctgaatccagcttctctc

SEQ ID NO: 241473 - DNA, 25 bp, Mus musculus
atcatgtctgtcaccaactggcttt

SEQ ID NO: 241474 - DNA, 25 bp, Mus musculus
atcatgtctgtctccaactggcttt

SEQ ID NO: 241475 - DNA, 25 bp, Mus musculus
atcatgtcttacaaacctaacccta

SEQ ID NO: 241476 - DNA, 25 bp, Mus musculus
atcatgtcttactaacctaacccta

SEQ ID NO: 241477 - DNA, 25 bp, Mus musculus
atcatgtcttctcaggttcctcctc

SEQ ID NO: 241478 - DNA, 25 bp, Mus musculus
atcatgtcttctgaggttcctcctc

SEQ ID NO: 241479 - DNA, 25 bp, Mus musculus
atcatgtgaggccacaccaccattc

SEQ ID NO: 241480 - DNA, 25 bp, Mus musculus
atcatgtgaggcgacaccaccattc

SEQ ID NO: 241481 - DNA, 25 bp, Mus musculus
atcatgtgatatcgcctgatggcaa

SEQ ID NO: 241482 - DNA, 25 bp, Mus musculus
atcatgtgatatggcctgatggcaa

SEQ ID NO: 241483 - DNA, 25 bp, Mus musculus
atcatgtgatggcacgtgctcaggc

SEQ ID NO: 241484 - DNA, 25 bp, Mus musculus
atcatgtgatgggacgtgctcaggc

SEQ ID NO: 241485 - DNA, 25 bp, Mus musculus
atcatgtgcgcacggactgtgctaa

SEQ ID NO: 241486 - DNA, 25 bp, Mus musculus
atcatgtgcgcagggactgtgctaa

SEQ ID NO: 241487 - DNA, 25 bp, Mus musculus
atcatgtgctgtctggaatggacca

SEQ ID NO: 241488 - DNA, 25 bp, Mus musculus
atcatgtgctgtgtggaatggacca

SEQ ID NO: 241489 - DNA, 25 bp, Mus musculus
atcatgtggaaacgaagctctcccc

SEQ ID NO: 241490 - DNA, 25 bp, Mus musculus
atcatgtggaaaggaagctctcccc

SEQ ID NO: 241491 - DNA, 25 bp, Mus musculus
atcatgtgtactccattgcgtccct

SEQ ID NO: 241492 - DNA, 25 bp, Mus musculus
atcatgtgtactgcattgcgtccct

SEQ ID NO: 241493 - DNA, 25 bp, Mus musculus
atcatgtgttgtaaagttttcctaa

SEQ ID NO: 241494 - DNA, 25 bp, Mus musculus
atcatgtgttgttaagttttcctaa

SEQ ID NO: 241495 - DNA, 25 bp, Mus musculus
atcatgttaagtccatcacccagtg

SEQ ID NO: 241496 - DNA, 25 bp, Mus musculus
atcatgttaagtgcatcacccagtg

SEQ ID NO: 241497 - DNA, 25 bp, Mus musculus
atcatgttaccaagccctgagcaga

SEQ ID NO: 241498 - DNA, 25 bp, Mus musculus
atcatgttaccatgccctgagcaga

SEQ ID NO: 241499 - DNA, 25 bp, Mus musculus
atcatgttagatctctgtcctacgc

SEQ ID NO: 241500 - DNA, 25 bp, Mus musculus
atcatgttagatgtctgtcctacgc

SEQ ID NO: 241501 - DNA, 25 bp, Mus musculus
atcatgttagtcctccagagcgcta

SEQ ID NO: 241502 - DNA, 25 bp, Mus musculus
atcatgttagtcgtccagagcgcta

SEQ ID NO: 241503 - DNA, 25 bp, Mus musculus
atcatgttcagcaacggagagaaag

SEQ ID NO: 241504 - DNA, 25 bp, Mus musculus
atcatgttcagcacggatgcctgat

SEQ ID NO: 241505 - DNA, 25 bp, Mus musculus
atcatgttcagctacggagagaaag

SEQ ID NO: 241506 - DNA, 25 bp, Mus musculus
atcatgttcagctcggatgcctgat

SEQ ID NO: 241507 - DNA, 25 bp, Mus musculus
atcatgttcccaatacagtagcaag

SEQ ID NO: 241508 - DNA, 25 bp, Mus musculus
atcatgttcccattacagtagcaag

SEQ ID NO: 241509 - DNA, 25 bp, Mus musculus
atcatgttccccagaagttattgag

SEQ ID NO: 241510 - DNA, 25 bp, Mus musculus
atcatgttcccctgaagttattgag

SEQ ID NO: 241511 - DNA, 25 bp, Mus musculus
atcatgttggttataaagtagttct

SEQ ID NO: 241512 - DNA, 25 bp, Mus musculus
atcatgttggttttaaagtagttct

SEQ ID NO: 241513 - DNA, 25 bp, Mus musculus
atcatgttgttactgctgcaatcta

SEQ ID NO: 241514 - DNA, 25 bp, Mus musculus
atcatgttgttagtgctgcaatcta

SEQ ID NO: 241515 - DNA, 25 bp, Mus musculus
atcatgtttacaacgcatctctgca

SEQ ID NO: 241516 - DNA, 25 bp, Mus musculus
atcatgtttacatcgcatctctgca

SEQ ID NO: 241517 - DNA, 25 bp, Mus musculus
atcatgtttccaccaagtccctttt

SEQ ID NO: 241518 - DNA, 25 bp, Mus musculus
atcatgtttccagcaagtccctttt

SEQ ID NO: 241519 - DNA, 25 bp, Mus musculus
atcatgtttctaactgtgcaatggt

SEQ ID NO: 241520 - DNA, 25 bp, Mus musculus
atcatgtttctatctgtgcaatggt

SEQ ID NO: 241521 - DNA, 25 bp, Mus musculus
atcatgtttggcctatacttcgtgt

SEQ ID NO: 241522 - DNA, 25 bp, Mus musculus
atcatgtttggcgtatacttcgtgt

SEQ ID NO: 241523 - DNA, 25 bp, Mus musculus
atcatgtttgttcacccttctttga

SEQ ID NO: 241524 - DNA, 25 bp, Mus musculus
atcatgtttgttgacccttctttga

SEQ ID NO: 241525 - DNA, 25 bp, Mus musculus
atcatgttttttcaaatctgttctg

SEQ ID NO: 241526 - DNA, 25 bp, Mus musculus
atcatgttttttccctccacccttt

SEQ ID NO: 241527 - DNA, 25 bp, Mus musculus
atcatgttttttgaaatctgttctg

SEQ ID NO: 241528 - DNA, 25 bp, Mus musculus
atcatgttttttgcctccacccttt

SEQ ID NO: 241529 - DNA, 25 bp, Mus musculus
atcattaaaaccatatctcctccca

SEQ ID NO: 241530 - DNA, 25 bp, Mus musculus
atcattaaaaccttatctcctccca

SEQ ID NO: 241531 - DNA, 25 bp, Mus musculus
atcattaaccatctattgagtactg

SEQ ID NO: 241532 - DNA, 25 bp, Mus musculus
atcattaaccatgtattgagtactg

SEQ ID NO: 241533 - DNA, 25 bp, Mus musculus
atcattaacctcaacaacacattcc

SEQ ID NO: 241534 - DNA, 25 bp, Mus musculus
atcattaacctctacaacacattcc

SEQ ID NO: 241535 - DNA, 25 bp, Mus musculus
atcattaaggacaccatctggctaa

SEQ ID NO: 241536 - DNA, 25 bp, Mus musculus
atcattaaggactccatctggctaa

SEQ ID NO: 241537 - DNA, 25 bp, Mus musculus
atcattaccaacacgcagtgctgaa

SEQ ID NO: 241538 - DNA, 25 bp, Mus musculus
atcattaccaactcgcagtgctgaa

SEQ ID NO: 241539 - DNA, 25 bp, Mus musculus
atcattaccattactacatctgtca

SEQ ID NO: 241540 - DNA, 25 bp, Mus musculus
atcattaccatttctacatctgtca

SEQ ID NO: 241541 - DNA, 25 bp, Mus musculus
atcattacccataactgtgccatac

SEQ ID NO: 241542 - DNA, 25 bp, Mus musculus
atcattacccattactgtgccatac

SEQ ID NO: 241543 - DNA, 25 bp, Mus musculus
atcattacctggagcagtctctcag

SEQ ID NO: 241544 - DNA, 25 bp, Mus musculus
atcattacctggtgcagtctctcag

SEQ ID NO: 241545 - DNA, 25 bp, Mus musculus
atcattactgagcttgtctaaggac

SEQ ID NO: 241546 - DNA, 25 bp, Mus musculus
atcattactgaggttgtctaaggac

SEQ ID NO: 241547 - DNA, 25 bp, Mus musculus
atcattagaccccagctctgcacgg

SEQ ID NO: 241548 - DNA, 25 bp, Mus musculus
atcattagacccgagctctgcacgg

SEQ ID NO: 241549 - DNA, 25 bp, Mus musculus
atcattagcctaccatgtccttgac

SEQ ID NO: 241550 - DNA, 25 bp, Mus musculus
atcattagcctagcatgtccttgac

SEQ ID NO: 241551 - DNA, 25 bp, Mus musculus
atcattaggacccagatcgctagcc

SEQ ID NO: 241552 - DNA, 25 bp, Mus musculus
atcattaggaccgagatcgctagcc

SEQ ID NO: 241553 - DNA, 25 bp, Mus musculus
atcattatcaccaggttttcttccc

SEQ ID NO: 241554 - DNA, 25 bp, Mus musculus
atcattatcacctggttttcttccc

SEQ ID NO: 241555 - DNA, 25 bp, Mus musculus
atcattatccatctgttgaagcaat

SEQ ID NO: 241556 - DNA, 25 bp, Mus musculus
atcattatccatgtgttgaagcaat

SEQ ID NO: 241557 - DNA, 25 bp, Mus musculus
atcattatcctccttttggtctacc

SEQ ID NO: 241558 - DNA, 25 bp, Mus musculus
atcattatcctcgttttggtctacc

SEQ ID NO: 241559 - DNA, 25 bp, Mus musculus
atcattatgtgtaggaaggcaggca

SEQ ID NO: 241560 - DNA, 25 bp, Mus musculus
atcattatgtgttggaaggcaggca

SEQ ID NO: 241561 - DNA, 25 bp, Mus musculus
atcattattaagaaactgtcccaca

SEQ ID NO: 241562 - DNA, 25 bp, Mus musculus
atcattattaagtaactgtcccaca

SEQ ID NO: 241563 - DNA, 25 bp, Mus musculus
atcattattgcaccttgtggtactc

SEQ ID NO: 241564 - DNA, 25 bp, Mus musculus
atcattattgcagcttgtggtactc

SEQ ID NO: 241565 - DNA, 25 bp, Mus musculus
atcattattgggactctgccttaaa

SEQ ID NO: 241566 - DNA, 25 bp, Mus musculus
atcattattgggtctctgccttaaa

SEQ ID NO: 241567 - DNA, 25 bp, Mus musculus
atcattcaaagcctccagaggaggg

SEQ ID NO: 241568 - DNA, 25 bp, Mus musculus
atcattcaaagcgtccagaggaggg

SEQ ID NO: 241569 - DNA, 25 bp, Mus musculus
atcattcaaagtctagtttacctat

SEQ ID NO: 241570 - DNA, 25 bp, Mus musculus
atcattcaaagtgtagtttacctat

SEQ ID NO: 241571 - DNA, 25 bp, Mus musculus
atcattcaacttcagaccctcttgc

SEQ ID NO: 241572 - DNA, 25 bp, Mus musculus
atcattcaacttgagaccctcttgc

SEQ ID NO: 241573 - DNA, 25 bp, Mus musculus
atcattcaatttcatttatcaactg

SEQ ID NO: 241574 - DNA, 25 bp, Mus musculus
atcattcaatttgatttatcaactg

SEQ ID NO: 241575 - DNA, 25 bp, Mus musculus
atcattcacctacatcatggctaag

SEQ ID NO: 241576 - DNA, 25 bp, Mus musculus
atcattcacctagatcatggctaag

SEQ ID NO: 241577 - DNA, 25 bp, Mus musculus
atcattcacttaattatcttgccaa

SEQ ID NO: 241578 - DNA, 25 bp, Mus musculus
atcattcacttatttatcttgccaa

SEQ ID NO: 241579 - DNA, 25 bp, Mus musculus
atcattcagaaacacgcccaagcaa

SEQ ID NO: 241580 - DNA, 25 bp, Mus musculus
atcattcagaaagacgcccaagcaa

SEQ ID NO: 241581 - DNA, 25 bp, Mus musculus
atcattcagcatatcgtggtccaga

SEQ ID NO: 241582 - DNA, 25 bp, Mus musculus
atcattcagcatttcgtggtccaga

SEQ ID NO: 241583 - DNA, 25 bp, Mus musculus
atcattcagggaccgacagcgttca

SEQ ID NO: 241584 - DNA, 25 bp, Mus musculus
atcattcagggagcgacagcgttca

SEQ ID NO: 241585 - DNA, 25 bp, Mus musculus
atcattcattctctgccattcagta

SEQ ID NO: 241586 - DNA, 25 bp, Mus musculus
atcattcattctgtgccattcagta

SEQ ID NO: 241587 - DNA, 25 bp, Mus musculus
atcattcatttcaccagccaggaaa

SEQ ID NO: 241588 - DNA, 25 bp, Mus musculus
atcattcatttctccagccaggaaa

SEQ ID NO: 241589 - DNA, 25 bp, Mus musculus
atcattccagccatatgtctcattc

SEQ ID NO: 241590 - DNA, 25 bp, Mus musculus
atcattccagccttatgtctcattc

SEQ ID NO: 241591 - DNA, 25 bp, Mus musculus
atcattccaggaaatagtctccagg

SEQ ID NO: 241592 - DNA, 25 bp, Mus musculus
atcattccaggaagtgtaagaccac

SEQ ID NO: 241593 - DNA, 25 bp, Mus musculus
atcattccaggatatagtctccagg

SEQ ID NO: 241594 - DNA, 25 bp, Mus musculus
atcattccaggatgtgtaagaccac

SEQ ID NO: 241595 - DNA, 25 bp, Mus musculus
atcattccaggcacagtagttctca

SEQ ID NO: 241596 - DNA, 25 bp, Mus musculus
atcattccaggctcagtagttctca

SEQ ID NO: 241597 - DNA, 25 bp, Mus musculus
atcattccatccacttaggtggttt

SEQ ID NO: 241598 - DNA, 25 bp, Mus musculus
atcattccatcctcttaggtggttt

SEQ ID NO: 241599 - DNA, 25 bp, Mus musculus
atcattccatgccttaatatgcttg

SEQ ID NO: 241600 - DNA, 25 bp, Mus musculus
atcattccatgcgttaatatgcttg

SEQ ID NO: 241601 - DNA, 25 bp, Mus musculus
atcattcccaaaatctgtttccttc

SEQ ID NO: 241602 - DNA, 25 bp, Mus musculus
atcattcccaaattctgtttccttc

SEQ ID NO: 241603 - DNA, 25 bp, Mus musculus
atcattccccagagggttgttcgtt

SEQ ID NO: 241604 - DNA, 25 bp, Mus musculus
atcattccccagtgggttgttcgtt

SEQ ID NO: 241605 - DNA, 25 bp, Mus musculus
atcattccctacatttctacgtagc

SEQ ID NO: 241606 - DNA, 25 bp, Mus musculus
atcattccctacttttctacgtagc

SEQ ID NO: 241607 - DNA, 25 bp, Mus musculus
atcattcctgcccaaagctttgatt

SEQ ID NO: 241608 - DNA, 25 bp, Mus musculus
atcattcctgccgaaagctttgatt

SEQ ID NO: 241609 - DNA, 25 bp, Mus musculus
atcattcctgtaataacacccatcc

SEQ ID NO: 241610 - DNA, 25 bp, Mus musculus
atcattcctgtattaacacccatcc

SEQ ID NO: 241611 - DNA, 25 bp, Mus musculus
atcattcctgtgactgttcccgtga

SEQ ID NO: 241612 - DNA, 25 bp, Mus musculus
atcattcctgtgtctgttcccgtga

SEQ ID NO: 241613 - DNA, 25 bp, Mus musculus
atcattcctgttcactcctttgatt

SEQ ID NO: 241614 - DNA, 25 bp, Mus musculus
atcattcctgttcgcatgacatttg

SEQ ID NO: 241615 - DNA, 25 bp, Mus musculus
atcattcctgttcgcttatgtaata

SEQ ID NO: 241616 - DNA, 25 bp, Mus musculus
atcattcctgttgactcctttgatt

SEQ ID NO: 241617 - DNA, 25 bp, Mus musculus
atcattcctgttggcatgacatttg

SEQ ID NO: 241618 - DNA, 25 bp, Mus musculus
atcattcctgttggcttatgtaata

SEQ ID NO: 241619 - DNA, 25 bp, Mus musculus
atcattccttagagtttagggacca

SEQ ID NO: 241620 - DNA, 25 bp, Mus musculus
atcattccttagtgtttagggacca

SEQ ID NO: 241621 - DNA, 25 bp, Mus musculus
atcattccttcccttttagcaattt

SEQ ID NO: 241622 - DNA, 25 bp, Mus musculus
atcattccttccgttttagcaattt

SEQ ID NO: 241623 - DNA, 25 bp, Mus musculus
atcattcggaatcacctcatggatg

SEQ ID NO: 241624 - DNA, 25 bp, Mus musculus
atcattcggaatgacctcatggatg

SEQ ID NO: 241625 - DNA, 25 bp, Mus musculus
atcattcgttccacaagggcagttg

SEQ ID NO: 241626 - DNA, 25 bp, Mus musculus
atcattcgttcctcaagggcagttg

SEQ ID NO: 241627 - DNA, 25 bp, Mus musculus
atcattctaaggcatgggttggcaa

SEQ ID NO: 241628 - DNA, 25 bp, Mus musculus
atcattctaagggatgggttggcaa

SEQ ID NO: 241629 - DNA, 25 bp, Mus musculus
atcattctatttccaggagacccaa

SEQ ID NO: 241630 - DNA, 25 bp, Mus musculus
atcattctatttgcaggagacccaa

SEQ ID NO: 241631 - DNA, 25 bp, Mus musculus
atcattctcagcaaaaggttccgct

SEQ ID NO: 241632 - DNA, 25 bp, Mus musculus
atcattctcagctaaaggttccgct

SEQ ID NO: 241633 - DNA, 25 bp, Mus musculus
atcattctccctaagatcctagtgt

SEQ ID NO: 241634 - DNA, 25 bp, Mus musculus
atcattctcccttagatcctagtgt

SEQ ID NO: 241635 - DNA, 25 bp, Mus musculus
atcattctcggtagtgtgcaccaca

SEQ ID NO: 241636 - DNA, 25 bp, Mus musculus
atcattctcggttgtgtgcaccaca

SEQ ID NO: 241637 - DNA, 25 bp, Mus musculus
atcattctctgcacacaggaagtag

SEQ ID NO: 241638 - DNA, 25 bp, Mus musculus
atcattctctgctcacaggaagtag

SEQ ID NO: 241639 - DNA, 25 bp, Mus musculus
atcattctctggaatggagagtgtc

SEQ ID NO: 241640 - DNA, 25 bp, Mus musculus
atcattctctggtatggagagtgtc

SEQ ID NO: 241641 - DNA, 25 bp, Mus musculus
atcattctgaaaaagttccctctct

SEQ ID NO: 241642 - DNA, 25 bp, Mus musculus
atcattctgaaatagttccctctct

SEQ ID NO: 241643 - DNA, 25 bp, Mus musculus
atcattctgacccatggctgacact

SEQ ID NO: 241644 - DNA, 25 bp, Mus musculus
atcattctgaccgatggctgacact

SEQ ID NO: 241645 - DNA, 25 bp, Mus musculus
atcattctgatgactatttctgtgg

SEQ ID NO: 241646 - DNA, 25 bp, Mus musculus
atcattctgatgtctatttctgtgg

SEQ ID NO: 241647 - DNA, 25 bp, Mus musculus
atcattctgcagcatacaagaaaca

SEQ ID NO: 241648 - DNA, 25 bp, Mus musculus
atcattctgcaggatacaagaaaca

SEQ ID NO: 241649 - DNA, 25 bp, Mus musculus
atcattctgcctactccaagtttaa

SEQ ID NO: 241650 - DNA, 25 bp, Mus musculus
atcattctgccttctccaagtttaa

SEQ ID NO: 241651 - DNA, 25 bp, Mus musculus
atcattctgggcatcatcttgtagc

SEQ ID NO: 241652 - DNA, 25 bp, Mus musculus
atcattctgggcttcatcttgtagc

SEQ ID NO: 241653 - DNA, 25 bp, Mus musculus
atcattctgtaccaagggctcctgg

SEQ ID NO: 241654 - DNA, 25 bp, Mus musculus
atcattctgtacgaagggctcctgg

SEQ ID NO: 241655 - DNA, 25 bp, Mus musculus
atcattctgtgacaatccctctcgt

SEQ ID NO: 241656 - DNA, 25 bp, Mus musculus
atcattctgtgagaatccctctcgt

SEQ ID NO: 241657 - DNA, 25 bp, Mus musculus
atcattctgttactgtttctgcctc

SEQ ID NO: 241658 - DNA, 25 bp, Mus musculus
atcattctgttagtgtttctgcctc

SEQ ID NO: 241659 - DNA, 25 bp, Mus musculus
atcattctgtttccttgctgcaggg

SEQ ID NO: 241660 - DNA, 25 bp, Mus musculus
atcattctgtttgcttgctgcaggg

SEQ ID NO: 241661 - DNA, 25 bp, Mus musculus
atcattcttgagctttttatataaa

SEQ ID NO: 241662 - DNA, 25 bp, Mus musculus
atcattcttgaggtttttatataaa

SEQ ID NO: 241663 - DNA, 25 bp, Mus musculus
atcattgacaccatccaaacctgct

SEQ ID NO: 241664 - DNA, 25 bp, Mus musculus
atcattgacaccttccaaacctgct

SEQ ID NO: 241665 - DNA, 25 bp, Mus musculus
atcattgacgctcccatggatatcc

SEQ ID NO: 241666 - DNA, 25 bp, Mus musculus
atcattgacgctgccatggatatcc

SEQ ID NO: 241667 - DNA, 25 bp, Mus musculus
atcattgagcgcaccaacacgcgtt

SEQ ID NO: 241668 - DNA, 25 bp, Mus musculus
atcattgagcgctccaacacgcgtt

SEQ ID NO: 241669 - DNA, 25 bp, Mus musculus
atcattgaggacacactaacaaagg

SEQ ID NO: 241670 - DNA, 25 bp, Mus musculus
atcattgaggactcactaacaaagg

SEQ ID NO: 241671 - DNA, 25 bp, Mus musculus
atcattgaggtgcatcccgacacca

SEQ ID NO: 241672 - DNA, 25 bp, Mus musculus
atcattgaggtggatcccgacacca

SEQ ID NO: 241673 - DNA, 25 bp, Mus musculus
atcattgatcacatcctctgtgaca

SEQ ID NO: 241674 - DNA, 25 bp, Mus musculus
atcattgatcacttcctctgtgaca

SEQ ID NO: 241675 - DNA, 25 bp, Mus musculus
atcattgattatagagcctcgcccc

SEQ ID NO: 241676 - DNA, 25 bp, Mus musculus
atcattgattattgagcctcgcccc

SEQ ID NO: 241677 - DNA, 25 bp, Mus musculus
atcattgcagtgatcagcccagtgt

SEQ ID NO: 241678 - DNA, 25 bp, Mus musculus
atcattgcagtgttcagcccagtgt

SEQ ID NO: 241679 - DNA, 25 bp, Mus musculus
atcattgcatgaagttcagctctca

SEQ ID NO: 241680 - DNA, 25 bp, Mus musculus
atcattgcatgatgttcagctctca

SEQ ID NO: 241681 - DNA, 25 bp, Mus musculus
atcattgccactcaggtcggaccag

SEQ ID NO: 241682 - DNA, 25 bp, Mus musculus
atcattgccactgaggtcggaccag

SEQ ID NO: 241683 - DNA, 25 bp, Mus musculus
atcattgccatcaggagacaccttt

SEQ ID NO: 241684 - DNA, 25 bp, Mus musculus
atcattgccatctggagacaccttt

SEQ ID NO: 241685 - DNA, 25 bp, Mus musculus
atcattgccgggagtgtggattcta

SEQ ID NO: 241686 - DNA, 25 bp, Mus musculus
atcattgccgggtgtgtggattcta

SEQ ID NO: 241687 - DNA, 25 bp, Mus musculus
atcattgcggcccagggcacatact

SEQ ID NO: 241688 - DNA, 25 bp, Mus musculus
atcattgcggccgagggcacatact

SEQ ID NO: 241689 - DNA, 25 bp, Mus musculus
atcattgctacaacagttgttacag

SEQ ID NO: 241690 - DNA, 25 bp, Mus musculus
atcattgctacatcagttgttacag

SEQ ID NO: 241691 - DNA, 25 bp, Mus musculus
atcattgctctacggctgaggacat

SEQ ID NO: 241692 - DNA, 25 bp, Mus musculus
atcattgctctagggctgaggacat

SEQ ID NO: 241693 - DNA, 25 bp, Mus musculus
atcattgctctcaaaattagcttct

SEQ ID NO: 241694 - DNA, 25 bp, Mus musculus
atcattgctctctaaattagcttct

SEQ ID NO: 241695 - DNA, 25 bp, Mus musculus
atcattgcttggctttgcttacaag

SEQ ID NO: 241696 - DNA, 25 bp, Mus musculus
atcattgcttgggtttgcttacaag

SEQ ID NO: 241697 - DNA, 25 bp, Mus musculus
atcattggacctcagcttgtattgc

SEQ ID NO: 241698 - DNA, 25 bp, Mus musculus
atcattggacctgagcttgtattgc

SEQ ID NO: 241699 - DNA, 25 bp, Mus musculus
atcattggatatcggctagaacaca

SEQ ID NO: 241700 - DNA, 25 bp, Mus musculus
atcattggatatgggctagaacaca

SEQ ID NO: 241701 - DNA, 25 bp, Mus musculus
atcattggatggactccatggaacc

SEQ ID NO: 241702 - DNA, 25 bp, Mus musculus
atcattggatggtctccatggaacc

SEQ ID NO: 241703 - DNA, 25 bp, Mus musculus
atcattggcaatctttatttacccc

SEQ ID NO: 241704 - DNA, 25 bp, Mus musculus
atcattggcaatgtttatttacccc

SEQ ID NO: 241705 - DNA, 25 bp, Mus musculus
atcattggcactcttgctcacttgt

SEQ ID NO: 241706 - DNA, 25 bp, Mus musculus
atcattggcactgttgctcacttgt

SEQ ID NO: 241707 - DNA, 25 bp, Mus musculus
atcattggccatacccaaaaaacag

SEQ ID NO: 241708 - DNA, 25 bp, Mus musculus
atcattggccattcccaaaaaacag

SEQ ID NO: 241709 - DNA, 25 bp, Mus musculus
atcattggccccagtggtactgcca

SEQ ID NO: 241710 - DNA, 25 bp, Mus musculus
atcattggcccctgtggtactgcca

SEQ ID NO: 241711 - DNA, 25 bp, Mus musculus
atcattgggtgtccgcacatctgta

SEQ ID NO: 241712 - DNA, 25 bp, Mus musculus
atcattgggtgtgcgcacatctgta

SEQ ID NO: 241713 - DNA, 25 bp, Mus musculus
atcattggtccaagcaaggtccttt

SEQ ID NO: 241714 - DNA, 25 bp, Mus musculus
atcattggtccatgcaaggtccttt

SEQ ID NO: 241715 - DNA, 25 bp, Mus musculus
atcattggtgaacggcgctctggct

SEQ ID NO: 241716 - DNA, 25 bp, Mus musculus
atcattggtgaagggcgctctggct

SEQ ID NO: 241717 - DNA, 25 bp, Mus musculus
atcattggtgtcatctgcttcatca

SEQ ID NO: 241718 - DNA, 25 bp, Mus musculus
atcattggtgtcttctgcttcatca

SEQ ID NO: 241719 - DNA, 25 bp, Mus musculus
atcattggttaacggcacgggctgt

SEQ ID NO: 241720 - DNA, 25 bp, Mus musculus
atcattggttaagggcacgggctgt

SEQ ID NO: 241721 - DNA, 25 bp, Mus musculus
atcattgtatttactttgaatcgaa

SEQ ID NO: 241722 - DNA, 25 bp, Mus musculus
atcattgtattttctttgaatcgaa

SEQ ID NO: 241723 - DNA, 25 bp, Mus musculus
atcattgtcaggatcagattctctt

SEQ ID NO: 241724 - DNA, 25 bp, Mus musculus
atcattgtcaggttcagattctctt

SEQ ID NO: 241725 - DNA, 25 bp, Mus musculus
atcattgtccagcaatctgtctcag

SEQ ID NO: 241726 - DNA, 25 bp, Mus musculus
atcattgtccaggaatctgtctcag

SEQ ID NO: 241727 - DNA, 25 bp, Mus musculus
atcattgtcgctctggtctgtgcct

SEQ ID NO: 241728 - DNA, 25 bp, Mus musculus
atcattgtcgctgtggtctgtgcct

SEQ ID NO: 241729 - DNA, 25 bp, Mus musculus
atcattgtcgtaatgtagtcctaag

SEQ ID NO: 241730 - DNA, 25 bp, Mus musculus
atcattgtcgtattgtagtcctaag

SEQ ID NO: 241731 - DNA, 25 bp, Mus musculus
atcattgtctgcaacaccctgatga

SEQ ID NO: 241732 - DNA, 25 bp, Mus musculus
atcattgtctgctacaccctgatga

SEQ ID NO: 241733 - DNA, 25 bp, Mus musculus
atcattgtgacgatgcccgatggac

SEQ ID NO: 241734 - DNA, 25 bp, Mus musculus
atcattgtgacgttgcccgatggac

SEQ ID NO: 241735 - DNA, 25 bp, Mus musculus
atcattgtgttcatacagagagcaa

SEQ ID NO: 241736 - DNA, 25 bp, Mus musculus
atcattgtgttcttacagagagcaa

SEQ ID NO: 241737 - DNA, 25 bp, Mus musculus
atcattgttgatctgggcctctttc

SEQ ID NO: 241738 - DNA, 25 bp, Mus musculus
atcattgttgatgtgggcctctttc

SEQ ID NO: 241739 - DNA, 25 bp, Mus musculus
atcatttaaatcctctaactttcat

SEQ ID NO: 241740 - DNA, 25 bp, Mus musculus
atcatttaaatcgtctaactttcat

SEQ ID NO: 241741 - DNA, 25 bp, Mus musculus
atcatttaacttatcaaccctatca

SEQ ID NO: 241742 - DNA, 25 bp, Mus musculus
atcatttaacttttcaaccctatca

SEQ ID NO: 241743 - DNA, 25 bp, Mus musculus
atcatttacaacctcagcttttctc

SEQ ID NO: 241744 - DNA, 25 bp, Mus musculus
atcatttacaacgtcagcttttctc

SEQ ID NO: 241745 - DNA, 25 bp, Mus musculus
atcatttactatattgctttacttt

SEQ ID NO: 241746 - DNA, 25 bp, Mus musculus
atcatttactattttgctttacttt

SEQ ID NO: 241747 - DNA, 25 bp, Mus musculus
atcatttacttaccgttcatttcaa

SEQ ID NO: 241748 - DNA, 25 bp, Mus musculus
atcatttacttagcgttcatttcaa

SEQ ID NO: 241749 - DNA, 25 bp, Mus musculus
atcatttagaataccctatttgtaa

SEQ ID NO: 241750 - DNA, 25 bp, Mus musculus
atcatttagaattccctatttgtaa

SEQ ID NO: 241751 - DNA, 25 bp, Mus musculus
atcatttagcagcatggaccacaca

SEQ ID NO: 241752 - DNA, 25 bp, Mus musculus
atcatttagcaggatggaccacaca

SEQ ID NO: 241753 - DNA, 25 bp, Mus musculus
atcatttagccacatttcaaatctc

SEQ ID NO: 241754 - DNA, 25 bp, Mus musculus
atcatttagccagatttcaaatctc

SEQ ID NO: 241755 - DNA, 25 bp, Mus musculus
atcatttatggcatcgctgtcaaca

SEQ ID NO: 241756 - DNA, 25 bp, Mus musculus
atcatttatggcttcgctgtcaaca

SEQ ID NO: 241757 - DNA, 25 bp, Mus musculus
atcatttcacgtattggagactcaa

SEQ ID NO: 241758 - DNA, 25 bp, Mus musculus
atcatttcacgttttggagactcaa

SEQ ID NO: 241759 - DNA, 25 bp, Mus musculus
atcatttcattcatccttgcctgga

SEQ ID NO: 241760 - DNA, 25 bp, Mus musculus
atcatttcattcttccttgcctgga

SEQ ID NO: 241761 - DNA, 25 bp, Mus musculus
atcatttcccaaaccacagcaagga

SEQ ID NO: 241762 - DNA, 25 bp, Mus musculus
atcatttcccaatccacagcaagga

SEQ ID NO: 241763 - DNA, 25 bp, Mus musculus
atcatttcccctatggcttgagtct

SEQ ID NO: 241764 - DNA, 25 bp, Mus musculus
atcatttcccctttggcttgagtct

SEQ ID NO: 241765 - DNA, 25 bp, Mus musculus
atcatttctaatcttttcagttgta

SEQ ID NO: 241766 - DNA, 25 bp, Mus musculus
atcatttctaatgttttcagttgta

SEQ ID NO: 241767 - DNA, 25 bp, Mus musculus
atcatttctactccatttacttccc

SEQ ID NO: 241768 - DNA, 25 bp, Mus musculus
atcatttctactgcatttacttccc

SEQ ID NO: 241769 - DNA, 25 bp, Mus musculus
atcatttctcttctattagtggcag

SEQ ID NO: 241770 - DNA, 25 bp, Mus musculus
atcatttctcttgtattagtggcag

SEQ ID NO: 241771 - DNA, 25 bp, Mus musculus
atcatttctgtaaccaacttgagag

SEQ ID NO: 241772 - DNA, 25 bp, Mus musculus
atcatttctgtatccaacttgagag

SEQ ID NO: 241773 - DNA, 25 bp, Mus musculus
atcatttcttgtaaagcttacccac

SEQ ID NO: 241774 - DNA, 25 bp, Mus musculus
atcatttcttgttaagcttacccac

SEQ ID NO: 241775 - DNA, 25 bp, Mus musculus
atcatttgagttatagctttagtac

SEQ ID NO: 241776 - DNA, 25 bp, Mus musculus
atcatttgagttttagctttagtac

SEQ ID NO: 241777 - DNA, 25 bp, Mus musculus
atcatttgcaaacaactgagcttat

SEQ ID NO: 241778 - DNA, 25 bp, Mus musculus
atcatttgcaaagaactgagcttat

SEQ ID NO: 241779 - DNA, 25 bp, Mus musculus
atcatttgcactacgctttcttgaa

SEQ ID NO: 241780 - DNA, 25 bp, Mus musculus
atcatttgcacttcgctttcttgaa

SEQ ID NO: 241781 - DNA, 25 bp, Mus musculus
atcatttgccgaattcctggatcat

SEQ ID NO: 241782 - DNA, 25 bp, Mus musculus
atcatttgccgatttcctggatcat

SEQ ID NO: 241783 - DNA, 25 bp, Mus musculus
atcatttgctcacagattcttcaga

SEQ ID NO: 241784 - DNA, 25 bp, Mus musculus
atcatttgctcagagattcttcaga

SEQ ID NO: 241785 - DNA, 25 bp, Mus musculus
atcatttgctgtacagtcactcgga

SEQ ID NO: 241786 - DNA, 25 bp, Mus musculus
atcatttgctgttcagtcactcgga

SEQ ID NO: 241787 - DNA, 25 bp, Mus musculus
atcatttgtaaactggtcccaccat

SEQ ID NO: 241788 - DNA, 25 bp, Mus musculus
atcatttgtaaagtggtcccaccat

SEQ ID NO: 241789 - DNA, 25 bp, Mus musculus
atcatttgtcacagacactaattcc

SEQ ID NO: 241790 - DNA, 25 bp, Mus musculus
atcatttgtcactgacactaattcc

SEQ ID NO: 241791 - DNA, 25 bp, Mus musculus
atcattttaagcactgctctaggtg

SEQ ID NO: 241792 - DNA, 25 bp, Mus musculus
atcattttaagctctgctctaggtg

SEQ ID NO: 241793 - DNA, 25 bp, Mus musculus
atcattttacgacttgctttaccaa

SEQ ID NO: 241794 - DNA, 25 bp, Mus musculus
atcattttacgagttgctttaccaa

SEQ ID NO: 241795 - DNA, 25 bp, Mus musculus
atcattttagacctaccgtttcaag

SEQ ID NO: 241796 - DNA, 25 bp, Mus musculus
atcattttagacgtaccgtttcaag

SEQ ID NO: 241797 - DNA, 25 bp, Mus musculus
atcattttaggtactttttcgatgc

SEQ ID NO: 241798 - DNA, 25 bp, Mus musculus
atcattttaggttctttttcgatgc

SEQ ID NO: 241799 - DNA, 25 bp, Mus musculus
atcattttcagaagtgtcattgtgc

SEQ ID NO: 241800 - DNA, 25 bp, Mus musculus
atcattttcagatgtgtcattgtgc

SEQ ID NO: 241801 - DNA, 25 bp, Mus musculus
atcattttccaaacaagtactcgag

SEQ ID NO: 241802 - DNA, 25 bp, Mus musculus
atcattttccaatcaagtactcgag

SEQ ID NO: 241803 - DNA, 25 bp, Mus musculus
atcattttcctcagcctgaagcaag

SEQ ID NO: 241804 - DNA, 25 bp, Mus musculus
atcattttcctctgcctgaagcaag

SEQ ID NO: 241805 - DNA, 25 bp, Mus musculus
atcattttcctgagctttgtacttt

SEQ ID NO: 241806 - DNA, 25 bp, Mus musculus
atcattttcctgcttgttcacacca

SEQ ID NO: 241807 - DNA, 25 bp, Mus musculus
atcattttcctggttgttcacacca

SEQ ID NO: 241808 - DNA, 25 bp, Mus musculus
atcattttcctgtgctttgtacttt

SEQ ID NO: 241809 - DNA, 25 bp, Mus musculus
atcattttccttcttcctgggagac

SEQ ID NO: 241810 - DNA, 25 bp, Mus musculus
atcattttccttgttcctgggagac

SEQ ID NO: 241811 - DNA, 25 bp, Mus musculus
atcattttcgctaatttatttcttc

SEQ ID NO: 241812 - DNA, 25 bp, Mus musculus
atcattttcgcttatttatttcttc

SEQ ID NO: 241813 - DNA, 25 bp, Mus musculus
atcattttctccaacggtgacctag

SEQ ID NO: 241814 - DNA, 25 bp, Mus musculus
atcattttctcctacggtgacctag

SEQ ID NO: 241815 - DNA, 25 bp, Mus musculus
atcattttctgtacaagttttggtt

SEQ ID NO: 241816 - DNA, 25 bp, Mus musculus
atcattttctgttcaagttttggtt

SEQ ID NO: 241817 - DNA, 25 bp, Mus musculus
atcattttgacacgcttggtctcca

SEQ ID NO: 241818 - DNA, 25 bp, Mus musculus
atcattttgacaggcttggtctcca

SEQ ID NO: 241819 - DNA, 25 bp, Mus musculus
atcattttgggcctggcgaacctga

SEQ ID NO: 241820 - DNA, 25 bp, Mus musculus
atcattttgggcgtggcgaacctga

SEQ ID NO: 241821 - DNA, 25 bp, Mus musculus
atcattttggtgctcactatcctcc

SEQ ID NO: 241822 - DNA, 25 bp, Mus musculus
atcattttggtggtcactatcctcc

SEQ ID NO: 241823 - DNA, 25 bp, Mus musculus
atcattttgtggacaccccatgatc

SEQ ID NO: 241824 - DNA, 25 bp, Mus musculus
atcattttgtggtcaccccatgatc

SEQ ID NO: 241825 - DNA, 25 bp, Mus musculus
atcatttttgatcccacatcccatt

SEQ ID NO: 241826 - DNA, 25 bp, Mus musculus
atcatttttgatgccacatcccatt

SEQ ID NO: 241827 - DNA, 25 bp, Mus musculus
atcattttttccaagtagggagaag

SEQ ID NO: 241828 - DNA, 25 bp, Mus musculus
atcattttttcccactttttgaatg

SEQ ID NO: 241829 - DNA, 25 bp, Mus musculus
atcattttttccgactttttgaatg

SEQ ID NO: 241830 - DNA, 25 bp, Mus musculus
atcattttttcctagtagggagaag

SEQ ID NO: 241831 - DNA, 25 bp, Mus musculus
atccaaacatcaaatcccttcaggg

SEQ ID NO: 241832 - DNA, 25 bp, Mus musculus
atccaaacatcatatcccttcaggg

SEQ ID NO: 241833 - DNA, 25 bp, Mus musculus
atccaaaccaaacgagctcttcaag

SEQ ID NO: 241834 - DNA, 25 bp, Mus musculus
atccaaaccaaaggagctcttcaag

SEQ ID NO: 241835 - DNA, 25 bp, Mus musculus
atccaaaccctcatgatggtcactt

SEQ ID NO: 241836 - DNA, 25 bp, Mus musculus
atccaaaccctcttgatggtcactt

SEQ ID NO: 241837 - DNA, 25 bp, Mus musculus
atccaaacctagcaaacctgactgt

SEQ ID NO: 241838 - DNA, 25 bp, Mus musculus
atccaaacctaggaaacctgactgt

SEQ ID NO: 241839 - DNA, 25 bp, Mus musculus
atccaaacgcagagggacacgtctt

SEQ ID NO: 241840 - DNA, 25 bp, Mus musculus
atccaaacgcagtgggacacgtctt

SEQ ID NO: 241841 - DNA, 25 bp, Mus musculus
atccaaacgtgtatccttctggcac

SEQ ID NO: 241842 - DNA, 25 bp, Mus musculus
atccaaacgtgtttccttctggcac

SEQ ID NO: 241843 - DNA, 25 bp, Mus musculus
atccaaactaccagacgctgacatc

SEQ ID NO: 241844 - DNA, 25 bp, Mus musculus
atccaaactacctgacgctgacatc

SEQ ID NO: 241845 - DNA, 25 bp, Mus musculus
atccaaacttggactgagtgagata

SEQ ID NO: 241846 - DNA, 25 bp, Mus musculus
atccaaacttggtctgagtgagata

SEQ ID NO: 241847 - DNA, 25 bp, Mus musculus
atccaaagagaacctacctacaggt

SEQ ID NO: 241848 - DNA, 25 bp, Mus musculus
atccaaagagaagctacctacaggt

SEQ ID NO: 241849 - DNA, 25 bp, Mus musculus
atccaaagcaggcaaacccaattcc

SEQ ID NO: 241850 - DNA, 25 bp, Mus musculus
atccaaagcagggaaacccaattcc

SEQ ID NO: 241851 - DNA, 25 bp, Mus musculus
atccaaagcttgaattttctgtgca

SEQ ID NO: 241852 - DNA, 25 bp, Mus musculus
atccaaagcttgtattttctgtgca

SEQ ID NO: 241853 - DNA, 25 bp, Mus musculus
atccaaaggcccaaacgtttctgtg

SEQ ID NO: 241854 - DNA, 25 bp, Mus musculus
atccaaaggccctaacgtttctgtg

SEQ ID NO: 241855 - DNA, 25 bp, Mus musculus
atccaaagttttctacatcctgttg

SEQ ID NO: 241856 - DNA, 25 bp, Mus musculus
atccaaagttttgtacatcctgttg

SEQ ID NO: 241857 - DNA, 25 bp, Mus musculus
atccaaatcagaacatacccctagc

SEQ ID NO: 241858 - DNA, 25 bp, Mus musculus
atccaaatcagatcatacccctagc

SEQ ID NO: 241859 - DNA, 25 bp, Mus musculus
atccaaatccagcatcgacgtgctg

SEQ ID NO: 241860 - DNA, 25 bp, Mus musculus
atccaaatccaggatcgacgtgctg

SEQ ID NO: 241861 - DNA, 25 bp, Mus musculus
atccaaatccggctctgggcagcag

SEQ ID NO: 241862 - DNA, 25 bp, Mus musculus
atccaaatccgggtctgggcagcag

SEQ ID NO: 241863 - DNA, 25 bp, Mus musculus
atccaaatctgcatgtgctcactgt

SEQ ID NO: 241864 - DNA, 25 bp, Mus musculus
atccaaatctgcttgtgctcactgt

SEQ ID NO: 241865 - DNA, 25 bp, Mus musculus
atccaaatgcttctgtcttctgagg

SEQ ID NO: 241866 - DNA, 25 bp, Mus musculus
atccaaatgcttgtgtcttctgagg

SEQ ID NO: 241867 - DNA, 25 bp, Mus musculus
atccaaatggaaacacagcaagctt

SEQ ID NO: 241868 - DNA, 25 bp, Mus musculus
atccaaatggaatcacagcaagctt

SEQ ID NO: 241869 - DNA, 25 bp, Mus musculus
atccaaatggttcggcacacctgtg

SEQ ID NO: 241870 - DNA, 25 bp, Mus musculus
atccaaatggttgggcacacctgtg

SEQ ID NO: 241871 - DNA, 25 bp, Mus musculus
atccaaatgtccagcctgttcagtg

SEQ ID NO: 241872 - DNA, 25 bp, Mus musculus
atccaaatgtcctgcctgttcagtg

SEQ ID NO: 241873 - DNA, 25 bp, Mus musculus
atccaaatgtggactttacctttat

SEQ ID NO: 241874 - DNA, 25 bp, Mus musculus
atccaaatgtggtctttacctttat

SEQ ID NO: 241875 - DNA, 25 bp, Mus musculus
atccaaattccacatcctgggctct

SEQ ID NO: 241876 - DNA, 25 bp, Mus musculus
atccaaattccagatcctgggctct

SEQ ID NO: 241877 - DNA, 25 bp, Mus musculus
atccaaattgaccaataaagccttt

SEQ ID NO: 241878 - DNA, 25 bp, Mus musculus
atccaaattgacgaataaagccttt

SEQ ID NO: 241879 - DNA, 25 bp, Mus musculus
atccaacaaaggcttcagatgcaag

SEQ ID NO: 241880 - DNA, 25 bp, Mus musculus
atccaacaaagggttcagatgcaag

SEQ ID NO: 241881 - DNA, 25 bp, Mus musculus
atccaacaaggaagcagctctaatg

SEQ ID NO: 241882 - DNA, 25 bp, Mus musculus
atccaacaaggatgcagctctaatg

SEQ ID NO: 241883 - DNA, 25 bp, Mus musculus
atccaacaagggacgtttgtgacaa

SEQ ID NO: 241884 - DNA, 25 bp, Mus musculus
atccaacaagggtcgtttgtgacaa

SEQ ID NO: 241885 - DNA, 25 bp, Mus musculus
atccaacacttgaaaccgacacgca

SEQ ID NO: 241886 - DNA, 25 bp, Mus musculus
atccaacacttgtaaccgacacgca

SEQ ID NO: 241887 - DNA, 25 bp, Mus musculus
atccaacagggccagaagctttagg

SEQ ID NO: 241888 - DNA, 25 bp, Mus musculus
atccaacagggcgagaagctttagg

SEQ ID NO: 241889 - DNA, 25 bp, Mus musculus
atccaacaggttcggtttcacatta

SEQ ID NO: 241890 - DNA, 25 bp, Mus musculus
atccaacaggttgggtttcacatta

SEQ ID NO: 241891 - DNA, 25 bp, Mus musculus
atccaacagtggcttttagtcatat

SEQ ID NO: 241892 - DNA, 25 bp, Mus musculus
atccaacagtgggttttagtcatat

SEQ ID NO: 241893 - DNA, 25 bp, Mus musculus
atccaacatcctcttgtgagcacta

SEQ ID NO: 241894 - DNA, 25 bp, Mus musculus
atccaacatcctgttgtgagcacta

SEQ ID NO: 241895 - DNA, 25 bp, Mus musculus
atccaacatggtactggaagcggaa

SEQ ID NO: 241896 - DNA, 25 bp, Mus musculus
atccaacatggttctggaagcggaa

SEQ ID NO: 241897 - DNA, 25 bp, Mus musculus
atccaaccaagacggctgctaaggg

SEQ ID NO: 241898 - DNA, 25 bp, Mus musculus
atccaaccaagagggctgctaaggg

SEQ ID NO: 241899 - DNA, 25 bp, Mus musculus
atccaaccagccaccaagttaatag

SEQ ID NO: 241900 - DNA, 25 bp, Mus musculus
atccaaccagcctccaagttaatag

SEQ ID NO: 241901 - DNA, 25 bp, Mus musculus
atccaacccaaccaggacggagagt

SEQ ID NO: 241902 - DNA, 25 bp, Mus musculus
atccaacccaacgaggacggagagt

SEQ ID NO: 241903 - DNA, 25 bp, Mus musculus
atccaacccaatctcatgtggctgc

SEQ ID NO: 241904 - DNA, 25 bp, Mus musculus
atccaacccaatgtcatgtggctgc

SEQ ID NO: 241905 - DNA, 25 bp, Mus musculus
atccaaccgtgcatcagtgtgcttg

SEQ ID NO: 241906 - DNA, 25 bp, Mus musculus
atccaaccgtgcttcagtgtgcttg

SEQ ID NO: 241907 - DNA, 25 bp, Mus musculus
atccaacctcgcagatcactaggaa

SEQ ID NO: 241908 - DNA, 25 bp, Mus musculus
atccaacctcgctgatcactaggaa

SEQ ID NO: 241909 - DNA, 25 bp, Mus musculus
atccaaccttgaatgttcctagttc

SEQ ID NO: 241910 - DNA, 25 bp, Mus musculus
atccaaccttgattgttcctagttc

SEQ ID NO: 241911 - DNA, 25 bp, Mus musculus
atccaacgaactatcttatcctgaa

SEQ ID NO: 241912 - DNA, 25 bp, Mus musculus
atccaacgaactttcttatcctgaa

SEQ ID NO: 241913 - DNA, 25 bp, Mus musculus
atccaacgcaggcagcattgcatga

SEQ ID NO: 241914 - DNA, 25 bp, Mus musculus
atccaacgcagggagcattgcatga

SEQ ID NO: 241915 - DNA, 25 bp, Mus musculus
atccaactccttcctgtacactggg

SEQ ID NO: 241916 - DNA, 25 bp, Mus musculus
atccaactccttgctgtacactggg

SEQ ID NO: 241917 - DNA, 25 bp, Mus musculus
atccaactctatacagatccagtgg

SEQ ID NO: 241918 - DNA, 25 bp, Mus musculus
atccaactctattcagatccagtgg

SEQ ID NO: 241919 - DNA, 25 bp, Mus musculus
atccaactgaggatgtcacttggtg

SEQ ID NO: 241920 - DNA, 25 bp, Mus musculus
atccaactgaggttgtcacttggtg

SEQ ID NO: 241921 - DNA, 25 bp, Mus musculus
atccaactgcccatgcgccaatgat

SEQ ID NO: 241922 - DNA, 25 bp, Mus musculus
atccaactgcccttgcgccaatgat

SEQ ID NO: 241923 - DNA, 25 bp, Mus musculus
atccaactgcctctgtctagatgac

SEQ ID NO: 241924 - DNA, 25 bp, Mus musculus
atccaactgcctgtgtctagatgac

SEQ ID NO: 241925 - DNA, 25 bp, Mus musculus
atccaacttcccagcttgacaggag

SEQ ID NO: 241926 - DNA, 25 bp, Mus musculus
atccaacttccctgcttgacaggag

SEQ ID NO: 241927 - DNA, 25 bp, Mus musculus
atccaacttcctctgttgctctaaa

SEQ ID NO: 241928 - DNA, 25 bp, Mus musculus
atccaacttcctgtgttgctctaaa

SEQ ID NO: 241929 - DNA, 25 bp, Mus musculus
atccaagaaacacgaacacagtgtt

SEQ ID NO: 241930 - DNA, 25 bp, Mus musculus
atccaagaaacaggaacacagtgtt

SEQ ID NO: 241931 - DNA, 25 bp, Mus musculus
atccaagaactcatcgttctctagc

SEQ ID NO: 241932 - DNA, 25 bp, Mus musculus
atccaagaactcttcgttctctagc

SEQ ID NO: 241933 - DNA, 25 bp, Mus musculus
atccaagaagagacccactgagttt

SEQ ID NO: 241934 - DNA, 25 bp, Mus musculus
atccaagaagagtcccactgagttt

SEQ ID NO: 241935 - DNA, 25 bp, Mus musculus
atccaagaagatagaccgccatatg

SEQ ID NO: 241936 - DNA, 25 bp, Mus musculus
atccaagaagattgaccgccatatg

SEQ ID NO: 241937 - DNA, 25 bp, Mus musculus
atccaagaagtgatgtgcctcggcc

SEQ ID NO: 241938 - DNA, 25 bp, Mus musculus
atccaagaagtgttgtgcctcggcc
